United States Patent 7,655,785 (BIOINFORMATICALLY DETECTABLE GROUP OF NOVEL REGULATORY OLIGONUCLEOTIDES AND USES THEREOF) - sequence listing, part 47

SEQ ID NO: 1945812 - RNA, 22 nt, Homo sapiens
cugugcauugguggcaucacag

SEQ ID NO: 1945813 - RNA, 19 nt, Homo sapiens
agagugagacucgucucaa

SEQ ID NO: 1945814 - RNA, 17 nt, Homo sapiens
gcuuugaaaaaucucau

SEQ ID NO: 1945815 - RNA, 18 nt, Homo sapiens
cugguggucaugaauuca

SEQ ID NO: 1945816 - RNA, 20 nt, Homo sapiens
gaacauagacucacucuucc

SEQ ID NO: 1945817 - RNA, 14 nt, Homo sapiens
caguaaauauccca

SEQ ID NO: 1945818 - RNA, 23 nt, Homo sapiens
gaaaggaaaaccugaagacugag

SEQ ID NO: 1945819 - RNA, 18 nt, Homo sapiens
cgcaccuaccaucaggga

SEQ ID NO: 1945820 - RNA, 18 nt, Homo sapiens
aagcgucugugcauuuau

SEQ ID NO: 1945821 - RNA, 23 nt, Homo sapiens
agacaccaccacccuugccaugg

SEQ ID NO: 1945822 - RNA, 22 nt, Homo sapiens
cugccaagagagggccaugcaa

SEQ ID NO: 1945823 - RNA, 14 nt, Homo sapiens
agaugucucugcaa

SEQ ID NO: 1945824 - RNA, 19 nt, Homo sapiens
agaagcgcggcuaacuuau

SEQ ID NO: 1945825 - RNA, 17 nt, Homo sapiens
aaccuguuccauuccau

SEQ ID NO: 1945826 - RNA, 20 nt, Homo sapiens
cagggcuccaggagccucau

SEQ ID NO: 1945827 - RNA, 18 nt, Homo sapiens
auggagucucgcucugcu

SEQ ID NO: 1945828 - RNA, 15 nt, Homo sapiens
uaaaucccauuauuc

SEQ ID NO: 1945829 - RNA, 13 nt, Homo sapiens
accuaagauguaa

SEQ ID NO: 1945830 - RNA, 17 nt, Homo sapiens
ugaaguuuuacugucua

SEQ ID NO: 1945831 - RNA, 16 nt, Homo sapiens
uggccuuugcuugaaa

SEQ ID NO: 1945832 - RNA, 23 nt, Homo sapiens
uuuucagggaagcugccaaagaa

SEQ ID NO: 1945833 - RNA, 19 nt, Homo sapiens
guaugugacaccaaagcca

SEQ ID NO: 1945834 - RNA, 18 nt, Homo sapiens
ucaaucccaggauguaca

SEQ ID NO: 1945835 - RNA, 20 nt, Homo sapiens
gcucaagcaauccuccugcc

SEQ ID NO: 1945836 - RNA, 20 nt, Homo sapiens
ccugugcaguagagagccuu

SEQ ID NO: 1945837 - RNA, 20 nt, Homo sapiens
aauuguaacuacacuaauaa

SEQ ID NO: 1945838 - RNA, 14 nt, Homo sapiens
agaagcauuuugca

SEQ ID NO: 1945839 - RNA, 14 nt, Homo sapiens
ggaucccaccccau

SEQ ID NO: 1945840 - RNA, 17 nt, Homo sapiens
agugcauccuugaacug

SEQ ID NO: 1945841 - RNA, 17 nt, Homo sapiens
ugauuauauaagcaaaa

SEQ ID NO: 1945842 - RNA, 21 nt, Homo sapiens
uagagacaggguuuugccaug

SEQ ID NO: 1945843 - RNA, 15 nt, Homo sapiens
cuaacugacagcuuc

SEQ ID NO: 1945844 - RNA, 17 nt, Homo sapiens
aaaaugcaguccugagg

SEQ ID NO: 1945845 - RNA, 17 nt, Homo sapiens
agacccacagcccugaa

SEQ ID NO: 1945846 - RNA, 17 nt, Homo sapiens
guaaaauuggauuauua

SEQ ID NO: 1945847 - RNA, 23 nt, Homo sapiens
aaccuuucaaaggauaugcagaa

SEQ ID NO: 1945848 - RNA, 15 nt, Homo sapiens
cuagcaguaugugug

SEQ ID NO: 1945849 - RNA, 16 nt, Homo sapiens
ucugauaguagucuuu

SEQ ID NO: 1945850 - RNA, 22 nt, Homo sapiens
guagcaggcaccuguagucuua

SEQ ID NO: 1945851 - RNA, 16 nt, Homo sapiens
gaaggggaaacacagc

SEQ ID NO: 1945852 - RNA, 13 nt, Homo sapiens
ucacaaacuucau

SEQ ID NO: 1945853 - RNA, 13 nt, Homo sapiens
acacuaacaucaa

SEQ ID NO: 1945854 - RNA, 18 nt, Homo sapiens
agugccacccaugcagcu

SEQ ID NO: 1945855 - RNA, 20 nt, Homo sapiens
cucuccacauuccaaacaga

SEQ ID NO: 1945856 - RNA, 18 nt, Homo sapiens
auguuacuacaugcacuu

SEQ ID NO: 1945857 - RNA, 17 nt, Homo sapiens
aauaaaggcugaagcuu

SEQ ID NO: 1945858 - RNA, 12 nt, Homo sapiens
gauucugaccau

SEQ ID NO: 1945859 - RNA, 22 nt, Homo sapiens
ccccaggucugcagcuccaggu

SEQ ID NO: 1945860 - RNA, 20 nt, Homo sapiens
cucucuacccggcccagaga

SEQ ID NO: 1945861 - RNA, 22 nt, Homo sapiens
caaaggauguguuuucagucuu

SEQ ID NO: 1945862 - RNA, 21 nt, Homo sapiens
gccaaaaucccaccacugcac

SEQ ID NO: 1945863 - RNA, 23 nt, Homo sapiens
aaacuaggguccauaugagggaa

SEQ ID NO: 1945864 - RNA, 23 nt, Homo sapiens
uggguauguuaaccuaggcagug

SEQ ID NO: 1945865 - RNA, 19 nt, Homo sapiens
agguugggcuuccaugccu

SEQ ID NO: 1945866 - RNA, 19 nt, Homo sapiens
aggcuguggcaucagggua

SEQ ID NO: 1945867 - RNA, 20 nt, Homo sapiens
ugaaucuucugaaaccaaau

SEQ ID NO: 1945868 - RNA, 16 nt, Homo sapiens
uugaaacaaucugaau

SEQ ID NO: 1945869 - RNA, 19 nt, Homo sapiens
cauauaaagcacuauacag

SEQ ID NO: 1945870 - RNA, 18 nt, Homo sapiens
caggaaguuaguuuuagu

SEQ ID NO: 1945871 - RNA, 15 nt, Homo sapiens
ggaguuaacuacccu

SEQ ID NO: 1945872 - RNA, 9 nt, Homo sapiens
gcucaggaa

SEQ ID NO: 1945873 - RNA, 17 nt, Homo sapiens
cugacauuuaucaggca

SEQ ID NO: 1945874 - RNA, 23 nt, Homo sapiens
acuguacaaugacuuuauugcau

SEQ ID NO: 1945875 - RNA, 12 nt, Homo sapiens
gaaacgucuccc

SEQ ID NO: 1945876 - RNA, 23 nt, Homo sapiens
ccucagauuuucuggacuuaguc

SEQ ID NO: 1945877 - RNA, 15 nt, Homo sapiens
uuuaaaaacauuuuc

SEQ ID NO: 1945878 - RNA, 22 nt, Homo sapiens
uaaguccaacuacuaaacuggg

SEQ ID NO: 1945879 - RNA, 17 nt, Homo sapiens
gaaggugcugacaaaga

SEQ ID NO: 1945880 - RNA, 16 nt, Homo sapiens
gcugugugaaacaugg

SEQ ID NO: 1945881 - RNA, 15 nt, Homo sapiens
ccuguugcacccagc

SEQ ID NO: 1945882 - RNA, 15 nt, Homo sapiens
cacagcgagccugug

SEQ ID NO: 1945883 - RNA, 15 nt, Homo sapiens
aguugaggcauuugg

SEQ ID NO: 1945884 - RNA, 24 nt, Homo sapiens
aauuuggguugacuccugagcaua

SEQ ID NO: 1945885 - RNA, 20 nt, Homo sapiens
ccuaccaggcacgucugcag

SEQ ID NO: 1945886 - RNA, 20 nt, Homo sapiens
agagauuuucaacauuucaa

SEQ ID NO: 1945887 - RNA, 19 nt, Homo sapiens
uugagcacacuuuacacaa

SEQ ID NO: 1945888 - RNA, 20 nt, Homo sapiens
aagaugagcuuugucuacuu

SEQ ID NO: 1945889 - RNA, 17 nt, Homo sapiens
aucuucacaaaacacuu

SEQ ID NO: 1945890 - RNA, 22 nt, Homo sapiens
ggaaaaauggauccccagugaa

SEQ ID NO: 1945891 - RNA, 15 nt, Homo sapiens
augcaacaucaugga

SEQ ID NO: 1945892 - RNA, 17 nt, Homo sapiens
aagaaaaaaaaucucuu

SEQ ID NO: 1945893 - RNA, 21 nt, Homo sapiens
gguuuguccuggucaugcaca

SEQ ID NO: 1945894 - RNA, 21 nt, Homo sapiens
guccuuuuuuccuuccuucuc

SEQ ID NO: 1945895 - RNA, 15 nt, Homo sapiens
augcaaucacuuuug

SEQ ID NO: 1945896 - RNA, 20 nt, Homo sapiens
guggggauggggccucccuc

SEQ ID NO: 1945897 - RNA, 18 nt, Homo sapiens
auuugaauuucaguaaac

SEQ ID NO: 1945898 - RNA, 24 nt, Homo sapiens
agccuacaguuauguucagucaca

SEQ ID NO: 1945899 - RNA, 15 nt, Homo sapiens
ucacaauacagugga

SEQ ID NO: 1945900 - RNA, 19 nt, Homo sapiens
gaacacacaagcuugucaa

SEQ ID NO: 1945901 - RNA, 18 nt, Homo sapiens
agcagugccgcguggccu

SEQ ID NO: 1945902 - RNA, 17 nt, Homo sapiens
gcacugucugaagcaau

SEQ ID NO: 1945903 - RNA, 15 nt, Homo sapiens
agggacccaccugcu

SEQ ID NO: 1945904 - RNA, 23 nt, Homo sapiens
ugucaucaaauauuaccaaaaaa

SEQ ID NO: 1945905 - RNA, 16 nt, Homo sapiens
cugaggccaagccacu

SEQ ID NO: 1945906 - RNA, 18 nt, Homo sapiens
cucaaugcaugaaucugu

SEQ ID NO: 1945907 - RNA, 20 nt, Homo sapiens
gggucuuugugagagugagc

SEQ ID NO: 1945908 - RNA, 20 nt, Homo sapiens
acggggucuugcucugucuc

SEQ ID NO: 1945909 - RNA, 16 nt, Homo sapiens
aagacuggcaguccaa

SEQ ID NO: 1945910 - RNA, 16 nt, Homo sapiens
agaggaacagcacugg

SEQ ID NO: 1945911 - RNA, 14 nt, Homo sapiens
aguucaucucugcu

SEQ ID NO: 1945912 - RNA, 14 nt, Homo sapiens
ucuuauucagugaa

SEQ ID NO: 1945913 - RNA, 19 nt, Homo sapiens
gccaggcccggcaugaggc

SEQ ID NO: 1945914 - RNA, 15 nt, Homo sapiens
cagauuccccaggaa

SEQ ID NO: 1945915 - RNA, 18 nt, Homo sapiens
ucaccuacauuaucucac

SEQ ID NO: 1945916 - RNA, 19 nt, Homo sapiens
auaaacuauuuauaucaca

SEQ ID NO: 1945917 - RNA, 23 nt, Homo sapiens
cuccacauggaagcccaacuggg

SEQ ID NO: 1945918 - RNA, 18 nt, Homo sapiens
cucccaccccacccccuu

SEQ ID NO: 1945919 - RNA, 17 nt, Homo sapiens
uccagggcauugcucag

SEQ ID NO: 1945920 - RNA, 22 nt, Homo sapiens
gcuugguuuccucaccuugaaa

SEQ ID NO: 1945921 - RNA, 14 nt, Homo sapiens
aacuacaauguagu

SEQ ID NO: 1945922 - RNA, 14 nt, Homo sapiens
uguaauaaaacugc

SEQ ID NO: 1945923 - RNA, 17 nt, Homo sapiens
uccauuacuugccaggg

SEQ ID NO: 1945924 - RNA, 20 nt, Homo sapiens
ccucccauagugcugggauu

SEQ ID NO: 1945925 - RNA, 17 nt, Homo sapiens
agaaaucuuaagucaua

SEQ ID NO: 1945926 - RNA, 14 nt, Homo sapiens
ugguuuuccucaau

SEQ ID NO: 1945927 - RNA, 14 nt, Homo sapiens
uggaauuccucuuu

SEQ ID NO: 1945928 - RNA, 18 nt, Homo sapiens
caggagaauuacuugaac

SEQ ID NO: 1945929 - RNA, 17 nt, Homo sapiens
uguuucaaacaaaaagu

SEQ ID NO: 1945930 - RNA, 14 nt, Homo sapiens
cacgcuaccaaauc

SEQ ID NO: 1945931 - RNA, 19 nt, Homo sapiens
ugcaguccucggcagcucc

SEQ ID NO: 1945932 - RNA, 23 nt, Homo sapiens
augauauuuuuauccuguucuca

SEQ ID NO: 1945933 - RNA, 13 nt, Homo sapiens
ccccccacugagc

SEQ ID NO: 1945934 - RNA, 18 nt, Homo sapiens
cucauuuggauugccuua

SEQ ID NO: 1945935 - RNA, 16 nt, Homo sapiens
uaacgggcauguauua

SEQ ID NO: 1945936 - RNA, 18 nt, Homo sapiens
gauuggccagcaaaaacu

SEQ ID NO: 1945937 - RNA, 13 nt, Homo sapiens
ugagcaggagcag

SEQ ID NO: 1945938 - RNA, 14 nt, Homo sapiens
gaggaccgggcugg

SEQ ID NO: 1945939 - RNA, 17 nt, Homo sapiens
aaacuacugccuuucaa

SEQ ID NO: 1945940 - RNA, 22 nt, Homo sapiens
caaucuggcccuuacacacuca

SEQ ID NO: 1945941 - RNA, 11 nt, Homo sapiens
cauccuuccaa

SEQ ID NO: 1945942 - RNA, 13 nt, Homo sapiens
cagagcaaacaga

SEQ ID NO: 1945943 - RNA, 16 nt, Homo sapiens
uacacugaaucauuaa

SEQ ID NO: 1945944 - RNA, 15 nt, Homo sapiens
agccccagugccaag

SEQ ID NO: 1945945 - RNA, 13 nt, Homo sapiens
aaacucuuggcca

SEQ ID NO: 1945946 - RNA, 18 nt, Homo sapiens
agagaacccagauguugu

SEQ ID NO: 1945947 - RNA, 24 nt, Homo sapiens
uugguaccccuaaaaagauugcca

SEQ ID NO: 1945948 - RNA, 20 nt, Homo sapiens
gcuccccauuuuauaccaaa

SEQ ID NO: 1945949 - RNA, 18 nt, Homo sapiens
guauguacaauacaaugu

SEQ ID NO: 1945950 - RNA, 15 nt, Homo sapiens
cuccgccucugccag

SEQ ID NO: 1945951 - RNA, 21 nt, Homo sapiens
ugacacucuucccuccuccca

SEQ ID NO: 1945952 - RNA, 13 nt, Homo sapiens
aauuauaucacuu

SEQ ID NO: 1945953 - RNA, 13 nt, Homo sapiens
gauucucuacugc

SEQ ID NO: 1945954 - RNA, 15 nt, Homo sapiens
uccacaauagucaga

SEQ ID NO: 1945955 - RNA, 14 nt, Homo sapiens
ugcccuauauaccu

SEQ ID NO: 1945956 - RNA, 17 nt, Homo sapiens
gaaaugcuguuaguaaa

SEQ ID NO: 1945957 - RNA, 15 nt, Homo sapiens
acugggucaugugca

SEQ ID NO: 1945958 - RNA, 16 nt, Homo sapiens
uaaggacaaagugcca

SEQ ID NO: 1945959 - RNA, 23 nt, Homo sapiens
ugcacagagcacacugcacacau

SEQ ID NO: 1945960 - RNA, 17 nt, Homo sapiens
ccucaaaugacccaaag

SEQ ID NO: 1945961 - RNA, 15 nt, Homo sapiens
guucaauaaagcacu

SEQ ID NO: 1945962 - RNA, 19 nt, Homo sapiens
cccugcguggggacagggc

SEQ ID NO: 1945963 - RNA, 13 nt, Homo sapiens
ggcugggccaugu

SEQ ID NO: 1945964 - RNA, 20 nt, Homo sapiens
uacauccugcuacacucauc

SEQ ID NO: 1945965 - RNA, 18 nt, Homo sapiens
cuuagacaguaugcauac

SEQ ID NO: 1945966 - RNA, 17 nt, Homo sapiens
agaccaucgcacaccaa

SEQ ID NO: 1945967 - RNA, 21 nt, Homo sapiens
uccuuugcgcaaacuuuaaca

SEQ ID NO: 1945968 - RNA, 21 nt, Homo sapiens
ucaugggagcaugcuuaccuu

SEQ ID NO: 1945969 - RNA, 13 nt, Homo sapiens
aauguuaccucua

SEQ ID NO: 1945970 - RNA, 16 nt, Homo sapiens
ugaucuggacagaaca

SEQ ID NO: 1945971 - RNA, 16 nt, Homo sapiens
ugagcuggacauaaca

SEQ ID NO: 1945972 - RNA, 20 nt, Homo sapiens
ggggugguuuuugagccaug

SEQ ID NO: 1945973 - RNA, 18 nt, Homo sapiens
agugacagggaagcuaca

SEQ ID NO: 1945974 - RNA, 21 nt, Homo sapiens
gagccugaagaccuucagucu

SEQ ID NO: 1945975 - RNA, 15 nt, Homo sapiens
acugaggaauuucac

SEQ ID NO: 1945976 - RNA, 20 nt, Homo sapiens
auaucuaucuauauauacau

SEQ ID NO: 1945977 - RNA, 12 nt, Homo sapiens
uuggaccugcug

SEQ ID NO: 1945978 - RNA, 18 nt, Homo sapiens
auagcagauuguguaaca

SEQ ID NO: 1945979 - RNA, 17 nt, Homo sapiens
uguuauugccaauguuc

SEQ ID NO: 1945980 - RNA, 21 nt, Homo sapiens
ccucccaaaguguuaggauua

SEQ ID NO: 1945981 - RNA, 14 nt, Homo sapiens
agggcaacagauca

SEQ ID NO: 1945982 - RNA, 21 nt, Homo sapiens
cacuccugcuuaaucuucaaa

SEQ ID NO: 1945983 - RNA, 10 nt, Homo sapiens
aaaacugggg

SEQ ID NO: 1945984 - RNA, 12 nt, Homo sapiens
caaggucugcuc

SEQ ID NO: 1945985 - RNA, 23 nt, Homo sapiens
auuuugcauugugugagcuucua

SEQ ID NO: 1945986 - RNA, 13 nt, Homo sapiens
ucuuagguggcag

SEQ ID NO: 1945987 - RNA, 14 nt, Homo sapiens
auguggacgugcac

SEQ ID NO: 1945988 - RNA, 20 nt, Homo sapiens
uggucuuguggaauugggag

SEQ ID NO: 1945989 - RNA, 15 nt, Homo sapiens
uucucucccauacca

SEQ ID NO: 1945990 - RNA, 16 nt, Homo sapiens
augcauuuggguccag

SEQ ID NO: 1945991 - RNA, 13 nt, Homo sapiens
caaauuuaagcaa

SEQ ID NO: 1945992 - RNA, 13 nt, Homo sapiens
acccugugcuguc

SEQ ID NO: 1945993 - RNA, 12 nt, Homo sapiens
uagugauuuaca

SEQ ID NO: 1945994 - RNA, 22 nt, Homo sapiens
cauggcuuaguuuucauacaca

SEQ ID NO: 1945995 - RNA, 18 nt, Homo sapiens
cugcucuggaauuugcaa

SEQ ID NO: 1945996 - RNA, 12 nt, Homo sapiens
caagacuccuca

SEQ ID NO: 1945997 - RNA, 17 nt, Homo sapiens
cccugcaauguggugac

SEQ ID NO: 1945998 - RNA, 20 nt, Homo sapiens
agccacagggugagcacucu

SEQ ID NO: 1945999 - RNA, 16 nt, Homo sapiens
ggguagacugagggau

SEQ ID NO: 1946000 - RNA, 11 nt, Homo sapiens
cucucaucucu

SEQ ID NO: 1946001 - RNA, 19 nt, Homo sapiens
uaggaagaaaucacuuaaa

SEQ ID NO: 1946002 - RNA, 19 nt, Homo sapiens
aacagccaaaaaggacuuu

SEQ ID NO: 1946003 - RNA, 19 nt, Homo sapiens
cucagcaaucacaagccaa

SEQ ID NO: 1946004 - RNA, 15 nt, Homo sapiens
uggcacguauugcug

SEQ ID NO: 1946005 - RNA, 13 nt, Homo sapiens
gcaguugacucag

SEQ ID NO: 1946006 - RNA, 16 nt, Homo sapiens
uuccuuuguagcuacu

SEQ ID NO: 1946007 - RNA, 20 nt, Homo sapiens
aauaaacuuucagaacugcu

SEQ ID NO: 1946008 - RNA, 20 nt, Homo sapiens
accaagaugaucacauggaa

SEQ ID NO: 1946009 - RNA, 14 nt, Homo sapiens
cuauuuucagagca

SEQ ID NO: 1946010 - RNA, 15 nt, Homo sapiens
auuugauaugugaac

SEQ ID NO: 1946011 - RNA, 15 nt, Homo sapiens
ugcauuuagcuucuu

SEQ ID NO: 1946012 - RNA, 19 nt, Homo sapiens
aguccucguagccaucucu

SEQ ID NO: 1946013 - RNA, 21 nt, Homo sapiens
caggauggcugcaagcgcacu

SEQ ID NO: 1946014 - RNA, 20 nt, Homo sapiens
gagccuaccuucaccaccua

SEQ ID NO: 1946015 - RNA, 19 nt, Homo sapiens
gaaaugauuacuccuccau

SEQ ID NO: 1946016 - RNA, 12 nt, Homo sapiens
accaacuggaag

SEQ ID NO: 1946017 - RNA, 20 nt, Homo sapiens
agaacagagugcaacccagu

SEQ ID NO: 1946018 - RNA, 21 nt, Homo sapiens
cuuuggaaacaauaugcaaug

SEQ ID NO: 1946019 - RNA, 11 nt, Homo sapiens
aauuuccccac

SEQ ID NO: 1946020 - RNA, 22 nt, Homo sapiens
cugaggaauuucaccuguaaac

SEQ ID NO: 1946021 - RNA, 14 nt, Homo sapiens
guuaguuccuucau

SEQ ID NO: 1946022 - RNA, 18 nt, Homo sapiens
aggcccugugagcacaaa

SEQ ID NO: 1946023 - RNA, 16 nt, Homo sapiens
ugaagcuaauugugca

SEQ ID NO: 1946024 - RNA, 16 nt, Homo sapiens
gaaaaaaauugcucug

SEQ ID NO: 1946025 - RNA, 14 nt, Homo sapiens
uaccugguuuacuu

SEQ ID NO: 1946026 - RNA, 16 nt, Homo sapiens
cgcgugccguggcacc

SEQ ID NO: 1946027 - RNA, 17 nt, Homo sapiens
uucugaaaagcaccauu

SEQ ID NO: 1946028 - RNA, 22 nt, Homo sapiens
agaauccaucuucagaccuuug

SEQ ID NO: 1946029 - RNA, 16 nt, Homo sapiens
gacuccuggucuguga

SEQ ID NO: 1946030 - RNA, 20 nt, Homo sapiens
gggccacaccugagcgcugu

SEQ ID NO: 1946031 - RNA, 21 nt, Homo sapiens
agucauuggguuuuaucagug

SEQ ID NO: 1946032 - RNA, 21 nt, Homo sapiens
ugugauuccauggauugauuc

SEQ ID NO: 1946033 - RNA, 14 nt, Homo sapiens
gcugaagaaugaag

SEQ ID NO: 1946034 - RNA, 12 nt, Homo sapiens
acugaguugcac

SEQ ID NO: 1946035 - RNA, 18 nt, Homo sapiens
ccaaacacauacaggaag

SEQ ID NO: 1946036 - RNA, 13 nt, Homo sapiens
ucugaaucagcca

SEQ ID NO: 1946037 - RNA, 18 nt, Homo sapiens
cuaagccgaaguuuugua

SEQ ID NO: 1946038 - RNA, 13 nt, Homo sapiens
augcaaaugcacu

SEQ ID NO: 1946039 - RNA, 16 nt, Homo sapiens
uaauuuagccaggacc

SEQ ID NO: 1946040 - RNA, 20 nt, Homo sapiens
aaaugagccuuucugccuca

SEQ ID NO: 1946041 - RNA, 18 nt, Homo sapiens
uaagagaacucuccucuu

SEQ ID NO: 1946042 - RNA, 22 nt, Homo sapiens
accaucugccaaugccaugacu

SEQ ID NO: 1946043 - RNA, 14 nt, Homo sapiens
ucccuaaacugcag

SEQ ID NO: 1946044 - RNA, 18 nt, Homo sapiens
aaaucauggguccagccu

SEQ ID NO: 1946045 - RNA, 16 nt, Homo sapiens
uuugucaguaaauacu

SEQ ID NO: 1946046 - RNA, 19 nt, Homo sapiens
uaagacugugacaacuguc

SEQ ID NO: 1946047 - RNA, 14 nt, Homo sapiens
cagagugaauuuca

SEQ ID NO: 1946048 - RNA, 22 nt, Homo sapiens
guggccuuccccuuuugccugg

SEQ ID NO: 1946049 - RNA, 21 nt, Homo sapiens
ccuauagaaauagaacacugc

SEQ ID NO: 1946050 - RNA, 10 nt, Homo sapiens
gccucugugc

SEQ ID NO: 1946051 - RNA, 23 nt, Homo sapiens
ccauggcaugggggccucagggc

SEQ ID NO: 1946052 - RNA, 17 nt, Homo sapiens
cuaauucacagugcucu

SEQ ID NO: 1946053 - RNA, 17 nt, Homo sapiens
aaacaggccaggcucca

SEQ ID NO: 1946054 - RNA, 20 nt, Homo sapiens
aauugacugaagcacagcac

SEQ ID NO: 1946055 - RNA, 20 nt, Homo sapiens
cuugacacggugaaauccag

SEQ ID NO: 1946056 - RNA, 15 nt, Homo sapiens
uuucugccagggaug

SEQ ID NO: 1946057 - RNA, 13 nt, Homo sapiens
cauuaauguguaa

SEQ ID NO: 1946058 - RNA, 19 nt, Homo sapiens
cgaguacucuugaacacaa

SEQ ID NO: 1946059 - RNA, 13 nt, Homo sapiens
cuaaaugaacuca

SEQ ID NO: 1946060 - RNA, 21 nt, Homo sapiens
aaagucccuugagacucccca

SEQ ID NO: 1946061 - RNA, 18 nt, Homo sapiens
gaguugaccuucugaaca

SEQ ID NO: 1946062 - RNA, 13 nt, Homo sapiens
ucucugguaauau

SEQ ID NO: 1946063 - RNA, 17 nt, Homo sapiens
cccaggcugggaacuca

SEQ ID NO: 1946064 - RNA, 17 nt, Homo sapiens
gccaggcuguaagcauu

SEQ ID NO: 1946065 - RNA, 19 nt, Homo sapiens
ucccccauucgaacuuaac

SEQ ID NO: 1946066 - RNA, 14 nt, Homo sapiens
ccggcacuggguuu

SEQ ID NO: 1946067 - RNA, 14 nt, Homo sapiens
caucaagugcaguc

SEQ ID NO: 1946068 - RNA, 15 nt, Homo sapiens
accucuccagcuccu

SEQ ID NO: 1946069 - RNA, 16 nt, Homo sapiens
ccacugucccuaccac

SEQ ID NO: 1946070 - RNA, 15 nt, Homo sapiens
guaaaccaaacccua

SEQ ID NO: 1946071 - RNA, 17 nt, Homo sapiens
cauggagcugcacucua

SEQ ID NO: 1946072 - RNA, 19 nt, Homo sapiens
gagauuuugcaaucugugu

SEQ ID NO: 1946073 - RNA, 14 nt, Homo sapiens
ugccagcauuuccc

SEQ ID NO: 1946074 - RNA, 13 nt, Homo sapiens
agcuguucagcug

SEQ ID NO: 1946075 - RNA, 14 nt, Homo sapiens
uuuagcuaccucac

SEQ ID NO: 1946076 - RNA, 14 nt, Homo sapiens
gugcauaagcacag

SEQ ID NO: 1946077 - RNA, 13 nt, Homo sapiens
caaggacucuucc

SEQ ID NO: 1946078 - RNA, 18 nt, Homo sapiens
ucacauccuggggcucag

SEQ ID NO: 1946079 - RNA, 16 nt, Homo sapiens
aauucuguacuuccaa

SEQ ID NO: 1946080 - RNA, 16 nt, Homo sapiens
ccccaugucaccacaa

SEQ ID NO: 1946081 - RNA, 19 nt, Homo sapiens
aagcuugggacaguuauug

SEQ ID NO: 1946082 - RNA, 18 nt, Homo sapiens
ugucccugccaaugcucc

SEQ ID NO: 1946083 - RNA, 21 nt, Homo sapiens
cucaaaagaaaaaaaaaagca

SEQ ID NO: 1946084 - RNA, 14 nt, Homo sapiens
ugagaaggacccug

SEQ ID NO: 1946085 - RNA, 18 nt, Homo sapiens
ucuuuaauuuuaacugau

SEQ ID NO: 1946086 - RNA, 21 nt, Homo sapiens
uuaaugugaagcaaaacacaa

SEQ ID NO: 1946087 - RNA, 16 nt, Homo sapiens
ugcugguguacucuag

SEQ ID NO: 1946088 - RNA, 14 nt, Homo sapiens
auaguguguccaug

SEQ ID NO: 1946089 - RNA, 20 nt, Homo sapiens
ccugaugauggucauugggg

SEQ ID NO: 1946090 - RNA, 16 nt, Homo sapiens
aagcuaccauuuauca

SEQ ID NO: 1946091 - RNA, 21 nt, Homo sapiens
ggagagauauuuugauucuca

SEQ ID NO: 1946092 - RNA, 23 nt, Homo sapiens
ugccacauugaaaaauguccaca

SEQ ID NO: 1946093 - RNA, 19 nt, Homo sapiens
uuuucagaggugaauuaau

SEQ ID NO: 1946094 - RNA, 17 nt, Homo sapiens
agguggcgcccaggggc

SEQ ID NO: 1946095 - RNA, 13 nt, Homo sapiens
uugggauuugccg

SEQ ID NO: 1946096 - RNA, 18 nt, Homo sapiens
uaggaguucucugaugca

SEQ ID NO: 1946097 - RNA, 14 nt, Homo sapiens
gccucugugccuuc

SEQ ID NO: 1946098 - RNA, 21 nt, Homo sapiens
caagccugcguucuugugaca

SEQ ID NO: 1946099 - RNA, 23 nt, Homo sapiens
gcuucugaugaucauuguugcca

SEQ ID NO: 1946100 - RNA, 15 nt, Homo sapiens
aguuaaugugccaaa

SEQ ID NO: 1946101 - RNA, 15 nt, Homo sapiens
cuccuguucgccucc

SEQ ID NO: 1946102 - RNA, 17 nt, Homo sapiens
accucuuguuucugggu

SEQ ID NO: 1946103 - RNA, 20 nt, Homo sapiens
ugcccuuuggaaagccauug

SEQ ID NO: 1946104 - RNA, 17 nt, Homo sapiens
gcuguaaggcaugaagg

SEQ ID NO: 1946105 - RNA, 23 nt, Homo sapiens
uuucuuaauuuggaaacuaauaa

SEQ ID NO: 1946106 - RNA, 17 nt, Homo sapiens
agguggguugaaagcca

SEQ ID NO: 1946107 - RNA, 22 nt, Homo sapiens
gcugcuuccuguaaugcaggac

SEQ ID NO: 1946108 - RNA, 19 nt, Homo sapiens
agagcacacuguagcauua

SEQ ID NO: 1946109 - RNA, 21 nt, Homo sapiens
ugcagauauuugauguaguuu

SEQ ID NO: 1946110 - RNA, 23 nt, Homo sapiens
cuggugggcuagccaauagaguu

SEQ ID NO: 1946111 - RNA, 15 nt, Homo sapiens
gacucgcagcaccca

SEQ ID NO: 1946112 - RNA, 15 nt, Homo sapiens
gcauagcagaccaca

SEQ ID NO: 1946113 - RNA, 13 nt, Homo sapiens
uagagagccuuaa

SEQ ID NO: 1946114 - RNA, 22 nt, Homo sapiens
aauuuacuuuuuaaacaguguu

SEQ ID NO: 1946115 - RNA, 22 nt, Homo sapiens
gauuugauugggaugaaugcca

SEQ ID NO: 1946116 - RNA, 18 nt, Homo sapiens
ucuccucuucuagcauuu

SEQ ID NO: 1946117 - RNA, 16 nt, Homo sapiens
auaaauuugcacuguu

SEQ ID NO: 1946118 - RNA, 15 nt, Homo sapiens
auacauacacauaua

SEQ ID NO: 1946119 - RNA, 18 nt, Homo sapiens
acuuguggacacagcucu

SEQ ID NO: 1946120 - RNA, 17 nt, Homo sapiens
cuaaaguaccagauuau

SEQ ID NO: 1946121 - RNA, 13 nt, Homo sapiens
aguaggaguggcu

SEQ ID NO: 1946122 - RNA, 18 nt, Homo sapiens
uaugugauuaguaugcua

SEQ ID NO: 1946123 - RNA, 14 nt, Homo sapiens
cauaaacauuugag

SEQ ID NO: 1946124 - RNA, 18 nt, Homo sapiens
cucugucuagcaugccaa

SEQ ID NO: 1946125 - RNA, 20 nt, Homo sapiens
cccaggcuggaaugcagugg

SEQ ID NO: 1946126 - RNA, 20 nt, Homo sapiens
cccaggcuggagugcaguga

SEQ ID NO: 1946127 - RNA, 22 nt, Homo sapiens
uaauugugaaguauuaagccua

SEQ ID NO: 1946128 - RNA, 16 nt, Homo sapiens
uggauguacuuaagag

SEQ ID NO: 1946129 - RNA, 19 nt, Homo sapiens
gucauugagcaguauauau

SEQ ID NO: 1946130 - RNA, 16 nt, Homo sapiens
gcccagcucggaucaa

SEQ ID NO: 1946131 - RNA, 20 nt, Homo sapiens
gagccuggaagacacccuaa

SEQ ID NO: 1946132 - RNA, 16 nt, Homo sapiens
uugaagauaguaacug

SEQ ID NO: 1946133 - RNA, 23 nt, Homo sapiens
aaacagacgggucugagacugaa

SEQ ID NO: 1946134 - RNA, 14 nt, Homo sapiens
cugaccccaaagac

SEQ ID NO: 1946135 - RNA, 22 nt, Homo sapiens
uagagcauuaaaauaacuauca

SEQ ID NO: 1946136 - RNA, 20 nt, Homo sapiens
ggcauacaaggggguaacuc

SEQ ID NO: 1946137 - RNA, 20 nt, Homo sapiens
cugcacguugugcacaugua

SEQ ID NO: 1946138 - RNA, 21 nt, Homo sapiens
gcacuuacaaucccaccuuuc

SEQ ID NO: 1946139 - RNA, 15 nt, Homo sapiens
ugcaccaugcugcug

SEQ ID NO: 1946140 - RNA, 16 nt, Homo sapiens
acucugugggugcuac

SEQ ID NO: 1946141 - RNA, 16 nt, Homo sapiens
uguuuugcaagggaau

SEQ ID NO: 1946142 - RNA, 13 nt, Homo sapiens
uugcugugaaauu

SEQ ID NO: 1946143 - RNA, 22 nt, Homo sapiens
ccuguggccaugacccugccuc

SEQ ID NO: 1946144 - RNA, 21 nt, Homo sapiens
uuuaucucacacacauuauga

SEQ ID NO: 1946145 - RNA, 21 nt, Homo sapiens
cuaauguacaauaaagcaaug

SEQ ID NO: 1946146 - RNA, 18 nt, Homo sapiens
gaggccaaggugggugga

SEQ ID NO: 1946147 - RNA, 21 nt, Homo sapiens
cagaagcagguucuugauguc

SEQ ID NO: 1946148 - RNA, 22 nt, Homo sapiens
caggagaccuggcacuggaugc

SEQ ID NO: 1946149 - RNA, 22 nt, Homo sapiens
gauuacaggcgugagccacugc

SEQ ID NO: 1946150 - RNA, 14 nt, Homo sapiens
agcacaucauggca

SEQ ID NO: 1946151 - RNA, 14 nt, Homo sapiens
ucuuuaacauacau

SEQ ID NO: 1946152 - RNA, 13 nt, Homo sapiens
accauucaggaca

SEQ ID NO: 1946153 - RNA, 22 nt, Homo sapiens
acagucaucauuuaucaucaca

SEQ ID NO: 1946154 - RNA, 22 nt, Homo sapiens
auaucguuaaguuaaacaaguu

SEQ ID NO: 1946155 - RNA, 16 nt, Homo sapiens
guccaaucacauucag

SEQ ID NO: 1946156 - RNA, 16 nt, Homo sapiens
uuuuugagauggaauc

SEQ ID NO: 1946157 - RNA, 21 nt, Homo sapiens
agagaaacuguguauagcuua

SEQ ID NO: 1946158 - RNA, 15 nt, Homo sapiens
cugagcauuugcacc

SEQ ID NO: 1946159 - RNA, 13 nt, Homo sapiens
gaauaaaguaugu

SEQ ID NO: 1946160 - RNA, 13 nt, Homo sapiens
gaacugugcuuuu

SEQ ID NO: 1946161 - RNA, 19 nt, Homo sapiens
cugggucuccacaucccca

SEQ ID NO: 1946162 - RNA, 16 nt, Homo sapiens
ccccugucuucucuca

SEQ ID NO: 1946163 - RNA, 18 nt, Homo sapiens
aauccacaaugagaugca

SEQ ID NO: 1946164 - RNA, 14 nt, Homo sapiens
uguuauaacuucau

SEQ ID NO: 1946165 - RNA, 13 nt, Homo sapiens
auuaugcuuuuaa

SEQ ID NO: 1946166 - RNA, 14 nt, Homo sapiens
acuagauuacauuc

SEQ ID NO: 1946167 - RNA, 15 nt, Homo sapiens
caggaucugcuccaa

SEQ ID NO: 1946168 - RNA, 13 nt, Homo sapiens
ucuucagcuuuga

SEQ ID NO: 1946169 - RNA, 17 nt, Homo sapiens
accacugagcccuugca

SEQ ID NO: 1946170 - RNA, 18 nt, Homo sapiens
ccaagaagauaaucucca

SEQ ID NO: 1946171 - RNA, 15 nt, Homo sapiens
uggugggcaaaaaca

SEQ ID NO: 1946172 - RNA, 22 nt, Homo sapiens
cagccuccccacauauggcaca

SEQ ID NO: 1946173 - RNA, 20 nt, Homo sapiens
uauaauguauuuucagcuca

SEQ ID NO: 1946174 - RNA, 19 nt, Homo sapiens
aacacagaaacuauaugca

SEQ ID NO: 1946175 - RNA, 21 nt, Homo sapiens
gaggcaagugugggggguccu

SEQ ID NO: 1946176 - RNA, 19 nt, Homo sapiens
agacuguugggacagccau

SEQ ID NO: 1946177 - RNA, 17 nt, Homo sapiens
auauucaaugcauuuaa

SEQ ID NO: 1946178 - RNA, 15 nt, Homo sapiens
accaaguacaaggac

SEQ ID NO: 1946179 - RNA, 12 nt, Homo sapiens
gauuuguugcca

SEQ ID NO: 1946180 - RNA, 14 nt, Homo sapiens
cagggaccucugaa

SEQ ID NO: 1946181 - RNA, 19 nt, Homo sapiens
aaaaucaagccugauucaa

SEQ ID NO: 1946182 - RNA, 21 nt, Homo sapiens
acauucccaugguggccucaa

SEQ ID NO: 1946183 - RNA, 14 nt, Homo sapiens
accaagaacagagu

SEQ ID NO: 1946184 - RNA, 19 nt, Homo sapiens
uggagggguuuaugcucaa

SEQ ID NO: 1946185 - RNA, 20 nt, Homo sapiens
uagaaaacaggcaaauuccu

SEQ ID NO: 1946186 - RNA, 18 nt, Homo sapiens
gaaagcuccuuccagacc

SEQ ID NO: 1946187 - RNA, 13 nt, Homo sapiens
acaugcauaacaa

SEQ ID NO: 1946188 - RNA, 17 nt, Homo sapiens
agccaagggcagaucac

SEQ ID NO: 1946189 - RNA, 14 nt, Homo sapiens
cuauuaacaugaug

SEQ ID NO: 1946190 - RNA, 15 nt, Homo sapiens
agcgccgcugugagg

SEQ ID NO: 1946191 - RNA, 19 nt, Homo sapiens
uaucauccccaaauguguc

SEQ ID NO: 1946192 - RNA, 15 nt, Homo sapiens
uacauguggcccaac

SEQ ID NO: 1946193 - RNA, 21 nt, Homo sapiens
caccguacgacucuuuuccaa

SEQ ID NO: 1946194 - RNA, 15 nt, Homo sapiens
cccuguuagcuuucc

SEQ ID NO: 1946195 - RNA, 16 nt, Homo sapiens
guauugucuuuugaca

SEQ ID NO: 1946196 - RNA, 15 nt, Homo sapiens
ccagggcuuccucaa

SEQ ID NO: 1946197 - RNA, 20 nt, Homo sapiens
cacagggucccacagccacg

SEQ ID NO: 1946198 - RNA, 17 nt, Homo sapiens
uggaaagaaucuaauag

SEQ ID NO: 1946199 - RNA, 14 nt, Homo sapiens
gggccacaucccac

SEQ ID NO: 1946200 - RNA, 22 nt, Homo sapiens
acucauuguauuccuccugaga

SEQ ID NO: 1946201 - RNA, 21 nt, Homo sapiens
ucccagauguuggaccaacac

SEQ ID NO: 1946202 - RNA, 18 nt, Homo sapiens
aagauuagagguuuguca

SEQ ID NO: 1946203 - RNA, 20 nt, Homo sapiens
uuucuccucacuguauccag

SEQ ID NO: 1946204 - RNA, 14 nt, Homo sapiens
uauaaaaaguggag

SEQ ID NO: 1946205 - RNA, 16 nt, Homo sapiens
cuccagaaaaaugaaa

SEQ ID NO: 1946206 - RNA, 21 nt, Homo sapiens
aaacagggcuuuacuaucuuu

SEQ ID NO: 1946207 - RNA, 15 nt, Homo sapiens
uaauagcuauccuaa

SEQ ID NO: 1946208 - RNA, 23 nt, Homo sapiens
cuuaggccuuccucucuccagau

SEQ ID NO: 1946209 - RNA, 16 nt, Homo sapiens
uuccucuguaagauau

SEQ ID NO: 1946210 - RNA, 18 nt, Homo sapiens
caggagcuccaguguccu

SEQ ID NO: 1946211 - RNA, 17 nt, Homo sapiens
ugaucuugugcuaugaa

SEQ ID NO: 1946212 - RNA, 19 nt, Homo sapiens
gcuggcaugcagugcccuc

SEQ ID NO: 1946213 - RNA, 18 nt, Homo sapiens
cuugcuccuaagcaaaag

SEQ ID NO: 1946214 - RNA, 19 nt, Homo sapiens
uuccuuccagauccugggu

SEQ ID NO: 1946215 - RNA, 21 nt, Homo sapiens
auuaccugccaauugcuaccg

SEQ ID NO: 1946216 - RNA, 22 nt, Homo sapiens
ggcuccugauggugucauucug

SEQ ID NO: 1946217 - RNA, 16 nt, Homo sapiens
cugacgacacugaaga

SEQ ID NO: 1946218 - RNA, 23 nt, Homo sapiens
cuuuuuagguacaguaaaacaau

SEQ ID NO: 1946219 - RNA, 16 nt, Homo sapiens
ucaaaauccaaaaaga

SEQ ID NO: 1946220 - RNA, 19 nt, Homo sapiens
accuggcccuugcaaucuu

SEQ ID NO: 1946221 - RNA, 19 nt, Homo sapiens
ugcuaugucaggcuuucau

SEQ ID NO: 1946222 - RNA, 17 nt, Homo sapiens
aggcuguucugcacuga

SEQ ID NO: 1946223 - RNA, 19 nt, Homo sapiens
uauucuuuuguauaacuac

SEQ ID NO: 1946224 - RNA, 17 nt, Homo sapiens
gaugcucacauaugaua

SEQ ID NO: 1946225 - RNA, 16 nt, Homo sapiens
uugagccccagaggca

SEQ ID NO: 1946226 - RNA, 20 nt, Homo sapiens
gaaucaggaauauuuuccaa

SEQ ID NO: 1946227 - RNA, 20 nt, Homo sapiens
guuucaacucugaaagugaa

SEQ ID NO: 1946228 - RNA, 14 nt, Homo sapiens
ccuuccaaaccuca

SEQ ID NO: 1946229 - RNA, 15 nt, Homo sapiens
auuugggauggagaa

SEQ ID NO: 1946230 - RNA, 11 nt, Homo sapiens
guacaaaaaca

SEQ ID NO: 1946231 - RNA, 14 nt, Homo sapiens
ccuuggugugaccc

SEQ ID NO: 1946232 - RNA, 16 nt, Homo sapiens
ugcaugugacucugaa

SEQ ID NO: 1946233 - RNA, 21 nt, Homo sapiens
ucaucauuuguggcagucccu

SEQ ID NO: 1946234 - RNA, 14 nt, Homo sapiens
uauaaaaaacacua

SEQ ID NO: 1946235 - RNA, 18 nt, Homo sapiens
auguggccaagcacaucu

SEQ ID NO: 1946236 - RNA, 13 nt, Homo sapiens
cccuaauucuuau

SEQ ID NO: 1946237 - RNA, 20 nt, Homo sapiens
ccgagcugggggccaugagc

SEQ ID NO: 1946238 - RNA, 23 nt, Homo sapiens
uccaaaaaugcacccaacuagcu

SEQ ID NO: 1946239 - RNA, 18 nt, Homo sapiens
ucuucagucucuauacca

SEQ ID NO: 1946240 - RNA, 16 nt, Homo sapiens
uucacugcauguaggu

SEQ ID NO: 1946241 - RNA, 16 nt, Homo sapiens
aguauucugccaucau

SEQ ID NO: 1946242 - RNA, 12 nt, Homo sapiens
ucauucacuguc

SEQ ID NO: 1946243 - RNA, 16 nt, Homo sapiens
cacuuuaucuugaaua

SEQ ID NO: 1946244 - RNA, 17 nt, Homo sapiens
auaucuguggucuucaa

SEQ ID NO: 1946245 - RNA, 15 nt, Homo sapiens
cuagauagcuauuaa

SEQ ID NO: 1946246 - RNA, 15 nt, Homo sapiens
guugaaagaucaaaa

SEQ ID NO: 1946247 - RNA, 14 nt, Homo sapiens
aguguacacagacu

SEQ ID NO: 1946248 - RNA, 15 nt, Homo sapiens
ucucaggauugcuag

SEQ ID NO: 1946249 - RNA, 20 nt, Homo sapiens
uccagagaccccaggaacaa

SEQ ID NO: 1946250 - RNA, 17 nt, Homo sapiens
caaccucauugcagcua

SEQ ID NO: 1946251 - RNA, 19 nt, Homo sapiens
uggcucccaccuguagucc

SEQ ID NO: 1946252 - RNA, 19 nt, Homo sapiens
ggccaagagaaacuuccua

SEQ ID NO: 1946253 - RNA, 14 nt, Homo sapiens
caguucugucauau

SEQ ID NO: 1946254 - RNA, 18 nt, Homo sapiens
acauaacgcugacugcaa

SEQ ID NO: 1946255 - RNA, 20 nt, Homo sapiens
aaagacuguacaaaguagaa

SEQ ID NO: 1946256 - RNA, 23 nt, Homo sapiens
guaauagaucagcauccaaaagc

SEQ ID NO: 1946257 - RNA, 20 nt, Homo sapiens
uuuauauggaguagcaaagg

SEQ ID NO: 1946258 - RNA, 15 nt, Homo sapiens
ggacagccaccaaga

SEQ ID NO: 1946259 - RNA, 18 nt, Homo sapiens
aagaugguccgugcccag

SEQ ID NO: 1946260 - RNA, 18 nt, Homo sapiens
uaaaccguacacuguguu

SEQ ID NO: 1946261 - RNA, 18 nt, Homo sapiens
gagauaaccacaaccagg

SEQ ID NO: 1946262 - RNA, 16 nt, Homo sapiens
ucacagaccucugcuu

SEQ ID NO: 1946263 - RNA, 13 nt, Homo sapiens
ggaacaccaggcu

SEQ ID NO: 1946264 - RNA, 22 nt, Homo sapiens
uuacaaggcaggccuuuccuac

SEQ ID NO: 1946265 - RNA, 16 nt, Homo sapiens
gccuccugucccucau

SEQ ID NO: 1946266 - RNA, 19 nt, Homo sapiens
ccaguuguuaaaaugagca

SEQ ID NO: 1946267 - RNA, 19 nt, Homo sapiens
gaagaccauccauccuccc

SEQ ID NO: 1946268 - RNA, 14 nt, Homo sapiens
gcucagcgccagcc

SEQ ID NO: 1946269 - RNA, 22 nt, Homo sapiens
caccucuuggggacccugccua

SEQ ID NO: 1946270 - RNA, 14 nt, Homo sapiens
agaugaaauuccau

SEQ ID NO: 1946271 - RNA, 14 nt, Homo sapiens
ccugccuaggaauu

SEQ ID NO: 1946272 - RNA, 16 nt, Homo sapiens
ugaaaguggacaagga

SEQ ID NO: 1946273 - RNA, 18 nt, Homo sapiens
aguaaucuguguacaaag

SEQ ID NO: 1946274 - RNA, 19 nt, Homo sapiens
cugacccuggucaccagag

SEQ ID NO: 1946275 - RNA, 17 nt, Homo sapiens
auacuuuuuguuuauuu

SEQ ID NO: 1946276 - RNA, 21 nt, Homo sapiens
uucucaaguucuaagauucua

SEQ ID NO: 1946277 - RNA, 20 nt, Homo sapiens
acaccuuggccuucugggaa

SEQ ID NO: 1946278 - RNA, 22 nt, Homo sapiens
uuguugccagaugcagcacaua

SEQ ID NO: 1946279 - RNA, 19 nt, Homo sapiens
gccauugaacaaaugugug

SEQ ID NO: 1946280 - RNA, 14 nt, Homo sapiens
aguacaaaguuuca

SEQ ID NO: 1946281 - RNA, 13 nt, Homo sapiens
cucuuggcaucga

SEQ ID NO: 1946282 - RNA, 16 nt, Homo sapiens
gaaauguaagauuuca

SEQ ID NO: 1946283 - RNA, 17 nt, Homo sapiens
agcacaucucucugccc

SEQ ID NO: 1946284 - RNA, 13 nt, Homo sapiens
aggaaucauguca

SEQ ID NO: 1946285 - RNA, 17 nt, Homo sapiens
ugcaccaaaucaucucu

SEQ ID NO: 1946286 - RNA, 17 nt, Homo sapiens
agugaccaccaacauuc

SEQ ID NO: 1946287 - RNA, 19 nt, Homo sapiens
cuccgcuuucuacccagcg

SEQ ID NO: 1946288 - RNA, 21 nt, Homo sapiens
cuguggggcugaauugccagg

SEQ ID NO: 1946289 - RNA, 19 nt, Homo sapiens
cacaggacugaaaagggaa

SEQ ID NO: 1946290 - RNA, 23 nt, Homo sapiens
ugcucagaccgagcgugugccac

SEQ ID NO: 1946291 - RNA, 17 nt, Homo sapiens
aaguaugagggaaaaug

SEQ ID NO: 1946292 - RNA, 22 nt, Homo sapiens
cuacuagagucugaacagcugu

SEQ ID NO: 1946293 - RNA, 21 nt, Homo sapiens
accaugcugcuggggaagaca

SEQ ID NO: 1946294 - RNA, 17 nt, Homo sapiens
gcauugcuggacucuga

SEQ ID NO: 1946295 - RNA, 13 nt, Homo sapiens
cuggucauucaca

SEQ ID NO: 1946296 - RNA, 15 nt, Homo sapiens
caucuguacauacug

SEQ ID NO: 1946297 - RNA, 15 nt, Homo sapiens
aaauucuacaacuuu

SEQ ID NO: 1946298 - RNA, 17 nt, Homo sapiens
ucaugccuguaaucuca

SEQ ID NO: 1946299 - RNA, 14 nt, Homo sapiens
cucacacacauaga

SEQ ID NO: 1946300 - RNA, 14 nt, Homo sapiens
cacagacacuuaca

SEQ ID NO: 1946301 - RNA, 20 nt, Homo sapiens
accugaaauuuauucacaua

SEQ ID NO: 1946302 - RNA, 18 nt, Homo sapiens
ucagaggugcagcuggag

SEQ ID NO: 1946303 - RNA, 14 nt, Homo sapiens
uugaagagaguugc

SEQ ID NO: 1946304 - RNA, 19 nt, Homo sapiens
guaccuaaaauugcaacuu

SEQ ID NO: 1946305 - RNA, 17 nt, Homo sapiens
cucucugaguacauugu

SEQ ID NO: 1946306 - RNA, 23 nt, Homo sapiens
uccauacgcguucuaggcauaca

SEQ ID NO: 1946307 - RNA, 16 nt, Homo sapiens
cuaguacucaguacua

SEQ ID NO: 1946308 - RNA, 14 nt, Homo sapiens
aaaaauauauguaa

SEQ ID NO: 1946309 - RNA, 14 nt, Homo sapiens
uaaauuauuuguua

SEQ ID NO: 1946310 - RNA, 15 nt, Homo sapiens
aaauggagugacuua

SEQ ID NO: 1946311 - RNA, 13 nt, Homo sapiens
aaaaugaacugaa

SEQ ID NO: 1946312 - RNA, 16 nt, Homo sapiens
gagcugcucuccuauc

SEQ ID NO: 1946313 - RNA, 12 nt, Homo sapiens
ugauuucucaaa

SEQ ID NO: 1946314 - RNA, 20 nt, Homo sapiens
auugacucaacaguuuccag

SEQ ID NO: 1946315 - RNA, 15 nt, Homo sapiens
augaauuaacccaaa

SEQ ID NO: 1946316 - RNA, 18 nt, Homo sapiens
ggagccugcaauaaggga

SEQ ID NO: 1946317 - RNA, 19 nt, Homo sapiens
aaguugcuaggaacaugug

SEQ ID NO: 1946318 - RNA, 20 nt, Homo sapiens
acucccagggacccagggag

SEQ ID NO: 1946319 - RNA, 13 nt, Homo sapiens
ugaagccacugaa

SEQ ID NO: 1946320 - RNA, 12 nt, Homo sapiens
cuaaaaaucaaa

SEQ ID NO: 1946321 - RNA, 22 nt, Homo sapiens
uacaaaaauaccuacugcugag

SEQ ID NO: 1946322 - RNA, 14 nt, Homo sapiens
gauggugacccaga

SEQ ID NO: 1946323 - RNA, 17 nt, Homo sapiens
agaaugcagcugaagac

SEQ ID NO: 1946324 - RNA, 13 nt, Homo sapiens
uccagcacaaccu

SEQ ID NO: 1946325 - RNA, 18 nt, Homo sapiens
gagggcuagaaccuggag

SEQ ID NO: 1946326 - RNA, 22 nt, Homo sapiens
ugacuuaaaauuggaaauguca

SEQ ID NO: 1946327 - RNA, 13 nt, Homo sapiens
ccaagaaggugag

SEQ ID NO: 1946328 - RNA, 20 nt, Homo sapiens
uacagacaugagccacugca

SEQ ID NO: 1946329 - RNA, 17 nt, Homo sapiens
ugggcugaguacaguca

SEQ ID NO: 1946330 - RNA, 17 nt, Homo sapiens
uauuuauacucacugag

SEQ ID NO: 1946331 - RNA, 22 nt, Homo sapiens
guaccaauucagugucuguucc

SEQ ID NO: 1946332 - RNA, 13 nt, Homo sapiens
gguacauggugcu

SEQ ID NO: 1946333 - RNA, 19 nt, Homo sapiens
gccucaguuucuucaccug

SEQ ID NO: 1946334 - RNA, 13 nt, Homo sapiens
agaccuacccucc

SEQ ID NO: 1946335 - RNA, 18 nt, Homo sapiens
augacaucucaggggcca

SEQ ID NO: 1946336 - RNA, 21 nt, Homo sapiens
uaccuaaggacaagacacuga

SEQ ID NO: 1946337 - RNA, 17 nt, Homo sapiens
aaugaaagaaaaugaga

SEQ ID NO: 1946338 - RNA, 22 nt, Homo sapiens
cagaaagggauugcuuugcauu

SEQ ID NO: 1946339 - RNA, 19 nt, Homo sapiens
uugagccugucaagaggca

SEQ ID NO: 1946340 - RNA, 16 nt, Homo sapiens
cauuguggucacagga

SEQ ID NO: 1946341 - RNA, 12 nt, Homo sapiens
cuaccucagguu

SEQ ID NO: 1946342 - RNA, 15 nt, Homo sapiens
caggagcaaucacag

SEQ ID NO: 1946343 - RNA, 13 nt, Homo sapiens
uauuaucuugcaa

SEQ ID NO: 1946344 - RNA, 22 nt, Homo sapiens
aaauacaguucugaauaugcug

SEQ ID NO: 1946345 - RNA, 20 nt, Homo sapiens
uggaauuugcaagucauggc

SEQ ID NO: 1946346 - RNA, 20 nt, Homo sapiens
aguuuuuguucuuaauugca

SEQ ID NO: 1946347 - RNA, 22 nt, Homo sapiens
uaccuuuaaaauuuaccacaga

SEQ ID NO: 1946348 - RNA, 19 nt, Homo sapiens
acugaugacaaacccagga

SEQ ID NO: 1946349 - RNA, 17 nt, Homo sapiens
agcucuccccuccugcu

SEQ ID NO: 1946350 - RNA, 22 nt, Homo sapiens
uauaagcccacuguuaauauuc

SEQ ID NO: 1946351 - RNA, 18 nt, Homo sapiens
gacccaguguaaagaaua

SEQ ID NO: 1946352 - RNA, 22 nt, Homo sapiens
cuuaucucagucaugcauaaau

SEQ ID NO: 1946353 - RNA, 16 nt, Homo sapiens
uguagcuucuucugaa

SEQ ID NO: 1946354 - RNA, 19 nt, Homo sapiens
accagugaaacuaugaucc

SEQ ID NO: 1946355 - RNA, 23 nt, Homo sapiens
aucacucaagaugccuccuguca

SEQ ID NO: 1946356 - RNA, 13 nt, Homo sapiens
auggcaccuguau

SEQ ID NO: 1946357 - RNA, 23 nt, Homo sapiens
agcgacagccugggcacccgcgg

SEQ ID NO: 1946358 - RNA, 23 nt, Homo sapiens
acccagacguggugcuucucaca

SEQ ID NO: 1946359 - RNA, 22 nt, Homo sapiens
uagccgggauggucuugaucuc

SEQ ID NO: 1946360 - RNA, 18 nt, Homo sapiens
uccaucaaaccuuugcca

SEQ ID NO: 1946361 - RNA, 22 nt, Homo sapiens
agucaacagagaggggcaggga

SEQ ID NO: 1946362 - RNA, 20 nt, Homo sapiens
gccacauggccccaucccag

SEQ ID NO: 1946363 - RNA, 22 nt, Homo sapiens
ucgugauauccacaaaugcuau

SEQ ID NO: 1946364 - RNA, 15 nt, Homo sapiens
agcugaagcuggugc

SEQ ID NO: 1946365 - RNA, 13 nt, Homo sapiens
uccauacuguaga

SEQ ID NO: 1946366 - RNA, 19 nt, Homo sapiens
uuaacuaugaauucuuaag

SEQ ID NO: 1946367 - RNA, 16 nt, Homo sapiens
guaggggcuacuguga

SEQ ID NO: 1946368 - RNA, 21 nt, Homo sapiens
acaggguuuuguauucuuuac

SEQ ID NO: 1946369 - RNA, 20 nt, Homo sapiens
aggcuggccgacauggugaa

SEQ ID NO: 1946370 - RNA, 16 nt, Homo sapiens
aggaaauacauaugca

SEQ ID NO: 1946371 - RNA, 18 nt, Homo sapiens
ccucuuuccuugucccag

SEQ ID NO: 1946372 - RNA, 22 nt, Homo sapiens
aucaaaucaucauuaaugacuu

SEQ ID NO: 1946373 - RNA, 18 nt, Homo sapiens
guaaucccauuucccaaa

SEQ ID NO: 1946374 - RNA, 19 nt, Homo sapiens
aggucuccaccugcacauu

SEQ ID NO: 1946375 - RNA, 15 nt, Homo sapiens
auauccuaggcaucu

SEQ ID NO: 1946376 - RNA, 15 nt, Homo sapiens
gcagucacccugugg

SEQ ID NO: 1946377 - RNA, 13 nt, Homo sapiens
cauugguguuguc

SEQ ID NO: 1946378 - RNA, 19 nt, Homo sapiens
gguuucauguuaguuaccu

SEQ ID NO: 1946379 - RNA, 14 nt, Homo sapiens
ucugucccagcucc

SEQ ID NO: 1946380 - RNA, 17 nt, Homo sapiens
caagcucccugccccaa

SEQ ID NO: 1946381 - RNA, 13 nt, Homo sapiens
cacuucauucaca

SEQ ID NO: 1946382 - RNA, 11 nt, Homo sapiens
ccacucagguc

SEQ ID NO: 1946383 - RNA, 15 nt, Homo sapiens
uguuuuuucugcaau

SEQ ID NO: 1946384 - RNA, 12 nt, Homo sapiens
agccacagcucu

SEQ ID NO: 1946385 - RNA, 13 nt, Homo sapiens
uggccacacugug

SEQ ID NO: 1946386 - RNA, 15 nt, Homo sapiens
auccucaggucucca

SEQ ID NO: 1946387 - RNA, 21 nt, Homo sapiens
auaaaccaguugaaucauuga

SEQ ID NO: 1946388 - RNA, 16 nt, Homo sapiens
cucaggacagaaccac

SEQ ID NO: 1946389 - RNA, 21 nt, Homo sapiens
gcugcacucuugaacugggcg

SEQ ID NO: 1946390 - RNA, 18 nt, Homo sapiens
acaaaugggaauucacuc

SEQ ID NO: 1946391 - RNA, 23 nt, Homo sapiens
aaugcucaagcccccagcuggaa

SEQ ID NO: 1946392 - RNA, 23 nt, Homo sapiens
cuggucuccuaaccaaggugcac

SEQ ID NO: 1946393 - RNA, 22 nt, Homo sapiens
uauuagcagaaauguaucuaua

SEQ ID NO: 1946394 - RNA, 20 nt, Homo sapiens
augguaguuuaaguuuccuu

SEQ ID NO: 1946395 - RNA, 21 nt, Homo sapiens
acgcuggggaauauacgugcu

SEQ ID NO: 1946396 - RNA, 14 nt, Homo sapiens
aauuaaucagcucg

SEQ ID NO: 1946397 - RNA, 20 nt, Homo sapiens
cauguugugauguacacauu

SEQ ID NO: 1946398 - RNA, 18 nt, Homo sapiens
ccaaaaucauaaugccau

SEQ ID NO: 1946399 - RNA, 17 nt, Homo sapiens
aauucuauacuguugau

SEQ ID NO: 1946400 - RNA, 21 nt, Homo sapiens
ugccccacaaaacuucagugu

SEQ ID NO: 1946401 - RNA, 17 nt, Homo sapiens
ugaagcuaaaacacuuc

SEQ ID NO: 1946402 - RNA, 18 nt, Homo sapiens
gaaauauuuucagcaaaa

SEQ ID NO: 1946403 - RNA, 15 nt, Homo sapiens
gaacccugugcaauu

SEQ ID NO: 1946404 - RNA, 14 nt, Homo sapiens
cuggggcugaggga

SEQ ID NO: 1946405 - RNA, 22 nt, Homo sapiens
gagacacccuaacucuugcuca

SEQ ID NO: 1946406 - RNA, 22 nt, Homo sapiens
aggaccaggagccagguguccu

SEQ ID NO: 1946407 - RNA, 17 nt, Homo sapiens
gagacggcaagacucca

SEQ ID NO: 1946408 - RNA, 20 nt, Homo sapiens
gagucuuguguucacccgug

SEQ ID NO: 1946409 - RNA, 18 nt, Homo sapiens
auauauuuuaaagcacuu

SEQ ID NO: 1946410 - RNA, 13 nt, Homo sapiens
aaagguuguguag

SEQ ID NO: 1946411 - RNA, 23 nt, Homo sapiens
gaaaacccaacuccucuccuccc

SEQ ID NO: 1946412 - RNA, 20 nt, Homo sapiens
ucucaggaaaugcugaccca

SEQ ID NO: 1946413 - RNA, 13 nt, Homo sapiens
aacaccugccuag

SEQ ID NO: 1946414 - RNA, 23 nt, Homo sapiens
gcugaauguaugucagugcuaua

SEQ ID NO: 1946415 - RNA, 13 nt, Homo sapiens
accacagcugcug

SEQ ID NO: 1946416 - RNA, 14 nt, Homo sapiens
agggagauucagac

SEQ ID NO: 1946417 - RNA, 16 nt, Homo sapiens
aacuauugggugaaua

SEQ ID NO: 1946418 - RNA, 14 nt, Homo sapiens
aggcugcugugaac

SEQ ID NO: 1946419 - RNA, 21 nt, Homo sapiens
cugcaccuucgccagggagca

SEQ ID NO: 1946420 - RNA, 16 nt, Homo sapiens
aaccuuuuuauuuuca

SEQ ID NO: 1946421 - RNA, 19 nt, Homo sapiens
gaaaaugcuauccagcaga

SEQ ID NO: 1946422 - RNA, 18 nt, Homo sapiens
acuaccucaaaacacuuu

SEQ ID NO: 1946423 - RNA, 12 nt, Homo sapiens
ccugauggugcu

SEQ ID NO: 1946424 - RNA, 16 nt, Homo sapiens
aaucaugcccugccuu

SEQ ID NO: 1946425 - RNA, 13 nt, Homo sapiens
gcaggaaagccac

SEQ ID NO: 1946426 - RNA, 23 nt, Homo sapiens
ugcuaaauggucgcccaggagac

SEQ ID NO: 1946427 - RNA, 21 nt, Homo sapiens
acgcauuuuugacagguugcu

SEQ ID NO: 1946428 - RNA, 19 nt, Homo sapiens
accuuucugaggaguaaaa

SEQ ID NO: 1946429 - RNA, 17 nt, Homo sapiens
gaauucguuucugacau

SEQ ID NO: 1946430 - RNA, 23 nt, Homo sapiens
agagcagugauucucucuucucu

SEQ ID NO: 1946431 - RNA, 20 nt, Homo sapiens
cucacacgcgaaaguaucac

SEQ ID NO: 1946432 - RNA, 14 nt, Homo sapiens
augaugaaacauuc

SEQ ID NO: 1946433 - RNA, 20 nt, Homo sapiens
uaugcccuugccucucugga

SEQ ID NO: 1946434 - RNA, 18 nt, Homo sapiens
uaaaucaaauauauguca

SEQ ID NO: 1946435 - RNA, 22 nt, Homo sapiens
ugauugcuuccacccacacgac

SEQ ID NO: 1946436 - RNA, 19 nt, Homo sapiens
gucuggcaucucccacaca

SEQ ID NO: 1946437 - RNA, 19 nt, Homo sapiens
cugacaugccauccuucca

SEQ ID NO: 1946438 - RNA, 20 nt, Homo sapiens
cccaucaauucuuagaauau

SEQ ID NO: 1946439 - RNA, 15 nt, Homo sapiens
acuaugaucacagug

SEQ ID NO: 1946440 - RNA, 18 nt, Homo sapiens
ucaagggguguucaguua

SEQ ID NO: 1946441 - RNA, 22 nt, Homo sapiens
cccuuuggauuaugcccaugaa

SEQ ID NO: 1946442 - RNA, 20 nt, Homo sapiens
aaguacuggcucuuuauuca

SEQ ID NO: 1946443 - RNA, 14 nt, Homo sapiens
uuguacauuuggaa

SEQ ID NO: 1946444 - RNA, 22 nt, Homo sapiens
ucaugaaaaaugaucucugcuu

SEQ ID NO: 1946445 - RNA, 14 nt, Homo sapiens
guaaucgugcuauu

SEQ ID NO: 1946446 - RNA, 14 nt, Homo sapiens
ggagaccucagaag

SEQ ID NO: 1946447 - RNA, 15 nt, Homo sapiens
agauguauuaugcaa

SEQ ID NO: 1946448 - RNA, 19 nt, Homo sapiens
cauugcucagaaaugucau

SEQ ID NO: 1946449 - RNA, 18 nt, Homo sapiens
ucccagaggcuagucucu

SEQ ID NO: 1946450 - RNA, 15 nt, Homo sapiens
aaccacuguacauau

SEQ ID NO: 1946451 - RNA, 15 nt, Homo sapiens
auucucaguuuaaaa

SEQ ID NO: 1946452 - RNA, 21 nt, Homo sapiens
uauauccuugacaccuuacuu

SEQ ID NO: 1946453 - RNA, 19 nt, Homo sapiens
gaaaaagcuucauucucuu

SEQ ID NO: 1946454 - RNA, 16 nt, Homo sapiens
ccagcccuacuccugc

SEQ ID NO: 1946455 - RNA, 17 nt, Homo sapiens
cagacccuucaauggaa

SEQ ID NO: 1946456 - RNA, 16 nt, Homo sapiens
gaggcaguggcagcaa

SEQ ID NO: 1946457 - RNA, 22 nt, Homo sapiens
cuuuucggccccauguaucuca

SEQ ID NO: 1946458 - RNA, 19 nt, Homo sapiens
agcuuucucgcgcccuccc

SEQ ID NO: 1946459 - RNA, 12 nt, Homo sapiens
ugaagacugggu

SEQ ID NO: 1946460 - RNA, 19 nt, Homo sapiens
acucacugauucucuacau

SEQ ID NO: 1946461 - RNA, 17 nt, Homo sapiens
aaguaaguuugauuuca

SEQ ID NO: 1946462 - RNA, 22 nt, Homo sapiens
aguggauaugcuagcauuuuag

SEQ ID NO: 1946463 - RNA, 20 nt, Homo sapiens
gcuggagugcaguggcauga

SEQ ID NO: 1946464 - RNA, 20 nt, Homo sapiens
acauuuggaaaagacagaaa

SEQ ID NO: 1946465 - RNA, 20 nt, Homo sapiens
cguucuuauuuaaucuccau

SEQ ID NO: 1946466 - RNA, 19 nt, Homo sapiens
aaccaaagggggacaguga

SEQ ID NO: 1946467 - RNA, 21 nt, Homo sapiens
aauguuccugaaaauugcaau

SEQ ID NO: 1946468 - RNA, 16 nt, Homo sapiens
cagcccaggacucuaa

SEQ ID NO: 1946469 - RNA, 20 nt, Homo sapiens
agcaauaauugacaaacuuu

SEQ ID NO: 1946470 - RNA, 17 nt, Homo sapiens
acaccauuucugggcuc

SEQ ID NO: 1946471 - RNA, 12 nt, Homo sapiens
aacaggcauuug

SEQ ID NO: 1946472 - RNA, 18 nt, Homo sapiens
gacaguaccuagcuguaa

SEQ ID NO: 1946473 - RNA, 10 nt, Homo sapiens
aacuccuucc

SEQ ID NO: 1946474 - RNA, 21 nt, Homo sapiens
cauggcgagauacugcauguu

SEQ ID NO: 1946475 - RNA, 23 nt, Homo sapiens
cagggugggcuggggacucuggc

SEQ ID NO: 1946476 - RNA, 20 nt, Homo sapiens
caaggaucagaguaacacaa

SEQ ID NO: 1946477 - RNA, 16 nt, Homo sapiens
gaacaaagacauuuau

SEQ ID NO: 1946478 - RNA, 21 nt, Homo sapiens
auaacauuuucaauacugucc

SEQ ID NO: 1946479 - RNA, 18 nt, Homo sapiens
auaccaggcagugugcca

SEQ ID NO: 1946480 - RNA, 18 nt, Homo sapiens
ugggagacugaagacuca

SEQ ID NO: 1946481 - RNA, 11 nt, Homo sapiens
gguauggccaa

SEQ ID NO: 1946482 - RNA, 14 nt, Homo sapiens
aagaucaauucccu

SEQ ID NO: 1946483 - RNA, 22 nt, Homo sapiens
ucugccaggguggggcucucua

SEQ ID NO: 1946484 - RNA, 21 nt, Homo sapiens
caacuaguagcuaaccaucac

SEQ ID NO: 1946485 - RNA, 22 nt, Homo sapiens
uaaccugccaacauacuuuaag

SEQ ID NO: 1946486 - RNA, 16 nt, Homo sapiens
cauaaaggacacugga

SEQ ID NO: 1946487 - RNA, 20 nt, Homo sapiens
aaagcagccauuggcacugu

SEQ ID NO: 1946488 - RNA, 15 nt, Homo sapiens
cagcauugcugguuc

SEQ ID NO: 1946489 - RNA, 21 nt, Homo sapiens
cugggucugcuggcuucuaca

SEQ ID NO: 1946490 - RNA, 21 nt, Homo sapiens
aucccccgccuuuaguucucc

SEQ ID NO: 1946491 - RNA, 14 nt, Homo sapiens
gcagauacugcugu

SEQ ID NO: 1946492 - RNA, 14 nt, Homo sapiens
ccgaauaaauguuu

SEQ ID NO: 1946493 - RNA, 15 nt, Homo sapiens
uguauaagcuacuca

SEQ ID NO: 1946494 - RNA, 14 nt, Homo sapiens
ccucccucugcucu

SEQ ID NO: 1946495 - RNA, 17 nt, Homo sapiens
aaauucaaacauauucu

SEQ ID NO: 1946496 - RNA, 23 nt, Homo sapiens
augaaggcaucagaaacaucuga

SEQ ID NO: 1946497 - RNA, 23 nt, Homo sapiens
agguucuccuugauugggacugg

SEQ ID NO: 1946498 - RNA, 18 nt, Homo sapiens
acauguauucuguuggcc

SEQ ID NO: 1946499 - RNA, 16 nt, Homo sapiens
accccaaccccaggga

SEQ ID NO: 1946500 - RNA, 17 nt, Homo sapiens
ugcuaccucacuggggu

SEQ ID NO: 1946501 - RNA, 14 nt, Homo sapiens
agauccucuucuca

SEQ ID NO: 1946502 - RNA, 18 nt, Homo sapiens
ucagguaccacguauucc

SEQ ID NO: 1946503 - RNA, 22 nt, Homo sapiens
ccuggggaagcugcgggcaccc

SEQ ID NO: 1946504 - RNA, 20 nt, Homo sapiens
acugaaauguggaugugauu

SEQ ID NO: 1946505 - RNA, 19 nt, Homo sapiens
aucacaaacugaaugacuu

SEQ ID NO: 1946506 - RNA, 20 nt, Homo sapiens
agacccaacauuacuaacaa

SEQ ID NO: 1946507 - RNA, 22 nt, Homo sapiens
acaauguugcauuuaugaugca

SEQ ID NO: 1946508 - RNA, 18 nt, Homo sapiens
acgugcucuucuguucuc

SEQ ID NO: 1946509 - RNA, 22 nt, Homo sapiens
gccaggaaaagcccucaucuuc

SEQ ID NO: 1946510 - RNA, 21 nt, Homo sapiens
ccaaugugaaagauuauuuaa

SEQ ID NO: 1946511 - RNA, 20 nt, Homo sapiens
gcagacccauaccuuuccag

SEQ ID NO: 1946512 - RNA, 20 nt, Homo sapiens
agccaaacagagccuucaca

SEQ ID NO: 1946513 - RNA, 14 nt, Homo sapiens
uuuggccauuccaa

SEQ ID NO: 1946514 - RNA, 18 nt, Homo sapiens
ccuaaugggaaucauucc

SEQ ID NO: 1946515 - RNA, 16 nt, Homo sapiens
aaugaugaagcuuccu

SEQ ID NO: 1946516 - RNA, 18 nt, Homo sapiens
cauaccuggguaugugua

SEQ ID NO: 1946517 - RNA, 18 nt, Homo sapiens
uucccauaucaaaagaca

SEQ ID NO: 1946518 - RNA, 16 nt, Homo sapiens
ucuuuuacauucugca

SEQ ID NO: 1946519 - RNA, 19 nt, Homo sapiens
cuuugugauaguucagucc

SEQ ID NO: 1946520 - RNA, 19 nt, Homo sapiens
auaagcuacuagcaaaaua

SEQ ID NO: 1946521 - RNA, 21 nt, Homo sapiens
caauuagcuccuccuuuuucc

SEQ ID NO: 1946522 - RNA, 16 nt, Homo sapiens
ucaacaacagugugau

SEQ ID NO: 1946523 - RNA, 19 nt, Homo sapiens
ucaaaucuccugcugauuu

SEQ ID NO: 1946524 - RNA, 13 nt, Homo sapiens
ugcugagaacaaa

SEQ ID NO: 1946525 - RNA, 15 nt, Homo sapiens
acacacacagaugca

SEQ ID NO: 1946526 - RNA, 13 nt, Homo sapiens
cacaauauuccua

SEQ ID NO: 1946527 - RNA, 23 nt, Homo sapiens
uggauuuguuuguuuucuugucu

SEQ ID NO: 1946528 - RNA, 18 nt, Homo sapiens
cugagucccuccaugcaa

SEQ ID NO: 1946529 - RNA, 14 nt, Homo sapiens
caagauugaagucu

SEQ ID NO: 1946530 - RNA, 16 nt, Homo sapiens
ccaggggaauguauuu

SEQ ID NO: 1946531 - RNA, 16 nt, Homo sapiens
cguucugcaagcauca

SEQ ID NO: 1946532 - RNA, 20 nt, Homo sapiens
uaaggaaaauuaauccucac

SEQ ID NO: 1946533 - RNA, 14 nt, Homo sapiens
guggccggggucca

SEQ ID NO: 1946534 - RNA, 17 nt, Homo sapiens
acccuggagagugcaca

SEQ ID NO: 1946535 - RNA, 20 nt, Homo sapiens
uacacacuuuccaaguacuc

SEQ ID NO: 1946536 - RNA, 18 nt, Homo sapiens
ugagcagcuuuucucccc

SEQ ID NO: 1946537 - RNA, 17 nt, Homo sapiens
aaacacuuggcauacaa

SEQ ID NO: 1946538 - RNA, 14 nt, Homo sapiens
cucucuuguagcuc

SEQ ID NO: 1946539 - RNA, 14 nt, Homo sapiens
accccauuccugau

SEQ ID NO: 1946540 - RNA, 15 nt, Homo sapiens
auuauaucugugaau

SEQ ID NO: 1946541 - RNA, 23 nt, Homo sapiens
gcucaaguugaugaaucaugggg

SEQ ID NO: 1946542 - RNA, 17 nt, Homo sapiens
gauguaaagaauggaag

SEQ ID NO: 1946543 - RNA, 12 nt, Homo sapiens
ggggcagggugu

SEQ ID NO: 1946544 - RNA, 18 nt, Homo sapiens
cucacacaaucagaccaa

SEQ ID NO: 1946545 - RNA, 18 nt, Homo sapiens
cugugugcgagucugagu

SEQ ID NO: 1946546 - RNA, 17 nt, Homo sapiens
acaccgagugaggccau

SEQ ID NO: 1946547 - RNA, 17 nt, Homo sapiens
ugcucucaacaggacuu

SEQ ID NO: 1946548 - RNA, 9 nt, Homo sapiens
ucacugaga

SEQ ID NO: 1946549 - RNA, 16 nt, Homo sapiens
aucagcuaaacaccac

SEQ ID NO: 1946550 - RNA, 15 nt, Homo sapiens
ugauuucacagugug

SEQ ID NO: 1946551 - RNA, 23 nt, Homo sapiens
ucuaaugaaaccugugucucuga

SEQ ID NO: 1946552 - RNA, 16 nt, Homo sapiens
ccagugacacaacuca

SEQ ID NO: 1946553 - RNA, 13 nt, Homo sapiens
agaaaccucggaa

SEQ ID NO: 1946554 - RNA, 19 nt, Homo sapiens
ggcagaucccacuugcagc

SEQ ID NO: 1946555 - RNA, 23 nt, Homo sapiens
uauccuuaaggcauauacuuugu

SEQ ID NO: 1946556 - RNA, 22 nt, Homo sapiens
caccagagggauaaaaacaaua

SEQ ID NO: 1946557 - RNA, 18 nt, Homo sapiens
auauuaaaaaaagacaua

SEQ ID NO: 1946558 - RNA, 22 nt, Homo sapiens
auugugcccgggcccaugggga

SEQ ID NO: 1946559 - RNA, 22 nt, Homo sapiens
ugcccauuguccuuaccguccu

SEQ ID NO: 1946560 - RNA, 11 nt, Homo sapiens
ggccauagcaa

SEQ ID NO: 1946561 - RNA, 20 nt, Homo sapiens
uuuggagcacaaaauucaaa

SEQ ID NO: 1946562 - RNA, 17 nt, Homo sapiens
aagcaguucaugucuga

SEQ ID NO: 1946563 - RNA, 20 nt, Homo sapiens
acucugagcccccugaccuu

SEQ ID NO: 1946564 - RNA, 14 nt, Homo sapiens
guaugccacugcac

SEQ ID NO: 1946565 - RNA, 16 nt, Homo sapiens
caagugugugcacaug

SEQ ID NO: 1946566 - RNA, 13 nt, Homo sapiens
ucugcuguagcuu

SEQ ID NO: 1946567 - RNA, 20 nt, Homo sapiens
uuucuaagcaguuaugguga

SEQ ID NO: 1946568 - RNA, 18 nt, Homo sapiens
cuuauagaaaguucaaaa

SEQ ID NO: 1946569 - RNA, 21 nt, Homo sapiens
aagccaccuuccagugagcuc

SEQ ID NO: 1946570 - RNA, 15 nt, Homo sapiens
ccccuccuccaucuc

SEQ ID NO: 1946571 - RNA, 15 nt, Homo sapiens
cugccacaacaccag

SEQ ID NO: 1946572 - RNA, 17 nt, Homo sapiens
gcccccagcugugaccg

SEQ ID NO: 1946573 - RNA, 15 nt, Homo sapiens
ucauaauuuugcaaa

SEQ ID NO: 1946574 - RNA, 17 nt, Homo sapiens
gaauuucuguucuucca

SEQ ID NO: 1946575 - RNA, 23 nt, Homo sapiens
ugugucugggauaaccucggcug

SEQ ID NO: 1946576 - RNA, 22 nt, Homo sapiens
uaacauaccguuuauaaugcca

SEQ ID NO: 1946577 - RNA, 17 nt, Homo sapiens
guuccugcacuccagaa

SEQ ID NO: 1946578 - RNA, 13 nt, Homo sapiens
cagacaagcuuga

SEQ ID NO: 1946579 - RNA, 16 nt, Homo sapiens
gagggaggcaucugca

SEQ ID NO: 1946580 - RNA, 19 nt, Homo sapiens
ggacaaugccuugggagag

SEQ ID NO: 1946581 - RNA, 21 nt, Homo sapiens
cugugaauaaaaacccuguau

SEQ ID NO: 1946582 - RNA, 22 nt, Homo sapiens
cauuccaggaccagaagcauuu

SEQ ID NO: 1946583 - RNA, 18 nt, Homo sapiens
agaaauuuugccuuuaag

SEQ ID NO: 1946584 - RNA, 22 nt, Homo sapiens
acuaguuugcuuugcugaccaa

SEQ ID NO: 1946585 - RNA, 23 nt, Homo sapiens
acggcuugugggcacugugccaa

SEQ ID NO: 1946586 - RNA, 23 nt, Homo sapiens
ugucugucccaguuaacuguuaa

SEQ ID NO: 1946587 - RNA, 18 nt, Homo sapiens
ggucaaaauagugccacu

SEQ ID NO: 1946588 - RNA, 20 nt, Homo sapiens
uaugcagauuauuugcccaa

SEQ ID NO: 1946589 - RNA, 15 nt, Homo sapiens
ccagucucauuuuca

SEQ ID NO: 1946590 - RNA, 20 nt, Homo sapiens
uguaggccuuccagugcagg

SEQ ID NO: 1946591 - RNA, 20 nt, Homo sapiens
gauggccccuccacugggga

SEQ ID NO: 1946592 - RNA, 22 nt, Homo sapiens
cuucuuugacaccacaccauca

SEQ ID NO: 1946593 - RNA, 22 nt, Homo sapiens
cuacaugucuagagaacacugu

SEQ ID NO: 1946594 - RNA, 16 nt, Homo sapiens
uucagccaagaauucu

SEQ ID NO: 1946595 - RNA, 14 nt, Homo sapiens
acccugaaccuaug

SEQ ID NO: 1946596 - RNA, 19 nt, Homo sapiens
cuauaaguuguaccaaaac

SEQ ID NO: 1946597 - RNA, 18 nt, Homo sapiens
guccucccucugauuuuu

SEQ ID NO: 1946598 - RNA, 13 nt, Homo sapiens
ggagccugggaug

SEQ ID NO: 1946599 - RNA, 17 nt, Homo sapiens
acaaauuucauugcacu

SEQ ID NO: 1946600 - RNA, 18 nt, Homo sapiens
cuuauuuguaguuguuag

SEQ ID NO: 1946601 - RNA, 14 nt, Homo sapiens
gggcccagggccua

SEQ ID NO: 1946602 - RNA, 15 nt, Homo sapiens
uggaguuaaucuuau

SEQ ID NO: 1946603 - RNA, 17 nt, Homo sapiens
gcagcauacacagauga

SEQ ID NO: 1946604 - RNA, 12 nt, Homo sapiens
aacuugcugcuu

SEQ ID NO: 1946605 - RNA, 21 nt, Homo sapiens
uucuagccuuaagacauuuga

SEQ ID NO: 1946606 - RNA, 20 nt, Homo sapiens
cuuccuuggaggggggagcc

SEQ ID NO: 1946607 - RNA, 12 nt, Homo sapiens
gcuugaaauuga

SEQ ID NO: 1946608 - RNA, 14 nt, Homo sapiens
gaaaagaacuggaa

SEQ ID NO: 1946609 - RNA, 19 nt, Homo sapiens
ucaauaacuauugcugcuu

SEQ ID NO: 1946610 - RNA, 18 nt, Homo sapiens
auuucuuggcaugcaucu

SEQ ID NO: 1946611 - RNA, 20 nt, Homo sapiens
ccacuuugucuuggugggag

SEQ ID NO: 1946612 - RNA, 21 nt, Homo sapiens
ucugcucaucugauauucaaa

SEQ ID NO: 1946613 - RNA, 21 nt, Homo sapiens
acuucccagcccuggccucca

SEQ ID NO: 1946614 - RNA, 16 nt, Homo sapiens
ugguuuuuacauucaa

SEQ ID NO: 1946615 - RNA, 15 nt, Homo sapiens
acuuggaguguucau

SEQ ID NO: 1946616 - RNA, 16 nt, Homo sapiens
cucuaacuccugccau

SEQ ID NO: 1946617 - RNA, 21 nt, Homo sapiens
acuuauuauuccagaucugca

SEQ ID NO: 1946618 - RNA, 14 nt, Homo sapiens
cguaaacaccaaau

SEQ ID NO: 1946619 - RNA, 20 nt, Homo sapiens
cucuaugaaaauuauaucuc

SEQ ID NO: 1946620 - RNA, 15 nt, Homo sapiens
ucggcucagugcaac

SEQ ID NO: 1946621 - RNA, 22 nt, Homo sapiens
gacugccucugccacacucuga

SEQ ID NO: 1946622 - RNA, 21 nt, Homo sapiens
ugaccucuuuggaaacuauaa

SEQ ID NO: 1946623 - RNA, 17 nt, Homo sapiens
agucugaggcaggagaa

SEQ ID NO: 1946624 - RNA, 17 nt, Homo sapiens
caugaucaccccuuuga

SEQ ID NO: 1946625 - RNA, 21 nt, Homo sapiens
uaaaguugcugugaauacuua

SEQ ID NO: 1946626 - RNA, 20 nt, Homo sapiens
aggacauucuacaaaauauc

SEQ ID NO: 1946627 - RNA, 16 nt, Homo sapiens
guauaugucauuuacu

SEQ ID NO: 1946628 - RNA, 14 nt, Homo sapiens
uacaagaaccugcu

SEQ ID NO: 1946629 - RNA, 21 nt, Homo sapiens
gugcauuuguuuguauacaua

SEQ ID NO: 1946630 - RNA, 16 nt, Homo sapiens
cuugcugcugagugca

SEQ ID NO: 1946631 - RNA, 15 nt, Homo sapiens
ucuuucugccaacuu

SEQ ID NO: 1946632 - RNA, 14 nt, Homo sapiens
gugguuuguuauca

SEQ ID NO: 1946633 - RNA, 23 nt, Homo sapiens
cuccuuauuaaaaaucuucgcaa

SEQ ID NO: 1946634 - RNA, 22 nt, Homo sapiens
ugcccaaaagccauguauuuca

SEQ ID NO: 1946635 - RNA, 15 nt, Homo sapiens
ucaauguuuguccug

SEQ ID NO: 1946636 - RNA, 16 nt, Homo sapiens
cagaaguuugagauca

SEQ ID NO: 1946637 - RNA, 19 nt, Homo sapiens
ggggcgggaaagccaguga

SEQ ID NO: 1946638 - RNA, 16 nt, Homo sapiens
uuauuagcaccagcuu

SEQ ID NO: 1946639 - RNA, 21 nt, Homo sapiens
ccaguguaucaggucagggac

SEQ ID NO: 1946640 - RNA, 17 nt, Homo sapiens
aauguuuucaaaaccaa

SEQ ID NO: 1946641 - RNA, 15 nt, Homo sapiens
agcaaagcacagaga

SEQ ID NO: 1946642 - RNA, 13 nt, Homo sapiens
augaaaacuguaa

SEQ ID NO: 1946643 - RNA, 16 nt, Homo sapiens
aaauaaaggcucugug

SEQ ID NO: 1946644 - RNA, 16 nt, Homo sapiens
caacuugcaauuugca

SEQ ID NO: 1946645 - RNA, 14 nt, Homo sapiens
ugcuauaucaguuu

SEQ ID NO: 1946646 - RNA, 20 nt, Homo sapiens
cauuagugaauuacacucaa

SEQ ID NO: 1946647 - RNA, 21 nt, Homo sapiens
cuugucagacauaaagccaug

SEQ ID NO: 1946648 - RNA, 17 nt, Homo sapiens
uucacgaacuguucaca

SEQ ID NO: 1946649 - RNA, 11 nt, Homo sapiens
accaugaucac

SEQ ID NO: 1946650 - RNA, 15 nt, Homo sapiens
gaaggcaaccuggaa

SEQ ID NO: 1946651 - RNA, 21 nt, Homo sapiens
gaagaagucuaagagugaagu

SEQ ID NO: 1946652 - RNA, 19 nt, Homo sapiens
gcagcccuaaugucugacc

SEQ ID NO: 1946653 - RNA, 12 nt, Homo sapiens
auagcaugguuu

SEQ ID NO: 1946654 - RNA, 21 nt, Homo sapiens
cauaacuucucugagucugaa

SEQ ID NO: 1946655 - RNA, 13 nt, Homo sapiens
gccaguacagccu

SEQ ID NO: 1946656 - RNA, 17 nt, Homo sapiens
cugaaugcauucagggg

SEQ ID NO: 1946657 - RNA, 21 nt, Homo sapiens
ucuagucuccuuugcacugag

SEQ ID NO: 1946658 - RNA, 21 nt, Homo sapiens
uagacuuuaacauaagcuauu

SEQ ID NO: 1946659 - RNA, 18 nt, Homo sapiens
agagagcaucugcaacaa

SEQ ID NO: 1946660 - RNA, 23 nt, Homo sapiens
caaccuuaaaggccgucauuuca

SEQ ID NO: 1946661 - RNA, 20 nt, Homo sapiens
caaucuuuuaccuuuuccaa

SEQ ID NO: 1946662 - RNA, 20 nt, Homo sapiens
cacucugcuaccuugcccca

SEQ ID NO: 1946663 - RNA, 21 nt, Homo sapiens
ugugagaacuguucucaugga

SEQ ID NO: 1946664 - RNA, 19 nt, Homo sapiens
ugaaaaauaucugguuaua

SEQ ID NO: 1946665 - RNA, 16 nt, Homo sapiens
gggcuggccccagcca

SEQ ID NO: 1946666 - RNA, 13 nt, Homo sapiens
cccauuugggaca

SEQ ID NO: 1946667 - RNA, 18 nt, Homo sapiens
acuccagccugggugaca

SEQ ID NO: 1946668 - RNA, 18 nt, Homo sapiens
ccagaggcccuggcuccu

SEQ ID NO: 1946669 - RNA, 18 nt, Homo sapiens
gagagacacacugaagaa

SEQ ID NO: 1946670 - RNA, 14 nt, Homo sapiens
cuaaacucucauuu

SEQ ID NO: 1946671 - RNA, 19 nt, Homo sapiens
aacaaaacuguaacugcau

SEQ ID NO: 1946672 - RNA, 21 nt, Homo sapiens
ggguuaguuuacaaucagcca

SEQ ID NO: 1946673 - RNA, 14 nt, Homo sapiens
gccuuugaggcaaa

SEQ ID NO: 1946674 - RNA, 20 nt, Homo sapiens
augcaucaaguuauugacaa

SEQ ID NO: 1946675 - RNA, 14 nt, Homo sapiens
cucccaaaauacua

SEQ ID NO: 1946676 - RNA, 15 nt, Homo sapiens
ugguacucaagcccg

SEQ ID NO: 1946677 - RNA, 23 nt, Homo sapiens
acuauggcaacuaacucacucaa

SEQ ID NO: 1946678 - RNA, 15 nt, Homo sapiens
ccuguuugaacccag

SEQ ID NO: 1946679 - RNA, 16 nt, Homo sapiens
uccaccucuaccaaaa

SEQ ID NO: 1946680 - RNA, 20 nt, Homo sapiens
ccucuccaggaaugccuccu

SEQ ID NO: 1946681 - RNA, 23 nt, Homo sapiens
aaaaucuuuuuugauaugauaau

SEQ ID NO: 1946682 - RNA, 17 nt, Homo sapiens
ggauccagaacugcacu

SEQ ID NO: 1946683 - RNA, 19 nt, Homo sapiens
auuuugugcaacauaacaa

SEQ ID NO: 1946684 - RNA, 15 nt, Homo sapiens
cucuuuaaucuucag

SEQ ID NO: 1946685 - RNA, 12 nt, Homo sapiens
acugggggcaac

SEQ ID NO: 1946686 - RNA, 18 nt, Homo sapiens
acaaaggauuugaugcuu

SEQ ID NO: 1946687 - RNA, 10 nt, Homo sapiens
cacucuggau

SEQ ID NO: 1946688 - RNA, 19 nt, Homo sapiens
auaaaaucuagccuagaag

SEQ ID NO: 1946689 - RNA, 14 nt, Homo sapiens
caaugaucaucuca

SEQ ID NO: 1946690 - RNA, 22 nt, Homo sapiens
ggagggcugcugggagccucuc

SEQ ID NO: 1946691 - RNA, 19 nt, Homo sapiens
gcuucacauagcaugucaa

SEQ ID NO: 1946692 - RNA, 21 nt, Homo sapiens
gcuacaagauuuuuuuacuua

SEQ ID NO: 1946693 - RNA, 18 nt, Homo sapiens
uugcaggcucugggcuca

SEQ ID NO: 1946694 - RNA, 19 nt, Homo sapiens
caaccucggggagugccac

SEQ ID NO: 1946695 - RNA, 20 nt, Homo sapiens
gguggggguaaggugcaucu

SEQ ID NO: 1946696 - RNA, 18 nt, Homo sapiens
ucuucaaucacuagucaa

SEQ ID NO: 1946697 - RNA, 14 nt, Homo sapiens
aaagaaauuuugcc

SEQ ID NO: 1946698 - RNA, 15 nt, Homo sapiens
uuuauuucaauguaa

SEQ ID NO: 1946699 - RNA, 17 nt, Homo sapiens
uugauucaaagcacugu

SEQ ID NO: 1946700 - RNA, 22 nt, Homo sapiens
cccagaccuuuuauccacuuac

SEQ ID NO: 1946701 - RNA, 12 nt, Homo sapiens
cccagaucucau

SEQ ID NO: 1946702 - RNA, 18 nt, Homo sapiens
agguaaaggaugaggguu

SEQ ID NO: 1946703 - RNA, 21 nt, Homo sapiens
uaagcacuuuaacacaguguc

SEQ ID NO: 1946704 - RNA, 17 nt, Homo sapiens
gcaauauuaaugaagua

SEQ ID NO: 1946705 - RNA, 22 nt, Homo sapiens
cuaugcagaacaggcagaaaua

SEQ ID NO: 1946706 - RNA, 19 nt, Homo sapiens
gcucuggcaccaucagccu

SEQ ID NO: 1946707 - RNA, 18 nt, Homo sapiens
cugggcagaaggccaaga

SEQ ID NO: 1946708 - RNA, 17 nt, Homo sapiens
cccuaaagauaggaauu

SEQ ID NO: 1946709 - RNA, 15 nt, Homo sapiens
ggagcugaggccaca

SEQ ID NO: 1946710 - RNA, 20 nt, Homo sapiens
gaggcaggagacuggcguga

SEQ ID NO: 1946711 - RNA, 15 nt, Homo sapiens
acucauuaucacagu

SEQ ID NO: 1946712 - RNA, 14 nt, Homo sapiens
auguuuccccagac

SEQ ID NO: 1946713 - RNA, 14 nt, Homo sapiens
cagaaaaaaggacu

SEQ ID NO: 1946714 - RNA, 11 nt, Homo sapiens
gaacacuggcc

SEQ ID NO: 1946715 - RNA, 12 nt, Homo sapiens
auaccacaagac

SEQ ID NO: 1946716 - RNA, 14 nt, Homo sapiens
aagacucagugggg

SEQ ID NO: 1946717 - RNA, 22 nt, Homo sapiens
caggagcucaggaagaagagau

SEQ ID NO: 1946718 - RNA, 22 nt, Homo sapiens
cugggcccgagggugguuuacc

SEQ ID NO: 1946719 - RNA, 17 nt, Homo sapiens
gaacagcucuucuccca

SEQ ID NO: 1946720 - RNA, 15 nt, Homo sapiens
aucuuguuaauguca

SEQ ID NO: 1946721 - RNA, 18 nt, Homo sapiens
guaacugguaguguucag

SEQ ID NO: 1946722 - RNA, 23 nt, Homo sapiens
uaugaucuuaacuucacuuccau

SEQ ID NO: 1946723 - RNA, 18 nt, Homo sapiens
uguauuuuuuguuuguau

SEQ ID NO: 1946724 - RNA, 14 nt, Homo sapiens
agaccuccagcugu

SEQ ID NO: 1946725 - RNA, 19 nt, Homo sapiens
ugaauuugcaaaguacugu

SEQ ID NO: 1946726 - RNA, 18 nt, Homo sapiens
aaccugggaaagccauga

SEQ ID NO: 1946727 - RNA, 13 nt, Homo sapiens
acaguacagugag

SEQ ID NO: 1946728 - RNA, 13 nt, Homo sapiens
ugagagaccugcu

SEQ ID NO: 1946729 - RNA, 15 nt, Homo sapiens
acacuuaaugauaca

SEQ ID NO: 1946730 - RNA, 15 nt, Homo sapiens
cuucaacauccugcc

SEQ ID NO: 1946731 - RNA, 14 nt, Homo sapiens
ucuugaaucucuga

SEQ ID NO: 1946732 - RNA, 19 nt, Homo sapiens
uuacacagaaaugcugcug

SEQ ID NO: 1946733 - RNA, 12 nt, Homo sapiens
cuuucauuuacu

SEQ ID NO: 1946734 - RNA, 22 nt, Homo sapiens
agacucuugaagacaacucuga

SEQ ID NO: 1946735 - RNA, 21 nt, Homo sapiens
ugggacaaaacagaaguccau

SEQ ID NO: 1946736 - RNA, 13 nt, Homo sapiens
accucaccugcug

SEQ ID NO: 1946737 - RNA, 22 nt, Homo sapiens
aauauccaugcguuucuuccac

SEQ ID NO: 1946738 - RNA, 17 nt, Homo sapiens
cagccaugcaaugccaa

SEQ ID NO: 1946739 - RNA, 18 nt, Homo sapiens
gcuuuucagugauacuca

SEQ ID NO: 1946740 - RNA, 16 nt, Homo sapiens
ucaacauuaacauuga

SEQ ID NO: 1946741 - RNA, 18 nt, Homo sapiens
uaugggucuugagugcau

SEQ ID NO: 1946742 - RNA, 18 nt, Homo sapiens
cugauggccuuguuucaa

SEQ ID NO: 1946743 - RNA, 14 nt, Homo sapiens
auggcgugaucucg

SEQ ID NO: 1946744 - RNA, 17 nt, Homo sapiens
ccagguaugaccuuuua

SEQ ID NO: 1946745 - RNA, 22 nt, Homo sapiens
cgcaccuugcugugugaccuga

SEQ ID NO: 1946746 - RNA, 15 nt, Homo sapiens
ucugccuuuguucac

SEQ ID NO: 1946747 - RNA, 19 nt, Homo sapiens
cucuguaggucauuggcca

SEQ ID NO: 1946748 - RNA, 23 nt, Homo sapiens
gacuuagaaucccuguguuaauu

SEQ ID NO: 1946749 - RNA, 22 nt, Homo sapiens
gcugaauguggacucaaucccu

SEQ ID NO: 1946750 - RNA, 21 nt, Homo sapiens
agagcugcugaggacaauguc

SEQ ID NO: 1946751 - RNA, 16 nt, Homo sapiens
aaauucguuguuccca

SEQ ID NO: 1946752 - RNA, 22 nt, Homo sapiens
gugcaguguaacgaugcacuuu

SEQ ID NO: 1946753 - RNA, 20 nt, Homo sapiens
augaacuaacugacagcuuc

SEQ ID NO: 1946754 - RNA, 20 nt, Homo sapiens
uuaacuguucaguauugcaa

SEQ ID NO: 1946755 - RNA, 23 nt, Homo sapiens
ugaggaccacuccuguacacuga

SEQ ID NO: 1946756 - RNA, 15 nt, Homo sapiens
guaagaaguuuuaaa

SEQ ID NO: 1946757 - RNA, 18 nt, Homo sapiens
aacuauguuuagugugau

SEQ ID NO: 1946758 - RNA, 18 nt, Homo sapiens
caggaugaugacuaugga

SEQ ID NO: 1946759 - RNA, 23 nt, Homo sapiens
guucuaaggggaccuacagacag

SEQ ID NO: 1946760 - RNA, 12 nt, Homo sapiens
acuaagcacugu

SEQ ID NO: 1946761 - RNA, 21 nt, Homo sapiens
ucccauaauugcuuugccaaa

SEQ ID NO: 1946762 - RNA, 12 nt, Homo sapiens
cgcccccugaaa

SEQ ID NO: 1946763 - RNA, 19 nt, Homo sapiens
gccccaggcauugccaagg

SEQ ID NO: 1946764 - RNA, 23 nt, Homo sapiens
acccauugucuuuacuccaugaa

SEQ ID NO: 1946765 - RNA, 17 nt, Homo sapiens
aaggggugaaucuccuu

SEQ ID NO: 1946766 - RNA, 15 nt, Homo sapiens
cagaacuugugcccu

SEQ ID NO: 1946767 - RNA, 14 nt, Homo sapiens
cuuuucaaugugug

SEQ ID NO: 1946768 - RNA, 20 nt, Homo sapiens
caagaccuaaggguuuuauc

SEQ ID NO: 1946769 - RNA, 20 nt, Homo sapiens
gacaaaugggccugccaaac

SEQ ID NO: 1946770 - RNA, 18 nt, Homo sapiens
uugggggagucaugguca

SEQ ID NO: 1946771 - RNA, 22 nt, Homo sapiens
auuaaugauaaaaauaaugcau

SEQ ID NO: 1946772 - RNA, 14 nt, Homo sapiens
uggucacauacaau

SEQ ID NO: 1946773 - RNA, 16 nt, Homo sapiens
uagaaagauggggcau

SEQ ID NO: 1946774 - RNA, 18 nt, Homo sapiens
auuuuaccaaagcaucaa

SEQ ID NO: 1946775 - RNA, 16 nt, Homo sapiens
ugaaaacucucaguca

SEQ ID NO: 1946776 - RNA, 12 nt, Homo sapiens
gagauggucaca

SEQ ID NO: 1946777 - RNA, 14 nt, Homo sapiens
cuuucuaagcccug

SEQ ID NO: 1946778 - RNA, 20 nt, Homo sapiens
gagugcaguggcaugaucau

SEQ ID NO: 1946779 - RNA, 13 nt, Homo sapiens
ucccacacugugg

SEQ ID NO: 1946780 - RNA, 21 nt, Homo sapiens
agggaggaaucgaggaaccag

SEQ ID NO: 1946781 - RNA, 20 nt, Homo sapiens
gggcaggagggcccuaccug

SEQ ID NO: 1946782 - RNA, 19 nt, Homo sapiens
ggaugaucuugauuguggg

SEQ ID NO: 1946783 - RNA, 22 nt, Homo sapiens
agugcuucuccagccucagccu

SEQ ID NO: 1946784 - RNA, 15 nt, Homo sapiens
cugggccccaccacc

SEQ ID NO: 1946785 - RNA, 13 nt, Homo sapiens
augugaguuucca

SEQ ID NO: 1946786 - RNA, 18 nt, Homo sapiens
uugaaaguuaacauuaau

SEQ ID NO: 1946787 - RNA, 15 nt, Homo sapiens
uuugaauucuugaua

SEQ ID NO: 1946788 - RNA, 21 nt, Homo sapiens
ccuaugcacugaagagcucuu

SEQ ID NO: 1946789 - RNA, 12 nt, Homo sapiens
ucguuucauuca

SEQ ID NO: 1946790 - RNA, 18 nt, Homo sapiens
caaaaggauaaugaauac

SEQ ID NO: 1946791 - RNA, 12 nt, Homo sapiens
cugcuguacuga

SEQ ID NO: 1946792 - RNA, 16 nt, Homo sapiens
gacaugagccacugca

SEQ ID NO: 1946793 - RNA, 20 nt, Homo sapiens
aauucccaacauuucuuaaa

SEQ ID NO: 1946794 - RNA, 20 nt, Homo sapiens
uaauguucugacaguuguga

SEQ ID NO: 1946795 - RNA, 14 nt, Homo sapiens
caacugaaauuaca

SEQ ID NO: 1946796 - RNA, 15 nt, Homo sapiens
uaaaauacauaacuu

SEQ ID NO: 1946797 - RNA, 21 nt, Homo sapiens
cauuucuauacuuuacaggaa

SEQ ID NO: 1946798 - RNA, 20 nt, Homo sapiens
ccgcauggaacagugcagga

SEQ ID NO: 1946799 - RNA, 16 nt, Homo sapiens
cugcagauagugccuc

SEQ ID NO: 1946800 - RNA, 16 nt, Homo sapiens
cuuggcacacucucca

SEQ ID NO: 1946801 - RNA, 19 nt, Homo sapiens
gaaaugcagagaagaauaa

SEQ ID NO: 1946802 - RNA, 18 nt, Homo sapiens
gaaugaacaaauugaacu

SEQ ID NO: 1946803 - RNA, 16 nt, Homo sapiens
uccacuaggacuucaa

SEQ ID NO: 1946804 - RNA, 21 nt, Homo sapiens
cauugccugauuuguuccuuc

SEQ ID NO: 1946805 - RNA, 16 nt, Homo sapiens
ucuguugggaugccag

SEQ ID NO: 1946806 - RNA, 14 nt, Homo sapiens
cgcugucacuggcu

SEQ ID NO: 1946807 - RNA, 20 nt, Homo sapiens
caccuccgccccagacacac

SEQ ID NO: 1946808 - RNA, 17 nt, Homo sapiens
uccaaccccugcccuuc

SEQ ID NO: 1946809 - RNA, 14 nt, Homo sapiens
ccucacauauuauu

SEQ ID NO: 1946810 - RNA, 23 nt, Homo sapiens
agaccagacuguggagaaauaaa

SEQ ID NO: 1946811 - RNA, 19 nt, Homo sapiens
agugcaggaaaccgaguag

SEQ ID NO: 1946812 - RNA, 21 nt, Homo sapiens
cucagaaaugucauguggcua

SEQ ID NO: 1946813 - RNA, 17 nt, Homo sapiens
cagaaagguuaguauca

SEQ ID NO: 1946814 - RNA, 19 nt, Homo sapiens
ccgaaauucuagcucugac

SEQ ID NO: 1946815 - RNA, 14 nt, Homo sapiens
aaauuugugugaca

SEQ ID NO: 1946816 - RNA, 23 nt, Homo sapiens
ugagcaugcucccucaugcagau

SEQ ID NO: 1946817 - RNA, 15 nt, Homo sapiens
aaaguaucugagauu

SEQ ID NO: 1946818 - RNA, 19 nt, Homo sapiens
aucauuuuuguaucuacau

SEQ ID NO: 1946819 - RNA, 13 nt, Homo sapiens
ggaaucaucuccu

SEQ ID NO: 1946820 - RNA, 20 nt, Homo sapiens
uaaaaugcaaaugcacucau

SEQ ID NO: 1946821 - RNA, 13 nt, Homo sapiens
cuaaucugaaugu

SEQ ID NO: 1946822 - RNA, 18 nt, Homo sapiens
ugcaaaaauaacaaaaua

SEQ ID NO: 1946823 - RNA, 17 nt, Homo sapiens
agagaaagggacaauga

SEQ ID NO: 1946824 - RNA, 17 nt, Homo sapiens
cugaauuuugcaaugua

SEQ ID NO: 1946825 - RNA, 15 nt, Homo sapiens
ccacucccugccaac

SEQ ID NO: 1946826 - RNA, 10 nt, Homo sapiens
ggauguugcc

SEQ ID NO: 1946827 - RNA, 23 nt, Homo sapiens
acaaaacaucuuuucacaacuua

SEQ ID NO: 1946828 - RNA, 19 nt, Homo sapiens
ucaucuccugacccuccca

SEQ ID NO: 1946829 - RNA, 18 nt, Homo sapiens
gaucccaagacaaugaaa

SEQ ID NO: 1946830 - RNA, 12 nt, Homo sapiens
caaaaacuguau

SEQ ID NO: 1946831 - RNA, 21 nt, Homo sapiens
ucacuaaauaaaggaagugcc

SEQ ID NO: 1946832 - RNA, 23 nt, Homo sapiens
ugacucaggauuuaaaaacugga

SEQ ID NO: 1946833 - RNA, 16 nt, Homo sapiens
gcgcccgccgucugcu

SEQ ID NO: 1946834 - RNA, 18 nt, Homo sapiens
aagcugauuuuauucaau

SEQ ID NO: 1946835 - RNA, 17 nt, Homo sapiens
uggagugcccacccugg

SEQ ID NO: 1946836 - RNA, 21 nt, Homo sapiens
agcccauuggcucccaucuga

SEQ ID NO: 1946837 - RNA, 19 nt, Homo sapiens
cagcccugugugugucacc

SEQ ID NO: 1946838 - RNA, 13 nt, Homo sapiens
uaaauccccucac

SEQ ID NO: 1946839 - RNA, 20 nt, Homo sapiens
uagguacuucacauugcaaa

SEQ ID NO: 1946840 - RNA, 18 nt, Homo sapiens
ccuuuuucccuucccucc

SEQ ID NO: 1946841 - RNA, 21 nt, Homo sapiens
cauuaggaagaaaggagcucc

SEQ ID NO: 1946842 - RNA, 20 nt, Homo sapiens
ccuuauaagaauuaaucuua

SEQ ID NO: 1946843 - RNA, 15 nt, Homo sapiens
ccccuccugcugggc

SEQ ID NO: 1946844 - RNA, 20 nt, Homo sapiens
uucaauauuuguuacuguua

SEQ ID NO: 1946845 - RNA, 18 nt, Homo sapiens
uugcaggugaacagccuc

SEQ ID NO: 1946846 - RNA, 17 nt, Homo sapiens
uuuaaaagacuuugaug

SEQ ID NO: 1946847 - RNA, 19 nt, Homo sapiens
acccacgcagagaagcccc

SEQ ID NO: 1946848 - RNA, 10 nt, Homo sapiens
ugccaaaaau

SEQ ID NO: 1946849 - RNA, 18 nt, Homo sapiens
aguuaauuuugaccaaaa

SEQ ID NO: 1946850 - RNA, 13 nt, Homo sapiens
ccaucaauccuga

SEQ ID NO: 1946851 - RNA, 20 nt, Homo sapiens
caguaugugggggcuucauc

SEQ ID NO: 1946852 - RNA, 14 nt, Homo sapiens
uacuguaugcagua

SEQ ID NO: 1946853 - RNA, 12 nt, Homo sapiens
ugugucuacugu

SEQ ID NO: 1946854 - RNA, 16 nt, Homo sapiens
gcugaauuccuuuaca

SEQ ID NO: 1946855 - RNA, 15 nt, Homo sapiens
cugcaugugcuguca

SEQ ID NO: 1946856 - RNA, 23 nt, Homo sapiens
ugugccugggguguuaguggcac

SEQ ID NO: 1946857 - RNA, 21 nt, Homo sapiens
cuuuuguuagauuugaauaua

SEQ ID NO: 1946858 - RNA, 22 nt, Homo sapiens
uguaauuaaguaaaccaaaaag

SEQ ID NO: 1946859 - RNA, 17 nt, Homo sapiens
ucucaacugagugagca

SEQ ID NO: 1946860 - RNA, 17 nt, Homo sapiens
ccaugcagaucuagcca

SEQ ID NO: 1946861 - RNA, 20 nt, Homo sapiens
uuuugagauguugagaggaa

SEQ ID NO: 1946862 - RNA, 13 nt, Homo sapiens
ggucaaaugcugu

SEQ ID NO: 1946863 - RNA, 23 nt, Homo sapiens
caaaaaagcuuaauuaaguacaa

SEQ ID NO: 1946864 - RNA, 18 nt, Homo sapiens
uucauuguuacauguaau

SEQ ID NO: 1946865 - RNA, 15 nt, Homo sapiens
gcccucgacacucac

SEQ ID NO: 1946866 - RNA, 19 nt, Homo sapiens
auuuacauuuaauacagau

SEQ ID NO: 1946867 - RNA, 21 nt, Homo sapiens
aagcuccggauggaggccagc

SEQ ID NO: 1946868 - RNA, 14 nt, Homo sapiens
uuguuugugcuuca

SEQ ID NO: 1946869 - RNA, 17 nt, Homo sapiens
gccgggcccgggcacug

SEQ ID NO: 1946870 - RNA, 15 nt, Homo sapiens
cucuuggagcuguga

SEQ ID NO: 1946871 - RNA, 17 nt, Homo sapiens
caucucuuuugagcuaa

SEQ ID NO: 1946872 - RNA, 19 nt, Homo sapiens
acccucauucuacugaaaa

SEQ ID NO: 1946873 - RNA, 13 nt, Homo sapiens
caaaggcucccug

SEQ ID NO: 1946874 - RNA, 19 nt, Homo sapiens
gcucugugcccacccucca

SEQ ID NO: 1946875 - RNA, 19 nt, Homo sapiens
ccuacauuaaacaugacuc

SEQ ID NO: 1946876 - RNA, 13 nt, Homo sapiens
cccuucuggagau

SEQ ID NO: 1946877 - RNA, 13 nt, Homo sapiens
uaucacacuguau

SEQ ID NO: 1946878 - RNA, 12 nt, Homo sapiens
uuuauuuccaca

SEQ ID NO: 1946879 - RNA, 15 nt, Homo sapiens
ucaucaugaaaacug

SEQ ID NO: 1946880 - RNA, 15 nt, Homo sapiens
cuaccaggaugcuaa

SEQ ID NO: 1946881 - RNA, 21 nt, Homo sapiens
caaagugcugcuggaaguaga

SEQ ID NO: 1946882 - RNA, 19 nt, Homo sapiens
caaccuuguaaauuccccu

SEQ ID NO: 1946883 - RNA, 22 nt, Homo sapiens
ggcugucucucccuuccaggaa

SEQ ID NO: 1946884 - RNA, 19 nt, Homo sapiens
cggguguguacaccaaggu

SEQ ID NO: 1946885 - RNA, 17 nt, Homo sapiens
aguugagaacuggucag

SEQ ID NO: 1946886 - RNA, 13 nt, Homo sapiens
cuagguguucuaa

SEQ ID NO: 1946887 - RNA, 12 nt, Homo sapiens
aggccaccaucu

SEQ ID NO: 1946888 - RNA, 21 nt, Homo sapiens
cagaaaucuagaagacuguca

SEQ ID NO: 1946889 - RNA, 20 nt, Homo sapiens
augguggcacaggcacugaa

SEQ ID NO: 1946890 - RNA, 17 nt, Homo sapiens
guauuauauaauucaag

SEQ ID NO: 1946891 - RNA, 22 nt, Homo sapiens
ugauggaacuuagacuccucuu

SEQ ID NO: 1946892 - RNA, 13 nt, Homo sapiens
ggccucagguuug

SEQ ID NO: 1946893 - RNA, 14 nt, Homo sapiens
acuacuauuccuuu

SEQ ID NO: 1946894 - RNA, 18 nt, Homo sapiens
cugucacauaaugcucau

SEQ ID NO: 1946895 - RNA, 23 nt, Homo sapiens
ugccaggaccccaggucaggggc

SEQ ID NO: 1946896 - RNA, 18 nt, Homo sapiens
cuuguuucuauacauucu

SEQ ID NO: 1946897 - RNA, 14 nt, Homo sapiens
guggccaacccucu

SEQ ID NO: 1946898 - RNA, 15 nt, Homo sapiens
ugaagguaacuauua

SEQ ID NO: 1946899 - RNA, 14 nt, Homo sapiens
cucaggacagugau

SEQ ID NO: 1946900 - RNA, 18 nt, Homo sapiens
uuaaaaugagucacuuac

SEQ ID NO: 1946901 - RNA, 12 nt, Homo sapiens
caugugccugua

SEQ ID NO: 1946902 - RNA, 18 nt, Homo sapiens
cuuacuguagccucagau

SEQ ID NO: 1946903 - RNA, 20 nt, Homo sapiens
agaagagaugcacuauaugu

SEQ ID NO: 1946904 - RNA, 15 nt, Homo sapiens
caagcuauuucucug

SEQ ID NO: 1946905 - RNA, 21 nt, Homo sapiens
cagaaagaacuuuaaagcuca

SEQ ID NO: 1946906 - RNA, 15 nt, Homo sapiens
uaucugcgugcacuu

SEQ ID NO: 1946907 - RNA, 19 nt, Homo sapiens
gccggucagccacaccagg

SEQ ID NO: 1946908 - RNA, 19 nt, Homo sapiens
ggcauucucucugcucagu

SEQ ID NO: 1946909 - RNA, 16 nt, Homo sapiens
gaaacauccguuuuca

SEQ ID NO: 1946910 - RNA, 14 nt, Homo sapiens
aucacugcagucac

SEQ ID NO: 1946911 - RNA, 19 nt, Homo sapiens
augugcaaguauauagauu

SEQ ID NO: 1946912 - RNA, 13 nt, Homo sapiens
caauucacagccu

SEQ ID NO: 1946913 - RNA, 20 nt, Homo sapiens
agaagaccacaaauaguuau

SEQ ID NO: 1946914 - RNA, 23 nt, Homo sapiens
cuaaguuagagcuggcaccagaa

SEQ ID NO: 1946915 - RNA, 20 nt, Homo sapiens
acuauuuacaagacugcuga

SEQ ID NO: 1946916 - RNA, 21 nt, Homo sapiens
cuuuccagggucaaaguacag

SEQ ID NO: 1946917 - RNA, 15 nt, Homo sapiens
acgcacuaacccagc

SEQ ID NO: 1946918 - RNA, 22 nt, Homo sapiens
gccauguggaaggcaagccagg

SEQ ID NO: 1946919 - RNA, 13 nt, Homo sapiens
auugaauuugcac

SEQ ID NO: 1946920 - RNA, 14 nt, Homo sapiens
agccugccugaaga

SEQ ID NO: 1946921 - RNA, 12 nt, Homo sapiens
aggauacaggug

SEQ ID NO: 1946922 - RNA, 13 nt, Homo sapiens
agaauuagcugcu

SEQ ID NO: 1946923 - RNA, 15 nt, Homo sapiens
gagggaacuguguag

SEQ ID NO: 1946924 - RNA, 13 nt, Homo sapiens
ugagagcugcuuu

SEQ ID NO: 1946925 - RNA, 22 nt, Homo sapiens
uuacuauuuauugcugaaugac

SEQ ID NO: 1946926 - RNA, 14 nt, Homo sapiens
agaucaacugaguu

SEQ ID NO: 1946927 - RNA, 14 nt, Homo sapiens
aggaauuguguuua

SEQ ID NO: 1946928 - RNA, 18 nt, Homo sapiens
ccacacccuacagcagau

SEQ ID NO: 1946929 - RNA, 19 nt, Homo sapiens
uuggggugcaaaugcuaau

SEQ ID NO: 1946930 - RNA, 14 nt, Homo sapiens
cagcucugccuguu

SEQ ID NO: 1946931 - RNA, 14 nt, Homo sapiens
uagcccugucugcu

SEQ ID NO: 1946932 - RNA, 19 nt, Homo sapiens
auacaaacauucuaauuaa

SEQ ID NO: 1946933 - RNA, 17 nt, Homo sapiens
uauacuguacugagaca

SEQ ID NO: 1946934 - RNA, 20 nt, Homo sapiens
aggcagcccugccaugucac

SEQ ID NO: 1946935 - RNA, 12 nt, Homo sapiens
aucuaccugugu

SEQ ID NO: 1946936 - RNA, 19 nt, Homo sapiens
uuaauuguuuaaaaaccga

SEQ ID NO: 1946937 - RNA, 13 nt, Homo sapiens
ugauuuaaucacc

SEQ ID NO: 1946938 - RNA, 22 nt, Homo sapiens
caucaucaggaagccuguggug

SEQ ID NO: 1946939 - RNA, 23 nt, Homo sapiens
guuggacaaaccgagugcaauga

SEQ ID NO: 1946940 - RNA, 15 nt, Homo sapiens
auucuugugccucag

SEQ ID NO: 1946941 - RNA, 11 nt, Homo sapiens
ccuggagcucc

SEQ ID NO: 1946942 - RNA, 13 nt, Homo sapiens
ggccugggguccc

SEQ ID NO: 1946943 - RNA, 20 nt, Homo sapiens
uaccugcacguucauaacca

SEQ ID NO: 1946944 - RNA, 19 nt, Homo sapiens
agggcagugcccuuugaga

SEQ ID NO: 1946945 - RNA, 15 nt, Homo sapiens
cacccaacuuuguca

SEQ ID NO: 1946946 - RNA, 23 nt, Homo sapiens
ggaccaaaggaaggaagcaagca

SEQ ID NO: 1946947 - RNA, 22 nt, Homo sapiens
uugguuuuauuuuauacuugcc

SEQ ID NO: 1946948 - RNA, 14 nt, Homo sapiens
guccuuaaagccau

SEQ ID NO: 1946949 - RNA, 22 nt, Homo sapiens
ucaguugggagugguugcuaua

SEQ ID NO: 1946950 - RNA, 22 nt, Homo sapiens
ccauggcccccaauaaaggcag

SEQ ID NO: 1946951 - RNA, 17 nt, Homo sapiens
cauuauucaagaaugaa

SEQ ID NO: 1946952 - RNA, 21 nt, Homo sapiens
auguacaugaagaagcuaaau

SEQ ID NO: 1946953 - RNA, 21 nt, Homo sapiens
aaagcugauggccuuguuuca

SEQ ID NO: 1946954 - RNA, 21 nt, Homo sapiens
uccacccuuggccugucucau

SEQ ID NO: 1946955 - RNA, 23 nt, Homo sapiens
cugaugagggggaauuccuggaa

SEQ ID NO: 1946956 - RNA, 18 nt, Homo sapiens
aguggaaauuaagacuuu

SEQ ID NO: 1946957 - RNA, 16 nt, Homo sapiens
gacaugucucacagac

SEQ ID NO: 1946958 - RNA, 16 nt, Homo sapiens
ccggacuugcugugua

SEQ ID NO: 1946959 - RNA, 20 nt, Homo sapiens
uacauauuccugguguagca

SEQ ID NO: 1946960 - RNA, 15 nt, Homo sapiens
guaauaauaaaacca

SEQ ID NO: 1946961 - RNA, 20 nt, Homo sapiens
auucaacgugaggaagcaag

SEQ ID NO: 1946962 - RNA, 23 nt, Homo sapiens
ggacaaaauggaagguuggagac

SEQ ID NO: 1946963 - RNA, 13 nt, Homo sapiens
aucugccacuggu

SEQ ID NO: 1946964 - RNA, 21 nt, Homo sapiens
aguuuggaauuauuguagaca

SEQ ID NO: 1946965 - RNA, 14 nt, Homo sapiens
uccaggaggcccug

SEQ ID NO: 1946966 - RNA, 21 nt, Homo sapiens
cucagccuccugaacagcugg

SEQ ID NO: 1946967 - RNA, 14 nt, Homo sapiens
guucuuacugcuug

SEQ ID NO: 1946968 - RNA, 15 nt, Homo sapiens
caggaccaguuugau

SEQ ID NO: 1946969 - RNA, 16 nt, Homo sapiens
agauuccccauugccu

SEQ ID NO: 1946970 - RNA, 13 nt, Homo sapiens
cuuuauacauuag

SEQ ID NO: 1946971 - RNA, 16 nt, Homo sapiens
cagaguugaaguuuac

SEQ ID NO: 1946972 - RNA, 19 nt, Homo sapiens
ucuguacauauuacuguug

SEQ ID NO: 1946973 - RNA, 14 nt, Homo sapiens
uuauacuaauucag

SEQ ID NO: 1946974 - RNA, 17 nt, Homo sapiens
uuccaggcugagccaug

SEQ ID NO: 1946975 - RNA, 17 nt, Homo sapiens
agacagaaaaaacugag

SEQ ID NO: 1946976 - RNA, 13 nt, Homo sapiens
cuggugccauuuc

SEQ ID NO: 1946977 - RNA, 15 nt, Homo sapiens
caaaggaaucagcug

SEQ ID NO: 1946978 - RNA, 23 nt, Homo sapiens
ggcacccaccgucucggcccuga

SEQ ID NO: 1946979 - RNA, 15 nt, Homo sapiens
uugcuccauuuacaa

SEQ ID NO: 1946980 - RNA, 14 nt, Homo sapiens
cucuacauguaacu

SEQ ID NO: 1946981 - RNA, 13 nt, Homo sapiens
ugccccuaauccc

SEQ ID NO: 1946982 - RNA, 21 nt, Homo sapiens
uuuaauccuuaacacauucaa

SEQ ID NO: 1946983 - RNA, 21 nt, Homo sapiens
ugcauguauuuauccaauaaa

SEQ ID NO: 1946984 - RNA, 23 nt, Homo sapiens
gaggcuaucuaauuuuacacucu

SEQ ID NO: 1946985 - RNA, 16 nt, Homo sapiens
aaaauauaaccauuac

SEQ ID NO: 1946986 - RNA, 12 nt, Homo sapiens
cauucuuuuaua

SEQ ID NO: 1946987 - RNA, 16 nt, Homo sapiens
cuuuugcauaaaagac

SEQ ID NO: 1946988 - RNA, 17 nt, Homo sapiens
ugacgaagacgccaaaa

SEQ ID NO: 1946989 - RNA, 22 nt, Homo sapiens
aguauuugcugaauggggaccu

SEQ ID NO: 1946990 - RNA, 11 nt, Homo sapiens
uaagagcaaaa

SEQ ID NO: 1946991 - RNA, 18 nt, Homo sapiens
aggggucuggacaugugg

SEQ ID NO: 1946992 - RNA, 20 nt, Homo sapiens
uacagcuaacccucacaagc

SEQ ID NO: 1946993 - RNA, 16 nt, Homo sapiens
ccauguaagguugugc

SEQ ID NO: 1946994 - RNA, 13 nt, Homo sapiens
ggcaccaugcaaa

SEQ ID NO: 1946995 - RNA, 16 nt, Homo sapiens
cuugauggagaaggaa

SEQ ID NO: 1946996 - RNA, 18 nt, Homo sapiens
aggcccaggagaccucca

SEQ ID NO: 1946997 - RNA, 18 nt, Homo sapiens
uauuauuguugcauuaaa

SEQ ID NO: 1946998 - RNA, 15 nt, Homo sapiens
ccccuuuacuccucg

SEQ ID NO: 1946999 - RNA, 15 nt, Homo sapiens
ugcuuacaauggagu

SEQ ID NO: 1947000 - RNA, 18 nt, Homo sapiens
gcccuggcagggggcaug

SEQ ID NO: 1947001 - RNA, 15 nt, Homo sapiens
cuggucaaguuguaa

SEQ ID NO: 1947002 - RNA, 20 nt, Homo sapiens
uccugcacgccguggagcau

SEQ ID NO: 1947003 - RNA, 14 nt, Homo sapiens
auccuuuugcuuca

SEQ ID NO: 1947004 - RNA, 23 nt, Homo sapiens
ugugacuuugaacacaucucuua

SEQ ID NO: 1947005 - RNA, 17 nt, Homo sapiens
caccacagccagcaccu

SEQ ID NO: 1947006 - RNA, 22 nt, Homo sapiens
agacaacccugcaaaggacugu

SEQ ID NO: 1947007 - RNA, 15 nt, Homo sapiens
uugauaauacuugac

SEQ ID NO: 1947008 - RNA, 21 nt, Homo sapiens
caguaaauggcuuauccagcu

SEQ ID NO: 1947009 - RNA, 21 nt, Homo sapiens
cagggguuugccaaacagccc

SEQ ID NO: 1947010 - RNA, 17 nt, Homo sapiens
cauucuaguacuuggga

SEQ ID NO: 1947011 - RNA, 15 nt, Homo sapiens
uaagcaauaccagca

SEQ ID NO: 1947012 - RNA, 23 nt, Homo sapiens
ccuaugucaauuuguauaucaug

SEQ ID NO: 1947013 - RNA, 17 nt, Homo sapiens
gacgucucaagacugaa

SEQ ID NO: 1947014 - RNA, 20 nt, Homo sapiens
uucaugguccgccugccuca

SEQ ID NO: 1947015 - RNA, 20 nt, Homo sapiens
cuccuaucagaagcucccag

SEQ ID NO: 1947016 - RNA, 14 nt, Homo sapiens
uccaccuugcucuu

SEQ ID NO: 1947017 - RNA, 18 nt, Homo sapiens
aucugaccacagacacuc

SEQ ID NO: 1947018 - RNA, 16 nt, Homo sapiens
uagaaacaacacugua

SEQ ID NO: 1947019 - RNA, 17 nt, Homo sapiens
agccugggccagagaag

SEQ ID NO: 1947020 - RNA, 14 nt, Homo sapiens
aagggacacuuuua

SEQ ID NO: 1947021 - RNA, 21 nt, Homo sapiens
cccucuuguccuuuaauauuu

SEQ ID NO: 1947022 - RNA, 16 nt, Homo sapiens
gaauggguuugcuaga

SEQ ID NO: 1947023 - RNA, 23 nt, Homo sapiens
cacacugguaaauguuaccucua

SEQ ID NO: 1947024 - RNA, 20 nt, Homo sapiens
agcccuaggcuuccacguac

SEQ ID NO: 1947025 - RNA, 13 nt, Homo sapiens
uaauacaacaauc

SEQ ID NO: 1947026 - RNA, 15 nt, Homo sapiens
caauuaguggucaua

SEQ ID NO: 1947027 - RNA, 14 nt, Homo sapiens
ggcugaacccugug

SEQ ID NO: 1947028 - RNA, 22 nt, Homo sapiens
uaagauaaaggguauugccuug

SEQ ID NO: 1947029 - RNA, 18 nt, Homo sapiens
acccuggauuugcauaca

SEQ ID NO: 1947030 - RNA, 16 nt, Homo sapiens
uuuuuggcaaagccag

SEQ ID NO: 1947031 - RNA, 17 nt, Homo sapiens
aaaggaaucacguuaga

SEQ ID NO: 1947032 - RNA, 11 nt, Homo sapiens
caaaaagccac

SEQ ID NO: 1947033 - RNA, 15 nt, Homo sapiens
uagcuugauugcuca

SEQ ID NO: 1947034 - RNA, 14 nt, Homo sapiens
ccuuugaugaauuc

SEQ ID NO: 1947035 - RNA, 20 nt, Homo sapiens
auuuucuuaauuguuagcua

SEQ ID NO: 1947036 - RNA, 20 nt, Homo sapiens
cucaacagaauuaaaauguc

SEQ ID NO: 1947037 - RNA, 14 nt, Homo sapiens
agcugcuucugccc

SEQ ID NO: 1947038 - RNA, 12 nt, Homo sapiens
gggagucugggc

SEQ ID NO: 1947039 - RNA, 14 nt, Homo sapiens
cccuaugcugguag

SEQ ID NO: 1947040 - RNA, 22 nt, Homo sapiens
aaccaaaucuuaaaugagacca

SEQ ID NO: 1947041 - RNA, 20 nt, Homo sapiens
cagaaaaaugaaaagcaaua

SEQ ID NO: 1947042 - RNA, 13 nt, Homo sapiens
ugaugucauguca

SEQ ID NO: 1947043 - RNA, 17 nt, Homo sapiens
cugaguguuuaauuuca

SEQ ID NO: 1947044 - RNA, 13 nt, Homo sapiens
gcgcuauuacaaa

SEQ ID NO: 1947045 - RNA, 18 nt, Homo sapiens
cugcagggacuccaugcu

SEQ ID NO: 1947046 - RNA, 14 nt, Homo sapiens
cauuuugaauguga

SEQ ID NO: 1947047 - RNA, 22 nt, Homo sapiens
aaucauuuuucuuuuguagcua

SEQ ID NO: 1947048 - RNA, 21 nt, Homo sapiens
aaaaauccauaaaauccuuaa

SEQ ID NO: 1947049 - RNA, 19 nt, Homo sapiens
aagccauuuuuuauuucag

SEQ ID NO: 1947050 - RNA, 19 nt, Homo sapiens
aaacaaguuuuucugucaa

SEQ ID NO: 1947051 - RNA, 20 nt, Homo sapiens
ugaaacccagucacugugag

SEQ ID NO: 1947052 - RNA, 14 nt, Homo sapiens
uccccagacuucau

SEQ ID NO: 1947053 - RNA, 13 nt, Homo sapiens
uggacugcaauga

SEQ ID NO: 1947054 - RNA, 20 nt, Homo sapiens
auuuuucacuguacauuaua

SEQ ID NO: 1947055 - RNA, 13 nt, Homo sapiens
agcuaacacuggc

SEQ ID NO: 1947056 - RNA, 14 nt, Homo sapiens
aaggaugggaagga

SEQ ID NO: 1947057 - RNA, 13 nt, Homo sapiens
gcuggugggauag

SEQ ID NO: 1947058 - RNA, 16 nt, Homo sapiens
uucuuacaucuguaaa

SEQ ID NO: 1947059 - RNA, 21 nt, Homo sapiens
auccagccucagagaucuccc

SEQ ID NO: 1947060 - RNA, 13 nt, Homo sapiens
aaagaaaaaaagu

SEQ ID NO: 1947061 - RNA, 13 nt, Homo sapiens
auugaaaugucac

SEQ ID NO: 1947062 - RNA, 21 nt, Homo sapiens
caaguguaaaaagaugacuua

SEQ ID NO: 1947063 - RNA, 15 nt, Homo sapiens
aacgcccugugucca

SEQ ID NO: 1947064 - RNA, 23 nt, Homo sapiens
ucuaagauggauuaaacaaguau

SEQ ID NO: 1947065 - RNA, 22 nt, Homo sapiens
uuuucaagcaaaacaguucuca

SEQ ID NO: 1947066 - RNA, 12 nt, Homo sapiens
cacacuucauug

SEQ ID NO: 1947067 - RNA, 15 nt, Homo sapiens
guucagaaagcaaua

SEQ ID NO: 1947068 - RNA, 18 nt, Homo sapiens
aucuaccugcaacacaac

SEQ ID NO: 1947069 - RNA, 18 nt, Homo sapiens
aaauuucuucugguagug

SEQ ID NO: 1947070 - RNA, 11 nt, Homo sapiens
cucacaguccu

SEQ ID NO: 1947071 - RNA, 16 nt, Homo sapiens
cuuuagagaagccaua

SEQ ID NO: 1947072 - RNA, 14 nt, Homo sapiens
caggccaggccacc

SEQ ID NO: 1947073 - RNA, 22 nt, Homo sapiens
auaggaaaccacacagacuugg

SEQ ID NO: 1947074 - RNA, 20 nt, Homo sapiens
aucucugaguugcccugauu

SEQ ID NO: 1947075 - RNA, 17 nt, Homo sapiens
gcccucucugaaccuca

SEQ ID NO: 1947076 - RNA, 17 nt, Homo sapiens
gcacuaaaugcacaaaa

SEQ ID NO: 1947077 - RNA, 17 nt, Homo sapiens
acgauugguaugaugcu

SEQ ID NO: 1947078 - RNA, 14 nt, Homo sapiens
aaacucagauuuaa

SEQ ID NO: 1947079 - RNA, 20 nt, Homo sapiens
cugauucauaauaaauaucu

SEQ ID NO: 1947080 - RNA, 15 nt, Homo sapiens
caaucaagaugggug

SEQ ID NO: 1947081 - RNA, 13 nt, Homo sapiens
aguucacaucaga

SEQ ID NO: 1947082 - RNA, 22 nt, Homo sapiens
ggugugcaaacuuguaucugaa

SEQ ID NO: 1947083 - RNA, 21 nt, Homo sapiens
cucccuugcuuuuugcugugu

SEQ ID NO: 1947084 - RNA, 19 nt, Homo sapiens
gcucccagacggucaggaa

SEQ ID NO: 1947085 - RNA, 20 nt, Homo sapiens
ccaaaacacugucugcauau

SEQ ID NO: 1947086 - RNA, 14 nt, Homo sapiens
cauuacuugcacaa

SEQ ID NO: 1947087 - RNA, 17 nt, Homo sapiens
guuuugcacuucuguaa

SEQ ID NO: 1947088 - RNA, 18 nt, Homo sapiens
aucaaggugcucuucuca

SEQ ID NO: 1947089 - RNA, 11 nt, Homo sapiens
agaaaaaccac

SEQ ID NO: 1947090 - RNA, 20 nt, Homo sapiens
ugcggaaugaaccacaucuu

SEQ ID NO: 1947091 - RNA, 19 nt, Homo sapiens
cagaccauucaggacacag

SEQ ID NO: 1947092 - RNA, 19 nt, Homo sapiens
guuuaaagaagcucuccag

SEQ ID NO: 1947093 - RNA, 22 nt, Homo sapiens
auuccugugcggacagcccuuc

SEQ ID NO: 1947094 - RNA, 18 nt, Homo sapiens
ucgaugcguucacuccaa

SEQ ID NO: 1947095 - RNA, 21 nt, Homo sapiens
ccauccagaugugugcaaugu

SEQ ID NO: 1947096 - RNA, 22 nt, Homo sapiens
cccacacacagguggugucacu

SEQ ID NO: 1947097 - RNA, 15 nt, Homo sapiens
gacaagcauguugau

SEQ ID NO: 1947098 - RNA, 14 nt, Homo sapiens
aauaacaaucacaa

SEQ ID NO: 1947099 - RNA, 17 nt, Homo sapiens
gauacacaccuuucaca

SEQ ID NO: 1947100 - RNA, 20 nt, Homo sapiens
auuuauucauguguacagaa

SEQ ID NO: 1947101 - RNA, 23 nt, Homo sapiens
ggauuugggcuacccuaaaggga

SEQ ID NO: 1947102 - RNA, 13 nt, Homo sapiens
caacagagacugg

SEQ ID NO: 1947103 - RNA, 11 nt, Homo sapiens
aucccauucca

SEQ ID NO: 1947104 - RNA, 19 nt, Homo sapiens
agcgagugugccucaggga

SEQ ID NO: 1947105 - RNA, 19 nt, Homo sapiens
ucauggugauagacugaag

SEQ ID NO: 1947106 - RNA, 14 nt, Homo sapiens
ccucugaaaugccu

SEQ ID NO: 1947107 - RNA, 16 nt, Homo sapiens
gcuuuuaacuuuauaa

SEQ ID NO: 1947108 - RNA, 17 nt, Homo sapiens
ucugcaggccacuguga

SEQ ID NO: 1947109 - RNA, 18 nt, Homo sapiens
uugcauagaguauagcuc

SEQ ID NO: 1947110 - RNA, 23 nt, Homo sapiens
ccugaaacaucucaacaaccuga

SEQ ID NO: 1947111 - RNA, 17 nt, Homo sapiens
cucaggagcuuuacuca

SEQ ID NO: 1947112 - RNA, 18 nt, Homo sapiens
cuuucuuuugaaaugcca

SEQ ID NO: 1947113 - RNA, 14 nt, Homo sapiens
augccagcccaaag

SEQ ID NO: 1947114 - RNA, 23 nt, Homo sapiens
caucagagccagucucaccuuca

SEQ ID NO: 1947115 - RNA, 16 nt, Homo sapiens
ucacuacauugugcaa

SEQ ID NO: 1947116 - RNA, 20 nt, Homo sapiens
aacaucuuuacguacuguaa

SEQ ID NO: 1947117 - RNA, 19 nt, Homo sapiens
ucaguuucacauauuugua

SEQ ID NO: 1947118 - RNA, 16 nt, Homo sapiens
acaagaacaaagccac

SEQ ID NO: 1947119 - RNA, 20 nt, Homo sapiens
caauugucuauuuaucuuuu

SEQ ID NO: 1947120 - RNA, 16 nt, Homo sapiens
ugcuagaagacagaca

SEQ ID NO: 1947121 - RNA, 14 nt, Homo sapiens
gaagauggggacca

SEQ ID NO: 1947122 - RNA, 24 nt, Homo sapiens
ugaaagcacaugaauaauuucacu

SEQ ID NO: 1947123 - RNA, 17 nt, Homo sapiens
auugacucaaaccauau

SEQ ID NO: 1947124 - RNA, 16 nt, Homo sapiens
aaggaauacacuugug

SEQ ID NO: 1947125 - RNA, 14 nt, Homo sapiens
gagcaugaccugag

SEQ ID NO: 1947126 - RNA, 18 nt, Homo sapiens
ggacaaaggugauuuucc

SEQ ID NO: 1947127 - RNA, 15 nt, Homo sapiens
aaguucuaaguucau

SEQ ID NO: 1947128 - RNA, 12 nt, Homo sapiens
uaaacuucuuaa

SEQ ID NO: 1947129 - RNA, 20 nt, Homo sapiens
agcccccccccggagcugcg

SEQ ID NO: 1947130 - RNA, 16 nt, Homo sapiens
ccagugccagcaauag

SEQ ID NO: 1947131 - RNA, 22 nt, Homo sapiens
ugagaacccugcguggggacag

SEQ ID NO: 1947132 - RNA, 18 nt, Homo sapiens
ucauucuggucuuugaaa

SEQ ID NO: 1947133 - RNA, 20 nt, Homo sapiens
aagguccggaugucacucau

SEQ ID NO: 1947134 - RNA, 20 nt, Homo sapiens
uauaauaccaucagaaagaa

SEQ ID NO: 1947135 - RNA, 17 nt, Homo sapiens
agagacuccugaagguc

SEQ ID NO: 1947136 - RNA, 12 nt, Homo sapiens
accguacuguau

SEQ ID NO: 1947137 - RNA, 19 nt, Homo sapiens
auauucuccagaccaaagc

SEQ ID NO: 1947138 - RNA, 14 nt, Homo sapiens
aguccaagguauug

SEQ ID NO: 1947139 - RNA, 17 nt, Homo sapiens
aaaauaaaacugucacu

SEQ ID NO: 1947140 - RNA, 19 nt, Homo sapiens
ugauccagucacagccaua

SEQ ID NO: 1947141 - RNA, 16 nt, Homo sapiens
agaaagcaacaguuac

SEQ ID NO: 1947142 - RNA, 18 nt, Homo sapiens
uaaugaauuuuuaugaua

SEQ ID NO: 1947143 - RNA, 19 nt, Homo sapiens
ccaucugcuuacaauuccc

SEQ ID NO: 1947144 - RNA, 15 nt, Homo sapiens
aaugcuagguucuac

SEQ ID NO: 1947145 - RNA, 14 nt, Homo sapiens
ugcauggcuccaga

SEQ ID NO: 1947146 - RNA, 20 nt, Homo sapiens
auacugaggaaugucuuuca

SEQ ID NO: 1947147 - RNA, 16 nt, Homo sapiens
uucgaaacuccauuga

SEQ ID NO: 1947148 - RNA, 15 nt, Homo sapiens
uuaaaagccaucaaa

SEQ ID NO: 1947149 - RNA, 18 nt, Homo sapiens
cauuguauucagcucuua

SEQ ID NO: 1947150 - RNA, 19 nt, Homo sapiens
ugagugucuucuaacuuua

SEQ ID NO: 1947151 - RNA, 20 nt, Homo sapiens
cuggggaggccaguguugug

SEQ ID NO: 1947152 - RNA, 14 nt, Homo sapiens
aauuugaggacaag

SEQ ID NO: 1947153 - RNA, 23 nt, Homo sapiens
ugguuuaagaguaacaguuugau

SEQ ID NO: 1947154 - RNA, 19 nt, Homo sapiens
ucaagacuggcauggacau

SEQ ID NO: 1947155 - RNA, 16 nt, Homo sapiens
gaucaugauagacuug

SEQ ID NO: 1947156 - RNA, 12 nt, Homo sapiens
cauuuaggaacu

SEQ ID NO: 1947157 - RNA, 22 nt, Homo sapiens
uacaauuuuuuaucaugcaugu

SEQ ID NO: 1947158 - RNA, 17 nt, Homo sapiens
uaacaugauaaaagaca

SEQ ID NO: 1947159 - RNA, 19 nt, Homo sapiens
ucaaacagggacacuacaa

SEQ ID NO: 1947160 - RNA, 20 nt, Homo sapiens
acaauuguguuuucgucaca

SEQ ID NO: 1947161 - RNA, 19 nt, Homo sapiens
caagaauuaaguauuuucc

SEQ ID NO: 1947162 - RNA, 18 nt, Homo sapiens
ccacaaugcugaugaaaa

SEQ ID NO: 1947163 - RNA, 15 nt, Homo sapiens
gccugucacuacugg

SEQ ID NO: 1947164 - RNA, 23 nt, Homo sapiens
aaggaguaacuugcaaguuuuca

SEQ ID NO: 1947165 - RNA, 22 nt, Homo sapiens
aucugacuucauacaucccuca

SEQ ID NO: 1947166 - RNA, 16 nt, Homo sapiens
cucaggaaccgaggca

SEQ ID NO: 1947167 - RNA, 16 nt, Homo sapiens
ucccugccuugcugac

SEQ ID NO: 1947168 - RNA, 19 nt, Homo sapiens
ucucaggagcuugcaagaa

SEQ ID NO: 1947169 - RNA, 23 nt, Homo sapiens
ucccuuggaaaucugccaugagc

SEQ ID NO: 1947170 - RNA, 20 nt, Homo sapiens
gcccaggcuggaguggagug

SEQ ID NO: 1947171 - RNA, 14 nt, Homo sapiens
aaucugccuuccag

SEQ ID NO: 1947172 - RNA, 18 nt, Homo sapiens
auucauuuucaucacugg

SEQ ID NO: 1947173 - RNA, 20 nt, Homo sapiens
ucgggugcccugcauucaca

SEQ ID NO: 1947174 - RNA, 22 nt, Homo sapiens
uaauauuccuggcauaccuuua

SEQ ID NO: 1947175 - RNA, 13 nt, Homo sapiens
augaccauaugca

SEQ ID NO: 1947176 - RNA, 16 nt, Homo sapiens
uccauuucaugugauc

SEQ ID NO: 1947177 - RNA, 15 nt, Homo sapiens
ucaguucaaagucau

SEQ ID NO: 1947178 - RNA, 22 nt, Homo sapiens
ugggucugggagucacacagug

SEQ ID NO: 1947179 - RNA, 19 nt, Homo sapiens
augcagugaccgcuucccc

SEQ ID NO: 1947180 - RNA, 11 nt, Homo sapiens
agcaguauucu

SEQ ID NO: 1947181 - RNA, 21 nt, Homo sapiens
uugaguccacgcccaccagcc

SEQ ID NO: 1947182 - RNA, 20 nt, Homo sapiens
ugaugucagcugcuguugaa

SEQ ID NO: 1947183 - RNA, 13 nt, Homo sapiens
aaaucauauagac

SEQ ID NO: 1947184 - RNA, 13 nt, Homo sapiens
cagagaugacugu

SEQ ID NO: 1947185 - RNA, 20 nt, Homo sapiens
uacuuugugaauagaacucu

SEQ ID NO: 1947186 - RNA, 13 nt, Homo sapiens
aggcuguugaauc

SEQ ID NO: 1947187 - RNA, 17 nt, Homo sapiens
auguuggaaaacauaug

SEQ ID NO: 1947188 - RNA, 17 nt, Homo sapiens
ugaagaaacuucugcuu

SEQ ID NO: 1947189 - RNA, 20 nt, Homo sapiens
auucauuuucaucacuggga

SEQ ID NO: 1947190 - RNA, 20 nt, Homo sapiens
gacuccauauggaggccuca

SEQ ID NO: 1947191 - RNA, 14 nt, Homo sapiens
caaccauaagacaa

SEQ ID NO: 1947192 - RNA, 18 nt, Homo sapiens
cuaggacucugcacugaa

SEQ ID NO: 1947193 - RNA, 23 nt, Homo sapiens
ggacaaguagccaccugaguucc

SEQ ID NO: 1947194 - RNA, 19 nt, Homo sapiens
caauguuuuuaaaaaucug

SEQ ID NO: 1947195 - RNA, 12 nt, Homo sapiens
gcaggacugugg

SEQ ID NO: 1947196 - RNA, 16 nt, Homo sapiens
uguguuucaaacugua

SEQ ID NO: 1947197 - RNA, 19 nt, Homo sapiens
auauguggguugagcuaug

SEQ ID NO: 1947198 - RNA, 13 nt, Homo sapiens
ggagcuccaacuc

SEQ ID NO: 1947199 - RNA, 17 nt, Homo sapiens
acugcguccugccuaaa

SEQ ID NO: 1947200 - RNA, 18 nt, Homo sapiens
auuucaaucaaccaaagu

SEQ ID NO: 1947201 - RNA, 16 nt, Homo sapiens
cagcugcaccagcagg

SEQ ID NO: 1947202 - RNA, 16 nt, Homo sapiens
caaaaaggccaagaga

SEQ ID NO: 1947203 - RNA, 14 nt, Homo sapiens
uaaaugcauguccu

SEQ ID NO: 1947204 - RNA, 19 nt, Homo sapiens
ggcaugguggcucaugccu

SEQ ID NO: 1947205 - RNA, 13 nt, Homo sapiens
uggagagaugucu

SEQ ID NO: 1947206 - RNA, 17 nt, Homo sapiens
agaggagucaaguaaug

SEQ ID NO: 1947207 - RNA, 17 nt, Homo sapiens
uaaagauauuucuuuaa

SEQ ID NO: 1947208 - RNA, 20 nt, Homo sapiens
guggcuuuuuuccuccugug

SEQ ID NO: 1947209 - RNA, 18 nt, Homo sapiens
gucucuccuuguugcccc

SEQ ID NO: 1947210 - RNA, 18 nt, Homo sapiens
ggagucugccacuuguca

SEQ ID NO: 1947211 - RNA, 17 nt, Homo sapiens
uacacugugaacuuggg

SEQ ID NO: 1947212 - RNA, 22 nt, Homo sapiens
ggaagaacauugauuucauuga

SEQ ID NO: 1947213 - RNA, 16 nt, Homo sapiens
uaaaaaugaaaauucu

SEQ ID NO: 1947214 - RNA, 12 nt, Homo sapiens
auguacaaauag

SEQ ID NO: 1947215 - RNA, 17 nt, Homo sapiens
gaaagccucagugaaac

SEQ ID NO: 1947216 - RNA, 16 nt, Homo sapiens
gagcaggcuacuguca

SEQ ID NO: 1947217 - RNA, 23 nt, Homo sapiens
uaugaaagacucaaaaagcugcc

SEQ ID NO: 1947218 - RNA, 15 nt, Homo sapiens
gcacacacaaaccua

SEQ ID NO: 1947219 - RNA, 15 nt, Homo sapiens
uuggaaaaugugcaa

SEQ ID NO: 1947220 - RNA, 14 nt, Homo sapiens
acugguuaucacac

SEQ ID NO: 1947221 - RNA, 18 nt, Homo sapiens
agaugcagccaccacauc

SEQ ID NO: 1947222 - RNA, 18 nt, Homo sapiens
gcaacauucauagucuuu

SEQ ID NO: 1947223 - RNA, 22 nt, Homo sapiens
uuucuuccuucaaauccugcca

SEQ ID NO: 1947224 - RNA, 21 nt, Homo sapiens
gagggcaaugaugugugcaag

SEQ ID NO: 1947225 - RNA, 22 nt, Homo sapiens
uaaauauuagcaaagcaugcca

SEQ ID NO: 1947226 - RNA, 19 nt, Homo sapiens
agcacugggugaccagcug

SEQ ID NO: 1947227 - RNA, 23 nt, Homo sapiens
uccaacguggcccagagaagcca

SEQ ID NO: 1947228 - RNA, 13 nt, Homo sapiens
cacacacagccug

SEQ ID NO: 1947229 - RNA, 13 nt, Homo sapiens
caaagacagcauc

SEQ ID NO: 1947230 - RNA, 18 nt, Homo sapiens
uuaauauuccuggcauac

SEQ ID NO: 1947231 - RNA, 22 nt, Homo sapiens
gacucaggucuguaacugccca

SEQ ID NO: 1947232 - RNA, 21 nt, Homo sapiens
ugccuagaaacagaccugcau

SEQ ID NO: 1947233 - RNA, 17 nt, Homo sapiens
ggacugaggcaagcaca

SEQ ID NO: 1947234 - RNA, 20 nt, Homo sapiens
ucaaggagaauguacuggcg

SEQ ID NO: 1947235 - RNA, 18 nt, Homo sapiens
uuuaaacuuguuugcugu

SEQ ID NO: 1947236 - RNA, 17 nt, Homo sapiens
aacauuucuuaugauuu

SEQ ID NO: 1947237 - RNA, 20 nt, Homo sapiens
guaaaugccacacaccuuua

SEQ ID NO: 1947238 - RNA, 17 nt, Homo sapiens
ucauuaccucccuauca

SEQ ID NO: 1947239 - RNA, 12 nt, Homo sapiens
ucauugucuuau

SEQ ID NO: 1947240 - RNA, 22 nt, Homo sapiens
gcaaucucuugucucacaugcu

SEQ ID NO: 1947241 - RNA, 22 nt, Homo sapiens
augauuaggcccgccaaacuuc

SEQ ID NO: 1947242 - RNA, 21 nt, Homo sapiens
cuuaucucccugcuucauauc

SEQ ID NO: 1947243 - RNA, 22 nt, Homo sapiens
gcuaugaaaacagcuaucucac

SEQ ID NO: 1947244 - RNA, 11 nt, Homo sapiens
acgguggugcc

SEQ ID NO: 1947245 - RNA, 11 nt, Homo sapiens
agggugguggc

SEQ ID NO: 1947246 - RNA, 22 nt, Homo sapiens
caguuuugucaaugcaguuguc

SEQ ID NO: 1947247 - RNA, 21 nt, Homo sapiens
cuuuguguucaguuccacuau

SEQ ID NO: 1947248 - RNA, 14 nt, Homo sapiens
uccggcagcacaag

SEQ ID NO: 1947249 - RNA, 23 nt, Homo sapiens
ccucugcgccucuccacuguuuc

SEQ ID NO: 1947250 - RNA, 18 nt, Homo sapiens
cuguucuguuccuugugu

SEQ ID NO: 1947251 - RNA, 14 nt, Homo sapiens
cucucugaccuccu

SEQ ID NO: 1947252 - RNA, 21 nt, Homo sapiens
acccuaagccuccuuuugcuu

SEQ ID NO: 1947253 - RNA, 17 nt, Homo sapiens
cgggaacaaaaugaugu

SEQ ID NO: 1947254 - RNA, 15 nt, Homo sapiens
gaagaucgugaugcu

SEQ ID NO: 1947255 - RNA, 16 nt, Homo sapiens
cuuaggcaaaauacca

SEQ ID NO: 1947256 - RNA, 22 nt, Homo sapiens
aagaaggccacuguuugucuca

SEQ ID NO: 1947257 - RNA, 15 nt, Homo sapiens
aggcugggcagcaca

SEQ ID NO: 1947258 - RNA, 18 nt, Homo sapiens
uacauuuguuuguauuca

SEQ ID NO: 1947259 - RNA, 18 nt, Homo sapiens
agguaccccagcucugcu

SEQ ID NO: 1947260 - RNA, 15 nt, Homo sapiens
uccuaaacuuuccaa

SEQ ID NO: 1947261 - RNA, 18 nt, Homo sapiens
ugacaguaaaucacacaa

SEQ ID NO: 1947262 - RNA, 21 nt, Homo sapiens
auguagccagcugugcacuuu

SEQ ID NO: 1947263 - RNA, 17 nt, Homo sapiens
aucuccucuaucacauu

SEQ ID NO: 1947264 - RNA, 17 nt, Homo sapiens
auaaaccugcaggguca

SEQ ID NO: 1947265 - RNA, 17 nt, Homo sapiens
ucuugggauaguuccca

SEQ ID NO: 1947266 - RNA, 15 nt, Homo sapiens
gcauaggugacaggg

SEQ ID NO: 1947267 - RNA, 19 nt, Homo sapiens
auaugagccuuugcacagg

SEQ ID NO: 1947268 - RNA, 16 nt, Homo sapiens
aacccauugucuuuac

SEQ ID NO: 1947269 - RNA, 20 nt, Homo sapiens
guccuuagccuggaccucug

SEQ ID NO: 1947270 - RNA, 17 nt, Homo sapiens
cuuggcuaacauagcac

SEQ ID NO: 1947271 - RNA, 21 nt, Homo sapiens
agucagaaacuaaaacaaaua

SEQ ID NO: 1947272 - RNA, 16 nt, Homo sapiens
gcaaauggccaaugag

SEQ ID NO: 1947273 - RNA, 15 nt, Homo sapiens
cacagggucugcucu

SEQ ID NO: 1947274 - RNA, 23 nt, Homo sapiens
ucauuucaggagcagccucagaa

SEQ ID NO: 1947275 - RNA, 19 nt, Homo sapiens
ugccaccucuaacagcacc

SEQ ID NO: 1947276 - RNA, 14 nt, Homo sapiens
ucugauguuaacca

SEQ ID NO: 1947277 - RNA, 22 nt, Homo sapiens
uccaaccugagaaauggccaaa

SEQ ID NO: 1947278 - RNA, 16 nt, Homo sapiens
gcuucuaccaacugga

SEQ ID NO: 1947279 - RNA, 18 nt, Homo sapiens
ugcuuccuugcuuuuaug

SEQ ID NO: 1947280 - RNA, 18 nt, Homo sapiens
uucugucuuucugcuaug

SEQ ID NO: 1947281 - RNA, 14 nt, Homo sapiens
uaccaaaacacugc

SEQ ID NO: 1947282 - RNA, 21 nt, Homo sapiens
acgucuggcuaaucuuuuuau

SEQ ID NO: 1947283 - RNA, 20 nt, Homo sapiens
cuucagucuuaauacuuuau

SEQ ID NO: 1947284 - RNA, 13 nt, Homo sapiens
caucaaguuccac

SEQ ID NO: 1947285 - RNA, 14 nt, Homo sapiens
uucagaguuuuacu

SEQ ID NO: 1947286 - RNA, 14 nt, Homo sapiens
gacuguugcucaaa

SEQ ID NO: 1947287 - RNA, 22 nt, Homo sapiens
aauccuucuaacuaaacuaaaa

SEQ ID NO: 1947288 - RNA, 22 nt, Homo sapiens
cugcuuuugugucccauucaca

SEQ ID NO: 1947289 - RNA, 18 nt, Homo sapiens
cucuaguuuccagaggcu

SEQ ID NO: 1947290 - RNA, 16 nt, Homo sapiens
aaauauguauuuacca

SEQ ID NO: 1947291 - RNA, 12 nt, Homo sapiens
cacaccaaagcu

SEQ ID NO: 1947292 - RNA, 16 nt, Homo sapiens
ccagcccaacaucucc

SEQ ID NO: 1947293 - RNA, 14 nt, Homo sapiens
aacucaggcuuuca

SEQ ID NO: 1947294 - RNA, 21 nt, Homo sapiens
auccuguuacugaauuugcua

SEQ ID NO: 1947295 - RNA, 14 nt, Homo sapiens
agaaauagcuuaug

SEQ ID NO: 1947296 - RNA, 23 nt, Homo sapiens
uuaauaaaaaggaauacauugca

SEQ ID NO: 1947297 - RNA, 20 nt, Homo sapiens
gccuuacacaaaggggauca

SEQ ID NO: 1947298 - RNA, 13 nt, Homo sapiens
cuaaugugcauua

SEQ ID NO: 1947299 - RNA, 13 nt, Homo sapiens
auuccauuuugcu

SEQ ID NO: 1947300 - RNA, 17 nt, Homo sapiens
ccuccagggacucuggg

SEQ ID NO: 1947301 - RNA, 18 nt, Homo sapiens
aucccccaaaaugcauuu

SEQ ID NO: 1947302 - RNA, 19 nt, Homo sapiens
aaugccuucuguuuuccaa

SEQ ID NO: 1947303 - RNA, 15 nt, Homo sapiens
uacagaugcacccca

SEQ ID NO: 1947304 - RNA, 14 nt, Homo sapiens
aagcuagaggaaua

SEQ ID NO: 1947305 - RNA, 14 nt, Homo sapiens
uguucuugaugaca

SEQ ID NO: 1947306 - RNA, 14 nt, Homo sapiens
cccagcuaccccuu

SEQ ID NO: 1947307 - RNA, 13 nt, Homo sapiens
ugcuggugucgca

SEQ ID NO: 1947308 - RNA, 20 nt, Homo sapiens
ccugcguucuccccaugaac

SEQ ID NO: 1947309 - RNA, 22 nt, Homo sapiens
auuaaaaaagcucaaugcauug

SEQ ID NO: 1947310 - RNA, 17 nt, Homo sapiens
acugagcaaagcauuga

SEQ ID NO: 1947311 - RNA, 17 nt, Homo sapiens
aauaacugagauauuau

SEQ ID NO: 1947312 - RNA, 15 nt, Homo sapiens
agauauaauguucac

SEQ ID NO: 1947313 - RNA, 15 nt, Homo sapiens
auuuaacauuaucua

SEQ ID NO: 1947314 - RNA, 14 nt, Homo sapiens
ggccccaacuacac

SEQ ID NO: 1947315 - RNA, 23 nt, Homo sapiens
cagggggaaguucagaaggugug

SEQ ID NO: 1947316 - RNA, 23 nt, Homo sapiens
caggcugcccgccgccccuccac

SEQ ID NO: 1947317 - RNA, 18 nt, Homo sapiens
uuacuccaucauggcugc

SEQ ID NO: 1947318 - RNA, 16 nt, Homo sapiens
gcucagcaaccuuuca

SEQ ID NO: 1947319 - RNA, 13 nt, Homo sapiens
agaauggaacuca

SEQ ID NO: 1947320 - RNA, 15 nt, Homo sapiens
aaacucugcaccuaa

SEQ ID NO: 1947321 - RNA, 19 nt, Homo sapiens
cuucucaggccucugcucu

SEQ ID NO: 1947322 - RNA, 16 nt, Homo sapiens
ccagagcaaaguguaa

SEQ ID NO: 1947323 - RNA, 19 nt, Homo sapiens
auuugagauaaagucaaau

SEQ ID NO: 1947324 - RNA, 13 nt, Homo sapiens
caccauggcuuua

SEQ ID NO: 1947325 - RNA, 16 nt, Homo sapiens
acaaaaaaaacaacaa

SEQ ID NO: 1947326 - RNA, 18 nt, Homo sapiens
cccuuugggaaagcucuu

SEQ ID NO: 1947327 - RNA, 13 nt, Homo sapiens
ugcuacaguauau

SEQ ID NO: 1947328 - RNA, 17 nt, Homo sapiens
ccacaaugagauuccau

SEQ ID NO: 1947329 - RNA, 14 nt, Homo sapiens
uccgucucuguccu

SEQ ID NO: 1947330 - RNA, 20 nt, Homo sapiens
agacucugccauuaaaacau

SEQ ID NO: 1947331 - RNA, 16 nt, Homo sapiens
acgcucugcaccuucu

SEQ ID NO: 1947332 - RNA, 17 nt, Homo sapiens
cuaugccugucuuuacc

SEQ ID NO: 1947333 - RNA, 21 nt, Homo sapiens
uacauuauuacuccuugccau

SEQ ID NO: 1947334 - RNA, 21 nt, Homo sapiens
acccuuccaucugauuccagc

SEQ ID NO: 1947335 - RNA, 20 nt, Homo sapiens
ggaauaagcauauauucagu

SEQ ID NO: 1947336 - RNA, 13 nt, Homo sapiens
ccugcacugccag

SEQ ID NO: 1947337 - RNA, 17 nt, Homo sapiens
uauucuuucuaaacuac

SEQ ID NO: 1947338 - RNA, 20 nt, Homo sapiens
ugcaaugcccucauacccau

SEQ ID NO: 1947339 - RNA, 14 nt, Homo sapiens
cucagaaaagugac

SEQ ID NO: 1947340 - RNA, 21 nt, Homo sapiens
agagccaauguuuuccaccca

SEQ ID NO: 1947341 - RNA, 17 nt, Homo sapiens
agccaggcuaugguugc

SEQ ID NO: 1947342 - RNA, 15 nt, Homo sapiens
cucucaagcagguuu

SEQ ID NO: 1947343 - RNA, 18 nt, Homo sapiens
caugggagugaucucacc

SEQ ID NO: 1947344 - RNA, 20 nt, Homo sapiens
gucaguccaggaugcuaaca

SEQ ID NO: 1947345 - RNA, 12 nt, Homo sapiens
uugaaaaccugg

SEQ ID NO: 1947346 - RNA, 19 nt, Homo sapiens
cacgcagucugcuucagug

SEQ ID NO: 1947347 - RNA, 20 nt, Homo sapiens
gaucuuggggugcagcacuu

SEQ ID NO: 1947348 - RNA, 17 nt, Homo sapiens
uucgugcagugcccuga

SEQ ID NO: 1947349 - RNA, 16 nt, Homo sapiens
uuauaugauauacuau

SEQ ID NO: 1947350 - RNA, 23 nt, Homo sapiens
uccuugagaggagaaaugcaaua

SEQ ID NO: 1947351 - RNA, 12 nt, Homo sapiens
uccaacuguaua

SEQ ID NO: 1947352 - RNA, 22 nt, Homo sapiens
auuuuacacguaucucuuggua

SEQ ID NO: 1947353 - RNA, 14 nt, Homo sapiens
agcacagcugccaa

SEQ ID NO: 1947354 - RNA, 19 nt, Homo sapiens
auucauaaugacuuaagca

SEQ ID NO: 1947355 - RNA, 15 nt, Homo sapiens
gggccuaggaggacc

SEQ ID NO: 1947356 - RNA, 16 nt, Homo sapiens
gccuacaugcuuugug

SEQ ID NO: 1947357 - RNA, 23 nt, Homo sapiens
uugcaaaaauuauaaaguaauuu

SEQ ID NO: 1947358 - RNA, 15 nt, Homo sapiens
ucacaguaacccaga

SEQ ID NO: 1947359 - RNA, 14 nt, Homo sapiens
acaucuuucagcug

SEQ ID NO: 1947360 - RNA, 20 nt, Homo sapiens
gacaaaauugcagauaccau

SEQ ID NO: 1947361 - RNA, 20 nt, Homo sapiens
gaucagcugguucaguacug

SEQ ID NO: 1947362 - RNA, 17 nt, Homo sapiens
uguaaaauucauagcau

SEQ ID NO: 1947363 - RNA, 19 nt, Homo sapiens
ugaaucugagagucauuca

SEQ ID NO: 1947364 - RNA, 21 nt, Homo sapiens
auaaugugggcagauuuggcu

SEQ ID NO: 1947365 - RNA, 17 nt, Homo sapiens
agagacaugcaagucau

SEQ ID NO: 1947366 - RNA, 11 nt, Homo sapiens
cuauacugugg

SEQ ID NO: 1947367 - RNA, 23 nt, Homo sapiens
aaacagugauuuagguuuguaac

SEQ ID NO: 1947368 - RNA, 20 nt, Homo sapiens
cuuauuuggaauauauauca

SEQ ID NO: 1947369 - RNA, 12 nt, Homo sapiens
aaccccuuccag

SEQ ID NO: 1947370 - RNA, 16 nt, Homo sapiens
gcagaggggugcucau

SEQ ID NO: 1947371 - RNA, 18 nt, Homo sapiens
cuuuuccugggugcucag

SEQ ID NO: 1947372 - RNA, 23 nt, Homo sapiens
cagugaaggcuaagaaccuggug

SEQ ID NO: 1947373 - RNA, 23 nt, Homo sapiens
gcauccacgucaaugucauucuc

SEQ ID NO: 1947374 - RNA, 22 nt, Homo sapiens
uacagaucaucuuggaacugca

SEQ ID NO: 1947375 - RNA, 19 nt, Homo sapiens
ugaguugcuuuucagcuga

SEQ ID NO: 1947376 - RNA, 18 nt, Homo sapiens
acaacuuucucuuguaaa

SEQ ID NO: 1947377 - RNA, 19 nt, Homo sapiens
cagauuuaaagaaaaccac

SEQ ID NO: 1947378 - RNA, 19 nt, Homo sapiens
cagccccggccacucccug

SEQ ID NO: 1947379 - RNA, 15 nt, Homo sapiens
aagacauuuccuacc

SEQ ID NO: 1947380 - RNA, 16 nt, Homo sapiens
uaaugcacaucugcag

SEQ ID NO: 1947381 - RNA, 16 nt, Homo sapiens
accccugguucucauc

SEQ ID NO: 1947382 - RNA, 21 nt, Homo sapiens
aacaccuaggucgccagugaa

SEQ ID NO: 1947383 - RNA, 21 nt, Homo sapiens
uaaccugggaaagccaugacc

SEQ ID NO: 1947384 - RNA, 18 nt, Homo sapiens
cacaaaaagaugcaucua

SEQ ID NO: 1947385 - RNA, 14 nt, Homo sapiens
ccuucacuuuacaa

SEQ ID NO: 1947386 - RNA, 21 nt, Homo sapiens
accaagaaaacaugcaacuca

SEQ ID NO: 1947387 - RNA, 18 nt, Homo sapiens
ugggccccucaacagcca

SEQ ID NO: 1947388 - RNA, 19 nt, Homo sapiens
acuaaagagugaaugccau

SEQ ID NO: 1947389 - RNA, 20 nt, Homo sapiens
gcuccuaaaggcagcaacca

SEQ ID NO: 1947390 - RNA, 13 nt, Homo sapiens
cugccccuuccac

SEQ ID NO: 1947391 - RNA, 23 nt, Homo sapiens
aaagguuauuuucuccugauaua

SEQ ID NO: 1947392 - RNA, 20 nt, Homo sapiens
uguagccucgccgucuguga

SEQ ID NO: 1947393 - RNA, 17 nt, Homo sapiens
ccuacagaggucucugc

SEQ ID NO: 1947394 - RNA, 16 nt, Homo sapiens
cuucauccauagacac

SEQ ID NO: 1947395 - RNA, 23 nt, Homo sapiens
uucaggaauaaaguucagugugc

SEQ ID NO: 1947396 - RNA, 16 nt, Homo sapiens
ugauaaaagauggcca

SEQ ID NO: 1947397 - RNA, 17 nt, Homo sapiens
gugaucaguaugcuguu

SEQ ID NO: 1947398 - RNA, 15 nt, Homo sapiens
gaucauuugcagcug

SEQ ID NO: 1947399 - RNA, 20 nt, Homo sapiens
accacugugucccagugucu

SEQ ID NO: 1947400 - RNA, 19 nt, Homo sapiens
cagaggaguuucuuaauga

SEQ ID NO: 1947401 - RNA, 19 nt, Homo sapiens
uccagggaggcgaugccag

SEQ ID NO: 1947402 - RNA, 20 nt, Homo sapiens
aguggcgcgaucucagcuca

SEQ ID NO: 1947403 - RNA, 16 nt, Homo sapiens
uucuuggauuacuuua

SEQ ID NO: 1947404 - RNA, 19 nt, Homo sapiens
uuuuauucaaagacagaga

SEQ ID NO: 1947405 - RNA, 20 nt, Homo sapiens
ugggagaauaugguuuucua

SEQ ID NO: 1947406 - RNA, 22 nt, Homo sapiens
ugccugggaccugaaccuggag

SEQ ID NO: 1947407 - RNA, 11 nt, Homo sapiens
gguccacagag

SEQ ID NO: 1947408 - RNA, 22 nt, Homo sapiens
auucuaacccagguauccaaaa

SEQ ID NO: 1947409 - RNA, 11 nt, Homo sapiens
aaaaauccauu

SEQ ID NO: 1947410 - RNA, 16 nt, Homo sapiens
cauacaauuuacuuuu

SEQ ID NO: 1947411 - RNA, 13 nt, Homo sapiens
acuacaacauaug

SEQ ID NO: 1947412 - RNA, 21 nt, Homo sapiens
aacaugugaggcauucgggga

SEQ ID NO: 1947413 - RNA, 18 nt, Homo sapiens
guaagaaaugcugcccau

SEQ ID NO: 1947414 - RNA, 23 nt, Homo sapiens
ucaaacuacuuugcugcuaauau

SEQ ID NO: 1947415 - RNA, 14 nt, Homo sapiens
uuuauuacauauga

SEQ ID NO: 1947416 - RNA, 23 nt, Homo sapiens
agcaucacuccccaaggaagagc

SEQ ID NO: 1947417 - RNA, 16 nt, Homo sapiens
caagccugccuaggaa

SEQ ID NO: 1947418 - RNA, 13 nt, Homo sapiens
auggaagaaagaa

SEQ ID NO: 1947419 - RNA, 23 nt, Homo sapiens
aagauuccuaauaaucauuggau

SEQ ID NO: 1947420 - RNA, 18 nt, Homo sapiens
accuccacgggcucuccu

SEQ ID NO: 1947421 - RNA, 16 nt, Homo sapiens
ccaggccagagccugu

SEQ ID NO: 1947422 - RNA, 12 nt, Homo sapiens
agggaugggaga

SEQ ID NO: 1947423 - RNA, 18 nt, Homo sapiens
cugcgggcccgcacguuu

SEQ ID NO: 1947424 - RNA, 18 nt, Homo sapiens
ccuggacucaucuuggga

SEQ ID NO: 1947425 - RNA, 19 nt, Homo sapiens
caauauauacuuauagaau

SEQ ID NO: 1947426 - RNA, 12 nt, Homo sapiens
ugaugaaugaga

SEQ ID NO: 1947427 - RNA, 17 nt, Homo sapiens
caaaagaaacuuaccaa

SEQ ID NO: 1947428 - RNA, 13 nt, Homo sapiens
aaauguacacuuu

SEQ ID NO: 1947429 - RNA, 18 nt, Homo sapiens
cccacuuucaccaguuuc

SEQ ID NO: 1947430 - RNA, 18 nt, Homo sapiens
cagccucccugaagccuu

SEQ ID NO: 1947431 - RNA, 18 nt, Homo sapiens
cucgccuccuacucugag

SEQ ID NO: 1947432 - RNA, 20 nt, Homo sapiens
cccaccugggcccuaggcau

SEQ ID NO: 1947433 - RNA, 13 nt, Homo sapiens
agcucgaaaacaa

SEQ ID NO: 1947434 - RNA, 23 nt, Homo sapiens
guuuugaaggcaaaauugcaaau

SEQ ID NO: 1947435 - RNA, 20 nt, Homo sapiens
gguccacucccugcuccacg

SEQ ID NO: 1947436 - RNA, 15 nt, Homo sapiens
acaacugcauaaccu

SEQ ID NO: 1947437 - RNA, 11 nt, Homo sapiens
ucauacaggug

SEQ ID NO: 1947438 - RNA, 15 nt, Homo sapiens
aaaucaaccccagac

SEQ ID NO: 1947439 - RNA, 15 nt, Homo sapiens
cacccuucucaggga

SEQ ID NO: 1947440 - RNA, 15 nt, Homo sapiens
guuuuuggagggguu

SEQ ID NO: 1947441 - RNA, 13 nt, Homo sapiens
guuucccagugag

SEQ ID NO: 1947442 - RNA, 21 nt, Homo sapiens
gcugcccguuuguacauggga

SEQ ID NO: 1947443 - RNA, 22 nt, Homo sapiens
cagagauggaugcauguucuga

SEQ ID NO: 1947444 - RNA, 13 nt, Homo sapiens
cacucaauccauc

SEQ ID NO: 1947445 - RNA, 13 nt, Homo sapiens
gacaaaaugcaaa

SEQ ID NO: 1947446 - RNA, 13 nt, Homo sapiens
gaaaaaaugccaa

SEQ ID NO: 1947447 - RNA, 20 nt, Homo sapiens
agccucaaccuccccggcuc

SEQ ID NO: 1947448 - RNA, 16 nt, Homo sapiens
ugagucugaauucugc

SEQ ID NO: 1947449 - RNA, 20 nt, Homo sapiens
uuaguuguccacaaaucuuc

SEQ ID NO: 1947450 - RNA, 19 nt, Homo sapiens
gagacuaagauguauuaac

SEQ ID NO: 1947451 - RNA, 14 nt, Homo sapiens
ccagccucccacaa

SEQ ID NO: 1947452 - RNA, 22 nt, Homo sapiens
agggcugcucuuuccacuugcc

SEQ ID NO: 1947453 - RNA, 19 nt, Homo sapiens
aauucagcacugauuucac

SEQ ID NO: 1947454 - RNA, 18 nt, Homo sapiens
ggccccgaaugucacugg

SEQ ID NO: 1947455 - RNA, 19 nt, Homo sapiens
uagaauaucuagcauguaa

SEQ ID NO: 1947456 - RNA, 15 nt, Homo sapiens
uggcaaaaacggcca

SEQ ID NO: 1947457 - RNA, 14 nt, Homo sapiens
ucaugcagcucaac

SEQ ID NO: 1947458 - RNA, 19 nt, Homo sapiens
aguagugguguucacaaua

SEQ ID NO: 1947459 - RNA, 12 nt, Homo sapiens
cucaauucacau

SEQ ID NO: 1947460 - RNA, 23 nt, Homo sapiens
ucagcuuucccuggcucagggau

SEQ ID NO: 1947461 - RNA, 13 nt, Homo sapiens
cugucucagugau

SEQ ID NO: 1947462 - RNA, 13 nt, Homo sapiens
gauucucacauau

SEQ ID NO: 1947463 - RNA, 18 nt, Homo sapiens
aaagcugcugcacagcug

SEQ ID NO: 1947464 - RNA, 15 nt, Homo sapiens
aucaggauuuuucaa

SEQ ID NO: 1947465 - RNA, 17 nt, Homo sapiens
uuugaucaagaaugcaa

SEQ ID NO: 1947466 - RNA, 13 nt, Homo sapiens
acccagaacagga

SEQ ID NO: 1947467 - RNA, 16 nt, Homo sapiens
uaucuuuguauucuuc

SEQ ID NO: 1947468 - RNA, 21 nt, Homo sapiens
uguggacguggguugcacugg

SEQ ID NO: 1947469 - RNA, 16 nt, Homo sapiens
cgcugcagucagcaca

SEQ ID NO: 1947470 - RNA, 14 nt, Homo sapiens
auaaacugaguuua

SEQ ID NO: 1947471 - RNA, 18 nt, Homo sapiens
ggacuguggccucaggag

SEQ ID NO: 1947472 - RNA, 12 nt, Homo sapiens
cacacacugacc

SEQ ID NO: 1947473 - RNA, 20 nt, Homo sapiens
accuuuaagagaaaugagcu

SEQ ID NO: 1947474 - RNA, 16 nt, Homo sapiens
agcucugcucucagca

SEQ ID NO: 1947475 - RNA, 21 nt, Homo sapiens
auauaauuuccauagugugag

SEQ ID NO: 1947476 - RNA, 13 nt, Homo sapiens
uuugaaagaugca

SEQ ID NO: 1947477 - RNA, 15 nt, Homo sapiens
gaggcaaaggccagc

SEQ ID NO: 1947478 - RNA, 15 nt, Homo sapiens
gagcagaacuuucac

SEQ ID NO: 1947479 - RNA, 14 nt, Homo sapiens
augcaagacuucac

SEQ ID NO: 1947480 - RNA, 17 nt, Homo sapiens
aguucaggcagcacauc

SEQ ID NO: 1947481 - RNA, 23 nt, Homo sapiens
agaaccaggcagcccugccaugu

SEQ ID NO: 1947482 - RNA, 17 nt, Homo sapiens
ugaugauuugcuaucaa

SEQ ID NO: 1947483 - RNA, 16 nt, Homo sapiens
cuaggcucauacucaa

SEQ ID NO: 1947484 - RNA, 16 nt, Homo sapiens
uaacauuguacuguaa

SEQ ID NO: 1947485 - RNA, 22 nt, Homo sapiens
aucagggguuagggugcaagaa

SEQ ID NO: 1947486 - RNA, 16 nt, Homo sapiens
aguguugagcaucugu

SEQ ID NO: 1947487 - RNA, 14 nt, Homo sapiens
auuaaacacaggga

SEQ ID NO: 1947488 - RNA, 19 nt, Homo sapiens
uaguagauguggccuuuga

SEQ ID NO: 1947489 - RNA, 17 nt, Homo sapiens
ccuccccagauaucauu

SEQ ID NO: 1947490 - RNA, 20 nt, Homo sapiens
agaccccucucccagcuauu

SEQ ID NO: 1947491 - RNA, 18 nt, Homo sapiens
uacacucaagcaugaaga

SEQ ID NO: 1947492 - RNA, 19 nt, Homo sapiens
aggcugucaauuacaggaa

SEQ ID NO: 1947493 - RNA, 12 nt, Homo sapiens
uaauccaaagaa

SEQ ID NO: 1947494 - RNA, 14 nt, Homo sapiens
ggcuuucaugauuu

SEQ ID NO: 1947495 - RNA, 14 nt, Homo sapiens
ugaauacaggcaua

SEQ ID NO: 1947496 - RNA, 19 nt, Homo sapiens
agcacuuuagaucacuuga

SEQ ID NO: 1947497 - RNA, 14 nt, Homo sapiens
ugggcugggaacca

SEQ ID NO: 1947498 - RNA, 22 nt, Homo sapiens
ccucagaaacccuucagugcua

SEQ ID NO: 1947499 - RNA, 20 nt, Homo sapiens
uccccuugucugcacuguuc

SEQ ID NO: 1947500 - RNA, 16 nt, Homo sapiens
auucaguuuucaggau

SEQ ID NO: 1947501 - RNA, 14 nt, Homo sapiens
guguuuauuacugc

SEQ ID NO: 1947502 - RNA, 14 nt, Homo sapiens
ggggcaugggugga

SEQ ID NO: 1947503 - RNA, 14 nt, Homo sapiens
cuuuguugcugucu

SEQ ID NO: 1947504 - RNA, 18 nt, Homo sapiens
cuacaaaauuggaaagaa

SEQ ID NO: 1947505 - RNA, 16 nt, Homo sapiens
gcccgucucuuucuca

SEQ ID NO: 1947506 - RNA, 16 nt, Homo sapiens
cuuccugugccuguga

SEQ ID NO: 1947507 - RNA, 17 nt, Homo sapiens
gaggcugcccuccugug

SEQ ID NO: 1947508 - RNA, 12 nt, Homo sapiens
aaugccaugacu

SEQ ID NO: 1947509 - RNA, 18 nt, Homo sapiens
uaaccugggaccaaccug

SEQ ID NO: 1947510 - RNA, 13 nt, Homo sapiens
auuagaggaagaa

SEQ ID NO: 1947511 - RNA, 16 nt, Homo sapiens
cucaggaaucaucucc

SEQ ID NO: 1947512 - RNA, 23 nt, Homo sapiens
guacaucgaggcucuugcucaag

SEQ ID NO: 1947513 - RNA, 16 nt, Homo sapiens
ccugagaccagggugg

SEQ ID NO: 1947514 - RNA, 16 nt, Homo sapiens
gcucuuugcugcacua

SEQ ID NO: 1947515 - RNA, 14 nt, Homo sapiens
aaauugcuuauucu

SEQ ID NO: 1947516 - RNA, 20 nt, Homo sapiens
aacacaggcaaguccacccc

SEQ ID NO: 1947517 - RNA, 22 nt, Homo sapiens
uggcuuaugccccugcacugaa

SEQ ID NO: 1947518 - RNA, 17 nt, Homo sapiens
aaagauaccauguauaa

SEQ ID NO: 1947519 - RNA, 14 nt, Homo sapiens
uucuuaggccacau

SEQ ID NO: 1947520 - RNA, 10 nt, Homo sapiens
gaauuucaca

SEQ ID NO: 1947521 - RNA, 24 nt, Homo sapiens
aagaacuucucguagaugcugccu

SEQ ID NO: 1947522 - RNA, 18 nt, Homo sapiens
guaauuguaaacuaguac

SEQ ID NO: 1947523 - RNA, 13 nt, Homo sapiens
auaggcaauaaua

SEQ ID NO: 1947524 - RNA, 11 nt, Homo sapiens
cguaaacuaug

SEQ ID NO: 1947525 - RNA, 18 nt, Homo sapiens
aaugacuuugaaguaaaa

SEQ ID NO: 1947526 - RNA, 14 nt, Homo sapiens
auacuccacacaua

SEQ ID NO: 1947527 - RNA, 15 nt, Homo sapiens
auuuaaaaagcccaa

SEQ ID NO: 1947528 - RNA, 21 nt, Homo sapiens
caaacuccuuguaggucugca

SEQ ID NO: 1947529 - RNA, 19 nt, Homo sapiens
auccuacuccuaccugguc

SEQ ID NO: 1947530 - RNA, 22 nt, Homo sapiens
ucuacauaauuuagaguguaug

SEQ ID NO: 1947531 - RNA, 16 nt, Homo sapiens
cacaacccuguuuuau

SEQ ID NO: 1947532 - RNA, 14 nt, Homo sapiens
cacaaaugguagca

SEQ ID NO: 1947533 - RNA, 15 nt, Homo sapiens
aucagggccugcccc

SEQ ID NO: 1947534 - RNA, 16 nt, Homo sapiens
cauaaaauaaacugaa

SEQ ID NO: 1947535 - RNA, 11 nt, Homo sapiens
uaccauagaaa

SEQ ID NO: 1947536 - RNA, 13 nt, Homo sapiens
aaugccacaaaac

SEQ ID NO: 1947537 - RNA, 12 nt, Homo sapiens
agaaacauuugg

SEQ ID NO: 1947538 - RNA, 14 nt, Homo sapiens
uagacacuaugugu

SEQ ID NO: 1947539 - RNA, 19 nt, Homo sapiens
cgacccccucucccugcau

SEQ ID NO: 1947540 - RNA, 22 nt, Homo sapiens
gcaagaggugguagaaccacuu

SEQ ID NO: 1947541 - RNA, 14 nt, Homo sapiens
acuugaaugugcac

SEQ ID NO: 1947542 - RNA, 21 nt, Homo sapiens
ccaaggcagggcccagcauaa

SEQ ID NO: 1947543 - RNA, 14 nt, Homo sapiens
acuaacuaaccaca

SEQ ID NO: 1947544 - RNA, 13 nt, Homo sapiens
cucaaccaugacc

SEQ ID NO: 1947545 - RNA, 20 nt, Homo sapiens
acccuuuugucgccuggaug

SEQ ID NO: 1947546 - RNA, 13 nt, Homo sapiens
ugaacucagggag

SEQ ID NO: 1947547 - RNA, 13 nt, Homo sapiens
guaucucauugug

SEQ ID NO: 1947548 - RNA, 22 nt, Homo sapiens
uaaaacagccaaaacuccacag

SEQ ID NO: 1947549 - RNA, 19 nt, Homo sapiens
acaauaacuuggagacaga

SEQ ID NO: 1947550 - RNA, 15 nt, Homo sapiens
caggggagugugaag

SEQ ID NO: 1947551 - RNA, 21 nt, Homo sapiens
acaaaauauuucuaagcuuau

SEQ ID NO: 1947552 - RNA, 17 nt, Homo sapiens
aagugacuuauuugcuc

SEQ ID NO: 1947553 - RNA, 23 nt, Homo sapiens
uaugaccucgcccuccacaaaug

SEQ ID NO: 1947554 - RNA, 20 nt, Homo sapiens
cuugacuauuggaggaccaa

SEQ ID NO: 1947555 - RNA, 13 nt, Homo sapiens
aaagugcaguaaa

SEQ ID NO: 1947556 - RNA, 23 nt, Homo sapiens
aaaaggaagccucuucaucuccc

SEQ ID NO: 1947557 - RNA, 20 nt, Homo sapiens
aguacuuaauugaagcuuuu

SEQ ID NO: 1947558 - RNA, 21 nt, Homo sapiens
gcauugcaggccaaaccguac

SEQ ID NO: 1947559 - RNA, 15 nt, Homo sapiens
acaucccaaaugcca

SEQ ID NO: 1947560 - RNA, 16 nt, Homo sapiens
cuagacucccauggaa

SEQ ID NO: 1947561 - RNA, 16 nt, Homo sapiens
ucggcaggggccuugu

SEQ ID NO: 1947562 - RNA, 17 nt, Homo sapiens
ugcuugaggcuaccucu

SEQ ID NO: 1947563 - RNA, 13 nt, Homo sapiens
cucugaucccucu

SEQ ID NO: 1947564 - RNA, 20 nt, Homo sapiens
gaauaacaugauacuauuca

SEQ ID NO: 1947565 - RNA, 18 nt, Homo sapiens
aaagcccauucauuccau

SEQ ID NO: 1947566 - RNA, 23 nt, Homo sapiens
gacggugggccuggcacacgccu

SEQ ID NO: 1947567 - RNA, 12 nt, Homo sapiens
cauucugccaaa

SEQ ID NO: 1947568 - RNA, 14 nt, Homo sapiens
cccaacaaugagug

SEQ ID NO: 1947569 - RNA, 13 nt, Homo sapiens
gcccgcugagugg

SEQ ID NO: 1947570 - RNA, 22 nt, Homo sapiens
cauuuugcugcuuuaucaaaau

SEQ ID NO: 1947571 - RNA, 14 nt, Homo sapiens
uagaauguaaggua

SEQ ID NO: 1947572 - RNA, 14 nt, Homo sapiens
acuaucuucuucaa

SEQ ID NO: 1947573 - RNA, 23 nt, Homo sapiens
ucccgauaucaaaaagacugugg

SEQ ID NO: 1947574 - RNA, 20 nt, Homo sapiens
cugccugggccguggcacag

SEQ ID NO: 1947575 - RNA, 13 nt, Homo sapiens
gagccauaugaau

SEQ ID NO: 1947576 - RNA, 18 nt, Homo sapiens
cguuaugauaguguccca

SEQ ID NO: 1947577 - RNA, 13 nt, Homo sapiens
ggaaccucacucu

SEQ ID NO: 1947578 - RNA, 15 nt, Homo sapiens
cuuucuccauucugu

SEQ ID NO: 1947579 - RNA, 21 nt, Homo sapiens
cccuuuacagcaccaccuugc

SEQ ID NO: 1947580 - RNA, 19 nt, Homo sapiens
cuguuuauagaauaaggga

SEQ ID NO: 1947581 - RNA, 19 nt, Homo sapiens
ccagccagauggacuccag

SEQ ID NO: 1947582 - RNA, 18 nt, Homo sapiens
ccaauagugucauccuca

SEQ ID NO: 1947583 - RNA, 15 nt, Homo sapiens
caggaguaagcccaa

SEQ ID NO: 1947584 - RNA, 20 nt, Homo sapiens
ggcuucccucuuucaucucc

SEQ ID NO: 1947585 - RNA, 15 nt, Homo sapiens
guguuugaacagggc

SEQ ID NO: 1947586 - RNA, 23 nt, Homo sapiens
gaauccagagagcaguguggaaa

SEQ ID NO: 1947587 - RNA, 19 nt, Homo sapiens
ucuuuccuaagaaagacau

SEQ ID NO: 1947588 - RNA, 18 nt, Homo sapiens
uugaauuucuccgaaugu

SEQ ID NO: 1947589 - RNA, 13 nt, Homo sapiens
uacuggaaguuga

SEQ ID NO: 1947590 - RNA, 19 nt, Homo sapiens
caaacucaguuccaaaguc

SEQ ID NO: 1947591 - RNA, 21 nt, Homo sapiens
ccccacgcgcaagacagccca

SEQ ID NO: 1947592 - RNA, 18 nt, Homo sapiens
uaaaaugauaaacaaguc

SEQ ID NO: 1947593 - RNA, 22 nt, Homo sapiens
uuccuaugauguauacugccac

SEQ ID NO: 1947594 - RNA, 12 nt, Homo sapiens
gacaggugaaug

SEQ ID NO: 1947595 - RNA, 16 nt, Homo sapiens
aauaaauaaucuacau

SEQ ID NO: 1947596 - RNA, 18 nt, Homo sapiens
acagcaaccccaggcuga

SEQ ID NO: 1947597 - RNA, 17 nt, Homo sapiens
cuauuuccauuccagaa

SEQ ID NO: 1947598 - RNA, 18 nt, Homo sapiens
aaacuaaugaguuuaaua

SEQ ID NO: 1947599 - RNA, 15 nt, Homo sapiens
auuugcuaaggcagc

SEQ ID NO: 1947600 - RNA, 21 nt, Homo sapiens
ucucccccagacgccugauau

SEQ ID NO: 1947601 - RNA, 21 nt, Homo sapiens
ucgaauaaaggaugggaccaa

SEQ ID NO: 1947602 - RNA, 15 nt, Homo sapiens
agacauaugggccau

SEQ ID NO: 1947603 - RNA, 22 nt, Homo sapiens
caaaaugcagucuuaccaauga

SEQ ID NO: 1947604 - RNA, 15 nt, Homo sapiens
uaaaccaaaaacuga

SEQ ID NO: 1947605 - RNA, 14 nt, Homo sapiens
guguaacaggucuc

SEQ ID NO: 1947606 - RNA, 16 nt, Homo sapiens
gcugcagagagcaccu

SEQ ID NO: 1947607 - RNA, 23 nt, Homo sapiens
uugauaagagggcacacacugug

SEQ ID NO: 1947608 - RNA, 16 nt, Homo sapiens
guaguauuuaguauau

SEQ ID NO: 1947609 - RNA, 22 nt, Homo sapiens
uucaaguaaaaaucaauacccu

SEQ ID NO: 1947610 - RNA, 23 nt, Homo sapiens
aauugaaacuuuuuucauuuuga

SEQ ID NO: 1947611 - RNA, 19 nt, Homo sapiens
cagcuucccaaguagcugg

SEQ ID NO: 1947612 - RNA, 22 nt, Homo sapiens
uagcucuccugggguucuggga

SEQ ID NO: 1947613 - RNA, 19 nt, Homo sapiens
guuaugaagggaagcgaga

SEQ ID NO: 1947614 - RNA, 15 nt, Homo sapiens
aaagcagccugugaa

SEQ ID NO: 1947615 - RNA, 13 nt, Homo sapiens
aacuucgccagcc

SEQ ID NO: 1947616 - RNA, 20 nt, Homo sapiens
caguuauuuuuaaacuguaa

SEQ ID NO: 1947617 - RNA, 14 nt, Homo sapiens
ugcugccacugagg

SEQ ID NO: 1947618 - RNA, 14 nt, Homo sapiens
cagcccaggccaca

SEQ ID NO: 1947619 - RNA, 11 nt, Homo sapiens
guauaaugugc

SEQ ID NO: 1947620 - RNA, 19 nt, Homo sapiens
ggauccauccguccagcca

SEQ ID NO: 1947621 - RNA, 17 nt, Homo sapiens
uccaagucaugggagaa

SEQ ID NO: 1947622 - RNA, 16 nt, Homo sapiens
caagacucugaacaau

SEQ ID NO: 1947623 - RNA, 13 nt, Homo sapiens
aucugugucauau

SEQ ID NO: 1947624 - RNA, 20 nt, Homo sapiens
ccucaguuucccuccucugc

SEQ ID NO: 1947625 - RNA, 13 nt, Homo sapiens
aaaccucacaggg

SEQ ID NO: 1947626 - RNA, 14 nt, Homo sapiens
gaaagugacuuuaa

SEQ ID NO: 1947627 - RNA, 20 nt, Homo sapiens
ccucugccugggcucuggaa

SEQ ID NO: 1947628 - RNA, 13 nt, Homo sapiens
gugucuucaggag

SEQ ID NO: 1947629 - RNA, 22 nt, Homo sapiens
agugcggcgugggggcacugac

SEQ ID NO: 1947630 - RNA, 17 nt, Homo sapiens
auuuauuuuuuuacuuc

SEQ ID NO: 1947631 - RNA, 11 nt, Homo sapiens
ccacaccucag

SEQ ID NO: 1947632 - RNA, 22 nt, Homo sapiens
gucucaaagaccacgugacuuu

SEQ ID NO: 1947633 - RNA, 23 nt, Homo sapiens
uaacauaccguuuauaaugccau

SEQ ID NO: 1947634 - RNA, 21 nt, Homo sapiens
gggugcucagggcaugcuuau

SEQ ID NO: 1947635 - RNA, 19 nt, Homo sapiens
gaauuagcaauaacauaca

SEQ ID NO: 1947636 - RNA, 19 nt, Homo sapiens
aguaaaaucaaaugugcau

SEQ ID NO: 1947637 - RNA, 13 nt, Homo sapiens
gcucugccauuca

SEQ ID NO: 1947638 - RNA, 17 nt, Homo sapiens
acagugggugaggagau

SEQ ID NO: 1947639 - RNA, 14 nt, Homo sapiens
uaaacaauauaguc

SEQ ID NO: 1947640 - RNA, 21 nt, Homo sapiens
gaggguaaugagaagcuuugg

SEQ ID NO: 1947641 - RNA, 13 nt, Homo sapiens
aaauauagucaca

SEQ ID NO: 1947642 - RNA, 17 nt, Homo sapiens
agaaugauuaugaauua

SEQ ID NO: 1947643 - RNA, 14 nt, Homo sapiens
cuaguguacauuuc

SEQ ID NO: 1947644 - RNA, 18 nt, Homo sapiens
guauaaugguugacuggg

SEQ ID NO: 1947645 - RNA, 12 nt, Homo sapiens
ucagauggacaa

SEQ ID NO: 1947646 - RNA, 14 nt, Homo sapiens
cugagaauuguuga

SEQ ID NO: 1947647 - RNA, 16 nt, Homo sapiens
uuuuuaaguaacuuaa

SEQ ID NO: 1947648 - RNA, 17 nt, Homo sapiens
augcauuauaucaaauc

SEQ ID NO: 1947649 - RNA, 15 nt, Homo sapiens
uccuacucacuuaaa

SEQ ID NO: 1947650 - RNA, 15 nt, Homo sapiens
agcugaucaugucag

SEQ ID NO: 1947651 - RNA, 21 nt, Homo sapiens
uacaaugaguaaaaucacaga

SEQ ID NO: 1947652 - RNA, 16 nt, Homo sapiens
uacauuugugcuccau

SEQ ID NO: 1947653 - RNA, 13 nt, Homo sapiens
gcagauucuagca

SEQ ID NO: 1947654 - RNA, 15 nt, Homo sapiens
aguggauaauuccaa

SEQ ID NO: 1947655 - RNA, 15 nt, Homo sapiens
gcccagaagugcaga

SEQ ID NO: 1947656 - RNA, 20 nt, Homo sapiens
gugggaggggcgcccaccuc

SEQ ID NO: 1947657 - RNA, 16 nt, Homo sapiens
agacaaaauauuuucc

SEQ ID NO: 1947658 - RNA, 13 nt, Homo sapiens
aacagugccaugu

SEQ ID NO: 1947659 - RNA, 15 nt, Homo sapiens
gcaggcaugcugaac

SEQ ID NO: 1947660 - RNA, 22 nt, Homo sapiens
acaaucaaaucuccugcugauu

SEQ ID NO: 1947661 - RNA, 14 nt, Homo sapiens
guaauuguacaaua

SEQ ID NO: 1947662 - RNA, 13 nt, Homo sapiens
ccaucacuauuca

SEQ ID NO: 1947663 - RNA, 14 nt, Homo sapiens
cugauucugaacaa

SEQ ID NO: 1947664 - RNA, 22 nt, Homo sapiens
ucuuucacacggcacauuugga

SEQ ID NO: 1947665 - RNA, 18 nt, Homo sapiens
gggcgcauacuacaguaa

SEQ ID NO: 1947666 - RNA, 12 nt, Homo sapiens
caccaaugagcc

SEQ ID NO: 1947667 - RNA, 19 nt, Homo sapiens
acauguaagaaaauguuac

SEQ ID NO: 1947668 - RNA, 12 nt, Homo sapiens
aucuuuaccucc

SEQ ID NO: 1947669 - RNA, 13 nt, Homo sapiens
uuauguacuuuga

SEQ ID NO: 1947670 - RNA, 18 nt, Homo sapiens
cccagacucccaccccag

SEQ ID NO: 1947671 - RNA, 19 nt, Homo sapiens
uccuuggaccuagaggauu

SEQ ID NO: 1947672 - RNA, 15 nt, Homo sapiens
uacaccugaggacaa

SEQ ID NO: 1947673 - RNA, 17 nt, Homo sapiens
ugucaacacaaagacac

SEQ ID NO: 1947674 - RNA, 20 nt, Homo sapiens
uauaaagccuguauucucaa

SEQ ID NO: 1947675 - RNA, 17 nt, Homo sapiens
uucccuccugcccagga

SEQ ID NO: 1947676 - RNA, 19 nt, Homo sapiens
agcaggagggacagucuca

SEQ ID NO: 1947677 - RNA, 17 nt, Homo sapiens
gagucggccaccacaga

SEQ ID NO: 1947678 - RNA, 17 nt, Homo sapiens
cagccaggugcugugac

SEQ ID NO: 1947679 - RNA, 17 nt, Homo sapiens
uggcugcucauuccuuc

SEQ ID NO: 1947680 - RNA, 13 nt, Homo sapiens
gaacuuacuguag

SEQ ID NO: 1947681 - RNA, 21 nt, Homo sapiens
gaauuggcaaacuagaauuua

SEQ ID NO: 1947682 - RNA, 17 nt, Homo sapiens
ccuaaaaguucauaaca

SEQ ID NO: 1947683 - RNA, 18 nt, Homo sapiens
uuaaucaagacucuugaa

SEQ ID NO: 1947684 - RNA, 16 nt, Homo sapiens
ccaccauuuaauuuca

SEQ ID NO: 1947685 - RNA, 21 nt, Homo sapiens
uucugucuacuaagugaugcu

SEQ ID NO: 1947686 - RNA, 22 nt, Homo sapiens
gucucuuccuggucugaacucc

SEQ ID NO: 1947687 - RNA, 14 nt, Homo sapiens
gccacuaaaacaca

SEQ ID NO: 1947688 - RNA, 14 nt, Homo sapiens
acagagugugcugc

SEQ ID NO: 1947689 - RNA, 22 nt, Homo sapiens
uguccuuucuagagcacugcca

SEQ ID NO: 1947690 - RNA, 22 nt, Homo sapiens
aagaauuuaaaacgcaugugca

SEQ ID NO: 1947691 - RNA, 19 nt, Homo sapiens
accuggggcacaguccagg

SEQ ID NO: 1947692 - RNA, 19 nt, Homo sapiens
cuaccccgagggcgccaug

SEQ ID NO: 1947693 - RNA, 14 nt, Homo sapiens
cucccagacuugcc

SEQ ID NO: 1947694 - RNA, 20 nt, Homo sapiens
ggugucguccugcaguguga

SEQ ID NO: 1947695 - RNA, 14 nt, Homo sapiens
caguucaagacuua

SEQ ID NO: 1947696 - RNA, 17 nt, Homo sapiens
augaucagcuguuuguc

SEQ ID NO: 1947697 - RNA, 10 nt, Homo sapiens
ugagaugugc

SEQ ID NO: 1947698 - RNA, 15 nt, Homo sapiens
ucaggacugccauug

SEQ ID NO: 1947699 - RNA, 17 nt, Homo sapiens
ucaucauugugcuagcu

SEQ ID NO: 1947700 - RNA, 20 nt, Homo sapiens
ugcccaaacagcuguauuua

SEQ ID NO: 1947701 - RNA, 17 nt, Homo sapiens
agccaguggcaguguau

SEQ ID NO: 1947702 - RNA, 17 nt, Homo sapiens
agugacaagaugcucug

SEQ ID NO: 1947703 - RNA, 20 nt, Homo sapiens
aguugccguggcaacugugg

SEQ ID NO: 1947704 - RNA, 17 nt, Homo sapiens
uuaugcaaauacaauca

SEQ ID NO: 1947705 - RNA, 17 nt, Homo sapiens
aacuaugcaucugagaa

SEQ ID NO: 1947706 - RNA, 14 nt, Homo sapiens
aaacauauuggaau

SEQ ID NO: 1947707 - RNA, 16 nt, Homo sapiens
aagaaaauggaugaca

SEQ ID NO: 1947708 - RNA, 11 nt, Homo sapiens
cuggcuaauaa

SEQ ID NO: 1947709 - RNA, 15 nt, Homo sapiens
agccagcccuuccca

SEQ ID NO: 1947710 - RNA, 13 nt, Homo sapiens
ucuugaggucucu

SEQ ID NO: 1947711 - RNA, 19 nt, Homo sapiens
uuucccuguagauguauca

SEQ ID NO: 1947712 - RNA, 16 nt, Homo sapiens
uagagcugcagggugg

SEQ ID NO: 1947713 - RNA, 21 nt, Homo sapiens
agaauucuucauccuaaauua

SEQ ID NO: 1947714 - RNA, 22 nt, Homo sapiens
acauauauacccacauguacag

SEQ ID NO: 1947715 - RNA, 11 nt, Homo sapiens
gcccugaccuc

SEQ ID NO: 1947716 - RNA, 21 nt, Homo sapiens
gcauaugcagccaaccaagau

SEQ ID NO: 1947717 - RNA, 17 nt, Homo sapiens
agucauggggucccugc

SEQ ID NO: 1947718 - RNA, 16 nt, Homo sapiens
auggcccgacauuucu

SEQ ID NO: 1947719 - RNA, 22 nt, Homo sapiens
caccgauugcaggacacaagca

SEQ ID NO: 1947720 - RNA, 17 nt, Homo sapiens
ugagacagagaagggaa

SEQ ID NO: 1947721 - RNA, 18 nt, Homo sapiens
cccuccacagcuguguga

SEQ ID NO: 1947722 - RNA, 19 nt, Homo sapiens
ucaaauguacagugguccu

SEQ ID NO: 1947723 - RNA, 15 nt, Homo sapiens
ccaggugggagccaa

SEQ ID NO: 1947724 - RNA, 20 nt, Homo sapiens
auucuuucaacuucaucuca

SEQ ID NO: 1947725 - RNA, 14 nt, Homo sapiens
gaauggggugagca

SEQ ID NO: 1947726 - RNA, 16 nt, Homo sapiens
aucucagcuaacauuc

SEQ ID NO: 1947727 - RNA, 17 nt, Homo sapiens
ugaaaaaauagauccaa

SEQ ID NO: 1947728 - RNA, 13 nt, Homo sapiens
gaaccauaugugc

SEQ ID NO: 1947729 - RNA, 21 nt, Homo sapiens
caaccccugaccuaccccagc

SEQ ID NO: 1947730 - RNA, 14 nt, Homo sapiens
agauacaucacugc

SEQ ID NO: 1947731 - RNA, 15 nt, Homo sapiens
acauauggcacaacu

SEQ ID NO: 1947732 - RNA, 17 nt, Homo sapiens
ccaaagcuuucauguaa

SEQ ID NO: 1947733 - RNA, 19 nt, Homo sapiens
auuguuaggaaaugucauc

SEQ ID NO: 1947734 - RNA, 21 nt, Homo sapiens
ucagugcucccucacauguca

SEQ ID NO: 1947735 - RNA, 16 nt, Homo sapiens
acuaaggaaucuuucu

SEQ ID NO: 1947736 - RNA, 15 nt, Homo sapiens
aucaugauggaauuu

SEQ ID NO: 1947737 - RNA, 15 nt, Homo sapiens
ccaaguggacuugga

SEQ ID NO: 1947738 - RNA, 13 nt, Homo sapiens
agauuuccaagaa

SEQ ID NO: 1947739 - RNA, 22 nt, Homo sapiens
guggagaagaucgcauggcaga

SEQ ID NO: 1947740 - RNA, 17 nt, Homo sapiens
gagaaucaacagaucaa

SEQ ID NO: 1947741 - RNA, 15 nt, Homo sapiens
gaccaaaucacccaa

SEQ ID NO: 1947742 - RNA, 22 nt, Homo sapiens
ucccuuuauaaagagugcuaca

SEQ ID NO: 1947743 - RNA, 19 nt, Homo sapiens
gaagccguccaagaacaag

SEQ ID NO: 1947744 - RNA, 20 nt, Homo sapiens
aaggugggcagaucacugga

SEQ ID NO: 1947745 - RNA, 23 nt, Homo sapiens
ccugcuuggguggagaagccauu

SEQ ID NO: 1947746 - RNA, 15 nt, Homo sapiens
aaacaugaguuauuc

SEQ ID NO: 1947747 - RNA, 17 nt, Homo sapiens
cuugcagaguacaugau

SEQ ID NO: 1947748 - RNA, 14 nt, Homo sapiens
uuuaagucagcaaa

SEQ ID NO: 1947749 - RNA, 23 nt, Homo sapiens
caaacaaaacaaaaaccaaacac

SEQ ID NO: 1947750 - RNA, 18 nt, Homo sapiens
agguaaggaauaccuguc

SEQ ID NO: 1947751 - RNA, 18 nt, Homo sapiens
gugcaaaugugcugguca

SEQ ID NO: 1947752 - RNA, 20 nt, Homo sapiens
acuacgugccaggcacuguu

SEQ ID NO: 1947753 - RNA, 19 nt, Homo sapiens
gccccugacuuaacuuuaa

SEQ ID NO: 1947754 - RNA, 14 nt, Homo sapiens
ccuuucauuuacug

SEQ ID NO: 1947755 - RNA, 15 nt, Homo sapiens
gcguccgaagggaaa

SEQ ID NO: 1947756 - RNA, 15 nt, Homo sapiens
uucugcuaaagaaga

SEQ ID NO: 1947757 - RNA, 16 nt, Homo sapiens
cauaucggcucacaaa

SEQ ID NO: 1947758 - RNA, 19 nt, Homo sapiens
cagcauuuccuaccuugug

SEQ ID NO: 1947759 - RNA, 22 nt, Homo sapiens
uuugccauucagucuagcuuuu

SEQ ID NO: 1947760 - RNA, 18 nt, Homo sapiens
ugauuaaucugauuauac

SEQ ID NO: 1947761 - RNA, 20 nt, Homo sapiens
agcuuaggaaagaacaucac

SEQ ID NO: 1947762 - RNA, 21 nt, Homo sapiens
gaaacacugccuuugucuuac

SEQ ID NO: 1947763 - RNA, 17 nt, Homo sapiens
uccccagucccagacaa

SEQ ID NO: 1947764 - RNA, 15 nt, Homo sapiens
cauaaucauggcucu

SEQ ID NO: 1947765 - RNA, 22 nt, Homo sapiens
ugggacagucaccucauggaau

SEQ ID NO: 1947766 - RNA, 19 nt, Homo sapiens
ccugccagugccagggugg

SEQ ID NO: 1947767 - RNA, 18 nt, Homo sapiens
ugauuggccccacugacg

SEQ ID NO: 1947768 - RNA, 22 nt, Homo sapiens
uuccucaagauccugucuugcu

SEQ ID NO: 1947769 - RNA, 19 nt, Homo sapiens
cucuugaguuccucugcag

SEQ ID NO: 1947770 - RNA, 22 nt, Homo sapiens
aaucuguuuccuguguuaguca

SEQ ID NO: 1947771 - RNA, 21 nt, Homo sapiens
aagcagaaaaucuaccaagaa

SEQ ID NO: 1947772 - RNA, 22 nt, Homo sapiens
ccaccuacuuauuucagauuca

SEQ ID NO: 1947773 - RNA, 14 nt, Homo sapiens
uuuuauuuaugaua

SEQ ID NO: 1947774 - RNA, 17 nt, Homo sapiens
gaauggaggagucucaa

SEQ ID NO: 1947775 - RNA, 17 nt, Homo sapiens
cugagaucgugccacug

SEQ ID NO: 1947776 - RNA, 23 nt, Homo sapiens
uauuguugcugaaaacucuaugu

SEQ ID NO: 1947777 - RNA, 22 nt, Homo sapiens
uugcuuucgcuucuacagugca

SEQ ID NO: 1947778 - RNA, 19 nt, Homo sapiens
auuacaggaaguacuggag

SEQ ID NO: 1947779 - RNA, 23 nt, Homo sapiens
accacuuuuuuuuuuuucuuccc

SEQ ID NO: 1947780 - RNA, 9 nt, Homo sapiens
ccugggcug

SEQ ID NO: 1947781 - RNA, 18 nt, Homo sapiens
caagaucacgccauugca

SEQ ID NO: 1947782 - RNA, 23 nt, Homo sapiens
uucagcucccccaggcuguucuc

SEQ ID NO: 1947783 - RNA, 17 nt, Homo sapiens
gguaguccccuguugau

SEQ ID NO: 1947784 - RNA, 20 nt, Homo sapiens
gucuuuccuaaggcugcaag

SEQ ID NO: 1947785 - RNA, 20 nt, Homo sapiens
cuaugauauuccccauuucc

SEQ ID NO: 1947786 - RNA, 13 nt, Homo sapiens
auucagcaugggu

SEQ ID NO: 1947787 - RNA, 23 nt, Homo sapiens
ucccacccacacagcugcccuag

SEQ ID NO: 1947788 - RNA, 12 nt, Homo sapiens
cucaacucccag

SEQ ID NO: 1947789 - RNA, 21 nt, Homo sapiens
aggucuugccugaauccauca

SEQ ID NO: 1947790 - RNA, 15 nt, Homo sapiens
uccuuugaucccaga

SEQ ID NO: 1947791 - RNA, 22 nt, Homo sapiens
aggaacauccggaacagccaaa

SEQ ID NO: 1947792 - RNA, 23 nt, Homo sapiens
gaaaguccaauuccaaagccaga

SEQ ID NO: 1947793 - RNA, 21 nt, Homo sapiens
ucugccuuuggggacuuuucu

SEQ ID NO: 1947794 - RNA, 23 nt, Homo sapiens
aauaaaccauuggacagauuuca

SEQ ID NO: 1947795 - RNA, 19 nt, Homo sapiens
auagaaaugcauaccagua

SEQ ID NO: 1947796 - RNA, 19 nt, Homo sapiens
uucagauuccccacucagc

SEQ ID NO: 1947797 - RNA, 17 nt, Homo sapiens
uagccauaccaggguga

SEQ ID NO: 1947798 - RNA, 12 nt, Homo sapiens
gauaucuuggcu

SEQ ID NO: 1947799 - RNA, 17 nt, Homo sapiens
ugugcacacauuaggca

SEQ ID NO: 1947800 - RNA, 13 nt, Homo sapiens
ugucccucugccc

SEQ ID NO: 1947801 - RNA, 17 nt, Homo sapiens
auaaagauuucaagauc

SEQ ID NO: 1947802 - RNA, 23 nt, Homo sapiens
auaauagguuugugacuuuccua

SEQ ID NO: 1947803 - RNA, 16 nt, Homo sapiens
uucuaauuggcaugaa

SEQ ID NO: 1947804 - RNA, 13 nt, Homo sapiens
gaucacagguuau

SEQ ID NO: 1947805 - RNA, 12 nt, Homo sapiens
aauccucuaugu

SEQ ID NO: 1947806 - RNA, 24 nt, Homo sapiens
aauacaggaguuuucacuuucuuu

SEQ ID NO: 1947807 - RNA, 13 nt, Homo sapiens
auagauguugcua

SEQ ID NO: 1947808 - RNA, 16 nt, Homo sapiens
caauuuauuacugaaa

SEQ ID NO: 1947809 - RNA, 15 nt, Homo sapiens
cggcagugugcagug

SEQ ID NO: 1947810 - RNA, 18 nt, Homo sapiens
caaaagcaauuguauuac

SEQ ID NO: 1947811 - RNA, 12 nt, Homo sapiens
cagcaugaauaa

SEQ ID NO: 1947812 - RNA, 23 nt, Homo sapiens
aggaagugcccucgagcacugaa

SEQ ID NO: 1947813 - RNA, 17 nt, Homo sapiens
ucgaugcagugcuucca

SEQ ID NO: 1947814 - RNA, 12 nt, Homo sapiens
aauuuauacuua

SEQ ID NO: 1947815 - RNA, 22 nt, Homo sapiens
acuccgcaaauauccuccacuu

SEQ ID NO: 1947816 - RNA, 20 nt, Homo sapiens
cuggccaucccuucauuuaa

SEQ ID NO: 1947817 - RNA, 14 nt, Homo sapiens
aguauacaguccua

SEQ ID NO: 1947818 - RNA, 15 nt, Homo sapiens
uaaauagaccucuca

SEQ ID NO: 1947819 - RNA, 20 nt, Homo sapiens
agcuucucuacagacuccaa

SEQ ID NO: 1947820 - RNA, 19 nt, Homo sapiens
uuuaaauuacacacacucu

SEQ ID NO: 1947821 - RNA, 15 nt, Homo sapiens
aaguauuuugaugaa

SEQ ID NO: 1947822 - RNA, 20 nt, Homo sapiens
uuagucgugagcucuuguga

SEQ ID NO: 1947823 - RNA, 19 nt, Homo sapiens
auuaauacucugcagugau

SEQ ID NO: 1947824 - RNA, 16 nt, Homo sapiens
uauaaagaccuauaaa

SEQ ID NO: 1947825 - RNA, 13 nt, Homo sapiens
uacaugucuagag

SEQ ID NO: 1947826 - RNA, 11 nt, Homo sapiens
cacugaccuca

SEQ ID NO: 1947827 - RNA, 15 nt, Homo sapiens
ccuacccacuggucu

SEQ ID NO: 1947828 - RNA, 14 nt, Homo sapiens
uucaacaucacuga

SEQ ID NO: 1947829 - RNA, 14 nt, Homo sapiens
agccaaacucugcc

SEQ ID NO: 1947830 - RNA, 22 nt, Homo sapiens
ccuuacagaacacgcuuucaca

SEQ ID NO: 1947831 - RNA, 22 nt, Homo sapiens
uuuggcccugaaccagggccag

SEQ ID NO: 1947832 - RNA, 15 nt, Homo sapiens
uucaugaucaucaca

SEQ ID NO: 1947833 - RNA, 11 nt, Homo sapiens
caguccagcuu

SEQ ID NO: 1947834 - RNA, 16 nt, Homo sapiens
gaucugucuuguaaua

SEQ ID NO: 1947835 - RNA, 15 nt, Homo sapiens
aggugccacacugaa

SEQ ID NO: 1947836 - RNA, 20 nt, Homo sapiens
ucccaccucugugaccucag

SEQ ID NO: 1947837 - RNA, 22 nt, Homo sapiens
ccucucccauggugcccgugcc

SEQ ID NO: 1947838 - RNA, 15 nt, Homo sapiens
uuucaguguugacac

SEQ ID NO: 1947839 - RNA, 20 nt, Homo sapiens
cagaggcauccggaucccag

SEQ ID NO: 1947840 - RNA, 15 nt, Homo sapiens
uuucuguacaacuac

SEQ ID NO: 1947841 - RNA, 19 nt, Homo sapiens
uggugcaguaaccauuuaa

SEQ ID NO: 1947842 - RNA, 17 nt, Homo sapiens
ccacuggguuuggcaaa

SEQ ID NO: 1947843 - RNA, 16 nt, Homo sapiens
aggugaccucacagua

SEQ ID NO: 1947844 - RNA, 18 nt, Homo sapiens
auuaaauuaccuugccaa

SEQ ID NO: 1947845 - RNA, 18 nt, Homo sapiens
caauaaaccagugugaac

SEQ ID NO: 1947846 - RNA, 16 nt, Homo sapiens
ccagccccugguggug

SEQ ID NO: 1947847 - RNA, 19 nt, Homo sapiens
ggauaggcuuuauucugca

SEQ ID NO: 1947848 - RNA, 16 nt, Homo sapiens
ugcagaagucccaaga

SEQ ID NO: 1947849 - RNA, 22 nt, Homo sapiens
uugcugcuucaauuuauaccuc

SEQ ID NO: 1947850 - RNA, 23 nt, Homo sapiens
gaagaccuccacauuaaguggcu

SEQ ID NO: 1947851 - RNA, 15 nt, Homo sapiens
aacccuuaucuguaa

SEQ ID NO: 1947852 - RNA, 18 nt, Homo sapiens
cucaggccuaggugcgca

SEQ ID NO: 1947853 - RNA, 22 nt, Homo sapiens
ugagagaaagagagaagccagc

SEQ ID NO: 1947854 - RNA, 18 nt, Homo sapiens
cuggaaccaggcuugccu

SEQ ID NO: 1947855 - RNA, 14 nt, Homo sapiens
guggaacucaguca

SEQ ID NO: 1947856 - RNA, 17 nt, Homo sapiens
cuuaggugugaggucca

SEQ ID NO: 1947857 - RNA, 14 nt, Homo sapiens
cuguaauuccagcu

SEQ ID NO: 1947858 - RNA, 17 nt, Homo sapiens
aauauaccuucagagac

SEQ ID NO: 1947859 - RNA, 21 nt, Homo sapiens
agaagcaacacuuugugaucu

SEQ ID NO: 1947860 - RNA, 20 nt, Homo sapiens
augccuuucucucuuucucu

SEQ ID NO: 1947861 - RNA, 16 nt, Homo sapiens
cagggucuugcuguaa

SEQ ID NO: 1947862 - RNA, 13 nt, Homo sapiens
aggcaaaggcccc

SEQ ID NO: 1947863 - RNA, 17 nt, Homo sapiens
cuguuuuuuuugcugcu

SEQ ID NO: 1947864 - RNA, 22 nt, Homo sapiens
cagcuggagaaaaaacauugcc

SEQ ID NO: 1947865 - RNA, 22 nt, Homo sapiens
agcuuuuuuuuuuuuuccuguu

SEQ ID NO: 1947866 - RNA, 15 nt, Homo sapiens
cucuggaggccugug

SEQ ID NO: 1947867 - RNA, 18 nt, Homo sapiens
auaguaugaaaauggaaa

SEQ ID NO: 1947868 - RNA, 18 nt, Homo sapiens
aacuuacauuuaaaagac

SEQ ID NO: 1947869 - RNA, 17 nt, Homo sapiens
uauuauauuuggaugca

SEQ ID NO: 1947870 - RNA, 14 nt, Homo sapiens
caguggcuuugcau

SEQ ID NO: 1947871 - RNA, 14 nt, Homo sapiens
aagcagccuccuua

SEQ ID NO: 1947872 - RNA, 16 nt, Homo sapiens
ugagaugccuguugaa

SEQ ID NO: 1947873 - RNA, 21 nt, Homo sapiens
uggccugugccagcaccacag

SEQ ID NO: 1947874 - RNA, 21 nt, Homo sapiens
auauuggagggaaaucuuggu

SEQ ID NO: 1947875 - RNA, 18 nt, Homo sapiens
cugaguauaguauuuaac

SEQ ID NO: 1947876 - RNA, 17 nt, Homo sapiens
ucaguauuuaauaucug

SEQ ID NO: 1947877 - RNA, 14 nt, Homo sapiens
gcacaugaacuguc

SEQ ID NO: 1947878 - RNA, 22 nt, Homo sapiens
uuuccugugucaauccagaugg

SEQ ID NO: 1947879 - RNA, 20 nt, Homo sapiens
guauuaauaguucaguguau

SEQ ID NO: 1947880 - RNA, 21 nt, Homo sapiens
acauucaaggcauuucuauca

SEQ ID NO: 1947881 - RNA, 12 nt, Homo sapiens
ccugagugaucc

SEQ ID NO: 1947882 - RNA, 18 nt, Homo sapiens
uccauccaaacucagaag

SEQ ID NO: 1947883 - RNA, 15 nt, Homo sapiens
ugaaagaacaucagu

SEQ ID NO: 1947884 - RNA, 14 nt, Homo sapiens
aaggucuugccuga

SEQ ID NO: 1947885 - RNA, 15 nt, Homo sapiens
uaucugccagucucu

SEQ ID NO: 1947886 - RNA, 15 nt, Homo sapiens
agucccccacccacc

SEQ ID NO: 1947887 - RNA, 14 nt, Homo sapiens
ggccaagaugcuaa

SEQ ID NO: 1947888 - RNA, 14 nt, Homo sapiens
uuccaagagucuaa

SEQ ID NO: 1947889 - RNA, 12 nt, Homo sapiens
ucgcgcuggaau

SEQ ID NO: 1947890 - RNA, 17 nt, Homo sapiens
uugauuuuauaugcuau

SEQ ID NO: 1947891 - RNA, 17 nt, Homo sapiens
uuuccugguccaucuca

SEQ ID NO: 1947892 - RNA, 11 nt, Homo sapiens
uucaacuggag

SEQ ID NO: 1947893 - RNA, 18 nt, Homo sapiens
caaaagccauguauuuca

SEQ ID NO: 1947894 - RNA, 16 nt, Homo sapiens
uauaaaguaauuguau

SEQ ID NO: 1947895 - RNA, 13 nt, Homo sapiens
aucccuacuguaa

SEQ ID NO: 1947896 - RNA, 16 nt, Homo sapiens
cucauaaacugccaag

SEQ ID NO: 1947897 - RNA, 20 nt, Homo sapiens
auaaaacuuuucugcugaua

SEQ ID NO: 1947898 - RNA, 20 nt, Homo sapiens
ccuccaugaacaucauggac

SEQ ID NO: 1947899 - RNA, 12 nt, Homo sapiens
gugccaguuccu

SEQ ID NO: 1947900 - RNA, 10 nt, Homo sapiens
auuuccuugu

SEQ ID NO: 1947901 - RNA, 21 nt, Homo sapiens
accaaccuguuucuaccuaua

SEQ ID NO: 1947902 - RNA, 16 nt, Homo sapiens
gcagagccaccagggc

SEQ ID NO: 1947903 - RNA, 20 nt, Homo sapiens
uucaccaugagggaagaaua

SEQ ID NO: 1947904 - RNA, 14 nt, Homo sapiens
ugcuaugcaaaaaa

SEQ ID NO: 1947905 - RNA, 18 nt, Homo sapiens
aaguaauuguaugugcuu

SEQ ID NO: 1947906 - RNA, 19 nt, Homo sapiens
gcgcuggucgucaccuggg

SEQ ID NO: 1947907 - RNA, 17 nt, Homo sapiens
aaguuauuucaugcgca

SEQ ID NO: 1947908 - RNA, 21 nt, Homo sapiens
acgguuaagaaagcacuuaaa

SEQ ID NO: 1947909 - RNA, 20 nt, Homo sapiens
uuauaaacccacauucuuac

SEQ ID NO: 1947910 - RNA, 21 nt, Homo sapiens
ugaaaaauucccucuuuccau

SEQ ID NO: 1947911 - RNA, 21 nt, Homo sapiens
aauguuuaaauucucuuucac

SEQ ID NO: 1947912 - RNA, 18 nt, Homo sapiens
agucugcuuugguacuaa

SEQ ID NO: 1947913 - RNA, 20 nt, Homo sapiens
acgccagcuccucucugaag

SEQ ID NO: 1947914 - RNA, 19 nt, Homo sapiens
ggacgaggaguaauggcau

SEQ ID NO: 1947915 - RNA, 14 nt, Homo sapiens
uugagcgacaucuc

SEQ ID NO: 1947916 - RNA, 16 nt, Homo sapiens
agucacugaacaaaac

SEQ ID NO: 1947917 - RNA, 20 nt, Homo sapiens
ugcccaggcuggagugcaau

SEQ ID NO: 1947918 - RNA, 20 nt, Homo sapiens
ugcccaggcuagagugcagu

SEQ ID NO: 1947919 - RNA, 20 nt, Homo sapiens
caagcucucgggacuagcug

SEQ ID NO: 1947920 - RNA, 19 nt, Homo sapiens
uguacaaaaguuucauccu

SEQ ID NO: 1947921 - RNA, 21 nt, Homo sapiens
cuccgaauaaacgugcucccc

SEQ ID NO: 1947922 - RNA, 21 nt, Homo sapiens
ggagccuccucugcuugcauc

SEQ ID NO: 1947923 - RNA, 21 nt, Homo sapiens
aacucccuuucaacagaauuc

SEQ ID NO: 1947924 - RNA, 18 nt, Homo sapiens
ccacuggggaaugcuccc

SEQ ID NO: 1947925 - RNA, 16 nt, Homo sapiens
auuugagcaugcacag

SEQ ID NO: 1947926 - RNA, 15 nt, Homo sapiens
uugcucacucaggac

SEQ ID NO: 1947927 - RNA, 20 nt, Homo sapiens
cagguuccuuaucugucaca

SEQ ID NO: 1947928 - RNA, 18 nt, Homo sapiens
gcagauguuuaaugaagu

SEQ ID NO: 1947929 - RNA, 17 nt, Homo sapiens
uguugauacguguguga

SEQ ID NO: 1947930 - RNA, 23 nt, Homo sapiens
ugugugaaaggaagcuccacugu

SEQ ID NO: 1947931 - RNA, 17 nt, Homo sapiens
gaggcccaggcugggaa

SEQ ID NO: 1947932 - RNA, 20 nt, Homo sapiens
uaagucuuuaaugccgauau

SEQ ID NO: 1947933 - RNA, 14 nt, Homo sapiens
aaaugacacuacuu

SEQ ID NO: 1947934 - RNA, 19 nt, Homo sapiens
uucaaagggaaacuuuaau

SEQ ID NO: 1947935 - RNA, 16 nt, Homo sapiens
uuuaugguuaauacua

SEQ ID NO: 1947936 - RNA, 14 nt, Homo sapiens
uacacuccaggugu

SEQ ID NO: 1947937 - RNA, 13 nt, Homo sapiens
uuugguugcuuua

SEQ ID NO: 1947938 - RNA, 20 nt, Homo sapiens
agaguugguggagaacagaa

SEQ ID NO: 1947939 - RNA, 21 nt, Homo sapiens
cuuuccagccuauagcagaag

SEQ ID NO: 1947940 - RNA, 20 nt, Homo sapiens
ggcuggagugcaguggugca

SEQ ID NO: 1947941 - RNA, 20 nt, Homo sapiens
ggcuagagugcaauggugca

SEQ ID NO: 1947942 - RNA, 13 nt, Homo sapiens
gauaaaagcagua

SEQ ID NO: 1947943 - RNA, 16 nt, Homo sapiens
gagccccccuagcaau

SEQ ID NO: 1947944 - RNA, 15 nt, Homo sapiens
cauauuggacugaua

SEQ ID NO: 1947945 - RNA, 14 nt, Homo sapiens
uccuugauggcugg

SEQ ID NO: 1947946 - RNA, 22 nt, Homo sapiens
uguguaggcaccaccucuguca

SEQ ID NO: 1947947 - RNA, 18 nt, Homo sapiens
caaaagguuaauggaugg

SEQ ID NO: 1947948 - RNA, 12 nt, Homo sapiens
ugaauagcacag

SEQ ID NO: 1947949 - RNA, 17 nt, Homo sapiens
ccagggauuugccucac

SEQ ID NO: 1947950 - RNA, 21 nt, Homo sapiens
gugcauauuaauucaugcaaa

SEQ ID NO: 1947951 - RNA, 20 nt, Homo sapiens
aagaaccccagaccucugaa

SEQ ID NO: 1947952 - RNA, 20 nt, Homo sapiens
cagaacuggaccaucuccaa

SEQ ID NO: 1947953 - RNA, 15 nt, Homo sapiens
cacgauuggagaaua

SEQ ID NO: 1947954 - RNA, 14 nt, Homo sapiens
uggacccugaccag

SEQ ID NO: 1947955 - RNA, 14 nt, Homo sapiens
cuagcccugggaca

SEQ ID NO: 1947956 - RNA, 14 nt, Homo sapiens
agcugccucugcuc

SEQ ID NO: 1947957 - RNA, 15 nt, Homo sapiens
agauucccaagccaa

SEQ ID NO: 1947958 - RNA, 14 nt, Homo sapiens
ccuuguacucuuag

SEQ ID NO: 1947959 - RNA, 18 nt, Homo sapiens
ucuguccuaaucauauac

SEQ ID NO: 1947960 - RNA, 17 nt, Homo sapiens
gaacuaccuaauuuuca

SEQ ID NO: 1947961 - RNA, 13 nt, Homo sapiens
ccugccucaggcc

SEQ ID NO: 1947962 - RNA, 12 nt, Homo sapiens
aaauguuucuca

SEQ ID NO: 1947963 - RNA, 15 nt, Homo sapiens
ucuuacauugccaag

SEQ ID NO: 1947964 - RNA, 16 nt, Homo sapiens
ucaugauuucauuuca

SEQ ID NO: 1947965 - RNA, 21 nt, Homo sapiens
acaucucucuggcuucugaag

SEQ ID NO: 1947966 - RNA, 14 nt, Homo sapiens
uaccauucucaggu

SEQ ID NO: 1947967 - RNA, 20 nt, Homo sapiens
cacuucagaaauauaugcag

SEQ ID NO: 1947968 - RNA, 13 nt, Homo sapiens
gcagaacagugag

SEQ ID NO: 1947969 - RNA, 24 nt, Homo sapiens
aauuuucugaucucagagcauuuc

SEQ ID NO: 1947970 - RNA, 22 nt, Homo sapiens
agugccucugauucuauguaac

SEQ ID NO: 1947971 - RNA, 17 nt, Homo sapiens
agcccugggaucacugu

SEQ ID NO: 1947972 - RNA, 21 nt, Homo sapiens
caauucugauguuacugagau

SEQ ID NO: 1947973 - RNA, 13 nt, Homo sapiens
aaugaaaacaguc

SEQ ID NO: 1947974 - RNA, 14 nt, Homo sapiens
ugccaacuauucuc

SEQ ID NO: 1947975 - RNA, 14 nt, Homo sapiens
cugaaaaccucucc

SEQ ID NO: 1947976 - RNA, 14 nt, Homo sapiens
caguuucaaaaacu

SEQ ID NO: 1947977 - RNA, 14 nt, Homo sapiens
auguuccacuaacc

SEQ ID NO: 1947978 - RNA, 19 nt, Homo sapiens
augcacuucuuacaauaau

SEQ ID NO: 1947979 - RNA, 22 nt, Homo sapiens
aagcaaaaaguuguuuuaucca

SEQ ID NO: 1947980 - RNA, 13 nt, Homo sapiens
cccacauucuaua

SEQ ID NO: 1947981 - RNA, 14 nt, Homo sapiens
agguuuacagugaa

SEQ ID NO: 1947982 - RNA, 15 nt, Homo sapiens
gcgugcacaucugcu

SEQ ID NO: 1947983 - RNA, 21 nt, Homo sapiens
aaauaagucagguucuuuaca

SEQ ID NO: 1947984 - RNA, 16 nt, Homo sapiens
uagacuuauugccaaa

SEQ ID NO: 1947985 - RNA, 16 nt, Homo sapiens
uagcaaauuugaauuu

SEQ ID NO: 1947986 - RNA, 20 nt, Homo sapiens
acccauauguuaaaauucuc

SEQ ID NO: 1947987 - RNA, 18 nt, Homo sapiens
cccgugggagucaucuca

SEQ ID NO: 1947988 - RNA, 15 nt, Homo sapiens
caccagaaugcuaaa

SEQ ID NO: 1947989 - RNA, 17 nt, Homo sapiens
agcccagaaaaccucca

SEQ ID NO: 1947990 - RNA, 19 nt, Homo sapiens
gggugggauccacacugag

SEQ ID NO: 1947991 - RNA, 15 nt, Homo sapiens
caagaacucuaacca

SEQ ID NO: 1947992 - RNA, 23 nt, Homo sapiens
guacucaggcagugcaguacuca

SEQ ID NO: 1947993 - RNA, 22 nt, Homo sapiens
uuuucuuuauugcuuacugugu

SEQ ID NO: 1947994 - RNA, 15 nt, Homo sapiens
cuuccuguccagaga

SEQ ID NO: 1947995 - RNA, 11 nt, Homo sapiens
caucugaccau

SEQ ID NO: 1947996 - RNA, 17 nt, Homo sapiens
aguguagcuaccuacau

SEQ ID NO: 1947997 - RNA, 20 nt, Homo sapiens
uuggacagaaaaugcaauga

SEQ ID NO: 1947998 - RNA, 21 nt, Homo sapiens
ugaauacaaagaaccaagaaa

SEQ ID NO: 1947999 - RNA, 12 nt, Homo sapiens
agguagcacagc

SEQ ID NO: 1948000 - RNA, 15 nt, Homo sapiens
aaucaaccagcagga

SEQ ID NO: 1948001 - RNA, 19 nt, Homo sapiens
cccugaugugacauuccau

SEQ ID NO: 1948002 - RNA, 14 nt, Homo sapiens
auuuauaggaggaa

SEQ ID NO: 1948003 - RNA, 14 nt, Homo sapiens
accaccaucaccac

SEQ ID NO: 1948004 - RNA, 14 nt, Homo sapiens
acucuuucuuucaa

SEQ ID NO: 1948005 - RNA, 20 nt, Homo sapiens
ugacuuugcuugcuuugaag

SEQ ID NO: 1948006 - RNA, 15 nt, Homo sapiens
auaauaauugaucaa

SEQ ID NO: 1948007 - RNA, 12 nt, Homo sapiens
aguauuaacucu

SEQ ID NO: 1948008 - RNA, 18 nt, Homo sapiens
ugcaagcgacgacagaug

SEQ ID NO: 1948009 - RNA, 21 nt, Homo sapiens
gggaaaggauauuuucuucca

SEQ ID NO: 1948010 - RNA, 17 nt, Homo sapiens
accuaucaauccugccc

SEQ ID NO: 1948011 - RNA, 17 nt, Homo sapiens
gcacuuugggaggccaa

SEQ ID NO: 1948012 - RNA, 22 nt, Homo sapiens
aaagauugagaaguuacuuucc

SEQ ID NO: 1948013 - RNA, 11 nt, Homo sapiens
aggaagcccac

SEQ ID NO: 1948014 - RNA, 19 nt, Homo sapiens
aacaaccuuuucucuggac

SEQ ID NO: 1948015 - RNA, 17 nt, Homo sapiens
ucgucuuuacuuccauc

SEQ ID NO: 1948016 - RNA, 15 nt, Homo sapiens
uguccuugcacacuc

SEQ ID NO: 1948017 - RNA, 17 nt, Homo sapiens
caugaagaggaugcugu

SEQ ID NO: 1948018 - RNA, 17 nt, Homo sapiens
cugcauuucacucuggg

SEQ ID NO: 1948019 - RNA, 16 nt, Homo sapiens
ucuggaguauucuaua

SEQ ID NO: 1948020 - RNA, 15 nt, Homo sapiens
gcacacucagcaccc

SEQ ID NO: 1948021 - RNA, 22 nt, Homo sapiens
agugggcauggagccagugccu

SEQ ID NO: 1948022 - RNA, 15 nt, Homo sapiens
aaauagacaaaaagu

SEQ ID NO: 1948023 - RNA, 15 nt, Homo sapiens
aaaugaacaaaagau

SEQ ID NO: 1948024 - RNA, 14 nt, Homo sapiens
uugcugugaaauuu

SEQ ID NO: 1948025 - RNA, 16 nt, Homo sapiens
uauuucagaacuuuga

SEQ ID NO: 1948026 - RNA, 12 nt, Homo sapiens
gcugcucauggg

SEQ ID NO: 1948027 - RNA, 13 nt, Homo sapiens
cccgaaugcauuu

SEQ ID NO: 1948028 - RNA, 14 nt, Homo sapiens
gcacugaggugccg

SEQ ID NO: 1948029 - RNA, 19 nt, Homo sapiens
uuauauauuaugucauuca

SEQ ID NO: 1948030 - RNA, 17 nt, Homo sapiens
uaacuguaaacuuggaa

SEQ ID NO: 1948031 - RNA, 22 nt, Homo sapiens
uaucugcacucuaaacugcaaa

SEQ ID NO: 1948032 - RNA, 23 nt, Homo sapiens
cagaacacauuucucugaucucc

SEQ ID NO: 1948033 - RNA, 23 nt, Homo sapiens
gcaaagaacucauuugaaugcuu

SEQ ID NO: 1948034 - RNA, 22 nt, Homo sapiens
acaaauagcauacaccaaacau

SEQ ID NO: 1948035 - RNA, 17 nt, Homo sapiens
auacaucaagccaauac

SEQ ID NO: 1948036 - RNA, 15 nt, Homo sapiens
accuaaauuucugcc

SEQ ID NO: 1948037 - RNA, 18 nt, Homo sapiens
aaguucacucagagggaa

SEQ ID NO: 1948038 - RNA, 14 nt, Homo sapiens
ccuuaaacugccaa

SEQ ID NO: 1948039 - RNA, 14 nt, Homo sapiens
cagcuccuugaggg

SEQ ID NO: 1948040 - RNA, 20 nt, Homo sapiens
cugugucaggaaacauauuu

SEQ ID NO: 1948041 - RNA, 11 nt, Homo sapiens
aaaacauaugc

SEQ ID NO: 1948042 - RNA, 15 nt, Homo sapiens
aagaaagacuuauca

SEQ ID NO: 1948043 - RNA, 20 nt, Homo sapiens
uccuaguaauaaagugaaau

SEQ ID NO: 1948044 - RNA, 14 nt, Homo sapiens
agucagagacagau

SEQ ID NO: 1948045 - RNA, 12 nt, Homo sapiens
cuggucaccucc

SEQ ID NO: 1948046 - RNA, 22 nt, Homo sapiens
ccaacccuucuucauguucaau

SEQ ID NO: 1948047 - RNA, 20 nt, Homo sapiens
ucauaauucuaaucuaacaa

SEQ ID NO: 1948048 - RNA, 24 nt, Homo sapiens
cuccuuucaccacaugugcacaug

SEQ ID NO: 1948049 - RNA, 22 nt, Homo sapiens
aacaauuuucagauuugcacaa

SEQ ID NO: 1948050 - RNA, 14 nt, Homo sapiens
acuccuuccagcua

SEQ ID NO: 1948051 - RNA, 18 nt, Homo sapiens
cagaagaauauucaggac

SEQ ID NO: 1948052 - RNA, 14 nt, Homo sapiens
guacggacuuccuu

SEQ ID NO: 1948053 - RNA, 23 nt, Homo sapiens
gaaaggcuguuaaauacaggaaa

SEQ ID NO: 1948054 - RNA, 19 nt, Homo sapiens
accugcccugacaugcaca

SEQ ID NO: 1948055 - RNA, 20 nt, Homo sapiens
aaaacaguccuucaaacuuc

SEQ ID NO: 1948056 - RNA, 13 nt, Homo sapiens
gucccuugccucu

SEQ ID NO: 1948057 - RNA, 23 nt, Homo sapiens
guuggcccagaccucaggugcua

SEQ ID NO: 1948058 - RNA, 22 nt, Homo sapiens
agucagacuucagacuuucaag

SEQ ID NO: 1948059 - RNA, 20 nt, Homo sapiens
caccuacaaaauuucaccug

SEQ ID NO: 1948060 - RNA, 18 nt, Homo sapiens
cucucugggauuuaccag

SEQ ID NO: 1948061 - RNA, 15 nt, Homo sapiens
aacaaaacagccucu

SEQ ID NO: 1948062 - RNA, 16 nt, Homo sapiens
caaguccucacucuuc

SEQ ID NO: 1948063 - RNA, 20 nt, Homo sapiens
gcucuuaugugugccuuugu

SEQ ID NO: 1948064 - RNA, 20 nt, Homo sapiens
auaucagauucuuggcugca

SEQ ID NO: 1948065 - RNA, 12 nt, Homo sapiens
auaucaaaaagg

SEQ ID NO: 1948066 - RNA, 19 nt, Homo sapiens
uaaaaaagacgggauuuua

SEQ ID NO: 1948067 - RNA, 17 nt, Homo sapiens
auuaagcccucuuccau

SEQ ID NO: 1948068 - RNA, 21 nt, Homo sapiens
gaccuccugagcgaugacuca

SEQ ID NO: 1948069 - RNA, 14 nt, Homo sapiens
uuaacauaccuaag

SEQ ID NO: 1948070 - RNA, 19 nt, Homo sapiens
cugucagcuccuugaccua

SEQ ID NO: 1948071 - RNA, 17 nt, Homo sapiens
uuucagugcacuaaugu

SEQ ID NO: 1948072 - RNA, 14 nt, Homo sapiens
aaagcucacuucaa

SEQ ID NO: 1948073 - RNA, 19 nt, Homo sapiens
ugaaucaaggaaagccagg

SEQ ID NO: 1948074 - RNA, 15 nt, Homo sapiens
cccugccagccugaa

SEQ ID NO: 1948075 - RNA, 22 nt, Homo sapiens
agauguagccccucuccuggaa

SEQ ID NO: 1948076 - RNA, 18 nt, Homo sapiens
gauugaaaauaaugcugu

SEQ ID NO: 1948077 - RNA, 20 nt, Homo sapiens
aggugcuguccccacugccc

SEQ ID NO: 1948078 - RNA, 21 nt, Homo sapiens
agccuccugagggcuccaugc

SEQ ID NO: 1948079 - RNA, 22 nt, Homo sapiens
uccccuguucaaagaugcauuu

SEQ ID NO: 1948080 - RNA, 17 nt, Homo sapiens
aaggcuagaucaugaag

SEQ ID NO: 1948081 - RNA, 14 nt, Homo sapiens
ccagucagcaggag

SEQ ID NO: 1948082 - RNA, 19 nt, Homo sapiens
caagguggacaucuucacg

SEQ ID NO: 1948083 - RNA, 17 nt, Homo sapiens
gaaaaaauaauauccau

SEQ ID NO: 1948084 - RNA, 22 nt, Homo sapiens
aggcuaaaacaccuuggcuugu

SEQ ID NO: 1948085 - RNA, 17 nt, Homo sapiens
cugacagaggugucauc

SEQ ID NO: 1948086 - RNA, 21 nt, Homo sapiens
ggugcaagcacucgggguccc

SEQ ID NO: 1948087 - RNA, 17 nt, Homo sapiens
ugcugacuacuacucug

SEQ ID NO: 1948088 - RNA, 21 nt, Homo sapiens
uuaggugucuguccuuuauga

SEQ ID NO: 1948089 - RNA, 20 nt, Homo sapiens
uucucuugccauuuguagcu

SEQ ID NO: 1948090 - RNA, 14 nt, Homo sapiens
uuacugaccagcaa

SEQ ID NO: 1948091 - RNA, 18 nt, Homo sapiens
cugaaaaaauacuaccua

SEQ ID NO: 1948092 - RNA, 21 nt, Homo sapiens
ugcccaaggagcccccugaga

SEQ ID NO: 1948093 - RNA, 19 nt, Homo sapiens
aaaaucucuccacuuucag

SEQ ID NO: 1948094 - RNA, 21 nt, Homo sapiens
aagcuuuuuauuccuccugcu

SEQ ID NO: 1948095 - RNA, 17 nt, Homo sapiens
cccuuggucuguacaaa

SEQ ID NO: 1948096 - RNA, 17 nt, Homo sapiens
cugugcaguagccguuu

SEQ ID NO: 1948097 - RNA, 14 nt, Homo sapiens
uacuuuucugccaa

SEQ ID NO: 1948098 - RNA, 18 nt, Homo sapiens
uaacaagauuuguaauua

SEQ ID NO: 1948099 - RNA, 14 nt, Homo sapiens
cuuuaaacaccccc

SEQ ID NO: 1948100 - RNA, 16 nt, Homo sapiens
cuucagaguaucuaau

SEQ ID NO: 1948101 - RNA, 17 nt, Homo sapiens
aaaguguaccaacauaa

SEQ ID NO: 1948102 - RNA, 18 nt, Homo sapiens
uuaaauggcauaccaaaa

SEQ ID NO: 1948103 - RNA, 13 nt, Homo sapiens
augaucugucaaa

SEQ ID NO: 1948104 - RNA, 18 nt, Homo sapiens
gcaaaucacaacauucug

SEQ ID NO: 1948105 - RNA, 15 nt, Homo sapiens
aagcuagaaccugga

SEQ ID NO: 1948106 - RNA, 20 nt, Homo sapiens
auugagcagaagaucaagga

SEQ ID NO: 1948107 - RNA, 15 nt, Homo sapiens
cccugacauuuaguu

SEQ ID NO: 1948108 - RNA, 21 nt, Homo sapiens
caccagccauacuuaucucuc

SEQ ID NO: 1948109 - RNA, 21 nt, Homo sapiens
aacagagcaagacuccaucuc

SEQ ID NO: 1948110 - RNA, 19 nt, Homo sapiens
ugagggagccuggccccau

SEQ ID NO: 1948111 - RNA, 22 nt, Homo sapiens
gagaccuuugauuuuuugccca

SEQ ID NO: 1948112 - RNA, 18 nt, Homo sapiens
cucuucaauauuugugua

SEQ ID NO: 1948113 - RNA, 17 nt, Homo sapiens
auuuaagugcagucauu

SEQ ID NO: 1948114 - RNA, 12 nt, Homo sapiens
uuaauauacugc

SEQ ID NO: 1948115 - RNA, 20 nt, Homo sapiens
aauaucaaauaaaauaucau

SEQ ID NO: 1948116 - RNA, 19 nt, Homo sapiens
aguuuguggcaucuugcca

SEQ ID NO: 1948117 - RNA, 12 nt, Homo sapiens
gaaagcuuucau

SEQ ID NO: 1948118 - RNA, 14 nt, Homo sapiens
ccaagaugagcugc

SEQ ID NO: 1948119 - RNA, 15 nt, Homo sapiens
aaacagaaaggugca

SEQ ID NO: 1948120 - RNA, 19 nt, Homo sapiens
uauagcugcuuuugaugaa

SEQ ID NO: 1948121 - RNA, 22 nt, Homo sapiens
gcagacuugaccccgacgccac

SEQ ID NO: 1948122 - RNA, 20 nt, Homo sapiens
gauauuaaaaguuaagcaaa

SEQ ID NO: 1948123 - RNA, 20 nt, Homo sapiens
auauguccgcagaauggacu

SEQ ID NO: 1948124 - RNA, 22 nt, Homo sapiens
uaugcaauaaaauuauuugcag

SEQ ID NO: 1948125 - RNA, 22 nt, Homo sapiens
auccuuuaagaaaaacaucugg

SEQ ID NO: 1948126 - RNA, 20 nt, Homo sapiens
aguauauuuaagaagccaag

SEQ ID NO: 1948127 - RNA, 16 nt, Homo sapiens
uuugaaagcuguauaa

SEQ ID NO: 1948128 - RNA, 18 nt, Homo sapiens
uucaucuugcaagcaaau

SEQ ID NO: 1948129 - RNA, 16 nt, Homo sapiens
acccaggcccagcuga

SEQ ID NO: 1948130 - RNA, 22 nt, Homo sapiens
uccucuacucacagcugaagaa

SEQ ID NO: 1948131 - RNA, 12 nt, Homo sapiens
uuaaagagcccc

SEQ ID NO: 1948132 - RNA, 22 nt, Homo sapiens
cucagggcauaaugaguuccug

SEQ ID NO: 1948133 - RNA, 19 nt, Homo sapiens
caccugggagaaaucuggc

SEQ ID NO: 1948134 - RNA, 16 nt, Homo sapiens
auaucuuuauuaauca

SEQ ID NO: 1948135 - RNA, 18 nt, Homo sapiens
cucguuuacacugcacau

SEQ ID NO: 1948136 - RNA, 18 nt, Homo sapiens
acagcagccacucaguuc

SEQ ID NO: 1948137 - RNA, 20 nt, Homo sapiens
ugccccugagacaaauggag

SEQ ID NO: 1948138 - RNA, 20 nt, Homo sapiens
cucaaguucugcccugguga

SEQ ID NO: 1948139 - RNA, 12 nt, Homo sapiens
ugaacccugugc

SEQ ID NO: 1948140 - RNA, 16 nt, Homo sapiens
gagcccacgacacugc

SEQ ID NO: 1948141 - RNA, 23 nt, Homo sapiens
uaaagagccuucacugguucugc

SEQ ID NO: 1948142 - RNA, 18 nt, Homo sapiens
cuaagaucacaucacugc

SEQ ID NO: 1948143 - RNA, 13 nt, Homo sapiens
agaaaugcugaaa

SEQ ID NO: 1948144 - RNA, 13 nt, Homo sapiens
aaugaugcuauga

SEQ ID NO: 1948145 - RNA, 15 nt, Homo sapiens
agaucacagcagggc

SEQ ID NO: 1948146 - RNA, 13 nt, Homo sapiens
gaaaauugcaaua

SEQ ID NO: 1948147 - RNA, 17 nt, Homo sapiens
gacugaauuacucucca

SEQ ID NO: 1948148 - RNA, 20 nt, Homo sapiens
cauucugccucuccucagga

SEQ ID NO: 1948149 - RNA, 14 nt, Homo sapiens
cuggcaagaaccag

SEQ ID NO: 1948150 - RNA, 18 nt, Homo sapiens
agccagaggguagggcac

SEQ ID NO: 1948151 - RNA, 14 nt, Homo sapiens
gcucaguucugccu

SEQ ID NO: 1948152 - RNA, 23 nt, Homo sapiens
uuuuccauuuuuauuucaaaaua

SEQ ID NO: 1948153 - RNA, 17 nt, Homo sapiens
aaagcaaaccagccuca

SEQ ID NO: 1948154 - RNA, 21 nt, Homo sapiens
auuuuaaaggcagagaaguuc

SEQ ID NO: 1948155 - RNA, 18 nt, Homo sapiens
ccucugcugccauuugaa

SEQ ID NO: 1948156 - RNA, 17 nt, Homo sapiens
uccacaagagugaauuu

SEQ ID NO: 1948157 - RNA, 19 nt, Homo sapiens
cagaacuucguacccuuug

SEQ ID NO: 1948158 - RNA, 20 nt, Homo sapiens
cugccaaaaagaacacccau

SEQ ID NO: 1948159 - RNA, 15 nt, Homo sapiens
agcuagacauugcaa

SEQ ID NO: 1948160 - RNA, 19 nt, Homo sapiens
auguauaauuucacagaua

SEQ ID NO: 1948161 - RNA, 12 nt, Homo sapiens
cugucacucuag

SEQ ID NO: 1948162 - RNA, 12 nt, Homo sapiens
ggagcacugggu

SEQ ID NO: 1948163 - RNA, 16 nt, Homo sapiens
uuuauugcauugcugg

SEQ ID NO: 1948164 - RNA, 21 nt, Homo sapiens
cucagguagccaccaccgggg

SEQ ID NO: 1948165 - RNA, 18 nt, Homo sapiens
uuguugcuguuguucaga

SEQ ID NO: 1948166 - RNA, 23 nt, Homo sapiens
ugagggaauccauugaacuggaa

SEQ ID NO: 1948167 - RNA, 21 nt, Homo sapiens
ucucccacccuuucugccagg

SEQ ID NO: 1948168 - RNA, 13 nt, Homo sapiens
agcuagugccuuu

SEQ ID NO: 1948169 - RNA, 13 nt, Homo sapiens
uauugacacugaa

SEQ ID NO: 1948170 - RNA, 23 nt, Homo sapiens
ucuaggauaagcacuagaucucc

SEQ ID NO: 1948171 - RNA, 20 nt, Homo sapiens
gcccaggccuugcugacucu

SEQ ID NO: 1948172 - RNA, 23 nt, Homo sapiens
ugcuuguugcauuuccagcugug

SEQ ID NO: 1948173 - RNA, 19 nt, Homo sapiens
ccuuaaugacaacacuuaa

SEQ ID NO: 1948174 - RNA, 19 nt, Homo sapiens
aaaucacaaaaaaacuguu

SEQ ID NO: 1948175 - RNA, 19 nt, Homo sapiens
uaugaacgcacaacaugca

SEQ ID NO: 1948176 - RNA, 22 nt, Homo sapiens
gcauccucuuuuuccaacuugg

SEQ ID NO: 1948177 - RNA, 17 nt, Homo sapiens
caagcagagcaaucagu

SEQ ID NO: 1948178 - RNA, 21 nt, Homo sapiens
auucugccgcccccuccugaa

SEQ ID NO: 1948179 - RNA, 16 nt, Homo sapiens
gucugucuacauuucu

SEQ ID NO: 1948180 - RNA, 16 nt, Homo sapiens
acaagucagucauuca

SEQ ID NO: 1948181 - RNA, 23 nt, Homo sapiens
gccaccucucuccuuugcugagg

SEQ ID NO: 1948182 - RNA, 22 nt, Homo sapiens
uauguauuaagccaaacaugag

SEQ ID NO: 1948183 - RNA, 11 nt, Homo sapiens
aaccuacauau

SEQ ID NO: 1948184 - RNA, 14 nt, Homo sapiens
caggugaugccauu

SEQ ID NO: 1948185 - RNA, 18 nt, Homo sapiens
agcacagugccugacaca

SEQ ID NO: 1948186 - RNA, 19 nt, Homo sapiens
uggagccuacauuccuuga

SEQ ID NO: 1948187 - RNA, 19 nt, Homo sapiens
aguaccgccucugucccua

SEQ ID NO: 1948188 - RNA, 21 nt, Homo sapiens
ucuuguacugugaccuaagaa

SEQ ID NO: 1948189 - RNA, 20 nt, Homo sapiens
aaggucccauaauaaaaaga

SEQ ID NO: 1948190 - RNA, 23 nt, Homo sapiens
cuacugucuauuaaaauucugau

SEQ ID NO: 1948191 - RNA, 16 nt, Homo sapiens
aaaaguuacagccaua

SEQ ID NO: 1948192 - RNA, 23 nt, Homo sapiens
gugagaauaaacuagacucugaa

SEQ ID NO: 1948193 - RNA, 13 nt, Homo sapiens
aacucuugacagc

SEQ ID NO: 1948194 - RNA, 15 nt, Homo sapiens
uagcuuuauucuuca

SEQ ID NO: 1948195 - RNA, 20 nt, Homo sapiens
uacuuguagaguggugcugc

SEQ ID NO: 1948196 - RNA, 19 nt, Homo sapiens
caccuuaauaugcugcaac

SEQ ID NO: 1948197 - RNA, 23 nt, Homo sapiens
ucagaggaccuguauuuaagcaa

SEQ ID NO: 1948198 - RNA, 20 nt, Homo sapiens
ggaagcggagcuugcaguga

SEQ ID NO: 1948199 - RNA, 14 nt, Homo sapiens
cuauuaauuccaug

SEQ ID NO: 1948200 - RNA, 19 nt, Homo sapiens
cuggccaggacacacugaa

SEQ ID NO: 1948201 - RNA, 22 nt, Homo sapiens
ccggauuaaaagccucauccac

SEQ ID NO: 1948202 - RNA, 17 nt, Homo sapiens
cauucuccuuguguuac

SEQ ID NO: 1948203 - RNA, 18 nt, Homo sapiens
cuaugaggaaacugaguc

SEQ ID NO: 1948204 - RNA, 18 nt, Homo sapiens
aggaaaauuaaaccaaug

SEQ ID NO: 1948205 - RNA, 17 nt, Homo sapiens
agauuuuuuauugcuag

SEQ ID NO: 1948206 - RNA, 19 nt, Homo sapiens
guucauauuuauacuuugc

SEQ ID NO: 1948207 - RNA, 16 nt, Homo sapiens
agagaaccucagauca

SEQ ID NO: 1948208 - RNA, 17 nt, Homo sapiens
ucuuuggggaauggaag

SEQ ID NO: 1948209 - RNA, 21 nt, Homo sapiens
augugcuuguuaacugagugc

SEQ ID NO: 1948210 - RNA, 13 nt, Homo sapiens
cauccaacugaga

SEQ ID NO: 1948211 - RNA, 17 nt, Homo sapiens
uaccgcagaguauuuga

SEQ ID NO: 1948212 - RNA, 15 nt, Homo sapiens
aaagaacucauuuga

SEQ ID NO: 1948213 - RNA, 18 nt, Homo sapiens
aauaucagacaagcacua

SEQ ID NO: 1948214 - RNA, 16 nt, Homo sapiens
cagggaccugagagca

SEQ ID NO: 1948215 - RNA, 14 nt, Homo sapiens
caggcagcugccug

SEQ ID NO: 1948216 - RNA, 21 nt, Homo sapiens
gcuuaaccuuuccaguuuaua

SEQ ID NO: 1948217 - RNA, 13 nt, Homo sapiens
aaaauuagccagg

SEQ ID NO: 1948218 - RNA, 14 nt, Homo sapiens
aacugaacucacuu

SEQ ID NO: 1948219 - RNA, 21 nt, Homo sapiens
cagccuccacaccuaccacga

SEQ ID NO: 1948220 - RNA, 20 nt, Homo sapiens
auguccggagagacagugac

SEQ ID NO: 1948221 - RNA, 15 nt, Homo sapiens
acacggggcaguggc

SEQ ID NO: 1948222 - RNA, 16 nt, Homo sapiens
caagcauuuagaugua

SEQ ID NO: 1948223 - RNA, 23 nt, Homo sapiens
gauggaauaaagcccuugaacca

SEQ ID NO: 1948224 - RNA, 19 nt, Homo sapiens
ccaguaggaaaagcaaugc

SEQ ID NO: 1948225 - RNA, 15 nt, Homo sapiens
uuaaacaucaguauu

SEQ ID NO: 1948226 - RNA, 21 nt, Homo sapiens
cuguauguaauauuuacauaa

SEQ ID NO: 1948227 - RNA, 22 nt, Homo sapiens
cuuuugugccaggagugggugg

SEQ ID NO: 1948228 - RNA, 14 nt, Homo sapiens
uaaaggaaacauau

SEQ ID NO: 1948229 - RNA, 16 nt, Homo sapiens
ccugccuccugguccc

SEQ ID NO: 1948230 - RNA, 22 nt, Homo sapiens
gagacggagucuugcucuguca

SEQ ID NO: 1948231 - RNA, 21 nt, Homo sapiens
gauaacccauacuacccucau

SEQ ID NO: 1948232 - RNA, 16 nt, Homo sapiens
ccucuacuuaaugaga

SEQ ID NO: 1948233 - RNA, 18 nt, Homo sapiens
caucauuggaauacagga

SEQ ID NO: 1948234 - RNA, 12 nt, Homo sapiens
cccaacacaggc

SEQ ID NO: 1948235 - RNA, 17 nt, Homo sapiens
caagaaguaaucaguau

SEQ ID NO: 1948236 - RNA, 16 nt, Homo sapiens
uguaucaugugcuaga

SEQ ID NO: 1948237 - RNA, 16 nt, Homo sapiens
ugcaaaauguguuuca

SEQ ID NO: 1948238 - RNA, 22 nt, Homo sapiens
ggauggagagcagccagcaccc

SEQ ID NO: 1948239 - RNA, 19 nt, Homo sapiens
acuagguuucaccucccaa

SEQ ID NO: 1948240 - RNA, 14 nt, Homo sapiens
gacauuccaaagaa

SEQ ID NO: 1948241 - RNA, 18 nt, Homo sapiens
uugcugcaccaaugcacu

SEQ ID NO: 1948242 - RNA, 16 nt, Homo sapiens
agagauggccugagaa

SEQ ID NO: 1948243 - RNA, 16 nt, Homo sapiens
aagaauuugcauacuu

SEQ ID NO: 1948244 - RNA, 22 nt, Homo sapiens
ugacuuuuuggcuuuaagccau

SEQ ID NO: 1948245 - RNA, 22 nt, Homo sapiens
cccuguaguugacaauucugca

SEQ ID NO: 1948246 - RNA, 17 nt, Homo sapiens
ugaagaaucugcucuga

SEQ ID NO: 1948247 - RNA, 14 nt, Homo sapiens
agaucuauguacug

SEQ ID NO: 1948248 - RNA, 23 nt, Homo sapiens
cuacaaaggaaauaucaaagugu

SEQ ID NO: 1948249 - RNA, 23 nt, Homo sapiens
uuuuucagaaagcauuacauuuc

SEQ ID NO: 1948250 - RNA, 17 nt, Homo sapiens
gaggccaacacuguggg

SEQ ID NO: 1948251 - RNA, 22 nt, Homo sapiens
acaauagccgauaucagaauuu

SEQ ID NO: 1948252 - RNA, 23 nt, Homo sapiens
ugaugcucccuccccugcccugg

SEQ ID NO: 1948253 - RNA, 15 nt, Homo sapiens
aaaagaaaugaacau

SEQ ID NO: 1948254 - RNA, 13 nt, Homo sapiens
ucauaaagcauug

SEQ ID NO: 1948255 - RNA, 15 nt, Homo sapiens
cagaccgccaaauaa

SEQ ID NO: 1948256 - RNA, 16 nt, Homo sapiens
gaaaaugugaguagua

SEQ ID NO: 1948257 - RNA, 20 nt, Homo sapiens
aaaugcugugaaugcagaau

SEQ ID NO: 1948258 - RNA, 17 nt, Homo sapiens
gcaacucgugacagccu

SEQ ID NO: 1948259 - RNA, 21 nt, Homo sapiens
aggauguagagagaacaggug

SEQ ID NO: 1948260 - RNA, 14 nt, Homo sapiens
ccuuauaguucaua

SEQ ID NO: 1948261 - RNA, 14 nt, Homo sapiens
aaagccucucacua

SEQ ID NO: 1948262 - RNA, 13 nt, Homo sapiens
uuuuuucaccaau

SEQ ID NO: 1948263 - RNA, 15 nt, Homo sapiens
aauaugaaagccuag

SEQ ID NO: 1948264 - RNA, 17 nt, Homo sapiens
agcugauuugauaccau

SEQ ID NO: 1948265 - RNA, 22 nt, Homo sapiens
ggaggucccugccaguguuuag

SEQ ID NO: 1948266 - RNA, 21 nt, Homo sapiens
uaguucuuaagcauuugcgua

SEQ ID NO: 1948267 - RNA, 15 nt, Homo sapiens
uaauuuauccaugcu

SEQ ID NO: 1948268 - RNA, 20 nt, Homo sapiens
aacaggugugugugaacugg

SEQ ID NO: 1948269 - RNA, 15 nt, Homo sapiens
auaauuaguuccuca

SEQ ID NO: 1948270 - RNA, 16 nt, Homo sapiens
uucaagaaagaauucc

SEQ ID NO: 1948271 - RNA, 20 nt, Homo sapiens
gauguggguaagaggagcag

SEQ ID NO: 1948272 - RNA, 21 nt, Homo sapiens
gacuaacuuccauggugcccu

SEQ ID NO: 1948273 - RNA, 17 nt, Homo sapiens
uuccuuaggagauguca

SEQ ID NO: 1948274 - RNA, 18 nt, Homo sapiens
acuguugauaauucuuau

SEQ ID NO: 1948275 - RNA, 14 nt, Homo sapiens
ucacagucuacuga

SEQ ID NO: 1948276 - RNA, 16 nt, Homo sapiens
auuacaggcaugagcu

SEQ ID NO: 1948277 - RNA, 13 nt, Homo sapiens
aacacaagcaaaa

SEQ ID NO: 1948278 - RNA, 16 nt, Homo sapiens
aucacugugucucaug

SEQ ID NO: 1948279 - RNA, 17 nt, Homo sapiens
gagacccaggacuccuc

SEQ ID NO: 1948280 - RNA, 21 nt, Homo sapiens
uaucccucuccauaaccccac

SEQ ID NO: 1948281 - RNA, 22 nt, Homo sapiens
acucugguuguuuaugcaagag

SEQ ID NO: 1948282 - RNA, 17 nt, Homo sapiens
ucaggacaucagucuga

SEQ ID NO: 1948283 - RNA, 17 nt, Homo sapiens
gugaaauucaguuauaa

SEQ ID NO: 1948284 - RNA, 16 nt, Homo sapiens
caccucagggcauaaa

SEQ ID NO: 1948285 - RNA, 14 nt, Homo sapiens
cuggggucugugau

SEQ ID NO: 1948286 - RNA, 12 nt, Homo sapiens
uguaggaagauu

SEQ ID NO: 1948287 - RNA, 20 nt, Homo sapiens
cugagcaaucucuugcauuu

SEQ ID NO: 1948288 - RNA, 18 nt, Homo sapiens
ugcaagcgucugugcauu

SEQ ID NO: 1948289 - RNA, 16 nt, Homo sapiens
accaacgcacaacagg

SEQ ID NO: 1948290 - RNA, 23 nt, Homo sapiens
agaaaaaaauucaugcaucucaa

SEQ ID NO: 1948291 - RNA, 18 nt, Homo sapiens
acacagagauaugcacac

SEQ ID NO: 1948292 - RNA, 18 nt, Homo sapiens
aguguuucuuccacaaca

SEQ ID NO: 1948293 - RNA, 14 nt, Homo sapiens
acacguguguauga

SEQ ID NO: 1948294 - RNA, 19 nt, Homo sapiens
uagcugugaucagugauuu

SEQ ID NO: 1948295 - RNA, 13 nt, Homo sapiens
ccagcuagacucc

SEQ ID NO: 1948296 - RNA, 18 nt, Homo sapiens
uaucccugcucuggauuu

SEQ ID NO: 1948297 - RNA, 21 nt, Homo sapiens
cuugagcaaccuggcuaagau

SEQ ID NO: 1948298 - RNA, 16 nt, Homo sapiens
cuucgaccuacugaaa

SEQ ID NO: 1948299 - RNA, 23 nt, Homo sapiens
cucuguagaauuuagcuuauaca

SEQ ID NO: 1948300 - RNA, 14 nt, Homo sapiens
agggguaauugcau

SEQ ID NO: 1948301 - RNA, 13 nt, Homo sapiens
ccauucauugcag

SEQ ID NO: 1948302 - RNA, 15 nt, Homo sapiens
cuaaaaaugcaaaaa

SEQ ID NO: 1948303 - RNA, 14 nt, Homo sapiens
caaacuacaaagcu

SEQ ID NO: 1948304 - RNA, 14 nt, Homo sapiens
gaggcagcaggacu

SEQ ID NO: 1948305 - RNA, 14 nt, Homo sapiens
ccuuuuugguacuu

SEQ ID NO: 1948306 - RNA, 18 nt, Homo sapiens
aucaauaucccaacauuc

SEQ ID NO: 1948307 - RNA, 16 nt, Homo sapiens
ugcuccaagauucuag

SEQ ID NO: 1948308 - RNA, 18 nt, Homo sapiens
auuacugaugugugcaac

SEQ ID NO: 1948309 - RNA, 23 nt, Homo sapiens
ugaccauaaccacugaagggaau

SEQ ID NO: 1948310 - RNA, 15 nt, Homo sapiens
uauaguagccaugac

SEQ ID NO: 1948311 - RNA, 20 nt, Homo sapiens
gcuuuuuuccuccuguguac

SEQ ID NO: 1948312 - RNA, 17 nt, Homo sapiens
uaugugcggcuuuucag

SEQ ID NO: 1948313 - RNA, 13 nt, Homo sapiens
accaucuuggcca

SEQ ID NO: 1948314 - RNA, 16 nt, Homo sapiens
gcuuuccucccaaagg

SEQ ID NO: 1948315 - RNA, 14 nt, Homo sapiens
acgugguagucacu

SEQ ID NO: 1948316 - RNA, 14 nt, Homo sapiens
gcugcuuccagugu

SEQ ID NO: 1948317 - RNA, 13 nt, Homo sapiens
ucagcccucagaa

SEQ ID NO: 1948318 - RNA, 23 nt, Homo sapiens
cuaacucuuacggcuaucuaguu

SEQ ID NO: 1948319 - RNA, 13 nt, Homo sapiens
aucccuuugacca

SEQ ID NO: 1948320 - RNA, 12 nt, Homo sapiens
gccucaucccag

SEQ ID NO: 1948321 - RNA, 19 nt, Homo sapiens
gugaggcuguccuguacau

SEQ ID NO: 1948322 - RNA, 16 nt, Homo sapiens
acagugccuauugaua

SEQ ID NO: 1948323 - RNA, 14 nt, Homo sapiens
ccuggaccauuuga

SEQ ID NO: 1948324 - RNA, 19 nt, Homo sapiens
ucuucuacccucaucauca

SEQ ID NO: 1948325 - RNA, 14 nt, Homo sapiens
gcaccucucaggau

SEQ ID NO: 1948326 - RNA, 19 nt, Homo sapiens
uugcccacuugauugagaa

SEQ ID NO: 1948327 - RNA, 15 nt, Homo sapiens
agcccucacccuggg

SEQ ID NO: 1948328 - RNA, 17 nt, Homo sapiens
uaaaggggagaccucag

SEQ ID NO: 1948329 - RNA, 13 nt, Homo sapiens
acaaugaagugac

SEQ ID NO: 1948330 - RNA, 15 nt, Homo sapiens
ggaagcaagauguga

SEQ ID NO: 1948331 - RNA, 16 nt, Homo sapiens
auccauaaauguguuc

SEQ ID NO: 1948332 - RNA, 17 nt, Homo sapiens
uaccccugaucugacau

SEQ ID NO: 1948333 - RNA, 15 nt, Homo sapiens
cacuguuucuucuca

SEQ ID NO: 1948334 - RNA, 21 nt, Homo sapiens
cagcaucuuuuccauccugag

SEQ ID NO: 1948335 - RNA, 15 nt, Homo sapiens
ucuagaacacucagc

SEQ ID NO: 1948336 - RNA, 15 nt, Homo sapiens
auucagccuuuagaa

SEQ ID NO: 1948337 - RNA, 18 nt, Homo sapiens
cuauugugacagagccau

SEQ ID NO: 1948338 - RNA, 16 nt, Homo sapiens
uucaaaaaaaaaagca

SEQ ID NO: 1948339 - RNA, 14 nt, Homo sapiens
uauuggaaugcaca

SEQ ID NO: 1948340 - RNA, 16 nt, Homo sapiens
cacuugucaaagaagg

SEQ ID NO: 1948341 - RNA, 16 nt, Homo sapiens
acacagauaugcacac

SEQ ID NO: 1948342 - RNA, 12 nt, Homo sapiens
gagccgcuguga

SEQ ID NO: 1948343 - RNA, 22 nt, Homo sapiens
accccagccccaacuccagggg

SEQ ID NO: 1948344 - RNA, 13 nt, Homo sapiens
gcccagcccagcu

SEQ ID NO: 1948345 - RNA, 20 nt, Homo sapiens
uccuugcaggugacauuugc

SEQ ID NO: 1948346 - RNA, 19 nt, Homo sapiens
aucuuuauuuuauuauuca

SEQ ID NO: 1948347 - RNA, 19 nt, Homo sapiens
aagcuuugaauacugugaa

SEQ ID NO: 1948348 - RNA, 17 nt, Homo sapiens
ccauguauuucagggac

SEQ ID NO: 1948349 - RNA, 18 nt, Homo sapiens
acacuuugguauucaauu

SEQ ID NO: 1948350 - RNA, 16 nt, Homo sapiens
aaccaucaucuugcca

SEQ ID NO: 1948351 - RNA, 13 nt, Homo sapiens
ucuguaacagggu

SEQ ID NO: 1948352 - RNA, 20 nt, Homo sapiens
cuugaacugaggcccuguga

SEQ ID NO: 1948353 - RNA, 16 nt, Homo sapiens
agaagauggcacuguc

SEQ ID NO: 1948354 - RNA, 17 nt, Homo sapiens
cagauggaaagaaagca

SEQ ID NO: 1948355 - RNA, 22 nt, Homo sapiens
uacaaaugccaaaauucauuca

SEQ ID NO: 1948356 - RNA, 16 nt, Homo sapiens
gaauucagaugcaaga

SEQ ID NO: 1948357 - RNA, 12 nt, Homo sapiens
aguuagcaucca

SEQ ID NO: 1948358 - RNA, 20 nt, Homo sapiens
agagugcuggacuguuccag

SEQ ID NO: 1948359 - RNA, 15 nt, Homo sapiens
augucuuacuacuuu

SEQ ID NO: 1948360 - RNA, 19 nt, Homo sapiens
aaguauuguggcaccucaa

SEQ ID NO: 1948361 - RNA, 12 nt, Homo sapiens
caaaaccagcug

SEQ ID NO: 1948362 - RNA, 16 nt, Homo sapiens
aauaaucaaugcaguu

SEQ ID NO: 1948363 - RNA, 16 nt, Homo sapiens
caugcauuuagcauga

SEQ ID NO: 1948364 - RNA, 13 nt, Homo sapiens
cuggaccaaagcu

SEQ ID NO: 1948365 - RNA, 15 nt, Homo sapiens
aacagcucaccaacu

SEQ ID NO: 1948366 - RNA, 15 nt, Homo sapiens
caaaaaacccaagaa

SEQ ID NO: 1948367 - RNA, 12 nt, Homo sapiens
aaugugccaaaa

SEQ ID NO: 1948368 - RNA, 15 nt, Homo sapiens
caaagcuugccacuu

SEQ ID NO: 1948369 - RNA, 17 nt, Homo sapiens
uccugcugccucucuuu

SEQ ID NO: 1948370 - RNA, 15 nt, Homo sapiens
cugaauggcaaugaa

SEQ ID NO: 1948371 - RNA, 13 nt, Homo sapiens
uagaauggcacau

SEQ ID NO: 1948372 - RNA, 23 nt, Homo sapiens
agaucaccccagccucacuccau

SEQ ID NO: 1948373 - RNA, 18 nt, Homo sapiens
cccagccccuccacguga

SEQ ID NO: 1948374 - RNA, 17 nt, Homo sapiens
gggcuauagcacacagu

SEQ ID NO: 1948375 - RNA, 12 nt, Homo sapiens
uuccguuuccag

SEQ ID NO: 1948376 - RNA, 20 nt, Homo sapiens
uguugcucucuaguuuccag

SEQ ID NO: 1948377 - RNA, 17 nt, Homo sapiens
uaggaauucuuugcauu

SEQ ID NO: 1948378 - RNA, 21 nt, Homo sapiens
ccaagaaugucuccauuguua

SEQ ID NO: 1948379 - RNA, 21 nt, Homo sapiens
uuugagccaacaacucugauu

SEQ ID NO: 1948380 - RNA, 23 nt, Homo sapiens
agucaugauguuuuuaaaaucuu

SEQ ID NO: 1948381 - RNA, 23 nt, Homo sapiens
aagguugaaaagacaauagccca

SEQ ID NO: 1948382 - RNA, 15 nt, Homo sapiens
acgaggucaggagau

SEQ ID NO: 1948383 - RNA, 22 nt, Homo sapiens
uuguuuucagcacugauggaaa

SEQ ID NO: 1948384 - RNA, 17 nt, Homo sapiens
uagaggacgugggaccg

SEQ ID NO: 1948385 - RNA, 21 nt, Homo sapiens
aacccacuugucacugacaca

SEQ ID NO: 1948386 - RNA, 16 nt, Homo sapiens
cugcuauuauguaaca

SEQ ID NO: 1948387 - RNA, 14 nt, Homo sapiens
cauaaaaaagggac

SEQ ID NO: 1948388 - RNA, 22 nt, Homo sapiens
cucccuuaauaaacucacaacu

SEQ ID NO: 1948389 - RNA, 19 nt, Homo sapiens
ccuuucaagguaacuguac

SEQ ID NO: 1948390 - RNA, 21 nt, Homo sapiens
cagaugcuacgcuccagcuga

SEQ ID NO: 1948391 - RNA, 22 nt, Homo sapiens
auguuccaaacccuccugggaa

SEQ ID NO: 1948392 - RNA, 14 nt, Homo sapiens
uaccaaaacauaag

SEQ ID NO: 1948393 - RNA, 15 nt, Homo sapiens
ucauuccauugccua

SEQ ID NO: 1948394 - RNA, 22 nt, Homo sapiens
ggccggggcccugcaccugugc

SEQ ID NO: 1948395 - RNA, 20 nt, Homo sapiens
gguguagccagguauggcuc

SEQ ID NO: 1948396 - RNA, 15 nt, Homo sapiens
aagcugaauccagau

SEQ ID NO: 1948397 - RNA, 13 nt, Homo sapiens
ccagugccaagga

SEQ ID NO: 1948398 - RNA, 14 nt, Homo sapiens
uaauuguacuuuga

SEQ ID NO: 1948399 - RNA, 21 nt, Homo sapiens
cuuaagcauuugcguauguaa

SEQ ID NO: 1948400 - RNA, 17 nt, Homo sapiens
aaacacaagaggcuucc

SEQ ID NO: 1948401 - RNA, 15 nt, Homo sapiens
ugcuggcccugauga

SEQ ID NO: 1948402 - RNA, 17 nt, Homo sapiens
agggcacuuaauuugua

SEQ ID NO: 1948403 - RNA, 15 nt, Homo sapiens
agauucuuaccaaga

SEQ ID NO: 1948404 - RNA, 20 nt, Homo sapiens
agacugucagaaaaagcuag

SEQ ID NO: 1948405 - RNA, 18 nt, Homo sapiens
uguacauuucacaaaaag

SEQ ID NO: 1948406 - RNA, 23 nt, Homo sapiens
cuaaccuucacgauuaacuguga

SEQ ID NO: 1948407 - RNA, 20 nt, Homo sapiens
uucccuuuaugcacccaaga

SEQ ID NO: 1948408 - RNA, 17 nt, Homo sapiens
aacugcaccugucauca

SEQ ID NO: 1948409 - RNA, 14 nt, Homo sapiens
cuucugaaggccaa

SEQ ID NO: 1948410 - RNA, 17 nt, Homo sapiens
cuccccgccuguucccc

SEQ ID NO: 1948411 - RNA, 15 nt, Homo sapiens
acauaccacauggac

SEQ ID NO: 1948412 - RNA, 14 nt, Homo sapiens
auccagaagccagu

SEQ ID NO: 1948413 - RNA, 15 nt, Homo sapiens
uacauuuucucugau

SEQ ID NO: 1948414 - RNA, 12 nt, Homo sapiens
ucugaauauucu

SEQ ID NO: 1948415 - RNA, 15 nt, Homo sapiens
gugcugagaaugugu

SEQ ID NO: 1948416 - RNA, 20 nt, Homo sapiens
aacaagacuccucaucauga

SEQ ID NO: 1948417 - RNA, 13 nt, Homo sapiens
ugcuucgugccac

SEQ ID NO: 1948418 - RNA, 18 nt, Homo sapiens
agggggugugucugcuca

SEQ ID NO: 1948419 - RNA, 15 nt, Homo sapiens
cuuucuguugaauga

SEQ ID NO: 1948420 - RNA, 15 nt, Homo sapiens
aaguaaguaccacuc

SEQ ID NO: 1948421 - RNA, 13 nt, Homo sapiens
uccugccaccacu

SEQ ID NO: 1948422 - RNA, 19 nt, Homo sapiens
uccuccaucauuaauguga

SEQ ID NO: 1948423 - RNA, 14 nt, Homo sapiens
ucagacugagcucc

SEQ ID NO: 1948424 - RNA, 14 nt, Homo sapiens
ccugguccuggaca

SEQ ID NO: 1948425 - RNA, 14 nt, Homo sapiens
acuauacacuuaau

SEQ ID NO: 1948426 - RNA, 16 nt, Homo sapiens
ccugccucugacccca

SEQ ID NO: 1948427 - RNA, 13 nt, Homo sapiens
uugugcaaacaug

SEQ ID NO: 1948428 - RNA, 14 nt, Homo sapiens
guugugugugcuuu

SEQ ID NO: 1948429 - RNA, 20 nt, Homo sapiens
uuacguauguuuguacuugg

SEQ ID NO: 1948430 - RNA, 20 nt, Homo sapiens
aggagguugagaaugcagug

SEQ ID NO: 1948431 - RNA, 12 nt, Homo sapiens
auacacacuguu

SEQ ID NO: 1948432 - RNA, 13 nt, Homo sapiens
aacuguacugaag

SEQ ID NO: 1948433 - RNA, 13 nt, Homo sapiens
uacauuacagauu

SEQ ID NO: 1948434 - RNA, 20 nt, Homo sapiens
ggccgguucuaaggcucaga

SEQ ID NO: 1948435 - RNA, 22 nt, Homo sapiens
cucaguucuugagggccucccc

SEQ ID NO: 1948436 - RNA, 17 nt, Homo sapiens
cuuugaguagauccauu

SEQ ID NO: 1948437 - RNA, 14 nt, Homo sapiens
ugagugaccucacu

SEQ ID NO: 1948438 - RNA, 19 nt, Homo sapiens
uuaccuaccaccuucccuc

SEQ ID NO: 1948439 - RNA, 22 nt, Homo sapiens
caccaaaagugcuccccaaaag

SEQ ID NO: 1948440 - RNA, 16 nt, Homo sapiens
cuacaugcauuucaau

SEQ ID NO: 1948441 - RNA, 15 nt, Homo sapiens
gguauuucuuggcau

SEQ ID NO: 1948442 - RNA, 15 nt, Homo sapiens
guauguuuguuucau

SEQ ID NO: 1948443 - RNA, 21 nt, Homo sapiens
aacggaguacagacgucucaa

SEQ ID NO: 1948444 - RNA, 22 nt, Homo sapiens
aucuugcauccaaaccuguaac

SEQ ID NO: 1948445 - RNA, 12 nt, Homo sapiens
ugaaucuaugaa

SEQ ID NO: 1948446 - RNA, 19 nt, Homo sapiens
ucuucaguugucucugaug

SEQ ID NO: 1948447 - RNA, 16 nt, Homo sapiens
aacaaguugugccuuu

SEQ ID NO: 1948448 - RNA, 21 nt, Homo sapiens
ucuguccccgagccgagcucu

SEQ ID NO: 1948449 - RNA, 19 nt, Homo sapiens
agcauguuugccuagacag

SEQ ID NO: 1948450 - RNA, 15 nt, Homo sapiens
caucaguggagucca

SEQ ID NO: 1948451 - RNA, 13 nt, Homo sapiens
gcuuucagcugau

SEQ ID NO: 1948452 - RNA, 19 nt, Homo sapiens
caaagugcugggauuacag

SEQ ID NO: 1948453 - RNA, 18 nt, Homo sapiens
agaaauggcgucugcucu

SEQ ID NO: 1948454 - RNA, 16 nt, Homo sapiens
aaucccaccacugcac

SEQ ID NO: 1948455 - RNA, 21 nt, Homo sapiens
gugcugguccuguugauccca

SEQ ID NO: 1948456 - RNA, 20 nt, Homo sapiens
auuuaagguacauggaacac

SEQ ID NO: 1948457 - RNA, 19 nt, Homo sapiens
uaaaugggaauucucaggu

SEQ ID NO: 1948458 - RNA, 19 nt, Homo sapiens
auguugguuacaugaauga

SEQ ID NO: 1948459 - RNA, 14 nt, Homo sapiens
gaaucuaucaccca

SEQ ID NO: 1948460 - RNA, 23 nt, Homo sapiens
uagcccuggguuuaaugucaaau

SEQ ID NO: 1948461 - RNA, 22 nt, Homo sapiens
caauuauuuauuaaaugcccag

SEQ ID NO: 1948462 - RNA, 15 nt, Homo sapiens
uucuccgucacucca

SEQ ID NO: 1948463 - RNA, 13 nt, Homo sapiens
ugacuuauuagga

SEQ ID NO: 1948464 - RNA, 13 nt, Homo sapiens
uguggcagugguu

SEQ ID NO: 1948465 - RNA, 13 nt, Homo sapiens
uggugcagugugu

SEQ ID NO: 1948466 - RNA, 21 nt, Homo sapiens
gagacaccaaccgacaggccc

SEQ ID NO: 1948467 - RNA, 21 nt, Homo sapiens
ccugaaauccaggaagucccu

SEQ ID NO: 1948468 - RNA, 15 nt, Homo sapiens
ugccucuucaguggg

SEQ ID NO: 1948469 - RNA, 18 nt, Homo sapiens
ggccccuugcugaugcuc

SEQ ID NO: 1948470 - RNA, 13 nt, Homo sapiens
aaaucauuguuaa

SEQ ID NO: 1948471 - RNA, 20 nt, Homo sapiens
cugcccaugagucaggggag

SEQ ID NO: 1948472 - RNA, 15 nt, Homo sapiens
ugcccuuuccuggca

SEQ ID NO: 1948473 - RNA, 17 nt, Homo sapiens
gaaaaccucuccugacc

SEQ ID NO: 1948474 - RNA, 17 nt, Homo sapiens
ggggcuucuagcugacu

SEQ ID NO: 1948475 - RNA, 16 nt, Homo sapiens
ccuauucuguugccaa

SEQ ID NO: 1948476 - RNA, 14 nt, Homo sapiens
ugucuggugggugg

SEQ ID NO: 1948477 - RNA, 19 nt, Homo sapiens
aaugaacuugguaccugca

SEQ ID NO: 1948478 - RNA, 15 nt, Homo sapiens
agagaggagccagga

SEQ ID NO: 1948479 - RNA, 12 nt, Homo sapiens
auauugucauua

SEQ ID NO: 1948480 - RNA, 18 nt, Homo sapiens
uaacccuuucugugguaa

SEQ ID NO: 1948481 - RNA, 14 nt, Homo sapiens
augauuucuaugaa

SEQ ID NO: 1948482 - RNA, 22 nt, Homo sapiens
gauaacaaaaucacaagcaaua

SEQ ID NO: 1948483 - RNA, 15 nt, Homo sapiens
uuugaguauugcuga

SEQ ID NO: 1948484 - RNA, 18 nt, Homo sapiens
uggggcuccuuucuccag

SEQ ID NO: 1948485 - RNA, 14 nt, Homo sapiens
cucugauagcuguu

SEQ ID NO: 1948486 - RNA, 22 nt, Homo sapiens
uucucucagcucccaggccaac

SEQ ID NO: 1948487 - RNA, 18 nt, Homo sapiens
cugcuugcagccaggaga

SEQ ID NO: 1948488 - RNA, 17 nt, Homo sapiens
uaaaguuuuauuugaau

SEQ ID NO: 1948489 - RNA, 16 nt, Homo sapiens
gccucccuaguagcug

SEQ ID NO: 1948490 - RNA, 15 nt, Homo sapiens
auuucuacacagugg

SEQ ID NO: 1948491 - RNA, 11 nt, Homo sapiens
aaauuacuuua

SEQ ID NO: 1948492 - RNA, 15 nt, Homo sapiens
aguucccucccucaa

SEQ ID NO: 1948493 - RNA, 14 nt, Homo sapiens
ugggaggaagcaaa

SEQ ID NO: 1948494 - RNA, 21 nt, Homo sapiens
cagcguggccuccgugaccca

SEQ ID NO: 1948495 - RNA, 19 nt, Homo sapiens
gcaagugucugugugcaag

SEQ ID NO: 1948496 - RNA, 17 nt, Homo sapiens
cagcagcccuggcaugu

SEQ ID NO: 1948497 - RNA, 22 nt, Homo sapiens
auucuauaaaacacaucaucaa

SEQ ID NO: 1948498 - RNA, 18 nt, Homo sapiens
cacuucucuacucuggaa

SEQ ID NO: 1948499 - RNA, 14 nt, Homo sapiens
accguacacugugu

SEQ ID NO: 1948500 - RNA, 23 nt, Homo sapiens
caacaugaugugaaaacccaucu

SEQ ID NO: 1948501 - RNA, 11 nt, Homo sapiens
gcuagaaccua

SEQ ID NO: 1948502 - RNA, 16 nt, Homo sapiens
ugaguucucacucugg

SEQ ID NO: 1948503 - RNA, 21 nt, Homo sapiens
caauuaccacaccaucuccca

SEQ ID NO: 1948504 - RNA, 18 nt, Homo sapiens
aaguagcugggauuacag

SEQ ID NO: 1948505 - RNA, 14 nt, Homo sapiens
auauuuacaaccua

SEQ ID NO: 1948506 - RNA, 15 nt, Homo sapiens
caguuugugauuucu

SEQ ID NO: 1948507 - RNA, 21 nt, Homo sapiens
acuggagguacaaauaauuua

SEQ ID NO: 1948508 - RNA, 13 nt, Homo sapiens
uucaucuucaaaa

SEQ ID NO: 1948509 - RNA, 23 nt, Homo sapiens
cccugagugaggauuacaugccc

SEQ ID NO: 1948510 - RNA, 23 nt, Homo sapiens
uguucucaucggcggagccuucu

SEQ ID NO: 1948511 - RNA, 12 nt, Homo sapiens
ccuuuccagggu

SEQ ID NO: 1948512 - RNA, 14 nt, Homo sapiens
ucaagaacacagcc

SEQ ID NO: 1948513 - RNA, 12 nt, Homo sapiens
guucaagaccag

SEQ ID NO: 1948514 - RNA, 13 nt, Homo sapiens
gaguugaucugga

SEQ ID NO: 1948515 - RNA, 12 nt, Homo sapiens
cuagaaggccac

SEQ ID NO: 1948516 - RNA, 17 nt, Homo sapiens
caaauggggccagaucc

SEQ ID NO: 1948517 - RNA, 17 nt, Homo sapiens
agucacccuucugggca

SEQ ID NO: 1948518 - RNA, 19 nt, Homo sapiens
uagcauuucaaaacccaaa

SEQ ID NO: 1948519 - RNA, 22 nt, Homo sapiens
guuugggaauauccauguacuu

SEQ ID NO: 1948520 - RNA, 18 nt, Homo sapiens
auuacuucuagucaguca

SEQ ID NO: 1948521 - RNA, 14 nt, Homo sapiens
auccagcuaugaau

SEQ ID NO: 1948522 - RNA, 21 nt, Homo sapiens
gauccccggggcggcaggaag

SEQ ID NO: 1948523 - RNA, 15 nt, Homo sapiens
acccccaugcacuca

SEQ ID NO: 1948524 - RNA, 23 nt, Homo sapiens
ucuccuaaccaaggugcacugag

SEQ ID NO: 1948525 - RNA, 18 nt, Homo sapiens
cuuuuaaaaaauucuugu

SEQ ID NO: 1948526 - RNA, 22 nt, Homo sapiens
cucaucauaaaauaaaguauau

SEQ ID NO: 1948527 - RNA, 19 nt, Homo sapiens
ggccccgcaccccuccucc

SEQ ID NO: 1948528 - RNA, 13 nt, Homo sapiens
aggccagugccag

SEQ ID NO: 1948529 - RNA, 17 nt, Homo sapiens
acaaaaggaauguguaa

SEQ ID NO: 1948530 - RNA, 20 nt, Homo sapiens
auccagaugaaggaaaggaa

SEQ ID NO: 1948531 - RNA, 14 nt, Homo sapiens
cugacaagauggaa

SEQ ID NO: 1948532 - RNA, 15 nt, Homo sapiens
agauccuuucucuca

SEQ ID NO: 1948533 - RNA, 20 nt, Homo sapiens
cugacucucgugcauuucaa

SEQ ID NO: 1948534 - RNA, 18 nt, Homo sapiens
cugauucuaaaaugucuc

SEQ ID NO: 1948535 - RNA, 22 nt, Homo sapiens
gcgucaggcagugugaguuugc

SEQ ID NO: 1948536 - RNA, 15 nt, Homo sapiens
ccaaagacauguuua

SEQ ID NO: 1948537 - RNA, 16 nt, Homo sapiens
ugaaaugcauuuugcu

SEQ ID NO: 1948538 - RNA, 20 nt, Homo sapiens
auccauuuggacaaaaugga

SEQ ID NO: 1948539 - RNA, 16 nt, Homo sapiens
cgaaugauuaaucaua

SEQ ID NO: 1948540 - RNA, 12 nt, Homo sapiens
agaccuaccuca

SEQ ID NO: 1948541 - RNA, 13 nt, Homo sapiens
auccguggcugca

SEQ ID NO: 1948542 - RNA, 15 nt, Homo sapiens
ugacuucagaaacuu

SEQ ID NO: 1948543 - RNA, 15 nt, Homo sapiens
gagagaaggggccca

SEQ ID NO: 1948544 - RNA, 18 nt, Homo sapiens
gcauugaucugagugcuu

SEQ ID NO: 1948545 - RNA, 16 nt, Homo sapiens
gauauggaagcaccca

SEQ ID NO: 1948546 - RNA, 16 nt, Homo sapiens
uauauggcuucaaguu

SEQ ID NO: 1948547 - RNA, 15 nt, Homo sapiens
auucuuuccccagag

SEQ ID NO: 1948548 - RNA, 23 nt, Homo sapiens
cuaugcugugugcagaguauaca

SEQ ID NO: 1948549 - RNA, 14 nt, Homo sapiens
gcuuucaagcucau

SEQ ID NO: 1948550 - RNA, 14 nt, Homo sapiens
auuuaaaacuugcc

SEQ ID NO: 1948551 - RNA, 22 nt, Homo sapiens
agaugggcaaauuaaggcauaa

SEQ ID NO: 1948552 - RNA, 22 nt, Homo sapiens
cuuucuauuaccccucauuuaa

SEQ ID NO: 1948553 - RNA, 23 nt, Homo sapiens
gcuccgucagcuucucccaagcc

SEQ ID NO: 1948554 - RNA, 13 nt, Homo sapiens
ucaauagcuugaa

SEQ ID NO: 1948555 - RNA, 13 nt, Homo sapiens
acauaggugcucu

SEQ ID NO: 1948556 - RNA, 11 nt, Homo sapiens
cccuuuuccau

SEQ ID NO: 1948557 - RNA, 16 nt, Homo sapiens
uuuugaaaacacuuau

SEQ ID NO: 1948558 - RNA, 17 nt, Homo sapiens
cuucuugcagcuguuga

SEQ ID NO: 1948559 - RNA, 16 nt, Homo sapiens
aguggccaucuggaaa

SEQ ID NO: 1948560 - RNA, 20 nt, Homo sapiens
aaauacauucuaaaucacuu

SEQ ID NO: 1948561 - RNA, 15 nt, Homo sapiens
caugcaaaauauguu

SEQ ID NO: 1948562 - RNA, 15 nt, Homo sapiens
ccuauucaugucucu

SEQ ID NO: 1948563 - RNA, 22 nt, Homo sapiens
gugugugcacguacacacacau

SEQ ID NO: 1948564 - RNA, 15 nt, Homo sapiens
accaccugcuucuga

SEQ ID NO: 1948565 - RNA, 17 nt, Homo sapiens
ugggggucaggggcuag

SEQ ID NO: 1948566 - RNA, 17 nt, Homo sapiens
cccagaaacagugugca

SEQ ID NO: 1948567 - RNA, 17 nt, Homo sapiens
ucugcaugucuacucag

SEQ ID NO: 1948568 - RNA, 19 nt, Homo sapiens
ucauguuuuuaacuuuuaa

SEQ ID NO: 1948569 - RNA, 17 nt, Homo sapiens
aaauguuguauaaccaa

SEQ ID NO: 1948570 - RNA, 18 nt, Homo sapiens
uggagcaugcaacacauc

SEQ ID NO: 1948571 - RNA, 20 nt, Homo sapiens
auuuugcugcacacaaucua

SEQ ID NO: 1948572 - RNA, 21 nt, Homo sapiens
cagccccagcugacaccugga

SEQ ID NO: 1948573 - RNA, 14 nt, Homo sapiens
ucacuggugcuaua

SEQ ID NO: 1948574 - RNA, 22 nt, Homo sapiens
ucggagaagcuggaaaguguga

SEQ ID NO: 1948575 - RNA, 14 nt, Homo sapiens
caggagcugcucag

SEQ ID NO: 1948576 - RNA, 15 nt, Homo sapiens
ccccaggcagcuccu

SEQ ID NO: 1948577 - RNA, 15 nt, Homo sapiens
caguaacuaaagcuu

SEQ ID NO: 1948578 - RNA, 23 nt, Homo sapiens
gguggccuccuugcuuguuacau

SEQ ID NO: 1948579 - RNA, 20 nt, Homo sapiens
gcccuuccucccauuuccca

SEQ ID NO: 1948580 - RNA, 23 nt, Homo sapiens
cccaucuuguuucacacuaguca

SEQ ID NO: 1948581 - RNA, 15 nt, Homo sapiens
cucacgucucccuaa

SEQ ID NO: 1948582 - RNA, 17 nt, Homo sapiens
aaaguaggaaauacaau

SEQ ID NO: 1948583 - RNA, 23 nt, Homo sapiens
uuggccagaagggggccaugagg

SEQ ID NO: 1948584 - RNA, 15 nt, Homo sapiens
agguuugccagcauu

SEQ ID NO: 1948585 - RNA, 18 nt, Homo sapiens
cugagcacccaagccagg

SEQ ID NO: 1948586 - RNA, 14 nt, Homo sapiens
acacauacaaugaa

SEQ ID NO: 1948587 - RNA, 19 nt, Homo sapiens
ggaaagucucucuucugaa

SEQ ID NO: 1948588 - RNA, 18 nt, Homo sapiens
cuuauuuugguugcaguu

SEQ ID NO: 1948589 - RNA, 16 nt, Homo sapiens
caaaauuaaauacaua

SEQ ID NO: 1948590 - RNA, 17 nt, Homo sapiens
caaaagggccauguuuc

SEQ ID NO: 1948591 - RNA, 16 nt, Homo sapiens
ccuggaguccuugacc

SEQ ID NO: 1948592 - RNA, 22 nt, Homo sapiens
aacauaaaaugaggcaguuaaa

SEQ ID NO: 1948593 - RNA, 16 nt, Homo sapiens
aacauaauucucucac

SEQ ID NO: 1948594 - RNA, 22 nt, Homo sapiens
agcuaguuuuuuugaaauccaa

SEQ ID NO: 1948595 - RNA, 15 nt, Homo sapiens
ucaagguguucucug

SEQ ID NO: 1948596 - RNA, 14 nt, Homo sapiens
agcaggacacugau

SEQ ID NO: 1948597 - RNA, 20 nt, Homo sapiens
acauagaacucagagccaga

SEQ ID NO: 1948598 - RNA, 22 nt, Homo sapiens
caucccacacgcacugcacugc

SEQ ID NO: 1948599 - RNA, 15 nt, Homo sapiens
gcauccaaguuuaug

SEQ ID NO: 1948600 - RNA, 19 nt, Homo sapiens
ggccaggacaaaaugcaga

SEQ ID NO: 1948601 - RNA, 14 nt, Homo sapiens
cugagggcccgugu

SEQ ID NO: 1948602 - RNA, 16 nt, Homo sapiens
cugccugccucuuggc

SEQ ID NO: 1948603 - RNA, 18 nt, Homo sapiens
cacuauauugcucaggcu

SEQ ID NO: 1948604 - RNA, 15 nt, Homo sapiens
ucuccucuuccagag

SEQ ID NO: 1948605 - RNA, 18 nt, Homo sapiens
ggaccugaauucuacuga

SEQ ID NO: 1948606 - RNA, 22 nt, Homo sapiens
acauuauuuguaauagccaaaa

SEQ ID NO: 1948607 - RNA, 13 nt, Homo sapiens
uagcagaaaucua

SEQ ID NO: 1948608 - RNA, 18 nt, Homo sapiens
acgaugucaaggacuccu

SEQ ID NO: 1948609 - RNA, 16 nt, Homo sapiens
gaaaccaacacccaaa

SEQ ID NO: 1948610 - RNA, 20 nt, Homo sapiens
cuaaaccauugugcauucua

SEQ ID NO: 1948611 - RNA, 16 nt, Homo sapiens
uaacacagcugaacua

SEQ ID NO: 1948612 - RNA, 13 nt, Homo sapiens
ucgauauaugacu

SEQ ID NO: 1948613 - RNA, 22 nt, Homo sapiens
gugggugccccccuugccagac

SEQ ID NO: 1948614 - RNA, 14 nt, Homo sapiens
agccaccucucugc

SEQ ID NO: 1948615 - RNA, 19 nt, Homo sapiens
ucaugcauggaaauucccu

SEQ ID NO: 1948616 - RNA, 13 nt, Homo sapiens
agucccugacucu

SEQ ID NO: 1948617 - RNA, 13 nt, Homo sapiens
agcuucugaccuc

SEQ ID NO: 1948618 - RNA, 13 nt, Homo sapiens
ugacccugucacu

SEQ ID NO: 1948619 - RNA, 16 nt, Homo sapiens
acucgagagugggcag

SEQ ID NO: 1948620 - RNA, 21 nt, Homo sapiens
uaagcagaagaucaaaaugcu

SEQ ID NO: 1948621 - RNA, 20 nt, Homo sapiens
auacaucuguggacaagaca

SEQ ID NO: 1948622 - RNA, 23 nt, Homo sapiens
aguucauccccugugaaucagag

SEQ ID NO: 1948623 - RNA, 15 nt, Homo sapiens
gaugauccauuugaa

SEQ ID NO: 1948624 - RNA, 14 nt, Homo sapiens
uacuauugcucuua

SEQ ID NO: 1948625 - RNA, 23 nt, Homo sapiens
agaaagcagaggcuggccucaga

SEQ ID NO: 1948626 - RNA, 13 nt, Homo sapiens
aagaaagccacac

SEQ ID NO: 1948627 - RNA, 22 nt, Homo sapiens
aggaaucuguuucucugcuguc

SEQ ID NO: 1948628 - RNA, 16 nt, Homo sapiens
aauuggcuaaucagua

SEQ ID NO: 1948629 - RNA, 18 nt, Homo sapiens
guccuagaaguucaguuu

SEQ ID NO: 1948630 - RNA, 22 nt, Homo sapiens
uuaauaagaacuugaauuucug

SEQ ID NO: 1948631 - RNA, 15 nt, Homo sapiens
caugccaaccccgcc

SEQ ID NO: 1948632 - RNA, 22 nt, Homo sapiens
cuuuaauguugcccacauuaag

SEQ ID NO: 1948633 - RNA, 19 nt, Homo sapiens
aaccacauuucuaagccuu

SEQ ID NO: 1948634 - RNA, 15 nt, Homo sapiens
acaucugcugugguc

SEQ ID NO: 1948635 - RNA, 21 nt, Homo sapiens
agagacgggguuucaccaugu

SEQ ID NO: 1948636 - RNA, 18 nt, Homo sapiens
acuugugccaacacucaa

SEQ ID NO: 1948637 - RNA, 22 nt, Homo sapiens
ccugaccgguuugcuacauucu

SEQ ID NO: 1948638 - RNA, 14 nt, Homo sapiens
uccccaucauccca

SEQ ID NO: 1948639 - RNA, 14 nt, Homo sapiens
ucucauucauucau

SEQ ID NO: 1948640 - RNA, 19 nt, Homo sapiens
auggaguguuuuaguucuu

SEQ ID NO: 1948641 - RNA, 18 nt, Homo sapiens
uguccugcuggcuuccag

SEQ ID NO: 1948642 - RNA, 19 nt, Homo sapiens
ccacaaucugacauucuca

SEQ ID NO: 1948643 - RNA, 15 nt, Homo sapiens
guguccuaugcaaua

SEQ ID NO: 1948644 - RNA, 16 nt, Homo sapiens
caguccuuuguugcug

SEQ ID NO: 1948645 - RNA, 19 nt, Homo sapiens
aaccuggguuguugcagag

SEQ ID NO: 1948646 - RNA, 15 nt, Homo sapiens
cagguagaccugucu

SEQ ID NO: 1948647 - RNA, 23 nt, Homo sapiens
gcaaaaaugaguugucacagaaa

SEQ ID NO: 1948648 - RNA, 18 nt, Homo sapiens
gauuucuauggcuuucaa

SEQ ID NO: 1948649 - RNA, 20 nt, Homo sapiens
uaacuuuuuuuucucucuuu

SEQ ID NO: 1948650 - RNA, 18 nt, Homo sapiens
augggcuuagagcucuca

SEQ ID NO: 1948651 - RNA, 23 nt, Homo sapiens
uacggacuuccuuuaggaucuca

SEQ ID NO: 1948652 - RNA, 20 nt, Homo sapiens
uguuuugaaaguuuaacaaa

SEQ ID NO: 1948653 - RNA, 23 nt, Homo sapiens
uaguaguuaauucugucacucac

SEQ ID NO: 1948654 - RNA, 22 nt, Homo sapiens
ucugccugggcuuaugcccuca

SEQ ID NO: 1948655 - RNA, 15 nt, Homo sapiens
uguuggcccuuccag

SEQ ID NO: 1948656 - RNA, 17 nt, Homo sapiens
augcauguagcauauaa

SEQ ID NO: 1948657 - RNA, 15 nt, Homo sapiens
cuccugcuggagcca

SEQ ID NO: 1948658 - RNA, 16 nt, Homo sapiens
cacccccaccauccag

SEQ ID NO: 1948659 - RNA, 21 nt, Homo sapiens
accaauguucuaaaguuuugc

SEQ ID NO: 1948660 - RNA, 23 nt, Homo sapiens
ugucauuuuuauaaaacuuugaa

SEQ ID NO: 1948661 - RNA, 14 nt, Homo sapiens
ccucacuucuggca

SEQ ID NO: 1948662 - RNA, 14 nt, Homo sapiens
gaaaacuucacugu

SEQ ID NO: 1948663 - RNA, 20 nt, Homo sapiens
uguacaagguauuuacacau

SEQ ID NO: 1948664 - RNA, 22 nt, Homo sapiens
auuguuuaaagcaacugucuau

SEQ ID NO: 1948665 - RNA, 14 nt, Homo sapiens
agacagaagccugg

SEQ ID NO: 1948666 - RNA, 18 nt, Homo sapiens
cugaauucacuccaguca

SEQ ID NO: 1948667 - RNA, 17 nt, Homo sapiens
uggucauggacagauag

SEQ ID NO: 1948668 - RNA, 15 nt, Homo sapiens
ugaggacagcugucc

SEQ ID NO: 1948669 - RNA, 20 nt, Homo sapiens
cuggggagagucacccugag

SEQ ID NO: 1948670 - RNA, 20 nt, Homo sapiens
aguauaaaucuaugauauau

SEQ ID NO: 1948671 - RNA, 20 nt, Homo sapiens
ucccgaguugcugggauuac

SEQ ID NO: 1948672 - RNA, 20 nt, Homo sapiens
aauuauagucaauauaccau

SEQ ID NO: 1948673 - RNA, 21 nt, Homo sapiens
aaagugugcuuaacauugaca

SEQ ID NO: 1948674 - RNA, 21 nt, Homo sapiens
cuuuuuuggcugcugaaggcu

SEQ ID NO: 1948675 - RNA, 18 nt, Homo sapiens
accugacaauggcagcua

SEQ ID NO: 1948676 - RNA, 17 nt, Homo sapiens
uaaaugauagguauuau

SEQ ID NO: 1948677 - RNA, 16 nt, Homo sapiens
uguaacuuauauugaa

SEQ ID NO: 1948678 - RNA, 16 nt, Homo sapiens
cugcaggauaaaaugg

SEQ ID NO: 1948679 - RNA, 15 nt, Homo sapiens
aucuccuuccagggc

SEQ ID NO: 1948680 - RNA, 16 nt, Homo sapiens
ugugcaggguccuccg

SEQ ID NO: 1948681 - RNA, 14 nt, Homo sapiens
cucuagaagccaag

SEQ ID NO: 1948682 - RNA, 12 nt, Homo sapiens
gcaaaugccuuu

SEQ ID NO: 1948683 - RNA, 20 nt, Homo sapiens
gauucagaaaauguucuguu

SEQ ID NO: 1948684 - RNA, 17 nt, Homo sapiens
uuuugaaaucccaucag

SEQ ID NO: 1948685 - RNA, 17 nt, Homo sapiens
uccacugaggaugugag

SEQ ID NO: 1948686 - RNA, 12 nt, Homo sapiens
ugcaacagcuac

SEQ ID NO: 1948687 - RNA, 18 nt, Homo sapiens
gacaaauacucaugugua

SEQ ID NO: 1948688 - RNA, 12 nt, Homo sapiens
auuaaagugaua

SEQ ID NO: 1948689 - RNA, 22 nt, Homo sapiens
ucacaacgggccagcucuagua

SEQ ID NO: 1948690 - RNA, 20 nt, Homo sapiens
cugcagacuccaauggggcc

SEQ ID NO: 1948691 - RNA, 14 nt, Homo sapiens
cuacugucaaauga

SEQ ID NO: 1948692 - RNA, 19 nt, Homo sapiens
uggacaagccauuauacca

SEQ ID NO: 1948693 - RNA, 17 nt, Homo sapiens
aaggcacuaaugauguu

SEQ ID NO: 1948694 - RNA, 19 nt, Homo sapiens
augugucugggagagccug

SEQ ID NO: 1948695 - RNA, 11 nt, Homo sapiens
uccuaggucuc

SEQ ID NO: 1948696 - RNA, 14 nt, Homo sapiens
cgaguguuugccag

SEQ ID NO: 1948697 - RNA, 14 nt, Homo sapiens
cuaaaauaugaugu

SEQ ID NO: 1948698 - RNA, 22 nt, Homo sapiens
auuacauagaacacuucagaca

SEQ ID NO: 1948699 - RNA, 15 nt, Homo sapiens
cacuuaaacucagcu

SEQ ID NO: 1948700 - RNA, 22 nt, Homo sapiens
ugcagaggcccagggcacucaa

SEQ ID NO: 1948701 - RNA, 19 nt, Homo sapiens
gcagccugagaaugaccug

SEQ ID NO: 1948702 - RNA, 17 nt, Homo sapiens
aaucagcccagugcaaa

SEQ ID NO: 1948703 - RNA, 19 nt, Homo sapiens
caggaauuucuguuagcaa

SEQ ID NO: 1948704 - RNA, 15 nt, Homo sapiens
uacugcgugugauaa

SEQ ID NO: 1948705 - RNA, 20 nt, Homo sapiens
aagagguagagaaaauggaa

SEQ ID NO: 1948706 - RNA, 22 nt, Homo sapiens
uuggacccaccugaaaugcagu

SEQ ID NO: 1948707 - RNA, 22 nt, Homo sapiens
cauuuagcuuguuccacugcaa

SEQ ID NO: 1948708 - RNA, 20 nt, Homo sapiens
acaguagcauacugaugaga

SEQ ID NO: 1948709 - RNA, 12 nt, Homo sapiens
auuaagugcaau

SEQ ID NO: 1948710 - RNA, 13 nt, Homo sapiens
uguuaguaguuuc

SEQ ID NO: 1948711 - RNA, 17 nt, Homo sapiens
uuaauaacuaaaccaga

SEQ ID NO: 1948712 - RNA, 22 nt, Homo sapiens
uuaucugcaccuagaaccuccc

SEQ ID NO: 1948713 - RNA, 21 nt, Homo sapiens
uuugucauauaagauucauau

SEQ ID NO: 1948714 - RNA, 19 nt, Homo sapiens
uguguccccaccucaggcu

SEQ ID NO: 1948715 - RNA, 18 nt, Homo sapiens
uuucugcuguaaagaaag

SEQ ID NO: 1948716 - RNA, 14 nt, Homo sapiens
ugcccacagggaac

SEQ ID NO: 1948717 - RNA, 18 nt, Homo sapiens
agacucacuaaauccuuu

SEQ ID NO: 1948718 - RNA, 22 nt, Homo sapiens
cugugugcccucccucacuugu

SEQ ID NO: 1948719 - RNA, 16 nt, Homo sapiens
uguagccaguuaagga

SEQ ID NO: 1948720 - RNA, 16 nt, Homo sapiens
gccuuagggcacuggg

SEQ ID NO: 1948721 - RNA, 21 nt, Homo sapiens
auaguagaaagacaucugccu

SEQ ID NO: 1948722 - RNA, 14 nt, Homo sapiens
ugucuuaaaucagu

SEQ ID NO: 1948723 - RNA, 23 nt, Homo sapiens
aaacaccaagugaggccauagca

SEQ ID NO: 1948724 - RNA, 20 nt, Homo sapiens
ugccuccaccccccagaacc

SEQ ID NO: 1948725 - RNA, 18 nt, Homo sapiens
uaaagagcuuugugauau

SEQ ID NO: 1948726 - RNA, 15 nt, Homo sapiens
aaagcuacuguagaa

SEQ ID NO: 1948727 - RNA, 16 nt, Homo sapiens
agggcaccauccagcu

SEQ ID NO: 1948728 - RNA, 16 nt, Homo sapiens
guggcaguggccaggc

SEQ ID NO: 1948729 - RNA, 15 nt, Homo sapiens
auguagcugaaugug

SEQ ID NO: 1948730 - RNA, 18 nt, Homo sapiens
acaugcuauccaaucuca

SEQ ID NO: 1948731 - RNA, 16 nt, Homo sapiens
aaacauaucaauucaa

SEQ ID NO: 1948732 - RNA, 14 nt, Homo sapiens
accuuuccauuuau

SEQ ID NO: 1948733 - RNA, 22 nt, Homo sapiens
uucugcaacaucuuaagaucca

SEQ ID NO: 1948734 - RNA, 10 nt, Homo sapiens
cggaucucug

SEQ ID NO: 1948735 - RNA, 18 nt, Homo sapiens
gauuuuuuuaaaguaguu

SEQ ID NO: 1948736 - RNA, 17 nt, Homo sapiens
agacugcuagaaccaag

SEQ ID NO: 1948737 - RNA, 16 nt, Homo sapiens
cgugcaccaccaugcc

SEQ ID NO: 1948738 - RNA, 21 nt, Homo sapiens
uuuacuaaaauggcagcuuaa

SEQ ID NO: 1948739 - RNA, 17 nt, Homo sapiens
ucucugaaaguggugcu

SEQ ID NO: 1948740 - RNA, 21 nt, Homo sapiens
cuguugggagccugugagccc

SEQ ID NO: 1948741 - RNA, 16 nt, Homo sapiens
uaacucaucugucacc

SEQ ID NO: 1948742 - RNA, 16 nt, Homo sapiens
ucacucuuaugcugua

SEQ ID NO: 1948743 - RNA, 22 nt, Homo sapiens
ccaucuuuaucaugaagcacau

SEQ ID NO: 1948744 - RNA, 19 nt, Homo sapiens
accauucaggacacaggga

SEQ ID NO: 1948745 - RNA, 14 nt, Homo sapiens
aacacuaauuauca

SEQ ID NO: 1948746 - RNA, 18 nt, Homo sapiens
uaugucucagaccacuau

SEQ ID NO: 1948747 - RNA, 18 nt, Homo sapiens
gccugagucgugaccugc

SEQ ID NO: 1948748 - RNA, 21 nt, Homo sapiens
aacuauaugccauaaaccuca

SEQ ID NO: 1948749 - RNA, 20 nt, Homo sapiens
gaugauuugcuuaaauaucc

SEQ ID NO: 1948750 - RNA, 13 nt, Homo sapiens
uggccuggcacau

SEQ ID NO: 1948751 - RNA, 19 nt, Homo sapiens
guggcucaacacaugagaa

SEQ ID NO: 1948752 - RNA, 14 nt, Homo sapiens
ucagcggcuccagc

SEQ ID NO: 1948753 - RNA, 14 nt, Homo sapiens
guaaguuucaggug

SEQ ID NO: 1948754 - RNA, 19 nt, Homo sapiens
uauguaaaauuuugccuaa

SEQ ID NO: 1948755 - RNA, 16 nt, Homo sapiens
cuguguguggggccca

SEQ ID NO: 1948756 - RNA, 15 nt, Homo sapiens
agguuugccagugaa

SEQ ID NO: 1948757 - RNA, 20 nt, Homo sapiens
augccagccaagcucugcag

SEQ ID NO: 1948758 - RNA, 22 nt, Homo sapiens
ucaguuaugauuuuuuuuucau

SEQ ID NO: 1948759 - RNA, 22 nt, Homo sapiens
aggcacacaccaccaugcucaa

SEQ ID NO: 1948760 - RNA, 23 nt, Homo sapiens
gauauuaaaaauugaaaacuuug

SEQ ID NO: 1948761 - RNA, 14 nt, Homo sapiens
aaauaggauuugca

SEQ ID NO: 1948762 - RNA, 22 nt, Homo sapiens
ucagagagccuagaacaucccu

SEQ ID NO: 1948763 - RNA, 20 nt, Homo sapiens
accuuugcaggcaugcaugu

SEQ ID NO: 1948764 - RNA, 19 nt, Homo sapiens
cuuuaaucuucaguuuuau

SEQ ID NO: 1948765 - RNA, 12 nt, Homo sapiens
ugauucauaugu

SEQ ID NO: 1948766 - RNA, 24 nt, Homo sapiens
uuaucuaauuugugccucacugga

SEQ ID NO: 1948767 - RNA, 17 nt, Homo sapiens
ggagaauuuuacugugu

SEQ ID NO: 1948768 - RNA, 13 nt, Homo sapiens
uuggauaagccaa

SEQ ID NO: 1948769 - RNA, 16 nt, Homo sapiens
ccaaauauugaucugu

SEQ ID NO: 1948770 - RNA, 18 nt, Homo sapiens
cuccauuucuuucuucca

SEQ ID NO: 1948771 - RNA, 15 nt, Homo sapiens
aacauggacuuguau

SEQ ID NO: 1948772 - RNA, 19 nt, Homo sapiens
cagggacucaggccaguca

SEQ ID NO: 1948773 - RNA, 19 nt, Homo sapiens
cuguacaaaagggacauga

SEQ ID NO: 1948774 - RNA, 19 nt, Homo sapiens
agaggaauuuauaccucaa

SEQ ID NO: 1948775 - RNA, 14 nt, Homo sapiens
auuguacauucccu

SEQ ID NO: 1948776 - RNA, 13 nt, Homo sapiens
aauauuacauugc

SEQ ID NO: 1948777 - RNA, 14 nt, Homo sapiens
gucuuucacuggaa

SEQ ID NO: 1948778 - RNA, 17 nt, Homo sapiens
auuggaagcauacaaag

SEQ ID NO: 1948779 - RNA, 18 nt, Homo sapiens
caccaaaacaaacccaaa

SEQ ID NO: 1948780 - RNA, 24 nt, Homo sapiens
cugguaaauuuuauaaugucauau

SEQ ID NO: 1948781 - RNA, 20 nt, Homo sapiens
gaaaauaguuuggauuacuu

SEQ ID NO: 1948782 - RNA, 23 nt, Homo sapiens
auguacguuacagcuuucacaga

SEQ ID NO: 1948783 - RNA, 13 nt, Homo sapiens
uauucauaugcuu

SEQ ID NO: 1948784 - RNA, 14 nt, Homo sapiens
gagcaauuugcaca

SEQ ID NO: 1948785 - RNA, 21 nt, Homo sapiens
agacaguugguuuugcauguc

SEQ ID NO: 1948786 - RNA, 16 nt, Homo sapiens
auuguugaacacuuga

SEQ ID NO: 1948787 - RNA, 13 nt, Homo sapiens
uuucuagcaaaca

SEQ ID NO: 1948788 - RNA, 13 nt, Homo sapiens
uaaaaagcauuau

SEQ ID NO: 1948789 - RNA, 13 nt, Homo sapiens
aaaaaagcuuuau

SEQ ID NO: 1948790 - RNA, 15 nt, Homo sapiens
uagaucaaagucaaa

SEQ ID NO: 1948791 - RNA, 21 nt, Homo sapiens
ccccaagaagaugaaagauuc

SEQ ID NO: 1948792 - RNA, 12 nt, Homo sapiens
ugucccaggacu

SEQ ID NO: 1948793 - RNA, 11 nt, Homo sapiens
uagacuaguuu

SEQ ID NO: 1948794 - RNA, 18 nt, Homo sapiens
augaaucauugauugaau

SEQ ID NO: 1948795 - RNA, 14 nt, Homo sapiens
ucaaauuuaucucu

SEQ ID NO: 1948796 - RNA, 19 nt, Homo sapiens
uccaauuauuacaguccuu

SEQ ID NO: 1948797 - RNA, 17 nt, Homo sapiens
uggccuccccugcugaa

SEQ ID NO: 1948798 - RNA, 20 nt, Homo sapiens
aacaaaaugaauucugggaa

SEQ ID NO: 1948799 - RNA, 21 nt, Homo sapiens
cuaaagagcugcacagcaaaa

SEQ ID NO: 1948800 - RNA, 21 nt, Homo sapiens
aucuaccaucuaaucuaugca

SEQ ID NO: 1948801 - RNA, 17 nt, Homo sapiens
acacuguuucaucucag

SEQ ID NO: 1948802 - RNA, 20 nt, Homo sapiens
cagagguuguggugagccga

SEQ ID NO: 1948803 - RNA, 19 nt, Homo sapiens
agccauggugacacacagc

SEQ ID NO: 1948804 - RNA, 21 nt, Homo sapiens
augucuucaauggaauacagu

SEQ ID NO: 1948805 - RNA, 17 nt, Homo sapiens
uaaugucuuguuaauau

SEQ ID NO: 1948806 - RNA, 23 nt, Homo sapiens
uaaugucuccuuugcucuugcca

SEQ ID NO: 1948807 - RNA, 21 nt, Homo sapiens
ugcccaagucuuuccuaccuu

SEQ ID NO: 1948808 - RNA, 22 nt, Homo sapiens
auucccugccuugcugacaaua

SEQ ID NO: 1948809 - RNA, 21 nt, Homo sapiens
uugugaacgcugugaugcugu

SEQ ID NO: 1948810 - RNA, 23 nt, Homo sapiens
caucauuguuuaggggugaagga

SEQ ID NO: 1948811 - RNA, 20 nt, Homo sapiens
uccaaagaguuucugcaaag

SEQ ID NO: 1948812 - RNA, 21 nt, Homo sapiens
aagacauuuuguuuuuacugu

SEQ ID NO: 1948813 - RNA, 21 nt, Homo sapiens
caguggaagggaaaagcccau

SEQ ID NO: 1948814 - RNA, 12 nt, Homo sapiens
uuccuaacauaa

SEQ ID NO: 1948815 - RNA, 23 nt, Homo sapiens
acuaauguuagaauugauuucca

SEQ ID NO: 1948816 - RNA, 17 nt, Homo sapiens
cugcccugaggcuguga

SEQ ID NO: 1948817 - RNA, 15 nt, Homo sapiens
uaaauuuucuaugcu

SEQ ID NO: 1948818 - RNA, 19 nt, Homo sapiens
ccuacaaguugaucaugca

SEQ ID NO: 1948819 - RNA, 23 nt, Homo sapiens
ucucccaagcugauuuuauucaa

SEQ ID NO: 1948820 - RNA, 13 nt, Homo sapiens
uccugugcuggaa

SEQ ID NO: 1948821 - RNA, 23 nt, Homo sapiens
ucagaugcuugcggcaaaaggaa

SEQ ID NO: 1948822 - RNA, 21 nt, Homo sapiens
uuuccacucaaaauaugucaa

SEQ ID NO: 1948823 - RNA, 22 nt, Homo sapiens
uagcaagaacucugcacagcaa

SEQ ID NO: 1948824 - RNA, 17 nt, Homo sapiens
caacuacgcugauuuga

SEQ ID NO: 1948825 - RNA, 22 nt, Homo sapiens
uggcccaaagcuguugaaguca

SEQ ID NO: 1948826 - RNA, 19 nt, Homo sapiens
aaaacugacaguaaaucuc

SEQ ID NO: 1948827 - RNA, 20 nt, Homo sapiens
auaugggguugguguucuca

SEQ ID NO: 1948828 - RNA, 13 nt, Homo sapiens
aauuaaucacaaa

SEQ ID NO: 1948829 - RNA, 15 nt, Homo sapiens
acaggggcacaagcc

SEQ ID NO: 1948830 - RNA, 14 nt, Homo sapiens
aguggauuuuacau

SEQ ID NO: 1948831 - RNA, 16 nt, Homo sapiens
ugaccauuucaggggu

SEQ ID NO: 1948832 - RNA, 17 nt, Homo sapiens
uaacucaccagauuuac

SEQ ID NO: 1948833 - RNA, 23 nt, Homo sapiens
acuuauuguuuaagguuuccuca

SEQ ID NO: 1948834 - RNA, 15 nt, Homo sapiens
auauaugauuagcca

SEQ ID NO: 1948835 - RNA, 21 nt, Homo sapiens
aaagacauaauuuaauuccuu

SEQ ID NO: 1948836 - RNA, 16 nt, Homo sapiens
gagaaauuuuaguuua

SEQ ID NO: 1948837 - RNA, 17 nt, Homo sapiens
ugcaaccuuguacuuua

SEQ ID NO: 1948838 - RNA, 19 nt, Homo sapiens
ugcccugcugagcacagac

SEQ ID NO: 1948839 - RNA, 18 nt, Homo sapiens
acaaauaaacucauuuaa

SEQ ID NO: 1948840 - RNA, 14 nt, Homo sapiens
uuccaacugccaga

SEQ ID NO: 1948841 - RNA, 11 nt, Homo sapiens
accagggacac

SEQ ID NO: 1948842 - RNA, 21 nt, Homo sapiens
ugugggccuucucaaaccgcc

SEQ ID NO: 1948843 - RNA, 16 nt, Homo sapiens
uauuaaauguugcaca

SEQ ID NO: 1948844 - RNA, 15 nt, Homo sapiens
ugaucaggcacagug

SEQ ID NO: 1948845 - RNA, 18 nt, Homo sapiens
cucagcagggcuggucac

SEQ ID NO: 1948846 - RNA, 17 nt, Homo sapiens
ccagcgggcacagggca

SEQ ID NO: 1948847 - RNA, 21 nt, Homo sapiens
ucacauaagcucagaauccaa

SEQ ID NO: 1948848 - RNA, 16 nt, Homo sapiens
cugcuccaccuugaac

SEQ ID NO: 1948849 - RNA, 20 nt, Homo sapiens
cuggagugcagugaugcaau

SEQ ID NO: 1948850 - RNA, 13 nt, Homo sapiens
cauguaauggacu

SEQ ID NO: 1948851 - RNA, 21 nt, Homo sapiens
uccaugagggcagggacauca

SEQ ID NO: 1948852 - RNA, 16 nt, Homo sapiens
uuuucuauauggggau

SEQ ID NO: 1948853 - RNA, 18 nt, Homo sapiens
gugaacacuagccagaca

SEQ ID NO: 1948854 - RNA, 21 nt, Homo sapiens
caucucccacgaacucaaggg

SEQ ID NO: 1948855 - RNA, 16 nt, Homo sapiens
guagcauuuuccagca

SEQ ID NO: 1948856 - RNA, 20 nt, Homo sapiens
caaaccaaugcuauugugau

SEQ ID NO: 1948857 - RNA, 17 nt, Homo sapiens
auuacaaguuguacuaa

SEQ ID NO: 1948858 - RNA, 13 nt, Homo sapiens
ggucccuauagca

SEQ ID NO: 1948859 - RNA, 20 nt, Homo sapiens
gcauuucacaugccuugcaa

SEQ ID NO: 1948860 - RNA, 15 nt, Homo sapiens
uuugcgucaggagca

SEQ ID NO: 1948861 - RNA, 22 nt, Homo sapiens
cuccauccugcagauacuuuga

SEQ ID NO: 1948862 - RNA, 15 nt, Homo sapiens
cucaaugcacugaca

SEQ ID NO: 1948863 - RNA, 13 nt, Homo sapiens
cgaaacacacaaa

SEQ ID NO: 1948864 - RNA, 18 nt, Homo sapiens
uccuaaaaguguaagaaa

SEQ ID NO: 1948865 - RNA, 12 nt, Homo sapiens
cugaagugaaua

SEQ ID NO: 1948866 - RNA, 12 nt, Homo sapiens
cuggagugaaug

SEQ ID NO: 1948867 - RNA, 21 nt, Homo sapiens
agaacugacaugcaggucaaa

SEQ ID NO: 1948868 - RNA, 15 nt, Homo sapiens
auacaaaacuauuaa

SEQ ID NO: 1948869 - RNA, 15 nt, Homo sapiens
caucaggaaauuugg

SEQ ID NO: 1948870 - RNA, 19 nt, Homo sapiens
cugucccuugcuguaugcu

SEQ ID NO: 1948871 - RNA, 16 nt, Homo sapiens
cccaaguagcugcuac

SEQ ID NO: 1948872 - RNA, 13 nt, Homo sapiens
gcuaagaaccugg

SEQ ID NO: 1948873 - RNA, 16 nt, Homo sapiens
cuggagugcaguggcg

SEQ ID NO: 1948874 - RNA, 16 nt, Homo sapiens
cgggagaccugugcua

SEQ ID NO: 1948875 - RNA, 15 nt, Homo sapiens
aauauuuuagccuua

SEQ ID NO: 1948876 - RNA, 16 nt, Homo sapiens
uguaacugcauuagaa

SEQ ID NO: 1948877 - RNA, 20 nt, Homo sapiens
cuuugaagcuagugcauugg

SEQ ID NO: 1948878 - RNA, 13 nt, Homo sapiens
uuuaaccaaaaca

SEQ ID NO: 1948879 - RNA, 22 nt, Homo sapiens
uuaaauggaauuuucuaauaua

SEQ ID NO: 1948880 - RNA, 18 nt, Homo sapiens
uauuuaaagccuccucau

SEQ ID NO: 1948881 - RNA, 16 nt, Homo sapiens
aucucuaggaagucaa

SEQ ID NO: 1948882 - RNA, 21 nt, Homo sapiens
uuuaaagcuuauuaaaacuca

SEQ ID NO: 1948883 - RNA, 22 nt, Homo sapiens
acuuugguaccagauaacuuuu

SEQ ID NO: 1948884 - RNA, 18 nt, Homo sapiens
ugagcacuaucuuucagg

SEQ ID NO: 1948885 - RNA, 19 nt, Homo sapiens
uccugcuccuccaguacaa

SEQ ID NO: 1948886 - RNA, 23 nt, Homo sapiens
caaacaaacgaaaaacauuucaa

SEQ ID NO: 1948887 - RNA, 21 nt, Homo sapiens
aacucuuucuuugguauucca

SEQ ID NO: 1948888 - RNA, 15 nt, Homo sapiens
ccaaugggagcucau

SEQ ID NO: 1948889 - RNA, 13 nt, Homo sapiens
uaauuaacauauc

SEQ ID NO: 1948890 - RNA, 19 nt, Homo sapiens
gcauagaguagguacucca

SEQ ID NO: 1948891 - RNA, 15 nt, Homo sapiens
ugcggugucacuggg

SEQ ID NO: 1948892 - RNA, 20 nt, Homo sapiens
cagcagggcuggucaccucc

SEQ ID NO: 1948893 - RNA, 17 nt, Homo sapiens
aagaacugcuuucuuuc

SEQ ID NO: 1948894 - RNA, 20 nt, Homo sapiens
uagccucugggaucugccaa

SEQ ID NO: 1948895 - RNA, 17 nt, Homo sapiens
ccacuggccaucuccac

SEQ ID NO: 1948896 - RNA, 20 nt, Homo sapiens
accuucugucguccccagac

SEQ ID NO: 1948897 - RNA, 18 nt, Homo sapiens
gcagggacaauuugcugc

SEQ ID NO: 1948898 - RNA, 22 nt, Homo sapiens
ugugaaaguaugugauaucuga

SEQ ID NO: 1948899 - RNA, 17 nt, Homo sapiens
uggaauagaugucucaa

SEQ ID NO: 1948900 - RNA, 15 nt, Homo sapiens
gaaagaguugcagua

SEQ ID NO: 1948901 - RNA, 23 nt, Homo sapiens
auucagaauuucuaaaaguuuaa

SEQ ID NO: 1948902 - RNA, 15 nt, Homo sapiens
acacgaagccagcag

SEQ ID NO: 1948903 - RNA, 23 nt, Homo sapiens
aucacucucugcuggcaggauuc

SEQ ID NO: 1948904 - RNA, 23 nt, Homo sapiens
ugacauaggauccgaagugcaau

SEQ ID NO: 1948905 - RNA, 22 nt, Homo sapiens
uguuuucaauguuucacuacuc

SEQ ID NO: 1948906 - RNA, 20 nt, Homo sapiens
acuuaucacgccuacuuaag

SEQ ID NO: 1948907 - RNA, 21 nt, Homo sapiens
augauuggauuauucauuuaa

SEQ ID NO: 1948908 - RNA, 19 nt, Homo sapiens
cugugugcaagugugugca

SEQ ID NO: 1948909 - RNA, 18 nt, Homo sapiens
gucacguucuuggauccu

SEQ ID NO: 1948910 - RNA, 21 nt, Homo sapiens
augagccucagcauccuggca

SEQ ID NO: 1948911 - RNA, 18 nt, Homo sapiens
aagaacauggacuuguau

SEQ ID NO: 1948912 - RNA, 16 nt, Homo sapiens
agggucccuuuugcau

SEQ ID NO: 1948913 - RNA, 13 nt, Homo sapiens
ccgugaggucaca

SEQ ID NO: 1948914 - RNA, 19 nt, Homo sapiens
ugugcuugggaucuucaau

SEQ ID NO: 1948915 - RNA, 19 nt, Homo sapiens
acuugauggaaggaucucu

SEQ ID NO: 1948916 - RNA, 21 nt, Homo sapiens
aguucuaugcagaacagugag

SEQ ID NO: 1948917 - RNA, 16 nt, Homo sapiens
cauauuccaugacuca

SEQ ID NO: 1948918 - RNA, 12 nt, Homo sapiens
agacacuggaca

SEQ ID NO: 1948919 - RNA, 16 nt, Homo sapiens
ucuuccagaccugcuu

SEQ ID NO: 1948920 - RNA, 18 nt, Homo sapiens
uuguugagugcacugacu

SEQ ID NO: 1948921 - RNA, 21 nt, Homo sapiens
uggcccaugugacuguggcau

SEQ ID NO: 1948922 - RNA, 19 nt, Homo sapiens
uucugagccuucuacuuau

SEQ ID NO: 1948923 - RNA, 12 nt, Homo sapiens
cuuuuuacacuu

SEQ ID NO: 1948924 - RNA, 22 nt, Homo sapiens
uugcuuaacccacaguucucca

SEQ ID NO: 1948925 - RNA, 19 nt, Homo sapiens
agaagcaucaccaugcaug

SEQ ID NO: 1948926 - RNA, 18 nt, Homo sapiens
ugcccugauccaaguuua

SEQ ID NO: 1948927 - RNA, 21 nt, Homo sapiens
aaaaguauuguggcaccucaa

SEQ ID NO: 1948928 - RNA, 20 nt, Homo sapiens
aaaguuuucuccacuggaaa

SEQ ID NO: 1948929 - RNA, 21 nt, Homo sapiens
ccucuuucuccagcagcugau

SEQ ID NO: 1948930 - RNA, 13 nt, Homo sapiens
gcuuuaugcacau

SEQ ID NO: 1948931 - RNA, 14 nt, Homo sapiens
uccucuagacuuga

SEQ ID NO: 1948932 - RNA, 18 nt, Homo sapiens
gaacugcacaaugcauug

SEQ ID NO: 1948933 - RNA, 16 nt, Homo sapiens
uuauauguacauacau

SEQ ID NO: 1948934 - RNA, 19 nt, Homo sapiens
ucucaaggagaggcaaaga

SEQ ID NO: 1948935 - RNA, 18 nt, Homo sapiens
gccacuaaccuuccaaaa

SEQ ID NO: 1948936 - RNA, 21 nt, Homo sapiens
gcccagaauaaacuggcagcu

SEQ ID NO: 1948937 - RNA, 20 nt, Homo sapiens
uccccuccguggcaucaccu

SEQ ID NO: 1948938 - RNA, 21 nt, Homo sapiens
uacaguuucuggcuggcuuca

SEQ ID NO: 1948939 - RNA, 18 nt, Homo sapiens
cuuguucauuuuucucuc

SEQ ID NO: 1948940 - RNA, 12 nt, Homo sapiens
guuucugauuaa

SEQ ID NO: 1948941 - RNA, 18 nt, Homo sapiens
agccucuuagaugcaguu

SEQ ID NO: 1948942 - RNA, 18 nt, Homo sapiens
cuccucugcuaugcauuu

SEQ ID NO: 1948943 - RNA, 17 nt, Homo sapiens
aggcaucucuguacuuu

SEQ ID NO: 1948944 - RNA, 23 nt, Homo sapiens
agggcuagaaccuguagagcuag

SEQ ID NO: 1948945 - RNA, 21 nt, Homo sapiens
ugaucccugugccucuuccca

SEQ ID NO: 1948946 - RNA, 13 nt, Homo sapiens
uggcuaugccuuc

SEQ ID NO: 1948947 - RNA, 16 nt, Homo sapiens
agauguguuaggaaug

SEQ ID NO: 1948948 - RNA, 18 nt, Homo sapiens
caugguuuuucacauugc

SEQ ID NO: 1948949 - RNA, 17 nt, Homo sapiens
ucaauaaggcagugcag

SEQ ID NO: 1948950 - RNA, 21 nt, Homo sapiens
gagaagggaggguggccagca

SEQ ID NO: 1948951 - RNA, 14 nt, Homo sapiens
aaacugucugggag

SEQ ID NO: 1948952 - RNA, 13 nt, Homo sapiens
augcuagcagcug

SEQ ID NO: 1948953 - RNA, 15 nt, Homo sapiens
ccuucuuugcacuuu

SEQ ID NO: 1948954 - RNA, 11 nt, Homo sapiens
ccgugccuuca

SEQ ID NO: 1948955 - RNA, 15 nt, Homo sapiens
aaagcuuaggcugcu

SEQ ID NO: 1948956 - RNA, 13 nt, Homo sapiens
agaugagcuuaca

SEQ ID NO: 1948957 - RNA, 20 nt, Homo sapiens
gaaauauauuauuuccuuua

SEQ ID NO: 1948958 - RNA, 19 nt, Homo sapiens
augauuucaugcuaucucu

SEQ ID NO: 1948959 - RNA, 22 nt, Homo sapiens
gacaccauccaggaagacccca

SEQ ID NO: 1948960 - RNA, 20 nt, Homo sapiens
auaaugaguuccugagacau

SEQ ID NO: 1948961 - RNA, 15 nt, Homo sapiens
aacaacugaccaguu

SEQ ID NO: 1948962 - RNA, 20 nt, Homo sapiens
agucagacuuacuuacuccc

SEQ ID NO: 1948963 - RNA, 16 nt, Homo sapiens
aaauuuuuugauuaau

SEQ ID NO: 1948964 - RNA, 19 nt, Homo sapiens
ggccaagguuucccaguga

SEQ ID NO: 1948965 - RNA, 15 nt, Homo sapiens
acugucuauuaaaau

SEQ ID NO: 1948966 - RNA, 16 nt, Homo sapiens
auccuuaugcaugaaa

SEQ ID NO: 1948967 - RNA, 18 nt, Homo sapiens
ccacagccacuaagauaa

SEQ ID NO: 1948968 - RNA, 22 nt, Homo sapiens
aggaacugcuugugcacuggau

SEQ ID NO: 1948969 - RNA, 14 nt, Homo sapiens
uuuaggaguacuga

SEQ ID NO: 1948970 - RNA, 21 nt, Homo sapiens
cuugaguagauccaguauuug

SEQ ID NO: 1948971 - RNA, 15 nt, Homo sapiens
augaaugugcugaag

SEQ ID NO: 1948972 - RNA, 16 nt, Homo sapiens
uccuuuguacugauga

SEQ ID NO: 1948973 - RNA, 22 nt, Homo sapiens
ucuucccaccugucaaccugaa

SEQ ID NO: 1948974 - RNA, 19 nt, Homo sapiens
agaaaucugugccugagaa

SEQ ID NO: 1948975 - RNA, 14 nt, Homo sapiens
cuuacugugaagga

SEQ ID NO: 1948976 - RNA, 11 nt, Homo sapiens
aaggucucauu

SEQ ID NO: 1948977 - RNA, 15 nt, Homo sapiens
uaugguucugcaguc

SEQ ID NO: 1948978 - RNA, 20 nt, Homo sapiens
gaaaacagagccugccuaac

SEQ ID NO: 1948979 - RNA, 16 nt, Homo sapiens
uuccaugaaaaugcaa

SEQ ID NO: 1948980 - RNA, 16 nt, Homo sapiens
agacagugacuguaca

SEQ ID NO: 1948981 - RNA, 22 nt, Homo sapiens
gauccuuuugugccauguucaa

SEQ ID NO: 1948982 - RNA, 20 nt, Homo sapiens
caggaccacaggcucaggca

SEQ ID NO: 1948983 - RNA, 21 nt, Homo sapiens
agcacagauguucccccaucu

SEQ ID NO: 1948984 - RNA, 12 nt, Homo sapiens
gauuuugaauag

SEQ ID NO: 1948985 - RNA, 18 nt, Homo sapiens
ccuggcagcaugacucag

SEQ ID NO: 1948986 - RNA, 16 nt, Homo sapiens
gcuaaaugugauccug

SEQ ID NO: 1948987 - RNA, 23 nt, Homo sapiens
uaaucauaucuuuuaauugugua

SEQ ID NO: 1948988 - RNA, 16 nt, Homo sapiens
uagcauuaugcaauua

SEQ ID NO: 1948989 - RNA, 21 nt, Homo sapiens
ugcucugucuucuuugcccac

SEQ ID NO: 1948990 - RNA, 20 nt, Homo sapiens
ugcauauccaacaugugcuc

SEQ ID NO: 1948991 - RNA, 13 nt, Homo sapiens
uacgauuguguau

SEQ ID NO: 1948992 - RNA, 12 nt, Homo sapiens
agagguuaacag

SEQ ID NO: 1948993 - RNA, 19 nt, Homo sapiens
ucucuuccggucggaucuc

SEQ ID NO: 1948994 - RNA, 23 nt, Homo sapiens
uuugcuuguccuuuggccuuuca

SEQ ID NO: 1948995 - RNA, 14 nt, Homo sapiens
aaccauauggauau

SEQ ID NO: 1948996 - RNA, 20 nt, Homo sapiens
guguccuucuccucuuguag

SEQ ID NO: 1948997 - RNA, 19 nt, Homo sapiens
caaauguguggguuuuuaa

SEQ ID NO: 1948998 - RNA, 22 nt, Homo sapiens
gauuuacuuaauucagucucag

SEQ ID NO: 1948999 - RNA, 22 nt, Homo sapiens
uacccaagcaaaaucauggaau

SEQ ID NO: 1949000 - RNA, 16 nt, Homo sapiens
aauuaagcucuugcua

SEQ ID NO: 1949001 - RNA, 23 nt, Homo sapiens
ccuuuugucucugcaaacugccu

SEQ ID NO: 1949002 - RNA, 20 nt, Homo sapiens
ucaucaggaaggaaaugaca

SEQ ID NO: 1949003 - RNA, 19 nt, Homo sapiens
acugaggcagcgaccucaa

SEQ ID NO: 1949004 - RNA, 14 nt, Homo sapiens
cucccuuacccucc

SEQ ID NO: 1949005 - RNA, 19 nt, Homo sapiens
gcaacaggaggcauucugu

SEQ ID NO: 1949006 - RNA, 15 nt, Homo sapiens
ggacacggacccugu

SEQ ID NO: 1949007 - RNA, 13 nt, Homo sapiens
ugaacuacacugc

SEQ ID NO: 1949008 - RNA, 22 nt, Homo sapiens
caagaagaaaacgaacugggaa

SEQ ID NO: 1949009 - RNA, 18 nt, Homo sapiens
caaggagcacaagccaca

SEQ ID NO: 1949010 - RNA, 16 nt, Homo sapiens
uguuaaacaugcuaaa

SEQ ID NO: 1949011 - RNA, 16 nt, Homo sapiens
uuguuaucagucaaua

SEQ ID NO: 1949012 - RNA, 20 nt, Homo sapiens
ucacagggccccagaaggca

SEQ ID NO: 1949013 - RNA, 16 nt, Homo sapiens
cuccgcgugucucauu

SEQ ID NO: 1949014 - RNA, 12 nt, Homo sapiens
aaccugaguuua

SEQ ID NO: 1949015 - RNA, 21 nt, Homo sapiens
ggaauacacuugcauguacag

SEQ ID NO: 1949016 - RNA, 23 nt, Homo sapiens
uucucaguaaauauuaaccugaa

SEQ ID NO: 1949017 - RNA, 21 nt, Homo sapiens
guagugucauguucugugcau

SEQ ID NO: 1949018 - RNA, 19 nt, Homo sapiens
accaggugucucugagaau

SEQ ID NO: 1949019 - RNA, 19 nt, Homo sapiens
uuacacccuuucuugacaa

SEQ ID NO: 1949020 - RNA, 22 nt, Homo sapiens
cuuauugguggcuguuccugaa

SEQ ID NO: 1949021 - RNA, 22 nt, Homo sapiens
ucacauauuauuggucaagaaa

SEQ ID NO: 1949022 - RNA, 17 nt, Homo sapiens
aaaucucccaugugcau

SEQ ID NO: 1949023 - RNA, 11 nt, Homo sapiens
uaaucuaagaa

SEQ ID NO: 1949024 - RNA, 22 nt, Homo sapiens
uaauuuagacauugaguucaaa

SEQ ID NO: 1949025 - RNA, 21 nt, Homo sapiens
aaaguggugagaggcauccag

SEQ ID NO: 1949026 - RNA, 13 nt, Homo sapiens
aaugacauuugua

SEQ ID NO: 1949027 - RNA, 21 nt, Homo sapiens
uacagacauccuagcauuugu

SEQ ID NO: 1949028 - RNA, 17 nt, Homo sapiens
caauaaaugccacuuca

SEQ ID NO: 1949029 - RNA, 15 nt, Homo sapiens
uuuagaaacugaguc

SEQ ID NO: 1949030 - RNA, 13 nt, Homo sapiens
cugggccaagcca

SEQ ID NO: 1949031 - RNA, 20 nt, Homo sapiens
ggugaccucacacaccucug

SEQ ID NO: 1949032 - RNA, 17 nt, Homo sapiens
ucuccucuagacugacu

SEQ ID NO: 1949033 - RNA, 15 nt, Homo sapiens
uggccaagccuauca

SEQ ID NO: 1949034 - RNA, 20 nt, Homo sapiens
acuaaagcucccagcuccuu

SEQ ID NO: 1949035 - RNA, 18 nt, Homo sapiens
uauugaggaaaauuaaua

SEQ ID NO: 1949036 - RNA, 23 nt, Homo sapiens
cuauuuuuauuuguuugugcauu

SEQ ID NO: 1949037 - RNA, 20 nt, Homo sapiens
ccauccuaccaaugcaugca

SEQ ID NO: 1949038 - RNA, 18 nt, Homo sapiens
aaaccauguagcagugag

SEQ ID NO: 1949039 - RNA, 14 nt, Homo sapiens
uuccuucuacuuac

SEQ ID NO: 1949040 - RNA, 17 nt, Homo sapiens
acucauccauccccugg

SEQ ID NO: 1949041 - RNA, 22 nt, Homo sapiens
ccacugaguauguucauugcca

SEQ ID NO: 1949042 - RNA, 18 nt, Homo sapiens
acuugcagaguacaugau

SEQ ID NO: 1949043 - RNA, 16 nt, Homo sapiens
auuuauuuacaacuca

SEQ ID NO: 1949044 - RNA, 14 nt, Homo sapiens
gcugaagcagguuc

SEQ ID NO: 1949045 - RNA, 18 nt, Homo sapiens
aggaugcuaaaaauguca

SEQ ID NO: 1949046 - RNA, 19 nt, Homo sapiens
auuuauuuaaaacuaccca

SEQ ID NO: 1949047 - RNA, 15 nt, Homo sapiens
agccuuguaaauaac

SEQ ID NO: 1949048 - RNA, 15 nt, Homo sapiens
guuauguuugaauga

SEQ ID NO: 1949049 - RNA, 17 nt, Homo sapiens
cugggcuaaggaaguau

SEQ ID NO: 1949050 - RNA, 16 nt, Homo sapiens
accuucauaugcagua

SEQ ID NO: 1949051 - RNA, 16 nt, Homo sapiens
ccuuacucaccucucu

SEQ ID NO: 1949052 - RNA, 20 nt, Homo sapiens
auguguuuuuaaggaaaaug

SEQ ID NO: 1949053 - RNA, 16 nt, Homo sapiens
ugcuuucugcucuuua

SEQ ID NO: 1949054 - RNA, 18 nt, Homo sapiens
uguaguccuagcuaucaa

SEQ ID NO: 1949055 - RNA, 19 nt, Homo sapiens
gucacuaaccaagccagaa

SEQ ID NO: 1949056 - RNA, 24 nt, Homo sapiens
cacagguguguuucccaucccacu

SEQ ID NO: 1949057 - RNA, 10 nt, Homo sapiens
cucacaaaag

SEQ ID NO: 1949058 - RNA, 22 nt, Homo sapiens
gagucucagagcacagagguag

SEQ ID NO: 1949059 - RNA, 14 nt, Homo sapiens
uaaguuuaucuuuc

SEQ ID NO: 1949060 - RNA, 22 nt, Homo sapiens
aauugcagguauuggggaacag

SEQ ID NO: 1949061 - RNA, 18 nt, Homo sapiens
cuuucauugccagugucu

SEQ ID NO: 1949062 - RNA, 18 nt, Homo sapiens
auguaaaguuauucuuga

SEQ ID NO: 1949063 - RNA, 17 nt, Homo sapiens
gcagaagagggagacuc

SEQ ID NO: 1949064 - RNA, 15 nt, Homo sapiens
ugccaaacagccaca

SEQ ID NO: 1949065 - RNA, 22 nt, Homo sapiens
aaccauuguucugaaugcugcu

SEQ ID NO: 1949066 - RNA, 18 nt, Homo sapiens
ccuguggugguugugauc

SEQ ID NO: 1949067 - RNA, 17 nt, Homo sapiens
ccagcccaaaggggaca

SEQ ID NO: 1949068 - RNA, 13 nt, Homo sapiens
agaaggaaggcag

SEQ ID NO: 1949069 - RNA, 16 nt, Homo sapiens
agcagaggcccugugg

SEQ ID NO: 1949070 - RNA, 19 nt, Homo sapiens
uuguaaaauuucacuuaau

SEQ ID NO: 1949071 - RNA, 15 nt, Homo sapiens
ugcauuuugcuuguu

SEQ ID NO: 1949072 - RNA, 20 nt, Homo sapiens
uuccuguaaugcaggacucc

SEQ ID NO: 1949073 - RNA, 14 nt, Homo sapiens
aaauaccagugaac

SEQ ID NO: 1949074 - RNA, 19 nt, Homo sapiens
gcucaaaauccacugacga

SEQ ID NO: 1949075 - RNA, 14 nt, Homo sapiens
auuuaucagugaca

SEQ ID NO: 1949076 - RNA, 16 nt, Homo sapiens
aucugagaauugcaaa

SEQ ID NO: 1949077 - RNA, 20 nt, Homo sapiens
cacugaucuaagcaguggca

SEQ ID NO: 1949078 - RNA, 23 nt, Homo sapiens
cuaaacucuuuuucauccaggcc

SEQ ID NO: 1949079 - RNA, 12 nt, Homo sapiens
uauaucuugucu

SEQ ID NO: 1949080 - RNA, 15 nt, Homo sapiens
guuggguuccagaca

SEQ ID NO: 1949081 - RNA, 14 nt, Homo sapiens
ucugaagaguagaa

SEQ ID NO: 1949082 - RNA, 23 nt, Homo sapiens
ucucaggaguaucuuaccuguaa

SEQ ID NO: 1949083 - RNA, 18 nt, Homo sapiens
cuguguauaucucuguaa

SEQ ID NO: 1949084 - RNA, 16 nt, Homo sapiens
cuucauguaaauugac

SEQ ID NO: 1949085 - RNA, 11 nt, Homo sapiens
uugaagaccag

SEQ ID NO: 1949086 - RNA, 23 nt, Homo sapiens
aaagacuucauuuaacacugagu

SEQ ID NO: 1949087 - RNA, 11 nt, Homo sapiens
uuaaagaccaa

SEQ ID NO: 1949088 - RNA, 20 nt, Homo sapiens
caaaaguuuaaaaagcucac

SEQ ID NO: 1949089 - RNA, 23 nt, Homo sapiens
caggguggggggccauguuccca

SEQ ID NO: 1949090 - RNA, 14 nt, Homo sapiens
gucucacgauucca

SEQ ID NO: 1949091 - RNA, 15 nt, Homo sapiens
ucagcccccaucacc

SEQ ID NO: 1949092 - RNA, 22 nt, Homo sapiens
uccugcuggaugcgugcccuga

SEQ ID NO: 1949093 - RNA, 15 nt, Homo sapiens
caaaaggacucucag

SEQ ID NO: 1949094 - RNA, 16 nt, Homo sapiens
aauauaaaaugccaag

SEQ ID NO: 1949095 - RNA, 14 nt, Homo sapiens
accccguguucaaa

SEQ ID NO: 1949096 - RNA, 17 nt, Homo sapiens
gacaggaaggaaugcaa

SEQ ID NO: 1949097 - RNA, 22 nt, Homo sapiens
acacagagcaggacugcacagc

SEQ ID NO: 1949098 - RNA, 14 nt, Homo sapiens
uguucaaugauuau

SEQ ID NO: 1949099 - RNA, 12 nt, Homo sapiens
gugucugucagc

SEQ ID NO: 1949100 - RNA, 17 nt, Homo sapiens
acauuuagaguauuuac

SEQ ID NO: 1949101 - RNA, 21 nt, Homo sapiens
uuuggggcuuucccaggagaa

SEQ ID NO: 1949102 - RNA, 14 nt, Homo sapiens
gaaacaucuacagg

SEQ ID NO: 1949103 - RNA, 14 nt, Homo sapiens
acacuaacauauaa

SEQ ID NO: 1949104 - RNA, 21 nt, Homo sapiens
cagaucaacugaguucaggag

SEQ ID NO: 1949105 - RNA, 17 nt, Homo sapiens
aaggcacugacugagca

SEQ ID NO: 1949106 - RNA, 13 nt, Homo sapiens
uucacgccauucu

SEQ ID NO: 1949107 - RNA, 23 nt, Homo sapiens
uuucaauaauagacuuauaugca

SEQ ID NO: 1949108 - RNA, 15 nt, Homo sapiens
acaccugaccaauca

SEQ ID NO: 1949109 - RNA, 14 nt, Homo sapiens
uucgcccucugaaa

SEQ ID NO: 1949110 - RNA, 15 nt, Homo sapiens
ggacuuggaagcucc

SEQ ID NO: 1949111 - RNA, 13 nt, Homo sapiens
cuaacaaauucca

SEQ ID NO: 1949112 - RNA, 15 nt, Homo sapiens
ugccaaaaaucuuuu

SEQ ID NO: 1949113 - RNA, 19 nt, Homo sapiens
cuggcauagcccuccugag

SEQ ID NO: 1949114 - RNA, 17 nt, Homo sapiens
ugcgagugguuucuugu

SEQ ID NO: 1949115 - RNA, 19 nt, Homo sapiens
cccaucagccuuguccuaa

SEQ ID NO: 1949116 - RNA, 13 nt, Homo sapiens
aacuauacuugau

SEQ ID NO: 1949117 - RNA, 16 nt, Homo sapiens
uucacagagacacgug

SEQ ID NO: 1949118 - RNA, 15 nt, Homo sapiens
aaaauuccuaucuca

SEQ ID NO: 1949119 - RNA, 21 nt, Homo sapiens
cuaaaaaauuccuaggugcua

SEQ ID NO: 1949120 - RNA, 23 nt, Homo sapiens
auuuuuccccaaaaagaauggga

SEQ ID NO: 1949121 - RNA, 18 nt, Homo sapiens
gguccuggacaaaggagu

SEQ ID NO: 1949122 - RNA, 22 nt, Homo sapiens
cuccagguggcucugaggugcc

SEQ ID NO: 1949123 - RNA, 18 nt, Homo sapiens
agaagggccuggaugcaa

SEQ ID NO: 1949124 - RNA, 15 nt, Homo sapiens
auaaacaugucugcc

SEQ ID NO: 1949125 - RNA, 18 nt, Homo sapiens
ugccuccaggaccuugcu

SEQ ID NO: 1949126 - RNA, 19 nt, Homo sapiens
auuugccuccagugcaguc

SEQ ID NO: 1949127 - RNA, 13 nt, Homo sapiens
cugggaacaugua

SEQ ID NO: 1949128 - RNA, 13 nt, Homo sapiens
ccaugaacacaga

SEQ ID NO: 1949129 - RNA, 16 nt, Homo sapiens
gggagaaugucaguau

SEQ ID NO: 1949130 - RNA, 18 nt, Homo sapiens
uacccaccugagcuuugg

SEQ ID NO: 1949131 - RNA, 16 nt, Homo sapiens
ucuuguuaagugcagu

SEQ ID NO: 1949132 - RNA, 13 nt, Homo sapiens
auguugcaaagaa

SEQ ID NO: 1949133 - RNA, 22 nt, Homo sapiens
ucuuauuuagcccauaaucucu

SEQ ID NO: 1949134 - RNA, 23 nt, Homo sapiens
aagccugucucuuuccacuuugu

SEQ ID NO: 1949135 - RNA, 22 nt, Homo sapiens
guaucugcucauuuugacaaag

SEQ ID NO: 1949136 - RNA, 23 nt, Homo sapiens
agaguguagaccgagauggugca

SEQ ID NO: 1949137 - RNA, 15 nt, Homo sapiens
ugaaaacaacauugg

SEQ ID NO: 1949138 - RNA, 17 nt, Homo sapiens
agucuucaugauucugu

SEQ ID NO: 1949139 - RNA, 15 nt, Homo sapiens
gcuagagguggcaug

SEQ ID NO: 1949140 - RNA, 19 nt, Homo sapiens
uacaaaaacauggccuuug

SEQ ID NO: 1949141 - RNA, 18 nt, Homo sapiens
uaagagaacaaagaguga

SEQ ID NO: 1949142 - RNA, 16 nt, Homo sapiens
gagaauguaagaacua

SEQ ID NO: 1949143 - RNA, 19 nt, Homo sapiens
aggccaguggacagaggga

SEQ ID NO: 1949144 - RNA, 14 nt, Homo sapiens
cuguacacacuuua

SEQ ID NO: 1949145 - RNA, 19 nt, Homo sapiens
uucuuguucugcccuccag

SEQ ID NO: 1949146 - RNA, 15 nt, Homo sapiens
gcgcagcugaagccu

SEQ ID NO: 1949147 - RNA, 23 nt, Homo sapiens
aguaguacuucuucuguaauauu

SEQ ID NO: 1949148 - RNA, 13 nt, Homo sapiens
gggccacacaagu

SEQ ID NO: 1949149 - RNA, 23 nt, Homo sapiens
acuaaucuaaacuguagcuguau

SEQ ID NO: 1949150 - RNA, 14 nt, Homo sapiens
ugacauuuaaacuc

SEQ ID NO: 1949151 - RNA, 24 nt, Homo sapiens
aaagcagaauuuuaaugugaagac

SEQ ID NO: 1949152 - RNA, 21 nt, Homo sapiens
ccuccuuucauugcuguuguc

SEQ ID NO: 1949153 - RNA, 10 nt, Homo sapiens
guaccauuca

SEQ ID NO: 1949154 - RNA, 13 nt, Homo sapiens
ugcucacaaaagu

SEQ ID NO: 1949155 - RNA, 22 nt, Homo sapiens
cauaugaggacgaggaguaaug

SEQ ID NO: 1949156 - RNA, 20 nt, Homo sapiens
uacuuauauguaaaguauua

SEQ ID NO: 1949157 - RNA, 21 nt, Homo sapiens
gcaauauccaaauaaugagua

SEQ ID NO: 1949158 - RNA, 18 nt, Homo sapiens
aucuuuaaaauacacacu

SEQ ID NO: 1949159 - RNA, 14 nt, Homo sapiens
uuuggaacuuacaa

SEQ ID NO: 1949160 - RNA, 22 nt, Homo sapiens
gcagagcagagaccaucccuga

SEQ ID NO: 1949161 - RNA, 16 nt, Homo sapiens
gcugcaagguacucug

SEQ ID NO: 1949162 - RNA, 13 nt, Homo sapiens
uuuguaaagguca

SEQ ID NO: 1949163 - RNA, 11 nt, Homo sapiens
agcacaugugu

SEQ ID NO: 1949164 - RNA, 18 nt, Homo sapiens
aauaaauucccaacuucu

SEQ ID NO: 1949165 - RNA, 18 nt, Homo sapiens
ucccaaauuuucacauaa

SEQ ID NO: 1949166 - RNA, 13 nt, Homo sapiens
aaucucuccugaa

SEQ ID NO: 1949167 - RNA, 10 nt, Homo sapiens
ccaccuguga

SEQ ID NO: 1949168 - RNA, 14 nt, Homo sapiens
auccagcagucaau

SEQ ID NO: 1949169 - RNA, 19 nt, Homo sapiens
ggcagguguugggaccugc

SEQ ID NO: 1949170 - RNA, 20 nt, Homo sapiens
agcuggcuuuucccauuuca

SEQ ID NO: 1949171 - RNA, 18 nt, Homo sapiens
guaauacuucauucucuc

SEQ ID NO: 1949172 - RNA, 21 nt, Homo sapiens
ucaggaccuuuuggucuucag

SEQ ID NO: 1949173 - RNA, 16 nt, Homo sapiens
cucugugccuugccac

SEQ ID NO: 1949174 - RNA, 20 nt, Homo sapiens
agcaaacuccagguuccuga

SEQ ID NO: 1949175 - RNA, 23 nt, Homo sapiens
cuugaaaagacaucaagcacaga

SEQ ID NO: 1949176 - RNA, 22 nt, Homo sapiens
aaugaaagcccucaugugcagu

SEQ ID NO: 1949177 - RNA, 21 nt, Homo sapiens
aacacuuggugcugggaaccu

SEQ ID NO: 1949178 - RNA, 14 nt, Homo sapiens
auuuaucugugaau

SEQ ID NO: 1949179 - RNA, 16 nt, Homo sapiens
ccauggacacauuuuc

SEQ ID NO: 1949180 - RNA, 12 nt, Homo sapiens
cucaggccaguc

SEQ ID NO: 1949181 - RNA, 22 nt, Homo sapiens
cuaaccugccgagaguccauca

SEQ ID NO: 1949182 - RNA, 14 nt, Homo sapiens
ugagagucugagaa

SEQ ID NO: 1949183 - RNA, 18 nt, Homo sapiens
uguauagcuuaccugaac

SEQ ID NO: 1949184 - RNA, 14 nt, Homo sapiens
gcugggaccugggg

SEQ ID NO: 1949185 - RNA, 18 nt, Homo sapiens
caguucuacacugauaca

SEQ ID NO: 1949186 - RNA, 22 nt, Homo sapiens
guucuguauuuuuaaauugcca

SEQ ID NO: 1949187 - RNA, 15 nt, Homo sapiens
ucuccucuccuagcc

SEQ ID NO: 1949188 - RNA, 19 nt, Homo sapiens
cgaucaggaagacuggacc

SEQ ID NO: 1949189 - RNA, 22 nt, Homo sapiens
gaaauccuuccuaaacccaaug

SEQ ID NO: 1949190 - RNA, 17 nt, Homo sapiens
augcacacacagaugca

SEQ ID NO: 1949191 - RNA, 17 nt, Homo sapiens
aaaucaguuuuguguac

SEQ ID NO: 1949192 - RNA, 11 nt, Homo sapiens
ugauggugcug

SEQ ID NO: 1949193 - RNA, 13 nt, Homo sapiens
ucccagcacuuug

SEQ ID NO: 1949194 - RNA, 20 nt, Homo sapiens
accucauguccuucuugucc

SEQ ID NO: 1949195 - RNA, 18 nt, Homo sapiens
gauggaauaaagcccuug

SEQ ID NO: 1949196 - RNA, 17 nt, Homo sapiens
aauacuuuaugaugcua

SEQ ID NO: 1949197 - RNA, 17 nt, Homo sapiens
cacgugauggaccaaag

SEQ ID NO: 1949198 - RNA, 14 nt, Homo sapiens
augcgaggggccag

SEQ ID NO: 1949199 - RNA, 21 nt, Homo sapiens
uauuguucagacauuccaugg

SEQ ID NO: 1949200 - RNA, 16 nt, Homo sapiens
ugccugcuccaucuca

SEQ ID NO: 1949201 - RNA, 17 nt, Homo sapiens
ugcacaaauggaacucc

SEQ ID NO: 1949202 - RNA, 15 nt, Homo sapiens
aaaugcaaauucuca

SEQ ID NO: 1949203 - RNA, 13 nt, Homo sapiens
ucaucucauucca

SEQ ID NO: 1949204 - RNA, 20 nt, Homo sapiens
uuacuuccaugauacuuuaa

SEQ ID NO: 1949205 - RNA, 20 nt, Homo sapiens
cuguccccgagccgagcucu

SEQ ID NO: 1949206 - RNA, 16 nt, Homo sapiens
ucuuaacuucuugcuu

SEQ ID NO: 1949207 - RNA, 15 nt, Homo sapiens
caucaaaccucacau

SEQ ID NO: 1949208 - RNA, 16 nt, Homo sapiens
acugagaaagccaaug

SEQ ID NO: 1949209 - RNA, 13 nt, Homo sapiens
gacauucacugag

SEQ ID NO: 1949210 - RNA, 15 nt, Homo sapiens
uucucugguuucacc

SEQ ID NO: 1949211 - RNA, 20 nt, Homo sapiens
agucuuaauaaaacauugaa

SEQ ID NO: 1949212 - RNA, 18 nt, Homo sapiens
caugcccgccagugcaca

SEQ ID NO: 1949213 - RNA, 14 nt, Homo sapiens
ugauguugugaaau

SEQ ID NO: 1949214 - RNA, 18 nt, Homo sapiens
uaacaaacaagaaagcua

SEQ ID NO: 1949215 - RNA, 15 nt, Homo sapiens
aaaacuuuaaggaag

SEQ ID NO: 1949216 - RNA, 21 nt, Homo sapiens
cuaaagguggugaggcaauaa

SEQ ID NO: 1949217 - RNA, 15 nt, Homo sapiens
augaacccccaugau

SEQ ID NO: 1949218 - RNA, 16 nt, Homo sapiens
aacucaugccauucca

SEQ ID NO: 1949219 - RNA, 17 nt, Homo sapiens
uaaaaauugacuucuug

SEQ ID NO: 1949220 - RNA, 17 nt, Homo sapiens
guuuucccauugcaguu

SEQ ID NO: 1949221 - RNA, 19 nt, Homo sapiens
ugauguccuuggacuccau

SEQ ID NO: 1949222 - RNA, 13 nt, Homo sapiens
agaggugugugac

SEQ ID NO: 1949223 - RNA, 20 nt, Homo sapiens
aacuggauucuuaaccaaga

SEQ ID NO: 1949224 - RNA, 14 nt, Homo sapiens
uaaaacuuccacua

SEQ ID NO: 1949225 - RNA, 19 nt, Homo sapiens
ucaugccucuaaucucagc

SEQ ID NO: 1949226 - RNA, 14 nt, Homo sapiens
uccugagaaaaucc

SEQ ID NO: 1949227 - RNA, 14 nt, Homo sapiens
cuguacuacaucua

SEQ ID NO: 1949228 - RNA, 19 nt, Homo sapiens
cugguagcuccacaagaga

SEQ ID NO: 1949229 - RNA, 17 nt, Homo sapiens
aauuccuggaaaacugg

SEQ ID NO: 1949230 - RNA, 13 nt, Homo sapiens
cuuuugacaucca

SEQ ID NO: 1949231 - RNA, 17 nt, Homo sapiens
uuaagcuuaugucagac

SEQ ID NO: 1949232 - RNA, 19 nt, Homo sapiens
aagcauacaaagcaguuua

SEQ ID NO: 1949233 - RNA, 18 nt, Homo sapiens
uuuucuccggguccuccu

SEQ ID NO: 1949234 - RNA, 20 nt, Homo sapiens
ccaggagcgcagcugcauuu

SEQ ID NO: 1949235 - RNA, 17 nt, Homo sapiens
cagucagaguugugcac

SEQ ID NO: 1949236 - RNA, 20 nt, Homo sapiens
agccuccccgugccaaaaau

SEQ ID NO: 1949237 - RNA, 15 nt, Homo sapiens
gcuccgugugucuca

SEQ ID NO: 1949238 - RNA, 17 nt, Homo sapiens
gcuucuaccaacuggaa

SEQ ID NO: 1949239 - RNA, 20 nt, Homo sapiens
gcccacacccgacaccagcc

SEQ ID NO: 1949240 - RNA, 16 nt, Homo sapiens
gaagagggcugcaaau

SEQ ID NO: 1949241 - RNA, 22 nt, Homo sapiens
agaugcuuuucugucucugccu

SEQ ID NO: 1949242 - RNA, 21 nt, Homo sapiens
gaagcuaaugaacucuuucaa

SEQ ID NO: 1949243 - RNA, 16 nt, Homo sapiens
cccacugcucugguua

SEQ ID NO: 1949244 - RNA, 15 nt, Homo sapiens
gugauauaugccuau

SEQ ID NO: 1949245 - RNA, 14 nt, Homo sapiens
gcuccuugucaaua

SEQ ID NO: 1949246 - RNA, 16 nt, Homo sapiens
auaggucuccaagacc

SEQ ID NO: 1949247 - RNA, 18 nt, Homo sapiens
ugggccaagucaaagaca

SEQ ID NO: 1949248 - RNA, 17 nt, Homo sapiens
cggcuggcuccccugca

SEQ ID NO: 1949249 - RNA, 17 nt, Homo sapiens
gucaggcagggugcagu

SEQ ID NO: 1949250 - RNA, 15 nt, Homo sapiens
gucagcacaucucaa

SEQ ID NO: 1949251 - RNA, 13 nt, Homo sapiens
uccuauugucauu

SEQ ID NO: 1949252 - RNA, 22 nt, Homo sapiens
ugacagcugaccuuugucaucu

SEQ ID NO: 1949253 - RNA, 21 nt, Homo sapiens
uggaaguaaagauuaaaacca

SEQ ID NO: 1949254 - RNA, 12 nt, Homo sapiens
agggcugaccca

SEQ ID NO: 1949255 - RNA, 13 nt, Homo sapiens
caauaggugaucu

SEQ ID NO: 1949256 - RNA, 19 nt, Homo sapiens
aagucccuuccuauucucc

SEQ ID NO: 1949257 - RNA, 19 nt, Homo sapiens
ucaaaucuucuaauuccaa

SEQ ID NO: 1949258 - RNA, 15 nt, Homo sapiens
gcccuaguugugauc

SEQ ID NO: 1949259 - RNA, 12 nt, Homo sapiens
gaaacaaggaaa

SEQ ID NO: 1949260 - RNA, 23 nt, Homo sapiens
gguucucuuagcaacucagagaa

SEQ ID NO: 1949261 - RNA, 13 nt, Homo sapiens
acagaaaaccuca

SEQ ID NO: 1949262 - RNA, 19 nt, Homo sapiens
cuuucaacauguacaggaa

SEQ ID NO: 1949263 - RNA, 14 nt, Homo sapiens
agcagcagagguga

SEQ ID NO: 1949264 - RNA, 22 nt, Homo sapiens
cagcagguugugugugugugca

SEQ ID NO: 1949265 - RNA, 22 nt, Homo sapiens
ucccuaggaaacucacacuccc

SEQ ID NO: 1949266 - RNA, 23 nt, Homo sapiens
aagauccccagacuucauagaau

SEQ ID NO: 1949267 - RNA, 14 nt, Homo sapiens
aauaauaguuauua

SEQ ID NO: 1949268 - RNA, 15 nt, Homo sapiens
uaacaaaugcuuuau

SEQ ID NO: 1949269 - RNA, 19 nt, Homo sapiens
cacugcccucuguucagua

SEQ ID NO: 1949270 - RNA, 15 nt, Homo sapiens
accuguguucuugcu

SEQ ID NO: 1949271 - RNA, 20 nt, Homo sapiens
aauggcgugaucucagcuca

SEQ ID NO: 1949272 - RNA, 20 nt, Homo sapiens
gcccaucuccgucucccaaa

SEQ ID NO: 1949273 - RNA, 20 nt, Homo sapiens
ucuaagaucuuagauucucu

SEQ ID NO: 1949274 - RNA, 23 nt, Homo sapiens
cacagagauuagccuguagcuua

SEQ ID NO: 1949275 - RNA, 15 nt, Homo sapiens
uccuuuaacauaggu

SEQ ID NO: 1949276 - RNA, 20 nt, Homo sapiens
uccucaucagucuccauacc

SEQ ID NO: 1949277 - RNA, 16 nt, Homo sapiens
auagucgggaugucag

SEQ ID NO: 1949278 - RNA, 18 nt, Homo sapiens
caaaggaaggacccugag

SEQ ID NO: 1949279 - RNA, 20 nt, Homo sapiens
gaaaaaggcuggcugaaaau

SEQ ID NO: 1949280 - RNA, 14 nt, Homo sapiens
gcauauaacuuaua

SEQ ID NO: 1949281 - RNA, 22 nt, Homo sapiens
aaacagaaaaaaaaauggaagc

SEQ ID NO: 1949282 - RNA, 23 nt, Homo sapiens
cugacuugcucaccuggaacacc

SEQ ID NO: 1949283 - RNA, 14 nt, Homo sapiens
gaaacucaucucau

SEQ ID NO: 1949284 - RNA, 15 nt, Homo sapiens
cuuguccugaugcug

SEQ ID NO: 1949285 - RNA, 18 nt, Homo sapiens
acaaccaaguaugaaucu

SEQ ID NO: 1949286 - RNA, 13 nt, Homo sapiens
ugcuaaaugucaa

SEQ ID NO: 1949287 - RNA, 18 nt, Homo sapiens
auugacgcauauuuaacu

SEQ ID NO: 1949288 - RNA, 14 nt, Homo sapiens
gcccagccagcguc

SEQ ID NO: 1949289 - RNA, 18 nt, Homo sapiens
ggcaucuaagacauucac

SEQ ID NO: 1949290 - RNA, 22 nt, Homo sapiens
ucugaaguagccugaucuuucu

SEQ ID NO: 1949291 - RNA, 12 nt, Homo sapiens
acacuaugccug

SEQ ID NO: 1949292 - RNA, 22 nt, Homo sapiens
aaagacggauggcaggauccaa

SEQ ID NO: 1949293 - RNA, 14 nt, Homo sapiens
cuguagaaaugaug

SEQ ID NO: 1949294 - RNA, 16 nt, Homo sapiens
ugcaaucaauuuaaau

SEQ ID NO: 1949295 - RNA, 21 nt, Homo sapiens
agcuguugggugucuugccuc

SEQ ID NO: 1949296 - RNA, 22 nt, Homo sapiens
uagagccuucugaugucucuaa

SEQ ID NO: 1949297 - RNA, 21 nt, Homo sapiens
ugagguccugaucagcuucaa

SEQ ID NO: 1949298 - RNA, 13 nt, Homo sapiens
uaccuauuguaga

SEQ ID NO: 1949299 - RNA, 20 nt, Homo sapiens
agaaggauguacauuuccaa

SEQ ID NO: 1949300 - RNA, 18 nt, Homo sapiens
cuggggacagcuuccuca

SEQ ID NO: 1949301 - RNA, 15 nt, Homo sapiens
gagaagcaagccagc

SEQ ID NO: 1949302 - RNA, 15 nt, Homo sapiens
aagaagaaggccaga

SEQ ID NO: 1949303 - RNA, 15 nt, Homo sapiens
auucuguuugucucg

SEQ ID NO: 1949304 - RNA, 13 nt, Homo sapiens
uuuaggagugugu

SEQ ID NO: 1949305 - RNA, 23 nt, Homo sapiens
agcuaggggggucagccagcccu

SEQ ID NO: 1949306 - RNA, 19 nt, Homo sapiens
uuuuuauaccagcuuaaua

SEQ ID NO: 1949307 - RNA, 23 nt, Homo sapiens
aggcccgcccugcccgggcuccc

SEQ ID NO: 1949308 - RNA, 18 nt, Homo sapiens
aaaaacuaaugugucuca

SEQ ID NO: 1949309 - RNA, 13 nt, Homo sapiens
caaaaugcagaca

SEQ ID NO: 1949310 - RNA, 14 nt, Homo sapiens
aaaugcuguagaag

SEQ ID NO: 1949311 - RNA, 15 nt, Homo sapiens
ucuaucaacuuuaau

SEQ ID NO: 1949312 - RNA, 17 nt, Homo sapiens
gacacauccaucuugca

SEQ ID NO: 1949313 - RNA, 12 nt, Homo sapiens
uugguacccugg

SEQ ID NO: 1949314 - RNA, 13 nt, Homo sapiens
aauggaagacagc

SEQ ID NO: 1949315 - RNA, 22 nt, Homo sapiens
cagaggaauaacaucaccacug

SEQ ID NO: 1949316 - RNA, 18 nt, Homo sapiens
cuucagcugccugaaaca

SEQ ID NO: 1949317 - RNA, 18 nt, Homo sapiens
guauuuuuccagaauucu

SEQ ID NO: 1949318 - RNA, 19 nt, Homo sapiens
ugaagauucuccugugcua

SEQ ID NO: 1949319 - RNA, 12 nt, Homo sapiens
gcccugcauuca

SEQ ID NO: 1949320 - RNA, 16 nt, Homo sapiens
aaauuacaauugucau

SEQ ID NO: 1949321 - RNA, 14 nt, Homo sapiens
gguguccccuaucc

SEQ ID NO: 1949322 - RNA, 16 nt, Homo sapiens
ccuccagggagucuca

SEQ ID NO: 1949323 - RNA, 13 nt, Homo sapiens
uuacugucucucu

SEQ ID NO: 1949324 - RNA, 11 nt, Homo sapiens
cacacccagcu

SEQ ID NO: 1949325 - RNA, 18 nt, Homo sapiens
ucuuucuuuuuuccuuac

SEQ ID NO: 1949326 - RNA, 18 nt, Homo sapiens
auauuacuuuaucacuuu

SEQ ID NO: 1949327 - RNA, 18 nt, Homo sapiens
guccaugugcacccggcc

SEQ ID NO: 1949328 - RNA, 18 nt, Homo sapiens
acugugaaccggcuccca

SEQ ID NO: 1949329 - RNA, 14 nt, Homo sapiens
uuucaaaugauuau

SEQ ID NO: 1949330 - RNA, 19 nt, Homo sapiens
aguaagaguacugggagaa

SEQ ID NO: 1949331 - RNA, 21 nt, Homo sapiens
aaaccugaaauauauuuuaaa

SEQ ID NO: 1949332 - RNA, 16 nt, Homo sapiens
uacaucuuguuucuga

SEQ ID NO: 1949333 - RNA, 15 nt, Homo sapiens
uaugguaacugauga

SEQ ID NO: 1949334 - RNA, 15 nt, Homo sapiens
ugaaguuacaugcau

SEQ ID NO: 1949335 - RNA, 24 nt, Homo sapiens
ccuguuuuaaaaaauacaguauua

SEQ ID NO: 1949336 - RNA, 13 nt, Homo sapiens
uggccacugcucc

SEQ ID NO: 1949337 - RNA, 20 nt, Homo sapiens
gcuggugugggaacuucccc

SEQ ID NO: 1949338 - RNA, 14 nt, Homo sapiens
auuuauuugguucc

SEQ ID NO: 1949339 - RNA, 21 nt, Homo sapiens
acuguaaauacgaacccaauc

SEQ ID NO: 1949340 - RNA, 20 nt, Homo sapiens
aaaaauauuguuucugcauu

SEQ ID NO: 1949341 - RNA, 22 nt, Homo sapiens
auacacaaggacccuucaggug

SEQ ID NO: 1949342 - RNA, 18 nt, Homo sapiens
aauaaugcacuuccuuac

SEQ ID NO: 1949343 - RNA, 18 nt, Homo sapiens
uagcagccuacaacugaa

SEQ ID NO: 1949344 - RNA, 12 nt, Homo sapiens
uuggguuccuuu

SEQ ID NO: 1949345 - RNA, 14 nt, Homo sapiens
ucuaaagauucuau

SEQ ID NO: 1949346 - RNA, 19 nt, Homo sapiens
uugccauuaaacuuaccug

SEQ ID NO: 1949347 - RNA, 20 nt, Homo sapiens
cagaaacuugugaaguggaa

SEQ ID NO: 1949348 - RNA, 19 nt, Homo sapiens
gucaccggccgauggagac

SEQ ID NO: 1949349 - RNA, 20 nt, Homo sapiens
uaguaaucccccuugccaaa

SEQ ID NO: 1949350 - RNA, 16 nt, Homo sapiens
cucagccccacugaca

SEQ ID NO: 1949351 - RNA, 22 nt, Homo sapiens
caguauaucacagagccacucu

SEQ ID NO: 1949352 - RNA, 15 nt, Homo sapiens
auucaugaagugaau

SEQ ID NO: 1949353 - RNA, 23 nt, Homo sapiens
agacaucccugauucucucucca

SEQ ID NO: 1949354 - RNA, 23 nt, Homo sapiens
ucucuaaaauagccacuuaccuu

SEQ ID NO: 1949355 - RNA, 22 nt, Homo sapiens
ggacuucugcaucuuacaguca

SEQ ID NO: 1949356 - RNA, 16 nt, Homo sapiens
guauaugaacuuaaca

SEQ ID NO: 1949357 - RNA, 18 nt, Homo sapiens
uagaguguuaucagucau

SEQ ID NO: 1949358 - RNA, 12 nt, Homo sapiens
uguaauggugcu

SEQ ID NO: 1949359 - RNA, 13 nt, Homo sapiens
uggaaauuguuaa

SEQ ID NO: 1949360 - RNA, 19 nt, Homo sapiens
gacuuaccuggcagacuug

SEQ ID NO: 1949361 - RNA, 14 nt, Homo sapiens
caguuugcuugaua

SEQ ID NO: 1949362 - RNA, 15 nt, Homo sapiens
uauuguauuacauuu

SEQ ID NO: 1949363 - RNA, 23 nt, Homo sapiens
uccaagugaauauuuuucuucua

SEQ ID NO: 1949364 - RNA, 16 nt, Homo sapiens
ugcucucuucucccca

SEQ ID NO: 1949365 - RNA, 14 nt, Homo sapiens
acacuaaaaccaua

SEQ ID NO: 1949366 - RNA, 22 nt, Homo sapiens
aagcaccugccucagcaauugu

SEQ ID NO: 1949367 - RNA, 14 nt, Homo sapiens
gaaauaacauugca

SEQ ID NO: 1949368 - RNA, 17 nt, Homo sapiens
accauugugcauucuag

SEQ ID NO: 1949369 - RNA, 20 nt, Homo sapiens
acagaaaccagaaaagcaau

SEQ ID NO: 1949370 - RNA, 13 nt, Homo sapiens
gcgaacugugcag

SEQ ID NO: 1949371 - RNA, 24 nt, Homo sapiens
aacaauugguaaaacucacuguga

SEQ ID NO: 1949372 - RNA, 22 nt, Homo sapiens
uugaagaaucugccccuguuga

SEQ ID NO: 1949373 - RNA, 22 nt, Homo sapiens
agcauuuuuaaucuguguaaac

SEQ ID NO: 1949374 - RNA, 17 nt, Homo sapiens
ggcuggcgggccuuuuu

SEQ ID NO: 1949375 - RNA, 17 nt, Homo sapiens
acuuucccacccaggaa

SEQ ID NO: 1949376 - RNA, 14 nt, Homo sapiens
aagaagguggucau

SEQ ID NO: 1949377 - RNA, 17 nt, Homo sapiens
aaccucauuguucugua

SEQ ID NO: 1949378 - RNA, 19 nt, Homo sapiens
gcucaucagaaacucaaaa

SEQ ID NO: 1949379 - RNA, 19 nt, Homo sapiens
auaaaaucuuuccaucuca

SEQ ID NO: 1949380 - RNA, 17 nt, Homo sapiens
guaggucauugcaccua

SEQ ID NO: 1949381 - RNA, 16 nt, Homo sapiens
cucuccaccagguucu

SEQ ID NO: 1949382 - RNA, 17 nt, Homo sapiens
aauaaccuuucacuuaa

SEQ ID NO: 1949383 - RNA, 16 nt, Homo sapiens
aggcaccaucugccaa

SEQ ID NO: 1949384 - RNA, 16 nt, Homo sapiens
ucaccauguuggucag

SEQ ID NO: 1949385 - RNA, 17 nt, Homo sapiens
caacugcugaugcucau

SEQ ID NO: 1949386 - RNA, 19 nt, Homo sapiens
agaacgcgacuuccacaaa

SEQ ID NO: 1949387 - RNA, 21 nt, Homo sapiens
uuccaacucgaaucuguguga

SEQ ID NO: 1949388 - RNA, 19 nt, Homo sapiens
auuccuauauccugugacu

SEQ ID NO: 1949389 - RNA, 19 nt, Homo sapiens
cuuuuauaaugauucauaa

SEQ ID NO: 1949390 - RNA, 23 nt, Homo sapiens
cgugaccugccaggcacacugag

SEQ ID NO: 1949391 - RNA, 18 nt, Homo sapiens
cccucacaggagcaucuc

SEQ ID NO: 1949392 - RNA, 11 nt, Homo sapiens
uuuaagacauu

SEQ ID NO: 1949393 - RNA, 16 nt, Homo sapiens
aaugaggaaacugcac

SEQ ID NO: 1949394 - RNA, 21 nt, Homo sapiens
acuacucugccugaacacugc

SEQ ID NO: 1949395 - RNA, 23 nt, Homo sapiens
uucuuccuccagucuguucucac

SEQ ID NO: 1949396 - RNA, 19 nt, Homo sapiens
auugagauguaagucucaa

SEQ ID NO: 1949397 - RNA, 22 nt, Homo sapiens
acagcugaaguaaugacagauu

SEQ ID NO: 1949398 - RNA, 18 nt, Homo sapiens
uuccagugucauuucuca

SEQ ID NO: 1949399 - RNA, 16 nt, Homo sapiens
guggauuuacugagag

SEQ ID NO: 1949400 - RNA, 16 nt, Homo sapiens
caggaagccgugcccu

SEQ ID NO: 1949401 - RNA, 13 nt, Homo sapiens
aguaaagucaaca

SEQ ID NO: 1949402 - RNA, 16 nt, Homo sapiens
acuaacgccauccagg

SEQ ID NO: 1949403 - RNA, 20 nt, Homo sapiens
agaugccauggccugugcug

SEQ ID NO: 1949404 - RNA, 19 nt, Homo sapiens
ucaccuucuggccaggccu

SEQ ID NO: 1949405 - RNA, 14 nt, Homo sapiens
cuccucuugccacu

SEQ ID NO: 1949406 - RNA, 15 nt, Homo sapiens
gucugauuggcucac

SEQ ID NO: 1949407 - RNA, 16 nt, Homo sapiens
uaucucacagcacacu

SEQ ID NO: 1949408 - RNA, 23 nt, Homo sapiens
gacaaccaacggccgacugccug

SEQ ID NO: 1949409 - RNA, 16 nt, Homo sapiens
ucuuaaaaaucuuggu

SEQ ID NO: 1949410 - RNA, 16 nt, Homo sapiens
gagcccccaccacaaa

SEQ ID NO: 1949411 - RNA, 15 nt, Homo sapiens
ucccugacuguaaau

SEQ ID NO: 1949412 - RNA, 21 nt, Homo sapiens
uggagagagagcaagauuccu

SEQ ID NO: 1949413 - RNA, 22 nt, Homo sapiens
gaaaauugugcuggaaauggac

SEQ ID NO: 1949414 - RNA, 17 nt, Homo sapiens
agucucagcagcucuuc

SEQ ID NO: 1949415 - RNA, 22 nt, Homo sapiens
ccaccuguuuucugaaacacac

SEQ ID NO: 1949416 - RNA, 18 nt, Homo sapiens
gaaaauggagaaagccca

SEQ ID NO: 1949417 - RNA, 13 nt, Homo sapiens
ugucuuaauggau

SEQ ID NO: 1949418 - RNA, 14 nt, Homo sapiens
uguuaucauagaau

SEQ ID NO: 1949419 - RNA, 20 nt, Homo sapiens
uaccucgcaucauugcagau

SEQ ID NO: 1949420 - RNA, 17 nt, Homo sapiens
uucucuuugguguuaca

SEQ ID NO: 1949421 - RNA, 14 nt, Homo sapiens
acaacauuucucaa

SEQ ID NO: 1949422 - RNA, 15 nt, Homo sapiens
uaucaaucaguauaa

SEQ ID NO: 1949423 - RNA, 15 nt, Homo sapiens
aaccuugguguaguu

SEQ ID NO: 1949424 - RNA, 13 nt, Homo sapiens
uugaauguaucua

SEQ ID NO: 1949425 - RNA, 15 nt, Homo sapiens
acuccuuguggacug

SEQ ID NO: 1949426 - RNA, 13 nt, Homo sapiens
agguuuuguugcu

SEQ ID NO: 1949427 - RNA, 21 nt, Homo sapiens
uaaagaacaggauuccagaau

SEQ ID NO: 1949428 - RNA, 14 nt, Homo sapiens
cccgagaaacacag

SEQ ID NO: 1949429 - RNA, 16 nt, Homo sapiens
aauuugccuaauauga

SEQ ID NO: 1949430 - RNA, 22 nt, Homo sapiens
uaccacaauucauuuacccauu

SEQ ID NO: 1949431 - RNA, 13 nt, Homo sapiens
ucucagcaagugu

SEQ ID NO: 1949432 - RNA, 17 nt, Homo sapiens
cauuaaguaaacaauaa

SEQ ID NO: 1949433 - RNA, 22 nt, Homo sapiens
uucagcacugucccuugccuca

SEQ ID NO: 1949434 - RNA, 14 nt, Homo sapiens
gaacugcaaccuca

SEQ ID NO: 1949435 - RNA, 23 nt, Homo sapiens
uaaguuucaggauacaugugccg

SEQ ID NO: 1949436 - RNA, 20 nt, Homo sapiens
aaguguauuuuauaagcauu

SEQ ID NO: 1949437 - RNA, 23 nt, Homo sapiens
uucuggcacugugacuacuaugg

SEQ ID NO: 1949438 - RNA, 13 nt, Homo sapiens
cgugcccccagcg

SEQ ID NO: 1949439 - RNA, 15 nt, Homo sapiens
uggcuggaucuguga

SEQ ID NO: 1949440 - RNA, 15 nt, Homo sapiens
accaccuucuucucc

SEQ ID NO: 1949441 - RNA, 11 nt, Homo sapiens
cuuaauuaccu

SEQ ID NO: 1949442 - RNA, 15 nt, Homo sapiens
caagaagaaugaacu

SEQ ID NO: 1949443 - RNA, 13 nt, Homo sapiens
ggugaaugcacag

SEQ ID NO: 1949444 - RNA, 16 nt, Homo sapiens
gaauguugcaauguga

SEQ ID NO: 1949445 - RNA, 18 nt, Homo sapiens
uuugauauacaugcucaa

SEQ ID NO: 1949446 - RNA, 13 nt, Homo sapiens
ugacucagggcau

SEQ ID NO: 1949447 - RNA, 18 nt, Homo sapiens
uccugagagcugcuuuga

SEQ ID NO: 1949448 - RNA, 15 nt, Homo sapiens
aagagaggaguucaa

SEQ ID NO: 1949449 - RNA, 22 nt, Homo sapiens
gacgcggcgggaggcccacggu

SEQ ID NO: 1949450 - RNA, 17 nt, Homo sapiens
cuagaagugccaucuca

SEQ ID NO: 1949451 - RNA, 15 nt, Homo sapiens
gcuggguccagggga

SEQ ID NO: 1949452 - RNA, 19 nt, Homo sapiens
uaucuaguaugaaauuaua

SEQ ID NO: 1949453 - RNA, 21 nt, Homo sapiens
auaaauuaaaacaugcacaaa

SEQ ID NO: 1949454 - RNA, 21 nt, Homo sapiens
ugcgugacacucuccuugcag

SEQ ID NO: 1949455 - RNA, 17 nt, Homo sapiens
uugauauugccugcuuu

SEQ ID NO: 1949456 - RNA, 14 nt, Homo sapiens
cuuucucuuaccac

SEQ ID NO: 1949457 - RNA, 14 nt, Homo sapiens
gcugggaaccagca

SEQ ID NO: 1949458 - RNA, 18 nt, Homo sapiens
auagcuauauccauguac

SEQ ID NO: 1949459 - RNA, 18 nt, Homo sapiens
aguacauccucacuuuua

SEQ ID NO: 1949460 - RNA, 20 nt, Homo sapiens
ucugggcacuuuugaacuca

SEQ ID NO: 1949461 - RNA, 14 nt, Homo sapiens
uugcauuaaucuaa

SEQ ID NO: 1949462 - RNA, 19 nt, Homo sapiens
gugacucuaagcucagugc

SEQ ID NO: 1949463 - RNA, 16 nt, Homo sapiens
aucaggaccuccaagc

SEQ ID NO: 1949464 - RNA, 16 nt, Homo sapiens
uucuccaccuccccca

SEQ ID NO: 1949465 - RNA, 14 nt, Homo sapiens
gacaugggccuccc

SEQ ID NO: 1949466 - RNA, 13 nt, Homo sapiens
uauugguguugca

SEQ ID NO: 1949467 - RNA, 19 nt, Homo sapiens
uuuauuaacuugagcuuca

SEQ ID NO: 1949468 - RNA, 19 nt, Homo sapiens
augucucaauggugcuaua

SEQ ID NO: 1949469 - RNA, 19 nt, Homo sapiens
ggggcggcaugaacccucu

SEQ ID NO: 1949470 - RNA, 18 nt, Homo sapiens
aacaugagcgcugaugau

SEQ ID NO: 1949471 - RNA, 22 nt, Homo sapiens
agcagaugacaaaaaggugcag

SEQ ID NO: 1949472 - RNA, 16 nt, Homo sapiens
gaggaauuaugaacug

SEQ ID NO: 1949473 - RNA, 12 nt, Homo sapiens
agcacugacacu

SEQ ID NO: 1949474 - RNA, 12 nt, Homo sapiens
caaacugaagau

SEQ ID NO: 1949475 - RNA, 23 nt, Homo sapiens
gcaacucaaagagguaacugagg

SEQ ID NO: 1949476 - RNA, 17 nt, Homo sapiens
aggaagaugauggcuca

SEQ ID NO: 1949477 - RNA, 17 nt, Homo sapiens
auuuuucaagagcuccu

SEQ ID NO: 1949478 - RNA, 17 nt, Homo sapiens
gaauuaagcugugcaau

SEQ ID NO: 1949479 - RNA, 14 nt, Homo sapiens
caguccugcugacu

SEQ ID NO: 1949480 - RNA, 20 nt, Homo sapiens
aaaauagggguuaagacuga

SEQ ID NO: 1949481 - RNA, 15 nt, Homo sapiens
ugacuccuucugcca

SEQ ID NO: 1949482 - RNA, 18 nt, Homo sapiens
gguauugccuugugaauu

SEQ ID NO: 1949483 - RNA, 20 nt, Homo sapiens
caccacgugcaguaucucaa

SEQ ID NO: 1949484 - RNA, 21 nt, Homo sapiens
ggcagaugaaauuuauuucca

SEQ ID NO: 1949485 - RNA, 13 nt, Homo sapiens
uuggaggauuuca

SEQ ID NO: 1949486 - RNA, 23 nt, Homo sapiens
ugcccagccugugcgccggggga

SEQ ID NO: 1949487 - RNA, 18 nt, Homo sapiens
ccuacaaaauggagggag

SEQ ID NO: 1949488 - RNA, 16 nt, Homo sapiens
gcccuuccuugccagu

SEQ ID NO: 1949489 - RNA, 20 nt, Homo sapiens
aggaagccucccacgacugc

SEQ ID NO: 1949490 - RNA, 19 nt, Homo sapiens
cauguggcuaaaugccuaa

SEQ ID NO: 1949491 - RNA, 23 nt, Homo sapiens
ccaucugucuucagcacauucca

SEQ ID NO: 1949492 - RNA, 19 nt, Homo sapiens
ugucuuccuuggccuauuc

SEQ ID NO: 1949493 - RNA, 19 nt, Homo sapiens
uguauacuuuugguggaga

SEQ ID NO: 1949494 - RNA, 17 nt, Homo sapiens
ugaaggaggugagggau

SEQ ID NO: 1949495 - RNA, 21 nt, Homo sapiens
ugagagaaaauacuauuucaa

SEQ ID NO: 1949496 - RNA, 18 nt, Homo sapiens
auugaggaguugccugac

SEQ ID NO: 1949497 - RNA, 18 nt, Homo sapiens
ugggacgggaugguucug

SEQ ID NO: 1949498 - RNA, 13 nt, Homo sapiens
ugauagguuacau

SEQ ID NO: 1949499 - RNA, 22 nt, Homo sapiens
acugauuaccuccuguguggaa

SEQ ID NO: 1949500 - RNA, 17 nt, Homo sapiens
agaaagcagaucaucuc

SEQ ID NO: 1949501 - RNA, 17 nt, Homo sapiens
uuccaggagacauauau

SEQ ID NO: 1949502 - RNA, 23 nt, Homo sapiens
agaggacggggagauagaacugu

SEQ ID NO: 1949503 - RNA, 19 nt, Homo sapiens
aaaagcaagggaccuucau

SEQ ID NO: 1949504 - RNA, 14 nt, Homo sapiens
agcuuggaaacugg

SEQ ID NO: 1949505 - RNA, 14 nt, Homo sapiens
gagggggaggggug

SEQ ID NO: 1949506 - RNA, 22 nt, Homo sapiens
cccaggagccggacacuucuca

SEQ ID NO: 1949507 - RNA, 16 nt, Homo sapiens
acuccacccaccuggc

SEQ ID NO: 1949508 - RNA, 16 nt, Homo sapiens
ucuguuccagucacau

SEQ ID NO: 1949509 - RNA, 17 nt, Homo sapiens
ucuggaucuaucuguau

SEQ ID NO: 1949510 - RNA, 22 nt, Homo sapiens
uguuccagauccuucaaagagu

SEQ ID NO: 1949511 - RNA, 14 nt, Homo sapiens
uggaaugaaaacuu

SEQ ID NO: 1949512 - RNA, 23 nt, Homo sapiens
aggaaagagagcaccacgugaug

SEQ ID NO: 1949513 - RNA, 20 nt, Homo sapiens
gaaaaguuucccagucuuca

SEQ ID NO: 1949514 - RNA, 21 nt, Homo sapiens
acaguaaccauuucaguguau

SEQ ID NO: 1949515 - RNA, 21 nt, Homo sapiens
uacucuauguaugcaucuaua

SEQ ID NO: 1949516 - RNA, 15 nt, Homo sapiens
cagauggcugugaaa

SEQ ID NO: 1949517 - RNA, 14 nt, Homo sapiens
aaugucauagucuu

SEQ ID NO: 1949518 - RNA, 14 nt, Homo sapiens
agccuugcaaccca

SEQ ID NO: 1949519 - RNA, 19 nt, Homo sapiens
uuccggcacacugccaaau

SEQ ID NO: 1949520 - RNA, 19 nt, Homo sapiens
gagagaacuuaaaaaagca

SEQ ID NO: 1949521 - RNA, 16 nt, Homo sapiens
uaaaauacuauugccu

SEQ ID NO: 1949522 - RNA, 18 nt, Homo sapiens
auccauuuuacacuugcu

SEQ ID NO: 1949523 - RNA, 14 nt, Homo sapiens
acaaucguucugug

SEQ ID NO: 1949524 - RNA, 21 nt, Homo sapiens
uauuauuuacaucacuuugug

SEQ ID NO: 1949525 - RNA, 17 nt, Homo sapiens
uggggguucuggcagga

SEQ ID NO: 1949526 - RNA, 12 nt, Homo sapiens
cucuaucaaaug

SEQ ID NO: 1949527 - RNA, 20 nt, Homo sapiens
uucccuauacuucacacuga

SEQ ID NO: 1949528 - RNA, 23 nt, Homo sapiens
uauuuaagcaauaaaacugcuag

SEQ ID NO: 1949529 - RNA, 15 nt, Homo sapiens
aguggccaucuggaa

SEQ ID NO: 1949530 - RNA, 22 nt, Homo sapiens
cacucagcacucuggacuccac

SEQ ID NO: 1949531 - RNA, 18 nt, Homo sapiens
agccauugaacagcugug

SEQ ID NO: 1949532 - RNA, 15 nt, Homo sapiens
uaaaggcucuggaag

SEQ ID NO: 1949533 - RNA, 18 nt, Homo sapiens
uaggccaggcgugguggc

SEQ ID NO: 1949534 - RNA, 16 nt, Homo sapiens
aucccugccuggucac

SEQ ID NO: 1949535 - RNA, 13 nt, Homo sapiens
uuaaaugcauguc

SEQ ID NO: 1949536 - RNA, 23 nt, Homo sapiens
augauagaaacagacugccugaa

SEQ ID NO: 1949537 - RNA, 22 nt, Homo sapiens
guuugcagauauucucuaguca

SEQ ID NO: 1949538 - RNA, 13 nt, Homo sapiens
gcucugcaccuuc

SEQ ID NO: 1949539 - RNA, 15 nt, Homo sapiens
cuccucauagcauga

SEQ ID NO: 1949540 - RNA, 17 nt, Homo sapiens
ucaccugaggucgggag

SEQ ID NO: 1949541 - RNA, 19 nt, Homo sapiens
cuauuuuuauacacuguaa

SEQ ID NO: 1949542 - RNA, 23 nt, Homo sapiens
caaaaaugaaagcaugucucaau

SEQ ID NO: 1949543 - RNA, 19 nt, Homo sapiens
gccacuccccuccacucuc

SEQ ID NO: 1949544 - RNA, 22 nt, Homo sapiens
gucagacugaaacgccuugcac

SEQ ID NO: 1949545 - RNA, 22 nt, Homo sapiens
uacgcucugcucaaugaaaccu

SEQ ID NO: 1949546 - RNA, 21 nt, Homo sapiens
ugcccuuggagcugccgugcc

SEQ ID NO: 1949547 - RNA, 22 nt, Homo sapiens
uuccuaaggcacccacaaauaa

SEQ ID NO: 1949548 - RNA, 16 nt, Homo sapiens
auaaguaaacaacaua

SEQ ID NO: 1949549 - RNA, 14 nt, Homo sapiens
ccacuuaaucuucu

SEQ ID NO: 1949550 - RNA, 15 nt, Homo sapiens
ccaggacaguggaga

SEQ ID NO: 1949551 - RNA, 14 nt, Homo sapiens
uagcagcauuccau

SEQ ID NO: 1949552 - RNA, 13 nt, Homo sapiens
cuuccucacaaaa

SEQ ID NO: 1949553 - RNA, 13 nt, Homo sapiens
gacaguauuccau

SEQ ID NO: 1949554 - RNA, 19 nt, Homo sapiens
uuuguagcucuggaccugu

SEQ ID NO: 1949555 - RNA, 15 nt, Homo sapiens
cacaccuacccaggg

SEQ ID NO: 1949556 - RNA, 17 nt, Homo sapiens
auagauuaauggcacug

SEQ ID NO: 1949557 - RNA, 23 nt, Homo sapiens
ugcugugcccucccauagcacug

SEQ ID NO: 1949558 - RNA, 16 nt, Homo sapiens
accucccugcaauaaa

SEQ ID NO: 1949559 - RNA, 21 nt, Homo sapiens
uucagaccacaaggggcucca

SEQ ID NO: 1949560 - RNA, 15 nt, Homo sapiens
cugacagcaaacaca

SEQ ID NO: 1949561 - RNA, 20 nt, Homo sapiens
agccaaggucaugccacugc

SEQ ID NO: 1949562 - RNA, 16 nt, Homo sapiens
gccaguaaggcagcuc

SEQ ID NO: 1949563 - RNA, 21 nt, Homo sapiens
aacauggcuguuaacccacug

SEQ ID NO: 1949564 - RNA, 23 nt, Homo sapiens
aaccuuuucaccuccaacuggau

SEQ ID NO: 1949565 - RNA, 22 nt, Homo sapiens
aauuacuucucucuaucuggaa

SEQ ID NO: 1949566 - RNA, 20 nt, Homo sapiens
aauggacguuauccucucag

SEQ ID NO: 1949567 - RNA, 16 nt, Homo sapiens
aauacaauucagucuu

SEQ ID NO: 1949568 - RNA, 20 nt, Homo sapiens
uguugcaaaucacucugcaa

SEQ ID NO: 1949569 - RNA, 11 nt, Homo sapiens
uuuaaguccac

SEQ ID NO: 1949570 - RNA, 17 nt, Homo sapiens
cuggccuuugcucuuac

SEQ ID NO: 1949571 - RNA, 20 nt, Homo sapiens
gacuccugucuguccuggag

SEQ ID NO: 1949572 - RNA, 20 nt, Homo sapiens
aggagcaugucacuccagca

SEQ ID NO: 1949573 - RNA, 14 nt, Homo sapiens
caccucugugccca

SEQ ID NO: 1949574 - RNA, 22 nt, Homo sapiens
ugaggcacaagaaucacuugaa

SEQ ID NO: 1949575 - RNA, 18 nt, Homo sapiens
gaagucuuagacuugaaa

SEQ ID NO: 1949576 - RNA, 22 nt, Homo sapiens
aguugagagggugcaguccaga

SEQ ID NO: 1949577 - RNA, 16 nt, Homo sapiens
uggguaggcaugugca

SEQ ID NO: 1949578 - RNA, 18 nt, Homo sapiens
ugggucuggggagggaga

SEQ ID NO: 1949579 - RNA, 22 nt, Homo sapiens
ugaaccauccacuuacauauau

SEQ ID NO: 1949580 - RNA, 14 nt, Homo sapiens
cccugugucccaca

SEQ ID NO: 1949581 - RNA, 18 nt, Homo sapiens
uuaauauaguugguacac

SEQ ID NO: 1949582 - RNA, 14 nt, Homo sapiens
gcaaaagcucugug

SEQ ID NO: 1949583 - RNA, 22 nt, Homo sapiens
gguugcuguccucucauuugca

SEQ ID NO: 1949584 - RNA, 14 nt, Homo sapiens
ccugugcuaaagaa

SEQ ID NO: 1949585 - RNA, 17 nt, Homo sapiens
agccagggggacuagcc

SEQ ID NO: 1949586 - RNA, 13 nt, Homo sapiens
aaagucauguauu

SEQ ID NO: 1949587 - RNA, 18 nt, Homo sapiens
ucacacuggccacaagga

SEQ ID NO: 1949588 - RNA, 19 nt, Homo sapiens
guacauucccugcauccaa

SEQ ID NO: 1949589 - RNA, 17 nt, Homo sapiens
auagcauuuguguaaag

SEQ ID NO: 1949590 - RNA, 23 nt, Homo sapiens
cagucauggccaaauguucaaua

SEQ ID NO: 1949591 - RNA, 22 nt, Homo sapiens
guccaucugucuguccuacccg

SEQ ID NO: 1949592 - RNA, 15 nt, Homo sapiens
ucagcucaaccacag

SEQ ID NO: 1949593 - RNA, 22 nt, Homo sapiens
aaagucaccacuccauucccaa

SEQ ID NO: 1949594 - RNA, 15 nt, Homo sapiens
cuggcuguauggaaa

SEQ ID NO: 1949595 - RNA, 19 nt, Homo sapiens
aagauaagaugaaucauuu

SEQ ID NO: 1949596 - RNA, 18 nt, Homo sapiens
cuucccaaagcacaaagc

SEQ ID NO: 1949597 - RNA, 20 nt, Homo sapiens
acuggccuuacgauggcaau

SEQ ID NO: 1949598 - RNA, 13 nt, Homo sapiens
gauuaaacuuaau

SEQ ID NO: 1949599 - RNA, 17 nt, Homo sapiens
uaugcacaaaucugcca

SEQ ID NO: 1949600 - RNA, 15 nt, Homo sapiens
cuuugaaaacauaca

SEQ ID NO: 1949601 - RNA, 14 nt, Homo sapiens
cccagccccuucca

SEQ ID NO: 1949602 - RNA, 13 nt, Homo sapiens
uacauuuacuuua

SEQ ID NO: 1949603 - RNA, 16 nt, Homo sapiens
uaucucggaccuuuca

SEQ ID NO: 1949604 - RNA, 16 nt, Homo sapiens
caaaggugauuuuccu

SEQ ID NO: 1949605 - RNA, 15 nt, Homo sapiens
cuuucaacuugcauc

SEQ ID NO: 1949606 - RNA, 23 nt, Homo sapiens
gcaauacugcuuaauugcugaua

SEQ ID NO: 1949607 - RNA, 13 nt, Homo sapiens
auacaauugucau

SEQ ID NO: 1949608 - RNA, 13 nt, Homo sapiens
ugccuugcaccuc

SEQ ID NO: 1949609 - RNA, 23 nt, Homo sapiens
auaaaaaguuucacaggucaaua

SEQ ID NO: 1949610 - RNA, 20 nt, Homo sapiens
ggcaggaccgccauggugcu

SEQ ID NO: 1949611 - RNA, 23 nt, Homo sapiens
ugccaagggaggcggauuucccu

SEQ ID NO: 1949612 - RNA, 24 nt, Homo sapiens
ugucuaauggucacagagcacugu

SEQ ID NO: 1949613 - RNA, 22 nt, Homo sapiens
guuagcaccauuaacuccuccu

SEQ ID NO: 1949614 - RNA, 21 nt, Homo sapiens
uccccagcuccucgucuuuga

SEQ ID NO: 1949615 - RNA, 23 nt, Homo sapiens
aaaggucuauggcucaugucuga

SEQ ID NO: 1949616 - RNA, 14 nt, Homo sapiens
guucugcacugaaa

SEQ ID NO: 1949617 - RNA, 21 nt, Homo sapiens
gggcuaagguuuccagucaga

SEQ ID NO: 1949618 - RNA, 23 nt, Homo sapiens
agaucuagucuguuacaccauuu

SEQ ID NO: 1949619 - RNA, 23 nt, Homo sapiens
ugcuuccccaaaggccaacagca

SEQ ID NO: 1949620 - RNA, 19 nt, Homo sapiens
ccccaguuccucccaggaa

SEQ ID NO: 1949621 - RNA, 13 nt, Homo sapiens
caaagauguucau

SEQ ID NO: 1949622 - RNA, 15 nt, Homo sapiens
gcuaacaagucacca

SEQ ID NO: 1949623 - RNA, 17 nt, Homo sapiens
caaugcaaaguacaugu

SEQ ID NO: 1949624 - RNA, 22 nt, Homo sapiens
uaauaaaaugcuaaaugucaau

SEQ ID NO: 1949625 - RNA, 14 nt, Homo sapiens
gccaguagcugcca

SEQ ID NO: 1949626 - RNA, 13 nt, Homo sapiens
uuuguugccuuau

SEQ ID NO: 1949627 - RNA, 14 nt, Homo sapiens
caggaaguacugga

SEQ ID NO: 1949628 - RNA, 20 nt, Homo sapiens
ggcagagaggacuguugaca

SEQ ID NO: 1949629 - RNA, 15 nt, Homo sapiens
uuaagagcaauucaa

SEQ ID NO: 1949630 - RNA, 20 nt, Homo sapiens
ucuaaguuauuuacuuuuac

SEQ ID NO: 1949631 - RNA, 20 nt, Homo sapiens
caauuguuacaguacuguuc

SEQ ID NO: 1949632 - RNA, 14 nt, Homo sapiens
gcagcagaagccaa

SEQ ID NO: 1949633 - RNA, 16 nt, Homo sapiens
cugaccuuuguccuua

SEQ ID NO: 1949634 - RNA, 14 nt, Homo sapiens
aaucaaaagcuauu

SEQ ID NO: 1949635 - RNA, 22 nt, Homo sapiens
acgucugcagaaacagugcaag

SEQ ID NO: 1949636 - RNA, 13 nt, Homo sapiens
agacuauggagcc

SEQ ID NO: 1949637 - RNA, 19 nt, Homo sapiens
ucaagcaauccuccugccu

SEQ ID NO: 1949638 - RNA, 21 nt, Homo sapiens
gcagcccuugggcaguucuca

SEQ ID NO: 1949639 - RNA, 21 nt, Homo sapiens
cagagcaccuuugcacaggau

SEQ ID NO: 1949640 - RNA, 20 nt, Homo sapiens
caucuguucagucaucucca

SEQ ID NO: 1949641 - RNA, 22 nt, Homo sapiens
auugaaauaaagauaaaugcaa

SEQ ID NO: 1949642 - RNA, 23 nt, Homo sapiens
aauaguauucugaucaguugcca

SEQ ID NO: 1949643 - RNA, 18 nt, Homo sapiens
ugaagacccuugugcauu

SEQ ID NO: 1949644 - RNA, 16 nt, Homo sapiens
gccccaaaaccacagc

SEQ ID NO: 1949645 - RNA, 12 nt, Homo sapiens
uaaauguuaaag

SEQ ID NO: 1949646 - RNA, 16 nt, Homo sapiens
aagaucacaucacugc

SEQ ID NO: 1949647 - RNA, 11 nt, Homo sapiens
cccgugugagg

SEQ ID NO: 1949648 - RNA, 13 nt, Homo sapiens
cuaguaccuguga

SEQ ID NO: 1949649 - RNA, 15 nt, Homo sapiens
caaugaauuuugcuu

SEQ ID NO: 1949650 - RNA, 21 nt, Homo sapiens
uaaaauaaagaaauagaacaa

SEQ ID NO: 1949651 - RNA, 15 nt, Homo sapiens
ccuagccugcucugc

SEQ ID NO: 1949652 - RNA, 22 nt, Homo sapiens
cugcuaacaagucaccaaaaga

SEQ ID NO: 1949653 - RNA, 15 nt, Homo sapiens
agauuuuguugaccu

SEQ ID NO: 1949654 - RNA, 23 nt, Homo sapiens
uuacuuuaaaauaaaaaaguaac

SEQ ID NO: 1949655 - RNA, 23 nt, Homo sapiens
cagccucgucucuuuacagaagu

SEQ ID NO: 1949656 - RNA, 16 nt, Homo sapiens
uuggagucagacagau

SEQ ID NO: 1949657 - RNA, 16 nt, Homo sapiens
auaauaaacaguggaa

SEQ ID NO: 1949658 - RNA, 19 nt, Homo sapiens
uaugaaucacagcugccag

SEQ ID NO: 1949659 - RNA, 23 nt, Homo sapiens
cugcaugcugcccagccacucca

SEQ ID NO: 1949660 - RNA, 12 nt, Homo sapiens
gcggaagccaaa

SEQ ID NO: 1949661 - RNA, 16 nt, Homo sapiens
augugcccacagggac

SEQ ID NO: 1949662 - RNA, 16 nt, Homo sapiens
aaaguuccaugaauuc

SEQ ID NO: 1949663 - RNA, 18 nt, Homo sapiens
ugcccacggcaacugccu

SEQ ID NO: 1949664 - RNA, 13 nt, Homo sapiens
ugcggccauucaa

SEQ ID NO: 1949665 - RNA, 21 nt, Homo sapiens
aacucaucuguaaacuuuuau

SEQ ID NO: 1949666 - RNA, 16 nt, Homo sapiens
ccaacuacucagccua

SEQ ID NO: 1949667 - RNA, 21 nt, Homo sapiens
gagaugggguuucaccauguu

SEQ ID NO: 1949668 - RNA, 14 nt, Homo sapiens
ucuuagugugccaa

SEQ ID NO: 1949669 - RNA, 16 nt, Homo sapiens
uuagucauaccaucca

SEQ ID NO: 1949670 - RNA, 16 nt, Homo sapiens
caacucugcugagggu

SEQ ID NO: 1949671 - RNA, 12 nt, Homo sapiens
agcuaagugaaa

SEQ ID NO: 1949672 - RNA, 14 nt, Homo sapiens
caucuagaauucac

SEQ ID NO: 1949673 - RNA, 18 nt, Homo sapiens
acaugcaacagaagugac

SEQ ID NO: 1949674 - RNA, 23 nt, Homo sapiens
aaugugucaggugacccugauga

SEQ ID NO: 1949675 - RNA, 20 nt, Homo sapiens
acauagaauugcaaucuaua

SEQ ID NO: 1949676 - RNA, 10 nt, Homo sapiens
ccccuugaau

SEQ ID NO: 1949677 - RNA, 20 nt, Homo sapiens
aaucuguuuuauaccuugcu

SEQ ID NO: 1949678 - RNA, 19 nt, Homo sapiens
caagaugagaacagauaaa

SEQ ID NO: 1949679 - RNA, 12 nt, Homo sapiens
cuuagcaacagc

SEQ ID NO: 1949680 - RNA, 17 nt, Homo sapiens
cucagcaaacccaaaga

SEQ ID NO: 1949681 - RNA, 19 nt, Homo sapiens
cuggacucuguggggccac

SEQ ID NO: 1949682 - RNA, 22 nt, Homo sapiens
uuccugagggcuaauucuggga

SEQ ID NO: 1949683 - RNA, 16 nt, Homo sapiens
auccugaccugagcca

SEQ ID NO: 1949684 - RNA, 23 nt, Homo sapiens
caagagucaacaggucacuugau

SEQ ID NO: 1949685 - RNA, 21 nt, Homo sapiens
cauauagauuguccuuuugca

SEQ ID NO: 1949686 - RNA, 18 nt, Homo sapiens
gcagcugcuggcugugac

SEQ ID NO: 1949687 - RNA, 20 nt, Homo sapiens
uguguugaaggaacuugucu

SEQ ID NO: 1949688 - RNA, 22 nt, Homo sapiens
uugcaagacaaaguugaaugua

SEQ ID NO: 1949689 - RNA, 14 nt, Homo sapiens
guacagaaugcuau

SEQ ID NO: 1949690 - RNA, 19 nt, Homo sapiens
cuggggucacccaaccuga

SEQ ID NO: 1949691 - RNA, 22 nt, Homo sapiens
aauauucuuuuuauauucugug

SEQ ID NO: 1949692 - RNA, 13 nt, Homo sapiens
gaagaugugugau

SEQ ID NO: 1949693 - RNA, 20 nt, Homo sapiens
caguuguaacaauagcacaa

SEQ ID NO: 1949694 - RNA, 17 nt, Homo sapiens
uguacugcacaaggaca

SEQ ID NO: 1949695 - RNA, 20 nt, Homo sapiens
uagauuaccugccacuucca

SEQ ID NO: 1949696 - RNA, 17 nt, Homo sapiens
aaacagcugacccagug

SEQ ID NO: 1949697 - RNA, 16 nt, Homo sapiens
aaugacucuuaggaca

SEQ ID NO: 1949698 - RNA, 16 nt, Homo sapiens
ccacuuuauugcaaug

SEQ ID NO: 1949699 - RNA, 21 nt, Homo sapiens
acucuguagcuuaaaccaaca

SEQ ID NO: 1949700 - RNA, 13 nt, Homo sapiens
acaguccuuuaaa

SEQ ID NO: 1949701 - RNA, 12 nt, Homo sapiens
uagucacauggc

SEQ ID NO: 1949702 - RNA, 16 nt, Homo sapiens
acaggcccuuccucuc

SEQ ID NO: 1949703 - RNA, 24 nt, Homo sapiens
agccacaguuuccucaucugucca

SEQ ID NO: 1949704 - RNA, 14 nt, Homo sapiens
aagggauguugcaa

SEQ ID NO: 1949705 - RNA, 14 nt, Homo sapiens
gaggcggcacauug

SEQ ID NO: 1949706 - RNA, 12 nt, Homo sapiens
cuacuugaggcu

SEQ ID NO: 1949707 - RNA, 15 nt, Homo sapiens
aagcaacaucagcuu

SEQ ID NO: 1949708 - RNA, 12 nt, Homo sapiens
augaaugcacac

SEQ ID NO: 1949709 - RNA, 13 nt, Homo sapiens
uacuuccaugaua

SEQ ID NO: 1949710 - RNA, 15 nt, Homo sapiens
gaaugcugaaaccaa

SEQ ID NO: 1949711 - RNA, 21 nt, Homo sapiens
cagauacuucccauuuuggaa

SEQ ID NO: 1949712 - RNA, 18 nt, Homo sapiens
gcauuggguagcuauacu

SEQ ID NO: 1949713 - RNA, 14 nt, Homo sapiens
acauuuuccugaga

SEQ ID NO: 1949714 - RNA, 18 nt, Homo sapiens
gaacccgaggcugagaau

SEQ ID NO: 1949715 - RNA, 18 nt, Homo sapiens
ucuaauauuuuuagcucu

SEQ ID NO: 1949716 - RNA, 22 nt, Homo sapiens
gcaccuuagggagggacuggga

SEQ ID NO: 1949717 - RNA, 17 nt, Homo sapiens
aacuggaagccuucccc

SEQ ID NO: 1949718 - RNA, 17 nt, Homo sapiens
cacagcaaggaaauguc

SEQ ID NO: 1949719 - RNA, 18 nt, Homo sapiens
cugcgaaguugaacccag

SEQ ID NO: 1949720 - RNA, 18 nt, Homo sapiens
gauacuguugcacgugug

SEQ ID NO: 1949721 - RNA, 15 nt, Homo sapiens
uauggaaacagagca

SEQ ID NO: 1949722 - RNA, 15 nt, Homo sapiens
aggaggcugggagag

SEQ ID NO: 1949723 - RNA, 19 nt, Homo sapiens
acgucuccuagccaaucag

SEQ ID NO: 1949724 - RNA, 22 nt, Homo sapiens
uuccuggacuggcccuugccca

SEQ ID NO: 1949725 - RNA, 14 nt, Homo sapiens
uauaagcuguaaua

SEQ ID NO: 1949726 - RNA, 17 nt, Homo sapiens
caaugcugccaugccca

SEQ ID NO: 1949727 - RNA, 17 nt, Homo sapiens
aauuucugccuuucccc

SEQ ID NO: 1949728 - RNA, 17 nt, Homo sapiens
gcacuguggaacugcca

SEQ ID NO: 1949729 - RNA, 23 nt, Homo sapiens
cagugacagaacuaagaugauca

SEQ ID NO: 1949730 - RNA, 11 nt, Homo sapiens
ucauugcacuu

SEQ ID NO: 1949731 - RNA, 18 nt, Homo sapiens
ccagauggucauccagac

SEQ ID NO: 1949732 - RNA, 16 nt, Homo sapiens
aauucaccaguguucc

SEQ ID NO: 1949733 - RNA, 14 nt, Homo sapiens
uguauuagauauca

SEQ ID NO: 1949734 - RNA, 17 nt, Homo sapiens
auacugaggcacacaga

SEQ ID NO: 1949735 - RNA, 17 nt, Homo sapiens
ggaggacaguggcacaa

SEQ ID NO: 1949736 - RNA, 15 nt, Homo sapiens
aggcucuucuuccuc

SEQ ID NO: 1949737 - RNA, 14 nt, Homo sapiens
cggaucuuuggaca

SEQ ID NO: 1949738 - RNA, 15 nt, Homo sapiens
acaacaacaaaaaac

SEQ ID NO: 1949739 - RNA, 15 nt, Homo sapiens
gaauuaaagucuaca

SEQ ID NO: 1949740 - RNA, 13 nt, Homo sapiens
uuuugcacuauug

SEQ ID NO: 1949741 - RNA, 23 nt, Homo sapiens
aacccuuucuucaauacaaaaag

SEQ ID NO: 1949742 - RNA, 18 nt, Homo sapiens
ggaauauguuaccauuaa

SEQ ID NO: 1949743 - RNA, 21 nt, Homo sapiens
aacuaccaaauuagugaacca

SEQ ID NO: 1949744 - RNA, 18 nt, Homo sapiens
cugagaucuguugauuga

SEQ ID NO: 1949745 - RNA, 17 nt, Homo sapiens
agucgaucaagggaugu

SEQ ID NO: 1949746 - RNA, 13 nt, Homo sapiens
ucagagacauaca

SEQ ID NO: 1949747 - RNA, 14 nt, Homo sapiens
cagaugaucucucc

SEQ ID NO: 1949748 - RNA, 18 nt, Homo sapiens
cccaggcuggaguacaau

SEQ ID NO: 1949749 - RNA, 14 nt, Homo sapiens
gccccaguccaugc

SEQ ID NO: 1949750 - RNA, 14 nt, Homo sapiens
gucccagcuacuca

SEQ ID NO: 1949751 - RNA, 21 nt, Homo sapiens
ugugguggugacucauuucca

SEQ ID NO: 1949752 - RNA, 22 nt, Homo sapiens
guggauuguauuuaagacauaa

SEQ ID NO: 1949753 - RNA, 13 nt, Homo sapiens
guaggacccaagc

SEQ ID NO: 1949754 - RNA, 18 nt, Homo sapiens
aggugaaagcuauaucaa

SEQ ID NO: 1949755 - RNA, 13 nt, Homo sapiens
caaaagaguccau

SEQ ID NO: 1949756 - RNA, 14 nt, Homo sapiens
aggagaucauuuag

SEQ ID NO: 1949757 - RNA, 12 nt, Homo sapiens
agccacacuggg

SEQ ID NO: 1949758 - RNA, 16 nt, Homo sapiens
ugaaaucagucuacca

SEQ ID NO: 1949759 - RNA, 21 nt, Homo sapiens
uguauugcagcuaagcucaaa

SEQ ID NO: 1949760 - RNA, 22 nt, Homo sapiens
ggguccaggccuggccaugugg

SEQ ID NO: 1949761 - RNA, 21 nt, Homo sapiens
auuaagcagaaauccugcaau

SEQ ID NO: 1949762 - RNA, 15 nt, Homo sapiens
uuucugacacaguca

SEQ ID NO: 1949763 - RNA, 17 nt, Homo sapiens
agauacuucccaaagcc

SEQ ID NO: 1949764 - RNA, 21 nt, Homo sapiens
gauuuaaucaccacucaaaaa

SEQ ID NO: 1949765 - RNA, 17 nt, Homo sapiens
ugauguuucacauaaaa

SEQ ID NO: 1949766 - RNA, 20 nt, Homo sapiens
ucacuagaaguccugcugga

SEQ ID NO: 1949767 - RNA, 20 nt, Homo sapiens
aucaccucccaccauaaucc

SEQ ID NO: 1949768 - RNA, 15 nt, Homo sapiens
cugugccuaacagca

SEQ ID NO: 1949769 - RNA, 16 nt, Homo sapiens
aaccacugcacccacc

SEQ ID NO: 1949770 - RNA, 15 nt, Homo sapiens
agccuucccucugca

SEQ ID NO: 1949771 - RNA, 14 nt, Homo sapiens
uuguagccagguac

SEQ ID NO: 1949772 - RNA, 17 nt, Homo sapiens
cuguccuauuauauuca

SEQ ID NO: 1949773 - RNA, 22 nt, Homo sapiens
uacguagggcuucuaccagaga

SEQ ID NO: 1949774 - RNA, 13 nt, Homo sapiens
gaaacagccugug

SEQ ID NO: 1949775 - RNA, 17 nt, Homo sapiens
gccuugcauguacuuga

SEQ ID NO: 1949776 - RNA, 23 nt, Homo sapiens
gaucagagcguuuguucccccau

SEQ ID NO: 1949777 - RNA, 22 nt, Homo sapiens
agaaggugccacuuuacccacc

SEQ ID NO: 1949778 - RNA, 17 nt, Homo sapiens
cuccaucuucagcuucu

SEQ ID NO: 1949779 - RNA, 18 nt, Homo sapiens
caaaaugaauucugggaa

SEQ ID NO: 1949780 - RNA, 16 nt, Homo sapiens
auaaagauauuuccaa

SEQ ID NO: 1949781 - RNA, 14 nt, Homo sapiens
ucuaugaacuagag

SEQ ID NO: 1949782 - RNA, 13 nt, Homo sapiens
uagauauuuucca

SEQ ID NO: 1949783 - RNA, 15 nt, Homo sapiens
cucccucgcuguaug

SEQ ID NO: 1949784 - RNA, 12 nt, Homo sapiens
augcuuaaggga

SEQ ID NO: 1949785 - RNA, 23 nt, Homo sapiens
gauuuuuuguuauguuugcacuu

SEQ ID NO: 1949786 - RNA, 15 nt, Homo sapiens
gcauuugaggggcca

SEQ ID NO: 1949787 - RNA, 21 nt, Homo sapiens
aacugcauugguuuuccauga

SEQ ID NO: 1949788 - RNA, 14 nt, Homo sapiens
uauaagaguaauau

SEQ ID NO: 1949789 - RNA, 13 nt, Homo sapiens
ccccaccuucaau

SEQ ID NO: 1949790 - RNA, 15 nt, Homo sapiens
agggaauuucuucaa

SEQ ID NO: 1949791 - RNA, 20 nt, Homo sapiens
gcacuaccugaacauuguaa

SEQ ID NO: 1949792 - RNA, 22 nt, Homo sapiens
ugaggccaagaguuugagacca

SEQ ID NO: 1949793 - RNA, 18 nt, Homo sapiens
cccaagugaggagugcca

SEQ ID NO: 1949794 - RNA, 10 nt, Homo sapiens
cuuccugacu

SEQ ID NO: 1949795 - RNA, 17 nt, Homo sapiens
uauauaguagcauuuca

SEQ ID NO: 1949796 - RNA, 18 nt, Homo sapiens
aucauuuggaaaucagca

SEQ ID NO: 1949797 - RNA, 21 nt, Homo sapiens
ccagaugcuggacacccucuu

SEQ ID NO: 1949798 - RNA, 19 nt, Homo sapiens
ugacaaccaaaagucuuca

SEQ ID NO: 1949799 - RNA, 22 nt, Homo sapiens
caaagccagugcugucugggau

SEQ ID NO: 1949800 - RNA, 14 nt, Homo sapiens
gaaauauuauagag

SEQ ID NO: 1949801 - RNA, 17 nt, Homo sapiens
cuaaaacaaucuaaaac

SEQ ID NO: 1949802 - RNA, 16 nt, Homo sapiens
uuuuacauacugcugu

SEQ ID NO: 1949803 - RNA, 23 nt, Homo sapiens
ugcacugugguuucagaugugca

SEQ ID NO: 1949804 - RNA, 16 nt, Homo sapiens
aguuuauaucucucau

SEQ ID NO: 1949805 - RNA, 14 nt, Homo sapiens
agaaaaucaaugaa

SEQ ID NO: 1949806 - RNA, 20 nt, Homo sapiens
auugggcuugugauuuccau

SEQ ID NO: 1949807 - RNA, 19 nt, Homo sapiens
uaauauuucaagugccuag

SEQ ID NO: 1949808 - RNA, 16 nt, Homo sapiens
gcuucccaacuucaua

SEQ ID NO: 1949809 - RNA, 22 nt, Homo sapiens
uggguuggggacccccucagga

SEQ ID NO: 1949810 - RNA, 13 nt, Homo sapiens
guaaacacaggga

SEQ ID NO: 1949811 - RNA, 18 nt, Homo sapiens
cauccagaguaagugaug

SEQ ID NO: 1949812 - RNA, 20 nt, Homo sapiens
augguccugcagaagcagaa

SEQ ID NO: 1949813 - RNA, 20 nt, Homo sapiens
ucuugccagccucaggcuug

SEQ ID NO: 1949814 - RNA, 19 nt, Homo sapiens
caguuuuuauauagucuac

SEQ ID NO: 1949815 - RNA, 14 nt, Homo sapiens
gaaagaauguuacu

SEQ ID NO: 1949816 - RNA, 20 nt, Homo sapiens
auguucugggacacaguuca

SEQ ID NO: 1949817 - RNA, 20 nt, Homo sapiens
guuuacauccagaguucugu

SEQ ID NO: 1949818 - RNA, 23 nt, Homo sapiens
caaaggugugcuuccugcuguau

SEQ ID NO: 1949819 - RNA, 14 nt, Homo sapiens
aauugcucuuucac

SEQ ID NO: 1949820 - RNA, 16 nt, Homo sapiens
uaguaacaguauuucc

SEQ ID NO: 1949821 - RNA, 19 nt, Homo sapiens
auuaccugucaucugggcc

SEQ ID NO: 1949822 - RNA, 13 nt, Homo sapiens
cugacgcagcaca

SEQ ID NO: 1949823 - RNA, 13 nt, Homo sapiens
caaaacagcguuu

SEQ ID NO: 1949824 - RNA, 22 nt, Homo sapiens
aacuuugcauagcagcugcuac

SEQ ID NO: 1949825 - RNA, 18 nt, Homo sapiens
cuauggaaauguaggcca

SEQ ID NO: 1949826 - RNA, 16 nt, Homo sapiens
cuuucaggccaaggcu

SEQ ID NO: 1949827 - RNA, 17 nt, Homo sapiens
aucuugauuucacugga

SEQ ID NO: 1949828 - RNA, 19 nt, Homo sapiens
uacaaguuaagguaucugg

SEQ ID NO: 1949829 - RNA, 16 nt, Homo sapiens
caagugccaagacaca

SEQ ID NO: 1949830 - RNA, 17 nt, Homo sapiens
ucccccucucugcccug

SEQ ID NO: 1949831 - RNA, 15 nt, Homo sapiens
ccgcuuggcacauga

SEQ ID NO: 1949832 - RNA, 17 nt, Homo sapiens
uauuaggaaauucugau

SEQ ID NO: 1949833 - RNA, 17 nt, Homo sapiens
ucuccuggacucagggu

SEQ ID NO: 1949834 - RNA, 22 nt, Homo sapiens
cugagggaggaccuggggcaca

SEQ ID NO: 1949835 - RNA, 17 nt, Homo sapiens
uucacuuuuaauuugcu

SEQ ID NO: 1949836 - RNA, 19 nt, Homo sapiens
aagcguaauuuugccaaau

SEQ ID NO: 1949837 - RNA, 16 nt, Homo sapiens
aagaaugaacccaaga

SEQ ID NO: 1949838 - RNA, 21 nt, Homo sapiens
ucuaggacuagaaaaacuugg

SEQ ID NO: 1949839 - RNA, 17 nt, Homo sapiens
gaaccaguuaagagaca

SEQ ID NO: 1949840 - RNA, 21 nt, Homo sapiens
cuugcaacuaaggacaaauua

SEQ ID NO: 1949841 - RNA, 22 nt, Homo sapiens
agccuggcuggagagcugcuau

SEQ ID NO: 1949842 - RNA, 14 nt, Homo sapiens
aggaagauaugcca

SEQ ID NO: 1949843 - RNA, 14 nt, Homo sapiens
uguaagauuuucca

SEQ ID NO: 1949844 - RNA, 22 nt, Homo sapiens
uacaggcgugcgccacuaugcc

SEQ ID NO: 1949845 - RNA, 23 nt, Homo sapiens
acugacagcccuguguugugcuc

SEQ ID NO: 1949846 - RNA, 13 nt, Homo sapiens
agcugaacccugc

SEQ ID NO: 1949847 - RNA, 17 nt, Homo sapiens
uaauaaucuucagguga

SEQ ID NO: 1949848 - RNA, 14 nt, Homo sapiens
uaugcuugcucuaa

SEQ ID NO: 1949849 - RNA, 10 nt, Homo sapiens
uccagcugcc

SEQ ID NO: 1949850 - RNA, 20 nt, Homo sapiens
agccaucaagagacugaguc

SEQ ID NO: 1949851 - RNA, 10 nt, Homo sapiens
uucagcugcu

SEQ ID NO: 1949852 - RNA, 14 nt, Homo sapiens
agagagugcuauug

SEQ ID NO: 1949853 - RNA, 17 nt, Homo sapiens
uguggguccaacacuua

SEQ ID NO: 1949854 - RNA, 20 nt, Homo sapiens
ggcucaagcaguccucccac

SEQ ID NO: 1949855 - RNA, 22 nt, Homo sapiens
ucuccucuaucacauuacauca

SEQ ID NO: 1949856 - RNA, 19 nt, Homo sapiens
guaagaccucugagaccaa

SEQ ID NO: 1949857 - RNA, 15 nt, Homo sapiens
augcuguuaaccaaa

SEQ ID NO: 1949858 - RNA, 18 nt, Homo sapiens
ucagagcccucaacuauu

SEQ ID NO: 1949859 - RNA, 15 nt, Homo sapiens
ucauuugcauccuau

SEQ ID NO: 1949860 - RNA, 17 nt, Homo sapiens
ucacggcugcaccugca

SEQ ID NO: 1949861 - RNA, 23 nt, Homo sapiens
gugggguacagagaugaaagagg

SEQ ID NO: 1949862 - RNA, 13 nt, Homo sapiens
acguuuaacacaa

SEQ ID NO: 1949863 - RNA, 12 nt, Homo sapiens
ggcuaaucagua

SEQ ID NO: 1949864 - RNA, 13 nt, Homo sapiens
ugccugggaugau

SEQ ID NO: 1949865 - RNA, 23 nt, Homo sapiens
cugcuggagaaaaaacacacucc

SEQ ID NO: 1949866 - RNA, 15 nt, Homo sapiens
cauuguuaggugcug

SEQ ID NO: 1949867 - RNA, 23 nt, Homo sapiens
aaccagucagcuggccagauuuc

SEQ ID NO: 1949868 - RNA, 15 nt, Homo sapiens
ggagaggguacacaa

SEQ ID NO: 1949869 - RNA, 13 nt, Homo sapiens
ucaacagaucaau

SEQ ID NO: 1949870 - RNA, 13 nt, Homo sapiens
cagacagacagau

SEQ ID NO: 1949871 - RNA, 13 nt, Homo sapiens
uucuuagauucuc

SEQ ID NO: 1949872 - RNA, 12 nt, Homo sapiens
aggcuacauaua

SEQ ID NO: 1949873 - RNA, 16 nt, Homo sapiens
cagagaaacagacaga

SEQ ID NO: 1949874 - RNA, 22 nt, Homo sapiens
gugaaucccaccugccaccagc

SEQ ID NO: 1949875 - RNA, 14 nt, Homo sapiens
caggugaacaaagu

SEQ ID NO: 1949876 - RNA, 14 nt, Homo sapiens
auccuuccaccuca

SEQ ID NO: 1949877 - RNA, 17 nt, Homo sapiens
gugcuccucacuuccuc

SEQ ID NO: 1949878 - RNA, 17 nt, Homo sapiens
ccucuuuccccaccucu

SEQ ID NO: 1949879 - RNA, 20 nt, Homo sapiens
cucaugaaagcagugaagca

SEQ ID NO: 1949880 - RNA, 16 nt, Homo sapiens
acuccaggauucagga

SEQ ID NO: 1949881 - RNA, 10 nt, Homo sapiens
cacacacaaa

SEQ ID NO: 1949882 - RNA, 12 nt, Homo sapiens
ucaagugccuua

SEQ ID NO: 1949883 - RNA, 16 nt, Homo sapiens
ccuggcucugcuucca

SEQ ID NO: 1949884 - RNA, 23 nt, Homo sapiens
cuaauuugaauggaaaacacaug

SEQ ID NO: 1949885 - RNA, 17 nt, Homo sapiens
agcaaaagucagucuua

SEQ ID NO: 1949886 - RNA, 19 nt, Homo sapiens
agcauuugguacacacuug

SEQ ID NO: 1949887 - RNA, 13 nt, Homo sapiens
cucagcucagugc

SEQ ID NO: 1949888 - RNA, 20 nt, Homo sapiens
ugaaucaguaugaagacacu

SEQ ID NO: 1949889 - RNA, 13 nt, Homo sapiens
aucaaaagaaaga

SEQ ID NO: 1949890 - RNA, 15 nt, Homo sapiens
cccauaucuguucaa

SEQ ID NO: 1949891 - RNA, 24 nt, Homo sapiens
ucuguuuugcuuuuccauauagcu

SEQ ID NO: 1949892 - RNA, 18 nt, Homo sapiens
ggauauuggaaugcacag

SEQ ID NO: 1949893 - RNA, 22 nt, Homo sapiens
auguccuucuuuaucugugaua

SEQ ID NO: 1949894 - RNA, 19 nt, Homo sapiens
agcaucaauacaaccagcc

SEQ ID NO: 1949895 - RNA, 14 nt, Homo sapiens
agagucugugcugg

SEQ ID NO: 1949896 - RNA, 19 nt, Homo sapiens
ucuuuuuacauaacugccu

SEQ ID NO: 1949897 - RNA, 16 nt, Homo sapiens
gcagauucaagagcca

SEQ ID NO: 1949898 - RNA, 22 nt, Homo sapiens
aaauauaaguggugcuuagaaa

SEQ ID NO: 1949899 - RNA, 22 nt, Homo sapiens
ucaugccuggagaaaccuucag

SEQ ID NO: 1949900 - RNA, 18 nt, Homo sapiens
ugccagcaguuacuguga

SEQ ID NO: 1949901 - RNA, 14 nt, Homo sapiens
agagaggacaaaga

SEQ ID NO: 1949902 - RNA, 19 nt, Homo sapiens
cucauuuuuauauucauuu

SEQ ID NO: 1949903 - RNA, 15 nt, Homo sapiens
aggcuccaaacugga

SEQ ID NO: 1949904 - RNA, 21 nt, Homo sapiens
ugugaauagucugugugcaca

SEQ ID NO: 1949905 - RNA, 22 nt, Homo sapiens
uguuucaaacaaaaagucauaa

SEQ ID NO: 1949906 - RNA, 18 nt, Homo sapiens
gcugcuuuccaaagccaa

SEQ ID NO: 1949907 - RNA, 20 nt, Homo sapiens
aauaaagacagaucauuuca

SEQ ID NO: 1949908 - RNA, 23 nt, Homo sapiens
aguccucuggauggcaccagagg

SEQ ID NO: 1949909 - RNA, 18 nt, Homo sapiens
gucaauccccucauucag

SEQ ID NO: 1949910 - RNA, 18 nt, Homo sapiens
uggcuuuuuccaucucaa

SEQ ID NO: 1949911 - RNA, 19 nt, Homo sapiens
caaaggcccccaucacacu

SEQ ID NO: 1949912 - RNA, 17 nt, Homo sapiens
uguacaugugcacuccc

SEQ ID NO: 1949913 - RNA, 17 nt, Homo sapiens
aggcagaaaaaugucau

SEQ ID NO: 1949914 - RNA, 14 nt, Homo sapiens
uacauuuauuuaca

SEQ ID NO: 1949915 - RNA, 18 nt, Homo sapiens
acuaccauucuauuccau

SEQ ID NO: 1949916 - RNA, 19 nt, Homo sapiens
cuuuaaaaacuguuuuaga

SEQ ID NO: 1949917 - RNA, 20 nt, Homo sapiens
cagucagcgccagcacugua

SEQ ID NO: 1949918 - RNA, 15 nt, Homo sapiens
auuaacaucaaagac

SEQ ID NO: 1949919 - RNA, 21 nt, Homo sapiens
gcauaaucagcgcccuggagu

SEQ ID NO: 1949920 - RNA, 20 nt, Homo sapiens
uagaguagguacuccauaaa

SEQ ID NO: 1949921 - RNA, 21 nt, Homo sapiens
augucccuccaacacagaucc

SEQ ID NO: 1949922 - RNA, 18 nt, Homo sapiens
aauuuggaaacuaauaaa

SEQ ID NO: 1949923 - RNA, 20 nt, Homo sapiens
accagcagaaaaccuguuca

SEQ ID NO: 1949924 - RNA, 14 nt, Homo sapiens
uccaaucauacaaa

SEQ ID NO: 1949925 - RNA, 23 nt, Homo sapiens
ucuaccuccuuguguugcacuga

SEQ ID NO: 1949926 - RNA, 18 nt, Homo sapiens
gcagagcaaugacugugc

SEQ ID NO: 1949927 - RNA, 17 nt, Homo sapiens
acugucaaguguuuuac

SEQ ID NO: 1949928 - RNA, 20 nt, Homo sapiens
aagucccaguauaccucauu

SEQ ID NO: 1949929 - RNA, 17 nt, Homo sapiens
caucggaaaaauaauca

SEQ ID NO: 1949930 - RNA, 20 nt, Homo sapiens
uaaaugaaaaaaaugaucua

SEQ ID NO: 1949931 - RNA, 18 nt, Homo sapiens
gagucggagaagcuggaa

SEQ ID NO: 1949932 - RNA, 21 nt, Homo sapiens
ggccucaagaaacaaugucug

SEQ ID NO: 1949933 - RNA, 21 nt, Homo sapiens
caaaccucuaaccgacauucc

SEQ ID NO: 1949934 - RNA, 20 nt, Homo sapiens
cugcagguuuguaaugcaaa

SEQ ID NO: 1949935 - RNA, 23 nt, Homo sapiens
acacuguugucaaaaaguuccau

SEQ ID NO: 1949936 - RNA, 16 nt, Homo sapiens
cccuggagagugcaca

SEQ ID NO: 1949937 - RNA, 19 nt, Homo sapiens
cuacuuuugaaaaucaaga

SEQ ID NO: 1949938 - RNA, 15 nt, Homo sapiens
uaucaugaagcacau

SEQ ID NO: 1949939 - RNA, 20 nt, Homo sapiens
cuuucagcuggcagaguuag

SEQ ID NO: 1949940 - RNA, 15 nt, Homo sapiens
cuaccguaaaugucc

SEQ ID NO: 1949941 - RNA, 20 nt, Homo sapiens
ggagaguaccuguguguuuc

SEQ ID NO: 1949942 - RNA, 20 nt, Homo sapiens
aguggauaaauauacaaauc

SEQ ID NO: 1949943 - RNA, 18 nt, Homo sapiens
aaaauccugaacuuucuc

SEQ ID NO: 1949944 - RNA, 17 nt, Homo sapiens
guccagcuuuacugugg

SEQ ID NO: 1949945 - RNA, 17 nt, Homo sapiens
uuccaucuguacuuugg

SEQ ID NO: 1949946 - RNA, 13 nt, Homo sapiens
uaaguuauugcca

SEQ ID NO: 1949947 - RNA, 17 nt, Homo sapiens
auuacaucugccuuaaa

SEQ ID NO: 1949948 - RNA, 16 nt, Homo sapiens
caaauaauuaaaucuc

SEQ ID NO: 1949949 - RNA, 16 nt, Homo sapiens
aagggccgacuaagag

SEQ ID NO: 1949950 - RNA, 16 nt, Homo sapiens
gugauccgccuaccuc

SEQ ID NO: 1949951 - RNA, 16 nt, Homo sapiens
accuguccuucucagg

SEQ ID NO: 1949952 - RNA, 14 nt, Homo sapiens
caaaugaacacgug

SEQ ID NO: 1949953 - RNA, 19 nt, Homo sapiens
agaucgcgccacugcacuc

SEQ ID NO: 1949954 - RNA, 15 nt, Homo sapiens
accuucaagaucuca

SEQ ID NO: 1949955 - RNA, 12 nt, Homo sapiens
aguauacugugu

SEQ ID NO: 1949956 - RNA, 20 nt, Homo sapiens
agcaaugcuucugccucagc

SEQ ID NO: 1949957 - RNA, 18 nt, Homo sapiens
aagucauccccuugggcu

SEQ ID NO: 1949958 - RNA, 19 nt, Homo sapiens
aaagaugcuugaugcccag

SEQ ID NO: 1949959 - RNA, 12 nt, Homo sapiens
ugcgcucagggg

SEQ ID NO: 1949960 - RNA, 19 nt, Homo sapiens
aaagucacacagagugccu

SEQ ID NO: 1949961 - RNA, 13 nt, Homo sapiens
caugggacagggg

SEQ ID NO: 1949962 - RNA, 14 nt, Homo sapiens
cuuaacugaugaca

SEQ ID NO: 1949963 - RNA, 22 nt, Homo sapiens
aaccuggauuuuuuaaaucaua

SEQ ID NO: 1949964 - RNA, 19 nt, Homo sapiens
agauucugggaaaggugcu

SEQ ID NO: 1949965 - RNA, 18 nt, Homo sapiens
auaacucugcacuacucc

SEQ ID NO: 1949966 - RNA, 14 nt, Homo sapiens
caagugucaccucc

SEQ ID NO: 1949967 - RNA, 19 nt, Homo sapiens
uuaugguuaauacuauuaa

SEQ ID NO: 1949968 - RNA, 22 nt, Homo sapiens
uccugugcaaaaauaaaaugga

SEQ ID NO: 1949969 - RNA, 21 nt, Homo sapiens
ucccaaagggaggguggcaga

SEQ ID NO: 1949970 - RNA, 21 nt, Homo sapiens
aacauucaucaagcuguacau

SEQ ID NO: 1949971 - RNA, 15 nt, Homo sapiens
uuguagcagugugcu

SEQ ID NO: 1949972 - RNA, 13 nt, Homo sapiens
ccagugccagcuc

SEQ ID NO: 1949973 - RNA, 19 nt, Homo sapiens
gaagcugggagcuacaggg

SEQ ID NO: 1949974 - RNA, 16 nt, Homo sapiens
caugagaacuuagaca

SEQ ID NO: 1949975 - RNA, 15 nt, Homo sapiens
guguuauuugcacac

SEQ ID NO: 1949976 - RNA, 10 nt, Homo sapiens
auagugucuu

SEQ ID NO: 1949977 - RNA, 13 nt, Homo sapiens
gccaacacuuugu

SEQ ID NO: 1949978 - RNA, 22 nt, Homo sapiens
uucccuccucgggcuucucgcc

SEQ ID NO: 1949979 - RNA, 17 nt, Homo sapiens
caagcuucacauuugcg

SEQ ID NO: 1949980 - RNA, 18 nt, Homo sapiens
ugaaacagccauguccaa

SEQ ID NO: 1949981 - RNA, 18 nt, Homo sapiens
cucuuuggcaguugcauu

SEQ ID NO: 1949982 - RNA, 18 nt, Homo sapiens
caagacacaucccuacaa

SEQ ID NO: 1949983 - RNA, 18 nt, Homo sapiens
caaggccagcacccaaag

SEQ ID NO: 1949984 - RNA, 20 nt, Homo sapiens
aaauugggaaaggaguagaa

SEQ ID NO: 1949985 - RNA, 17 nt, Homo sapiens
guuuccuggcacugcuu

SEQ ID NO: 1949986 - RNA, 14 nt, Homo sapiens
aggccagagugcug

SEQ ID NO: 1949987 - RNA, 22 nt, Homo sapiens
ucagcgugguuuuuauguguau

SEQ ID NO: 1949988 - RNA, 16 nt, Homo sapiens
agggauggagaaagaa

SEQ ID NO: 1949989 - RNA, 20 nt, Homo sapiens
ccugggccaccaugcacuca

SEQ ID NO: 1949990 - RNA, 15 nt, Homo sapiens
uaguuauaaaccaau

SEQ ID NO: 1949991 - RNA, 17 nt, Homo sapiens
ugccccucuucccggga

SEQ ID NO: 1949992 - RNA, 19 nt, Homo sapiens
ugaagacauguacugauga

SEQ ID NO: 1949993 - RNA, 18 nt, Homo sapiens
aaaccuuuacaguuagca

SEQ ID NO: 1949994 - RNA, 11 nt, Homo sapiens
agccuucuuag

SEQ ID NO: 1949995 - RNA, 17 nt, Homo sapiens
ucauaucuguaugccuc

SEQ ID NO: 1949996 - RNA, 22 nt, Homo sapiens
ugccucccccgccuccagucau

SEQ ID NO: 1949997 - RNA, 13 nt, Homo sapiens
cauuauuagcacu

SEQ ID NO: 1949998 - RNA, 20 nt, Homo sapiens
gagaugcaugcgcaggcuca

SEQ ID NO: 1949999 - RNA, 17 nt, Homo sapiens
cgcugugccaaagccag

SEQ ID NO: 1950000 - RNA, 16 nt, Homo sapiens
ccaaacauguucccaa

SEQ ID NO: 1950001 - RNA, 14 nt, Homo sapiens
guauaaguauucaa

SEQ ID NO: 1950002 - RNA, 21 nt, Homo sapiens
auuaaggauguagcuuuucac

SEQ ID NO: 1950003 - RNA, 22 nt, Homo sapiens
gucuugauuucacacucauuua

SEQ ID NO: 1950004 - RNA, 15 nt, Homo sapiens
gggcaucauucucua

SEQ ID NO: 1950005 - RNA, 13 nt, Homo sapiens
acugauaaucucu

SEQ ID NO: 1950006 - RNA, 14 nt, Homo sapiens
uacuacauacaagc

SEQ ID NO: 1950007 - RNA, 12 nt, Homo sapiens
gggcauugccau

SEQ ID NO: 1950008 - RNA, 22 nt, Homo sapiens
aaaucauuucaguaucaucucc

SEQ ID NO: 1950009 - RNA, 19 nt, Homo sapiens
agcaucugggccuuggccu

SEQ ID NO: 1950010 - RNA, 23 nt, Homo sapiens
auagagaccaucuuugccaacau

SEQ ID NO: 1950011 - RNA, 21 nt, Homo sapiens
cccugcuucagcgaaagggac

SEQ ID NO: 1950012 - RNA, 17 nt, Homo sapiens
gauguuacaucacagug

SEQ ID NO: 1950013 - RNA, 14 nt, Homo sapiens
ugcgccuugcaaaa

SEQ ID NO: 1950014 - RNA, 22 nt, Homo sapiens
ccccugggauccgagggccccu

SEQ ID NO: 1950015 - RNA, 22 nt, Homo sapiens
cacccauugugauuguggaaga

SEQ ID NO: 1950016 - RNA, 21 nt, Homo sapiens
caagccuggucuccucccaaa

SEQ ID NO: 1950017 - RNA, 19 nt, Homo sapiens
uuucuaauguaugcauuca

SEQ ID NO: 1950018 - RNA, 19 nt, Homo sapiens
agccucuauugccaugaga

SEQ ID NO: 1950019 - RNA, 18 nt, Homo sapiens
ccaaccuuaaaccucuuc

SEQ ID NO: 1950020 - RNA, 14 nt, Homo sapiens
aaggagcauugcag

SEQ ID NO: 1950021 - RNA, 20 nt, Homo sapiens
ugaugggccacaacugucuu

SEQ ID NO: 1950022 - RNA, 14 nt, Homo sapiens
gcuacuuuugccaa

SEQ ID NO: 1950023 - RNA, 14 nt, Homo sapiens
ugcacuuugcucaa

SEQ ID NO: 1950024 - RNA, 19 nt, Homo sapiens
ggaugugcauuucugugau

SEQ ID NO: 1950025 - RNA, 19 nt, Homo sapiens
caagcuuuucaaaauugga

SEQ ID NO: 1950026 - RNA, 20 nt, Homo sapiens
gccagcaccaccccauccgc

SEQ ID NO: 1950027 - RNA, 15 nt, Homo sapiens
ccuauguuucacugu

SEQ ID NO: 1950028 - RNA, 16 nt, Homo sapiens
aauccacuuugcucug

SEQ ID NO: 1950029 - RNA, 22 nt, Homo sapiens
gaaugugucuugcgagcuguug

SEQ ID NO: 1950030 - RNA, 16 nt, Homo sapiens
ugucucuaaccauuca

SEQ ID NO: 1950031 - RNA, 22 nt, Homo sapiens
aauuguuaauaaaauagucacu

SEQ ID NO: 1950032 - RNA, 17 nt, Homo sapiens
uuaaaaucacuauaucu

SEQ ID NO: 1950033 - RNA, 21 nt, Homo sapiens
caaaugaugaagaccaaagac

SEQ ID NO: 1950034 - RNA, 17 nt, Homo sapiens
ucagacagagacuuuaa

SEQ ID NO: 1950035 - RNA, 15 nt, Homo sapiens
uauguccuauucauu

SEQ ID NO: 1950036 - RNA, 21 nt, Homo sapiens
aagcguuucuuuacuucucac

SEQ ID NO: 1950037 - RNA, 19 nt, Homo sapiens
ucugauaccacugcacugu

SEQ ID NO: 1950038 - RNA, 22 nt, Homo sapiens
aagacugacaaagucauccucc

SEQ ID NO: 1950039 - RNA, 15 nt, Homo sapiens
ccugcagaagcagaa

SEQ ID NO: 1950040 - RNA, 17 nt, Homo sapiens
ucauagagacggagauc

SEQ ID NO: 1950041 - RNA, 19 nt, Homo sapiens
uuucaucuuuugaagagca

SEQ ID NO: 1950042 - RNA, 22 nt, Homo sapiens
acuuagguaaaauaaaagacua

SEQ ID NO: 1950043 - RNA, 14 nt, Homo sapiens
uccacucugagucg

SEQ ID NO: 1950044 - RNA, 20 nt, Homo sapiens
gccuuggccuggagcacaaa

SEQ ID NO: 1950045 - RNA, 22 nt, Homo sapiens
gggcccaagggcagaccuuucu

SEQ ID NO: 1950046 - RNA, 19 nt, Homo sapiens
ggcccccgggccugcacag

SEQ ID NO: 1950047 - RNA, 15 nt, Homo sapiens
ccacccaacaagcca

SEQ ID NO: 1950048 - RNA, 17 nt, Homo sapiens
aaagccuuuuccagaag

SEQ ID NO: 1950049 - RNA, 16 nt, Homo sapiens
ucacccaccagacuuu

SEQ ID NO: 1950050 - RNA, 16 nt, Homo sapiens
auggccuuaauuaauu

SEQ ID NO: 1950051 - RNA, 21 nt, Homo sapiens
ucuuugucaccacguggggcu

SEQ ID NO: 1950052 - RNA, 13 nt, Homo sapiens
aauaaaacaguug

SEQ ID NO: 1950053 - RNA, 21 nt, Homo sapiens
uugagugacagcuuucuggga

SEQ ID NO: 1950054 - RNA, 21 nt, Homo sapiens
aaaagcuuucugccaccccua

SEQ ID NO: 1950055 - RNA, 23 nt, Homo sapiens
uuuuaucuucagaaauucucugc

SEQ ID NO: 1950056 - RNA, 14 nt, Homo sapiens
ucacauauaaaagu

SEQ ID NO: 1950057 - RNA, 17 nt, Homo sapiens
aguuccaaaagcacaga

SEQ ID NO: 1950058 - RNA, 14 nt, Homo sapiens
ggcuugaagccaaa

SEQ ID NO: 1950059 - RNA, 19 nt, Homo sapiens
ccucguugggccgcucuga

SEQ ID NO: 1950060 - RNA, 15 nt, Homo sapiens
ucaacagaauucacu

SEQ ID NO: 1950061 - RNA, 22 nt, Homo sapiens
ccaagauguggccuuuagcaaa

SEQ ID NO: 1950062 - RNA, 16 nt, Homo sapiens
uugccuucuaggucac

SEQ ID NO: 1950063 - RNA, 22 nt, Homo sapiens
acagacacacacacaccuugca

SEQ ID NO: 1950064 - RNA, 15 nt, Homo sapiens
uuaaauaaaacuuuc

SEQ ID NO: 1950065 - RNA, 22 nt, Homo sapiens
ugcacagagucaggaucucaca

SEQ ID NO: 1950066 - RNA, 14 nt, Homo sapiens
uggauuauucauuu

SEQ ID NO: 1950067 - RNA, 20 nt, Homo sapiens
gugcucucaacaggacuuaa

SEQ ID NO: 1950068 - RNA, 19 nt, Homo sapiens
agcaaucaagguuauaauu

SEQ ID NO: 1950069 - RNA, 17 nt, Homo sapiens
uucuuguuuaccaaaga

SEQ ID NO: 1950070 - RNA, 16 nt, Homo sapiens
gucaugcuuuugcuau

SEQ ID NO: 1950071 - RNA, 16 nt, Homo sapiens
ugagccccuaccccac

SEQ ID NO: 1950072 - RNA, 22 nt, Homo sapiens
caugaggaggucccacuugcaa

SEQ ID NO: 1950073 - RNA, 19 nt, Homo sapiens
gagcuggcccagggggccu

SEQ ID NO: 1950074 - RNA, 15 nt, Homo sapiens
auacuggagaccagc

SEQ ID NO: 1950075 - RNA, 15 nt, Homo sapiens
ugucagccuugcuac

SEQ ID NO: 1950076 - RNA, 14 nt, Homo sapiens
gagacgccauguga

SEQ ID NO: 1950077 - RNA, 18 nt, Homo sapiens
ggccuguggcuaauggag

SEQ ID NO: 1950078 - RNA, 21 nt, Homo sapiens
uggauggaguuaaacuugaug

SEQ ID NO: 1950079 - RNA, 13 nt, Homo sapiens
cugaagcaaagaa

SEQ ID NO: 1950080 - RNA, 17 nt, Homo sapiens
caagucucacauauuca

SEQ ID NO: 1950081 - RNA, 19 nt, Homo sapiens
acccaggcuggagugcaau

SEQ ID NO: 1950082 - RNA, 22 nt, Homo sapiens
aaccaauaauggucaguccuca

SEQ ID NO: 1950083 - RNA, 18 nt, Homo sapiens
uuccacacacgcuaugga

SEQ ID NO: 1950084 - RNA, 16 nt, Homo sapiens
uagaagaauaagucau

SEQ ID NO: 1950085 - RNA, 18 nt, Homo sapiens
auuuuaccuagcauuuca

SEQ ID NO: 1950086 - RNA, 16 nt, Homo sapiens
gacuuuaaaccaccua

SEQ ID NO: 1950087 - RNA, 22 nt, Homo sapiens
aauuauaucugaggaauucugu

SEQ ID NO: 1950088 - RNA, 16 nt, Homo sapiens
aagaccaucucucccu

SEQ ID NO: 1950089 - RNA, 16 nt, Homo sapiens
cacacaaaaugucaca

SEQ ID NO: 1950090 - RNA, 17 nt, Homo sapiens
uugucuuugauuaugac

SEQ ID NO: 1950091 - RNA, 17 nt, Homo sapiens
augggaacaaggcaaug

SEQ ID NO: 1950092 - RNA, 14 nt, Homo sapiens
acugcauacaaucu

SEQ ID NO: 1950093 - RNA, 19 nt, Homo sapiens
ggcucugcuucuccaagga

SEQ ID NO: 1950094 - RNA, 13 nt, Homo sapiens
acaugauaguuaa

SEQ ID NO: 1950095 - RNA, 23 nt, Homo sapiens
gauuuuuuuuuuaaaacuaucca

SEQ ID NO: 1950096 - RNA, 17 nt, Homo sapiens
ucccugucacacacugg

SEQ ID NO: 1950097 - RNA, 21 nt, Homo sapiens
agaaugguugaguuacauuaa

SEQ ID NO: 1950098 - RNA, 14 nt, Homo sapiens
ucaguaagaucaag

SEQ ID NO: 1950099 - RNA, 19 nt, Homo sapiens
agacagccacccugagaac

SEQ ID NO: 1950100 - RNA, 16 nt, Homo sapiens
gagccaggaaagaaga

SEQ ID NO: 1950101 - RNA, 13 nt, Homo sapiens
caaguccaucaag

SEQ ID NO: 1950102 - RNA, 15 nt, Homo sapiens
accagccugggcaac

SEQ ID NO: 1950103 - RNA, 23 nt, Homo sapiens
auuuaaguuuuaagggcauuuaa

SEQ ID NO: 1950104 - RNA, 14 nt, Homo sapiens
uuuuaacauagcag

SEQ ID NO: 1950105 - RNA, 14 nt, Homo sapiens
gaguuacaguucug

SEQ ID NO: 1950106 - RNA, 14 nt, Homo sapiens
uaguagcauuucaa

SEQ ID NO: 1950107 - RNA, 15 nt, Homo sapiens
guguuuacauuuacu

SEQ ID NO: 1950108 - RNA, 21 nt, Homo sapiens
cuucugucucuaugagagaua

SEQ ID NO: 1950109 - RNA, 15 nt, Homo sapiens
acccgaggcugagaa

SEQ ID NO: 1950110 - RNA, 17 nt, Homo sapiens
aaugcaagagaacauuu

SEQ ID NO: 1950111 - RNA, 15 nt, Homo sapiens
cuuucauuuacugau

SEQ ID NO: 1950112 - RNA, 13 nt, Homo sapiens
agaaaacacacuc

SEQ ID NO: 1950113 - RNA, 15 nt, Homo sapiens
agucagcacagagag

SEQ ID NO: 1950114 - RNA, 13 nt, Homo sapiens
auuuuacugcuua

SEQ ID NO: 1950115 - RNA, 19 nt, Homo sapiens
caauuuauccaacccauuu

SEQ ID NO: 1950116 - RNA, 14 nt, Homo sapiens
uucuauaguucuag

SEQ ID NO: 1950117 - RNA, 15 nt, Homo sapiens
aucagaaauacaaaa

SEQ ID NO: 1950118 - RNA, 22 nt, Homo sapiens
gcauacuucuaaauuauaccau

SEQ ID NO: 1950119 - RNA, 22 nt, Homo sapiens
gcccggugaggccaagguuucc

SEQ ID NO: 1950120 - RNA, 12 nt, Homo sapiens
aaauacuugaaa

SEQ ID NO: 1950121 - RNA, 12 nt, Homo sapiens
agcuacuuggca

SEQ ID NO: 1950122 - RNA, 12 nt, Homo sapiens
aaguacuugaga

SEQ ID NO: 1950123 - RNA, 18 nt, Homo sapiens
caaccacaggaagcugca

SEQ ID NO: 1950124 - RNA, 17 nt, Homo sapiens
uuccaugucaggccagc

SEQ ID NO: 1950125 - RNA, 23 nt, Homo sapiens
gagcagacaccagcagcccuguc

SEQ ID NO: 1950126 - RNA, 17 nt, Homo sapiens
cacacuuuauaacccaa

SEQ ID NO: 1950127 - RNA, 20 nt, Homo sapiens
ggagcccccaccacaaacuu

SEQ ID NO: 1950128 - RNA, 16 nt, Homo sapiens
ugacaguccucuccac

SEQ ID NO: 1950129 - RNA, 20 nt, Homo sapiens
acucaaaugaauuugcuaaa

SEQ ID NO: 1950130 - RNA, 19 nt, Homo sapiens
uauuuuaagagaaaacugc

SEQ ID NO: 1950131 - RNA, 23 nt, Homo sapiens
ugacuagccaucucaagcaaguu

SEQ ID NO: 1950132 - RNA, 16 nt, Homo sapiens
accaagauuggccuga

SEQ ID NO: 1950133 - RNA, 14 nt, Homo sapiens
ggugcucucucuga

SEQ ID NO: 1950134 - RNA, 22 nt, Homo sapiens
cuuuaauuguuaagauaugaug

SEQ ID NO: 1950135 - RNA, 21 nt, Homo sapiens
caacaauuuaggaaugcucaa

SEQ ID NO: 1950136 - RNA, 14 nt, Homo sapiens
aauauuauacuucu

SEQ ID NO: 1950137 - RNA, 21 nt, Homo sapiens
uaagcuaucagcaauacucau

SEQ ID NO: 1950138 - RNA, 13 nt, Homo sapiens
cugggguccucac

SEQ ID NO: 1950139 - RNA, 13 nt, Homo sapiens
ucuugacauguaa

SEQ ID NO: 1950140 - RNA, 18 nt, Homo sapiens
uaccagucuauuuccacu

SEQ ID NO: 1950141 - RNA, 20 nt, Homo sapiens
aaagaaguacuguacuuucc

SEQ ID NO: 1950142 - RNA, 14 nt, Homo sapiens
ccaccuagucugua

SEQ ID NO: 1950143 - RNA, 17 nt, Homo sapiens
ucucaaagaaagcauuu

SEQ ID NO: 1950144 - RNA, 16 nt, Homo sapiens
gcuauggaaccagcag

SEQ ID NO: 1950145 - RNA, 16 nt, Homo sapiens
ccuguaagcccagcau

SEQ ID NO: 1950146 - RNA, 16 nt, Homo sapiens
gaggacaguggcagac

SEQ ID NO: 1950147 - RNA, 21 nt, Homo sapiens
uucuucugaagaucagaacau

SEQ ID NO: 1950148 - RNA, 21 nt, Homo sapiens
gggagccugaggagcccagcg

SEQ ID NO: 1950149 - RNA, 15 nt, Homo sapiens
gccugccaggcuccu

SEQ ID NO: 1950150 - RNA, 13 nt, Homo sapiens
agaaaccaagcca

SEQ ID NO: 1950151 - RNA, 21 nt, Homo sapiens
aaacugagguauggccaugcc

SEQ ID NO: 1950152 - RNA, 16 nt, Homo sapiens
cuagcuaauguaauaa

SEQ ID NO: 1950153 - RNA, 18 nt, Homo sapiens
cuuccuaaaccauuuugc

SEQ ID NO: 1950154 - RNA, 19 nt, Homo sapiens
ggucuccguggcacuugua

SEQ ID NO: 1950155 - RNA, 17 nt, Homo sapiens
cagagcaaaagacuuga

SEQ ID NO: 1950156 - RNA, 18 nt, Homo sapiens
ucuugcucugucgccaag

SEQ ID NO: 1950157 - RNA, 15 nt, Homo sapiens
uuucaugcuccuuac

SEQ ID NO: 1950158 - RNA, 24 nt, Homo sapiens
cagauucagcauuuguucuuugcc

SEQ ID NO: 1950159 - RNA, 15 nt, Homo sapiens
aagacuucacugcag

SEQ ID NO: 1950160 - RNA, 19 nt, Homo sapiens
aguugccuaaauccauuug

SEQ ID NO: 1950161 - RNA, 16 nt, Homo sapiens
gcuuuaucccacggaa

SEQ ID NO: 1950162 - RNA, 17 nt, Homo sapiens
aagagggcucacaagac

SEQ ID NO: 1950163 - RNA, 21 nt, Homo sapiens
accauuuugaaauauucacaa

SEQ ID NO: 1950164 - RNA, 13 nt, Homo sapiens
aacacugcugcuc

SEQ ID NO: 1950165 - RNA, 19 nt, Homo sapiens
cugaaacgagaagugcccu

SEQ ID NO: 1950166 - RNA, 13 nt, Homo sapiens
gcggaaccauagc

SEQ ID NO: 1950167 - RNA, 14 nt, Homo sapiens
uucuucuucuccua

SEQ ID NO: 1950168 - RNA, 20 nt, Homo sapiens
uggccaagcaauuccucuga

SEQ ID NO: 1950169 - RNA, 17 nt, Homo sapiens
augaucaagauauaugu

SEQ ID NO: 1950170 - RNA, 20 nt, Homo sapiens
ugcaauccagccugggcaac

SEQ ID NO: 1950171 - RNA, 12 nt, Homo sapiens
ucuugguguugu

SEQ ID NO: 1950172 - RNA, 13 nt, Homo sapiens
ucucccaaggcca

SEQ ID NO: 1950173 - RNA, 22 nt, Homo sapiens
acacugcugcuccagugcagga

SEQ ID NO: 1950174 - RNA, 18 nt, Homo sapiens
aauccacaucuuuacuca

SEQ ID NO: 1950175 - RNA, 19 nt, Homo sapiens
ccaccauuguucauuugug

SEQ ID NO: 1950176 - RNA, 16 nt, Homo sapiens
aagggaguaaguagag

SEQ ID NO: 1950177 - RNA, 19 nt, Homo sapiens
aucugauuucgucaccuga

SEQ ID NO: 1950178 - RNA, 19 nt, Homo sapiens
caccaugagggaagaauaa

SEQ ID NO: 1950179 - RNA, 18 nt, Homo sapiens
ucaaaaaaaaaagcaaca

SEQ ID NO: 1950180 - RNA, 12 nt, Homo sapiens
gguguguguuac

SEQ ID NO: 1950181 - RNA, 22 nt, Homo sapiens
cuuuuuguugauuccaaaccaa

SEQ ID NO: 1950182 - RNA, 16 nt, Homo sapiens
guacacugguauuuau

SEQ ID NO: 1950183 - RNA, 15 nt, Homo sapiens
ccucuuccagaguca

SEQ ID NO: 1950184 - RNA, 17 nt, Homo sapiens
ccuaagcuggagugcag

SEQ ID NO: 1950185 - RNA, 17 nt, Homo sapiens
ggacaagcagcuggugc

SEQ ID NO: 1950186 - RNA, 18 nt, Homo sapiens
ggcaucucucugggaugc

SEQ ID NO: 1950187 - RNA, 18 nt, Homo sapiens
aaguacuuuucuguucau

SEQ ID NO: 1950188 - RNA, 20 nt, Homo sapiens
cucaguaucaguauuuacau

SEQ ID NO: 1950189 - RNA, 20 nt, Homo sapiens
acauggaauuaccuuagauu

SEQ ID NO: 1950190 - RNA, 13 nt, Homo sapiens
aaacuaaaacaga

SEQ ID NO: 1950191 - RNA, 13 nt, Homo sapiens
ugacauuccauga

SEQ ID NO: 1950192 - RNA, 20 nt, Homo sapiens
uccucauugccuccuguucu

SEQ ID NO: 1950193 - RNA, 22 nt, Homo sapiens
cagcaggugucuuuaacuguca

SEQ ID NO: 1950194 - RNA, 20 nt, Homo sapiens
ccagcuuggcucaggcugag

SEQ ID NO: 1950195 - RNA, 15 nt, Homo sapiens
uuucauaugcuucaa

SEQ ID NO: 1950196 - RNA, 21 nt, Homo sapiens
uauauuggucauugccuugcc

SEQ ID NO: 1950197 - RNA, 12 nt, Homo sapiens
caucuaccuucc

SEQ ID NO: 1950198 - RNA, 20 nt, Homo sapiens
caugacuuauuaugcauaaa

SEQ ID NO: 1950199 - RNA, 18 nt, Homo sapiens
uaagucucuagccucuuu

SEQ ID NO: 1950200 - RNA, 10 nt, Homo sapiens
cuagugucuu

SEQ ID NO: 1950201 - RNA, 17 nt, Homo sapiens
aauaaacgaaacacaga

SEQ ID NO: 1950202 - RNA, 20 nt, Homo sapiens
agggauauuuugaguucugu

SEQ ID NO: 1950203 - RNA, 22 nt, Homo sapiens
acaugccuguuaauauucaugu

SEQ ID NO: 1950204 - RNA, 14 nt, Homo sapiens
uucagcccucagaa

SEQ ID NO: 1950205 - RNA, 12 nt, Homo sapiens
uaccuauuuuca

SEQ ID NO: 1950206 - RNA, 12 nt, Homo sapiens
cuaauauucaac

SEQ ID NO: 1950207 - RNA, 13 nt, Homo sapiens
cguggaugaagca

SEQ ID NO: 1950208 - RNA, 17 nt, Homo sapiens
agcaaaugccugccaaa

SEQ ID NO: 1950209 - RNA, 12 nt, Homo sapiens
acaaaauuacuu

SEQ ID NO: 1950210 - RNA, 16 nt, Homo sapiens
gaaguccaguguuucc

SEQ ID NO: 1950211 - RNA, 20 nt, Homo sapiens
cagauuccauuaagagugaa

SEQ ID NO: 1950212 - RNA, 17 nt, Homo sapiens
gagcccacgacacugca

SEQ ID NO: 1950213 - RNA, 17 nt, Homo sapiens
ccagccacuggcugcua

SEQ ID NO: 1950214 - RNA, 18 nt, Homo sapiens
caaauacaugcacaguca

SEQ ID NO: 1950215 - RNA, 12 nt, Homo sapiens
cucuugaacccc

SEQ ID NO: 1950216 - RNA, 15 nt, Homo sapiens
cucccagcccuaugg

SEQ ID NO: 1950217 - RNA, 19 nt, Homo sapiens
aaucuacagaacuacauau

SEQ ID NO: 1950218 - RNA, 15 nt, Homo sapiens
cucuucccaccucag

SEQ ID NO: 1950219 - RNA, 15 nt, Homo sapiens
caagagugcugagaa

SEQ ID NO: 1950220 - RNA, 13 nt, Homo sapiens
uuugcacagugau

SEQ ID NO: 1950221 - RNA, 12 nt, Homo sapiens
uaaaacaugugu

SEQ ID NO: 1950222 - RNA, 17 nt, Homo sapiens
ccuguaaaaugggguga

SEQ ID NO: 1950223 - RNA, 14 nt, Homo sapiens
cauuguaaucacug

SEQ ID NO: 1950224 - RNA, 21 nt, Homo sapiens
cucuugauaggacuuccuuaa

SEQ ID NO: 1950225 - RNA, 14 nt, Homo sapiens
uuuuguuacauaga

SEQ ID NO: 1950226 - RNA, 13 nt, Homo sapiens
uauuaaagcaaaa

SEQ ID NO: 1950227 - RNA, 23 nt, Homo sapiens
aaauauuuaugagaaaguucuca

SEQ ID NO: 1950228 - RNA, 18 nt, Homo sapiens
ugcccagggccacucugc

SEQ ID NO: 1950229 - RNA, 16 nt, Homo sapiens
aaaaauagcaaugccu

SEQ ID NO: 1950230 - RNA, 20 nt, Homo sapiens
uagcugucauggugcaauuu

SEQ ID NO: 1950231 - RNA, 19 nt, Homo sapiens
gccccucugaccugcacug

SEQ ID NO: 1950232 - RNA, 22 nt, Homo sapiens
accuuuuccccaaccacagaga

SEQ ID NO: 1950233 - RNA, 19 nt, Homo sapiens
aacucacaacucucugguu

SEQ ID NO: 1950234 - RNA, 20 nt, Homo sapiens
gauuuugaaauuuuuauuaa

SEQ ID NO: 1950235 - RNA, 17 nt, Homo sapiens
gcugaccuggagaugcu

SEQ ID NO: 1950236 - RNA, 17 nt, Homo sapiens
auccagcaguacaauaa

SEQ ID NO: 1950237 - RNA, 15 nt, Homo sapiens
gaaaggcauugcaca

SEQ ID NO: 1950238 - RNA, 21 nt, Homo sapiens
uagacuuuuaacuucaccuua

SEQ ID NO: 1950239 - RNA, 17 nt, Homo sapiens
uagugccccgcacugug

SEQ ID NO: 1950240 - RNA, 16 nt, Homo sapiens
cuugguaaaauaauca

SEQ ID NO: 1950241 - RNA, 19 nt, Homo sapiens
ucuguucauuuccucaaaa

SEQ ID NO: 1950242 - RNA, 15 nt, Homo sapiens
gcaagagaauuacuu

SEQ ID NO: 1950243 - RNA, 13 nt, Homo sapiens
uguugacuugcau

SEQ ID NO: 1950244 - RNA, 17 nt, Homo sapiens
aagggcaggagcucaca

SEQ ID NO: 1950245 - RNA, 17 nt, Homo sapiens
uguggauacagucauua

SEQ ID NO: 1950246 - RNA, 13 nt, Homo sapiens
ugaguuacccugg

SEQ ID NO: 1950247 - RNA, 14 nt, Homo sapiens
ugcuuggauucucu

SEQ ID NO: 1950248 - RNA, 20 nt, Homo sapiens
auaaagcaauuuuccuugaa

SEQ ID NO: 1950249 - RNA, 15 nt, Homo sapiens
gccaaccacaauuca

SEQ ID NO: 1950250 - RNA, 21 nt, Homo sapiens
ugaauaaagccugcuuuuuaa

SEQ ID NO: 1950251 - RNA, 18 nt, Homo sapiens
ucuagugaaacugcauua

SEQ ID NO: 1950252 - RNA, 18 nt, Homo sapiens
caauuauauuuauauuuc

SEQ ID NO: 1950253 - RNA, 21 nt, Homo sapiens
ugcccagcaaucaaaggcaau

SEQ ID NO: 1950254 - RNA, 13 nt, Homo sapiens
aacaaaaaccaaa

SEQ ID NO: 1950255 - RNA, 18 nt, Homo sapiens
cugcuccccuacuucuca

SEQ ID NO: 1950256 - RNA, 14 nt, Homo sapiens
auaggguuagcuca

SEQ ID NO: 1950257 - RNA, 14 nt, Homo sapiens
ccaguccuguccua

SEQ ID NO: 1950258 - RNA, 22 nt, Homo sapiens
uacguauuuuuucuaaugugca

SEQ ID NO: 1950259 - RNA, 15 nt, Homo sapiens
ucugcaaugagccau

SEQ ID NO: 1950260 - RNA, 17 nt, Homo sapiens
ccuuucuaaauugcaug

SEQ ID NO: 1950261 - RNA, 22 nt, Homo sapiens
agcgugcuggcgacacucaggg

SEQ ID NO: 1950262 - RNA, 15 nt, Homo sapiens
gaccccaccagccuc

SEQ ID NO: 1950263 - RNA, 24 nt, Homo sapiens
gacucaggagucugccacuuguca

SEQ ID NO: 1950264 - RNA, 14 nt, Homo sapiens
agcugcuguccagg

SEQ ID NO: 1950265 - RNA, 13 nt, Homo sapiens
cugcccuuccucu

SEQ ID NO: 1950266 - RNA, 14 nt, Homo sapiens
ucugcucucaagga

SEQ ID NO: 1950267 - RNA, 17 nt, Homo sapiens
uucauuagggaaaugca

SEQ ID NO: 1950268 - RNA, 20 nt, Homo sapiens
uccaucauaaccaccccagc

SEQ ID NO: 1950269 - RNA, 22 nt, Homo sapiens
augaaacauuguagguauauau

SEQ ID NO: 1950270 - RNA, 15 nt, Homo sapiens
ugacauaccuaccag

SEQ ID NO: 1950271 - RNA, 14 nt, Homo sapiens
accuuggaccucag

SEQ ID NO: 1950272 - RNA, 17 nt, Homo sapiens
uaaaagaacaacacuaa

SEQ ID NO: 1950273 - RNA, 19 nt, Homo sapiens
accagcaucccuugaccag

SEQ ID NO: 1950274 - RNA, 18 nt, Homo sapiens
uguccaccugugcugcug

SEQ ID NO: 1950275 - RNA, 19 nt, Homo sapiens
cagauccucacaaccaccu

SEQ ID NO: 1950276 - RNA, 16 nt, Homo sapiens
uuuaaagugcucuuau

SEQ ID NO: 1950277 - RNA, 18 nt, Homo sapiens
cucaacugggugacaagg

SEQ ID NO: 1950278 - RNA, 16 nt, Homo sapiens
agaaaguaagcauuuc

SEQ ID NO: 1950279 - RNA, 15 nt, Homo sapiens
gaaguuaaagggaag

SEQ ID NO: 1950280 - RNA, 21 nt, Homo sapiens
cuauuuuaauaaagauucuau

SEQ ID NO: 1950281 - RNA, 24 nt, Homo sapiens
uucagaaguaauuugaauagccug

SEQ ID NO: 1950282 - RNA, 21 nt, Homo sapiens
uugcaagauuccaaguucuca

SEQ ID NO: 1950283 - RNA, 16 nt, Homo sapiens
augaaacauguucuca

SEQ ID NO: 1950284 - RNA, 19 nt, Homo sapiens
uuggcuuguguguuucacu

SEQ ID NO: 1950285 - RNA, 15 nt, Homo sapiens
acaaacccuuuucau

SEQ ID NO: 1950286 - RNA, 19 nt, Homo sapiens
acauguaugugcauuucaa

SEQ ID NO: 1950287 - RNA, 18 nt, Homo sapiens
uuggaaagcaagguuucc

SEQ ID NO: 1950288 - RNA, 21 nt, Homo sapiens
uuuauuccccagugacuccag

SEQ ID NO: 1950289 - RNA, 18 nt, Homo sapiens
ugggaugcagugauguga

SEQ ID NO: 1950290 - RNA, 15 nt, Homo sapiens
cccauuuguguuuca

SEQ ID NO: 1950291 - RNA, 16 nt, Homo sapiens
cugcuccuugugguua

SEQ ID NO: 1950292 - RNA, 21 nt, Homo sapiens
cagguacugauccuguuucuu

SEQ ID NO: 1950293 - RNA, 19 nt, Homo sapiens
gugaaggacuuguuuugac

SEQ ID NO: 1950294 - RNA, 17 nt, Homo sapiens
agauuuucaugcaaaag

SEQ ID NO: 1950295 - RNA, 17 nt, Homo sapiens
agaugguuaagucaauu

SEQ ID NO: 1950296 - RNA, 18 nt, Homo sapiens
uccgacaccucuguuucc

SEQ ID NO: 1950297 - RNA, 22 nt, Homo sapiens
uaugagugcaagcaaagcagaa

SEQ ID NO: 1950298 - RNA, 14 nt, Homo sapiens
auauuugagucacu

SEQ ID NO: 1950299 - RNA, 15 nt, Homo sapiens
gcauuaauauucuuu

SEQ ID NO: 1950300 - RNA, 18 nt, Homo sapiens
agaaagccaggguccuga

SEQ ID NO: 1950301 - RNA, 21 nt, Homo sapiens
gcgguagccagcacacagggc

SEQ ID NO: 1950302 - RNA, 23 nt, Homo sapiens
auuccuguccuucacauuuacua

SEQ ID NO: 1950303 - RNA, 13 nt, Homo sapiens
ugcauacuuagau

SEQ ID NO: 1950304 - RNA, 19 nt, Homo sapiens
ugucacugaugaacuagug

SEQ ID NO: 1950305 - RNA, 14 nt, Homo sapiens
aggugggguuucac

SEQ ID NO: 1950306 - RNA, 16 nt, Homo sapiens
acucccgccucagggc

SEQ ID NO: 1950307 - RNA, 23 nt, Homo sapiens
accauuuuacauuucuauuucau

SEQ ID NO: 1950308 - RNA, 21 nt, Homo sapiens
ccuugaauauuuauucaguga

SEQ ID NO: 1950309 - RNA, 22 nt, Homo sapiens
guaggaaagcaccgcagcaugu

SEQ ID NO: 1950310 - RNA, 23 nt, Homo sapiens
auuugcacccaccuuucugcaca

SEQ ID NO: 1950311 - RNA, 15 nt, Homo sapiens
agagaggcuggauga

SEQ ID NO: 1950312 - RNA, 17 nt, Homo sapiens
gcuguuugauagcagaa

SEQ ID NO: 1950313 - RNA, 20 nt, Homo sapiens
ccuggcaaggcauuccucau

SEQ ID NO: 1950314 - RNA, 16 nt, Homo sapiens
ugaagaggagauuggc

SEQ ID NO: 1950315 - RNA, 16 nt, Homo sapiens
uaacuuagguggcaag

SEQ ID NO: 1950316 - RNA, 17 nt, Homo sapiens
acaacucagucccuaaa

SEQ ID NO: 1950317 - RNA, 23 nt, Homo sapiens
cccacaucccacuggaucuggcu

SEQ ID NO: 1950318 - RNA, 16 nt, Homo sapiens
cuguauuaagccacuu

SEQ ID NO: 1950319 - RNA, 14 nt, Homo sapiens
gagaaucacuggaa

SEQ ID NO: 1950320 - RNA, 19 nt, Homo sapiens
cucugaauuugagauacaa

SEQ ID NO: 1950321 - RNA, 15 nt, Homo sapiens
cgcugcaaagccaua

SEQ ID NO: 1950322 - RNA, 16 nt, Homo sapiens
gugguguuucuguaag

SEQ ID NO: 1950323 - RNA, 14 nt, Homo sapiens
gcauuuagaucuac

SEQ ID NO: 1950324 - RNA, 22 nt, Homo sapiens
accuguuuccuggaccagugac

SEQ ID NO: 1950325 - RNA, 16 nt, Homo sapiens
cucccagggagcauga

SEQ ID NO: 1950326 - RNA, 15 nt, Homo sapiens
aucuugauaccaccu

SEQ ID NO: 1950327 - RNA, 14 nt, Homo sapiens
aauuaaagcagcaa

SEQ ID NO: 1950328 - RNA, 21 nt, Homo sapiens
uaaaagcaccauugugaagca

SEQ ID NO: 1950329 - RNA, 22 nt, Homo sapiens
gaaaacuauaagccaauauucc

SEQ ID NO: 1950330 - RNA, 22 nt, Homo sapiens
cuaacaaguagcacccuggauu

SEQ ID NO: 1950331 - RNA, 11 nt, Homo sapiens
acgaugcauuu

SEQ ID NO: 1950332 - RNA, 20 nt, Homo sapiens
cuggacauuuuuucagucau

SEQ ID NO: 1950333 - RNA, 23 nt, Homo sapiens
cagauuuguaacauuaguuuuaa

SEQ ID NO: 1950334 - RNA, 21 nt, Homo sapiens
cgggagaccccuuguugcacu

SEQ ID NO: 1950335 - RNA, 12 nt, Homo sapiens
acagacucucac

SEQ ID NO: 1950336 - RNA, 17 nt, Homo sapiens
caggaugcagccuuugc

SEQ ID NO: 1950337 - RNA, 21 nt, Homo sapiens
gccucugguguuugcaaagga

SEQ ID NO: 1950338 - RNA, 13 nt, Homo sapiens
aaaaaaguucaau

SEQ ID NO: 1950339 - RNA, 14 nt, Homo sapiens
agaucgaagccaaa

SEQ ID NO: 1950340 - RNA, 13 nt, Homo sapiens
gagacgaugcuuu

SEQ ID NO: 1950341 - RNA, 21 nt, Homo sapiens
augcccuccaauccuuuccac

SEQ ID NO: 1950342 - RNA, 15 nt, Homo sapiens
auucuccugucucag

SEQ ID NO: 1950343 - RNA, 15 nt, Homo sapiens
gccgcugcaggaaac

SEQ ID NO: 1950344 - RNA, 18 nt, Homo sapiens
cugaguaauuaauaaaga

SEQ ID NO: 1950345 - RNA, 23 nt, Homo sapiens
aaaucaaucuguaaaacuaagaa

SEQ ID NO: 1950346 - RNA, 13 nt, Homo sapiens
gcucuauuuacuu

SEQ ID NO: 1950347 - RNA, 16 nt, Homo sapiens
gaaucacagcccucau

SEQ ID NO: 1950348 - RNA, 13 nt, Homo sapiens
guuagaaaugcaa

SEQ ID NO: 1950349 - RNA, 15 nt, Homo sapiens
cuuccucucugcaau

SEQ ID NO: 1950350 - RNA, 22 nt, Homo sapiens
gcccaagcuucccuccaucccc

SEQ ID NO: 1950351 - RNA, 14 nt, Homo sapiens
cuuccccugggcaa

SEQ ID NO: 1950352 - RNA, 19 nt, Homo sapiens
aaacuuagaucaucaguca

SEQ ID NO: 1950353 - RNA, 16 nt, Homo sapiens
cuccgucucaaaagaa

SEQ ID NO: 1950354 - RNA, 18 nt, Homo sapiens
caccuuuugcacauaaca

SEQ ID NO: 1950355 - RNA, 21 nt, Homo sapiens
cugucccggguacucagucag

SEQ ID NO: 1950356 - RNA, 14 nt, Homo sapiens
gagacauacuugaa

SEQ ID NO: 1950357 - RNA, 13 nt, Homo sapiens
ggccuaacauguu

SEQ ID NO: 1950358 - RNA, 18 nt, Homo sapiens
aaauggagauaaaagcaa

SEQ ID NO: 1950359 - RNA, 16 nt, Homo sapiens
cuggaggccagagggg

SEQ ID NO: 1950360 - RNA, 18 nt, Homo sapiens
agucccuuccccaugcuu

SEQ ID NO: 1950361 - RNA, 19 nt, Homo sapiens
uaacacaaguccugugaau

SEQ ID NO: 1950362 - RNA, 19 nt, Homo sapiens
uucauguaauaaacagguu

SEQ ID NO: 1950363 - RNA, 18 nt, Homo sapiens
uggagugcaacggcauga

SEQ ID NO: 1950364 - RNA, 17 nt, Homo sapiens
cagcucugggagaggau

SEQ ID NO: 1950365 - RNA, 12 nt, Homo sapiens
gaggagguugug

SEQ ID NO: 1950366 - RNA, 16 nt, Homo sapiens
agaggaagcacacugc

SEQ ID NO: 1950367 - RNA, 15 nt, Homo sapiens
auuuuuguguaggug

SEQ ID NO: 1950368 - RNA, 16 nt, Homo sapiens
cauauuuauauguaug

SEQ ID NO: 1950369 - RNA, 19 nt, Homo sapiens
uauaugcuuuuuugcaaua

SEQ ID NO: 1950370 - RNA, 18 nt, Homo sapiens
uaaauuccagaggacucu

SEQ ID NO: 1950371 - RNA, 20 nt, Homo sapiens
cagcacauccgacaccuccc

SEQ ID NO: 1950372 - RNA, 22 nt, Homo sapiens
caaguuuucauaagcacacuuc

SEQ ID NO: 1950373 - RNA, 14 nt, Homo sapiens
gagaccccaggaac

SEQ ID NO: 1950374 - RNA, 16 nt, Homo sapiens
auuaagggaguaggaa

SEQ ID NO: 1950375 - RNA, 19 nt, Homo sapiens
cauuugugugugugcaagu

SEQ ID NO: 1950376 - RNA, 22 nt, Homo sapiens
uguauggaaucccacuguauga

SEQ ID NO: 1950377 - RNA, 18 nt, Homo sapiens
ucagccaacaugugacua

SEQ ID NO: 1950378 - RNA, 22 nt, Homo sapiens
cccggggcuggcggcuacucag

SEQ ID NO: 1950379 - RNA, 17 nt, Homo sapiens
caauaaacgaaacacag

SEQ ID NO: 1950380 - RNA, 19 nt, Homo sapiens
cagaauaaagaacauucua

SEQ ID NO: 1950381 - RNA, 21 nt, Homo sapiens
guauuuggaaauaaagucaga

SEQ ID NO: 1950382 - RNA, 17 nt, Homo sapiens
ggaaagaaaaagcaaua

SEQ ID NO: 1950383 - RNA, 16 nt, Homo sapiens
ucguauaccuuauuaa

SEQ ID NO: 1950384 - RNA, 19 nt, Homo sapiens
uucucauaacucugugauc

SEQ ID NO: 1950385 - RNA, 14 nt, Homo sapiens
uccagaucuugccu

SEQ ID NO: 1950386 - RNA, 15 nt, Homo sapiens
gccuccaguccaguu

SEQ ID NO: 1950387 - RNA, 20 nt, Homo sapiens
uggcuguuccugcaguagaa

SEQ ID NO: 1950388 - RNA, 23 nt, Homo sapiens
gacauauuucaugggaauauuca

SEQ ID NO: 1950389 - RNA, 14 nt, Homo sapiens
ggggcgagcacugu

SEQ ID NO: 1950390 - RNA, 23 nt, Homo sapiens
agaguguccccagagacaugcaa

SEQ ID NO: 1950391 - RNA, 19 nt, Homo sapiens
ucucugaccuccuccuuca

SEQ ID NO: 1950392 - RNA, 21 nt, Homo sapiens
caauacaugcugcuaauucaa

SEQ ID NO: 1950393 - RNA, 21 nt, Homo sapiens
caaaagagaaggacucuucca

SEQ ID NO: 1950394 - RNA, 23 nt, Homo sapiens
gcugggggagagaaacacugcug

SEQ ID NO: 1950395 - RNA, 14 nt, Homo sapiens
cuucaagugccaaa

SEQ ID NO: 1950396 - RNA, 12 nt, Homo sapiens
cauuuuugccag

SEQ ID NO: 1950397 - RNA, 22 nt, Homo sapiens
cuagucacuaccuucaugcaua

SEQ ID NO: 1950398 - RNA, 22 nt, Homo sapiens
acuuugaauaauggaaucuaua

SEQ ID NO: 1950399 - RNA, 22 nt, Homo sapiens
uugucugucuccagcacccaga

SEQ ID NO: 1950400 - RNA, 20 nt, Homo sapiens
agaaauuaacaaaugugcug

SEQ ID NO: 1950401 - RNA, 13 nt, Homo sapiens
gucuccucaggac

SEQ ID NO: 1950402 - RNA, 20 nt, Homo sapiens
ugaacaggggcugguauuau

SEQ ID NO: 1950403 - RNA, 19 nt, Homo sapiens
gacuuuugaagaacaaaag

SEQ ID NO: 1950404 - RNA, 22 nt, Homo sapiens
ccuucugggacuggacagcuuu

SEQ ID NO: 1950405 - RNA, 23 nt, Homo sapiens
auagaaguauuuguguaccugga

SEQ ID NO: 1950406 - RNA, 17 nt, Homo sapiens
caugguccccauggcau

SEQ ID NO: 1950407 - RNA, 19 nt, Homo sapiens
gucaacuucaacauuuaca

SEQ ID NO: 1950408 - RNA, 13 nt, Homo sapiens
uggguuugcccag

SEQ ID NO: 1950409 - RNA, 16 nt, Homo sapiens
accucucuggguugaa

SEQ ID NO: 1950410 - RNA, 19 nt, Homo sapiens
ugaccccagcauuuccaga

SEQ ID NO: 1950411 - RNA, 18 nt, Homo sapiens
acucaaggccuccagcca

SEQ ID NO: 1950412 - RNA, 13 nt, Homo sapiens
cagcaagugucau

SEQ ID NO: 1950413 - RNA, 20 nt, Homo sapiens
auucaacagagacugaauag

SEQ ID NO: 1950414 - RNA, 23 nt, Homo sapiens
cuccuaaucuuaucaauucugau

SEQ ID NO: 1950415 - RNA, 13 nt, Homo sapiens
uucuuuaccucca

SEQ ID NO: 1950416 - RNA, 21 nt, Homo sapiens
agugauaaaucgggaaauuua

SEQ ID NO: 1950417 - RNA, 20 nt, Homo sapiens
cacucaacaauaaagacuga

SEQ ID NO: 1950418 - RNA, 17 nt, Homo sapiens
uuaguuguguacucugg

SEQ ID NO: 1950419 - RNA, 16 nt, Homo sapiens
gcccacagggaccaag

SEQ ID NO: 1950420 - RNA, 17 nt, Homo sapiens
ucaccgacucaccugcg

SEQ ID NO: 1950421 - RNA, 17 nt, Homo sapiens
augcagaagugcaugaa

SEQ ID NO: 1950422 - RNA, 21 nt, Homo sapiens
aggacaaccauuccagacugc

SEQ ID NO: 1950423 - RNA, 15 nt, Homo sapiens
uacgcucaucaccua

SEQ ID NO: 1950424 - RNA, 16 nt, Homo sapiens
ucaacugaaguucuau

SEQ ID NO: 1950425 - RNA, 12 nt, Homo sapiens
ggacuacaggug

SEQ ID NO: 1950426 - RNA, 13 nt, Homo sapiens
accaaguuggucu

SEQ ID NO: 1950427 - RNA, 14 nt, Homo sapiens
ccugucuucucuca

SEQ ID NO: 1950428 - RNA, 21 nt, Homo sapiens
accuuguguggcgcacuucag

SEQ ID NO: 1950429 - RNA, 16 nt, Homo sapiens
guguucgauggcucaa

SEQ ID NO: 1950430 - RNA, 20 nt, Homo sapiens
acucacuguguggccucaga

SEQ ID NO: 1950431 - RNA, 19 nt, Homo sapiens
uggucuccucugauuauca

SEQ ID NO: 1950432 - RNA, 17 nt, Homo sapiens
ggccccuggcacucuug

SEQ ID NO: 1950433 - RNA, 18 nt, Homo sapiens
aaggaacuaauccucacu

SEQ ID NO: 1950434 - RNA, 15 nt, Homo sapiens
gucuauuaucuguag

SEQ ID NO: 1950435 - RNA, 20 nt, Homo sapiens
acagaaggaaggagccagcu

SEQ ID NO: 1950436 - RNA, 22 nt, Homo sapiens
uucaaucacugaaaaugugcuc

SEQ ID NO: 1950437 - RNA, 20 nt, Homo sapiens
acacccagcucagcauuucc

SEQ ID NO: 1950438 - RNA, 21 nt, Homo sapiens
agucuguguuguguccugaca

SEQ ID NO: 1950439 - RNA, 22 nt, Homo sapiens
cugaaaaaaacauauccaaaau

SEQ ID NO: 1950440 - RNA, 15 nt, Homo sapiens
aaauaauucaaacac

SEQ ID NO: 1950441 - RNA, 12 nt, Homo sapiens
cagccauguauu

SEQ ID NO: 1950442 - RNA, 17 nt, Homo sapiens
cugcagcucccauuuca

SEQ ID NO: 1950443 - RNA, 13 nt, Homo sapiens
auucuauuccaug

SEQ ID NO: 1950444 - RNA, 16 nt, Homo sapiens
uuucuuagugugccaa

SEQ ID NO: 1950445 - RNA, 19 nt, Homo sapiens
ggagcgagagagaggugcc

SEQ ID NO: 1950446 - RNA, 18 nt, Homo sapiens
auggcugcuccacugggu

SEQ ID NO: 1950447 - RNA, 16 nt, Homo sapiens
agagcacucauuccuu

SEQ ID NO: 1950448 - RNA, 17 nt, Homo sapiens
acgggcaagaagcugcu

SEQ ID NO: 1950449 - RNA, 13 nt, Homo sapiens
uucccaucucagg

SEQ ID NO: 1950450 - RNA, 16 nt, Homo sapiens
agucucuauaccaaua

SEQ ID NO: 1950451 - RNA, 21 nt, Homo sapiens
ccuauauaugauuguuugcac

SEQ ID NO: 1950452 - RNA, 19 nt, Homo sapiens
ugcuucacaguagagccag

SEQ ID NO: 1950453 - RNA, 15 nt, Homo sapiens
uacaguguacuuugu

SEQ ID NO: 1950454 - RNA, 23 nt, Homo sapiens
aagacacgcccgacucucuccau

SEQ ID NO: 1950455 - RNA, 23 nt, Homo sapiens
auuugucaggacaagggcucaga

SEQ ID NO: 1950456 - RNA, 12 nt, Homo sapiens
ugucccauuucc

SEQ ID NO: 1950457 - RNA, 16 nt, Homo sapiens
ucuaccugacuccuga

SEQ ID NO: 1950458 - RNA, 21 nt, Homo sapiens
uaacuuuaaaacuguauuuaa

SEQ ID NO: 1950459 - RNA, 20 nt, Homo sapiens
caggugccagaauccucuca

SEQ ID NO: 1950460 - RNA, 16 nt, Homo sapiens
gacucaguggacacuc

SEQ ID NO: 1950461 - RNA, 12 nt, Homo sapiens
gcagaucacuug

SEQ ID NO: 1950462 - RNA, 20 nt, Homo sapiens
acugaagagcaggugagcaa

SEQ ID NO: 1950463 - RNA, 14 nt, Homo sapiens
aaaugaaaacaauc

SEQ ID NO: 1950464 - RNA, 19 nt, Homo sapiens
uaaaugccaggccuggcaa

SEQ ID NO: 1950465 - RNA, 20 nt, Homo sapiens
agugaagggcaguacagugg

SEQ ID NO: 1950466 - RNA, 19 nt, Homo sapiens
guuuuggggacucauuuca

SEQ ID NO: 1950467 - RNA, 19 nt, Homo sapiens
aggcucacugcaacuucug

SEQ ID NO: 1950468 - RNA, 19 nt, Homo sapiens
aaugagaacauguugguau

SEQ ID NO: 1950469 - RNA, 20 nt, Homo sapiens
uccacaaacagaucaggaag

SEQ ID NO: 1950470 - RNA, 21 nt, Homo sapiens
acacacuaacaucaauggcuu

SEQ ID NO: 1950471 - RNA, 19 nt, Homo sapiens
agcgcagguuuaguuuacu

SEQ ID NO: 1950472 - RNA, 15 nt, Homo sapiens
aauggcucugugaaa

SEQ ID NO: 1950473 - RNA, 20 nt, Homo sapiens
ccuuuguucccuaaguccaa

SEQ ID NO: 1950474 - RNA, 16 nt, Homo sapiens
auaaugccaccaaagg

SEQ ID NO: 1950475 - RNA, 19 nt, Homo sapiens
aggaguucacuucaucuuc

SEQ ID NO: 1950476 - RNA, 23 nt, Homo sapiens
cugucccagccccggcaagccac

SEQ ID NO: 1950477 - RNA, 17 nt, Homo sapiens
acauuuacaaacugaag

SEQ ID NO: 1950478 - RNA, 11 nt, Homo sapiens
auaggacaaau

SEQ ID NO: 1950479 - RNA, 23 nt, Homo sapiens
ccuggcuuagaaggcacugggaa

SEQ ID NO: 1950480 - RNA, 16 nt, Homo sapiens
cuaggggaacagacca

SEQ ID NO: 1950481 - RNA, 12 nt, Homo sapiens
cacaaaccacaa

SEQ ID NO: 1950482 - RNA, 22 nt, Homo sapiens
gaugggucuccgcacuuggaaa

SEQ ID NO: 1950483 - RNA, 14 nt, Homo sapiens
ugcaaaacacuaaa

SEQ ID NO: 1950484 - RNA, 14 nt, Homo sapiens
ugccccacacuccc

SEQ ID NO: 1950485 - RNA, 17 nt, Homo sapiens
ucuaaauaccauucccu

SEQ ID NO: 1950486 - RNA, 14 nt, Homo sapiens
agugugcaugauug

SEQ ID NO: 1950487 - RNA, 20 nt, Homo sapiens
ucacagaaauguuaaacuga

SEQ ID NO: 1950488 - RNA, 16 nt, Homo sapiens
aaugauaaaauacuaa

SEQ ID NO: 1950489 - RNA, 12 nt, Homo sapiens
cuucccuuccac

SEQ ID NO: 1950490 - RNA, 12 nt, Homo sapiens
cuuuccuuccau

SEQ ID NO: 1950491 - RNA, 15 nt, Homo sapiens
uaucuggacaagcca

SEQ ID NO: 1950492 - RNA, 11 nt, Homo sapiens
auaugcacaaa

SEQ ID NO: 1950493 - RNA, 16 nt, Homo sapiens
cucuaauguacaauaa

SEQ ID NO: 1950494 - RNA, 12 nt, Homo sapiens
uuccacaagaca

SEQ ID NO: 1950495 - RNA, 20 nt, Homo sapiens
uucauguaaaaagugcagua

SEQ ID NO: 1950496 - RNA, 20 nt, Homo sapiens
aaagcccugacggacuucau

SEQ ID NO: 1950497 - RNA, 13 nt, Homo sapiens
aggaggggaacac

SEQ ID NO: 1950498 - RNA, 22 nt, Homo sapiens
gaaaagcuuguccaucacucua

SEQ ID NO: 1950499 - RNA, 19 nt, Homo sapiens
cacagcuuauggcaucuca

SEQ ID NO: 1950500 - RNA, 15 nt, Homo sapiens
uccuuuuccacuuua

SEQ ID NO: 1950501 - RNA, 19 nt, Homo sapiens
uaugaagaaucugcucuga

SEQ ID NO: 1950502 - RNA, 20 nt, Homo sapiens
cucuaugcuuuccaaaccuu

SEQ ID NO: 1950503 - RNA, 23 nt, Homo sapiens
ccagccccuuccuggguauuuau

SEQ ID NO: 1950504 - RNA, 13 nt, Homo sapiens
caagugauacucc

SEQ ID NO: 1950505 - RNA, 13 nt, Homo sapiens
ugcgugacuguau

SEQ ID NO: 1950506 - RNA, 20 nt, Homo sapiens
guuugugucuguugcuugua

SEQ ID NO: 1950507 - RNA, 18 nt, Homo sapiens
cacgcuuuuugaaaaagc

SEQ ID NO: 1950508 - RNA, 18 nt, Homo sapiens
ggugaggcgugggaucca

SEQ ID NO: 1950509 - RNA, 21 nt, Homo sapiens
uuccacaaagaaaauuccuau

SEQ ID NO: 1950510 - RNA, 18 nt, Homo sapiens
aaguuaaauguguguaaa

SEQ ID NO: 1950511 - RNA, 17 nt, Homo sapiens
cuuuaugcaugaagaua

SEQ ID NO: 1950512 - RNA, 23 nt, Homo sapiens
uauaaauuauucaguaacuguca

SEQ ID NO: 1950513 - RNA, 22 nt, Homo sapiens
cagaagcgcccaucugauauga

SEQ ID NO: 1950514 - RNA, 16 nt, Homo sapiens
cuuccucacacugcug

SEQ ID NO: 1950515 - RNA, 19 nt, Homo sapiens
auaauaguacuauuacuau

SEQ ID NO: 1950516 - RNA, 21 nt, Homo sapiens
guggaaauaaaaagaaggaaa

SEQ ID NO: 1950517 - RNA, 23 nt, Homo sapiens
uuccgacuugucccucucucagc

SEQ ID NO: 1950518 - RNA, 17 nt, Homo sapiens
aaagaaaucucuuccau

SEQ ID NO: 1950519 - RNA, 19 nt, Homo sapiens
ucuguaaaaacacugaaaa

SEQ ID NO: 1950520 - RNA, 15 nt, Homo sapiens
gcuuaccaucucuac

SEQ ID NO: 1950521 - RNA, 15 nt, Homo sapiens
uucauauuaccagaa

SEQ ID NO: 1950522 - RNA, 20 nt, Homo sapiens
cuucuacugccuugaaaaau

SEQ ID NO: 1950523 - RNA, 18 nt, Homo sapiens
auuacuuguaauuaugaa

SEQ ID NO: 1950524 - RNA, 23 nt, Homo sapiens
aaauuccuuagcuuagaccucag

SEQ ID NO: 1950525 - RNA, 19 nt, Homo sapiens
cucccaaagugcugggauu

SEQ ID NO: 1950526 - RNA, 22 nt, Homo sapiens
agggucagugccaagucucagg

SEQ ID NO: 1950527 - RNA, 22 nt, Homo sapiens
gaaaacuugacauguagcuucu

SEQ ID NO: 1950528 - RNA, 18 nt, Homo sapiens
ccagaaauugugugugca

SEQ ID NO: 1950529 - RNA, 13 nt, Homo sapiens
gaaacacugccuu

SEQ ID NO: 1950530 - RNA, 16 nt, Homo sapiens
acuuaaguggcauuaa

SEQ ID NO: 1950531 - RNA, 18 nt, Homo sapiens
gccugcuggaucucccag

SEQ ID NO: 1950532 - RNA, 13 nt, Homo sapiens
ugaaaaugugcau

SEQ ID NO: 1950533 - RNA, 13 nt, Homo sapiens
auacaaugauccu

SEQ ID NO: 1950534 - RNA, 21 nt, Homo sapiens
cucuaauuaaaaugugcagua

SEQ ID NO: 1950535 - RNA, 19 nt, Homo sapiens
ccaaaggaauaaccuuucu

SEQ ID NO: 1950536 - RNA, 20 nt, Homo sapiens
ucugugagauaaaugcacau

SEQ ID NO: 1950537 - RNA, 19 nt, Homo sapiens
aagucaucauuacuuggga

SEQ ID NO: 1950538 - RNA, 13 nt, Homo sapiens
uuacuaaauuuuc

SEQ ID NO: 1950539 - RNA, 19 nt, Homo sapiens
gacaauuaucugugucaaa

SEQ ID NO: 1950540 - RNA, 15 nt, Homo sapiens
acuacauauuguaaa

SEQ ID NO: 1950541 - RNA, 17 nt, Homo sapiens
cugagugaagcaaaaac

SEQ ID NO: 1950542 - RNA, 17 nt, Homo sapiens
gagcaacuuucuuacac

SEQ ID NO: 1950543 - RNA, 21 nt, Homo sapiens
cugggaacucccaagaacagc

SEQ ID NO: 1950544 - RNA, 14 nt, Homo sapiens
aggaccaagggcag

SEQ ID NO: 1950545 - RNA, 22 nt, Homo sapiens
aaguacuuuccaaucucaguca

SEQ ID NO: 1950546 - RNA, 18 nt, Homo sapiens
uuguaaggcuuugauuag

SEQ ID NO: 1950547 - RNA, 18 nt, Homo sapiens
uaccuuauugaucuuugc

SEQ ID NO: 1950548 - RNA, 12 nt, Homo sapiens
caucauguugaa

SEQ ID NO: 1950549 - RNA, 17 nt, Homo sapiens
ucuauuuaagauuccca

SEQ ID NO: 1950550 - RNA, 23 nt, Homo sapiens
agaucucaauuuuauaguagugg

SEQ ID NO: 1950551 - RNA, 19 nt, Homo sapiens
uccucccauuucccauuaa

SEQ ID NO: 1950552 - RNA, 23 nt, Homo sapiens
ucagguguauagggaauuuucau

SEQ ID NO: 1950553 - RNA, 22 nt, Homo sapiens
agugcuuuucagugauacucac

SEQ ID NO: 1950554 - RNA, 15 nt, Homo sapiens
uccauccaaacucag

SEQ ID NO: 1950555 - RNA, 15 nt, Homo sapiens
caagccuacaugaca

SEQ ID NO: 1950556 - RNA, 22 nt, Homo sapiens
ucucggaguaucugggaacugu

SEQ ID NO: 1950557 - RNA, 16 nt, Homo sapiens
uuauucugugguucua

SEQ ID NO: 1950558 - RNA, 16 nt, Homo sapiens
agacucaaaugcucag

SEQ ID NO: 1950559 - RNA, 15 nt, Homo sapiens
uaucauuaaccuuau

SEQ ID NO: 1950560 - RNA, 16 nt, Homo sapiens
agccuggugcugcugc

SEQ ID NO: 1950561 - RNA, 22 nt, Homo sapiens
cuggugcuacgaccagggugag

SEQ ID NO: 1950562 - RNA, 18 nt, Homo sapiens
accuggcccugugccuug

SEQ ID NO: 1950563 - RNA, 16 nt, Homo sapiens
ggaugaaacuaaagca

SEQ ID NO: 1950564 - RNA, 18 nt, Homo sapiens
uacauugugaacagaagu

SEQ ID NO: 1950565 - RNA, 13 nt, Homo sapiens
ccaccacucccca

SEQ ID NO: 1950566 - RNA, 13 nt, Homo sapiens
auauaacuaucuc

SEQ ID NO: 1950567 - RNA, 13 nt, Homo sapiens
uucacacuuuaaa

SEQ ID NO: 1950568 - RNA, 20 nt, Homo sapiens
aaacacaagaauuacacuaa

SEQ ID NO: 1950569 - RNA, 17 nt, Homo sapiens
gaagccucagcucccac

SEQ ID NO: 1950570 - RNA, 17 nt, Homo sapiens
gccacauucaccaacca

SEQ ID NO: 1950571 - RNA, 20 nt, Homo sapiens
ggauggggcuucacugcugu

SEQ ID NO: 1950572 - RNA, 14 nt, Homo sapiens
caaaacugcuaaau

SEQ ID NO: 1950573 - RNA, 14 nt, Homo sapiens
cacuagccagacac

SEQ ID NO: 1950574 - RNA, 17 nt, Homo sapiens
ggaaaauaaacaucagu

SEQ ID NO: 1950575 - RNA, 11 nt, Homo sapiens
cuacacauaua

SEQ ID NO: 1950576 - RNA, 23 nt, Homo sapiens
gacuuaauaaagguuuaaagcug

SEQ ID NO: 1950577 - RNA, 15 nt, Homo sapiens
acaguguuuggacag

SEQ ID NO: 1950578 - RNA, 21 nt, Homo sapiens
aaagagcauggaugcauuuca

SEQ ID NO: 1950579 - RNA, 12 nt, Homo sapiens
ugcuuacauuuu

SEQ ID NO: 1950580 - RNA, 17 nt, Homo sapiens
auucaauucugauucca

SEQ ID NO: 1950581 - RNA, 18 nt, Homo sapiens
ucucagggaaagccucug

SEQ ID NO: 1950582 - RNA, 14 nt, Homo sapiens
acaaucagcuccuu

SEQ ID NO: 1950583 - RNA, 23 nt, Homo sapiens
cugcuccaaaggaaauccaaaaa

SEQ ID NO: 1950584 - RNA, 19 nt, Homo sapiens
uagcagaggccaauucaau

SEQ ID NO: 1950585 - RNA, 17 nt, Homo sapiens
aauuuaaucacuuucau

SEQ ID NO: 1950586 - RNA, 16 nt, Homo sapiens
uuaaaauacauaacuu

SEQ ID NO: 1950587 - RNA, 17 nt, Homo sapiens
ugaugccccuuccccaa

SEQ ID NO: 1950588 - RNA, 23 nt, Homo sapiens
ucacucagcacuuucccucugca

SEQ ID NO: 1950589 - RNA, 16 nt, Homo sapiens
uuaccuuuacauauua

SEQ ID NO: 1950590 - RNA, 14 nt, Homo sapiens
uuaaauagaugaca

SEQ ID NO: 1950591 - RNA, 18 nt, Homo sapiens
caguagaaagcauaacaa

SEQ ID NO: 1950592 - RNA, 18 nt, Homo sapiens
uaaguuaggcagucuucu

SEQ ID NO: 1950593 - RNA, 18 nt, Homo sapiens
aaagguuaaaacaaaaac

SEQ ID NO: 1950594 - RNA, 18 nt, Homo sapiens
cuuacacauaaagcacua

SEQ ID NO: 1950595 - RNA, 23 nt, Homo sapiens
uaucugagggaggaggccaccuc

SEQ ID NO: 1950596 - RNA, 19 nt, Homo sapiens
auggggguacucaauggag

SEQ ID NO: 1950597 - RNA, 13 nt, Homo sapiens
ugaaacaauccaa

SEQ ID NO: 1950598 - RNA, 22 nt, Homo sapiens
gcucucuaaaugggaauucuca

SEQ ID NO: 1950599 - RNA, 21 nt, Homo sapiens
auuggguaucaagacauagca

SEQ ID NO: 1950600 - RNA, 23 nt, Homo sapiens
ugcucccucuguuagguccauuu

SEQ ID NO: 1950601 - RNA, 20 nt, Homo sapiens
ucacaaccaagaauguuaug

SEQ ID NO: 1950602 - RNA, 23 nt, Homo sapiens
aaaaugcugcuuccacucagggc

SEQ ID NO: 1950603 - RNA, 20 nt, Homo sapiens
uggggauagaggaaagggau

SEQ ID NO: 1950604 - RNA, 18 nt, Homo sapiens
agccccucacacugcaag

SEQ ID NO: 1950605 - RNA, 13 nt, Homo sapiens
ugucacuccagca

SEQ ID NO: 1950606 - RNA, 19 nt, Homo sapiens
cccagacuacuauuuucuu

SEQ ID NO: 1950607 - RNA, 15 nt, Homo sapiens
ucacucacacuggcc

SEQ ID NO: 1950608 - RNA, 22 nt, Homo sapiens
acaggcagauguuugccucaua

SEQ ID NO: 1950609 - RNA, 14 nt, Homo sapiens
acugcagcugugag

SEQ ID NO: 1950610 - RNA, 19 nt, Homo sapiens
caggcuguaagcauucuga

SEQ ID NO: 1950611 - RNA, 16 nt, Homo sapiens
aagcaaaaugugauau

SEQ ID NO: 1950612 - RNA, 20 nt, Homo sapiens
augacaucacuuguacaaaa

SEQ ID NO: 1950613 - RNA, 23 nt, Homo sapiens
auaagcagaacauacuguucuca

SEQ ID NO: 1950614 - RNA, 17 nt, Homo sapiens
cgacagugcauuugccu

SEQ ID NO: 1950615 - RNA, 14 nt, Homo sapiens
cucacccaucccac

SEQ ID NO: 1950616 - RNA, 12 nt, Homo sapiens
ugucacauggaa

SEQ ID NO: 1950617 - RNA, 17 nt, Homo sapiens
agucaucaucucuugau

SEQ ID NO: 1950618 - RNA, 17 nt, Homo sapiens
auuuacaacaaacaccu

SEQ ID NO: 1950619 - RNA, 21 nt, Homo sapiens
uucggggagggcgccuagucc

SEQ ID NO: 1950620 - RNA, 15 nt, Homo sapiens
cagaagcaugaucac

SEQ ID NO: 1950621 - RNA, 18 nt, Homo sapiens
uggaaggcccacugucca

SEQ ID NO: 1950622 - RNA, 13 nt, Homo sapiens
ugcaccucauucc

SEQ ID NO: 1950623 - RNA, 13 nt, Homo sapiens
uucacaccagcua

SEQ ID NO: 1950624 - RNA, 14 nt, Homo sapiens
gugccuuacacaau

SEQ ID NO: 1950625 - RNA, 16 nt, Homo sapiens
aagauugaaaauggac

SEQ ID NO: 1950626 - RNA, 24 nt, Homo sapiens
aaagccuccaaggguuucgacugg

SEQ ID NO: 1950627 - RNA, 22 nt, Homo sapiens
ugacccagucagaguugugcac

SEQ ID NO: 1950628 - RNA, 19 nt, Homo sapiens
uuuuaaaaaaauuccaagu

SEQ ID NO: 1950629 - RNA, 20 nt, Homo sapiens
ccuucaaguuagcucaggag

SEQ ID NO: 1950630 - RNA, 16 nt, Homo sapiens
cgggcucuaugccugc

SEQ ID NO: 1950631 - RNA, 14 nt, Homo sapiens
auguguaaggugaa

SEQ ID NO: 1950632 - RNA, 22 nt, Homo sapiens
guucuuaaauguuuauacugua

SEQ ID NO: 1950633 - RNA, 13 nt, Homo sapiens
caugaaaaaccau

SEQ ID NO: 1950634 - RNA, 22 nt, Homo sapiens
gaagacaaauaguguggaguga

SEQ ID NO: 1950635 - RNA, 20 nt, Homo sapiens
cccucuuuggaacagauauu

SEQ ID NO: 1950636 - RNA, 23 nt, Homo sapiens
guccugaugcaaagguggggaga

SEQ ID NO: 1950637 - RNA, 23 nt, Homo sapiens
cugcccacgugcagcaccuguca

SEQ ID NO: 1950638 - RNA, 20 nt, Homo sapiens
cagucagccaagaucuugcc

SEQ ID NO: 1950639 - RNA, 17 nt, Homo sapiens
agagagacaacagauuu

SEQ ID NO: 1950640 - RNA, 19 nt, Homo sapiens
caugauuucauguacugca

SEQ ID NO: 1950641 - RNA, 17 nt, Homo sapiens
ucgaaucucugugccuu

SEQ ID NO: 1950642 - RNA, 20 nt, Homo sapiens
auggaauccuucccugguga

SEQ ID NO: 1950643 - RNA, 14 nt, Homo sapiens
aaccagaucauguu

SEQ ID NO: 1950644 - RNA, 12 nt, Homo sapiens
aauuucacccau

SEQ ID NO: 1950645 - RNA, 11 nt, Homo sapiens
aggggccagag

SEQ ID NO: 1950646 - RNA, 16 nt, Homo sapiens
auggaacaucagugga

SEQ ID NO: 1950647 - RNA, 22 nt, Homo sapiens
uggaagguuagagguuugucaa

SEQ ID NO: 1950648 - RNA, 13 nt, Homo sapiens
uggaggggccaug

SEQ ID NO: 1950649 - RNA, 14 nt, Homo sapiens
acccuguuaauccc

SEQ ID NO: 1950650 - RNA, 18 nt, Homo sapiens
ucuucuuagcugucaccu

SEQ ID NO: 1950651 - RNA, 21 nt, Homo sapiens
cagcuuggugguuauguccca

SEQ ID NO: 1950652 - RNA, 17 nt, Homo sapiens
acccuucgagaucauca

SEQ ID NO: 1950653 - RNA, 13 nt, Homo sapiens
ucugaugugaaaa

SEQ ID NO: 1950654 - RNA, 15 nt, Homo sapiens
gguucuccaggugau

SEQ ID NO: 1950655 - RNA, 18 nt, Homo sapiens
ccaggcuggaaugcagug

SEQ ID NO: 1950656 - RNA, 16 nt, Homo sapiens
ccagaaagaggcagug

SEQ ID NO: 1950657 - RNA, 22 nt, Homo sapiens
aggccgaggcagguugaucacc

SEQ ID NO: 1950658 - RNA, 21 nt, Homo sapiens
gcugggccaccagccacuuua

SEQ ID NO: 1950659 - RNA, 21 nt, Homo sapiens
aagccacaucuugcucugcau

SEQ ID NO: 1950660 - RNA, 19 nt, Homo sapiens
agacaucugccauucccaa

SEQ ID NO: 1950661 - RNA, 22 nt, Homo sapiens
ccuaaauguuaacuacauauug

SEQ ID NO: 1950662 - RNA, 17 nt, Homo sapiens
uccagguggaacaaaca

SEQ ID NO: 1950663 - RNA, 20 nt, Homo sapiens
cucuggaaagaaacauguga

SEQ ID NO: 1950664 - RNA, 19 nt, Homo sapiens
cagauucuucacuggugag

SEQ ID NO: 1950665 - RNA, 17 nt, Homo sapiens
agacaccuucugugcuc

SEQ ID NO: 1950666 - RNA, 11 nt, Homo sapiens
ucaggccaaag

SEQ ID NO: 1950667 - RNA, 15 nt, Homo sapiens
ugcucuuaugccauu

SEQ ID NO: 1950668 - RNA, 14 nt, Homo sapiens
uuuacuagugugca

SEQ ID NO: 1950669 - RNA, 14 nt, Homo sapiens
uuaaaaaaagaaca

SEQ ID NO: 1950670 - RNA, 18 nt, Homo sapiens
uccaucacguuagcuguc

SEQ ID NO: 1950671 - RNA, 23 nt, Homo sapiens
cauccuuacagcuaucuguagaa

SEQ ID NO: 1950672 - RNA, 12 nt, Homo sapiens
aucuucuacuuu

SEQ ID NO: 1950673 - RNA, 14 nt, Homo sapiens
uggggugaucucau

SEQ ID NO: 1950674 - RNA, 23 nt, Homo sapiens
acuugaggccagugagcugugau

SEQ ID NO: 1950675 - RNA, 17 nt, Homo sapiens
cugaauuugcuaauaaa

SEQ ID NO: 1950676 - RNA, 22 nt, Homo sapiens
ggacauucuaaugcauauuuau

SEQ ID NO: 1950677 - RNA, 15 nt, Homo sapiens
cuugcgugcugggac

SEQ ID NO: 1950678 - RNA, 21 nt, Homo sapiens
uggaauuuugcaaagauuuaa

SEQ ID NO: 1950679 - RNA, 21 nt, Homo sapiens
aaauauguccauaucuaacca

SEQ ID NO: 1950680 - RNA, 12 nt, Homo sapiens
uaaaaugauaaa

SEQ ID NO: 1950681 - RNA, 12 nt, Homo sapiens
acaaaugaacaa

SEQ ID NO: 1950682 - RNA, 20 nt, Homo sapiens
aagaugggaggauugcuuga

SEQ ID NO: 1950683 - RNA, 23 nt, Homo sapiens
ggacacagcgcgguuuuuuccac

SEQ ID NO: 1950684 - RNA, 17 nt, Homo sapiens
caaucagaaucaucaua

SEQ ID NO: 1950685 - RNA, 15 nt, Homo sapiens
uaccgagcacuguga

SEQ ID NO: 1950686 - RNA, 14 nt, Homo sapiens
ccucaggcccagga

SEQ ID NO: 1950687 - RNA, 14 nt, Homo sapiens
aacacugugcaaag

SEQ ID NO: 1950688 - RNA, 13 nt, Homo sapiens
aguuuuccaugaa

SEQ ID NO: 1950689 - RNA, 14 nt, Homo sapiens
caagugacaucucu

SEQ ID NO: 1950690 - RNA, 23 nt, Homo sapiens
aaaaggauucuauaucaugacca

SEQ ID NO: 1950691 - RNA, 18 nt, Homo sapiens
uguguuuugcuaaaggaa

SEQ ID NO: 1950692 - RNA, 20 nt, Homo sapiens
ucugucccucacagcacuag

SEQ ID NO: 1950693 - RNA, 19 nt, Homo sapiens
caauauccuuuuacugcag

SEQ ID NO: 1950694 - RNA, 17 nt, Homo sapiens
auuuggaaaauguuaug

SEQ ID NO: 1950695 - RNA, 16 nt, Homo sapiens
gccuuggcuagaguuu

SEQ ID NO: 1950696 - RNA, 12 nt, Homo sapiens
aaaagacugaau

SEQ ID NO: 1950697 - RNA, 21 nt, Homo sapiens
cauagcugugcuaugagguuu

SEQ ID NO: 1950698 - RNA, 19 nt, Homo sapiens
uugauccauuucuaauuau

SEQ ID NO: 1950699 - RNA, 17 nt, Homo sapiens
uucuggggacaccucag

SEQ ID NO: 1950700 - RNA, 14 nt, Homo sapiens
auaugaaguguuag

SEQ ID NO: 1950701 - RNA, 12 nt, Homo sapiens
gcagcagaauug

SEQ ID NO: 1950702 - RNA, 14 nt, Homo sapiens
aaucuaacagugac

SEQ ID NO: 1950703 - RNA, 15 nt, Homo sapiens
acagcuacacgcuga

SEQ ID NO: 1950704 - RNA, 23 nt, Homo sapiens
ugcaaauacaaucagcccagugc

SEQ ID NO: 1950705 - RNA, 20 nt, Homo sapiens
acaggaauggaacacacuug

SEQ ID NO: 1950706 - RNA, 15 nt, Homo sapiens
agcaaaaaaguacuu

SEQ ID NO: 1950707 - RNA, 13 nt, Homo sapiens
acagcacccaggc

SEQ ID NO: 1950708 - RNA, 13 nt, Homo sapiens
caggaaccacaga

SEQ ID NO: 1950709 - RNA, 21 nt, Homo sapiens
aggacaugaaaaauugcuaug

SEQ ID NO: 1950710 - RNA, 22 nt, Homo sapiens
acuacuaaagugccuaccccag

SEQ ID NO: 1950711 - RNA, 14 nt, Homo sapiens
agaaaucaggccuu

SEQ ID NO: 1950712 - RNA, 19 nt, Homo sapiens
ugcaguggcaucaucucag

SEQ ID NO: 1950713 - RNA, 17 nt, Homo sapiens
cacuccgucugcuccaa

SEQ ID NO: 1950714 - RNA, 15 nt, Homo sapiens
cucaggaacagaaca

SEQ ID NO: 1950715 - RNA, 18 nt, Homo sapiens
uauuaguuaaaacacaua

SEQ ID NO: 1950716 - RNA, 21 nt, Homo sapiens
ucacccucuccagcaagagaa

SEQ ID NO: 1950717 - RNA, 20 nt, Homo sapiens
aaugaguuuaaugccauaaa

SEQ ID NO: 1950718 - RNA, 16 nt, Homo sapiens
guagccaggaagcccc

SEQ ID NO: 1950719 - RNA, 12 nt, Homo sapiens
acugacacagga

SEQ ID NO: 1950720 - RNA, 23 nt, Homo sapiens
acuaaugcucaaccuaaccaccu

SEQ ID NO: 1950721 - RNA, 19 nt, Homo sapiens
caugcagccagccaucaaa

SEQ ID NO: 1950722 - RNA, 20 nt, Homo sapiens
ucacuguccagguaggaaac

SEQ ID NO: 1950723 - RNA, 20 nt, Homo sapiens
caguuuguaaaaguguaaca

SEQ ID NO: 1950724 - RNA, 21 nt, Homo sapiens
cccucuggccgccuaggcuca

SEQ ID NO: 1950725 - RNA, 15 nt, Homo sapiens
cacaggaguccuuuc

SEQ ID NO: 1950726 - RNA, 16 nt, Homo sapiens
uuugcgcugcuaagaa

SEQ ID NO: 1950727 - RNA, 14 nt, Homo sapiens
uaucaacacacauu

SEQ ID NO: 1950728 - RNA, 17 nt, Homo sapiens
cugagucgcucucauga

SEQ ID NO: 1950729 - RNA, 19 nt, Homo sapiens
agaaguuuaaaaaaccaug

SEQ ID NO: 1950730 - RNA, 21 nt, Homo sapiens
ccaugucuuuggacaaccaug

SEQ ID NO: 1950731 - RNA, 17 nt, Homo sapiens
cccucucccgccagacu

SEQ ID NO: 1950732 - RNA, 22 nt, Homo sapiens
ucugccugcaccccugcaguuu

SEQ ID NO: 1950733 - RNA, 16 nt, Homo sapiens
cuggagggggagcacc

SEQ ID NO: 1950734 - RNA, 13 nt, Homo sapiens
ucaaauaccacau

SEQ ID NO: 1950735 - RNA, 18 nt, Homo sapiens
accugucucauagccucg

SEQ ID NO: 1950736 - RNA, 21 nt, Homo sapiens
aaugaaggcucauuuacuuga

SEQ ID NO: 1950737 - RNA, 16 nt, Homo sapiens
cacugguuuuacacag

SEQ ID NO: 1950738 - RNA, 16 nt, Homo sapiens
gccguugcugcguucu

SEQ ID NO: 1950739 - RNA, 19 nt, Homo sapiens
uagagaugugucuauggcu

SEQ ID NO: 1950740 - RNA, 20 nt, Homo sapiens
gccuggaacaccagcagcac

SEQ ID NO: 1950741 - RNA, 18 nt, Homo sapiens
agcaucaacaagugggga

SEQ ID NO: 1950742 - RNA, 16 nt, Homo sapiens
accuggcacaauggcu

SEQ ID NO: 1950743 - RNA, 14 nt, Homo sapiens
ugcuuugguauucu

SEQ ID NO: 1950744 - RNA, 16 nt, Homo sapiens
acaguccuauguacag

SEQ ID NO: 1950745 - RNA, 22 nt, Homo sapiens
caaagaggccaguacuuugcca

SEQ ID NO: 1950746 - RNA, 12 nt, Homo sapiens
gggagcccagug

SEQ ID NO: 1950747 - RNA, 17 nt, Homo sapiens
uccccacccagucucau

SEQ ID NO: 1950748 - RNA, 19 nt, Homo sapiens
aaauagcagguaguccagg

SEQ ID NO: 1950749 - RNA, 13 nt, Homo sapiens
aaucugcacugug

SEQ ID NO: 1950750 - RNA, 15 nt, Homo sapiens
cuuuaaaaaagcaaa

SEQ ID NO: 1950751 - RNA, 20 nt, Homo sapiens
uuucacuuuuggcuuguaaa

SEQ ID NO: 1950752 - RNA, 15 nt, Homo sapiens
auuagaaucugagua

SEQ ID NO: 1950753 - RNA, 13 nt, Homo sapiens
uaaagaugguuua

SEQ ID NO: 1950754 - RNA, 15 nt, Homo sapiens
gcucaucuugcaaag

SEQ ID NO: 1950755 - RNA, 16 nt, Homo sapiens
uugcccaccagaucau

SEQ ID NO: 1950756 - RNA, 21 nt, Homo sapiens
cucgcaagggaaguccuugca

SEQ ID NO: 1950757 - RNA, 14 nt, Homo sapiens
uuuguuucaguaga

SEQ ID NO: 1950758 - RNA, 20 nt, Homo sapiens
uuggaaguguucccugagaa

SEQ ID NO: 1950759 - RNA, 22 nt, Homo sapiens
caguggaaaaaucagaagcaca

SEQ ID NO: 1950760 - RNA, 23 nt, Homo sapiens
cucaguguugucaccagaucuga

SEQ ID NO: 1950761 - RNA, 16 nt, Homo sapiens
cucuauuaaaauuacu

SEQ ID NO: 1950762 - RNA, 14 nt, Homo sapiens
uuuaccacuaugca

SEQ ID NO: 1950763 - RNA, 17 nt, Homo sapiens
cugcguaugagucccau

SEQ ID NO: 1950764 - RNA, 15 nt, Homo sapiens
ucaccuucuagucuu

SEQ ID NO: 1950765 - RNA, 18 nt, Homo sapiens
acuuugaacaagguuuca

SEQ ID NO: 1950766 - RNA, 15 nt, Homo sapiens
uucuugaauucaugu

SEQ ID NO: 1950767 - RNA, 14 nt, Homo sapiens
cccaugagugcuaa

SEQ ID NO: 1950768 - RNA, 23 nt, Homo sapiens
ucaucuggcuggcauccucacaa

SEQ ID NO: 1950769 - RNA, 15 nt, Homo sapiens
ugcuacuagcucuuu

SEQ ID NO: 1950770 - RNA, 22 nt, Homo sapiens
acuuacccucaccugucaggcc

SEQ ID NO: 1950771 - RNA, 20 nt, Homo sapiens
gccugagcacacugcccugu

SEQ ID NO: 1950772 - RNA, 17 nt, Homo sapiens
uuuuucuuuccuuuccc

SEQ ID NO: 1950773 - RNA, 13 nt, Homo sapiens
gaaacuguaugaa

SEQ ID NO: 1950774 - RNA, 18 nt, Homo sapiens
aaaacauugacuguggcu

SEQ ID NO: 1950775 - RNA, 21 nt, Homo sapiens
guagcacugacagauuuccau

SEQ ID NO: 1950776 - RNA, 15 nt, Homo sapiens
guuuuuggcaccuua

SEQ ID NO: 1950777 - RNA, 12 nt, Homo sapiens
aacaaaacuaua

SEQ ID NO: 1950778 - RNA, 14 nt, Homo sapiens
ccagaucucaggca

SEQ ID NO: 1950779 - RNA, 14 nt, Homo sapiens
cagcagaagcccca

SEQ ID NO: 1950780 - RNA, 21 nt, Homo sapiens
cacccuuccccuccuucuccc

SEQ ID NO: 1950781 - RNA, 23 nt, Homo sapiens
uccugcagaagcagaagugcaau

SEQ ID NO: 1950782 - RNA, 18 nt, Homo sapiens
ccugccucccaagcagcu

SEQ ID NO: 1950783 - RNA, 21 nt, Homo sapiens
cagguaggauacguacaccuc

SEQ ID NO: 1950784 - RNA, 18 nt, Homo sapiens
ucugcauuuugcuauugu

SEQ ID NO: 1950785 - RNA, 14 nt, Homo sapiens
gaaucuacagaaca

SEQ ID NO: 1950786 - RNA, 14 nt, Homo sapiens
aguaccuguaguga

SEQ ID NO: 1950787 - RNA, 11 nt, Homo sapiens
uccugugaaag

SEQ ID NO: 1950788 - RNA, 22 nt, Homo sapiens
cagcauaaccccacccuuuaca

SEQ ID NO: 1950789 - RNA, 14 nt, Homo sapiens
acacccagugccag

SEQ ID NO: 1950790 - RNA, 15 nt, Homo sapiens
auaauuaaggccaga

SEQ ID NO: 1950791 - RNA, 18 nt, Homo sapiens
agcuguuugaaauguuua

SEQ ID NO: 1950792 - RNA, 16 nt, Homo sapiens
ucaucauuuaucauca

SEQ ID NO: 1950793 - RNA, 19 nt, Homo sapiens
acuuugaaagagcuuuuag

SEQ ID NO: 1950794 - RNA, 15 nt, Homo sapiens
aaguccuggcacagu

SEQ ID NO: 1950795 - RNA, 12 nt, Homo sapiens
caaaacucuguc

SEQ ID NO: 1950796 - RNA, 12 nt, Homo sapiens
ugaaacuccauc

SEQ ID NO: 1950797 - RNA, 20 nt, Homo sapiens
auguguaauuguuuuggaau

SEQ ID NO: 1950798 - RNA, 14 nt, Homo sapiens
cuuugguaaucucu

SEQ ID NO: 1950799 - RNA, 13 nt, Homo sapiens
cagugcaguuucu

SEQ ID NO: 1950800 - RNA, 16 nt, Homo sapiens
cauaaauugguauaau

SEQ ID NO: 1950801 - RNA, 14 nt, Homo sapiens
uuacaaaagacaga

SEQ ID NO: 1950802 - RNA, 19 nt, Homo sapiens
accuggccgcuaaguugcu

SEQ ID NO: 1950803 - RNA, 16 nt, Homo sapiens
acaacaaacacuguga

SEQ ID NO: 1950804 - RNA, 19 nt, Homo sapiens
ccacaauggucucagccua

SEQ ID NO: 1950805 - RNA, 17 nt, Homo sapiens
gccugguacucaagccc

SEQ ID NO: 1950806 - RNA, 19 nt, Homo sapiens
gaauccauaaauguguucc

SEQ ID NO: 1950807 - RNA, 23 nt, Homo sapiens
gacugaugucuccuaagcaccug

SEQ ID NO: 1950808 - RNA, 18 nt, Homo sapiens
aagcacaaccacuguagc

SEQ ID NO: 1950809 - RNA, 21 nt, Homo sapiens
caagugcuggcaccaccaggc

SEQ ID NO: 1950810 - RNA, 13 nt, Homo sapiens
cacucugccaggg

SEQ ID NO: 1950811 - RNA, 18 nt, Homo sapiens
auauguauaucuuugcac

SEQ ID NO: 1950812 - RNA, 17 nt, Homo sapiens
uaguccuggaugacucg

SEQ ID NO: 1950813 - RNA, 15 nt, Homo sapiens
ucugauaccaaagag

SEQ ID NO: 1950814 - RNA, 17 nt, Homo sapiens
ucccaacucgaugggca

SEQ ID NO: 1950815 - RNA, 12 nt, Homo sapiens
ggcacacagcua

SEQ ID NO: 1950816 - RNA, 12 nt, Homo sapiens
cagccucucugc

SEQ ID NO: 1950817 - RNA, 23 nt, Homo sapiens
gucaauucugauguuacugagau

SEQ ID NO: 1950818 - RNA, 18 nt, Homo sapiens
aacuguucccaccugcug

SEQ ID NO: 1950819 - RNA, 23 nt, Homo sapiens
aaguacuccuauugccgccagaa

SEQ ID NO: 1950820 - RNA, 15 nt, Homo sapiens
cuauaaauuuacucu

SEQ ID NO: 1950821 - RNA, 13 nt, Homo sapiens
guaucacucccac

SEQ ID NO: 1950822 - RNA, 13 nt, Homo sapiens
aauuacagacaaa

SEQ ID NO: 1950823 - RNA, 14 nt, Homo sapiens
ucuuccacagugcc

SEQ ID NO: 1950824 - RNA, 13 nt, Homo sapiens
ggcaaaguaaaau

SEQ ID NO: 1950825 - RNA, 17 nt, Homo sapiens
ucugagaucagugccuc

SEQ ID NO: 1950826 - RNA, 16 nt, Homo sapiens
agcaaaucccauuucu

SEQ ID NO: 1950827 - RNA, 19 nt, Homo sapiens
cggguacucagucagccca

SEQ ID NO: 1950828 - RNA, 22 nt, Homo sapiens
cauuaacaaaaauauuagcaaa

SEQ ID NO: 1950829 - RNA, 24 nt, Homo sapiens
agccagaaucucauuacugcuuca

SEQ ID NO: 1950830 - RNA, 14 nt, Homo sapiens
uagcugaaugaguc

SEQ ID NO: 1950831 - RNA, 22 nt, Homo sapiens
uaacauggugaaacauggugaa

SEQ ID NO: 1950832 - RNA, 14 nt, Homo sapiens
ugagcuuagugaaa

SEQ ID NO: 1950833 - RNA, 18 nt, Homo sapiens
ucuagcugucugugaaua

SEQ ID NO: 1950834 - RNA, 14 nt, Homo sapiens
gcaccacggccuca

SEQ ID NO: 1950835 - RNA, 19 nt, Homo sapiens
auagaucaaagucaaaaau

SEQ ID NO: 1950836 - RNA, 15 nt, Homo sapiens
ucucuagccacuuug

SEQ ID NO: 1950837 - RNA, 13 nt, Homo sapiens
caaucucacaccu

SEQ ID NO: 1950838 - RNA, 19 nt, Homo sapiens
aaaggacucugcuucaguc

SEQ ID NO: 1950839 - RNA, 16 nt, Homo sapiens
aaaauuaaaaccaauu

SEQ ID NO: 1950840 - RNA, 12 nt, Homo sapiens
cugaacuugaag

SEQ ID NO: 1950841 - RNA, 15 nt, Homo sapiens
ccuuuguagcuacuu

SEQ ID NO: 1950842 - RNA, 19 nt, Homo sapiens
uccacucuuguggucauca

SEQ ID NO: 1950843 - RNA, 12 nt, Homo sapiens
ugggggauuuca

SEQ ID NO: 1950844 - RNA, 14 nt, Homo sapiens
auuaaaugugucau

SEQ ID NO: 1950845 - RNA, 13 nt, Homo sapiens
augcagacaugag

SEQ ID NO: 1950846 - RNA, 16 nt, Homo sapiens
ggcauguauacuuaau

SEQ ID NO: 1950847 - RNA, 11 nt, Homo sapiens
gcccagcacug

SEQ ID NO: 1950848 - RNA, 15 nt, Homo sapiens
aagaauuuaauguac

SEQ ID NO: 1950849 - RNA, 20 nt, Homo sapiens
cuggaagaagugagcagugu

SEQ ID NO: 1950850 - RNA, 21 nt, Homo sapiens
ucccgccccgccccucccacg

SEQ ID NO: 1950851 - RNA, 18 nt, Homo sapiens
uuguugaugaagcacauu

SEQ ID NO: 1950852 - RNA, 16 nt, Homo sapiens
auuccccugugucauc

SEQ ID NO: 1950853 - RNA, 22 nt, Homo sapiens
ccacagaggacucacuugccca

SEQ ID NO: 1950854 - RNA, 22 nt, Homo sapiens
cucccugcuuggcuuaugaaaa

SEQ ID NO: 1950855 - RNA, 12 nt, Homo sapiens
caauccaugaga

SEQ ID NO: 1950856 - RNA, 15 nt, Homo sapiens
caggcacagcacagg

SEQ ID NO: 1950857 - RNA, 19 nt, Homo sapiens
cuccauacccacaaucuga

SEQ ID NO: 1950858 - RNA, 15 nt, Homo sapiens
gcccgcugcucacuu

SEQ ID NO: 1950859 - RNA, 15 nt, Homo sapiens
caguuaucacacuuu

SEQ ID NO: 1950860 - RNA, 19 nt, Homo sapiens
acuaccugguguaugaaau

SEQ ID NO: 1950861 - RNA, 17 nt, Homo sapiens
acuguauaaacaaaaga

SEQ ID NO: 1950862 - RNA, 22 nt, Homo sapiens
ucuaucucacacugcaccaagc

SEQ ID NO: 1950863 - RNA, 20 nt, Homo sapiens
auuaauuuugauauaaucuu

SEQ ID NO: 1950864 - RNA, 21 nt, Homo sapiens
uccacacagccugucuucaga

SEQ ID NO: 1950865 - RNA, 16 nt, Homo sapiens
uugucauuuccaaauu

SEQ ID NO: 1950866 - RNA, 16 nt, Homo sapiens
ucaaagucauuaaaga

SEQ ID NO: 1950867 - RNA, 16 nt, Homo sapiens
ggcaauccaaguacau

SEQ ID NO: 1950868 - RNA, 16 nt, Homo sapiens
gcauuaaaacaaagga

SEQ ID NO: 1950869 - RNA, 22 nt, Homo sapiens
cuccccucccucgccaccccaa

SEQ ID NO: 1950870 - RNA, 19 nt, Homo sapiens
gagcauuugaaaggugugc

SEQ ID NO: 1950871 - RNA, 14 nt, Homo sapiens
ugucgcuaugugac

SEQ ID NO: 1950872 - RNA, 20 nt, Homo sapiens
cauggagaagccccgucucu

SEQ ID NO: 1950873 - RNA, 16 nt, Homo sapiens
uuaguuccacugagac

SEQ ID NO: 1950874 - RNA, 23 nt, Homo sapiens
aaugcucaagaaacaacuucuac

SEQ ID NO: 1950875 - RNA, 18 nt, Homo sapiens
caggauugccauaugugc

SEQ ID NO: 1950876 - RNA, 21 nt, Homo sapiens
ugucuuucugagcacacuuua

SEQ ID NO: 1950877 - RNA, 20 nt, Homo sapiens
aguaaaacauaauguaucau

SEQ ID NO: 1950878 - RNA, 21 nt, Homo sapiens
ucuaggcacacaaacauuuaa

SEQ ID NO: 1950879 - RNA, 20 nt, Homo sapiens
auacaaaaggcuccauauau

SEQ ID NO: 1950880 - RNA, 20 nt, Homo sapiens
gagugccuggccaaagggau

SEQ ID NO: 1950881 - RNA, 20 nt, Homo sapiens
cuaucaccucuuaugcacac

SEQ ID NO: 1950882 - RNA, 15 nt, Homo sapiens
aggcaaugacuguga

SEQ ID NO: 1950883 - RNA, 20 nt, Homo sapiens
ccugaggacaggaguuugag

SEQ ID NO: 1950884 - RNA, 22 nt, Homo sapiens
gcacgugcaauacggaacacug

SEQ ID NO: 1950885 - RNA, 19 nt, Homo sapiens
cuuuauguauggagcucua

SEQ ID NO: 1950886 - RNA, 16 nt, Homo sapiens
acacugaaucucaccu

SEQ ID NO: 1950887 - RNA, 19 nt, Homo sapiens
agccauggaaaaacuuccu

SEQ ID NO: 1950888 - RNA, 21 nt, Homo sapiens
ccucugugcugcaucccacca

SEQ ID NO: 1950889 - RNA, 13 nt, Homo sapiens
ccauucucaggug

SEQ ID NO: 1950890 - RNA, 22 nt, Homo sapiens
ccaccgacccuuccuggccuaa

SEQ ID NO: 1950891 - RNA, 17 nt, Homo sapiens
aaagccuagaagagcuu

SEQ ID NO: 1950892 - RNA, 18 nt, Homo sapiens
ugucacucguaggggaug

SEQ ID NO: 1950893 - RNA, 18 nt, Homo sapiens
acuuuaugaaaacugaag

SEQ ID NO: 1950894 - RNA, 14 nt, Homo sapiens
gucacucuagucaa

SEQ ID NO: 1950895 - RNA, 19 nt, Homo sapiens
gaucuggaacccagacuca

SEQ ID NO: 1950896 - RNA, 21 nt, Homo sapiens
ucccaacugcaagucacaaag

SEQ ID NO: 1950897 - RNA, 18 nt, Homo sapiens
gacgcuguccauugccac

SEQ ID NO: 1950898 - RNA, 18 nt, Homo sapiens
cuuucaugaguuucccag

SEQ ID NO: 1950899 - RNA, 21 nt, Homo sapiens
gauguuucaucaaugcaguuc

SEQ ID NO: 1950900 - RNA, 13 nt, Homo sapiens
uccauacuuugaa

SEQ ID NO: 1950901 - RNA, 22 nt, Homo sapiens
uacuacccgagcccagcuacau

SEQ ID NO: 1950902 - RNA, 19 nt, Homo sapiens
agcccauccugaccagcug

SEQ ID NO: 1950903 - RNA, 18 nt, Homo sapiens
ucuauagugaugaugauc

SEQ ID NO: 1950904 - RNA, 17 nt, Homo sapiens
aaagagacuccgucuca

SEQ ID NO: 1950905 - RNA, 20 nt, Homo sapiens
ucuucaugaguagugggcua

SEQ ID NO: 1950906 - RNA, 22 nt, Homo sapiens
ccagcauuugguuuuacacagg

SEQ ID NO: 1950907 - RNA, 17 nt, Homo sapiens
ccagccuuccucugcag

SEQ ID NO: 1950908 - RNA, 13 nt, Homo sapiens
ggucuugacucau

SEQ ID NO: 1950909 - RNA, 13 nt, Homo sapiens
uuuccucuaauga

SEQ ID NO: 1950910 - RNA, 20 nt, Homo sapiens
aacccugcugaacacagugu

SEQ ID NO: 1950911 - RNA, 22 nt, Homo sapiens
auaacauggccuuggagggcau

SEQ ID NO: 1950912 - RNA, 21 nt, Homo sapiens
aguuugcaaauagaacuaaua

SEQ ID NO: 1950913 - RNA, 12 nt, Homo sapiens
acuguugcacgu

SEQ ID NO: 1950914 - RNA, 14 nt, Homo sapiens
acacagcugggcug

SEQ ID NO: 1950915 - RNA, 17 nt, Homo sapiens
uugacuagccaucucaa

SEQ ID NO: 1950916 - RNA, 16 nt, Homo sapiens
ucugauuuccuuccaa

SEQ ID NO: 1950917 - RNA, 15 nt, Homo sapiens
uauaaauaaucacac

SEQ ID NO: 1950918 - RNA, 18 nt, Homo sapiens
aauuauuugaagauuuaa

SEQ ID NO: 1950919 - RNA, 14 nt, Homo sapiens
guaccucaucccau

SEQ ID NO: 1950920 - RNA, 19 nt, Homo sapiens
ggcaaucacauagugaaag

SEQ ID NO: 1950921 - RNA, 16 nt, Homo sapiens
aggaaaauauugauca

SEQ ID NO: 1950922 - RNA, 17 nt, Homo sapiens
aggaugcagcacugcgc

SEQ ID NO: 1950923 - RNA, 18 nt, Homo sapiens
ugcccugccccucuggcc

SEQ ID NO: 1950924 - RNA, 17 nt, Homo sapiens
auaauaggaacaaucuu

SEQ ID NO: 1950925 - RNA, 13 nt, Homo sapiens
aacccugccaugg

SEQ ID NO: 1950926 - RNA, 20 nt, Homo sapiens
gcuucucuugcuaccuguga

SEQ ID NO: 1950927 - RNA, 24 nt, Homo sapiens
aaggcgugagucugcaucuuaggg

SEQ ID NO: 1950928 - RNA, 21 nt, Homo sapiens
acaaugaaggaaaaccucacu

SEQ ID NO: 1950929 - RNA, 23 nt, Homo sapiens
gggggucccagugggaggggcag

SEQ ID NO: 1950930 - RNA, 18 nt, Homo sapiens
gcaauucuccugccuuug

SEQ ID NO: 1950931 - RNA, 21 nt, Homo sapiens
cuauagcagaagcacauuuuc

SEQ ID NO: 1950932 - RNA, 17 nt, Homo sapiens
ugguuugccaugucgcu

SEQ ID NO: 1950933 - RNA, 22 nt, Homo sapiens
caucccuuccuccucuccugga

SEQ ID NO: 1950934 - RNA, 19 nt, Homo sapiens
aaauaguuacaagcauuga

SEQ ID NO: 1950935 - RNA, 17 nt, Homo sapiens
ccuugaucgacuucuug

SEQ ID NO: 1950936 - RNA, 14 nt, Homo sapiens
uuuccucaagcaau

SEQ ID NO: 1950937 - RNA, 15 nt, Homo sapiens
agagagcagaaauaa

SEQ ID NO: 1950938 - RNA, 17 nt, Homo sapiens
gcuuugugauagugaca

SEQ ID NO: 1950939 - RNA, 12 nt, Homo sapiens
aaaucaaaaagg

SEQ ID NO: 1950940 - RNA, 18 nt, Homo sapiens
uauuucuuaagaauucaa

SEQ ID NO: 1950941 - RNA, 17 nt, Homo sapiens
cuuucccugaacuggga

SEQ ID NO: 1950942 - RNA, 14 nt, Homo sapiens
gugucacccugcag

SEQ ID NO: 1950943 - RNA, 21 nt, Homo sapiens
uagauuucuauaggauuuuuc

SEQ ID NO: 1950944 - RNA, 17 nt, Homo sapiens
gaagaaaccguauccau

SEQ ID NO: 1950945 - RNA, 13 nt, Homo sapiens
uguccugcuacaa

SEQ ID NO: 1950946 - RNA, 21 nt, Homo sapiens
gaagaccuucugaagaucuca

SEQ ID NO: 1950947 - RNA, 22 nt, Homo sapiens
gauuaauuuaauucauguauua

SEQ ID NO: 1950948 - RNA, 22 nt, Homo sapiens
cugcuugaauaaacaccacugg

SEQ ID NO: 1950949 - RNA, 15 nt, Homo sapiens
ggaaaauuugacauu

SEQ ID NO: 1950950 - RNA, 19 nt, Homo sapiens
gagucccacggaaugggga

SEQ ID NO: 1950951 - RNA, 19 nt, Homo sapiens
ucacacaacacugauguga

SEQ ID NO: 1950952 - RNA, 16 nt, Homo sapiens
cccgucuggugccagu

SEQ ID NO: 1950953 - RNA, 15 nt, Homo sapiens
aaacucucauuauuc

SEQ ID NO: 1950954 - RNA, 14 nt, Homo sapiens
ggcaguguuccuug

SEQ ID NO: 1950955 - RNA, 17 nt, Homo sapiens
gcgguuccugugcagau

SEQ ID NO: 1950956 - RNA, 13 nt, Homo sapiens
aacaccccacuga

SEQ ID NO: 1950957 - RNA, 22 nt, Homo sapiens
uuaaguagaaaaguugcagaug

SEQ ID NO: 1950958 - RNA, 16 nt, Homo sapiens
uccuuuccuaucuucc

SEQ ID NO: 1950959 - RNA, 16 nt, Homo sapiens
aacccuccacuucucc

SEQ ID NO: 1950960 - RNA, 19 nt, Homo sapiens
aaacucauuacuuuuccau

SEQ ID NO: 1950961 - RNA, 13 nt, Homo sapiens
cacucagguucuu

SEQ ID NO: 1950962 - RNA, 16 nt, Homo sapiens
cuguagccugggacca

SEQ ID NO: 1950963 - RNA, 13 nt, Homo sapiens
uuccccauuguau

SEQ ID NO: 1950964 - RNA, 20 nt, Homo sapiens
gucacgcuugccuggucacc

SEQ ID NO: 1950965 - RNA, 15 nt, Homo sapiens
gaagauuagcaugaa

SEQ ID NO: 1950966 - RNA, 19 nt, Homo sapiens
agaugauacauccaaagca

SEQ ID NO: 1950967 - RNA, 16 nt, Homo sapiens
uuauaaacuagaucuc

SEQ ID NO: 1950968 - RNA, 20 nt, Homo sapiens
cuggagauggcugcugcuca

SEQ ID NO: 1950969 - RNA, 20 nt, Homo sapiens
acuugucuuacauaaucaca

SEQ ID NO: 1950970 - RNA, 20 nt, Homo sapiens
gguugauuaaggcaguacaa

SEQ ID NO: 1950971 - RNA, 23 nt, Homo sapiens
aaacuuggacauuuauguacaaa

SEQ ID NO: 1950972 - RNA, 20 nt, Homo sapiens
agaugcguuguuacaggaag

SEQ ID NO: 1950973 - RNA, 18 nt, Homo sapiens
cccccgaacggcauucuc

SEQ ID NO: 1950974 - RNA, 12 nt, Homo sapiens
acacacacagcc

SEQ ID NO: 1950975 - RNA, 23 nt, Homo sapiens
aggggagcaaaaucgaugcagug

SEQ ID NO: 1950976 - RNA, 14 nt, Homo sapiens
ugauaaccacuaag

SEQ ID NO: 1950977 - RNA, 23 nt, Homo sapiens
cuuaaaaaaauagaaauuauucu

SEQ ID NO: 1950978 - RNA, 21 nt, Homo sapiens
caggaagggggccgacuccac

SEQ ID NO: 1950979 - RNA, 15 nt, Homo sapiens
auuaauuacugugug

SEQ ID NO: 1950980 - RNA, 15 nt, Homo sapiens
cugaaauaauuugag

SEQ ID NO: 1950981 - RNA, 14 nt, Homo sapiens
accgcuggagcucc

SEQ ID NO: 1950982 - RNA, 16 nt, Homo sapiens
aaggaaggaugccuua

SEQ ID NO: 1950983 - RNA, 13 nt, Homo sapiens
ugcacaccaaggc

SEQ ID NO: 1950984 - RNA, 16 nt, Homo sapiens
aguuuggagagagcag

SEQ ID NO: 1950985 - RNA, 16 nt, Homo sapiens
cacugugaugcuuuau

SEQ ID NO: 1950986 - RNA, 14 nt, Homo sapiens
caaggggcuuuguc

SEQ ID NO: 1950987 - RNA, 16 nt, Homo sapiens
cacagaccaccugcuu

SEQ ID NO: 1950988 - RNA, 15 nt, Homo sapiens
uaagaauuaaucuua

SEQ ID NO: 1950989 - RNA, 15 nt, Homo sapiens
ugacagagagaggca

SEQ ID NO: 1950990 - RNA, 18 nt, Homo sapiens
cuaaguauuuugaugaag

SEQ ID NO: 1950991 - RNA, 18 nt, Homo sapiens
agccagcuuaaacccaua

SEQ ID NO: 1950992 - RNA, 22 nt, Homo sapiens
ugcccacugaacaugcucaugu

SEQ ID NO: 1950993 - RNA, 15 nt, Homo sapiens
gucagccacaccugu

SEQ ID NO: 1950994 - RNA, 18 nt, Homo sapiens
uguuucuuuuguauguaa

SEQ ID NO: 1950995 - RNA, 14 nt, Homo sapiens
cagcagaggcagga

SEQ ID NO: 1950996 - RNA, 16 nt, Homo sapiens
agcaguucugaugcuu

SEQ ID NO: 1950997 - RNA, 22 nt, Homo sapiens
ggccagguagcagcaaauagca

SEQ ID NO: 1950998 - RNA, 19 nt, Homo sapiens
caugugaccgaacacugca

SEQ ID NO: 1950999 - RNA, 21 nt, Homo sapiens
ugcauuucuucacgcaccucg

SEQ ID NO: 1951000 - RNA, 16 nt, Homo sapiens
gaggcugaggcaagag

SEQ ID NO: 1951001 - RNA, 21 nt, Homo sapiens
gugucuagacugccagggaga

SEQ ID NO: 1951002 - RNA, 16 nt, Homo sapiens
aggagggcaguggugg

SEQ ID NO: 1951003 - RNA, 13 nt, Homo sapiens
auuacuaucauaa

SEQ ID NO: 1951004 - RNA, 18 nt, Homo sapiens
uccaaagaacaucugcac

SEQ ID NO: 1951005 - RNA, 11 nt, Homo sapiens
caagcuuucag

SEQ ID NO: 1951006 - RNA, 22 nt, Homo sapiens
uuuuccccuuaaaucaggaaau

SEQ ID NO: 1951007 - RNA, 24 nt, Homo sapiens
gaggcaagauacaacagcugccga

SEQ ID NO: 1951008 - RNA, 18 nt, Homo sapiens
auacugaaggaaaaacac

SEQ ID NO: 1951009 - RNA, 22 nt, Homo sapiens
ccacuuccauguugucuuauaa

SEQ ID NO: 1951010 - RNA, 19 nt, Homo sapiens
aacugauuuguagugauuc

SEQ ID NO: 1951011 - RNA, 20 nt, Homo sapiens
aguauauuuuugcaggugcu

SEQ ID NO: 1951012 - RNA, 15 nt, Homo sapiens
ugcagauaugggacu

SEQ ID NO: 1951013 - RNA, 17 nt, Homo sapiens
aagaugaagacaacagc

SEQ ID NO: 1951014 - RNA, 16 nt, Homo sapiens
agccugucacgugguc

SEQ ID NO: 1951015 - RNA, 21 nt, Homo sapiens
auuacuguuugaaacuuuuca

SEQ ID NO: 1951016 - RNA, 12 nt, Homo sapiens
acaaauauugcu

SEQ ID NO: 1951017 - RNA, 18 nt, Homo sapiens
augacagugacacccaga

SEQ ID NO: 1951018 - RNA, 18 nt, Homo sapiens
ccagacgcauccugccac

SEQ ID NO: 1951019 - RNA, 19 nt, Homo sapiens
uaaguuagggaauggcaca

SEQ ID NO: 1951020 - RNA, 13 nt, Homo sapiens
uugacaugugcaa

SEQ ID NO: 1951021 - RNA, 13 nt, Homo sapiens
gcagaugaugcuu

SEQ ID NO: 1951022 - RNA, 20 nt, Homo sapiens
cccaugggccucaugaauaa

SEQ ID NO: 1951023 - RNA, 15 nt, Homo sapiens
uggguucugcuacuc

SEQ ID NO: 1951024 - RNA, 15 nt, Homo sapiens
cuguauuuagaucuc

SEQ ID NO: 1951025 - RNA, 22 nt, Homo sapiens
uccaugcugcaaaggagaagca

SEQ ID NO: 1951026 - RNA, 13 nt, Homo sapiens
aucauguaucucu

SEQ ID NO: 1951027 - RNA, 23 nt, Homo sapiens
guguuguaaaaaugucuuucaug

SEQ ID NO: 1951028 - RNA, 14 nt, Homo sapiens
caguaaaaucuugc

SEQ ID NO: 1951029 - RNA, 22 nt, Homo sapiens
ccuucuuacuuaaccugaagcu

SEQ ID NO: 1951030 - RNA, 13 nt, Homo sapiens
ccuaggcuuuuac

SEQ ID NO: 1951031 - RNA, 15 nt, Homo sapiens
cauauauuuaacuuu

SEQ ID NO: 1951032 - RNA, 23 nt, Homo sapiens
gcccugagcgaguggagucugcc

SEQ ID NO: 1951033 - RNA, 23 nt, Homo sapiens
augaucaccauguuagccuuaga

SEQ ID NO: 1951034 - RNA, 22 nt, Homo sapiens
ucaaugaucuagguuuaacuca

SEQ ID NO: 1951035 - RNA, 21 nt, Homo sapiens
ccaccucuaacagcaccaaau

SEQ ID NO: 1951036 - RNA, 22 nt, Homo sapiens
aggcucugcccugcccuagcuc

SEQ ID NO: 1951037 - RNA, 15 nt, Homo sapiens
uguuuuuucuugcca

SEQ ID NO: 1951038 - RNA, 20 nt, Homo sapiens
aagaugugauauucuaagac

SEQ ID NO: 1951039 - RNA, 15 nt, Homo sapiens
ugaccagccuugaca

SEQ ID NO: 1951040 - RNA, 13 nt, Homo sapiens
aucagcaucaucu

SEQ ID NO: 1951041 - RNA, 14 nt, Homo sapiens
gaauaaauuuggga

SEQ ID NO: 1951042 - RNA, 22 nt, Homo sapiens
acucagagcugcugaggacaau

SEQ ID NO: 1951043 - RNA, 17 nt, Homo sapiens
agacaacuugcuccuuu

SEQ ID NO: 1951044 - RNA, 23 nt, Homo sapiens
ggaaggcuguacgacacgggugg

SEQ ID NO: 1951045 - RNA, 13 nt, Homo sapiens
caacuucagcacc

SEQ ID NO: 1951046 - RNA, 17 nt, Homo sapiens
auuaguuggcuuucaua

SEQ ID NO: 1951047 - RNA, 16 nt, Homo sapiens
gcugucagcucaggug

SEQ ID NO: 1951048 - RNA, 15 nt, Homo sapiens
caaccagugccaagg

SEQ ID NO: 1951049 - RNA, 14 nt, Homo sapiens
ccugcaguggauga

SEQ ID NO: 1951050 - RNA, 22 nt, Homo sapiens
ugagcaauccugcaagaacaag

SEQ ID NO: 1951051 - RNA, 10 nt, Homo sapiens
ggacugggag

SEQ ID NO: 1951052 - RNA, 15 nt, Homo sapiens
ucagcaccugggacc

SEQ ID NO: 1951053 - RNA, 24 nt, Homo sapiens
agguguggcagaagcuugcagaug

SEQ ID NO: 1951054 - RNA, 24 nt, Homo sapiens
uuacagcugccugcaguacuuuac

SEQ ID NO: 1951055 - RNA, 12 nt, Homo sapiens
aaauuugcacug

SEQ ID NO: 1951056 - RNA, 23 nt, Homo sapiens
aagaggcuccagaaauguuugcu

SEQ ID NO: 1951057 - RNA, 19 nt, Homo sapiens
ccaagugaggccauagcaa

SEQ ID NO: 1951058 - RNA, 21 nt, Homo sapiens
uaaacaauuccuuacauuuac

SEQ ID NO: 1951059 - RNA, 23 nt, Homo sapiens
ucauuuuuaacagcaugcugcuu

SEQ ID NO: 1951060 - RNA, 18 nt, Homo sapiens
ggcagggugagaagcuag

SEQ ID NO: 1951061 - RNA, 14 nt, Homo sapiens
caucacuguauacc

SEQ ID NO: 1951062 - RNA, 13 nt, Homo sapiens
auucuaacauauu

SEQ ID NO: 1951063 - RNA, 16 nt, Homo sapiens
agaagugcaucuggag

SEQ ID NO: 1951064 - RNA, 16 nt, Homo sapiens
aucucuauaacagauc

SEQ ID NO: 1951065 - RNA, 17 nt, Homo sapiens
uauauaguaugaaugca

SEQ ID NO: 1951066 - RNA, 19 nt, Homo sapiens
ccugugggggcggcugugg

SEQ ID NO: 1951067 - RNA, 15 nt, Homo sapiens
ccuuaccaagggaag

SEQ ID NO: 1951068 - RNA, 16 nt, Homo sapiens
cuggcuguacugccaa

SEQ ID NO: 1951069 - RNA, 20 nt, Homo sapiens
uuuaucuaaauuaaagccuu

SEQ ID NO: 1951070 - RNA, 20 nt, Homo sapiens
ggucucacuauauugcucag

SEQ ID NO: 1951071 - RNA, 16 nt, Homo sapiens
agaagucauggcccaa

SEQ ID NO: 1951072 - RNA, 20 nt, Homo sapiens
ugaaauaaaagcacacugcu

SEQ ID NO: 1951073 - RNA, 17 nt, Homo sapiens
acgacaacgaugaugcu

SEQ ID NO: 1951074 - RNA, 14 nt, Homo sapiens
ggccacccaaacag

SEQ ID NO: 1951075 - RNA, 14 nt, Homo sapiens
uaaauccaaugaca

SEQ ID NO: 1951076 - RNA, 14 nt, Homo sapiens
auuccaccaagaca

SEQ ID NO: 1951077 - RNA, 15 nt, Homo sapiens
agcccagccuagccc

SEQ ID NO: 1951078 - RNA, 18 nt, Homo sapiens
ugaaugcuauuuucaaau

SEQ ID NO: 1951079 - RNA, 19 nt, Homo sapiens
gcucuuucucugagaacca

SEQ ID NO: 1951080 - RNA, 22 nt, Homo sapiens
aagccccuuacuaugaucucag

SEQ ID NO: 1951081 - RNA, 20 nt, Homo sapiens
agaucuaccccagggagaau

SEQ ID NO: 1951082 - RNA, 15 nt, Homo sapiens
ggacagccacagcca

SEQ ID NO: 1951083 - RNA, 18 nt, Homo sapiens
aaccacuucauucuugaa

SEQ ID NO: 1951084 - RNA, 14 nt, Homo sapiens
ccacagccaacaaa

SEQ ID NO: 1951085 - RNA, 22 nt, Homo sapiens
ccuccaggaaccacaccacauc

SEQ ID NO: 1951086 - RNA, 16 nt, Homo sapiens
aguaaauugcucuguu

SEQ ID NO: 1951087 - RNA, 18 nt, Homo sapiens
ugcuuuugaaaaacaacu

SEQ ID NO: 1951088 - RNA, 20 nt, Homo sapiens
gagaucauugcaaacucaac

SEQ ID NO: 1951089 - RNA, 23 nt, Homo sapiens
gagagcuuucuguccuuuuggca

SEQ ID NO: 1951090 - RNA, 17 nt, Homo sapiens
caaacuuuguuugucac

SEQ ID NO: 1951091 - RNA, 20 nt, Homo sapiens
gcagcgcgugcggugcaaag

SEQ ID NO: 1951092 - RNA, 19 nt, Homo sapiens
acaauuaaaccgcauguga

SEQ ID NO: 1951093 - RNA, 17 nt, Homo sapiens
guugcaggagcuggcug

SEQ ID NO: 1951094 - RNA, 17 nt, Homo sapiens
cucaccuguuacugaaa

SEQ ID NO: 1951095 - RNA, 21 nt, Homo sapiens
ugcugccagccacuucauccc

SEQ ID NO: 1951096 - RNA, 12 nt, Homo sapiens
acuccuguuacu

SEQ ID NO: 1951097 - RNA, 16 nt, Homo sapiens
caauaagauuuaguug

SEQ ID NO: 1951098 - RNA, 16 nt, Homo sapiens
acagucaccucacaaa

SEQ ID NO: 1951099 - RNA, 14 nt, Homo sapiens
aggcauuuccagac

SEQ ID NO: 1951100 - RNA, 19 nt, Homo sapiens
cccagggccuuaaaagcca

SEQ ID NO: 1951101 - RNA, 18 nt, Homo sapiens
agccgcgggccaggaggc

SEQ ID NO: 1951102 - RNA, 15 nt, Homo sapiens
aguuuuaaauaagcu

SEQ ID NO: 1951103 - RNA, 11 nt, Homo sapiens
gcaucuacucu

SEQ ID NO: 1951104 - RNA, 21 nt, Homo sapiens
accccaucccuggcugaccug

SEQ ID NO: 1951105 - RNA, 15 nt, Homo sapiens
augaucccagucacu

SEQ ID NO: 1951106 - RNA, 18 nt, Homo sapiens
aguauuauugagcucuau

SEQ ID NO: 1951107 - RNA, 22 nt, Homo sapiens
ugauuuuggggagacaaaggga

SEQ ID NO: 1951108 - RNA, 20 nt, Homo sapiens
guuaugcauagcuuugcacu

SEQ ID NO: 1951109 - RNA, 17 nt, Homo sapiens
cugucaaaucuaguuuc

SEQ ID NO: 1951110 - RNA, 15 nt, Homo sapiens
agagcccaggagcuc

SEQ ID NO: 1951111 - RNA, 11 nt, Homo sapiens
aaaagugcucc

SEQ ID NO: 1951112 - RNA, 17 nt, Homo sapiens
uagugucucauguggaa

SEQ ID NO: 1951113 - RNA, 23 nt, Homo sapiens
cucuuaguuuuuaaaaaggccuu

SEQ ID NO: 1951114 - RNA, 16 nt, Homo sapiens
gacaucaagcucaagg

SEQ ID NO: 1951115 - RNA, 18 nt, Homo sapiens
gaacuucuccuacuguag

SEQ ID NO: 1951116 - RNA, 21 nt, Homo sapiens
aagaccggggugacaagcaga

SEQ ID NO: 1951117 - RNA, 15 nt, Homo sapiens
aguacucuuaacucc

SEQ ID NO: 1951118 - RNA, 16 nt, Homo sapiens
guguccagcauugcug

SEQ ID NO: 1951119 - RNA, 23 nt, Homo sapiens
guuugauugaggagcugcacuga

SEQ ID NO: 1951120 - RNA, 16 nt, Homo sapiens
ugaaucuucccuguca

SEQ ID NO: 1951121 - RNA, 17 nt, Homo sapiens
gccuguugaagguacau

SEQ ID NO: 1951122 - RNA, 18 nt, Homo sapiens
aauuuugguuacuugaau

SEQ ID NO: 1951123 - RNA, 18 nt, Homo sapiens
aaaugugagggugguggg

SEQ ID NO: 1951124 - RNA, 16 nt, Homo sapiens
aggcagaaggccagga

SEQ ID NO: 1951125 - RNA, 16 nt, Homo sapiens
auguuuaaauagccua

SEQ ID NO: 1951126 - RNA, 23 nt, Homo sapiens
gaaggggcaaagaaaagccagag

SEQ ID NO: 1951127 - RNA, 22 nt, Homo sapiens
cacccagacuggaaugcaguga

SEQ ID NO: 1951128 - RNA, 20 nt, Homo sapiens
gaauacccaggaagacuuug

SEQ ID NO: 1951129 - RNA, 16 nt, Homo sapiens
ugaguaccucaaagga

SEQ ID NO: 1951130 - RNA, 14 nt, Homo sapiens
ccacccccaaacac

SEQ ID NO: 1951131 - RNA, 19 nt, Homo sapiens
auccucuuccuccccaguc

SEQ ID NO: 1951132 - RNA, 14 nt, Homo sapiens
aaacaccuccucau

SEQ ID NO: 1951133 - RNA, 21 nt, Homo sapiens
cuauguuuggcuucaguguuu

SEQ ID NO: 1951134 - RNA, 17 nt, Homo sapiens
gccacauccaacauuuc

SEQ ID NO: 1951135 - RNA, 11 nt, Homo sapiens
cagauucugug

SEQ ID NO: 1951136 - RNA, 15 nt, Homo sapiens
ccuagggcaccaggg

SEQ ID NO: 1951137 - RNA, 22 nt, Homo sapiens
agcaacuaucagacuaagccag

SEQ ID NO: 1951138 - RNA, 19 nt, Homo sapiens
auuuguaggaggaugugau

SEQ ID NO: 1951139 - RNA, 17 nt, Homo sapiens
auguucuaauacuuugu

SEQ ID NO: 1951140 - RNA, 19 nt, Homo sapiens
uccacaaagcaaaggcagu

SEQ ID NO: 1951141 - RNA, 18 nt, Homo sapiens
cuucagggccuugcugcu

SEQ ID NO: 1951142 - RNA, 20 nt, Homo sapiens
cuguucugaaaggagacauu

SEQ ID NO: 1951143 - RNA, 22 nt, Homo sapiens
uacagauguacaauuuagcuua

SEQ ID NO: 1951144 - RNA, 14 nt, Homo sapiens
ucuucuucauugaa

SEQ ID NO: 1951145 - RNA, 20 nt, Homo sapiens
ugggagauucaagggaccca

SEQ ID NO: 1951146 - RNA, 15 nt, Homo sapiens
auuuacaaaccucuc

SEQ ID NO: 1951147 - RNA, 15 nt, Homo sapiens
gaaguugauaugccu

SEQ ID NO: 1951148 - RNA, 18 nt, Homo sapiens
gccagaggcucuaaugua

SEQ ID NO: 1951149 - RNA, 16 nt, Homo sapiens
cugcuaugccauuucu

SEQ ID NO: 1951150 - RNA, 14 nt, Homo sapiens
cuggauucuaucua

SEQ ID NO: 1951151 - RNA, 20 nt, Homo sapiens
gcucucaguuaaaaugugag

SEQ ID NO: 1951152 - RNA, 13 nt, Homo sapiens
uccaaucagguag

SEQ ID NO: 1951153 - RNA, 21 nt, Homo sapiens
gccugcaccucuccagcuccu

SEQ ID NO: 1951154 - RNA, 18 nt, Homo sapiens
gaccuaguauaucaguga

SEQ ID NO: 1951155 - RNA, 10 nt, Homo sapiens
aguagcucag

SEQ ID NO: 1951156 - RNA, 21 nt, Homo sapiens
uucaggggugacucagaagaa

SEQ ID NO: 1951157 - RNA, 15 nt, Homo sapiens
agaggauggcuuccc

SEQ ID NO: 1951158 - RNA, 14 nt, Homo sapiens
uagcagacaggccc

SEQ ID NO: 1951159 - RNA, 23 nt, Homo sapiens
ugcaccuuacaacucggggacaa

SEQ ID NO: 1951160 - RNA, 15 nt, Homo sapiens
aagauuuggaaaauu

SEQ ID NO: 1951161 - RNA, 18 nt, Homo sapiens
cuuaauucccaaucccau

SEQ ID NO: 1951162 - RNA, 14 nt, Homo sapiens
ggaaggagugagau

SEQ ID NO: 1951163 - RNA, 17 nt, Homo sapiens
uugccuuccuuucucca

SEQ ID NO: 1951164 - RNA, 21 nt, Homo sapiens
ccauuuggcaaugccaucauc

SEQ ID NO: 1951165 - RNA, 20 nt, Homo sapiens
aauguucauucuaugacaau

SEQ ID NO: 1951166 - RNA, 15 nt, Homo sapiens
caaccccugcuuccc

SEQ ID NO: 1951167 - RNA, 20 nt, Homo sapiens
uacaaacaagcacagacauu

SEQ ID NO: 1951168 - RNA, 16 nt, Homo sapiens
cuggccuuauaucauu

SEQ ID NO: 1951169 - RNA, 16 nt, Homo sapiens
ggagaaaucacagaga

SEQ ID NO: 1951170 - RNA, 16 nt, Homo sapiens
auaaugaggaguuuau

SEQ ID NO: 1951171 - RNA, 15 nt, Homo sapiens
ucuucccuuaccuca

SEQ ID NO: 1951172 - RNA, 14 nt, Homo sapiens
ugcccaguguucuc

SEQ ID NO: 1951173 - RNA, 14 nt, Homo sapiens
caauaacacugucu

SEQ ID NO: 1951174 - RNA, 15 nt, Homo sapiens
augauuuaggcuucu

SEQ ID NO: 1951175 - RNA, 17 nt, Homo sapiens
agguuuuguaaaacugu

SEQ ID NO: 1951176 - RNA, 15 nt, Homo sapiens
cuggacgacacggcc

SEQ ID NO: 1951177 - RNA, 15 nt, Homo sapiens
cucaaacacagagag

SEQ ID NO: 1951178 - RNA, 17 nt, Homo sapiens
cagaguccuugcaaaau

SEQ ID NO: 1951179 - RNA, 14 nt, Homo sapiens
ggcagcuucgugug

SEQ ID NO: 1951180 - RNA, 18 nt, Homo sapiens
cagauuccgcaccaauaa

SEQ ID NO: 1951181 - RNA, 16 nt, Homo sapiens
uuuccagcuacuuuug

SEQ ID NO: 1951182 - RNA, 15 nt, Homo sapiens
aagccgugauuuuca

SEQ ID NO: 1951183 - RNA, 17 nt, Homo sapiens
uaaccaaacaaugcaga

SEQ ID NO: 1951184 - RNA, 21 nt, Homo sapiens
ucugccaagucaguucucuuu

SEQ ID NO: 1951185 - RNA, 20 nt, Homo sapiens
ucauuccccuuugcacugua

SEQ ID NO: 1951186 - RNA, 21 nt, Homo sapiens
ccugacuguauacagaaugaa

SEQ ID NO: 1951187 - RNA, 17 nt, Homo sapiens
acuguguuucaaguuca

SEQ ID NO: 1951188 - RNA, 20 nt, Homo sapiens
cuuuuauuucuucaccagau

SEQ ID NO: 1951189 - RNA, 14 nt, Homo sapiens
uccaguacugggag

SEQ ID NO: 1951190 - RNA, 19 nt, Homo sapiens
ugacuuguuugucuuccau

SEQ ID NO: 1951191 - RNA, 21 nt, Homo sapiens
gccuguaaucccaacuacuca

SEQ ID NO: 1951192 - RNA, 11 nt, Homo sapiens
ugccacgcagg

SEQ ID NO: 1951193 - RNA, 20 nt, Homo sapiens
ugagggagggccaagcccag

SEQ ID NO: 1951194 - RNA, 20 nt, Homo sapiens
aagaaggacugaacuccauc

SEQ ID NO: 1951195 - RNA, 20 nt, Homo sapiens
aacuuugcuucuccaaauac

SEQ ID NO: 1951196 - RNA, 22 nt, Homo sapiens
uggacacgguaacuguugcagu

SEQ ID NO: 1951197 - RNA, 15 nt, Homo sapiens
uuguuucacaaacag

SEQ ID NO: 1951198 - RNA, 18 nt, Homo sapiens
gaaggcccugcugaguca

SEQ ID NO: 1951199 - RNA, 18 nt, Homo sapiens
aaaugguaggcauuuccu

SEQ ID NO: 1951200 - RNA, 14 nt, Homo sapiens
uacuguugugaaaa

SEQ ID NO: 1951201 - RNA, 17 nt, Homo sapiens
cuccucuuuuucugugu

SEQ ID NO: 1951202 - RNA, 12 nt, Homo sapiens
gaaaacugcuga

SEQ ID NO: 1951203 - RNA, 20 nt, Homo sapiens
aaguacaccaaaugaucuca

SEQ ID NO: 1951204 - RNA, 20 nt, Homo sapiens
ugacucuuuccuaaagccaa

SEQ ID NO: 1951205 - RNA, 19 nt, Homo sapiens
gcuacauuuccgccacauc

SEQ ID NO: 1951206 - RNA, 16 nt, Homo sapiens
gaaugaagcguugcca

SEQ ID NO: 1951207 - RNA, 22 nt, Homo sapiens
gaaaaggcacgcuggcuuguga

SEQ ID NO: 1951208 - RNA, 19 nt, Homo sapiens
auuaguuccccuacuacac

SEQ ID NO: 1951209 - RNA, 20 nt, Homo sapiens
uuucugccaccaaaggccag

SEQ ID NO: 1951210 - RNA, 15 nt, Homo sapiens
cgauaucaccaugau

SEQ ID NO: 1951211 - RNA, 21 nt, Homo sapiens
ugggaccacgugagaucauuc

SEQ ID NO: 1951212 - RNA, 20 nt, Homo sapiens
cugcagcugcuuguugucaa

SEQ ID NO: 1951213 - RNA, 13 nt, Homo sapiens
acuugaaaccugg

SEQ ID NO: 1951214 - RNA, 13 nt, Homo sapiens
aauguaaacauuu

SEQ ID NO: 1951215 - RNA, 12 nt, Homo sapiens
auuuuaagacaa

SEQ ID NO: 1951216 - RNA, 19 nt, Homo sapiens
uuguaaaagaugcagagua

SEQ ID NO: 1951217 - RNA, 17 nt, Homo sapiens
aucagaccacauuugaa

SEQ ID NO: 1951218 - RNA, 16 nt, Homo sapiens
uagcuggccacugcug

SEQ ID NO: 1951219 - RNA, 15 nt, Homo sapiens
uacacacauauacau

SEQ ID NO: 1951220 - RNA, 15 nt, Homo sapiens
aaaauugacaaugau

SEQ ID NO: 1951221 - RNA, 18 nt, Homo sapiens
aagcaaauuaguaauugu

SEQ ID NO: 1951222 - RNA, 19 nt, Homo sapiens
ggauguugaacuggucauu

SEQ ID NO: 1951223 - RNA, 16 nt, Homo sapiens
auugauacguuuauua

SEQ ID NO: 1951224 - RNA, 18 nt, Homo sapiens
caucauccuccauugcuc

SEQ ID NO: 1951225 - RNA, 16 nt, Homo sapiens
cauaugugaagacaga

SEQ ID NO: 1951226 - RNA, 23 nt, Homo sapiens
accuggacauuccccauccugca

SEQ ID NO: 1951227 - RNA, 20 nt, Homo sapiens
ucuggucaaccccacaagca

SEQ ID NO: 1951228 - RNA, 17 nt, Homo sapiens
uuuaaauaaauccaaaa

SEQ ID NO: 1951229 - RNA, 18 nt, Homo sapiens
gauagacagguccugauu

SEQ ID NO: 1951230 - RNA, 19 nt, Homo sapiens
agacacgugugagugguca

SEQ ID NO: 1951231 - RNA, 12 nt, Homo sapiens
auuaguuuacau

SEQ ID NO: 1951232 - RNA, 17 nt, Homo sapiens
gaagacuauauuguaca

SEQ ID NO: 1951233 - RNA, 20 nt, Homo sapiens
augcauaaaaaaaugaugca

SEQ ID NO: 1951234 - RNA, 15 nt, Homo sapiens
acugccugcccagug

SEQ ID NO: 1951235 - RNA, 13 nt, Homo sapiens
cccaagaccuaag

SEQ ID NO: 1951236 - RNA, 17 nt, Homo sapiens
uggccuugguguaaaau

SEQ ID NO: 1951237 - RNA, 15 nt, Homo sapiens
uccaugauacuuuaa

SEQ ID NO: 1951238 - RNA, 15 nt, Homo sapiens
ucuggugacaccagc

SEQ ID NO: 1951239 - RNA, 19 nt, Homo sapiens
aaauuauaucaaggucuca

SEQ ID NO: 1951240 - RNA, 17 nt, Homo sapiens
caaaacuaaccaucuga

SEQ ID NO: 1951241 - RNA, 12 nt, Homo sapiens
gacccagggucc

SEQ ID NO: 1951242 - RNA, 18 nt, Homo sapiens
gaaguggcccucccucag

SEQ ID NO: 1951243 - RNA, 23 nt, Homo sapiens
acagaaccuucaacccagugggu

SEQ ID NO: 1951244 - RNA, 18 nt, Homo sapiens
auuuuuacauaauugcca

SEQ ID NO: 1951245 - RNA, 15 nt, Homo sapiens
augggggcaagaaga

SEQ ID NO: 1951246 - RNA, 14 nt, Homo sapiens
uaccagaugcugac

SEQ ID NO: 1951247 - RNA, 22 nt, Homo sapiens
uuccuuuauuuaggaaacacca

SEQ ID NO: 1951248 - RNA, 18 nt, Homo sapiens
caggagcuagagccauuu

SEQ ID NO: 1951249 - RNA, 20 nt, Homo sapiens
gggaaacccugcuguuucau

SEQ ID NO: 1951250 - RNA, 14 nt, Homo sapiens
gaagaggucugauu

SEQ ID NO: 1951251 - RNA, 23 nt, Homo sapiens
cugcauguaaacacgccugcaaa

SEQ ID NO: 1951252 - RNA, 17 nt, Homo sapiens
augugauggacacucca

SEQ ID NO: 1951253 - RNA, 18 nt, Homo sapiens
ggauucaacacugugcac

SEQ ID NO: 1951254 - RNA, 14 nt, Homo sapiens
acaccccucccaca

SEQ ID NO: 1951255 - RNA, 14 nt, Homo sapiens
auccgacucuaagc

SEQ ID NO: 1951256 - RNA, 16 nt, Homo sapiens
aaucaauguguacaag

SEQ ID NO: 1951257 - RNA, 22 nt, Homo sapiens
ugccugcagaggucugugcuga

SEQ ID NO: 1951258 - RNA, 21 nt, Homo sapiens
ccauaaccccaggcaucccau

SEQ ID NO: 1951259 - RNA, 17 nt, Homo sapiens
gacuacauguuacuaag

SEQ ID NO: 1951260 - RNA, 15 nt, Homo sapiens
gccaccuacaauaca

SEQ ID NO: 1951261 - RNA, 18 nt, Homo sapiens
uuuucugucuuuauguaa

SEQ ID NO: 1951262 - RNA, 17 nt, Homo sapiens
aauauguaacagccaaa

SEQ ID NO: 1951263 - RNA, 20 nt, Homo sapiens
auuugcugcucuucauccca

SEQ ID NO: 1951264 - RNA, 14 nt, Homo sapiens
ugugaaaacucugg

SEQ ID NO: 1951265 - RNA, 24 nt, Homo sapiens
gaaggaugggaaaaacugcaguca

SEQ ID NO: 1951266 - RNA, 21 nt, Homo sapiens
aauaagauuuaguugaguuau

SEQ ID NO: 1951267 - RNA, 17 nt, Homo sapiens
aaaucuauucuguguug

SEQ ID NO: 1951268 - RNA, 20 nt, Homo sapiens
aacuuuggaguccccucacc

SEQ ID NO: 1951269 - RNA, 23 nt, Homo sapiens
uccucaaaccuaccacucaggaa

SEQ ID NO: 1951270 - RNA, 18 nt, Homo sapiens
aaaaucacauccuggccu

SEQ ID NO: 1951271 - RNA, 13 nt, Homo sapiens
uccagaugccuuc

SEQ ID NO: 1951272 - RNA, 19 nt, Homo sapiens
ggacaaagaaauuccccaa

SEQ ID NO: 1951273 - RNA, 20 nt, Homo sapiens
uacugaagaaggugcauuga

SEQ ID NO: 1951274 - RNA, 20 nt, Homo sapiens
ugcaguggcccccacagaaa

SEQ ID NO: 1951275 - RNA, 12 nt, Homo sapiens
cuauuacuauua

SEQ ID NO: 1951276 - RNA, 17 nt, Homo sapiens
acaagauuuccuacuuu

SEQ ID NO: 1951277 - RNA, 16 nt, Homo sapiens
agacaguauauaacua

SEQ ID NO: 1951278 - RNA, 15 nt, Homo sapiens
uccgcaugugucugu

SEQ ID NO: 1951279 - RNA, 20 nt, Homo sapiens
gauggcauuuggucucaggc

SEQ ID NO: 1951280 - RNA, 14 nt, Homo sapiens
agaacugcagucag

SEQ ID NO: 1951281 - RNA, 15 nt, Homo sapiens
gcaggaagcucagac

SEQ ID NO: 1951282 - RNA, 12 nt, Homo sapiens
gaaagagacaca

SEQ ID NO: 1951283 - RNA, 20 nt, Homo sapiens
caaggaaacccccaguguaa

SEQ ID NO: 1951284 - RNA, 13 nt, Homo sapiens
gcuucagccuccc

SEQ ID NO: 1951285 - RNA, 18 nt, Homo sapiens
acagcuaaguguggagcu

SEQ ID NO: 1951286 - RNA, 20 nt, Homo sapiens
cccaucagugcucuguaaaa

SEQ ID NO: 1951287 - RNA, 14 nt, Homo sapiens
aguacuggcauggu

SEQ ID NO: 1951288 - RNA, 13 nt, Homo sapiens
gcgagcagucagc

SEQ ID NO: 1951289 - RNA, 19 nt, Homo sapiens
gaacuccagcuggugcccc

SEQ ID NO: 1951290 - RNA, 12 nt, Homo sapiens
cuauacaaccua

SEQ ID NO: 1951291 - RNA, 18 nt, Homo sapiens
aauacaaacaccuggacu

SEQ ID NO: 1951292 - RNA, 13 nt, Homo sapiens
uuuuucugaugau

SEQ ID NO: 1951293 - RNA, 21 nt, Homo sapiens
ggaaguuaguuuuuaaucucu

SEQ ID NO: 1951294 - RNA, 16 nt, Homo sapiens
aaggccuucuucccaa

SEQ ID NO: 1951295 - RNA, 14 nt, Homo sapiens
cacacacacaaaaa

SEQ ID NO: 1951296 - RNA, 14 nt, Homo sapiens
agaccucaagccau

SEQ ID NO: 1951297 - RNA, 22 nt, Homo sapiens
aagcuucaauagaacuguuuca

SEQ ID NO: 1951298 - RNA, 20 nt, Homo sapiens
cuuaaucugccauaaagcca

SEQ ID NO: 1951299 - RNA, 15 nt, Homo sapiens
ucucauguccugcug

SEQ ID NO: 1951300 - RNA, 20 nt, Homo sapiens
uguguggaggccucagggag

SEQ ID NO: 1951301 - RNA, 16 nt, Homo sapiens
acagaugcugagccau

SEQ ID NO: 1951302 - RNA, 20 nt, Homo sapiens
uggaaauaacggguggcauu

SEQ ID NO: 1951303 - RNA, 20 nt, Homo sapiens
cacccagacuggagugcagu

SEQ ID NO: 1951304 - RNA, 20 nt, Homo sapiens
cacccaggcuggaguacagu

SEQ ID NO: 1951305 - RNA, 21 nt, Homo sapiens
aggucaguaaugcugcaggaa

SEQ ID NO: 1951306 - RNA, 12 nt, Homo sapiens
auccuuacaaau

SEQ ID NO: 1951307 - RNA, 12 nt, Homo sapiens
aucuuuacaaac

SEQ ID NO: 1951308 - RNA, 15 nt, Homo sapiens
gacaauggacuguac

SEQ ID NO: 1951309 - RNA, 22 nt, Homo sapiens
auuuucagucauaaaagcuuua

SEQ ID NO: 1951310 - RNA, 16 nt, Homo sapiens
gagucuuuguaaugcu

SEQ ID NO: 1951311 - RNA, 17 nt, Homo sapiens
uagaauuuugaguauuc

SEQ ID NO: 1951312 - RNA, 23 nt, Homo sapiens
gacaggcccaagagaugaagagu

SEQ ID NO: 1951313 - RNA, 22 nt, Homo sapiens
augagcaaauggugcugaauac

SEQ ID NO: 1951314 - RNA, 22 nt, Homo sapiens
acagcacccuauauacacuugg

SEQ ID NO: 1951315 - RNA, 10 nt, Homo sapiens
aguaagccac

SEQ ID NO: 1951316 - RNA, 17 nt, Homo sapiens
agacuccgucucaagga

SEQ ID NO: 1951317 - RNA, 19 nt, Homo sapiens
augccaaacacuagcucug

SEQ ID NO: 1951318 - RNA, 21 nt, Homo sapiens
gacaaaaagcacuaguauaaa

SEQ ID NO: 1951319 - RNA, 12 nt, Homo sapiens
gaugccaugaag

SEQ ID NO: 1951320 - RNA, 20 nt, Homo sapiens
guccugaaggaaaaugacuc

SEQ ID NO: 1951321 - RNA, 13 nt, Homo sapiens
ccuaagagauucu

SEQ ID NO: 1951322 - RNA, 12 nt, Homo sapiens
ugacaguagcau

SEQ ID NO: 1951323 - RNA, 12 nt, Homo sapiens
cacaagcucaga

SEQ ID NO: 1951324 - RNA, 13 nt, Homo sapiens
auaacagcauucu

SEQ ID NO: 1951325 - RNA, 17 nt, Homo sapiens
ugcgaaguggcucucag

SEQ ID NO: 1951326 - RNA, 17 nt, Homo sapiens
aaaaugcacccaucagc

SEQ ID NO: 1951327 - RNA, 15 nt, Homo sapiens
gacgagguuucacug

SEQ ID NO: 1951328 - RNA, 20 nt, Homo sapiens
ucuauuuucccucgcugggg

SEQ ID NO: 1951329 - RNA, 17 nt, Homo sapiens
cuuuuucuuugaauuua

SEQ ID NO: 1951330 - RNA, 22 nt, Homo sapiens
uucgcuauucgccagcagacau

SEQ ID NO: 1951331 - RNA, 12 nt, Homo sapiens
gcaauacuguag

SEQ ID NO: 1951332 - RNA, 16 nt, Homo sapiens
ugauuuccauuugcaa

SEQ ID NO: 1951333 - RNA, 18 nt, Homo sapiens
agacacagcccugaauca

SEQ ID NO: 1951334 - RNA, 17 nt, Homo sapiens
uucuaagaaccaaaaaa

SEQ ID NO: 1951335 - RNA, 17 nt, Homo sapiens
uuauaaaagcaaaagag

SEQ ID NO: 1951336 - RNA, 19 nt, Homo sapiens
augcuauugaaaaugugaa

SEQ ID NO: 1951337 - RNA, 22 nt, Homo sapiens
cucagccuuccuccucauccuc

SEQ ID NO: 1951338 - RNA, 13 nt, Homo sapiens
cugggucuuucau

SEQ ID NO: 1951339 - RNA, 20 nt, Homo sapiens
guuuaaacauaggaaagaag

SEQ ID NO: 1951340 - RNA, 15 nt, Homo sapiens
cuguaaugacaaaua

SEQ ID NO: 1951341 - RNA, 14 nt, Homo sapiens
cugugucacuguau

SEQ ID NO: 1951342 - RNA, 14 nt, Homo sapiens
auuugucaauuuau

SEQ ID NO: 1951343 - RNA, 19 nt, Homo sapiens
gaucagauugcaugugacu

SEQ ID NO: 1951344 - RNA, 15 nt, Homo sapiens
aacaugcucaugugu

SEQ ID NO: 1951345 - RNA, 23 nt, Homo sapiens
cagaucuggucuaguuaaccuag

SEQ ID NO: 1951346 - RNA, 23 nt, Homo sapiens
uggacucauugcuucacaaccca

SEQ ID NO: 1951347 - RNA, 23 nt, Homo sapiens
gucucaggacagaaccacugagu

SEQ ID NO: 1951348 - RNA, 12 nt, Homo sapiens
acauaucuagua

SEQ ID NO: 1951349 - RNA, 17 nt, Homo sapiens
guggccggcaucuggcc

SEQ ID NO: 1951350 - RNA, 19 nt, Homo sapiens
cugccacuguguacugugg

SEQ ID NO: 1951351 - RNA, 14 nt, Homo sapiens
gcccagcuauacug

SEQ ID NO: 1951352 - RNA, 16 nt, Homo sapiens
uaaucacaaauuucac

SEQ ID NO: 1951353 - RNA, 16 nt, Homo sapiens
uugcgcucucaagacc

SEQ ID NO: 1951354 - RNA, 14 nt, Homo sapiens
uguuauaaagacac

SEQ ID NO: 1951355 - RNA, 14 nt, Homo sapiens
caguuuuuggcaaa

SEQ ID NO: 1951356 - RNA, 21 nt, Homo sapiens
acugcauaaaaagugccugua

SEQ ID NO: 1951357 - RNA, 17 nt, Homo sapiens
uaguuauuucugccuau

SEQ ID NO: 1951358 - RNA, 21 nt, Homo sapiens
caagcucucagcaagugccca

SEQ ID NO: 1951359 - RNA, 23 nt, Homo sapiens
caguugguuuggauuuuuggacc

SEQ ID NO: 1951360 - RNA, 14 nt, Homo sapiens
guuucaaaccugca

SEQ ID NO: 1951361 - RNA, 16 nt, Homo sapiens
ucaagauuugaccaaa

SEQ ID NO: 1951362 - RNA, 21 nt, Homo sapiens
auuguacauauuuguggaaua

SEQ ID NO: 1951363 - RNA, 24 nt, Homo sapiens
agaaacuaccuuuuuauaaugcac

SEQ ID NO: 1951364 - RNA, 23 nt, Homo sapiens
uuugguagagauggagucuugcu

SEQ ID NO: 1951365 - RNA, 19 nt, Homo sapiens
cugcucacuguucuaucuc

SEQ ID NO: 1951366 - RNA, 19 nt, Homo sapiens
accuucaccaucuguauau

SEQ ID NO: 1951367 - RNA, 22 nt, Homo sapiens
acccagguuggcgacugcaaca

SEQ ID NO: 1951368 - RNA, 18 nt, Homo sapiens
cagaacugaagagacuag

SEQ ID NO: 1951369 - RNA, 23 nt, Homo sapiens
ucccaccuccauuugcaauugac

SEQ ID NO: 1951370 - RNA, 14 nt, Homo sapiens
cauggccauggucc

SEQ ID NO: 1951371 - RNA, 13 nt, Homo sapiens
acccacaaacucc

SEQ ID NO: 1951372 - RNA, 19 nt, Homo sapiens
cuggcugggcuuuggggcu

SEQ ID NO: 1951373 - RNA, 17 nt, Homo sapiens
cuagauuuauaaaugca

SEQ ID NO: 1951374 - RNA, 14 nt, Homo sapiens
acagauacuccucc

SEQ ID NO: 1951375 - RNA, 15 nt, Homo sapiens
gaacauuauuuaaua

SEQ ID NO: 1951376 - RNA, 20 nt, Homo sapiens
ccugcuguauccagaagcca

SEQ ID NO: 1951377 - RNA, 11 nt, Homo sapiens
cuuuaucucac

SEQ ID NO: 1951378 - RNA, 23 nt, Homo sapiens
gagaaaucauuauuaaaugaagc

SEQ ID NO: 1951379 - RNA, 14 nt, Homo sapiens
uauuacauugcugc

SEQ ID NO: 1951380 - RNA, 17 nt, Homo sapiens
augauuuccgucaugcu

SEQ ID NO: 1951381 - RNA, 22 nt, Homo sapiens
guucacguuguucacaucccau

SEQ ID NO: 1951382 - RNA, 17 nt, Homo sapiens
cuuuugaaaaacaacug

SEQ ID NO: 1951383 - RNA, 21 nt, Homo sapiens
ccagccuggguaacagaguga

SEQ ID NO: 1951384 - RNA, 20 nt, Homo sapiens
aaggaauagaagcaaauuaa

SEQ ID NO: 1951385 - RNA, 20 nt, Homo sapiens
aguuauuacugucucuggca

SEQ ID NO: 1951386 - RNA, 18 nt, Homo sapiens
cacacagauggucacaca

SEQ ID NO: 1951387 - RNA, 23 nt, Homo sapiens
uugucuaugaauaugaucccuaa

SEQ ID NO: 1951388 - RNA, 19 nt, Homo sapiens
gcuucuggaacccagaaga

SEQ ID NO: 1951389 - RNA, 20 nt, Homo sapiens
cagaggggugcgcagagcug

SEQ ID NO: 1951390 - RNA, 14 nt, Homo sapiens
gugagagcugggau

SEQ ID NO: 1951391 - RNA, 15 nt, Homo sapiens
gggcucuguggcaaa

SEQ ID NO: 1951392 - RNA, 14 nt, Homo sapiens
agugccuuuaguuu

SEQ ID NO: 1951393 - RNA, 21 nt, Homo sapiens
uaaauucacagcgcuaugcaa

SEQ ID NO: 1951394 - RNA, 16 nt, Homo sapiens
ggaaucuucaccucag

SEQ ID NO: 1951395 - RNA, 23 nt, Homo sapiens
aggagcuuucucaaugucuuccc

SEQ ID NO: 1951396 - RNA, 15 nt, Homo sapiens
ugacaaggagcacaa

SEQ ID NO: 1951397 - RNA, 15 nt, Homo sapiens
uccaagagacaugcu

SEQ ID NO: 1951398 - RNA, 21 nt, Homo sapiens
ugccuguuaaggaaacuuuau

SEQ ID NO: 1951399 - RNA, 22 nt, Homo sapiens
uuuuauugcuucuuuuuggaga

SEQ ID NO: 1951400 - RNA, 21 nt, Homo sapiens
cgcuguauuccaaggccugug

SEQ ID NO: 1951401 - RNA, 15 nt, Homo sapiens
augcuaucucugugu

SEQ ID NO: 1951402 - RNA, 14 nt, Homo sapiens
ggaccagaaggcaa

SEQ ID NO: 1951403 - RNA, 16 nt, Homo sapiens
cuaaaugaugccuuug

SEQ ID NO: 1951404 - RNA, 19 nt, Homo sapiens
cauucuaaugauggcccau

SEQ ID NO: 1951405 - RNA, 17 nt, Homo sapiens
cgaggagugacugccaa

SEQ ID NO: 1951406 - RNA, 15 nt, Homo sapiens
ugcugggaccagagc

SEQ ID NO: 1951407 - RNA, 14 nt, Homo sapiens
cauaccuacauuca

SEQ ID NO: 1951408 - RNA, 16 nt, Homo sapiens
cagagaccugggagca

SEQ ID NO: 1951409 - RNA, 16 nt, Homo sapiens
aguagggguugaagaa

SEQ ID NO: 1951410 - RNA, 23 nt, Homo sapiens
gccuaaaaguuacuuaccacaga

SEQ ID NO: 1951411 - RNA, 15 nt, Homo sapiens
cuuagcauacauuca

SEQ ID NO: 1951412 - RNA, 14 nt, Homo sapiens
ucaaagaucuuucg

SEQ ID NO: 1951413 - RNA, 22 nt, Homo sapiens
gcucgcuuccgcauccuagucu

SEQ ID NO: 1951414 - RNA, 14 nt, Homo sapiens
cagguggugcaaau

SEQ ID NO: 1951415 - RNA, 17 nt, Homo sapiens
aaauacacuugugauua

SEQ ID NO: 1951416 - RNA, 19 nt, Homo sapiens
caagcauauguuagcauua

SEQ ID NO: 1951417 - RNA, 14 nt, Homo sapiens
acagaucccgggga

SEQ ID NO: 1951418 - RNA, 13 nt, Homo sapiens
gaacaacaacaac

SEQ ID NO: 1951419 - RNA, 18 nt, Homo sapiens
cuuuuccacuuguuaaaa

SEQ ID NO: 1951420 - RNA, 19 nt, Homo sapiens
gaaaugaacaaacuaugua

SEQ ID NO: 1951421 - RNA, 14 nt, Homo sapiens
cacacucuggucuu

SEQ ID NO: 1951422 - RNA, 13 nt, Homo sapiens
gcaagguguuucu

SEQ ID NO: 1951423 - RNA, 16 nt, Homo sapiens
caauuuugauagucug

SEQ ID NO: 1951424 - RNA, 13 nt, Homo sapiens
agugaggggaaca

SEQ ID NO: 1951425 - RNA, 11 nt, Homo sapiens
uugucugagac

SEQ ID NO: 1951426 - RNA, 19 nt, Homo sapiens
aauuauaagaggauaugaa

SEQ ID NO: 1951427 - RNA, 21 nt, Homo sapiens
ccucaucuuugacguggagcu

SEQ ID NO: 1951428 - RNA, 17 nt, Homo sapiens
ccccaucugguccaguu

SEQ ID NO: 1951429 - RNA, 20 nt, Homo sapiens
guauuuaacuacaucugccu

SEQ ID NO: 1951430 - RNA, 18 nt, Homo sapiens
agacauucauugucccug

SEQ ID NO: 1951431 - RNA, 16 nt, Homo sapiens
uaccccuuugcacuug

SEQ ID NO: 1951432 - RNA, 24 nt, Homo sapiens
ucuuuaaguauuuguuccugccac

SEQ ID NO: 1951433 - RNA, 22 nt, Homo sapiens
agagacugcagggguccacugu

SEQ ID NO: 1951434 - RNA, 16 nt, Homo sapiens
uuugacucaguuccag

SEQ ID NO: 1951435 - RNA, 22 nt, Homo sapiens
ggauggccacaaguucuuuccc

SEQ ID NO: 1951436 - RNA, 16 nt, Homo sapiens
aaugcccuucacuguc

SEQ ID NO: 1951437 - RNA, 20 nt, Homo sapiens
uugcuccagauucugaugca

SEQ ID NO: 1951438 - RNA, 18 nt, Homo sapiens
ucauguugaucauguacu

SEQ ID NO: 1951439 - RNA, 19 nt, Homo sapiens
aaugcccuuuaacuuucua

SEQ ID NO: 1951440 - RNA, 17 nt, Homo sapiens
agcccugcagccaaaca

SEQ ID NO: 1951441 - RNA, 16 nt, Homo sapiens
uucacauuuguauuaa

SEQ ID NO: 1951442 - RNA, 21 nt, Homo sapiens
gccuuuguaagacacacagcc

SEQ ID NO: 1951443 - RNA, 18 nt, Homo sapiens
aaaccccuucuuuacuuc

SEQ ID NO: 1951444 - RNA, 19 nt, Homo sapiens
gaguggucaggcaucuucc

SEQ ID NO: 1951445 - RNA, 17 nt, Homo sapiens
gaaacagauuccauuaa

SEQ ID NO: 1951446 - RNA, 23 nt, Homo sapiens
gaaugaaagauuaaacagaugau

SEQ ID NO: 1951447 - RNA, 13 nt, Homo sapiens
cuccaacuggauu

SEQ ID NO: 1951448 - RNA, 13 nt, Homo sapiens
aggagaccuucca

SEQ ID NO: 1951449 - RNA, 22 nt, Homo sapiens
uggauuuucaaaaagccguuga

SEQ ID NO: 1951450 - RNA, 20 nt, Homo sapiens
acacauucuuaacacauguc

SEQ ID NO: 1951451 - RNA, 14 nt, Homo sapiens
ugcgugaagaccaa

SEQ ID NO: 1951452 - RNA, 17 nt, Homo sapiens
uaaaacuaucagcagcg

SEQ ID NO: 1951453 - RNA, 16 nt, Homo sapiens
aagcagaaagucuuca

SEQ ID NO: 1951454 - RNA, 14 nt, Homo sapiens
uaaaguggcauuuc

SEQ ID NO: 1951455 - RNA, 22 nt, Homo sapiens
cgaaggaaaacugccauaacau

SEQ ID NO: 1951456 - RNA, 16 nt, Homo sapiens
gacuuugauugcacau

SEQ ID NO: 1951457 - RNA, 21 nt, Homo sapiens
cggcugguugugggcacuggc

SEQ ID NO: 1951458 - RNA, 21 nt, Homo sapiens
gaaaacuaaucuaaacuguag

SEQ ID NO: 1951459 - RNA, 21 nt, Homo sapiens
cauccuguuuugcaaauugga

SEQ ID NO: 1951460 - RNA, 16 nt, Homo sapiens
ccuauggaaagggugu

SEQ ID NO: 1951461 - RNA, 23 nt, Homo sapiens
cacgugcacagcuuccugaguca

SEQ ID NO: 1951462 - RNA, 13 nt, Homo sapiens
cuuuguauacuuu

SEQ ID NO: 1951463 - RNA, 19 nt, Homo sapiens
uuaacaauugccagggaaa

SEQ ID NO: 1951464 - RNA, 22 nt, Homo sapiens
caaguuggaaauauucaugcuu

SEQ ID NO: 1951465 - RNA, 20 nt, Homo sapiens
uuggaaagacuucucaaaga

SEQ ID NO: 1951466 - RNA, 20 nt, Homo sapiens
gcugagauugcaccacugca

SEQ ID NO: 1951467 - RNA, 23 nt, Homo sapiens
uucugccuaucuucuuucacaua

SEQ ID NO: 1951468 - RNA, 20 nt, Homo sapiens
gcccagcgcucuccuggacg

SEQ ID NO: 1951469 - RNA, 17 nt, Homo sapiens
gaaagaagagaggacac

SEQ ID NO: 1951470 - RNA, 12 nt, Homo sapiens
cuuaacaucccu

SEQ ID NO: 1951471 - RNA, 16 nt, Homo sapiens
ugccccccuugccaga

SEQ ID NO: 1951472 - RNA, 22 nt, Homo sapiens
uuuggggagaaauaaauuuugu

SEQ ID NO: 1951473 - RNA, 21 nt, Homo sapiens
gagaauuuccaaaacuuuaau

SEQ ID NO: 1951474 - RNA, 18 nt, Homo sapiens
ccucccugccuccaggaa

SEQ ID NO: 1951475 - RNA, 13 nt, Homo sapiens
acugcugcuuaaa

SEQ ID NO: 1951476 - RNA, 22 nt, Homo sapiens
gcuggauuacaggcaugugcca

SEQ ID NO: 1951477 - RNA, 23 nt, Homo sapiens
ugaccgaccccuccccagugccu

SEQ ID NO: 1951478 - RNA, 18 nt, Homo sapiens
aagaaaugcauguuuccu

SEQ ID NO: 1951479 - RNA, 13 nt, Homo sapiens
aauugacaaauga

SEQ ID NO: 1951480 - RNA, 14 nt, Homo sapiens
cuugaucaaaggca

SEQ ID NO: 1951481 - RNA, 14 nt, Homo sapiens
agcaguagacauuu

SEQ ID NO: 1951482 - RNA, 19 nt, Homo sapiens
auguucacauagugaaaua

SEQ ID NO: 1951483 - RNA, 22 nt, Homo sapiens
ggcacauacaccucgucaagag

SEQ ID NO: 1951484 - RNA, 11 nt, Homo sapiens
cacauaccugg

SEQ ID NO: 1951485 - RNA, 22 nt, Homo sapiens
ggggcaggaggaggccaacuca

SEQ ID NO: 1951486 - RNA, 19 nt, Homo sapiens
cuuuauucagagcuaauaa

SEQ ID NO: 1951487 - RNA, 17 nt, Homo sapiens
cugccuauaaauuuacu

SEQ ID NO: 1951488 - RNA, 17 nt, Homo sapiens
cuucagcucuucuugac

SEQ ID NO: 1951489 - RNA, 18 nt, Homo sapiens
cauuaauauuuaccaaag

SEQ ID NO: 1951490 - RNA, 14 nt, Homo sapiens
ucuaacugcuguua

SEQ ID NO: 1951491 - RNA, 15 nt, Homo sapiens
aagcugaugccaagg

SEQ ID NO: 1951492 - RNA, 15 nt, Homo sapiens
ugccgucacuauuca

SEQ ID NO: 1951493 - RNA, 20 nt, Homo sapiens
cugcccaaaaugugaagcuu

SEQ ID NO: 1951494 - RNA, 21 nt, Homo sapiens
gaaccgagcaauuuucugcua

SEQ ID NO: 1951495 - RNA, 13 nt, Homo sapiens
aaauaaacaaagu

SEQ ID NO: 1951496 - RNA, 13 nt, Homo sapiens
uuuuuaacuuuga

SEQ ID NO: 1951497 - RNA, 16 nt, Homo sapiens
gucugcuagccaggau

SEQ ID NO: 1951498 - RNA, 19 nt, Homo sapiens
auguuucgcugauauaugu

SEQ ID NO: 1951499 - RNA, 17 nt, Homo sapiens
uggauucuuaaccaaga

SEQ ID NO: 1951500 - RNA, 13 nt, Homo sapiens
cagaccuagggau

SEQ ID NO: 1951501 - RNA, 16 nt, Homo sapiens
ucuuuggaacaacagc

SEQ ID NO: 1951502 - RNA, 17 nt, Homo sapiens
aaauaaucuauauuaaa

SEQ ID NO: 1951503 - RNA, 12 nt, Homo sapiens
cuuuaauuguau

SEQ ID NO: 1951504 - RNA, 15 nt, Homo sapiens
ugucagcuucccagc

SEQ ID NO: 1951505 - RNA, 15 nt, Homo sapiens
ucccuucccuuccac

SEQ ID NO: 1951506 - RNA, 11 nt, Homo sapiens
gcugcugcuaa

SEQ ID NO: 1951507 - RNA, 18 nt, Homo sapiens
aaaucacuugauucauaa

SEQ ID NO: 1951508 - RNA, 16 nt, Homo sapiens
ccugcauuggaacugg

SEQ ID NO: 1951509 - RNA, 20 nt, Homo sapiens
auccguacauucaauguuua

SEQ ID NO: 1951510 - RNA, 21 nt, Homo sapiens
uaaucuacuguaaaguacucu

SEQ ID NO: 1951511 - RNA, 15 nt, Homo sapiens
ucaggggugcauucu

SEQ ID NO: 1951512 - RNA, 12 nt, Homo sapiens
agcaagauuccu

SEQ ID NO: 1951513 - RNA, 13 nt, Homo sapiens
aaaaugauccuca

SEQ ID NO: 1951514 - RNA, 18 nt, Homo sapiens
uguguccuugugugcauu

SEQ ID NO: 1951515 - RNA, 15 nt, Homo sapiens
gaucccguguugcca

SEQ ID NO: 1951516 - RNA, 15 nt, Homo sapiens
aaggcaguaugccaa

SEQ ID NO: 1951517 - RNA, 14 nt, Homo sapiens
cuccagacccagag

SEQ ID NO: 1951518 - RNA, 14 nt, Homo sapiens
uuccccacucagcc

SEQ ID NO: 1951519 - RNA, 14 nt, Homo sapiens
auggauuuccagcc

SEQ ID NO: 1951520 - RNA, 20 nt, Homo sapiens
aauguuaacuaaauaacuuu

SEQ ID NO: 1951521 - RNA, 22 nt, Homo sapiens
uggccuggucccuguuuuccca

SEQ ID NO: 1951522 - RNA, 22 nt, Homo sapiens
augacuugguuuauggccuuaa

SEQ ID NO: 1951523 - RNA, 12 nt, Homo sapiens
aggcagcagggg

SEQ ID NO: 1951524 - RNA, 17 nt, Homo sapiens
caggccuggagcguuug

SEQ ID NO: 1951525 - RNA, 13 nt, Homo sapiens
accuauugcugua

SEQ ID NO: 1951526 - RNA, 22 nt, Homo sapiens
gcaugguuuugugccaucugua

SEQ ID NO: 1951527 - RNA, 15 nt, Homo sapiens
aagaaggacuuguuu

SEQ ID NO: 1951528 - RNA, 13 nt, Homo sapiens
aaaauaguuuaaa

SEQ ID NO: 1951529 - RNA, 20 nt, Homo sapiens
cauucuuggucaaguuuuuc

SEQ ID NO: 1951530 - RNA, 20 nt, Homo sapiens
aaggccacuguuugucucac

SEQ ID NO: 1951531 - RNA, 19 nt, Homo sapiens
ccacagagugagccaguga

SEQ ID NO: 1951532 - RNA, 14 nt, Homo sapiens
aucgggaagcagaa

SEQ ID NO: 1951533 - RNA, 22 nt, Homo sapiens
gauguaccaggcucucgcacac

SEQ ID NO: 1951534 - RNA, 13 nt, Homo sapiens
uuaaugaacuaac

SEQ ID NO: 1951535 - RNA, 23 nt, Homo sapiens
uuuggaaggugacuuuucaccuu

SEQ ID NO: 1951536 - RNA, 13 nt, Homo sapiens
uccagcucaaggg

SEQ ID NO: 1951537 - RNA, 15 nt, Homo sapiens
cagugcccuacaaag

SEQ ID NO: 1951538 - RNA, 13 nt, Homo sapiens
gcacgugcacaaa

SEQ ID NO: 1951539 - RNA, 13 nt, Homo sapiens
gaagaccuggacc

SEQ ID NO: 1951540 - RNA, 23 nt, Homo sapiens
aucugcugcaccuucacucucca

SEQ ID NO: 1951541 - RNA, 17 nt, Homo sapiens
accgcugccagcacaga

SEQ ID NO: 1951542 - RNA, 15 nt, Homo sapiens
gggacuaggaccuga

SEQ ID NO: 1951543 - RNA, 17 nt, Homo sapiens
cuccagcuguacuguag

SEQ ID NO: 1951544 - RNA, 21 nt, Homo sapiens
ggcuuguguguuucacuuuua

SEQ ID NO: 1951545 - RNA, 21 nt, Homo sapiens
cuuguagaaugggaugugaua

SEQ ID NO: 1951546 - RNA, 21 nt, Homo sapiens
ccuccuucaauuccauauauc

SEQ ID NO: 1951547 - RNA, 19 nt, Homo sapiens
uucucucuguguggcaaac

SEQ ID NO: 1951548 - RNA, 20 nt, Homo sapiens
gacaagcagugucugucagc

SEQ ID NO: 1951549 - RNA, 13 nt, Homo sapiens
acucaagugccau

SEQ ID NO: 1951550 - RNA, 17 nt, Homo sapiens
gagucuuugcaccaaag

SEQ ID NO: 1951551 - RNA, 14 nt, Homo sapiens
ucagcuggaucucc

SEQ ID NO: 1951552 - RNA, 16 nt, Homo sapiens
acgcacugguaugugu

SEQ ID NO: 1951553 - RNA, 20 nt, Homo sapiens
aacaguucauguuugcuuca

SEQ ID NO: 1951554 - RNA, 13 nt, Homo sapiens
gguacaaaaccac

SEQ ID NO: 1951555 - RNA, 16 nt, Homo sapiens
uacgauaauuccucaa

SEQ ID NO: 1951556 - RNA, 19 nt, Homo sapiens
ugugauacacugaaaggaa

SEQ ID NO: 1951557 - RNA, 16 nt, Homo sapiens
caggcuggagugcaga

SEQ ID NO: 1951558 - RNA, 14 nt, Homo sapiens
caucccuagucucu

SEQ ID NO: 1951559 - RNA, 17 nt, Homo sapiens
uaaauuugguucuaggc

SEQ ID NO: 1951560 - RNA, 20 nt, Homo sapiens
gaugauuucaauagcuuugu

SEQ ID NO: 1951561 - RNA, 13 nt, Homo sapiens
cacucaugcugaa

SEQ ID NO: 1951562 - RNA, 13 nt, Homo sapiens
gauuuaguacuug

SEQ ID NO: 1951563 - RNA, 22 nt, Homo sapiens
uggagccccagugccaagcaca

SEQ ID NO: 1951564 - RNA, 22 nt, Homo sapiens
aacauuuauauauuuccauuca

SEQ ID NO: 1951565 - RNA, 22 nt, Homo sapiens
uucacaaacagaaaacauguaa

SEQ ID NO: 1951566 - RNA, 18 nt, Homo sapiens
acucuaggcagugacagu

SEQ ID NO: 1951567 - RNA, 21 nt, Homo sapiens
ucaggaaacgagacuuuccau

SEQ ID NO: 1951568 - RNA, 19 nt, Homo sapiens
gcugaaaaccaucuggccu

SEQ ID NO: 1951569 - RNA, 22 nt, Homo sapiens
cagaaauguuugcugagugagu

SEQ ID NO: 1951570 - RNA, 13 nt, Homo sapiens
guucuacuugaua

SEQ ID NO: 1951571 - RNA, 17 nt, Homo sapiens
agauauuaggggggaaa

SEQ ID NO: 1951572 - RNA, 21 nt, Homo sapiens
agggggacuagccccugugga

SEQ ID NO: 1951573 - RNA, 23 nt, Homo sapiens
agaacaggcugguucugaguucu

SEQ ID NO: 1951574 - RNA, 12 nt, Homo sapiens
aaacuccaugau

SEQ ID NO: 1951575 - RNA, 20 nt, Homo sapiens
uuuucuauagaaaaaguaaa

SEQ ID NO: 1951576 - RNA, 21 nt, Homo sapiens
acuguuucuccuguuggcuca

SEQ ID NO: 1951577 - RNA, 13 nt, Homo sapiens
uagagaguggcaa

SEQ ID NO: 1951578 - RNA, 12 nt, Homo sapiens
cugcacacucca

SEQ ID NO: 1951579 - RNA, 21 nt, Homo sapiens
gaauuaaagucuacacugccu

SEQ ID NO: 1951580 - RNA, 17 nt, Homo sapiens
guacagguaaggugagg

SEQ ID NO: 1951581 - RNA, 15 nt, Homo sapiens
cuuaacucaccauaa

SEQ ID NO: 1951582 - RNA, 18 nt, Homo sapiens
agggagacugcaucucaa

SEQ ID NO: 1951583 - RNA, 13 nt, Homo sapiens
ggagccugcaaua

SEQ ID NO: 1951584 - RNA, 13 nt, Homo sapiens
aagacaaaaagcu

SEQ ID NO: 1951585 - RNA, 22 nt, Homo sapiens
ucccauacuagacucauacuca

SEQ ID NO: 1951586 - RNA, 17 nt, Homo sapiens
ugaggauaacuuuuuaa

SEQ ID NO: 1951587 - RNA, 11 nt, Homo sapiens
uugauccugca

SEQ ID NO: 1951588 - RNA, 15 nt, Homo sapiens
ugcucaaaaucuuuc

SEQ ID NO: 1951589 - RNA, 20 nt, Homo sapiens
uguggagggggaggcgccaa

SEQ ID NO: 1951590 - RNA, 16 nt, Homo sapiens
cuacagacuccaaaag

SEQ ID NO: 1951591 - RNA, 15 nt, Homo sapiens
gcugauguuuacaau

SEQ ID NO: 1951592 - RNA, 22 nt, Homo sapiens
cagucagauuuccagucuccac

SEQ ID NO: 1951593 - RNA, 16 nt, Homo sapiens
cacugaaguagccaac

SEQ ID NO: 1951594 - RNA, 22 nt, Homo sapiens
gucucaguguuaauacugagaa

SEQ ID NO: 1951595 - RNA, 17 nt, Homo sapiens
uguccaugccuacagau

SEQ ID NO: 1951596 - RNA, 21 nt, Homo sapiens
ucugggaaaggugcucaaaga

SEQ ID NO: 1951597 - RNA, 17 nt, Homo sapiens
acucaggcagugcagua

SEQ ID NO: 1951598 - RNA, 21 nt, Homo sapiens
auauuggaggaauacuucuga

SEQ ID NO: 1951599 - RNA, 22 nt, Homo sapiens
cugccccuccucucugcccuaa

SEQ ID NO: 1951600 - RNA, 20 nt, Homo sapiens
agaacaccugaggacaggag

SEQ ID NO: 1951601 - RNA, 16 nt, Homo sapiens
ugacuaucacauacaa

SEQ ID NO: 1951602 - RNA, 22 nt, Homo sapiens
ucaacauuuguuagaaccaguc

SEQ ID NO: 1951603 - RNA, 18 nt, Homo sapiens
cauauugaugugugucua

SEQ ID NO: 1951604 - RNA, 14 nt, Homo sapiens
uguauauaguauga

SEQ ID NO: 1951605 - RNA, 12 nt, Homo sapiens
caaacugugcuu

SEQ ID NO: 1951606 - RNA, 15 nt, Homo sapiens
accuguccaagacag

SEQ ID NO: 1951607 - RNA, 14 nt, Homo sapiens
ucgugcaacuguag

SEQ ID NO: 1951608 - RNA, 18 nt, Homo sapiens
ugucuuuucuuccacugc

SEQ ID NO: 1951609 - RNA, 21 nt, Homo sapiens
auguggaagaaaacaagacau

SEQ ID NO: 1951610 - RNA, 22 nt, Homo sapiens
auuuggacuggugugcucucuu

SEQ ID NO: 1951611 - RNA, 13 nt, Homo sapiens
gggcaacugauga

SEQ ID NO: 1951612 - RNA, 13 nt, Homo sapiens
cuuaacgugucug

SEQ ID NO: 1951613 - RNA, 18 nt, Homo sapiens
cagcagggccacugagua

SEQ ID NO: 1951614 - RNA, 19 nt, Homo sapiens
uaaaagcaauucugacugu

SEQ ID NO: 1951615 - RNA, 18 nt, Homo sapiens
cuuggguccaguauuuac

SEQ ID NO: 1951616 - RNA, 18 nt, Homo sapiens
ucuaacagcccuccucug

SEQ ID NO: 1951617 - RNA, 18 nt, Homo sapiens
ugagcccccugugcccac

SEQ ID NO: 1951618 - RNA, 17 nt, Homo sapiens
ucuuguaagagcuauac

SEQ ID NO: 1951619 - RNA, 14 nt, Homo sapiens
cugcucacaguccu

SEQ ID NO: 1951620 - RNA, 18 nt, Homo sapiens
agaacacacugagacuug

SEQ ID NO: 1951621 - RNA, 17 nt, Homo sapiens
agaaacuguagucucag

SEQ ID NO: 1951622 - RNA, 13 nt, Homo sapiens
uagaaauggauuu

SEQ ID NO: 1951623 - RNA, 17 nt, Homo sapiens
guaaucauuccaggugu

SEQ ID NO: 1951624 - RNA, 14 nt, Homo sapiens
aacaucagcuugac

SEQ ID NO: 1951625 - RNA, 16 nt, Homo sapiens
cuggacacuguccaug

SEQ ID NO: 1951626 - RNA, 16 nt, Homo sapiens
auccacacacagcagc

SEQ ID NO: 1951627 - RNA, 20 nt, Homo sapiens
aaugcccugucccuagcuca

SEQ ID NO: 1951628 - RNA, 17 nt, Homo sapiens
accagggcccugggcag

SEQ ID NO: 1951629 - RNA, 14 nt, Homo sapiens
uauaaaugcuauuu

SEQ ID NO: 1951630 - RNA, 16 nt, Homo sapiens
agcuuuacagugccac

SEQ ID NO: 1951631 - RNA, 19 nt, Homo sapiens
gaauuguaggugacuauua

SEQ ID NO: 1951632 - RNA, 15 nt, Homo sapiens
ugucacccaaagccu

SEQ ID NO: 1951633 - RNA, 21 nt, Homo sapiens
guuuagcguuguuuuguggau

SEQ ID NO: 1951634 - RNA, 13 nt, Homo sapiens
auuccaucuugcc

SEQ ID NO: 1951635 - RNA, 18 nt, Homo sapiens
aucuuccugccucaggcu

SEQ ID NO: 1951636 - RNA, 16 nt, Homo sapiens
ccucucuguuacucag

SEQ ID NO: 1951637 - RNA, 20 nt, Homo sapiens
aacuguugauacaaauguua

SEQ ID NO: 1951638 - RNA, 14 nt, Homo sapiens
caaacccuuucaua

SEQ ID NO: 1951639 - RNA, 20 nt, Homo sapiens
uaacuuuauaaauccaguga

SEQ ID NO: 1951640 - RNA, 17 nt, Homo sapiens
ucuucauuucauuguau

SEQ ID NO: 1951641 - RNA, 21 nt, Homo sapiens
gaaugauucccucuugcuauu

SEQ ID NO: 1951642 - RNA, 22 nt, Homo sapiens
cuccucauucagaccaaucuua

SEQ ID NO: 1951643 - RNA, 20 nt, Homo sapiens
gaaccaaaucuggaagccaa

SEQ ID NO: 1951644 - RNA, 19 nt, Homo sapiens
cagguccugugcuaucaca

SEQ ID NO: 1951645 - RNA, 22 nt, Homo sapiens
caacaaugacuuaaccauauaa

SEQ ID NO: 1951646 - RNA, 22 nt, Homo sapiens
uccccuccugugucccuuguaa

SEQ ID NO: 1951647 - RNA, 19 nt, Homo sapiens
cuucuaugguugacauugu

SEQ ID NO: 1951648 - RNA, 16 nt, Homo sapiens
cuucuaccugccccca

SEQ ID NO: 1951649 - RNA, 15 nt, Homo sapiens
ucacacgggguauuu

SEQ ID NO: 1951650 - RNA, 15 nt, Homo sapiens
ccuaaaaaguuccau

SEQ ID NO: 1951651 - RNA, 23 nt, Homo sapiens
cacguuucuaaaggcuaccuuug

SEQ ID NO: 1951652 - RNA, 20 nt, Homo sapiens
cuccugagcagcugggauua

SEQ ID NO: 1951653 - RNA, 24 nt, Homo sapiens
acacauggugugaguccaaagaag

SEQ ID NO: 1951654 - RNA, 14 nt, Homo sapiens
aaauuaguuccauu

SEQ ID NO: 1951655 - RNA, 14 nt, Homo sapiens
uaucaguugcaaua

SEQ ID NO: 1951656 - RNA, 20 nt, Homo sapiens
aagaauuggcagaagcaguu

SEQ ID NO: 1951657 - RNA, 13 nt, Homo sapiens
gggcaaagaagaa

SEQ ID NO: 1951658 - RNA, 15 nt, Homo sapiens
uuucccaaugguguu

SEQ ID NO: 1951659 - RNA, 17 nt, Homo sapiens
agggcauguugggauaa

SEQ ID NO: 1951660 - RNA, 24 nt, Homo sapiens
aguacucaguaaggcagugcagua

SEQ ID NO: 1951661 - RNA, 15 nt, Homo sapiens
ugcaggggugccugg

SEQ ID NO: 1951662 - RNA, 18 nt, Homo sapiens
aggccccaucgugaauua

SEQ ID NO: 1951663 - RNA, 17 nt, Homo sapiens
aggugucuagacugcca

SEQ ID NO: 1951664 - RNA, 13 nt, Homo sapiens
uacagcuguuuac

SEQ ID NO: 1951665 - RNA, 15 nt, Homo sapiens
aagcauuuugugaug

SEQ ID NO: 1951666 - RNA, 22 nt, Homo sapiens
uauccaaagggaauacucacau

SEQ ID NO: 1951667 - RNA, 20 nt, Homo sapiens
accuuuuccccaaccacaga

SEQ ID NO: 1951668 - RNA, 21 nt, Homo sapiens
cugggaaaggaaagaagaaau

SEQ ID NO: 1951669 - RNA, 16 nt, Homo sapiens
ccagggagagcccagg

SEQ ID NO: 1951670 - RNA, 18 nt, Homo sapiens
cugagacuuucagugcac

SEQ ID NO: 1951671 - RNA, 17 nt, Homo sapiens
agcaggugcugacuuca

SEQ ID NO: 1951672 - RNA, 15 nt, Homo sapiens
gggcgacagagccag

SEQ ID NO: 1951673 - RNA, 23 nt, Homo sapiens
aguaaucauauuguuacugguac

SEQ ID NO: 1951674 - RNA, 15 nt, Homo sapiens
cuaauauauuccaac

SEQ ID NO: 1951675 - RNA, 22 nt, Homo sapiens
agaaaaucugcauguuugauua

SEQ ID NO: 1951676 - RNA, 17 nt, Homo sapiens
cuuccccuucuugccau

SEQ ID NO: 1951677 - RNA, 16 nt, Homo sapiens
guagcugccacuugaa

SEQ ID NO: 1951678 - RNA, 15 nt, Homo sapiens
ggucucuggggaccc

SEQ ID NO: 1951679 - RNA, 22 nt, Homo sapiens
ucuauauucuuuauucucagua

SEQ ID NO: 1951680 - RNA, 20 nt, Homo sapiens
cuaugguaaauaacugugac

SEQ ID NO: 1951681 - RNA, 15 nt, Homo sapiens
ugcugauguuuacaa

SEQ ID NO: 1951682 - RNA, 13 nt, Homo sapiens
gaauauuguuaaa

SEQ ID NO: 1951683 - RNA, 16 nt, Homo sapiens
ugcaaaggugugcaaa

SEQ ID NO: 1951684 - RNA, 16 nt, Homo sapiens
agauucuaaagcucaa

SEQ ID NO: 1951685 - RNA, 22 nt, Homo sapiens
uugaucauaaacugacuaucau

SEQ ID NO: 1951686 - RNA, 13 nt, Homo sapiens
ugcauacuucuaa

SEQ ID NO: 1951687 - RNA, 16 nt, Homo sapiens
agagagcacagugauc

SEQ ID NO: 1951688 - RNA, 13 nt, Homo sapiens
uggcgucaccugu

SEQ ID NO: 1951689 - RNA, 18 nt, Homo sapiens
aucagcgccgcaccagcc

SEQ ID NO: 1951690 - RNA, 14 nt, Homo sapiens
caguuccuucacuu

SEQ ID NO: 1951691 - RNA, 16 nt, Homo sapiens
ccuucuauacuuucuc

SEQ ID NO: 1951692 - RNA, 15 nt, Homo sapiens
aguaguuuauuugaa

SEQ ID NO: 1951693 - RNA, 16 nt, Homo sapiens
uuacaagaaaacuaca

SEQ ID NO: 1951694 - RNA, 22 nt, Homo sapiens
ggcaaggcagcucccagguuua

SEQ ID NO: 1951695 - RNA, 16 nt, Homo sapiens
gagggauugcugugaa

SEQ ID NO: 1951696 - RNA, 19 nt, Homo sapiens
acaauggguaucuaauaaa

SEQ ID NO: 1951697 - RNA, 18 nt, Homo sapiens
agaaucauuaauacaaag

SEQ ID NO: 1951698 - RNA, 21 nt, Homo sapiens
uaacucaggggugauucugaa

SEQ ID NO: 1951699 - RNA, 15 nt, Homo sapiens
agauuugccaaaaac

SEQ ID NO: 1951700 - RNA, 14 nt, Homo sapiens
aaaggucuguuaau

SEQ ID NO: 1951701 - RNA, 22 nt, Homo sapiens
augacagucacagacucgccuc

SEQ ID NO: 1951702 - RNA, 15 nt, Homo sapiens
guaucaaaugugaca

SEQ ID NO: 1951703 - RNA, 14 nt, Homo sapiens
agcugaagugaagg

SEQ ID NO: 1951704 - RNA, 17 nt, Homo sapiens
aauguagcuuccaccuc

SEQ ID NO: 1951705 - RNA, 14 nt, Homo sapiens
gcccggacaugucu

SEQ ID NO: 1951706 - RNA, 13 nt, Homo sapiens
aaauggcugcuuu

SEQ ID NO: 1951707 - RNA, 13 nt, Homo sapiens
aaauugcugcuug

SEQ ID NO: 1951708 - RNA, 14 nt, Homo sapiens
uuucucccuauguu

SEQ ID NO: 1951709 - RNA, 13 nt, Homo sapiens
gagaaugccauuc

SEQ ID NO: 1951710 - RNA, 14 nt, Homo sapiens
uauucuauuaccuu

SEQ ID NO: 1951711 - RNA, 16 nt, Homo sapiens
gucgaggggcucucag

SEQ ID NO: 1951712 - RNA, 22 nt, Homo sapiens
ugucuuacuauuauagcaacuu

SEQ ID NO: 1951713 - RNA, 20 nt, Homo sapiens
uacugaaucugcuaccaaaa

SEQ ID NO: 1951714 - RNA, 15 nt, Homo sapiens
ucauuacuaaccaua

SEQ ID NO: 1951715 - RNA, 19 nt, Homo sapiens
gugccuccucagaggacag

SEQ ID NO: 1951716 - RNA, 22 nt, Homo sapiens
cuucugacuuaagugugcaaaa

SEQ ID NO: 1951717 - RNA, 23 nt, Homo sapiens
cuaaagaaacucagcagccucag

SEQ ID NO: 1951718 - RNA, 13 nt, Homo sapiens
ccuggugcccugg

SEQ ID NO: 1951719 - RNA, 13 nt, Homo sapiens
caaaaugccaaaa

SEQ ID NO: 1951720 - RNA, 13 nt, Homo sapiens
cuuugugccuuug

SEQ ID NO: 1951721 - RNA, 13 nt, Homo sapiens
acaugugcacaug

SEQ ID NO: 1951722 - RNA, 14 nt, Homo sapiens
ugguuagaaguaag

SEQ ID NO: 1951723 - RNA, 17 nt, Homo sapiens
acagcccaggcaucucc

SEQ ID NO: 1951724 - RNA, 10 nt, Homo sapiens
ugggugcugc

SEQ ID NO: 1951725 - RNA, 15 nt, Homo sapiens
ucgaaagcucuagaa

SEQ ID NO: 1951726 - RNA, 16 nt, Homo sapiens
cuuuucugugccagac

SEQ ID NO: 1951727 - RNA, 15 nt, Homo sapiens
cagacgcucauucag

SEQ ID NO: 1951728 - RNA, 18 nt, Homo sapiens
aagaucauugcugagaaa

SEQ ID NO: 1951729 - RNA, 16 nt, Homo sapiens
guuuaggggguuuguu

SEQ ID NO: 1951730 - RNA, 19 nt, Homo sapiens
cagagaauagcaguuucac

SEQ ID NO: 1951731 - RNA, 15 nt, Homo sapiens
cagcgucaguuucac

SEQ ID NO: 1951732 - RNA, 20 nt, Homo sapiens
uauaagcagaagcacauaug

SEQ ID NO: 1951733 - RNA, 14 nt, Homo sapiens
ugaagaugugauca

SEQ ID NO: 1951734 - RNA, 21 nt, Homo sapiens
acaugaccaaaaaccaaaagu

SEQ ID NO: 1951735 - RNA, 21 nt, Homo sapiens
caggauccccugcuacuccac

SEQ ID NO: 1951736 - RNA, 19 nt, Homo sapiens
cugcagcggcacaaaugca

SEQ ID NO: 1951737 - RNA, 17 nt, Homo sapiens
auguacaagguauguac

SEQ ID NO: 1951738 - RNA, 14 nt, Homo sapiens
uauauaucaaggau

SEQ ID NO: 1951739 - RNA, 23 nt, Homo sapiens
guaacaguucccaucaccaucac

SEQ ID NO: 1951740 - RNA, 20 nt, Homo sapiens
ugcgggaagcugaccuuuaa

SEQ ID NO: 1951741 - RNA, 22 nt, Homo sapiens
aauacuuagacaguaugcauac

SEQ ID NO: 1951742 - RNA, 22 nt, Homo sapiens
aauuucccauuuuggaaccuaa

SEQ ID NO: 1951743 - RNA, 14 nt, Homo sapiens
ugcaaccucugccu

SEQ ID NO: 1951744 - RNA, 17 nt, Homo sapiens
aagaguauuuacaauaa

SEQ ID NO: 1951745 - RNA, 16 nt, Homo sapiens
cagaauuuugcacagu

SEQ ID NO: 1951746 - RNA, 19 nt, Homo sapiens
guucacuucuaaaccaaaa

SEQ ID NO: 1951747 - RNA, 21 nt, Homo sapiens
ggccccuggacgaaggucuga

SEQ ID NO: 1951748 - RNA, 21 nt, Homo sapiens
cucaaagucuaacauauucaa

SEQ ID NO: 1951749 - RNA, 17 nt, Homo sapiens
cugcaaguauccagacc

SEQ ID NO: 1951750 - RNA, 18 nt, Homo sapiens
uguagauaguaugcacua

SEQ ID NO: 1951751 - RNA, 14 nt, Homo sapiens
uugcuuugggagac

SEQ ID NO: 1951752 - RNA, 12 nt, Homo sapiens
gaggcugagacu

SEQ ID NO: 1951753 - RNA, 18 nt, Homo sapiens
cuggaauggcucagggau

SEQ ID NO: 1951754 - RNA, 20 nt, Homo sapiens
aaguguucugauuccuucaa

SEQ ID NO: 1951755 - RNA, 18 nt, Homo sapiens
aagucucagaugaacaau

SEQ ID NO: 1951756 - RNA, 12 nt, Homo sapiens
cgugccauuguc

SEQ ID NO: 1951757 - RNA, 22 nt, Homo sapiens
ggugagaagcuagaugccccug

SEQ ID NO: 1951758 - RNA, 16 nt, Homo sapiens
gcaaacccuggugcuu

SEQ ID NO: 1951759 - RNA, 17 nt, Homo sapiens
cuuauucccaacugcuc

SEQ ID NO: 1951760 - RNA, 16 nt, Homo sapiens
ugugcacacuuccagg

SEQ ID NO: 1951761 - RNA, 15 nt, Homo sapiens
uaccagucaccuccu

SEQ ID NO: 1951762 - RNA, 21 nt, Homo sapiens
ggucccgagcccccuguccuu

SEQ ID NO: 1951763 - RNA, 22 nt, Homo sapiens
ugcaguuuuugccuggguccca

SEQ ID NO: 1951764 - RNA, 19 nt, Homo sapiens
ucagccuugggcaacugca

SEQ ID NO: 1951765 - RNA, 12 nt, Homo sapiens
uuucugccaggg

SEQ ID NO: 1951766 - RNA, 18 nt, Homo sapiens
gugacagcuuucugggau

SEQ ID NO: 1951767 - RNA, 13 nt, Homo sapiens
augaacucauguc

SEQ ID NO: 1951768 - RNA, 22 nt, Homo sapiens
guaguuucuugaggccaaacac

SEQ ID NO: 1951769 - RNA, 17 nt, Homo sapiens
ucaugaugguaucuaua

SEQ ID NO: 1951770 - RNA, 22 nt, Homo sapiens
cugcuucuguguguggugagca

SEQ ID NO: 1951771 - RNA, 18 nt, Homo sapiens
cuuuucugguagguucug

SEQ ID NO: 1951772 - RNA, 17 nt, Homo sapiens
cacugagggguggcacg

SEQ ID NO: 1951773 - RNA, 23 nt, Homo sapiens
guccccauacuccuaugaucuga

SEQ ID NO: 1951774 - RNA, 14 nt, Homo sapiens
uccacaacaguccc

SEQ ID NO: 1951775 - RNA, 13 nt, Homo sapiens
gauauugaugaua

SEQ ID NO: 1951776 - RNA, 14 nt, Homo sapiens
cauuagaaagcaaa

SEQ ID NO: 1951777 - RNA, 13 nt, Homo sapiens
uucuuaacagauc

SEQ ID NO: 1951778 - RNA, 20 nt, Homo sapiens
gaggaaauugcagaagcagg

SEQ ID NO: 1951779 - RNA, 20 nt, Homo sapiens
ccucccaaagugcugagauu

SEQ ID NO: 1951780 - RNA, 19 nt, Homo sapiens
cugagcaggucaggacuca

SEQ ID NO: 1951781 - RNA, 13 nt, Homo sapiens
cauguaauccuuu

SEQ ID NO: 1951782 - RNA, 17 nt, Homo sapiens
acaggagaagaaacagc

SEQ ID NO: 1951783 - RNA, 16 nt, Homo sapiens
accauauaccaucucc

SEQ ID NO: 1951784 - RNA, 20 nt, Homo sapiens
aacuuuuaauuaaaugcuca

SEQ ID NO: 1951785 - RNA, 23 nt, Homo sapiens
cuuagaaacaaaaagagcuuucc

SEQ ID NO: 1951786 - RNA, 16 nt, Homo sapiens
uugggaaucagaguau

SEQ ID NO: 1951787 - RNA, 13 nt, Homo sapiens
caggcagcucaag

SEQ ID NO: 1951788 - RNA, 16 nt, Homo sapiens
accgcaacucacacau

SEQ ID NO: 1951789 - RNA, 14 nt, Homo sapiens
aggagcaaaacgcc

SEQ ID NO: 1951790 - RNA, 17 nt, Homo sapiens
uucccuucuugcauccu

SEQ ID NO: 1951791 - RNA, 19 nt, Homo sapiens
cauguucauugcaaacaga

SEQ ID NO: 1951792 - RNA, 19 nt, Homo sapiens
cagcccuccuugacccaga

SEQ ID NO: 1951793 - RNA, 12 nt, Homo sapiens
gaguauaugcac

SEQ ID NO: 1951794 - RNA, 15 nt, Homo sapiens
uguccuuggggacau

SEQ ID NO: 1951795 - RNA, 23 nt, Homo sapiens
agguggggcgggaaagccaguga

SEQ ID NO: 1951796 - RNA, 23 nt, Homo sapiens
acccuccccaacaccccacugag

SEQ ID NO: 1951797 - RNA, 20 nt, Homo sapiens
ggaagcaaguuuucuuccau

SEQ ID NO: 1951798 - RNA, 20 nt, Homo sapiens
agagugagacuccaccucaa

SEQ ID NO: 1951799 - RNA, 16 nt, Homo sapiens
aggagacuaggaggga

SEQ ID NO: 1951800 - RNA, 16 nt, Homo sapiens
cugaauuaugcuucca

SEQ ID NO: 1951801 - RNA, 18 nt, Homo sapiens
aauucauaucauuuggcc

SEQ ID NO: 1951802 - RNA, 14 nt, Homo sapiens
aaacauauuuuaca

SEQ ID NO: 1951803 - RNA, 13 nt, Homo sapiens
gucaagcuccuag

SEQ ID NO: 1951804 - RNA, 20 nt, Homo sapiens
uuauaccgcuaucauuccaa

SEQ ID NO: 1951805 - RNA, 20 nt, Homo sapiens
aucauuaccuuuuaccagcu

SEQ ID NO: 1951806 - RNA, 22 nt, Homo sapiens
ugaaacguaauuguacaagcag

SEQ ID NO: 1951807 - RNA, 21 nt, Homo sapiens
gugaagaacacuacugcuaaa

SEQ ID NO: 1951808 - RNA, 21 nt, Homo sapiens
ccacaccugcggcccaaucca

SEQ ID NO: 1951809 - RNA, 13 nt, Homo sapiens
cuccuccacgugc

SEQ ID NO: 1951810 - RNA, 19 nt, Homo sapiens
gaauaaauuaaaauuacac

SEQ ID NO: 1951811 - RNA, 23 nt, Homo sapiens
aucuacccuccgauuguuccuga

SEQ ID NO: 1951812 - RNA, 20 nt, Homo sapiens
caaaauuuaacguugaugua

SEQ ID NO: 1951813 - RNA, 20 nt, Homo sapiens
auuauuuuugagacagaguc

SEQ ID NO: 1951814 - RNA, 15 nt, Homo sapiens
gaaaucccugcucac

SEQ ID NO: 1951815 - RNA, 12 nt, Homo sapiens
guggcaugcaug

SEQ ID NO: 1951816 - RNA, 16 nt, Homo sapiens
ucuauuuauuugacug

SEQ ID NO: 1951817 - RNA, 21 nt, Homo sapiens
ccauacacccccucuucugag

SEQ ID NO: 1951818 - RNA, 19 nt, Homo sapiens
cccucacgcucuccaucau

SEQ ID NO: 1951819 - RNA, 18 nt, Homo sapiens
acaccugccuucuacccu

SEQ ID NO: 1951820 - RNA, 17 nt, Homo sapiens
cugugccuaucaccucu

SEQ ID NO: 1951821 - RNA, 13 nt, Homo sapiens
acuuuagacauuu

SEQ ID NO: 1951822 - RNA, 14 nt, Homo sapiens
uccagaucagauuc

SEQ ID NO: 1951823 - RNA, 20 nt, Homo sapiens
cccacccgggagcagugucc

SEQ ID NO: 1951824 - RNA, 23 nt, Homo sapiens
augcaguucucacgaaaguauuu

SEQ ID NO: 1951825 - RNA, 23 nt, Homo sapiens
ucaccugcuaaaggagauuuaca

SEQ ID NO: 1951826 - RNA, 14 nt, Homo sapiens
ugagugugugcaag

SEQ ID NO: 1951827 - RNA, 16 nt, Homo sapiens
gaggccucauccaggg

SEQ ID NO: 1951828 - RNA, 23 nt, Homo sapiens
ggguauuguuaggaaaugucauc

SEQ ID NO: 1951829 - RNA, 22 nt, Homo sapiens
uuaagcaugacgggaaaaccaa

SEQ ID NO: 1951830 - RNA, 17 nt, Homo sapiens
aaacuuuauguacugcu

SEQ ID NO: 1951831 - RNA, 16 nt, Homo sapiens
gaaaaccuacauauuc

SEQ ID NO: 1951832 - RNA, 22 nt, Homo sapiens
uugaacagccauaucugaaugc

SEQ ID NO: 1951833 - RNA, 16 nt, Homo sapiens
accaaagucacaaauc

SEQ ID NO: 1951834 - RNA, 15 nt, Homo sapiens
cagaacuuucugucc

SEQ ID NO: 1951835 - RNA, 18 nt, Homo sapiens
uaaaacuuuauguacugc

SEQ ID NO: 1951836 - RNA, 20 nt, Homo sapiens
auuaauuucaaucaaccaaa

SEQ ID NO: 1951837 - RNA, 13 nt, Homo sapiens
cugcuucauaucu

SEQ ID NO: 1951838 - RNA, 20 nt, Homo sapiens
aggcugggagagccuuccag

SEQ ID NO: 1951839 - RNA, 20 nt, Homo sapiens
aaugaugugaguacccagga

SEQ ID NO: 1951840 - RNA, 14 nt, Homo sapiens
aaaauacuguucuu

SEQ ID NO: 1951841 - RNA, 13 nt, Homo sapiens
ucucagcucacug

SEQ ID NO: 1951842 - RNA, 21 nt, Homo sapiens
gcccuccacgccggcucuucc

SEQ ID NO: 1951843 - RNA, 13 nt, Homo sapiens
cauuauugaguca

SEQ ID NO: 1951844 - RNA, 22 nt, Homo sapiens
ugauggucaucgagauggagcu

SEQ ID NO: 1951845 - RNA, 13 nt, Homo sapiens
aaauaaugcuuaa

SEQ ID NO: 1951846 - RNA, 21 nt, Homo sapiens
aaaaauauguugaguguucau

SEQ ID NO: 1951847 - RNA, 22 nt, Homo sapiens
ucccacuggaggcaugugauga

SEQ ID NO: 1951848 - RNA, 22 nt, Homo sapiens
gcauaaaauguaugaccacugg

SEQ ID NO: 1951849 - RNA, 20 nt, Homo sapiens
ugaaaucgccguguuacugu

SEQ ID NO: 1951850 - RNA, 15 nt, Homo sapiens
aagguuaagauauca

SEQ ID NO: 1951851 - RNA, 11 nt, Homo sapiens
ugaguaugugu

SEQ ID NO: 1951852 - RNA, 21 nt, Homo sapiens
ugcgccacugcacuccagucu

SEQ ID NO: 1951853 - RNA, 13 nt, Homo sapiens
augaaaauauucu

SEQ ID NO: 1951854 - RNA, 18 nt, Homo sapiens
guucccagaggguuucca

SEQ ID NO: 1951855 - RNA, 18 nt, Homo sapiens
caaagcaaauuucuauca

SEQ ID NO: 1951856 - RNA, 11 nt, Homo sapiens
cgcacagugug

SEQ ID NO: 1951857 - RNA, 15 nt, Homo sapiens
ggccacucccaggga

SEQ ID NO: 1951858 - RNA, 22 nt, Homo sapiens
cugcaaaggcgucugaaugugu

SEQ ID NO: 1951859 - RNA, 16 nt, Homo sapiens
cugcaacugaaugacu

SEQ ID NO: 1951860 - RNA, 19 nt, Homo sapiens
agccaaggccuaugccacc

SEQ ID NO: 1951861 - RNA, 17 nt, Homo sapiens
uaacuagaauuuauuca

SEQ ID NO: 1951862 - RNA, 20 nt, Homo sapiens
uagaauggauucaacacugu

SEQ ID NO: 1951863 - RNA, 12 nt, Homo sapiens
caaaaacauuuc

SEQ ID NO: 1951864 - RNA, 19 nt, Homo sapiens
uugucagaaaccugcaggg

SEQ ID NO: 1951865 - RNA, 23 nt, Homo sapiens
ucaucuucgaccacaucagaaag

SEQ ID NO: 1951866 - RNA, 22 nt, Homo sapiens
uucuuuguaagcgggacauuua

SEQ ID NO: 1951867 - RNA, 17 nt, Homo sapiens
ucacacuuccaccagcc

SEQ ID NO: 1951868 - RNA, 23 nt, Homo sapiens
uggucaguaaauaacaggcauuu

SEQ ID NO: 1951869 - RNA, 21 nt, Homo sapiens
aggaggugucucaggcugccu

SEQ ID NO: 1951870 - RNA, 18 nt, Homo sapiens
ucaucucagcaaucacaa

SEQ ID NO: 1951871 - RNA, 17 nt, Homo sapiens
agacccagggguccagg

SEQ ID NO: 1951872 - RNA, 17 nt, Homo sapiens
gaucaguggggccccaa

SEQ ID NO: 1951873 - RNA, 14 nt, Homo sapiens
uggcuuguauccuu

SEQ ID NO: 1951874 - RNA, 17 nt, Homo sapiens
ccacucccaaagcucag

SEQ ID NO: 1951875 - RNA, 22 nt, Homo sapiens
cagacaaauacuuagacaguau

SEQ ID NO: 1951876 - RNA, 14 nt, Homo sapiens
aauuaauacaauca

SEQ ID NO: 1951877 - RNA, 17 nt, Homo sapiens
caacaggaaacugggaa

SEQ ID NO: 1951878 - RNA, 18 nt, Homo sapiens
ugagcugaccccugcuga

SEQ ID NO: 1951879 - RNA, 16 nt, Homo sapiens
caguaaaguguaacau

SEQ ID NO: 1951880 - RNA, 17 nt, Homo sapiens
ugcgggucugucagggu

SEQ ID NO: 1951881 - RNA, 14 nt, Homo sapiens
cuuucaugccuuuu

SEQ ID NO: 1951882 - RNA, 19 nt, Homo sapiens
ccuucuauacuuucucaca

SEQ ID NO: 1951883 - RNA, 21 nt, Homo sapiens
cugccuauaaucuuauacaac

SEQ ID NO: 1951884 - RNA, 16 nt, Homo sapiens
caaagcuuuauuucaa

SEQ ID NO: 1951885 - RNA, 17 nt, Homo sapiens
uauuaacuuuaauucuc

SEQ ID NO: 1951886 - RNA, 18 nt, Homo sapiens
aaagauauaagacuuaau

SEQ ID NO: 1951887 - RNA, 16 nt, Homo sapiens
acugaacagaaccaca

SEQ ID NO: 1951888 - RNA, 17 nt, Homo sapiens
aucugguccaacaugaa

SEQ ID NO: 1951889 - RNA, 14 nt, Homo sapiens
agacaguccuuaau

SEQ ID NO: 1951890 - RNA, 18 nt, Homo sapiens
uugcacuccuacugaguu

SEQ ID NO: 1951891 - RNA, 15 nt, Homo sapiens
aaaucagacuaugaa

SEQ ID NO: 1951892 - RNA, 14 nt, Homo sapiens
gccacccagcaaca

SEQ ID NO: 1951893 - RNA, 21 nt, Homo sapiens
aucuuuggacagaagcagcuc

SEQ ID NO: 1951894 - RNA, 18 nt, Homo sapiens
uguaacucaccagccucu

SEQ ID NO: 1951895 - RNA, 13 nt, Homo sapiens
agaugauuucuca

SEQ ID NO: 1951896 - RNA, 12 nt, Homo sapiens
cugaugugccag

SEQ ID NO: 1951897 - RNA, 17 nt, Homo sapiens
uggaucugacccuccca

SEQ ID NO: 1951898 - RNA, 19 nt, Homo sapiens
ucugagcaacugugcagca

SEQ ID NO: 1951899 - RNA, 12 nt, Homo sapiens
aaguauccuuca

SEQ ID NO: 1951900 - RNA, 20 nt, Homo sapiens
uucaauccccauaaugcuuc

SEQ ID NO: 1951901 - RNA, 11 nt, Homo sapiens
aaaugcauucg

SEQ ID NO: 1951902 - RNA, 9 nt, Homo sapiens
ucucagcug

SEQ ID NO: 1951903 - RNA, 14 nt, Homo sapiens
auaaauaugucaga

SEQ ID NO: 1951904 - RNA, 20 nt, Homo sapiens
aaucuauguauauacauuua

SEQ ID NO: 1951905 - RNA, 23 nt, Homo sapiens
gugaucucagcucacucugcaac

SEQ ID NO: 1951906 - RNA, 19 nt, Homo sapiens
aagugguaggaaagccuca

SEQ ID NO: 1951907 - RNA, 22 nt, Homo sapiens
gcccaaaucuucuucagauuca

SEQ ID NO: 1951908 - RNA, 14 nt, Homo sapiens
auuuagaaguguca

SEQ ID NO: 1951909 - RNA, 13 nt, Homo sapiens
gcagaacugccau

SEQ ID NO: 1951910 - RNA, 14 nt, Homo sapiens
gccucauugcuugg

SEQ ID NO: 1951911 - RNA, 13 nt, Homo sapiens
caguuuaaguaau

SEQ ID NO: 1951912 - RNA, 23 nt, Homo sapiens
uucccguauaauaaaaccaaaga

SEQ ID NO: 1951913 - RNA, 17 nt, Homo sapiens
uugccaauguacauacc

SEQ ID NO: 1951914 - RNA, 18 nt, Homo sapiens
uucugaggugcacuggga

SEQ ID NO: 1951915 - RNA, 17 nt, Homo sapiens
ccaugcauggugcauca

SEQ ID NO: 1951916 - RNA, 19 nt, Homo sapiens
cuagguuucaccucccaaa

SEQ ID NO: 1951917 - RNA, 15 nt, Homo sapiens
uguugagcagcaucu

SEQ ID NO: 1951918 - RNA, 21 nt, Homo sapiens
ugagcuggccucucuagcaca

SEQ ID NO: 1951919 - RNA, 18 nt, Homo sapiens
uaaaacuuaucugaguca

SEQ ID NO: 1951920 - RNA, 17 nt, Homo sapiens
cuuaauaaucaaccugg

SEQ ID NO: 1951921 - RNA, 22 nt, Homo sapiens
uguguaucugaaaggaagacau

SEQ ID NO: 1951922 - RNA, 22 nt, Homo sapiens
guauuuugugaugaaucuacau

SEQ ID NO: 1951923 - RNA, 17 nt, Homo sapiens
uccacaccuuuuauuga

SEQ ID NO: 1951924 - RNA, 18 nt, Homo sapiens
acucugguaaaugaucac

SEQ ID NO: 1951925 - RNA, 21 nt, Homo sapiens
accuucccaagucucccuuuc

SEQ ID NO: 1951926 - RNA, 23 nt, Homo sapiens
ccaugugauggacacuccaggga

SEQ ID NO: 1951927 - RNA, 17 nt, Homo sapiens
cuauuauaagugcuuca

SEQ ID NO: 1951928 - RNA, 13 nt, Homo sapiens
cuuugacuugugu

SEQ ID NO: 1951929 - RNA, 20 nt, Homo sapiens
uuguguauggguagcacuac

SEQ ID NO: 1951930 - RNA, 23 nt, Homo sapiens
augacgguguuaauuuugcuaac

SEQ ID NO: 1951931 - RNA, 17 nt, Homo sapiens
uauagaccccaagcauu

SEQ ID NO: 1951932 - RNA, 14 nt, Homo sapiens
cacacugacauuau

SEQ ID NO: 1951933 - RNA, 15 nt, Homo sapiens
ugaguaucagaauug

SEQ ID NO: 1951934 - RNA, 22 nt, Homo sapiens
ccaaccacaggaagcugcaauu

SEQ ID NO: 1951935 - RNA, 22 nt, Homo sapiens
aucuauuuuuggagguuuauua

SEQ ID NO: 1951936 - RNA, 13 nt, Homo sapiens
uuuuggacacugu

SEQ ID NO: 1951937 - RNA, 16 nt, Homo sapiens
aaaugucuguauuuca

SEQ ID NO: 1951938 - RNA, 15 nt, Homo sapiens
uacuuuuguuguaug

SEQ ID NO: 1951939 - RNA, 20 nt, Homo sapiens
aaagaccaggucuacaguga

SEQ ID NO: 1951940 - RNA, 17 nt, Homo sapiens
gucuuuuucgccaaacu

SEQ ID NO: 1951941 - RNA, 17 nt, Homo sapiens
gcucuggguugugcaca

SEQ ID NO: 1951942 - RNA, 22 nt, Homo sapiens
uuuccuuuuaaaaggcccugug

SEQ ID NO: 1951943 - RNA, 17 nt, Homo sapiens
aauuauuuuuguucaua

SEQ ID NO: 1951944 - RNA, 17 nt, Homo sapiens
cauccaauggacugcau

SEQ ID NO: 1951945 - RNA, 14 nt, Homo sapiens
aaauagcaaaagaa

SEQ ID NO: 1951946 - RNA, 12 nt, Homo sapiens
cuccgaggcucc

SEQ ID NO: 1951947 - RNA, 17 nt, Homo sapiens
auccaagaagcaugcag

SEQ ID NO: 1951948 - RNA, 15 nt, Homo sapiens
cccaccucacaguga

SEQ ID NO: 1951949 - RNA, 22 nt, Homo sapiens
uauagugaacucccaucuauua

SEQ ID NO: 1951950 - RNA, 16 nt, Homo sapiens
ugguaacugcacacau

SEQ ID NO: 1951951 - RNA, 22 nt, Homo sapiens
ccauaaaaauaaaucaguucau

SEQ ID NO: 1951952 - RNA, 18 nt, Homo sapiens
aaaggcugcuguacugaa

SEQ ID NO: 1951953 - RNA, 18 nt, Homo sapiens
cuagagugcaguggugca

SEQ ID NO: 1951954 - RNA, 15 nt, Homo sapiens
auuucauucauaucc

SEQ ID NO: 1951955 - RNA, 19 nt, Homo sapiens
aaaauaguacacacauaua

SEQ ID NO: 1951956 - RNA, 18 nt, Homo sapiens
auagcacccuuuguuaau

SEQ ID NO: 1951957 - RNA, 20 nt, Homo sapiens
gcucaggacacagugggaca

SEQ ID NO: 1951958 - RNA, 23 nt, Homo sapiens
auugucucguguacagcucccuu

SEQ ID NO: 1951959 - RNA, 13 nt, Homo sapiens
aaucuaaauggaa

SEQ ID NO: 1951960 - RNA, 17 nt, Homo sapiens
ccaucagcucucugcaa

SEQ ID NO: 1951961 - RNA, 15 nt, Homo sapiens
ugaaaaguaucagga

SEQ ID NO: 1951962 - RNA, 13 nt, Homo sapiens
gcauuaaauucac

SEQ ID NO: 1951963 - RNA, 22 nt, Homo sapiens
cuucccuugcuggaaaacccaa

SEQ ID NO: 1951964 - RNA, 14 nt, Homo sapiens
uaaaauaguagcau

SEQ ID NO: 1951965 - RNA, 17 nt, Homo sapiens
cauuuuuuaaugugcuc

SEQ ID NO: 1951966 - RNA, 14 nt, Homo sapiens
cagaggcccugugg

SEQ ID NO: 1951967 - RNA, 17 nt, Homo sapiens
cuaaaaauaaaaaagcc

SEQ ID NO: 1951968 - RNA, 23 nt, Homo sapiens
uuugcaacucacugauucucuac

SEQ ID NO: 1951969 - RNA, 22 nt, Homo sapiens
aaagugucaccccucacuguga

SEQ ID NO: 1951970 - RNA, 22 nt, Homo sapiens
aagguauuuuccugugccuuua

SEQ ID NO: 1951971 - RNA, 21 nt, Homo sapiens
ccaagauacuugaacacugug

SEQ ID NO: 1951972 - RNA, 20 nt, Homo sapiens
cugccacauacaggugcuca

SEQ ID NO: 1951973 - RNA, 23 nt, Homo sapiens
acuucaguacgucaccagggauc

SEQ ID NO: 1951974 - RNA, 13 nt, Homo sapiens
uuauauaaucaau

SEQ ID NO: 1951975 - RNA, 13 nt, Homo sapiens
accuauaaaucau

SEQ ID NO: 1951976 - RNA, 17 nt, Homo sapiens
uaaaacaccuaaauaac

SEQ ID NO: 1951977 - RNA, 16 nt, Homo sapiens
aacagaucuccuggca

SEQ ID NO: 1951978 - RNA, 23 nt, Homo sapiens
ccuuuuuugaucaggcacagugg

SEQ ID NO: 1951979 - RNA, 16 nt, Homo sapiens
uuugcaguaugaacua

SEQ ID NO: 1951980 - RNA, 19 nt, Homo sapiens
gcugccugcugugcuggga

SEQ ID NO: 1951981 - RNA, 15 nt, Homo sapiens
aucccagcacugcac

SEQ ID NO: 1951982 - RNA, 16 nt, Homo sapiens
aaggaggaaguggaag

SEQ ID NO: 1951983 - RNA, 16 nt, Homo sapiens
gaaaagacuuaccuga

SEQ ID NO: 1951984 - RNA, 21 nt, Homo sapiens
caguaggggaggagcacaguu

SEQ ID NO: 1951985 - RNA, 19 nt, Homo sapiens
ccuggggagucugggcaca

SEQ ID NO: 1951986 - RNA, 20 nt, Homo sapiens
caggcugggcucagcucagc

SEQ ID NO: 1951987 - RNA, 18 nt, Homo sapiens
ucuugaauauuugcuuaa

SEQ ID NO: 1951988 - RNA, 13 nt, Homo sapiens
gcuagcacuaacu

SEQ ID NO: 1951989 - RNA, 16 nt, Homo sapiens
ggacugauacugcagu

SEQ ID NO: 1951990 - RNA, 21 nt, Homo sapiens
ccuucacagaugccuacuuuu

SEQ ID NO: 1951991 - RNA, 18 nt, Homo sapiens
aaggcccacuucuucuca

SEQ ID NO: 1951992 - RNA, 21 nt, Homo sapiens
accugaaauuuauucacauau

SEQ ID NO: 1951993 - RNA, 15 nt, Homo sapiens
ggccuucaccaagca

SEQ ID NO: 1951994 - RNA, 14 nt, Homo sapiens
ggcuuggugaaugc

SEQ ID NO: 1951995 - RNA, 12 nt, Homo sapiens
uucuuucucuca

SEQ ID NO: 1951996 - RNA, 16 nt, Homo sapiens
acaaggggcccagugc

SEQ ID NO: 1951997 - RNA, 22 nt, Homo sapiens
cuauaaccaucaguuacugguu

SEQ ID NO: 1951998 - RNA, 19 nt, Homo sapiens
guaaaucagugcaguacuc

SEQ ID NO: 1951999 - RNA, 18 nt, Homo sapiens
aguugugaagaggggcca

SEQ ID NO: 1952000 - RNA, 23 nt, Homo sapiens
ucuguauuuccccaacauguaau

SEQ ID NO: 1952001 - RNA, 22 nt, Homo sapiens
ugcauuuccucgcagccucuca

SEQ ID NO: 1952002 - RNA, 16 nt, Homo sapiens
uccugugucuguguau

SEQ ID NO: 1952003 - RNA, 18 nt, Homo sapiens
ugugaacauuugugauau

SEQ ID NO: 1952004 - RNA, 15 nt, Homo sapiens
gggagcaguggccau

SEQ ID NO: 1952005 - RNA, 13 nt, Homo sapiens
acgugucucagga

SEQ ID NO: 1952006 - RNA, 17 nt, Homo sapiens
aucaaagaaaacauagc

SEQ ID NO: 1952007 - RNA, 15 nt, Homo sapiens
cugcuugaccaaaga

SEQ ID NO: 1952008 - RNA, 20 nt, Homo sapiens
ccaugcugcccgcuucucac

SEQ ID NO: 1952009 - RNA, 19 nt, Homo sapiens
acuaaauaucauaaucuga

SEQ ID NO: 1952010 - RNA, 16 nt, Homo sapiens
uaagcccagcauuuga

SEQ ID NO: 1952011 - RNA, 17 nt, Homo sapiens
ggcauuagugcugauag

SEQ ID NO: 1952012 - RNA, 20 nt, Homo sapiens
caaaugugugcccagcuuau

SEQ ID NO: 1952013 - RNA, 11 nt, Homo sapiens
gagagugcaga

SEQ ID NO: 1952014 - RNA, 21 nt, Homo sapiens
ugucuauuucuaaaagccaau

SEQ ID NO: 1952015 - RNA, 16 nt, Homo sapiens
agaaucagucuaucca

SEQ ID NO: 1952016 - RNA, 19 nt, Homo sapiens
agaaaccagcuuccuucag

SEQ ID NO: 1952017 - RNA, 13 nt, Homo sapiens
aggaaacuuugca

SEQ ID NO: 1952018 - RNA, 22 nt, Homo sapiens
ucgccagugccuggaacagugu

SEQ ID NO: 1952019 - RNA, 16 nt, Homo sapiens
cugcgggucauauuca

SEQ ID NO: 1952020 - RNA, 16 nt, Homo sapiens
ccagucauucugggaa

SEQ ID NO: 1952021 - RNA, 22 nt, Homo sapiens
gaucuauauuuuuguacugaau

SEQ ID NO: 1952022 - RNA, 14 nt, Homo sapiens
ugauugcagcuuua

SEQ ID NO: 1952023 - RNA, 20 nt, Homo sapiens
agaugacaaccuccauucua

SEQ ID NO: 1952024 - RNA, 19 nt, Homo sapiens
cugacccugcuucaaauau

SEQ ID NO: 1952025 - RNA, 12 nt, Homo sapiens
gaagacuaguua

SEQ ID NO: 1952026 - RNA, 22 nt, Homo sapiens
ggucccugcaaaacuccaggca

SEQ ID NO: 1952027 - RNA, 15 nt, Homo sapiens
uaauacagacaucua

SEQ ID NO: 1952028 - RNA, 14 nt, Homo sapiens
cuauaaucugucaa

SEQ ID NO: 1952029 - RNA, 17 nt, Homo sapiens
ucagcuacauauaugaa

SEQ ID NO: 1952030 - RNA, 13 nt, Homo sapiens
gaauaaaaccauc

SEQ ID NO: 1952031 - RNA, 21 nt, Homo sapiens
uaauaauagaaaaauacucau

SEQ ID NO: 1952032 - RNA, 17 nt, Homo sapiens
guggcauucacaucuca

SEQ ID NO: 1952033 - RNA, 16 nt, Homo sapiens
ucuauguauucaagua

SEQ ID NO: 1952034 - RNA, 18 nt, Homo sapiens
ucagccauugcccuguga

SEQ ID NO: 1952035 - RNA, 18 nt, Homo sapiens
cucagguaguacugggaa

SEQ ID NO: 1952036 - RNA, 15 nt, Homo sapiens
aauagccacauuugg

SEQ ID NO: 1952037 - RNA, 13 nt, Homo sapiens
cugcccacccacu

SEQ ID NO: 1952038 - RNA, 15 nt, Homo sapiens
cuuccucuccugucu

SEQ ID NO: 1952039 - RNA, 14 nt, Homo sapiens
cgugcuggcgacac

SEQ ID NO: 1952040 - RNA, 17 nt, Homo sapiens
ucaagauccucuugcca

SEQ ID NO: 1952041 - RNA, 16 nt, Homo sapiens
ucuugguuuccaucaa

SEQ ID NO: 1952042 - RNA, 16 nt, Homo sapiens
aacaguguuuacuuua

SEQ ID NO: 1952043 - RNA, 13 nt, Homo sapiens
ggaggcagugaug

SEQ ID NO: 1952044 - RNA, 22 nt, Homo sapiens
cucaaacggaggaagcccacau

SEQ ID NO: 1952045 - RNA, 17 nt, Homo sapiens
uuauuuccccagccaca

SEQ ID NO: 1952046 - RNA, 17 nt, Homo sapiens
cugcaagugacaucucu

SEQ ID NO: 1952047 - RNA, 18 nt, Homo sapiens
agucaguaauuuaucuua

SEQ ID NO: 1952048 - RNA, 15 nt, Homo sapiens
aagcugucacucaca

SEQ ID NO: 1952049 - RNA, 20 nt, Homo sapiens
ugcaaaucuaaaguugcucc

SEQ ID NO: 1952050 - RNA, 14 nt, Homo sapiens
uucucccugggaag

SEQ ID NO: 1952051 - RNA, 20 nt, Homo sapiens
uucccaucuuccaaggguac

SEQ ID NO: 1952052 - RNA, 13 nt, Homo sapiens
agaagagguguuu

SEQ ID NO: 1952053 - RNA, 23 nt, Homo sapiens
aggggacgggugguggugucugu

SEQ ID NO: 1952054 - RNA, 15 nt, Homo sapiens
ccauauagaaaucua

SEQ ID NO: 1952055 - RNA, 21 nt, Homo sapiens
uuguugccagauuucagaaaa

SEQ ID NO: 1952056 - RNA, 22 nt, Homo sapiens
uuuguuuugauguuuguggccu

SEQ ID NO: 1952057 - RNA, 19 nt, Homo sapiens
cgggagaggagaucagggc

SEQ ID NO: 1952058 - RNA, 21 nt, Homo sapiens
caugugaaaauaaaauaugag

SEQ ID NO: 1952059 - RNA, 15 nt, Homo sapiens
gguagauucgcuguc

SEQ ID NO: 1952060 - RNA, 13 nt, Homo sapiens
uaucugcauuuac

SEQ ID NO: 1952061 - RNA, 14 nt, Homo sapiens
uuuguuuaugaaga

SEQ ID NO: 1952062 - RNA, 22 nt, Homo sapiens
agucccagacaauuccauucaa

SEQ ID NO: 1952063 - RNA, 22 nt, Homo sapiens
aacugcuacugaccaucugcac

SEQ ID NO: 1952064 - RNA, 11 nt, Homo sapiens
uuuacuuuaaa

SEQ ID NO: 1952065 - RNA, 15 nt, Homo sapiens
uaagagaucccuucc

SEQ ID NO: 1952066 - RNA, 19 nt, Homo sapiens
guuugccaagcugaagcua

SEQ ID NO: 1952067 - RNA, 21 nt, Homo sapiens
uuguauauuauuucuaggaag

SEQ ID NO: 1952068 - RNA, 19 nt, Homo sapiens
gaauguaaaacagagccau

SEQ ID NO: 1952069 - RNA, 16 nt, Homo sapiens
cacccccagcaagaag

SEQ ID NO: 1952070 - RNA, 12 nt, Homo sapiens
uucagguuucca

SEQ ID NO: 1952071 - RNA, 19 nt, Homo sapiens
aaccucucuacuagcacca

SEQ ID NO: 1952072 - RNA, 23 nt, Homo sapiens
uccaggggccacaagaccaucua

SEQ ID NO: 1952073 - RNA, 12 nt, Homo sapiens
uaagaugaaaca

SEQ ID NO: 1952074 - RNA, 15 nt, Homo sapiens
uaccacuaugcaaua

SEQ ID NO: 1952075 - RNA, 16 nt, Homo sapiens
uaaaugacacuacuug

SEQ ID NO: 1952076 - RNA, 18 nt, Homo sapiens
gaguugaguauuacacau

SEQ ID NO: 1952077 - RNA, 15 nt, Homo sapiens
agcuuggagggaugg

SEQ ID NO: 1952078 - RNA, 22 nt, Homo sapiens
ucaccucccaaacccagccucu

SEQ ID NO: 1952079 - RNA, 20 nt, Homo sapiens
aucgcaggagucucugccac

SEQ ID NO: 1952080 - RNA, 14 nt, Homo sapiens
uguugcauauacca

SEQ ID NO: 1952081 - RNA, 13 nt, Homo sapiens
acuguccugugaa

SEQ ID NO: 1952082 - RNA, 14 nt, Homo sapiens
uggaacagauuuca

SEQ ID NO: 1952083 - RNA, 22 nt, Homo sapiens
cagccacuccucaaccuugacu

SEQ ID NO: 1952084 - RNA, 22 nt, Homo sapiens
aagauccugugaggagccccau

SEQ ID NO: 1952085 - RNA, 13 nt, Homo sapiens
gccaccaagacag

SEQ ID NO: 1952086 - RNA, 17 nt, Homo sapiens
accaggggcccuaccug

SEQ ID NO: 1952087 - RNA, 21 nt, Homo sapiens
gaaauguucucaugaacuacc

SEQ ID NO: 1952088 - RNA, 21 nt, Homo sapiens
auccugucuguacuaaaaaua

SEQ ID NO: 1952089 - RNA, 11 nt, Homo sapiens
uggcuguaaac

SEQ ID NO: 1952090 - RNA, 16 nt, Homo sapiens
cuuugcccaacaccag

SEQ ID NO: 1952091 - RNA, 20 nt, Homo sapiens
cagcaggugucuuuaacugu

SEQ ID NO: 1952092 - RNA, 17 nt, Homo sapiens
gcuucauuaugcagcug

SEQ ID NO: 1952093 - RNA, 17 nt, Homo sapiens
acccucagcgagucccu

SEQ ID NO: 1952094 - RNA, 16 nt, Homo sapiens
cccauagcccuuaccu

SEQ ID NO: 1952095 - RNA, 16 nt, Homo sapiens
auuuuauuccaaaaua

SEQ ID NO: 1952096 - RNA, 16 nt, Homo sapiens
agaucguuuaaaaaca

SEQ ID NO: 1952097 - RNA, 13 nt, Homo sapiens
uugcaaagauuua

SEQ ID NO: 1952098 - RNA, 21 nt, Homo sapiens
gcaagaacucaucacuguggc

SEQ ID NO: 1952099 - RNA, 19 nt, Homo sapiens
ccacuguccggaaauucau

SEQ ID NO: 1952100 - RNA, 14 nt, Homo sapiens
aggcuucuuccuac

SEQ ID NO: 1952101 - RNA, 22 nt, Homo sapiens
caaaacccacggaaagccucau

SEQ ID NO: 1952102 - RNA, 22 nt, Homo sapiens
aacugugaaauaccacaagccu

SEQ ID NO: 1952103 - RNA, 15 nt, Homo sapiens
augaaucaucaaagc

SEQ ID NO: 1952104 - RNA, 18 nt, Homo sapiens
ccagugaaaaacuauuaa

SEQ ID NO: 1952105 - RNA, 13 nt, Homo sapiens
ucaaugaccugua

SEQ ID NO: 1952106 - RNA, 15 nt, Homo sapiens
acagagggaagccau

SEQ ID NO: 1952107 - RNA, 22 nt, Homo sapiens
agcaauuauuacaauucuugaa

SEQ ID NO: 1952108 - RNA, 15 nt, Homo sapiens
uaugcucauugaacu

SEQ ID NO: 1952109 - RNA, 15 nt, Homo sapiens
gaauggaggcuccca

SEQ ID NO: 1952110 - RNA, 18 nt, Homo sapiens
ggugaccuguuaggucuc

SEQ ID NO: 1952111 - RNA, 15 nt, Homo sapiens
ccaagcucugcaguc

SEQ ID NO: 1952112 - RNA, 19 nt, Homo sapiens
gcugagugcaccacuucaa

SEQ ID NO: 1952113 - RNA, 12 nt, Homo sapiens
uucucuccggga

SEQ ID NO: 1952114 - RNA, 15 nt, Homo sapiens
ucaguuucauuuucc

SEQ ID NO: 1952115 - RNA, 16 nt, Homo sapiens
aguccugucaccaagg

SEQ ID NO: 1952116 - RNA, 16 nt, Homo sapiens
ccuacuuucauaauaa

SEQ ID NO: 1952117 - RNA, 23 nt, Homo sapiens
ucaaggugggccuugcuaccuca

SEQ ID NO: 1952118 - RNA, 16 nt, Homo sapiens
uggauggcaccucagg

SEQ ID NO: 1952119 - RNA, 16 nt, Homo sapiens
uuuaacacuucuguau

SEQ ID NO: 1952120 - RNA, 21 nt, Homo sapiens
acccccagcaacccuccuauc

SEQ ID NO: 1952121 - RNA, 20 nt, Homo sapiens
gaagguauuagcaaagcaaa

SEQ ID NO: 1952122 - RNA, 22 nt, Homo sapiens
uuaugaaagaccuuagacauaa

SEQ ID NO: 1952123 - RNA, 18 nt, Homo sapiens
uggagcagccaacaagca

SEQ ID NO: 1952124 - RNA, 20 nt, Homo sapiens
acucaggcagagcagcucca

SEQ ID NO: 1952125 - RNA, 16 nt, Homo sapiens
acagaugugucagcca

SEQ ID NO: 1952126 - RNA, 19 nt, Homo sapiens
aaggagccuacuccaagaa

SEQ ID NO: 1952127 - RNA, 22 nt, Homo sapiens
aauaaagguuagauaaguccuu

SEQ ID NO: 1952128 - RNA, 18 nt, Homo sapiens
aggccgugugucugucag

SEQ ID NO: 1952129 - RNA, 19 nt, Homo sapiens
acccaaguugaagacuuug

SEQ ID NO: 1952130 - RNA, 16 nt, Homo sapiens
ugucuuuaucaaagga

SEQ ID NO: 1952131 - RNA, 16 nt, Homo sapiens
ugagacuaugcaaaag

SEQ ID NO: 1952132 - RNA, 22 nt, Homo sapiens
cucagggcuucuccucugcuag

SEQ ID NO: 1952133 - RNA, 20 nt, Homo sapiens
gcucacgccuguaauucuag

SEQ ID NO: 1952134 - RNA, 13 nt, Homo sapiens
aauugacagauca

SEQ ID NO: 1952135 - RNA, 12 nt, Homo sapiens
ccuggaccucag

SEQ ID NO: 1952136 - RNA, 16 nt, Homo sapiens
gugcgugcaugugcac

SEQ ID NO: 1952137 - RNA, 22 nt, Homo sapiens
cuggguugcugcuguccagugc

SEQ ID NO: 1952138 - RNA, 20 nt, Homo sapiens
auacuguagacacucugaca

SEQ ID NO: 1952139 - RNA, 15 nt, Homo sapiens
auaguaacaucaaag

SEQ ID NO: 1952140 - RNA, 13 nt, Homo sapiens
ucauuacaauaca

SEQ ID NO: 1952141 - RNA, 15 nt, Homo sapiens
cucagccuugcaaau

SEQ ID NO: 1952142 - RNA, 22 nt, Homo sapiens
aaauguuagucccuaaccacuu

SEQ ID NO: 1952143 - RNA, 20 nt, Homo sapiens
uacuucucuuguuagguaau

SEQ ID NO: 1952144 - RNA, 20 nt, Homo sapiens
ggugucaccaugagcaccuc

SEQ ID NO: 1952145 - RNA, 15 nt, Homo sapiens
ugcuuguaaaaccaa

SEQ ID NO: 1952146 - RNA, 15 nt, Homo sapiens
uuacuguacauacaa

SEQ ID NO: 1952147 - RNA, 13 nt, Homo sapiens
cugccuguauacu

SEQ ID NO: 1952148 - RNA, 16 nt, Homo sapiens
aggagaaggagaggga

SEQ ID NO: 1952149 - RNA, 18 nt, Homo sapiens
ugucuuuaacucauaaaa

SEQ ID NO: 1952150 - RNA, 18 nt, Homo sapiens
acuccugggcaucugugc

SEQ ID NO: 1952151 - RNA, 19 nt, Homo sapiens
uuugguuuugacagguuuu

SEQ ID NO: 1952152 - RNA, 18 nt, Homo sapiens
aagccccagcuuggcuca

SEQ ID NO: 1952153 - RNA, 17 nt, Homo sapiens
caggccagugccaggac

SEQ ID NO: 1952154 - RNA, 14 nt, Homo sapiens
uccgggaacuggag

SEQ ID NO: 1952155 - RNA, 14 nt, Homo sapiens
uccagcaacugaac

SEQ ID NO: 1952156 - RNA, 19 nt, Homo sapiens
agaaagucaaugucaauga

SEQ ID NO: 1952157 - RNA, 23 nt, Homo sapiens
acuugguguuugguuccuguuca

SEQ ID NO: 1952158 - RNA, 19 nt, Homo sapiens
cccucuuucuacauucuca

SEQ ID NO: 1952159 - RNA, 20 nt, Homo sapiens
gaccuaaaauuugcccuccc

SEQ ID NO: 1952160 - RNA, 14 nt, Homo sapiens
auaaggagaaaaau

SEQ ID NO: 1952161 - RNA, 10 nt, Homo sapiens
agcuacugaa

SEQ ID NO: 1952162 - RNA, 17 nt, Homo sapiens
gccuggaccagccucuc

SEQ ID NO: 1952163 - RNA, 14 nt, Homo sapiens
gccacgaggagcuu

SEQ ID NO: 1952164 - RNA, 16 nt, Homo sapiens
caggcccugccuucag

SEQ ID NO: 1952165 - RNA, 14 nt, Homo sapiens
caggcacuuugcau

SEQ ID NO: 1952166 - RNA, 15 nt, Homo sapiens
ucauuuugcacugua

SEQ ID NO: 1952167 - RNA, 18 nt, Homo sapiens
agcauacgguaugauauu

SEQ ID NO: 1952168 - RNA, 22 nt, Homo sapiens
caccugccaccacgcccggcua

SEQ ID NO: 1952169 - RNA, 12 nt, Homo sapiens
aauuccuagcug

SEQ ID NO: 1952170 - RNA, 13 nt, Homo sapiens
uggauuaaagacu

SEQ ID NO: 1952171 - RNA, 21 nt, Homo sapiens
uuggccuucuuaggugacaau

SEQ ID NO: 1952172 - RNA, 21 nt, Homo sapiens
acuagagugaugacugcuugu

SEQ ID NO: 1952173 - RNA, 21 nt, Homo sapiens
ggccacaaaaguucccucuca

SEQ ID NO: 1952174 - RNA, 15 nt, Homo sapiens
uaugcuccaguaugg

SEQ ID NO: 1952175 - RNA, 14 nt, Homo sapiens
ucagccucccaaag

SEQ ID NO: 1952176 - RNA, 23 nt, Homo sapiens
agucucacugugggaaggccagc

SEQ ID NO: 1952177 - RNA, 16 nt, Homo sapiens
uauugaucaccaugaa

SEQ ID NO: 1952178 - RNA, 16 nt, Homo sapiens
ugaauuuagugagcau

SEQ ID NO: 1952179 - RNA, 14 nt, Homo sapiens
gguuguuucuucca

SEQ ID NO: 1952180 - RNA, 13 nt, Homo sapiens
ucgaggcaggaag

SEQ ID NO: 1952181 - RNA, 18 nt, Homo sapiens
uuuuucuaagcauauuca

SEQ ID NO: 1952182 - RNA, 19 nt, Homo sapiens
cauuacucugaaauuguaa

SEQ ID NO: 1952183 - RNA, 13 nt, Homo sapiens
uaugccacugacc

SEQ ID NO: 1952184 - RNA, 18 nt, Homo sapiens
auugcuaugguuuaauua

SEQ ID NO: 1952185 - RNA, 11 nt, Homo sapiens
aaaacacuguc

SEQ ID NO: 1952186 - RNA, 22 nt, Homo sapiens
ugaggcugcgagagaaagggag

SEQ ID NO: 1952187 - RNA, 21 nt, Homo sapiens
cugaggaaaauggaagaccua

SEQ ID NO: 1952188 - RNA, 23 nt, Homo sapiens
gaugugcauuucaccugugacaa

SEQ ID NO: 1952189 - RNA, 16 nt, Homo sapiens
aagcuguauauauuau

SEQ ID NO: 1952190 - RNA, 18 nt, Homo sapiens
agagaagcugccauccac

SEQ ID NO: 1952191 - RNA, 23 nt, Homo sapiens
agagguggggugcuggggcugca

SEQ ID NO: 1952192 - RNA, 23 nt, Homo sapiens
agauggaacacuggaacauucca

SEQ ID NO: 1952193 - RNA, 14 nt, Homo sapiens
aauguaacauacuc

SEQ ID NO: 1952194 - RNA, 22 nt, Homo sapiens
gaaaugaaagggaaacugggaa

SEQ ID NO: 1952195 - RNA, 18 nt, Homo sapiens
cagcacuuuguuucauau

SEQ ID NO: 1952196 - RNA, 17 nt, Homo sapiens
cuaucuuuuguucuacc

SEQ ID NO: 1952197 - RNA, 16 nt, Homo sapiens
agacaugaaugcacac

SEQ ID NO: 1952198 - RNA, 17 nt, Homo sapiens
uaaacccuuuagugcuu

SEQ ID NO: 1952199 - RNA, 17 nt, Homo sapiens
ccugcuaugacagcugg

SEQ ID NO: 1952200 - RNA, 20 nt, Homo sapiens
ugaggaagagaauaaauuaa

SEQ ID NO: 1952201 - RNA, 20 nt, Homo sapiens
aaaauauggacuuccaaucu

SEQ ID NO: 1952202 - RNA, 22 nt, Homo sapiens
aucccuccacccccauguggca

SEQ ID NO: 1952203 - RNA, 12 nt, Homo sapiens
aaacccaaauaa

SEQ ID NO: 1952204 - RNA, 18 nt, Homo sapiens
acagaaacuccuguucau

SEQ ID NO: 1952205 - RNA, 15 nt, Homo sapiens
guggaggauugcuau

SEQ ID NO: 1952206 - RNA, 21 nt, Homo sapiens
augucuuuucuuggcaaaagc

SEQ ID NO: 1952207 - RNA, 15 nt, Homo sapiens
gauguucugggacac

SEQ ID NO: 1952208 - RNA, 19 nt, Homo sapiens
uuuuagaggaagaccaaaa

SEQ ID NO: 1952209 - RNA, 17 nt, Homo sapiens
agcaagggacagugagg

SEQ ID NO: 1952210 - RNA, 21 nt, Homo sapiens
cagcuaucaggaugucccuga

SEQ ID NO: 1952211 - RNA, 16 nt, Homo sapiens
uuuuccuucuacuuac

SEQ ID NO: 1952212 - RNA, 13 nt, Homo sapiens
agggaagugugag

SEQ ID NO: 1952213 - RNA, 15 nt, Homo sapiens
aauaaugcaccacuu

SEQ ID NO: 1952214 - RNA, 20 nt, Homo sapiens
uaaccucuaccagcacauua

SEQ ID NO: 1952215 - RNA, 20 nt, Homo sapiens
gcccaccacccuggcaggcu

SEQ ID NO: 1952216 - RNA, 13 nt, Homo sapiens
accugaauguguc

SEQ ID NO: 1952217 - RNA, 19 nt, Homo sapiens
acuguagaaaccagcucau

SEQ ID NO: 1952218 - RNA, 19 nt, Homo sapiens
caaggugaggugaacucca

SEQ ID NO: 1952219 - RNA, 20 nt, Homo sapiens
gaggcaggagaaucgcuuga

SEQ ID NO: 1952220 - RNA, 15 nt, Homo sapiens
guucuguuggaugac

SEQ ID NO: 1952221 - RNA, 13 nt, Homo sapiens
caugcagccucuu

SEQ ID NO: 1952222 - RNA, 13 nt, Homo sapiens
agcuucuacccuu

SEQ ID NO: 1952223 - RNA, 12 nt, Homo sapiens
cucuuuaacuuc

SEQ ID NO: 1952224 - RNA, 23 nt, Homo sapiens
ccauccgguggccuauuccagga

SEQ ID NO: 1952225 - RNA, 20 nt, Homo sapiens
aucuaaauagauacuuuuga

SEQ ID NO: 1952226 - RNA, 14 nt, Homo sapiens
aaaaaagcaugcau

SEQ ID NO: 1952227 - RNA, 14 nt, Homo sapiens
uauuuuacacagca

SEQ ID NO: 1952228 - RNA, 14 nt, Homo sapiens
gaaauagagugaau

SEQ ID NO: 1952229 - RNA, 21 nt, Homo sapiens
uucaacugaaaaaaacauauc

SEQ ID NO: 1952230 - RNA, 18 nt, Homo sapiens
aucuuuuagcacaugugu

SEQ ID NO: 1952231 - RNA, 15 nt, Homo sapiens
agucuaaucaagugu

SEQ ID NO: 1952232 - RNA, 22 nt, Homo sapiens
ugaaugugcuggugaacacugu

SEQ ID NO: 1952233 - RNA, 19 nt, Homo sapiens
uugaauaucuuccacagag

SEQ ID NO: 1952234 - RNA, 18 nt, Homo sapiens
guucuaaaaucaagugca

SEQ ID NO: 1952235 - RNA, 10 nt, Homo sapiens
guugaugacu

SEQ ID NO: 1952236 - RNA, 15 nt, Homo sapiens
cccccauuuuuguaa

SEQ ID NO: 1952237 - RNA, 17 nt, Homo sapiens
acuccugaccucaggca

SEQ ID NO: 1952238 - RNA, 15 nt, Homo sapiens
caugaggaacuagcc

SEQ ID NO: 1952239 - RNA, 22 nt, Homo sapiens
gugcacugaaucguuucaugua

SEQ ID NO: 1952240 - RNA, 19 nt, Homo sapiens
ugaacagcuugcugucacu

SEQ ID NO: 1952241 - RNA, 12 nt, Homo sapiens
auugccaaaaag

SEQ ID NO: 1952242 - RNA, 16 nt, Homo sapiens
cuuuuuaggcucugag

SEQ ID NO: 1952243 - RNA, 18 nt, Homo sapiens
cccuuacuaugaucucag

SEQ ID NO: 1952244 - RNA, 19 nt, Homo sapiens
ugugucaaggugaagcaca

SEQ ID NO: 1952245 - RNA, 17 nt, Homo sapiens
ccuuuuuguuucaauga

SEQ ID NO: 1952246 - RNA, 17 nt, Homo sapiens
caggaugaaaaugaaga

SEQ ID NO: 1952247 - RNA, 19 nt, Homo sapiens
ccuggcuuugcuuagcuug

SEQ ID NO: 1952248 - RNA, 16 nt, Homo sapiens
uaaaaaccuguucaag

SEQ ID NO: 1952249 - RNA, 19 nt, Homo sapiens
ggcucagcggggacagcuc

SEQ ID NO: 1952250 - RNA, 21 nt, Homo sapiens
gugacuucuccaggucucacg

SEQ ID NO: 1952251 - RNA, 19 nt, Homo sapiens
cugcugauauaauaucaua

SEQ ID NO: 1952252 - RNA, 14 nt, Homo sapiens
cagccaaguuuuau

SEQ ID NO: 1952253 - RNA, 20 nt, Homo sapiens
ggcacaagaaucacuugaac

SEQ ID NO: 1952254 - RNA, 18 nt, Homo sapiens
acacauuuuucuuaggga

SEQ ID NO: 1952255 - RNA, 22 nt, Homo sapiens
agaacaugaggauaacuuccuu

SEQ ID NO: 1952256 - RNA, 19 nt, Homo sapiens
agaaguccccucuacuuua

SEQ ID NO: 1952257 - RNA, 18 nt, Homo sapiens
ucuuucaacugcagugua

SEQ ID NO: 1952258 - RNA, 18 nt, Homo sapiens
ucaagagcaucuggaaca

SEQ ID NO: 1952259 - RNA, 14 nt, Homo sapiens
cuucauuuguguca

SEQ ID NO: 1952260 - RNA, 12 nt, Homo sapiens
cuggacgcauca

SEQ ID NO: 1952261 - RNA, 14 nt, Homo sapiens
uucauuuccgugaa

SEQ ID NO: 1952262 - RNA, 19 nt, Homo sapiens
uaacgugauaaaccugcuc

SEQ ID NO: 1952263 - RNA, 17 nt, Homo sapiens
cucugaaggaggccacc

SEQ ID NO: 1952264 - RNA, 22 nt, Homo sapiens
augccuuccgacaccacuggga

SEQ ID NO: 1952265 - RNA, 21 nt, Homo sapiens
aagcccagccuaucucucuuc

SEQ ID NO: 1952266 - RNA, 16 nt, Homo sapiens
agggucucugcuccag

SEQ ID NO: 1952267 - RNA, 19 nt, Homo sapiens
gguagcugggauuacaggc

SEQ ID NO: 1952268 - RNA, 19 nt, Homo sapiens
uauccauaguggacauugu

SEQ ID NO: 1952269 - RNA, 14 nt, Homo sapiens
agaaaagacacuga

SEQ ID NO: 1952270 - RNA, 13 nt, Homo sapiens
cgaauaaagugaa

SEQ ID NO: 1952271 - RNA, 22 nt, Homo sapiens
uccuggacaaccuggacccaga

SEQ ID NO: 1952272 - RNA, 14 nt, Homo sapiens
uguuccugccacau

SEQ ID NO: 1952273 - RNA, 18 nt, Homo sapiens
aggcaugaagaagccacu

SEQ ID NO: 1952274 - RNA, 22 nt, Homo sapiens
cauauaggauuauagauacuua

SEQ ID NO: 1952275 - RNA, 16 nt, Homo sapiens
cagcaccaaccacagc

SEQ ID NO: 1952276 - RNA, 19 nt, Homo sapiens
ugugccuagugauguagaa

SEQ ID NO: 1952277 - RNA, 16 nt, Homo sapiens
ugggcgagacacagcu

SEQ ID NO: 1952278 - RNA, 17 nt, Homo sapiens
gaaaagcgcagagaaau

SEQ ID NO: 1952279 - RNA, 11 nt, Homo sapiens
accacugaccc

SEQ ID NO: 1952280 - RNA, 11 nt, Homo sapiens
cauacugaaau

SEQ ID NO: 1952281 - RNA, 23 nt, Homo sapiens
uuaaaacaaaggaacuaacuuac

SEQ ID NO: 1952282 - RNA, 18 nt, Homo sapiens
ugucuacaugccaugacc

SEQ ID NO: 1952283 - RNA, 22 nt, Homo sapiens
aaagaauuccugcagcaguuau

SEQ ID NO: 1952284 - RNA, 14 nt, Homo sapiens
cacaggugcacaga

SEQ ID NO: 1952285 - RNA, 19 nt, Homo sapiens
auagccuguggccuuugca

SEQ ID NO: 1952286 - RNA, 13 nt, Homo sapiens
cguucaccaguug

SEQ ID NO: 1952287 - RNA, 11 nt, Homo sapiens
acugaguccac

SEQ ID NO: 1952288 - RNA, 13 nt, Homo sapiens
ccaauagucauau

SEQ ID NO: 1952289 - RNA, 22 nt, Homo sapiens
cauccugagcagugccagcuuu

SEQ ID NO: 1952290 - RNA, 18 nt, Homo sapiens
auucuuaauaggcuuuau

SEQ ID NO: 1952291 - RNA, 19 nt, Homo sapiens
cuuuuaaaauaagcauuua

SEQ ID NO: 1952292 - RNA, 15 nt, Homo sapiens
accaacugcucucaa

SEQ ID NO: 1952293 - RNA, 19 nt, Homo sapiens
gcaaaaucucuacugcuuu

SEQ ID NO: 1952294 - RNA, 23 nt, Homo sapiens
caaaggaucuuauuuugugaacu

SEQ ID NO: 1952295 - RNA, 16 nt, Homo sapiens
gaguccuccuguccag

SEQ ID NO: 1952296 - RNA, 21 nt, Homo sapiens
ucuuuccgacacauuuaccaa

SEQ ID NO: 1952297 - RNA, 18 nt, Homo sapiens
ugaacauaaguaaucacu

SEQ ID NO: 1952298 - RNA, 20 nt, Homo sapiens
auuuacugcaagaaguacau

SEQ ID NO: 1952299 - RNA, 22 nt, Homo sapiens
ugcacaaugauuuuuugcaaaa

SEQ ID NO: 1952300 - RNA, 12 nt, Homo sapiens
augcucccucag

SEQ ID NO: 1952301 - RNA, 15 nt, Homo sapiens
cagggagggcugugg

SEQ ID NO: 1952302 - RNA, 18 nt, Homo sapiens
gcuuacaaguauugaaau

SEQ ID NO: 1952303 - RNA, 23 nt, Homo sapiens
aaaauuaauuaggaauuacuuua

SEQ ID NO: 1952304 - RNA, 19 nt, Homo sapiens
auacaaugacuagucaccu

SEQ ID NO: 1952305 - RNA, 18 nt, Homo sapiens
ugagggaucacugccaaa

SEQ ID NO: 1952306 - RNA, 20 nt, Homo sapiens
aacaugcugaaaacuacaca

SEQ ID NO: 1952307 - RNA, 20 nt, Homo sapiens
agaccuuccaaggacauauu

SEQ ID NO: 1952308 - RNA, 21 nt, Homo sapiens
uaacacauuuuuuugcaugca

SEQ ID NO: 1952309 - RNA, 19 nt, Homo sapiens
ccugagaggagcguguccu

SEQ ID NO: 1952310 - RNA, 23 nt, Homo sapiens
acagagaagcggauuuccaggga

SEQ ID NO: 1952311 - RNA, 17 nt, Homo sapiens
uuucuaauuugcugcug

SEQ ID NO: 1952312 - RNA, 19 nt, Homo sapiens
uggcaagucuagagucuca

SEQ ID NO: 1952313 - RNA, 21 nt, Homo sapiens
uacagacaaccuaucauuuau

SEQ ID NO: 1952314 - RNA, 10 nt, Homo sapiens
aucaaugugu

SEQ ID NO: 1952315 - RNA, 21 nt, Homo sapiens
gacaccagagcagaugcagag

SEQ ID NO: 1952316 - RNA, 17 nt, Homo sapiens
gccugugucccaugacc

SEQ ID NO: 1952317 - RNA, 14 nt, Homo sapiens
caccacuccugcca

SEQ ID NO: 1952318 - RNA, 14 nt, Homo sapiens
uauuauauuaucau

SEQ ID NO: 1952319 - RNA, 14 nt, Homo sapiens
ucauucauucacuc

SEQ ID NO: 1952320 - RNA, 14 nt, Homo sapiens
gaacaaaugaauaa

SEQ ID NO: 1952321 - RNA, 23 nt, Homo sapiens
aaugguuuuaauguucuuuugac

SEQ ID NO: 1952322 - RNA, 20 nt, Homo sapiens
ucuauaaagaagaacuugca

SEQ ID NO: 1952323 - RNA, 21 nt, Homo sapiens
uuugggucucucauaccucug

SEQ ID NO: 1952324 - RNA, 17 nt, Homo sapiens
aaagaucugcuccucgc

SEQ ID NO: 1952325 - RNA, 15 nt, Homo sapiens
uugauuuuuugccca

SEQ ID NO: 1952326 - RNA, 16 nt, Homo sapiens
cuauguauucaaguaa

SEQ ID NO: 1952327 - RNA, 20 nt, Homo sapiens
cuuauucaguucuuacacau

SEQ ID NO: 1952328 - RNA, 14 nt, Homo sapiens
auaaaaaugagugc

SEQ ID NO: 1952329 - RNA, 18 nt, Homo sapiens
gaugugugagcuaugcaa

SEQ ID NO: 1952330 - RNA, 22 nt, Homo sapiens
auauuuuauaaagauacuaaac

SEQ ID NO: 1952331 - RNA, 21 nt, Homo sapiens
agcauuuuacuacuuguuacc

SEQ ID NO: 1952332 - RNA, 23 nt, Homo sapiens
aaucugagccagugcuuuaaugg

SEQ ID NO: 1952333 - RNA, 19 nt, Homo sapiens
agaguccuguaccacucac

SEQ ID NO: 1952334 - RNA, 21 nt, Homo sapiens
uuuuauaugcuuuuucucaga

SEQ ID NO: 1952335 - RNA, 17 nt, Homo sapiens
gaagccacagugcccac

SEQ ID NO: 1952336 - RNA, 13 nt, Homo sapiens
caagcugcugcuu

SEQ ID NO: 1952337 - RNA, 17 nt, Homo sapiens
gugccauuacuacugua

SEQ ID NO: 1952338 - RNA, 22 nt, Homo sapiens
uacauauguagacuauauacau

SEQ ID NO: 1952339 - RNA, 23 nt, Homo sapiens
auaauaaaguguuuuuaauaauu

SEQ ID NO: 1952340 - RNA, 14 nt, Homo sapiens
uccaaaugagccac

SEQ ID NO: 1952341 - RNA, 17 nt, Homo sapiens
auaaaugucagauaauu

SEQ ID NO: 1952342 - RNA, 17 nt, Homo sapiens
cucuguuugugggacug

SEQ ID NO: 1952343 - RNA, 13 nt, Homo sapiens
ugcccaaagccau

SEQ ID NO: 1952344 - RNA, 20 nt, Homo sapiens
aauucuggaaacuccugaca

SEQ ID NO: 1952345 - RNA, 19 nt, Homo sapiens
aaaauguaugaccacuggg

SEQ ID NO: 1952346 - RNA, 18 nt, Homo sapiens
auaguaagccucccuccu

SEQ ID NO: 1952347 - RNA, 15 nt, Homo sapiens
ccugcuucauaucuc

SEQ ID NO: 1952348 - RNA, 20 nt, Homo sapiens
uagucucucugcaagacaga

SEQ ID NO: 1952349 - RNA, 16 nt, Homo sapiens
agccauaccaggguga

SEQ ID NO: 1952350 - RNA, 21 nt, Homo sapiens
cauccauuuauuuggcaucug

SEQ ID NO: 1952351 - RNA, 22 nt, Homo sapiens
cuuuggguuggagcuguuccau

SEQ ID NO: 1952352 - RNA, 13 nt, Homo sapiens
ucugcucacuuua

SEQ ID NO: 1952353 - RNA, 16 nt, Homo sapiens
gguagcagcaaauagc

SEQ ID NO: 1952354 - RNA, 13 nt, Homo sapiens
uguucugugccug

SEQ ID NO: 1952355 - RNA, 13 nt, Homo sapiens
gguucuguuccug

SEQ ID NO: 1952356 - RNA, 22 nt, Homo sapiens
gguccuaaauucuuaaccugga

SEQ ID NO: 1952357 - RNA, 23 nt, Homo sapiens
aauggcucacuauggugccaaug

SEQ ID NO: 1952358 - RNA, 18 nt, Homo sapiens
ccucuuugugauaauucu

SEQ ID NO: 1952359 - RNA, 15 nt, Homo sapiens
uuagcuucaggauac

SEQ ID NO: 1952360 - RNA, 19 nt, Homo sapiens
cagcuguacugaggaugau

SEQ ID NO: 1952361 - RNA, 22 nt, Homo sapiens
guccuccauuucaacuccagaa

SEQ ID NO: 1952362 - RNA, 20 nt, Homo sapiens
cugcucugguuagaaaaagg

SEQ ID NO: 1952363 - RNA, 17 nt, Homo sapiens
uauuuuuuucugaaauu

SEQ ID NO: 1952364 - RNA, 17 nt, Homo sapiens
aagcuagaggugaacua

SEQ ID NO: 1952365 - RNA, 18 nt, Homo sapiens
uuaaauuuagcugcugca

SEQ ID NO: 1952366 - RNA, 15 nt, Homo sapiens
auuccaccaaaugug

SEQ ID NO: 1952367 - RNA, 17 nt, Homo sapiens
ggcacucccauccaucc

SEQ ID NO: 1952368 - RNA, 16 nt, Homo sapiens
caaaggaacacugaca

SEQ ID NO: 1952369 - RNA, 19 nt, Homo sapiens
ggccggacagaacuggugc

SEQ ID NO: 1952370 - RNA, 21 nt, Homo sapiens
cacuugggcccaggaggucaa

SEQ ID NO: 1952371 - RNA, 18 nt, Homo sapiens
uuucuucaguccagagaa

SEQ ID NO: 1952372 - RNA, 19 nt, Homo sapiens
cucagagcuccacagaaga

SEQ ID NO: 1952373 - RNA, 18 nt, Homo sapiens
gccaauaaaaaugucuca

SEQ ID NO: 1952374 - RNA, 16 nt, Homo sapiens
uauauuggaagcugcu

SEQ ID NO: 1952375 - RNA, 23 nt, Homo sapiens
cauuuaaacucagcugaucugau

SEQ ID NO: 1952376 - RNA, 17 nt, Homo sapiens
acccgccgccucccacg

SEQ ID NO: 1952377 - RNA, 22 nt, Homo sapiens
uaugagggccacgggucugugu

SEQ ID NO: 1952378 - RNA, 14 nt, Homo sapiens
caaauuuucaaguu

SEQ ID NO: 1952379 - RNA, 10 nt, Homo sapiens
cuucagggcg

SEQ ID NO: 1952380 - RNA, 15 nt, Homo sapiens
cauuaaccugagguc

SEQ ID NO: 1952381 - RNA, 17 nt, Homo sapiens
ggagguuccggugucug

SEQ ID NO: 1952382 - RNA, 16 nt, Homo sapiens
caacccgguucacucu

SEQ ID NO: 1952383 - RNA, 20 nt, Homo sapiens
uacuacuguguaagggccag

SEQ ID NO: 1952384 - RNA, 14 nt, Homo sapiens
caauaaaaccaaac

SEQ ID NO: 1952385 - RNA, 18 nt, Homo sapiens
ugauugcccaauggaacu

SEQ ID NO: 1952386 - RNA, 18 nt, Homo sapiens
auuccugguuugacucag

SEQ ID NO: 1952387 - RNA, 18 nt, Homo sapiens
cauguuggcuagccucug

SEQ ID NO: 1952388 - RNA, 12 nt, Homo sapiens
uagcuaggauuu

SEQ ID NO: 1952389 - RNA, 14 nt, Homo sapiens
uuaaauggcuuuau

SEQ ID NO: 1952390 - RNA, 18 nt, Homo sapiens
acaggaggucagcacaag

SEQ ID NO: 1952391 - RNA, 18 nt, Homo sapiens
auaaaguaaugaucucaa

SEQ ID NO: 1952392 - RNA, 16 nt, Homo sapiens
uuaaugaagugcaaua

SEQ ID NO: 1952393 - RNA, 23 nt, Homo sapiens
uagacacccauuuucacauuccc

SEQ ID NO: 1952394 - RNA, 17 nt, Homo sapiens
uccccaacugaguucaa

SEQ ID NO: 1952395 - RNA, 20 nt, Homo sapiens
uucuccugccuuugccucca

SEQ ID NO: 1952396 - RNA, 18 nt, Homo sapiens
auguuugcacacuugugu

SEQ ID NO: 1952397 - RNA, 15 nt, Homo sapiens
cugcggcgucugucu

SEQ ID NO: 1952398 - RNA, 20 nt, Homo sapiens
gaucucaggggucuuaccuu

SEQ ID NO: 1952399 - RNA, 18 nt, Homo sapiens
cagaauuuggaagcuaga

SEQ ID NO: 1952400 - RNA, 14 nt, Homo sapiens
uugucuagaacacu

SEQ ID NO: 1952401 - RNA, 22 nt, Homo sapiens
gaaguacugcacccagcagugu

SEQ ID NO: 1952402 - RNA, 13 nt, Homo sapiens
caccagacaucac

SEQ ID NO: 1952403 - RNA, 19 nt, Homo sapiens
uucuccaucccucuaauga

SEQ ID NO: 1952404 - RNA, 18 nt, Homo sapiens
cauuguauggauaguaaa

SEQ ID NO: 1952405 - RNA, 23 nt, Homo sapiens
gagugugggggaggcgcacagug

SEQ ID NO: 1952406 - RNA, 22 nt, Homo sapiens
cauuccccucgugugacucucu

SEQ ID NO: 1952407 - RNA, 19 nt, Homo sapiens
caucagcuguuaaccauuu

SEQ ID NO: 1952408 - RNA, 23 nt, Homo sapiens
gauucacccccaaacagugacau

SEQ ID NO: 1952409 - RNA, 14 nt, Homo sapiens
gguaccauggugua

SEQ ID NO: 1952410 - RNA, 15 nt, Homo sapiens
agucaguugcucaaa

SEQ ID NO: 1952411 - RNA, 12 nt, Homo sapiens
ugcucaggauaa

SEQ ID NO: 1952412 - RNA, 17 nt, Homo sapiens
caaggugaauagcacag

SEQ ID NO: 1952413 - RNA, 14 nt, Homo sapiens
gcaccucucugggu

SEQ ID NO: 1952414 - RNA, 22 nt, Homo sapiens
aguggucaauguagauuucaag

SEQ ID NO: 1952415 - RNA, 16 nt, Homo sapiens
guuagaaaugcaaauu

SEQ ID NO: 1952416 - RNA, 17 nt, Homo sapiens
ccauccggucaccagaa

SEQ ID NO: 1952417 - RNA, 23 nt, Homo sapiens
ucuggcacccuguccgucuccag

SEQ ID NO: 1952418 - RNA, 23 nt, Homo sapiens
cucugcuccagacucacuugcca

SEQ ID NO: 1952419 - RNA, 17 nt, Homo sapiens
cuuggggaaggggccug

SEQ ID NO: 1952420 - RNA, 19 nt, Homo sapiens
caguaguguauuaaaugaa

SEQ ID NO: 1952421 - RNA, 14 nt, Homo sapiens
agaccuggcucuca

SEQ ID NO: 1952422 - RNA, 18 nt, Homo sapiens
gaagcgaaacacagagaa

SEQ ID NO: 1952423 - RNA, 19 nt, Homo sapiens
augguaauagcuuuaguga

SEQ ID NO: 1952424 - RNA, 16 nt, Homo sapiens
aucugccgcuuugucu

SEQ ID NO: 1952425 - RNA, 18 nt, Homo sapiens
cuguguauauuauuuggc

SEQ ID NO: 1952426 - RNA, 16 nt, Homo sapiens
cgaguucagcaaagag

SEQ ID NO: 1952427 - RNA, 20 nt, Homo sapiens
ccaccaacagcccucagguc

SEQ ID NO: 1952428 - RNA, 14 nt, Homo sapiens
ccuucagcaucuca

SEQ ID NO: 1952429 - RNA, 14 nt, Homo sapiens
accaaugccuuaau

SEQ ID NO: 1952430 - RNA, 20 nt, Homo sapiens
cacccuggagagugcacaug

SEQ ID NO: 1952431 - RNA, 16 nt, Homo sapiens
aggagccuacuccaag

SEQ ID NO: 1952432 - RNA, 15 nt, Homo sapiens
aagaaaacacuguca

SEQ ID NO: 1952433 - RNA, 18 nt, Homo sapiens
uccaggcccaacugugag

SEQ ID NO: 1952434 - RNA, 13 nt, Homo sapiens
ucugccgccucag

SEQ ID NO: 1952435 - RNA, 20 nt, Homo sapiens
uaaaugugacauugauuugc

SEQ ID NO: 1952436 - RNA, 15 nt, Homo sapiens
ccuucugcugcccaa

SEQ ID NO: 1952437 - RNA, 15 nt, Homo sapiens
acauccccagcugcc

SEQ ID NO: 1952438 - RNA, 14 nt, Homo sapiens
agugggacaguucc

SEQ ID NO: 1952439 - RNA, 17 nt, Homo sapiens
agucugauucccaagcu

SEQ ID NO: 1952440 - RNA, 20 nt, Homo sapiens
accauaaaaaggaauccacu

SEQ ID NO: 1952441 - RNA, 21 nt, Homo sapiens
agcaauaucauaauuaaugua

SEQ ID NO: 1952442 - RNA, 16 nt, Homo sapiens
acccugcuucaaauau

SEQ ID NO: 1952443 - RNA, 14 nt, Homo sapiens
uggguuugguuaga

SEQ ID NO: 1952444 - RNA, 18 nt, Homo sapiens
auccuacccuaaugccag

SEQ ID NO: 1952445 - RNA, 18 nt, Homo sapiens
gauaucuaugacuguguu

SEQ ID NO: 1952446 - RNA, 22 nt, Homo sapiens
cuccuguguuugcaccaaaaua

SEQ ID NO: 1952447 - RNA, 21 nt, Homo sapiens
ccuugggaugaugccucauga

SEQ ID NO: 1952448 - RNA, 16 nt, Homo sapiens
aaaauuaaaauggaug

SEQ ID NO: 1952449 - RNA, 16 nt, Homo sapiens
aauauagcaucuuuca

SEQ ID NO: 1952450 - RNA, 17 nt, Homo sapiens
uggaaaaguacaaguag

SEQ ID NO: 1952451 - RNA, 21 nt, Homo sapiens
ccauguuaacaugacauuuac

SEQ ID NO: 1952452 - RNA, 22 nt, Homo sapiens
accaggaaggaagcuguugcuu

SEQ ID NO: 1952453 - RNA, 21 nt, Homo sapiens
aaggcacauugaaauacuuga

SEQ ID NO: 1952454 - RNA, 19 nt, Homo sapiens
guucaacuuuuccuuugaa

SEQ ID NO: 1952455 - RNA, 15 nt, Homo sapiens
ucuccuauguggcag

SEQ ID NO: 1952456 - RNA, 17 nt, Homo sapiens
auuccugguuugacuca

SEQ ID NO: 1952457 - RNA, 23 nt, Homo sapiens
cucccaacaacaugaaacugccu

SEQ ID NO: 1952458 - RNA, 22 nt, Homo sapiens
ugucuugggaauuuucuuccaa

SEQ ID NO: 1952459 - RNA, 15 nt, Homo sapiens
uaauaaacucucuag

SEQ ID NO: 1952460 - RNA, 16 nt, Homo sapiens
uuuuuccucucugcaa

SEQ ID NO: 1952461 - RNA, 18 nt, Homo sapiens
gcauugauugcacuugau

SEQ ID NO: 1952462 - RNA, 15 nt, Homo sapiens
ugucuucucccugca

SEQ ID NO: 1952463 - RNA, 23 nt, Homo sapiens
uauauauguacccacuuagucau

SEQ ID NO: 1952464 - RNA, 23 nt, Homo sapiens
gcauggaggcugcgacugaugaa

SEQ ID NO: 1952465 - RNA, 21 nt, Homo sapiens
ccagcauuuugagaggcugag

SEQ ID NO: 1952466 - RNA, 20 nt, Homo sapiens
caaguauagccuauggcaga

SEQ ID NO: 1952467 - RNA, 14 nt, Homo sapiens
cacugcacugcaug

SEQ ID NO: 1952468 - RNA, 19 nt, Homo sapiens
cagccuccagggcauugcu

SEQ ID NO: 1952469 - RNA, 14 nt, Homo sapiens
acacaggucagggc

SEQ ID NO: 1952470 - RNA, 17 nt, Homo sapiens
aggcagagguugcagug

SEQ ID NO: 1952471 - RNA, 19 nt, Homo sapiens
uccauucagaaagcauuua

SEQ ID NO: 1952472 - RNA, 19 nt, Homo sapiens
agacuguuuucagaccuuu

SEQ ID NO: 1952473 - RNA, 17 nt, Homo sapiens
ucugugccccucaugcu

SEQ ID NO: 1952474 - RNA, 16 nt, Homo sapiens
ucuaccaggcaaauuc

SEQ ID NO: 1952475 - RNA, 16 nt, Homo sapiens
ucuuggcaguauucca

SEQ ID NO: 1952476 - RNA, 12 nt, Homo sapiens
cugaaacugcag

SEQ ID NO: 1952477 - RNA, 20 nt, Homo sapiens
aggggguuacaaacugcaau

SEQ ID NO: 1952478 - RNA, 15 nt, Homo sapiens
cagcaccccugcuga

SEQ ID NO: 1952479 - RNA, 20 nt, Homo sapiens
uucuuucuuaaccacuuuca

SEQ ID NO: 1952480 - RNA, 15 nt, Homo sapiens
accgagcacauacca

SEQ ID NO: 1952481 - RNA, 23 nt, Homo sapiens
ucuguuucuaauuugcugcugau

SEQ ID NO: 1952482 - RNA, 10 nt, Homo sapiens
agaagccauu

SEQ ID NO: 1952483 - RNA, 20 nt, Homo sapiens
cuuguuuucuacuuugccac

SEQ ID NO: 1952484 - RNA, 15 nt, Homo sapiens
ugaauaguugcuuaa

SEQ ID NO: 1952485 - RNA, 20 nt, Homo sapiens
uuuguuuuguaucauuauga

SEQ ID NO: 1952486 - RNA, 17 nt, Homo sapiens
gacuuagugcaacaggu

SEQ ID NO: 1952487 - RNA, 23 nt, Homo sapiens
agggcuagaaucuggagagcuag

SEQ ID NO: 1952488 - RNA, 14 nt, Homo sapiens
agauuuccuacuuu

SEQ ID NO: 1952489 - RNA, 17 nt, Homo sapiens
caaauguucaucaauga

SEQ ID NO: 1952490 - RNA, 18 nt, Homo sapiens
gguggcggcagggccagg

SEQ ID NO: 1952491 - RNA, 14 nt, Homo sapiens
gccaggagcccugg

SEQ ID NO: 1952492 - RNA, 14 nt, Homo sapiens
gagauaagcaguua

SEQ ID NO: 1952493 - RNA, 21 nt, Homo sapiens
aagaguugagauuuugcaauc

SEQ ID NO: 1952494 - RNA, 16 nt, Homo sapiens
gcaguggcgugaucuc

SEQ ID NO: 1952495 - RNA, 15 nt, Homo sapiens
uggaucaccauuaua

SEQ ID NO: 1952496 - RNA, 15 nt, Homo sapiens
gcucaaaaucuguga

SEQ ID NO: 1952497 - RNA, 16 nt, Homo sapiens
uuaccgagagccaaac

SEQ ID NO: 1952498 - RNA, 22 nt, Homo sapiens
cccuuuccugggggaugugcac

SEQ ID NO: 1952499 - RNA, 19 nt, Homo sapiens
cuaagacccacaaacugcc

SEQ ID NO: 1952500 - RNA, 17 nt, Homo sapiens
uagggaaggccucccag

SEQ ID NO: 1952501 - RNA, 13 nt, Homo sapiens
augaaugcugauu

SEQ ID NO: 1952502 - RNA, 13 nt, Homo sapiens
gcuuacugcgcua

SEQ ID NO: 1952503 - RNA, 16 nt, Homo sapiens
ucuugaacucuuggcc

SEQ ID NO: 1952504 - RNA, 20 nt, Homo sapiens
ucaggacucagaacagucug

SEQ ID NO: 1952505 - RNA, 21 nt, Homo sapiens
cuuggcuuuaugcaaauacaa

SEQ ID NO: 1952506 - RNA, 15 nt, Homo sapiens
gcuaugucucuagca

SEQ ID NO: 1952507 - RNA, 16 nt, Homo sapiens
uacucaaaaauuugcu

SEQ ID NO: 1952508 - RNA, 19 nt, Homo sapiens
cuuacaagaggauuguaaa

SEQ ID NO: 1952509 - RNA, 16 nt, Homo sapiens
aagcucugaagucaca

SEQ ID NO: 1952510 - RNA, 19 nt, Homo sapiens
caugaagcuucaugcacuu

SEQ ID NO: 1952511 - RNA, 15 nt, Homo sapiens
cucuggcacccaucu

SEQ ID NO: 1952512 - RNA, 14 nt, Homo sapiens
ggccccuccaucca

SEQ ID NO: 1952513 - RNA, 13 nt, Homo sapiens
guuuaucucugag

SEQ ID NO: 1952514 - RNA, 22 nt, Homo sapiens
ucccccuggggcuucuccugac

SEQ ID NO: 1952515 - RNA, 18 nt, Homo sapiens
cucggagaagagcgcagu

SEQ ID NO: 1952516 - RNA, 23 nt, Homo sapiens
ggagcagugugaccuccugugac

SEQ ID NO: 1952517 - RNA, 18 nt, Homo sapiens
uaucuagacccaucuucu

SEQ ID NO: 1952518 - RNA, 21 nt, Homo sapiens
cuaaagaauucuugaaaaacu

SEQ ID NO: 1952519 - RNA, 15 nt, Homo sapiens
cuugcuggaccugaa

SEQ ID NO: 1952520 - RNA, 18 nt, Homo sapiens
aggugccuggccauguca

SEQ ID NO: 1952521 - RNA, 14 nt, Homo sapiens
gauccgagucuacc

SEQ ID NO: 1952522 - RNA, 21 nt, Homo sapiens
gacuccacaguuuugccuuaa

SEQ ID NO: 1952523 - RNA, 16 nt, Homo sapiens
ccccugguaagcagag

SEQ ID NO: 1952524 - RNA, 16 nt, Homo sapiens
cugggauuaagugaga

SEQ ID NO: 1952525 - RNA, 14 nt, Homo sapiens
aucuuaaaugagac

SEQ ID NO: 1952526 - RNA, 18 nt, Homo sapiens
ucauauuugaaaaccaua

SEQ ID NO: 1952527 - RNA, 18 nt, Homo sapiens
uucagggccagggcucca

SEQ ID NO: 1952528 - RNA, 17 nt, Homo sapiens
agagaaaauuaauuccu

SEQ ID NO: 1952529 - RNA, 23 nt, Homo sapiens
ggcaucaccuccaccauacucca

SEQ ID NO: 1952530 - RNA, 16 nt, Homo sapiens
uugguaacauccuuuc

SEQ ID NO: 1952531 - RNA, 17 nt, Homo sapiens
gaaguuaacuacagugu

SEQ ID NO: 1952532 - RNA, 22 nt, Homo sapiens
auugucuauuccugaguuauaa

SEQ ID NO: 1952533 - RNA, 17 nt, Homo sapiens
auuuuaguuguccucag

SEQ ID NO: 1952534 - RNA, 19 nt, Homo sapiens
ugaccuugggguacaauug

SEQ ID NO: 1952535 - RNA, 22 nt, Homo sapiens
acagguuuuauuuuaucacuug

SEQ ID NO: 1952536 - RNA, 22 nt, Homo sapiens
cuauacccacccagaaugagac

SEQ ID NO: 1952537 - RNA, 16 nt, Homo sapiens
aaauaaaauauucacu

SEQ ID NO: 1952538 - RNA, 15 nt, Homo sapiens
caaaaauucacaaau

SEQ ID NO: 1952539 - RNA, 13 nt, Homo sapiens
cagccaagggaug

SEQ ID NO: 1952540 - RNA, 14 nt, Homo sapiens
uagcugcuaccuuc

SEQ ID NO: 1952541 - RNA, 14 nt, Homo sapiens
aguggggucagggc

SEQ ID NO: 1952542 - RNA, 23 nt, Homo sapiens
ggacucaggcgggacagugcugc

SEQ ID NO: 1952543 - RNA, 19 nt, Homo sapiens
uguaaaauaaguauuucca

SEQ ID NO: 1952544 - RNA, 21 nt, Homo sapiens
accuaauaagugcuacuuugc

SEQ ID NO: 1952545 - RNA, 22 nt, Homo sapiens
augaacccauccgguuugccau

SEQ ID NO: 1952546 - RNA, 14 nt, Homo sapiens
acuccacucagguu

SEQ ID NO: 1952547 - RNA, 23 nt, Homo sapiens
aggaagcucagccuucuccuccc

SEQ ID NO: 1952548 - RNA, 16 nt, Homo sapiens
ugggcaccgggacccc

SEQ ID NO: 1952549 - RNA, 14 nt, Homo sapiens
ugagguacagcaga

SEQ ID NO: 1952550 - RNA, 18 nt, Homo sapiens
uuaagacuguaaugugua

SEQ ID NO: 1952551 - RNA, 15 nt, Homo sapiens
cugggcacaguggac

SEQ ID NO: 1952552 - RNA, 18 nt, Homo sapiens
cacauaaagcacuaccua

SEQ ID NO: 1952553 - RNA, 19 nt, Homo sapiens
ccagcuccuuggcugcagc

SEQ ID NO: 1952554 - RNA, 19 nt, Homo sapiens
cugcccccucccccgcaga

SEQ ID NO: 1952555 - RNA, 17 nt, Homo sapiens
uucauucagcuaacaaa

SEQ ID NO: 1952556 - RNA, 19 nt, Homo sapiens
cauauugcuaccaaaaacu

SEQ ID NO: 1952557 - RNA, 19 nt, Homo sapiens
cacacaacacugaugugac

SEQ ID NO: 1952558 - RNA, 13 nt, Homo sapiens
gucuccucuguca

SEQ ID NO: 1952559 - RNA, 11 nt, Homo sapiens
accugcugcug

SEQ ID NO: 1952560 - RNA, 16 nt, Homo sapiens
uaugaggguacugugg

SEQ ID NO: 1952561 - RNA, 16 nt, Homo sapiens
ggaaguccucugggua

SEQ ID NO: 1952562 - RNA, 16 nt, Homo sapiens
ugugaacaucccuuau

SEQ ID NO: 1952563 - RNA, 21 nt, Homo sapiens
aaugaaaacaguguguaaaca

SEQ ID NO: 1952564 - RNA, 18 nt, Homo sapiens
auaacauauagcagacca

SEQ ID NO: 1952565 - RNA, 21 nt, Homo sapiens
augaccuugaguuaacaggac

SEQ ID NO: 1952566 - RNA, 23 nt, Homo sapiens
uuccucccaaaggcuuucuuucc

SEQ ID NO: 1952567 - RNA, 12 nt, Homo sapiens
uggggcagacaa

SEQ ID NO: 1952568 - RNA, 22 nt, Homo sapiens
acuaaagcagagcuaguaaugc

SEQ ID NO: 1952569 - RNA, 16 nt, Homo sapiens
cuguucucagcguuuu

SEQ ID NO: 1952570 - RNA, 13 nt, Homo sapiens
cucuguccugacu

SEQ ID NO: 1952571 - RNA, 16 nt, Homo sapiens
auuugugaacugucau

SEQ ID NO: 1952572 - RNA, 11 nt, Homo sapiens
augaccugcug

SEQ ID NO: 1952573 - RNA, 22 nt, Homo sapiens
cugauaagagaaucaacauuuc

SEQ ID NO: 1952574 - RNA, 14 nt, Homo sapiens
guuucuguccugua

SEQ ID NO: 1952575 - RNA, 16 nt, Homo sapiens
aauagaggggcauuca

SEQ ID NO: 1952576 - RNA, 16 nt, Homo sapiens
uuuaaaacauucacac

SEQ ID NO: 1952577 - RNA, 14 nt, Homo sapiens
aucaguguuuccaa

SEQ ID NO: 1952578 - RNA, 20 nt, Homo sapiens
agggugggauuaaguacaag

SEQ ID NO: 1952579 - RNA, 16 nt, Homo sapiens
ccuagacauaguucag

SEQ ID NO: 1952580 - RNA, 12 nt, Homo sapiens
accaccaugcca

SEQ ID NO: 1952581 - RNA, 18 nt, Homo sapiens
ccucccugaaauugcaua

SEQ ID NO: 1952582 - RNA, 20 nt, Homo sapiens
gugcaauggcacgaucucag

SEQ ID NO: 1952583 - RNA, 22 nt, Homo sapiens
auaagcuaccugaauggagaau

SEQ ID NO: 1952584 - RNA, 16 nt, Homo sapiens
cauuucuuugaauuua

SEQ ID NO: 1952585 - RNA, 23 nt, Homo sapiens
gccuaaugcugugugaugcaccu

SEQ ID NO: 1952586 - RNA, 14 nt, Homo sapiens
uauguuuaaaaagu

SEQ ID NO: 1952587 - RNA, 20 nt, Homo sapiens
ggaacugcguggugcucuuu

SEQ ID NO: 1952588 - RNA, 19 nt, Homo sapiens
uugacuuccugccauggau

SEQ ID NO: 1952589 - RNA, 13 nt, Homo sapiens
uacugcaaaucag

SEQ ID NO: 1952590 - RNA, 20 nt, Homo sapiens
cugaguguggcgggaagggu

SEQ ID NO: 1952591 - RNA, 22 nt, Homo sapiens
aagcaauuagaagccauccuaa

SEQ ID NO: 1952592 - RNA, 17 nt, Homo sapiens
ccaaacuuuaaaaugcg

SEQ ID NO: 1952593 - RNA, 18 nt, Homo sapiens
gagccagauuucacucuc

SEQ ID NO: 1952594 - RNA, 12 nt, Homo sapiens
aguauuccauuu

SEQ ID NO: 1952595 - RNA, 16 nt, Homo sapiens
acucccagaaccacua

SEQ ID NO: 1952596 - RNA, 15 nt, Homo sapiens
gcuucccaaagugcu

SEQ ID NO: 1952597 - RNA, 16 nt, Homo sapiens
caaccuaguacuuuau

SEQ ID NO: 1952598 - RNA, 18 nt, Homo sapiens
cccuggcagcaugacuca

SEQ ID NO: 1952599 - RNA, 15 nt, Homo sapiens
cuuuuccugucugua

SEQ ID NO: 1952600 - RNA, 20 nt, Homo sapiens
aagauaggaauucacugaua

SEQ ID NO: 1952601 - RNA, 20 nt, Homo sapiens
acacaagacagcagagccau

SEQ ID NO: 1952602 - RNA, 16 nt, Homo sapiens
auauaaauuuguguuc

SEQ ID NO: 1952603 - RNA, 20 nt, Homo sapiens
caaagcaaaacagacugugu

SEQ ID NO: 1952604 - RNA, 13 nt, Homo sapiens
aaagcaguauuug

SEQ ID NO: 1952605 - RNA, 21 nt, Homo sapiens
cuugaaauagugucugaugaa

SEQ ID NO: 1952606 - RNA, 18 nt, Homo sapiens
uuaguauuugcauauucu

SEQ ID NO: 1952607 - RNA, 22 nt, Homo sapiens
ggucccagccugguuugcaaag

SEQ ID NO: 1952608 - RNA, 17 nt, Homo sapiens
augucuguuugcugaug

SEQ ID NO: 1952609 - RNA, 20 nt, Homo sapiens
uuuaauucucaugugauccu

SEQ ID NO: 1952610 - RNA, 14 nt, Homo sapiens
cuaagcuaauucca

SEQ ID NO: 1952611 - RNA, 18 nt, Homo sapiens
acauggcuggcacugagc

SEQ ID NO: 1952612 - RNA, 15 nt, Homo sapiens
ggggagccuuagccg

SEQ ID NO: 1952613 - RNA, 12 nt, Homo sapiens
aggcaacacugg

SEQ ID NO: 1952614 - RNA, 12 nt, Homo sapiens
ggcugguccuga

SEQ ID NO: 1952615 - RNA, 20 nt, Homo sapiens
uaaauguggagaaacuguag

SEQ ID NO: 1952616 - RNA, 17 nt, Homo sapiens
gcuaaccucucugaacu

SEQ ID NO: 1952617 - RNA, 14 nt, Homo sapiens
aggcagaucaccug

SEQ ID NO: 1952618 - RNA, 19 nt, Homo sapiens
guaaaguuuauggaacuca

SEQ ID NO: 1952619 - RNA, 15 nt, Homo sapiens
auuuuuuaccacaau

SEQ ID NO: 1952620 - RNA, 18 nt, Homo sapiens
caaagccaccacauuuag

SEQ ID NO: 1952621 - RNA, 19 nt, Homo sapiens
cuuaucucucaaaacaaua

SEQ ID NO: 1952622 - RNA, 18 nt, Homo sapiens
caaugagauugaauuuca

SEQ ID NO: 1952623 - RNA, 20 nt, Homo sapiens
agagacagaauguaucugug

SEQ ID NO: 1952624 - RNA, 20 nt, Homo sapiens
aagaagggaaccacagugga

SEQ ID NO: 1952625 - RNA, 17 nt, Homo sapiens
auuugagauaaagucaa

SEQ ID NO: 1952626 - RNA, 22 nt, Homo sapiens
cuacucuuacagagccuugaga

SEQ ID NO: 1952627 - RNA, 21 nt, Homo sapiens
uaaaucuguuugacagucugc

SEQ ID NO: 1952628 - RNA, 13 nt, Homo sapiens
ccaccaggcaccu

SEQ ID NO: 1952629 - RNA, 9 nt, Homo sapiens
ccuauuuau

SEQ ID NO: 1952630 - RNA, 15 nt, Homo sapiens
acuggauguuucuca

SEQ ID NO: 1952631 - RNA, 23 nt, Homo sapiens
uggucagaaugggugcaguuuga

SEQ ID NO: 1952632 - RNA, 14 nt, Homo sapiens
gacagacauacauu

SEQ ID NO: 1952633 - RNA, 19 nt, Homo sapiens
cucacaugcuucuggcaaa

SEQ ID NO: 1952634 - RNA, 18 nt, Homo sapiens
cugggcucuggaccucag

SEQ ID NO: 1952635 - RNA, 12 nt, Homo sapiens
cugagaaagccc

SEQ ID NO: 1952636 - RNA, 19 nt, Homo sapiens
agcaauugguuguuuaaca

SEQ ID NO: 1952637 - RNA, 14 nt, Homo sapiens
acuaagacaccuga

SEQ ID NO: 1952638 - RNA, 14 nt, Homo sapiens
aguuggacagcaaa

SEQ ID NO: 1952639 - RNA, 13 nt, Homo sapiens
aggucaaacacaa

SEQ ID NO: 1952640 - RNA, 16 nt, Homo sapiens
uauucaguaguggaaa

SEQ ID NO: 1952641 - RNA, 22 nt, Homo sapiens
aaauuuguccaauggcuguaaa

SEQ ID NO: 1952642 - RNA, 23 nt, Homo sapiens
uuacagacuggaauaguggcaua

SEQ ID NO: 1952643 - RNA, 23 nt, Homo sapiens
agaccguucgcauggcagccauc

SEQ ID NO: 1952644 - RNA, 16 nt, Homo sapiens
aguacauugaaggccu

SEQ ID NO: 1952645 - RNA, 13 nt, Homo sapiens
agcccccucggug

SEQ ID NO: 1952646 - RNA, 12 nt, Homo sapiens
auaugacugcau

SEQ ID NO: 1952647 - RNA, 21 nt, Homo sapiens
cuaggcugagcuggcauuggu

SEQ ID NO: 1952648 - RNA, 23 nt, Homo sapiens
auguagaauaggcagggggcccu

SEQ ID NO: 1952649 - RNA, 18 nt, Homo sapiens
ucgggcgagucacugccu

SEQ ID NO: 1952650 - RNA, 16 nt, Homo sapiens
gcccaaccagaacuuu

SEQ ID NO: 1952651 - RNA, 23 nt, Homo sapiens
cuagcaaauggcagaaccaaagc

SEQ ID NO: 1952652 - RNA, 16 nt, Homo sapiens
gucagugccaugacug

SEQ ID NO: 1952653 - RNA, 22 nt, Homo sapiens
cauuaccgucauuggccuguga

SEQ ID NO: 1952654 - RNA, 23 nt, Homo sapiens
cagcagggccacugaguagucau

SEQ ID NO: 1952655 - RNA, 17 nt, Homo sapiens
aggaagaaaugucagau

SEQ ID NO: 1952656 - RNA, 23 nt, Homo sapiens
uccuccccaccagucucacccac

SEQ ID NO: 1952657 - RNA, 20 nt, Homo sapiens
cuuugaauuuuuuuaauugc

SEQ ID NO: 1952658 - RNA, 22 nt, Homo sapiens
aggaauuucuguuagcaauaug

SEQ ID NO: 1952659 - RNA, 16 nt, Homo sapiens
gcuucaggauaccaua

SEQ ID NO: 1952660 - RNA, 23 nt, Homo sapiens
gccucauauuuaaagacagggaa

SEQ ID NO: 1952661 - RNA, 21 nt, Homo sapiens
aacguagcuucuaccaugaac

SEQ ID NO: 1952662 - RNA, 14 nt, Homo sapiens
ggacuagaugacuc

SEQ ID NO: 1952663 - RNA, 13 nt, Homo sapiens
caccaccaaucac

SEQ ID NO: 1952664 - RNA, 22 nt, Homo sapiens
ugaaugucauugaaaaacuaaa

SEQ ID NO: 1952665 - RNA, 21 nt, Homo sapiens
cauuuaucaacuguugauaca

SEQ ID NO: 1952666 - RNA, 21 nt, Homo sapiens
ccacccugggcaacaugauga

SEQ ID NO: 1952667 - RNA, 17 nt, Homo sapiens
ucaguucauggcaucac

SEQ ID NO: 1952668 - RNA, 12 nt, Homo sapiens
uacuaacacugg

SEQ ID NO: 1952669 - RNA, 16 nt, Homo sapiens
ugccuguaacaaugua

SEQ ID NO: 1952670 - RNA, 16 nt, Homo sapiens
ugccaaaaacaaaaaa

SEQ ID NO: 1952671 - RNA, 18 nt, Homo sapiens
uaaaagaggaaaagccaa

SEQ ID NO: 1952672 - RNA, 19 nt, Homo sapiens
aggaaacccccaguguaau

SEQ ID NO: 1952673 - RNA, 23 nt, Homo sapiens
uguacaauaaagcaaugugguag

SEQ ID NO: 1952674 - RNA, 23 nt, Homo sapiens
acaucauuacuuaugaugaugaa

SEQ ID NO: 1952675 - RNA, 15 nt, Homo sapiens
caggaucuguacaau

SEQ ID NO: 1952676 - RNA, 19 nt, Homo sapiens
cucauucagcuaaauucac

SEQ ID NO: 1952677 - RNA, 16 nt, Homo sapiens
ccugccacugaccuca

SEQ ID NO: 1952678 - RNA, 14 nt, Homo sapiens
cucagaagucugca

SEQ ID NO: 1952679 - RNA, 23 nt, Homo sapiens
caacauagugauaccccaucucu

SEQ ID NO: 1952680 - RNA, 20 nt, Homo sapiens
ucaucuuggaacugcauucu

SEQ ID NO: 1952681 - RNA, 19 nt, Homo sapiens
caaauguauccaucuugaa

SEQ ID NO: 1952682 - RNA, 18 nt, Homo sapiens
uaguuacucauucaggga

SEQ ID NO: 1952683 - RNA, 18 nt, Homo sapiens
uacucccuacacugaugc

SEQ ID NO: 1952684 - RNA, 19 nt, Homo sapiens
ugcaaauacuguauauuca

SEQ ID NO: 1952685 - RNA, 14 nt, Homo sapiens
cacgccugccaucu

SEQ ID NO: 1952686 - RNA, 23 nt, Homo sapiens
cuuggaaagcaucaccucaggcc

SEQ ID NO: 1952687 - RNA, 16 nt, Homo sapiens
ucggcaccagugccuc

SEQ ID NO: 1952688 - RNA, 18 nt, Homo sapiens
acuugaggccugagacac

SEQ ID NO: 1952689 - RNA, 19 nt, Homo sapiens
acuuuguuuaaaccuucca

SEQ ID NO: 1952690 - RNA, 16 nt, Homo sapiens
caucuuuggcugagcu

SEQ ID NO: 1952691 - RNA, 12 nt, Homo sapiens
ccaguaucauac

SEQ ID NO: 1952692 - RNA, 23 nt, Homo sapiens
auauaauuuauaagcauugccau

SEQ ID NO: 1952693 - RNA, 16 nt, Homo sapiens
ccugaccuucugggac

SEQ ID NO: 1952694 - RNA, 14 nt, Homo sapiens
cagcguaaggggau

SEQ ID NO: 1952695 - RNA, 15 nt, Homo sapiens
acagacgcuccugaa

SEQ ID NO: 1952696 - RNA, 15 nt, Homo sapiens
agcacugcaccugcc

SEQ ID NO: 1952697 - RNA, 15 nt, Homo sapiens
cugcaaaaugggaug

SEQ ID NO: 1952698 - RNA, 14 nt, Homo sapiens
uuagguuuuguaca

SEQ ID NO: 1952699 - RNA, 15 nt, Homo sapiens
guaacacagugcagu

SEQ ID NO: 1952700 - RNA, 17 nt, Homo sapiens
ucucucauuugggguga

SEQ ID NO: 1952701 - RNA, 17 nt, Homo sapiens
cagugcagcaaggagaa

SEQ ID NO: 1952702 - RNA, 21 nt, Homo sapiens
accugccagucccagaucaca

SEQ ID NO: 1952703 - RNA, 22 nt, Homo sapiens
caggaaaccuuggccucugcua

SEQ ID NO: 1952704 - RNA, 22 nt, Homo sapiens
aagugcauuuuuaaauuuccuc

SEQ ID NO: 1952705 - RNA, 11 nt, Homo sapiens
uuaacaucuca

SEQ ID NO: 1952706 - RNA, 14 nt, Homo sapiens
uggugcugcucaua

SEQ ID NO: 1952707 - RNA, 22 nt, Homo sapiens
uuccaaugugacuaaugaccac

SEQ ID NO: 1952708 - RNA, 23 nt, Homo sapiens
ugaaguacaguaguuucccuacu

SEQ ID NO: 1952709 - RNA, 17 nt, Homo sapiens
ucauguaaacugugcac

SEQ ID NO: 1952710 - RNA, 13 nt, Homo sapiens
aacuuauuugccc

SEQ ID NO: 1952711 - RNA, 17 nt, Homo sapiens
cugcaacuacuauccaa

SEQ ID NO: 1952712 - RNA, 22 nt, Homo sapiens
acugacugcuuauaaacauuua

SEQ ID NO: 1952713 - RNA, 16 nt, Homo sapiens
aauucucaugugaucc

SEQ ID NO: 1952714 - RNA, 16 nt, Homo sapiens
ugggaaucaagucaua

SEQ ID NO: 1952715 - RNA, 16 nt, Homo sapiens
aauugacauguuguca

SEQ ID NO: 1952716 - RNA, 22 nt, Homo sapiens
acuaaucugauguuaaccaaug

SEQ ID NO: 1952717 - RNA, 23 nt, Homo sapiens
uucauauuguggcacaagcaaaa

SEQ ID NO: 1952718 - RNA, 22 nt, Homo sapiens
uaauuuuuacugacgcucagua

SEQ ID NO: 1952719 - RNA, 17 nt, Homo sapiens
uaaauaccaguacuuga

SEQ ID NO: 1952720 - RNA, 14 nt, Homo sapiens
ccugaaagccacag

SEQ ID NO: 1952721 - RNA, 14 nt, Homo sapiens
ugagcgagugucca

SEQ ID NO: 1952722 - RNA, 19 nt, Homo sapiens
agccuucaaucaacaucuc

SEQ ID NO: 1952723 - RNA, 14 nt, Homo sapiens
acagcuguauauug

SEQ ID NO: 1952724 - RNA, 13 nt, Homo sapiens
aaagccuguccca

SEQ ID NO: 1952725 - RNA, 16 nt, Homo sapiens
gcccuacucaccugag

SEQ ID NO: 1952726 - RNA, 16 nt, Homo sapiens
ccugggcugauggaag

SEQ ID NO: 1952727 - RNA, 23 nt, Homo sapiens
cuugauugguguugccaguuguc

SEQ ID NO: 1952728 - RNA, 23 nt, Homo sapiens
agaagugauuagaggcagaucug

SEQ ID NO: 1952729 - RNA, 18 nt, Homo sapiens
cagcaggaugcucaguga

SEQ ID NO: 1952730 - RNA, 23 nt, Homo sapiens
cuaaguaauuuagaagauauuau

SEQ ID NO: 1952731 - RNA, 16 nt, Homo sapiens
cagaaagccuauucca

SEQ ID NO: 1952732 - RNA, 19 nt, Homo sapiens
uggcaugauccaagcaaga

SEQ ID NO: 1952733 - RNA, 16 nt, Homo sapiens
cacucuguugccauua

SEQ ID NO: 1952734 - RNA, 19 nt, Homo sapiens
acaagaaccugcuaaggcu

SEQ ID NO: 1952735 - RNA, 13 nt, Homo sapiens
uguaccaguuugu

SEQ ID NO: 1952736 - RNA, 15 nt, Homo sapiens
auccacaaaucaucu

SEQ ID NO: 1952737 - RNA, 16 nt, Homo sapiens
uacucuuuugggcaac

SEQ ID NO: 1952738 - RNA, 12 nt, Homo sapiens
aagugaggccau

SEQ ID NO: 1952739 - RNA, 12 nt, Homo sapiens
gccucuccccaa

SEQ ID NO: 1952740 - RNA, 18 nt, Homo sapiens
cauuaagccucuugucua

SEQ ID NO: 1952741 - RNA, 19 nt, Homo sapiens
uucuuguugcugcaucucc

SEQ ID NO: 1952742 - RNA, 14 nt, Homo sapiens
agccagaagcugag

SEQ ID NO: 1952743 - RNA, 17 nt, Homo sapiens
uaaaauguacucagcua

SEQ ID NO: 1952744 - RNA, 18 nt, Homo sapiens
agggcccaucaggcagug

SEQ ID NO: 1952745 - RNA, 22 nt, Homo sapiens
acaauauuaauuauaauaaagg

SEQ ID NO: 1952746 - RNA, 15 nt, Homo sapiens
ugaaaaaugaucucu

SEQ ID NO: 1952747 - RNA, 14 nt, Homo sapiens
acugugagcaagga

SEQ ID NO: 1952748 - RNA, 16 nt, Homo sapiens
aacaugcuugcauuau

SEQ ID NO: 1952749 - RNA, 22 nt, Homo sapiens
aguugcauagagauuuguauug

SEQ ID NO: 1952750 - RNA, 17 nt, Homo sapiens
ccuggguaacuagggaa

SEQ ID NO: 1952751 - RNA, 22 nt, Homo sapiens
cucucccgucagggcccaaguc

SEQ ID NO: 1952752 - RNA, 19 nt, Homo sapiens
aucaugaguggacuuugca

SEQ ID NO: 1952753 - RNA, 14 nt, Homo sapiens
aauuccaaagcaaa

SEQ ID NO: 1952754 - RNA, 12 nt, Homo sapiens
aagaaauuggaa

SEQ ID NO: 1952755 - RNA, 14 nt, Homo sapiens
acaauaaaaccugg

SEQ ID NO: 1952756 - RNA, 18 nt, Homo sapiens
acuagauuuauaaaugca

SEQ ID NO: 1952757 - RNA, 13 nt, Homo sapiens
auaaaaacauaac

SEQ ID NO: 1952758 - RNA, 13 nt, Homo sapiens
auauaaacauauc

SEQ ID NO: 1952759 - RNA, 12 nt, Homo sapiens
cggaaggcaaag

SEQ ID NO: 1952760 - RNA, 19 nt, Homo sapiens
acaaucaucaucauucuca

SEQ ID NO: 1952761 - RNA, 22 nt, Homo sapiens
cuaaguucccuucuauauccuc

SEQ ID NO: 1952762 - RNA, 22 nt, Homo sapiens
acugagcauguauuuugugcca

SEQ ID NO: 1952763 - RNA, 12 nt, Homo sapiens
uucaucagagga

SEQ ID NO: 1952764 - RNA, 17 nt, Homo sapiens
gcagccuugacuucuca

SEQ ID NO: 1952765 - RNA, 20 nt, Homo sapiens
auuuuuuuagaaagcauuug

SEQ ID NO: 1952766 - RNA, 20 nt, Homo sapiens
gucccaggucuucuccaagg

SEQ ID NO: 1952767 - RNA, 22 nt, Homo sapiens
ggugaaagccagagaaugacag

SEQ ID NO: 1952768 - RNA, 17 nt, Homo sapiens
ucaauuuccugaugcau

SEQ ID NO: 1952769 - RNA, 22 nt, Homo sapiens
guacucaguaaaucagugcagu

SEQ ID NO: 1952770 - RNA, 18 nt, Homo sapiens
uguauuccugccuuugau

SEQ ID NO: 1952771 - RNA, 12 nt, Homo sapiens
ucaaaugcuuag

SEQ ID NO: 1952772 - RNA, 21 nt, Homo sapiens
uaacuucugacuuacugucag

SEQ ID NO: 1952773 - RNA, 21 nt, Homo sapiens
ccauuuagaauggugauuuua

SEQ ID NO: 1952774 - RNA, 21 nt, Homo sapiens
uccuuauuguuuguaaacaac

SEQ ID NO: 1952775 - RNA, 22 nt, Homo sapiens
ugcuaaauaguucuaucaggaa

SEQ ID NO: 1952776 - RNA, 19 nt, Homo sapiens
ccaaacaauauugcuccau

SEQ ID NO: 1952777 - RNA, 22 nt, Homo sapiens
ucacacuguauauaaacauauc

SEQ ID NO: 1952778 - RNA, 19 nt, Homo sapiens
guuauagauauguagauaa

SEQ ID NO: 1952779 - RNA, 15 nt, Homo sapiens
gggaacacuggggac

SEQ ID NO: 1952780 - RNA, 18 nt, Homo sapiens
guuacuauucuguaucau

SEQ ID NO: 1952781 - RNA, 21 nt, Homo sapiens
auggcugaguaauaguccaug

SEQ ID NO: 1952782 - RNA, 17 nt, Homo sapiens
acaagauguagcaccuu

SEQ ID NO: 1952783 - RNA, 15 nt, Homo sapiens
ucauucuaaaccaaa

SEQ ID NO: 1952784 - RNA, 15 nt, Homo sapiens
ccccuggccacagua

SEQ ID NO: 1952785 - RNA, 13 nt, Homo sapiens
acugaacacugca

SEQ ID NO: 1952786 - RNA, 14 nt, Homo sapiens
ggaaaggugcucaa

SEQ ID NO: 1952787 - RNA, 18 nt, Homo sapiens
aauacuaugcaguaucuc

SEQ ID NO: 1952788 - RNA, 18 nt, Homo sapiens
guucacaccauucuccug

SEQ ID NO: 1952789 - RNA, 11 nt, Homo sapiens
uucuuugccau

SEQ ID NO: 1952790 - RNA, 14 nt, Homo sapiens
uguacaaaauaucc

SEQ ID NO: 1952791 - RNA, 20 nt, Homo sapiens
aucaugaagcccaaccugca

SEQ ID NO: 1952792 - RNA, 23 nt, Homo sapiens
ggacgagauaaugugaacuagcu

SEQ ID NO: 1952793 - RNA, 18 nt, Homo sapiens
ucaaggacuuucugaagc

SEQ ID NO: 1952794 - RNA, 13 nt, Homo sapiens
agaguaugugaga

SEQ ID NO: 1952795 - RNA, 14 nt, Homo sapiens
cuacuauguacugc

SEQ ID NO: 1952796 - RNA, 18 nt, Homo sapiens
ccucccuggcucccauga

SEQ ID NO: 1952797 - RNA, 14 nt, Homo sapiens
cauucuuauugaca

SEQ ID NO: 1952798 - RNA, 15 nt, Homo sapiens
uaaaccauugugcau

SEQ ID NO: 1952799 - RNA, 22 nt, Homo sapiens
uccaaguguuauaccaacuaaa

SEQ ID NO: 1952800 - RNA, 23 nt, Homo sapiens
ucuuucguuuguuuguuucaaua

SEQ ID NO: 1952801 - RNA, 21 nt, Homo sapiens
agauuuaaaaaaagaacauaa

SEQ ID NO: 1952802 - RNA, 19 nt, Homo sapiens
gacacccacccugugccau

SEQ ID NO: 1952803 - RNA, 14 nt, Homo sapiens
ccuaucuccugaca

SEQ ID NO: 1952804 - RNA, 17 nt, Homo sapiens
gagaaaguucucauuua

SEQ ID NO: 1952805 - RNA, 20 nt, Homo sapiens
caaagaaugggcuugaaaca

SEQ ID NO: 1952806 - RNA, 17 nt, Homo sapiens
guacugagacauuacag

SEQ ID NO: 1952807 - RNA, 14 nt, Homo sapiens
ugguucacugcaac

SEQ ID NO: 1952808 - RNA, 14 nt, Homo sapiens
ccugcugcaugacc

SEQ ID NO: 1952809 - RNA, 14 nt, Homo sapiens
uaaaacacaucauc

SEQ ID NO: 1952810 - RNA, 19 nt, Homo sapiens
cacgugucuccccuuggua

SEQ ID NO: 1952811 - RNA, 14 nt, Homo sapiens
ggcugcacucaaga

SEQ ID NO: 1952812 - RNA, 23 nt, Homo sapiens
gcucugcccacugugaaaccacu

SEQ ID NO: 1952813 - RNA, 13 nt, Homo sapiens
cuggaaugcagug

SEQ ID NO: 1952814 - RNA, 17 nt, Homo sapiens
aguuuuaguucuguaga

SEQ ID NO: 1952815 - RNA, 14 nt, Homo sapiens
uucuaggugaugag

SEQ ID NO: 1952816 - RNA, 16 nt, Homo sapiens
ccuucugucucuugca

SEQ ID NO: 1952817 - RNA, 13 nt, Homo sapiens
ugguuuuucacca

SEQ ID NO: 1952818 - RNA, 13 nt, Homo sapiens
caguuuuuugcca

SEQ ID NO: 1952819 - RNA, 17 nt, Homo sapiens
auuuaucacacaaagca

SEQ ID NO: 1952820 - RNA, 13 nt, Homo sapiens
cucccagugcuug

SEQ ID NO: 1952821 - RNA, 19 nt, Homo sapiens
gagugagacucugucucaa

SEQ ID NO: 1952822 - RNA, 19 nt, Homo sapiens
gagcgagacuccgucucaa

SEQ ID NO: 1952823 - RNA, 20 nt, Homo sapiens
uagccuggugggaaaaugca

SEQ ID NO: 1952824 - RNA, 19 nt, Homo sapiens
gcuucucaaaguacuggga

SEQ ID NO: 1952825 - RNA, 15 nt, Homo sapiens
uguaagaacuguaca

SEQ ID NO: 1952826 - RNA, 23 nt, Homo sapiens
uagacagcagggcucucuguauc

SEQ ID NO: 1952827 - RNA, 22 nt, Homo sapiens
ccuaguaggagcugagcuuucc

SEQ ID NO: 1952828 - RNA, 15 nt, Homo sapiens
uuugaccuuccccaa

SEQ ID NO: 1952829 - RNA, 22 nt, Homo sapiens
auuugguagggugaguguuucc

SEQ ID NO: 1952830 - RNA, 15 nt, Homo sapiens
uggacaggaaagggc

SEQ ID NO: 1952831 - RNA, 15 nt, Homo sapiens
aagguuaagccauau

SEQ ID NO: 1952832 - RNA, 15 nt, Homo sapiens
aacagauaagcaaga

SEQ ID NO: 1952833 - RNA, 11 nt, Homo sapiens
ucucaaaagga

SEQ ID NO: 1952834 - RNA, 18 nt, Homo sapiens
uugccccuuccacuuuga

SEQ ID NO: 1952835 - RNA, 21 nt, Homo sapiens
accuguuccuuuuucuggguu

SEQ ID NO: 1952836 - RNA, 17 nt, Homo sapiens
aagaauagcugcuuccg

SEQ ID NO: 1952837 - RNA, 18 nt, Homo sapiens
ugugugaaaauacuggaa

SEQ ID NO: 1952838 - RNA, 21 nt, Homo sapiens
ccugccccagauuuacuaaau

SEQ ID NO: 1952839 - RNA, 22 nt, Homo sapiens
aaugucuuuccuuuugcucuua

SEQ ID NO: 1952840 - RNA, 22 nt, Homo sapiens
gccucagagaucucccuucuca

SEQ ID NO: 1952841 - RNA, 16 nt, Homo sapiens
aaacaaagaguaucau

SEQ ID NO: 1952842 - RNA, 23 nt, Homo sapiens
acagggagaaguagcuaguagca

SEQ ID NO: 1952843 - RNA, 17 nt, Homo sapiens
acaaaaacauggccuuu

SEQ ID NO: 1952844 - RNA, 16 nt, Homo sapiens
gggucgggggagcaaa

SEQ ID NO: 1952845 - RNA, 16 nt, Homo sapiens
gaugauccuugcacag

SEQ ID NO: 1952846 - RNA, 19 nt, Homo sapiens
ggacaaucuagcucuccau

SEQ ID NO: 1952847 - RNA, 13 nt, Homo sapiens
acauacagaacuc

SEQ ID NO: 1952848 - RNA, 21 nt, Homo sapiens
acaagccccacagccccucaa

SEQ ID NO: 1952849 - RNA, 18 nt, Homo sapiens
ccaaagugcaggacauca

SEQ ID NO: 1952850 - RNA, 13 nt, Homo sapiens
cagcaucagcuca

SEQ ID NO: 1952851 - RNA, 18 nt, Homo sapiens
ucagaaauguaguuugca

SEQ ID NO: 1952852 - RNA, 18 nt, Homo sapiens
cucacaacucucugguuc

SEQ ID NO: 1952853 - RNA, 16 nt, Homo sapiens
caauaaagugugagga

SEQ ID NO: 1952854 - RNA, 21 nt, Homo sapiens
caaagcgugguggacaugcac

SEQ ID NO: 1952855 - RNA, 18 nt, Homo sapiens
auucaccugcccugugca

SEQ ID NO: 1952856 - RNA, 21 nt, Homo sapiens
cugcuggcccacagcucugcu

SEQ ID NO: 1952857 - RNA, 13 nt, Homo sapiens
cuuggcacacucu

SEQ ID NO: 1952858 - RNA, 13 nt, Homo sapiens
cuucucacacugg

SEQ ID NO: 1952859 - RNA, 14 nt, Homo sapiens
ggaagggccaccac

SEQ ID NO: 1952860 - RNA, 13 nt, Homo sapiens
cucugccaugugg

SEQ ID NO: 1952861 - RNA, 22 nt, Homo sapiens
acucuucaaggucugcuuuuca

SEQ ID NO: 1952862 - RNA, 16 nt, Homo sapiens
cagaaucaucauauca

SEQ ID NO: 1952863 - RNA, 21 nt, Homo sapiens
uugaaguaacuauaacaaaaa

SEQ ID NO: 1952864 - RNA, 18 nt, Homo sapiens
aagaugagagaacuggag

SEQ ID NO: 1952865 - RNA, 18 nt, Homo sapiens
aaggaaguaagggaguca

SEQ ID NO: 1952866 - RNA, 13 nt, Homo sapiens
ccaugacugagaa

SEQ ID NO: 1952867 - RNA, 22 nt, Homo sapiens
ucauugcccgaaaccagagccu

SEQ ID NO: 1952868 - RNA, 18 nt, Homo sapiens
uuacaauauuaugaaauu

SEQ ID NO: 1952869 - RNA, 17 nt, Homo sapiens
agccacgaccagccccu

SEQ ID NO: 1952870 - RNA, 11 nt, Homo sapiens
ccgccuuccaa

SEQ ID NO: 1952871 - RNA, 20 nt, Homo sapiens
gacugucaguaggcuggaag

SEQ ID NO: 1952872 - RNA, 12 nt, Homo sapiens
aaaccaguguga

SEQ ID NO: 1952873 - RNA, 16 nt, Homo sapiens
acuccgccagccacag

SEQ ID NO: 1952874 - RNA, 12 nt, Homo sapiens
caaaauucucau

SEQ ID NO: 1952875 - RNA, 22 nt, Homo sapiens
auuuagugaucaaauugugcag

SEQ ID NO: 1952876 - RNA, 13 nt, Homo sapiens
ccaucuugaucug

SEQ ID NO: 1952877 - RNA, 17 nt, Homo sapiens
ccaggaccaggggccca

SEQ ID NO: 1952878 - RNA, 15 nt, Homo sapiens
auggcaccaaagcca

SEQ ID NO: 1952879 - RNA, 13 nt, Homo sapiens
uuuccaacuuuua

SEQ ID NO: 1952880 - RNA, 21 nt, Homo sapiens
gaacuuaauaacuguguacug

SEQ ID NO: 1952881 - RNA, 20 nt, Homo sapiens
aagaaaauccuaacuuucag

SEQ ID NO: 1952882 - RNA, 19 nt, Homo sapiens
aaaauuuuaaguguucucg

SEQ ID NO: 1952883 - RNA, 18 nt, Homo sapiens
ugggauaacugauuucua

SEQ ID NO: 1952884 - RNA, 14 nt, Homo sapiens
ccuuccacauguac

SEQ ID NO: 1952885 - RNA, 22 nt, Homo sapiens
aauaauuagguauuuucuccaa

SEQ ID NO: 1952886 - RNA, 23 nt, Homo sapiens
uaaaacucuuuugaccuguaacu

SEQ ID NO: 1952887 - RNA, 18 nt, Homo sapiens
cuuaagcuuuggacccaa

SEQ ID NO: 1952888 - RNA, 12 nt, Homo sapiens
agagugcauaua

SEQ ID NO: 1952889 - RNA, 18 nt, Homo sapiens
cuuaugcuguacccaguu

SEQ ID NO: 1952890 - RNA, 18 nt, Homo sapiens
gacacugcugaaccuuuc

SEQ ID NO: 1952891 - RNA, 9 nt, Homo sapiens
ggcuuuaug

SEQ ID NO: 1952892 - RNA, 24 nt, Homo sapiens
cauucugaaccuuaucaagaggau

SEQ ID NO: 1952893 - RNA, 13 nt, Homo sapiens
aguaccauuugau

SEQ ID NO: 1952894 - RNA, 21 nt, Homo sapiens
ggaacucuucaugagcacuuu

SEQ ID NO: 1952895 - RNA, 14 nt, Homo sapiens
ugggggucccagga

SEQ ID NO: 1952896 - RNA, 17 nt, Homo sapiens
gaccggugcaugaugcu

SEQ ID NO: 1952897 - RNA, 17 nt, Homo sapiens
uugugguuucucuggcc

SEQ ID NO: 1952898 - RNA, 19 nt, Homo sapiens
uggccagagccucuggccc

SEQ ID NO: 1952899 - RNA, 19 nt, Homo sapiens
aggagccucacuggggcag

SEQ ID NO: 1952900 - RNA, 17 nt, Homo sapiens
ccaugugaaacucaucu

SEQ ID NO: 1952901 - RNA, 15 nt, Homo sapiens
ucguuuuguucauau

SEQ ID NO: 1952902 - RNA, 20 nt, Homo sapiens
guuuagaugaggcucagaga

SEQ ID NO: 1952903 - RNA, 19 nt, Homo sapiens
ucugugcuucgacuacugc

SEQ ID NO: 1952904 - RNA, 20 nt, Homo sapiens
caaauaaaugauuauauuca

SEQ ID NO: 1952905 - RNA, 21 nt, Homo sapiens
aagcagccauuggcacugugg

SEQ ID NO: 1952906 - RNA, 16 nt, Homo sapiens
uuggauacacucucua

SEQ ID NO: 1952907 - RNA, 17 nt, Homo sapiens
auucccagccuguggca

SEQ ID NO: 1952908 - RNA, 22 nt, Homo sapiens
ggggaaaaucucagcaaugauu

SEQ ID NO: 1952909 - RNA, 14 nt, Homo sapiens
uaauguuaugagga

SEQ ID NO: 1952910 - RNA, 21 nt, Homo sapiens
cucuagaaugagcaagacugg

SEQ ID NO: 1952911 - RNA, 18 nt, Homo sapiens
gaucucugggaguuauag

SEQ ID NO: 1952912 - RNA, 21 nt, Homo sapiens
auauuaaucaacuuuccuuaa

SEQ ID NO: 1952913 - RNA, 15 nt, Homo sapiens
guccaugugaucuca

SEQ ID NO: 1952914 - RNA, 16 nt, Homo sapiens
cuggcuuguuguaaag

SEQ ID NO: 1952915 - RNA, 13 nt, Homo sapiens
guguauauaccuc

SEQ ID NO: 1952916 - RNA, 17 nt, Homo sapiens
uccuuaacacauucaau

SEQ ID NO: 1952917 - RNA, 18 nt, Homo sapiens
ggagcuuucucaaugucu

SEQ ID NO: 1952918 - RNA, 12 nt, Homo sapiens
ugccucaggaau

SEQ ID NO: 1952919 - RNA, 21 nt, Homo sapiens
auucauuugaauaaaaaggaa

SEQ ID NO: 1952920 - RNA, 20 nt, Homo sapiens
agacaagucuugcugugcuu

SEQ ID NO: 1952921 - RNA, 13 nt, Homo sapiens
cccuauacacuag

SEQ ID NO: 1952922 - RNA, 18 nt, Homo sapiens
ucuggugaguuaaugggg

SEQ ID NO: 1952923 - RNA, 16 nt, Homo sapiens
ccagcacagguauuuc

SEQ ID NO: 1952924 - RNA, 23 nt, Homo sapiens
ccuccugggcccacaacagcgug

SEQ ID NO: 1952925 - RNA, 19 nt, Homo sapiens
cccgaaauagauccagugc

SEQ ID NO: 1952926 - RNA, 19 nt, Homo sapiens
gaaugugguaguacccagg

SEQ ID NO: 1952927 - RNA, 22 nt, Homo sapiens
aucucucgagcugucuugcuga

SEQ ID NO: 1952928 - RNA, 22 nt, Homo sapiens
aauucaguaacaaagguuuaaa

SEQ ID NO: 1952929 - RNA, 18 nt, Homo sapiens
uuugcccaaaacugucau

SEQ ID NO: 1952930 - RNA, 18 nt, Homo sapiens
uucaagcgauucucaugc

SEQ ID NO: 1952931 - RNA, 19 nt, Homo sapiens
uuggcauuuuacuguacag

SEQ ID NO: 1952932 - RNA, 14 nt, Homo sapiens
uggcuuaaagggau

SEQ ID NO: 1952933 - RNA, 19 nt, Homo sapiens
ucccuuuugcauugccaag

SEQ ID NO: 1952934 - RNA, 16 nt, Homo sapiens
accuuccauagccucc

SEQ ID NO: 1952935 - RNA, 14 nt, Homo sapiens
cacuugcagccucc

SEQ ID NO: 1952936 - RNA, 15 nt, Homo sapiens
agcuuauugauccca

SEQ ID NO: 1952937 - RNA, 23 nt, Homo sapiens
ugaaugugguuacuuccuacugu

SEQ ID NO: 1952938 - RNA, 21 nt, Homo sapiens
cuguaauuuuaaccaaucaga

SEQ ID NO: 1952939 - RNA, 15 nt, Homo sapiens
uccacugucaggguu

SEQ ID NO: 1952940 - RNA, 16 nt, Homo sapiens
aaauuuuuguuuauaa

SEQ ID NO: 1952941 - RNA, 16 nt, Homo sapiens
aaucucuaguugucac

SEQ ID NO: 1952942 - RNA, 12 nt, Homo sapiens
ucggcugugagg

SEQ ID NO: 1952943 - RNA, 14 nt, Homo sapiens
aaagaagauuuugc

SEQ ID NO: 1952944 - RNA, 14 nt, Homo sapiens
uacucucuucucaa

SEQ ID NO: 1952945 - RNA, 23 nt, Homo sapiens
auaaauguacuuuuccuuccaga

SEQ ID NO: 1952946 - RNA, 19 nt, Homo sapiens
guggagugcaguggugcga

SEQ ID NO: 1952947 - RNA, 19 nt, Homo sapiens
augugggggaggagggaga

SEQ ID NO: 1952948 - RNA, 21 nt, Homo sapiens
aauuaauaucccuacauguau

SEQ ID NO: 1952949 - RNA, 22 nt, Homo sapiens
aagcucagcugccuuccugggg

SEQ ID NO: 1952950 - RNA, 16 nt, Homo sapiens
auaaguaacacuagua

SEQ ID NO: 1952951 - RNA, 21 nt, Homo sapiens
aguaacacagugcaguacuca

SEQ ID NO: 1952952 - RNA, 22 nt, Homo sapiens
cucauaacucugugaucuugcu

SEQ ID NO: 1952953 - RNA, 13 nt, Homo sapiens
agugaaugcacug

SEQ ID NO: 1952954 - RNA, 14 nt, Homo sapiens
auauaguaucuacc

SEQ ID NO: 1952955 - RNA, 12 nt, Homo sapiens
uuauaagcauuu

SEQ ID NO: 1952956 - RNA, 13 nt, Homo sapiens
aaguuaagcuuuu

SEQ ID NO: 1952957 - RNA, 13 nt, Homo sapiens
auucaaagcagca

SEQ ID NO: 1952958 - RNA, 22 nt, Homo sapiens
agcagcagugagcuucuauuaa

SEQ ID NO: 1952959 - RNA, 16 nt, Homo sapiens
ugcugggcuguuuacu

SEQ ID NO: 1952960 - RNA, 15 nt, Homo sapiens
ugugucagcuacugc

SEQ ID NO: 1952961 - RNA, 14 nt, Homo sapiens
ggcagugcauguga

SEQ ID NO: 1952962 - RNA, 14 nt, Homo sapiens
gagcauggguucau

SEQ ID NO: 1952963 - RNA, 13 nt, Homo sapiens
ugaggcaggugga

SEQ ID NO: 1952964 - RNA, 17 nt, Homo sapiens
uggacccccacccugca

SEQ ID NO: 1952965 - RNA, 13 nt, Homo sapiens
auaaacacugugu

SEQ ID NO: 1952966 - RNA, 18 nt, Homo sapiens
aggcccacuggcauuaaa

SEQ ID NO: 1952967 - RNA, 23 nt, Homo sapiens
cucuuggacccaccuguggggcc

SEQ ID NO: 1952968 - RNA, 13 nt, Homo sapiens
aucauguauuuau

SEQ ID NO: 1952969 - RNA, 15 nt, Homo sapiens
ucagaaaauaccuua

SEQ ID NO: 1952970 - RNA, 13 nt, Homo sapiens
gcccugcacagau

SEQ ID NO: 1952971 - RNA, 19 nt, Homo sapiens
ccucggcuuuucucagcug

SEQ ID NO: 1952972 - RNA, 14 nt, Homo sapiens
guaaugaaauggag

SEQ ID NO: 1952973 - RNA, 17 nt, Homo sapiens
augauuuccuaguagaa

SEQ ID NO: 1952974 - RNA, 22 nt, Homo sapiens
auccaccugcacaaacauagac

SEQ ID NO: 1952975 - RNA, 20 nt, Homo sapiens
ccuccuagagugcagggauu

SEQ ID NO: 1952976 - RNA, 19 nt, Homo sapiens
ucagaaaaucgaccacagu

SEQ ID NO: 1952977 - RNA, 18 nt, Homo sapiens
gggccagagggagcugga

SEQ ID NO: 1952978 - RNA, 19 nt, Homo sapiens
uguacuguaaacaguucug

SEQ ID NO: 1952979 - RNA, 14 nt, Homo sapiens
acuuugcuccucac

SEQ ID NO: 1952980 - RNA, 13 nt, Homo sapiens
uuguaaugcugca

SEQ ID NO: 1952981 - RNA, 13 nt, Homo sapiens
uaucuaugcauuu

SEQ ID NO: 1952982 - RNA, 16 nt, Homo sapiens
ucugucacuugcauuc

SEQ ID NO: 1952983 - RNA, 13 nt, Homo sapiens
cuuauuugguaua

SEQ ID NO: 1952984 - RNA, 23 nt, Homo sapiens
ugaaaacuuagagagguacaagu

SEQ ID NO: 1952985 - RNA, 21 nt, Homo sapiens
ccugaaugcucuguagccuaa

SEQ ID NO: 1952986 - RNA, 22 nt, Homo sapiens
uaaaaauaaaucccauggaaua

SEQ ID NO: 1952987 - RNA, 22 nt, Homo sapiens
aaaugagucaggcaauugauug

SEQ ID NO: 1952988 - RNA, 19 nt, Homo sapiens
cuaauuuguaggaaaaagc

SEQ ID NO: 1952989 - RNA, 11 nt, Homo sapiens
gauauucucau

SEQ ID NO: 1952990 - RNA, 11 nt, Homo sapiens
aagcaaccucc

SEQ ID NO: 1952991 - RNA, 14 nt, Homo sapiens
uugugaguaugugu

SEQ ID NO: 1952992 - RNA, 15 nt, Homo sapiens
aucuguuacacaaag

SEQ ID NO: 1952993 - RNA, 21 nt, Homo sapiens
uuuggggaccauaucaggaga

SEQ ID NO: 1952994 - RNA, 22 nt, Homo sapiens
cucgccagcucauucucaccaa

SEQ ID NO: 1952995 - RNA, 21 nt, Homo sapiens
gcucgcuggaccaaccccagg

SEQ ID NO: 1952996 - RNA, 20 nt, Homo sapiens
gagccaguccuccacucgac

SEQ ID NO: 1952997 - RNA, 21 nt, Homo sapiens
agaaucuguuucccagcagug

SEQ ID NO: 1952998 - RNA, 16 nt, Homo sapiens
uuuccagauuugcuca

SEQ ID NO: 1952999 - RNA, 16 nt, Homo sapiens
ugacacccacaauccc

SEQ ID NO: 1953000 - RNA, 14 nt, Homo sapiens
gccucuaacucccu

SEQ ID NO: 1953001 - RNA, 14 nt, Homo sapiens
ccagacuggcacag

SEQ ID NO: 1953002 - RNA, 20 nt, Homo sapiens
uaaccaagagauaacuguaa

SEQ ID NO: 1953003 - RNA, 22 nt, Homo sapiens
gugccuggcucugauucuucau

SEQ ID NO: 1953004 - RNA, 15 nt, Homo sapiens
ggugggcacacugaa

SEQ ID NO: 1953005 - RNA, 20 nt, Homo sapiens
uucaaugagcaaaucuccau

SEQ ID NO: 1953006 - RNA, 19 nt, Homo sapiens
guaccucuauugugccuau

SEQ ID NO: 1953007 - RNA, 18 nt, Homo sapiens
uuccaucagcacaaagac

SEQ ID NO: 1953008 - RNA, 23 nt, Homo sapiens
uuaauaaaaacaaauaauaucuc

SEQ ID NO: 1953009 - RNA, 20 nt, Homo sapiens
uagggcugaggaaccaauca

SEQ ID NO: 1953010 - RNA, 16 nt, Homo sapiens
uaacaaugccuauugu

SEQ ID NO: 1953011 - RNA, 19 nt, Homo sapiens
ugugcaguuaauacuuaac

SEQ ID NO: 1953012 - RNA, 15 nt, Homo sapiens
agggucccgguguau

SEQ ID NO: 1953013 - RNA, 20 nt, Homo sapiens
aagaauuucccagugaaaua

SEQ ID NO: 1953014 - RNA, 16 nt, Homo sapiens
aaguucucaucauuau

SEQ ID NO: 1953015 - RNA, 14 nt, Homo sapiens
cuaagcaguggcau

SEQ ID NO: 1953016 - RNA, 18 nt, Homo sapiens
auuccuaggucacuugaa

SEQ ID NO: 1953017 - RNA, 14 nt, Homo sapiens
aaauaaucagugac

SEQ ID NO: 1953018 - RNA, 16 nt, Homo sapiens
accucuuugucacagg

SEQ ID NO: 1953019 - RNA, 19 nt, Homo sapiens
acccucccacucccaucuc

SEQ ID NO: 1953020 - RNA, 12 nt, Homo sapiens
aucuacacucca

SEQ ID NO: 1953021 - RNA, 21 nt, Homo sapiens
caugguauaaggaaauaucau

SEQ ID NO: 1953022 - RNA, 20 nt, Homo sapiens
uugcuaaucagugucucaca

SEQ ID NO: 1953023 - RNA, 21 nt, Homo sapiens
ucuucucacauccaucuacuu

SEQ ID NO: 1953024 - RNA, 16 nt, Homo sapiens
ccuauaacacugugaa

SEQ ID NO: 1953025 - RNA, 15 nt, Homo sapiens
cucaccugcugggga

SEQ ID NO: 1953026 - RNA, 17 nt, Homo sapiens
aaacagggaaaaugaag

SEQ ID NO: 1953027 - RNA, 19 nt, Homo sapiens
cuggguuacagaaucacag

SEQ ID NO: 1953028 - RNA, 16 nt, Homo sapiens
cucuggaccauauacc

SEQ ID NO: 1953029 - RNA, 14 nt, Homo sapiens
ggucagguccccau

SEQ ID NO: 1953030 - RNA, 18 nt, Homo sapiens
uguauaaagauuguacuu

SEQ ID NO: 1953031 - RNA, 13 nt, Homo sapiens
cagcagauuucca

SEQ ID NO: 1953032 - RNA, 16 nt, Homo sapiens
uacuguucagcuuuua

SEQ ID NO: 1953033 - RNA, 18 nt, Homo sapiens
uaccaguuuuccagaaca

SEQ ID NO: 1953034 - RNA, 22 nt, Homo sapiens
ggcucuguuaugcaagcacaaa

SEQ ID NO: 1953035 - RNA, 23 nt, Homo sapiens
cugacugcugugggcugcucacu

SEQ ID NO: 1953036 - RNA, 20 nt, Homo sapiens
uuuacucugcucuaugccag

SEQ ID NO: 1953037 - RNA, 20 nt, Homo sapiens
cucugcuugccgaaacugga

SEQ ID NO: 1953038 - RNA, 17 nt, Homo sapiens
uacuguagcugaugaaa

SEQ ID NO: 1953039 - RNA, 21 nt, Homo sapiens
cccgggagacucaaagggaga

SEQ ID NO: 1953040 - RNA, 20 nt, Homo sapiens
cagaagagaaaguacaacca

SEQ ID NO: 1953041 - RNA, 17 nt, Homo sapiens
auaagaaagcacuauua

SEQ ID NO: 1953042 - RNA, 16 nt, Homo sapiens
aggcagguccacagag

SEQ ID NO: 1953043 - RNA, 21 nt, Homo sapiens
aguuccugcuccguggacugc

SEQ ID NO: 1953044 - RNA, 19 nt, Homo sapiens
gaaucguuucaaauggacu

SEQ ID NO: 1953045 - RNA, 23 nt, Homo sapiens
ccccagggacugcaaguggccau

SEQ ID NO: 1953046 - RNA, 18 nt, Homo sapiens
aaauauuuuagccuuaaa

SEQ ID NO: 1953047 - RNA, 16 nt, Homo sapiens
uguggacacuguggaa

SEQ ID NO: 1953048 - RNA, 14 nt, Homo sapiens
aauucuaugagaua

SEQ ID NO: 1953049 - RNA, 14 nt, Homo sapiens
ccauuguggucaca

SEQ ID NO: 1953050 - RNA, 21 nt, Homo sapiens
acaagcauggaaaaucaguga

SEQ ID NO: 1953051 - RNA, 12 nt, Homo sapiens
gaaacgugaaag

SEQ ID NO: 1953052 - RNA, 21 nt, Homo sapiens
gccccauggaggguauacuga

SEQ ID NO: 1953053 - RNA, 22 nt, Homo sapiens
gccauacagcuguccacacuga

SEQ ID NO: 1953054 - RNA, 16 nt, Homo sapiens
agauagcuacagugua

SEQ ID NO: 1953055 - RNA, 14 nt, Homo sapiens
auuaauacaaugau

SEQ ID NO: 1953056 - RNA, 15 nt, Homo sapiens
gcauauauguauaua

SEQ ID NO: 1953057 - RNA, 15 nt, Homo sapiens
auuucaguacuucag

SEQ ID NO: 1953058 - RNA, 18 nt, Homo sapiens
uugagcugagugcugaaa

SEQ ID NO: 1953059 - RNA, 23 nt, Homo sapiens
gugcaaaccuguucaucuugcca

SEQ ID NO: 1953060 - RNA, 19 nt, Homo sapiens
uuaagacaacaggcauuuu

SEQ ID NO: 1953061 - RNA, 15 nt, Homo sapiens
aaguauaauuugcug

SEQ ID NO: 1953062 - RNA, 13 nt, Homo sapiens
aaucaugagauaa

SEQ ID NO: 1953063 - RNA, 19 nt, Homo sapiens
uggcuggacaaacugcacc

SEQ ID NO: 1953064 - RNA, 15 nt, Homo sapiens
cuuuggaucaggaaa

SEQ ID NO: 1953065 - RNA, 14 nt, Homo sapiens
auaagaaagcacua

SEQ ID NO: 1953066 - RNA, 23 nt, Homo sapiens
agucagaaugugaaaaaggaaua

SEQ ID NO: 1953067 - RNA, 21 nt, Homo sapiens
caaacaggucgagcugugcuc

SEQ ID NO: 1953068 - RNA, 15 nt, Homo sapiens
aagacugcugcugaa

SEQ ID NO: 1953069 - RNA, 23 nt, Homo sapiens
accccgauauauuuuagcauuuu

SEQ ID NO: 1953070 - RNA, 15 nt, Homo sapiens
ucuaaaggugcuauu

SEQ ID NO: 1953071 - RNA, 14 nt, Homo sapiens
gaguuucuguucuc

SEQ ID NO: 1953072 - RNA, 18 nt, Homo sapiens
cuucugcugucucuccua

SEQ ID NO: 1953073 - RNA, 16 nt, Homo sapiens
aagugaauacauuuug

SEQ ID NO: 1953074 - RNA, 17 nt, Homo sapiens
cuacauauuugcacuga

SEQ ID NO: 1953075 - RNA, 16 nt, Homo sapiens
acaugcaauuuugcau

SEQ ID NO: 1953076 - RNA, 18 nt, Homo sapiens
augcacacucaugcacac

SEQ ID NO: 1953077 - RNA, 17 nt, Homo sapiens
ucauguggcuguagauc

SEQ ID NO: 1953078 - RNA, 23 nt, Homo sapiens
cugagcagugcuugaaugaaguu

SEQ ID NO: 1953079 - RNA, 21 nt, Homo sapiens
ccugugagcuccccaauccaa

SEQ ID NO: 1953080 - RNA, 19 nt, Homo sapiens
uggcuguuggugggacccg

SEQ ID NO: 1953081 - RNA, 14 nt, Homo sapiens
uaagggacaacauc

SEQ ID NO: 1953082 - RNA, 21 nt, Homo sapiens
uucuacucaggcugguggaga

SEQ ID NO: 1953083 - RNA, 15 nt, Homo sapiens
cgucagcugcucccu

SEQ ID NO: 1953084 - RNA, 23 nt, Homo sapiens
gauuuauaaauuugaaauccaaa

SEQ ID NO: 1953085 - RNA, 20 nt, Homo sapiens
aagagccauauaaguuugaa

SEQ ID NO: 1953086 - RNA, 17 nt, Homo sapiens
cugagaggggcugucca

SEQ ID NO: 1953087 - RNA, 20 nt, Homo sapiens
uugaucccacuucacuguga

SEQ ID NO: 1953088 - RNA, 15 nt, Homo sapiens
agcuuauacagagcc

SEQ ID NO: 1953089 - RNA, 23 nt, Homo sapiens
uaccccaccacgauguggcccug

SEQ ID NO: 1953090 - RNA, 15 nt, Homo sapiens
ccguggacuacacag

SEQ ID NO: 1953091 - RNA, 13 nt, Homo sapiens
gcuccagugcagg

SEQ ID NO: 1953092 - RNA, 13 nt, Homo sapiens
auuaaaauauucu

SEQ ID NO: 1953093 - RNA, 13 nt, Homo sapiens
auccaaauaucau

SEQ ID NO: 1953094 - RNA, 14 nt, Homo sapiens
gugggauccuccag

SEQ ID NO: 1953095 - RNA, 18 nt, Homo sapiens
gugucaaauaaacacugu

SEQ ID NO: 1953096 - RNA, 14 nt, Homo sapiens
ccagcuucaggcag

SEQ ID NO: 1953097 - RNA, 21 nt, Homo sapiens
gagacgcagcccugggggcca

SEQ ID NO: 1953098 - RNA, 18 nt, Homo sapiens
cagcccuccuuaucaaag

SEQ ID NO: 1953099 - RNA, 13 nt, Homo sapiens
ggaagcccucguc

SEQ ID NO: 1953100 - RNA, 16 nt, Homo sapiens
cacagcaugugccaag

SEQ ID NO: 1953101 - RNA, 18 nt, Homo sapiens
aagaaaggccagcaaauu

SEQ ID NO: 1953102 - RNA, 16 nt, Homo sapiens
acccaucuguacucau

SEQ ID NO: 1953103 - RNA, 21 nt, Homo sapiens
ccacaccuggcauggugcagg

SEQ ID NO: 1953104 - RNA, 20 nt, Homo sapiens
agcaguggcuuagcugccau

SEQ ID NO: 1953105 - RNA, 19 nt, Homo sapiens
agaaucccuuaaaauuacc

SEQ ID NO: 1953106 - RNA, 16 nt, Homo sapiens
uucauacagcauuaca

SEQ ID NO: 1953107 - RNA, 22 nt, Homo sapiens
uagagugcuuuccuugugaugc

SEQ ID NO: 1953108 - RNA, 15 nt, Homo sapiens
uguugagugcaacaa

SEQ ID NO: 1953109 - RNA, 21 nt, Homo sapiens
uuugcuccauccuccugggau

SEQ ID NO: 1953110 - RNA, 21 nt, Homo sapiens
uguguacauaaagucaucaaa

SEQ ID NO: 1953111 - RNA, 14 nt, Homo sapiens
aguggagacagacu

SEQ ID NO: 1953112 - RNA, 18 nt, Homo sapiens
ucaugaggccggaugaaa

SEQ ID NO: 1953113 - RNA, 18 nt, Homo sapiens
aaguggggugagugccuc

SEQ ID NO: 1953114 - RNA, 14 nt, Homo sapiens
aguuaauuugauaa

SEQ ID NO: 1953115 - RNA, 20 nt, Homo sapiens
ugcaaucugguugugauuua

SEQ ID NO: 1953116 - RNA, 16 nt, Homo sapiens
ugugaaauucauuugu

SEQ ID NO: 1953117 - RNA, 17 nt, Homo sapiens
aggccaguaaaaguaua

SEQ ID NO: 1953118 - RNA, 18 nt, Homo sapiens
ccacaagggcaguggaag

SEQ ID NO: 1953119 - RNA, 17 nt, Homo sapiens
gcuccuuggcuuaccug

SEQ ID NO: 1953120 - RNA, 22 nt, Homo sapiens
uaaucagggaggucauuuuggu

SEQ ID NO: 1953121 - RNA, 17 nt, Homo sapiens
ugucaaaagccagaugu

SEQ ID NO: 1953122 - RNA, 13 nt, Homo sapiens
uugucacugagac

SEQ ID NO: 1953123 - RNA, 13 nt, Homo sapiens
gagacacuuuguc

SEQ ID NO: 1953124 - RNA, 20 nt, Homo sapiens
cacaggguaccaggauaaag

SEQ ID NO: 1953125 - RNA, 19 nt, Homo sapiens
gguuaauaaguuucacuga

SEQ ID NO: 1953126 - RNA, 19 nt, Homo sapiens
uaacuuauauugaagacaa

SEQ ID NO: 1953127 - RNA, 16 nt, Homo sapiens
ugaagagaguugcuuu

SEQ ID NO: 1953128 - RNA, 14 nt, Homo sapiens
gggacacuuaccca

SEQ ID NO: 1953129 - RNA, 23 nt, Homo sapiens
guguacaacaaugcuuugauaaa

SEQ ID NO: 1953130 - RNA, 21 nt, Homo sapiens
uguagcggugaagaguacaga

SEQ ID NO: 1953131 - RNA, 19 nt, Homo sapiens
ugguuuauauaaggcagua

SEQ ID NO: 1953132 - RNA, 15 nt, Homo sapiens
ugggauaucacuucc

SEQ ID NO: 1953133 - RNA, 18 nt, Homo sapiens
cagccuccgccauuccaa

SEQ ID NO: 1953134 - RNA, 17 nt, Homo sapiens
gaucaugucucacuuca

SEQ ID NO: 1953135 - RNA, 20 nt, Homo sapiens
ccaggacuguugaugccuuu

SEQ ID NO: 1953136 - RNA, 20 nt, Homo sapiens
cagaagagacccaaccacuu

SEQ ID NO: 1953137 - RNA, 22 nt, Homo sapiens
acaugcucaccucuagccuuaa

SEQ ID NO: 1953138 - RNA, 15 nt, Homo sapiens
gccucgcuacaagaa

SEQ ID NO: 1953139 - RNA, 17 nt, Homo sapiens
uuucuggggacaccagc

SEQ ID NO: 1953140 - RNA, 17 nt, Homo sapiens
caugccauuuguacuga

SEQ ID NO: 1953141 - RNA, 15 nt, Homo sapiens
gcauggugcuuucag

SEQ ID NO: 1953142 - RNA, 18 nt, Homo sapiens
auuaagacuuuauguagu

SEQ ID NO: 1953143 - RNA, 17 nt, Homo sapiens
gaauggagggagcucca

SEQ ID NO: 1953144 - RNA, 14 nt, Homo sapiens
uaaauguaucugaa

SEQ ID NO: 1953145 - RNA, 19 nt, Homo sapiens
ugcgaaaucuguugugcau

SEQ ID NO: 1953146 - RNA, 11 nt, Homo sapiens
gaaagugaaac

SEQ ID NO: 1953147 - RNA, 18 nt, Homo sapiens
uggucuauuuauguauaa

SEQ ID NO: 1953148 - RNA, 20 nt, Homo sapiens
cccuucccucaccuuggcac

SEQ ID NO: 1953149 - RNA, 22 nt, Homo sapiens
ccugcacagccucuaguguccg

SEQ ID NO: 1953150 - RNA, 21 nt, Homo sapiens
uucuuaaaagaaaucuugcuu

SEQ ID NO: 1953151 - RNA, 19 nt, Homo sapiens
acccuguagcgccagugua

SEQ ID NO: 1953152 - RNA, 16 nt, Homo sapiens
cacugguaacauguga

SEQ ID NO: 1953153 - RNA, 23 nt, Homo sapiens
acguacaaaauccagcuaugaau

SEQ ID NO: 1953154 - RNA, 16 nt, Homo sapiens
uuaugaugugcuuaac

SEQ ID NO: 1953155 - RNA, 23 nt, Homo sapiens
ugacaaggcuacgcugacaauca

SEQ ID NO: 1953156 - RNA, 11 nt, Homo sapiens
ugccauaacau

SEQ ID NO: 1953157 - RNA, 22 nt, Homo sapiens
aucugcauccagccuccugcua

SEQ ID NO: 1953158 - RNA, 16 nt, Homo sapiens
uuaauuguguaacugu

SEQ ID NO: 1953159 - RNA, 21 nt, Homo sapiens
ugcauagaauucuagcuuuuu

SEQ ID NO: 1953160 - RNA, 19 nt, Homo sapiens
uugucauugaaauuuggca

SEQ ID NO: 1953161 - RNA, 22 nt, Homo sapiens
ccggcgucuugcccagcagcuc

SEQ ID NO: 1953162 - RNA, 22 nt, Homo sapiens
agccucccaaagugcugagauu

SEQ ID NO: 1953163 - RNA, 23 nt, Homo sapiens
aguauaggauaaauuacauuaaa

SEQ ID NO: 1953164 - RNA, 16 nt, Homo sapiens
aagucccgaggcagca

SEQ ID NO: 1953165 - RNA, 18 nt, Homo sapiens
ggcucccucacucucagg

SEQ ID NO: 1953166 - RNA, 18 nt, Homo sapiens
uguaagguggucacuguu

SEQ ID NO: 1953167 - RNA, 21 nt, Homo sapiens
cacaucacuacaguacaguga

SEQ ID NO: 1953168 - RNA, 21 nt, Homo sapiens
uaaaaauuagcaugcugcuuu

SEQ ID NO: 1953169 - RNA, 14 nt, Homo sapiens
uuuuccucuaauau

SEQ ID NO: 1953170 - RNA, 23 nt, Homo sapiens
aaacugcuuuuuuuuuuccagca

SEQ ID NO: 1953171 - RNA, 18 nt, Homo sapiens
auauuuuaaaaaaucaaa

SEQ ID NO: 1953172 - RNA, 23 nt, Homo sapiens
cagaggaaacuuaagcauaaaaa

SEQ ID NO: 1953173 - RNA, 17 nt, Homo sapiens
aacacaaagcucuguca

SEQ ID NO: 1953174 - RNA, 18 nt, Homo sapiens
gcgguugaggagaauugc

SEQ ID NO: 1953175 - RNA, 16 nt, Homo sapiens
aaguacccugugcuca

SEQ ID NO: 1953176 - RNA, 18 nt, Homo sapiens
gaguagguuuaccagaga

SEQ ID NO: 1953177 - RNA, 16 nt, Homo sapiens
uauacaucuguguauu

SEQ ID NO: 1953178 - RNA, 15 nt, Homo sapiens
acucacucaguuuau

SEQ ID NO: 1953179 - RNA, 15 nt, Homo sapiens
uaauuuauaaauaca

SEQ ID NO: 1953180 - RNA, 15 nt, Homo sapiens
caaaaagucugccaa

SEQ ID NO: 1953181 - RNA, 17 nt, Homo sapiens
cugaccugguacugagg

SEQ ID NO: 1953182 - RNA, 18 nt, Homo sapiens
gugcauaggccacacagc

SEQ ID NO: 1953183 - RNA, 16 nt, Homo sapiens
auuaauugugcuguuu

SEQ ID NO: 1953184 - RNA, 23 nt, Homo sapiens
acaaggcgaguggauaauuccaa

SEQ ID NO: 1953185 - RNA, 19 nt, Homo sapiens
ugugccauuucucagggaa

SEQ ID NO: 1953186 - RNA, 21 nt, Homo sapiens
cuggguugggggcuagggaga

SEQ ID NO: 1953187 - RNA, 16 nt, Homo sapiens
ucuuuccuauuugcac

SEQ ID NO: 1953188 - RNA, 14 nt, Homo sapiens
aguagcaacaaaag

SEQ ID NO: 1953189 - RNA, 22 nt, Homo sapiens
aaauggugcugcagauuugaua

SEQ ID NO: 1953190 - RNA, 17 nt, Homo sapiens
auuuauuaccucugaua

SEQ ID NO: 1953191 - RNA, 21 nt, Homo sapiens
uuccaaauguggccuccaugu

SEQ ID NO: 1953192 - RNA, 17 nt, Homo sapiens
agugcuuaguguacuug

SEQ ID NO: 1953193 - RNA, 13 nt, Homo sapiens
acuggcucuccaa

SEQ ID NO: 1953194 - RNA, 13 nt, Homo sapiens
agcagcucuguga

SEQ ID NO: 1953195 - RNA, 14 nt, Homo sapiens
ccgggcacugucau

SEQ ID NO: 1953196 - RNA, 19 nt, Homo sapiens
uccuggcuuugacaugaaa

SEQ ID NO: 1953197 - RNA, 20 nt, Homo sapiens
acaugggagcaguccaugca

SEQ ID NO: 1953198 - RNA, 17 nt, Homo sapiens
caaauuguacaagguau

SEQ ID NO: 1953199 - RNA, 22 nt, Homo sapiens
ugaauuaugauggucugcauua

SEQ ID NO: 1953200 - RNA, 19 nt, Homo sapiens
uugucaacaaaaagacaug

SEQ ID NO: 1953201 - RNA, 14 nt, Homo sapiens
acaaaacuauggaa

SEQ ID NO: 1953202 - RNA, 17 nt, Homo sapiens
ccucaucaguagauggu

SEQ ID NO: 1953203 - RNA, 17 nt, Homo sapiens
ccaggcccaaggaguaa

SEQ ID NO: 1953204 - RNA, 18 nt, Homo sapiens
ccuuaaggaaaucuuuac

SEQ ID NO: 1953205 - RNA, 15 nt, Homo sapiens
cugacuugagccacu

SEQ ID NO: 1953206 - RNA, 20 nt, Homo sapiens
aacuauauaaaugacauuau

SEQ ID NO: 1953207 - RNA, 21 nt, Homo sapiens
cuuagagcacuagaagcacag

SEQ ID NO: 1953208 - RNA, 22 nt, Homo sapiens
gccaacugcuuggacagcagcc

SEQ ID NO: 1953209 - RNA, 20 nt, Homo sapiens
ugaacugaggcccugugaua

SEQ ID NO: 1953210 - RNA, 15 nt, Homo sapiens
gccugcccagacuga

SEQ ID NO: 1953211 - RNA, 18 nt, Homo sapiens
uugccucuuucacauuga

SEQ ID NO: 1953212 - RNA, 16 nt, Homo sapiens
gccgacauuaaaguau

SEQ ID NO: 1953213 - RNA, 20 nt, Homo sapiens
agguaauguuccugaaaauu

SEQ ID NO: 1953214 - RNA, 17 nt, Homo sapiens
ugcuccaguguuuucuu

SEQ ID NO: 1953215 - RNA, 18 nt, Homo sapiens
uaugcuauuauucuguaa

SEQ ID NO: 1953216 - RNA, 15 nt, Homo sapiens
caugcucuugaccuu

SEQ ID NO: 1953217 - RNA, 13 nt, Homo sapiens
ucaccuucuuccc

SEQ ID NO: 1953218 - RNA, 23 nt, Homo sapiens
aacuaaaguugaaaauacauucu

SEQ ID NO: 1953219 - RNA, 11 nt, Homo sapiens
accccaggugg

SEQ ID NO: 1953220 - RNA, 13 nt, Homo sapiens
cauguucuauauu

SEQ ID NO: 1953221 - RNA, 18 nt, Homo sapiens
agccacaaacuccaucca

SEQ ID NO: 1953222 - RNA, 17 nt, Homo sapiens
uuucccacgaggaaucu

SEQ ID NO: 1953223 - RNA, 19 nt, Homo sapiens
ugcauguaauacacaguga

SEQ ID NO: 1953224 - RNA, 14 nt, Homo sapiens
uuaaguuguauuaa

SEQ ID NO: 1953225 - RNA, 16 nt, Homo sapiens
cuuuguguuuggauca

SEQ ID NO: 1953226 - RNA, 18 nt, Homo sapiens
aaaccaaccgauugccuu

SEQ ID NO: 1953227 - RNA, 22 nt, Homo sapiens
uauauuugugugaaaaugugac

SEQ ID NO: 1953228 - RNA, 18 nt, Homo sapiens
acccacaccucugccaga

SEQ ID NO: 1953229 - RNA, 23 nt, Homo sapiens
ucucaugauccaacuaaugccuu

SEQ ID NO: 1953230 - RNA, 13 nt, Homo sapiens
cuguaaacaguuc

SEQ ID NO: 1953231 - RNA, 13 nt, Homo sapiens
aguacaaccugaa

SEQ ID NO: 1953232 - RNA, 19 nt, Homo sapiens
gaaagcugauuacugucaa

SEQ ID NO: 1953233 - RNA, 21 nt, Homo sapiens
gacaugcgggcugggcagcug

SEQ ID NO: 1953234 - RNA, 13 nt, Homo sapiens
aacgucucuucaa

SEQ ID NO: 1953235 - RNA, 20 nt, Homo sapiens
guugggucucacucucuggg

SEQ ID NO: 1953236 - RNA, 14 nt, Homo sapiens
guuugccauucucu

SEQ ID NO: 1953237 - RNA, 21 nt, Homo sapiens
aguuuccaaguuuauugcccu

SEQ ID NO: 1953238 - RNA, 21 nt, Homo sapiens
cauggcugaaggaaaccagug

SEQ ID NO: 1953239 - RNA, 22 nt, Homo sapiens
uucuacuguaucgccagugccu

SEQ ID NO: 1953240 - RNA, 15 nt, Homo sapiens
ccaagguuuaaagag

SEQ ID NO: 1953241 - RNA, 13 nt, Homo sapiens
gcaguaagccugu

SEQ ID NO: 1953242 - RNA, 20 nt, Homo sapiens
caggucuuuaaaucauuuua

SEQ ID NO: 1953243 - RNA, 16 nt, Homo sapiens
cacacauauacaugua

SEQ ID NO: 1953244 - RNA, 16 nt, Homo sapiens
ucagcugguccugacc

SEQ ID NO: 1953245 - RNA, 14 nt, Homo sapiens
uaaaaauggcucag

SEQ ID NO: 1953246 - RNA, 18 nt, Homo sapiens
cuaucccaucccauccca

SEQ ID NO: 1953247 - RNA, 21 nt, Homo sapiens
agccaucccaaggcuccugac

SEQ ID NO: 1953248 - RNA, 17 nt, Homo sapiens
ucccucucaacacccag

SEQ ID NO: 1953249 - RNA, 21 nt, Homo sapiens
aaagucuguuucugcuuccuu

SEQ ID NO: 1953250 - RNA, 21 nt, Homo sapiens
cugaggcccagugcauaugca

SEQ ID NO: 1953251 - RNA, 17 nt, Homo sapiens
gcuguuauuucuucccu

SEQ ID NO: 1953252 - RNA, 16 nt, Homo sapiens
gagccccagcuacccu

SEQ ID NO: 1953253 - RNA, 22 nt, Homo sapiens
auucccugaaucugugccugca

SEQ ID NO: 1953254 - RNA, 23 nt, Homo sapiens
uagauggggagaaaacacaguug

SEQ ID NO: 1953255 - RNA, 17 nt, Homo sapiens
cucuguauauaaauaug

SEQ ID NO: 1953256 - RNA, 17 nt, Homo sapiens
ccaccugggcauaucca

SEQ ID NO: 1953257 - RNA, 23 nt, Homo sapiens
gucuguaguauacagacaggaag

SEQ ID NO: 1953258 - RNA, 20 nt, Homo sapiens
cugaagucacguagcacaga

SEQ ID NO: 1953259 - RNA, 16 nt, Homo sapiens
uccaaggacauauugc

SEQ ID NO: 1953260 - RNA, 22 nt, Homo sapiens
gauuauaaaaaauguaacauca

SEQ ID NO: 1953261 - RNA, 17 nt, Homo sapiens
ucuaauaaacacagauu

SEQ ID NO: 1953262 - RNA, 17 nt, Homo sapiens
uauguuaauaaacugca

SEQ ID NO: 1953263 - RNA, 18 nt, Homo sapiens
acuguagucagaccucag

SEQ ID NO: 1953264 - RNA, 23 nt, Homo sapiens
acuguauuuuauauaggcauuuc

SEQ ID NO: 1953265 - RNA, 21 nt, Homo sapiens
uccuaugcccagguaccaccc

SEQ ID NO: 1953266 - RNA, 21 nt, Homo sapiens
ccaacguguccuuguacccug

SEQ ID NO: 1953267 - RNA, 22 nt, Homo sapiens
gauagugcuggaacacugcuga

SEQ ID NO: 1953268 - RNA, 12 nt, Homo sapiens
auuucucuguga

SEQ ID NO: 1953269 - RNA, 20 nt, Homo sapiens
aucuucucagcucccauuuc

SEQ ID NO: 1953270 - RNA, 19 nt, Homo sapiens
caaaauugaugauccauua

SEQ ID NO: 1953271 - RNA, 14 nt, Homo sapiens
aaaaucaaaucaug

SEQ ID NO: 1953272 - RNA, 18 nt, Homo sapiens
ccuguaaagaaacauuuc

SEQ ID NO: 1953273 - RNA, 16 nt, Homo sapiens
uuucgugcacucugcu

SEQ ID NO: 1953274 - RNA, 22 nt, Homo sapiens
aggccugcuugacuuuccagaa

SEQ ID NO: 1953275 - RNA, 19 nt, Homo sapiens
agcaagauuuugucaaaaa

SEQ ID NO: 1953276 - RNA, 19 nt, Homo sapiens
aagaacagagucucaggac

SEQ ID NO: 1953277 - RNA, 21 nt, Homo sapiens
cccaggaggugugauuccuga

SEQ ID NO: 1953278 - RNA, 22 nt, Homo sapiens
uaaacaacuuguacuuguuuca

SEQ ID NO: 1953279 - RNA, 16 nt, Homo sapiens
gcucaaugaaaccuuc

SEQ ID NO: 1953280 - RNA, 16 nt, Homo sapiens
accagccugagcaaca

SEQ ID NO: 1953281 - RNA, 16 nt, Homo sapiens
auucaaugaacuucca

SEQ ID NO: 1953282 - RNA, 19 nt, Homo sapiens
ggaaaaacaaaugccauau

SEQ ID NO: 1953283 - RNA, 18 nt, Homo sapiens
guauugucugacuucuca

SEQ ID NO: 1953284 - RNA, 21 nt, Homo sapiens
aacauucugaaucaagcacac

SEQ ID NO: 1953285 - RNA, 13 nt, Homo sapiens
gaugaagaccaaa

SEQ ID NO: 1953286 - RNA, 21 nt, Homo sapiens
agacaaaggcucuacacauac

SEQ ID NO: 1953287 - RNA, 23 nt, Homo sapiens
auaagcuuccuagaaaguucugu

SEQ ID NO: 1953288 - RNA, 19 nt, Homo sapiens
ugacauuucuaacauaugu

SEQ ID NO: 1953289 - RNA, 15 nt, Homo sapiens
guuuugcaagggaau

SEQ ID NO: 1953290 - RNA, 19 nt, Homo sapiens
ucguccucacuggucuaca

SEQ ID NO: 1953291 - RNA, 19 nt, Homo sapiens
ugccacaguucacaugcca

SEQ ID NO: 1953292 - RNA, 17 nt, Homo sapiens
gaaaaaaugcugagcca

SEQ ID NO: 1953293 - RNA, 18 nt, Homo sapiens
acauguuugguaccaaga

SEQ ID NO: 1953294 - RNA, 15 nt, Homo sapiens
uugacgccaccauaa

SEQ ID NO: 1953295 - RNA, 18 nt, Homo sapiens
aacagugucauauacaau

SEQ ID NO: 1953296 - RNA, 12 nt, Homo sapiens
cugcaugcugcc

SEQ ID NO: 1953297 - RNA, 16 nt, Homo sapiens
aacugugacauuccac

SEQ ID NO: 1953298 - RNA, 13 nt, Homo sapiens
cuuccuauucuca

SEQ ID NO: 1953299 - RNA, 20 nt, Homo sapiens
ucugugugugugugugcaua

SEQ ID NO: 1953300 - RNA, 17 nt, Homo sapiens
gacaauauacuucacug

SEQ ID NO: 1953301 - RNA, 19 nt, Homo sapiens
gaaaccagaaauaccacau

SEQ ID NO: 1953302 - RNA, 19 nt, Homo sapiens
auuaguauucaggcacuga

SEQ ID NO: 1953303 - RNA, 21 nt, Homo sapiens
accauguauaugagcuuauaa

SEQ ID NO: 1953304 - RNA, 13 nt, Homo sapiens
uuuuacagugaau

SEQ ID NO: 1953305 - RNA, 20 nt, Homo sapiens
caugacugcauuuuacugua

SEQ ID NO: 1953306 - RNA, 21 nt, Homo sapiens
cagugggugccccccuugcca

SEQ ID NO: 1953307 - RNA, 17 nt, Homo sapiens
uugccaagaccauuuca

SEQ ID NO: 1953308 - RNA, 19 nt, Homo sapiens
agcgcuuugcuuaccaaaa

SEQ ID NO: 1953309 - RNA, 16 nt, Homo sapiens
gauucaauauuaugaa

SEQ ID NO: 1953310 - RNA, 15 nt, Homo sapiens
acauacguacuuuuc

SEQ ID NO: 1953311 - RNA, 16 nt, Homo sapiens
ucaccucccaaaccca

SEQ ID NO: 1953312 - RNA, 18 nt, Homo sapiens
cggugacucaugccugua

SEQ ID NO: 1953313 - RNA, 18 nt, Homo sapiens
cgugcacuuggugcugcg

SEQ ID NO: 1953314 - RNA, 15 nt, Homo sapiens
uaaaauaaagcuacc

SEQ ID NO: 1953315 - RNA, 20 nt, Homo sapiens
aauguuucuggacauucucu

SEQ ID NO: 1953316 - RNA, 14 nt, Homo sapiens
ccuccggccuccac

SEQ ID NO: 1953317 - RNA, 19 nt, Homo sapiens
guccauggaaugcuugaaa

SEQ ID NO: 1953318 - RNA, 22 nt, Homo sapiens
aggggagcccggagcuuugcaa

SEQ ID NO: 1953319 - RNA, 14 nt, Homo sapiens
uauacuauaugaaa

SEQ ID NO: 1953320 - RNA, 23 nt, Homo sapiens
uggcccucacugcagggcacugu

SEQ ID NO: 1953321 - RNA, 22 nt, Homo sapiens
uucaaaccaauucacccagaaa

SEQ ID NO: 1953322 - RNA, 20 nt, Homo sapiens
aaauaacuucaguccugcuc

SEQ ID NO: 1953323 - RNA, 22 nt, Homo sapiens
ggacuaaacuaucuguauuuau

SEQ ID NO: 1953324 - RNA, 17 nt, Homo sapiens
uauuauaagugcuucac

SEQ ID NO: 1953325 - RNA, 23 nt, Homo sapiens
uauuuaaacaugguuacaaucau

SEQ ID NO: 1953326 - RNA, 18 nt, Homo sapiens
cccgagcuagagugcagu

SEQ ID NO: 1953327 - RNA, 15 nt, Homo sapiens
aacuugaaacagauu

SEQ ID NO: 1953328 - RNA, 14 nt, Homo sapiens
ucccaucuuuacuc

SEQ ID NO: 1953329 - RNA, 19 nt, Homo sapiens
uuaggaaaaaaacuauuaa

SEQ ID NO: 1953330 - RNA, 18 nt, Homo sapiens
uaauuaguugauugcugu

SEQ ID NO: 1953331 - RNA, 15 nt, Homo sapiens
acaccaaaacaugcc

SEQ ID NO: 1953332 - RNA, 13 nt, Homo sapiens
caguauauaacua

SEQ ID NO: 1953333 - RNA, 17 nt, Homo sapiens
ugacugacugcaccuuc

SEQ ID NO: 1953334 - RNA, 13 nt, Homo sapiens
auuaaaacacuua

SEQ ID NO: 1953335 - RNA, 19 nt, Homo sapiens
auuccacaggaucaucauu

SEQ ID NO: 1953336 - RNA, 23 nt, Homo sapiens
auguucuuuuuucugucuugucu

SEQ ID NO: 1953337 - RNA, 22 nt, Homo sapiens
uuccacuuguucauucugugac

SEQ ID NO: 1953338 - RNA, 16 nt, Homo sapiens
ucaguucuacacugau

SEQ ID NO: 1953339 - RNA, 16 nt, Homo sapiens
acugauguuccacaaa

SEQ ID NO: 1953340 - RNA, 15 nt, Homo sapiens
gccuuuguuucccau

SEQ ID NO: 1953341 - RNA, 13 nt, Homo sapiens
uagucaaaccacu

SEQ ID NO: 1953342 - RNA, 19 nt, Homo sapiens
cuucuauuaaggacauuua

SEQ ID NO: 1953343 - RNA, 20 nt, Homo sapiens
guaucaugcccugugcaacc

SEQ ID NO: 1953344 - RNA, 22 nt, Homo sapiens
accagguaaugugggucuacca

SEQ ID NO: 1953345 - RNA, 20 nt, Homo sapiens
ugagcugccccugcugcuua

SEQ ID NO: 1953346 - RNA, 17 nt, Homo sapiens
gcacggaucacgaugua

SEQ ID NO: 1953347 - RNA, 17 nt, Homo sapiens
auauuugauacauauaa

SEQ ID NO: 1953348 - RNA, 10 nt, Homo sapiens
uccucugcau

SEQ ID NO: 1953349 - RNA, 15 nt, Homo sapiens
cuuuauagcucauca

SEQ ID NO: 1953350 - RNA, 13 nt, Homo sapiens
guucgacaaaagc

SEQ ID NO: 1953351 - RNA, 17 nt, Homo sapiens
acauuucuaacucugau

SEQ ID NO: 1953352 - RNA, 14 nt, Homo sapiens
caagaaugcauuaa

SEQ ID NO: 1953353 - RNA, 21 nt, Homo sapiens
aagggauuuucagcccucaga

SEQ ID NO: 1953354 - RNA, 20 nt, Homo sapiens
aaaauauuucuguugucaau

SEQ ID NO: 1953355 - RNA, 18 nt, Homo sapiens
aauccuaguaugccaaaa

SEQ ID NO: 1953356 - RNA, 14 nt, Homo sapiens
uccaaaacuuuaau

SEQ ID NO: 1953357 - RNA, 12 nt, Homo sapiens
cugggagacaaa

SEQ ID NO: 1953358 - RNA, 11 nt, Homo sapiens
cucguccuccc

SEQ ID NO: 1953359 - RNA, 21 nt, Homo sapiens
acagaguuuuuuauaaaugua

SEQ ID NO: 1953360 - RNA, 14 nt, Homo sapiens
aguagaagcucaca

SEQ ID NO: 1953361 - RNA, 22 nt, Homo sapiens
aagaugauggaaacgcacuuac

SEQ ID NO: 1953362 - RNA, 17 nt, Homo sapiens
agcacuguuuauacacu

SEQ ID NO: 1953363 - RNA, 11 nt, Homo sapiens
ggcauaugcac

SEQ ID NO: 1953364 - RNA, 16 nt, Homo sapiens
ugaaaggcccauggau

SEQ ID NO: 1953365 - RNA, 13 nt, Homo sapiens
acaguagaagcuc

SEQ ID NO: 1953366 - RNA, 19 nt, Homo sapiens
gcugccuguuguuaugggu

SEQ ID NO: 1953367 - RNA, 12 nt, Homo sapiens
aucuccacuuuu

SEQ ID NO: 1953368 - RNA, 16 nt, Homo sapiens
acacuaauucugucag

SEQ ID NO: 1953369 - RNA, 15 nt, Homo sapiens
agcuagaaugcacac

SEQ ID NO: 1953370 - RNA, 14 nt, Homo sapiens
uaaagaugguuuau

SEQ ID NO: 1953371 - RNA, 16 nt, Homo sapiens
agugccaccaagcuca

SEQ ID NO: 1953372 - RNA, 23 nt, Homo sapiens
aaguaaaacaugcugaaaacuac

SEQ ID NO: 1953373 - RNA, 14 nt, Homo sapiens
gggcugcccucucc

SEQ ID NO: 1953374 - RNA, 15 nt, Homo sapiens
ugaucugugcagggu

SEQ ID NO: 1953375 - RNA, 12 nt, Homo sapiens
ccucuaccaaaa

SEQ ID NO: 1953376 - RNA, 18 nt, Homo sapiens
ucucuaacuccugccauu

SEQ ID NO: 1953377 - RNA, 14 nt, Homo sapiens
acacaacauguaug

SEQ ID NO: 1953378 - RNA, 15 nt, Homo sapiens
aucaguacugacuuu

SEQ ID NO: 1953379 - RNA, 21 nt, Homo sapiens
cuuuaguacauggagcucagg

SEQ ID NO: 1953380 - RNA, 14 nt, Homo sapiens
gaucgaagccaaag

SEQ ID NO: 1953381 - RNA, 13 nt, Homo sapiens
ucccugacugggg

SEQ ID NO: 1953382 - RNA, 19 nt, Homo sapiens
cccauagugcacacuugua

SEQ ID NO: 1953383 - RNA, 17 nt, Homo sapiens
aaaccagaaaagcaaua

SEQ ID NO: 1953384 - RNA, 16 nt, Homo sapiens
agggagacugacccau

SEQ ID NO: 1953385 - RNA, 21 nt, Homo sapiens
ucccgauucacccuguccaaa

SEQ ID NO: 1953386 - RNA, 15 nt, Homo sapiens
ugauuguggcauuua

SEQ ID NO: 1953387 - RNA, 19 nt, Homo sapiens
ccauaugcuaccaccagcu

SEQ ID NO: 1953388 - RNA, 11 nt, Homo sapiens
gcuugaugcug

SEQ ID NO: 1953389 - RNA, 13 nt, Homo sapiens
gccugggugcaaa

SEQ ID NO: 1953390 - RNA, 11 nt, Homo sapiens
accccauacau

SEQ ID NO: 1953391 - RNA, 15 nt, Homo sapiens
auuuaucaucacaaa

SEQ ID NO: 1953392 - RNA, 16 nt, Homo sapiens
ucgauucaaacugcuc

SEQ ID NO: 1953393 - RNA, 18 nt, Homo sapiens
aaccagauugucagcucc

SEQ ID NO: 1953394 - RNA, 19 nt, Homo sapiens
augaaauaaugcacugagu

SEQ ID NO: 1953395 - RNA, 17 nt, Homo sapiens
cgaaugauugcuuuuaa

SEQ ID NO: 1953396 - RNA, 17 nt, Homo sapiens
gcauggcucucuauucc

SEQ ID NO: 1953397 - RNA, 18 nt, Homo sapiens
uuaaaaacacuacuuuug

SEQ ID NO: 1953398 - RNA, 15 nt, Homo sapiens
aggauuuggcucgcu

SEQ ID NO: 1953399 - RNA, 12 nt, Homo sapiens
cucuuucacuuc

SEQ ID NO: 1953400 - RNA, 23 nt, Homo sapiens
cagucaagugaggugacacucca

SEQ ID NO: 1953401 - RNA, 19 nt, Homo sapiens
aauggaguuaaacuuuagu

SEQ ID NO: 1953402 - RNA, 14 nt, Homo sapiens
uuguacaauguaga

SEQ ID NO: 1953403 - RNA, 16 nt, Homo sapiens
uggggaagaagacaca

SEQ ID NO: 1953404 - RNA, 19 nt, Homo sapiens
gguacauuucccugugcug

SEQ ID NO: 1953405 - RNA, 23 nt, Homo sapiens
caaagcgugguggacaugcacag

SEQ ID NO: 1953406 - RNA, 18 nt, Homo sapiens
gucccaagcggugucucu

SEQ ID NO: 1953407 - RNA, 19 nt, Homo sapiens
uuaaagaaaauaugcauaa

SEQ ID NO: 1953408 - RNA, 21 nt, Homo sapiens
caacuguguguucgacaguga

SEQ ID NO: 1953409 - RNA, 17 nt, Homo sapiens
ugggagaaaagccagau

SEQ ID NO: 1953410 - RNA, 23 nt, Homo sapiens
uaaagaauguuucuuaacuauaa

SEQ ID NO: 1953411 - RNA, 14 nt, Homo sapiens
aaauaaccacugca

SEQ ID NO: 1953412 - RNA, 14 nt, Homo sapiens
ggccagagggcagu

SEQ ID NO: 1953413 - RNA, 16 nt, Homo sapiens
guccaccccuuuccug

SEQ ID NO: 1953414 - RNA, 19 nt, Homo sapiens
ggcaaguuucaauggugag

SEQ ID NO: 1953415 - RNA, 14 nt, Homo sapiens
auuucauaccucag

SEQ ID NO: 1953416 - RNA, 15 nt, Homo sapiens
gucaaggcuucagug

SEQ ID NO: 1953417 - RNA, 21 nt, Homo sapiens
ucagcaacccuacaguauaua

SEQ ID NO: 1953418 - RNA, 15 nt, Homo sapiens
cuccuuccaccacaa

SEQ ID NO: 1953419 - RNA, 12 nt, Homo sapiens
agcucacuuccu

SEQ ID NO: 1953420 - RNA, 16 nt, Homo sapiens
uaauaugguauuugcu

SEQ ID NO: 1953421 - RNA, 16 nt, Homo sapiens
uuuauaugcaugcaca

SEQ ID NO: 1953422 - RNA, 20 nt, Homo sapiens
agaagagguugggcuuccau

SEQ ID NO: 1953423 - RNA, 17 nt, Homo sapiens
uugugucuggcaguuua

SEQ ID NO: 1953424 - RNA, 18 nt, Homo sapiens
uguugagaggaacaagaa

SEQ ID NO: 1953425 - RNA, 21 nt, Homo sapiens
gaccagcucacguaaugcauu

SEQ ID NO: 1953426 - RNA, 16 nt, Homo sapiens
ucccuaggggacacuu

SEQ ID NO: 1953427 - RNA, 19 nt, Homo sapiens
gcuuuggacacacacagcu

SEQ ID NO: 1953428 - RNA, 16 nt, Homo sapiens
cucgagcaguccugcc

SEQ ID NO: 1953429 - RNA, 15 nt, Homo sapiens
acaaagacuaccuga

SEQ ID NO: 1953430 - RNA, 14 nt, Homo sapiens
aagaagacauguuu

SEQ ID NO: 1953431 - RNA, 18 nt, Homo sapiens
cuaauuugauguuuacag

SEQ ID NO: 1953432 - RNA, 17 nt, Homo sapiens
agcacugucucaguuuc

SEQ ID NO: 1953433 - RNA, 17 nt, Homo sapiens
ugaucugucuguggcaa

SEQ ID NO: 1953434 - RNA, 23 nt, Homo sapiens
cuucucaguagaaaggaacagaa

SEQ ID NO: 1953435 - RNA, 18 nt, Homo sapiens
agcauuuucaaugugaua

SEQ ID NO: 1953436 - RNA, 12 nt, Homo sapiens
cucauccaaagu

SEQ ID NO: 1953437 - RNA, 20 nt, Homo sapiens
uuuuaguucaauacagugaa

SEQ ID NO: 1953438 - RNA, 20 nt, Homo sapiens
cuuuggagaaaugcuuagaa

SEQ ID NO: 1953439 - RNA, 15 nt, Homo sapiens
agccugggcaacaaa

SEQ ID NO: 1953440 - RNA, 22 nt, Homo sapiens
cccagggggcugaaacuugaac

SEQ ID NO: 1953441 - RNA, 19 nt, Homo sapiens
acccuuucaaacuauuuau

SEQ ID NO: 1953442 - RNA, 14 nt, Homo sapiens
gcugauucaagaaa

SEQ ID NO: 1953443 - RNA, 23 nt, Homo sapiens
ugaaccuauuucuuaaacacuug

SEQ ID NO: 1953444 - RNA, 11 nt, Homo sapiens
gcaucuacccu

SEQ ID NO: 1953445 - RNA, 20 nt, Homo sapiens
uaaaacuagugacagcuugu

SEQ ID NO: 1953446 - RNA, 16 nt, Homo sapiens
uguauuuuaugaucuu

SEQ ID NO: 1953447 - RNA, 14 nt, Homo sapiens
guuuaguugcacaa

SEQ ID NO: 1953448 - RNA, 17 nt, Homo sapiens
aaguuucuuaaagcaac

SEQ ID NO: 1953449 - RNA, 16 nt, Homo sapiens
cauuaguuucaggcaa

SEQ ID NO: 1953450 - RNA, 19 nt, Homo sapiens
aucauuggauccuacucaa

SEQ ID NO: 1953451 - RNA, 16 nt, Homo sapiens
ccuuccuaagacuucu

SEQ ID NO: 1953452 - RNA, 19 nt, Homo sapiens
caaaugucauuucauacaa

SEQ ID NO: 1953453 - RNA, 15 nt, Homo sapiens
gagaauucccugugg

SEQ ID NO: 1953454 - RNA, 21 nt, Homo sapiens
acuggcuucucuugagucaca

SEQ ID NO: 1953455 - RNA, 21 nt, Homo sapiens
acagugaaauacauccuucaa

SEQ ID NO: 1953456 - RNA, 14 nt, Homo sapiens
ugcuagccacugga

SEQ ID NO: 1953457 - RNA, 17 nt, Homo sapiens
caugaccacucuuggcu

SEQ ID NO: 1953458 - RNA, 24 nt, Homo sapiens
ugacaauccuugagaaucuuugca

SEQ ID NO: 1953459 - RNA, 22 nt, Homo sapiens
uguugucauuauguacaauaca

SEQ ID NO: 1953460 - RNA, 16 nt, Homo sapiens
ucaggagucugccacu

SEQ ID NO: 1953461 - RNA, 20 nt, Homo sapiens
uuucaugauucaugagcugg

SEQ ID NO: 1953462 - RNA, 22 nt, Homo sapiens
ggcaaggacggccuucaacuga

SEQ ID NO: 1953463 - RNA, 21 nt, Homo sapiens
ucuacugcuuggauccauaca

SEQ ID NO: 1953464 - RNA, 21 nt, Homo sapiens
ucaccggccuugugacauuca

SEQ ID NO: 1953465 - RNA, 13 nt, Homo sapiens
uccagaacugcac

SEQ ID NO: 1953466 - RNA, 15 nt, Homo sapiens
cuaccuaaacauguu

SEQ ID NO: 1953467 - RNA, 23 nt, Homo sapiens
ggauacgaagaccauacauaaua

SEQ ID NO: 1953468 - RNA, 18 nt, Homo sapiens
ugcugccaccaaaucugu

SEQ ID NO: 1953469 - RNA, 16 nt, Homo sapiens
agcaugggaggugagg

SEQ ID NO: 1953470 - RNA, 20 nt, Homo sapiens
ugcacuccagucuggaugac

SEQ ID NO: 1953471 - RNA, 18 nt, Homo sapiens
auauaccaaugacuucca

SEQ ID NO: 1953472 - RNA, 21 nt, Homo sapiens
auucccauuggcucccugugu

SEQ ID NO: 1953473 - RNA, 18 nt, Homo sapiens
ccuucaccaaagaucugc

SEQ ID NO: 1953474 - RNA, 12 nt, Homo sapiens
ugguucucucca

SEQ ID NO: 1953475 - RNA, 12 nt, Homo sapiens
acgaucucagcu

SEQ ID NO: 1953476 - RNA, 12 nt, Homo sapiens
accuucucagga

SEQ ID NO: 1953477 - RNA, 15 nt, Homo sapiens
aauucucuagauuua

SEQ ID NO: 1953478 - RNA, 18 nt, Homo sapiens
agaagcuggaaaguguga

SEQ ID NO: 1953479 - RNA, 16 nt, Homo sapiens
gggcaugagcugcugu

SEQ ID NO: 1953480 - RNA, 22 nt, Homo sapiens
uauauaggcaauguaguacuca

SEQ ID NO: 1953481 - RNA, 20 nt, Homo sapiens
ucuauaacuacauauugaau

SEQ ID NO: 1953482 - RNA, 15 nt, Homo sapiens
agcuauccacagcuu

SEQ ID NO: 1953483 - RNA, 19 nt, Homo sapiens
aaugucucacuuuacuuuc

SEQ ID NO: 1953484 - RNA, 19 nt, Homo sapiens
aaagaaaaauaucuuggcc

SEQ ID NO: 1953485 - RNA, 21 nt, Homo sapiens
uauuucuaucugcaaauaguu

SEQ ID NO: 1953486 - RNA, 12 nt, Homo sapiens
aucuuucaggaa

SEQ ID NO: 1953487 - RNA, 11 nt, Homo sapiens
cacaccugcag

SEQ ID NO: 1953488 - RNA, 16 nt, Homo sapiens
accuccauaugcugua

SEQ ID NO: 1953489 - RNA, 16 nt, Homo sapiens
uuuauccucauuccau

SEQ ID NO: 1953490 - RNA, 20 nt, Homo sapiens
uuauaauuuuacucacucac

SEQ ID NO: 1953491 - RNA, 16 nt, Homo sapiens
auuuuuuacuacauaa

SEQ ID NO: 1953492 - RNA, 17 nt, Homo sapiens
cugagccugccgagcaa

SEQ ID NO: 1953493 - RNA, 17 nt, Homo sapiens
agcccucuccacccaga

SEQ ID NO: 1953494 - RNA, 14 nt, Homo sapiens
auucccucuugcua

SEQ ID NO: 1953495 - RNA, 13 nt, Homo sapiens
uacuaaaugugca

SEQ ID NO: 1953496 - RNA, 17 nt, Homo sapiens
uacuauuaaaguaacau

SEQ ID NO: 1953497 - RNA, 16 nt, Homo sapiens
gucuuuguucugugau

SEQ ID NO: 1953498 - RNA, 14 nt, Homo sapiens
acuguccugugagg

SEQ ID NO: 1953499 - RNA, 19 nt, Homo sapiens
ccuagggucuuguguugca

SEQ ID NO: 1953500 - RNA, 13 nt, Homo sapiens
accuacucuugcc

SEQ ID NO: 1953501 - RNA, 20 nt, Homo sapiens
acuguccugcuccacagugu

SEQ ID NO: 1953502 - RNA, 20 nt, Homo sapiens
auuugguguguucguugcac

SEQ ID NO: 1953503 - RNA, 18 nt, Homo sapiens
cuugcucccaauggugcu

SEQ ID NO: 1953504 - RNA, 13 nt, Homo sapiens
caggaaacauauu

SEQ ID NO: 1953505 - RNA, 20 nt, Homo sapiens
agcuccgccccuugaacaug

SEQ ID NO: 1953506 - RNA, 15 nt, Homo sapiens
uacaucuaacucauc

SEQ ID NO: 1953507 - RNA, 16 nt, Homo sapiens
cucggcucacugcaac

SEQ ID NO: 1953508 - RNA, 22 nt, Homo sapiens
agacauugggaggggcuucuga

SEQ ID NO: 1953509 - RNA, 20 nt, Homo sapiens
accucucuucugcacagcuc

SEQ ID NO: 1953510 - RNA, 13 nt, Homo sapiens
cgccuuagcuuug

SEQ ID NO: 1953511 - RNA, 23 nt, Homo sapiens
agcaaucugagagauuugaauag

SEQ ID NO: 1953512 - RNA, 13 nt, Homo sapiens
gauaugugccagg

SEQ ID NO: 1953513 - RNA, 15 nt, Homo sapiens
accauaaacauuugc

SEQ ID NO: 1953514 - RNA, 18 nt, Homo sapiens
cugcccugguccagggaa

SEQ ID NO: 1953515 - RNA, 16 nt, Homo sapiens
ucuguuaagugguuuc

SEQ ID NO: 1953516 - RNA, 22 nt, Homo sapiens
uccuaauauuuuguucugcaaa

SEQ ID NO: 1953517 - RNA, 19 nt, Homo sapiens
gcaguugaaaagacuccaa

SEQ ID NO: 1953518 - RNA, 13 nt, Homo sapiens
ccaagacaaauca

SEQ ID NO: 1953519 - RNA, 16 nt, Homo sapiens
guaagcccagcauuug

SEQ ID NO: 1953520 - RNA, 16 nt, Homo sapiens
uagcacaugcuucaau

SEQ ID NO: 1953521 - RNA, 18 nt, Homo sapiens
gccucauggcaucaucca

SEQ ID NO: 1953522 - RNA, 23 nt, Homo sapiens
agggggugggggugccgcuuucu

SEQ ID NO: 1953523 - RNA, 15 nt, Homo sapiens
gccggcggcuucucc

SEQ ID NO: 1953524 - RNA, 16 nt, Homo sapiens
acuuuucaccaaugag

SEQ ID NO: 1953525 - RNA, 12 nt, Homo sapiens
acacgcuuucac

SEQ ID NO: 1953526 - RNA, 12 nt, Homo sapiens
aaaagcuuuaaa

SEQ ID NO: 1953527 - RNA, 20 nt, Homo sapiens
aaaucuugagaaucaaucaa

SEQ ID NO: 1953528 - RNA, 20 nt, Homo sapiens
aauauuucccucaccuuucc

SEQ ID NO: 1953529 - RNA, 22 nt, Homo sapiens
acuuugagccucuuaggcagaa

SEQ ID NO: 1953530 - RNA, 22 nt, Homo sapiens
ccucuucucuugacagucugaa

SEQ ID NO: 1953531 - RNA, 19 nt, Homo sapiens
gaaacaguugguaacuuuu

SEQ ID NO: 1953532 - RNA, 22 nt, Homo sapiens
uuuucuuuuuugagacaggguc

SEQ ID NO: 1953533 - RNA, 16 nt, Homo sapiens
gcuuucccugaacugg

SEQ ID NO: 1953534 - RNA, 18 nt, Homo sapiens
ucuguugaaaagcacaca

SEQ ID NO: 1953535 - RNA, 11 nt, Homo sapiens
ucuaccaagcu

SEQ ID NO: 1953536 - RNA, 19 nt, Homo sapiens
aauaaguacuguguacaga

SEQ ID NO: 1953537 - RNA, 13 nt, Homo sapiens
gcagcacugaaau

SEQ ID NO: 1953538 - RNA, 13 nt, Homo sapiens
aaagcacuacaau

SEQ ID NO: 1953539 - RNA, 20 nt, Homo sapiens
auguaaugaucauaagucua

SEQ ID NO: 1953540 - RNA, 15 nt, Homo sapiens
uuuuuugccaaauag

SEQ ID NO: 1953541 - RNA, 15 nt, Homo sapiens
caggaucauggugua

SEQ ID NO: 1953542 - RNA, 14 nt, Homo sapiens
auaugaaggaaaug

SEQ ID NO: 1953543 - RNA, 18 nt, Homo sapiens
cuguggaacauaaaaagg

SEQ ID NO: 1953544 - RNA, 13 nt, Homo sapiens
aucuuucuuccaa

SEQ ID NO: 1953545 - RNA, 20 nt, Homo sapiens
ugagggccagugaugauguu

SEQ ID NO: 1953546 - RNA, 16 nt, Homo sapiens
uguguugacugcugcu

SEQ ID NO: 1953547 - RNA, 18 nt, Homo sapiens
ucgggugcccugcauuca

SEQ ID NO: 1953548 - RNA, 20 nt, Homo sapiens
ggauuuauuuuuuguaacuc

SEQ ID NO: 1953549 - RNA, 14 nt, Homo sapiens
gagaggaucaucug

SEQ ID NO: 1953550 - RNA, 17 nt, Homo sapiens
cuuuagcaaaacuggac

SEQ ID NO: 1953551 - RNA, 16 nt, Homo sapiens
caacucauuugcucua

SEQ ID NO: 1953552 - RNA, 13 nt, Homo sapiens
uuucccucgaaaa

SEQ ID NO: 1953553 - RNA, 20 nt, Homo sapiens
accuauuaucccagcugccu

SEQ ID NO: 1953554 - RNA, 14 nt, Homo sapiens
aauauaauacugua

SEQ ID NO: 1953555 - RNA, 17 nt, Homo sapiens
uguuugacgggaaacaa

SEQ ID NO: 1953556 - RNA, 14 nt, Homo sapiens
ugcaaaacauuuca

SEQ ID NO: 1953557 - RNA, 17 nt, Homo sapiens
aaacacucaacaauaaa

SEQ ID NO: 1953558 - RNA, 23 nt, Homo sapiens
uuacuuuuuuucugugacauuua

SEQ ID NO: 1953559 - RNA, 17 nt, Homo sapiens
aauuugggagagccaua

SEQ ID NO: 1953560 - RNA, 15 nt, Homo sapiens
cggaugacacaaaua

SEQ ID NO: 1953561 - RNA, 20 nt, Homo sapiens
uucaaauguuagcugcugaa

SEQ ID NO: 1953562 - RNA, 14 nt, Homo sapiens
ggaacucucuccac

SEQ ID NO: 1953563 - RNA, 22 nt, Homo sapiens
agcucaccuugagauaacaauc

SEQ ID NO: 1953564 - RNA, 20 nt, Homo sapiens
uugaaccagugauccauguc

SEQ ID NO: 1953565 - RNA, 18 nt, Homo sapiens
caaugaagugacacuuug

SEQ ID NO: 1953566 - RNA, 11 nt, Homo sapiens
ugacuaaagag

SEQ ID NO: 1953567 - RNA, 23 nt, Homo sapiens
aggccugccaaugccacagccaa

SEQ ID NO: 1953568 - RNA, 15 nt, Homo sapiens
cacauuucuaugcca

SEQ ID NO: 1953569 - RNA, 20 nt, Homo sapiens
uuccuuuucccugcuuccag

SEQ ID NO: 1953570 - RNA, 20 nt, Homo sapiens
ucacucuuaguuaugugacg

SEQ ID NO: 1953571 - RNA, 23 nt, Homo sapiens
cuucaccuuucccacuuucuucu

SEQ ID NO: 1953572 - RNA, 13 nt, Homo sapiens
ugcuuuugaggac

SEQ ID NO: 1953573 - RNA, 18 nt, Homo sapiens
gugguagaaauuuuuacc

SEQ ID NO: 1953574 - RNA, 18 nt, Homo sapiens
accaauuccaaguuuuaa

SEQ ID NO: 1953575 - RNA, 22 nt, Homo sapiens
aggcaguggccacguucaggga

SEQ ID NO: 1953576 - RNA, 22 nt, Homo sapiens
cagccccacgggacucuggugg

SEQ ID NO: 1953577 - RNA, 17 nt, Homo sapiens
gauuaaaaucacucuca

SEQ ID NO: 1953578 - RNA, 12 nt, Homo sapiens
caggaaccugag

SEQ ID NO: 1953579 - RNA, 18 nt, Homo sapiens
ucacugcagggcacugug

SEQ ID NO: 1953580 - RNA, 18 nt, Homo sapiens
gcuugaauaaacaccacu

SEQ ID NO: 1953581 - RNA, 13 nt, Homo sapiens
gauuugauaccau

SEQ ID NO: 1953582 - RNA, 17 nt, Homo sapiens
cuauuuuccaggcuucu

SEQ ID NO: 1953583 - RNA, 12 nt, Homo sapiens
agacuucugucu

SEQ ID NO: 1953584 - RNA, 21 nt, Homo sapiens
ugggucuucccuguaugauuc

SEQ ID NO: 1953585 - RNA, 20 nt, Homo sapiens
uuacaagacuguaaauucca

SEQ ID NO: 1953586 - RNA, 18 nt, Homo sapiens
augucuagccacugauca

SEQ ID NO: 1953587 - RNA, 19 nt, Homo sapiens
aaucuguuuguugacuuau

SEQ ID NO: 1953588 - RNA, 19 nt, Homo sapiens
acauacuuuaucaaugugu

SEQ ID NO: 1953589 - RNA, 15 nt, Homo sapiens
uuguucauacuuugg

SEQ ID NO: 1953590 - RNA, 21 nt, Homo sapiens
auugaaggaaagcuauaucua

SEQ ID NO: 1953591 - RNA, 18 nt, Homo sapiens
aaugaaccccagucagcc

SEQ ID NO: 1953592 - RNA, 14 nt, Homo sapiens
ucacagauaccucu

SEQ ID NO: 1953593 - RNA, 15 nt, Homo sapiens
gcuuugaggacaaag

SEQ ID NO: 1953594 - RNA, 15 nt, Homo sapiens
ccucauauacuugaa

SEQ ID NO: 1953595 - RNA, 22 nt, Homo sapiens
cuaaaugugaaugaugauccua

SEQ ID NO: 1953596 - RNA, 22 nt, Homo sapiens
cugcuuagugucccuuaccugg

SEQ ID NO: 1953597 - RNA, 21 nt, Homo sapiens
agccuaaccccauuccugugc

SEQ ID NO: 1953598 - RNA, 17 nt, Homo sapiens
caaacccuggugguauu

SEQ ID NO: 1953599 - RNA, 15 nt, Homo sapiens
aucuuaauacuugaa

SEQ ID NO: 1953600 - RNA, 21 nt, Homo sapiens
ucacaauuccauuuccaguuc

SEQ ID NO: 1953601 - RNA, 21 nt, Homo sapiens
uccaggauaccagcaaaugga

SEQ ID NO: 1953602 - RNA, 16 nt, Homo sapiens
caggagcaaaauaugg

SEQ ID NO: 1953603 - RNA, 14 nt, Homo sapiens
gcagaaucuuugca

SEQ ID NO: 1953604 - RNA, 15 nt, Homo sapiens
gacgcacagugcagu

SEQ ID NO: 1953605 - RNA, 20 nt, Homo sapiens
uagcaggucccuauagcaua

SEQ ID NO: 1953606 - RNA, 16 nt, Homo sapiens
uuugcuucuccaaaua

SEQ ID NO: 1953607 - RNA, 21 nt, Homo sapiens
cuuuguaagagcaaaagccuc

SEQ ID NO: 1953608 - RNA, 20 nt, Homo sapiens
augguggcgcgcaccuguaa

SEQ ID NO: 1953609 - RNA, 12 nt, Homo sapiens
gcaugagccagc

SEQ ID NO: 1953610 - RNA, 17 nt, Homo sapiens
uguucccgugccuggga

SEQ ID NO: 1953611 - RNA, 16 nt, Homo sapiens
aaaggugagcccucau

SEQ ID NO: 1953612 - RNA, 14 nt, Homo sapiens
auucaccaucaugu

SEQ ID NO: 1953613 - RNA, 16 nt, Homo sapiens
aggaagauaugccacu

SEQ ID NO: 1953614 - RNA, 16 nt, Homo sapiens
cagagucaaauuugaa

SEQ ID NO: 1953615 - RNA, 17 nt, Homo sapiens
auuucuuaaaauucagu

SEQ ID NO: 1953616 - RNA, 23 nt, Homo sapiens
uccuugucccaagcccagggacu

SEQ ID NO: 1953617 - RNA, 18 nt, Homo sapiens
acaagaaugcauucccug

SEQ ID NO: 1953618 - RNA, 23 nt, Homo sapiens
uccaaccccccagcacugaggaa

SEQ ID NO: 1953619 - RNA, 18 nt, Homo sapiens
auuguuaggaaaugucau

SEQ ID NO: 1953620 - RNA, 15 nt, Homo sapiens
cucauaaggugcuau

SEQ ID NO: 1953621 - RNA, 15 nt, Homo sapiens
uaaaaccacuaugca

SEQ ID NO: 1953622 - RNA, 18 nt, Homo sapiens
aggaauuuugugugauug

SEQ ID NO: 1953623 - RNA, 14 nt, Homo sapiens
ugcugccaucucca

SEQ ID NO: 1953624 - RNA, 12 nt, Homo sapiens
acugaagugauu

SEQ ID NO: 1953625 - RNA, 19 nt, Homo sapiens
cuggaaaagucacacagac

SEQ ID NO: 1953626 - RNA, 14 nt, Homo sapiens
auaagcuauaucau

SEQ ID NO: 1953627 - RNA, 14 nt, Homo sapiens
ccacuuaugcugcu

SEQ ID NO: 1953628 - RNA, 12 nt, Homo sapiens
caggcacugaga

SEQ ID NO: 1953629 - RNA, 19 nt, Homo sapiens
gcagaugcuuuacagucaa

SEQ ID NO: 1953630 - RNA, 21 nt, Homo sapiens
agcccacgugggccucugggg

SEQ ID NO: 1953631 - RNA, 17 nt, Homo sapiens
cuugaaucaaagcaguu

SEQ ID NO: 1953632 - RNA, 14 nt, Homo sapiens
cuugcucuaccugg

SEQ ID NO: 1953633 - RNA, 21 nt, Homo sapiens
uaguguuggaaaaugugcaau

SEQ ID NO: 1953634 - RNA, 13 nt, Homo sapiens
uguucaagugucc

SEQ ID NO: 1953635 - RNA, 13 nt, Homo sapiens
ccaucaagccacc

SEQ ID NO: 1953636 - RNA, 13 nt, Homo sapiens
agugagaugacau

SEQ ID NO: 1953637 - RNA, 22 nt, Homo sapiens
auuaaaucauagcuaguauaac

SEQ ID NO: 1953638 - RNA, 12 nt, Homo sapiens
gcugggagacaa

SEQ ID NO: 1953639 - RNA, 17 nt, Homo sapiens
cucuuucuacaugacug

SEQ ID NO: 1953640 - RNA, 20 nt, Homo sapiens
caaaagcaggaacccaucua

SEQ ID NO: 1953641 - RNA, 15 nt, Homo sapiens
acuggugauuucuga

SEQ ID NO: 1953642 - RNA, 15 nt, Homo sapiens
augugcuaugcaaaa

SEQ ID NO: 1953643 - RNA, 22 nt, Homo sapiens
agaugucaugaggaaacuacug

SEQ ID NO: 1953644 - RNA, 21 nt, Homo sapiens
uccaaaguugccacagaugau

SEQ ID NO: 1953645 - RNA, 14 nt, Homo sapiens
cuucuauuaaucaa

SEQ ID NO: 1953646 - RNA, 17 nt, Homo sapiens
aagcaguggccuuuuuc

SEQ ID NO: 1953647 - RNA, 14 nt, Homo sapiens
gugaacuaaccaaa

SEQ ID NO: 1953648 - RNA, 22 nt, Homo sapiens
aaaauggucauccaaacucaaa

SEQ ID NO: 1953649 - RNA, 15 nt, Homo sapiens
gucuuggggugggca

SEQ ID NO: 1953650 - RNA, 15 nt, Homo sapiens
ucggacuauguaauu

SEQ ID NO: 1953651 - RNA, 12 nt, Homo sapiens
ccacaacuuuaa

SEQ ID NO: 1953652 - RNA, 17 nt, Homo sapiens
gccaucuaauggcuuca

SEQ ID NO: 1953653 - RNA, 12 nt, Homo sapiens
acuucagacuuu

SEQ ID NO: 1953654 - RNA, 17 nt, Homo sapiens
ggcagauuuucaugcaa

SEQ ID NO: 1953655 - RNA, 16 nt, Homo sapiens
ugacucuggguccuuc

SEQ ID NO: 1953656 - RNA, 17 nt, Homo sapiens
cugaaagugguacuuga

SEQ ID NO: 1953657 - RNA, 14 nt, Homo sapiens
caaguugagacaga

SEQ ID NO: 1953658 - RNA, 18 nt, Homo sapiens
ucagauuuugugaacucc

SEQ ID NO: 1953659 - RNA, 20 nt, Homo sapiens
cuuuauauauguccuauuca

SEQ ID NO: 1953660 - RNA, 22 nt, Homo sapiens
uucugagugacggaccagcuca

SEQ ID NO: 1953661 - RNA, 15 nt, Homo sapiens
aaaacgcaugugcag

SEQ ID NO: 1953662 - RNA, 11 nt, Homo sapiens
gauguggcaua

SEQ ID NO: 1953663 - RNA, 18 nt, Homo sapiens
cuguaaaaacugugggau

SEQ ID NO: 1953664 - RNA, 12 nt, Homo sapiens
aguuacuaccug

SEQ ID NO: 1953665 - RNA, 17 nt, Homo sapiens
uagaugaccuuuuugca

SEQ ID NO: 1953666 - RNA, 23 nt, Homo sapiens
aauucacucacuggaaucguggc

SEQ ID NO: 1953667 - RNA, 12 nt, Homo sapiens
agaguaaccuau

SEQ ID NO: 1953668 - RNA, 13 nt, Homo sapiens
auuuggucugcca

SEQ ID NO: 1953669 - RNA, 21 nt, Homo sapiens
cugucauuuuucuagcauuuu

SEQ ID NO: 1953670 - RNA, 21 nt, Homo sapiens
ugaugccaaagcugcuuucuu

SEQ ID NO: 1953671 - RNA, 16 nt, Homo sapiens
gguucuaaggggaccu

SEQ ID NO: 1953672 - RNA, 21 nt, Homo sapiens
ccagguaaguauaaguauuca

SEQ ID NO: 1953673 - RNA, 16 nt, Homo sapiens
ccaaagacacuaccac

SEQ ID NO: 1953674 - RNA, 20 nt, Homo sapiens
uguuuucgcaccuaccauca

SEQ ID NO: 1953675 - RNA, 22 nt, Homo sapiens
gucuccauuuucuucucuguga

SEQ ID NO: 1953676 - RNA, 15 nt, Homo sapiens
aacuuugcaucucag

SEQ ID NO: 1953677 - RNA, 17 nt, Homo sapiens
gcccucaucuugaaggg

SEQ ID NO: 1953678 - RNA, 12 nt, Homo sapiens
ccacugccugag

SEQ ID NO: 1953679 - RNA, 16 nt, Homo sapiens
agcucagcauuuccac

SEQ ID NO: 1953680 - RNA, 19 nt, Homo sapiens
uagaacucagagccagauc

SEQ ID NO: 1953681 - RNA, 17 nt, Homo sapiens
aguuagaggagaaaaag

SEQ ID NO: 1953682 - RNA, 20 nt, Homo sapiens
ucaucuguugacaauuugcc

SEQ ID NO: 1953683 - RNA, 13 nt, Homo sapiens
cuccugggcucaa

SEQ ID NO: 1953684 - RNA, 19 nt, Homo sapiens
uagaagucuuucaguggaa

SEQ ID NO: 1953685 - RNA, 20 nt, Homo sapiens
ugacuagccaucucaagcaa

SEQ ID NO: 1953686 - RNA, 13 nt, Homo sapiens
uuauuccuugcuu

SEQ ID NO: 1953687 - RNA, 12 nt, Homo sapiens
aucaaagcacuu

SEQ ID NO: 1953688 - RNA, 14 nt, Homo sapiens
cagacucacuggga

SEQ ID NO: 1953689 - RNA, 14 nt, Homo sapiens
aaaguagacuucau

SEQ ID NO: 1953690 - RNA, 17 nt, Homo sapiens
cauaacuagaguaugug

SEQ ID NO: 1953691 - RNA, 17 nt, Homo sapiens
cggcaccucuccgagcc

SEQ ID NO: 1953692 - RNA, 20 nt, Homo sapiens
gagcccaagugccaucccac

SEQ ID NO: 1953693 - RNA, 23 nt, Homo sapiens
aacaugugagagguuugacuaga

SEQ ID NO: 1953694 - RNA, 13 nt, Homo sapiens
aauacaaccagcc

SEQ ID NO: 1953695 - RNA, 12 nt, Homo sapiens
cagagcacagau

SEQ ID NO: 1953696 - RNA, 20 nt, Homo sapiens
ucuguccugauuucuacaac

SEQ ID NO: 1953697 - RNA, 18 nt, Homo sapiens
gcugcaaagugcaaauac

SEQ ID NO: 1953698 - RNA, 18 nt, Homo sapiens
aaugauguuagccugauu

SEQ ID NO: 1953699 - RNA, 14 nt, Homo sapiens
gagaggugggagac

SEQ ID NO: 1953700 - RNA, 17 nt, Homo sapiens
cugaaggaaauaaugca

SEQ ID NO: 1953701 - RNA, 17 nt, Homo sapiens
augggggaaauggugcc

SEQ ID NO: 1953702 - RNA, 14 nt, Homo sapiens
auuuucacuucugu

SEQ ID NO: 1953703 - RNA, 20 nt, Homo sapiens
aaccugacuuccucugccac

SEQ ID NO: 1953704 - RNA, 12 nt, Homo sapiens
aucccacaucca

SEQ ID NO: 1953705 - RNA, 14 nt, Homo sapiens
gcagcccagagacu

SEQ ID NO: 1953706 - RNA, 23 nt, Homo sapiens
uccugucuuccuugaccaaagcu

SEQ ID NO: 1953707 - RNA, 17 nt, Homo sapiens
uagggcugcugcuucug

SEQ ID NO: 1953708 - RNA, 14 nt, Homo sapiens
agcgcuuugaauau

SEQ ID NO: 1953709 - RNA, 22 nt, Homo sapiens
cccugggcaaugcagugcagca

SEQ ID NO: 1953710 - RNA, 14 nt, Homo sapiens
ugcagucaucuccc

SEQ ID NO: 1953711 - RNA, 19 nt, Homo sapiens
uuccugguguagcacuuaa

SEQ ID NO: 1953712 - RNA, 13 nt, Homo sapiens
uaccucagccuag

SEQ ID NO: 1953713 - RNA, 11 nt, Homo sapiens
uccucagggag

SEQ ID NO: 1953714 - RNA, 16 nt, Homo sapiens
uagcacauggcagauu

SEQ ID NO: 1953715 - RNA, 16 nt, Homo sapiens
gcugaggggcagggag

SEQ ID NO: 1953716 - RNA, 12 nt, Homo sapiens
ccucagggacca

SEQ ID NO: 1953717 - RNA, 18 nt, Homo sapiens
gacuaaucaccuacucaa

SEQ ID NO: 1953718 - RNA, 15 nt, Homo sapiens
ucuuguuacugcuga

SEQ ID NO: 1953719 - RNA, 20 nt, Homo sapiens
auuggcagcuucaaaacaga

SEQ ID NO: 1953720 - RNA, 19 nt, Homo sapiens
ugaucuuucucaaucuuga

SEQ ID NO: 1953721 - RNA, 17 nt, Homo sapiens
augacugcaccaacauc

SEQ ID NO: 1953722 - RNA, 14 nt, Homo sapiens
gauaugugccaaag

SEQ ID NO: 1953723 - RNA, 13 nt, Homo sapiens
uuuauaaucuaua

SEQ ID NO: 1953724 - RNA, 16 nt, Homo sapiens
uguguacugcaguugg

SEQ ID NO: 1953725 - RNA, 16 nt, Homo sapiens
agaguggugaguggaa

SEQ ID NO: 1953726 - RNA, 19 nt, Homo sapiens
aacaguugcauuuagcuuc

SEQ ID NO: 1953727 - RNA, 17 nt, Homo sapiens
acauagugauaccccau

SEQ ID NO: 1953728 - RNA, 21 nt, Homo sapiens
ccugacaccgucccucaguga

SEQ ID NO: 1953729 - RNA, 17 nt, Homo sapiens
ugugagggcaccaccaa

SEQ ID NO: 1953730 - RNA, 23 nt, Homo sapiens
ucuugaagaaaauucagaaugaa

SEQ ID NO: 1953731 - RNA, 22 nt, Homo sapiens
ugaaggcgcugacacuggcaga

SEQ ID NO: 1953732 - RNA, 20 nt, Homo sapiens
gaguugcuaaguggccggaa

SEQ ID NO: 1953733 - RNA, 23 nt, Homo sapiens
cagauaucagaaucauugaagua

SEQ ID NO: 1953734 - RNA, 21 nt, Homo sapiens
uaugaaauuauauaaguauuc

SEQ ID NO: 1953735 - RNA, 15 nt, Homo sapiens
cucugagcugugcag

SEQ ID NO: 1953736 - RNA, 17 nt, Homo sapiens
acaagcuuguccaugua

SEQ ID NO: 1953737 - RNA, 18 nt, Homo sapiens
ccuaagcagaaaacuggc

SEQ ID NO: 1953738 - RNA, 20 nt, Homo sapiens
gaaaugaccaggccaagacu

SEQ ID NO: 1953739 - RNA, 22 nt, Homo sapiens
guggccaccaguaugacaguau

SEQ ID NO: 1953740 - RNA, 18 nt, Homo sapiens
gugccuggccuggcacac

SEQ ID NO: 1953741 - RNA, 14 nt, Homo sapiens
acacauucugccuu

SEQ ID NO: 1953742 - RNA, 19 nt, Homo sapiens
uggcugaugauccagaaca

SEQ ID NO: 1953743 - RNA, 14 nt, Homo sapiens
uuugucuucaugaa

SEQ ID NO: 1953744 - RNA, 13 nt, Homo sapiens
ugcugccaugugg

SEQ ID NO: 1953745 - RNA, 13 nt, Homo sapiens
ugaaagcagugaa

SEQ ID NO: 1953746 - RNA, 17 nt, Homo sapiens
gcacaugugauguggug

SEQ ID NO: 1953747 - RNA, 21 nt, Homo sapiens
gcugaugaacucuuaaucaaa

SEQ ID NO: 1953748 - RNA, 19 nt, Homo sapiens
agccugugcccugauccaa

SEQ ID NO: 1953749 - RNA, 23 nt, Homo sapiens
ggacuaaccccaacgcacaggaa

SEQ ID NO: 1953750 - RNA, 17 nt, Homo sapiens
uagagaagaucuaauac

SEQ ID NO: 1953751 - RNA, 14 nt, Homo sapiens
cugugucccaugac

SEQ ID NO: 1953752 - RNA, 15 nt, Homo sapiens
uguuuacagacugug

SEQ ID NO: 1953753 - RNA, 18 nt, Homo sapiens
agacaguguguccaguua

SEQ ID NO: 1953754 - RNA, 18 nt, Homo sapiens
guauucccaagaguggug

SEQ ID NO: 1953755 - RNA, 19 nt, Homo sapiens
cucccaaaaaacuacuucu

SEQ ID NO: 1953756 - RNA, 20 nt, Homo sapiens
cauguaugcuuccagggaca

SEQ ID NO: 1953757 - RNA, 15 nt, Homo sapiens
cucuggcuggaauag

SEQ ID NO: 1953758 - RNA, 18 nt, Homo sapiens
auacuuugccacugcugu

SEQ ID NO: 1953759 - RNA, 23 nt, Homo sapiens
acuaaugaggaaacugcacuguu

SEQ ID NO: 1953760 - RNA, 22 nt, Homo sapiens
gcggaccccucgucaucaggug

SEQ ID NO: 1953761 - RNA, 18 nt, Homo sapiens
caccuacucacacaggca

SEQ ID NO: 1953762 - RNA, 21 nt, Homo sapiens
aaaaccgaauuagguccacuu

SEQ ID NO: 1953763 - RNA, 19 nt, Homo sapiens
ggccuuaacacacuggcca

SEQ ID NO: 1953764 - RNA, 19 nt, Homo sapiens
aaaucuuguuggcaaauca

SEQ ID NO: 1953765 - RNA, 22 nt, Homo sapiens
aauuguuuuuuaaagcaaguca

SEQ ID NO: 1953766 - RNA, 19 nt, Homo sapiens
agguuacuaaaacagggug

SEQ ID NO: 1953767 - RNA, 19 nt, Homo sapiens
ggcagccaagagccaucug

SEQ ID NO: 1953768 - RNA, 15 nt, Homo sapiens
gauuuaaagugccuu

SEQ ID NO: 1953769 - RNA, 18 nt, Homo sapiens
ccagaggcuggcauugag

SEQ ID NO: 1953770 - RNA, 18 nt, Homo sapiens
cuggaugcuuacagugac

SEQ ID NO: 1953771 - RNA, 17 nt, Homo sapiens
aauuugaugauuuucau

SEQ ID NO: 1953772 - RNA, 18 nt, Homo sapiens
agcacaucaauuacaagc

SEQ ID NO: 1953773 - RNA, 19 nt, Homo sapiens
agccugggccccucagcca

SEQ ID NO: 1953774 - RNA, 13 nt, Homo sapiens
ccaguagccauuu

SEQ ID NO: 1953775 - RNA, 18 nt, Homo sapiens
aaagguagcuuaccugac

SEQ ID NO: 1953776 - RNA, 18 nt, Homo sapiens
cagaaacacacagucaca

SEQ ID NO: 1953777 - RNA, 20 nt, Homo sapiens
ugggagggagguaacgggug

SEQ ID NO: 1953778 - RNA, 15 nt, Homo sapiens
cacugccuguauacu

SEQ ID NO: 1953779 - RNA, 23 nt, Homo sapiens
aaugucuaguucuuacccaguua

SEQ ID NO: 1953780 - RNA, 18 nt, Homo sapiens
aaaauucuggacacauua

SEQ ID NO: 1953781 - RNA, 19 nt, Homo sapiens
accaauagggcugagcucu

SEQ ID NO: 1953782 - RNA, 23 nt, Homo sapiens
uauccuguaauaaagcucuuuaa

SEQ ID NO: 1953783 - RNA, 14 nt, Homo sapiens
auaaagucacuucc

SEQ ID NO: 1953784 - RNA, 20 nt, Homo sapiens
uugagcucaggaguuugaga

SEQ ID NO: 1953785 - RNA, 20 nt, Homo sapiens
ugacaguuuuugacauuuau

SEQ ID NO: 1953786 - RNA, 14 nt, Homo sapiens
aguguuucuguucu

SEQ ID NO: 1953787 - RNA, 13 nt, Homo sapiens
ucuacuugcugaa

SEQ ID NO: 1953788 - RNA, 14 nt, Homo sapiens
auauaaugaugcug

SEQ ID NO: 1953789 - RNA, 18 nt, Homo sapiens
ucagcagcaaaugccacu

SEQ ID NO: 1953790 - RNA, 20 nt, Homo sapiens
gaaggcgugagucugcaucu

SEQ ID NO: 1953791 - RNA, 21 nt, Homo sapiens
ugccccuucucuuuaaucuca

SEQ ID NO: 1953792 - RNA, 20 nt, Homo sapiens
uuuauuuugacugugauuua

SEQ ID NO: 1953793 - RNA, 22 nt, Homo sapiens
uguucuucccaggggaguguga

SEQ ID NO: 1953794 - RNA, 15 nt, Homo sapiens
ugcuaguacuaguac

SEQ ID NO: 1953795 - RNA, 15 nt, Homo sapiens
aucccaaacugugau

SEQ ID NO: 1953796 - RNA, 13 nt, Homo sapiens
gcuucagugacaa

SEQ ID NO: 1953797 - RNA, 17 nt, Homo sapiens
ugaaaacauaaucugca

SEQ ID NO: 1953798 - RNA, 12 nt, Homo sapiens
ggccucaaggga

SEQ ID NO: 1953799 - RNA, 20 nt, Homo sapiens
uuucaccugcaaaccuuaaa

SEQ ID NO: 1953800 - RNA, 20 nt, Homo sapiens
cuauccugaauaaagcagac

SEQ ID NO: 1953801 - RNA, 16 nt, Homo sapiens
guggacgugcacugac

SEQ ID NO: 1953802 - RNA, 17 nt, Homo sapiens
aucaacuaggggaggag

SEQ ID NO: 1953803 - RNA, 22 nt, Homo sapiens
gugccaaaugacuuugcaccug

SEQ ID NO: 1953804 - RNA, 18 nt, Homo sapiens
acacauauacauguagga

SEQ ID NO: 1953805 - RNA, 18 nt, Homo sapiens
gaaauacugagaugcugg

SEQ ID NO: 1953806 - RNA, 18 nt, Homo sapiens
aggauacagaaaugcaaa

SEQ ID NO: 1953807 - RNA, 22 nt, Homo sapiens
uuaaaacaacacucacauuuau

SEQ ID NO: 1953808 - RNA, 21 nt, Homo sapiens
caagccacagcagguccucca

SEQ ID NO: 1953809 - RNA, 22 nt, Homo sapiens
gaaaaugcuuucucaugcauag

SEQ ID NO: 1953810 - RNA, 14 nt, Homo sapiens
gcaguguagggagu

SEQ ID NO: 1953811 - RNA, 9 nt, Homo sapiens
aagggccag

SEQ ID NO: 1953812 - RNA, 12 nt, Homo sapiens
ucccugguuuuc

SEQ ID NO: 1953813 - RNA, 22 nt, Homo sapiens
ugugacuaccgugccagcagcg

SEQ ID NO: 1953814 - RNA, 14 nt, Homo sapiens
uaguguaacacugc

SEQ ID NO: 1953815 - RNA, 21 nt, Homo sapiens
acguuauaguccaugguccau

SEQ ID NO: 1953816 - RNA, 21 nt, Homo sapiens
cuguuucaacuguauaacuau

SEQ ID NO: 1953817 - RNA, 23 nt, Homo sapiens
auaauauuaaggaagacaaugug

SEQ ID NO: 1953818 - RNA, 15 nt, Homo sapiens
guuaccucaugccgc

SEQ ID NO: 1953819 - RNA, 21 nt, Homo sapiens
ugacagucaugcagucuggga

SEQ ID NO: 1953820 - RNA, 22 nt, Homo sapiens
cacuugucaaagaaggugcuga

SEQ ID NO: 1953821 - RNA, 15 nt, Homo sapiens
uauuuaaaugcuuuu

SEQ ID NO: 1953822 - RNA, 19 nt, Homo sapiens
ugugagccaccacacccag

SEQ ID NO: 1953823 - RNA, 12 nt, Homo sapiens
aaagcaaauguc

SEQ ID NO: 1953824 - RNA, 14 nt, Homo sapiens
aagugauguuauag

SEQ ID NO: 1953825 - RNA, 22 nt, Homo sapiens
acucuaauuguccauucuugcu

SEQ ID NO: 1953826 - RNA, 16 nt, Homo sapiens
cuaagaauguccuuau

SEQ ID NO: 1953827 - RNA, 22 nt, Homo sapiens
cuuuuuauuagguuaagucuca

SEQ ID NO: 1953828 - RNA, 15 nt, Homo sapiens
agccagguaauguga

SEQ ID NO: 1953829 - RNA, 13 nt, Homo sapiens
aaauuauaccaug

SEQ ID NO: 1953830 - RNA, 17 nt, Homo sapiens
ucugucuagcaugccaa

SEQ ID NO: 1953831 - RNA, 23 nt, Homo sapiens
acauuuguauucucagacacuga

SEQ ID NO: 1953832 - RNA, 17 nt, Homo sapiens
cacagucacuggcccaa

SEQ ID NO: 1953833 - RNA, 21 nt, Homo sapiens
auuccuuucagaguuuuacua

SEQ ID NO: 1953834 - RNA, 14 nt, Homo sapiens
ucagugaauugugu

SEQ ID NO: 1953835 - RNA, 22 nt, Homo sapiens
agggggguuucagggcugaacc

SEQ ID NO: 1953836 - RNA, 17 nt, Homo sapiens
ucacccgacccgugcac

SEQ ID NO: 1953837 - RNA, 19 nt, Homo sapiens
cccucaaugcagucagugu

SEQ ID NO: 1953838 - RNA, 17 nt, Homo sapiens
cucugcagcccauuccc

SEQ ID NO: 1953839 - RNA, 20 nt, Homo sapiens
gcugaauuucccucucucau

SEQ ID NO: 1953840 - RNA, 13 nt, Homo sapiens
cuauuuaucugau

SEQ ID NO: 1953841 - RNA, 17 nt, Homo sapiens
cucaagccaagcagcca

SEQ ID NO: 1953842 - RNA, 20 nt, Homo sapiens
guuggucugccuucugcuga

SEQ ID NO: 1953843 - RNA, 14 nt, Homo sapiens
uuaguuaacacuga

SEQ ID NO: 1953844 - RNA, 17 nt, Homo sapiens
ucucccuuaauaaacuc

SEQ ID NO: 1953845 - RNA, 23 nt, Homo sapiens
agauaacuguuauuuauaaucac

SEQ ID NO: 1953846 - RNA, 21 nt, Homo sapiens
gguacacagagcuaaggccaa

SEQ ID NO: 1953847 - RNA, 20 nt, Homo sapiens
cuugaucuuaacaaagccuu

SEQ ID NO: 1953848 - RNA, 14 nt, Homo sapiens
cuuugucucugaga

SEQ ID NO: 1953849 - RNA, 17 nt, Homo sapiens
gcuagguggaaaagccu

SEQ ID NO: 1953850 - RNA, 15 nt, Homo sapiens
uuggaagccccauaa

SEQ ID NO: 1953851 - RNA, 14 nt, Homo sapiens
acugucauagaaau

SEQ ID NO: 1953852 - RNA, 20 nt, Homo sapiens
auugacuaacaggccaaaga

SEQ ID NO: 1953853 - RNA, 20 nt, Homo sapiens
caauuccaccaagacagugc

SEQ ID NO: 1953854 - RNA, 16 nt, Homo sapiens
aaaaucaaaucauccu

SEQ ID NO: 1953855 - RNA, 20 nt, Homo sapiens
aacuguagugguagcuuuca

SEQ ID NO: 1953856 - RNA, 14 nt, Homo sapiens
cagagccagucuca

SEQ ID NO: 1953857 - RNA, 15 nt, Homo sapiens
cugacacaagaggaa

SEQ ID NO: 1953858 - RNA, 14 nt, Homo sapiens
uuaaaaucuuagaa

SEQ ID NO: 1953859 - RNA, 14 nt, Homo sapiens
caggauuccagaau

SEQ ID NO: 1953860 - RNA, 11 nt, Homo sapiens
ugaaaugcuag

SEQ ID NO: 1953861 - RNA, 17 nt, Homo sapiens
ugcccuuuaacuuucag

SEQ ID NO: 1953862 - RNA, 23 nt, Homo sapiens
uaggccacagaaggugaacuuug

SEQ ID NO: 1953863 - RNA, 19 nt, Homo sapiens
uauuguuaucuuuaccucc

SEQ ID NO: 1953864 - RNA, 12 nt, Homo sapiens
cuaauuaauucu

SEQ ID NO: 1953865 - RNA, 22 nt, Homo sapiens
ccacaccggccuugcauugccu

SEQ ID NO: 1953866 - RNA, 17 nt, Homo sapiens
ccaucugcugccaugag

SEQ ID NO: 1953867 - RNA, 15 nt, Homo sapiens
acaccuguacauucu

SEQ ID NO: 1953868 - RNA, 14 nt, Homo sapiens
caggugugagucac

SEQ ID NO: 1953869 - RNA, 13 nt, Homo sapiens
ugugcuggggucu

SEQ ID NO: 1953870 - RNA, 13 nt, Homo sapiens
guugguguucuca

SEQ ID NO: 1953871 - RNA, 12 nt, Homo sapiens
uggggaagacag

SEQ ID NO: 1953872 - RNA, 23 nt, Homo sapiens
aaucauuuauuuacaugugauug

SEQ ID NO: 1953873 - RNA, 21 nt, Homo sapiens
cugaacucuucagaacacaca

SEQ ID NO: 1953874 - RNA, 17 nt, Homo sapiens
ccaagcucccaagagcu

SEQ ID NO: 1953875 - RNA, 15 nt, Homo sapiens
agagaggcaugugau

SEQ ID NO: 1953876 - RNA, 14 nt, Homo sapiens
caagaggucuccau

SEQ ID NO: 1953877 - RNA, 20 nt, Homo sapiens
acaccaccuauaccaauauu

SEQ ID NO: 1953878 - RNA, 12 nt, Homo sapiens
ugguacaaggaa

SEQ ID NO: 1953879 - RNA, 21 nt, Homo sapiens
caggcugcuggagugcagugg

SEQ ID NO: 1953880 - RNA, 21 nt, Homo sapiens
aacacuuuuuccauuucuuca

SEQ ID NO: 1953881 - RNA, 17 nt, Homo sapiens
cauaccucugaccaaca

SEQ ID NO: 1953882 - RNA, 21 nt, Homo sapiens
ggcugacuucucugaaucaga

SEQ ID NO: 1953883 - RNA, 23 nt, Homo sapiens
cuauuuccuuuccagucauuuca

SEQ ID NO: 1953884 - RNA, 14 nt, Homo sapiens
uauuuuguguccuc

SEQ ID NO: 1953885 - RNA, 17 nt, Homo sapiens
agcugcuguucuuagca

SEQ ID NO: 1953886 - RNA, 15 nt, Homo sapiens
gguuauagacugcca

SEQ ID NO: 1953887 - RNA, 18 nt, Homo sapiens
aaggucaauaaauuauua

SEQ ID NO: 1953888 - RNA, 17 nt, Homo sapiens
acuggacccccuggaag

SEQ ID NO: 1953889 - RNA, 18 nt, Homo sapiens
gcaggacggcaguacuca

SEQ ID NO: 1953890 - RNA, 23 nt, Homo sapiens
uguacagaggucagcacacauua

SEQ ID NO: 1953891 - RNA, 14 nt, Homo sapiens
uuccugaagccaga

SEQ ID NO: 1953892 - RNA, 16 nt, Homo sapiens
agaaccacacuugaaa

SEQ ID NO: 1953893 - RNA, 16 nt, Homo sapiens
ucugcugggcucugcc

SEQ ID NO: 1953894 - RNA, 17 nt, Homo sapiens
agccgagcggggagcca

SEQ ID NO: 1953895 - RNA, 23 nt, Homo sapiens
gacauguagguaggaagcacuga

SEQ ID NO: 1953896 - RNA, 13 nt, Homo sapiens
gacacagaaaaug

SEQ ID NO: 1953897 - RNA, 11 nt, Homo sapiens
aacucuucagu

SEQ ID NO: 1953898 - RNA, 20 nt, Homo sapiens
auuuugccauaaagucaaau

SEQ ID NO: 1953899 - RNA, 19 nt, Homo sapiens
acagccagggcgcucuucc

SEQ ID NO: 1953900 - RNA, 17 nt, Homo sapiens
aagugcaguucuuagcc

SEQ ID NO: 1953901 - RNA, 23 nt, Homo sapiens
caggcuugccaccggggaaccca

SEQ ID NO: 1953902 - RNA, 19 nt, Homo sapiens
ugacacucuauaagauucc

SEQ ID NO: 1953903 - RNA, 18 nt, Homo sapiens
uaugagccaggcaucaua

SEQ ID NO: 1953904 - RNA, 21 nt, Homo sapiens
gaaguuuacauuuuuauuuau

SEQ ID NO: 1953905 - RNA, 14 nt, Homo sapiens
cauccuugaccuca

SEQ ID NO: 1953906 - RNA, 24 nt, Homo sapiens
cagaguggccuagagcacucucac

SEQ ID NO: 1953907 - RNA, 21 nt, Homo sapiens
agaaaaguagguuuacauuca

SEQ ID NO: 1953908 - RNA, 18 nt, Homo sapiens
cuuuuuuuuaaaaaaacu

SEQ ID NO: 1953909 - RNA, 20 nt, Homo sapiens
aauuaaugagacacacuuaa

SEQ ID NO: 1953910 - RNA, 19 nt, Homo sapiens
ugcacuaauugacccaaaa

SEQ ID NO: 1953911 - RNA, 13 nt, Homo sapiens
ugaaaagugugua

SEQ ID NO: 1953912 - RNA, 24 nt, Homo sapiens
guguuucuucuggcuuagucuguu

SEQ ID NO: 1953913 - RNA, 17 nt, Homo sapiens
uacugaaccacucuccc

SEQ ID NO: 1953914 - RNA, 20 nt, Homo sapiens
cacagcugaguuaugaugua

SEQ ID NO: 1953915 - RNA, 14 nt, Homo sapiens
ccuucugaccccac

SEQ ID NO: 1953916 - RNA, 19 nt, Homo sapiens
cucccucccaggacucuga

SEQ ID NO: 1953917 - RNA, 20 nt, Homo sapiens
gcaaccaacugccccagggg

SEQ ID NO: 1953918 - RNA, 14 nt, Homo sapiens
ugauuuuuacuuca

SEQ ID NO: 1953919 - RNA, 22 nt, Homo sapiens
cccaagaggacugagacuggca

SEQ ID NO: 1953920 - RNA, 13 nt, Homo sapiens
aggcccuuuucag

SEQ ID NO: 1953921 - RNA, 18 nt, Homo sapiens
auuuuacccacacacaga

SEQ ID NO: 1953922 - RNA, 15 nt, Homo sapiens
uacagacagacauac

SEQ ID NO: 1953923 - RNA, 19 nt, Homo sapiens
uuaucaaggaagucuucaa

SEQ ID NO: 1953924 - RNA, 19 nt, Homo sapiens
gacagaauguggucuguca

SEQ ID NO: 1953925 - RNA, 15 nt, Homo sapiens
ucugaacagcagaaa

SEQ ID NO: 1953926 - RNA, 19 nt, Homo sapiens
cuuuacauggacagaauuu

SEQ ID NO: 1953927 - RNA, 22 nt, Homo sapiens
cauauaacuaagacauaugcau

SEQ ID NO: 1953928 - RNA, 17 nt, Homo sapiens
ccagagcugaguggcag

SEQ ID NO: 1953929 - RNA, 21 nt, Homo sapiens
caauugucauuuauaaaacca

SEQ ID NO: 1953930 - RNA, 16 nt, Homo sapiens
auuagaaaggacugua

SEQ ID NO: 1953931 - RNA, 20 nt, Homo sapiens
aggggccugcccagugcacu

SEQ ID NO: 1953932 - RNA, 17 nt, Homo sapiens
ugacagccuucuugaug

SEQ ID NO: 1953933 - RNA, 16 nt, Homo sapiens
aaguauuggcauucaa

SEQ ID NO: 1953934 - RNA, 17 nt, Homo sapiens
ggugcacucacuccuga

SEQ ID NO: 1953935 - RNA, 16 nt, Homo sapiens
uaaguauuuugaucac

SEQ ID NO: 1953936 - RNA, 14 nt, Homo sapiens
caggccagcccagc

SEQ ID NO: 1953937 - RNA, 15 nt, Homo sapiens
agacagugugugagc

SEQ ID NO: 1953938 - RNA, 20 nt, Homo sapiens
ucuuuuuccaucccuagcca

SEQ ID NO: 1953939 - RNA, 14 nt, Homo sapiens
acgaaacacugugc

SEQ ID NO: 1953940 - RNA, 20 nt, Homo sapiens
cuuguggucucgaugcugcu

SEQ ID NO: 1953941 - RNA, 17 nt, Homo sapiens
agcauuucaaaauggac

SEQ ID NO: 1953942 - RNA, 15 nt, Homo sapiens
cuggggcuuuagcua

SEQ ID NO: 1953943 - RNA, 16 nt, Homo sapiens
ucucuuaaaaugacaa

SEQ ID NO: 1953944 - RNA, 20 nt, Homo sapiens
aacugcugaugcucaugguc

SEQ ID NO: 1953945 - RNA, 13 nt, Homo sapiens
auaaugcaauccu

SEQ ID NO: 1953946 - RNA, 20 nt, Homo sapiens
auuauccuuuauuuuauuga

SEQ ID NO: 1953947 - RNA, 17 nt, Homo sapiens
gucagcaaaaagcaaaa

SEQ ID NO: 1953948 - RNA, 23 nt, Homo sapiens
aaagaccgugugugaaauucucu

SEQ ID NO: 1953949 - RNA, 22 nt, Homo sapiens
aaugcuacugaaacuuaccuga

SEQ ID NO: 1953950 - RNA, 13 nt, Homo sapiens
aauauuccuuuau

SEQ ID NO: 1953951 - RNA, 16 nt, Homo sapiens
aaccccaaacagugac

SEQ ID NO: 1953952 - RNA, 23 nt, Homo sapiens
guccuuaaaaaucacacuguaaa

SEQ ID NO: 1953953 - RNA, 21 nt, Homo sapiens
cugaccccgccucaccaauac

SEQ ID NO: 1953954 - RNA, 17 nt, Homo sapiens
ccacucccaucccuuca

SEQ ID NO: 1953955 - RNA, 13 nt, Homo sapiens
gagugcacagcug

SEQ ID NO: 1953956 - RNA, 21 nt, Homo sapiens
ggcucacucuuucccccaaau

SEQ ID NO: 1953957 - RNA, 21 nt, Homo sapiens
acucuaaagaaaaaugccugu

SEQ ID NO: 1953958 - RNA, 17 nt, Homo sapiens
gaaggaggaggcuccca

SEQ ID NO: 1953959 - RNA, 15 nt, Homo sapiens
auagacuuauaugca

SEQ ID NO: 1953960 - RNA, 15 nt, Homo sapiens
auaagcugaugucca

SEQ ID NO: 1953961 - RNA, 24 nt, Homo sapiens
aaauguauagacucagugcacauu

SEQ ID NO: 1953962 - RNA, 17 nt, Homo sapiens
aucugauguaacaaggu

SEQ ID NO: 1953963 - RNA, 14 nt, Homo sapiens
cccuucucuguauu

SEQ ID NO: 1953964 - RNA, 23 nt, Homo sapiens
ccuaucucauagggaugcuguga

SEQ ID NO: 1953965 - RNA, 18 nt, Homo sapiens
acagugggcagucacaca

SEQ ID NO: 1953966 - RNA, 20 nt, Homo sapiens
agauucaaagcuccucucuu

SEQ ID NO: 1953967 - RNA, 15 nt, Homo sapiens
ucugaaugacaucaa

SEQ ID NO: 1953968 - RNA, 15 nt, Homo sapiens
aggaaaauaaugaca

SEQ ID NO: 1953969 - RNA, 13 nt, Homo sapiens
cugucaccugaaa

SEQ ID NO: 1953970 - RNA, 16 nt, Homo sapiens
caggagaaucgcuuga

SEQ ID NO: 1953971 - RNA, 18 nt, Homo sapiens
aucaaaggaccuuuugca

SEQ ID NO: 1953972 - RNA, 22 nt, Homo sapiens
aucucuucagucucuauaccaa

SEQ ID NO: 1953973 - RNA, 15 nt, Homo sapiens
agaauguacauuacc

SEQ ID NO: 1953974 - RNA, 15 nt, Homo sapiens
aaaaaggccggguga

SEQ ID NO: 1953975 - RNA, 12 nt, Homo sapiens
ucagcacucugu

SEQ ID NO: 1953976 - RNA, 12 nt, Homo sapiens
ccaucacuuugg

SEQ ID NO: 1953977 - RNA, 19 nt, Homo sapiens
ugccagcuguuucaucacc

SEQ ID NO: 1953978 - RNA, 16 nt, Homo sapiens
ugauugugccuacgaa

SEQ ID NO: 1953979 - RNA, 15 nt, Homo sapiens
aaccugcaucuuuag

SEQ ID NO: 1953980 - RNA, 14 nt, Homo sapiens
cccagaugugacgg

SEQ ID NO: 1953981 - RNA, 12 nt, Homo sapiens
agaggugaccua

SEQ ID NO: 1953982 - RNA, 20 nt, Homo sapiens
aggcaucuucccuucacuca

SEQ ID NO: 1953983 - RNA, 12 nt, Homo sapiens
ucacagagucaa

SEQ ID NO: 1953984 - RNA, 18 nt, Homo sapiens
ucuugaaggugcugccac

SEQ ID NO: 1953985 - RNA, 21 nt, Homo sapiens
guagcugugaaauccauauau

SEQ ID NO: 1953986 - RNA, 17 nt, Homo sapiens
caugugugcgugugcgu

SEQ ID NO: 1953987 - RNA, 18 nt, Homo sapiens
aauauaaauuuacauaua

SEQ ID NO: 1953988 - RNA, 23 nt, Homo sapiens
gacugggacagcccaggaaacaa

SEQ ID NO: 1953989 - RNA, 16 nt, Homo sapiens
cucacugccagugcag

SEQ ID NO: 1953990 - RNA, 19 nt, Homo sapiens
uacaaucaaggccacugcu

SEQ ID NO: 1953991 - RNA, 23 nt, Homo sapiens
cucaaagaagucggaaugucaua

SEQ ID NO: 1953992 - RNA, 13 nt, Homo sapiens
ugugauaaaaccc

SEQ ID NO: 1953993 - RNA, 18 nt, Homo sapiens
gcacucuuguacaaaaga

SEQ ID NO: 1953994 - RNA, 17 nt, Homo sapiens
uuccuuacuugcacugu

SEQ ID NO: 1953995 - RNA, 17 nt, Homo sapiens
aaacccaccucucugga

SEQ ID NO: 1953996 - RNA, 20 nt, Homo sapiens
ucaagcgauucuccugucuc

SEQ ID NO: 1953997 - RNA, 18 nt, Homo sapiens
agguagcuauaguugcag

SEQ ID NO: 1953998 - RNA, 23 nt, Homo sapiens
ccuugaacccaacagucccuuau

SEQ ID NO: 1953999 - RNA, 18 nt, Homo sapiens
accuucugggacauggug

SEQ ID NO: 1954000 - RNA, 16 nt, Homo sapiens
gcagugagcugagauc

SEQ ID NO: 1954001 - RNA, 22 nt, Homo sapiens
cacguuggucuugaacuccuga

SEQ ID NO: 1954002 - RNA, 23 nt, Homo sapiens
gugccgggaggcagccacaggga

SEQ ID NO: 1954003 - RNA, 15 nt, Homo sapiens
ccucgcuggacucuc

SEQ ID NO: 1954004 - RNA, 14 nt, Homo sapiens
cagaaaaagaucuu

SEQ ID NO: 1954005 - RNA, 21 nt, Homo sapiens
cuaucacccaggaaucucaaa

SEQ ID NO: 1954006 - RNA, 20 nt, Homo sapiens
auggaucaaccaaguuacac

SEQ ID NO: 1954007 - RNA, 15 nt, Homo sapiens
agagccaagccuuaa

SEQ ID NO: 1954008 - RNA, 20 nt, Homo sapiens
acugcaucuuucucuuccca

SEQ ID NO: 1954009 - RNA, 21 nt, Homo sapiens
cuuugccaauucauuucucua

SEQ ID NO: 1954010 - RNA, 20 nt, Homo sapiens
acucuauuuaagauucccaa

SEQ ID NO: 1954011 - RNA, 14 nt, Homo sapiens
uuuccccagugugg

SEQ ID NO: 1954012 - RNA, 19 nt, Homo sapiens
aacacccucacacugggac

SEQ ID NO: 1954013 - RNA, 16 nt, Homo sapiens
gguguaaauauguuuc

SEQ ID NO: 1954014 - RNA, 16 nt, Homo sapiens
guuauucuucaaacac

SEQ ID NO: 1954015 - RNA, 21 nt, Homo sapiens
uuuuugacauuuacuguggau

SEQ ID NO: 1954016 - RNA, 18 nt, Homo sapiens
agaugauuucaguucauc

SEQ ID NO: 1954017 - RNA, 18 nt, Homo sapiens
auacgcuuaagguggaaa

SEQ ID NO: 1954018 - RNA, 13 nt, Homo sapiens
uacuccagugcca

SEQ ID NO: 1954019 - RNA, 19 nt, Homo sapiens
gauuucugacuuggggaaa

SEQ ID NO: 1954020 - RNA, 19 nt, Homo sapiens
cuucuggaggacacacagu

SEQ ID NO: 1954021 - RNA, 16 nt, Homo sapiens
ugggguuccccuggaa

SEQ ID NO: 1954022 - RNA, 20 nt, Homo sapiens
caggcuggagugcaauggcg

SEQ ID NO: 1954023 - RNA, 20 nt, Homo sapiens
acauguguagccugugcaug

SEQ ID NO: 1954024 - RNA, 13 nt, Homo sapiens
gcaugaccuauca

SEQ ID NO: 1954025 - RNA, 14 nt, Homo sapiens
aguguuacauauuc

SEQ ID NO: 1954026 - RNA, 18 nt, Homo sapiens
cagaagguuugcaccccu

SEQ ID NO: 1954027 - RNA, 22 nt, Homo sapiens
gcacaagccacaagucuuccag

SEQ ID NO: 1954028 - RNA, 21 nt, Homo sapiens
auugaaaauuuuuaaauauuc

SEQ ID NO: 1954029 - RNA, 17 nt, Homo sapiens
cauuuauuuuaagcacu

SEQ ID NO: 1954030 - RNA, 13 nt, Homo sapiens
ucacaaugaaaug

SEQ ID NO: 1954031 - RNA, 13 nt, Homo sapiens
cuauuuucauucu

SEQ ID NO: 1954032 - RNA, 18 nt, Homo sapiens
gauucaucaucccuuaau

SEQ ID NO: 1954033 - RNA, 23 nt, Homo sapiens
cauggaaaaucagugacaucuga

SEQ ID NO: 1954034 - RNA, 13 nt, Homo sapiens
ggaagcugccucc

SEQ ID NO: 1954035 - RNA, 18 nt, Homo sapiens
cacagucucauuuugaca

SEQ ID NO: 1954036 - RNA, 19 nt, Homo sapiens
gguggaagagcucaaggga

SEQ ID NO: 1954037 - RNA, 19 nt, Homo sapiens
accugaacucugcaacuga

SEQ ID NO: 1954038 - RNA, 18 nt, Homo sapiens
uucccuguggccuuauga

SEQ ID NO: 1954039 - RNA, 14 nt, Homo sapiens
cucuugucaaaagg

SEQ ID NO: 1954040 - RNA, 18 nt, Homo sapiens
uaauuuguggcacuauga

SEQ ID NO: 1954041 - RNA, 22 nt, Homo sapiens
gcaucuugcuaugagguuugcu

SEQ ID NO: 1954042 - RNA, 17 nt, Homo sapiens
ggcccagcccugggcaa

SEQ ID NO: 1954043 - RNA, 16 nt, Homo sapiens
ugaucgucaucaucaa

SEQ ID NO: 1954044 - RNA, 17 nt, Homo sapiens
gaaaugagcugcacucc

SEQ ID NO: 1954045 - RNA, 19 nt, Homo sapiens
acagucacuaauauaguag

SEQ ID NO: 1954046 - RNA, 18 nt, Homo sapiens
uguacaucccaaaggaug

SEQ ID NO: 1954047 - RNA, 21 nt, Homo sapiens
ggauuguauuuaagacauaaa

SEQ ID NO: 1954048 - RNA, 19 nt, Homo sapiens
cugcccauucaccaaaauu

SEQ ID NO: 1954049 - RNA, 17 nt, Homo sapiens
ccucuucccaugacugc

SEQ ID NO: 1954050 - RNA, 14 nt, Homo sapiens
aguagggggagcaa

SEQ ID NO: 1954051 - RNA, 19 nt, Homo sapiens
guuuccacguaagucacug

SEQ ID NO: 1954052 - RNA, 23 nt, Homo sapiens
cucugcccagccgggcacagugg

SEQ ID NO: 1954053 - RNA, 15 nt, Homo sapiens
uuaccaaagcaucaa

SEQ ID NO: 1954054 - RNA, 20 nt, Homo sapiens
ucccagcggcaccaacauca

SEQ ID NO: 1954055 - RNA, 14 nt, Homo sapiens
caagucacaaagga

SEQ ID NO: 1954056 - RNA, 19 nt, Homo sapiens
acaucuacuacagcacugu

SEQ ID NO: 1954057 - RNA, 17 nt, Homo sapiens
gcaagagggaaugucag

SEQ ID NO: 1954058 - RNA, 14 nt, Homo sapiens
gccacuaagccaag

SEQ ID NO: 1954059 - RNA, 20 nt, Homo sapiens
aauagaagaagcuacugcau

SEQ ID NO: 1954060 - RNA, 20 nt, Homo sapiens
ucucuaaguuaugacuguga

SEQ ID NO: 1954061 - RNA, 23 nt, Homo sapiens
auauacugcagcuuuacugccuu

SEQ ID NO: 1954062 - RNA, 19 nt, Homo sapiens
uggagaagugucguuuuca

SEQ ID NO: 1954063 - RNA, 20 nt, Homo sapiens
caggacuuccauuugcuuug

SEQ ID NO: 1954064 - RNA, 17 nt, Homo sapiens
aauguucuccagucauu

SEQ ID NO: 1954065 - RNA, 13 nt, Homo sapiens
auuuggaaauuca

SEQ ID NO: 1954066 - RNA, 17 nt, Homo sapiens
ggcugccagggggcaag

SEQ ID NO: 1954067 - RNA, 16 nt, Homo sapiens
ucacugcuuaacuuca

SEQ ID NO: 1954068 - RNA, 16 nt, Homo sapiens
accuggauaacuguaa

SEQ ID NO: 1954069 - RNA, 18 nt, Homo sapiens
gagacugcaucucaaaaa

SEQ ID NO: 1954070 - RNA, 16 nt, Homo sapiens
caauuucaagguucua

SEQ ID NO: 1954071 - RNA, 23 nt, Homo sapiens
caguaaauuugcuagcaguaaaa

SEQ ID NO: 1954072 - RNA, 17 nt, Homo sapiens
ucauagaaugaaaguau

SEQ ID NO: 1954073 - RNA, 20 nt, Homo sapiens
guuaaauugcacgugcaaua

SEQ ID NO: 1954074 - RNA, 16 nt, Homo sapiens
cugaaauaacauggcc

SEQ ID NO: 1954075 - RNA, 23 nt, Homo sapiens
acccuuccacuuccaucugggag

SEQ ID NO: 1954076 - RNA, 14 nt, Homo sapiens
gucaggccuaccuc

SEQ ID NO: 1954077 - RNA, 21 nt, Homo sapiens
ccuucugguucuaacugcugu

SEQ ID NO: 1954078 - RNA, 17 nt, Homo sapiens
cuagcaaucugccugua

SEQ ID NO: 1954079 - RNA, 13 nt, Homo sapiens
agaagaacugaaa

SEQ ID NO: 1954080 - RNA, 18 nt, Homo sapiens
ugacaguauuaaggguag

SEQ ID NO: 1954081 - RNA, 15 nt, Homo sapiens
aagauuaacugguag

SEQ ID NO: 1954082 - RNA, 17 nt, Homo sapiens
gcagugcaauacucagu

SEQ ID NO: 1954083 - RNA, 17 nt, Homo sapiens
acagugcaguacucagu

SEQ ID NO: 1954084 - RNA, 20 nt, Homo sapiens
acccagccccagguucaaug

SEQ ID NO: 1954085 - RNA, 19 nt, Homo sapiens
cccacgucuucuugcugca

SEQ ID NO: 1954086 - RNA, 13 nt, Homo sapiens
ccauuuguuccug

SEQ ID NO: 1954087 - RNA, 17 nt, Homo sapiens
cagaacguauuuagcca

SEQ ID NO: 1954088 - RNA, 13 nt, Homo sapiens
aucauauguucua

SEQ ID NO: 1954089 - RNA, 22 nt, Homo sapiens
gaauaaaacguuaguuaauccc

SEQ ID NO: 1954090 - RNA, 15 nt, Homo sapiens
aaauauugcuucaau

SEQ ID NO: 1954091 - RNA, 15 nt, Homo sapiens
cggugcuccaucucc

SEQ ID NO: 1954092 - RNA, 17 nt, Homo sapiens
cuugacccauguucuca

SEQ ID NO: 1954093 - RNA, 23 nt, Homo sapiens
acacccccaugacauugcauuug

SEQ ID NO: 1954094 - RNA, 16 nt, Homo sapiens
ucuccuggaguugcau

SEQ ID NO: 1954095 - RNA, 17 nt, Homo sapiens
cacccuccuugcaggau

SEQ ID NO: 1954096 - RNA, 19 nt, Homo sapiens
cuccagcugcucugucuuc

SEQ ID NO: 1954097 - RNA, 23 nt, Homo sapiens
acccuggugaccagcaccaucuc

SEQ ID NO: 1954098 - RNA, 17 nt, Homo sapiens
acucgagucacacucaa

SEQ ID NO: 1954099 - RNA, 15 nt, Homo sapiens
acccacaucuaaugu

SEQ ID NO: 1954100 - RNA, 18 nt, Homo sapiens
aucaagacugcaaacccu

SEQ ID NO: 1954101 - RNA, 14 nt, Homo sapiens
ugaagaaggucuca

SEQ ID NO: 1954102 - RNA, 18 nt, Homo sapiens
ccauaauaauaauuugca

SEQ ID NO: 1954103 - RNA, 21 nt, Homo sapiens
uaauuaaagccuuaagcacaa

SEQ ID NO: 1954104 - RNA, 17 nt, Homo sapiens
auucaaucaaccugcac

SEQ ID NO: 1954105 - RNA, 13 nt, Homo sapiens
gcucugagugcua

SEQ ID NO: 1954106 - RNA, 18 nt, Homo sapiens
guucauuccuccagguau

SEQ ID NO: 1954107 - RNA, 13 nt, Homo sapiens
ucaagaguucagu

SEQ ID NO: 1954108 - RNA, 22 nt, Homo sapiens
uccucuguauuugucauuccuc

SEQ ID NO: 1954109 - RNA, 14 nt, Homo sapiens
agcaaucauuuuau

SEQ ID NO: 1954110 - RNA, 22 nt, Homo sapiens
uaggcaccuuuuacugugaugu

SEQ ID NO: 1954111 - RNA, 17 nt, Homo sapiens
caguaaaucucacaaau

SEQ ID NO: 1954112 - RNA, 20 nt, Homo sapiens
ugggccucagucacagagga

SEQ ID NO: 1954113 - RNA, 23 nt, Homo sapiens
cacucuuguggucaucauggcca

SEQ ID NO: 1954114 - RNA, 13 nt, Homo sapiens
gggaacugaaauc

SEQ ID NO: 1954115 - RNA, 12 nt, Homo sapiens
uuugaaaacacc

SEQ ID NO: 1954116 - RNA, 13 nt, Homo sapiens
gucuccacugugc

SEQ ID NO: 1954117 - RNA, 18 nt, Homo sapiens
ggagccuccugacccugu

SEQ ID NO: 1954118 - RNA, 18 nt, Homo sapiens
caaguuucuagcuagaaa

SEQ ID NO: 1954119 - RNA, 19 nt, Homo sapiens
uaguacaccauaaacuggg

SEQ ID NO: 1954120 - RNA, 12 nt, Homo sapiens
uuugaagugauu

SEQ ID NO: 1954121 - RNA, 15 nt, Homo sapiens
caccucucccugacc

SEQ ID NO: 1954122 - RNA, 12 nt, Homo sapiens
caaaagcaggaa

SEQ ID NO: 1954123 - RNA, 22 nt, Homo sapiens
cuuccuuuuacuuuucuucuau

SEQ ID NO: 1954124 - RNA, 17 nt, Homo sapiens
aggaguugccugacucc

SEQ ID NO: 1954125 - RNA, 21 nt, Homo sapiens
cuauuucuggcacuugcaagu

SEQ ID NO: 1954126 - RNA, 22 nt, Homo sapiens
uacaaaaacuuagaugggcaug

SEQ ID NO: 1954127 - RNA, 12 nt, Homo sapiens
uacaagaucuca

SEQ ID NO: 1954128 - RNA, 21 nt, Homo sapiens
acaacagauuugugaacucag

SEQ ID NO: 1954129 - RNA, 16 nt, Homo sapiens
auuuugcaaagauuua

SEQ ID NO: 1954130 - RNA, 14 nt, Homo sapiens
cacaucuucaugug

SEQ ID NO: 1954131 - RNA, 17 nt, Homo sapiens
aucuuaaagcacuuaca

SEQ ID NO: 1954132 - RNA, 13 nt, Homo sapiens
ggcauaugcacag

SEQ ID NO: 1954133 - RNA, 15 nt, Homo sapiens
uggccucaugucaaa

SEQ ID NO: 1954134 - RNA, 18 nt, Homo sapiens
aaacagugucauauacaa

SEQ ID NO: 1954135 - RNA, 16 nt, Homo sapiens
cugccaaaacaaugcc

SEQ ID NO: 1954136 - RNA, 14 nt, Homo sapiens
ugcucaugcugcuc

SEQ ID NO: 1954137 - RNA, 12 nt, Homo sapiens
ggaacuacgggg

SEQ ID NO: 1954138 - RNA, 14 nt, Homo sapiens
uauaaauuaucuga

SEQ ID NO: 1954139 - RNA, 14 nt, Homo sapiens
cucuccaagcacua

SEQ ID NO: 1954140 - RNA, 12 nt, Homo sapiens
agccaaagccaa

SEQ ID NO: 1954141 - RNA, 18 nt, Homo sapiens
cguaguauuaugauugca

SEQ ID NO: 1954142 - RNA, 16 nt, Homo sapiens
uauaaaaacagcuccu

SEQ ID NO: 1954143 - RNA, 13 nt, Homo sapiens
uuguaugugcaua

SEQ ID NO: 1954144 - RNA, 16 nt, Homo sapiens
uaggguggcccuugca

SEQ ID NO: 1954145 - RNA, 13 nt, Homo sapiens
agagagauucaga

SEQ ID NO: 1954146 - RNA, 18 nt, Homo sapiens
auuuugagaucagucuuu

SEQ ID NO: 1954147 - RNA, 14 nt, Homo sapiens
auguggaugcucuu

SEQ ID NO: 1954148 - RNA, 23 nt, Homo sapiens
aguuaaugaaauaaaauuugaaa

SEQ ID NO: 1954149 - RNA, 22 nt, Homo sapiens
cugacaaugggcacacagggaa

SEQ ID NO: 1954150 - RNA, 22 nt, Homo sapiens
uuacuaggagauaccaccgaca

SEQ ID NO: 1954151 - RNA, 18 nt, Homo sapiens
gcacaaagaauugauuca

SEQ ID NO: 1954152 - RNA, 21 nt, Homo sapiens
uugagcgugaccuugcaaugu

SEQ ID NO: 1954153 - RNA, 17 nt, Homo sapiens
aacuggaauccuuucag

SEQ ID NO: 1954154 - RNA, 15 nt, Homo sapiens
uuuuaucuugcacuu

SEQ ID NO: 1954155 - RNA, 11 nt, Homo sapiens
gacugugccug

SEQ ID NO: 1954156 - RNA, 14 nt, Homo sapiens
ugcucgugugauuu

SEQ ID NO: 1954157 - RNA, 14 nt, Homo sapiens
ugugggucugggga

SEQ ID NO: 1954158 - RNA, 23 nt, Homo sapiens
uggcaccgagacaaugauaugca

SEQ ID NO: 1954159 - RNA, 17 nt, Homo sapiens
ugaugccuguguacugc

SEQ ID NO: 1954160 - RNA, 18 nt, Homo sapiens
agugaguacaugcacacu

SEQ ID NO: 1954161 - RNA, 18 nt, Homo sapiens
cugaguagcugggauuac

SEQ ID NO: 1954162 - RNA, 13 nt, Homo sapiens
agccucagccacc

SEQ ID NO: 1954163 - RNA, 13 nt, Homo sapiens
gugugacuugaua

SEQ ID NO: 1954164 - RNA, 13 nt, Homo sapiens
auauaacaaauaa

SEQ ID NO: 1954165 - RNA, 17 nt, Homo sapiens
aucaagagagcuuaaca

SEQ ID NO: 1954166 - RNA, 13 nt, Homo sapiens
auuuaccaaauag

SEQ ID NO: 1954167 - RNA, 11 nt, Homo sapiens
uucgcacacac

SEQ ID NO: 1954168 - RNA, 17 nt, Homo sapiens
cccaggcaaacuugcac

SEQ ID NO: 1954169 - RNA, 18 nt, Homo sapiens
ccuuggccgcaccuaaag

SEQ ID NO: 1954170 - RNA, 19 nt, Homo sapiens
caggccagccugucccuga

SEQ ID NO: 1954171 - RNA, 11 nt, Homo sapiens
gugcauuuuau

SEQ ID NO: 1954172 - RNA, 12 nt, Homo sapiens
ucuuuaccugag

SEQ ID NO: 1954173 - RNA, 11 nt, Homo sapiens
ucauacagaga

SEQ ID NO: 1954174 - RNA, 18 nt, Homo sapiens
aaccaaaggugaaggaau

SEQ ID NO: 1954175 - RNA, 13 nt, Homo sapiens
aauagaugucuca

SEQ ID NO: 1954176 - RNA, 23 nt, Homo sapiens
ucugugggaagcucccagaguuu

SEQ ID NO: 1954177 - RNA, 23 nt, Homo sapiens
augucccaggaaucaguuuaaaa

SEQ ID NO: 1954178 - RNA, 15 nt, Homo sapiens
uuuaugugcuaugca

SEQ ID NO: 1954179 - RNA, 18 nt, Homo sapiens
uuguuuaacauugcugau

SEQ ID NO: 1954180 - RNA, 12 nt, Homo sapiens
aaaagaaaucca

SEQ ID NO: 1954181 - RNA, 15 nt, Homo sapiens
uuaccuccucauggc

SEQ ID NO: 1954182 - RNA, 23 nt, Homo sapiens
augugcuggacacuguccaugaa

SEQ ID NO: 1954183 - RNA, 13 nt, Homo sapiens
gcucacaucugaa

SEQ ID NO: 1954184 - RNA, 14 nt, Homo sapiens
cugaccaacgcaca

SEQ ID NO: 1954185 - RNA, 17 nt, Homo sapiens
ccucuguauuugucauu

SEQ ID NO: 1954186 - RNA, 20 nt, Homo sapiens
acucucgcacacacagugau

SEQ ID NO: 1954187 - RNA, 17 nt, Homo sapiens
uguauuuccagugcaau

SEQ ID NO: 1954188 - RNA, 20 nt, Homo sapiens
uuuuccuacuuguuaugguu

SEQ ID NO: 1954189 - RNA, 14 nt, Homo sapiens
uggaacuacuguac

SEQ ID NO: 1954190 - RNA, 17 nt, Homo sapiens
cuggggccucaccugcu

SEQ ID NO: 1954191 - RNA, 16 nt, Homo sapiens
caguagcugggaccac

SEQ ID NO: 1954192 - RNA, 16 nt, Homo sapiens
aaaagauaacaagauc

SEQ ID NO: 1954193 - RNA, 22 nt, Homo sapiens
gaaaggacguggaugaagcaga

SEQ ID NO: 1954194 - RNA, 17 nt, Homo sapiens
uggcaguuauauuuuaa

SEQ ID NO: 1954195 - RNA, 18 nt, Homo sapiens
acaguugcauguuauauu

SEQ ID NO: 1954196 - RNA, 20 nt, Homo sapiens
gaaggacucuuccagaguca

SEQ ID NO: 1954197 - RNA, 17 nt, Homo sapiens
ccccaaauugcuaccuc

SEQ ID NO: 1954198 - RNA, 11 nt, Homo sapiens
gucccaagaca

SEQ ID NO: 1954199 - RNA, 18 nt, Homo sapiens
gaacugacuucaacuggg

SEQ ID NO: 1954200 - RNA, 16 nt, Homo sapiens
acugaaggacacagca

SEQ ID NO: 1954201 - RNA, 23 nt, Homo sapiens
aaauacuauuggacagacacaga

SEQ ID NO: 1954202 - RNA, 21 nt, Homo sapiens
ugggauguccacagaugccuc

SEQ ID NO: 1954203 - RNA, 14 nt, Homo sapiens
uuucuuuuuccacc

SEQ ID NO: 1954204 - RNA, 14 nt, Homo sapiens
gcccaggcuggaau

SEQ ID NO: 1954205 - RNA, 13 nt, Homo sapiens
acaaaugcaguau

SEQ ID NO: 1954206 - RNA, 22 nt, Homo sapiens
aacaagcuuuggcuuuuuccau

SEQ ID NO: 1954207 - RNA, 16 nt, Homo sapiens
uggaagauggggacca

SEQ ID NO: 1954208 - RNA, 17 nt, Homo sapiens
cagaaaugagaucaggc

SEQ ID NO: 1954209 - RNA, 18 nt, Homo sapiens
uaauuagcucucgccuca

SEQ ID NO: 1954210 - RNA, 12 nt, Homo sapiens
uuauuucacuuu

SEQ ID NO: 1954211 - RNA, 17 nt, Homo sapiens
acaauacaugcugcuaa

SEQ ID NO: 1954212 - RNA, 22 nt, Homo sapiens
ucagcaucacccgggaacuuuu

SEQ ID NO: 1954213 - RNA, 14 nt, Homo sapiens
ucuugaagaauauu

SEQ ID NO: 1954214 - RNA, 14 nt, Homo sapiens
gacaaggugccugu

SEQ ID NO: 1954215 - RNA, 18 nt, Homo sapiens
uaugagggaaaaugagua

SEQ ID NO: 1954216 - RNA, 20 nt, Homo sapiens
gucauguuucugcaguauuc

SEQ ID NO: 1954217 - RNA, 23 nt, Homo sapiens
ucccaccacggggucugcagcaa

SEQ ID NO: 1954218 - RNA, 21 nt, Homo sapiens
cagcuccuccucuuggagcug

SEQ ID NO: 1954219 - RNA, 13 nt, Homo sapiens
ugucuccuuccau

SEQ ID NO: 1954220 - RNA, 14 nt, Homo sapiens
uguugcagguucau

SEQ ID NO: 1954221 - RNA, 15 nt, Homo sapiens
gugacauuccuucuc

SEQ ID NO: 1954222 - RNA, 18 nt, Homo sapiens
agauuucagcuacauaua

SEQ ID NO: 1954223 - RNA, 18 nt, Homo sapiens
cucaauuugaaacacaag

SEQ ID NO: 1954224 - RNA, 21 nt, Homo sapiens
uaaagcacccuguaucacaga

SEQ ID NO: 1954225 - RNA, 17 nt, Homo sapiens
cuuaugaucaccaugua

SEQ ID NO: 1954226 - RNA, 20 nt, Homo sapiens
aggcugcagugagcugugau

SEQ ID NO: 1954227 - RNA, 16 nt, Homo sapiens
caagcuucacauuugc

SEQ ID NO: 1954228 - RNA, 17 nt, Homo sapiens
uugaagauaucuugaaa

SEQ ID NO: 1954229 - RNA, 13 nt, Homo sapiens
cauguaugccaug

SEQ ID NO: 1954230 - RNA, 12 nt, Homo sapiens
cccccccggagc

SEQ ID NO: 1954231 - RNA, 19 nt, Homo sapiens
guccuuaggugugaggucc

SEQ ID NO: 1954232 - RNA, 20 nt, Homo sapiens
aauaugaaagaaaaauggau

SEQ ID NO: 1954233 - RNA, 22 nt, Homo sapiens
ucaagcaaaucuccugccucag

SEQ ID NO: 1954234 - RNA, 16 nt, Homo sapiens
ccggauggaaucacag

SEQ ID NO: 1954235 - RNA, 18 nt, Homo sapiens
guucagaaaagaagugaa

SEQ ID NO: 1954236 - RNA, 15 nt, Homo sapiens
cugcauacccgggca

SEQ ID NO: 1954237 - RNA, 15 nt, Homo sapiens
ucaagccaagucauc

SEQ ID NO: 1954238 - RNA, 15 nt, Homo sapiens
cgagaccaucuuggc

SEQ ID NO: 1954239 - RNA, 17 nt, Homo sapiens
aacccugccccugcccc

SEQ ID NO: 1954240 - RNA, 17 nt, Homo sapiens
aaauagguagagucauu

SEQ ID NO: 1954241 - RNA, 16 nt, Homo sapiens
agaagggggugggggg

SEQ ID NO: 1954242 - RNA, 16 nt, Homo sapiens
cgcuggcucccugggc

SEQ ID NO: 1954243 - RNA, 12 nt, Homo sapiens
uuccagguaaaa

SEQ ID NO: 1954244 - RNA, 14 nt, Homo sapiens
uguccuccuggcac

SEQ ID NO: 1954245 - RNA, 17 nt, Homo sapiens
caggaaauccuugcacc

SEQ ID NO: 1954246 - RNA, 13 nt, Homo sapiens
gaaguuuggcaau

SEQ ID NO: 1954247 - RNA, 22 nt, Homo sapiens
gcaacucuauucauuccuugcc

SEQ ID NO: 1954248 - RNA, 12 nt, Homo sapiens
caaaacccaucg

SEQ ID NO: 1954249 - RNA, 15 nt, Homo sapiens
auuuacagucucuuu

SEQ ID NO: 1954250 - RNA, 22 nt, Homo sapiens
acuauuaaaaagguuuacagaa

SEQ ID NO: 1954251 - RNA, 13 nt, Homo sapiens
accuuauacauca

SEQ ID NO: 1954252 - RNA, 14 nt, Homo sapiens
uuggucagcguuac

SEQ ID NO: 1954253 - RNA, 12 nt, Homo sapiens
guucucuuccac

SEQ ID NO: 1954254 - RNA, 16 nt, Homo sapiens
auggacucagcucugu

SEQ ID NO: 1954255 - RNA, 18 nt, Homo sapiens
ccucauucagagacugcc

SEQ ID NO: 1954256 - RNA, 21 nt, Homo sapiens
ccucaaacuuccagucaggua

SEQ ID NO: 1954257 - RNA, 19 nt, Homo sapiens
ucuaagucgugcacuuucu

SEQ ID NO: 1954258 - RNA, 17 nt, Homo sapiens
cacuuguucauucugug

SEQ ID NO: 1954259 - RNA, 21 nt, Homo sapiens
aacucuggggcuuguccugug

SEQ ID NO: 1954260 - RNA, 21 nt, Homo sapiens
gccagagagaacaacaggcag

SEQ ID NO: 1954261 - RNA, 13 nt, Homo sapiens
agcucagacauau

SEQ ID NO: 1954262 - RNA, 14 nt, Homo sapiens
auaaauguucauga

SEQ ID NO: 1954263 - RNA, 14 nt, Homo sapiens
ugcacacauaacac

SEQ ID NO: 1954264 - RNA, 21 nt, Homo sapiens
gguugccaaauugcugcauau

SEQ ID NO: 1954265 - RNA, 13 nt, Homo sapiens
acaugcaagucau

SEQ ID NO: 1954266 - RNA, 20 nt, Homo sapiens
aguucccuaaacaaaagcaa

SEQ ID NO: 1954267 - RNA, 11 nt, Homo sapiens
accucuuguuu

SEQ ID NO: 1954268 - RNA, 15 nt, Homo sapiens
aaguucuucuaagcu

SEQ ID NO: 1954269 - RNA, 15 nt, Homo sapiens
cugaguauaaauuua

SEQ ID NO: 1954270 - RNA, 17 nt, Homo sapiens
auaaaacaucacuauca

SEQ ID NO: 1954271 - RNA, 16 nt, Homo sapiens
gucugugugcaagugu

SEQ ID NO: 1954272 - RNA, 15 nt, Homo sapiens
uucuguagcaccaga

SEQ ID NO: 1954273 - RNA, 18 nt, Homo sapiens
gaauguuaugugcaaguu

SEQ ID NO: 1954274 - RNA, 14 nt, Homo sapiens
uccuggagaaggca

SEQ ID NO: 1954275 - RNA, 12 nt, Homo sapiens
uggcuagccuuu

SEQ ID NO: 1954276 - RNA, 18 nt, Homo sapiens
gugaagauuucauggaca

SEQ ID NO: 1954277 - RNA, 17 nt, Homo sapiens
aguguggcagugaccau

SEQ ID NO: 1954278 - RNA, 18 nt, Homo sapiens
caaugccugccugaacaa

SEQ ID NO: 1954279 - RNA, 21 nt, Homo sapiens
auauguaaacuuuaacuucca

SEQ ID NO: 1954280 - RNA, 22 nt, Homo sapiens
aucaagaaauaugaagcacuuu

SEQ ID NO: 1954281 - RNA, 21 nt, Homo sapiens
agaacuucguacccuuugcac

SEQ ID NO: 1954282 - RNA, 14 nt, Homo sapiens
uagccagcuguguu

SEQ ID NO: 1954283 - RNA, 19 nt, Homo sapiens
uagucccuguuuuugcagu

SEQ ID NO: 1954284 - RNA, 12 nt, Homo sapiens
acuuagugacaa

SEQ ID NO: 1954285 - RNA, 20 nt, Homo sapiens
uaaauuggugauaaguggaa

SEQ ID NO: 1954286 - RNA, 23 nt, Homo sapiens
uccaucucgcugccgucuguccc

SEQ ID NO: 1954287 - RNA, 15 nt, Homo sapiens
cgugacaagugccuu

SEQ ID NO: 1954288 - RNA, 20 nt, Homo sapiens
caaagugcuuccaaggcaga

SEQ ID NO: 1954289 - RNA, 13 nt, Homo sapiens
auacucaccucac

SEQ ID NO: 1954290 - RNA, 16 nt, Homo sapiens
aaaguuuccuaggaug

SEQ ID NO: 1954291 - RNA, 12 nt, Homo sapiens
aaugugugcaua

SEQ ID NO: 1954292 - RNA, 18 nt, Homo sapiens
ccagcggcugggugguga

SEQ ID NO: 1954293 - RNA, 12 nt, Homo sapiens
gcuaauguuucc

SEQ ID NO: 1954294 - RNA, 20 nt, Homo sapiens
ugcaaaguauaaaauuauau

SEQ ID NO: 1954295 - RNA, 22 nt, Homo sapiens
aauagauuuuagcaugaugaaa

SEQ ID NO: 1954296 - RNA, 14 nt, Homo sapiens
uaugcaagcagcuu

SEQ ID NO: 1954297 - RNA, 16 nt, Homo sapiens
cuccaaaccugucuug

SEQ ID NO: 1954298 - RNA, 19 nt, Homo sapiens
caaaguguacaauuuucau

SEQ ID NO: 1954299 - RNA, 16 nt, Homo sapiens
agaguuuaaacaaaaa

SEQ ID NO: 1954300 - RNA, 19 nt, Homo sapiens
gcugguauuuaucugcaag

SEQ ID NO: 1954301 - RNA, 23 nt, Homo sapiens
uaugcauuaagaguaaaauuccu

SEQ ID NO: 1954302 - RNA, 16 nt, Homo sapiens
auguuggggcucuucc

SEQ ID NO: 1954303 - RNA, 21 nt, Homo sapiens
cuuuuggaggaagauacauuu

SEQ ID NO: 1954304 - RNA, 18 nt, Homo sapiens
cucagaauauucuucuaa

SEQ ID NO: 1954305 - RNA, 19 nt, Homo sapiens
auaaucgacuuguucuuga

SEQ ID NO: 1954306 - RNA, 18 nt, Homo sapiens
ucaucucagugcuguaaa

SEQ ID NO: 1954307 - RNA, 20 nt, Homo sapiens
cugaaguguggcugcaucuu

SEQ ID NO: 1954308 - RNA, 21 nt, Homo sapiens
agcugguaggauguaagccug

SEQ ID NO: 1954309 - RNA, 22 nt, Homo sapiens
ucagugaugaaaauuugccuuu

SEQ ID NO: 1954310 - RNA, 19 nt, Homo sapiens
ccuaugcagacaucucugg

SEQ ID NO: 1954311 - RNA, 21 nt, Homo sapiens
accccggcugcuuggcaguug

SEQ ID NO: 1954312 - RNA, 15 nt, Homo sapiens
gccucagcccagguc

SEQ ID NO: 1954313 - RNA, 19 nt, Homo sapiens
uagaugggugggggcuccu

SEQ ID NO: 1954314 - RNA, 20 nt, Homo sapiens
uauaauuuccauagugugag

SEQ ID NO: 1954315 - RNA, 20 nt, Homo sapiens
uccauuugugugugugcaag

SEQ ID NO: 1954316 - RNA, 17 nt, Homo sapiens
cucaaggcaaugggcua

SEQ ID NO: 1954317 - RNA, 12 nt, Homo sapiens
ccugaaagccac

SEQ ID NO: 1954318 - RNA, 16 nt, Homo sapiens
caugaauaucaguuau

SEQ ID NO: 1954319 - RNA, 21 nt, Homo sapiens
ugcauggcucccgaguacagu

SEQ ID NO: 1954320 - RNA, 14 nt, Homo sapiens
ugcugcucaucuga

SEQ ID NO: 1954321 - RNA, 12 nt, Homo sapiens
uuaugacuguuu

SEQ ID NO: 1954322 - RNA, 19 nt, Homo sapiens
gaaucccauggauguuucu

SEQ ID NO: 1954323 - RNA, 16 nt, Homo sapiens
cacauggccuaugcac

SEQ ID NO: 1954324 - RNA, 20 nt, Homo sapiens
ugaaaaaaaauaaauugcuc

SEQ ID NO: 1954325 - RNA, 17 nt, Homo sapiens
gccugacucugugcuga

SEQ ID NO: 1954326 - RNA, 22 nt, Homo sapiens
acacaugauccugcaauuccac

SEQ ID NO: 1954327 - RNA, 11 nt, Homo sapiens
gacuguaaaau

SEQ ID NO: 1954328 - RNA, 22 nt, Homo sapiens
uccuaagccaugggagacacug

SEQ ID NO: 1954329 - RNA, 17 nt, Homo sapiens
uuugaaacagauuccau

SEQ ID NO: 1954330 - RNA, 14 nt, Homo sapiens
auaaacuacuguaa

SEQ ID NO: 1954331 - RNA, 19 nt, Homo sapiens
gcacugaaaauaccaucag

SEQ ID NO: 1954332 - RNA, 14 nt, Homo sapiens
caauaucaugucuu

SEQ ID NO: 1954333 - RNA, 13 nt, Homo sapiens
aauuggcuuuuca

SEQ ID NO: 1954334 - RNA, 15 nt, Homo sapiens
caaaggaguggucaa

SEQ ID NO: 1954335 - RNA, 12 nt, Homo sapiens
guucucuguauu

SEQ ID NO: 1954336 - RNA, 15 nt, Homo sapiens
gccuggaagccaaac

SEQ ID NO: 1954337 - RNA, 16 nt, Homo sapiens
ggcaucacagacccca

SEQ ID NO: 1954338 - RNA, 14 nt, Homo sapiens
accaguaauuguga

SEQ ID NO: 1954339 - RNA, 22 nt, Homo sapiens
ggucacuguccuugaacccaac

SEQ ID NO: 1954340 - RNA, 17 nt, Homo sapiens
cccacccuugagaaggu

SEQ ID NO: 1954341 - RNA, 13 nt, Homo sapiens
aauguacuugaua

SEQ ID NO: 1954342 - RNA, 20 nt, Homo sapiens
cugaaucuucaagaccaaag

SEQ ID NO: 1954343 - RNA, 17 nt, Homo sapiens
ugagacccauggcugug

SEQ ID NO: 1954344 - RNA, 12 nt, Homo sapiens
auaaaaguuauu

SEQ ID NO: 1954345 - RNA, 22 nt, Homo sapiens
uacacugcggaagccaaaggca

SEQ ID NO: 1954346 - RNA, 16 nt, Homo sapiens
aggccugguguguuca

SEQ ID NO: 1954347 - RNA, 20 nt, Homo sapiens
ggauuacaggcgccugccac

SEQ ID NO: 1954348 - RNA, 19 nt, Homo sapiens
uuuaacuuaagggagaaaa

SEQ ID NO: 1954349 - RNA, 18 nt, Homo sapiens
agugucacugagcugugu

SEQ ID NO: 1954350 - RNA, 16 nt, Homo sapiens
acuggcagucgcacac

SEQ ID NO: 1954351 - RNA, 20 nt, Homo sapiens
ccgagagccuuauuuaccua

SEQ ID NO: 1954352 - RNA, 20 nt, Homo sapiens
acuuuucuauauugcagugu

SEQ ID NO: 1954353 - RNA, 19 nt, Homo sapiens
aggaaaaaauccucacuca

SEQ ID NO: 1954354 - RNA, 15 nt, Homo sapiens
uggccacccaaacag

SEQ ID NO: 1954355 - RNA, 20 nt, Homo sapiens
augcacagagauaugcacac

SEQ ID NO: 1954356 - RNA, 13 nt, Homo sapiens
auuuaguuucaua

SEQ ID NO: 1954357 - RNA, 17 nt, Homo sapiens
guuuuccccccauauuu

SEQ ID NO: 1954358 - RNA, 18 nt, Homo sapiens
uaaucaagggcacuguga

SEQ ID NO: 1954359 - RNA, 19 nt, Homo sapiens
gcuuauuguacuuguuauc

SEQ ID NO: 1954360 - RNA, 18 nt, Homo sapiens
cugauugucaacacaaac

SEQ ID NO: 1954361 - RNA, 13 nt, Homo sapiens
gccgcuccugcuu

SEQ ID NO: 1954362 - RNA, 20 nt, Homo sapiens
auucuuguuuuacauuugga

SEQ ID NO: 1954363 - RNA, 22 nt, Homo sapiens
gagggaugcuggaaccaguuac

SEQ ID NO: 1954364 - RNA, 17 nt, Homo sapiens
aaggacagcucuucccc

SEQ ID NO: 1954365 - RNA, 21 nt, Homo sapiens
gagccaaguucacaccacugc

SEQ ID NO: 1954366 - RNA, 22 nt, Homo sapiens
gcaagcugggacuggcaggaaa

SEQ ID NO: 1954367 - RNA, 18 nt, Homo sapiens
uuucaaagacugccacgu

SEQ ID NO: 1954368 - RNA, 17 nt, Homo sapiens
gcuguucaacaucacug

SEQ ID NO: 1954369 - RNA, 18 nt, Homo sapiens
cuuguguuuuuugcucac

SEQ ID NO: 1954370 - RNA, 14 nt, Homo sapiens
uugaguauuacaca

SEQ ID NO: 1954371 - RNA, 20 nt, Homo sapiens
ugugguagcgccauggcugu

SEQ ID NO: 1954372 - RNA, 16 nt, Homo sapiens
aaggaugagcauuuag

SEQ ID NO: 1954373 - RNA, 21 nt, Homo sapiens
gcuuuggcaaauaaaccuccu

SEQ ID NO: 1954374 - RNA, 19 nt, Homo sapiens
aaaagucugccuauccugg

SEQ ID NO: 1954375 - RNA, 16 nt, Homo sapiens
uaacgucaucucaggg

SEQ ID NO: 1954376 - RNA, 22 nt, Homo sapiens
uauguauguguuuagaauugaa

SEQ ID NO: 1954377 - RNA, 17 nt, Homo sapiens
ccggacucucggcucuu

SEQ ID NO: 1954378 - RNA, 15 nt, Homo sapiens
ccuucaccaucugua

SEQ ID NO: 1954379 - RNA, 18 nt, Homo sapiens
acuugaggccaggacuuu

SEQ ID NO: 1954380 - RNA, 23 nt, Homo sapiens
ugcagccucacaguccuuaccag

SEQ ID NO: 1954381 - RNA, 12 nt, Homo sapiens
ccuuaccaaaaa

SEQ ID NO: 1954382 - RNA, 22 nt, Homo sapiens
ugggcccuuggaaaaacaggaa

SEQ ID NO: 1954383 - RNA, 18 nt, Homo sapiens
cacaggggcccauggacu

SEQ ID NO: 1954384 - RNA, 13 nt, Homo sapiens
acuucaaggguuu

SEQ ID NO: 1954385 - RNA, 19 nt, Homo sapiens
ccuggugggcucaaccaca

SEQ ID NO: 1954386 - RNA, 16 nt, Homo sapiens
uauuccauugugugag

SEQ ID NO: 1954387 - RNA, 19 nt, Homo sapiens
aaauccuaguaugccaaaa

SEQ ID NO: 1954388 - RNA, 21 nt, Homo sapiens
aguggccaagagaugcagugc

SEQ ID NO: 1954389 - RNA, 17 nt, Homo sapiens
gaagagcuuauuacuua

SEQ ID NO: 1954390 - RNA, 20 nt, Homo sapiens
ccuauacaguucuaugcaga

SEQ ID NO: 1954391 - RNA, 23 nt, Homo sapiens
uuaagugaaagagauuacuuaaa

SEQ ID NO: 1954392 - RNA, 22 nt, Homo sapiens
uguggagagcuuauacagagcc

SEQ ID NO: 1954393 - RNA, 20 nt, Homo sapiens
auauuucccaauacauacca

SEQ ID NO: 1954394 - RNA, 15 nt, Homo sapiens
cagugccuguaucuu

SEQ ID NO: 1954395 - RNA, 23 nt, Homo sapiens
gcauacgguaugauauugcagcu

SEQ ID NO: 1954396 - RNA, 15 nt, Homo sapiens
gccccuccucccuca

SEQ ID NO: 1954397 - RNA, 16 nt, Homo sapiens
gagcaccagcggucca

SEQ ID NO: 1954398 - RNA, 17 nt, Homo sapiens
uaaauuuuacccuuuag

SEQ ID NO: 1954399 - RNA, 15 nt, Homo sapiens
aaugcuucuuucauu

SEQ ID NO: 1954400 - RNA, 16 nt, Homo sapiens
cauggagcaugggacu

SEQ ID NO: 1954401 - RNA, 16 nt, Homo sapiens
aggguccgcaccagcu

SEQ ID NO: 1954402 - RNA, 11 nt, Homo sapiens
guacaugagaa

SEQ ID NO: 1954403 - RNA, 20 nt, Homo sapiens
uucuguguugaagcacuguu

SEQ ID NO: 1954404 - RNA, 16 nt, Homo sapiens
uauuucagccaugaua

SEQ ID NO: 1954405 - RNA, 20 nt, Homo sapiens
ggguggaucaccugugguca

SEQ ID NO: 1954406 - RNA, 21 nt, Homo sapiens
gauucauaaaguaaugaugaa

SEQ ID NO: 1954407 - RNA, 17 nt, Homo sapiens
uacagaaaguagugcug

SEQ ID NO: 1954408 - RNA, 15 nt, Homo sapiens
aguggccgaugauuu

SEQ ID NO: 1954409 - RNA, 12 nt, Homo sapiens
accuccccagac

SEQ ID NO: 1954410 - RNA, 15 nt, Homo sapiens
cuacuucauagcucc

SEQ ID NO: 1954411 - RNA, 14 nt, Homo sapiens
gcacugucaugccc

SEQ ID NO: 1954412 - RNA, 20 nt, Homo sapiens
uucucaucacucaaccuuau

SEQ ID NO: 1954413 - RNA, 21 nt, Homo sapiens
gccauggccugcaaacuggga

SEQ ID NO: 1954414 - RNA, 16 nt, Homo sapiens
gcugcucagagccaag

SEQ ID NO: 1954415 - RNA, 13 nt, Homo sapiens
acagaaaacccag

SEQ ID NO: 1954416 - RNA, 13 nt, Homo sapiens
gcgagcacaccuu

SEQ ID NO: 1954417 - RNA, 14 nt, Homo sapiens
cuacuugaccuaag

SEQ ID NO: 1954418 - RNA, 17 nt, Homo sapiens
cuuacacauuaagcaaa

SEQ ID NO: 1954419 - RNA, 21 nt, Homo sapiens
caauugauguuuuacgugcaa

SEQ ID NO: 1954420 - RNA, 16 nt, Homo sapiens
cuucaguguaauguga

SEQ ID NO: 1954421 - RNA, 18 nt, Homo sapiens
gccaggcacgguggcuga

SEQ ID NO: 1954422 - RNA, 20 nt, Homo sapiens
cccagcugcucuguacugca

SEQ ID NO: 1954423 - RNA, 17 nt, Homo sapiens
gagggaggccaggcggg

SEQ ID NO: 1954424 - RNA, 16 nt, Homo sapiens
aacucugccagccaca

SEQ ID NO: 1954425 - RNA, 17 nt, Homo sapiens
aaauuugaugaaaucag

SEQ ID NO: 1954426 - RNA, 14 nt, Homo sapiens
ugcauuugcacuau

SEQ ID NO: 1954427 - RNA, 20 nt, Homo sapiens
uucccugaaggaaccaaagc

SEQ ID NO: 1954428 - RNA, 19 nt, Homo sapiens
acccuggcccuuuuauacu

SEQ ID NO: 1954429 - RNA, 15 nt, Homo sapiens
caugugguacuugag

SEQ ID NO: 1954430 - RNA, 14 nt, Homo sapiens
cuacagaaugcggc

SEQ ID NO: 1954431 - RNA, 20 nt, Homo sapiens
aacauaauacauuaauacuu

SEQ ID NO: 1954432 - RNA, 15 nt, Homo sapiens
auuuccaagcuguua

SEQ ID NO: 1954433 - RNA, 16 nt, Homo sapiens
cguacacuguacuucu

SEQ ID NO: 1954434 - RNA, 22 nt, Homo sapiens
uaaaaugguuuuugccuaaaau

SEQ ID NO: 1954435 - RNA, 17 nt, Homo sapiens
ugacauguacauacugu

SEQ ID NO: 1954436 - RNA, 18 nt, Homo sapiens
ugcagggagcacuguuca

SEQ ID NO: 1954437 - RNA, 21 nt, Homo sapiens
gauuuuaucuguuaaccaaau

SEQ ID NO: 1954438 - RNA, 18 nt, Homo sapiens
ucugggccaagucaaaga

SEQ ID NO: 1954439 - RNA, 23 nt, Homo sapiens
uacugcaaaguguaugcaguauu

SEQ ID NO: 1954440 - RNA, 14 nt, Homo sapiens
ugaccucacaguga

SEQ ID NO: 1954441 - RNA, 22 nt, Homo sapiens
uggugaaaaugaagggauuuca

SEQ ID NO: 1954442 - RNA, 13 nt, Homo sapiens
gacucugugaucu

SEQ ID NO: 1954443 - RNA, 15 nt, Homo sapiens
ugcuagcaacaacuu

SEQ ID NO: 1954444 - RNA, 13 nt, Homo sapiens
cugaagugcuuag

SEQ ID NO: 1954445 - RNA, 13 nt, Homo sapiens
caguagugcauug

SEQ ID NO: 1954446 - RNA, 20 nt, Homo sapiens
auuucuccugacuccaguga

SEQ ID NO: 1954447 - RNA, 14 nt, Homo sapiens
cuguggccauuugu

SEQ ID NO: 1954448 - RNA, 20 nt, Homo sapiens
augguagugggugccuguaa

SEQ ID NO: 1954449 - RNA, 20 nt, Homo sapiens
ccccgucuggugccagugug

SEQ ID NO: 1954450 - RNA, 18 nt, Homo sapiens
ccccagguaauggcauga

SEQ ID NO: 1954451 - RNA, 14 nt, Homo sapiens
uccuccaagcuauu

SEQ ID NO: 1954452 - RNA, 18 nt, Homo sapiens
agaacucgcgcucaguaa

SEQ ID NO: 1954453 - RNA, 23 nt, Homo sapiens
uuggaauuaugucugcugaauaa

SEQ ID NO: 1954454 - RNA, 17 nt, Homo sapiens
agucugggcaaugaaac

SEQ ID NO: 1954455 - RNA, 23 nt, Homo sapiens
gucacuuacuguuucugucagga

SEQ ID NO: 1954456 - RNA, 16 nt, Homo sapiens
aucccuugaguuauau

SEQ ID NO: 1954457 - RNA, 18 nt, Homo sapiens
agcagccaguucaaaaac

SEQ ID NO: 1954458 - RNA, 10 nt, Homo sapiens
ugaagccagc

SEQ ID NO: 1954459 - RNA, 17 nt, Homo sapiens
cggcaguggcuggggga

SEQ ID NO: 1954460 - RNA, 22 nt, Homo sapiens
uaaaucugccuaguuuugauga

SEQ ID NO: 1954461 - RNA, 19 nt, Homo sapiens
gucugcuucuguccaggac

SEQ ID NO: 1954462 - RNA, 18 nt, Homo sapiens
caaguguuugugggacac

SEQ ID NO: 1954463 - RNA, 19 nt, Homo sapiens
uuuccccauucagugacau

SEQ ID NO: 1954464 - RNA, 21 nt, Homo sapiens
gacucacacuuacugcaaagg

SEQ ID NO: 1954465 - RNA, 15 nt, Homo sapiens
ccugaggaguguccu

SEQ ID NO: 1954466 - RNA, 22 nt, Homo sapiens
cuaaguguugugaaacuguaaa

SEQ ID NO: 1954467 - RNA, 17 nt, Homo sapiens
uguguuccugugaucuc

SEQ ID NO: 1954468 - RNA, 12 nt, Homo sapiens
guucugaugcuu

SEQ ID NO: 1954469 - RNA, 13 nt, Homo sapiens
aacuuacuuccaa

SEQ ID NO: 1954470 - RNA, 20 nt, Homo sapiens
uuuugaauucugaccaugga

SEQ ID NO: 1954471 - RNA, 19 nt, Homo sapiens
ccuauugugauuugacugu

SEQ ID NO: 1954472 - RNA, 20 nt, Homo sapiens
auuucuuuucuacacauuga

SEQ ID NO: 1954473 - RNA, 21 nt, Homo sapiens
aucuccagccaauuucaaaga

SEQ ID NO: 1954474 - RNA, 17 nt, Homo sapiens
gguccaaaaauagucaa

SEQ ID NO: 1954475 - RNA, 19 nt, Homo sapiens
uagcagggauucucucauc

SEQ ID NO: 1954476 - RNA, 16 nt, Homo sapiens
ugcuaauuucugucca

SEQ ID NO: 1954477 - RNA, 12 nt, Homo sapiens
uauugauacaaa

SEQ ID NO: 1954478 - RNA, 15 nt, Homo sapiens
cugggccaguuccuc

SEQ ID NO: 1954479 - RNA, 14 nt, Homo sapiens
guacauauguuuca

SEQ ID NO: 1954480 - RNA, 15 nt, Homo sapiens
cugaggucaucugua

SEQ ID NO: 1954481 - RNA, 16 nt, Homo sapiens
uucuaaauugagauuc

SEQ ID NO: 1954482 - RNA, 23 nt, Homo sapiens
guuauaaaucaaugucacuuaaa

SEQ ID NO: 1954483 - RNA, 15 nt, Homo sapiens
cagaaauccauuuga

SEQ ID NO: 1954484 - RNA, 14 nt, Homo sapiens
uaaagaaaaccaca

SEQ ID NO: 1954485 - RNA, 16 nt, Homo sapiens
ggcagacuuucuucuc

SEQ ID NO: 1954486 - RNA, 22 nt, Homo sapiens
gaaaaaggagcuuaccucccac

SEQ ID NO: 1954487 - RNA, 22 nt, Homo sapiens
uggugccauuucugaacuguua

SEQ ID NO: 1954488 - RNA, 15 nt, Homo sapiens
ugaaauaacuaccuu

SEQ ID NO: 1954489 - RNA, 23 nt, Homo sapiens
uaccaguguaaauucagucuuuu

SEQ ID NO: 1954490 - RNA, 16 nt, Homo sapiens
uuugaaaaagcgaaaa

SEQ ID NO: 1954491 - RNA, 19 nt, Homo sapiens
aagauguccugacuuugcc

SEQ ID NO: 1954492 - RNA, 19 nt, Homo sapiens
acuuagugguaugucucuu

SEQ ID NO: 1954493 - RNA, 11 nt, Homo sapiens
aagauuaacac

SEQ ID NO: 1954494 - RNA, 13 nt, Homo sapiens
cuugggagucagg

SEQ ID NO: 1954495 - RNA, 14 nt, Homo sapiens
ugaaaccugagaug

SEQ ID NO: 1954496 - RNA, 14 nt, Homo sapiens
cagaagaacugugu

SEQ ID NO: 1954497 - RNA, 17 nt, Homo sapiens
ugcccaaccucagcaac

SEQ ID NO: 1954498 - RNA, 20 nt, Homo sapiens
gcaagagcccagaucaccca

SEQ ID NO: 1954499 - RNA, 16 nt, Homo sapiens
auugaaguuuugacau

SEQ ID NO: 1954500 - RNA, 18 nt, Homo sapiens
caaguguuucuguuucaa

SEQ ID NO: 1954501 - RNA, 13 nt, Homo sapiens
guugggcuuucac

SEQ ID NO: 1954502 - RNA, 17 nt, Homo sapiens
acauccuuaagucaaaa

SEQ ID NO: 1954503 - RNA, 16 nt, Homo sapiens
aaggugccgauuucau

SEQ ID NO: 1954504 - RNA, 17 nt, Homo sapiens
gagagacacucccaggg

SEQ ID NO: 1954505 - RNA, 16 nt, Homo sapiens
cuggguggaugggcca

SEQ ID NO: 1954506 - RNA, 19 nt, Homo sapiens
cucugucucucugucucuc

SEQ ID NO: 1954507 - RNA, 18 nt, Homo sapiens
uuagggaaaacauuccau

SEQ ID NO: 1954508 - RNA, 14 nt, Homo sapiens
uggacacugagaac

SEQ ID NO: 1954509 - RNA, 18 nt, Homo sapiens
cccuauuauaauugucau

SEQ ID NO: 1954510 - RNA, 16 nt, Homo sapiens
cgugaucaaagccaca

SEQ ID NO: 1954511 - RNA, 13 nt, Homo sapiens
gcuaacacgguga

SEQ ID NO: 1954512 - RNA, 20 nt, Homo sapiens
gcuagugccugagaugcacg

SEQ ID NO: 1954513 - RNA, 19 nt, Homo sapiens
uacugauaaccacuccuaa

SEQ ID NO: 1954514 - RNA, 24 nt, Homo sapiens
acacauagaaaacaaucaaauauu

SEQ ID NO: 1954515 - RNA, 21 nt, Homo sapiens
guggggagaugggcauuugga

SEQ ID NO: 1954516 - RNA, 23 nt, Homo sapiens
ugcagucugggccccaucauuaa

SEQ ID NO: 1954517 - RNA, 16 nt, Homo sapiens
agguccucaguguccu

SEQ ID NO: 1954518 - RNA, 18 nt, Homo sapiens
aggagaaagaagagcagc

SEQ ID NO: 1954519 - RNA, 15 nt, Homo sapiens
cacuguacucugcac

SEQ ID NO: 1954520 - RNA, 23 nt, Homo sapiens
aagucacaccagggcaacucuug

SEQ ID NO: 1954521 - RNA, 22 nt, Homo sapiens
augcacacacacggaugcacac

SEQ ID NO: 1954522 - RNA, 22 nt, Homo sapiens
guauugaaggaauuagaaauga

SEQ ID NO: 1954523 - RNA, 14 nt, Homo sapiens
gcaucaugggcaac

SEQ ID NO: 1954524 - RNA, 21 nt, Homo sapiens
aggccaauaaaaaguucagag

SEQ ID NO: 1954525 - RNA, 17 nt, Homo sapiens
uuaaaauaaugaauaca

SEQ ID NO: 1954526 - RNA, 14 nt, Homo sapiens
aggugauaauggau

SEQ ID NO: 1954527 - RNA, 23 nt, Homo sapiens
agucaggggucaggugucaggcc

SEQ ID NO: 1954528 - RNA, 12 nt, Homo sapiens
acauucccaugg

SEQ ID NO: 1954529 - RNA, 14 nt, Homo sapiens
ugacucugucacac

SEQ ID NO: 1954530 - RNA, 18 nt, Homo sapiens
acaagucuugcugugcuu

SEQ ID NO: 1954531 - RNA, 15 nt, Homo sapiens
uuccacgagcuauau

SEQ ID NO: 1954532 - RNA, 14 nt, Homo sapiens
agcaugacgugugg

SEQ ID NO: 1954533 - RNA, 13 nt, Homo sapiens
cugcgucaggcac

SEQ ID NO: 1954534 - RNA, 15 nt, Homo sapiens
ccccacaaugccaga

SEQ ID NO: 1954535 - RNA, 19 nt, Homo sapiens
gacuagugagucagcaccu

SEQ ID NO: 1954536 - RNA, 18 nt, Homo sapiens
uguuauguuugcacuuug

SEQ ID NO: 1954537 - RNA, 23 nt, Homo sapiens
acguugaucccagagagcagcuu

SEQ ID NO: 1954538 - RNA, 20 nt, Homo sapiens
gggcuuuuccaaaagcaaac

SEQ ID NO: 1954539 - RNA, 18 nt, Homo sapiens
acagggucugcacucuaa

SEQ ID NO: 1954540 - RNA, 20 nt, Homo sapiens
ggcauggcccugggguccca

SEQ ID NO: 1954541 - RNA, 22 nt, Homo sapiens
aaaugaaagggaaacugggaaa

SEQ ID NO: 1954542 - RNA, 18 nt, Homo sapiens
cuucuuggucaagaaagg

SEQ ID NO: 1954543 - RNA, 22 nt, Homo sapiens
cccaaggagggcaccaucuuac

SEQ ID NO: 1954544 - RNA, 15 nt, Homo sapiens
cuugaagccaaagaa

SEQ ID NO: 1954545 - RNA, 13 nt, Homo sapiens
aaucaccaaagua

SEQ ID NO: 1954546 - RNA, 13 nt, Homo sapiens
cauucuacucaaa

SEQ ID NO: 1954547 - RNA, 23 nt, Homo sapiens
uucuggagggaagcaccaugaau

SEQ ID NO: 1954548 - RNA, 20 nt, Homo sapiens
gagugggcgugguaccugcu

SEQ ID NO: 1954549 - RNA, 15 nt, Homo sapiens
aaggaugacacugcc

SEQ ID NO: 1954550 - RNA, 21 nt, Homo sapiens
caugacuucagaguacaucca

SEQ ID NO: 1954551 - RNA, 19 nt, Homo sapiens
aacuucagaugggaggaaa

SEQ ID NO: 1954552 - RNA, 16 nt, Homo sapiens
aucgcaccacugcacu

SEQ ID NO: 1954553 - RNA, 22 nt, Homo sapiens
agugcugccccuugcaagccau

SEQ ID NO: 1954554 - RNA, 15 nt, Homo sapiens
uaaaacucuacagau

SEQ ID NO: 1954555 - RNA, 15 nt, Homo sapiens
agagaucugucauau

SEQ ID NO: 1954556 - RNA, 18 nt, Homo sapiens
cagcccaggccacagcca

SEQ ID NO: 1954557 - RNA, 13 nt, Homo sapiens
aagaaagaaacca

SEQ ID NO: 1954558 - RNA, 15 nt, Homo sapiens
agauuuuaugcacag

SEQ ID NO: 1954559 - RNA, 15 nt, Homo sapiens
agacuugacagugga

SEQ ID NO: 1954560 - RNA, 16 nt, Homo sapiens
ucaguucuaggccuuu

SEQ ID NO: 1954561 - RNA, 23 nt, Homo sapiens
ccucaccucugauagacuuugug

SEQ ID NO: 1954562 - RNA, 19 nt, Homo sapiens
aauauuuuuggcauuccuc

SEQ ID NO: 1954563 - RNA, 18 nt, Homo sapiens
uagagaggacaauacugg

SEQ ID NO: 1954564 - RNA, 14 nt, Homo sapiens
uagcuuaguucuuc

SEQ ID NO: 1954565 - RNA, 14 nt, Homo sapiens
caguucagcuccuu

SEQ ID NO: 1954566 - RNA, 21 nt, Homo sapiens
gaaaagccaaauaaaaaucuu

SEQ ID NO: 1954567 - RNA, 13 nt, Homo sapiens
ccacacugaccac

SEQ ID NO: 1954568 - RNA, 14 nt, Homo sapiens
cgcggccaccucac

SEQ ID NO: 1954569 - RNA, 15 nt, Homo sapiens
aaauccugaugcugu

SEQ ID NO: 1954570 - RNA, 16 nt, Homo sapiens
uccauucuuccuccca

SEQ ID NO: 1954571 - RNA, 19 nt, Homo sapiens
ucccaaagggcacauuucu

SEQ ID NO: 1954572 - RNA, 21 nt, Homo sapiens
cugugauucccuccugcuacu

SEQ ID NO: 1954573 - RNA, 16 nt, Homo sapiens
aacuggaagaaagcaa

SEQ ID NO: 1954574 - RNA, 16 nt, Homo sapiens
gccaacaaacauagaa

SEQ ID NO: 1954575 - RNA, 17 nt, Homo sapiens
gcucuuuugcacaagga

SEQ ID NO: 1954576 - RNA, 20 nt, Homo sapiens
aaggucuuuuuacauuguga

SEQ ID NO: 1954577 - RNA, 13 nt, Homo sapiens
aaagcaaaagcaa

SEQ ID NO: 1954578 - RNA, 21 nt, Homo sapiens
gucuacauacuuucauccuga

SEQ ID NO: 1954579 - RNA, 14 nt, Homo sapiens
ccaguucuuuauaa

SEQ ID NO: 1954580 - RNA, 15 nt, Homo sapiens
gcacugcauguuccu

SEQ ID NO: 1954581 - RNA, 14 nt, Homo sapiens
uucaugucacuaaa

SEQ ID NO: 1954582 - RNA, 19 nt, Homo sapiens
aggguugggcuggugucac

SEQ ID NO: 1954583 - RNA, 17 nt, Homo sapiens
gaagaugaagagaagcu

SEQ ID NO: 1954584 - RNA, 20 nt, Homo sapiens
uggaaaugguuucacuugcu

SEQ ID NO: 1954585 - RNA, 15 nt, Homo sapiens
uccuuccauuccaca

SEQ ID NO: 1954586 - RNA, 20 nt, Homo sapiens
caaacugaacccccucaaaa

SEQ ID NO: 1954587 - RNA, 13 nt, Homo sapiens
aaauaaccacugc

SEQ ID NO: 1954588 - RNA, 13 nt, Homo sapiens
acuucaccaaaga

SEQ ID NO: 1954589 - RNA, 23 nt, Homo sapiens
cacagauuguucuaaaguaaaau

SEQ ID NO: 1954590 - RNA, 18 nt, Homo sapiens
guguauaugaaugaauaa

SEQ ID NO: 1954591 - RNA, 22 nt, Homo sapiens
cuaggauuacaggcaugagcca

SEQ ID NO: 1954592 - RNA, 18 nt, Homo sapiens
caauuucuuuuauguuaa

SEQ ID NO: 1954593 - RNA, 15 nt, Homo sapiens
augcuugacccugaa

SEQ ID NO: 1954594 - RNA, 13 nt, Homo sapiens
ccacugaccucac

SEQ ID NO: 1954595 - RNA, 16 nt, Homo sapiens
ucuccaaauacaagua

SEQ ID NO: 1954596 - RNA, 15 nt, Homo sapiens
aauacaaucagccca

SEQ ID NO: 1954597 - RNA, 16 nt, Homo sapiens
cuuaacucaugaauua

SEQ ID NO: 1954598 - RNA, 21 nt, Homo sapiens
gccgcggcuguugcucaggag

SEQ ID NO: 1954599 - RNA, 21 nt, Homo sapiens
cagauuaaacuucauauguaa

SEQ ID NO: 1954600 - RNA, 14 nt, Homo sapiens
ugaaaggcauguga

SEQ ID NO: 1954601 - RNA, 18 nt, Homo sapiens
uuaccucacuggugcauu

SEQ ID NO: 1954602 - RNA, 16 nt, Homo sapiens
cuggggguggggcucc

SEQ ID NO: 1954603 - RNA, 20 nt, Homo sapiens
aauuacaauugaucugucau

SEQ ID NO: 1954604 - RNA, 18 nt, Homo sapiens
gcaucuugcauuaugcaa

SEQ ID NO: 1954605 - RNA, 21 nt, Homo sapiens
agaggcgcccucccuuccuga

SEQ ID NO: 1954606 - RNA, 17 nt, Homo sapiens
ugggcagcuaaaagcau

SEQ ID NO: 1954607 - RNA, 17 nt, Homo sapiens
ccacuugucacuacaaa

SEQ ID NO: 1954608 - RNA, 19 nt, Homo sapiens
cacuggagaucaccagugu

SEQ ID NO: 1954609 - RNA, 12 nt, Homo sapiens
cauccuggguaa

SEQ ID NO: 1954610 - RNA, 15 nt, Homo sapiens
ggacugaaaagggaa

SEQ ID NO: 1954611 - RNA, 22 nt, Homo sapiens
aaugucccagaggcuagucucu

SEQ ID NO: 1954612 - RNA, 16 nt, Homo sapiens
cagcuugcucuucagu

SEQ ID NO: 1954613 - RNA, 22 nt, Homo sapiens
cagcgaggugggagaggccuca

SEQ ID NO: 1954614 - RNA, 15 nt, Homo sapiens
uuagugagacuagac

SEQ ID NO: 1954615 - RNA, 20 nt, Homo sapiens
guuucauguuuugugacuau

SEQ ID NO: 1954616 - RNA, 14 nt, Homo sapiens
ccagccucagcuca

SEQ ID NO: 1954617 - RNA, 15 nt, Homo sapiens
uggagaacugcugaa

SEQ ID NO: 1954618 - RNA, 21 nt, Homo sapiens
cauccagggguucauuuucau

SEQ ID NO: 1954619 - RNA, 18 nt, Homo sapiens
aguucaauaauccaugaa

SEQ ID NO: 1954620 - RNA, 21 nt, Homo sapiens
aguaccuugcuucuuacugau

SEQ ID NO: 1954621 - RNA, 14 nt, Homo sapiens
gccauugcacucca

SEQ ID NO: 1954622 - RNA, 19 nt, Homo sapiens
uagcauggcuucacacugu

SEQ ID NO: 1954623 - RNA, 15 nt, Homo sapiens
aaauuuuuauguaau

SEQ ID NO: 1954624 - RNA, 14 nt, Homo sapiens
auaaccacauuuaa

SEQ ID NO: 1954625 - RNA, 21 nt, Homo sapiens
uucuuggaucuuuuugcagac

SEQ ID NO: 1954626 - RNA, 22 nt, Homo sapiens
cacacucgcccgcccacugucc

SEQ ID NO: 1954627 - RNA, 14 nt, Homo sapiens
gauauuaacuguca

SEQ ID NO: 1954628 - RNA, 23 nt, Homo sapiens
caggguggcagaacuugaagggu

SEQ ID NO: 1954629 - RNA, 18 nt, Homo sapiens
cacccacucuccugugag

SEQ ID NO: 1954630 - RNA, 13 nt, Homo sapiens
aacuccccuugaa

SEQ ID NO: 1954631 - RNA, 16 nt, Homo sapiens
uaaucuuugagucuaa

SEQ ID NO: 1954632 - RNA, 21 nt, Homo sapiens
acuccugaccccagauucaac

SEQ ID NO: 1954633 - RNA, 21 nt, Homo sapiens
ucccagggccuuaaaagccau

SEQ ID NO: 1954634 - RNA, 22 nt, Homo sapiens
gaaccaggaauauuuccuccau

SEQ ID NO: 1954635 - RNA, 22 nt, Homo sapiens
auaaauggaaugaaauaauuca

SEQ ID NO: 1954636 - RNA, 16 nt, Homo sapiens
cucaagacucaccuca

SEQ ID NO: 1954637 - RNA, 16 nt, Homo sapiens
aauuugcuuagccuuu

SEQ ID NO: 1954638 - RNA, 22 nt, Homo sapiens
uguugaguucuguagagccuuc

SEQ ID NO: 1954639 - RNA, 16 nt, Homo sapiens
cccacugccucagguu

SEQ ID NO: 1954640 - RNA, 17 nt, Homo sapiens
gcagaguuugccuuccu

SEQ ID NO: 1954641 - RNA, 19 nt, Homo sapiens
gggcugugucguagccaag

SEQ ID NO: 1954642 - RNA, 16 nt, Homo sapiens
caacagauguuuuauu

SEQ ID NO: 1954643 - RNA, 14 nt, Homo sapiens
cagcaccugucacc

SEQ ID NO: 1954644 - RNA, 10 nt, Homo sapiens
aagcuuuauu

SEQ ID NO: 1954645 - RNA, 17 nt, Homo sapiens
gggccucaaggacuuga

SEQ ID NO: 1954646 - RNA, 14 nt, Homo sapiens
cuaugcacauaugg

SEQ ID NO: 1954647 - RNA, 15 nt, Homo sapiens
auuacaguguagcua

SEQ ID NO: 1954648 - RNA, 15 nt, Homo sapiens
caaugagcucuucca

SEQ ID NO: 1954649 - RNA, 14 nt, Homo sapiens
cgagucucuucucc

SEQ ID NO: 1954650 - RNA, 19 nt, Homo sapiens
gagccugccaaagugccug

SEQ ID NO: 1954651 - RNA, 15 nt, Homo sapiens
uuuaaaguugcacau

SEQ ID NO: 1954652 - RNA, 15 nt, Homo sapiens
uucaaauuuguacag

SEQ ID NO: 1954653 - RNA, 20 nt, Homo sapiens
aaucuuucagccugcuucuu

SEQ ID NO: 1954654 - RNA, 23 nt, Homo sapiens
gggaccucccagcgaccacugca

SEQ ID NO: 1954655 - RNA, 15 nt, Homo sapiens
auccuuccaaagaau

SEQ ID NO: 1954656 - RNA, 12 nt, Homo sapiens
aacauacaagag

SEQ ID NO: 1954657 - RNA, 17 nt, Homo sapiens
caguuucugagucuggg

SEQ ID NO: 1954658 - RNA, 22 nt, Homo sapiens
uacaggugugagccaccgugcc

SEQ ID NO: 1954659 - RNA, 19 nt, Homo sapiens
ccaacuagcucuauguuua

SEQ ID NO: 1954660 - RNA, 15 nt, Homo sapiens
ucccacccagcuaaa

SEQ ID NO: 1954661 - RNA, 15 nt, Homo sapiens
uggcagugccugaac

SEQ ID NO: 1954662 - RNA, 17 nt, Homo sapiens
cagucgaggcugguaag

SEQ ID NO: 1954663 - RNA, 19 nt, Homo sapiens
accacuaugcaauauauca

SEQ ID NO: 1954664 - RNA, 11 nt, Homo sapiens
uuacucaaagu

SEQ ID NO: 1954665 - RNA, 15 nt, Homo sapiens
acugggaaucucaua

SEQ ID NO: 1954666 - RNA, 17 nt, Homo sapiens
ccaagaaaauugccuuu

SEQ ID NO: 1954667 - RNA, 20 nt, Homo sapiens
uacaaccuaaaaaauuccua

SEQ ID NO: 1954668 - RNA, 19 nt, Homo sapiens
uuucucagauggauugaua

SEQ ID NO: 1954669 - RNA, 16 nt, Homo sapiens
cacgagcugcugucca

SEQ ID NO: 1954670 - RNA, 12 nt, Homo sapiens
caaaacauuugu

SEQ ID NO: 1954671 - RNA, 12 nt, Homo sapiens
caguacauuuaa

SEQ ID NO: 1954672 - RNA, 18 nt, Homo sapiens
cccaaguuggagugcagu

SEQ ID NO: 1954673 - RNA, 12 nt, Homo sapiens
uacugcuucauu

SEQ ID NO: 1954674 - RNA, 15 nt, Homo sapiens
ugggguacccggggg

SEQ ID NO: 1954675 - RNA, 18 nt, Homo sapiens
cucguagaaacaagacaa

SEQ ID NO: 1954676 - RNA, 16 nt, Homo sapiens
ucauccagaacugucu

SEQ ID NO: 1954677 - RNA, 20 nt, Homo sapiens
guuucuauucuaaguaauuc

SEQ ID NO: 1954678 - RNA, 14 nt, Homo sapiens
ugaagugaaucuga

SEQ ID NO: 1954679 - RNA, 15 nt, Homo sapiens
agaggagucugggaa

SEQ ID NO: 1954680 - RNA, 15 nt, Homo sapiens
auacauguaauucua

SEQ ID NO: 1954681 - RNA, 13 nt, Homo sapiens
aaugugcacucuc

SEQ ID NO: 1954682 - RNA, 21 nt, Homo sapiens
cuucgcgcuggaauccagaag

SEQ ID NO: 1954683 - RNA, 21 nt, Homo sapiens
auuuucaucaggggccugcag

SEQ ID NO: 1954684 - RNA, 18 nt, Homo sapiens
ggugcaaauccuacugaa

SEQ ID NO: 1954685 - RNA, 23 nt, Homo sapiens
cccagcucuacuccaggcuucca

SEQ ID NO: 1954686 - RNA, 15 nt, Homo sapiens
accaaagugauaaau

SEQ ID NO: 1954687 - RNA, 15 nt, Homo sapiens
ugagaaugugcuuug

SEQ ID NO: 1954688 - RNA, 15 nt, Homo sapiens
cugggggacacugug

SEQ ID NO: 1954689 - RNA, 14 nt, Homo sapiens
caucccaagccaga

SEQ ID NO: 1954690 - RNA, 19 nt, Homo sapiens
accuuccuuccucuugcag

SEQ ID NO: 1954691 - RNA, 19 nt, Homo sapiens
aggccucucaccucugugc

SEQ ID NO: 1954692 - RNA, 16 nt, Homo sapiens
uccuccgucugcaaug

SEQ ID NO: 1954693 - RNA, 13 nt, Homo sapiens
cuuguuagauuca

SEQ ID NO: 1954694 - RNA, 16 nt, Homo sapiens
uuaaggcccucauucu

SEQ ID NO: 1954695 - RNA, 18 nt, Homo sapiens
agucuccuacgcaccauu

SEQ ID NO: 1954696 - RNA, 17 nt, Homo sapiens
gccacuguguacugugg

SEQ ID NO: 1954697 - RNA, 14 nt, Homo sapiens
ccagcugcaaagga

SEQ ID NO: 1954698 - RNA, 13 nt, Homo sapiens
augaaauaauuca

SEQ ID NO: 1954699 - RNA, 17 nt, Homo sapiens
cgcucuguggaugccag

SEQ ID NO: 1954700 - RNA, 20 nt, Homo sapiens
uucucaauguucuuuuccaa

SEQ ID NO: 1954701 - RNA, 17 nt, Homo sapiens
agugaggugacacucca

SEQ ID NO: 1954702 - RNA, 20 nt, Homo sapiens
cuggguugaucuagaugucu

SEQ ID NO: 1954703 - RNA, 23 nt, Homo sapiens
accauuugauagggaacugggga

SEQ ID NO: 1954704 - RNA, 19 nt, Homo sapiens
ugagagggcugcugaccau

SEQ ID NO: 1954705 - RNA, 16 nt, Homo sapiens
uaaauuuaacugcaua

SEQ ID NO: 1954706 - RNA, 15 nt, Homo sapiens
aaauguuuagugaaa

SEQ ID NO: 1954707 - RNA, 21 nt, Homo sapiens
uuugaauuuagcaaccuagaa

SEQ ID NO: 1954708 - RNA, 12 nt, Homo sapiens
auaauaauagca

SEQ ID NO: 1954709 - RNA, 19 nt, Homo sapiens
gcaagcccgucaucuuccc

SEQ ID NO: 1954710 - RNA, 13 nt, Homo sapiens
uguccuccagaaa

SEQ ID NO: 1954711 - RNA, 21 nt, Homo sapiens
uccugccuugaaaaagacauu

SEQ ID NO: 1954712 - RNA, 13 nt, Homo sapiens
aggggaugaugac

SEQ ID NO: 1954713 - RNA, 16 nt, Homo sapiens
aaaaggauaagugaac

SEQ ID NO: 1954714 - RNA, 20 nt, Homo sapiens
gcaaccuccuuaucugcuaa

SEQ ID NO: 1954715 - RNA, 20 nt, Homo sapiens
cagagcggguaaagugcaau

SEQ ID NO: 1954716 - RNA, 13 nt, Homo sapiens
gacaacugugaag

SEQ ID NO: 1954717 - RNA, 14 nt, Homo sapiens
gacaaaugccaaau

SEQ ID NO: 1954718 - RNA, 20 nt, Homo sapiens
aauagcauuguaaaagcauu

SEQ ID NO: 1954719 - RNA, 17 nt, Homo sapiens
uaaacugcccugucuag

SEQ ID NO: 1954720 - RNA, 21 nt, Homo sapiens
gugcccaccagcggccuugaa

SEQ ID NO: 1954721 - RNA, 19 nt, Homo sapiens
aauuaucccuuacagacuu

SEQ ID NO: 1954722 - RNA, 19 nt, Homo sapiens
acugucacauaaugcucau

SEQ ID NO: 1954723 - RNA, 17 nt, Homo sapiens
aguuuccucaggcugcu

SEQ ID NO: 1954724 - RNA, 20 nt, Homo sapiens
cuacugcuagauaucacuua

SEQ ID NO: 1954725 - RNA, 14 nt, Homo sapiens
uauuucauaucuau

SEQ ID NO: 1954726 - RNA, 19 nt, Homo sapiens
caggugugagccaccacac

SEQ ID NO: 1954727 - RNA, 17 nt, Homo sapiens
ggauuuucacagaggaa

SEQ ID NO: 1954728 - RNA, 17 nt, Homo sapiens
acaauaacuuugaaccu

SEQ ID NO: 1954729 - RNA, 22 nt, Homo sapiens
guuguugagguuugaaaagcug

SEQ ID NO: 1954730 - RNA, 21 nt, Homo sapiens
cauugaggauaaauugccaua

SEQ ID NO: 1954731 - RNA, 12 nt, Homo sapiens
cgcgacuuccac

SEQ ID NO: 1954732 - RNA, 22 nt, Homo sapiens
cuuuugucacacuagcauagag

SEQ ID NO: 1954733 - RNA, 16 nt, Homo sapiens
ggacaaccaccaggug

SEQ ID NO: 1954734 - RNA, 13 nt, Homo sapiens
gucuagagucuca

SEQ ID NO: 1954735 - RNA, 21 nt, Homo sapiens
gagagaagggacacauucaac

SEQ ID NO: 1954736 - RNA, 14 nt, Homo sapiens
aaucucacauucau

SEQ ID NO: 1954737 - RNA, 22 nt, Homo sapiens
guccauccuccucuccaugcaa

SEQ ID NO: 1954738 - RNA, 23 nt, Homo sapiens
cacaccgauguacacacacagau

SEQ ID NO: 1954739 - RNA, 23 nt, Homo sapiens
uugaaggggcaacccaaggcauc

SEQ ID NO: 1954740 - RNA, 18 nt, Homo sapiens
uauguugauacuagcaua

SEQ ID NO: 1954741 - RNA, 17 nt, Homo sapiens
aguuugcuuuguaugca

SEQ ID NO: 1954742 - RNA, 21 nt, Homo sapiens
ucccuccuuuggaaugcugua

SEQ ID NO: 1954743 - RNA, 14 nt, Homo sapiens
cuccugaacccuau

SEQ ID NO: 1954744 - RNA, 20 nt, Homo sapiens
uagauuucgaagccacagag

SEQ ID NO: 1954745 - RNA, 17 nt, Homo sapiens
aaagacauuuguuggga

SEQ ID NO: 1954746 - RNA, 13 nt, Homo sapiens
cagauggagacau

SEQ ID NO: 1954747 - RNA, 13 nt, Homo sapiens
cagagggagacag

SEQ ID NO: 1954748 - RNA, 18 nt, Homo sapiens
ugggggccaggacaccag

SEQ ID NO: 1954749 - RNA, 20 nt, Homo sapiens
cagaucaacugaguucagga

SEQ ID NO: 1954750 - RNA, 16 nt, Homo sapiens
uauucauagcuguaua

SEQ ID NO: 1954751 - RNA, 20 nt, Homo sapiens
aucaucaucgaagucuuccc

SEQ ID NO: 1954752 - RNA, 14 nt, Homo sapiens
gaguggaaggugag

SEQ ID NO: 1954753 - RNA, 20 nt, Homo sapiens
cauagagaauacacauauaa

SEQ ID NO: 1954754 - RNA, 21 nt, Homo sapiens
cuauccuccccuuuuaccacu

SEQ ID NO: 1954755 - RNA, 19 nt, Homo sapiens
gccaccuccccaggccgug

SEQ ID NO: 1954756 - RNA, 20 nt, Homo sapiens
ucccuugcuguaugcugauc

SEQ ID NO: 1954757 - RNA, 17 nt, Homo sapiens
cuguucuuuugcaauaa

SEQ ID NO: 1954758 - RNA, 21 nt, Homo sapiens
gaggaaaaaacccagccccac

SEQ ID NO: 1954759 - RNA, 15 nt, Homo sapiens
acguuucacugcaaa

SEQ ID NO: 1954760 - RNA, 20 nt, Homo sapiens
uguaaucccagcauuuuggg

SEQ ID NO: 1954761 - RNA, 14 nt, Homo sapiens
uaagggcagugccc

SEQ ID NO: 1954762 - RNA, 14 nt, Homo sapiens
ugaaucugcuuuaa

SEQ ID NO: 1954763 - RNA, 14 nt, Homo sapiens
ugcugaauaugcaa

SEQ ID NO: 1954764 - RNA, 21 nt, Homo sapiens
ucuuuaaaaaaacacauaauu

SEQ ID NO: 1954765 - RNA, 15 nt, Homo sapiens
aacuugaacugauuc

SEQ ID NO: 1954766 - RNA, 18 nt, Homo sapiens
cggucagaagcaccaaga

SEQ ID NO: 1954767 - RNA, 19 nt, Homo sapiens
ccaucgccuccaucagcca

SEQ ID NO: 1954768 - RNA, 21 nt, Homo sapiens
cucuccccagagcauuugaua

SEQ ID NO: 1954769 - RNA, 16 nt, Homo sapiens
acaaaucaaacacaac

SEQ ID NO: 1954770 - RNA, 19 nt, Homo sapiens
uucuuuucuaaaugccaau

SEQ ID NO: 1954771 - RNA, 23 nt, Homo sapiens
uccacagcugcccuggcugugau

SEQ ID NO: 1954772 - RNA, 19 nt, Homo sapiens
cgaaguguuuauguaauag

SEQ ID NO: 1954773 - RNA, 20 nt, Homo sapiens
augauacugcugcuugucaa

SEQ ID NO: 1954774 - RNA, 21 nt, Homo sapiens
uuguuacccauuugaaagaau

SEQ ID NO: 1954775 - RNA, 15 nt, Homo sapiens
aucaaaagugaucag

SEQ ID NO: 1954776 - RNA, 17 nt, Homo sapiens
cccuucucuucuaacau

SEQ ID NO: 1954777 - RNA, 16 nt, Homo sapiens
acauaucuaguaugaa

SEQ ID NO: 1954778 - RNA, 20 nt, Homo sapiens
uuaauacgcaggcaucugau

SEQ ID NO: 1954779 - RNA, 21 nt, Homo sapiens
gacaccuagaaaggaacugca

SEQ ID NO: 1954780 - RNA, 16 nt, Homo sapiens
acugagcauuugcacc

SEQ ID NO: 1954781 - RNA, 14 nt, Homo sapiens
acuguaacuacuuc

SEQ ID NO: 1954782 - RNA, 14 nt, Homo sapiens
acugacacuacuaa

SEQ ID NO: 1954783 - RNA, 22 nt, Homo sapiens
uuaauaaaaaugacagacugaa

SEQ ID NO: 1954784 - RNA, 18 nt, Homo sapiens
ugagugacggaccagcuc

SEQ ID NO: 1954785 - RNA, 19 nt, Homo sapiens
cgcucuucccccaugugcc

SEQ ID NO: 1954786 - RNA, 23 nt, Homo sapiens
uuuucaauguuagccacagugua

SEQ ID NO: 1954787 - RNA, 17 nt, Homo sapiens
uacuugcaagccucaaa

SEQ ID NO: 1954788 - RNA, 17 nt, Homo sapiens
cuggaggggcaguggag

SEQ ID NO: 1954789 - RNA, 18 nt, Homo sapiens
uaaaguacuaaaucucac

SEQ ID NO: 1954790 - RNA, 21 nt, Homo sapiens
augaguuugccauguugagca

SEQ ID NO: 1954791 - RNA, 19 nt, Homo sapiens
ugcaggagcaguuugccac

SEQ ID NO: 1954792 - RNA, 11 nt, Homo sapiens
accugaacaaa

SEQ ID NO: 1954793 - RNA, 19 nt, Homo sapiens
gacauaagcaaagacuaug

SEQ ID NO: 1954794 - RNA, 16 nt, Homo sapiens
cgcacuuuccacugga

SEQ ID NO: 1954795 - RNA, 21 nt, Homo sapiens
aaguccuuggacuguuuugaa

SEQ ID NO: 1954796 - RNA, 11 nt, Homo sapiens
aaacacagccu

SEQ ID NO: 1954797 - RNA, 20 nt, Homo sapiens
ugcuccccagugcuaccucu

SEQ ID NO: 1954798 - RNA, 16 nt, Homo sapiens
caaaaaaagagaacac

SEQ ID NO: 1954799 - RNA, 15 nt, Homo sapiens
gaacgaagccaccuu

SEQ ID NO: 1954800 - RNA, 17 nt, Homo sapiens
uuuaacuuucuaaugau

SEQ ID NO: 1954801 - RNA, 16 nt, Homo sapiens
ccucagucccaacucc

SEQ ID NO: 1954802 - RNA, 14 nt, Homo sapiens
ucacauacauaagc

SEQ ID NO: 1954803 - RNA, 20 nt, Homo sapiens
ccuguuacaaagcuguguug

SEQ ID NO: 1954804 - RNA, 18 nt, Homo sapiens
ugcaauccuuccaaauga

SEQ ID NO: 1954805 - RNA, 19 nt, Homo sapiens
gucaccugcucacagggau

SEQ ID NO: 1954806 - RNA, 16 nt, Homo sapiens
cucagacucauuguaa

SEQ ID NO: 1954807 - RNA, 14 nt, Homo sapiens
uugaaaccagaaga

SEQ ID NO: 1954808 - RNA, 12 nt, Homo sapiens
uggcaguugcau

SEQ ID NO: 1954809 - RNA, 15 nt, Homo sapiens
uucagagagcuggua

SEQ ID NO: 1954810 - RNA, 16 nt, Homo sapiens
aagagcccugagcuca

SEQ ID NO: 1954811 - RNA, 18 nt, Homo sapiens
gggcugcugggagccucu

SEQ ID NO: 1954812 - RNA, 16 nt, Homo sapiens
uacaguggaauuguga

SEQ ID NO: 1954813 - RNA, 15 nt, Homo sapiens
aucuaccaagaacag

SEQ ID NO: 1954814 - RNA, 19 nt, Homo sapiens
caggcuggcccccacccac

SEQ ID NO: 1954815 - RNA, 19 nt, Homo sapiens
acccaguaacucaucuguc

SEQ ID NO: 1954816 - RNA, 13 nt, Homo sapiens
aaacuugaucaca

SEQ ID NO: 1954817 - RNA, 20 nt, Homo sapiens
agaccugcgauggacuucac

SEQ ID NO: 1954818 - RNA, 16 nt, Homo sapiens
cuggcuuaaacaacac

SEQ ID NO: 1954819 - RNA, 21 nt, Homo sapiens
uauaaaauauguacauaauau

SEQ ID NO: 1954820 - RNA, 18 nt, Homo sapiens
ugcagaauaaugacugac

SEQ ID NO: 1954821 - RNA, 16 nt, Homo sapiens
ugggcaccucagaaag

SEQ ID NO: 1954822 - RNA, 23 nt, Homo sapiens
acugaaugaccacuugauaugac

SEQ ID NO: 1954823 - RNA, 18 nt, Homo sapiens
cuugcucuucaucauaua

SEQ ID NO: 1954824 - RNA, 13 nt, Homo sapiens
agugcugcucuag

SEQ ID NO: 1954825 - RNA, 21 nt, Homo sapiens
uucaagaaagauaucuaugac

SEQ ID NO: 1954826 - RNA, 13 nt, Homo sapiens
ccuccccauugca

SEQ ID NO: 1954827 - RNA, 23 nt, Homo sapiens
acauuauagauuuucauguucuu

SEQ ID NO: 1954828 - RNA, 13 nt, Homo sapiens
cugauaaacacaa

SEQ ID NO: 1954829 - RNA, 13 nt, Homo sapiens
uagcaaaauuccu

SEQ ID NO: 1954830 - RNA, 19 nt, Homo sapiens
gcgugguggcgggcaccua

SEQ ID NO: 1954831 - RNA, 17 nt, Homo sapiens
gcgggcaccuguagucc

SEQ ID NO: 1954832 - RNA, 23 nt, Homo sapiens
acacgcgugauugguaacugccu

SEQ ID NO: 1954833 - RNA, 15 nt, Homo sapiens
ucacaugguuacaua

SEQ ID NO: 1954834 - RNA, 15 nt, Homo sapiens
ugcucaggaaaccac

SEQ ID NO: 1954835 - RNA, 21 nt, Homo sapiens
cauaaugcucauacuuaucua

SEQ ID NO: 1954836 - RNA, 20 nt, Homo sapiens
cugucauccucaggaaccaa

SEQ ID NO: 1954837 - RNA, 22 nt, Homo sapiens
auauaccuggcuuuuacuuuau

SEQ ID NO: 1954838 - RNA, 17 nt, Homo sapiens
gugucuuacgugccacc

SEQ ID NO: 1954839 - RNA, 15 nt, Homo sapiens
ccuaaaucacuuuga

SEQ ID NO: 1954840 - RNA, 19 nt, Homo sapiens
aaacguggcaggacuucca

SEQ ID NO: 1954841 - RNA, 16 nt, Homo sapiens
aaaauuacaacagaua

SEQ ID NO: 1954842 - RNA, 16 nt, Homo sapiens
caggcugccugagucg

SEQ ID NO: 1954843 - RNA, 19 nt, Homo sapiens
caaaaaaaccucuaugcaa

SEQ ID NO: 1954844 - RNA, 20 nt, Homo sapiens
aggaaaccuggcauggugcu

SEQ ID NO: 1954845 - RNA, 14 nt, Homo sapiens
gauccagcccaaac

SEQ ID NO: 1954846 - RNA, 21 nt, Homo sapiens
gagucucaugcaagacuucac

SEQ ID NO: 1954847 - RNA, 21 nt, Homo sapiens
aaaacuaauguacuguacaua

SEQ ID NO: 1954848 - RNA, 13 nt, Homo sapiens
acaaugugacuuu

SEQ ID NO: 1954849 - RNA, 13 nt, Homo sapiens
cauaagugcaaua

SEQ ID NO: 1954850 - RNA, 15 nt, Homo sapiens
gucuucccugcuuca

SEQ ID NO: 1954851 - RNA, 17 nt, Homo sapiens
gccaccaaagcugccca

SEQ ID NO: 1954852 - RNA, 20 nt, Homo sapiens
gcuccugugcucacccucuc

SEQ ID NO: 1954853 - RNA, 22 nt, Homo sapiens
gcaacaguacuucaaacagaac

SEQ ID NO: 1954854 - RNA, 20 nt, Homo sapiens
gauuagucucuucuguguga

SEQ ID NO: 1954855 - RNA, 23 nt, Homo sapiens
agaaagugacaugcauucacaua

SEQ ID NO: 1954856 - RNA, 22 nt, Homo sapiens
ugacagagcgagacuccaucuc

SEQ ID NO: 1954857 - RNA, 22 nt, Homo sapiens
caggugugugggccaccgugcc

SEQ ID NO: 1954858 - RNA, 18 nt, Homo sapiens
aggucccaccuccauuug

SEQ ID NO: 1954859 - RNA, 16 nt, Homo sapiens
augaggggccacugac

SEQ ID NO: 1954860 - RNA, 21 nt, Homo sapiens
aagauuugagcacaaaggcaa

SEQ ID NO: 1954861 - RNA, 18 nt, Homo sapiens
ggugccgcuuucucugag

SEQ ID NO: 1954862 - RNA, 17 nt, Homo sapiens
aaagauauaaggggaaa

SEQ ID NO: 1954863 - RNA, 18 nt, Homo sapiens
ccugauccugacacauuc

SEQ ID NO: 1954864 - RNA, 14 nt, Homo sapiens
aaucagcaucgugg

SEQ ID NO: 1954865 - RNA, 19 nt, Homo sapiens
aaccaguauuuuugcugcu

SEQ ID NO: 1954866 - RNA, 12 nt, Homo sapiens
auacacaugcac

SEQ ID NO: 1954867 - RNA, 12 nt, Homo sapiens
gcacacauauac

SEQ ID NO: 1954868 - RNA, 16 nt, Homo sapiens
caaaacugaaccacaa

SEQ ID NO: 1954869 - RNA, 18 nt, Homo sapiens
cuaaucaauaccuacaag

SEQ ID NO: 1954870 - RNA, 13 nt, Homo sapiens
uucuaccugcccu

SEQ ID NO: 1954871 - RNA, 20 nt, Homo sapiens
ugagaccccuucucaaaaaa

SEQ ID NO: 1954872 - RNA, 20 nt, Homo sapiens
gaagggggcggccuaugacu

SEQ ID NO: 1954873 - RNA, 14 nt, Homo sapiens
uucuccugugaaug

SEQ ID NO: 1954874 - RNA, 22 nt, Homo sapiens
gcuggcgggcccuggagcucaa

SEQ ID NO: 1954875 - RNA, 21 nt, Homo sapiens
caagcaauucuccugccucag

SEQ ID NO: 1954876 - RNA, 16 nt, Homo sapiens
guuaaggaaaacugag

SEQ ID NO: 1954877 - RNA, 14 nt, Homo sapiens
cuguaaauaaccua

SEQ ID NO: 1954878 - RNA, 13 nt, Homo sapiens
cucccaagcugcc

SEQ ID NO: 1954879 - RNA, 18 nt, Homo sapiens
cauuuugccacuggaaca

SEQ ID NO: 1954880 - RNA, 16 nt, Homo sapiens
cuggcagcccgcauca

SEQ ID NO: 1954881 - RNA, 15 nt, Homo sapiens
uuccucacaguccca

SEQ ID NO: 1954882 - RNA, 16 nt, Homo sapiens
aaagagaauauuuaca

SEQ ID NO: 1954883 - RNA, 15 nt, Homo sapiens
cuuucuuuccauuua

SEQ ID NO: 1954884 - RNA, 14 nt, Homo sapiens
uaaaauaugcacua

SEQ ID NO: 1954885 - RNA, 17 nt, Homo sapiens
agaaacacguggucaug

SEQ ID NO: 1954886 - RNA, 22 nt, Homo sapiens
uugggaggcugaggcaagagaa

SEQ ID NO: 1954887 - RNA, 22 nt, Homo sapiens
ugcuuccuucucaucuugccuc

SEQ ID NO: 1954888 - RNA, 22 nt, Homo sapiens
uguggggaaguuaggaacuggu

SEQ ID NO: 1954889 - RNA, 14 nt, Homo sapiens
agcugggagcacag

SEQ ID NO: 1954890 - RNA, 24 nt, Homo sapiens
ugaacaaccugcucacaguccuca

SEQ ID NO: 1954891 - RNA, 12 nt, Homo sapiens
auggacuuguau

SEQ ID NO: 1954892 - RNA, 14 nt, Homo sapiens
aaacaguaagaaau

SEQ ID NO: 1954893 - RNA, 13 nt, Homo sapiens
uaccaugcugcuu

SEQ ID NO: 1954894 - RNA, 22 nt, Homo sapiens
acauucucccuugauuccacuu

SEQ ID NO: 1954895 - RNA, 19 nt, Homo sapiens
gacagacccaggguggucu

SEQ ID NO: 1954896 - RNA, 15 nt, Homo sapiens
caggguccugugccu

SEQ ID NO: 1954897 - RNA, 15 nt, Homo sapiens
agacacaaggugauu

SEQ ID NO: 1954898 - RNA, 21 nt, Homo sapiens
ugucucagaugaggagggaga

SEQ ID NO: 1954899 - RNA, 22 nt, Homo sapiens
cauaaugcuaaauaaaacugug

SEQ ID NO: 1954900 - RNA, 18 nt, Homo sapiens
acuccuaugaucucaggu

SEQ ID NO: 1954901 - RNA, 19 nt, Homo sapiens
gaaauuuuggugaaugugg

SEQ ID NO: 1954902 - RNA, 14 nt, Homo sapiens
acuucucuacccca

SEQ ID NO: 1954903 - RNA, 22 nt, Homo sapiens
ucagaauuucuuugucauucaa

SEQ ID NO: 1954904 - RNA, 22 nt, Homo sapiens
cagggaauccagccaugacccc

SEQ ID NO: 1954905 - RNA, 14 nt, Homo sapiens
auguauauucccac

SEQ ID NO: 1954906 - RNA, 23 nt, Homo sapiens
cugcuguuguugaaauugauguu

SEQ ID NO: 1954907 - RNA, 23 nt, Homo sapiens
gagacugucucaaaaaaacaaaa

SEQ ID NO: 1954908 - RNA, 19 nt, Homo sapiens
aggucauugcaccuaucuc

SEQ ID NO: 1954909 - RNA, 16 nt, Homo sapiens
aaguaauuucuucuca

SEQ ID NO: 1954910 - RNA, 18 nt, Homo sapiens
acucaggccucugcagaa

SEQ ID NO: 1954911 - RNA, 19 nt, Homo sapiens
augaucaaaaccugugcca

SEQ ID NO: 1954912 - RNA, 19 nt, Homo sapiens
aucaauaaacagcagguga

SEQ ID NO: 1954913 - RNA, 23 nt, Homo sapiens
cucaguccaguccucacaugccc

SEQ ID NO: 1954914 - RNA, 14 nt, Homo sapiens
gcagccucaucauu

SEQ ID NO: 1954915 - RNA, 17 nt, Homo sapiens
augugcaaguguaugca

SEQ ID NO: 1954916 - RNA, 20 nt, Homo sapiens
ugucccuuuuugcaggggac

SEQ ID NO: 1954917 - RNA, 19 nt, Homo sapiens
ugguaacugcuuucuguuc

SEQ ID NO: 1954918 - RNA, 22 nt, Homo sapiens
ucagaagacacugaugggcaac

SEQ ID NO: 1954919 - RNA, 22 nt, Homo sapiens
uaggugggggaacacugagaaa

SEQ ID NO: 1954920 - RNA, 21 nt, Homo sapiens
uucucaucuucuuauuuucca

SEQ ID NO: 1954921 - RNA, 20 nt, Homo sapiens
cuacaaacguuugacaaaca

SEQ ID NO: 1954922 - RNA, 22 nt, Homo sapiens
gccaugggaccuccucccucau

SEQ ID NO: 1954923 - RNA, 23 nt, Homo sapiens
agcacugcaccccaggcagccac

SEQ ID NO: 1954924 - RNA, 16 nt, Homo sapiens
cuuauugaucccacau

SEQ ID NO: 1954925 - RNA, 19 nt, Homo sapiens
aggccagaauaauuggcau

SEQ ID NO: 1954926 - RNA, 16 nt, Homo sapiens
uguucccugaggaccu

SEQ ID NO: 1954927 - RNA, 18 nt, Homo sapiens
cuuuuaauuagugaaaau

SEQ ID NO: 1954928 - RNA, 18 nt, Homo sapiens
uauaucaaaugagcaucu

SEQ ID NO: 1954929 - RNA, 21 nt, Homo sapiens
cucuuccuggaaugcauucac

SEQ ID NO: 1954930 - RNA, 13 nt, Homo sapiens
cucccagcuguac

SEQ ID NO: 1954931 - RNA, 18 nt, Homo sapiens
cacuaccauuguacccug

SEQ ID NO: 1954932 - RNA, 16 nt, Homo sapiens
cugaaaauauaaccag

SEQ ID NO: 1954933 - RNA, 16 nt, Homo sapiens
cagaaaagaaaaccau

SEQ ID NO: 1954934 - RNA, 23 nt, Homo sapiens
uccagacccagccaugcugugau

SEQ ID NO: 1954935 - RNA, 21 nt, Homo sapiens
ucauucucugucucauccauc

SEQ ID NO: 1954936 - RNA, 14 nt, Homo sapiens
cugccacccacuca

SEQ ID NO: 1954937 - RNA, 23 nt, Homo sapiens
uugcuuccugauuaccagucuga

SEQ ID NO: 1954938 - RNA, 20 nt, Homo sapiens
ucccugggggcauccugcuu

SEQ ID NO: 1954939 - RNA, 16 nt, Homo sapiens
uaacuuggcugcauuu

SEQ ID NO: 1954940 - RNA, 15 nt, Homo sapiens
cuacauauaugcaau

SEQ ID NO: 1954941 - RNA, 13 nt, Homo sapiens
gccccagugaccg

SEQ ID NO: 1954942 - RNA, 17 nt, Homo sapiens
accugcaagccuucuaa

SEQ ID NO: 1954943 - RNA, 16 nt, Homo sapiens
aacucagacauuccaa

SEQ ID NO: 1954944 - RNA, 23 nt, Homo sapiens
aggauuauaaaugaaauuugcaa

SEQ ID NO: 1954945 - RNA, 13 nt, Homo sapiens
aaauacuggugca

SEQ ID NO: 1954946 - RNA, 13 nt, Homo sapiens
cauaacaauuccu

SEQ ID NO: 1954947 - RNA, 14 nt, Homo sapiens
accaugcauuucuc

SEQ ID NO: 1954948 - RNA, 16 nt, Homo sapiens
caaagugguacaggaa

SEQ ID NO: 1954949 - RNA, 14 nt, Homo sapiens
agggaagggagcag

SEQ ID NO: 1954950 - RNA, 17 nt, Homo sapiens
aggaauuucugcucugg

SEQ ID NO: 1954951 - RNA, 15 nt, Homo sapiens
gacccugggaccaca

SEQ ID NO: 1954952 - RNA, 17 nt, Homo sapiens
gcauuuggcaacccaag

SEQ ID NO: 1954953 - RNA, 22 nt, Homo sapiens
acuaucccaaucaaagaauuac

SEQ ID NO: 1954954 - RNA, 18 nt, Homo sapiens
gucuucuccuaauucugc

SEQ ID NO: 1954955 - RNA, 20 nt, Homo sapiens
gccaccagcuccacuggccu

SEQ ID NO: 1954956 - RNA, 14 nt, Homo sapiens
gagguuaggaguag

SEQ ID NO: 1954957 - RNA, 16 nt, Homo sapiens
gcuccaccgucagggg

SEQ ID NO: 1954958 - RNA, 20 nt, Homo sapiens
ccacagcagacaccauucau

SEQ ID NO: 1954959 - RNA, 17 nt, Homo sapiens
aaccuacgcacauaccu

SEQ ID NO: 1954960 - RNA, 21 nt, Homo sapiens
ugucuuuccacuccuccuagc

SEQ ID NO: 1954961 - RNA, 19 nt, Homo sapiens
accaaauagcaauacaaac

SEQ ID NO: 1954962 - RNA, 11 nt, Homo sapiens
ucuggcuuuac

SEQ ID NO: 1954963 - RNA, 19 nt, Homo sapiens
agauaaaaaucauauagac

SEQ ID NO: 1954964 - RNA, 19 nt, Homo sapiens
gugguacaaucuggcucac

SEQ ID NO: 1954965 - RNA, 16 nt, Homo sapiens
caaaaaucaauaugca

SEQ ID NO: 1954966 - RNA, 14 nt, Homo sapiens
ucauggagaccuca

SEQ ID NO: 1954967 - RNA, 15 nt, Homo sapiens
auugcagagucugua

SEQ ID NO: 1954968 - RNA, 18 nt, Homo sapiens
cacucuguauugaaaaug

SEQ ID NO: 1954969 - RNA, 18 nt, Homo sapiens
auaaauucagaacaagca

SEQ ID NO: 1954970 - RNA, 21 nt, Homo sapiens
cuaauucuuugcaaaaaucca

SEQ ID NO: 1954971 - RNA, 15 nt, Homo sapiens
gggccugcccagaca

SEQ ID NO: 1954972 - RNA, 12 nt, Homo sapiens
uauuacugaugu

SEQ ID NO: 1954973 - RNA, 15 nt, Homo sapiens
cuguugggaaccaga

SEQ ID NO: 1954974 - RNA, 18 nt, Homo sapiens
gagaguccugguccucag

SEQ ID NO: 1954975 - RNA, 13 nt, Homo sapiens
gcuucagugcugc

SEQ ID NO: 1954976 - RNA, 19 nt, Homo sapiens
ugggcugugggcaagccua

SEQ ID NO: 1954977 - RNA, 15 nt, Homo sapiens
cagccccaggaccaa

SEQ ID NO: 1954978 - RNA, 21 nt, Homo sapiens
cuuauccuccaccgucuuucu

SEQ ID NO: 1954979 - RNA, 12 nt, Homo sapiens
gggcacugucau

SEQ ID NO: 1954980 - RNA, 21 nt, Homo sapiens
ggcuauuuuucccccugcauu

SEQ ID NO: 1954981 - RNA, 18 nt, Homo sapiens
ccgccuccaaaugccaac

SEQ ID NO: 1954982 - RNA, 21 nt, Homo sapiens
gaguuaccacuuuccacuccc

SEQ ID NO: 1954983 - RNA, 21 nt, Homo sapiens
ccccaaugaccuuagccccau

SEQ ID NO: 1954984 - RNA, 22 nt, Homo sapiens
acagagauuggagagaagggca

SEQ ID NO: 1954985 - RNA, 17 nt, Homo sapiens
auagcccaucuuccuga

SEQ ID NO: 1954986 - RNA, 14 nt, Homo sapiens
cugaguaguggcca

SEQ ID NO: 1954987 - RNA, 18 nt, Homo sapiens
cagaaugcuagcucugag

SEQ ID NO: 1954988 - RNA, 19 nt, Homo sapiens
agaaauacaguacuguuuc

SEQ ID NO: 1954989 - RNA, 22 nt, Homo sapiens
gaggagcaggugucccugagaa

SEQ ID NO: 1954990 - RNA, 18 nt, Homo sapiens
cagggucaguuccugaag

SEQ ID NO: 1954991 - RNA, 16 nt, Homo sapiens
accuauaagaagccuu

SEQ ID NO: 1954992 - RNA, 17 nt, Homo sapiens
ccagagcugggugagug

SEQ ID NO: 1954993 - RNA, 20 nt, Homo sapiens
uaucuggaggccuuccagcu

SEQ ID NO: 1954994 - RNA, 15 nt, Homo sapiens
ucugcuggauucuaa

SEQ ID NO: 1954995 - RNA, 23 nt, Homo sapiens
aauguccauaugcuaauagugau

SEQ ID NO: 1954996 - RNA, 13 nt, Homo sapiens
acccaaacacuuc

SEQ ID NO: 1954997 - RNA, 18 nt, Homo sapiens
cacacaaaauaguuuuag

SEQ ID NO: 1954998 - RNA, 11 nt, Homo sapiens
cagucugcuca

SEQ ID NO: 1954999 - RNA, 14 nt, Homo sapiens
ugaaugcugccaca

SEQ ID NO: 1955000 - RNA, 16 nt, Homo sapiens
gacaucugucuaggaa

SEQ ID NO: 1955001 - RNA, 15 nt, Homo sapiens
acuuuguacuugugu

SEQ ID NO: 1955002 - RNA, 20 nt, Homo sapiens
acaccacgcuggagcugugu

SEQ ID NO: 1955003 - RNA, 14 nt, Homo sapiens
uauuucuaugcaaa

SEQ ID NO: 1955004 - RNA, 14 nt, Homo sapiens
uguuucuauacaaa

SEQ ID NO: 1955005 - RNA, 21 nt, Homo sapiens
uauuuauagucgaacaauuca

SEQ ID NO: 1955006 - RNA, 18 nt, Homo sapiens
gcauugcccagucuuuca

SEQ ID NO: 1955007 - RNA, 14 nt, Homo sapiens
uguacccuacccug

SEQ ID NO: 1955008 - RNA, 21 nt, Homo sapiens
ucagggacuugaaugcacuuu

SEQ ID NO: 1955009 - RNA, 16 nt, Homo sapiens
caaucacacugaggaa

SEQ ID NO: 1955010 - RNA, 23 nt, Homo sapiens
cuuccaaacaacucuuaggauug

SEQ ID NO: 1955011 - RNA, 20 nt, Homo sapiens
cuucccaaaguccugggauu

SEQ ID NO: 1955012 - RNA, 15 nt, Homo sapiens
accacucccaccaca

SEQ ID NO: 1955013 - RNA, 15 nt, Homo sapiens
aaauggguuuauuca

SEQ ID NO: 1955014 - RNA, 16 nt, Homo sapiens
cuaauagucuuugcca

SEQ ID NO: 1955015 - RNA, 14 nt, Homo sapiens
gccugugcugugac

SEQ ID NO: 1955016 - RNA, 21 nt, Homo sapiens
aagcuuugguucugccaucuc

SEQ ID NO: 1955017 - RNA, 15 nt, Homo sapiens
auggacauaagacag

SEQ ID NO: 1955018 - RNA, 18 nt, Homo sapiens
cuagaaggccacauguca

SEQ ID NO: 1955019 - RNA, 14 nt, Homo sapiens
caagacucagggga

SEQ ID NO: 1955020 - RNA, 13 nt, Homo sapiens
uuacaaauucaag

SEQ ID NO: 1955021 - RNA, 23 nt, Homo sapiens
ugaagccuuccccuuauccuccc

SEQ ID NO: 1955022 - RNA, 18 nt, Homo sapiens
aauguuuacaugucaaga

SEQ ID NO: 1955023 - RNA, 15 nt, Homo sapiens
uuccagcauuugcca

SEQ ID NO: 1955024 - RNA, 19 nt, Homo sapiens
uaaagaauuuucagaugga

SEQ ID NO: 1955025 - RNA, 18 nt, Homo sapiens
aaucaacuagguauuuaa

SEQ ID NO: 1955026 - RNA, 11 nt, Homo sapiens
gugaggacaaa

SEQ ID NO: 1955027 - RNA, 17 nt, Homo sapiens
ucugugugcguggcgug

SEQ ID NO: 1955028 - RNA, 24 nt, Homo sapiens
cugugauuuuuuuuaaaugugcag

SEQ ID NO: 1955029 - RNA, 14 nt, Homo sapiens
uggcccauucuuga

SEQ ID NO: 1955030 - RNA, 14 nt, Homo sapiens
agaaugagaagaca

SEQ ID NO: 1955031 - RNA, 12 nt, Homo sapiens
agcaggcucaga

SEQ ID NO: 1955032 - RNA, 17 nt, Homo sapiens
gaacuccacugcaagag

SEQ ID NO: 1955033 - RNA, 18 nt, Homo sapiens
uaccguauagagagccaa

SEQ ID NO: 1955034 - RNA, 20 nt, Homo sapiens
cucaaauucauggugcacug

SEQ ID NO: 1955035 - RNA, 11 nt, Homo sapiens
cacuagacugu

SEQ ID NO: 1955036 - RNA, 15 nt, Homo sapiens
auaaaaugauguaug

SEQ ID NO: 1955037 - RNA, 14 nt, Homo sapiens
ggaauugguguaua

SEQ ID NO: 1955038 - RNA, 22 nt, Homo sapiens
aaagcacuguagcccuggaccu

SEQ ID NO: 1955039 - RNA, 14 nt, Homo sapiens
augcaaagcacucu

SEQ ID NO: 1955040 - RNA, 17 nt, Homo sapiens
gagaauagacaguauga

SEQ ID NO: 1955041 - RNA, 17 nt, Homo sapiens
cauauauuuaugaaugu

SEQ ID NO: 1955042 - RNA, 19 nt, Homo sapiens
auaccuucuuaaguuuuca

SEQ ID NO: 1955043 - RNA, 16 nt, Homo sapiens
guauucuuguuagaau

SEQ ID NO: 1955044 - RNA, 20 nt, Homo sapiens
gcuaaguguaugaugucaca

SEQ ID NO: 1955045 - RNA, 14 nt, Homo sapiens
agaaaucccaguuc

SEQ ID NO: 1955046 - RNA, 11 nt, Homo sapiens
cuucaguauua

SEQ ID NO: 1955047 - RNA, 15 nt, Homo sapiens
cacacccacugcccc

SEQ ID NO: 1955048 - RNA, 15 nt, Homo sapiens
uuguaauuccuuacu

SEQ ID NO: 1955049 - RNA, 15 nt, Homo sapiens
aggaaagccaaacac

SEQ ID NO: 1955050 - RNA, 13 nt, Homo sapiens
cuggaccauuuga

SEQ ID NO: 1955051 - RNA, 14 nt, Homo sapiens
uuugagaaaugcau

SEQ ID NO: 1955052 - RNA, 13 nt, Homo sapiens
uccuaacccuggg

SEQ ID NO: 1955053 - RNA, 19 nt, Homo sapiens
aguauaauuaacauguuaa

SEQ ID NO: 1955054 - RNA, 21 nt, Homo sapiens
ugaagcuuuuuguugccuuau

SEQ ID NO: 1955055 - RNA, 14 nt, Homo sapiens
cacugguccaucug

SEQ ID NO: 1955056 - RNA, 11 nt, Homo sapiens
agacaccucag

SEQ ID NO: 1955057 - RNA, 21 nt, Homo sapiens
ggaccaacccuguuuccugag

SEQ ID NO: 1955058 - RNA, 16 nt, Homo sapiens
aagucagauucuugca

SEQ ID NO: 1955059 - RNA, 17 nt, Homo sapiens
gcacucccagccaagug

SEQ ID NO: 1955060 - RNA, 20 nt, Homo sapiens
aaaagcacauguauugacaa

SEQ ID NO: 1955061 - RNA, 22 nt, Homo sapiens
cagggccuguaaucccagcauu

SEQ ID NO: 1955062 - RNA, 23 nt, Homo sapiens
uacacuaagcgaauguguacaaa

SEQ ID NO: 1955063 - RNA, 23 nt, Homo sapiens
caugaugcagagcuuucaaggau

SEQ ID NO: 1955064 - RNA, 15 nt, Homo sapiens
acuccucccugaugu

SEQ ID NO: 1955065 - RNA, 19 nt, Homo sapiens
gauccaacuauuucuuuca

SEQ ID NO: 1955066 - RNA, 19 nt, Homo sapiens
acuccaaagagaaaccuau

SEQ ID NO: 1955067 - RNA, 19 nt, Homo sapiens
gcuucaucagcugugugca

SEQ ID NO: 1955068 - RNA, 15 nt, Homo sapiens
auacaggucauauua

SEQ ID NO: 1955069 - RNA, 15 nt, Homo sapiens
cuuucuaaacuacaa

SEQ ID NO: 1955070 - RNA, 18 nt, Homo sapiens
aucucuaauacaguguga

SEQ ID NO: 1955071 - RNA, 17 nt, Homo sapiens
cugaguuaggaaacaaa

SEQ ID NO: 1955072 - RNA, 21 nt, Homo sapiens
aaaauucugauguuucuguga

SEQ ID NO: 1955073 - RNA, 21 nt, Homo sapiens
gaauaagaaaaggcaucacuu

SEQ ID NO: 1955074 - RNA, 20 nt, Homo sapiens
guaaucucauaacuuuccaa

SEQ ID NO: 1955075 - RNA, 16 nt, Homo sapiens
ccugacugcagggguu

SEQ ID NO: 1955076 - RNA, 18 nt, Homo sapiens
aagagcauagaacucaaa

SEQ ID NO: 1955077 - RNA, 15 nt, Homo sapiens
ugugaagagcaagag

SEQ ID NO: 1955078 - RNA, 22 nt, Homo sapiens
uuacccagagaauauauacauu

SEQ ID NO: 1955079 - RNA, 16 nt, Homo sapiens
ggccuggcccgggccu

SEQ ID NO: 1955080 - RNA, 13 nt, Homo sapiens
ugcucccucagac

SEQ ID NO: 1955081 - RNA, 17 nt, Homo sapiens
acccagugacugacauu

SEQ ID NO: 1955082 - RNA, 16 nt, Homo sapiens
guauaaauauacagua

SEQ ID NO: 1955083 - RNA, 18 nt, Homo sapiens
caauaauuacauuggcac

SEQ ID NO: 1955084 - RNA, 19 nt, Homo sapiens
cauuguguacaaaauaucc

SEQ ID NO: 1955085 - RNA, 22 nt, Homo sapiens
aguucuaucugaauccaagaca

SEQ ID NO: 1955086 - RNA, 14 nt, Homo sapiens
ggugugagccacug

SEQ ID NO: 1955087 - RNA, 18 nt, Homo sapiens
gcugagugacugcagcuu

SEQ ID NO: 1955088 - RNA, 17 nt, Homo sapiens
cucuguggaugauguga

SEQ ID NO: 1955089 - RNA, 14 nt, Homo sapiens
gugaauuaacacag

SEQ ID NO: 1955090 - RNA, 15 nt, Homo sapiens
aagagcuacuucuaa

SEQ ID NO: 1955091 - RNA, 15 nt, Homo sapiens
uuacccuauaucuau

SEQ ID NO: 1955092 - RNA, 16 nt, Homo sapiens
agugcuggaacacugc

SEQ ID NO: 1955093 - RNA, 17 nt, Homo sapiens
ugcagauggcagugcag

SEQ ID NO: 1955094 - RNA, 14 nt, Homo sapiens
aauagugucauccu

SEQ ID NO: 1955095 - RNA, 22 nt, Homo sapiens
uaaaggagcagcuagcugcuuu

SEQ ID NO: 1955096 - RNA, 16 nt, Homo sapiens
ggaggacacaguuucu

SEQ ID NO: 1955097 - RNA, 16 nt, Homo sapiens
aagaaaacacuguuau

SEQ ID NO: 1955098 - RNA, 15 nt, Homo sapiens
uguagaauaaaugaa

SEQ ID NO: 1955099 - RNA, 15 nt, Homo sapiens
auuuuagugcuugcc

SEQ ID NO: 1955100 - RNA, 22 nt, Homo sapiens
cagucaugguggccacggccac

SEQ ID NO: 1955101 - RNA, 16 nt, Homo sapiens
aguccuauguacagag

SEQ ID NO: 1955102 - RNA, 19 nt, Homo sapiens
gccaagacugcuguggcca

SEQ ID NO: 1955103 - RNA, 18 nt, Homo sapiens
auuaagguagaacuugag

SEQ ID NO: 1955104 - RNA, 20 nt, Homo sapiens
ggcggacggcucugaccuga

SEQ ID NO: 1955105 - RNA, 17 nt, Homo sapiens
aaaauuugaauguggau

SEQ ID NO: 1955106 - RNA, 22 nt, Homo sapiens
acgcagcccugggggccagcug

SEQ ID NO: 1955107 - RNA, 14 nt, Homo sapiens
agcuucccuacucc

SEQ ID NO: 1955108 - RNA, 12 nt, Homo sapiens
aaacauuacugu

SEQ ID NO: 1955109 - RNA, 16 nt, Homo sapiens
ccaucugugugcagca

SEQ ID NO: 1955110 - RNA, 14 nt, Homo sapiens
ugcagcuuguucag

SEQ ID NO: 1955111 - RNA, 13 nt, Homo sapiens
uugcagacaggaa

SEQ ID NO: 1955112 - RNA, 18 nt, Homo sapiens
accuuguuuugcugucuu

SEQ ID NO: 1955113 - RNA, 14 nt, Homo sapiens
acauauagagcucc

SEQ ID NO: 1955114 - RNA, 19 nt, Homo sapiens
agacagauucuucacugug

SEQ ID NO: 1955115 - RNA, 16 nt, Homo sapiens
caugcucugcagcauu

SEQ ID NO: 1955116 - RNA, 20 nt, Homo sapiens
ucaugggagggggcuugaag

SEQ ID NO: 1955117 - RNA, 22 nt, Homo sapiens
ccacugcgcacagccccagcua

SEQ ID NO: 1955118 - RNA, 20 nt, Homo sapiens
gucuggcgucuccagacucu

SEQ ID NO: 1955119 - RNA, 17 nt, Homo sapiens
uaauuugugaauuugca

SEQ ID NO: 1955120 - RNA, 23 nt, Homo sapiens
uaguguggaggggagauauagau

SEQ ID NO: 1955121 - RNA, 22 nt, Homo sapiens
cggugcuugauagaaaugccaa

SEQ ID NO: 1955122 - RNA, 22 nt, Homo sapiens
aaacacauuaaagguacuuugc

SEQ ID NO: 1955123 - RNA, 19 nt, Homo sapiens
uucucagacugccaaagaa

SEQ ID NO: 1955124 - RNA, 22 nt, Homo sapiens
gaaaaccaaacacguucccuaa

SEQ ID NO: 1955125 - RNA, 14 nt, Homo sapiens
gacgauucuuaaca

SEQ ID NO: 1955126 - RNA, 21 nt, Homo sapiens
ucccacacccaccucugccac

SEQ ID NO: 1955127 - RNA, 11 nt, Homo sapiens
augucagaaaa

SEQ ID NO: 1955128 - RNA, 12 nt, Homo sapiens
uggauguccaga

SEQ ID NO: 1955129 - RNA, 16 nt, Homo sapiens
guucagacagguccaa

SEQ ID NO: 1955130 - RNA, 17 nt, Homo sapiens
aauucaaaaagaacuaa

SEQ ID NO: 1955131 - RNA, 13 nt, Homo sapiens
agacuuacugcuc

SEQ ID NO: 1955132 - RNA, 14 nt, Homo sapiens
uuaccaaaaaagga

SEQ ID NO: 1955133 - RNA, 18 nt, Homo sapiens
gguccaggaauggugcuu

SEQ ID NO: 1955134 - RNA, 22 nt, Homo sapiens
ugagauaacauuuccaaagcuu

SEQ ID NO: 1955135 - RNA, 14 nt, Homo sapiens
gggacuaacccaau

SEQ ID NO: 1955136 - RNA, 16 nt, Homo sapiens
ucauagccuauugugu

SEQ ID NO: 1955137 - RNA, 19 nt, Homo sapiens
ugaagaacacagcaugugc

SEQ ID NO: 1955138 - RNA, 20 nt, Homo sapiens
cagcugcauacaguuugcac

SEQ ID NO: 1955139 - RNA, 21 nt, Homo sapiens
cacuugccccuguuaccuaau

SEQ ID NO: 1955140 - RNA, 20 nt, Homo sapiens
augaaaaugggaugaauucu

SEQ ID NO: 1955141 - RNA, 17 nt, Homo sapiens
caucuggauuuucacac

SEQ ID NO: 1955142 - RNA, 17 nt, Homo sapiens
cuucugcuuauucaguc

SEQ ID NO: 1955143 - RNA, 13 nt, Homo sapiens
accuguaacuuaa

SEQ ID NO: 1955144 - RNA, 16 nt, Homo sapiens
cagaaaucccaguuca

SEQ ID NO: 1955145 - RNA, 19 nt, Homo sapiens
uagggucacuuugccauua

SEQ ID NO: 1955146 - RNA, 14 nt, Homo sapiens
cugcgacagaacuu

SEQ ID NO: 1955147 - RNA, 16 nt, Homo sapiens
uugacagaacacuguc

SEQ ID NO: 1955148 - RNA, 13 nt, Homo sapiens
aaguaaugaugaa

SEQ ID NO: 1955149 - RNA, 13 nt, Homo sapiens
cuaauaugcaauu

SEQ ID NO: 1955150 - RNA, 18 nt, Homo sapiens
cucuagugucuuuugccu

SEQ ID NO: 1955151 - RNA, 15 nt, Homo sapiens
cuaauuacauuucac

SEQ ID NO: 1955152 - RNA, 16 nt, Homo sapiens
aaauacacucucuuau

SEQ ID NO: 1955153 - RNA, 11 nt, Homo sapiens
cagcucacuca

SEQ ID NO: 1955154 - RNA, 18 nt, Homo sapiens
cuuccgacaccacuggga

SEQ ID NO: 1955155 - RNA, 21 nt, Homo sapiens
auaauuccuccaguuggauga

SEQ ID NO: 1955156 - RNA, 20 nt, Homo sapiens
guacaacccauaaucaugua

SEQ ID NO: 1955157 - RNA, 9 nt, Homo sapiens
acuuuccac

SEQ ID NO: 1955158 - RNA, 17 nt, Homo sapiens
ccaugcguccuggucaa

SEQ ID NO: 1955159 - RNA, 17 nt, Homo sapiens
ucauaccuucugaugaa

SEQ ID NO: 1955160 - RNA, 16 nt, Homo sapiens
cacagacugauuggaa

SEQ ID NO: 1955161 - RNA, 16 nt, Homo sapiens
agccaguguugcuuaa

SEQ ID NO: 1955162 - RNA, 13 nt, Homo sapiens
aaauggugaagga

SEQ ID NO: 1955163 - RNA, 14 nt, Homo sapiens
ucuuauacugaaaa

SEQ ID NO: 1955164 - RNA, 18 nt, Homo sapiens
ggacuaggguaaucugac

SEQ ID NO: 1955165 - RNA, 22 nt, Homo sapiens
aauuuauaguuaaggcuaaaaa

SEQ ID NO: 1955166 - RNA, 18 nt, Homo sapiens
ccuguagccccagugaca

SEQ ID NO: 1955167 - RNA, 21 nt, Homo sapiens
gcucuccccucagagugcaag

SEQ ID NO: 1955168 - RNA, 13 nt, Homo sapiens
uuaaucauaucaa

SEQ ID NO: 1955169 - RNA, 20 nt, Homo sapiens
gcauuugaugauagcagaca

SEQ ID NO: 1955170 - RNA, 15 nt, Homo sapiens
ucaagaaaaucuuug

SEQ ID NO: 1955171 - RNA, 17 nt, Homo sapiens
ccugcugcaaagccuuu

SEQ ID NO: 1955172 - RNA, 24 nt, Homo sapiens
ugcuuucaucacuaccuuuauagc

SEQ ID NO: 1955173 - RNA, 17 nt, Homo sapiens
aucccuuccuacaguaa

SEQ ID NO: 1955174 - RNA, 20 nt, Homo sapiens
ucaauuuuuaacuuaucucc

SEQ ID NO: 1955175 - RNA, 20 nt, Homo sapiens
uguggccuucacuuuguuca

SEQ ID NO: 1955176 - RNA, 20 nt, Homo sapiens
aagcuuuauuucaaaucucu

SEQ ID NO: 1955177 - RNA, 13 nt, Homo sapiens
agugucucagucc

SEQ ID NO: 1955178 - RNA, 12 nt, Homo sapiens
cuuuacuccugg

SEQ ID NO: 1955179 - RNA, 14 nt, Homo sapiens
uacaauuugcccaa

SEQ ID NO: 1955180 - RNA, 16 nt, Homo sapiens
uaauauauauuaucuu

SEQ ID NO: 1955181 - RNA, 17 nt, Homo sapiens
agagaaucaacagauga

SEQ ID NO: 1955182 - RNA, 20 nt, Homo sapiens
uggccgcggagccugcauuu

SEQ ID NO: 1955183 - RNA, 21 nt, Homo sapiens
acagugccauccccaccuuca

SEQ ID NO: 1955184 - RNA, 16 nt, Homo sapiens
augaugccccugagau

SEQ ID NO: 1955185 - RNA, 16 nt, Homo sapiens
cuauuauuaacacuga

SEQ ID NO: 1955186 - RNA, 15 nt, Homo sapiens
cuugugaauuauucu

SEQ ID NO: 1955187 - RNA, 12 nt, Homo sapiens
gauuugcucagg

SEQ ID NO: 1955188 - RNA, 12 nt, Homo sapiens
cuguugcuguug

SEQ ID NO: 1955189 - RNA, 13 nt, Homo sapiens
uugaacuuucaua

SEQ ID NO: 1955190 - RNA, 12 nt, Homo sapiens
ugcacaaccugg

SEQ ID NO: 1955191 - RNA, 16 nt, Homo sapiens
auuuauaucaguuuca

SEQ ID NO: 1955192 - RNA, 17 nt, Homo sapiens
agccacaauaagccacu

SEQ ID NO: 1955193 - RNA, 22 nt, Homo sapiens
ugccugaagaccccagauguga

SEQ ID NO: 1955194 - RNA, 15 nt, Homo sapiens
accucaagugccuua

SEQ ID NO: 1955195 - RNA, 15 nt, Homo sapiens
ugaggaaacaacagc

SEQ ID NO: 1955196 - RNA, 16 nt, Homo sapiens
cuuagcaccacaaaua

SEQ ID NO: 1955197 - RNA, 21 nt, Homo sapiens
auauauauuuauguuuucaca

SEQ ID NO: 1955198 - RNA, 15 nt, Homo sapiens
gcuccugucugccag

SEQ ID NO: 1955199 - RNA, 20 nt, Homo sapiens
gcacaugugccacacaguga

SEQ ID NO: 1955200 - RNA, 19 nt, Homo sapiens
cugucacguagaacuugga

SEQ ID NO: 1955201 - RNA, 20 nt, Homo sapiens
uugaaggagaaaaugcauua

SEQ ID NO: 1955202 - RNA, 14 nt, Homo sapiens
cauacgucagcauu

SEQ ID NO: 1955203 - RNA, 21 nt, Homo sapiens
auaaaccccaguucugaauca

SEQ ID NO: 1955204 - RNA, 11 nt, Homo sapiens
acaaaagcuau

SEQ ID NO: 1955205 - RNA, 16 nt, Homo sapiens
cugggaggggugcugc

SEQ ID NO: 1955206 - RNA, 18 nt, Homo sapiens
uaauagcaaacauuucua

SEQ ID NO: 1955207 - RNA, 20 nt, Homo sapiens
aaaguggcuuucaacuucaa

SEQ ID NO: 1955208 - RNA, 18 nt, Homo sapiens
aaguguguguuucuugcu

SEQ ID NO: 1955209 - RNA, 22 nt, Homo sapiens
gcuucccgaguaccagugacac

SEQ ID NO: 1955210 - RNA, 22 nt, Homo sapiens
augaagacaucuuauccauccu

SEQ ID NO: 1955211 - RNA, 22 nt, Homo sapiens
aucaaauaagcuaauauacagu

SEQ ID NO: 1955212 - RNA, 19 nt, Homo sapiens
cccugcaacuucuauccuu

SEQ ID NO: 1955213 - RNA, 18 nt, Homo sapiens
cuauaggcaaagaaagcu

SEQ ID NO: 1955214 - RNA, 15 nt, Homo sapiens
ggggaucaccucucu

SEQ ID NO: 1955215 - RNA, 20 nt, Homo sapiens
aagaauucucucuucuggaa

SEQ ID NO: 1955216 - RNA, 22 nt, Homo sapiens
agcaaauccucuucuaacucau

SEQ ID NO: 1955217 - RNA, 21 nt, Homo sapiens
auccaggaauauaugucagug

SEQ ID NO: 1955218 - RNA, 20 nt, Homo sapiens
aacuuuauuuaaaaugauuu

SEQ ID NO: 1955219 - RNA, 16 nt, Homo sapiens
auucauaaccaaagag

SEQ ID NO: 1955220 - RNA, 12 nt, Homo sapiens
ugaguuacuuga

SEQ ID NO: 1955221 - RNA, 22 nt, Homo sapiens
uggguuuugucucugcaucuca

SEQ ID NO: 1955222 - RNA, 16 nt, Homo sapiens
gccguggguucaggug

SEQ ID NO: 1955223 - RNA, 14 nt, Homo sapiens
uuauauauggcaua

SEQ ID NO: 1955224 - RNA, 14 nt, Homo sapiens
ugcaauauguauua

SEQ ID NO: 1955225 - RNA, 22 nt, Homo sapiens
aguuccaugaauucuugauuuc

SEQ ID NO: 1955226 - RNA, 15 nt, Homo sapiens
ggcaugacagcuguu

SEQ ID NO: 1955227 - RNA, 19 nt, Homo sapiens
uuggcuuuuuuaggauucu

SEQ ID NO: 1955228 - RNA, 13 nt, Homo sapiens
cagucacagccau

SEQ ID NO: 1955229 - RNA, 17 nt, Homo sapiens
cagaaaugucauguggc

SEQ ID NO: 1955230 - RNA, 19 nt, Homo sapiens
ugacaagggcacaagcuca

SEQ ID NO: 1955231 - RNA, 20 nt, Homo sapiens
uauacauguaggaguguuua

SEQ ID NO: 1955232 - RNA, 18 nt, Homo sapiens
ucccacaacaacaaaagc

SEQ ID NO: 1955233 - RNA, 16 nt, Homo sapiens
ccgagugagguguaca

SEQ ID NO: 1955234 - RNA, 19 nt, Homo sapiens
uaacucuguaaaagugucu

SEQ ID NO: 1955235 - RNA, 20 nt, Homo sapiens
aagcaauuauugugccucag

SEQ ID NO: 1955236 - RNA, 16 nt, Homo sapiens
ccaggacagcagccac

SEQ ID NO: 1955237 - RNA, 13 nt, Homo sapiens
ugugaacuagcug

SEQ ID NO: 1955238 - RNA, 23 nt, Homo sapiens
cccaaacccauuuuagagacaga

SEQ ID NO: 1955239 - RNA, 19 nt, Homo sapiens
gcuaauuucuauuugaucu

SEQ ID NO: 1955240 - RNA, 23 nt, Homo sapiens
uagguauaucucccagugcuauc

SEQ ID NO: 1955241 - RNA, 17 nt, Homo sapiens
uguguguuauaccuuga

SEQ ID NO: 1955242 - RNA, 19 nt, Homo sapiens
uauauuuuuugaacuuugu

SEQ ID NO: 1955243 - RNA, 22 nt, Homo sapiens
gaacuccaucagaaaaccaaag

SEQ ID NO: 1955244 - RNA, 13 nt, Homo sapiens
gucugagccaaag

SEQ ID NO: 1955245 - RNA, 18 nt, Homo sapiens
uuaccaauuccaauuuca

SEQ ID NO: 1955246 - RNA, 21 nt, Homo sapiens
ugaggugacacuccaguugca

SEQ ID NO: 1955247 - RNA, 20 nt, Homo sapiens
uggagaaaugaaaacagugu

SEQ ID NO: 1955248 - RNA, 19 nt, Homo sapiens
caguucccucagcccucau

SEQ ID NO: 1955249 - RNA, 19 nt, Homo sapiens
gucugaacaauauauacuu

SEQ ID NO: 1955250 - RNA, 15 nt, Homo sapiens
auaguagccaugaca

SEQ ID NO: 1955251 - RNA, 12 nt, Homo sapiens
uuugaaauccaa

SEQ ID NO: 1955252 - RNA, 17 nt, Homo sapiens
augcaguccagaauaag

SEQ ID NO: 1955253 - RNA, 19 nt, Homo sapiens
uuuaaagaugaacucugaa

SEQ ID NO: 1955254 - RNA, 21 nt, Homo sapiens
uuaauccacaucuuuacucag

SEQ ID NO: 1955255 - RNA, 20 nt, Homo sapiens
uccuuagcuuagaccucagc

SEQ ID NO: 1955256 - RNA, 15 nt, Homo sapiens
ugcuugcuccccaag

SEQ ID NO: 1955257 - RNA, 17 nt, Homo sapiens
auugugcuggaaaugga

SEQ ID NO: 1955258 - RNA, 17 nt, Homo sapiens
cuguccuugcacacucc

SEQ ID NO: 1955259 - RNA, 13 nt, Homo sapiens
auccuccacugac

SEQ ID NO: 1955260 - RNA, 20 nt, Homo sapiens
acgugagaucauucacucau

SEQ ID NO: 1955261 - RNA, 15 nt, Homo sapiens
uccgccagaccucaa

SEQ ID NO: 1955262 - RNA, 23 nt, Homo sapiens
uaauagauuguuuugccacuuag

SEQ ID NO: 1955263 - RNA, 22 nt, Homo sapiens
auggguuagggaaaacauucca

SEQ ID NO: 1955264 - RNA, 24 nt, Homo sapiens
acuuuggaaacaaaaauguacaau

SEQ ID NO: 1955265 - RNA, 13 nt, Homo sapiens
auuagagaucuga

SEQ ID NO: 1955266 - RNA, 21 nt, Homo sapiens
ggaugcaaauagauucagaga

SEQ ID NO: 1955267 - RNA, 21 nt, Homo sapiens
auuugaggagauaacauuuca

SEQ ID NO: 1955268 - RNA, 20 nt, Homo sapiens
uggccacaagcaaaguaaug

SEQ ID NO: 1955269 - RNA, 17 nt, Homo sapiens
gccuucaagugccaaac

SEQ ID NO: 1955270 - RNA, 16 nt, Homo sapiens
agauggcagcagugaa

SEQ ID NO: 1955271 - RNA, 23 nt, Homo sapiens
auuaagugcacaccgugugccau

SEQ ID NO: 1955272 - RNA, 12 nt, Homo sapiens
uauuacaguguc

SEQ ID NO: 1955273 - RNA, 13 nt, Homo sapiens
gcccuaaucucac

SEQ ID NO: 1955274 - RNA, 23 nt, Homo sapiens
aggcagguagggggucccuccaa

SEQ ID NO: 1955275 - RNA, 15 nt, Homo sapiens
aagcacaaaguucuc

SEQ ID NO: 1955276 - RNA, 18 nt, Homo sapiens
ugcucaggagccaccagc

SEQ ID NO: 1955277 - RNA, 21 nt, Homo sapiens
caugaagcacacacacaaaaa

SEQ ID NO: 1955278 - RNA, 16 nt, Homo sapiens
aaugugaaggcccaag

SEQ ID NO: 1955279 - RNA, 16 nt, Homo sapiens
cuuaugauauucucau

SEQ ID NO: 1955280 - RNA, 18 nt, Homo sapiens
acugugaggguaaaggcu

SEQ ID NO: 1955281 - RNA, 16 nt, Homo sapiens
ccgaaguaugagggaa

SEQ ID NO: 1955282 - RNA, 13 nt, Homo sapiens
uugucaugugaug

SEQ ID NO: 1955283 - RNA, 13 nt, Homo sapiens
ccaaccccguguc

SEQ ID NO: 1955284 - RNA, 20 nt, Homo sapiens
ccuauuuccauucaacaaga

SEQ ID NO: 1955285 - RNA, 16 nt, Homo sapiens
caacaguuuccaguca

SEQ ID NO: 1955286 - RNA, 18 nt, Homo sapiens
cacaguaccggauucucu

SEQ ID NO: 1955287 - RNA, 15 nt, Homo sapiens
aaauaaaccagacuc

SEQ ID NO: 1955288 - RNA, 18 nt, Homo sapiens
ggaugauuuuaauauuaa

SEQ ID NO: 1955289 - RNA, 17 nt, Homo sapiens
acuguguacaccucaaa

SEQ ID NO: 1955290 - RNA, 18 nt, Homo sapiens
aguggcauaccaaauggc

SEQ ID NO: 1955291 - RNA, 16 nt, Homo sapiens
cacuguccugcuccac

SEQ ID NO: 1955292 - RNA, 22 nt, Homo sapiens
cagcuuguaaauagcucaggug

SEQ ID NO: 1955293 - RNA, 20 nt, Homo sapiens
ccaggaggcggcagugcaac

SEQ ID NO: 1955294 - RNA, 21 nt, Homo sapiens
acagagaccaagagagguccu

SEQ ID NO: 1955295 - RNA, 11 nt, Homo sapiens
ccaaaacacag

SEQ ID NO: 1955296 - RNA, 21 nt, Homo sapiens
uaaauaaaacuuaaaucucac

SEQ ID NO: 1955297 - RNA, 12 nt, Homo sapiens
aagacucugagc

SEQ ID NO: 1955298 - RNA, 15 nt, Homo sapiens
ugaauuaguaacugu

SEQ ID NO: 1955299 - RNA, 16 nt, Homo sapiens
guuaugauauuguuua

SEQ ID NO: 1955300 - RNA, 16 nt, Homo sapiens
agacauuacaaugugu

SEQ ID NO: 1955301 - RNA, 21 nt, Homo sapiens
ucuguacaaaguacuagcuaa

SEQ ID NO: 1955302 - RNA, 13 nt, Homo sapiens
uacaaaaugacua

SEQ ID NO: 1955303 - RNA, 21 nt, Homo sapiens
ugcacuucuuguaaagaguga

SEQ ID NO: 1955304 - RNA, 16 nt, Homo sapiens
cucagcugcacauucc

SEQ ID NO: 1955305 - RNA, 21 nt, Homo sapiens
gagaagggugguuuccugcca

SEQ ID NO: 1955306 - RNA, 15 nt, Homo sapiens
cuucuacggccauga

SEQ ID NO: 1955307 - RNA, 19 nt, Homo sapiens
uccaaccaggcuccuguga

SEQ ID NO: 1955308 - RNA, 15 nt, Homo sapiens
cuggugauggucucu

SEQ ID NO: 1955309 - RNA, 15 nt, Homo sapiens
cacaggcagcauuua

SEQ ID NO: 1955310 - RNA, 15 nt, Homo sapiens
cugaucaaagcaccu

SEQ ID NO: 1955311 - RNA, 16 nt, Homo sapiens
aaacacuaggugccug

SEQ ID NO: 1955312 - RNA, 20 nt, Homo sapiens
uggagucagggcugugcuuu

SEQ ID NO: 1955313 - RNA, 14 nt, Homo sapiens
cugcagucccacac

SEQ ID NO: 1955314 - RNA, 15 nt, Homo sapiens
uuuuaaaugcaccug

SEQ ID NO: 1955315 - RNA, 23 nt, Homo sapiens
aauaaugugaaugcuauguucug

SEQ ID NO: 1955316 - RNA, 15 nt, Homo sapiens
uuccugaaugaaaua

SEQ ID NO: 1955317 - RNA, 17 nt, Homo sapiens
uugaucaccugagguca

SEQ ID NO: 1955318 - RNA, 14 nt, Homo sapiens
uacguccuuuggac

SEQ ID NO: 1955319 - RNA, 18 nt, Homo sapiens
ucuaagauuaauagcauu

SEQ ID NO: 1955320 - RNA, 23 nt, Homo sapiens
gggccuugucucucacugcauuu

SEQ ID NO: 1955321 - RNA, 14 nt, Homo sapiens
cauccaagcuuccu

SEQ ID NO: 1955322 - RNA, 21 nt, Homo sapiens
ccccuucccgggcugcacuuu

SEQ ID NO: 1955323 - RNA, 16 nt, Homo sapiens
cuccaauuaaggauuu

SEQ ID NO: 1955324 - RNA, 24 nt, Homo sapiens
ugugcucugaucauccacugugcc

SEQ ID NO: 1955325 - RNA, 21 nt, Homo sapiens
agaucuuagucuagguaaaga

SEQ ID NO: 1955326 - RNA, 18 nt, Homo sapiens
aacaucauggacugagcu

SEQ ID NO: 1955327 - RNA, 16 nt, Homo sapiens
gcuaauaaaagucaga

SEQ ID NO: 1955328 - RNA, 21 nt, Homo sapiens
cagugaaagaguagugcauuu

SEQ ID NO: 1955329 - RNA, 17 nt, Homo sapiens
cuccaagacccuguguu

SEQ ID NO: 1955330 - RNA, 14 nt, Homo sapiens
cuuuugucccagaa

SEQ ID NO: 1955331 - RNA, 18 nt, Homo sapiens
cauaugaucuguuuugua

SEQ ID NO: 1955332 - RNA, 17 nt, Homo sapiens
uugucgcucaugugugc

SEQ ID NO: 1955333 - RNA, 21 nt, Homo sapiens
aagcccagcgguucacacagg

SEQ ID NO: 1955334 - RNA, 22 nt, Homo sapiens
gccccuguucucuuccacucuc

SEQ ID NO: 1955335 - RNA, 15 nt, Homo sapiens
gacuccaagagggaa

SEQ ID NO: 1955336 - RNA, 13 nt, Homo sapiens
gauaagucuuuca

SEQ ID NO: 1955337 - RNA, 17 nt, Homo sapiens
cugccuguaacagccac

SEQ ID NO: 1955338 - RNA, 23 nt, Homo sapiens
gcuaauuuugaaaaacugcucau

SEQ ID NO: 1955339 - RNA, 14 nt, Homo sapiens
acucugggcuccag

SEQ ID NO: 1955340 - RNA, 21 nt, Homo sapiens
gugcugauccugcugaccuca

SEQ ID NO: 1955341 - RNA, 15 nt, Homo sapiens
ccuguguacauauaa

SEQ ID NO: 1955342 - RNA, 15 nt, Homo sapiens
uguauucaccaccaa

SEQ ID NO: 1955343 - RNA, 16 nt, Homo sapiens
uauaugcuaagucuua

SEQ ID NO: 1955344 - RNA, 15 nt, Homo sapiens
uaucuuguagcuuua

SEQ ID NO: 1955345 - RNA, 15 nt, Homo sapiens
agaccucaagccauc

SEQ ID NO: 1955346 - RNA, 15 nt, Homo sapiens
agccacaaagaccca

SEQ ID NO: 1955347 - RNA, 13 nt, Homo sapiens
agucagucucuug

SEQ ID NO: 1955348 - RNA, 17 nt, Homo sapiens
ggauacucauucucgaa

SEQ ID NO: 1955349 - RNA, 15 nt, Homo sapiens
ccagaagcugcccuc

SEQ ID NO: 1955350 - RNA, 17 nt, Homo sapiens
cuuuacguacuguaacu

SEQ ID NO: 1955351 - RNA, 15 nt, Homo sapiens
accaacuuuacuguc

SEQ ID NO: 1955352 - RNA, 18 nt, Homo sapiens
ccaguuuuuguugcuuga

SEQ ID NO: 1955353 - RNA, 16 nt, Homo sapiens
gaugagcgugcacucc

SEQ ID NO: 1955354 - RNA, 13 nt, Homo sapiens
gacaccaccaagg

SEQ ID NO: 1955355 - RNA, 21 nt, Homo sapiens
ggguucacaccauucuccggc

SEQ ID NO: 1955356 - RNA, 13 nt, Homo sapiens
gacccacggggca

SEQ ID NO: 1955357 - RNA, 13 nt, Homo sapiens
uuuaagguacuua

SEQ ID NO: 1955358 - RNA, 14 nt, Homo sapiens
ccuuguccccauga

SEQ ID NO: 1955359 - RNA, 14 nt, Homo sapiens
uaccuuguuauuaa

SEQ ID NO: 1955360 - RNA, 14 nt, Homo sapiens
gcuuuugugcccaa

SEQ ID NO: 1955361 - RNA, 20 nt, Homo sapiens
uugggccucccuggcacuga

SEQ ID NO: 1955362 - RNA, 17 nt, Homo sapiens
auuagggacacuuucac

SEQ ID NO: 1955363 - RNA, 17 nt, Homo sapiens
uggcggcgcagagggaa

SEQ ID NO: 1955364 - RNA, 16 nt, Homo sapiens
guguuaguguauguga

SEQ ID NO: 1955365 - RNA, 15 nt, Homo sapiens
cugaggccauucccu

SEQ ID NO: 1955366 - RNA, 16 nt, Homo sapiens
acuuucuugagcacca

SEQ ID NO: 1955367 - RNA, 13 nt, Homo sapiens
auaucccuuccag

SEQ ID NO: 1955368 - RNA, 14 nt, Homo sapiens
uagagcaaccucug

SEQ ID NO: 1955369 - RNA, 16 nt, Homo sapiens
gaguuccuucugcucc

SEQ ID NO: 1955370 - RNA, 16 nt, Homo sapiens
cacagccaaccuagcu

SEQ ID NO: 1955371 - RNA, 21 nt, Homo sapiens
uuguuccuacucagacuguug

SEQ ID NO: 1955372 - RNA, 16 nt, Homo sapiens
cacccauaauccuuuc

SEQ ID NO: 1955373 - RNA, 16 nt, Homo sapiens
gugauuuuacauuuau

SEQ ID NO: 1955374 - RNA, 20 nt, Homo sapiens
uacacaugccaacacuuaau

SEQ ID NO: 1955375 - RNA, 13 nt, Homo sapiens
ccugucuacucau

SEQ ID NO: 1955376 - RNA, 18 nt, Homo sapiens
ccaggauggagugcagug

SEQ ID NO: 1955377 - RNA, 12 nt, Homo sapiens
auggaugaagga

SEQ ID NO: 1955378 - RNA, 12 nt, Homo sapiens
agaaaugaauag

SEQ ID NO: 1955379 - RNA, 16 nt, Homo sapiens
auaguaccucugcuau

SEQ ID NO: 1955380 - RNA, 15 nt, Homo sapiens
agucugcauugcugg

SEQ ID NO: 1955381 - RNA, 14 nt, Homo sapiens
aacugcagugaugu

SEQ ID NO: 1955382 - RNA, 15 nt, Homo sapiens
aacugucuuguuuca

SEQ ID NO: 1955383 - RNA, 22 nt, Homo sapiens
ucucuuuugaggcucucucaua

SEQ ID NO: 1955384 - RNA, 21 nt, Homo sapiens
ucuucagauccuggucugcac

SEQ ID NO: 1955385 - RNA, 13 nt, Homo sapiens
uuccguuccagag

SEQ ID NO: 1955386 - RNA, 19 nt, Homo sapiens
uucuauaaacauaugcaaa

SEQ ID NO: 1955387 - RNA, 14 nt, Homo sapiens
uuccugcaguagaa

SEQ ID NO: 1955388 - RNA, 16 nt, Homo sapiens
uaaaaccaagugcuua

SEQ ID NO: 1955389 - RNA, 21 nt, Homo sapiens
uguaaauaguuuaacacuuuc

SEQ ID NO: 1955390 - RNA, 13 nt, Homo sapiens
ccagugucauccg

SEQ ID NO: 1955391 - RNA, 12 nt, Homo sapiens
gggccaccuccu

SEQ ID NO: 1955392 - RNA, 16 nt, Homo sapiens
gaaaaaagaacaggau

SEQ ID NO: 1955393 - RNA, 12 nt, Homo sapiens
guucaacaaagg

SEQ ID NO: 1955394 - RNA, 14 nt, Homo sapiens
ucauaauucauuua

SEQ ID NO: 1955395 - RNA, 20 nt, Homo sapiens
acuggaggggcccacccaca

SEQ ID NO: 1955396 - RNA, 17 nt, Homo sapiens
gagcagcccuuacagua

SEQ ID NO: 1955397 - RNA, 16 nt, Homo sapiens
ucauguucagucacau

SEQ ID NO: 1955398 - RNA, 17 nt, Homo sapiens
auaaaauuaacaugaua

SEQ ID NO: 1955399 - RNA, 22 nt, Homo sapiens
agaaauauacucucccagauuu

SEQ ID NO: 1955400 - RNA, 14 nt, Homo sapiens
gcccugagcucucu

SEQ ID NO: 1955401 - RNA, 14 nt, Homo sapiens
auuaagcaacacaa

SEQ ID NO: 1955402 - RNA, 14 nt, Homo sapiens
ucccaggaccaaga

SEQ ID NO: 1955403 - RNA, 21 nt, Homo sapiens
cugacucacaagaagaccaga

SEQ ID NO: 1955404 - RNA, 18 nt, Homo sapiens
aguuauaauaacugaacu

SEQ ID NO: 1955405 - RNA, 21 nt, Homo sapiens
gcgcugcagccucccuuccau

SEQ ID NO: 1955406 - RNA, 16 nt, Homo sapiens
ucaaagccuugguuua

SEQ ID NO: 1955407 - RNA, 19 nt, Homo sapiens
uaacugguagcuauaacuu

SEQ ID NO: 1955408 - RNA, 14 nt, Homo sapiens
ccguguggacugug

SEQ ID NO: 1955409 - RNA, 13 nt, Homo sapiens
uccuacaugucua

SEQ ID NO: 1955410 - RNA, 14 nt, Homo sapiens
ucuguuugugaccu

SEQ ID NO: 1955411 - RNA, 13 nt, Homo sapiens
gccaucauuucau

SEQ ID NO: 1955412 - RNA, 19 nt, Homo sapiens
aacauuuuugauucuagcu

SEQ ID NO: 1955413 - RNA, 16 nt, Homo sapiens
auaguucccuagucua

SEQ ID NO: 1955414 - RNA, 19 nt, Homo sapiens
acucucuugccagcauuuu

SEQ ID NO: 1955415 - RNA, 21 nt, Homo sapiens
aacuugauuuuuucaaaaaag

SEQ ID NO: 1955416 - RNA, 17 nt, Homo sapiens
acuuacuguagccucag

SEQ ID NO: 1955417 - RNA, 19 nt, Homo sapiens
aaacuauuggaaaguacuc

SEQ ID NO: 1955418 - RNA, 15 nt, Homo sapiens
aggagcuuccagugc

SEQ ID NO: 1955419 - RNA, 13 nt, Homo sapiens
ugaccccauuccu

SEQ ID NO: 1955420 - RNA, 20 nt, Homo sapiens
aguuugggguaugggagaga

SEQ ID NO: 1955421 - RNA, 19 nt, Homo sapiens
uugucaacacaaagacaug

SEQ ID NO: 1955422 - RNA, 12 nt, Homo sapiens
ucaucagagccu

SEQ ID NO: 1955423 - RNA, 16 nt, Homo sapiens
caauggugcgaucuca

SEQ ID NO: 1955424 - RNA, 17 nt, Homo sapiens
uaaacaagggcagugag

SEQ ID NO: 1955425 - RNA, 22 nt, Homo sapiens
gcugguauguuggggcccugug

SEQ ID NO: 1955426 - RNA, 22 nt, Homo sapiens
ucuguacaugucucccaucaga

SEQ ID NO: 1955427 - RNA, 23 nt, Homo sapiens
uguaauuuugaacuguuuaacac

SEQ ID NO: 1955428 - RNA, 12 nt, Homo sapiens
auucaugcagca

SEQ ID NO: 1955429 - RNA, 12 nt, Homo sapiens
uucccaguaauu

SEQ ID NO: 1955430 - RNA, 17 nt, Homo sapiens
uccugagaaugaaugag

SEQ ID NO: 1955431 - RNA, 15 nt, Homo sapiens
uuauauuuuuagccu

SEQ ID NO: 1955432 - RNA, 13 nt, Homo sapiens
agugagugaucac

SEQ ID NO: 1955433 - RNA, 17 nt, Homo sapiens
ccaugaacaucauggac

SEQ ID NO: 1955434 - RNA, 16 nt, Homo sapiens
ccccaguggauucuca

SEQ ID NO: 1955435 - RNA, 23 nt, Homo sapiens
uccagaagcaaaaacaaaccaug

SEQ ID NO: 1955436 - RNA, 20 nt, Homo sapiens
acagaauacuagccagagcu

SEQ ID NO: 1955437 - RNA, 20 nt, Homo sapiens
auaugcauaccuggauuucc

SEQ ID NO: 1955438 - RNA, 17 nt, Homo sapiens
aaccagagccacaggcc

SEQ ID NO: 1955439 - RNA, 22 nt, Homo sapiens
uacuccuuuugccacugcugug

SEQ ID NO: 1955440 - RNA, 18 nt, Homo sapiens
caguauuaacaucaaaga

SEQ ID NO: 1955441 - RNA, 15 nt, Homo sapiens
augucauuugcacac

SEQ ID NO: 1955442 - RNA, 21 nt, Homo sapiens
aaucuauuuucucauugcucu

SEQ ID NO: 1955443 - RNA, 15 nt, Homo sapiens
uagcuuaaaccaaca

SEQ ID NO: 1955444 - RNA, 19 nt, Homo sapiens
aacaaaaauguaaugauca

SEQ ID NO: 1955445 - RNA, 17 nt, Homo sapiens
aaugaacuaccaucuga

SEQ ID NO: 1955446 - RNA, 20 nt, Homo sapiens
ugguaguuuaaaacaucaga

SEQ ID NO: 1955447 - RNA, 13 nt, Homo sapiens
acuucugcucugg

SEQ ID NO: 1955448 - RNA, 19 nt, Homo sapiens
uugaaccagggagucagag

SEQ ID NO: 1955449 - RNA, 13 nt, Homo sapiens
ucuuagcaaaaaa

SEQ ID NO: 1955450 - RNA, 20 nt, Homo sapiens
uccccuccguaggagcucac

SEQ ID NO: 1955451 - RNA, 23 nt, Homo sapiens
cucuuuuacaguuagaaacacca

SEQ ID NO: 1955452 - RNA, 22 nt, Homo sapiens
guuugaugucauuaauguguug

SEQ ID NO: 1955453 - RNA, 16 nt, Homo sapiens
ugcaggugcaaauggu

SEQ ID NO: 1955454 - RNA, 18 nt, Homo sapiens
acagcaugaauaaaacac

SEQ ID NO: 1955455 - RNA, 14 nt, Homo sapiens
caagcaaaaccaaa

SEQ ID NO: 1955456 - RNA, 17 nt, Homo sapiens
cauuugauugucauuuu

SEQ ID NO: 1955457 - RNA, 13 nt, Homo sapiens
acaccuuuuauua

SEQ ID NO: 1955458 - RNA, 20 nt, Homo sapiens
gugcuuaagcagaagcauua

SEQ ID NO: 1955459 - RNA, 23 nt, Homo sapiens
agcuuaccagggucuuugcagau

SEQ ID NO: 1955460 - RNA, 13 nt, Homo sapiens
uggaaggucauca

SEQ ID NO: 1955461 - RNA, 17 nt, Homo sapiens
uccuagcugugugaaua

SEQ ID NO: 1955462 - RNA, 12 nt, Homo sapiens
acaucuguaaag

SEQ ID NO: 1955463 - RNA, 12 nt, Homo sapiens
gcuucugugaug

SEQ ID NO: 1955464 - RNA, 20 nt, Homo sapiens
cuuaguuuuuucaucuguaa

SEQ ID NO: 1955465 - RNA, 23 nt, Homo sapiens
cccugauuugcugggcaguuuuu

SEQ ID NO: 1955466 - RNA, 22 nt, Homo sapiens
uuugcauccagcagcagcacuu

SEQ ID NO: 1955467 - RNA, 20 nt, Homo sapiens
aagcgauucuccugccucag

SEQ ID NO: 1955468 - RNA, 15 nt, Homo sapiens
acgagaccuucacag

SEQ ID NO: 1955469 - RNA, 13 nt, Homo sapiens
gaauaaaacacuc

SEQ ID NO: 1955470 - RNA, 22 nt, Homo sapiens
uugcuuagccuuuaauaggcuu

SEQ ID NO: 1955471 - RNA, 16 nt, Homo sapiens
guauuuucaaccauaa

SEQ ID NO: 1955472 - RNA, 18 nt, Homo sapiens
uaaagaauauaaagccuc

SEQ ID NO: 1955473 - RNA, 21 nt, Homo sapiens
gguggccccagcugugacuga

SEQ ID NO: 1955474 - RNA, 15 nt, Homo sapiens
aucgaaaguaaaaaa

SEQ ID NO: 1955475 - RNA, 21 nt, Homo sapiens
uauuuaagaaaacaccaugga

SEQ ID NO: 1955476 - RNA, 17 nt, Homo sapiens
agucuggguccaggccu

SEQ ID NO: 1955477 - RNA, 15 nt, Homo sapiens
uucucaaguucuaag

SEQ ID NO: 1955478 - RNA, 19 nt, Homo sapiens
aucggcuggggacugcuac

SEQ ID NO: 1955479 - RNA, 16 nt, Homo sapiens
ugccauauugcacaug

SEQ ID NO: 1955480 - RNA, 17 nt, Homo sapiens
ugugcacuuaguaguuu

SEQ ID NO: 1955481 - RNA, 12 nt, Homo sapiens
cuuaacuaugag

SEQ ID NO: 1955482 - RNA, 21 nt, Homo sapiens
uagaacuaaaguaucugagau

SEQ ID NO: 1955483 - RNA, 21 nt, Homo sapiens
acgccacucauuucaucucau

SEQ ID NO: 1955484 - RNA, 17 nt, Homo sapiens
cugccaagauacuugaa

SEQ ID NO: 1955485 - RNA, 20 nt, Homo sapiens
cuuagaacauuuuaauucau

SEQ ID NO: 1955486 - RNA, 21 nt, Homo sapiens
cggguaauucuauugggauau

SEQ ID NO: 1955487 - RNA, 16 nt, Homo sapiens
gaaaagugaaccacaa

SEQ ID NO: 1955488 - RNA, 17 nt, Homo sapiens
cuucucaagcacugaca

SEQ ID NO: 1955489 - RNA, 22 nt, Homo sapiens
gagggcuuccucuagaagccaa

SEQ ID NO: 1955490 - RNA, 23 nt, Homo sapiens
aacaaauguaauuaauaacuuuc

SEQ ID NO: 1955491 - RNA, 20 nt, Homo sapiens
acugagcuucgcugaguuaa

SEQ ID NO: 1955492 - RNA, 17 nt, Homo sapiens
gagaagaaagaggugac

SEQ ID NO: 1955493 - RNA, 18 nt, Homo sapiens
uucuacuaaaccagaaau

SEQ ID NO: 1955494 - RNA, 23 nt, Homo sapiens
ccagcugcgccugcgcugcagga

SEQ ID NO: 1955495 - RNA, 16 nt, Homo sapiens
cuucccguuuccucuu

SEQ ID NO: 1955496 - RNA, 22 nt, Homo sapiens
ugugugcccagcuuauaaacag

SEQ ID NO: 1955497 - RNA, 18 nt, Homo sapiens
aaaauuuuaagcuguaca

SEQ ID NO: 1955498 - RNA, 16 nt, Homo sapiens
aaaugauuauauucac

SEQ ID NO: 1955499 - RNA, 22 nt, Homo sapiens
accaggauugacaggccaucca

SEQ ID NO: 1955500 - RNA, 15 nt, Homo sapiens
uccauuaauacuucc

SEQ ID NO: 1955501 - RNA, 19 nt, Homo sapiens
uaugcaacucaucuucaca

SEQ ID NO: 1955502 - RNA, 14 nt, Homo sapiens
uaaagagcauggaa

SEQ ID NO: 1955503 - RNA, 20 nt, Homo sapiens
auuuccccagccacaggcca

SEQ ID NO: 1955504 - RNA, 19 nt, Homo sapiens
acugccaucuuuaucauga

SEQ ID NO: 1955505 - RNA, 17 nt, Homo sapiens
aauaaaaaauauauauc

SEQ ID NO: 1955506 - RNA, 13 nt, Homo sapiens
ugccuauaaccau

SEQ ID NO: 1955507 - RNA, 20 nt, Homo sapiens
ggaaauauuuuaauguuucu

SEQ ID NO: 1955508 - RNA, 15 nt, Homo sapiens
ccaugggauguuaag

SEQ ID NO: 1955509 - RNA, 23 nt, Homo sapiens
cccauguguagguauugaaaaag

SEQ ID NO: 1955510 - RNA, 18 nt, Homo sapiens
uguaguuguugguuuauu

SEQ ID NO: 1955511 - RNA, 13 nt, Homo sapiens
uuaacaggauauu

SEQ ID NO: 1955512 - RNA, 15 nt, Homo sapiens
ucugcagugugcacg

SEQ ID NO: 1955513 - RNA, 17 nt, Homo sapiens
auaauuugaacagcuug

SEQ ID NO: 1955514 - RNA, 14 nt, Homo sapiens
aaaauagcucuugc

SEQ ID NO: 1955515 - RNA, 17 nt, Homo sapiens
ugagacuauaacuguca

SEQ ID NO: 1955516 - RNA, 11 nt, Homo sapiens
ucagcacugaa

SEQ ID NO: 1955517 - RNA, 11 nt, Homo sapiens
aauaggcuugu

SEQ ID NO: 1955518 - RNA, 20 nt, Homo sapiens
uuuaaauuaugacgugcaca

SEQ ID NO: 1955519 - RNA, 22 nt, Homo sapiens
uaggauaaaccaaucaucuuaa

SEQ ID NO: 1955520 - RNA, 19 nt, Homo sapiens
uccacgugugugugugauu

SEQ ID NO: 1955521 - RNA, 20 nt, Homo sapiens
agccuggcccuuaaacaacu

SEQ ID NO: 1955522 - RNA, 16 nt, Homo sapiens
ucucaaaugcacaucu

SEQ ID NO: 1955523 - RNA, 11 nt, Homo sapiens
acucacuucau

SEQ ID NO: 1955524 - RNA, 18 nt, Homo sapiens
auucugauuacacaaaac

SEQ ID NO: 1955525 - RNA, 18 nt, Homo sapiens
aauguaaaauaaauuggu

SEQ ID NO: 1955526 - RNA, 14 nt, Homo sapiens
ccugugugagccca

SEQ ID NO: 1955527 - RNA, 18 nt, Homo sapiens
cccaccgcaagcuuugag

SEQ ID NO: 1955528 - RNA, 11 nt, Homo sapiens
auuguaaaaug

SEQ ID NO: 1955529 - RNA, 22 nt, Homo sapiens
caccccagaaaucacugugaaa

SEQ ID NO: 1955530 - RNA, 22 nt, Homo sapiens
cagcaagucccagacaaggaga

SEQ ID NO: 1955531 - RNA, 16 nt, Homo sapiens
acucauauguggaauc

SEQ ID NO: 1955532 - RNA, 20 nt, Homo sapiens
cuauauuggaaucuguauca

SEQ ID NO: 1955533 - RNA, 15 nt, Homo sapiens
ccuguccaauuucug

SEQ ID NO: 1955534 - RNA, 18 nt, Homo sapiens
ggauuaccaaaacacugc

SEQ ID NO: 1955535 - RNA, 15 nt, Homo sapiens
ccaggacugucauuu

SEQ ID NO: 1955536 - RNA, 17 nt, Homo sapiens
auaaucacacugcggua

SEQ ID NO: 1955537 - RNA, 22 nt, Homo sapiens
caggccaccccuaggaacucag

SEQ ID NO: 1955538 - RNA, 16 nt, Homo sapiens
ucaugugguacuugag

SEQ ID NO: 1955539 - RNA, 17 nt, Homo sapiens
augagaaguacuugguu

SEQ ID NO: 1955540 - RNA, 18 nt, Homo sapiens
cagcaggagccagccaag

SEQ ID NO: 1955541 - RNA, 17 nt, Homo sapiens
uggcuggaugugcaucu

SEQ ID NO: 1955542 - RNA, 12 nt, Homo sapiens
cucgagcacuga

SEQ ID NO: 1955543 - RNA, 17 nt, Homo sapiens
aaccucucuaagccaca

SEQ ID NO: 1955544 - RNA, 15 nt, Homo sapiens
uuuauaaacugagag

SEQ ID NO: 1955545 - RNA, 18 nt, Homo sapiens
ugaaauaaacacuggugc

SEQ ID NO: 1955546 - RNA, 21 nt, Homo sapiens
cauacaggcguacacaugcac

SEQ ID NO: 1955547 - RNA, 19 nt, Homo sapiens
ggcuccuguuagcuccuca

SEQ ID NO: 1955548 - RNA, 14 nt, Homo sapiens
cugauccuugcacg

SEQ ID NO: 1955549 - RNA, 23 nt, Homo sapiens
uuagcucucauaggagacccaug

SEQ ID NO: 1955550 - RNA, 18 nt, Homo sapiens
acuguagcucaaguuuaa

SEQ ID NO: 1955551 - RNA, 16 nt, Homo sapiens
accagaccaaggcagg

SEQ ID NO: 1955552 - RNA, 19 nt, Homo sapiens
gcauuuguuccaugccugc

SEQ ID NO: 1955553 - RNA, 21 nt, Homo sapiens
cuggagauggcugcugcucac

SEQ ID NO: 1955554 - RNA, 18 nt, Homo sapiens
uuauaucuguaaugauac

SEQ ID NO: 1955555 - RNA, 12 nt, Homo sapiens
acuguagccuca

SEQ ID NO: 1955556 - RNA, 16 nt, Homo sapiens
cauccugucaccauga

SEQ ID NO: 1955557 - RNA, 16 nt, Homo sapiens
aaaguagguauacaaa

SEQ ID NO: 1955558 - RNA, 16 nt, Homo sapiens
ccucucaccccacucc

SEQ ID NO: 1955559 - RNA, 24 nt, Homo sapiens
ggcacuccuccuacucuguggaug

SEQ ID NO: 1955560 - RNA, 16 nt, Homo sapiens
ucuucccuacacgauc

SEQ ID NO: 1955561 - RNA, 17 nt, Homo sapiens
ucagacgggcacagugg

SEQ ID NO: 1955562 - RNA, 17 nt, Homo sapiens
uuguagacaaaguacau

SEQ ID NO: 1955563 - RNA, 22 nt, Homo sapiens
uacugcuucuaccaacuggaag

SEQ ID NO: 1955564 - RNA, 16 nt, Homo sapiens
ugcuguacaacuucug

SEQ ID NO: 1955565 - RNA, 10 nt, Homo sapiens
cugugccaac

SEQ ID NO: 1955566 - RNA, 22 nt, Homo sapiens
cagccuggcugggcucuggugg

SEQ ID NO: 1955567 - RNA, 23 nt, Homo sapiens
cuguuaacuaguguuucugcaga

SEQ ID NO: 1955568 - RNA, 16 nt, Homo sapiens
ugcucagcagccaguc

SEQ ID NO: 1955569 - RNA, 17 nt, Homo sapiens
uucacagaggucuuuca

SEQ ID NO: 1955570 - RNA, 22 nt, Homo sapiens
gcucccccuucccaguagcucu

SEQ ID NO: 1955571 - RNA, 17 nt, Homo sapiens
guaaacagaagccuguu

SEQ ID NO: 1955572 - RNA, 16 nt, Homo sapiens
uucugcccauucucuc

SEQ ID NO: 1955573 - RNA, 16 nt, Homo sapiens
caugccccuggaccag

SEQ ID NO: 1955574 - RNA, 12 nt, Homo sapiens
uuaagagcucac

SEQ ID NO: 1955575 - RNA, 12 nt, Homo sapiens
augcuuauuaga

SEQ ID NO: 1955576 - RNA, 19 nt, Homo sapiens
aaaccccuucucugugacc

SEQ ID NO: 1955577 - RNA, 11 nt, Homo sapiens
agcagguaguu

SEQ ID NO: 1955578 - RNA, 16 nt, Homo sapiens
agccucuggcuagagg

SEQ ID NO: 1955579 - RNA, 20 nt, Homo sapiens
aggaucugugauuggcuggu

SEQ ID NO: 1955580 - RNA, 19 nt, Homo sapiens
aauugauuaguuugccuaa

SEQ ID NO: 1955581 - RNA, 18 nt, Homo sapiens
aggcugcggcuugcccag

SEQ ID NO: 1955582 - RNA, 15 nt, Homo sapiens
ccauuugggugggag

SEQ ID NO: 1955583 - RNA, 13 nt, Homo sapiens
ccaagacagugag

SEQ ID NO: 1955584 - RNA, 13 nt, Homo sapiens
gagucucaagggu

SEQ ID NO: 1955585 - RNA, 14 nt, Homo sapiens
aauuuaucaucucg

SEQ ID NO: 1955586 - RNA, 16 nt, Homo sapiens
acugauuaacaaauaa

SEQ ID NO: 1955587 - RNA, 22 nt, Homo sapiens
ucuuucuaacuccagugaagua

SEQ ID NO: 1955588 - RNA, 17 nt, Homo sapiens
cacagggaacacauucc

SEQ ID NO: 1955589 - RNA, 16 nt, Homo sapiens
gaacaccauugaggga

SEQ ID NO: 1955590 - RNA, 22 nt, Homo sapiens
cccucgaggcggaucuuuggac

SEQ ID NO: 1955591 - RNA, 12 nt, Homo sapiens
gcuggccucuag

SEQ ID NO: 1955592 - RNA, 12 nt, Homo sapiens
gcacgccucuuc

SEQ ID NO: 1955593 - RNA, 22 nt, Homo sapiens
caccaaaugcuuuuugaucugu

SEQ ID NO: 1955594 - RNA, 17 nt, Homo sapiens
cugcaggggcuacguua

SEQ ID NO: 1955595 - RNA, 14 nt, Homo sapiens
guacagacagagaa

SEQ ID NO: 1955596 - RNA, 20 nt, Homo sapiens
auucuuguaaauacauaaaa

SEQ ID NO: 1955597 - RNA, 15 nt, Homo sapiens
gcucccgaguacagu

SEQ ID NO: 1955598 - RNA, 18 nt, Homo sapiens
uuaaaaccagaaagguga

SEQ ID NO: 1955599 - RNA, 14 nt, Homo sapiens
gauccagcucagaa

SEQ ID NO: 1955600 - RNA, 15 nt, Homo sapiens
ccucaggggccucuc

SEQ ID NO: 1955601 - RNA, 22 nt, Homo sapiens
augugauauuuuucuuauaauu

SEQ ID NO: 1955602 - RNA, 15 nt, Homo sapiens
ggccaggacaaaaug

SEQ ID NO: 1955603 - RNA, 22 nt, Homo sapiens
cugugccugcugggcacugggc

SEQ ID NO: 1955604 - RNA, 22 nt, Homo sapiens
ggcaugaaugagacccagcuga

SEQ ID NO: 1955605 - RNA, 14 nt, Homo sapiens
cacacacaaggugc

SEQ ID NO: 1955606 - RNA, 23 nt, Homo sapiens
uaaaaaggaaguggggacagauu

SEQ ID NO: 1955607 - RNA, 18 nt, Homo sapiens
acaugguggcaugcaccu

SEQ ID NO: 1955608 - RNA, 20 nt, Homo sapiens
uauuaucuacaaacacugca

SEQ ID NO: 1955609 - RNA, 19 nt, Homo sapiens
cuuuucucagcuggaugau

SEQ ID NO: 1955610 - RNA, 17 nt, Homo sapiens
cuauuuuuauacuuuau

SEQ ID NO: 1955611 - RNA, 15 nt, Homo sapiens
aaaguuaaccuaccu

SEQ ID NO: 1955612 - RNA, 17 nt, Homo sapiens
cggacugcccccagaaa

SEQ ID NO: 1955613 - RNA, 16 nt, Homo sapiens
uuggggcccagugcau

SEQ ID NO: 1955614 - RNA, 17 nt, Homo sapiens
cuggcucuacacauaua

SEQ ID NO: 1955615 - RNA, 21 nt, Homo sapiens
uucuucuuugacuauaacaaa

SEQ ID NO: 1955616 - RNA, 23 nt, Homo sapiens
cucaguguccagacuuucuguaa

SEQ ID NO: 1955617 - RNA, 16 nt, Homo sapiens
gaacugaaaaccaguc

SEQ ID NO: 1955618 - RNA, 14 nt, Homo sapiens
caggcgauggacaa

SEQ ID NO: 1955619 - RNA, 18 nt, Homo sapiens
agcuucuuuacuacugca

SEQ ID NO: 1955620 - RNA, 17 nt, Homo sapiens
ugccaaauaaaugcuca

SEQ ID NO: 1955621 - RNA, 14 nt, Homo sapiens
uaccuuacugcaau

SEQ ID NO: 1955622 - RNA, 18 nt, Homo sapiens
cccgguaaguaaacaguc

SEQ ID NO: 1955623 - RNA, 20 nt, Homo sapiens
cuuggaggugucuguaucag

SEQ ID NO: 1955624 - RNA, 15 nt, Homo sapiens
uccucagccaaggaa

SEQ ID NO: 1955625 - RNA, 17 nt, Homo sapiens
acucugacaacagacuu

SEQ ID NO: 1955626 - RNA, 18 nt, Homo sapiens
gacuagacauaguaccga

SEQ ID NO: 1955627 - RNA, 22 nt, Homo sapiens
caggaggggggagggaagggag

SEQ ID NO: 1955628 - RNA, 11 nt, Homo sapiens
uugaugccagu

SEQ ID NO: 1955629 - RNA, 14 nt, Homo sapiens
caguuuacaguauu

SEQ ID NO: 1955630 - RNA, 14 nt, Homo sapiens
aguagaaccaguga

SEQ ID NO: 1955631 - RNA, 21 nt, Homo sapiens
uggaguaugucugauggaucc

SEQ ID NO: 1955632 - RNA, 17 nt, Homo sapiens
ugaauauaaagcuuaau

SEQ ID NO: 1955633 - RNA, 20 nt, Homo sapiens
augcuaaauaguucuaucag

SEQ ID NO: 1955634 - RNA, 17 nt, Homo sapiens
guaaauauuaaguguuu

SEQ ID NO: 1955635 - RNA, 14 nt, Homo sapiens
ugaaagcucagcug

SEQ ID NO: 1955636 - RNA, 13 nt, Homo sapiens
acaucacuugaga

SEQ ID NO: 1955637 - RNA, 15 nt, Homo sapiens
uccauggaugcaugc

SEQ ID NO: 1955638 - RNA, 16 nt, Homo sapiens
ucuugaauagucucau

SEQ ID NO: 1955639 - RNA, 22 nt, Homo sapiens
cacugugcccggccuguguaca

SEQ ID NO: 1955640 - RNA, 19 nt, Homo sapiens
acauucagcacacugugaa

SEQ ID NO: 1955641 - RNA, 22 nt, Homo sapiens
gccccacuccucuccaccagac

SEQ ID NO: 1955642 - RNA, 22 nt, Homo sapiens
auauuucaaaggaaaguuuuaa

SEQ ID NO: 1955643 - RNA, 20 nt, Homo sapiens
agcccucagacugucaggca

SEQ ID NO: 1955644 - RNA, 21 nt, Homo sapiens
accuaugucccuucucaugcc

SEQ ID NO: 1955645 - RNA, 17 nt, Homo sapiens
guguuuuaaaauugaug

SEQ ID NO: 1955646 - RNA, 17 nt, Homo sapiens
accuuauuuuuucccaa

SEQ ID NO: 1955647 - RNA, 11 nt, Homo sapiens
uucccacucac

SEQ ID NO: 1955648 - RNA, 13 nt, Homo sapiens
aaccuaaugcacu

SEQ ID NO: 1955649 - RNA, 16 nt, Homo sapiens
uuggugaauuucacaa

SEQ ID NO: 1955650 - RNA, 19 nt, Homo sapiens
acaggcaaaacucaguaga

SEQ ID NO: 1955651 - RNA, 20 nt, Homo sapiens
uugcuacaaauagugcuaau

SEQ ID NO: 1955652 - RNA, 16 nt, Homo sapiens
acugaaauauacacac

SEQ ID NO: 1955653 - RNA, 15 nt, Homo sapiens
cuuauaaauaugaag

SEQ ID NO: 1955654 - RNA, 14 nt, Homo sapiens
cagccacugucaca

SEQ ID NO: 1955655 - RNA, 17 nt, Homo sapiens
uuaaagagggacaggcu

SEQ ID NO: 1955656 - RNA, 14 nt, Homo sapiens
uuuaugauuccacc

SEQ ID NO: 1955657 - RNA, 18 nt, Homo sapiens
aagccuuaaaaugcauug

SEQ ID NO: 1955658 - RNA, 19 nt, Homo sapiens
uuaagaauguugguuuacu

SEQ ID NO: 1955659 - RNA, 16 nt, Homo sapiens
cggacacaaccaaauc

SEQ ID NO: 1955660 - RNA, 12 nt, Homo sapiens
ccuuuugcaaau

SEQ ID NO: 1955661 - RNA, 12 nt, Homo sapiens
caauuugcacuu

SEQ ID NO: 1955662 - RNA, 12 nt, Homo sapiens
acucuugccaac

SEQ ID NO: 1955663 - RNA, 16 nt, Homo sapiens
aggggcaccugggaaa

SEQ ID NO: 1955664 - RNA, 18 nt, Homo sapiens
aguugaagggaggggcug

SEQ ID NO: 1955665 - RNA, 22 nt, Homo sapiens
cacuggaaacaacagacucuua

SEQ ID NO: 1955666 - RNA, 20 nt, Homo sapiens
cuugacuguuaguuguccac

SEQ ID NO: 1955667 - RNA, 16 nt, Homo sapiens
gggccacaaggcacag

SEQ ID NO: 1955668 - RNA, 22 nt, Homo sapiens
ugaaauaaagauaaaugcaacc

SEQ ID NO: 1955669 - RNA, 20 nt, Homo sapiens
augugaaguguauaugauuc

SEQ ID NO: 1955670 - RNA, 17 nt, Homo sapiens
aucucauagguugccaa

SEQ ID NO: 1955671 - RNA, 15 nt, Homo sapiens
agcuggagaucuuaa

SEQ ID NO: 1955672 - RNA, 14 nt, Homo sapiens
cagcuuccaaacau

SEQ ID NO: 1955673 - RNA, 19 nt, Homo sapiens
gugccaccacgcccagcua

SEQ ID NO: 1955674 - RNA, 16 nt, Homo sapiens
cuuaucuuacaacucc

SEQ ID NO: 1955675 - RNA, 17 nt, Homo sapiens
ccacccucaaaugucag

SEQ ID NO: 1955676 - RNA, 16 nt, Homo sapiens
caaagaccaugaggag

SEQ ID NO: 1955677 - RNA, 16 nt, Homo sapiens
ccuccuucaaaaagca

SEQ ID NO: 1955678 - RNA, 17 nt, Homo sapiens
aaguucauccaacguga

SEQ ID NO: 1955679 - RNA, 15 nt, Homo sapiens
uaucacaucacacaa

SEQ ID NO: 1955680 - RNA, 21 nt, Homo sapiens
uuuuuaugaagugcgugaaug

SEQ ID NO: 1955681 - RNA, 13 nt, Homo sapiens
ggaccucaggggc

SEQ ID NO: 1955682 - RNA, 22 nt, Homo sapiens
uacuuccaauuuauaaugaaua

SEQ ID NO: 1955683 - RNA, 14 nt, Homo sapiens
agguuagaaaggca

SEQ ID NO: 1955684 - RNA, 20 nt, Homo sapiens
ucugauuuuugucccaguag

SEQ ID NO: 1955685 - RNA, 15 nt, Homo sapiens
cuuacuuaggugugg

SEQ ID NO: 1955686 - RNA, 14 nt, Homo sapiens
ccugaauccauuaa

SEQ ID NO: 1955687 - RNA, 15 nt, Homo sapiens
uagcaacacaucuac

SEQ ID NO: 1955688 - RNA, 13 nt, Homo sapiens
agccaagugcccu

SEQ ID NO: 1955689 - RNA, 10 nt, Homo sapiens
uuauuauucu

SEQ ID NO: 1955690 - RNA, 16 nt, Homo sapiens
uguaacaacuaaagua

SEQ ID NO: 1955691 - RNA, 19 nt, Homo sapiens
accccuuccccauuuccuc

SEQ ID NO: 1955692 - RNA, 21 nt, Homo sapiens
agcuaccucaaacuuccaguc

SEQ ID NO: 1955693 - RNA, 14 nt, Homo sapiens
ucaaguuaauucuc

SEQ ID NO: 1955694 - RNA, 23 nt, Homo sapiens
gagaucuucaaugcuuccuccuu

SEQ ID NO: 1955695 - RNA, 18 nt, Homo sapiens
acuggggagcacaggugu

SEQ ID NO: 1955696 - RNA, 23 nt, Homo sapiens
uucaaaauagguuuuuauuguug

SEQ ID NO: 1955697 - RNA, 12 nt, Homo sapiens
uuuuagcccagu

SEQ ID NO: 1955698 - RNA, 12 nt, Homo sapiens
uuugagcccagg

SEQ ID NO: 1955699 - RNA, 13 nt, Homo sapiens
auuaaccugguca

SEQ ID NO: 1955700 - RNA, 20 nt, Homo sapiens
uguccccaaaaugugaugcu

SEQ ID NO: 1955701 - RNA, 23 nt, Homo sapiens
ugcagcugggccccaugcucugc

SEQ ID NO: 1955702 - RNA, 20 nt, Homo sapiens
uaccuggauuugggaugaaa

SEQ ID NO: 1955703 - RNA, 13 nt, Homo sapiens
accaacaauguga

SEQ ID NO: 1955704 - RNA, 13 nt, Homo sapiens
aucuagcauguaa

SEQ ID NO: 1955705 - RNA, 19 nt, Homo sapiens
uugugucacugacucaggc

SEQ ID NO: 1955706 - RNA, 16 nt, Homo sapiens
aaaacauguaugugca

SEQ ID NO: 1955707 - RNA, 13 nt, Homo sapiens
gcccacaccaacg

SEQ ID NO: 1955708 - RNA, 17 nt, Homo sapiens
auauuuuaauaaaguag

SEQ ID NO: 1955709 - RNA, 15 nt, Homo sapiens
aguaggauccaguga

SEQ ID NO: 1955710 - RNA, 23 nt, Homo sapiens
aacacaauacauguuuucacuua

SEQ ID NO: 1955711 - RNA, 19 nt, Homo sapiens
agucuuacucugucuccca

SEQ ID NO: 1955712 - RNA, 17 nt, Homo sapiens
cugcucugaggcuucca

SEQ ID NO: 1955713 - RNA, 22 nt, Homo sapiens
acuuaaggagaaauagcuguau

SEQ ID NO: 1955714 - RNA, 17 nt, Homo sapiens
gaaggggcgugucccuc

SEQ ID NO: 1955715 - RNA, 21 nt, Homo sapiens
aauuuaucuacaugcauuuca

SEQ ID NO: 1955716 - RNA, 20 nt, Homo sapiens
agaaggcuucuuagcgcagu

SEQ ID NO: 1955717 - RNA, 17 nt, Homo sapiens
ugcgaguauguguuugu

SEQ ID NO: 1955718 - RNA, 17 nt, Homo sapiens
ugaggaauauuugcaag

SEQ ID NO: 1955719 - RNA, 20 nt, Homo sapiens
uauguggacguaaucuccac

SEQ ID NO: 1955720 - RNA, 16 nt, Homo sapiens
acauuugguugcuacu

SEQ ID NO: 1955721 - RNA, 20 nt, Homo sapiens
aaauugagaccugagugaag

SEQ ID NO: 1955722 - RNA, 14 nt, Homo sapiens
uuucuaaaccuugu

SEQ ID NO: 1955723 - RNA, 19 nt, Homo sapiens
gucagggcccaagucccug

SEQ ID NO: 1955724 - RNA, 14 nt, Homo sapiens
uggacaaaauggaa

SEQ ID NO: 1955725 - RNA, 15 nt, Homo sapiens
agggauaauacugug

SEQ ID NO: 1955726 - RNA, 13 nt, Homo sapiens
aaugaacaucucu

SEQ ID NO: 1955727 - RNA, 14 nt, Homo sapiens
auuacauagacugu

SEQ ID NO: 1955728 - RNA, 20 nt, Homo sapiens
cacagcuucauuuccugugu

SEQ ID NO: 1955729 - RNA, 19 nt, Homo sapiens
agcuaagaaauaaaacugu

SEQ ID NO: 1955730 - RNA, 22 nt, Homo sapiens
aucuugaauccuuccauuccac

SEQ ID NO: 1955731 - RNA, 18 nt, Homo sapiens
gaguucuccugcucccca

SEQ ID NO: 1955732 - RNA, 20 nt, Homo sapiens
aucuuuguuuuuuguuuuca

SEQ ID NO: 1955733 - RNA, 14 nt, Homo sapiens
ugggaauucuugcu

SEQ ID NO: 1955734 - RNA, 9 nt, Homo sapiens
ccacaaagg

SEQ ID NO: 1955735 - RNA, 21 nt, Homo sapiens
auggcucagaugccacuucaa

SEQ ID NO: 1955736 - RNA, 23 nt, Homo sapiens
cuuccguggucagagugccacug

SEQ ID NO: 1955737 - RNA, 18 nt, Homo sapiens
uccaagucuguaccucaa

SEQ ID NO: 1955738 - RNA, 13 nt, Homo sapiens
uugcuuguuacau

SEQ ID NO: 1955739 - RNA, 22 nt, Homo sapiens
gagccaacaacucugauuaacu

SEQ ID NO: 1955740 - RNA, 13 nt, Homo sapiens
uguggucagagag

SEQ ID NO: 1955741 - RNA, 14 nt, Homo sapiens
uugucauccuuuga

SEQ ID NO: 1955742 - RNA, 22 nt, Homo sapiens
caauuaauuccuucagcacuuu

SEQ ID NO: 1955743 - RNA, 12 nt, Homo sapiens
agucagugucau

SEQ ID NO: 1955744 - RNA, 15 nt, Homo sapiens
gccaggggugcuccu

SEQ ID NO: 1955745 - RNA, 19 nt, Homo sapiens
cggccacauuugguucuaa

SEQ ID NO: 1955746 - RNA, 11 nt, Homo sapiens
cucuaccuaau

SEQ ID NO: 1955747 - RNA, 20 nt, Homo sapiens
ccaugcucccuuaaucccca

SEQ ID NO: 1955748 - RNA, 20 nt, Homo sapiens
uuaaacugaaugaacaaccu

SEQ ID NO: 1955749 - RNA, 17 nt, Homo sapiens
caaccuuuguguggcuc

SEQ ID NO: 1955750 - RNA, 17 nt, Homo sapiens
cacuagucuguguaacu

SEQ ID NO: 1955751 - RNA, 19 nt, Homo sapiens
accugaaccugggaaccau

SEQ ID NO: 1955752 - RNA, 12 nt, Homo sapiens
ugaaaugcauuu

SEQ ID NO: 1955753 - RNA, 20 nt, Homo sapiens
caccaagcagcaacagcaaa

SEQ ID NO: 1955754 - RNA, 19 nt, Homo sapiens
cuauaugccauaaaccuca

SEQ ID NO: 1955755 - RNA, 15 nt, Homo sapiens
guuaugacuauguaa

SEQ ID NO: 1955756 - RNA, 14 nt, Homo sapiens
cauugcacuuugau

SEQ ID NO: 1955757 - RNA, 16 nt, Homo sapiens
agcugaggccuaugca

SEQ ID NO: 1955758 - RNA, 13 nt, Homo sapiens
uguuuagcauuaa

SEQ ID NO: 1955759 - RNA, 21 nt, Homo sapiens
agaaaaauaugaccacacucc

SEQ ID NO: 1955760 - RNA, 12 nt, Homo sapiens
cagaguccuaca

SEQ ID NO: 1955761 - RNA, 20 nt, Homo sapiens
uccugcccccagucuggguu

SEQ ID NO: 1955762 - RNA, 12 nt, Homo sapiens
ccguguccuccu

SEQ ID NO: 1955763 - RNA, 23 nt, Homo sapiens
uccaaaagggggccccuugagaa

SEQ ID NO: 1955764 - RNA, 17 nt, Homo sapiens
uaaaugccaacugguca

SEQ ID NO: 1955765 - RNA, 21 nt, Homo sapiens
uggaccaugaaugauaugcua

SEQ ID NO: 1955766 - RNA, 12 nt, Homo sapiens
aaucagacugaa

SEQ ID NO: 1955767 - RNA, 16 nt, Homo sapiens
cuccugugcauuguag

SEQ ID NO: 1955768 - RNA, 14 nt, Homo sapiens
agucaugcacucag

SEQ ID NO: 1955769 - RNA, 14 nt, Homo sapiens
acagaggcagagau

SEQ ID NO: 1955770 - RNA, 13 nt, Homo sapiens
cauaucuuuauua

SEQ ID NO: 1955771 - RNA, 13 nt, Homo sapiens
uucuucuucucaa

SEQ ID NO: 1955772 - RNA, 14 nt, Homo sapiens
ucucaugaagcccu

SEQ ID NO: 1955773 - RNA, 18 nt, Homo sapiens
cuuuuuuuuaguucaaua

SEQ ID NO: 1955774 - RNA, 12 nt, Homo sapiens
cuggaauucuuc

SEQ ID NO: 1955775 - RNA, 18 nt, Homo sapiens
guuugguaguuuugccaa

SEQ ID NO: 1955776 - RNA, 12 nt, Homo sapiens
cacagucauuca

SEQ ID NO: 1955777 - RNA, 12 nt, Homo sapiens
aaauuuuacuuc

SEQ ID NO: 1955778 - RNA, 13 nt, Homo sapiens
cccuccugccuca

SEQ ID NO: 1955779 - RNA, 17 nt, Homo sapiens
ugcugaggcccagugca

SEQ ID NO: 1955780 - RNA, 17 nt, Homo sapiens
uuuaacuuaacauucug

SEQ ID NO: 1955781 - RNA, 16 nt, Homo sapiens
uauuccacuuaggaag

SEQ ID NO: 1955782 - RNA, 15 nt, Homo sapiens
gucuagcauucugca

SEQ ID NO: 1955783 - RNA, 17 nt, Homo sapiens
uucuuugaaaauucugg

SEQ ID NO: 1955784 - RNA, 15 nt, Homo sapiens
acaaggcugaccaag

SEQ ID NO: 1955785 - RNA, 17 nt, Homo sapiens
ucccaggaaagaagcau

SEQ ID NO: 1955786 - RNA, 15 nt, Homo sapiens
guaaauuuuuaggca

SEQ ID NO: 1955787 - RNA, 17 nt, Homo sapiens
uuacacuaaaugauauu

SEQ ID NO: 1955788 - RNA, 22 nt, Homo sapiens
auuuaggaccgugggucaugca

SEQ ID NO: 1955789 - RNA, 16 nt, Homo sapiens
ugauagaauaaagccu

SEQ ID NO: 1955790 - RNA, 14 nt, Homo sapiens
cucacagagugcau

SEQ ID NO: 1955791 - RNA, 22 nt, Homo sapiens
cugcugacugccaauaacauuc

SEQ ID NO: 1955792 - RNA, 20 nt, Homo sapiens
uugacuaaguuuuuauacca

SEQ ID NO: 1955793 - RNA, 20 nt, Homo sapiens
acuaaauggcugcagaacuc

SEQ ID NO: 1955794 - RNA, 16 nt, Homo sapiens
uggggauaaagacaga

SEQ ID NO: 1955795 - RNA, 15 nt, Homo sapiens
gaaacagcagcucca

SEQ ID NO: 1955796 - RNA, 18 nt, Homo sapiens
uuucaaaguguugauggu

SEQ ID NO: 1955797 - RNA, 20 nt, Homo sapiens
ucucacugcugucagccaag

SEQ ID NO: 1955798 - RNA, 11 nt, Homo sapiens
cuaacagacaa

SEQ ID NO: 1955799 - RNA, 18 nt, Homo sapiens
aaguuugggaagggaugg

SEQ ID NO: 1955800 - RNA, 23 nt, Homo sapiens
aaaauauauuugcauaauaugca

SEQ ID NO: 1955801 - RNA, 22 nt, Homo sapiens
auccugaggcuccacuuggucu

SEQ ID NO: 1955802 - RNA, 16 nt, Homo sapiens
agaccaaaguuugcaa

SEQ ID NO: 1955803 - RNA, 13 nt, Homo sapiens
cacccguguucuc

SEQ ID NO: 1955804 - RNA, 17 nt, Homo sapiens
aggcaucacaugcucaa

SEQ ID NO: 1955805 - RNA, 22 nt, Homo sapiens
uaaucaaaauugucucuucuga

SEQ ID NO: 1955806 - RNA, 19 nt, Homo sapiens
aucugacaucucugcaauc

SEQ ID NO: 1955807 - RNA, 13 nt, Homo sapiens
cuccucugugacu

SEQ ID NO: 1955808 - RNA, 14 nt, Homo sapiens
auauuuagucugca

SEQ ID NO: 1955809 - RNA, 23 nt, Homo sapiens
ugaaaucuacaacauaaugauac

SEQ ID NO: 1955810 - RNA, 16 nt, Homo sapiens
cauuguaaaucacuug

SEQ ID NO: 1955811 - RNA, 16 nt, Homo sapiens
cuuaauacccuaauaa

SEQ ID NO: 1955812 - RNA, 16 nt, Homo sapiens
ucaauaaaccacaagc

SEQ ID NO: 1955813 - RNA, 17 nt, Homo sapiens
cccuguaccugugcacg

SEQ ID NO: 1955814 - RNA, 15 nt, Homo sapiens
ugggcgucugagcug

SEQ ID NO: 1955815 - RNA, 14 nt, Homo sapiens
agcuaacauuccau

SEQ ID NO: 1955816 - RNA, 14 nt, Homo sapiens
ugcuaucaauccaa

SEQ ID NO: 1955817 - RNA, 21 nt, Homo sapiens
augugcacucauacauaugua

SEQ ID NO: 1955818 - RNA, 14 nt, Homo sapiens
acaauucaguuuua

SEQ ID NO: 1955819 - RNA, 12 nt, Homo sapiens
gggcaacugaga

SEQ ID NO: 1955820 - RNA, 12 nt, Homo sapiens
guuccagacuca

SEQ ID NO: 1955821 - RNA, 20 nt, Homo sapiens
agaauggagaggaacacagg

SEQ ID NO: 1955822 - RNA, 21 nt, Homo sapiens
cagaagcuuccugagcuucaa

SEQ ID NO: 1955823 - RNA, 20 nt, Homo sapiens
cugcuggagccaggccuucc

SEQ ID NO: 1955824 - RNA, 14 nt, Homo sapiens
uguaauccuguaca

SEQ ID NO: 1955825 - RNA, 14 nt, Homo sapiens
aggcauccaggcca

SEQ ID NO: 1955826 - RNA, 14 nt, Homo sapiens
acaagacauugugu

SEQ ID NO: 1955827 - RNA, 22 nt, Homo sapiens
auugcuuuaagaaacuguuacu

SEQ ID NO: 1955828 - RNA, 11 nt, Homo sapiens
aaaauggaacu

SEQ ID NO: 1955829 - RNA, 20 nt, Homo sapiens
aagucuaaaugaaguuauua

SEQ ID NO: 1955830 - RNA, 22 nt, Homo sapiens
agauuccugguuaaauuugaau

SEQ ID NO: 1955831 - RNA, 21 nt, Homo sapiens
ucuuccuuucuaaaucugaga

SEQ ID NO: 1955832 - RNA, 14 nt, Homo sapiens
cucggagcauauau

SEQ ID NO: 1955833 - RNA, 23 nt, Homo sapiens
caaguuucugauaccacugcacu

SEQ ID NO: 1955834 - RNA, 14 nt, Homo sapiens
cgugugcacacuca

SEQ ID NO: 1955835 - RNA, 21 nt, Homo sapiens
uccagaaagcuaaaauuuaau

SEQ ID NO: 1955836 - RNA, 15 nt, Homo sapiens
uucaaaacauacaag

SEQ ID NO: 1955837 - RNA, 14 nt, Homo sapiens
ggcucagugccacc

SEQ ID NO: 1955838 - RNA, 21 nt, Homo sapiens
agggacacuccaacucuacac

SEQ ID NO: 1955839 - RNA, 17 nt, Homo sapiens
gacugugccagcacaaa

SEQ ID NO: 1955840 - RNA, 18 nt, Homo sapiens
gaagcagcaacuugcaag

SEQ ID NO: 1955841 - RNA, 17 nt, Homo sapiens
cauuaaauaugugaaau

SEQ ID NO: 1955842 - RNA, 17 nt, Homo sapiens
aauucccuuucauuuga

SEQ ID NO: 1955843 - RNA, 14 nt, Homo sapiens
cucccaaguccaca

SEQ ID NO: 1955844 - RNA, 17 nt, Homo sapiens
ucaccacccaacaguga

SEQ ID NO: 1955845 - RNA, 15 nt, Homo sapiens
gaaagagaguaccau

SEQ ID NO: 1955846 - RNA, 16 nt, Homo sapiens
uagagcuagauguguc

SEQ ID NO: 1955847 - RNA, 13 nt, Homo sapiens
cucuaacaaaaug

SEQ ID NO: 1955848 - RNA, 20 nt, Homo sapiens
uacuguaggaauuuucuuga

SEQ ID NO: 1955849 - RNA, 21 nt, Homo sapiens
ugcauaaacuguuguaugccu

SEQ ID NO: 1955850 - RNA, 19 nt, Homo sapiens
gaaaggcaagagcucaagg

SEQ ID NO: 1955851 - RNA, 14 nt, Homo sapiens
aaaaugaacuguau

SEQ ID NO: 1955852 - RNA, 22 nt, Homo sapiens
ucaagugauucuccugccucag

SEQ ID NO: 1955853 - RNA, 15 nt, Homo sapiens
accaguggugccuug

SEQ ID NO: 1955854 - RNA, 21 nt, Homo sapiens
cagacucuacagaggccaugg

SEQ ID NO: 1955855 - RNA, 19 nt, Homo sapiens
ccuggggcagaaagccaca

SEQ ID NO: 1955856 - RNA, 15 nt, Homo sapiens
cuucagcauuuucca

SEQ ID NO: 1955857 - RNA, 19 nt, Homo sapiens
cugccccacuucucuacuc

SEQ ID NO: 1955858 - RNA, 12 nt, Homo sapiens
uuaaaccaccua

SEQ ID NO: 1955859 - RNA, 19 nt, Homo sapiens
aaagcaaaauacaucagcu

SEQ ID NO: 1955860 - RNA, 15 nt, Homo sapiens
cuccaggaaugaucu

SEQ ID NO: 1955861 - RNA, 18 nt, Homo sapiens
cauuggauccuacucaac

SEQ ID NO: 1955862 - RNA, 14 nt, Homo sapiens
uccccacuccccca

SEQ ID NO: 1955863 - RNA, 14 nt, Homo sapiens
cugcaccuuugcac

SEQ ID NO: 1955864 - RNA, 14 nt, Homo sapiens
ucuucccuccuucc

SEQ ID NO: 1955865 - RNA, 17 nt, Homo sapiens
agacagagggucucaga

SEQ ID NO: 1955866 - RNA, 18 nt, Homo sapiens
ugcagggccgccagggag

SEQ ID NO: 1955867 - RNA, 17 nt, Homo sapiens
uuauuucggagcgcaau

SEQ ID NO: 1955868 - RNA, 19 nt, Homo sapiens
cucagacuggagggcaagg

SEQ ID NO: 1955869 - RNA, 16 nt, Homo sapiens
uggggauuuucacuga

SEQ ID NO: 1955870 - RNA, 23 nt, Homo sapiens
agaaaccaaggccccgagcucag

SEQ ID NO: 1955871 - RNA, 19 nt, Homo sapiens
aggugguggugguggugaa

SEQ ID NO: 1955872 - RNA, 22 nt, Homo sapiens
acuugaacaaaaucuguugcca

SEQ ID NO: 1955873 - RNA, 16 nt, Homo sapiens
aggguguaggggccac

SEQ ID NO: 1955874 - RNA, 14 nt, Homo sapiens
uugcaugugcugca

SEQ ID NO: 1955875 - RNA, 13 nt, Homo sapiens
agaaauucauuaa

SEQ ID NO: 1955876 - RNA, 14 nt, Homo sapiens
uagguugugcaaau

SEQ ID NO: 1955877 - RNA, 21 nt, Homo sapiens
aaccugccagggagacagagc

SEQ ID NO: 1955878 - RNA, 15 nt, Homo sapiens
cccucugccuuugag

SEQ ID NO: 1955879 - RNA, 19 nt, Homo sapiens
ucuuugaauaaagucugag

SEQ ID NO: 1955880 - RNA, 23 nt, Homo sapiens
gagagcccugggcuggaggcuga

SEQ ID NO: 1955881 - RNA, 20 nt, Homo sapiens
ucacccaggcugcagugcaa

SEQ ID NO: 1955882 - RNA, 18 nt, Homo sapiens
gggcuucaaucacuguaa

SEQ ID NO: 1955883 - RNA, 15 nt, Homo sapiens
acucucagcuugcug

SEQ ID NO: 1955884 - RNA, 23 nt, Homo sapiens
augucauuuucagauccuuccaa

SEQ ID NO: 1955885 - RNA, 17 nt, Homo sapiens
ccaugcaucacuauuca

SEQ ID NO: 1955886 - RNA, 17 nt, Homo sapiens
ccuggcagcaaacugcu

SEQ ID NO: 1955887 - RNA, 14 nt, Homo sapiens
aaccucacugcccu

SEQ ID NO: 1955888 - RNA, 13 nt, Homo sapiens
cuguguacuguac

SEQ ID NO: 1955889 - RNA, 19 nt, Homo sapiens
uuacuucauauuguugcau

SEQ ID NO: 1955890 - RNA, 20 nt, Homo sapiens
cacaaacuugauugugcaua

SEQ ID NO: 1955891 - RNA, 23 nt, Homo sapiens
aagcauuuuacaagaucuugcau

SEQ ID NO: 1955892 - RNA, 16 nt, Homo sapiens
ugucauuuuuaucuau

SEQ ID NO: 1955893 - RNA, 16 nt, Homo sapiens
cauugauucaugucuc

SEQ ID NO: 1955894 - RNA, 19 nt, Homo sapiens
gucaaugagguuaugagaa

SEQ ID NO: 1955895 - RNA, 21 nt, Homo sapiens
uaauuugauuaauuuaauuca

SEQ ID NO: 1955896 - RNA, 21 nt, Homo sapiens
ucaccuaggacugacucggca

SEQ ID NO: 1955897 - RNA, 13 nt, Homo sapiens
agugcauuugccu

SEQ ID NO: 1955898 - RNA, 14 nt, Homo sapiens
aagaacaucuggau

SEQ ID NO: 1955899 - RNA, 21 nt, Homo sapiens
uuucaagaaaugacugaggua

SEQ ID NO: 1955900 - RNA, 18 nt, Homo sapiens
uaccuuuucucacaaaaa

SEQ ID NO: 1955901 - RNA, 21 nt, Homo sapiens
ucuggacacucaaacacauca

SEQ ID NO: 1955902 - RNA, 14 nt, Homo sapiens
gugucuuaauuguc

SEQ ID NO: 1955903 - RNA, 20 nt, Homo sapiens
aucagccacaccuuuuccag

SEQ ID NO: 1955904 - RNA, 13 nt, Homo sapiens
cagggaucuugca

SEQ ID NO: 1955905 - RNA, 16 nt, Homo sapiens
aucagugaggagggau

SEQ ID NO: 1955906 - RNA, 18 nt, Homo sapiens
ggcucauucuucuuggcu

SEQ ID NO: 1955907 - RNA, 19 nt, Homo sapiens
cagccacacccaggcacuu

SEQ ID NO: 1955908 - RNA, 19 nt, Homo sapiens
accauauugugcuucacag

SEQ ID NO: 1955909 - RNA, 16 nt, Homo sapiens
aagcaugugucaugca

SEQ ID NO: 1955910 - RNA, 14 nt, Homo sapiens
cuagggaugguaau

SEQ ID NO: 1955911 - RNA, 18 nt, Homo sapiens
cuuaaccuauucccaaau

SEQ ID NO: 1955912 - RNA, 21 nt, Homo sapiens
ucuuacguucuuucacuucaa

SEQ ID NO: 1955913 - RNA, 14 nt, Homo sapiens
ugcucuugccauag

SEQ ID NO: 1955914 - RNA, 16 nt, Homo sapiens
caagccagcaugugug

SEQ ID NO: 1955915 - RNA, 23 nt, Homo sapiens
agguguggggacacagcagugag

SEQ ID NO: 1955916 - RNA, 20 nt, Homo sapiens
cccagggccuuaaaagccau

SEQ ID NO: 1955917 - RNA, 10 nt, Homo sapiens
ucucccucac

SEQ ID NO: 1955918 - RNA, 16 nt, Homo sapiens
caauucuuuguugcuu

SEQ ID NO: 1955919 - RNA, 18 nt, Homo sapiens
auaaaauauuauugaacu

SEQ ID NO: 1955920 - RNA, 16 nt, Homo sapiens
uccaggagaccuucca

SEQ ID NO: 1955921 - RNA, 14 nt, Homo sapiens
agauaguaugcacu

SEQ ID NO: 1955922 - RNA, 19 nt, Homo sapiens
aaacaccgagugaggccau

SEQ ID NO: 1955923 - RNA, 18 nt, Homo sapiens
aagccauucgguugucuc

SEQ ID NO: 1955924 - RNA, 17 nt, Homo sapiens
uaacaugcaauuuugca

SEQ ID NO: 1955925 - RNA, 18 nt, Homo sapiens
cuuuugcagaaaucacaa

SEQ ID NO: 1955926 - RNA, 18 nt, Homo sapiens
uuaagcauuuucuacaca

SEQ ID NO: 1955927 - RNA, 12 nt, Homo sapiens
ucuccugacccc

SEQ ID NO: 1955928 - RNA, 18 nt, Homo sapiens
ugagaagccagcuuuccu

SEQ ID NO: 1955929 - RNA, 18 nt, Homo sapiens
gccccucgcugcugcuac

SEQ ID NO: 1955930 - RNA, 11 nt, Homo sapiens
ucaaccagcag

SEQ ID NO: 1955931 - RNA, 19 nt, Homo sapiens
ucacaauaaaacaaucucu

SEQ ID NO: 1955932 - RNA, 19 nt, Homo sapiens
agcccuuacguccuuccac

SEQ ID NO: 1955933 - RNA, 14 nt, Homo sapiens
ccacuacauucuga

SEQ ID NO: 1955934 - RNA, 18 nt, Homo sapiens
cauaaacuguacaaauga

SEQ ID NO: 1955935 - RNA, 19 nt, Homo sapiens
cuugcccagacuacagggc

SEQ ID NO: 1955936 - RNA, 21 nt, Homo sapiens
cacagugccaccaagcucaca

SEQ ID NO: 1955937 - RNA, 15 nt, Homo sapiens
ccacucuaccaaaua

SEQ ID NO: 1955938 - RNA, 14 nt, Homo sapiens
uacuacacagaauu

SEQ ID NO: 1955939 - RNA, 15 nt, Homo sapiens
uaaaauauacaaaca

SEQ ID NO: 1955940 - RNA, 20 nt, Homo sapiens
uuaacaaaaauauuagcaaa

SEQ ID NO: 1955941 - RNA, 15 nt, Homo sapiens
uauuguuggcacaga

SEQ ID NO: 1955942 - RNA, 15 nt, Homo sapiens
ccucuucuaugcuuu

SEQ ID NO: 1955943 - RNA, 17 nt, Homo sapiens
auggcucuggcacagug

SEQ ID NO: 1955944 - RNA, 15 nt, Homo sapiens
cucaccaacccugca

SEQ ID NO: 1955945 - RNA, 18 nt, Homo sapiens
aagggaugucucacaucc

SEQ ID NO: 1955946 - RNA, 15 nt, Homo sapiens
acacaccaaucagcg

SEQ ID NO: 1955947 - RNA, 22 nt, Homo sapiens
gcuucagucucugcagugucca

SEQ ID NO: 1955948 - RNA, 14 nt, Homo sapiens
cuccaucuccugac

SEQ ID NO: 1955949 - RNA, 15 nt, Homo sapiens
cuagaaaacauucca

SEQ ID NO: 1955950 - RNA, 18 nt, Homo sapiens
ucccacacccuguuuuac

SEQ ID NO: 1955951 - RNA, 21 nt, Homo sapiens
ugaaggcaaugccauccucaa

SEQ ID NO: 1955952 - RNA, 21 nt, Homo sapiens
cugcuaacaagucaccaaaag

SEQ ID NO: 1955953 - RNA, 15 nt, Homo sapiens
cacuuccuugccagu

SEQ ID NO: 1955954 - RNA, 13 nt, Homo sapiens
uacaacagccuga

SEQ ID NO: 1955955 - RNA, 13 nt, Homo sapiens
uaagauucuagau

SEQ ID NO: 1955956 - RNA, 14 nt, Homo sapiens
aggaaccacugcac

SEQ ID NO: 1955957 - RNA, 16 nt, Homo sapiens
guacucugaaggaaua

SEQ ID NO: 1955958 - RNA, 13 nt, Homo sapiens
caacuuugcaaau

SEQ ID NO: 1955959 - RNA, 18 nt, Homo sapiens
cccagaaaaccuccagua

SEQ ID NO: 1955960 - RNA, 23 nt, Homo sapiens
ccaaacaggacagcacugggaac

SEQ ID NO: 1955961 - RNA, 18 nt, Homo sapiens
agaguccaauguaccaug

SEQ ID NO: 1955962 - RNA, 14 nt, Homo sapiens
uauuccauguauaa

SEQ ID NO: 1955963 - RNA, 15 nt, Homo sapiens
agauggaguauacau

SEQ ID NO: 1955964 - RNA, 17 nt, Homo sapiens
caugccgcagacaugaa

SEQ ID NO: 1955965 - RNA, 19 nt, Homo sapiens
acugaaaaaucugguucau

SEQ ID NO: 1955966 - RNA, 22 nt, Homo sapiens
uucacacuuugcccuaugacau

SEQ ID NO: 1955967 - RNA, 12 nt, Homo sapiens
gugcaguauuuu

SEQ ID NO: 1955968 - RNA, 14 nt, Homo sapiens
cucuaaaucuuccu

SEQ ID NO: 1955969 - RNA, 16 nt, Homo sapiens
ccucucguacuugaac

SEQ ID NO: 1955970 - RNA, 18 nt, Homo sapiens
ccaugagaguucugucac

SEQ ID NO: 1955971 - RNA, 15 nt, Homo sapiens
acacagucaccuucu

SEQ ID NO: 1955972 - RNA, 17 nt, Homo sapiens
gaaguuacuuuccauug

SEQ ID NO: 1955973 - RNA, 18 nt, Homo sapiens
acaacuaaauaacuguau

SEQ ID NO: 1955974 - RNA, 19 nt, Homo sapiens
aaccacuuguagauuugau

SEQ ID NO: 1955975 - RNA, 16 nt, Homo sapiens
accacgaguuugguuu

SEQ ID NO: 1955976 - RNA, 15 nt, Homo sapiens
ucaaauggacuuuca

SEQ ID NO: 1955977 - RNA, 14 nt, Homo sapiens
aggagaccuuccac

SEQ ID NO: 1955978 - RNA, 19 nt, Homo sapiens
ccaucaauucuuagaauau

SEQ ID NO: 1955979 - RNA, 14 nt, Homo sapiens
augucaauugucag

SEQ ID NO: 1955980 - RNA, 20 nt, Homo sapiens
ccugcuggccccuucugggg

SEQ ID NO: 1955981 - RNA, 23 nt, Homo sapiens
ccauuuguuuucggcagccuuaa

SEQ ID NO: 1955982 - RNA, 18 nt, Homo sapiens
ccacaaagcaaaggcagu

SEQ ID NO: 1955983 - RNA, 19 nt, Homo sapiens
ccucacuuuauuacaagau

SEQ ID NO: 1955984 - RNA, 22 nt, Homo sapiens
cuugcguggacagucaggguuc

SEQ ID NO: 1955985 - RNA, 20 nt, Homo sapiens
gaugguuucuaucugcaauu

SEQ ID NO: 1955986 - RNA, 16 nt, Homo sapiens
caaaaccucaaaccag

SEQ ID NO: 1955987 - RNA, 13 nt, Homo sapiens
aauaaaguaccac

SEQ ID NO: 1955988 - RNA, 20 nt, Homo sapiens
ucacgucuccuacuuuuugu

SEQ ID NO: 1955989 - RNA, 19 nt, Homo sapiens
augagucacuuacuucaua

SEQ ID NO: 1955990 - RNA, 19 nt, Homo sapiens
aacuauuuaguguuaguua

SEQ ID NO: 1955991 - RNA, 22 nt, Homo sapiens
uggugguuaaaagggaacacaa

SEQ ID NO: 1955992 - RNA, 15 nt, Homo sapiens
agaggacacaucucc

SEQ ID NO: 1955993 - RNA, 18 nt, Homo sapiens
cagcucagugccaaagag

SEQ ID NO: 1955994 - RNA, 18 nt, Homo sapiens
gauuuagcauucauauuu

SEQ ID NO: 1955995 - RNA, 16 nt, Homo sapiens
cauuugcaccuaccuc

SEQ ID NO: 1955996 - RNA, 23 nt, Homo sapiens
guaacaggccuugagcacaaaau

SEQ ID NO: 1955997 - RNA, 17 nt, Homo sapiens
guuccagauagcagggc

SEQ ID NO: 1955998 - RNA, 17 nt, Homo sapiens
uucaucugaagauucga

SEQ ID NO: 1955999 - RNA, 14 nt, Homo sapiens
agccucacuccuca

SEQ ID NO: 1956000 - RNA, 14 nt, Homo sapiens
caaaguacauguau

SEQ ID NO: 1956001 - RNA, 20 nt, Homo sapiens
gcaaguguguguuugccaau

SEQ ID NO: 1956002 - RNA, 21 nt, Homo sapiens
caauguaguuuuauuacacau

SEQ ID NO: 1956003 - RNA, 20 nt, Homo sapiens
aaauugcuuauucuaggucu

SEQ ID NO: 1956004 - RNA, 13 nt, Homo sapiens
gagcucaugaggg

SEQ ID NO: 1956005 - RNA, 18 nt, Homo sapiens
agaauuuggauacacucu

SEQ ID NO: 1956006 - RNA, 17 nt, Homo sapiens
accccucacugugacug

SEQ ID NO: 1956007 - RNA, 15 nt, Homo sapiens
guucuagagugacag

SEQ ID NO: 1956008 - RNA, 16 nt, Homo sapiens
uuuucaauaccaggga

SEQ ID NO: 1956009 - RNA, 14 nt, Homo sapiens
guaagaugcacuga

SEQ ID NO: 1956010 - RNA, 14 nt, Homo sapiens
acucaaaagagaga

SEQ ID NO: 1956011 - RNA, 15 nt, Homo sapiens
uuucauauaaaugga

SEQ ID NO: 1956012 - RNA, 15 nt, Homo sapiens
uggcaugccuuccag

SEQ ID NO: 1956013 - RNA, 16 nt, Homo sapiens
auaaacugugagauaa

SEQ ID NO: 1956014 - RNA, 18 nt, Homo sapiens
ucugguuccuuacacauu

SEQ ID NO: 1956015 - RNA, 16 nt, Homo sapiens
uaauaguauaucuaau

SEQ ID NO: 1956016 - RNA, 14 nt, Homo sapiens
auaaauacugucaa

SEQ ID NO: 1956017 - RNA, 18 nt, Homo sapiens
uuugguuccuccacugga

SEQ ID NO: 1956018 - RNA, 20 nt, Homo sapiens
auaggucuuucucucaguga

SEQ ID NO: 1956019 - RNA, 15 nt, Homo sapiens
gaagacugucaggaa

SEQ ID NO: 1956020 - RNA, 17 nt, Homo sapiens
ugagcugugagugccuc

SEQ ID NO: 1956021 - RNA, 19 nt, Homo sapiens
uuaguauugcagccaaaga

SEQ ID NO: 1956022 - RNA, 16 nt, Homo sapiens
uauuuccccuuuccaa

SEQ ID NO: 1956023 - RNA, 22 nt, Homo sapiens
aggcaugagccacugcaccuga

SEQ ID NO: 1956024 - RNA, 23 nt, Homo sapiens
accacuguaagugagaacaaauu

SEQ ID NO: 1956025 - RNA, 21 nt, Homo sapiens
aaaagcuguucugucuuccca

SEQ ID NO: 1956026 - RNA, 22 nt, Homo sapiens
cugguauguuggggcccugugc

SEQ ID NO: 1956027 - RNA, 19 nt, Homo sapiens
cgacaagccuucagccaca

SEQ ID NO: 1956028 - RNA, 19 nt, Homo sapiens
ucucaauacccacugccag

SEQ ID NO: 1956029 - RNA, 19 nt, Homo sapiens
ccaagaaugcaagauuuca

SEQ ID NO: 1956030 - RNA, 17 nt, Homo sapiens
auguaguuuuccauccu

SEQ ID NO: 1956031 - RNA, 17 nt, Homo sapiens
ucccuaaagaacauacc

SEQ ID NO: 1956032 - RNA, 23 nt, Homo sapiens
uacagcagaaaaucuuuuacuag

SEQ ID NO: 1956033 - RNA, 18 nt, Homo sapiens
aaccuccuguggaaccca

SEQ ID NO: 1956034 - RNA, 12 nt, Homo sapiens
guggauaaccac

SEQ ID NO: 1956035 - RNA, 14 nt, Homo sapiens
gcaaagcucaccau

SEQ ID NO: 1956036 - RNA, 15 nt, Homo sapiens
gagaagcaaggguug

SEQ ID NO: 1956037 - RNA, 20 nt, Homo sapiens
uuaucaaacuucagcuguac

SEQ ID NO: 1956038 - RNA, 13 nt, Homo sapiens
caauuaugugaca

SEQ ID NO: 1956039 - RNA, 19 nt, Homo sapiens
cacacuguucugaaaguga

SEQ ID NO: 1956040 - RNA, 19 nt, Homo sapiens
ccacgcgugccguggcacc

SEQ ID NO: 1956041 - RNA, 14 nt, Homo sapiens
ucuuuucauucuca

SEQ ID NO: 1956042 - RNA, 17 nt, Homo sapiens
acugccaccuccccuug

SEQ ID NO: 1956043 - RNA, 19 nt, Homo sapiens
aauguuagauauugcuacu

SEQ ID NO: 1956044 - RNA, 15 nt, Homo sapiens
uuucucgggugcauu

SEQ ID NO: 1956045 - RNA, 18 nt, Homo sapiens
ugagccccaggcacuuug

SEQ ID NO: 1956046 - RNA, 13 nt, Homo sapiens
gcaaaaccaaaga

SEQ ID NO: 1956047 - RNA, 12 nt, Homo sapiens
augaaacuaaga

SEQ ID NO: 1956048 - RNA, 23 nt, Homo sapiens
aguccagguggugaauuuuccaa

SEQ ID NO: 1956049 - RNA, 17 nt, Homo sapiens
accccagcacagcuccu

SEQ ID NO: 1956050 - RNA, 19 nt, Homo sapiens
cucccuggcaggaugcuga

SEQ ID NO: 1956051 - RNA, 16 nt, Homo sapiens
gccauuaacaaugacc

SEQ ID NO: 1956052 - RNA, 17 nt, Homo sapiens
caacgcuccaaagucau

SEQ ID NO: 1956053 - RNA, 19 nt, Homo sapiens
cacuuacagaaccaauuca

SEQ ID NO: 1956054 - RNA, 21 nt, Homo sapiens
caauccugcccccagccaugg

SEQ ID NO: 1956055 - RNA, 22 nt, Homo sapiens
augaggccuuuccccagugugg

SEQ ID NO: 1956056 - RNA, 19 nt, Homo sapiens
ucaucaauucccauugcau

SEQ ID NO: 1956057 - RNA, 20 nt, Homo sapiens
guucauauuuauacuuugca

SEQ ID NO: 1956058 - RNA, 18 nt, Homo sapiens
gccugagaaugccuaggc

SEQ ID NO: 1956059 - RNA, 16 nt, Homo sapiens
uacagugagccaagau

SEQ ID NO: 1956060 - RNA, 13 nt, Homo sapiens
gcaccuuuuugca

SEQ ID NO: 1956061 - RNA, 23 nt, Homo sapiens
aggaacuugcccugagcacuccu

SEQ ID NO: 1956062 - RNA, 12 nt, Homo sapiens
acauaagcauaa

SEQ ID NO: 1956063 - RNA, 23 nt, Homo sapiens
uuuaauuaugaaaacuagcauua

SEQ ID NO: 1956064 - RNA, 21 nt, Homo sapiens
caggggauccagcucaaggga

SEQ ID NO: 1956065 - RNA, 19 nt, Homo sapiens
cagaaccuucaacccagug

SEQ ID NO: 1956066 - RNA, 20 nt, Homo sapiens
cccaguacaggggugcugca

SEQ ID NO: 1956067 - RNA, 19 nt, Homo sapiens
aagucuggcccacugugca

SEQ ID NO: 1956068 - RNA, 20 nt, Homo sapiens
cuagcauagagaauguguug

SEQ ID NO: 1956069 - RNA, 15 nt, Homo sapiens
agauaauaucuguga

SEQ ID NO: 1956070 - RNA, 21 nt, Homo sapiens
aauuacagaauauacuuagaa

SEQ ID NO: 1956071 - RNA, 20 nt, Homo sapiens
gccuccauucugaccauuuc

SEQ ID NO: 1956072 - RNA, 17 nt, Homo sapiens
uccucaaugcauugacu

SEQ ID NO: 1956073 - RNA, 14 nt, Homo sapiens
uuaacccuucacaa

SEQ ID NO: 1956074 - RNA, 14 nt, Homo sapiens
gagagagcucugca

SEQ ID NO: 1956075 - RNA, 15 nt, Homo sapiens
cugaagaacaguaac

SEQ ID NO: 1956076 - RNA, 16 nt, Homo sapiens
cuuaccuguaaccuac

SEQ ID NO: 1956077 - RNA, 20 nt, Homo sapiens
aaccugcacggggcauuccu

SEQ ID NO: 1956078 - RNA, 17 nt, Homo sapiens
gacucuugcagggguag

SEQ ID NO: 1956079 - RNA, 23 nt, Homo sapiens
aacucuucaguuaauucuuagau

SEQ ID NO: 1956080 - RNA, 20 nt, Homo sapiens
caugugcgaacacagugaca

SEQ ID NO: 1956081 - RNA, 12 nt, Homo sapiens
cucaggugggag

SEQ ID NO: 1956082 - RNA, 17 nt, Homo sapiens
gagccucguguccugcu

SEQ ID NO: 1956083 - RNA, 18 nt, Homo sapiens
aguguggacuuggcaggu

SEQ ID NO: 1956084 - RNA, 12 nt, Homo sapiens
aagaggcuggau

SEQ ID NO: 1956085 - RNA, 21 nt, Homo sapiens
uagcuucuuaaacgaaagaau

SEQ ID NO: 1956086 - RNA, 13 nt, Homo sapiens
uaguucuuuggaa

SEQ ID NO: 1956087 - RNA, 19 nt, Homo sapiens
aggguguaucuagcucuag

SEQ ID NO: 1956088 - RNA, 13 nt, Homo sapiens
uuccuucugcuau

SEQ ID NO: 1956089 - RNA, 19 nt, Homo sapiens
uucgaagucaucauuccuc

SEQ ID NO: 1956090 - RNA, 15 nt, Homo sapiens
ccagggaaacagccu

SEQ ID NO: 1956091 - RNA, 19 nt, Homo sapiens
caccaggacugaaagaaga

SEQ ID NO: 1956092 - RNA, 21 nt, Homo sapiens
agagacaggguuuugccaugu

SEQ ID NO: 1956093 - RNA, 21 nt, Homo sapiens
agagaugggguuucaccaugu

SEQ ID NO: 1956094 - RNA, 12 nt, Homo sapiens
acugaagcuuuu

SEQ ID NO: 1956095 - RNA, 14 nt, Homo sapiens
ucuucauguugaug

SEQ ID NO: 1956096 - RNA, 20 nt, Homo sapiens
uuucauuaaauaaauuugac

SEQ ID NO: 1956097 - RNA, 22 nt, Homo sapiens
uuucacucagggugauaaauca

SEQ ID NO: 1956098 - RNA, 14 nt, Homo sapiens
cagcaaucugugua

SEQ ID NO: 1956099 - RNA, 23 nt, Homo sapiens
cagagagcagcuucagugacaaa

SEQ ID NO: 1956100 - RNA, 20 nt, Homo sapiens
cuguacuaaaaauacaaaaa

SEQ ID NO: 1956101 - RNA, 17 nt, Homo sapiens
aagccaauaaaugaacu

SEQ ID NO: 1956102 - RNA, 17 nt, Homo sapiens
uagugaccuaaccacuu

SEQ ID NO: 1956103 - RNA, 14 nt, Homo sapiens
ccucacuugcauca

SEQ ID NO: 1956104 - RNA, 19 nt, Homo sapiens
cugcugugauuccacuaca

SEQ ID NO: 1956105 - RNA, 20 nt, Homo sapiens
guuugcccgggaauguuuca

SEQ ID NO: 1956106 - RNA, 16 nt, Homo sapiens
uguaaauuuaugugau

SEQ ID NO: 1956107 - RNA, 13 nt, Homo sapiens
uuauacauuugau

SEQ ID NO: 1956108 - RNA, 16 nt, Homo sapiens
uacacacacacucccu

SEQ ID NO: 1956109 - RNA, 19 nt, Homo sapiens
caauuaaacagccaaauaa

SEQ ID NO: 1956110 - RNA, 17 nt, Homo sapiens
ucauuuccguuuugccu

SEQ ID NO: 1956111 - RNA, 19 nt, Homo sapiens
gauaagccacucugucccu

SEQ ID NO: 1956112 - RNA, 19 nt, Homo sapiens
acuaaaguagaauuaucuc

SEQ ID NO: 1956113 - RNA, 17 nt, Homo sapiens
ccuuucuggccugcuau

SEQ ID NO: 1956114 - RNA, 21 nt, Homo sapiens
aagagggcuuccucuagaagc

SEQ ID NO: 1956115 - RNA, 15 nt, Homo sapiens
aaucugcaaggacau

SEQ ID NO: 1956116 - RNA, 20 nt, Homo sapiens
cugcacaguggggagcaugg

SEQ ID NO: 1956117 - RNA, 16 nt, Homo sapiens
gucugcuuaaagcuuc

SEQ ID NO: 1956118 - RNA, 14 nt, Homo sapiens
cagucaucaucuuu

SEQ ID NO: 1956119 - RNA, 19 nt, Homo sapiens
ugcuggcgcuuguguauaa

SEQ ID NO: 1956120 - RNA, 17 nt, Homo sapiens
acuucugaccacacuuc

SEQ ID NO: 1956121 - RNA, 21 nt, Homo sapiens
uguucaguguugacauagccu

SEQ ID NO: 1956122 - RNA, 17 nt, Homo sapiens
gucuuucccuggugaug

SEQ ID NO: 1956123 - RNA, 12 nt, Homo sapiens
uagccauaugca

SEQ ID NO: 1956124 - RNA, 19 nt, Homo sapiens
gaagcaacaggaaucaaga

SEQ ID NO: 1956125 - RNA, 14 nt, Homo sapiens
cucaaguccaaggc

SEQ ID NO: 1956126 - RNA, 19 nt, Homo sapiens
cugaacucaaacugaggaa

SEQ ID NO: 1956127 - RNA, 13 nt, Homo sapiens
uggauucaaguga

SEQ ID NO: 1956128 - RNA, 21 nt, Homo sapiens
gaaaugaauuccucauuugga

SEQ ID NO: 1956129 - RNA, 22 nt, Homo sapiens
uaugagcuggggaugucucuca

SEQ ID NO: 1956130 - RNA, 13 nt, Homo sapiens
aguuucaaaaacu

SEQ ID NO: 1956131 - RNA, 13 nt, Homo sapiens
uauaacuugcauu

SEQ ID NO: 1956132 - RNA, 19 nt, Homo sapiens
ccuguaaucucagcacuuu

SEQ ID NO: 1956133 - RNA, 15 nt, Homo sapiens
cuggucccagcaucc

SEQ ID NO: 1956134 - RNA, 18 nt, Homo sapiens
ucuucagccucauucacu

SEQ ID NO: 1956135 - RNA, 19 nt, Homo sapiens
gcucacaaggcccaggaga

SEQ ID NO: 1956136 - RNA, 21 nt, Homo sapiens
auuucccauuuuggaaccuaa

SEQ ID NO: 1956137 - RNA, 16 nt, Homo sapiens
uaacaucgcacaguuu

SEQ ID NO: 1956138 - RNA, 21 nt, Homo sapiens
auggcgaacacagguguugga

SEQ ID NO: 1956139 - RNA, 15 nt, Homo sapiens
cuuuucagugauacu

SEQ ID NO: 1956140 - RNA, 23 nt, Homo sapiens
guccuguuaacgucaucucaggg

SEQ ID NO: 1956141 - RNA, 12 nt, Homo sapiens
acugauuugcaa

SEQ ID NO: 1956142 - RNA, 14 nt, Homo sapiens
aaccaucagcauca

SEQ ID NO: 1956143 - RNA, 13 nt, Homo sapiens
cugcgaccuugca

SEQ ID NO: 1956144 - RNA, 19 nt, Homo sapiens
cucuaaaaugaguuaccua

SEQ ID NO: 1956145 - RNA, 13 nt, Homo sapiens
ugucuucuuucca

SEQ ID NO: 1956146 - RNA, 11 nt, Homo sapiens
uuauauggaaa

SEQ ID NO: 1956147 - RNA, 14 nt, Homo sapiens
ugugcuaugaagcu

SEQ ID NO: 1956148 - RNA, 15 nt, Homo sapiens
acaucuucucagugu

SEQ ID NO: 1956149 - RNA, 22 nt, Homo sapiens
uggcauuuuggcucagagucca

SEQ ID NO: 1956150 - RNA, 12 nt, Homo sapiens
gcgggcugagga

SEQ ID NO: 1956151 - RNA, 20 nt, Homo sapiens
acuauugguaauaaaccuug

SEQ ID NO: 1956152 - RNA, 22 nt, Homo sapiens
aaaaaccuagugcugauucaca

SEQ ID NO: 1956153 - RNA, 19 nt, Homo sapiens
acucuaauaugauuauaca

SEQ ID NO: 1956154 - RNA, 13 nt, Homo sapiens
accuuuuuacaca

SEQ ID NO: 1956155 - RNA, 18 nt, Homo sapiens
uuuuccuagcuguguuau

SEQ ID NO: 1956156 - RNA, 18 nt, Homo sapiens
auaaaugucuaaagcagg

SEQ ID NO: 1956157 - RNA, 23 nt, Homo sapiens
ccuuccagcccagacccccagug

SEQ ID NO: 1956158 - RNA, 15 nt, Homo sapiens
guacaaauuguucau

SEQ ID NO: 1956159 - RNA, 22 nt, Homo sapiens
agauguaauguuuucuuugcaa

SEQ ID NO: 1956160 - RNA, 18 nt, Homo sapiens
aaauggcaucagcacuuu

SEQ ID NO: 1956161 - RNA, 22 nt, Homo sapiens
cuggaagacaacccaggcagua

SEQ ID NO: 1956162 - RNA, 24 nt, Homo sapiens
uguugauaaauccaucacuauaau

SEQ ID NO: 1956163 - RNA, 15 nt, Homo sapiens
uuaaaauugauuucu

SEQ ID NO: 1956164 - RNA, 16 nt, Homo sapiens
agccuuagcugccagu

SEQ ID NO: 1956165 - RNA, 19 nt, Homo sapiens
cagauggacagacagccac

SEQ ID NO: 1956166 - RNA, 13 nt, Homo sapiens
gcccacacccagg

SEQ ID NO: 1956167 - RNA, 19 nt, Homo sapiens
ucuuuucccuucagucuuc

SEQ ID NO: 1956168 - RNA, 23 nt, Homo sapiens
agacccagcccagaccucugaca

SEQ ID NO: 1956169 - RNA, 17 nt, Homo sapiens
acucaggcccaaagccu

SEQ ID NO: 1956170 - RNA, 18 nt, Homo sapiens
ugggaacugaaucaggaa

SEQ ID NO: 1956171 - RNA, 22 nt, Homo sapiens
gggaaggggugcccccaggcuc

SEQ ID NO: 1956172 - RNA, 14 nt, Homo sapiens
agacauugcaauuu

SEQ ID NO: 1956173 - RNA, 19 nt, Homo sapiens
uauuugagagaaucuacua

SEQ ID NO: 1956174 - RNA, 20 nt, Homo sapiens
ggucucucuggcucuaggac

SEQ ID NO: 1956175 - RNA, 16 nt, Homo sapiens
cuuuuuacaauuaaaa

SEQ ID NO: 1956176 - RNA, 19 nt, Homo sapiens
accccuccaccucucucuc

SEQ ID NO: 1956177 - RNA, 22 nt, Homo sapiens
guugacacauaugaacacagac

SEQ ID NO: 1956178 - RNA, 19 nt, Homo sapiens
aacaaaugccacacaucac

SEQ ID NO: 1956179 - RNA, 13 nt, Homo sapiens
cagcucacuggca

SEQ ID NO: 1956180 - RNA, 23 nt, Homo sapiens
ucccaugacuccuggaucuaugu

SEQ ID NO: 1956181 - RNA, 16 nt, Homo sapiens
gacuugcucaccugga

SEQ ID NO: 1956182 - RNA, 21 nt, Homo sapiens
cucaaaugcacaucucauggc

SEQ ID NO: 1956183 - RNA, 20 nt, Homo sapiens
aaauacaaucagcccagugc

SEQ ID NO: 1956184 - RNA, 16 nt, Homo sapiens
uuuaauuugauaguau

SEQ ID NO: 1956185 - RNA, 20 nt, Homo sapiens
caagaucgugccauugcacu

SEQ ID NO: 1956186 - RNA, 14 nt, Homo sapiens
cuacaguacuucca

SEQ ID NO: 1956187 - RNA, 18 nt, Homo sapiens
cucaugccccuaauccca

SEQ ID NO: 1956188 - RNA, 23 nt, Homo sapiens
ggaccuggggcacaguccaggaa

SEQ ID NO: 1956189 - RNA, 16 nt, Homo sapiens
ccaaggaacaggaaac

SEQ ID NO: 1956190 - RNA, 21 nt, Homo sapiens
aagaauaaaauugcacuuuua

SEQ ID NO: 1956191 - RNA, 22 nt, Homo sapiens
augcugucuuaauucuuuucac

SEQ ID NO: 1956192 - RNA, 16 nt, Homo sapiens
gccaaggccagcccac

SEQ ID NO: 1956193 - RNA, 17 nt, Homo sapiens
gagacuuucuaaaucaa

SEQ ID NO: 1956194 - RNA, 22 nt, Homo sapiens
uuaggacaugcuaucaguaaua

SEQ ID NO: 1956195 - RNA, 23 nt, Homo sapiens
cuccuugugagaguggcuuucua

SEQ ID NO: 1956196 - RNA, 14 nt, Homo sapiens
gccauuguacucca

SEQ ID NO: 1956197 - RNA, 20 nt, Homo sapiens
gagccccagguaauggcaug

SEQ ID NO: 1956198 - RNA, 23 nt, Homo sapiens
ucccuauugugacagagccaugg

SEQ ID NO: 1956199 - RNA, 16 nt, Homo sapiens
cuguaugacugaagua

SEQ ID NO: 1956200 - RNA, 18 nt, Homo sapiens
ucccaccuuggagcauuu

SEQ ID NO: 1956201 - RNA, 22 nt, Homo sapiens
aagauuguccagugcaaccaca

SEQ ID NO: 1956202 - RNA, 23 nt, Homo sapiens
auuuccaagcacuuucaguccaa

SEQ ID NO: 1956203 - RNA, 18 nt, Homo sapiens
auggguggaccuguguau

SEQ ID NO: 1956204 - RNA, 22 nt, Homo sapiens
uucuuuuuuaagcgaaugauug

SEQ ID NO: 1956205 - RNA, 12 nt, Homo sapiens
ugcuuugagauc

SEQ ID NO: 1956206 - RNA, 13 nt, Homo sapiens
ucaguaaauacuc

SEQ ID NO: 1956207 - RNA, 20 nt, Homo sapiens
auugcuguugucucugcucu

SEQ ID NO: 1956208 - RNA, 17 nt, Homo sapiens
gaaugucaguuguuauu

SEQ ID NO: 1956209 - RNA, 19 nt, Homo sapiens
uucugucacggucacuuua

SEQ ID NO: 1956210 - RNA, 17 nt, Homo sapiens
uuccacuuaggaagaaa

SEQ ID NO: 1956211 - RNA, 16 nt, Homo sapiens
acaauuguuaugaucu

SEQ ID NO: 1956212 - RNA, 15 nt, Homo sapiens
aauggaacaguaaga

SEQ ID NO: 1956213 - RNA, 17 nt, Homo sapiens
aagauggagcuccccca

SEQ ID NO: 1956214 - RNA, 19 nt, Homo sapiens
cugcauuguugaauucugc

SEQ ID NO: 1956215 - RNA, 22 nt, Homo sapiens
gccucuccugcugcugaccuga

SEQ ID NO: 1956216 - RNA, 18 nt, Homo sapiens
ccucacauggucugcuua

SEQ ID NO: 1956217 - RNA, 15 nt, Homo sapiens
ggaagcugaggccca

SEQ ID NO: 1956218 - RNA, 15 nt, Homo sapiens
ggaagcagaggcccu

SEQ ID NO: 1956219 - RNA, 22 nt, Homo sapiens
auacggaaguaaaccugaacaa

SEQ ID NO: 1956220 - RNA, 20 nt, Homo sapiens
gcacucaccucacuguucaa

SEQ ID NO: 1956221 - RNA, 22 nt, Homo sapiens
agauauugucagaguucugcuc

SEQ ID NO: 1956222 - RNA, 13 nt, Homo sapiens
uacuaucauucuc

SEQ ID NO: 1956223 - RNA, 13 nt, Homo sapiens
cuugaucacaugc

SEQ ID NO: 1956224 - RNA, 18 nt, Homo sapiens
ccuugucugucucagcuc

SEQ ID NO: 1956225 - RNA, 22 nt, Homo sapiens
cacuggugggccauuagauuug

SEQ ID NO: 1956226 - RNA, 14 nt, Homo sapiens
cccugagaucucug

SEQ ID NO: 1956227 - RNA, 13 nt, Homo sapiens
ugaacaugcucau

SEQ ID NO: 1956228 - RNA, 14 nt, Homo sapiens
caaaaggcugagaa

SEQ ID NO: 1956229 - RNA, 16 nt, Homo sapiens
gcucucaagucaagga

SEQ ID NO: 1956230 - RNA, 18 nt, Homo sapiens
ucaaaauauuucagugaa

SEQ ID NO: 1956231 - RNA, 16 nt, Homo sapiens
aauaauguguacauua

SEQ ID NO: 1956232 - RNA, 12 nt, Homo sapiens
uccccacugcuc

SEQ ID NO: 1956233 - RNA, 18 nt, Homo sapiens
cugcaaggacauuucuca

SEQ ID NO: 1956234 - RNA, 13 nt, Homo sapiens
aguggaggcauug

SEQ ID NO: 1956235 - RNA, 16 nt, Homo sapiens
cccagcagccugccag

SEQ ID NO: 1956236 - RNA, 15 nt, Homo sapiens
gacaauuugucaaau

SEQ ID NO: 1956237 - RNA, 16 nt, Homo sapiens
uggcucuguuggcaga

SEQ ID NO: 1956238 - RNA, 14 nt, Homo sapiens
aguuuagugugaua

SEQ ID NO: 1956239 - RNA, 18 nt, Homo sapiens
aaccaguuaagaauggaa

SEQ ID NO: 1956240 - RNA, 19 nt, Homo sapiens
uuucaagaaagcauugcca

SEQ ID NO: 1956241 - RNA, 23 nt, Homo sapiens
auuucuuugucggcggcuugaua

SEQ ID NO: 1956242 - RNA, 14 nt, Homo sapiens
gacuucacuaggca

SEQ ID NO: 1956243 - RNA, 18 nt, Homo sapiens
gcaaguuuuaaacccaaa

SEQ ID NO: 1956244 - RNA, 20 nt, Homo sapiens
cuauuguauuauuuggaguu

SEQ ID NO: 1956245 - RNA, 20 nt, Homo sapiens
ucucaguaccccauggagcu

SEQ ID NO: 1956246 - RNA, 15 nt, Homo sapiens
cuuggagaacuuucc

SEQ ID NO: 1956247 - RNA, 22 nt, Homo sapiens
aaaagcaaaggauguguuuuca

SEQ ID NO: 1956248 - RNA, 14 nt, Homo sapiens
agguguuucuuucc

SEQ ID NO: 1956249 - RNA, 16 nt, Homo sapiens
caugucuuugcugcag

SEQ ID NO: 1956250 - RNA, 17 nt, Homo sapiens
agagucucuauuucaca

SEQ ID NO: 1956251 - RNA, 22 nt, Homo sapiens
agaugcacagaauauguaugua

SEQ ID NO: 1956252 - RNA, 13 nt, Homo sapiens
gacaucugcuuca

SEQ ID NO: 1956253 - RNA, 17 nt, Homo sapiens
uuucuaccaucucacgg

SEQ ID NO: 1956254 - RNA, 13 nt, Homo sapiens
uaaaccuccauac

SEQ ID NO: 1956255 - RNA, 22 nt, Homo sapiens
agaucuacaugaaugcaaaaca

SEQ ID NO: 1956256 - RNA, 14 nt, Homo sapiens
acacacacacucac

SEQ ID NO: 1956257 - RNA, 14 nt, Homo sapiens
uaaauaacuauaua

SEQ ID NO: 1956258 - RNA, 13 nt, Homo sapiens
gcacuuuccacuu

SEQ ID NO: 1956259 - RNA, 15 nt, Homo sapiens
uguugcccaguguga

SEQ ID NO: 1956260 - RNA, 15 nt, Homo sapiens
acauugccucaggca

SEQ ID NO: 1956261 - RNA, 17 nt, Homo sapiens
agcccuaaauaaaucua

SEQ ID NO: 1956262 - RNA, 17 nt, Homo sapiens
uccaaauucaguuucau

SEQ ID NO: 1956263 - RNA, 13 nt, Homo sapiens
cccuucauaccca

SEQ ID NO: 1956264 - RNA, 23 nt, Homo sapiens
caaguacuuuccaaucucaguca

SEQ ID NO: 1956265 - RNA, 20 nt, Homo sapiens
gcaggacaagggccugggau

SEQ ID NO: 1956266 - RNA, 16 nt, Homo sapiens
agaagauacacugcag

SEQ ID NO: 1956267 - RNA, 20 nt, Homo sapiens
auaugcuuauacacuuacac

SEQ ID NO: 1956268 - RNA, 20 nt, Homo sapiens
uaauauucacauguucuaau

SEQ ID NO: 1956269 - RNA, 22 nt, Homo sapiens
uacauuugaugcaaaaugacuu

SEQ ID NO: 1956270 - RNA, 16 nt, Homo sapiens
ggccagaggcauuuuu

SEQ ID NO: 1956271 - RNA, 18 nt, Homo sapiens
uuauucuagggucuuacu

SEQ ID NO: 1956272 - RNA, 15 nt, Homo sapiens
gcaaauauugucaua

SEQ ID NO: 1956273 - RNA, 15 nt, Homo sapiens
gaucaauuucaacau

SEQ ID NO: 1956274 - RNA, 20 nt, Homo sapiens
acagggucuaccucugucac

SEQ ID NO: 1956275 - RNA, 23 nt, Homo sapiens
uggauuugaucacuacaaguauu

SEQ ID NO: 1956276 - RNA, 22 nt, Homo sapiens
aaagccacgcugugucccucaa

SEQ ID NO: 1956277 - RNA, 24 nt, Homo sapiens
cucuuucuucgcugaagugugacu

SEQ ID NO: 1956278 - RNA, 16 nt, Homo sapiens
gggaaggucaccagca

SEQ ID NO: 1956279 - RNA, 16 nt, Homo sapiens
uuuuagugacuguaau

SEQ ID NO: 1956280 - RNA, 12 nt, Homo sapiens
cugauacugcug

SEQ ID NO: 1956281 - RNA, 16 nt, Homo sapiens
aucuaguacuucccag

SEQ ID NO: 1956282 - RNA, 19 nt, Homo sapiens
uaucaguaguaucaaugau

SEQ ID NO: 1956283 - RNA, 18 nt, Homo sapiens
auaguucuaucaggaaaa

SEQ ID NO: 1956284 - RNA, 15 nt, Homo sapiens
aagaauacuucucau

SEQ ID NO: 1956285 - RNA, 23 nt, Homo sapiens
acacuugugugugggcugugagu

SEQ ID NO: 1956286 - RNA, 20 nt, Homo sapiens
gccauauggacacugugaca

SEQ ID NO: 1956287 - RNA, 17 nt, Homo sapiens
ucauaagcugauuugau

SEQ ID NO: 1956288 - RNA, 17 nt, Homo sapiens
ugaaauauuuuugaaug

SEQ ID NO: 1956289 - RNA, 14 nt, Homo sapiens
uuuaaaauaacacu

SEQ ID NO: 1956290 - RNA, 20 nt, Homo sapiens
gaaucauacuuaacauuuca

SEQ ID NO: 1956291 - RNA, 12 nt, Homo sapiens
ucaauccuguca

SEQ ID NO: 1956292 - RNA, 17 nt, Homo sapiens
gagccucuccuugcccc

SEQ ID NO: 1956293 - RNA, 13 nt, Homo sapiens
ccagcacuccauc

SEQ ID NO: 1956294 - RNA, 13 nt, Homo sapiens
ucuuaacuucuga

SEQ ID NO: 1956295 - RNA, 22 nt, Homo sapiens
uauauaccuggcuuuuacuuua

SEQ ID NO: 1956296 - RNA, 17 nt, Homo sapiens
gaauauucaaauaucua

SEQ ID NO: 1956297 - RNA, 13 nt, Homo sapiens
cucacugauauau

SEQ ID NO: 1956298 - RNA, 23 nt, Homo sapiens
uuucuauuuaccuccuaauggca

SEQ ID NO: 1956299 - RNA, 14 nt, Homo sapiens
auacaacacugaua

SEQ ID NO: 1956300 - RNA, 13 nt, Homo sapiens
aauuuaaaagcag

SEQ ID NO: 1956301 - RNA, 19 nt, Homo sapiens
acgguaucacuguaucauc

SEQ ID NO: 1956302 - RNA, 19 nt, Homo sapiens
guagagcauaccacuugaa

SEQ ID NO: 1956303 - RNA, 22 nt, Homo sapiens
aauuaugucucuugagcaucaa

SEQ ID NO: 1956304 - RNA, 12 nt, Homo sapiens
gccucaugggcc

SEQ ID NO: 1956305 - RNA, 17 nt, Homo sapiens
aucaacugcugcuucac

SEQ ID NO: 1956306 - RNA, 16 nt, Homo sapiens
ggugaccagccacuca

SEQ ID NO: 1956307 - RNA, 12 nt, Homo sapiens
cagucacaugug

SEQ ID NO: 1956308 - RNA, 16 nt, Homo sapiens
agcuaucucucaguga

SEQ ID NO: 1956309 - RNA, 17 nt, Homo sapiens
uggcauggugcagggag

SEQ ID NO: 1956310 - RNA, 14 nt, Homo sapiens
ccacagcagccacu

SEQ ID NO: 1956311 - RNA, 15 nt, Homo sapiens
gaagucuaaaugaag

SEQ ID NO: 1956312 - RNA, 17 nt, Homo sapiens
ccauguaccacauaaca

SEQ ID NO: 1956313 - RNA, 17 nt, Homo sapiens
cacugaacccaauuaca

SEQ ID NO: 1956314 - RNA, 17 nt, Homo sapiens
uugaagauuauaugaag

SEQ ID NO: 1956315 - RNA, 22 nt, Homo sapiens
acacugugcugagucugaaggc

SEQ ID NO: 1956316 - RNA, 12 nt, Homo sapiens
ccuguggaugag

SEQ ID NO: 1956317 - RNA, 13 nt, Homo sapiens
guucagacaagac

SEQ ID NO: 1956318 - RNA, 15 nt, Homo sapiens
acacaaaaugucaca

SEQ ID NO: 1956319 - RNA, 20 nt, Homo sapiens
uguuaauuuaugaauauuag

SEQ ID NO: 1956320 - RNA, 16 nt, Homo sapiens
uauugucauaaccaac

SEQ ID NO: 1956321 - RNA, 14 nt, Homo sapiens
agacuccaccucaa

SEQ ID NO: 1956322 - RNA, 15 nt, Homo sapiens
aacccacagccaaac

SEQ ID NO: 1956323 - RNA, 21 nt, Homo sapiens
auagauccauuuggacaaaau

SEQ ID NO: 1956324 - RNA, 14 nt, Homo sapiens
auuaaaaauuacug

SEQ ID NO: 1956325 - RNA, 15 nt, Homo sapiens
cagacacacccagug

SEQ ID NO: 1956326 - RNA, 15 nt, Homo sapiens
ccugugccuccucag

SEQ ID NO: 1956327 - RNA, 12 nt, Homo sapiens
uuaccugugaca

SEQ ID NO: 1956328 - RNA, 22 nt, Homo sapiens
acaucuuuucuaaucacagugu

SEQ ID NO: 1956329 - RNA, 22 nt, Homo sapiens
gcucaggacucagaagccucug

SEQ ID NO: 1956330 - RNA, 23 nt, Homo sapiens
aacucagccuuaagaaagcuaua

SEQ ID NO: 1956331 - RNA, 23 nt, Homo sapiens
ccaguacugggagauacagccau

SEQ ID NO: 1956332 - RNA, 14 nt, Homo sapiens
caugugggcacgga

SEQ ID NO: 1956333 - RNA, 13 nt, Homo sapiens
aucauugugaaau

SEQ ID NO: 1956334 - RNA, 20 nt, Homo sapiens
cuuuugacggccuucuuggu

SEQ ID NO: 1956335 - RNA, 23 nt, Homo sapiens
ucugcaaugacuguggaguucca

SEQ ID NO: 1956336 - RNA, 18 nt, Homo sapiens
ucuccaagaauacagaaa

SEQ ID NO: 1956337 - RNA, 16 nt, Homo sapiens
gaaccuguccuaagga

SEQ ID NO: 1956338 - RNA, 19 nt, Homo sapiens
uaugcuacaguacuaugua

SEQ ID NO: 1956339 - RNA, 16 nt, Homo sapiens
cccaucauguggccca

SEQ ID NO: 1956340 - RNA, 20 nt, Homo sapiens
ccagcuaauaacugaucucg

SEQ ID NO: 1956341 - RNA, 21 nt, Homo sapiens
aggaacagcaaaugcaaaaac

SEQ ID NO: 1956342 - RNA, 16 nt, Homo sapiens
ucucaacaaaucucag

SEQ ID NO: 1956343 - RNA, 16 nt, Homo sapiens
ccccacuuacuguccu

SEQ ID NO: 1956344 - RNA, 14 nt, Homo sapiens
uccuaggucucaga

SEQ ID NO: 1956345 - RNA, 20 nt, Homo sapiens
ucuucccgcacaaauuccac

SEQ ID NO: 1956346 - RNA, 15 nt, Homo sapiens
uccagagaccccagg

SEQ ID NO: 1956347 - RNA, 14 nt, Homo sapiens
uggcagaugcacau

SEQ ID NO: 1956348 - RNA, 18 nt, Homo sapiens
acucaaggcuugagucac

SEQ ID NO: 1956349 - RNA, 18 nt, Homo sapiens
agaaaaguugggcuuuca

SEQ ID NO: 1956350 - RNA, 18 nt, Homo sapiens
uccuuucauuuucuuucc

SEQ ID NO: 1956351 - RNA, 17 nt, Homo sapiens
cagcauauauacuugca

SEQ ID NO: 1956352 - RNA, 19 nt, Homo sapiens
cguuaagugccccacagag

SEQ ID NO: 1956353 - RNA, 10 nt, Homo sapiens
cagugccauu

SEQ ID NO: 1956354 - RNA, 21 nt, Homo sapiens
ugaaaggugugcuagaacaag

SEQ ID NO: 1956355 - RNA, 18 nt, Homo sapiens
cuggcugggaguggaaga

SEQ ID NO: 1956356 - RNA, 17 nt, Homo sapiens
ggcucauauuucuuuuc

SEQ ID NO: 1956357 - RNA, 19 nt, Homo sapiens
gcugggugagcucuuccag

SEQ ID NO: 1956358 - RNA, 20 nt, Homo sapiens
agaguguggaaaaaaaaaga

SEQ ID NO: 1956359 - RNA, 16 nt, Homo sapiens
auaagcagaagccaua

SEQ ID NO: 1956360 - RNA, 21 nt, Homo sapiens
accugcacuuauacccaugaa

SEQ ID NO: 1956361 - RNA, 21 nt, Homo sapiens
uggggcaguuccccuucuuac

SEQ ID NO: 1956362 - RNA, 15 nt, Homo sapiens
cccagccucuuccau

SEQ ID NO: 1956363 - RNA, 15 nt, Homo sapiens
ucuccacuuucagcu

SEQ ID NO: 1956364 - RNA, 21 nt, Homo sapiens
uacagguccugcugaaacugc

SEQ ID NO: 1956365 - RNA, 18 nt, Homo sapiens
caugucuggacucacgga

SEQ ID NO: 1956366 - RNA, 21 nt, Homo sapiens
gcuaggacuccaaccucaggg

SEQ ID NO: 1956367 - RNA, 13 nt, Homo sapiens
ugucaaggugugg

SEQ ID NO: 1956368 - RNA, 20 nt, Homo sapiens
gacuggguuccccacaguga

SEQ ID NO: 1956369 - RNA, 16 nt, Homo sapiens
uugaaagaaaguguua

SEQ ID NO: 1956370 - RNA, 16 nt, Homo sapiens
acuaaguucacuaaaa

SEQ ID NO: 1956371 - RNA, 23 nt, Homo sapiens
gagacaaaucuaugccacucaga

SEQ ID NO: 1956372 - RNA, 19 nt, Homo sapiens
cuaaucucuguaaagcuaa

SEQ ID NO: 1956373 - RNA, 16 nt, Homo sapiens
guaguauuuuugccaa

SEQ ID NO: 1956374 - RNA, 14 nt, Homo sapiens
uguaacuuucauac

SEQ ID NO: 1956375 - RNA, 14 nt, Homo sapiens
ggaucuuugcuacu

SEQ ID NO: 1956376 - RNA, 21 nt, Homo sapiens
cugcgccaccucacugcagua

SEQ ID NO: 1956377 - RNA, 14 nt, Homo sapiens
guauuagcaaugaa

SEQ ID NO: 1956378 - RNA, 17 nt, Homo sapiens
accauuuuuagaaggaa

SEQ ID NO: 1956379 - RNA, 15 nt, Homo sapiens
gaccucuacuugcug

SEQ ID NO: 1956380 - RNA, 20 nt, Homo sapiens
augaaauuguaaaaccuguc

SEQ ID NO: 1956381 - RNA, 16 nt, Homo sapiens
ucacgucagugcucag

SEQ ID NO: 1956382 - RNA, 23 nt, Homo sapiens
cuggaacccagaagaggagacag

SEQ ID NO: 1956383 - RNA, 12 nt, Homo sapiens
caauccuauguc

SEQ ID NO: 1956384 - RNA, 18 nt, Homo sapiens
aaugguaauuuaguguau

SEQ ID NO: 1956385 - RNA, 15 nt, Homo sapiens
ccaaagugcugggau

SEQ ID NO: 1956386 - RNA, 23 nt, Homo sapiens
uuuagugagcauaggugauccau

SEQ ID NO: 1956387 - RNA, 15 nt, Homo sapiens
ggcuucucagccccu

SEQ ID NO: 1956388 - RNA, 22 nt, Homo sapiens
aggcugaggcagaacugcuuga

SEQ ID NO: 1956389 - RNA, 13 nt, Homo sapiens
gagauucugggaa

SEQ ID NO: 1956390 - RNA, 13 nt, Homo sapiens
gaaguucuggaga

SEQ ID NO: 1956391 - RNA, 19 nt, Homo sapiens
cuuaauaaaauaaacuaga

SEQ ID NO: 1956392 - RNA, 17 nt, Homo sapiens
gacggaguccuguguuu

SEQ ID NO: 1956393 - RNA, 21 nt, Homo sapiens
cucauugcuuucuaagaucua

SEQ ID NO: 1956394 - RNA, 14 nt, Homo sapiens
caagggagggugca

SEQ ID NO: 1956395 - RNA, 20 nt, Homo sapiens
auuagcccuuccuugccagu

SEQ ID NO: 1956396 - RNA, 22 nt, Homo sapiens
gauccugcaaggggacauucca

SEQ ID NO: 1956397 - RNA, 17 nt, Homo sapiens
ucccagcucacgucaca

SEQ ID NO: 1956398 - RNA, 18 nt, Homo sapiens
aaauuaaacuuauuuaca

SEQ ID NO: 1956399 - RNA, 18 nt, Homo sapiens
cuuguugcagacuggugu

SEQ ID NO: 1956400 - RNA, 20 nt, Homo sapiens
uugcuuaugacaugaucgcu

SEQ ID NO: 1956401 - RNA, 16 nt, Homo sapiens
gaaacuguaaauaugu

SEQ ID NO: 1956402 - RNA, 23 nt, Homo sapiens
caacaauaaauauguauuaccuc

SEQ ID NO: 1956403 - RNA, 15 nt, Homo sapiens
auuuaugcaacucau

SEQ ID NO: 1956404 - RNA, 20 nt, Homo sapiens
ugacaugcacaguuugcaau

SEQ ID NO: 1956405 - RNA, 13 nt, Homo sapiens
agaauauacuaaa

SEQ ID NO: 1956406 - RNA, 18 nt, Homo sapiens
uauauacaaguagauccu

SEQ ID NO: 1956407 - RNA, 14 nt, Homo sapiens
gccagcaccacuuc

SEQ ID NO: 1956408 - RNA, 18 nt, Homo sapiens
cuccucuuaauguuucca

SEQ ID NO: 1956409 - RNA, 19 nt, Homo sapiens
ucaauucuuagaauaucua

SEQ ID NO: 1956410 - RNA, 14 nt, Homo sapiens
gcaggcuacacuga

SEQ ID NO: 1956411 - RNA, 13 nt, Homo sapiens
gcaagucaaauac

SEQ ID NO: 1956412 - RNA, 13 nt, Homo sapiens
ugcuuugacgggc

SEQ ID NO: 1956413 - RNA, 17 nt, Homo sapiens
aauaguauuaacuauua

SEQ ID NO: 1956414 - RNA, 20 nt, Homo sapiens
gacauuuuuugcuauaauca

SEQ ID NO: 1956415 - RNA, 12 nt, Homo sapiens
augaagccagcu

SEQ ID NO: 1956416 - RNA, 18 nt, Homo sapiens
uacgugaguccuggcaug

SEQ ID NO: 1956417 - RNA, 20 nt, Homo sapiens
agcauagaaaccacuagaaa

SEQ ID NO: 1956418 - RNA, 15 nt, Homo sapiens
ggcauuucacaaaaa

SEQ ID NO: 1956419 - RNA, 15 nt, Homo sapiens
uuaugaggcuauuaa

SEQ ID NO: 1956420 - RNA, 16 nt, Homo sapiens
uguucaugucagcuua

SEQ ID NO: 1956421 - RNA, 16 nt, Homo sapiens
gaagcucugaagucac

SEQ ID NO: 1956422 - RNA, 12 nt, Homo sapiens
gauuagccuccc

SEQ ID NO: 1956423 - RNA, 22 nt, Homo sapiens
uaaccugcaaaaucuguucuaa

SEQ ID NO: 1956424 - RNA, 20 nt, Homo sapiens
acuuguguucaaucugugaa

SEQ ID NO: 1956425 - RNA, 22 nt, Homo sapiens
cugaggcaggaagauagcuuga

SEQ ID NO: 1956426 - RNA, 20 nt, Homo sapiens
uucgacuugcauuuuugcag

SEQ ID NO: 1956427 - RNA, 15 nt, Homo sapiens
caguuaaguguuucc

SEQ ID NO: 1956428 - RNA, 19 nt, Homo sapiens
gcaggcaaagucugaaguc

SEQ ID NO: 1956429 - RNA, 19 nt, Homo sapiens
caagguugggcuggugcuc

SEQ ID NO: 1956430 - RNA, 16 nt, Homo sapiens
acauaugucacuggga

SEQ ID NO: 1956431 - RNA, 19 nt, Homo sapiens
uggucccagcuacuuggga

SEQ ID NO: 1956432 - RNA, 23 nt, Homo sapiens
ccaagcacacaugcauggcauuu

SEQ ID NO: 1956433 - RNA, 19 nt, Homo sapiens
gcagcggcuccugcaaaag

SEQ ID NO: 1956434 - RNA, 15 nt, Homo sapiens
uucaugaccauacaa

SEQ ID NO: 1956435 - RNA, 16 nt, Homo sapiens
guucaaaguguauauu

SEQ ID NO: 1956436 - RNA, 19 nt, Homo sapiens
uguuaacucaggaugccaa

SEQ ID NO: 1956437 - RNA, 20 nt, Homo sapiens
ugccuguaauccuagcacuu

SEQ ID NO: 1956438 - RNA, 20 nt, Homo sapiens
ugguaaucauaugugucuuu

SEQ ID NO: 1956439 - RNA, 14 nt, Homo sapiens
cugaggugggcaga

SEQ ID NO: 1956440 - RNA, 15 nt, Homo sapiens
ugucaggagaaaguu

SEQ ID NO: 1956441 - RNA, 19 nt, Homo sapiens
aucacuucauucacauuca

SEQ ID NO: 1956442 - RNA, 17 nt, Homo sapiens
uaguggauuaaugcauu

SEQ ID NO: 1956443 - RNA, 18 nt, Homo sapiens
cacauccaacuacuccua

SEQ ID NO: 1956444 - RNA, 17 nt, Homo sapiens
agaaaacaaccaaagaa

SEQ ID NO: 1956445 - RNA, 12 nt, Homo sapiens
agagugcacaug

SEQ ID NO: 1956446 - RNA, 14 nt, Homo sapiens
cagcuuggagacag

SEQ ID NO: 1956447 - RNA, 15 nt, Homo sapiens
ucuggggagugaugg

SEQ ID NO: 1956448 - RNA, 21 nt, Homo sapiens
ucauuuccaaaccaucagcug

SEQ ID NO: 1956449 - RNA, 18 nt, Homo sapiens
cauuaguauuucacaaga

SEQ ID NO: 1956450 - RNA, 23 nt, Homo sapiens
aggaguccacugccuccaugaug

SEQ ID NO: 1956451 - RNA, 15 nt, Homo sapiens
gacgggccaggcccu

SEQ ID NO: 1956452 - RNA, 20 nt, Homo sapiens
cagucacauggcaugguuuu

SEQ ID NO: 1956453 - RNA, 12 nt, Homo sapiens
gugaaggugauu

SEQ ID NO: 1956454 - RNA, 17 nt, Homo sapiens
ucuggccuccaagucca

SEQ ID NO: 1956455 - RNA, 22 nt, Homo sapiens
gccuagcgaucucuccuggccu

SEQ ID NO: 1956456 - RNA, 16 nt, Homo sapiens
agucucacucugucac

SEQ ID NO: 1956457 - RNA, 19 nt, Homo sapiens
agaugggaaagaaccacac

SEQ ID NO: 1956458 - RNA, 15 nt, Homo sapiens
accccccugagagca

SEQ ID NO: 1956459 - RNA, 13 nt, Homo sapiens
uuucagguggaac

SEQ ID NO: 1956460 - RNA, 14 nt, Homo sapiens
gauuuacucauuau

SEQ ID NO: 1956461 - RNA, 12 nt, Homo sapiens
acuacauuugca

SEQ ID NO: 1956462 - RNA, 17 nt, Homo sapiens
cuuauagcacuuugaaa

SEQ ID NO: 1956463 - RNA, 20 nt, Homo sapiens
cacuugaguuggggccauug

SEQ ID NO: 1956464 - RNA, 15 nt, Homo sapiens
cuugguauuacccuc

SEQ ID NO: 1956465 - RNA, 21 nt, Homo sapiens
aagucaucuuuacuuucccaa

SEQ ID NO: 1956466 - RNA, 23 nt, Homo sapiens
cagggccuggccugguccaggcu

SEQ ID NO: 1956467 - RNA, 13 nt, Homo sapiens
ugagagaccugag

SEQ ID NO: 1956468 - RNA, 24 nt, Homo sapiens
ugccaggcccccaccacacauccc

SEQ ID NO: 1956469 - RNA, 16 nt, Homo sapiens
guaaaugucugcacug

SEQ ID NO: 1956470 - RNA, 18 nt, Homo sapiens
uggaagcuaauuugcauu

SEQ ID NO: 1956471 - RNA, 14 nt, Homo sapiens
gccuaggugacaga

SEQ ID NO: 1956472 - RNA, 17 nt, Homo sapiens
ugggaccaaguccaaca

SEQ ID NO: 1956473 - RNA, 23 nt, Homo sapiens
gcgucucccucgcagagcccuuc

SEQ ID NO: 1956474 - RNA, 15 nt, Homo sapiens
caggaacucuaaggu

SEQ ID NO: 1956475 - RNA, 17 nt, Homo sapiens
ccaagaucacaaauagu

SEQ ID NO: 1956476 - RNA, 20 nt, Homo sapiens
aacuauauauaaaugaccug

SEQ ID NO: 1956477 - RNA, 23 nt, Homo sapiens
cacccaaaagucaaaaggugccu

SEQ ID NO: 1956478 - RNA, 23 nt, Homo sapiens
aacugaaucaagaaaugaaugcu

SEQ ID NO: 1956479 - RNA, 23 nt, Homo sapiens
gaauugacaacccaaacucucca

SEQ ID NO: 1956480 - RNA, 17 nt, Homo sapiens
aguugcugcuucuccca

SEQ ID NO: 1956481 - RNA, 14 nt, Homo sapiens
uacugauauuucau

SEQ ID NO: 1956482 - RNA, 19 nt, Homo sapiens
gaaacugaagcuguucuca

SEQ ID NO: 1956483 - RNA, 19 nt, Homo sapiens
gccugucccauggacacuc

SEQ ID NO: 1956484 - RNA, 13 nt, Homo sapiens
ccuuaauauugag

SEQ ID NO: 1956485 - RNA, 21 nt, Homo sapiens
caccugcccacgcuaguucca

SEQ ID NO: 1956486 - RNA, 22 nt, Homo sapiens
augugcugaaugguuuucaaaa

SEQ ID NO: 1956487 - RNA, 18 nt, Homo sapiens
ugcaguggcaucaucuca

SEQ ID NO: 1956488 - RNA, 14 nt, Homo sapiens
ccagccaacauggc

SEQ ID NO: 1956489 - RNA, 17 nt, Homo sapiens
gcccaccaucaccaccg

SEQ ID NO: 1956490 - RNA, 19 nt, Homo sapiens
acugauuauucuucuuaca

SEQ ID NO: 1956491 - RNA, 18 nt, Homo sapiens
uauuucaagucucucacc

SEQ ID NO: 1956492 - RNA, 12 nt, Homo sapiens
cauuaagcacac

SEQ ID NO: 1956493 - RNA, 20 nt, Homo sapiens
ugcauuuaaaacagacacug

SEQ ID NO: 1956494 - RNA, 15 nt, Homo sapiens
cauguuuuagcauuu

SEQ ID NO: 1956495 - RNA, 19 nt, Homo sapiens
uggugagggcaguucugca

SEQ ID NO: 1956496 - RNA, 18 nt, Homo sapiens
uccuacacuauugaccag

SEQ ID NO: 1956497 - RNA, 21 nt, Homo sapiens
auaauuggacucugucacaaa

SEQ ID NO: 1956498 - RNA, 21 nt, Homo sapiens
cagaugacaaaaauucaacuc

SEQ ID NO: 1956499 - RNA, 22 nt, Homo sapiens
cagacuugucccuccuuuucca

SEQ ID NO: 1956500 - RNA, 20 nt, Homo sapiens
guuggagugcaauggugcga

SEQ ID NO: 1956501 - RNA, 20 nt, Homo sapiens
gcuggagugcaaugguguga

SEQ ID NO: 1956502 - RNA, 16 nt, Homo sapiens
uuuucgcugaugcugu

SEQ ID NO: 1956503 - RNA, 23 nt, Homo sapiens
gcaguuucauugugaucacugua

SEQ ID NO: 1956504 - RNA, 21 nt, Homo sapiens
uggacuguggcacuugccugg

SEQ ID NO: 1956505 - RNA, 20 nt, Homo sapiens
gccuuccacagugaaugugu

SEQ ID NO: 1956506 - RNA, 15 nt, Homo sapiens
ucuggacacugagag

SEQ ID NO: 1956507 - RNA, 23 nt, Homo sapiens
accuuggaagggcguucuaggua

SEQ ID NO: 1956508 - RNA, 16 nt, Homo sapiens
cgugaaccugccuugg

SEQ ID NO: 1956509 - RNA, 23 nt, Homo sapiens
cuucaacuccucgacaucacugu

SEQ ID NO: 1956510 - RNA, 18 nt, Homo sapiens
ucccagggaugcucuuug

SEQ ID NO: 1956511 - RNA, 14 nt, Homo sapiens
auugagcaaagggg

SEQ ID NO: 1956512 - RNA, 12 nt, Homo sapiens
gguggaaggugg

SEQ ID NO: 1956513 - RNA, 22 nt, Homo sapiens
ucaggccaguaaucccagugac

SEQ ID NO: 1956514 - RNA, 20 nt, Homo sapiens
uaggccaagguguccuacag

SEQ ID NO: 1956515 - RNA, 20 nt, Homo sapiens
acgugaaauacuucgaugau

SEQ ID NO: 1956516 - RNA, 22 nt, Homo sapiens
ugccacagaucuuuuguucucu

SEQ ID NO: 1956517 - RNA, 19 nt, Homo sapiens
agcaaggcacagccuuugc

SEQ ID NO: 1956518 - RNA, 17 nt, Homo sapiens
aggcagagacugaaaau

SEQ ID NO: 1956519 - RNA, 22 nt, Homo sapiens
aacauuuaaauaaaacuuucca

SEQ ID NO: 1956520 - RNA, 13 nt, Homo sapiens
accaggucuccuc

SEQ ID NO: 1956521 - RNA, 14 nt, Homo sapiens
auguaaacagugag

SEQ ID NO: 1956522 - RNA, 20 nt, Homo sapiens
agauccaaaugcugugcaaa

SEQ ID NO: 1956523 - RNA, 20 nt, Homo sapiens
acuagagaaaauaaauucca

SEQ ID NO: 1956524 - RNA, 18 nt, Homo sapiens
cccagugggaucuuaccc

SEQ ID NO: 1956525 - RNA, 13 nt, Homo sapiens
aacacggcagcug

SEQ ID NO: 1956526 - RNA, 19 nt, Homo sapiens
ccuugcaagaauggagaua

SEQ ID NO: 1956527 - RNA, 15 nt, Homo sapiens
aggucggcacuugga

SEQ ID NO: 1956528 - RNA, 18 nt, Homo sapiens
ugaagaacaguaacugcc

SEQ ID NO: 1956529 - RNA, 16 nt, Homo sapiens
aauagaaacauuugua

SEQ ID NO: 1956530 - RNA, 22 nt, Homo sapiens
ugacuacucacuucuccuuuaa

SEQ ID NO: 1956531 - RNA, 15 nt, Homo sapiens
cuggccgaugugggu

SEQ ID NO: 1956532 - RNA, 15 nt, Homo sapiens
cucugcaccuuugca

SEQ ID NO: 1956533 - RNA, 16 nt, Homo sapiens
gccacucauuccugua

SEQ ID NO: 1956534 - RNA, 23 nt, Homo sapiens
aaggaacagagugagagacauca

SEQ ID NO: 1956535 - RNA, 20 nt, Homo sapiens
gagucacccccccaggccuc

SEQ ID NO: 1956536 - RNA, 14 nt, Homo sapiens
ugaacuucagggag

SEQ ID NO: 1956537 - RNA, 16 nt, Homo sapiens
cacgaccauuugauag

SEQ ID NO: 1956538 - RNA, 23 nt, Homo sapiens
cuguccacugggccauuguggug

SEQ ID NO: 1956539 - RNA, 17 nt, Homo sapiens
agaggacgggaggcugg

SEQ ID NO: 1956540 - RNA, 16 nt, Homo sapiens
cccugucucuuaaaaa

SEQ ID NO: 1956541 - RNA, 20 nt, Homo sapiens
uccuugucucugcuaagaaa

SEQ ID NO: 1956542 - RNA, 18 nt, Homo sapiens
uucuuccucucucagggg

SEQ ID NO: 1956543 - RNA, 20 nt, Homo sapiens
ggaaacauuuuauacuguac

SEQ ID NO: 1956544 - RNA, 22 nt, Homo sapiens
cuggaaguguguguuucuugcu

SEQ ID NO: 1956545 - RNA, 14 nt, Homo sapiens
guuucacuguucau

SEQ ID NO: 1956546 - RNA, 18 nt, Homo sapiens
uucuccaaagcuugccac

SEQ ID NO: 1956547 - RNA, 19 nt, Homo sapiens
uucucaucuuuuuacuaaa

SEQ ID NO: 1956548 - RNA, 13 nt, Homo sapiens
aguagcugggauu

SEQ ID NO: 1956549 - RNA, 17 nt, Homo sapiens
caggaggggcagcgcau

SEQ ID NO: 1956550 - RNA, 21 nt, Homo sapiens
uuguauaaaugcaauaagaaa

SEQ ID NO: 1956551 - RNA, 22 nt, Homo sapiens
agcacauaugggaacuaugagg

SEQ ID NO: 1956552 - RNA, 22 nt, Homo sapiens
cgcauaugcaugccaggcuggg

SEQ ID NO: 1956553 - RNA, 20 nt, Homo sapiens
gcuagugaaguggccucuug

SEQ ID NO: 1956554 - RNA, 18 nt, Homo sapiens
ccuugaccaaagcucucu

SEQ ID NO: 1956555 - RNA, 15 nt, Homo sapiens
acuaaauuugauacu

SEQ ID NO: 1956556 - RNA, 18 nt, Homo sapiens
ucuuuguggucaugugau

SEQ ID NO: 1956557 - RNA, 23 nt, Homo sapiens
gaauacagcuuucugaccuucag

SEQ ID NO: 1956558 - RNA, 14 nt, Homo sapiens
agaaggcuuuggga

SEQ ID NO: 1956559 - RNA, 20 nt, Homo sapiens
uaaauucauuaaaaacacua

SEQ ID NO: 1956560 - RNA, 14 nt, Homo sapiens
uggugagcaccugu

SEQ ID NO: 1956561 - RNA, 20 nt, Homo sapiens
gaccugggcccacagagccu

SEQ ID NO: 1956562 - RNA, 16 nt, Homo sapiens
uucuuuuaaaccauuu

SEQ ID NO: 1956563 - RNA, 13 nt, Homo sapiens
ccaucacuggaau

SEQ ID NO: 1956564 - RNA, 22 nt, Homo sapiens
ucagcaaggaacaucccugaga

SEQ ID NO: 1956565 - RNA, 13 nt, Homo sapiens
gaaaggccuucag

SEQ ID NO: 1956566 - RNA, 21 nt, Homo sapiens
uccgccacuggggcucagagc

SEQ ID NO: 1956567 - RNA, 21 nt, Homo sapiens
cacuuagcaggaaguacucau

SEQ ID NO: 1956568 - RNA, 17 nt, Homo sapiens
cauuuuccgacuaggag

SEQ ID NO: 1956569 - RNA, 11 nt, Homo sapiens
ugagacaaaga

SEQ ID NO: 1956570 - RNA, 15 nt, Homo sapiens
auccuaacacauuau

SEQ ID NO: 1956571 - RNA, 14 nt, Homo sapiens
acacggacccugug

SEQ ID NO: 1956572 - RNA, 11 nt, Homo sapiens
ugugcugugac

SEQ ID NO: 1956573 - RNA, 16 nt, Homo sapiens
aagaaaaacauuuccu

SEQ ID NO: 1956574 - RNA, 15 nt, Homo sapiens
agcuggagugcugcu

SEQ ID NO: 1956575 - RNA, 15 nt, Homo sapiens
acaaaugcagacaca

SEQ ID NO: 1956576 - RNA, 16 nt, Homo sapiens
cccuggauuuuuacca

SEQ ID NO: 1956577 - RNA, 17 nt, Homo sapiens
gaauuuguuuuagccau

SEQ ID NO: 1956578 - RNA, 17 nt, Homo sapiens
auaaacuauacacuuaa

SEQ ID NO: 1956579 - RNA, 14 nt, Homo sapiens
augucacagauucc

SEQ ID NO: 1956580 - RNA, 21 nt, Homo sapiens
ugagccucguguccagacuca

SEQ ID NO: 1956581 - RNA, 15 nt, Homo sapiens
cagugaaacuugugc

SEQ ID NO: 1956582 - RNA, 17 nt, Homo sapiens
ccaugguaaaaacuagu

SEQ ID NO: 1956583 - RNA, 17 nt, Homo sapiens
auuccaggcagccucug

SEQ ID NO: 1956584 - RNA, 20 nt, Homo sapiens
agaguggcugcaccacuucc

SEQ ID NO: 1956585 - RNA, 18 nt, Homo sapiens
acaugucucauauuuuca

SEQ ID NO: 1956586 - RNA, 17 nt, Homo sapiens
accagugaaccaaagag

SEQ ID NO: 1956587 - RNA, 15 nt, Homo sapiens
acagacucauuacaa

SEQ ID NO: 1956588 - RNA, 18 nt, Homo sapiens
caaagcauggacauuuag

SEQ ID NO: 1956589 - RNA, 17 nt, Homo sapiens
ugugucccacccaugca

SEQ ID NO: 1956590 - RNA, 13 nt, Homo sapiens
agucuagccuugu

SEQ ID NO: 1956591 - RNA, 23 nt, Homo sapiens
aggggugcuaugacaugcaagug

SEQ ID NO: 1956592 - RNA, 23 nt, Homo sapiens
gacugaucugagagccauugggc

SEQ ID NO: 1956593 - RNA, 19 nt, Homo sapiens
acaguaaugaaauguuuac

SEQ ID NO: 1956594 - RNA, 14 nt, Homo sapiens
caccucaagugcaa

SEQ ID NO: 1956595 - RNA, 14 nt, Homo sapiens
caccaaaagugcuc

SEQ ID NO: 1956596 - RNA, 20 nt, Homo sapiens
acuccccauuggugcuaccu

SEQ ID NO: 1956597 - RNA, 15 nt, Homo sapiens
ugcacgcugggcaau

SEQ ID NO: 1956598 - RNA, 13 nt, Homo sapiens
acuguguuggcca

SEQ ID NO: 1956599 - RNA, 12 nt, Homo sapiens
gaaucagacuca

SEQ ID NO: 1956600 - RNA, 16 nt, Homo sapiens
cuucaagaacucuggg

SEQ ID NO: 1956601 - RNA, 21 nt, Homo sapiens
gugagaccauuagcauugcag

SEQ ID NO: 1956602 - RNA, 13 nt, Homo sapiens
acuggggcucaga

SEQ ID NO: 1956603 - RNA, 14 nt, Homo sapiens
aaucagaugcagcu

SEQ ID NO: 1956604 - RNA, 19 nt, Homo sapiens
uuccccucugcggcuuuca

SEQ ID NO: 1956605 - RNA, 17 nt, Homo sapiens
aggugauccaccugccu

SEQ ID NO: 1956606 - RNA, 11 nt, Homo sapiens
aggacugguaa

SEQ ID NO: 1956607 - RNA, 11 nt, Homo sapiens
ugaacuggaag

SEQ ID NO: 1956608 - RNA, 18 nt, Homo sapiens
acaagccuucagccacag

SEQ ID NO: 1956609 - RNA, 12 nt, Homo sapiens
uaacugcaauuu

SEQ ID NO: 1956610 - RNA, 23 nt, Homo sapiens
aucuacuaauugagccauuuaau

SEQ ID NO: 1956611 - RNA, 15 nt, Homo sapiens
agcacagcugugagg

SEQ ID NO: 1956612 - RNA, 14 nt, Homo sapiens
ccuucugagcuccu

SEQ ID NO: 1956613 - RNA, 12 nt, Homo sapiens
gugccaccgugc

SEQ ID NO: 1956614 - RNA, 20 nt, Homo sapiens
agaagucauaaacagcauuu

SEQ ID NO: 1956615 - RNA, 17 nt, Homo sapiens
auuugcaaaguacugua

SEQ ID NO: 1956616 - RNA, 20 nt, Homo sapiens
agcgccugccgccccgggga

SEQ ID NO: 1956617 - RNA, 12 nt, Homo sapiens
gguuaaguuaaa

SEQ ID NO: 1956618 - RNA, 16 nt, Homo sapiens
agcgaacguauuucuc

SEQ ID NO: 1956619 - RNA, 11 nt, Homo sapiens
aaguauuccac

SEQ ID NO: 1956620 - RNA, 20 nt, Homo sapiens
guucccaagcgucaucugug

SEQ ID NO: 1956621 - RNA, 16 nt, Homo sapiens
cuucucaagugccuua

SEQ ID NO: 1956622 - RNA, 14 nt, Homo sapiens
uguuauacuugaug

SEQ ID NO: 1956623 - RNA, 22 nt, Homo sapiens
uaacugcacacaugguuuccaa

SEQ ID NO: 1956624 - RNA, 15 nt, Homo sapiens
uucuuggugguggau

SEQ ID NO: 1956625 - RNA, 15 nt, Homo sapiens
auugguuaaggucuu

SEQ ID NO: 1956626 - RNA, 13 nt, Homo sapiens
uacaugugcacau

SEQ ID NO: 1956627 - RNA, 13 nt, Homo sapiens
ucuuugugccuuu

SEQ ID NO: 1956628 - RNA, 24 nt, Homo sapiens
gagggagagaacugagcaucucca

SEQ ID NO: 1956629 - RNA, 21 nt, Homo sapiens
ccuugcucacucacucacucc

SEQ ID NO: 1956630 - RNA, 16 nt, Homo sapiens
caacccaugagugcua

SEQ ID NO: 1956631 - RNA, 18 nt, Homo sapiens
gcuuuguuaaugaaaaug

SEQ ID NO: 1956632 - RNA, 18 nt, Homo sapiens
auuagcuuauuuaaucug

SEQ ID NO: 1956633 - RNA, 17 nt, Homo sapiens
ccugccucuuggccuca

SEQ ID NO: 1956634 - RNA, 14 nt, Homo sapiens
uauuugcacaaguu

SEQ ID NO: 1956635 - RNA, 22 nt, Homo sapiens
aaccaucuucacuggcuuccau

SEQ ID NO: 1956636 - RNA, 21 nt, Homo sapiens
ccaaggacacgacacacagua

SEQ ID NO: 1956637 - RNA, 20 nt, Homo sapiens
uuuaccaaucaacagcaugu

SEQ ID NO: 1956638 - RNA, 18 nt, Homo sapiens
uggucacaagcacaaagc

SEQ ID NO: 1956639 - RNA, 19 nt, Homo sapiens
cauaucaugugugagauaa

SEQ ID NO: 1956640 - RNA, 22 nt, Homo sapiens
uuuaaugcaagagaacauuuua

SEQ ID NO: 1956641 - RNA, 22 nt, Homo sapiens
caaauaagauauauaugugcuc

SEQ ID NO: 1956642 - RNA, 22 nt, Homo sapiens
cccuuaacugacaugggccuuu

SEQ ID NO: 1956643 - RNA, 13 nt, Homo sapiens
acguggugugaga

SEQ ID NO: 1956644 - RNA, 16 nt, Homo sapiens
acucaggccacagugg

SEQ ID NO: 1956645 - RNA, 21 nt, Homo sapiens
ugacacacugcggugucugca

SEQ ID NO: 1956646 - RNA, 11 nt, Homo sapiens
ggacugugaac

SEQ ID NO: 1956647 - RNA, 17 nt, Homo sapiens
gagggugagacacugca

SEQ ID NO: 1956648 - RNA, 17 nt, Homo sapiens
acuuccuuggacuacuu

SEQ ID NO: 1956649 - RNA, 14 nt, Homo sapiens
caaacaaugccauc

SEQ ID NO: 1956650 - RNA, 16 nt, Homo sapiens
aucaauacccuuguga

SEQ ID NO: 1956651 - RNA, 23 nt, Homo sapiens
gguaugcuugaaaguagcaauua

SEQ ID NO: 1956652 - RNA, 18 nt, Homo sapiens
caucaaaacaaaacagca

SEQ ID NO: 1956653 - RNA, 21 nt, Homo sapiens
ccuuggaagggcguucuaggu

SEQ ID NO: 1956654 - RNA, 17 nt, Homo sapiens
cugagcaacucuugauu

SEQ ID NO: 1956655 - RNA, 23 nt, Homo sapiens
gcuggaagaaggaagaagccaga

SEQ ID NO: 1956656 - RNA, 15 nt, Homo sapiens
cagguguguucagua

SEQ ID NO: 1956657 - RNA, 22 nt, Homo sapiens
ccaaugggaugaggucacuuuu

SEQ ID NO: 1956658 - RNA, 19 nt, Homo sapiens
agaaauuauuuaauaugca

SEQ ID NO: 1956659 - RNA, 16 nt, Homo sapiens
uugguuuugcuguuga

SEQ ID NO: 1956660 - RNA, 23 nt, Homo sapiens
cgcugccgaguccgggccggggc

SEQ ID NO: 1956661 - RNA, 15 nt, Homo sapiens
ucacuaauacacagu

SEQ ID NO: 1956662 - RNA, 19 nt, Homo sapiens
caaaccaaccgcacaugca

SEQ ID NO: 1956663 - RNA, 16 nt, Homo sapiens
uauuuggauaucuguu

SEQ ID NO: 1956664 - RNA, 13 nt, Homo sapiens
uugcauguguaaa

SEQ ID NO: 1956665 - RNA, 19 nt, Homo sapiens
gagcugggguagaacuggc

SEQ ID NO: 1956666 - RNA, 13 nt, Homo sapiens
uugagguccauau

SEQ ID NO: 1956667 - RNA, 19 nt, Homo sapiens
aggcuuaaggagaggagaa

SEQ ID NO: 1956668 - RNA, 19 nt, Homo sapiens
auaaugcaauccuuagucc

SEQ ID NO: 1956669 - RNA, 19 nt, Homo sapiens
gaaagggguuggggugaca

SEQ ID NO: 1956670 - RNA, 21 nt, Homo sapiens
ggacuacacaauacaguauua

SEQ ID NO: 1956671 - RNA, 11 nt, Homo sapiens
ccaugucaugu

SEQ ID NO: 1956672 - RNA, 16 nt, Homo sapiens
uguguauuuacaugaa

SEQ ID NO: 1956673 - RNA, 14 nt, Homo sapiens
uugccuugagcucu

SEQ ID NO: 1956674 - RNA, 17 nt, Homo sapiens
gcugcgccgucugcucg

SEQ ID NO: 1956675 - RNA, 18 nt, Homo sapiens
agcuauuuucugaccaaa

SEQ ID NO: 1956676 - RNA, 22 nt, Homo sapiens
aggccguugguugucugaagag

SEQ ID NO: 1956677 - RNA, 14 nt, Homo sapiens
ugagauacauuccc

SEQ ID NO: 1956678 - RNA, 21 nt, Homo sapiens
caucacugucuugccagauua

SEQ ID NO: 1956679 - RNA, 19 nt, Homo sapiens
uuaauaucaucaguauuga

SEQ ID NO: 1956680 - RNA, 22 nt, Homo sapiens
acugucacguggcuucaucagc

SEQ ID NO: 1956681 - RNA, 18 nt, Homo sapiens
ggaggcggugguagagag

SEQ ID NO: 1956682 - RNA, 14 nt, Homo sapiens
ugccacguggucac

SEQ ID NO: 1956683 - RNA, 17 nt, Homo sapiens
cagcugcaucuacucag

SEQ ID NO: 1956684 - RNA, 16 nt, Homo sapiens
gcauaauaacuacuuc

SEQ ID NO: 1956685 - RNA, 19 nt, Homo sapiens
ggcacaagaaucacuugaa

SEQ ID NO: 1956686 - RNA, 21 nt, Homo sapiens
uuucacacccuuuugugagac

SEQ ID NO: 1956687 - RNA, 16 nt, Homo sapiens
cuccuuugcaccugau

SEQ ID NO: 1956688 - RNA, 17 nt, Homo sapiens
auacgugucugugugua

SEQ ID NO: 1956689 - RNA, 21 nt, Homo sapiens
ugugccaacuacuacugguga

SEQ ID NO: 1956690 - RNA, 19 nt, Homo sapiens
agugugccccucuguaaca

SEQ ID NO: 1956691 - RNA, 17 nt, Homo sapiens
uaaauaccagacacgua

SEQ ID NO: 1956692 - RNA, 21 nt, Homo sapiens
uuucuaaaaaggcugcucaca

SEQ ID NO: 1956693 - RNA, 16 nt, Homo sapiens
acaacuuccacuccaa

SEQ ID NO: 1956694 - RNA, 22 nt, Homo sapiens
ccaaugcugcccuuucugcucc

SEQ ID NO: 1956695 - RNA, 12 nt, Homo sapiens
caggaguuccuu

SEQ ID NO: 1956696 - RNA, 14 nt, Homo sapiens
gcacagaucucuag

SEQ ID NO: 1956697 - RNA, 15 nt, Homo sapiens
aguucguauacuucg

SEQ ID NO: 1956698 - RNA, 13 nt, Homo sapiens
ggcuaaacaugug

SEQ ID NO: 1956699 - RNA, 22 nt, Homo sapiens
cacugcccauggcaugucuuug

SEQ ID NO: 1956700 - RNA, 16 nt, Homo sapiens
aaaaauguaaguugac

SEQ ID NO: 1956701 - RNA, 14 nt, Homo sapiens
gggccccauggcca

SEQ ID NO: 1956702 - RNA, 14 nt, Homo sapiens
ggcucacaugcucc

SEQ ID NO: 1956703 - RNA, 19 nt, Homo sapiens
ugauauuauggcaagugau

SEQ ID NO: 1956704 - RNA, 21 nt, Homo sapiens
caucuggcugccuuugcuuaa

SEQ ID NO: 1956705 - RNA, 18 nt, Homo sapiens
agguuugagaagcacugu

SEQ ID NO: 1956706 - RNA, 15 nt, Homo sapiens
ucuggccacugucaa

SEQ ID NO: 1956707 - RNA, 15 nt, Homo sapiens
ucugcccacugugaa

SEQ ID NO: 1956708 - RNA, 17 nt, Homo sapiens
cagcuggugucaguccc

SEQ ID NO: 1956709 - RNA, 22 nt, Homo sapiens
uuccucgcuagaguucuccaga

SEQ ID NO: 1956710 - RNA, 13 nt, Homo sapiens
auacauguagaau

SEQ ID NO: 1956711 - RNA, 17 nt, Homo sapiens
ucaaaacucaaauguga

SEQ ID NO: 1956712 - RNA, 15 nt, Homo sapiens
ccagcaacugaauaa

SEQ ID NO: 1956713 - RNA, 22 nt, Homo sapiens
agauauugugaggacaaauuga

SEQ ID NO: 1956714 - RNA, 13 nt, Homo sapiens
aggcuuaucaaaa

SEQ ID NO: 1956715 - RNA, 20 nt, Homo sapiens
uuauagauauauaaauaauc

SEQ ID NO: 1956716 - RNA, 18 nt, Homo sapiens
uaaaagaaaauccauuau

SEQ ID NO: 1956717 - RNA, 12 nt, Homo sapiens
aagagcuuugua

SEQ ID NO: 1956718 - RNA, 17 nt, Homo sapiens
aaacauagcaucucagg

SEQ ID NO: 1956719 - RNA, 14 nt, Homo sapiens
gccggaaucucagc

SEQ ID NO: 1956720 - RNA, 11 nt, Homo sapiens
aaauacaugua

SEQ ID NO: 1956721 - RNA, 11 nt, Homo sapiens
auguacaugag

SEQ ID NO: 1956722 - RNA, 16 nt, Homo sapiens
auaauuaaaaaccacu

SEQ ID NO: 1956723 - RNA, 20 nt, Homo sapiens
cggaguuuccucgcauuaaa

SEQ ID NO: 1956724 - RNA, 20 nt, Homo sapiens
uugagaucacuacucagugc

SEQ ID NO: 1956725 - RNA, 21 nt, Homo sapiens
guauugucgguuaccucugca

SEQ ID NO: 1956726 - RNA, 22 nt, Homo sapiens
ugccccucccagaacacacucc

SEQ ID NO: 1956727 - RNA, 18 nt, Homo sapiens
ugaauuacacucaaggaa

SEQ ID NO: 1956728 - RNA, 17 nt, Homo sapiens
aggagcugccuggaccc

SEQ ID NO: 1956729 - RNA, 14 nt, Homo sapiens
caacggaugaaugu

SEQ ID NO: 1956730 - RNA, 23 nt, Homo sapiens
ggcucaccuuugggcaaaggccc

SEQ ID NO: 1956731 - RNA, 13 nt, Homo sapiens
uagcagcugcuac

SEQ ID NO: 1956732 - RNA, 14 nt, Homo sapiens
aaacucaguaucau

SEQ ID NO: 1956733 - RNA, 14 nt, Homo sapiens
uugacuuccuccaa

SEQ ID NO: 1956734 - RNA, 18 nt, Homo sapiens
agagcuuuacagugccac

SEQ ID NO: 1956735 - RNA, 14 nt, Homo sapiens
caaaacuaguucuu

SEQ ID NO: 1956736 - RNA, 13 nt, Homo sapiens
cucuuucuugacu

SEQ ID NO: 1956737 - RNA, 18 nt, Homo sapiens
aucuuuugcuaaugcaau

SEQ ID NO: 1956738 - RNA, 21 nt, Homo sapiens
ugaugaaaauguaacuugaaa

SEQ ID NO: 1956739 - RNA, 13 nt, Homo sapiens
aagcguccucuca

SEQ ID NO: 1956740 - RNA, 21 nt, Homo sapiens
cagaaggggauggacuucauu

SEQ ID NO: 1956741 - RNA, 17 nt, Homo sapiens
auuaauacauucaccca

SEQ ID NO: 1956742 - RNA, 20 nt, Homo sapiens
guuaaauuaagcucuugcua

SEQ ID NO: 1956743 - RNA, 20 nt, Homo sapiens
accaccgaagaggaagcaag

SEQ ID NO: 1956744 - RNA, 14 nt, Homo sapiens
acacugucuucccg

SEQ ID NO: 1956745 - RNA, 23 nt, Homo sapiens
aucugcuuuugguuauaaugugu

SEQ ID NO: 1956746 - RNA, 15 nt, Homo sapiens
gcucuguauuaaucc

SEQ ID NO: 1956747 - RNA, 20 nt, Homo sapiens
uagcuggaacuacaaggaag

SEQ ID NO: 1956748 - RNA, 22 nt, Homo sapiens
guacugauauaauuuaguucca

SEQ ID NO: 1956749 - RNA, 17 nt, Homo sapiens
cagcgauguaugcagcu

SEQ ID NO: 1956750 - RNA, 19 nt, Homo sapiens
aaggagagagugagugcau

SEQ ID NO: 1956751 - RNA, 23 nt, Homo sapiens
auacaacuucauauaacugagau

SEQ ID NO: 1956752 - RNA, 19 nt, Homo sapiens
aaagcuggacugaccaaag

SEQ ID NO: 1956753 - RNA, 18 nt, Homo sapiens
caaguuguugacugugau

SEQ ID NO: 1956754 - RNA, 23 nt, Homo sapiens
cagauuccaggcgaugugcaagu

SEQ ID NO: 1956755 - RNA, 15 nt, Homo sapiens
gacacauugccccau

SEQ ID NO: 1956756 - RNA, 12 nt, Homo sapiens
guguccugacca

SEQ ID NO: 1956757 - RNA, 20 nt, Homo sapiens
aauaagucaggaggaugcaa

SEQ ID NO: 1956758 - RNA, 14 nt, Homo sapiens
guggcaugugcugu

SEQ ID NO: 1956759 - RNA, 17 nt, Homo sapiens
gauguuaguuaccaagc

SEQ ID NO: 1956760 - RNA, 22 nt, Homo sapiens
cagaaugaaucuaugcuggaua

SEQ ID NO: 1956761 - RNA, 21 nt, Homo sapiens
agugguguguguuaucagaua

SEQ ID NO: 1956762 - RNA, 21 nt, Homo sapiens
gggcccucggugggagccaug

SEQ ID NO: 1956763 - RNA, 19 nt, Homo sapiens
cuacuagcucuuugagaua

SEQ ID NO: 1956764 - RNA, 18 nt, Homo sapiens
ugugcuggucauggaaug

SEQ ID NO: 1956765 - RNA, 18 nt, Homo sapiens
cagauguaacagaacaaa

SEQ ID NO: 1956766 - RNA, 20 nt, Homo sapiens
cuaaucuuaccagucugucu

SEQ ID NO: 1956767 - RNA, 18 nt, Homo sapiens
gaaagccugggugacauu

SEQ ID NO: 1956768 - RNA, 20 nt, Homo sapiens
aauuauuuugugaugcaaau

SEQ ID NO: 1956769 - RNA, 12 nt, Homo sapiens
gcacaagacuga

SEQ ID NO: 1956770 - RNA, 19 nt, Homo sapiens
aaggugggcggaucacuug

SEQ ID NO: 1956771 - RNA, 14 nt, Homo sapiens
cauguacaugguau

SEQ ID NO: 1956772 - RNA, 20 nt, Homo sapiens
uuaucccucucucuaccugu

SEQ ID NO: 1956773 - RNA, 15 nt, Homo sapiens
ugcuauuugucaucu

SEQ ID NO: 1956774 - RNA, 17 nt, Homo sapiens
cuggugcacaugacauu

SEQ ID NO: 1956775 - RNA, 22 nt, Homo sapiens
auuguuggcacauccuaugcaa

SEQ ID NO: 1956776 - RNA, 21 nt, Homo sapiens
uuauuaccucugauaccucaa

SEQ ID NO: 1956777 - RNA, 15 nt, Homo sapiens
aaauacuuaaauucc

SEQ ID NO: 1956778 - RNA, 15 nt, Homo sapiens
agaaaucuagaauuu

SEQ ID NO: 1956779 - RNA, 18 nt, Homo sapiens
ugucuguguacauguaca

SEQ ID NO: 1956780 - RNA, 20 nt, Homo sapiens
cuguauuuuauauaggcauu

SEQ ID NO: 1956781 - RNA, 21 nt, Homo sapiens
aaaaauuagagugcauuacuu

SEQ ID NO: 1956782 - RNA, 18 nt, Homo sapiens
auaaagcuccucugcucc

SEQ ID NO: 1956783 - RNA, 16 nt, Homo sapiens
gaagucuuccauagag

SEQ ID NO: 1956784 - RNA, 13 nt, Homo sapiens
agaggcuuuccaa

SEQ ID NO: 1956785 - RNA, 14 nt, Homo sapiens
gaauaaaaauugac

SEQ ID NO: 1956786 - RNA, 15 nt, Homo sapiens
ccucauucuacugaa

SEQ ID NO: 1956787 - RNA, 18 nt, Homo sapiens
uguguagacuguaacuuu

SEQ ID NO: 1956788 - RNA, 14 nt, Homo sapiens
accgggaugggagc

SEQ ID NO: 1956789 - RNA, 18 nt, Homo sapiens
guuacaaaaagacaaaaa

SEQ ID NO: 1956790 - RNA, 13 nt, Homo sapiens
ccagcaguaacug

SEQ ID NO: 1956791 - RNA, 17 nt, Homo sapiens
uuaguuuugcuccuucu

SEQ ID NO: 1956792 - RNA, 14 nt, Homo sapiens
aacugaguccuguu

SEQ ID NO: 1956793 - RNA, 15 nt, Homo sapiens
uuauuuccauggauu

SEQ ID NO: 1956794 - RNA, 14 nt, Homo sapiens
acuucaaauucaaa

SEQ ID NO: 1956795 - RNA, 13 nt, Homo sapiens
caacaacugucag

SEQ ID NO: 1956796 - RNA, 17 nt, Homo sapiens
ucuugccucucucagga

SEQ ID NO: 1956797 - RNA, 20 nt, Homo sapiens
uugggcuggaugccgaggua

SEQ ID NO: 1956798 - RNA, 22 nt, Homo sapiens
cuuuugccaguauuaugcauau

SEQ ID NO: 1956799 - RNA, 22 nt, Homo sapiens
auuuauccuauaagaugacaau

SEQ ID NO: 1956800 - RNA, 20 nt, Homo sapiens
accucuucuacccucaucau

SEQ ID NO: 1956801 - RNA, 16 nt, Homo sapiens
caaagucaaaaauagc

SEQ ID NO: 1956802 - RNA, 13 nt, Homo sapiens
gccagagggcagu

SEQ ID NO: 1956803 - RNA, 22 nt, Homo sapiens
accguggaggaggaaggcaaga

SEQ ID NO: 1956804 - RNA, 19 nt, Homo sapiens
ggcugcacaggcugaaaua

SEQ ID NO: 1956805 - RNA, 22 nt, Homo sapiens
gccucauuauuuuucacugccc

SEQ ID NO: 1956806 - RNA, 16 nt, Homo sapiens
cacuggccauucuuau

SEQ ID NO: 1956807 - RNA, 17 nt, Homo sapiens
acaauagcccaaagcca

SEQ ID NO: 1956808 - RNA, 13 nt, Homo sapiens
aagaaaacuuuaa

SEQ ID NO: 1956809 - RNA, 14 nt, Homo sapiens
gugugaaaucucag

SEQ ID NO: 1956810 - RNA, 14 nt, Homo sapiens
uccgucaccucaga

SEQ ID NO: 1956811 - RNA, 17 nt, Homo sapiens
ggggccauugcuuaccu

SEQ ID NO: 1956812 - RNA, 18 nt, Homo sapiens
uaauagauguuacucaaa

SEQ ID NO: 1956813 - RNA, 22 nt, Homo sapiens
aagaugugggcagugaugucac

SEQ ID NO: 1956814 - RNA, 21 nt, Homo sapiens
cuuccucucuggauacugcaa

SEQ ID NO: 1956815 - RNA, 17 nt, Homo sapiens
acacauacagagugggc

SEQ ID NO: 1956816 - RNA, 15 nt, Homo sapiens
ucucaugcuccuuaa

SEQ ID NO: 1956817 - RNA, 18 nt, Homo sapiens
gcuuagccuccugaccug

SEQ ID NO: 1956818 - RNA, 15 nt, Homo sapiens
ucaaaaagagagauu

SEQ ID NO: 1956819 - RNA, 15 nt, Homo sapiens
aguaaacacagggaa

SEQ ID NO: 1956820 - RNA, 20 nt, Homo sapiens
ugcugaccuuuuuaucuuga

SEQ ID NO: 1956821 - RNA, 14 nt, Homo sapiens
cacgcgaaaaccuu

SEQ ID NO: 1956822 - RNA, 21 nt, Homo sapiens
uguuacuaaagucacauauaa

SEQ ID NO: 1956823 - RNA, 20 nt, Homo sapiens
gauugcaugugacucugaag

SEQ ID NO: 1956824 - RNA, 23 nt, Homo sapiens
uuccuuuaaauucuccaacccaa

SEQ ID NO: 1956825 - RNA, 19 nt, Homo sapiens
aaguauaaucagcacuuug

SEQ ID NO: 1956826 - RNA, 23 nt, Homo sapiens
ugggaaaaaaacuuggcacuuuu

SEQ ID NO: 1956827 - RNA, 21 nt, Homo sapiens
cacaaguauugcccuuuaaca

SEQ ID NO: 1956828 - RNA, 17 nt, Homo sapiens
cagaaaaaagaccaaua

SEQ ID NO: 1956829 - RNA, 23 nt, Homo sapiens
uucacacagugaaacgcaauuuu

SEQ ID NO: 1956830 - RNA, 14 nt, Homo sapiens
ugcagaagugcaug

SEQ ID NO: 1956831 - RNA, 18 nt, Homo sapiens
caggaagagcugacccau

SEQ ID NO: 1956832 - RNA, 16 nt, Homo sapiens
aguugagauucucuac

SEQ ID NO: 1956833 - RNA, 17 nt, Homo sapiens
aaaggacuugacuugca

SEQ ID NO: 1956834 - RNA, 20 nt, Homo sapiens
uaccucaaccaaugccaaaa

SEQ ID NO: 1956835 - RNA, 21 nt, Homo sapiens
ugaguuuuugauagcuuuauu

SEQ ID NO: 1956836 - RNA, 11 nt, Homo sapiens
gcucuugcagu

SEQ ID NO: 1956837 - RNA, 13 nt, Homo sapiens
gccacugccagcu

SEQ ID NO: 1956838 - RNA, 19 nt, Homo sapiens
uaaugacauuucacugaug

SEQ ID NO: 1956839 - RNA, 21 nt, Homo sapiens
uccaugugagaauauuuuucc

SEQ ID NO: 1956840 - RNA, 20 nt, Homo sapiens
ucugcccagcuugggcccag

SEQ ID NO: 1956841 - RNA, 21 nt, Homo sapiens
aagugaacauuacauugccau

SEQ ID NO: 1956842 - RNA, 16 nt, Homo sapiens
uaccuuaucacugcau

SEQ ID NO: 1956843 - RNA, 17 nt, Homo sapiens
cuccccgugagcacugc

SEQ ID NO: 1956844 - RNA, 13 nt, Homo sapiens
gucauaacaucca

SEQ ID NO: 1956845 - RNA, 19 nt, Homo sapiens
ggcuuuacuaucuuuucau

SEQ ID NO: 1956846 - RNA, 12 nt, Homo sapiens
agcagagucaag

SEQ ID NO: 1956847 - RNA, 17 nt, Homo sapiens
auaaaucuaauaauuau

SEQ ID NO: 1956848 - RNA, 16 nt, Homo sapiens
cuaagaaguuacuuuu

SEQ ID NO: 1956849 - RNA, 22 nt, Homo sapiens
cugcaggaacgagcacuggcca

SEQ ID NO: 1956850 - RNA, 12 nt, Homo sapiens
agugauccugcc

SEQ ID NO: 1956851 - RNA, 16 nt, Homo sapiens
ccuguccagguagaaa

SEQ ID NO: 1956852 - RNA, 22 nt, Homo sapiens
uagcaucagagguuugcuuccu

SEQ ID NO: 1956853 - RNA, 21 nt, Homo sapiens
cagacagcagaauuccucuua

SEQ ID NO: 1956854 - RNA, 22 nt, Homo sapiens
caaucccucuccacucuucucu

SEQ ID NO: 1956855 - RNA, 15 nt, Homo sapiens
cagcccccacagccc

SEQ ID NO: 1956856 - RNA, 19 nt, Homo sapiens
aaguguuuacuaugugcca

SEQ ID NO: 1956857 - RNA, 15 nt, Homo sapiens
cgucccuggggcucc

SEQ ID NO: 1956858 - RNA, 11 nt, Homo sapiens
gccggaccaag

SEQ ID NO: 1956859 - RNA, 19 nt, Homo sapiens
aacacugcaggcaucacag

SEQ ID NO: 1956860 - RNA, 23 nt, Homo sapiens
gcaaaggauguguuuucagucuu

SEQ ID NO: 1956861 - RNA, 15 nt, Homo sapiens
acuaguugcuuacaa

SEQ ID NO: 1956862 - RNA, 19 nt, Homo sapiens
cugugugggacuguacaca

SEQ ID NO: 1956863 - RNA, 15 nt, Homo sapiens
ccagccugggcaaca

SEQ ID NO: 1956864 - RNA, 19 nt, Homo sapiens
uggcaauaaacuccuacua

SEQ ID NO: 1956865 - RNA, 20 nt, Homo sapiens
agauaaaccaauaaauccac

SEQ ID NO: 1956866 - RNA, 21 nt, Homo sapiens
auccacagccaacaaacauag

SEQ ID NO: 1956867 - RNA, 22 nt, Homo sapiens
acauguagagauuugagugcag

SEQ ID NO: 1956868 - RNA, 20 nt, Homo sapiens
aaucugacgucaucuugucu

SEQ ID NO: 1956869 - RNA, 16 nt, Homo sapiens
ccuaaccaaaugcugu

SEQ ID NO: 1956870 - RNA, 15 nt, Homo sapiens
ccucugaguuaaaua

SEQ ID NO: 1956871 - RNA, 22 nt, Homo sapiens
auaauagcacuaaugcuuuaag

SEQ ID NO: 1956872 - RNA, 17 nt, Homo sapiens
ucugccuuuuuacuaua

SEQ ID NO: 1956873 - RNA, 15 nt, Homo sapiens
uucuugcaugaauca

SEQ ID NO: 1956874 - RNA, 13 nt, Homo sapiens
acgucacugauau

SEQ ID NO: 1956875 - RNA, 22 nt, Homo sapiens
gagauugcaccacugcacucca

SEQ ID NO: 1956876 - RNA, 23 nt, Homo sapiens
gcaacagauagauguugcucuuu

SEQ ID NO: 1956877 - RNA, 12 nt, Homo sapiens
cucugaugcuga

SEQ ID NO: 1956878 - RNA, 16 nt, Homo sapiens
aguagacugauuacac

SEQ ID NO: 1956879 - RNA, 14 nt, Homo sapiens
uaaacacugauggu

SEQ ID NO: 1956880 - RNA, 18 nt, Homo sapiens
gcuaaaaaaagugcauga

SEQ ID NO: 1956881 - RNA, 21 nt, Homo sapiens
auauuaacaacaauaacacug

SEQ ID NO: 1956882 - RNA, 22 nt, Homo sapiens
ccuaagcccuccgccauucuca

SEQ ID NO: 1956883 - RNA, 18 nt, Homo sapiens
uggaugcacacuucugac

SEQ ID NO: 1956884 - RNA, 19 nt, Homo sapiens
aguucugaauaacuugaag

SEQ ID NO: 1956885 - RNA, 15 nt, Homo sapiens
aauguaaacaauauc

SEQ ID NO: 1956886 - RNA, 11 nt, Homo sapiens
uacaaccagag

SEQ ID NO: 1956887 - RNA, 16 nt, Homo sapiens
guugcugcuacugucu

SEQ ID NO: 1956888 - RNA, 16 nt, Homo sapiens
cucugauauacaauua

SEQ ID NO: 1956889 - RNA, 15 nt, Homo sapiens
auaagggguggggga

SEQ ID NO: 1956890 - RNA, 19 nt, Homo sapiens
acuuuaaaacuguauuuaa

SEQ ID NO: 1956891 - RNA, 20 nt, Homo sapiens
uccucauuuauaaaauaaug

SEQ ID NO: 1956892 - RNA, 16 nt, Homo sapiens
uuaaaucacacaugcu

SEQ ID NO: 1956893 - RNA, 23 nt, Homo sapiens
cacuuaguauugcagccaaagaa

SEQ ID NO: 1956894 - RNA, 13 nt, Homo sapiens
cauggagaccuca

SEQ ID NO: 1956895 - RNA, 15 nt, Homo sapiens
gagccagaaaugggc

SEQ ID NO: 1956896 - RNA, 21 nt, Homo sapiens
auggaguuucucuagaagcuc

SEQ ID NO: 1956897 - RNA, 13 nt, Homo sapiens
cucaaucucaggu

SEQ ID NO: 1956898 - RNA, 19 nt, Homo sapiens
agauaacagccucuugccc

SEQ ID NO: 1956899 - RNA, 22 nt, Homo sapiens
gauuucaggauacucugucaga

SEQ ID NO: 1956900 - RNA, 22 nt, Homo sapiens
auuggaaugcagaggucuccaa

SEQ ID NO: 1956901 - RNA, 20 nt, Homo sapiens
guagcauuuacugugucuuu

SEQ ID NO: 1956902 - RNA, 19 nt, Homo sapiens
gcaguucucugccaaagcu

SEQ ID NO: 1956903 - RNA, 16 nt, Homo sapiens
ucuggucuccacagau

SEQ ID NO: 1956904 - RNA, 14 nt, Homo sapiens
agugagcucuggug

SEQ ID NO: 1956905 - RNA, 18 nt, Homo sapiens
caauagugcaacaucucu

SEQ ID NO: 1956906 - RNA, 15 nt, Homo sapiens
aauuaagcuguaauc

SEQ ID NO: 1956907 - RNA, 16 nt, Homo sapiens
guuuguuuaacuguga

SEQ ID NO: 1956908 - RNA, 16 nt, Homo sapiens
uugaugugauguggca

SEQ ID NO: 1956909 - RNA, 15 nt, Homo sapiens
guguaaaaaaaccac

SEQ ID NO: 1956910 - RNA, 23 nt, Homo sapiens
aauuucacuucaggagaaacugc

SEQ ID NO: 1956911 - RNA, 17 nt, Homo sapiens
augccuaaucuguaauc

SEQ ID NO: 1956912 - RNA, 22 nt, Homo sapiens
gcauaaaacaaaccagcaacuu

SEQ ID NO: 1956913 - RNA, 16 nt, Homo sapiens
uuggcccuucugcccu

SEQ ID NO: 1956914 - RNA, 16 nt, Homo sapiens
cagucaaaggcauuuu

SEQ ID NO: 1956915 - RNA, 14 nt, Homo sapiens
aaagcccugacgga

SEQ ID NO: 1956916 - RNA, 14 nt, Homo sapiens
aaaugccugacuca

SEQ ID NO: 1956917 - RNA, 19 nt, Homo sapiens
cccucucuuauaauuccag

SEQ ID NO: 1956918 - RNA, 13 nt, Homo sapiens
ccaccaguucuca

SEQ ID NO: 1956919 - RNA, 23 nt, Homo sapiens
gacucaaggggcuggaaucucau

SEQ ID NO: 1956920 - RNA, 18 nt, Homo sapiens
cauaaguuccuauaccuu

SEQ ID NO: 1956921 - RNA, 17 nt, Homo sapiens
cacagucugacuucccc

SEQ ID NO: 1956922 - RNA, 19 nt, Homo sapiens
uaaauaaccucuggcccuu

SEQ ID NO: 1956923 - RNA, 14 nt, Homo sapiens
acagucucacuuug

SEQ ID NO: 1956924 - RNA, 13 nt, Homo sapiens
ucauuauuggaau

SEQ ID NO: 1956925 - RNA, 21 nt, Homo sapiens
auucuucaagaucccauuuga

SEQ ID NO: 1956926 - RNA, 11 nt, Homo sapiens
ugaaagaucuu

SEQ ID NO: 1956927 - RNA, 12 nt, Homo sapiens
cuuguugccccc

SEQ ID NO: 1956928 - RNA, 21 nt, Homo sapiens
acauacaaacauaaggcacau

SEQ ID NO: 1956929 - RNA, 23 nt, Homo sapiens
ugaccagcauaccaguucuugca

SEQ ID NO: 1956930 - RNA, 20 nt, Homo sapiens
agaaacagcaggugaugacu

SEQ ID NO: 1956931 - RNA, 16 nt, Homo sapiens
uugcccaugccuccag

SEQ ID NO: 1956932 - RNA, 19 nt, Homo sapiens
ggcaauuuaacaaugucug

SEQ ID NO: 1956933 - RNA, 16 nt, Homo sapiens
gucugggcacagucag

SEQ ID NO: 1956934 - RNA, 16 nt, Homo sapiens
aacuuuggcuuucaua

SEQ ID NO: 1956935 - RNA, 21 nt, Homo sapiens
ccaggacuauauuugggccug

SEQ ID NO: 1956936 - RNA, 21 nt, Homo sapiens
cucuuaaugauguuaucuuaa

SEQ ID NO: 1956937 - RNA, 20 nt, Homo sapiens
acuaagagaaggggugcaga

SEQ ID NO: 1956938 - RNA, 16 nt, Homo sapiens
agcccagagacuuugu

SEQ ID NO: 1956939 - RNA, 18 nt, Homo sapiens
aauauugucugccuuaaa

SEQ ID NO: 1956940 - RNA, 21 nt, Homo sapiens
cauaccaaguugauacuugaa

SEQ ID NO: 1956941 - RNA, 19 nt, Homo sapiens
ucagucagagaacagagau

SEQ ID NO: 1956942 - RNA, 13 nt, Homo sapiens
ugaggcugucauu

SEQ ID NO: 1956943 - RNA, 13 nt, Homo sapiens
aauaaugccaaug

SEQ ID NO: 1956944 - RNA, 14 nt, Homo sapiens
ucagaucaauacaa

SEQ ID NO: 1956945 - RNA, 21 nt, Homo sapiens
uuacugcuuuuccaaacauuc

SEQ ID NO: 1956946 - RNA, 17 nt, Homo sapiens
acuuucccacagcacua

SEQ ID NO: 1956947 - RNA, 13 nt, Homo sapiens
cacuuaaaagcug

SEQ ID NO: 1956948 - RNA, 21 nt, Homo sapiens
gagcggauggagaagcagcag

SEQ ID NO: 1956949 - RNA, 23 nt, Homo sapiens
cuacccugcacauuguuaugcac

SEQ ID NO: 1956950 - RNA, 13 nt, Homo sapiens
aucaaggaugcuc

SEQ ID NO: 1956951 - RNA, 20 nt, Homo sapiens
gacaauggaaacuguaccau

SEQ ID NO: 1956952 - RNA, 16 nt, Homo sapiens
ugaucuauaccaccuu

SEQ ID NO: 1956953 - RNA, 17 nt, Homo sapiens
cugcuaauguugaucag

SEQ ID NO: 1956954 - RNA, 20 nt, Homo sapiens
ugccaccauggccagccaac

SEQ ID NO: 1956955 - RNA, 11 nt, Homo sapiens
ucauuaucuca

SEQ ID NO: 1956956 - RNA, 17 nt, Homo sapiens
augaaggaaggacuaug

SEQ ID NO: 1956957 - RNA, 18 nt, Homo sapiens
gccagacaugguggcaug

SEQ ID NO: 1956958 - RNA, 18 nt, Homo sapiens
cacuuccuuggaaacaga

SEQ ID NO: 1956959 - RNA, 14 nt, Homo sapiens
uucuacaaaauccu

SEQ ID NO: 1956960 - RNA, 20 nt, Homo sapiens
aagguccucugucagucaca

SEQ ID NO: 1956961 - RNA, 20 nt, Homo sapiens
ccuguagucucagcuacuua

SEQ ID NO: 1956962 - RNA, 23 nt, Homo sapiens
ugacaucacagcagccuccaaca

SEQ ID NO: 1956963 - RNA, 20 nt, Homo sapiens
cagagcgccaggaagccaga

SEQ ID NO: 1956964 - RNA, 15 nt, Homo sapiens
cucucugcucaguga

SEQ ID NO: 1956965 - RNA, 21 nt, Homo sapiens
ugauccauuaaguaaacaaua

SEQ ID NO: 1956966 - RNA, 12 nt, Homo sapiens
agaaauaagccc

SEQ ID NO: 1956967 - RNA, 15 nt, Homo sapiens
aguuugaaaaacuaa

SEQ ID NO: 1956968 - RNA, 21 nt, Homo sapiens
cucuggugcuccugcaucuca

SEQ ID NO: 1956969 - RNA, 23 nt, Homo sapiens
guagacaucccccuccuugccgc

SEQ ID NO: 1956970 - RNA, 17 nt, Homo sapiens
cucaggcucuccauuca

SEQ ID NO: 1956971 - RNA, 14 nt, Homo sapiens
auacaaaguacaga

SEQ ID NO: 1956972 - RNA, 22 nt, Homo sapiens
ugacagugaagcagcacuguga

SEQ ID NO: 1956973 - RNA, 19 nt, Homo sapiens
gucccagagguuaucugcc

SEQ ID NO: 1956974 - RNA, 17 nt, Homo sapiens
aaaguauuccaccuuaa

SEQ ID NO: 1956975 - RNA, 16 nt, Homo sapiens
acaacuggaagcuuug

SEQ ID NO: 1956976 - RNA, 11 nt, Homo sapiens
cugaggggugu

SEQ ID NO: 1956977 - RNA, 23 nt, Homo sapiens
aaaggcaaccgugguuacuguau

SEQ ID NO: 1956978 - RNA, 16 nt, Homo sapiens
uuuaucuuaaccucaa

SEQ ID NO: 1956979 - RNA, 17 nt, Homo sapiens
ucccucucuuccgggag

SEQ ID NO: 1956980 - RNA, 15 nt, Homo sapiens
ugcugaggcccagug

SEQ ID NO: 1956981 - RNA, 22 nt, Homo sapiens
cacaaucugagcacgcuaccaa

SEQ ID NO: 1956982 - RNA, 22 nt, Homo sapiens
ucagcagaugcuguugugaagc

SEQ ID NO: 1956983 - RNA, 18 nt, Homo sapiens
ccugugguuaacaucuca

SEQ ID NO: 1956984 - RNA, 15 nt, Homo sapiens
guuggaaaugugcaa

SEQ ID NO: 1956985 - RNA, 14 nt, Homo sapiens
gcugagucugcaga

SEQ ID NO: 1956986 - RNA, 21 nt, Homo sapiens
ggaauagaucguagauguugu

SEQ ID NO: 1956987 - RNA, 19 nt, Homo sapiens
ugaguauggcuaucuauac

SEQ ID NO: 1956988 - RNA, 13 nt, Homo sapiens
aggcgaagggugg

SEQ ID NO: 1956989 - RNA, 19 nt, Homo sapiens
agaaauucuaaauaaugca

SEQ ID NO: 1956990 - RNA, 23 nt, Homo sapiens
ugcgugccaucacucaaccauaa

SEQ ID NO: 1956991 - RNA, 13 nt, Homo sapiens
aaugcaaaugcac

SEQ ID NO: 1956992 - RNA, 16 nt, Homo sapiens
cugggcucagccugag

SEQ ID NO: 1956993 - RNA, 14 nt, Homo sapiens
ggacuccuggugcc

SEQ ID NO: 1956994 - RNA, 18 nt, Homo sapiens
uaaggggaauuaacaauu

SEQ ID NO: 1956995 - RNA, 17 nt, Homo sapiens
augccagacccacugaa

SEQ ID NO: 1956996 - RNA, 13 nt, Homo sapiens
agugucagcacuc

SEQ ID NO: 1956997 - RNA, 15 nt, Homo sapiens
cuaguggaaagucag

SEQ ID NO: 1956998 - RNA, 15 nt, Homo sapiens
ucugcaucagcuuuu

SEQ ID NO: 1956999 - RNA, 16 nt, Homo sapiens
cuuuguuuaugaagaa

SEQ ID NO: 1957000 - RNA, 20 nt, Homo sapiens
gcugauggguggaccugugu

SEQ ID NO: 1957001 - RNA, 23 nt, Homo sapiens
aauaggaccucaaaauaagccau

SEQ ID NO: 1957002 - RNA, 14 nt, Homo sapiens
cacacccaauucca

SEQ ID NO: 1957003 - RNA, 18 nt, Homo sapiens
caggaagacuuugugacu

SEQ ID NO: 1957004 - RNA, 17 nt, Homo sapiens
ugcaaacaaaucaugca

SEQ ID NO: 1957005 - RNA, 21 nt, Homo sapiens
cuucauguucagucacaugug

SEQ ID NO: 1957006 - RNA, 19 nt, Homo sapiens
gguaucaguugcaauaaua

SEQ ID NO: 1957007 - RNA, 17 nt, Homo sapiens
uuauguaacauccagaa

SEQ ID NO: 1957008 - RNA, 16 nt, Homo sapiens
gaccucccagcccuau

SEQ ID NO: 1957009 - RNA, 20 nt, Homo sapiens
ccuccaagcuccaucuccac

SEQ ID NO: 1957010 - RNA, 14 nt, Homo sapiens
cguaggugauuuga

SEQ ID NO: 1957011 - RNA, 14 nt, Homo sapiens
agaaaggcuuuuua

SEQ ID NO: 1957012 - RNA, 17 nt, Homo sapiens
acuggacugucuaugaa

SEQ ID NO: 1957013 - RNA, 20 nt, Homo sapiens
aaguuguagugaagcucuca

SEQ ID NO: 1957014 - RNA, 22 nt, Homo sapiens
aucagaaauuuucuacaguaca

SEQ ID NO: 1957015 - RNA, 11 nt, Homo sapiens
acaacauuaag

SEQ ID NO: 1957016 - RNA, 16 nt, Homo sapiens
uucaacaggagaauuu

SEQ ID NO: 1957017 - RNA, 23 nt, Homo sapiens
ccacuuucugccagcaucugcag

SEQ ID NO: 1957018 - RNA, 22 nt, Homo sapiens
auuucuaauuauguagcucuuu

SEQ ID NO: 1957019 - RNA, 17 nt, Homo sapiens
acucaauucugcaguau

SEQ ID NO: 1957020 - RNA, 18 nt, Homo sapiens
acauggcaauugcacuca

SEQ ID NO: 1957021 - RNA, 18 nt, Homo sapiens
uagauauugcuacuauaa

SEQ ID NO: 1957022 - RNA, 17 nt, Homo sapiens
ucuaaguucauguuugu

SEQ ID NO: 1957023 - RNA, 15 nt, Homo sapiens
auaauauacuaugca

SEQ ID NO: 1957024 - RNA, 19 nt, Homo sapiens
aggggaggggggagccaga

SEQ ID NO: 1957025 - RNA, 14 nt, Homo sapiens
ugcucuucuuuaga

SEQ ID NO: 1957026 - RNA, 16 nt, Homo sapiens
ggaguuuuacugccug

SEQ ID NO: 1957027 - RNA, 15 nt, Homo sapiens
gaacuucccuuaaga

SEQ ID NO: 1957028 - RNA, 15 nt, Homo sapiens
ucuuagauucuuaau

SEQ ID NO: 1957029 - RNA, 21 nt, Homo sapiens
gacaagauacauaugaggaca

SEQ ID NO: 1957030 - RNA, 11 nt, Homo sapiens
uggcugucacc

SEQ ID NO: 1957031 - RNA, 23 nt, Homo sapiens
caccgccuccccaccuccaggcu

SEQ ID NO: 1957032 - RNA, 18 nt, Homo sapiens
uaucugcuauugugaugc

SEQ ID NO: 1957033 - RNA, 19 nt, Homo sapiens
cgugggccguaucugucac

SEQ ID NO: 1957034 - RNA, 16 nt, Homo sapiens
ccgugccaggcauuca

SEQ ID NO: 1957035 - RNA, 18 nt, Homo sapiens
gcugggaguccuuaccuc

SEQ ID NO: 1957036 - RNA, 18 nt, Homo sapiens
caucagucuuaauauuca

SEQ ID NO: 1957037 - RNA, 19 nt, Homo sapiens
ggcaaugggaggggaugcu

SEQ ID NO: 1957038 - RNA, 13 nt, Homo sapiens
cacagcccaagag

SEQ ID NO: 1957039 - RNA, 17 nt, Homo sapiens
gaacaguguuuacuuua

SEQ ID NO: 1957040 - RNA, 16 nt, Homo sapiens
ucugugaaagcucuca

SEQ ID NO: 1957041 - RNA, 18 nt, Homo sapiens
uaaugucuccuuugcucu

SEQ ID NO: 1957042 - RNA, 15 nt, Homo sapiens
ugcagagguccacaa

SEQ ID NO: 1957043 - RNA, 13 nt, Homo sapiens
ucagggaguacac

SEQ ID NO: 1957044 - RNA, 14 nt, Homo sapiens
cagaggucuuucag

SEQ ID NO: 1957045 - RNA, 20 nt, Homo sapiens
cagcagccagcucucagcca

SEQ ID NO: 1957046 - RNA, 20 nt, Homo sapiens
ucauaauuuuaguaauuucc

SEQ ID NO: 1957047 - RNA, 20 nt, Homo sapiens
acaccaccaugcucaacuaa

SEQ ID NO: 1957048 - RNA, 14 nt, Homo sapiens
gagucgcugugcca

SEQ ID NO: 1957049 - RNA, 21 nt, Homo sapiens
ccaguucuucgacuguuguua

SEQ ID NO: 1957050 - RNA, 13 nt, Homo sapiens
auaaauucaucag

SEQ ID NO: 1957051 - RNA, 23 nt, Homo sapiens
agaaguucacaucagaacagaca

SEQ ID NO: 1957052 - RNA, 20 nt, Homo sapiens
caaaucguguaucugacaaa

SEQ ID NO: 1957053 - RNA, 16 nt, Homo sapiens
ugcaguaugguacauu

SEQ ID NO: 1957054 - RNA, 12 nt, Homo sapiens
ccugaacaaagc

SEQ ID NO: 1957055 - RNA, 18 nt, Homo sapiens
gcccugcccuuggcacca

SEQ ID NO: 1957056 - RNA, 14 nt, Homo sapiens
aagcccaacugggg

SEQ ID NO: 1957057 - RNA, 20 nt, Homo sapiens
aacugaaucuauggcuuuaa

SEQ ID NO: 1957058 - RNA, 18 nt, Homo sapiens
uuuucagucuaguugcca

SEQ ID NO: 1957059 - RNA, 16 nt, Homo sapiens
cagcuuuuccaaaaua

SEQ ID NO: 1957060 - RNA, 12 nt, Homo sapiens
uacaugcaauuu

SEQ ID NO: 1957061 - RNA, 22 nt, Homo sapiens
cgaauaaagugaauacauuuug

SEQ ID NO: 1957062 - RNA, 22 nt, Homo sapiens
aagcuaaguauaguugauguaa

SEQ ID NO: 1957063 - RNA, 18 nt, Homo sapiens
auuuauugagcaccugca

SEQ ID NO: 1957064 - RNA, 14 nt, Homo sapiens
cagcccaacuguga

SEQ ID NO: 1957065 - RNA, 20 nt, Homo sapiens
aguaacaggccuugagcaca

SEQ ID NO: 1957066 - RNA, 19 nt, Homo sapiens
uagucacauggccuaugca

SEQ ID NO: 1957067 - RNA, 23 nt, Homo sapiens
caucucccaaagugcugggauua

SEQ ID NO: 1957068 - RNA, 19 nt, Homo sapiens
accuuguuggagccugcag

SEQ ID NO: 1957069 - RNA, 15 nt, Homo sapiens
auggacagcugagca

SEQ ID NO: 1957070 - RNA, 13 nt, Homo sapiens
cucucagccagcu

SEQ ID NO: 1957071 - RNA, 15 nt, Homo sapiens
uugagacauuuacau

SEQ ID NO: 1957072 - RNA, 16 nt, Homo sapiens
aaugucagcacauguu

SEQ ID NO: 1957073 - RNA, 15 nt, Homo sapiens
aucccuucauacuug

SEQ ID NO: 1957074 - RNA, 15 nt, Homo sapiens
augucaggucagcca

SEQ ID NO: 1957075 - RNA, 19 nt, Homo sapiens
aacaggaauucuauaguaa

SEQ ID NO: 1957076 - RNA, 16 nt, Homo sapiens
augccggggacagaga

SEQ ID NO: 1957077 - RNA, 23 nt, Homo sapiens
aacauuccauuugaagcagugau

SEQ ID NO: 1957078 - RNA, 16 nt, Homo sapiens
cauuauccaucuuuca

SEQ ID NO: 1957079 - RNA, 21 nt, Homo sapiens
ucugccucccaggcucaagca

SEQ ID NO: 1957080 - RNA, 23 nt, Homo sapiens
ucaucuuagugccugagaguauu

SEQ ID NO: 1957081 - RNA, 23 nt, Homo sapiens
acaaaugguuaaaaagaaacaaa

SEQ ID NO: 1957082 - RNA, 15 nt, Homo sapiens
uggaaucaaggaauc

SEQ ID NO: 1957083 - RNA, 17 nt, Homo sapiens
caugcuucgugccacac

SEQ ID NO: 1957084 - RNA, 17 nt, Homo sapiens
cuggcaagagacuacuc

SEQ ID NO: 1957085 - RNA, 18 nt, Homo sapiens
aguucaugucgcaacagu

SEQ ID NO: 1957086 - RNA, 12 nt, Homo sapiens
ugcccagaguag

SEQ ID NO: 1957087 - RNA, 17 nt, Homo sapiens
cucuccuuggccacaga

SEQ ID NO: 1957088 - RNA, 12 nt, Homo sapiens
aacaugaugaaa

SEQ ID NO: 1957089 - RNA, 12 nt, Homo sapiens
acagugaugccg

SEQ ID NO: 1957090 - RNA, 16 nt, Homo sapiens
ggaggucaaggugagc

SEQ ID NO: 1957091 - RNA, 19 nt, Homo sapiens
ugacaccuauuuuagacaa

SEQ ID NO: 1957092 - RNA, 17 nt, Homo sapiens
agcaguaaauuugcuag

SEQ ID NO: 1957093 - RNA, 14 nt, Homo sapiens
ggagaugcugggaa

SEQ ID NO: 1957094 - RNA, 17 nt, Homo sapiens
acagcugacccaagaag

SEQ ID NO: 1957095 - RNA, 16 nt, Homo sapiens
uguuguuuuuccucaa

SEQ ID NO: 1957096 - RNA, 21 nt, Homo sapiens
uaguuuuuucuuccuuuucac

SEQ ID NO: 1957097 - RNA, 13 nt, Homo sapiens
uguaaaugugcau

SEQ ID NO: 1957098 - RNA, 17 nt, Homo sapiens
agcugccugcuuuucac

SEQ ID NO: 1957099 - RNA, 15 nt, Homo sapiens
cguugacaugcacag

SEQ ID NO: 1957100 - RNA, 22 nt, Homo sapiens
ucccgaccuaccaccccacugg

SEQ ID NO: 1957101 - RNA, 21 nt, Homo sapiens
caaccgggaaaggcaucuaag

SEQ ID NO: 1957102 - RNA, 14 nt, Homo sapiens
aggaauuacgugcu

SEQ ID NO: 1957103 - RNA, 14 nt, Homo sapiens
gucaacaguucaaa

SEQ ID NO: 1957104 - RNA, 22 nt, Homo sapiens
uaaaaaggaccagccuaaugua

SEQ ID NO: 1957105 - RNA, 14 nt, Homo sapiens
aagaaaucuugucu

SEQ ID NO: 1957106 - RNA, 18 nt, Homo sapiens
ucugcagagucacucaca

SEQ ID NO: 1957107 - RNA, 19 nt, Homo sapiens
uaaaucaaugucacuuaaa

SEQ ID NO: 1957108 - RNA, 18 nt, Homo sapiens
cuucugacaaagguggua

SEQ ID NO: 1957109 - RNA, 22 nt, Homo sapiens
ucagauuguuaucuaucaacua

SEQ ID NO: 1957110 - RNA, 14 nt, Homo sapiens
caaacauaacugug

SEQ ID NO: 1957111 - RNA, 16 nt, Homo sapiens
cagauccagacuguaa

SEQ ID NO: 1957112 - RNA, 12 nt, Homo sapiens
gacugcaaugag

SEQ ID NO: 1957113 - RNA, 16 nt, Homo sapiens
caggaggccaaggugg

SEQ ID NO: 1957114 - RNA, 16 nt, Homo sapiens
cacuuuuaauaaacuu

SEQ ID NO: 1957115 - RNA, 21 nt, Homo sapiens
cuaguucuccccgauggggca

SEQ ID NO: 1957116 - RNA, 22 nt, Homo sapiens
aauuaugcaucugcuacugugu

SEQ ID NO: 1957117 - RNA, 17 nt, Homo sapiens
guauaaagucacuucca

SEQ ID NO: 1957118 - RNA, 14 nt, Homo sapiens
uagcugugaacaga

SEQ ID NO: 1957119 - RNA, 17 nt, Homo sapiens
gccagcacccaguccuc

SEQ ID NO: 1957120 - RNA, 10 nt, Homo sapiens
ugucuuuauu

SEQ ID NO: 1957121 - RNA, 20 nt, Homo sapiens
gauacagguauucugcugau

SEQ ID NO: 1957122 - RNA, 14 nt, Homo sapiens
gugcucugaagugu

SEQ ID NO: 1957123 - RNA, 16 nt, Homo sapiens
cagcagggucaucugu

SEQ ID NO: 1957124 - RNA, 13 nt, Homo sapiens
caaacuaaaggug

SEQ ID NO: 1957125 - RNA, 19 nt, Homo sapiens
uauaaguuguaccaaaaca

SEQ ID NO: 1957126 - RNA, 23 nt, Homo sapiens
aagggcaguggaggugcugcauu

SEQ ID NO: 1957127 - RNA, 14 nt, Homo sapiens
acuaaaaaccaaug

SEQ ID NO: 1957128 - RNA, 14 nt, Homo sapiens
acuuugaaccauaa

SEQ ID NO: 1957129 - RNA, 23 nt, Homo sapiens
ggcuucugugcccagaauacuga

SEQ ID NO: 1957130 - RNA, 23 nt, Homo sapiens
gaacacucaugcggcccagccau

SEQ ID NO: 1957131 - RNA, 19 nt, Homo sapiens
cagccuggaaaccuacaga

SEQ ID NO: 1957132 - RNA, 23 nt, Homo sapiens
ccuaaagaccgggaaaagggaac

SEQ ID NO: 1957133 - RNA, 15 nt, Homo sapiens
gaggcuccugugcua

SEQ ID NO: 1957134 - RNA, 16 nt, Homo sapiens
ggauaauuagcaucuc

SEQ ID NO: 1957135 - RNA, 12 nt, Homo sapiens
ucaggaccugcu

SEQ ID NO: 1957136 - RNA, 15 nt, Homo sapiens
gaauggcaugcugaa

SEQ ID NO: 1957137 - RNA, 23 nt, Homo sapiens
ucucuucagucucuauaccaaua

SEQ ID NO: 1957138 - RNA, 22 nt, Homo sapiens
ucugugcugguugccacccaag

SEQ ID NO: 1957139 - RNA, 22 nt, Homo sapiens
cugagcagugaaugauucagug

SEQ ID NO: 1957140 - RNA, 17 nt, Homo sapiens
agcacuccuaccuuaau

SEQ ID NO: 1957141 - RNA, 19 nt, Homo sapiens
cagaggccaggaugccuga

SEQ ID NO: 1957142 - RNA, 14 nt, Homo sapiens
guuggggaccucac

SEQ ID NO: 1957143 - RNA, 12 nt, Homo sapiens
aacuguucucuu

SEQ ID NO: 1957144 - RNA, 19 nt, Homo sapiens
cugggcaacacagcgagac

SEQ ID NO: 1957145 - RNA, 13 nt, Homo sapiens
gaaauacuuugua

SEQ ID NO: 1957146 - RNA, 21 nt, Homo sapiens
aggaugagcauuuagggcaag

SEQ ID NO: 1957147 - RNA, 22 nt, Homo sapiens
ccacuaugcacagauuaaacuu

SEQ ID NO: 1957148 - RNA, 12 nt, Homo sapiens
uuuugucuuucc

SEQ ID NO: 1957149 - RNA, 18 nt, Homo sapiens
ugucauuucuacuuucag

SEQ ID NO: 1957150 - RNA, 17 nt, Homo sapiens
auacagaaaaaccacau

SEQ ID NO: 1957151 - RNA, 19 nt, Homo sapiens
acaccaccucuccagaggc

SEQ ID NO: 1957152 - RNA, 16 nt, Homo sapiens
aaguuuauuacuuuau

SEQ ID NO: 1957153 - RNA, 13 nt, Homo sapiens
ucugggcacaagc

SEQ ID NO: 1957154 - RNA, 23 nt, Homo sapiens
cccaggagcagcuggcacugaca

SEQ ID NO: 1957155 - RNA, 24 nt, Homo sapiens
ggccgcuucagacacgcacuucug

SEQ ID NO: 1957156 - RNA, 16 nt, Homo sapiens
auuuuaauugcaccug

SEQ ID NO: 1957157 - RNA, 14 nt, Homo sapiens
caaaaccaauucau

SEQ ID NO: 1957158 - RNA, 20 nt, Homo sapiens
acagagauaauucuagcuuu

SEQ ID NO: 1957159 - RNA, 22 nt, Homo sapiens
gagauuucacaggucuugccca

SEQ ID NO: 1957160 - RNA, 17 nt, Homo sapiens
ggaccugagaguggcua

SEQ ID NO: 1957161 - RNA, 21 nt, Homo sapiens
ucaggguauugcuugccacua

SEQ ID NO: 1957162 - RNA, 23 nt, Homo sapiens
cugucaguaggggcaugguauaa

SEQ ID NO: 1957163 - RNA, 19 nt, Homo sapiens
cugcuuuugaaaucuguau

SEQ ID NO: 1957164 - RNA, 13 nt, Homo sapiens
gucuaagaacuuc

SEQ ID NO: 1957165 - RNA, 14 nt, Homo sapiens
acccaucagcacuc

SEQ ID NO: 1957166 - RNA, 13 nt, Homo sapiens
cuccuccagauca

SEQ ID NO: 1957167 - RNA, 22 nt, Homo sapiens
cagcaggauaaacauuccagag

SEQ ID NO: 1957168 - RNA, 21 nt, Homo sapiens
ucuggggggacccagugcaga

SEQ ID NO: 1957169 - RNA, 17 nt, Homo sapiens
ugcaggagagcuucccc

SEQ ID NO: 1957170 - RNA, 17 nt, Homo sapiens
cucagccguucuugaca

SEQ ID NO: 1957171 - RNA, 19 nt, Homo sapiens
auaugcuucacauagcaug

SEQ ID NO: 1957172 - RNA, 15 nt, Homo sapiens
cacgcucgcugccau

SEQ ID NO: 1957173 - RNA, 19 nt, Homo sapiens
agaagaaaaucaaccagca

SEQ ID NO: 1957174 - RNA, 19 nt, Homo sapiens
aagucagaggagauguggu

SEQ ID NO: 1957175 - RNA, 21 nt, Homo sapiens
aguguccccuccacugucaca

SEQ ID NO: 1957176 - RNA, 21 nt, Homo sapiens
caucaaagugggguacaguaa

SEQ ID NO: 1957177 - RNA, 17 nt, Homo sapiens
uccagggcagaggccau

SEQ ID NO: 1957178 - RNA, 18 nt, Homo sapiens
ucaucagcauaccuuuau

SEQ ID NO: 1957179 - RNA, 17 nt, Homo sapiens
gaugaccauaaccacug

SEQ ID NO: 1957180 - RNA, 14 nt, Homo sapiens
gaccagugaccaaa

SEQ ID NO: 1957181 - RNA, 14 nt, Homo sapiens
cuauuuacauauaa

SEQ ID NO: 1957182 - RNA, 15 nt, Homo sapiens
accacccagaguggc

SEQ ID NO: 1957183 - RNA, 22 nt, Homo sapiens
ccaguaaggucaugugcuucca

SEQ ID NO: 1957184 - RNA, 12 nt, Homo sapiens
gucauuaucaaa

SEQ ID NO: 1957185 - RNA, 17 nt, Homo sapiens
cuuccuuuaggaucuca

SEQ ID NO: 1957186 - RNA, 14 nt, Homo sapiens
ucaagguguucucu

SEQ ID NO: 1957187 - RNA, 22 nt, Homo sapiens
cacuccacugccuuuggaaggg

SEQ ID NO: 1957188 - RNA, 18 nt, Homo sapiens
caauuguccccagggaca

SEQ ID NO: 1957189 - RNA, 19 nt, Homo sapiens
ucuggcauuccuuuuccca

SEQ ID NO: 1957190 - RNA, 13 nt, Homo sapiens
ugcuuauacacug

SEQ ID NO: 1957191 - RNA, 20 nt, Homo sapiens
gugggcucccugacugggag

SEQ ID NO: 1957192 - RNA, 17 nt, Homo sapiens
gccuuucuuauuugcaa

SEQ ID NO: 1957193 - RNA, 15 nt, Homo sapiens
cuaauuuuucagcuc

SEQ ID NO: 1957194 - RNA, 17 nt, Homo sapiens
guucacgcaacuugaaa

SEQ ID NO: 1957195 - RNA, 23 nt, Homo sapiens
gauggcaccuauugagggugaca

SEQ ID NO: 1957196 - RNA, 13 nt, Homo sapiens
cugggcacaagca

SEQ ID NO: 1957197 - RNA, 13 nt, Homo sapiens
aggagaagccagu

SEQ ID NO: 1957198 - RNA, 13 nt, Homo sapiens
uaaggugagggaa

SEQ ID NO: 1957199 - RNA, 13 nt, Homo sapiens
cugucuacacuaa

SEQ ID NO: 1957200 - RNA, 14 nt, Homo sapiens
ugugugcaucaugu

SEQ ID NO: 1957201 - RNA, 13 nt, Homo sapiens
gaucccagggaaa

SEQ ID NO: 1957202 - RNA, 19 nt, Homo sapiens
uccauacccacaaucugag

SEQ ID NO: 1957203 - RNA, 16 nt, Homo sapiens
cacagagaacaggcag

SEQ ID NO: 1957204 - RNA, 14 nt, Homo sapiens
uccaaugcucaaga

SEQ ID NO: 1957205 - RNA, 14 nt, Homo sapiens
uguauucauccaga

SEQ ID NO: 1957206 - RNA, 13 nt, Homo sapiens
ucagucauaauca

SEQ ID NO: 1957207 - RNA, 21 nt, Homo sapiens
aagcuccaucuuauuugucag

SEQ ID NO: 1957208 - RNA, 19 nt, Homo sapiens
gcuuccaguccaaucucau

SEQ ID NO: 1957209 - RNA, 19 nt, Homo sapiens
uucaaaucagagcagugau

SEQ ID NO: 1957210 - RNA, 14 nt, Homo sapiens
uguguggacuguga

SEQ ID NO: 1957211 - RNA, 15 nt, Homo sapiens
ugaaaucaacugaca

SEQ ID NO: 1957212 - RNA, 20 nt, Homo sapiens
aagcagaucauuucccaaaa

SEQ ID NO: 1957213 - RNA, 22 nt, Homo sapiens
uucacauauauguaauuuagca

SEQ ID NO: 1957214 - RNA, 20 nt, Homo sapiens
ccaagaggaaaauauugaca

SEQ ID NO: 1957215 - RNA, 16 nt, Homo sapiens
ucugcaucccccaaag

SEQ ID NO: 1957216 - RNA, 23 nt, Homo sapiens
agcuucuguccucuucugugagu

SEQ ID NO: 1957217 - RNA, 12 nt, Homo sapiens
caauaaaggggg

SEQ ID NO: 1957218 - RNA, 19 nt, Homo sapiens
ggagcauguuuuguauaca

SEQ ID NO: 1957219 - RNA, 23 nt, Homo sapiens
uuagcaaaaauuagaauuuuggu

SEQ ID NO: 1957220 - RNA, 12 nt, Homo sapiens
gccgacucagca

SEQ ID NO: 1957221 - RNA, 23 nt, Homo sapiens
guguauuuuagaaauaguaacuu

SEQ ID NO: 1957222 - RNA, 19 nt, Homo sapiens
cuggcaagucuuccaugac

SEQ ID NO: 1957223 - RNA, 13 nt, Homo sapiens
ugaaaaagacaua

SEQ ID NO: 1957224 - RNA, 20 nt, Homo sapiens
acauuuuuccucucugcaaa

SEQ ID NO: 1957225 - RNA, 16 nt, Homo sapiens
ccaggagccucaucca

SEQ ID NO: 1957226 - RNA, 19 nt, Homo sapiens
ucagcauuuccacaccaag

SEQ ID NO: 1957227 - RNA, 20 nt, Homo sapiens
cugaucucucgugauugaua

SEQ ID NO: 1957228 - RNA, 14 nt, Homo sapiens
cuguacucuuugcu

SEQ ID NO: 1957229 - RNA, 22 nt, Homo sapiens
ggcccagauacagcacauccac

SEQ ID NO: 1957230 - RNA, 19 nt, Homo sapiens
uacucuuuguaugaugaaa

SEQ ID NO: 1957231 - RNA, 17 nt, Homo sapiens
ugcccgaauuuguaauu

SEQ ID NO: 1957232 - RNA, 18 nt, Homo sapiens
ccaaugccaauucaucuc

SEQ ID NO: 1957233 - RNA, 17 nt, Homo sapiens
aucucagggaacugacc

SEQ ID NO: 1957234 - RNA, 23 nt, Homo sapiens
agaaagagccuuggccuuaagga

SEQ ID NO: 1957235 - RNA, 18 nt, Homo sapiens
uucugugcccuccugacc

SEQ ID NO: 1957236 - RNA, 21 nt, Homo sapiens
caacaagauuuccuugugcaa

SEQ ID NO: 1957237 - RNA, 18 nt, Homo sapiens
uggcugucugaccagaga

SEQ ID NO: 1957238 - RNA, 21 nt, Homo sapiens
gauccacauuguuaggugcug

SEQ ID NO: 1957239 - RNA, 11 nt, Homo sapiens
uugcaccagau

SEQ ID NO: 1957240 - RNA, 16 nt, Homo sapiens
guuuuauauguugcua

SEQ ID NO: 1957241 - RNA, 13 nt, Homo sapiens
cccuccucaguga

SEQ ID NO: 1957242 - RNA, 22 nt, Homo sapiens
ccagacacuggcguuacugcuu

SEQ ID NO: 1957243 - RNA, 16 nt, Homo sapiens
cgauuucuuuccucca

SEQ ID NO: 1957244 - RNA, 22 nt, Homo sapiens
gugccccaccacuccccaaccc

SEQ ID NO: 1957245 - RNA, 18 nt, Homo sapiens
ggaggacuccgggaccau

SEQ ID NO: 1957246 - RNA, 11 nt, Homo sapiens
gagacuuccuu

SEQ ID NO: 1957247 - RNA, 22 nt, Homo sapiens
ugucuuguucauuuugaguauu

SEQ ID NO: 1957248 - RNA, 15 nt, Homo sapiens
cuccuggccuggcca

SEQ ID NO: 1957249 - RNA, 13 nt, Homo sapiens
auauauacauucu

SEQ ID NO: 1957250 - RNA, 17 nt, Homo sapiens
auaagaggugaucucug

SEQ ID NO: 1957251 - RNA, 15 nt, Homo sapiens
cccuuccuggcacau

SEQ ID NO: 1957252 - RNA, 23 nt, Homo sapiens
gagauaaacugaaauuugcuaua

SEQ ID NO: 1957253 - RNA, 23 nt, Homo sapiens
uccaggcaaaauugauauacuuu

SEQ ID NO: 1957254 - RNA, 23 nt, Homo sapiens
agaagcguuaugugcaguacuua

SEQ ID NO: 1957255 - RNA, 21 nt, Homo sapiens
gcuccaccuuccaaaggaccu

SEQ ID NO: 1957256 - RNA, 13 nt, Homo sapiens
uggaucagcauuu

SEQ ID NO: 1957257 - RNA, 23 nt, Homo sapiens
cacauuugugcauaaauuuccac

SEQ ID NO: 1957258 - RNA, 13 nt, Homo sapiens
aaaccuuuguuaa

SEQ ID NO: 1957259 - RNA, 21 nt, Homo sapiens
gaauaaacacugguuguaguc

SEQ ID NO: 1957260 - RNA, 11 nt, Homo sapiens
aaaauuugcac

SEQ ID NO: 1957261 - RNA, 13 nt, Homo sapiens
gaacuggagccau

SEQ ID NO: 1957262 - RNA, 22 nt, Homo sapiens
gcacacacagauauacacaugg

SEQ ID NO: 1957263 - RNA, 20 nt, Homo sapiens
ucaauaucuuaauacccuaa

SEQ ID NO: 1957264 - RNA, 13 nt, Homo sapiens
uacagauugucau

SEQ ID NO: 1957265 - RNA, 20 nt, Homo sapiens
ugcccacuaccuaugcuucu

SEQ ID NO: 1957266 - RNA, 23 nt, Homo sapiens
ucucaauaaacuuuuaccacaaa

SEQ ID NO: 1957267 - RNA, 19 nt, Homo sapiens
auugucacagcuaccaaag

SEQ ID NO: 1957268 - RNA, 19 nt, Homo sapiens
uaaauacaguggaucucaa

SEQ ID NO: 1957269 - RNA, 15 nt, Homo sapiens
aaacagaccccuguu

SEQ ID NO: 1957270 - RNA, 19 nt, Homo sapiens
caugucugacuucaaggaa

SEQ ID NO: 1957271 - RNA, 12 nt, Homo sapiens
guaaacagauuu

SEQ ID NO: 1957272 - RNA, 14 nt, Homo sapiens
aagauuguugauag

SEQ ID NO: 1957273 - RNA, 15 nt, Homo sapiens
ccaagaauauugcaa

SEQ ID NO: 1957274 - RNA, 15 nt, Homo sapiens
cuagcauuacuagau

SEQ ID NO: 1957275 - RNA, 15 nt, Homo sapiens
caacaaguuguuuca

SEQ ID NO: 1957276 - RNA, 21 nt, Homo sapiens
acuuagaaaccaaauuacaag

SEQ ID NO: 1957277 - RNA, 16 nt, Homo sapiens
aggccugcccugcuau

SEQ ID NO: 1957278 - RNA, 16 nt, Homo sapiens
ccagaugaacauuuca

SEQ ID NO: 1957279 - RNA, 12 nt, Homo sapiens
gggccagugaug

SEQ ID NO: 1957280 - RNA, 22 nt, Homo sapiens
guacacuuuuaugagcuuccaa

SEQ ID NO: 1957281 - RNA, 15 nt, Homo sapiens
aaaggugcuauuuaa

SEQ ID NO: 1957282 - RNA, 15 nt, Homo sapiens
cuccccggcacuucc

SEQ ID NO: 1957283 - RNA, 22 nt, Homo sapiens
agagggagacuuguucuagaga

SEQ ID NO: 1957284 - RNA, 18 nt, Homo sapiens
ugugauugcacagaauuu

SEQ ID NO: 1957285 - RNA, 16 nt, Homo sapiens
aaacuaguaagaaaca

SEQ ID NO: 1957286 - RNA, 15 nt, Homo sapiens
ugaugcacauuucau

SEQ ID NO: 1957287 - RNA, 17 nt, Homo sapiens
gauuuaacacuauccaa

SEQ ID NO: 1957288 - RNA, 21 nt, Homo sapiens
acgcugcugucacaaccaaga

SEQ ID NO: 1957289 - RNA, 21 nt, Homo sapiens
gggagucugaagcagaugcaa

SEQ ID NO: 1957290 - RNA, 16 nt, Homo sapiens
acuguucuugcugcua

SEQ ID NO: 1957291 - RNA, 18 nt, Homo sapiens
ugagaagugcaacugcua

SEQ ID NO: 1957292 - RNA, 18 nt, Homo sapiens
aaagcuucuaucccagga

SEQ ID NO: 1957293 - RNA, 18 nt, Homo sapiens
ccagagccucagugagcc

SEQ ID NO: 1957294 - RNA, 19 nt, Homo sapiens
uacuaacaguaacugccau

SEQ ID NO: 1957295 - RNA, 17 nt, Homo sapiens
aggagucggagaagcug

SEQ ID NO: 1957296 - RNA, 18 nt, Homo sapiens
uuucauugaugagcaaga

SEQ ID NO: 1957297 - RNA, 20 nt, Homo sapiens
uucuacucgaguuacagaca

SEQ ID NO: 1957298 - RNA, 18 nt, Homo sapiens
ugggaaaaucacuugaac

SEQ ID NO: 1957299 - RNA, 12 nt, Homo sapiens
uuuacacugacu

SEQ ID NO: 1957300 - RNA, 15 nt, Homo sapiens
ccagaaaauaugaua

SEQ ID NO: 1957301 - RNA, 15 nt, Homo sapiens
ugcacauccauuccc

SEQ ID NO: 1957302 - RNA, 21 nt, Homo sapiens
gucuuaaggacaaagugccaa

SEQ ID NO: 1957303 - RNA, 18 nt, Homo sapiens
cgagaccugugugccagg

SEQ ID NO: 1957304 - RNA, 20 nt, Homo sapiens
uaggagggugugaguggcau

SEQ ID NO: 1957305 - RNA, 23 nt, Homo sapiens
acaugccuguccugaaagcggcu

SEQ ID NO: 1957306 - RNA, 19 nt, Homo sapiens
acuccugggcucaagcaau

SEQ ID NO: 1957307 - RNA, 13 nt, Homo sapiens
uaaucaacugggc

SEQ ID NO: 1957308 - RNA, 21 nt, Homo sapiens
gcuggggaaauggugaaggaa

SEQ ID NO: 1957309 - RNA, 17 nt, Homo sapiens
ugccaguucaagaauuu

SEQ ID NO: 1957310 - RNA, 14 nt, Homo sapiens
caaaagcuuacaaa

SEQ ID NO: 1957311 - RNA, 24 nt, Homo sapiens
gugaggaccuuugcacuuugccau

SEQ ID NO: 1957312 - RNA, 15 nt, Homo sapiens
uaacucugcccaccc

SEQ ID NO: 1957313 - RNA, 19 nt, Homo sapiens
auccuggagggcuacagca

SEQ ID NO: 1957314 - RNA, 15 nt, Homo sapiens
aguacuuugugcauu

SEQ ID NO: 1957315 - RNA, 22 nt, Homo sapiens
ugagaauacauaaacaacgcau

SEQ ID NO: 1957316 - RNA, 22 nt, Homo sapiens
aacuaugugauguuaacuauua

SEQ ID NO: 1957317 - RNA, 20 nt, Homo sapiens
ccgaggacaguggcagacag

SEQ ID NO: 1957318 - RNA, 18 nt, Homo sapiens
gacucccccaaccaagga

SEQ ID NO: 1957319 - RNA, 17 nt, Homo sapiens
gaaagagaacuacuaag

SEQ ID NO: 1957320 - RNA, 22 nt, Homo sapiens
auuuuccuaaaaauaagcuuua

SEQ ID NO: 1957321 - RNA, 17 nt, Homo sapiens
ccugaaauauccaggaa

SEQ ID NO: 1957322 - RNA, 14 nt, Homo sapiens
cuucaaauguggua

SEQ ID NO: 1957323 - RNA, 18 nt, Homo sapiens
uaccacacuagaauucau

SEQ ID NO: 1957324 - RNA, 19 nt, Homo sapiens
ugaaaaauggcaaagaauu

SEQ ID NO: 1957325 - RNA, 14 nt, Homo sapiens
gacaccuccgagag

SEQ ID NO: 1957326 - RNA, 19 nt, Homo sapiens
aguauuaaaauguaugcau

SEQ ID NO: 1957327 - RNA, 16 nt, Homo sapiens
uggcaaaucacuucaa

SEQ ID NO: 1957328 - RNA, 14 nt, Homo sapiens
aagucgccagucac

SEQ ID NO: 1957329 - RNA, 18 nt, Homo sapiens
aagcuggaagacugugca

SEQ ID NO: 1957330 - RNA, 12 nt, Homo sapiens
uauaugcugcau

SEQ ID NO: 1957331 - RNA, 16 nt, Homo sapiens
acagcccgcaggauca

SEQ ID NO: 1957332 - RNA, 18 nt, Homo sapiens
aggcccuuuccucaggca

SEQ ID NO: 1957333 - RNA, 18 nt, Homo sapiens
aggcugggccauguccaa

SEQ ID NO: 1957334 - RNA, 23 nt, Homo sapiens
gccaaauaaagucucuuccucca

SEQ ID NO: 1957335 - RNA, 20 nt, Homo sapiens
uagagcuggaggcuguggga

SEQ ID NO: 1957336 - RNA, 15 nt, Homo sapiens
gaacaggucuugggg

SEQ ID NO: 1957337 - RNA, 19 nt, Homo sapiens
gauaagaaaugaucuuuac

SEQ ID NO: 1957338 - RNA, 13 nt, Homo sapiens
gaugcagacacag

SEQ ID NO: 1957339 - RNA, 15 nt, Homo sapiens
uagaauuuaacauga

SEQ ID NO: 1957340 - RNA, 23 nt, Homo sapiens
guagaagauugagauguguucac

SEQ ID NO: 1957341 - RNA, 23 nt, Homo sapiens
agcucauuugugacaacauuuca

SEQ ID NO: 1957342 - RNA, 15 nt, Homo sapiens
uagccggguguggca

SEQ ID NO: 1957343 - RNA, 23 nt, Homo sapiens
agcaagcaggaucgcugcucaga

SEQ ID NO: 1957344 - RNA, 15 nt, Homo sapiens
caugaacacacugug

SEQ ID NO: 1957345 - RNA, 14 nt, Homo sapiens
acccccucauuugu

SEQ ID NO: 1957346 - RNA, 23 nt, Homo sapiens
ugggagagguucugugcaaaacu

SEQ ID NO: 1957347 - RNA, 12 nt, Homo sapiens
cgagacuccauc

SEQ ID NO: 1957348 - RNA, 11 nt, Homo sapiens
gaagugaaaac

SEQ ID NO: 1957349 - RNA, 17 nt, Homo sapiens
cuggaagaccugaaaga

SEQ ID NO: 1957350 - RNA, 18 nt, Homo sapiens
aauaaauccaagacuguc

SEQ ID NO: 1957351 - RNA, 18 nt, Homo sapiens
acagacacuuuaaaagcu

SEQ ID NO: 1957352 - RNA, 13 nt, Homo sapiens
cucccuaccuugc

SEQ ID NO: 1957353 - RNA, 15 nt, Homo sapiens
cccaaccuacauucc

SEQ ID NO: 1957354 - RNA, 18 nt, Homo sapiens
caguaacacagugcagua

SEQ ID NO: 1957355 - RNA, 15 nt, Homo sapiens
guggcugggugguca

SEQ ID NO: 1957356 - RNA, 17 nt, Homo sapiens
cuccugacuccagugag

SEQ ID NO: 1957357 - RNA, 17 nt, Homo sapiens
agauugugcccagcccu

SEQ ID NO: 1957358 - RNA, 15 nt, Homo sapiens
aguucacauacaaau

SEQ ID NO: 1957359 - RNA, 23 nt, Homo sapiens
ugucucaauucuuuguauaugca

SEQ ID NO: 1957360 - RNA, 17 nt, Homo sapiens
acgugccugcuuaccug

SEQ ID NO: 1957361 - RNA, 13 nt, Homo sapiens
auacgucagauug

SEQ ID NO: 1957362 - RNA, 23 nt, Homo sapiens
ugacauuagauugaugugcacug

SEQ ID NO: 1957363 - RNA, 22 nt, Homo sapiens
aagugauucugucccuccaaag

SEQ ID NO: 1957364 - RNA, 12 nt, Homo sapiens
gcagcacuguga

SEQ ID NO: 1957365 - RNA, 19 nt, Homo sapiens
ucuuguucugagauucaau

SEQ ID NO: 1957366 - RNA, 17 nt, Homo sapiens
aguguuaauacugagaa

SEQ ID NO: 1957367 - RNA, 15 nt, Homo sapiens
uuucccauuuaucua

SEQ ID NO: 1957368 - RNA, 23 nt, Homo sapiens
gcuauuuuuaauuuccugugagg

SEQ ID NO: 1957369 - RNA, 19 nt, Homo sapiens
cagguagcugggauuacag

SEQ ID NO: 1957370 - RNA, 19 nt, Homo sapiens
caaguagcugagauuacag

SEQ ID NO: 1957371 - RNA, 20 nt, Homo sapiens
gcuccccacaccuuccaggg

SEQ ID NO: 1957372 - RNA, 19 nt, Homo sapiens
agaccauuuguauuaccau

SEQ ID NO: 1957373 - RNA, 17 nt, Homo sapiens
ggacauuccucuaggac

SEQ ID NO: 1957374 - RNA, 16 nt, Homo sapiens
acccggcgcugagugg

SEQ ID NO: 1957375 - RNA, 17 nt, Homo sapiens
cuucacccuguaauggu

SEQ ID NO: 1957376 - RNA, 14 nt, Homo sapiens
uguguuaucucuua

SEQ ID NO: 1957377 - RNA, 17 nt, Homo sapiens
cauaauauaaaacagga

SEQ ID NO: 1957378 - RNA, 16 nt, Homo sapiens
cacucugaggucucac

SEQ ID NO: 1957379 - RNA, 17 nt, Homo sapiens
auccaugaacagcauua

SEQ ID NO: 1957380 - RNA, 20 nt, Homo sapiens
gaaaaaucaccacaccaaac

SEQ ID NO: 1957381 - RNA, 23 nt, Homo sapiens
ccauguacucaaguaccaccaag

SEQ ID NO: 1957382 - RNA, 14 nt, Homo sapiens
uaagacaaacugca

SEQ ID NO: 1957383 - RNA, 18 nt, Homo sapiens
gaagggccccacucaggg

SEQ ID NO: 1957384 - RNA, 10 nt, Homo sapiens
ccagacagac

SEQ ID NO: 1957385 - RNA, 21 nt, Homo sapiens
ccaagagcagcugccauugca

SEQ ID NO: 1957386 - RNA, 20 nt, Homo sapiens
uacacaauuaauucaucccu

SEQ ID NO: 1957387 - RNA, 15 nt, Homo sapiens
gacuggaggugggca

SEQ ID NO: 1957388 - RNA, 18 nt, Homo sapiens
auaucuggccacacuggg

SEQ ID NO: 1957389 - RNA, 23 nt, Homo sapiens
cuacugcaagagccaaguuccaa

SEQ ID NO: 1957390 - RNA, 22 nt, Homo sapiens
agugaagaccagagcaguuuca

SEQ ID NO: 1957391 - RNA, 23 nt, Homo sapiens
cucucuauaaguguucaguguug

SEQ ID NO: 1957392 - RNA, 21 nt, Homo sapiens
caaauaagaggacagauaacu

SEQ ID NO: 1957393 - RNA, 20 nt, Homo sapiens
uuuggccaaaaccuuucaaa

SEQ ID NO: 1957394 - RNA, 20 nt, Homo sapiens
cuggauuacaggcaugugcc

SEQ ID NO: 1957395 - RNA, 13 nt, Homo sapiens
uauaaacuaccaa

SEQ ID NO: 1957396 - RNA, 14 nt, Homo sapiens
aauaauaauaguua

SEQ ID NO: 1957397 - RNA, 17 nt, Homo sapiens
ggaagugaggaagccag

SEQ ID NO: 1957398 - RNA, 20 nt, Homo sapiens
ucucuaacauaugauacuga

SEQ ID NO: 1957399 - RNA, 20 nt, Homo sapiens
augcuucuaaauaugaagga

SEQ ID NO: 1957400 - RNA, 12 nt, Homo sapiens
augggcauuugg

SEQ ID NO: 1957401 - RNA, 23 nt, Homo sapiens
agacaugucuagccacugaucau

SEQ ID NO: 1957402 - RNA, 17 nt, Homo sapiens
uaagaggcuuucuccag

SEQ ID NO: 1957403 - RNA, 18 nt, Homo sapiens
acaaauguuuagugaaac

SEQ ID NO: 1957404 - RNA, 13 nt, Homo sapiens
ugcuaucucucaa

SEQ ID NO: 1957405 - RNA, 15 nt, Homo sapiens
cuuuugcuuaccuuu

SEQ ID NO: 1957406 - RNA, 22 nt, Homo sapiens
uggaugcugucuucgaggacag

SEQ ID NO: 1957407 - RNA, 17 nt, Homo sapiens
uaaaaauagucuuccac

SEQ ID NO: 1957408 - RNA, 18 nt, Homo sapiens
ugccgcaggugggugcug

SEQ ID NO: 1957409 - RNA, 15 nt, Homo sapiens
caugggaaugcauuu

SEQ ID NO: 1957410 - RNA, 19 nt, Homo sapiens
cucuaauugcugccaggau

SEQ ID NO: 1957411 - RNA, 14 nt, Homo sapiens
uacagggggucccc

SEQ ID NO: 1957412 - RNA, 19 nt, Homo sapiens
uggauaaauuguaugaaga

SEQ ID NO: 1957413 - RNA, 21 nt, Homo sapiens
cuuuugcauaagugcaugaca

SEQ ID NO: 1957414 - RNA, 14 nt, Homo sapiens
auaugcaucuggcc

SEQ ID NO: 1957415 - RNA, 14 nt, Homo sapiens
uuauuccacaucua

SEQ ID NO: 1957416 - RNA, 20 nt, Homo sapiens
agccucagcgcggcccuccc

SEQ ID NO: 1957417 - RNA, 16 nt, Homo sapiens
caagucucucuaagac

SEQ ID NO: 1957418 - RNA, 21 nt, Homo sapiens
uggacuuccagugcucagagg

SEQ ID NO: 1957419 - RNA, 22 nt, Homo sapiens
gaucuucauguaccugcucuuc

SEQ ID NO: 1957420 - RNA, 14 nt, Homo sapiens
aggucaaaacugaa

SEQ ID NO: 1957421 - RNA, 17 nt, Homo sapiens
uccuaacguuugucauu

SEQ ID NO: 1957422 - RNA, 11 nt, Homo sapiens
ucgacugcuuu

SEQ ID NO: 1957423 - RNA, 20 nt, Homo sapiens
gcaauggcgcgaucucagcu

SEQ ID NO: 1957424 - RNA, 22 nt, Homo sapiens
ugggaaaaauucagagaguuag

SEQ ID NO: 1957425 - RNA, 15 nt, Homo sapiens
ccuaaagacuguaua

SEQ ID NO: 1957426 - RNA, 15 nt, Homo sapiens
agcagaugguuucca

SEQ ID NO: 1957427 - RNA, 17 nt, Homo sapiens
ucaagcaauccuccuga

SEQ ID NO: 1957428 - RNA, 17 nt, Homo sapiens
ucaccuguuacuugaaa

SEQ ID NO: 1957429 - RNA, 19 nt, Homo sapiens
cauuugacccuugcuguga

SEQ ID NO: 1957430 - RNA, 17 nt, Homo sapiens
aauucuaguguaaauca

SEQ ID NO: 1957431 - RNA, 12 nt, Homo sapiens
acuugccuccac

SEQ ID NO: 1957432 - RNA, 23 nt, Homo sapiens
acaagcccacagcacagcucccu

SEQ ID NO: 1957433 - RNA, 14 nt, Homo sapiens
ugccccauugcuca

SEQ ID NO: 1957434 - RNA, 19 nt, Homo sapiens
accuguuacugaaaguggu

SEQ ID NO: 1957435 - RNA, 17 nt, Homo sapiens
cacugggaggagucuau

SEQ ID NO: 1957436 - RNA, 22 nt, Homo sapiens
ggcgcuguggcuccugccuuga

SEQ ID NO: 1957437 - RNA, 22 nt, Homo sapiens
gcuagaaaaggccuucuuccca

SEQ ID NO: 1957438 - RNA, 14 nt, Homo sapiens
guggccuguggcug

SEQ ID NO: 1957439 - RNA, 12 nt, Homo sapiens
gaaccauuucac

SEQ ID NO: 1957440 - RNA, 17 nt, Homo sapiens
agcccuauuucaguuua

SEQ ID NO: 1957441 - RNA, 18 nt, Homo sapiens
agcacagccucagaauaa

SEQ ID NO: 1957442 - RNA, 21 nt, Homo sapiens
acauuugugcauaaauuucca

SEQ ID NO: 1957443 - RNA, 14 nt, Homo sapiens
acuaccccugauga

SEQ ID NO: 1957444 - RNA, 13 nt, Homo sapiens
uccagccccugga

SEQ ID NO: 1957445 - RNA, 12 nt, Homo sapiens
gugugucacaag

SEQ ID NO: 1957446 - RNA, 17 nt, Homo sapiens
uggagaacucauuucaa

SEQ ID NO: 1957447 - RNA, 15 nt, Homo sapiens
uuguauuaugcugga

SEQ ID NO: 1957448 - RNA, 20 nt, Homo sapiens
uacacagugcuuuccagccu

SEQ ID NO: 1957449 - RNA, 22 nt, Homo sapiens
ucuuuccccaccucuuccuucc

SEQ ID NO: 1957450 - RNA, 16 nt, Homo sapiens
uauaauuggugcauag

SEQ ID NO: 1957451 - RNA, 16 nt, Homo sapiens
uuggagccacuccugu

SEQ ID NO: 1957452 - RNA, 17 nt, Homo sapiens
cuuugcauugaauuugg

SEQ ID NO: 1957453 - RNA, 20 nt, Homo sapiens
acuaagccaagcuguguuca

SEQ ID NO: 1957454 - RNA, 18 nt, Homo sapiens
caaagccaccaacagcca

SEQ ID NO: 1957455 - RNA, 16 nt, Homo sapiens
ggugcuaaaccauuca

SEQ ID NO: 1957456 - RNA, 20 nt, Homo sapiens
caguagaggcaugaacacac

SEQ ID NO: 1957457 - RNA, 21 nt, Homo sapiens
aauaaaaauacgguggcaaua

SEQ ID NO: 1957458 - RNA, 13 nt, Homo sapiens
uuaaggacacugg

SEQ ID NO: 1957459 - RNA, 13 nt, Homo sapiens
ggaucuuuggaca

SEQ ID NO: 1957460 - RNA, 13 nt, Homo sapiens
gccucuuugccca

SEQ ID NO: 1957461 - RNA, 12 nt, Homo sapiens
aguauugcuaau

SEQ ID NO: 1957462 - RNA, 12 nt, Homo sapiens
ugauuugcaaua

SEQ ID NO: 1957463 - RNA, 23 nt, Homo sapiens
cuccauuccuggagcccgaggca

SEQ ID NO: 1957464 - RNA, 14 nt, Homo sapiens
uuaugucucaaaau

SEQ ID NO: 1957465 - RNA, 15 nt, Homo sapiens
aaucacaucucaccu

SEQ ID NO: 1957466 - RNA, 17 nt, Homo sapiens
ccagaucccuuauccaa

SEQ ID NO: 1957467 - RNA, 20 nt, Homo sapiens
aauucuaugauuaaacuggg

SEQ ID NO: 1957468 - RNA, 14 nt, Homo sapiens
cauauguagcuaac

SEQ ID NO: 1957469 - RNA, 15 nt, Homo sapiens
gaaaauggcuuucuc

SEQ ID NO: 1957470 - RNA, 13 nt, Homo sapiens
uguuggggaccuu

SEQ ID NO: 1957471 - RNA, 13 nt, Homo sapiens
aacguacuaugga

SEQ ID NO: 1957472 - RNA, 15 nt, Homo sapiens
ccauguggccauuaa

SEQ ID NO: 1957473 - RNA, 15 nt, Homo sapiens
cccuuuggcccugaa

SEQ ID NO: 1957474 - RNA, 18 nt, Homo sapiens
aguagauauugauuacua

SEQ ID NO: 1957475 - RNA, 19 nt, Homo sapiens
caggacuuagaauagugcc

SEQ ID NO: 1957476 - RNA, 15 nt, Homo sapiens
aggccaagaguggcc

SEQ ID NO: 1957477 - RNA, 13 nt, Homo sapiens
auccucacugcug

SEQ ID NO: 1957478 - RNA, 15 nt, Homo sapiens
aagccacucuguccc

SEQ ID NO: 1957479 - RNA, 19 nt, Homo sapiens
acuuaaggauggagccagc

SEQ ID NO: 1957480 - RNA, 20 nt, Homo sapiens
aucauauuccaacccagcca

SEQ ID NO: 1957481 - RNA, 22 nt, Homo sapiens
ccacagcacuacgauguguuga

SEQ ID NO: 1957482 - RNA, 15 nt, Homo sapiens
uagaugacaguggca

SEQ ID NO: 1957483 - RNA, 14 nt, Homo sapiens
acuuaggaaggauc

SEQ ID NO: 1957484 - RNA, 23 nt, Homo sapiens
gauuccauuuggugaccaucugu

SEQ ID NO: 1957485 - RNA, 16 nt, Homo sapiens
ccaaguaugccuuaag

SEQ ID NO: 1957486 - RNA, 16 nt, Homo sapiens
cccggggccagcacuu

SEQ ID NO: 1957487 - RNA, 19 nt, Homo sapiens
aauucacuucucuuccucc

SEQ ID NO: 1957488 - RNA, 22 nt, Homo sapiens
ugugaaucucuucucccuuuga

SEQ ID NO: 1957489 - RNA, 16 nt, Homo sapiens
augcucuuuacuucau

SEQ ID NO: 1957490 - RNA, 16 nt, Homo sapiens
cuccugggcuacaagg

SEQ ID NO: 1957491 - RNA, 18 nt, Homo sapiens
cacggaucaauagacugu

SEQ ID NO: 1957492 - RNA, 14 nt, Homo sapiens
aggcagcaaacaga

SEQ ID NO: 1957493 - RNA, 14 nt, Homo sapiens
caguucugacacac

SEQ ID NO: 1957494 - RNA, 14 nt, Homo sapiens
gagugcacccggag

SEQ ID NO: 1957495 - RNA, 12 nt, Homo sapiens
gcuauagccuuu

SEQ ID NO: 1957496 - RNA, 21 nt, Homo sapiens
cauugugaauugccugccaug

SEQ ID NO: 1957497 - RNA, 15 nt, Homo sapiens
agugagaaaccagcc

SEQ ID NO: 1957498 - RNA, 17 nt, Homo sapiens
augcugaagacauucaa

SEQ ID NO: 1957499 - RNA, 16 nt, Homo sapiens
auauacaauaauguaa

SEQ ID NO: 1957500 - RNA, 14 nt, Homo sapiens
agcgaaugcacuca

SEQ ID NO: 1957501 - RNA, 19 nt, Homo sapiens
aguaaacgauaaaaugugg

SEQ ID NO: 1957502 - RNA, 14 nt, Homo sapiens
ugcaaguuacugca

SEQ ID NO: 1957503 - RNA, 19 nt, Homo sapiens
aggaaucguuuuugcugca

SEQ ID NO: 1957504 - RNA, 19 nt, Homo sapiens
gaaguuuauucucauuugg

SEQ ID NO: 1957505 - RNA, 12 nt, Homo sapiens
agaacuauccaa

SEQ ID NO: 1957506 - RNA, 23 nt, Homo sapiens
agaaaagaaauuggacagaacag

SEQ ID NO: 1957507 - RNA, 14 nt, Homo sapiens
ugagaggcucugug

SEQ ID NO: 1957508 - RNA, 14 nt, Homo sapiens
ugccuguaauccca

SEQ ID NO: 1957509 - RNA, 22 nt, Homo sapiens
aagacauggggaggaaggacaa

SEQ ID NO: 1957510 - RNA, 11 nt, Homo sapiens
cugaccaaggg

SEQ ID NO: 1957511 - RNA, 20 nt, Homo sapiens
agaccaccuucccuuccuca

SEQ ID NO: 1957512 - RNA, 17 nt, Homo sapiens
ucacacgauaaagggau

SEQ ID NO: 1957513 - RNA, 17 nt, Homo sapiens
acuauuuccacauggaa

SEQ ID NO: 1957514 - RNA, 23 nt, Homo sapiens
auugagguccauauuuaguggua

SEQ ID NO: 1957515 - RNA, 20 nt, Homo sapiens
agaaaucauggcauucacac

SEQ ID NO: 1957516 - RNA, 18 nt, Homo sapiens
cuugacaucaaggcucuu

SEQ ID NO: 1957517 - RNA, 17 nt, Homo sapiens
auccuagucucuaucau

SEQ ID NO: 1957518 - RNA, 20 nt, Homo sapiens
ugggaagguuguucuuggcu

SEQ ID NO: 1957519 - RNA, 15 nt, Homo sapiens
uacagagcuaauugu

SEQ ID NO: 1957520 - RNA, 14 nt, Homo sapiens
agacuggagugcag

SEQ ID NO: 1957521 - RNA, 14 nt, Homo sapiens
gugauagaagaaaa

SEQ ID NO: 1957522 - RNA, 13 nt, Homo sapiens
agagcaagcuuuu

SEQ ID NO: 1957523 - RNA, 19 nt, Homo sapiens
auuagauugcaaagcaaug

SEQ ID NO: 1957524 - RNA, 11 nt, Homo sapiens
uugugccaggu

SEQ ID NO: 1957525 - RNA, 11 nt, Homo sapiens
ccauagauggu

SEQ ID NO: 1957526 - RNA, 15 nt, Homo sapiens
cuuaagaauacacag

SEQ ID NO: 1957527 - RNA, 21 nt, Homo sapiens
guacaucaaguccaucugaca

SEQ ID NO: 1957528 - RNA, 14 nt, Homo sapiens
uugugucacaaaga

SEQ ID NO: 1957529 - RNA, 22 nt, Homo sapiens
acaggcuggucucaaacuccua

SEQ ID NO: 1957530 - RNA, 21 nt, Homo sapiens
ccacacucuuucuccugcuuu

SEQ ID NO: 1957531 - RNA, 18 nt, Homo sapiens
ucagaugcucauugcuuu

SEQ ID NO: 1957532 - RNA, 19 nt, Homo sapiens
aggacaagacccucucagg

SEQ ID NO: 1957533 - RNA, 15 nt, Homo sapiens
gugcccuuggugcga

SEQ ID NO: 1957534 - RNA, 22 nt, Homo sapiens
uaagaaucuuuagagaaguaua

SEQ ID NO: 1957535 - RNA, 14 nt, Homo sapiens
uccucacauucaca

SEQ ID NO: 1957536 - RNA, 22 nt, Homo sapiens
caggcugccucggacuccaugg

SEQ ID NO: 1957537 - RNA, 15 nt, Homo sapiens
aaucucccacuccag

SEQ ID NO: 1957538 - RNA, 12 nt, Homo sapiens
uccacacugaga

SEQ ID NO: 1957539 - RNA, 16 nt, Homo sapiens
uacagaacucacagua

SEQ ID NO: 1957540 - RNA, 15 nt, Homo sapiens
ugagagaagggacac

SEQ ID NO: 1957541 - RNA, 12 nt, Homo sapiens
aaggagaaggca

SEQ ID NO: 1957542 - RNA, 16 nt, Homo sapiens
uaauagacacaucaaa

SEQ ID NO: 1957543 - RNA, 14 nt, Homo sapiens
uucccuccugcuuu

SEQ ID NO: 1957544 - RNA, 17 nt, Homo sapiens
ccuugggcagggucucu

SEQ ID NO: 1957545 - RNA, 20 nt, Homo sapiens
guaauauauuuaaagggaaa

SEQ ID NO: 1957546 - RNA, 20 nt, Homo sapiens
ggaaacugaaacucacagua

SEQ ID NO: 1957547 - RNA, 14 nt, Homo sapiens
cucgccgucuguga

SEQ ID NO: 1957548 - RNA, 13 nt, Homo sapiens
cuuugacauauug

SEQ ID NO: 1957549 - RNA, 20 nt, Homo sapiens
uaaaagaaaaaaaccaaagu

SEQ ID NO: 1957550 - RNA, 17 nt, Homo sapiens
cauguuacugaccagca

SEQ ID NO: 1957551 - RNA, 13 nt, Homo sapiens
gggaagcucccag

SEQ ID NO: 1957552 - RNA, 23 nt, Homo sapiens
gaccaauugcccugccaggcugu

SEQ ID NO: 1957553 - RNA, 23 nt, Homo sapiens
ugacccaagagguggggaccaaa

SEQ ID NO: 1957554 - RNA, 14 nt, Homo sapiens
uuauugugccucag

SEQ ID NO: 1957555 - RNA, 20 nt, Homo sapiens
ccaccccuaaccuggcuuau

SEQ ID NO: 1957556 - RNA, 20 nt, Homo sapiens
uaaggcaucauuuucaccuc

SEQ ID NO: 1957557 - RNA, 21 nt, Homo sapiens
acacacuucggcucucuggac

SEQ ID NO: 1957558 - RNA, 22 nt, Homo sapiens
ucagaaucauugaaguauuuuc

SEQ ID NO: 1957559 - RNA, 12 nt, Homo sapiens
uguaugagacag

SEQ ID NO: 1957560 - RNA, 18 nt, Homo sapiens
aauuuuuaagcugcaaau

SEQ ID NO: 1957561 - RNA, 21 nt, Homo sapiens
aucacaguguuugcaauggug

SEQ ID NO: 1957562 - RNA, 19 nt, Homo sapiens
agauuuaugcuccuuauga

SEQ ID NO: 1957563 - RNA, 18 nt, Homo sapiens
guuuuacuuuugucuucc

SEQ ID NO: 1957564 - RNA, 18 nt, Homo sapiens
ucgccuguuggggaccuc

SEQ ID NO: 1957565 - RNA, 23 nt, Homo sapiens
aaauggacguguuaugacuccag

SEQ ID NO: 1957566 - RNA, 14 nt, Homo sapiens
gcaucucuguguac

SEQ ID NO: 1957567 - RNA, 20 nt, Homo sapiens
gcaaucucauuacuggguau

SEQ ID NO: 1957568 - RNA, 21 nt, Homo sapiens
aucgcaccauugcacuccagc

SEQ ID NO: 1957569 - RNA, 14 nt, Homo sapiens
auggucaaguauua

SEQ ID NO: 1957570 - RNA, 13 nt, Homo sapiens
aggcugagugcau

SEQ ID NO: 1957571 - RNA, 23 nt, Homo sapiens
uucaagcgauuuuccugcuucau

SEQ ID NO: 1957572 - RNA, 18 nt, Homo sapiens
acaggaagucccuugcca

SEQ ID NO: 1957573 - RNA, 11 nt, Homo sapiens
aguaccugcug

SEQ ID NO: 1957574 - RNA, 14 nt, Homo sapiens
gcaucugacucaca

SEQ ID NO: 1957575 - RNA, 21 nt, Homo sapiens
agauggcugcugcucacccuc

SEQ ID NO: 1957576 - RNA, 17 nt, Homo sapiens
aaugucuucuguauuca

SEQ ID NO: 1957577 - RNA, 15 nt, Homo sapiens
cauacuuaucucucu

SEQ ID NO: 1957578 - RNA, 22 nt, Homo sapiens
cccaugaggcacgaaugaucuu

SEQ ID NO: 1957579 - RNA, 22 nt, Homo sapiens
ccaucacgcggccgagacaugg

SEQ ID NO: 1957580 - RNA, 13 nt, Homo sapiens
auuucaugugaau

SEQ ID NO: 1957581 - RNA, 18 nt, Homo sapiens
ugaugccaaagcugcuuu

SEQ ID NO: 1957582 - RNA, 20 nt, Homo sapiens
gccacguuacuccccuggcu

SEQ ID NO: 1957583 - RNA, 22 nt, Homo sapiens
aguucugcuucugaaacuggag

SEQ ID NO: 1957584 - RNA, 20 nt, Homo sapiens
cccaagagugguuaugccuc

SEQ ID NO: 1957585 - RNA, 15 nt, Homo sapiens
ccuaggaacucaguc

SEQ ID NO: 1957586 - RNA, 22 nt, Homo sapiens
gaaauauuaguuacuugcuaua

SEQ ID NO: 1957587 - RNA, 18 nt, Homo sapiens
augccuguaacccuggca

SEQ ID NO: 1957588 - RNA, 19 nt, Homo sapiens
aucuuuguuuaaaugccaa

SEQ ID NO: 1957589 - RNA, 13 nt, Homo sapiens
aguaggugaucuu

SEQ ID NO: 1957590 - RNA, 22 nt, Homo sapiens
cugagaagaaugaaaaugcagu

SEQ ID NO: 1957591 - RNA, 19 nt, Homo sapiens
gacuuccucugguguuuau

SEQ ID NO: 1957592 - RNA, 23 nt, Homo sapiens
aagcacaaucacuaaacuuuauu

SEQ ID NO: 1957593 - RNA, 21 nt, Homo sapiens
ggaggccagccagugaccuga

SEQ ID NO: 1957594 - RNA, 23 nt, Homo sapiens
caccaugcugaauguacacugau

SEQ ID NO: 1957595 - RNA, 19 nt, Homo sapiens
ccugucagugaggacucuu

SEQ ID NO: 1957596 - RNA, 18 nt, Homo sapiens
uauuucauuucuugucaa

SEQ ID NO: 1957597 - RNA, 23 nt, Homo sapiens
ccauccuugugaaccccaaagug

SEQ ID NO: 1957598 - RNA, 13 nt, Homo sapiens
cuuucuucucucc

SEQ ID NO: 1957599 - RNA, 17 nt, Homo sapiens
acaagucgaugaacuau

SEQ ID NO: 1957600 - RNA, 22 nt, Homo sapiens
ucgcauggccugcagucuggca

SEQ ID NO: 1957601 - RNA, 19 nt, Homo sapiens
uuaaaguauaugugcaguc

SEQ ID NO: 1957602 - RNA, 16 nt, Homo sapiens
uaacaguggacaaagu

SEQ ID NO: 1957603 - RNA, 21 nt, Homo sapiens
aacuuguggagagcuuauaca

SEQ ID NO: 1957604 - RNA, 20 nt, Homo sapiens
aaaauugaaaacacuaacaa

SEQ ID NO: 1957605 - RNA, 18 nt, Homo sapiens
aucuuuauuaaauauuca

SEQ ID NO: 1957606 - RNA, 16 nt, Homo sapiens
cugggagcccucaggc

SEQ ID NO: 1957607 - RNA, 18 nt, Homo sapiens
aacugauuuaugaucacu

SEQ ID NO: 1957608 - RNA, 20 nt, Homo sapiens
aaugguuaucuuugagacca

SEQ ID NO: 1957609 - RNA, 23 nt, Homo sapiens
uccauguaggaaaguaaaaugga

SEQ ID NO: 1957610 - RNA, 23 nt, Homo sapiens
ugcagggacagccugcacagugg

SEQ ID NO: 1957611 - RNA, 11 nt, Homo sapiens
uacuuccacug

SEQ ID NO: 1957612 - RNA, 19 nt, Homo sapiens
cuggccucugcugauccuc

SEQ ID NO: 1957613 - RNA, 14 nt, Homo sapiens
uggauuauuuagau

SEQ ID NO: 1957614 - RNA, 17 nt, Homo sapiens
ucagaauaucacagaaa

SEQ ID NO: 1957615 - RNA, 20 nt, Homo sapiens
uccucccuccccgcccucac

SEQ ID NO: 1957616 - RNA, 22 nt, Homo sapiens
cucagaguguggguccuucaaa

SEQ ID NO: 1957617 - RNA, 22 nt, Homo sapiens
auuuuuuaaaugacugcugaau

SEQ ID NO: 1957618 - RNA, 19 nt, Homo sapiens
uuauauuuuccucuuagau

SEQ ID NO: 1957619 - RNA, 22 nt, Homo sapiens
aguaaauaucccaaacugugau

SEQ ID NO: 1957620 - RNA, 10 nt, Homo sapiens
cauuugauac

SEQ ID NO: 1957621 - RNA, 15 nt, Homo sapiens
uuccacagaggacac

SEQ ID NO: 1957622 - RNA, 20 nt, Homo sapiens
cgugguggcucaugccugua

SEQ ID NO: 1957623 - RNA, 18 nt, Homo sapiens
uguuuaaaugcuguguac

SEQ ID NO: 1957624 - RNA, 18 nt, Homo sapiens
uguagcuucuucugaaag

SEQ ID NO: 1957625 - RNA, 14 nt, Homo sapiens
uuccucaugugauc

SEQ ID NO: 1957626 - RNA, 20 nt, Homo sapiens
uuaaauuaaugaacauaugu

SEQ ID NO: 1957627 - RNA, 21 nt, Homo sapiens
auuuuguuuuugucuuaaaaa

SEQ ID NO: 1957628 - RNA, 16 nt, Homo sapiens
cuuuuaacugccaaga

SEQ ID NO: 1957629 - RNA, 17 nt, Homo sapiens
uuggacagacacuguug

SEQ ID NO: 1957630 - RNA, 22 nt, Homo sapiens
acauaagggguuugccauuuga

SEQ ID NO: 1957631 - RNA, 20 nt, Homo sapiens
uggacuuggucaccagcucc

SEQ ID NO: 1957632 - RNA, 16 nt, Homo sapiens
gugaauaaaccaucau

SEQ ID NO: 1957633 - RNA, 17 nt, Homo sapiens
aucagcauuuuacuacu

SEQ ID NO: 1957634 - RNA, 16 nt, Homo sapiens
auuugaaaaguauuau

SEQ ID NO: 1957635 - RNA, 22 nt, Homo sapiens
aaagggcuugaggugaauuuca

SEQ ID NO: 1957636 - RNA, 21 nt, Homo sapiens
uacugccccugcccugaggag

SEQ ID NO: 1957637 - RNA, 12 nt, Homo sapiens
uucacuuuacaa

SEQ ID NO: 1957638 - RNA, 19 nt, Homo sapiens
cuucuaaucccagcacuuu

SEQ ID NO: 1957639 - RNA, 19 nt, Homo sapiens
ccucuaaucucagcacuuu

SEQ ID NO: 1957640 - RNA, 20 nt, Homo sapiens
ugaaugcugcugagugaaug

SEQ ID NO: 1957641 - RNA, 17 nt, Homo sapiens
ggcgaaucuacagaaca

SEQ ID NO: 1957642 - RNA, 22 nt, Homo sapiens
gccagauuuuccugaaaacccu

SEQ ID NO: 1957643 - RNA, 23 nt, Homo sapiens
ugaaaugggggcaggaaagccac

SEQ ID NO: 1957644 - RNA, 15 nt, Homo sapiens
gaggcugcaguuccc

SEQ ID NO: 1957645 - RNA, 19 nt, Homo sapiens
ggcaaaugccugacucagu

SEQ ID NO: 1957646 - RNA, 16 nt, Homo sapiens
accgaagccacuuucu

SEQ ID NO: 1957647 - RNA, 12 nt, Homo sapiens
ccuucacuuuac

SEQ ID NO: 1957648 - RNA, 23 nt, Homo sapiens
gucuuugaagugacuucacagag

SEQ ID NO: 1957649 - RNA, 16 nt, Homo sapiens
ugggacugucggagga

SEQ ID NO: 1957650 - RNA, 13 nt, Homo sapiens
gggugaaggugac

SEQ ID NO: 1957651 - RNA, 12 nt, Homo sapiens
aguccuuuccaa

SEQ ID NO: 1957652 - RNA, 23 nt, Homo sapiens
acugccccccugccuugcucccc

SEQ ID NO: 1957653 - RNA, 21 nt, Homo sapiens
caaggucugaacccuuccacc

SEQ ID NO: 1957654 - RNA, 18 nt, Homo sapiens
cagacuugcacugaagcc

SEQ ID NO: 1957655 - RNA, 18 nt, Homo sapiens
cuucucugauuaugugcc

SEQ ID NO: 1957656 - RNA, 20 nt, Homo sapiens
caggcaugaaauacugugcc

SEQ ID NO: 1957657 - RNA, 19 nt, Homo sapiens
cuccuuuugcuugaaacca

SEQ ID NO: 1957658 - RNA, 13 nt, Homo sapiens
cucugaagggaaa

SEQ ID NO: 1957659 - RNA, 20 nt, Homo sapiens
ccucuuaauucccaauccca

SEQ ID NO: 1957660 - RNA, 22 nt, Homo sapiens
gaaauacuugaaaacuucucau

SEQ ID NO: 1957661 - RNA, 15 nt, Homo sapiens
cuuugugauaauuua

SEQ ID NO: 1957662 - RNA, 16 nt, Homo sapiens
aauguaucauagaaau

SEQ ID NO: 1957663 - RNA, 15 nt, Homo sapiens
uaaacucugcacuua

SEQ ID NO: 1957664 - RNA, 12 nt, Homo sapiens
uaucaguaccuc

SEQ ID NO: 1957665 - RNA, 21 nt, Homo sapiens
uucuuuccaauagcaaauuca

SEQ ID NO: 1957666 - RNA, 21 nt, Homo sapiens
augcccagcuuggagugccac

SEQ ID NO: 1957667 - RNA, 16 nt, Homo sapiens
cuauaacaaucacugg

SEQ ID NO: 1957668 - RNA, 22 nt, Homo sapiens
gcuacuacgguugaucuugcaa

SEQ ID NO: 1957669 - RNA, 19 nt, Homo sapiens
aaugcaaaacacauuuuau

SEQ ID NO: 1957670 - RNA, 14 nt, Homo sapiens
aucauccaagacag

SEQ ID NO: 1957671 - RNA, 20 nt, Homo sapiens
aggcacccaaaccccggggc

SEQ ID NO: 1957672 - RNA, 15 nt, Homo sapiens
gccucuuuuccccau

SEQ ID NO: 1957673 - RNA, 22 nt, Homo sapiens
ucagugaaauaauuacagaaua

SEQ ID NO: 1957674 - RNA, 19 nt, Homo sapiens
auaugcuggagauggacaa

SEQ ID NO: 1957675 - RNA, 21 nt, Homo sapiens
uagagauuugguguacaauuc

SEQ ID NO: 1957676 - RNA, 14 nt, Homo sapiens
cugagcacugacug

SEQ ID NO: 1957677 - RNA, 14 nt, Homo sapiens
ccacugugcuuuca

SEQ ID NO: 1957678 - RNA, 15 nt, Homo sapiens
uuuucucuaccuuca

SEQ ID NO: 1957679 - RNA, 17 nt, Homo sapiens
aacauagcaucucagga

SEQ ID NO: 1957680 - RNA, 17 nt, Homo sapiens
uggacaaggagugugac

SEQ ID NO: 1957681 - RNA, 11 nt, Homo sapiens
uaucaaaaagc

SEQ ID NO: 1957682 - RNA, 17 nt, Homo sapiens
caaguuggagugcagug

SEQ ID NO: 1957683 - RNA, 23 nt, Homo sapiens
ucacaggaaggacuucuuccagg

SEQ ID NO: 1957684 - RNA, 19 nt, Homo sapiens
uaguauuccuguaauacua

SEQ ID NO: 1957685 - RNA, 17 nt, Homo sapiens
uugaauaauaagcagga

SEQ ID NO: 1957686 - RNA, 13 nt, Homo sapiens
agcaaugugguag

SEQ ID NO: 1957687 - RNA, 13 nt, Homo sapiens
ccaagaugaauua

SEQ ID NO: 1957688 - RNA, 22 nt, Homo sapiens
cugugccaauacagacaaagca

SEQ ID NO: 1957689 - RNA, 14 nt, Homo sapiens
uagaugaacucuuc

SEQ ID NO: 1957690 - RNA, 19 nt, Homo sapiens
cagauuuacugucccagga

SEQ ID NO: 1957691 - RNA, 16 nt, Homo sapiens
auuuugaugaccaagu

SEQ ID NO: 1957692 - RNA, 14 nt, Homo sapiens
aaaauguuguccuu

SEQ ID NO: 1957693 - RNA, 23 nt, Homo sapiens
acaucuucugccuuagucucagu

SEQ ID NO: 1957694 - RNA, 14 nt, Homo sapiens
ccaaguaacauuuu

SEQ ID NO: 1957695 - RNA, 19 nt, Homo sapiens
aaaauugauuucuucucau

SEQ ID NO: 1957696 - RNA, 20 nt, Homo sapiens
uaugcaauauaucaauguaa

SEQ ID NO: 1957697 - RNA, 15 nt, Homo sapiens
cuauuaucuggguuu

SEQ ID NO: 1957698 - RNA, 13 nt, Homo sapiens
uuccucaccaagc

SEQ ID NO: 1957699 - RNA, 22 nt, Homo sapiens
gagcagaugcaaucucuugucu

SEQ ID NO: 1957700 - RNA, 18 nt, Homo sapiens
gggacagccugcacagug

SEQ ID NO: 1957701 - RNA, 23 nt, Homo sapiens
uuggccugucuuuggauuguuaa

SEQ ID NO: 1957702 - RNA, 16 nt, Homo sapiens
aaccagcaacuaauaa

SEQ ID NO: 1957703 - RNA, 15 nt, Homo sapiens
aucccucaccuguag

SEQ ID NO: 1957704 - RNA, 14 nt, Homo sapiens
cuuuuaaaucaaaa

SEQ ID NO: 1957705 - RNA, 21 nt, Homo sapiens
cuuucuuccuuggccaagaga

SEQ ID NO: 1957706 - RNA, 16 nt, Homo sapiens
cacauguuuaacuuua

SEQ ID NO: 1957707 - RNA, 19 nt, Homo sapiens
cuagaaauauauucauaau

SEQ ID NO: 1957708 - RNA, 23 nt, Homo sapiens
uccuauggaauguaaagugcaau

SEQ ID NO: 1957709 - RNA, 16 nt, Homo sapiens
cuacuuuaucaauuaa

SEQ ID NO: 1957710 - RNA, 19 nt, Homo sapiens
agcuuggauuaaauacaua

SEQ ID NO: 1957711 - RNA, 14 nt, Homo sapiens
uugaauaaacuaga

SEQ ID NO: 1957712 - RNA, 22 nt, Homo sapiens
uucuccacaacacugugucaca

SEQ ID NO: 1957713 - RNA, 12 nt, Homo sapiens
aaguggcagcuu

SEQ ID NO: 1957714 - RNA, 19 nt, Homo sapiens
cugaaaucaagucaucuau

SEQ ID NO: 1957715 - RNA, 23 nt, Homo sapiens
gaagguaacugauaaaccaaaau

SEQ ID NO: 1957716 - RNA, 21 nt, Homo sapiens
ggccaacugcccagagccaca

SEQ ID NO: 1957717 - RNA, 20 nt, Homo sapiens
gacagagccucgcucuguua

SEQ ID NO: 1957718 - RNA, 12 nt, Homo sapiens
auauaggauaau

SEQ ID NO: 1957719 - RNA, 18 nt, Homo sapiens
gcgcugccugcguugcaa

SEQ ID NO: 1957720 - RNA, 19 nt, Homo sapiens
agcugaccgggucacacaa

SEQ ID NO: 1957721 - RNA, 13 nt, Homo sapiens
ccaaucacaagca

SEQ ID NO: 1957722 - RNA, 22 nt, Homo sapiens
cuagaccaguuugcaugauucu

SEQ ID NO: 1957723 - RNA, 13 nt, Homo sapiens
aaaugacuccuaa

SEQ ID NO: 1957724 - RNA, 14 nt, Homo sapiens
auacauggacaaua

SEQ ID NO: 1957725 - RNA, 19 nt, Homo sapiens
cuugucaagccugugcaaa

SEQ ID NO: 1957726 - RNA, 22 nt, Homo sapiens
gccagaaggcaaaaaccagaaa

SEQ ID NO: 1957727 - RNA, 20 nt, Homo sapiens
cgggagaccccuuguugcac

SEQ ID NO: 1957728 - RNA, 14 nt, Homo sapiens
gaaagaaugcauuc

SEQ ID NO: 1957729 - RNA, 19 nt, Homo sapiens
uccagcuucuagccaugua

SEQ ID NO: 1957730 - RNA, 19 nt, Homo sapiens
cauugggcugacaccuacc

SEQ ID NO: 1957731 - RNA, 15 nt, Homo sapiens
aaugauaagugacaa

SEQ ID NO: 1957732 - RNA, 21 nt, Homo sapiens
ucacagccauacagcugucca

SEQ ID NO: 1957733 - RNA, 17 nt, Homo sapiens
cuccuccccacaucccc

SEQ ID NO: 1957734 - RNA, 16 nt, Homo sapiens
gcauuugcagugcauc

SEQ ID NO: 1957735 - RNA, 18 nt, Homo sapiens
gacaggauuucacugugu

SEQ ID NO: 1957736 - RNA, 17 nt, Homo sapiens
cuagguucuagguccug

SEQ ID NO: 1957737 - RNA, 23 nt, Homo sapiens
ugggacagccaaguuauacccaa

SEQ ID NO: 1957738 - RNA, 18 nt, Homo sapiens
accuggccgccuccagga

SEQ ID NO: 1957739 - RNA, 23 nt, Homo sapiens
aguugggcuuucacaaaaggcau

SEQ ID NO: 1957740 - RNA, 22 nt, Homo sapiens
ucaucuggaggcugcguccuga

SEQ ID NO: 1957741 - RNA, 16 nt, Homo sapiens
gugacuucacuguaua

SEQ ID NO: 1957742 - RNA, 21 nt, Homo sapiens
uuuccccgacuggggcagggu

SEQ ID NO: 1957743 - RNA, 22 nt, Homo sapiens
auaaaaaucauggcaacauaau

SEQ ID NO: 1957744 - RNA, 11 nt, Homo sapiens
ccuuugaucuu

SEQ ID NO: 1957745 - RNA, 14 nt, Homo sapiens
gggcauagccuuuc

SEQ ID NO: 1957746 - RNA, 16 nt, Homo sapiens
gcucugagccaaccuu

SEQ ID NO: 1957747 - RNA, 19 nt, Homo sapiens
guuugagaccgaccagcca

SEQ ID NO: 1957748 - RNA, 20 nt, Homo sapiens
gauaaaucaguuaugucaau

SEQ ID NO: 1957749 - RNA, 15 nt, Homo sapiens
cucccuuuuugaauu

SEQ ID NO: 1957750 - RNA, 21 nt, Homo sapiens
aagcaaaccuguaagugucuu

SEQ ID NO: 1957751 - RNA, 23 nt, Homo sapiens
ucgaugauucaggugcagaggaa

SEQ ID NO: 1957752 - RNA, 20 nt, Homo sapiens
caaaggacagaguaugaaca

SEQ ID NO: 1957753 - RNA, 20 nt, Homo sapiens
gaagcaaagauuucaguaga

SEQ ID NO: 1957754 - RNA, 22 nt, Homo sapiens
cuucuaguuuggcauuucacaa

SEQ ID NO: 1957755 - RNA, 11 nt, Homo sapiens
aacagcacuuu

SEQ ID NO: 1957756 - RNA, 11 nt, Homo sapiens
auuagcacuac

SEQ ID NO: 1957757 - RNA, 15 nt, Homo sapiens
ucccaaacuacagaa

SEQ ID NO: 1957758 - RNA, 16 nt, Homo sapiens
uucagaugacagaugu

SEQ ID NO: 1957759 - RNA, 13 nt, Homo sapiens
uauuaucauaaga

SEQ ID NO: 1957760 - RNA, 16 nt, Homo sapiens
aaugcaguccagugag

SEQ ID NO: 1957761 - RNA, 15 nt, Homo sapiens
guguccccaccucag

SEQ ID NO: 1957762 - RNA, 14 nt, Homo sapiens
gugcuggacacugu

SEQ ID NO: 1957763 - RNA, 16 nt, Homo sapiens
uaaauuauggcauuuu

SEQ ID NO: 1957764 - RNA, 22 nt, Homo sapiens
uguacagcucuccccucccuug

SEQ ID NO: 1957765 - RNA, 13 nt, Homo sapiens
guggagugcagug

SEQ ID NO: 1957766 - RNA, 18 nt, Homo sapiens
auuagccuguagcuuaua

SEQ ID NO: 1957767 - RNA, 16 nt, Homo sapiens
cucauagguugagcaa

SEQ ID NO: 1957768 - RNA, 19 nt, Homo sapiens
aagaucuaaaaugauacug

SEQ ID NO: 1957769 - RNA, 19 nt, Homo sapiens
ggcagucucugcccaaaca

SEQ ID NO: 1957770 - RNA, 13 nt, Homo sapiens
augcucaccaagg

SEQ ID NO: 1957771 - RNA, 13 nt, Homo sapiens
aauuaaaaccaau

SEQ ID NO: 1957772 - RNA, 21 nt, Homo sapiens
gcuacaaauuuaugcauuuca

SEQ ID NO: 1957773 - RNA, 15 nt, Homo sapiens
aaagggaccagggga

SEQ ID NO: 1957774 - RNA, 14 nt, Homo sapiens
aacauauggcuuua

SEQ ID NO: 1957775 - RNA, 19 nt, Homo sapiens
cucccaccaccucaccagu

SEQ ID NO: 1957776 - RNA, 19 nt, Homo sapiens
aacaggcucagaucucaug

SEQ ID NO: 1957777 - RNA, 23 nt, Homo sapiens
ugagaggaugaauguaugugcac

SEQ ID NO: 1957778 - RNA, 18 nt, Homo sapiens
uuuguuuucuacauugau

SEQ ID NO: 1957779 - RNA, 17 nt, Homo sapiens
guuagacaaaagugcuc

SEQ ID NO: 1957780 - RNA, 21 nt, Homo sapiens
uccccugcugaggcagugugg

SEQ ID NO: 1957781 - RNA, 20 nt, Homo sapiens
gugaagcaaaacacaaaaac

SEQ ID NO: 1957782 - RNA, 18 nt, Homo sapiens
agaaacaguccaguacuu

SEQ ID NO: 1957783 - RNA, 18 nt, Homo sapiens
ccuauuuaaaacuggguc

SEQ ID NO: 1957784 - RNA, 15 nt, Homo sapiens
ucccccaaagccauc

SEQ ID NO: 1957785 - RNA, 22 nt, Homo sapiens
uggacaagggcaggucuucaua

SEQ ID NO: 1957786 - RNA, 17 nt, Homo sapiens
aagcuggggacagagaa

SEQ ID NO: 1957787 - RNA, 13 nt, Homo sapiens
aucauauuaguau

SEQ ID NO: 1957788 - RNA, 22 nt, Homo sapiens
augugaaauggccaaagcacau

SEQ ID NO: 1957789 - RNA, 21 nt, Homo sapiens
ggagccuuaguugagauuuca

SEQ ID NO: 1957790 - RNA, 20 nt, Homo sapiens
ucagaugccucaguaggcau

SEQ ID NO: 1957791 - RNA, 15 nt, Homo sapiens
ugacacugcucuaac

SEQ ID NO: 1957792 - RNA, 15 nt, Homo sapiens
gcagggccaccugca

SEQ ID NO: 1957793 - RNA, 18 nt, Homo sapiens
aaguauaacaacuuugaa

SEQ ID NO: 1957794 - RNA, 20 nt, Homo sapiens
cuucccuaaaaucagggaau

SEQ ID NO: 1957795 - RNA, 14 nt, Homo sapiens
acugugucuacugu

SEQ ID NO: 1957796 - RNA, 16 nt, Homo sapiens
uugguuccuucugccc

SEQ ID NO: 1957797 - RNA, 16 nt, Homo sapiens
gagcguguacuacccc

SEQ ID NO: 1957798 - RNA, 14 nt, Homo sapiens
uuugugaacauucu

SEQ ID NO: 1957799 - RNA, 14 nt, Homo sapiens
gacuuuaaaguaua

SEQ ID NO: 1957800 - RNA, 20 nt, Homo sapiens
aggcaugagccaccgcgccu

SEQ ID NO: 1957801 - RNA, 19 nt, Homo sapiens
aauuaaaaaauaguugcaa

SEQ ID NO: 1957802 - RNA, 21 nt, Homo sapiens
uaaauuuuauaacagaauuaa

SEQ ID NO: 1957803 - RNA, 20 nt, Homo sapiens
uagguauugucuacucugaa

SEQ ID NO: 1957804 - RNA, 22 nt, Homo sapiens
acucccacagaggagagaggcu

SEQ ID NO: 1957805 - RNA, 20 nt, Homo sapiens
gauacaaaugggaauucacu

SEQ ID NO: 1957806 - RNA, 16 nt, Homo sapiens
uuagcccaucuuucaa

SEQ ID NO: 1957807 - RNA, 16 nt, Homo sapiens
cacgaaugauucuauu

SEQ ID NO: 1957808 - RNA, 20 nt, Homo sapiens
gauaauguucuccacugaca

SEQ ID NO: 1957809 - RNA, 18 nt, Homo sapiens
auaaaagguuuaauguca

SEQ ID NO: 1957810 - RNA, 20 nt, Homo sapiens
ucugucccaguuaacuguua

SEQ ID NO: 1957811 - RNA, 15 nt, Homo sapiens
agacagggcuccagc

SEQ ID NO: 1957812 - RNA, 14 nt, Homo sapiens
uugccuugugaauu

SEQ ID NO: 1957813 - RNA, 17 nt, Homo sapiens
uugaugugaaacauuau

SEQ ID NO: 1957814 - RNA, 22 nt, Homo sapiens
ccugagccaagaggaacuugac

SEQ ID NO: 1957815 - RNA, 21 nt, Homo sapiens
agccaggcucucugcugccca

SEQ ID NO: 1957816 - RNA, 15 nt, Homo sapiens
cuccauacaaugacu

SEQ ID NO: 1957817 - RNA, 17 nt, Homo sapiens
gaggaaagagaguuugu

SEQ ID NO: 1957818 - RNA, 20 nt, Homo sapiens
acacuaguccauaagcuuua

SEQ ID NO: 1957819 - RNA, 21 nt, Homo sapiens
aaacaaauauacucauuugga

SEQ ID NO: 1957820 - RNA, 14 nt, Homo sapiens
aauguaucugaaua

SEQ ID NO: 1957821 - RNA, 14 nt, Homo sapiens
acccagaggucucc

SEQ ID NO: 1957822 - RNA, 15 nt, Homo sapiens
aggaaggcagcugcu

SEQ ID NO: 1957823 - RNA, 14 nt, Homo sapiens
ucuucucuacucua

SEQ ID NO: 1957824 - RNA, 19 nt, Homo sapiens
auccccuccguggcaucac

SEQ ID NO: 1957825 - RNA, 19 nt, Homo sapiens
aguaauauagcugagacua

SEQ ID NO: 1957826 - RNA, 18 nt, Homo sapiens
ucacucuccgaagucuga

SEQ ID NO: 1957827 - RNA, 20 nt, Homo sapiens
augcuacuuuauuuauacac

SEQ ID NO: 1957828 - RNA, 13 nt, Homo sapiens
caaaacaauuuca

SEQ ID NO: 1957829 - RNA, 19 nt, Homo sapiens
uauucagacaaaauggaua

SEQ ID NO: 1957830 - RNA, 21 nt, Homo sapiens
aauguguggugcuaacuguau

SEQ ID NO: 1957831 - RNA, 16 nt, Homo sapiens
gcagcgcgcacacgca

SEQ ID NO: 1957832 - RNA, 18 nt, Homo sapiens
caagcacaaacugucguc

SEQ ID NO: 1957833 - RNA, 22 nt, Homo sapiens
cagcccuggcucucacgcuggg

SEQ ID NO: 1957834 - RNA, 21 nt, Homo sapiens
accgcugggugguuuuuuccc

SEQ ID NO: 1957835 - RNA, 14 nt, Homo sapiens
cuacugaggagcaa

SEQ ID NO: 1957836 - RNA, 16 nt, Homo sapiens
cuugggaucugcaaga

SEQ ID NO: 1957837 - RNA, 21 nt, Homo sapiens
aagagcaaacaaaaguucugc

SEQ ID NO: 1957838 - RNA, 22 nt, Homo sapiens
gugagugccuccuguggucuca

SEQ ID NO: 1957839 - RNA, 9 nt, Homo sapiens
aaagcaaaa

SEQ ID NO: 1957840 - RNA, 23 nt, Homo sapiens
aguuauaaaguccuuggacuguu

SEQ ID NO: 1957841 - RNA, 13 nt, Homo sapiens
cugccaugccagu

SEQ ID NO: 1957842 - RNA, 13 nt, Homo sapiens
cccagacaauggc

SEQ ID NO: 1957843 - RNA, 14 nt, Homo sapiens
cagggcaccccagc

SEQ ID NO: 1957844 - RNA, 20 nt, Homo sapiens
ugguccugacucaacauguu

SEQ ID NO: 1957845 - RNA, 18 nt, Homo sapiens
cagccauuaccauggaga

SEQ ID NO: 1957846 - RNA, 20 nt, Homo sapiens
cuaacuuauccaucuuugaa

SEQ ID NO: 1957847 - RNA, 15 nt, Homo sapiens
uccauacacuuuguu

SEQ ID NO: 1957848 - RNA, 20 nt, Homo sapiens
aauuguacccuucuugucuc

SEQ ID NO: 1957849 - RNA, 21 nt, Homo sapiens
ucaggagcagccucagaacaa

SEQ ID NO: 1957850 - RNA, 13 nt, Homo sapiens
gaagcaccaugaa

SEQ ID NO: 1957851 - RNA, 21 nt, Homo sapiens
caaggggaccgccccaggcac

SEQ ID NO: 1957852 - RNA, 19 nt, Homo sapiens
uucccuuuuguauucucuu

SEQ ID NO: 1957853 - RNA, 16 nt, Homo sapiens
gcugucggugugcugu

SEQ ID NO: 1957854 - RNA, 13 nt, Homo sapiens
acuccacaccagu

SEQ ID NO: 1957855 - RNA, 14 nt, Homo sapiens
caauaaacauguca

SEQ ID NO: 1957856 - RNA, 16 nt, Homo sapiens
ugagcucucuaauaga

SEQ ID NO: 1957857 - RNA, 23 nt, Homo sapiens
gauggugcaugccuguagucuca

SEQ ID NO: 1957858 - RNA, 19 nt, Homo sapiens
gguaaaagcaccauuguga

SEQ ID NO: 1957859 - RNA, 18 nt, Homo sapiens
aagaaccuacgugaccau

SEQ ID NO: 1957860 - RNA, 20 nt, Homo sapiens
gggugauuacauaaucugua

SEQ ID NO: 1957861 - RNA, 18 nt, Homo sapiens
auaaacacccaugaauca

SEQ ID NO: 1957862 - RNA, 16 nt, Homo sapiens
guucaacaucuaaaaa

SEQ ID NO: 1957863 - RNA, 16 nt, Homo sapiens
uuuauuaauucauuaa

SEQ ID NO: 1957864 - RNA, 16 nt, Homo sapiens
cucugcaccuuugcac

SEQ ID NO: 1957865 - RNA, 16 nt, Homo sapiens
cuuuaccacucuacca

SEQ ID NO: 1957866 - RNA, 16 nt, Homo sapiens
ucuaggacuccacagu

SEQ ID NO: 1957867 - RNA, 16 nt, Homo sapiens
ugggccagacaugcca

SEQ ID NO: 1957868 - RNA, 17 nt, Homo sapiens
cauguacuuucccugug

SEQ ID NO: 1957869 - RNA, 13 nt, Homo sapiens
caccucugcacaa

SEQ ID NO: 1957870 - RNA, 21 nt, Homo sapiens
ucuucaggagaaugugcagug

SEQ ID NO: 1957871 - RNA, 15 nt, Homo sapiens
acagaugcuaauaaa

SEQ ID NO: 1957872 - RNA, 18 nt, Homo sapiens
gauuuugcugacuuccca

SEQ ID NO: 1957873 - RNA, 22 nt, Homo sapiens
gaacucagagaugaacaucuaa

SEQ ID NO: 1957874 - RNA, 14 nt, Homo sapiens
ucuguuauguacua

SEQ ID NO: 1957875 - RNA, 20 nt, Homo sapiens
ucuuaggcaugugcugguau

SEQ ID NO: 1957876 - RNA, 16 nt, Homo sapiens
aaaauguuuaccagug

SEQ ID NO: 1957877 - RNA, 18 nt, Homo sapiens
uguagaugacauggugaa

SEQ ID NO: 1957878 - RNA, 18 nt, Homo sapiens
aaauuccaguuaaccuau

SEQ ID NO: 1957879 - RNA, 23 nt, Homo sapiens
uccuuugauagaaaggaauuuua

SEQ ID NO: 1957880 - RNA, 13 nt, Homo sapiens
auagcuacuguag

SEQ ID NO: 1957881 - RNA, 22 nt, Homo sapiens
ggagagaagcucuucaauagcu

SEQ ID NO: 1957882 - RNA, 21 nt, Homo sapiens
gaauuuuuuucugcacagcuu

SEQ ID NO: 1957883 - RNA, 21 nt, Homo sapiens
aggccccugcagcugccucac

SEQ ID NO: 1957884 - RNA, 22 nt, Homo sapiens
cucaggcaaggggcauuucaca

SEQ ID NO: 1957885 - RNA, 19 nt, Homo sapiens
agaggugccagcaacugaa

SEQ ID NO: 1957886 - RNA, 17 nt, Homo sapiens
gaguacagacgucucaa

SEQ ID NO: 1957887 - RNA, 19 nt, Homo sapiens
agucacggcugcgcacugu

SEQ ID NO: 1957888 - RNA, 19 nt, Homo sapiens
uaguauucuucuuccugaa

SEQ ID NO: 1957889 - RNA, 23 nt, Homo sapiens
agggcaacaauacaugcugcuaa

SEQ ID NO: 1957890 - RNA, 19 nt, Homo sapiens
uucccucuucccugaccuc

SEQ ID NO: 1957891 - RNA, 22 nt, Homo sapiens
cuaugauguuucuuuugcaauu

SEQ ID NO: 1957892 - RNA, 20 nt, Homo sapiens
uuacacccuuucuugacaaa

SEQ ID NO: 1957893 - RNA, 15 nt, Homo sapiens
ggauccagaacugca

SEQ ID NO: 1957894 - RNA, 23 nt, Homo sapiens
uuaaaggaaaaucacaucuccag

SEQ ID NO: 1957895 - RNA, 22 nt, Homo sapiens
cguaacccauuaaaaugaauuu

SEQ ID NO: 1957896 - RNA, 15 nt, Homo sapiens
uccugccucuacugg

SEQ ID NO: 1957897 - RNA, 13 nt, Homo sapiens
ccaacacccaaag

SEQ ID NO: 1957898 - RNA, 15 nt, Homo sapiens
aucucugcugaacau

SEQ ID NO: 1957899 - RNA, 18 nt, Homo sapiens
cugggccaaaaccaaugc

SEQ ID NO: 1957900 - RNA, 15 nt, Homo sapiens
uguaagaaaaccaaa

SEQ ID NO: 1957901 - RNA, 19 nt, Homo sapiens
gaucuggcacacucccucu

SEQ ID NO: 1957902 - RNA, 18 nt, Homo sapiens
uaaagggcauuuuacuaa

SEQ ID NO: 1957903 - RNA, 21 nt, Homo sapiens
ugaaaaugucagaaaccaguu

SEQ ID NO: 1957904 - RNA, 17 nt, Homo sapiens
uaaaugcaaacacugug

SEQ ID NO: 1957905 - RNA, 14 nt, Homo sapiens
ccagacucuugccu

SEQ ID NO: 1957906 - RNA, 13 nt, Homo sapiens
ccuacaucaaaug

SEQ ID NO: 1957907 - RNA, 15 nt, Homo sapiens
ucaauuuucuucaca

SEQ ID NO: 1957908 - RNA, 21 nt, Homo sapiens
gccugggcuguuggcacucac

SEQ ID NO: 1957909 - RNA, 12 nt, Homo sapiens
acugacccagga

SEQ ID NO: 1957910 - RNA, 20 nt, Homo sapiens
ggcagaacucuccuuggaua

SEQ ID NO: 1957911 - RNA, 22 nt, Homo sapiens
uucucucugacccucuccccac

SEQ ID NO: 1957912 - RNA, 16 nt, Homo sapiens
aucgucuaaacuuuag

SEQ ID NO: 1957913 - RNA, 13 nt, Homo sapiens
uaaguucagucca

SEQ ID NO: 1957914 - RNA, 13 nt, Homo sapiens
aaugaaguuauuu

SEQ ID NO: 1957915 - RNA, 20 nt, Homo sapiens
auaaaaugcaaaugcacuca

SEQ ID NO: 1957916 - RNA, 14 nt, Homo sapiens
uagucgguucugua

SEQ ID NO: 1957917 - RNA, 18 nt, Homo sapiens
gaugccggcaggccuucc

SEQ ID NO: 1957918 - RNA, 17 nt, Homo sapiens
uuuccauuuuaaggaua

SEQ ID NO: 1957919 - RNA, 15 nt, Homo sapiens
auuacaauccuugac

SEQ ID NO: 1957920 - RNA, 15 nt, Homo sapiens
cuaacccuacaugca

SEQ ID NO: 1957921 - RNA, 18 nt, Homo sapiens
uucugauuugccacugau

SEQ ID NO: 1957922 - RNA, 18 nt, Homo sapiens
ugccaugguuaccgagga

SEQ ID NO: 1957923 - RNA, 22 nt, Homo sapiens
cagcaaagaaacagagugcuaa

SEQ ID NO: 1957924 - RNA, 16 nt, Homo sapiens
aguccuucagaauuaa

SEQ ID NO: 1957925 - RNA, 15 nt, Homo sapiens
cagacuuguugugac

SEQ ID NO: 1957926 - RNA, 16 nt, Homo sapiens
ccaaaauacuccaaag

SEQ ID NO: 1957927 - RNA, 17 nt, Homo sapiens
aauauuuuuaugugcaa

SEQ ID NO: 1957928 - RNA, 21 nt, Homo sapiens
aagggugugggccaccagaga

SEQ ID NO: 1957929 - RNA, 17 nt, Homo sapiens
guccccucuugacccau

SEQ ID NO: 1957930 - RNA, 23 nt, Homo sapiens
cacugcagcagaaaacaaacaca

SEQ ID NO: 1957931 - RNA, 19 nt, Homo sapiens
ccgggcacagcugugguga

SEQ ID NO: 1957932 - RNA, 22 nt, Homo sapiens
aaacugauguacugaauuccau

SEQ ID NO: 1957933 - RNA, 22 nt, Homo sapiens
acagccccuuccucugccaggu

SEQ ID NO: 1957934 - RNA, 20 nt, Homo sapiens
agcccagccaccucccaagg

SEQ ID NO: 1957935 - RNA, 18 nt, Homo sapiens
augaaaacuuuuucacag

SEQ ID NO: 1957936 - RNA, 22 nt, Homo sapiens
accuccaaacuuauagcgcuga

SEQ ID NO: 1957937 - RNA, 16 nt, Homo sapiens
guuugucagacuuuaa

SEQ ID NO: 1957938 - RNA, 20 nt, Homo sapiens
caaaagguuucauguagauu

SEQ ID NO: 1957939 - RNA, 13 nt, Homo sapiens
uggaguuaucuaa

SEQ ID NO: 1957940 - RNA, 20 nt, Homo sapiens
ccaggcgggcggcacgccaa

SEQ ID NO: 1957941 - RNA, 19 nt, Homo sapiens
ccgcaccauugaacuguac

SEQ ID NO: 1957942 - RNA, 14 nt, Homo sapiens
aaaauucauuccau

SEQ ID NO: 1957943 - RNA, 24 nt, Homo sapiens
uaaaugaagaaaaguauugcaccu

SEQ ID NO: 1957944 - RNA, 16 nt, Homo sapiens
ggucccuggagggcaa

SEQ ID NO: 1957945 - RNA, 22 nt, Homo sapiens
acuuaauaucagugaacacagu

SEQ ID NO: 1957946 - RNA, 21 nt, Homo sapiens
agaaauuuuaucucuucuucc

SEQ ID NO: 1957947 - RNA, 13 nt, Homo sapiens
cucuuuguagcag

SEQ ID NO: 1957948 - RNA, 13 nt, Homo sapiens
cuuuguguaguau

SEQ ID NO: 1957949 - RNA, 17 nt, Homo sapiens
cccaucuuuugguugcc

SEQ ID NO: 1957950 - RNA, 18 nt, Homo sapiens
gcacucaaagcuuguuaa

SEQ ID NO: 1957951 - RNA, 11 nt, Homo sapiens
ggagaggucau

SEQ ID NO: 1957952 - RNA, 21 nt, Homo sapiens
ugaaccccaccucccucccac

SEQ ID NO: 1957953 - RNA, 22 nt, Homo sapiens
agacuguuugaaucuugucuca

SEQ ID NO: 1957954 - RNA, 21 nt, Homo sapiens
ccuguccaagacagggcucau

SEQ ID NO: 1957955 - RNA, 21 nt, Homo sapiens
cagagauaauucuagcuuuga

SEQ ID NO: 1957956 - RNA, 13 nt, Homo sapiens
gaaaauucagguc

SEQ ID NO: 1957957 - RNA, 20 nt, Homo sapiens
uggcagccauuucuccaugg

SEQ ID NO: 1957958 - RNA, 16 nt, Homo sapiens
uuggacggaauggagg

SEQ ID NO: 1957959 - RNA, 16 nt, Homo sapiens
auuuuucuaucaaaua

SEQ ID NO: 1957960 - RNA, 15 nt, Homo sapiens
aaggacaaagugcca

SEQ ID NO: 1957961 - RNA, 22 nt, Homo sapiens
agaauaaggaggaggagggaga

SEQ ID NO: 1957962 - RNA, 16 nt, Homo sapiens
uucaaacaauaucaua

SEQ ID NO: 1957963 - RNA, 16 nt, Homo sapiens
ccaggacgcaugcagg

SEQ ID NO: 1957964 - RNA, 18 nt, Homo sapiens
uggccuguuaugauucug

SEQ ID NO: 1957965 - RNA, 18 nt, Homo sapiens
ucacugcuggcugccuua

SEQ ID NO: 1957966 - RNA, 24 nt, Homo sapiens
ccaauggacaagcagugucuguca

SEQ ID NO: 1957967 - RNA, 18 nt, Homo sapiens
uuacucauauguggaauc

SEQ ID NO: 1957968 - RNA, 19 nt, Homo sapiens
caaguuuuuauaguuauua

SEQ ID NO: 1957969 - RNA, 20 nt, Homo sapiens
cauucucuugaaggugcugc

SEQ ID NO: 1957970 - RNA, 23 nt, Homo sapiens
uacuuccaggauggaugcaucac

SEQ ID NO: 1957971 - RNA, 15 nt, Homo sapiens
gcaucauuaguacau

SEQ ID NO: 1957972 - RNA, 13 nt, Homo sapiens
guuaaauuuagca

SEQ ID NO: 1957973 - RNA, 16 nt, Homo sapiens
uugauuccacauucca

SEQ ID NO: 1957974 - RNA, 18 nt, Homo sapiens
acucagccacugucacag

SEQ ID NO: 1957975 - RNA, 12 nt, Homo sapiens
cccaaacaguga

SEQ ID NO: 1957976 - RNA, 13 nt, Homo sapiens
ggacagcauauaa

SEQ ID NO: 1957977 - RNA, 24 nt, Homo sapiens
acuugggugaaaaguauggcagug

SEQ ID NO: 1957978 - RNA, 22 nt, Homo sapiens
uaacauagaauugcaaucuaua

SEQ ID NO: 1957979 - RNA, 20 nt, Homo sapiens
gaaggcuuuaauaaaggcca

SEQ ID NO: 1957980 - RNA, 19 nt, Homo sapiens
cugaucuuauucuguggug

SEQ ID NO: 1957981 - RNA, 15 nt, Homo sapiens
uuugaauaaagaaua

SEQ ID NO: 1957982 - RNA, 21 nt, Homo sapiens
aaugaaggaaaagcauguuau

SEQ ID NO: 1957983 - RNA, 22 nt, Homo sapiens
uacugccaagccccugcccugg

SEQ ID NO: 1957984 - RNA, 20 nt, Homo sapiens
cacucugcagacugcuagug

SEQ ID NO: 1957985 - RNA, 21 nt, Homo sapiens
uuacagccagaggaaccagca

SEQ ID NO: 1957986 - RNA, 19 nt, Homo sapiens
gucaucugggccaccagcu

SEQ ID NO: 1957987 - RNA, 17 nt, Homo sapiens
uggacucagaaagccaa

SEQ ID NO: 1957988 - RNA, 19 nt, Homo sapiens
agaccuaaucucuguaaag

SEQ ID NO: 1957989 - RNA, 21 nt, Homo sapiens
cucaaacccuguggggccuga

SEQ ID NO: 1957990 - RNA, 14 nt, Homo sapiens
aggcagcauuccau

SEQ ID NO: 1957991 - RNA, 21 nt, Homo sapiens
ucugccagcguccccggccac

SEQ ID NO: 1957992 - RNA, 15 nt, Homo sapiens
aaaaauauguagcaa

SEQ ID NO: 1957993 - RNA, 11 nt, Homo sapiens
cuaccaagaac

SEQ ID NO: 1957994 - RNA, 17 nt, Homo sapiens
cuguguuaggaugcggc

SEQ ID NO: 1957995 - RNA, 19 nt, Homo sapiens
caagauauccacuuaccug

SEQ ID NO: 1957996 - RNA, 23 nt, Homo sapiens
aagggaaccauguauaugagcuu

SEQ ID NO: 1957997 - RNA, 11 nt, Homo sapiens
cagcacugcac

SEQ ID NO: 1957998 - RNA, 11 nt, Homo sapiens
gggcacugggc

SEQ ID NO: 1957999 - RNA, 15 nt, Homo sapiens
auucucugcaauuug

SEQ ID NO: 1958000 - RNA, 18 nt, Homo sapiens
cucagaaugcacuugauu

SEQ ID NO: 1958001 - RNA, 20 nt, Homo sapiens
gugccccugaugacgggaug

SEQ ID NO: 1958002 - RNA, 9 nt, Homo sapiens
uaugugcaa

SEQ ID NO: 1958003 - RNA, 18 nt, Homo sapiens
aggucauaaagcauugga

SEQ ID NO: 1958004 - RNA, 18 nt, Homo sapiens
caguuagagacucuguca

SEQ ID NO: 1958005 - RNA, 21 nt, Homo sapiens
uuacaaaacugcuuugugcau

SEQ ID NO: 1958006 - RNA, 21 nt, Homo sapiens
gacaugugguuacuaguacag

SEQ ID NO: 1958007 - RNA, 17 nt, Homo sapiens
auaguguucugcuccug

SEQ ID NO: 1958008 - RNA, 22 nt, Homo sapiens
auagauuucauguuaugcauuu

SEQ ID NO: 1958009 - RNA, 16 nt, Homo sapiens
cuuuuuaaaaaaggaa

SEQ ID NO: 1958010 - RNA, 15 nt, Homo sapiens
aacggagagugcuug

SEQ ID NO: 1958011 - RNA, 18 nt, Homo sapiens
gucaaguuguuugucaau

SEQ ID NO: 1958012 - RNA, 14 nt, Homo sapiens
ugcuguggccuucc

SEQ ID NO: 1958013 - RNA, 16 nt, Homo sapiens
ggccaauuacuugaag

SEQ ID NO: 1958014 - RNA, 17 nt, Homo sapiens
ggggccacaccaccuau

SEQ ID NO: 1958015 - RNA, 17 nt, Homo sapiens
auagagcuccauuuccc

SEQ ID NO: 1958016 - RNA, 20 nt, Homo sapiens
ccaggcuggucuugaacugg

SEQ ID NO: 1958017 - RNA, 15 nt, Homo sapiens
ugauaugaccaaaau

SEQ ID NO: 1958018 - RNA, 12 nt, Homo sapiens
uuccugugagcu

SEQ ID NO: 1958019 - RNA, 13 nt, Homo sapiens
ggcacugccugau

SEQ ID NO: 1958020 - RNA, 16 nt, Homo sapiens
cucaaugaaugggaug

SEQ ID NO: 1958021 - RNA, 14 nt, Homo sapiens
uccagucauugcac

SEQ ID NO: 1958022 - RNA, 22 nt, Homo sapiens
ucaaauauuaucuuuguucucc

SEQ ID NO: 1958023 - RNA, 14 nt, Homo sapiens
agcaaaugccugcc

SEQ ID NO: 1958024 - RNA, 21 nt, Homo sapiens
accacggccaccacugcagcc

SEQ ID NO: 1958025 - RNA, 22 nt, Homo sapiens
gggaccccaggugggccuggca

SEQ ID NO: 1958026 - RNA, 13 nt, Homo sapiens
caagaaugaaaug

SEQ ID NO: 1958027 - RNA, 15 nt, Homo sapiens
uaauauugaugucag

SEQ ID NO: 1958028 - RNA, 17 nt, Homo sapiens
uaaaucuccagauuucu

SEQ ID NO: 1958029 - RNA, 22 nt, Homo sapiens
uacacaugugcugauguuuaca

SEQ ID NO: 1958030 - RNA, 22 nt, Homo sapiens
uguagacuuuugacacuuuuaa

SEQ ID NO: 1958031 - RNA, 17 nt, Homo sapiens
cucagagaaugaucacc

SEQ ID NO: 1958032 - RNA, 15 nt, Homo sapiens
ugggugggaggaaac

SEQ ID NO: 1958033 - RNA, 14 nt, Homo sapiens
gagaucgugccauu

SEQ ID NO: 1958034 - RNA, 17 nt, Homo sapiens
cuguuacuuaccuaaac

SEQ ID NO: 1958035 - RNA, 21 nt, Homo sapiens
guguccuccccucaaggacaa

SEQ ID NO: 1958036 - RNA, 19 nt, Homo sapiens
agugauucugaaucaaggu

SEQ ID NO: 1958037 - RNA, 15 nt, Homo sapiens
uucagguugugcauu

SEQ ID NO: 1958038 - RNA, 17 nt, Homo sapiens
cagaucuguaauucacu

SEQ ID NO: 1958039 - RNA, 16 nt, Homo sapiens
caggaaccagcaauga

SEQ ID NO: 1958040 - RNA, 19 nt, Homo sapiens
auguuuuuaugauaucccu

SEQ ID NO: 1958041 - RNA, 19 nt, Homo sapiens
ugagaaggcagccaccagc

SEQ ID NO: 1958042 - RNA, 21 nt, Homo sapiens
cuggagcccgaggcaccagug

SEQ ID NO: 1958043 - RNA, 13 nt, Homo sapiens
aagcaaucacugg

SEQ ID NO: 1958044 - RNA, 19 nt, Homo sapiens
acuuugacuaauacccaaa

SEQ ID NO: 1958045 - RNA, 15 nt, Homo sapiens
auuauauauaaucua

SEQ ID NO: 1958046 - RNA, 13 nt, Homo sapiens
uaauuguaauuaa

SEQ ID NO: 1958047 - RNA, 23 nt, Homo sapiens
agaccucgacgacccuuucauca

SEQ ID NO: 1958048 - RNA, 20 nt, Homo sapiens
cucugccaaaggaugugaua

SEQ ID NO: 1958049 - RNA, 17 nt, Homo sapiens
agcgggaggcagaguuu

SEQ ID NO: 1958050 - RNA, 18 nt, Homo sapiens
aaccaucacccccaggac

SEQ ID NO: 1958051 - RNA, 17 nt, Homo sapiens
aagacaauuuuaauguu

SEQ ID NO: 1958052 - RNA, 17 nt, Homo sapiens
gaaauaacccagacuua

SEQ ID NO: 1958053 - RNA, 16 nt, Homo sapiens
guuccagaaccgcagg

SEQ ID NO: 1958054 - RNA, 19 nt, Homo sapiens
gaugcgguggcuaaagguc

SEQ ID NO: 1958055 - RNA, 18 nt, Homo sapiens
uaauaguuuaacugaaag

SEQ ID NO: 1958056 - RNA, 18 nt, Homo sapiens
uaaaaaccuuguagauag

SEQ ID NO: 1958057 - RNA, 19 nt, Homo sapiens
auuuagaagccaacuauga

SEQ ID NO: 1958058 - RNA, 15 nt, Homo sapiens
ggugaaucaccuggc

SEQ ID NO: 1958059 - RNA, 13 nt, Homo sapiens
guaacuaacacac

SEQ ID NO: 1958060 - RNA, 18 nt, Homo sapiens
uuaagcaucuaaggacaa

SEQ ID NO: 1958061 - RNA, 17 nt, Homo sapiens
uucagagugacuacaca

SEQ ID NO: 1958062 - RNA, 21 nt, Homo sapiens
ucuggauggauuugaagcaaa

SEQ ID NO: 1958063 - RNA, 20 nt, Homo sapiens
acccaggguggagugcagug

SEQ ID NO: 1958064 - RNA, 14 nt, Homo sapiens
aggcugcaccuacu

SEQ ID NO: 1958065 - RNA, 19 nt, Homo sapiens
aaauuuauaaaggucugca

SEQ ID NO: 1958066 - RNA, 16 nt, Homo sapiens
acaauuuagcuuacau

SEQ ID NO: 1958067 - RNA, 17 nt, Homo sapiens
ccuaagcuggucucaaa

SEQ ID NO: 1958068 - RNA, 20 nt, Homo sapiens
agugagagcgugcuccagcc

SEQ ID NO: 1958069 - RNA, 18 nt, Homo sapiens
ccguuugguagacuccuu

SEQ ID NO: 1958070 - RNA, 13 nt, Homo sapiens
aggcacuaaaaag

SEQ ID NO: 1958071 - RNA, 16 nt, Homo sapiens
cacgguggcggcugca

SEQ ID NO: 1958072 - RNA, 15 nt, Homo sapiens
guggggauuggggga

SEQ ID NO: 1958073 - RNA, 18 nt, Homo sapiens
cagauagcugccacuggc

SEQ ID NO: 1958074 - RNA, 22 nt, Homo sapiens
gucgagggaaagagacccagaa

SEQ ID NO: 1958075 - RNA, 19 nt, Homo sapiens
uaacuuuucggucuuuccc

SEQ ID NO: 1958076 - RNA, 19 nt, Homo sapiens
aagauaaaucaaaguaaua

SEQ ID NO: 1958077 - RNA, 14 nt, Homo sapiens
ucaugcauuugcac

SEQ ID NO: 1958078 - RNA, 13 nt, Homo sapiens
cuguguuuacaga

SEQ ID NO: 1958079 - RNA, 11 nt, Homo sapiens
uguauaguguu

SEQ ID NO: 1958080 - RNA, 13 nt, Homo sapiens
cuuauaacugucu

SEQ ID NO: 1958081 - RNA, 14 nt, Homo sapiens
cagaacugucuuag

SEQ ID NO: 1958082 - RNA, 15 nt, Homo sapiens
aguguauaaauccaa

SEQ ID NO: 1958083 - RNA, 19 nt, Homo sapiens
caauacaaguuacauacau

SEQ ID NO: 1958084 - RNA, 17 nt, Homo sapiens
cuucagugagccaugau

SEQ ID NO: 1958085 - RNA, 14 nt, Homo sapiens
ggcaaucuugcccu

SEQ ID NO: 1958086 - RNA, 13 nt, Homo sapiens
ugugauuaccucu

SEQ ID NO: 1958087 - RNA, 14 nt, Homo sapiens
uccuuaucugcuaa

SEQ ID NO: 1958088 - RNA, 19 nt, Homo sapiens
ugaagcacugagcagaagc

SEQ ID NO: 1958089 - RNA, 23 nt, Homo sapiens
auauuuggauggugaagucacau

SEQ ID NO: 1958090 - RNA, 14 nt, Homo sapiens
auaccuccuauggg

SEQ ID NO: 1958091 - RNA, 19 nt, Homo sapiens
ucacauuuagaaaagugaa

SEQ ID NO: 1958092 - RNA, 18 nt, Homo sapiens
cacacaaaaaaugcacaa

SEQ ID NO: 1958093 - RNA, 15 nt, Homo sapiens
gcaaaacuuaggcau

SEQ ID NO: 1958094 - RNA, 15 nt, Homo sapiens
uaugacauauuacaa

SEQ ID NO: 1958095 - RNA, 17 nt, Homo sapiens
ucuucauuucuauagcc

SEQ ID NO: 1958096 - RNA, 17 nt, Homo sapiens
uccccaagacacauccu

SEQ ID NO: 1958097 - RNA, 19 nt, Homo sapiens
gguugggggcagaggccca

SEQ ID NO: 1958098 - RNA, 16 nt, Homo sapiens
agaaaaugaagcccua

SEQ ID NO: 1958099 - RNA, 18 nt, Homo sapiens
ucccagcaugcugagauu

SEQ ID NO: 1958100 - RNA, 18 nt, Homo sapiens
guguuuugcuaaaggaaa

SEQ ID NO: 1958101 - RNA, 12 nt, Homo sapiens
acugugcuacug

SEQ ID NO: 1958102 - RNA, 12 nt, Homo sapiens
uaucugcuuauc

SEQ ID NO: 1958103 - RNA, 12 nt, Homo sapiens
ccagugcuccag

SEQ ID NO: 1958104 - RNA, 19 nt, Homo sapiens
cuccaagucuguaccucaa

SEQ ID NO: 1958105 - RNA, 19 nt, Homo sapiens
agcugagguuugcacuucc

SEQ ID NO: 1958106 - RNA, 16 nt, Homo sapiens
aucuaauauauaugaa

SEQ ID NO: 1958107 - RNA, 13 nt, Homo sapiens
uuagaaaaaccac

SEQ ID NO: 1958108 - RNA, 13 nt, Homo sapiens
aucgcaaaucaaa

SEQ ID NO: 1958109 - RNA, 19 nt, Homo sapiens
uguuuguccguccaugcca

SEQ ID NO: 1958110 - RNA, 15 nt, Homo sapiens
auucauuugcuucag

SEQ ID NO: 1958111 - RNA, 13 nt, Homo sapiens
caucccaucuaag

SEQ ID NO: 1958112 - RNA, 21 nt, Homo sapiens
aagaauaaggcuuuuucuucc

SEQ ID NO: 1958113 - RNA, 13 nt, Homo sapiens
uaaguacuaugua

SEQ ID NO: 1958114 - RNA, 10 nt, Homo sapiens
cuccaugcac

SEQ ID NO: 1958115 - RNA, 16 nt, Homo sapiens
cauuaacaagcucuua

SEQ ID NO: 1958116 - RNA, 22 nt, Homo sapiens
cauauuuuaaaauguauaccaa

SEQ ID NO: 1958117 - RNA, 21 nt, Homo sapiens
gauaucauuuaggaguauuau

SEQ ID NO: 1958118 - RNA, 16 nt, Homo sapiens
ucacugucuuuccuag

SEQ ID NO: 1958119 - RNA, 16 nt, Homo sapiens
cagccaaacagagccu

SEQ ID NO: 1958120 - RNA, 23 nt, Homo sapiens
cucagucaauaaauuugcaaauu

SEQ ID NO: 1958121 - RNA, 17 nt, Homo sapiens
gcucccucccaucccuu

SEQ ID NO: 1958122 - RNA, 14 nt, Homo sapiens
uauucauuccucac

SEQ ID NO: 1958123 - RNA, 20 nt, Homo sapiens
aaugacugcgcagaguggau

SEQ ID NO: 1958124 - RNA, 17 nt, Homo sapiens
gagacuggagcaucuga

SEQ ID NO: 1958125 - RNA, 13 nt, Homo sapiens
caucugcuuuacu

SEQ ID NO: 1958126 - RNA, 15 nt, Homo sapiens
cuggaguaaaccaug

SEQ ID NO: 1958127 - RNA, 16 nt, Homo sapiens
aauacaauacaguacu

SEQ ID NO: 1958128 - RNA, 21 nt, Homo sapiens
ugguucccuccccaaggccac

SEQ ID NO: 1958129 - RNA, 17 nt, Homo sapiens
caggagaugaugugaug

SEQ ID NO: 1958130 - RNA, 16 nt, Homo sapiens
auucaaucuuuacaca

SEQ ID NO: 1958131 - RNA, 15 nt, Homo sapiens
agggagcucuggagu

SEQ ID NO: 1958132 - RNA, 22 nt, Homo sapiens
aaucagccucuucucugaugac

SEQ ID NO: 1958133 - RNA, 22 nt, Homo sapiens
uguauguuuuaauugcauuuaa

SEQ ID NO: 1958134 - RNA, 16 nt, Homo sapiens
gcaauaaaggcaccuc

SEQ ID NO: 1958135 - RNA, 16 nt, Homo sapiens
auaccgcucaguauuu

SEQ ID NO: 1958136 - RNA, 23 nt, Homo sapiens
uucuacacagagcaggacugcac

SEQ ID NO: 1958137 - RNA, 18 nt, Homo sapiens
ucggcuugaucacagcuc

SEQ ID NO: 1958138 - RNA, 15 nt, Homo sapiens
augcacacacagaug

SEQ ID NO: 1958139 - RNA, 15 nt, Homo sapiens
auggaugcacacaca

SEQ ID NO: 1958140 - RNA, 21 nt, Homo sapiens
acauauuuauugugcauuaaa

SEQ ID NO: 1958141 - RNA, 22 nt, Homo sapiens
aaugcuuuuccaacccaugagu

SEQ ID NO: 1958142 - RNA, 12 nt, Homo sapiens
acucccagacau

SEQ ID NO: 1958143 - RNA, 15 nt, Homo sapiens
agcguggacaggugu

SEQ ID NO: 1958144 - RNA, 15 nt, Homo sapiens
cagauugaagcauuu

SEQ ID NO: 1958145 - RNA, 21 nt, Homo sapiens
cuugcuauuugagcaugcaca

SEQ ID NO: 1958146 - RNA, 18 nt, Homo sapiens
uucaucccacccucucac

SEQ ID NO: 1958147 - RNA, 18 nt, Homo sapiens
uuaaagcauuacaguauu

SEQ ID NO: 1958148 - RNA, 22 nt, Homo sapiens
cuuucagaaaaacaaaugugaa

SEQ ID NO: 1958149 - RNA, 20 nt, Homo sapiens
agacacagacuggcaauaaa

SEQ ID NO: 1958150 - RNA, 20 nt, Homo sapiens
uauccuuuuagucugcauau

SEQ ID NO: 1958151 - RNA, 19 nt, Homo sapiens
gccaucaagaaacauucag

SEQ ID NO: 1958152 - RNA, 14 nt, Homo sapiens
auaaauucuacucu

SEQ ID NO: 1958153 - RNA, 14 nt, Homo sapiens
auaaaaagugaacu

SEQ ID NO: 1958154 - RNA, 16 nt, Homo sapiens
caguacugguuuucca

SEQ ID NO: 1958155 - RNA, 23 nt, Homo sapiens
aucucgcacuacaucugauauca

SEQ ID NO: 1958156 - RNA, 22 nt, Homo sapiens
cuuccauuguuuaaaaauacac

SEQ ID NO: 1958157 - RNA, 19 nt, Homo sapiens
accuucugacgcagccuga

SEQ ID NO: 1958158 - RNA, 22 nt, Homo sapiens
auugacauguagguacccugcc

SEQ ID NO: 1958159 - RNA, 20 nt, Homo sapiens
cugggaggagagacacuggu

SEQ ID NO: 1958160 - RNA, 17 nt, Homo sapiens
uggccccaguccaugcu

SEQ ID NO: 1958161 - RNA, 22 nt, Homo sapiens
uaaacauuaauuuugugcauuc

SEQ ID NO: 1958162 - RNA, 14 nt, Homo sapiens
aacaauaacacugc

SEQ ID NO: 1958163 - RNA, 19 nt, Homo sapiens
cgcaugugcagcuauuuaa

SEQ ID NO: 1958164 - RNA, 18 nt, Homo sapiens
auguuagaaguccaggca

SEQ ID NO: 1958165 - RNA, 17 nt, Homo sapiens
cuccaguuugcauuugg

SEQ ID NO: 1958166 - RNA, 16 nt, Homo sapiens
caggcgagccugacuc

SEQ ID NO: 1958167 - RNA, 19 nt, Homo sapiens
aggucaaccccacuguaga

SEQ ID NO: 1958168 - RNA, 17 nt, Homo sapiens
cuggccuugaguagaaa

SEQ ID NO: 1958169 - RNA, 20 nt, Homo sapiens
agcauccucucucacaugga

SEQ ID NO: 1958170 - RNA, 17 nt, Homo sapiens
aaggaaccuuccuuccu

SEQ ID NO: 1958171 - RNA, 19 nt, Homo sapiens
guuaaguaauauuggcuau

SEQ ID NO: 1958172 - RNA, 16 nt, Homo sapiens
cucgugccaugaucug

SEQ ID NO: 1958173 - RNA, 14 nt, Homo sapiens
acucuaccugcaag

SEQ ID NO: 1958174 - RNA, 18 nt, Homo sapiens
aggcggguggaucacuug

SEQ ID NO: 1958175 - RNA, 12 nt, Homo sapiens
cgaggccugaag

SEQ ID NO: 1958176 - RNA, 13 nt, Homo sapiens
caucugugcagua

SEQ ID NO: 1958177 - RNA, 12 nt, Homo sapiens
uaaaaaagccug

SEQ ID NO: 1958178 - RNA, 15 nt, Homo sapiens
auaguuguaccgcaa

SEQ ID NO: 1958179 - RNA, 17 nt, Homo sapiens
ucacugucccucaaaug

SEQ ID NO: 1958180 - RNA, 19 nt, Homo sapiens
gguaccuuucuagccuuag

SEQ ID NO: 1958181 - RNA, 13 nt, Homo sapiens
uguuuccacuauu

SEQ ID NO: 1958182 - RNA, 17 nt, Homo sapiens
gaccccacugccaagug

SEQ ID NO: 1958183 - RNA, 19 nt, Homo sapiens
cugaguuccggggugcaau

SEQ ID NO: 1958184 - RNA, 16 nt, Homo sapiens
accucaccaguuucca

SEQ ID NO: 1958185 - RNA, 23 nt, Homo sapiens
acagcuuuaucuccccaggagca

SEQ ID NO: 1958186 - RNA, 20 nt, Homo sapiens
uagaccagaaccagagcuca

SEQ ID NO: 1958187 - RNA, 17 nt, Homo sapiens
aaaaguccacaagaaca

SEQ ID NO: 1958188 - RNA, 21 nt, Homo sapiens
uucugccacuugcacugugcu

SEQ ID NO: 1958189 - RNA, 16 nt, Homo sapiens
uuuucaucccauuucc

SEQ ID NO: 1958190 - RNA, 23 nt, Homo sapiens
accugguggcuacgaaucuuccg

SEQ ID NO: 1958191 - RNA, 19 nt, Homo sapiens
ggagguggagguugcagug

SEQ ID NO: 1958192 - RNA, 13 nt, Homo sapiens
agagauaguucua

SEQ ID NO: 1958193 - RNA, 19 nt, Homo sapiens
gauuacugcccaauaugca

SEQ ID NO: 1958194 - RNA, 19 nt, Homo sapiens
auaugcacuuauucucaag

SEQ ID NO: 1958195 - RNA, 22 nt, Homo sapiens
agccucugccgcugccaugcuu

SEQ ID NO: 1958196 - RNA, 21 nt, Homo sapiens
cucauuagcugaauugagcua

SEQ ID NO: 1958197 - RNA, 19 nt, Homo sapiens
agcacgcuggacagcacuc

SEQ ID NO: 1958198 - RNA, 20 nt, Homo sapiens
ggagaggggagagggacgca

SEQ ID NO: 1958199 - RNA, 15 nt, Homo sapiens
agacuagauugccuu

SEQ ID NO: 1958200 - RNA, 21 nt, Homo sapiens
gagacuacaggugugugucca

SEQ ID NO: 1958201 - RNA, 13 nt, Homo sapiens
ucaggugccaacc

SEQ ID NO: 1958202 - RNA, 20 nt, Homo sapiens
acauauguuaauaaacugca

SEQ ID NO: 1958203 - RNA, 19 nt, Homo sapiens
ccaguuuccacaggcagca

SEQ ID NO: 1958204 - RNA, 19 nt, Homo sapiens
gccaucauccuccauugcu

SEQ ID NO: 1958205 - RNA, 23 nt, Homo sapiens
gaaggcacagcuaaccacuucgc

SEQ ID NO: 1958206 - RNA, 21 nt, Homo sapiens
caguuucuugaaguccagugu

SEQ ID NO: 1958207 - RNA, 21 nt, Homo sapiens
aaucaaugaaguagcugagaa

SEQ ID NO: 1958208 - RNA, 12 nt, Homo sapiens
uuaugaaugaca

SEQ ID NO: 1958209 - RNA, 18 nt, Homo sapiens
ugaacuuuuuuccacuga

SEQ ID NO: 1958210 - RNA, 13 nt, Homo sapiens
agaaggaaaaaug

SEQ ID NO: 1958211 - RNA, 23 nt, Homo sapiens
gccugaggccagccugcgggaag

SEQ ID NO: 1958212 - RNA, 21 nt, Homo sapiens
cauuggaggugaacaagcaaa

SEQ ID NO: 1958213 - RNA, 18 nt, Homo sapiens
agacaugagugcgugcuc

SEQ ID NO: 1958214 - RNA, 12 nt, Homo sapiens
cugcaacuccau

SEQ ID NO: 1958215 - RNA, 22 nt, Homo sapiens
ucaccugucgcacccacuguga

SEQ ID NO: 1958216 - RNA, 22 nt, Homo sapiens
caguguacacuguucccaauau

SEQ ID NO: 1958217 - RNA, 13 nt, Homo sapiens
caaagaggcugcc

SEQ ID NO: 1958218 - RNA, 21 nt, Homo sapiens
aggccucuuguugagugccag

SEQ ID NO: 1958219 - RNA, 13 nt, Homo sapiens
agaaucacugcag

SEQ ID NO: 1958220 - RNA, 14 nt, Homo sapiens
ucucuacagacucc

SEQ ID NO: 1958221 - RNA, 15 nt, Homo sapiens
gauacgacagcucuc

SEQ ID NO: 1958222 - RNA, 18 nt, Homo sapiens
gcacgcuggacagcacuc

SEQ ID NO: 1958223 - RNA, 14 nt, Homo sapiens
ucuaguuucauuau

SEQ ID NO: 1958224 - RNA, 19 nt, Homo sapiens
caggaucugucugugcaca

SEQ ID NO: 1958225 - RNA, 15 nt, Homo sapiens
caaaugacgucuuca

SEQ ID NO: 1958226 - RNA, 14 nt, Homo sapiens
gauccuucaaagag

SEQ ID NO: 1958227 - RNA, 18 nt, Homo sapiens
caauugcuuuaacaguca

SEQ ID NO: 1958228 - RNA, 13 nt, Homo sapiens
uggcacuggccac

SEQ ID NO: 1958229 - RNA, 14 nt, Homo sapiens
acugucauguggcu

SEQ ID NO: 1958230 - RNA, 11 nt, Homo sapiens
uaugcuguauu

SEQ ID NO: 1958231 - RNA, 18 nt, Homo sapiens
caucguccgucacuuaua

SEQ ID NO: 1958232 - RNA, 20 nt, Homo sapiens
accaccaagaaagccuucaa

SEQ ID NO: 1958233 - RNA, 23 nt, Homo sapiens
ucccuuaauaaacucacaacucu

SEQ ID NO: 1958234 - RNA, 14 nt, Homo sapiens
ggccccaucuccac

SEQ ID NO: 1958235 - RNA, 16 nt, Homo sapiens
ucuucucccaauucau

SEQ ID NO: 1958236 - RNA, 23 nt, Homo sapiens
cugucccccugagaucagagucc

SEQ ID NO: 1958237 - RNA, 14 nt, Homo sapiens
uuauaacauguaaa

SEQ ID NO: 1958238 - RNA, 14 nt, Homo sapiens
ugcugagcaggaac

SEQ ID NO: 1958239 - RNA, 17 nt, Homo sapiens
agcuuauagucuuccag

SEQ ID NO: 1958240 - RNA, 16 nt, Homo sapiens
ugugaagugcagauga

SEQ ID NO: 1958241 - RNA, 17 nt, Homo sapiens
acuaagaagugguguuc

SEQ ID NO: 1958242 - RNA, 15 nt, Homo sapiens
caugcugcuggggaa

SEQ ID NO: 1958243 - RNA, 22 nt, Homo sapiens
caguggacuauaauaauagugg

SEQ ID NO: 1958244 - RNA, 13 nt, Homo sapiens
cuugucucugagg

SEQ ID NO: 1958245 - RNA, 16 nt, Homo sapiens
aacgauaaaauuacaa

SEQ ID NO: 1958246 - RNA, 15 nt, Homo sapiens
caccaucugauuaaa

SEQ ID NO: 1958247 - RNA, 15 nt, Homo sapiens
acuccacucacugaa

SEQ ID NO: 1958248 - RNA, 22 nt, Homo sapiens
cagccaggauugaccuuugcac

SEQ ID NO: 1958249 - RNA, 19 nt, Homo sapiens
acacagucuuggcucacug

SEQ ID NO: 1958250 - RNA, 14 nt, Homo sapiens
cugcgaugcaaugc

SEQ ID NO: 1958251 - RNA, 23 nt, Homo sapiens
cuggcgagauaccauggugccau

SEQ ID NO: 1958252 - RNA, 21 nt, Homo sapiens
cuuaccugccaggaagccagc

SEQ ID NO: 1958253 - RNA, 16 nt, Homo sapiens
guaggggaagugugcu

SEQ ID NO: 1958254 - RNA, 19 nt, Homo sapiens
uuggaaauugagucugaag

SEQ ID NO: 1958255 - RNA, 18 nt, Homo sapiens
aaccacugcgaccacaag

SEQ ID NO: 1958256 - RNA, 18 nt, Homo sapiens
gcuccuccccacuagcau

SEQ ID NO: 1958257 - RNA, 15 nt, Homo sapiens
aucuagauuuuccua

SEQ ID NO: 1958258 - RNA, 17 nt, Homo sapiens
ccgugucaugugucugu

SEQ ID NO: 1958259 - RNA, 16 nt, Homo sapiens
gugcuuucuaaucucc

SEQ ID NO: 1958260 - RNA, 22 nt, Homo sapiens
agcccgaggaggugucucaggc

SEQ ID NO: 1958261 - RNA, 14 nt, Homo sapiens
uaaucaucaaguaa

SEQ ID NO: 1958262 - RNA, 17 nt, Homo sapiens
aaguccaauuccaaagc

SEQ ID NO: 1958263 - RNA, 16 nt, Homo sapiens
ugugccccaugccugu

SEQ ID NO: 1958264 - RNA, 13 nt, Homo sapiens
aagacaagcugca

SEQ ID NO: 1958265 - RNA, 13 nt, Homo sapiens
ucuaaaucauaua

SEQ ID NO: 1958266 - RNA, 16 nt, Homo sapiens
aagagaaaauugagag

SEQ ID NO: 1958267 - RNA, 15 nt, Homo sapiens
ugaacccacugcugc

SEQ ID NO: 1958268 - RNA, 21 nt, Homo sapiens
guauuugcagaauacauucaa

SEQ ID NO: 1958269 - RNA, 13 nt, Homo sapiens
ggcaggugccuug

SEQ ID NO: 1958270 - RNA, 15 nt, Homo sapiens
ucccagcuacuagag

SEQ ID NO: 1958271 - RNA, 13 nt, Homo sapiens
uacaauguagaug

SEQ ID NO: 1958272 - RNA, 22 nt, Homo sapiens
aaaccugcaguuuuguuuguac

SEQ ID NO: 1958273 - RNA, 15 nt, Homo sapiens
ucuuaaaugagaaag

SEQ ID NO: 1958274 - RNA, 13 nt, Homo sapiens
uugcucuccuaga

SEQ ID NO: 1958275 - RNA, 16 nt, Homo sapiens
cucuuuuuuucuuguc

SEQ ID NO: 1958276 - RNA, 14 nt, Homo sapiens
ccaaauacugaugg

SEQ ID NO: 1958277 - RNA, 15 nt, Homo sapiens
gcgccuucgugccug

SEQ ID NO: 1958278 - RNA, 20 nt, Homo sapiens
aguggccuccgucacuaccu

SEQ ID NO: 1958279 - RNA, 22 nt, Homo sapiens
uuucacuacaaucgcuaccuga

SEQ ID NO: 1958280 - RNA, 14 nt, Homo sapiens
uccucugaagggaa

SEQ ID NO: 1958281 - RNA, 10 nt, Homo sapiens
uagccagucc

SEQ ID NO: 1958282 - RNA, 21 nt, Homo sapiens
aagauuuaacaaauacauuca

SEQ ID NO: 1958283 - RNA, 13 nt, Homo sapiens
ugaaaguugcagg

SEQ ID NO: 1958284 - RNA, 16 nt, Homo sapiens
ugcucuggaagaccug

SEQ ID NO: 1958285 - RNA, 16 nt, Homo sapiens
ugaguguauguguuua

SEQ ID NO: 1958286 - RNA, 22 nt, Homo sapiens
ccugacuucuggaaucuuugag

SEQ ID NO: 1958287 - RNA, 14 nt, Homo sapiens
uauacaguacacag

SEQ ID NO: 1958288 - RNA, 13 nt, Homo sapiens
cuaucugcaaaua

SEQ ID NO: 1958289 - RNA, 16 nt, Homo sapiens
acuuccagcuugccug

SEQ ID NO: 1958290 - RNA, 15 nt, Homo sapiens
uuuuauccauggguu

SEQ ID NO: 1958291 - RNA, 17 nt, Homo sapiens
cuagcuagaaauaugau

SEQ ID NO: 1958292 - RNA, 18 nt, Homo sapiens
aacugaguguuagugacu

SEQ ID NO: 1958293 - RNA, 15 nt, Homo sapiens
ccuuugcuacuacua

SEQ ID NO: 1958294 - RNA, 20 nt, Homo sapiens
aaucccagcaugcugagauu

SEQ ID NO: 1958295 - RNA, 20 nt, Homo sapiens
cuugaagguuugaugccaaa

SEQ ID NO: 1958296 - RNA, 16 nt, Homo sapiens
aucauagucgggcaua

SEQ ID NO: 1958297 - RNA, 21 nt, Homo sapiens
guuaagcccccuccucacccc

SEQ ID NO: 1958298 - RNA, 19 nt, Homo sapiens
uccaagcgcgcuguugauu

SEQ ID NO: 1958299 - RNA, 21 nt, Homo sapiens
ucacuguguuuuaaaaggcaa

SEQ ID NO: 1958300 - RNA, 23 nt, Homo sapiens
agaaccaaccaaugaaaacaguc

SEQ ID NO: 1958301 - RNA, 17 nt, Homo sapiens
uagacaaaccaucuccu

SEQ ID NO: 1958302 - RNA, 15 nt, Homo sapiens
cuaaugaaguauuac

SEQ ID NO: 1958303 - RNA, 14 nt, Homo sapiens
gacaauaugcccuu

SEQ ID NO: 1958304 - RNA, 17 nt, Homo sapiens
augcagcaggaaggaac

SEQ ID NO: 1958305 - RNA, 13 nt, Homo sapiens
uggucaccaaauc

SEQ ID NO: 1958306 - RNA, 20 nt, Homo sapiens
uggaagcuuguugaaaaccc

SEQ ID NO: 1958307 - RNA, 21 nt, Homo sapiens
acagacuguucccuccaaggu

SEQ ID NO: 1958308 - RNA, 21 nt, Homo sapiens
ucauuuacacagugcuuucca

SEQ ID NO: 1958309 - RNA, 14 nt, Homo sapiens
guagacagaccucc

SEQ ID NO: 1958310 - RNA, 21 nt, Homo sapiens
accagacuugaauacaacauu

SEQ ID NO: 1958311 - RNA, 15 nt, Homo sapiens
auaggcuucugggau

SEQ ID NO: 1958312 - RNA, 14 nt, Homo sapiens
acugcaagagaugg

SEQ ID NO: 1958313 - RNA, 13 nt, Homo sapiens
agcauauacugaa

SEQ ID NO: 1958314 - RNA, 22 nt, Homo sapiens
aaugcacuguaauauguacaca

SEQ ID NO: 1958315 - RNA, 17 nt, Homo sapiens
ccugaaauuccaaugaa

SEQ ID NO: 1958316 - RNA, 23 nt, Homo sapiens
cuauagcaucuucucauucccau

SEQ ID NO: 1958317 - RNA, 16 nt, Homo sapiens
aagcaggguacccuuu

SEQ ID NO: 1958318 - RNA, 23 nt, Homo sapiens
ugagaagucacucacacuggcca

SEQ ID NO: 1958319 - RNA, 16 nt, Homo sapiens
uauucuugacaugaga

SEQ ID NO: 1958320 - RNA, 22 nt, Homo sapiens
ugagagaagggacacauucaac

SEQ ID NO: 1958321 - RNA, 14 nt, Homo sapiens
cuuaguuuccacag

SEQ ID NO: 1958322 - RNA, 13 nt, Homo sapiens
gccuccaccucug

SEQ ID NO: 1958323 - RNA, 19 nt, Homo sapiens
ugggagaucuucacucugg

SEQ ID NO: 1958324 - RNA, 11 nt, Homo sapiens
ugaaucuggag

SEQ ID NO: 1958325 - RNA, 20 nt, Homo sapiens
cugcccaccugucaaacaaa

SEQ ID NO: 1958326 - RNA, 16 nt, Homo sapiens
uggccuccguccuguc

SEQ ID NO: 1958327 - RNA, 13 nt, Homo sapiens
ucauaguugcaaa

SEQ ID NO: 1958328 - RNA, 13 nt, Homo sapiens
agccccccaugua

SEQ ID NO: 1958329 - RNA, 20 nt, Homo sapiens
cauuucuaaauuuauauuca

SEQ ID NO: 1958330 - RNA, 15 nt, Homo sapiens
cuccccuguaccuuu

SEQ ID NO: 1958331 - RNA, 15 nt, Homo sapiens
aguuggcaugcaucc

SEQ ID NO: 1958332 - RNA, 21 nt, Homo sapiens
acuagccaggaaguacuucca

SEQ ID NO: 1958333 - RNA, 15 nt, Homo sapiens
ugaacacuagccaga

SEQ ID NO: 1958334 - RNA, 23 nt, Homo sapiens
acaaggugguaugguuguauaca

SEQ ID NO: 1958335 - RNA, 21 nt, Homo sapiens
agaugguucuagcauggcaua

SEQ ID NO: 1958336 - RNA, 20 nt, Homo sapiens
aggcacccaccaccaugccc

SEQ ID NO: 1958337 - RNA, 13 nt, Homo sapiens
agaauaaguucau

SEQ ID NO: 1958338 - RNA, 18 nt, Homo sapiens
cucugaccuucacaggga

SEQ ID NO: 1958339 - RNA, 13 nt, Homo sapiens
cuuguuaauguca

SEQ ID NO: 1958340 - RNA, 14 nt, Homo sapiens
accaaaaaucucaa

SEQ ID NO: 1958341 - RNA, 23 nt, Homo sapiens
ccucacuaaaaaggaaacuucag

SEQ ID NO: 1958342 - RNA, 20 nt, Homo sapiens
ccacgugagagaaucugccu

SEQ ID NO: 1958343 - RNA, 15 nt, Homo sapiens
uugaguugugauuga

SEQ ID NO: 1958344 - RNA, 14 nt, Homo sapiens
auuccuuacuguaa

SEQ ID NO: 1958345 - RNA, 17 nt, Homo sapiens
acaacauuguagccuca

SEQ ID NO: 1958346 - RNA, 16 nt, Homo sapiens
ucacugaaguucuccu

SEQ ID NO: 1958347 - RNA, 21 nt, Homo sapiens
acauaauguuaguagcacuga

SEQ ID NO: 1958348 - RNA, 18 nt, Homo sapiens
agaauuuucaaauaagga

SEQ ID NO: 1958349 - RNA, 23 nt, Homo sapiens
cuuucccccuucccgccuuccaa

SEQ ID NO: 1958350 - RNA, 15 nt, Homo sapiens
uaucagaauucucag

SEQ ID NO: 1958351 - RNA, 18 nt, Homo sapiens
gaagcauuccuucuuuga

SEQ ID NO: 1958352 - RNA, 13 nt, Homo sapiens
acagugaagggag

SEQ ID NO: 1958353 - RNA, 21 nt, Homo sapiens
uacuugcuuucaauugacaaa

SEQ ID NO: 1958354 - RNA, 16 nt, Homo sapiens
cucagcuaacauucca

SEQ ID NO: 1958355 - RNA, 10 nt, Homo sapiens
aaugcaguuu

SEQ ID NO: 1958356 - RNA, 17 nt, Homo sapiens
aauauuugucauaugaa

SEQ ID NO: 1958357 - RNA, 12 nt, Homo sapiens
ucaggcaccugg

SEQ ID NO: 1958358 - RNA, 11 nt, Homo sapiens
uauauuugcuu

SEQ ID NO: 1958359 - RNA, 13 nt, Homo sapiens
auuuuugugauuu

SEQ ID NO: 1958360 - RNA, 22 nt, Homo sapiens
uuaaaaggcaagucaaauacca

SEQ ID NO: 1958361 - RNA, 19 nt, Homo sapiens
ggucuaaacagcugaccca

SEQ ID NO: 1958362 - RNA, 11 nt, Homo sapiens
uggagccagac

SEQ ID NO: 1958363 - RNA, 11 nt, Homo sapiens
ugcagccagag

SEQ ID NO: 1958364 - RNA, 18 nt, Homo sapiens
cuuaauuuauuucuuaac

SEQ ID NO: 1958365 - RNA, 20 nt, Homo sapiens
agugagacccccaucucuac

SEQ ID NO: 1958366 - RNA, 19 nt, Homo sapiens
uccacccuaaagucucagg

SEQ ID NO: 1958367 - RNA, 13 nt, Homo sapiens
aauaaauugucau

SEQ ID NO: 1958368 - RNA, 22 nt, Homo sapiens
uauuugugaugacaacuggaau

SEQ ID NO: 1958369 - RNA, 16 nt, Homo sapiens
gaggcagguauuagaa

SEQ ID NO: 1958370 - RNA, 20 nt, Homo sapiens
cagguucugguuagcucagc

SEQ ID NO: 1958371 - RNA, 18 nt, Homo sapiens
cagucgcacacacauuug

SEQ ID NO: 1958372 - RNA, 14 nt, Homo sapiens
aaauuuugaguuau

SEQ ID NO: 1958373 - RNA, 14 nt, Homo sapiens
uguuacuguaauuc

SEQ ID NO: 1958374 - RNA, 21 nt, Homo sapiens
cuuuuaaauaauauccaccuc

SEQ ID NO: 1958375 - RNA, 12 nt, Homo sapiens
uccaggccagug

SEQ ID NO: 1958376 - RNA, 19 nt, Homo sapiens
cuuccaauuauuacagucc

SEQ ID NO: 1958377 - RNA, 12 nt, Homo sapiens
aaugaaugugcu

SEQ ID NO: 1958378 - RNA, 13 nt, Homo sapiens
uagagagagacuu

SEQ ID NO: 1958379 - RNA, 14 nt, Homo sapiens
agcccccaccucag

SEQ ID NO: 1958380 - RNA, 18 nt, Homo sapiens
cgacuaacagcugaagua

SEQ ID NO: 1958381 - RNA, 17 nt, Homo sapiens
gaaucauguaguaucaa

SEQ ID NO: 1958382 - RNA, 22 nt, Homo sapiens
uagugaaucacguaaagcuaga

SEQ ID NO: 1958383 - RNA, 23 nt, Homo sapiens
agcugagugcuagaguaggugca

SEQ ID NO: 1958384 - RNA, 17 nt, Homo sapiens
cuaggucaaaacauuca

SEQ ID NO: 1958385 - RNA, 16 nt, Homo sapiens
cucauuaauacucuuu

SEQ ID NO: 1958386 - RNA, 13 nt, Homo sapiens
augccuuaccuaa

SEQ ID NO: 1958387 - RNA, 11 nt, Homo sapiens
ccucucugagu

SEQ ID NO: 1958388 - RNA, 13 nt, Homo sapiens
cugugaccaaagc

SEQ ID NO: 1958389 - RNA, 15 nt, Homo sapiens
ggcaccgagaacucg

SEQ ID NO: 1958390 - RNA, 17 nt, Homo sapiens
gacucuuuggacacuca

SEQ ID NO: 1958391 - RNA, 20 nt, Homo sapiens
uugaauuuagcaaccuagaa

SEQ ID NO: 1958392 - RNA, 16 nt, Homo sapiens
ggcucuaccaagacau

SEQ ID NO: 1958393 - RNA, 16 nt, Homo sapiens
ucuuagaaauacuugu

SEQ ID NO: 1958394 - RNA, 18 nt, Homo sapiens
auggcuuccccauugccu

SEQ ID NO: 1958395 - RNA, 17 nt, Homo sapiens
caucccaugagcagucc

SEQ ID NO: 1958396 - RNA, 13 nt, Homo sapiens
ucucagcauauau

SEQ ID NO: 1958397 - RNA, 15 nt, Homo sapiens
auuuaaagacaaaga

SEQ ID NO: 1958398 - RNA, 18 nt, Homo sapiens
uaauagaaauaaauuccu

SEQ ID NO: 1958399 - RNA, 22 nt, Homo sapiens
ugucuuguccccucuugaccca

SEQ ID NO: 1958400 - RNA, 20 nt, Homo sapiens
ccaucacaucccuucaagag

SEQ ID NO: 1958401 - RNA, 22 nt, Homo sapiens
cacuguugcguccaugcucaga

SEQ ID NO: 1958402 - RNA, 18 nt, Homo sapiens
ccuuccuguguccaugug

SEQ ID NO: 1958403 - RNA, 22 nt, Homo sapiens
augauacugucucuccagugaa

SEQ ID NO: 1958404 - RNA, 15 nt, Homo sapiens
cccauagcaaagggu

SEQ ID NO: 1958405 - RNA, 19 nt, Homo sapiens
ccugggcgacagagccaga

SEQ ID NO: 1958406 - RNA, 12 nt, Homo sapiens
accaggugaccu

SEQ ID NO: 1958407 - RNA, 18 nt, Homo sapiens
uuuacucagaaccugcuc

SEQ ID NO: 1958408 - RNA, 13 nt, Homo sapiens
guguagauuucau

SEQ ID NO: 1958409 - RNA, 18 nt, Homo sapiens
guaaagugaacaaaaagg

SEQ ID NO: 1958410 - RNA, 16 nt, Homo sapiens
ccuccaucagagccag

SEQ ID NO: 1958411 - RNA, 13 nt, Homo sapiens
uugauaccuguag

SEQ ID NO: 1958412 - RNA, 16 nt, Homo sapiens
auuagcaauacuggaa

SEQ ID NO: 1958413 - RNA, 15 nt, Homo sapiens
cugugcuuucuugcu

SEQ ID NO: 1958414 - RNA, 17 nt, Homo sapiens
uucucaaagauuugaca

SEQ ID NO: 1958415 - RNA, 14 nt, Homo sapiens
gccccuccuugcaa

SEQ ID NO: 1958416 - RNA, 19 nt, Homo sapiens
guuuucaucaagacuggaa

SEQ ID NO: 1958417 - RNA, 21 nt, Homo sapiens
uucuuaauaaacuugcuuuca

SEQ ID NO: 1958418 - RNA, 22 nt, Homo sapiens
gggaauucauuuucaucacugg

SEQ ID NO: 1958419 - RNA, 16 nt, Homo sapiens
aucacucaaccauaac

SEQ ID NO: 1958420 - RNA, 15 nt, Homo sapiens
uuccccuugccuuau

SEQ ID NO: 1958421 - RNA, 15 nt, Homo sapiens
gugugcaucaugucu

SEQ ID NO: 1958422 - RNA, 15 nt, Homo sapiens
aauuccaaacauaca

SEQ ID NO: 1958423 - RNA, 20 nt, Homo sapiens
ggaugcuauuucagccaauc

SEQ ID NO: 1958424 - RNA, 15 nt, Homo sapiens
gggagugugucugcu

SEQ ID NO: 1958425 - RNA, 19 nt, Homo sapiens
uugucacagggacugaaaa

SEQ ID NO: 1958426 - RNA, 17 nt, Homo sapiens
gaggcaaugacugugag

SEQ ID NO: 1958427 - RNA, 24 nt, Homo sapiens
uuaaaacuaaaaaggaccagagaa

SEQ ID NO: 1958428 - RNA, 12 nt, Homo sapiens
aauaagucucua

SEQ ID NO: 1958429 - RNA, 17 nt, Homo sapiens
cuugugagucuucacua

SEQ ID NO: 1958430 - RNA, 18 nt, Homo sapiens
cccugcacacacaugcau

SEQ ID NO: 1958431 - RNA, 14 nt, Homo sapiens
aaugaucaucucac

SEQ ID NO: 1958432 - RNA, 15 nt, Homo sapiens
cagucccaugaccuu

SEQ ID NO: 1958433 - RNA, 16 nt, Homo sapiens
uagugucuccagucaa

SEQ ID NO: 1958434 - RNA, 19 nt, Homo sapiens
cuucagguaacacuacaga

SEQ ID NO: 1958435 - RNA, 15 nt, Homo sapiens
uauguauaacaagcc

SEQ ID NO: 1958436 - RNA, 22 nt, Homo sapiens
cgcagccagcuuuuccagaaau

SEQ ID NO: 1958437 - RNA, 13 nt, Homo sapiens
aacaacacugugu

SEQ ID NO: 1958438 - RNA, 17 nt, Homo sapiens
ugcucaaggaccaagag

SEQ ID NO: 1958439 - RNA, 13 nt, Homo sapiens
cacugucccuacc

SEQ ID NO: 1958440 - RNA, 12 nt, Homo sapiens
caagacgcugcc

SEQ ID NO: 1958441 - RNA, 18 nt, Homo sapiens
uucccuucccccuggccu

SEQ ID NO: 1958442 - RNA, 16 nt, Homo sapiens
caggagccuaguacaa

SEQ ID NO: 1958443 - RNA, 13 nt, Homo sapiens
cauuccugaagaa

SEQ ID NO: 1958444 - RNA, 17 nt, Homo sapiens
cauggcuuggcauuuuc

SEQ ID NO: 1958445 - RNA, 19 nt, Homo sapiens
auauuuuaaaaaaucaaaa

SEQ ID NO: 1958446 - RNA, 14 nt, Homo sapiens
ccaggacaccugcc

SEQ ID NO: 1958447 - RNA, 12 nt, Homo sapiens
cccucggagcca

SEQ ID NO: 1958448 - RNA, 18 nt, Homo sapiens
cgugacgaggcucaaaaa

SEQ ID NO: 1958449 - RNA, 21 nt, Homo sapiens
uggucccaacaggaggacaau

SEQ ID NO: 1958450 - RNA, 21 nt, Homo sapiens
uacuguauguuuuuacugaau

SEQ ID NO: 1958451 - RNA, 18 nt, Homo sapiens
uaaaccacuaguugaugu

SEQ ID NO: 1958452 - RNA, 20 nt, Homo sapiens
ccagccuggggaacagagca

SEQ ID NO: 1958453 - RNA, 19 nt, Homo sapiens
ucuggcuggaacacuuuca

SEQ ID NO: 1958454 - RNA, 17 nt, Homo sapiens
caucuggaccugguaca

SEQ ID NO: 1958455 - RNA, 12 nt, Homo sapiens
cagggaugagcc

SEQ ID NO: 1958456 - RNA, 16 nt, Homo sapiens
uugcacgcccaugugu

SEQ ID NO: 1958457 - RNA, 15 nt, Homo sapiens
acauacgugugcaug

SEQ ID NO: 1958458 - RNA, 20 nt, Homo sapiens
auaggacucaaaguuucaga

SEQ ID NO: 1958459 - RNA, 20 nt, Homo sapiens
caguaauguauucuaucucu

SEQ ID NO: 1958460 - RNA, 15 nt, Homo sapiens
auugauaaguucaua

SEQ ID NO: 1958461 - RNA, 21 nt, Homo sapiens
uauaaaugugauugcagcuuu

SEQ ID NO: 1958462 - RNA, 23 nt, Homo sapiens
acucucuaccagauaacugagga

SEQ ID NO: 1958463 - RNA, 18 nt, Homo sapiens
uuaucaucaaaugcauuu

SEQ ID NO: 1958464 - RNA, 16 nt, Homo sapiens
guccagguugaucuug

SEQ ID NO: 1958465 - RNA, 19 nt, Homo sapiens
agcaaagauuaaauguguc

SEQ ID NO: 1958466 - RNA, 18 nt, Homo sapiens
guuucgaguaaacuugaa

SEQ ID NO: 1958467 - RNA, 22 nt, Homo sapiens
auuuuuauaaaaaugagugcuu

SEQ ID NO: 1958468 - RNA, 20 nt, Homo sapiens
ggaccugcuuugagauuucc

SEQ ID NO: 1958469 - RNA, 18 nt, Homo sapiens
cuucugagccucuuuaac

SEQ ID NO: 1958470 - RNA, 19 nt, Homo sapiens
uuuucaauguacuguauug

SEQ ID NO: 1958471 - RNA, 22 nt, Homo sapiens
gggcaacacggugaaaccccau

SEQ ID NO: 1958472 - RNA, 20 nt, Homo sapiens
ggaagccaccucaccaagga

SEQ ID NO: 1958473 - RNA, 12 nt, Homo sapiens
gcugagccaugg

SEQ ID NO: 1958474 - RNA, 16 nt, Homo sapiens
agucuucacuaaccuu

SEQ ID NO: 1958475 - RNA, 20 nt, Homo sapiens
aacaucuauuauaaaaccau

SEQ ID NO: 1958476 - RNA, 19 nt, Homo sapiens
ugccugaggacuaugccau

SEQ ID NO: 1958477 - RNA, 20 nt, Homo sapiens
uucccuaucuucucccccac

SEQ ID NO: 1958478 - RNA, 18 nt, Homo sapiens
uagugaaaggucaucuca

SEQ ID NO: 1958479 - RNA, 21 nt, Homo sapiens
cccccaaacagcaugugcuca

SEQ ID NO: 1958480 - RNA, 18 nt, Homo sapiens
uaaaagcaacaucagcuu

SEQ ID NO: 1958481 - RNA, 17 nt, Homo sapiens
uaacguucugcugcuug

SEQ ID NO: 1958482 - RNA, 22 nt, Homo sapiens
uggaauaacuaucucacuucca

SEQ ID NO: 1958483 - RNA, 16 nt, Homo sapiens
aauacagcacuuugac

SEQ ID NO: 1958484 - RNA, 12 nt, Homo sapiens
uguucauugcca

SEQ ID NO: 1958485 - RNA, 20 nt, Homo sapiens
acucgguauuaauccaaagc

SEQ ID NO: 1958486 - RNA, 19 nt, Homo sapiens
ugagacagugcacaugaac

SEQ ID NO: 1958487 - RNA, 22 nt, Homo sapiens
agcucuggccccaggcuuguca

SEQ ID NO: 1958488 - RNA, 16 nt, Homo sapiens
gaacaaaaccccagaa

SEQ ID NO: 1958489 - RNA, 18 nt, Homo sapiens
guccuucuuguccacggu

SEQ ID NO: 1958490 - RNA, 15 nt, Homo sapiens
uuuauacaauguucu

SEQ ID NO: 1958491 - RNA, 21 nt, Homo sapiens
ccaacugcaagucacaaagga

SEQ ID NO: 1958492 - RNA, 13 nt, Homo sapiens
cuauaguucuaga

SEQ ID NO: 1958493 - RNA, 23 nt, Homo sapiens
gacuucuugguacccagucaccu

SEQ ID NO: 1958494 - RNA, 16 nt, Homo sapiens
cuaaggagccuggaaa

SEQ ID NO: 1958495 - RNA, 19 nt, Homo sapiens
aaaugaguucaacuuugag

SEQ ID NO: 1958496 - RNA, 21 nt, Homo sapiens
gcagacaucggccuccaugac

SEQ ID NO: 1958497 - RNA, 16 nt, Homo sapiens
cuaaaggugcacugcu

SEQ ID NO: 1958498 - RNA, 20 nt, Homo sapiens
ccugggugacagagcaagac

SEQ ID NO: 1958499 - RNA, 22 nt, Homo sapiens
ucacuccaaaccuuacucugag

SEQ ID NO: 1958500 - RNA, 16 nt, Homo sapiens
auaguugcuucuuucc

SEQ ID NO: 1958501 - RNA, 20 nt, Homo sapiens
uguaaauaccagacugcagg

SEQ ID NO: 1958502 - RNA, 20 nt, Homo sapiens
aucuaaggaugucacagggc

SEQ ID NO: 1958503 - RNA, 11 nt, Homo sapiens
uucacaguauc

SEQ ID NO: 1958504 - RNA, 18 nt, Homo sapiens
uuaagcauuuugaaacaa

SEQ ID NO: 1958505 - RNA, 15 nt, Homo sapiens
gaugucucacauccu

SEQ ID NO: 1958506 - RNA, 15 nt, Homo sapiens
uacuuuaugagcagc

SEQ ID NO: 1958507 - RNA, 15 nt, Homo sapiens
cccugccaugucaca

SEQ ID NO: 1958508 - RNA, 21 nt, Homo sapiens
cuaauucccauuuugcaaaau

SEQ ID NO: 1958509 - RNA, 17 nt, Homo sapiens
ugauggaugaugaaccu

SEQ ID NO: 1958510 - RNA, 16 nt, Homo sapiens
uacagcaacaauuuau

SEQ ID NO: 1958511 - RNA, 16 nt, Homo sapiens
gcaguuacaaauuaua

SEQ ID NO: 1958512 - RNA, 17 nt, Homo sapiens
ggcagccccccccucaa

SEQ ID NO: 1958513 - RNA, 14 nt, Homo sapiens
agcuuacucucugc

SEQ ID NO: 1958514 - RNA, 13 nt, Homo sapiens
gccaguacaguau

SEQ ID NO: 1958515 - RNA, 13 nt, Homo sapiens
cucccccugugug

SEQ ID NO: 1958516 - RNA, 21 nt, Homo sapiens
uaaaaauauaaacaauguuca

SEQ ID NO: 1958517 - RNA, 14 nt, Homo sapiens
acaagaaucacuug

SEQ ID NO: 1958518 - RNA, 12 nt, Homo sapiens
cagaagggauaa

SEQ ID NO: 1958519 - RNA, 15 nt, Homo sapiens
ccuggggguggcagg

SEQ ID NO: 1958520 - RNA, 23 nt, Homo sapiens
auacugggauuacaggcuugagc

SEQ ID NO: 1958521 - RNA, 20 nt, Homo sapiens
ggcaacucacgggugcauga

SEQ ID NO: 1958522 - RNA, 20 nt, Homo sapiens
cugagugaguguuuggccga

SEQ ID NO: 1958523 - RNA, 22 nt, Homo sapiens
uagcuguaaaacgcugucaaaa

SEQ ID NO: 1958524 - RNA, 19 nt, Homo sapiens
ucucugagcccgugucaca

SEQ ID NO: 1958525 - RNA, 19 nt, Homo sapiens
agaaauauuuucagcaaaa

SEQ ID NO: 1958526 - RNA, 15 nt, Homo sapiens
gcucuccauucaauu

SEQ ID NO: 1958527 - RNA, 19 nt, Homo sapiens
ugguuuuuuuuugagacag

SEQ ID NO: 1958528 - RNA, 20 nt, Homo sapiens
cugucaugcuucaucauucc

SEQ ID NO: 1958529 - RNA, 22 nt, Homo sapiens
ucugccugaaggcucacaccuc

SEQ ID NO: 1958530 - RNA, 21 nt, Homo sapiens
cauucuccugccucagccucc

SEQ ID NO: 1958531 - RNA, 18 nt, Homo sapiens
gaauuuauaacccaguga

SEQ ID NO: 1958532 - RNA, 18 nt, Homo sapiens
ccuaagugcaacugcaag

SEQ ID NO: 1958533 - RNA, 15 nt, Homo sapiens
gccagcgcgaugaac

SEQ ID NO: 1958534 - RNA, 14 nt, Homo sapiens
gggcccccaaagag

SEQ ID NO: 1958535 - RNA, 14 nt, Homo sapiens
uuuuaaauccuaaa

SEQ ID NO: 1958536 - RNA, 19 nt, Homo sapiens
uuacagcacacacuuccau

SEQ ID NO: 1958537 - RNA, 13 nt, Homo sapiens
uagacucccaugg

SEQ ID NO: 1958538 - RNA, 15 nt, Homo sapiens
agaaggcaugagaaa

SEQ ID NO: 1958539 - RNA, 20 nt, Homo sapiens
uaaugaaaaugaauaucuau

SEQ ID NO: 1958540 - RNA, 23 nt, Homo sapiens
agcaauccuccugagugauccca

SEQ ID NO: 1958541 - RNA, 20 nt, Homo sapiens
aaaaauguucuauauucuca

SEQ ID NO: 1958542 - RNA, 22 nt, Homo sapiens
acaucucugcuuucacucuuua

SEQ ID NO: 1958543 - RNA, 14 nt, Homo sapiens
cuuucaguuugucc

SEQ ID NO: 1958544 - RNA, 17 nt, Homo sapiens
gaccaaccgccugcagg

SEQ ID NO: 1958545 - RNA, 16 nt, Homo sapiens
gaaugauuuuggugga

SEQ ID NO: 1958546 - RNA, 17 nt, Homo sapiens
uccuccagagacacuga

SEQ ID NO: 1958547 - RNA, 13 nt, Homo sapiens
ccauguccaaaga

SEQ ID NO: 1958548 - RNA, 21 nt, Homo sapiens
caccaacccagagaaccugcu

SEQ ID NO: 1958549 - RNA, 19 nt, Homo sapiens
ugcacacacagaugcacac

SEQ ID NO: 1958550 - RNA, 14 nt, Homo sapiens
uugguucucuccac

SEQ ID NO: 1958551 - RNA, 20 nt, Homo sapiens
acuuugaaaguuaacucuuc

SEQ ID NO: 1958552 - RNA, 17 nt, Homo sapiens
uuucauauguugcucag

SEQ ID NO: 1958553 - RNA, 14 nt, Homo sapiens
gugcuaugaagcuu

SEQ ID NO: 1958554 - RNA, 17 nt, Homo sapiens
cauacuucuguuuccau

SEQ ID NO: 1958555 - RNA, 15 nt, Homo sapiens
aaaaguccugucacc

SEQ ID NO: 1958556 - RNA, 18 nt, Homo sapiens
ggacuguucccugaggug

SEQ ID NO: 1958557 - RNA, 15 nt, Homo sapiens
uugucaccagcaaca

SEQ ID NO: 1958558 - RNA, 12 nt, Homo sapiens
uguaucugaggg

SEQ ID NO: 1958559 - RNA, 13 nt, Homo sapiens
aauguaugugcac

SEQ ID NO: 1958560 - RNA, 20 nt, Homo sapiens
ucuggacaaagacuaccuga

SEQ ID NO: 1958561 - RNA, 20 nt, Homo sapiens
ucaaacacggacccauagac

SEQ ID NO: 1958562 - RNA, 18 nt, Homo sapiens
gaucuuuugcuaaugcaa

SEQ ID NO: 1958563 - RNA, 16 nt, Homo sapiens
ccaccaggccagcuca

SEQ ID NO: 1958564 - RNA, 20 nt, Homo sapiens
gcucuacaggugcaacaggu

SEQ ID NO: 1958565 - RNA, 17 nt, Homo sapiens
gucagacauaaagccau

SEQ ID NO: 1958566 - RNA, 14 nt, Homo sapiens
aauuauuacagugu

SEQ ID NO: 1958567 - RNA, 14 nt, Homo sapiens
auuuguuacuguau

SEQ ID NO: 1958568 - RNA, 17 nt, Homo sapiens
accaggccugagcaaca

SEQ ID NO: 1958569 - RNA, 18 nt, Homo sapiens
acgacaagugcugaacag

SEQ ID NO: 1958570 - RNA, 22 nt, Homo sapiens
gcagcuugaauuucaaauaucc

SEQ ID NO: 1958571 - RNA, 13 nt, Homo sapiens
gaggaugccuagg

SEQ ID NO: 1958572 - RNA, 19 nt, Homo sapiens
uacuaguuuuccuugaaaa

SEQ ID NO: 1958573 - RNA, 19 nt, Homo sapiens
agcaacauggcagagcagu

SEQ ID NO: 1958574 - RNA, 23 nt, Homo sapiens
gacauacaccuaugucauuucau

SEQ ID NO: 1958575 - RNA, 17 nt, Homo sapiens
ccacacuguacucugca

SEQ ID NO: 1958576 - RNA, 23 nt, Homo sapiens
gccuagugugccaagaaugccca

SEQ ID NO: 1958577 - RNA, 13 nt, Homo sapiens
agccagucucaga

SEQ ID NO: 1958578 - RNA, 13 nt, Homo sapiens
uauaaaugucuag

SEQ ID NO: 1958579 - RNA, 17 nt, Homo sapiens
guguguauuuguauuaa

SEQ ID NO: 1958580 - RNA, 13 nt, Homo sapiens
gugcaguacuuaa

SEQ ID NO: 1958581 - RNA, 17 nt, Homo sapiens
auauuaugaaauuucac

SEQ ID NO: 1958582 - RNA, 14 nt, Homo sapiens
uggccgucgcugug

SEQ ID NO: 1958583 - RNA, 17 nt, Homo sapiens
caucucugaacauuucu

SEQ ID NO: 1958584 - RNA, 20 nt, Homo sapiens
agugacuuuagaaacaaauu

SEQ ID NO: 1958585 - RNA, 19 nt, Homo sapiens
aaaacuugaucacaugcuu

SEQ ID NO: 1958586 - RNA, 23 nt, Homo sapiens
aagauucaaugccccugaauuua

SEQ ID NO: 1958587 - RNA, 14 nt, Homo sapiens
ccuaccacaguguc

SEQ ID NO: 1958588 - RNA, 20 nt, Homo sapiens
caaaugcauacaaguuucau

SEQ ID NO: 1958589 - RNA, 23 nt, Homo sapiens
aaaauuuuggucauagcauucac

SEQ ID NO: 1958590 - RNA, 11 nt, Homo sapiens
aucaacaugac

SEQ ID NO: 1958591 - RNA, 11 nt, Homo sapiens
aaaaacaugua

SEQ ID NO: 1958592 - RNA, 20 nt, Homo sapiens
cuccuugaauaucuuucgau

SEQ ID NO: 1958593 - RNA, 22 nt, Homo sapiens
uggagaaguggcaucagucaac

SEQ ID NO: 1958594 - RNA, 13 nt, Homo sapiens
aguacaacccaua

SEQ ID NO: 1958595 - RNA, 15 nt, Homo sapiens
guguguguguguaau

SEQ ID NO: 1958596 - RNA, 15 nt, Homo sapiens
ucuagauuucuaaug

SEQ ID NO: 1958597 - RNA, 15 nt, Homo sapiens
acuuauguacuugau

SEQ ID NO: 1958598 - RNA, 16 nt, Homo sapiens
agacugguuagugaug

SEQ ID NO: 1958599 - RNA, 19 nt, Homo sapiens
ccagccccuucaauuauuu

SEQ ID NO: 1958600 - RNA, 19 nt, Homo sapiens
acgcagucugcuucagugc

SEQ ID NO: 1958601 - RNA, 16 nt, Homo sapiens
ugggcugugggcugca

SEQ ID NO: 1958602 - RNA, 23 nt, Homo sapiens
uacaugaugcuaaaggcugcgaa

SEQ ID NO: 1958603 - RNA, 21 nt, Homo sapiens
gccaggcccugggucuugcca

SEQ ID NO: 1958604 - RNA, 21 nt, Homo sapiens
caacacaauucuucuuccaac

SEQ ID NO: 1958605 - RNA, 15 nt, Homo sapiens
aaugcugcauucuaa

SEQ ID NO: 1958606 - RNA, 20 nt, Homo sapiens
uauuauguaguccguuaaca

SEQ ID NO: 1958607 - RNA, 16 nt, Homo sapiens
cagauuggaauaggaa

SEQ ID NO: 1958608 - RNA, 17 nt, Homo sapiens
aucguucucugccucac

SEQ ID NO: 1958609 - RNA, 18 nt, Homo sapiens
ggacaaaauuuguacuau

SEQ ID NO: 1958610 - RNA, 20 nt, Homo sapiens
acucuuaaguguaaauaaua

SEQ ID NO: 1958611 - RNA, 16 nt, Homo sapiens
guguugucagcacugu

SEQ ID NO: 1958612 - RNA, 12 nt, Homo sapiens
auguugauacua

SEQ ID NO: 1958613 - RNA, 22 nt, Homo sapiens
uuucaaggaaaagaauucucag

SEQ ID NO: 1958614 - RNA, 12 nt, Homo sapiens
gagccugugcag

SEQ ID NO: 1958615 - RNA, 20 nt, Homo sapiens
cagaaaaaacugagauguag

SEQ ID NO: 1958616 - RNA, 22 nt, Homo sapiens
ucuccccccaacacaaucuuuc

SEQ ID NO: 1958617 - RNA, 16 nt, Homo sapiens
uacuaucacacaugaa

SEQ ID NO: 1958618 - RNA, 22 nt, Homo sapiens
aagcugcuggagcccgcacugu

SEQ ID NO: 1958619 - RNA, 14 nt, Homo sapiens
accccacauaugca

SEQ ID NO: 1958620 - RNA, 22 nt, Homo sapiens
caagggaagugaccaaggugaa

SEQ ID NO: 1958621 - RNA, 18 nt, Homo sapiens
aaugaccgagcccuggag

SEQ ID NO: 1958622 - RNA, 18 nt, Homo sapiens
uaaagaauuuuaugucau

SEQ ID NO: 1958623 - RNA, 13 nt, Homo sapiens
agcccugcugcuu

SEQ ID NO: 1958624 - RNA, 13 nt, Homo sapiens
ucacuugcacauc

SEQ ID NO: 1958625 - RNA, 19 nt, Homo sapiens
aaugucaaacagugccaaa

SEQ ID NO: 1958626 - RNA, 14 nt, Homo sapiens
ugacagcaaacaca

SEQ ID NO: 1958627 - RNA, 14 nt, Homo sapiens
uuaaauguauacua

SEQ ID NO: 1958628 - RNA, 22 nt, Homo sapiens
accaagucuacuucacuaauga

SEQ ID NO: 1958629 - RNA, 22 nt, Homo sapiens
aaaccugggcaugguggcucac

SEQ ID NO: 1958630 - RNA, 17 nt, Homo sapiens
gcaaagaugaucaguau

SEQ ID NO: 1958631 - RNA, 16 nt, Homo sapiens
agcaaaaauucacaaa

SEQ ID NO: 1958632 - RNA, 23 nt, Homo sapiens
uaacuggggauauaauacuauau

SEQ ID NO: 1958633 - RNA, 14 nt, Homo sapiens
uaaacuaacuacug

SEQ ID NO: 1958634 - RNA, 19 nt, Homo sapiens
uucuggguggcuccugcca

SEQ ID NO: 1958635 - RNA, 22 nt, Homo sapiens
acaguacugauacauaauuuaa

SEQ ID NO: 1958636 - RNA, 16 nt, Homo sapiens
aggcucucaugucucu

SEQ ID NO: 1958637 - RNA, 16 nt, Homo sapiens
ccacacccaaugcugc

SEQ ID NO: 1958638 - RNA, 21 nt, Homo sapiens
uggacuggggagcacaggugu

SEQ ID NO: 1958639 - RNA, 18 nt, Homo sapiens
ucacaucagaacagacaa

SEQ ID NO: 1958640 - RNA, 12 nt, Homo sapiens
auugcauuguga

SEQ ID NO: 1958641 - RNA, 15 nt, Homo sapiens
uaugcaccaaaucau

SEQ ID NO: 1958642 - RNA, 20 nt, Homo sapiens
agaauggaacucaagcuggu

SEQ ID NO: 1958643 - RNA, 14 nt, Homo sapiens
uauuucacuugcca

SEQ ID NO: 1958644 - RNA, 19 nt, Homo sapiens
cagagucuuccucugucuc

SEQ ID NO: 1958645 - RNA, 23 nt, Homo sapiens
aggaaguuucuaguuuguguaac

SEQ ID NO: 1958646 - RNA, 15 nt, Homo sapiens
uggccagagccugug

SEQ ID NO: 1958647 - RNA, 20 nt, Homo sapiens
cauaguuauucuaucacugg

SEQ ID NO: 1958648 - RNA, 20 nt, Homo sapiens
gagauuagucucuucugugu

SEQ ID NO: 1958649 - RNA, 15 nt, Homo sapiens
caaugucaaugugaa

SEQ ID NO: 1958650 - RNA, 16 nt, Homo sapiens
aacaauggagauauca

SEQ ID NO: 1958651 - RNA, 22 nt, Homo sapiens
gagcugacccccaggaacagcu

SEQ ID NO: 1958652 - RNA, 20 nt, Homo sapiens
gaaaaauaaagaugugcuua

SEQ ID NO: 1958653 - RNA, 15 nt, Homo sapiens
ugucuggaagcugag

SEQ ID NO: 1958654 - RNA, 21 nt, Homo sapiens
agaggguggagaugucagucu

SEQ ID NO: 1958655 - RNA, 17 nt, Homo sapiens
acgcuguccugagauga

SEQ ID NO: 1958656 - RNA, 23 nt, Homo sapiens
cuuuuaaagaaauauaaacacaa

SEQ ID NO: 1958657 - RNA, 20 nt, Homo sapiens
ugcuccagauuagagccugu

SEQ ID NO: 1958658 - RNA, 16 nt, Homo sapiens
gaggccaccucuccaa

SEQ ID NO: 1958659 - RNA, 19 nt, Homo sapiens
cugcagaccucacugucag

SEQ ID NO: 1958660 - RNA, 10 nt, Homo sapiens
gucaaaaagu

SEQ ID NO: 1958661 - RNA, 15 nt, Homo sapiens
uuccccuugucccug

SEQ ID NO: 1958662 - RNA, 13 nt, Homo sapiens
agaccccagguca

SEQ ID NO: 1958663 - RNA, 14 nt, Homo sapiens
aaccuaauaaauau

SEQ ID NO: 1958664 - RNA, 18 nt, Homo sapiens
ccccagguuccauaccau

SEQ ID NO: 1958665 - RNA, 22 nt, Homo sapiens
aacccagggcucugccccaguc

SEQ ID NO: 1958666 - RNA, 18 nt, Homo sapiens
auaacuuuucaccaauga

SEQ ID NO: 1958667 - RNA, 23 nt, Homo sapiens
gucagaucuauuguuuguugcac

SEQ ID NO: 1958668 - RNA, 19 nt, Homo sapiens
aaccuacuuucauacugaa

SEQ ID NO: 1958669 - RNA, 12 nt, Homo sapiens
uucauugcaaac

SEQ ID NO: 1958670 - RNA, 20 nt, Homo sapiens
gcuuuagaaacagugcaaca

SEQ ID NO: 1958671 - RNA, 18 nt, Homo sapiens
guccuaaauccaaugaca

SEQ ID NO: 1958672 - RNA, 21 nt, Homo sapiens
auguuauucuuccuucccaac

SEQ ID NO: 1958673 - RNA, 15 nt, Homo sapiens
uucuggggacugcau

SEQ ID NO: 1958674 - RNA, 17 nt, Homo sapiens
uucuucuacucuugaga

SEQ ID NO: 1958675 - RNA, 16 nt, Homo sapiens
cucaguucuuccucca

SEQ ID NO: 1958676 - RNA, 12 nt, Homo sapiens
ggccucugucaa

SEQ ID NO: 1958677 - RNA, 16 nt, Homo sapiens
ugcuccccagugcuac

SEQ ID NO: 1958678 - RNA, 16 nt, Homo sapiens
aacuuuaucuaaagaa

SEQ ID NO: 1958679 - RNA, 13 nt, Homo sapiens
uggugacugggaa

SEQ ID NO: 1958680 - RNA, 14 nt, Homo sapiens
aaggugcuacuuga

SEQ ID NO: 1958681 - RNA, 21 nt, Homo sapiens
gugucaccaugagcaccucca

SEQ ID NO: 1958682 - RNA, 16 nt, Homo sapiens
aagccuuggauguaua

SEQ ID NO: 1958683 - RNA, 22 nt, Homo sapiens
ggaguaaagagcauauucacug

SEQ ID NO: 1958684 - RNA, 18 nt, Homo sapiens
auccaauccucacugggu

SEQ ID NO: 1958685 - RNA, 15 nt, Homo sapiens
uguacagagugcuuu

SEQ ID NO: 1958686 - RNA, 20 nt, Homo sapiens
auugcccccagggcacuuca

SEQ ID NO: 1958687 - RNA, 21 nt, Homo sapiens
cauagcuccuucucucuuaca

SEQ ID NO: 1958688 - RNA, 15 nt, Homo sapiens
uaagcuaugaaaaau

SEQ ID NO: 1958689 - RNA, 16 nt, Homo sapiens
uacuauucaaaaccuc

SEQ ID NO: 1958690 - RNA, 20 nt, Homo sapiens
cacagcaggcuuucaagaag

SEQ ID NO: 1958691 - RNA, 14 nt, Homo sapiens
uuguguuucuguuc

SEQ ID NO: 1958692 - RNA, 17 nt, Homo sapiens
ugacuaucacauacaau

SEQ ID NO: 1958693 - RNA, 17 nt, Homo sapiens
accacuucgaaaccugg

SEQ ID NO: 1958694 - RNA, 21 nt, Homo sapiens
aaugaaguaacuugucuuaaa

SEQ ID NO: 1958695 - RNA, 19 nt, Homo sapiens
ugaaacuucauaaauguuc

SEQ ID NO: 1958696 - RNA, 22 nt, Homo sapiens
cccaacucuccuggccuggcca

SEQ ID NO: 1958697 - RNA, 16 nt, Homo sapiens
gcagucuguccaggcu

SEQ ID NO: 1958698 - RNA, 20 nt, Homo sapiens
aagcaggggucguaccuugc

SEQ ID NO: 1958699 - RNA, 21 nt, Homo sapiens
gcccugggugcaggacacugg

SEQ ID NO: 1958700 - RNA, 15 nt, Homo sapiens
aagugacuauagaau

SEQ ID NO: 1958701 - RNA, 15 nt, Homo sapiens
cuucaaagcugaaua

SEQ ID NO: 1958702 - RNA, 17 nt, Homo sapiens
aacauccggaacagcca

SEQ ID NO: 1958703 - RNA, 14 nt, Homo sapiens
cagaacacacucca

SEQ ID NO: 1958704 - RNA, 23 nt, Homo sapiens
acuagcuaaaccagaaaggugau

SEQ ID NO: 1958705 - RNA, 17 nt, Homo sapiens
uagcugcaaaggacaga

SEQ ID NO: 1958706 - RNA, 15 nt, Homo sapiens
uggcugcuagcacuu

SEQ ID NO: 1958707 - RNA, 22 nt, Homo sapiens
uagaguuuuuauuaauuacuua

SEQ ID NO: 1958708 - RNA, 17 nt, Homo sapiens
cuagaaccucucguagu

SEQ ID NO: 1958709 - RNA, 18 nt, Homo sapiens
auuaaagucuacacugcc

SEQ ID NO: 1958710 - RNA, 18 nt, Homo sapiens
uuuccugagccauuauca

SEQ ID NO: 1958711 - RNA, 18 nt, Homo sapiens
gaaugauaguguaucuca

SEQ ID NO: 1958712 - RNA, 21 nt, Homo sapiens
ggacaugagaucagggccugc

SEQ ID NO: 1958713 - RNA, 18 nt, Homo sapiens
cauuucugaggugcacug

SEQ ID NO: 1958714 - RNA, 18 nt, Homo sapiens
aaguuucaggauacaugu

SEQ ID NO: 1958715 - RNA, 22 nt, Homo sapiens
agaauuagaaacaacauagcaa

SEQ ID NO: 1958716 - RNA, 12 nt, Homo sapiens
ggcaagugauau

SEQ ID NO: 1958717 - RNA, 22 nt, Homo sapiens
cacaggcagcuggaugagacuu

SEQ ID NO: 1958718 - RNA, 18 nt, Homo sapiens
ucagauggacaagauuac

SEQ ID NO: 1958719 - RNA, 15 nt, Homo sapiens
acuccucaacuggga

SEQ ID NO: 1958720 - RNA, 22 nt, Homo sapiens
gauguuuguacuuuuguguuac

SEQ ID NO: 1958721 - RNA, 23 nt, Homo sapiens
ugcauaccaaguugauacuugaa

SEQ ID NO: 1958722 - RNA, 14 nt, Homo sapiens
ugacacccaugcca

SEQ ID NO: 1958723 - RNA, 13 nt, Homo sapiens
caagcgacaggaa

SEQ ID NO: 1958724 - RNA, 16 nt, Homo sapiens
gcacugcugugcugug

SEQ ID NO: 1958725 - RNA, 16 nt, Homo sapiens
cucccauguaccagca

SEQ ID NO: 1958726 - RNA, 18 nt, Homo sapiens
guagcuagaugccacugc

SEQ ID NO: 1958727 - RNA, 21 nt, Homo sapiens
uugaaaaacuuuuagguuguu

SEQ ID NO: 1958728 - RNA, 19 nt, Homo sapiens
uaacuacuuuuuauacucc

SEQ ID NO: 1958729 - RNA, 13 nt, Homo sapiens
ccucugauuucac

SEQ ID NO: 1958730 - RNA, 17 nt, Homo sapiens
gggaggauugaaaggga

SEQ ID NO: 1958731 - RNA, 15 nt, Homo sapiens
uucuccuuuuugccc

SEQ ID NO: 1958732 - RNA, 15 nt, Homo sapiens
aguggcuuagcugcc

SEQ ID NO: 1958733 - RNA, 22 nt, Homo sapiens
gacuaaagauugcagcauuuau

SEQ ID NO: 1958734 - RNA, 21 nt, Homo sapiens
uuacuauaagaacuuugagcu

SEQ ID NO: 1958735 - RNA, 20 nt, Homo sapiens
uagagauauucuuauuucac

SEQ ID NO: 1958736 - RNA, 15 nt, Homo sapiens
uucuaguucugccag

SEQ ID NO: 1958737 - RNA, 19 nt, Homo sapiens
ugaaauuaguuuaccucau

SEQ ID NO: 1958738 - RNA, 20 nt, Homo sapiens
ugcuuuaauuguguggugcu

SEQ ID NO: 1958739 - RNA, 18 nt, Homo sapiens
cauaaugaguuccugaga

SEQ ID NO: 1958740 - RNA, 13 nt, Homo sapiens
auacacacauaua

SEQ ID NO: 1958741 - RNA, 13 nt, Homo sapiens
auauacacauaca

SEQ ID NO: 1958742 - RNA, 23 nt, Homo sapiens
uuaugcauguaauggacuaugca

SEQ ID NO: 1958743 - RNA, 12 nt, Homo sapiens
augucaccucag

SEQ ID NO: 1958744 - RNA, 16 nt, Homo sapiens
acugcagcaccuccag

SEQ ID NO: 1958745 - RNA, 10 nt, Homo sapiens
uagcagagua

SEQ ID NO: 1958746 - RNA, 20 nt, Homo sapiens
auuugagagaagccacgcug

SEQ ID NO: 1958747 - RNA, 17 nt, Homo sapiens
gaucuguuuuacaggaa

SEQ ID NO: 1958748 - RNA, 21 nt, Homo sapiens
aggucuugcaguggcuuuuca

SEQ ID NO: 1958749 - RNA, 15 nt, Homo sapiens
guggauagcauuguu

SEQ ID NO: 1958750 - RNA, 21 nt, Homo sapiens
ccuaugauuguaaaguagcug

SEQ ID NO: 1958751 - RNA, 17 nt, Homo sapiens
cugugcaguaagccugu

SEQ ID NO: 1958752 - RNA, 20 nt, Homo sapiens
uuuuugccuucauuaccuuu

SEQ ID NO: 1958753 - RNA, 18 nt, Homo sapiens
acugaccggugcuuuuau

SEQ ID NO: 1958754 - RNA, 18 nt, Homo sapiens
gugccgugugagugugac

SEQ ID NO: 1958755 - RNA, 13 nt, Homo sapiens
uaaaaaguucaua

SEQ ID NO: 1958756 - RNA, 19 nt, Homo sapiens
gacguucauuauguaugaa

SEQ ID NO: 1958757 - RNA, 16 nt, Homo sapiens
uuuucaaguaccuaua

SEQ ID NO: 1958758 - RNA, 21 nt, Homo sapiens
agacugaugccagacaaaccu

SEQ ID NO: 1958759 - RNA, 15 nt, Homo sapiens
gugacagugaggucc

SEQ ID NO: 1958760 - RNA, 22 nt, Homo sapiens
aauuguuuauacacaacuuugc

SEQ ID NO: 1958761 - RNA, 16 nt, Homo sapiens
uguaauacacagugag

SEQ ID NO: 1958762 - RNA, 19 nt, Homo sapiens
cuggcuacuccauguuggc

SEQ ID NO: 1958763 - RNA, 16 nt, Homo sapiens
cauggauguguugccc

SEQ ID NO: 1958764 - RNA, 19 nt, Homo sapiens
agggcuggagggacaggga

SEQ ID NO: 1958765 - RNA, 12 nt, Homo sapiens
ugcuucugccac

SEQ ID NO: 1958766 - RNA, 22 nt, Homo sapiens
ugaauacacaacuccacugucu

SEQ ID NO: 1958767 - RNA, 22 nt, Homo sapiens
acaacuuuugagaguauagcau

SEQ ID NO: 1958768 - RNA, 17 nt, Homo sapiens
auucucagugcucuccu

SEQ ID NO: 1958769 - RNA, 21 nt, Homo sapiens
gagaaacaaauaauuuguaua

SEQ ID NO: 1958770 - RNA, 20 nt, Homo sapiens
accuucuucuccuacauauc

SEQ ID NO: 1958771 - RNA, 14 nt, Homo sapiens
aacuauauucucag

SEQ ID NO: 1958772 - RNA, 14 nt, Homo sapiens
cgguggccacagcg

SEQ ID NO: 1958773 - RNA, 17 nt, Homo sapiens
ugacccucccagucuca

SEQ ID NO: 1958774 - RNA, 12 nt, Homo sapiens
accaauauuugu

SEQ ID NO: 1958775 - RNA, 16 nt, Homo sapiens
ccuccccguccaggcc

SEQ ID NO: 1958776 - RNA, 18 nt, Homo sapiens
agcacuguuuucaucaca

SEQ ID NO: 1958777 - RNA, 19 nt, Homo sapiens
gccacagucaugguggcca

SEQ ID NO: 1958778 - RNA, 13 nt, Homo sapiens
acugccaacuuuu

SEQ ID NO: 1958779 - RNA, 20 nt, Homo sapiens
gcucugagcaguuguuauau

SEQ ID NO: 1958780 - RNA, 15 nt, Homo sapiens
cuuccugugauccac

SEQ ID NO: 1958781 - RNA, 19 nt, Homo sapiens
uaugaguauaauacauuac

SEQ ID NO: 1958782 - RNA, 16 nt, Homo sapiens
augaguaguguggaau

SEQ ID NO: 1958783 - RNA, 18 nt, Homo sapiens
cagggcccuccaccgcca

SEQ ID NO: 1958784 - RNA, 22 nt, Homo sapiens
cucagugcaucuaaucacuuag

SEQ ID NO: 1958785 - RNA, 17 nt, Homo sapiens
auuccuaaaaugcuuca

SEQ ID NO: 1958786 - RNA, 23 nt, Homo sapiens
acaguuuauuuuuauacuuucag

SEQ ID NO: 1958787 - RNA, 19 nt, Homo sapiens
aucugucugcucugcauau

SEQ ID NO: 1958788 - RNA, 22 nt, Homo sapiens
uuacauuauuaaauguuucuca

SEQ ID NO: 1958789 - RNA, 22 nt, Homo sapiens
aucuguaugggucauucucacc

SEQ ID NO: 1958790 - RNA, 15 nt, Homo sapiens
uuguuguucauuauu

SEQ ID NO: 1958791 - RNA, 13 nt, Homo sapiens
acaguaaaucuca

SEQ ID NO: 1958792 - RNA, 13 nt, Homo sapiens
ucuguaaaacaca

SEQ ID NO: 1958793 - RNA, 14 nt, Homo sapiens
aggugaagcacaua

SEQ ID NO: 1958794 - RNA, 15 nt, Homo sapiens
uaacaucaacaggac

SEQ ID NO: 1958795 - RNA, 19 nt, Homo sapiens
uaguaacacauaaaguaaa

SEQ ID NO: 1958796 - RNA, 23 nt, Homo sapiens
cgaagccuuaacuuuaaaugaca

SEQ ID NO: 1958797 - RNA, 13 nt, Homo sapiens
aaggcuucuugcu

SEQ ID NO: 1958798 - RNA, 13 nt, Homo sapiens
uauccuucauugu

SEQ ID NO: 1958799 - RNA, 18 nt, Homo sapiens
gaauguuguguaacaguu

SEQ ID NO: 1958800 - RNA, 17 nt, Homo sapiens
cagaggcucuaauguac

SEQ ID NO: 1958801 - RNA, 11 nt, Homo sapiens
acagagccaug

SEQ ID NO: 1958802 - RNA, 15 nt, Homo sapiens
guagcauaacuguag

SEQ ID NO: 1958803 - RNA, 21 nt, Homo sapiens
uuuccacucccacugccagga

SEQ ID NO: 1958804 - RNA, 19 nt, Homo sapiens
uuugagcugagugcugaaa

SEQ ID NO: 1958805 - RNA, 12 nt, Homo sapiens
aagauacaauaa

SEQ ID NO: 1958806 - RNA, 22 nt, Homo sapiens
ugaaacuguguacgacaaagca

SEQ ID NO: 1958807 - RNA, 15 nt, Homo sapiens
ucauuuaucccucaa

SEQ ID NO: 1958808 - RNA, 14 nt, Homo sapiens
gcaagacccaucuc

SEQ ID NO: 1958809 - RNA, 12 nt, Homo sapiens
guuggucuugaa

SEQ ID NO: 1958810 - RNA, 16 nt, Homo sapiens
ucacuacagccucgaa

SEQ ID NO: 1958811 - RNA, 23 nt, Homo sapiens
ugcuauaggcuggagaagcucac

SEQ ID NO: 1958812 - RNA, 17 nt, Homo sapiens
ggcuccgucaguaucag

SEQ ID NO: 1958813 - RNA, 18 nt, Homo sapiens
ccagaucgauccuggauu

SEQ ID NO: 1958814 - RNA, 14 nt, Homo sapiens
acacuaacucacca

SEQ ID NO: 1958815 - RNA, 19 nt, Homo sapiens
gccacaauaagccacuggu

SEQ ID NO: 1958816 - RNA, 22 nt, Homo sapiens
ugcuaagcgggcccggguccca

SEQ ID NO: 1958817 - RNA, 14 nt, Homo sapiens
acagucuugcauuc

SEQ ID NO: 1958818 - RNA, 23 nt, Homo sapiens
gaguuccacuucaacaaguaccu

SEQ ID NO: 1958819 - RNA, 20 nt, Homo sapiens
cuaguucagacacuuuggaa

SEQ ID NO: 1958820 - RNA, 19 nt, Homo sapiens
augucgcuggguccucugc

SEQ ID NO: 1958821 - RNA, 15 nt, Homo sapiens
cuacaacagccugaa

SEQ ID NO: 1958822 - RNA, 17 nt, Homo sapiens
aacuccaagacagccau

SEQ ID NO: 1958823 - RNA, 16 nt, Homo sapiens
aagaugugucuucaau

SEQ ID NO: 1958824 - RNA, 12 nt, Homo sapiens
acugcaaccucc

SEQ ID NO: 1958825 - RNA, 13 nt, Homo sapiens
cagcuggugcugc

SEQ ID NO: 1958826 - RNA, 21 nt, Homo sapiens
ucacaaagugagaaauuauga

SEQ ID NO: 1958827 - RNA, 22 nt, Homo sapiens
ggaccaauuagcauuccaucaa

SEQ ID NO: 1958828 - RNA, 20 nt, Homo sapiens
ccaauuaaaaacgaaaaccu

SEQ ID NO: 1958829 - RNA, 20 nt, Homo sapiens
gaccguuugcuauauuccuu

SEQ ID NO: 1958830 - RNA, 19 nt, Homo sapiens
acgaugacugacacucaga

SEQ ID NO: 1958831 - RNA, 20 nt, Homo sapiens
uacaggcaguuaggugcuga

SEQ ID NO: 1958832 - RNA, 12 nt, Homo sapiens
aaguuuacuuuu

SEQ ID NO: 1958833 - RNA, 14 nt, Homo sapiens
gcagcuaguacuca

SEQ ID NO: 1958834 - RNA, 15 nt, Homo sapiens
acuauagguccagaa

SEQ ID NO: 1958835 - RNA, 20 nt, Homo sapiens
aauugauugaacguucucaa

SEQ ID NO: 1958836 - RNA, 23 nt, Homo sapiens
uugccaaaaucaauacaauccuu

SEQ ID NO: 1958837 - RNA, 14 nt, Homo sapiens
gugauuuuggucuc

SEQ ID NO: 1958838 - RNA, 10 nt, Homo sapiens
agaauggauu

SEQ ID NO: 1958839 - RNA, 22 nt, Homo sapiens
accuuugaggucuaaacaaaua

SEQ ID NO: 1958840 - RNA, 15 nt, Homo sapiens
gacaagcagcuggug

SEQ ID NO: 1958841 - RNA, 20 nt, Homo sapiens
agggagcgaggucagaggag

SEQ ID NO: 1958842 - RNA, 15 nt, Homo sapiens
gagaaugucacugua

SEQ ID NO: 1958843 - RNA, 22 nt, Homo sapiens
auuccucccucgcucagaggga

SEQ ID NO: 1958844 - RNA, 16 nt, Homo sapiens
ugccccuggcucugac

SEQ ID NO: 1958845 - RNA, 23 nt, Homo sapiens
aaccagcuucugauaaacacaau

SEQ ID NO: 1958846 - RNA, 19 nt, Homo sapiens
cuugaaccagggagucaga

SEQ ID NO: 1958847 - RNA, 14 nt, Homo sapiens
caccaucuggaguu

SEQ ID NO: 1958848 - RNA, 16 nt, Homo sapiens
aagcuugucugaucgu

SEQ ID NO: 1958849 - RNA, 16 nt, Homo sapiens
agguacucugcacaua

SEQ ID NO: 1958850 - RNA, 16 nt, Homo sapiens
ggccucucucaaaaga

SEQ ID NO: 1958851 - RNA, 23 nt, Homo sapiens
gggaaacagguugggaugggaua

SEQ ID NO: 1958852 - RNA, 13 nt, Homo sapiens
uagcaaagcaaaa

SEQ ID NO: 1958853 - RNA, 16 nt, Homo sapiens
caugugauguggugcg

SEQ ID NO: 1958854 - RNA, 14 nt, Homo sapiens
uggccaacugcaaa

SEQ ID NO: 1958855 - RNA, 14 nt, Homo sapiens
cuucggacaacuca

SEQ ID NO: 1958856 - RNA, 18 nt, Homo sapiens
gugccugccaccuucaag

SEQ ID NO: 1958857 - RNA, 22 nt, Homo sapiens
ggacaacagagaugccaugaua

SEQ ID NO: 1958858 - RNA, 22 nt, Homo sapiens
gccaacccucucucuuaccugg

SEQ ID NO: 1958859 - RNA, 21 nt, Homo sapiens
uggucucuuuccaaagcauuu

SEQ ID NO: 1958860 - RNA, 15 nt, Homo sapiens
cuucuugcucagucc

SEQ ID NO: 1958861 - RNA, 19 nt, Homo sapiens
guagcuaugggccauaacc

SEQ ID NO: 1958862 - RNA, 21 nt, Homo sapiens
cuggauauucgguaauaucau

SEQ ID NO: 1958863 - RNA, 14 nt, Homo sapiens
gaauaaaauacucu

SEQ ID NO: 1958864 - RNA, 15 nt, Homo sapiens
aguuuaaagaagagu

SEQ ID NO: 1958865 - RNA, 13 nt, Homo sapiens
cagauugacaagg

SEQ ID NO: 1958866 - RNA, 20 nt, Homo sapiens
aaauuuuuaaaacacagaaa

SEQ ID NO: 1958867 - RNA, 15 nt, Homo sapiens
caaaauuguuuacca

SEQ ID NO: 1958868 - RNA, 24 nt, Homo sapiens
caaauaaacggacucaguggacac

SEQ ID NO: 1958869 - RNA, 20 nt, Homo sapiens
ucuggauuuucuuaucacaa

SEQ ID NO: 1958870 - RNA, 12 nt, Homo sapiens
gugauacauuug

SEQ ID NO: 1958871 - RNA, 14 nt, Homo sapiens
cagaugagaacaaa

SEQ ID NO: 1958872 - RNA, 14 nt, Homo sapiens
aggguguggugcuu

SEQ ID NO: 1958873 - RNA, 18 nt, Homo sapiens
uuagagauuauaacaaau

SEQ ID NO: 1958874 - RNA, 12 nt, Homo sapiens
uuuccuacuguc

SEQ ID NO: 1958875 - RNA, 13 nt, Homo sapiens
acucucuuccuuu

SEQ ID NO: 1958876 - RNA, 16 nt, Homo sapiens
uacuauacagccauaa

SEQ ID NO: 1958877 - RNA, 19 nt, Homo sapiens
ugcuacuuucagaggcguu

SEQ ID NO: 1958878 - RNA, 14 nt, Homo sapiens
aguucaauugugaa

SEQ ID NO: 1958879 - RNA, 23 nt, Homo sapiens
guuuuaggaugucauucuuugca

SEQ ID NO: 1958880 - RNA, 15 nt, Homo sapiens
uguaaaauguauauu

SEQ ID NO: 1958881 - RNA, 24 nt, Homo sapiens
gaaugcacacuagccucuccagga

SEQ ID NO: 1958882 - RNA, 16 nt, Homo sapiens
auaauugcaagggaag

SEQ ID NO: 1958883 - RNA, 12 nt, Homo sapiens
uguauucacuua

SEQ ID NO: 1958884 - RNA, 14 nt, Homo sapiens
caauaaauguuugu

SEQ ID NO: 1958885 - RNA, 23 nt, Homo sapiens
caggugggugguggcucuuaagg

SEQ ID NO: 1958886 - RNA, 20 nt, Homo sapiens
ucuguuaauagucaucacau

SEQ ID NO: 1958887 - RNA, 19 nt, Homo sapiens
cuauuuuaaaccaauugca

SEQ ID NO: 1958888 - RNA, 16 nt, Homo sapiens
uguggaccaguucccu

SEQ ID NO: 1958889 - RNA, 19 nt, Homo sapiens
guaaaacuuguauuggaag

SEQ ID NO: 1958890 - RNA, 21 nt, Homo sapiens
uuacuauuuauugcugaauga

SEQ ID NO: 1958891 - RNA, 17 nt, Homo sapiens
cagcagcuucaccagag

SEQ ID NO: 1958892 - RNA, 19 nt, Homo sapiens
caucuuaagagaugccuca

SEQ ID NO: 1958893 - RNA, 16 nt, Homo sapiens
acuagaaagcagagau

SEQ ID NO: 1958894 - RNA, 16 nt, Homo sapiens
gacauucacacagaga

SEQ ID NO: 1958895 - RNA, 20 nt, Homo sapiens
cuuuugaauaauguagugca

SEQ ID NO: 1958896 - RNA, 22 nt, Homo sapiens
auguguucgucaguguucaugc

SEQ ID NO: 1958897 - RNA, 16 nt, Homo sapiens
ucaucucucaucacuu

SEQ ID NO: 1958898 - RNA, 12 nt, Homo sapiens
aguacacugugu

SEQ ID NO: 1958899 - RNA, 13 nt, Homo sapiens
uuauuuagauuca

SEQ ID NO: 1958900 - RNA, 20 nt, Homo sapiens
aaagugcugcuggaaguaga

SEQ ID NO: 1958901 - RNA, 17 nt, Homo sapiens
ccaguuuauuacauuua

SEQ ID NO: 1958902 - RNA, 14 nt, Homo sapiens
ggauuacacauuuc

SEQ ID NO: 1958903 - RNA, 14 nt, Homo sapiens
caccugaaacacuu

SEQ ID NO: 1958904 - RNA, 17 nt, Homo sapiens
aaguagacuugguguga

SEQ ID NO: 1958905 - RNA, 16 nt, Homo sapiens
aguguuccuucauuaa

SEQ ID NO: 1958906 - RNA, 18 nt, Homo sapiens
augucagggcacauguga

SEQ ID NO: 1958907 - RNA, 14 nt, Homo sapiens
gagaacucuuucau

SEQ ID NO: 1958908 - RNA, 23 nt, Homo sapiens
agcaaaggcugagaacacuguga

SEQ ID NO: 1958909 - RNA, 21 nt, Homo sapiens
cacuagacccacuggacucac

SEQ ID NO: 1958910 - RNA, 17 nt, Homo sapiens
uaaaaaauaaaguacgu

SEQ ID NO: 1958911 - RNA, 19 nt, Homo sapiens
ccucauuagcauuuugcua

SEQ ID NO: 1958912 - RNA, 13 nt, Homo sapiens
ucaauaaaccaca

SEQ ID NO: 1958913 - RNA, 13 nt, Homo sapiens
cucuuuggggcua

SEQ ID NO: 1958914 - RNA, 22 nt, Homo sapiens
agaggaaaccaguuuggugaua

SEQ ID NO: 1958915 - RNA, 14 nt, Homo sapiens
gagagaaugccaca

SEQ ID NO: 1958916 - RNA, 19 nt, Homo sapiens
agcucagaggagucuggga

SEQ ID NO: 1958917 - RNA, 19 nt, Homo sapiens
gccugggcuccucugcauc

SEQ ID NO: 1958918 - RNA, 13 nt, Homo sapiens
aaauuuuacacac

SEQ ID NO: 1958919 - RNA, 14 nt, Homo sapiens
cauugagaucuucc

SEQ ID NO: 1958920 - RNA, 16 nt, Homo sapiens
ucaucauucccucuca

SEQ ID NO: 1958921 - RNA, 19 nt, Homo sapiens
uaaacaaucuuagacauuu

SEQ ID NO: 1958922 - RNA, 17 nt, Homo sapiens
gauauacugcagcuuua

SEQ ID NO: 1958923 - RNA, 20 nt, Homo sapiens
acuugcucaauaaaggucau

SEQ ID NO: 1958924 - RNA, 20 nt, Homo sapiens
uggggaaacagaugccucag

SEQ ID NO: 1958925 - RNA, 16 nt, Homo sapiens
aagggcaggugcuuca

SEQ ID NO: 1958926 - RNA, 22 nt, Homo sapiens
cagcuaauaagaagugccaagu

SEQ ID NO: 1958927 - RNA, 20 nt, Homo sapiens
guucucauuuggucugccag

SEQ ID NO: 1958928 - RNA, 12 nt, Homo sapiens
uugaaucaguuu

SEQ ID NO: 1958929 - RNA, 20 nt, Homo sapiens
aagccuaagggauccugccu

SEQ ID NO: 1958930 - RNA, 18 nt, Homo sapiens
auugaauacuuugaaugu

SEQ ID NO: 1958931 - RNA, 12 nt, Homo sapiens
gcaagaaccagu

SEQ ID NO: 1958932 - RNA, 23 nt, Homo sapiens
uauuuccuuaaauguuuugccag

SEQ ID NO: 1958933 - RNA, 23 nt, Homo sapiens
ugccucaccacggaccaaaggga

SEQ ID NO: 1958934 - RNA, 13 nt, Homo sapiens
aaauacauguuca

SEQ ID NO: 1958935 - RNA, 18 nt, Homo sapiens
gagggaauccauugaacu

SEQ ID NO: 1958936 - RNA, 16 nt, Homo sapiens
aguuuggguaaaauac

SEQ ID NO: 1958937 - RNA, 12 nt, Homo sapiens
cuaacacaugca

SEQ ID NO: 1958938 - RNA, 12 nt, Homo sapiens
ugaccacacucc

SEQ ID NO: 1958939 - RNA, 12 nt, Homo sapiens
cuaccacaugcc

SEQ ID NO: 1958940 - RNA, 21 nt, Homo sapiens
uuucaugauaaugaacagaac

SEQ ID NO: 1958941 - RNA, 14 nt, Homo sapiens
ccugggcaacauag

SEQ ID NO: 1958942 - RNA, 16 nt, Homo sapiens
aggcgggagaacugaa

SEQ ID NO: 1958943 - RNA, 14 nt, Homo sapiens
uccccuacaucaaa

SEQ ID NO: 1958944 - RNA, 20 nt, Homo sapiens
gccuccagagaccccaggaa

SEQ ID NO: 1958945 - RNA, 19 nt, Homo sapiens
cacagcugcugcuggaaau

SEQ ID NO: 1958946 - RNA, 14 nt, Homo sapiens
agcaucugcaacaa

SEQ ID NO: 1958947 - RNA, 19 nt, Homo sapiens
cucccucccccuggcacug

SEQ ID NO: 1958948 - RNA, 23 nt, Homo sapiens
augaaaaggauauuaucuaccug

SEQ ID NO: 1958949 - RNA, 22 nt, Homo sapiens
uaguuguugaaacaaaacugga

SEQ ID NO: 1958950 - RNA, 23 nt, Homo sapiens
cagaucuaucuugucaaucccaa

SEQ ID NO: 1958951 - RNA, 19 nt, Homo sapiens
cuuaagggaaaaguucucc

SEQ ID NO: 1958952 - RNA, 21 nt, Homo sapiens
cucugucuaggacugcagugu

SEQ ID NO: 1958953 - RNA, 21 nt, Homo sapiens
gcagcaucuucaaacauguac

SEQ ID NO: 1958954 - RNA, 17 nt, Homo sapiens
ucccacucuucuugcag

SEQ ID NO: 1958955 - RNA, 16 nt, Homo sapiens
aaagauuuuagcuaca

SEQ ID NO: 1958956 - RNA, 15 nt, Homo sapiens
gaaauuuuaccaagu

SEQ ID NO: 1958957 - RNA, 22 nt, Homo sapiens
ugcaucagaaaaugcagccuua

SEQ ID NO: 1958958 - RNA, 14 nt, Homo sapiens
gacuguucuuccca

SEQ ID NO: 1958959 - RNA, 21 nt, Homo sapiens
augucucuaagccaacuuuaa

SEQ ID NO: 1958960 - RNA, 21 nt, Homo sapiens
accagaaaguguguguguucu

SEQ ID NO: 1958961 - RNA, 17 nt, Homo sapiens
uaccaucuuguauacac

SEQ ID NO: 1958962 - RNA, 15 nt, Homo sapiens
cacccagccuggauc

SEQ ID NO: 1958963 - RNA, 20 nt, Homo sapiens
gaacaaguguacagaagaau

SEQ ID NO: 1958964 - RNA, 18 nt, Homo sapiens
agaauggaccaaccacuu

SEQ ID NO: 1958965 - RNA, 16 nt, Homo sapiens
auuuauauuacugucu

SEQ ID NO: 1958966 - RNA, 13 nt, Homo sapiens
gaaagaaagggaa

SEQ ID NO: 1958967 - RNA, 13 nt, Homo sapiens
gaaaaaaagggag

SEQ ID NO: 1958968 - RNA, 13 nt, Homo sapiens
ucaggaacacccc

SEQ ID NO: 1958969 - RNA, 21 nt, Homo sapiens
gaugacauuaaagaaggguug

SEQ ID NO: 1958970 - RNA, 15 nt, Homo sapiens
ugccaggacugugac

SEQ ID NO: 1958971 - RNA, 14 nt, Homo sapiens
augguguagcuguc

SEQ ID NO: 1958972 - RNA, 20 nt, Homo sapiens
cuggagaccguccuggagcu

SEQ ID NO: 1958973 - RNA, 15 nt, Homo sapiens
uuaaagaaggguuga

SEQ ID NO: 1958974 - RNA, 16 nt, Homo sapiens
uaucccucucucuacc

SEQ ID NO: 1958975 - RNA, 18 nt, Homo sapiens
acuucuguacacaguuau

SEQ ID NO: 1958976 - RNA, 18 nt, Homo sapiens
aguuccaugggauacaac

SEQ ID NO: 1958977 - RNA, 15 nt, Homo sapiens
cagucacugugagcu

SEQ ID NO: 1958978 - RNA, 19 nt, Homo sapiens
ucuguccccgcuccccuaa

SEQ ID NO: 1958979 - RNA, 13 nt, Homo sapiens
aaaauucauuucu

SEQ ID NO: 1958980 - RNA, 13 nt, Homo sapiens
aaaacucauuucc

SEQ ID NO: 1958981 - RNA, 19 nt, Homo sapiens
aauugaagucaauuacucu

SEQ ID NO: 1958982 - RNA, 23 nt, Homo sapiens
uguaucuacaauacauauaucua

SEQ ID NO: 1958983 - RNA, 17 nt, Homo sapiens
gacaugugacaucuacc

SEQ ID NO: 1958984 - RNA, 17 nt, Homo sapiens
gucuucuggacaggcuc

SEQ ID NO: 1958985 - RNA, 12 nt, Homo sapiens
auccuugccagu

SEQ ID NO: 1958986 - RNA, 22 nt, Homo sapiens
accuuuguguaaagaagggaag

SEQ ID NO: 1958987 - RNA, 15 nt, Homo sapiens
uguagacugugccag

SEQ ID NO: 1958988 - RNA, 17 nt, Homo sapiens
caugaucccacugaccu

SEQ ID NO: 1958989 - RNA, 12 nt, Homo sapiens
acaagugucuaa

SEQ ID NO: 1958990 - RNA, 17 nt, Homo sapiens
ucucauguaacacauaa

SEQ ID NO: 1958991 - RNA, 15 nt, Homo sapiens
ugaagggaagugcau

SEQ ID NO: 1958992 - RNA, 20 nt, Homo sapiens
aaagcaaauuucauuaucua

SEQ ID NO: 1958993 - RNA, 17 nt, Homo sapiens
ccagccaagaaagcuau

SEQ ID NO: 1958994 - RNA, 15 nt, Homo sapiens
gcgucuggguucuca

SEQ ID NO: 1958995 - RNA, 15 nt, Homo sapiens
uuuuacuuugguuua

SEQ ID NO: 1958996 - RNA, 11 nt, Homo sapiens
gcaaaccucag

SEQ ID NO: 1958997 - RNA, 16 nt, Homo sapiens
accaauaccuccucca

SEQ ID NO: 1958998 - RNA, 17 nt, Homo sapiens
ccagugacacccaguca

SEQ ID NO: 1958999 - RNA, 17 nt, Homo sapiens
ccaaagagaaaagauua

SEQ ID NO: 1959000 - RNA, 15 nt, Homo sapiens
ugguccucuugccuc

SEQ ID NO: 1959001 - RNA, 18 nt, Homo sapiens
aaagugcauuaaacugaa

SEQ ID NO: 1959002 - RNA, 14 nt, Homo sapiens
aagucaugccugag

SEQ ID NO: 1959003 - RNA, 19 nt, Homo sapiens
aggaaccucaaacugggua

SEQ ID NO: 1959004 - RNA, 18 nt, Homo sapiens
auguccuccucugugaaa

SEQ ID NO: 1959005 - RNA, 16 nt, Homo sapiens
cuagaaacauguaauc

SEQ ID NO: 1959006 - RNA, 21 nt, Homo sapiens
aaaauuagcugggcauggugc

SEQ ID NO: 1959007 - RNA, 18 nt, Homo sapiens
acagucuaacaaauucca

SEQ ID NO: 1959008 - RNA, 15 nt, Homo sapiens
guggauucaguucau

SEQ ID NO: 1959009 - RNA, 22 nt, Homo sapiens
aauuccucuagcuaccauuuca

SEQ ID NO: 1959010 - RNA, 22 nt, Homo sapiens
agcugggcaaagccacaaggcu

SEQ ID NO: 1959011 - RNA, 12 nt, Homo sapiens
ggaacaauccau

SEQ ID NO: 1959012 - RNA, 17 nt, Homo sapiens
gugaacuuacuugcaua

SEQ ID NO: 1959013 - RNA, 14 nt, Homo sapiens
ugggccuggcuccc

SEQ ID NO: 1959014 - RNA, 17 nt, Homo sapiens
aaauucccaugagucag

SEQ ID NO: 1959015 - RNA, 21 nt, Homo sapiens
gagaucccacccgaacgucuu

SEQ ID NO: 1959016 - RNA, 13 nt, Homo sapiens
cucaagugcaagg

SEQ ID NO: 1959017 - RNA, 16 nt, Homo sapiens
guucagguaacaggca

SEQ ID NO: 1959018 - RNA, 17 nt, Homo sapiens
aaauaucgauaucacca

SEQ ID NO: 1959019 - RNA, 17 nt, Homo sapiens
cguugauaacucagugg

SEQ ID NO: 1959020 - RNA, 17 nt, Homo sapiens
ccacacguuugauuucu

SEQ ID NO: 1959021 - RNA, 13 nt, Homo sapiens
auaccuggcuuug

SEQ ID NO: 1959022 - RNA, 22 nt, Homo sapiens
auuguaaacagcuaauaaugaa

SEQ ID NO: 1959023 - RNA, 14 nt, Homo sapiens
gaaggagcuuucau

SEQ ID NO: 1959024 - RNA, 17 nt, Homo sapiens
uggauuuauucugccaa

SEQ ID NO: 1959025 - RNA, 21 nt, Homo sapiens
aaggggcaaagaaaagccaga

SEQ ID NO: 1959026 - RNA, 19 nt, Homo sapiens
cauuugggagacaugugac

SEQ ID NO: 1959027 - RNA, 22 nt, Homo sapiens
uugaaauccuuucuaaauugca

SEQ ID NO: 1959028 - RNA, 16 nt, Homo sapiens
auucauucagccuuca

SEQ ID NO: 1959029 - RNA, 16 nt, Homo sapiens
ucuauuucaacuucag

SEQ ID NO: 1959030 - RNA, 18 nt, Homo sapiens
agagaacaggggcuucuu

SEQ ID NO: 1959031 - RNA, 20 nt, Homo sapiens
gaaaaggucuuggugccucu

SEQ ID NO: 1959032 - RNA, 20 nt, Homo sapiens
ccuuuccaaccucacuuccc

SEQ ID NO: 1959033 - RNA, 15 nt, Homo sapiens
cuuggaccaaaugga

SEQ ID NO: 1959034 - RNA, 15 nt, Homo sapiens
uaaaccuccgccaau

SEQ ID NO: 1959035 - RNA, 13 nt, Homo sapiens
uuuaucugugcaa

SEQ ID NO: 1959036 - RNA, 16 nt, Homo sapiens
caggguuucuccaugu

SEQ ID NO: 1959037 - RNA, 18 nt, Homo sapiens
agggaccaaggaccccuc

SEQ ID NO: 1959038 - RNA, 18 nt, Homo sapiens
acuacagcuaugaagaaa

SEQ ID NO: 1959039 - RNA, 12 nt, Homo sapiens
aucacagaaaag

SEQ ID NO: 1959040 - RNA, 11 nt, Homo sapiens
ucaaucucagc

SEQ ID NO: 1959041 - RNA, 22 nt, Homo sapiens
uuaagaugcaaaucaacucucu

SEQ ID NO: 1959042 - RNA, 15 nt, Homo sapiens
cuuuuccugggacau

SEQ ID NO: 1959043 - RNA, 21 nt, Homo sapiens
cacuacucaauacuaccucug

SEQ ID NO: 1959044 - RNA, 23 nt, Homo sapiens
uuggaggugggagcuucccacac

SEQ ID NO: 1959045 - RNA, 22 nt, Homo sapiens
gcuauuuuuuauuuuacuuuua

SEQ ID NO: 1959046 - RNA, 15 nt, Homo sapiens
augauguuugcccaa

SEQ ID NO: 1959047 - RNA, 12 nt, Homo sapiens
gagcacagugau

SEQ ID NO: 1959048 - RNA, 20 nt, Homo sapiens
gauccauagugcuaccugca

SEQ ID NO: 1959049 - RNA, 18 nt, Homo sapiens
agccuccgccucccgggu

SEQ ID NO: 1959050 - RNA, 14 nt, Homo sapiens
guaaggaacuggaa

SEQ ID NO: 1959051 - RNA, 22 nt, Homo sapiens
aaccauucaaaugacgccugau

SEQ ID NO: 1959052 - RNA, 20 nt, Homo sapiens
gccuuugaauaaaaaugcac

SEQ ID NO: 1959053 - RNA, 18 nt, Homo sapiens
uucagcugugaacaugga

SEQ ID NO: 1959054 - RNA, 13 nt, Homo sapiens
cuucccagcaauu

SEQ ID NO: 1959055 - RNA, 17 nt, Homo sapiens
cagacucugauucuaca

SEQ ID NO: 1959056 - RNA, 15 nt, Homo sapiens
accuauguacuuaau

SEQ ID NO: 1959057 - RNA, 16 nt, Homo sapiens
uuuuugagaccaaauc

SEQ ID NO: 1959058 - RNA, 13 nt, Homo sapiens
aagccacugccuu

SEQ ID NO: 1959059 - RNA, 13 nt, Homo sapiens
gagccacuaccuu

SEQ ID NO: 1959060 - RNA, 16 nt, Homo sapiens
uuuuauacaaaugucu

SEQ ID NO: 1959061 - RNA, 21 nt, Homo sapiens
guauaguuuuuagucugugua

SEQ ID NO: 1959062 - RNA, 16 nt, Homo sapiens
caucuaaauaccugcc

SEQ ID NO: 1959063 - RNA, 23 nt, Homo sapiens
gaauuuugcaauguauuuagcua

SEQ ID NO: 1959064 - RNA, 15 nt, Homo sapiens
auacacuuuauuaau

SEQ ID NO: 1959065 - RNA, 16 nt, Homo sapiens
ucccugcacacacaug

SEQ ID NO: 1959066 - RNA, 13 nt, Homo sapiens
gaacaauguugca

SEQ ID NO: 1959067 - RNA, 20 nt, Homo sapiens
agaaucuagaaauguucaca

SEQ ID NO: 1959068 - RNA, 21 nt, Homo sapiens
cagcccagcuccacucagggc

SEQ ID NO: 1959069 - RNA, 20 nt, Homo sapiens
gccuccagggcauugcucag

SEQ ID NO: 1959070 - RNA, 12 nt, Homo sapiens
auagacaauucc

SEQ ID NO: 1959071 - RNA, 18 nt, Homo sapiens
cuccauacauaacuugau

SEQ ID NO: 1959072 - RNA, 16 nt, Homo sapiens
gaacagacaacagaag

SEQ ID NO: 1959073 - RNA, 21 nt, Homo sapiens
gaaaauauuuuguugccuuca

SEQ ID NO: 1959074 - RNA, 21 nt, Homo sapiens
gaaacuuaccauucaacugaa

SEQ ID NO: 1959075 - RNA, 14 nt, Homo sapiens
ugaugcugggaccc

SEQ ID NO: 1959076 - RNA, 19 nt, Homo sapiens
augguggcgcaugccugua

SEQ ID NO: 1959077 - RNA, 19 nt, Homo sapiens
caacaaagcgagaucccau

SEQ ID NO: 1959078 - RNA, 14 nt, Homo sapiens
uuuccuugucccag

SEQ ID NO: 1959079 - RNA, 15 nt, Homo sapiens
auguugaccuuugag

SEQ ID NO: 1959080 - RNA, 18 nt, Homo sapiens
acacaucccggcacuguu

SEQ ID NO: 1959081 - RNA, 18 nt, Homo sapiens
caagaguaggguagacca

SEQ ID NO: 1959082 - RNA, 17 nt, Homo sapiens
uccuaccaguugcccua

SEQ ID NO: 1959083 - RNA, 22 nt, Homo sapiens
cugcuccucuaggccucacuca

SEQ ID NO: 1959084 - RNA, 12 nt, Homo sapiens
auauugccuuau

SEQ ID NO: 1959085 - RNA, 19 nt, Homo sapiens
ucaaagcaucuugcauuau

SEQ ID NO: 1959086 - RNA, 13 nt, Homo sapiens
acucagcacuguu

SEQ ID NO: 1959087 - RNA, 10 nt, Homo sapiens
ugaaggugcu

SEQ ID NO: 1959088 - RNA, 14 nt, Homo sapiens
cuccccgucccugu

SEQ ID NO: 1959089 - RNA, 18 nt, Homo sapiens
cuaggaggcuguggguuu

SEQ ID NO: 1959090 - RNA, 19 nt, Homo sapiens
gggugagcagggcccucag

SEQ ID NO: 1959091 - RNA, 13 nt, Homo sapiens
gcucaucuucaaa

SEQ ID NO: 1959092 - RNA, 12 nt, Homo sapiens
ggaugggaccaa

SEQ ID NO: 1959093 - RNA, 20 nt, Homo sapiens
agguauuacacaagccaaaa

SEQ ID NO: 1959094 - RNA, 20 nt, Homo sapiens
uaugccucuguguaucucag

SEQ ID NO: 1959095 - RNA, 19 nt, Homo sapiens
gcaugcucaguuggugcug

SEQ ID NO: 1959096 - RNA, 14 nt, Homo sapiens
uucuguugcucucu

SEQ ID NO: 1959097 - RNA, 22 nt, Homo sapiens
acagcuucacuuaaaaucaaau

SEQ ID NO: 1959098 - RNA, 14 nt, Homo sapiens
ucgggaacaguguu

SEQ ID NO: 1959099 - RNA, 22 nt, Homo sapiens
uggaauggcaggugucauauga

SEQ ID NO: 1959100 - RNA, 23 nt, Homo sapiens
gacccugaaaggaacacuggcuu

SEQ ID NO: 1959101 - RNA, 20 nt, Homo sapiens
uauuucuucgugaacauaga

SEQ ID NO: 1959102 - RNA, 15 nt, Homo sapiens
ugauuuacacagguu

SEQ ID NO: 1959103 - RNA, 14 nt, Homo sapiens
ugacggcuaccaca

SEQ ID NO: 1959104 - RNA, 19 nt, Homo sapiens
aauguaaguugaccuucuc

SEQ ID NO: 1959105 - RNA, 23 nt, Homo sapiens
gcacuguggaucacgacaggaaa

SEQ ID NO: 1959106 - RNA, 18 nt, Homo sapiens
gucauaaacacugcauaa

SEQ ID NO: 1959107 - RNA, 14 nt, Homo sapiens
uaaguauuuccaua

SEQ ID NO: 1959108 - RNA, 16 nt, Homo sapiens
cacaacucuuuguuca

SEQ ID NO: 1959109 - RNA, 16 nt, Homo sapiens
cuugacuguuaucucg

SEQ ID NO: 1959110 - RNA, 21 nt, Homo sapiens
gacucagggccaugccugccc

SEQ ID NO: 1959111 - RNA, 14 nt, Homo sapiens
aucuugcauguaac

SEQ ID NO: 1959112 - RNA, 15 nt, Homo sapiens
cauuucugucuccag

SEQ ID NO: 1959113 - RNA, 17 nt, Homo sapiens
cauugacccucaccuga

SEQ ID NO: 1959114 - RNA, 22 nt, Homo sapiens
aguguucucggggaugcauaga

SEQ ID NO: 1959115 - RNA, 16 nt, Homo sapiens
auggcuggcacugagc

SEQ ID NO: 1959116 - RNA, 11 nt, Homo sapiens
uggcugugaca

SEQ ID NO: 1959117 - RNA, 13 nt, Homo sapiens
agucgagaccuca

SEQ ID NO: 1959118 - RNA, 19 nt, Homo sapiens
uuaugggaagacaaaacaa

SEQ ID NO: 1959119 - RNA, 23 nt, Homo sapiens
agucaucagauaugcuuacuaaa

SEQ ID NO: 1959120 - RNA, 18 nt, Homo sapiens
uaauccagcaaagugauu

SEQ ID NO: 1959121 - RNA, 16 nt, Homo sapiens
acagaauaauccagua

SEQ ID NO: 1959122 - RNA, 21 nt, Homo sapiens
agccugcagaaguaagccuca

SEQ ID NO: 1959123 - RNA, 24 nt, Homo sapiens
ggagaacaucuuugacacucugca

SEQ ID NO: 1959124 - RNA, 18 nt, Homo sapiens
ucauagguuacuaccuau

SEQ ID NO: 1959125 - RNA, 15 nt, Homo sapiens
uaugccuuaagccaa

SEQ ID NO: 1959126 - RNA, 13 nt, Homo sapiens
uauaagcaaaaac

SEQ ID NO: 1959127 - RNA, 16 nt, Homo sapiens
uaugaauagcugugua

SEQ ID NO: 1959128 - RNA, 17 nt, Homo sapiens
ccacagaggacagugcu

SEQ ID NO: 1959129 - RNA, 15 nt, Homo sapiens
cucccagggccauga

SEQ ID NO: 1959130 - RNA, 16 nt, Homo sapiens
gguacccagccaucug

SEQ ID NO: 1959131 - RNA, 14 nt, Homo sapiens
gagaucaugucuca

SEQ ID NO: 1959132 - RNA, 19 nt, Homo sapiens
agucuguaaaauacaugua

SEQ ID NO: 1959133 - RNA, 13 nt, Homo sapiens
cucucuucuucca

SEQ ID NO: 1959134 - RNA, 18 nt, Homo sapiens
aguggcacaggagacucc

SEQ ID NO: 1959135 - RNA, 12 nt, Homo sapiens
ucuaagucacag

SEQ ID NO: 1959136 - RNA, 11 nt, Homo sapiens
acuacacagcu

SEQ ID NO: 1959137 - RNA, 14 nt, Homo sapiens
uguuaccuguagau

SEQ ID NO: 1959138 - RNA, 15 nt, Homo sapiens
aggcaggugcaggga

SEQ ID NO: 1959139 - RNA, 17 nt, Homo sapiens
aauaaaucguccuccca

SEQ ID NO: 1959140 - RNA, 18 nt, Homo sapiens
agccgccugaaagccaca

SEQ ID NO: 1959141 - RNA, 13 nt, Homo sapiens
aagagaagcaaga

SEQ ID NO: 1959142 - RNA, 19 nt, Homo sapiens
gcuccagggaauccaagcc

SEQ ID NO: 1959143 - RNA, 15 nt, Homo sapiens
gacuuuagaaauaaa

SEQ ID NO: 1959144 - RNA, 20 nt, Homo sapiens
cuauuuugggaaaaugaagg

SEQ ID NO: 1959145 - RNA, 15 nt, Homo sapiens
ugacgcgacuaucau

SEQ ID NO: 1959146 - RNA, 13 nt, Homo sapiens
cuuaagccaaacu

SEQ ID NO: 1959147 - RNA, 20 nt, Homo sapiens
acaucuggcugcacaggcug

SEQ ID NO: 1959148 - RNA, 20 nt, Homo sapiens
ugggugaggcccgugugagg

SEQ ID NO: 1959149 - RNA, 18 nt, Homo sapiens
cggaagcugucgacuuca

SEQ ID NO: 1959150 - RNA, 13 nt, Homo sapiens
ucccucugcagaa

SEQ ID NO: 1959151 - RNA, 17 nt, Homo sapiens
gcacagagggaagccau

SEQ ID NO: 1959152 - RNA, 17 nt, Homo sapiens
caaaccugauacaauuu

SEQ ID NO: 1959153 - RNA, 20 nt, Homo sapiens
aauaaaugcauagagcaauu

SEQ ID NO: 1959154 - RNA, 15 nt, Homo sapiens
aaauguagacugaaa

SEQ ID NO: 1959155 - RNA, 22 nt, Homo sapiens
agaccaacuuuucaaugugauu

SEQ ID NO: 1959156 - RNA, 13 nt, Homo sapiens
gccugugcaugua

SEQ ID NO: 1959157 - RNA, 22 nt, Homo sapiens
aguguaaugugacuucaugcua

SEQ ID NO: 1959158 - RNA, 12 nt, Homo sapiens
ugaagaguacag

SEQ ID NO: 1959159 - RNA, 22 nt, Homo sapiens
gucacaaagaccuugcugauaa

SEQ ID NO: 1959160 - RNA, 19 nt, Homo sapiens
ugacucccagaucagucag

SEQ ID NO: 1959161 - RNA, 18 nt, Homo sapiens
cagccucccaaguagcug

SEQ ID NO: 1959162 - RNA, 22 nt, Homo sapiens
ucauucucucucauuauugaga

SEQ ID NO: 1959163 - RNA, 17 nt, Homo sapiens
cucaccugguugaccca

SEQ ID NO: 1959164 - RNA, 19 nt, Homo sapiens
ugguggcagauuuuacaaa

SEQ ID NO: 1959165 - RNA, 18 nt, Homo sapiens
aguucugaucuguaccua

SEQ ID NO: 1959166 - RNA, 18 nt, Homo sapiens
gccugugugagcaucucu

SEQ ID NO: 1959167 - RNA, 14 nt, Homo sapiens
cuucuuacuauuaa

SEQ ID NO: 1959168 - RNA, 14 nt, Homo sapiens
cuaguguuaaucca

SEQ ID NO: 1959169 - RNA, 12 nt, Homo sapiens
ugaaaagcacag

SEQ ID NO: 1959170 - RNA, 18 nt, Homo sapiens
ugcauugucugcaauggu

SEQ ID NO: 1959171 - RNA, 21 nt, Homo sapiens
uagaguguuuuaaaacauuca

SEQ ID NO: 1959172 - RNA, 22 nt, Homo sapiens
auguccucuuuuguuguuucuu

SEQ ID NO: 1959173 - RNA, 21 nt, Homo sapiens
caacauggugaaaccucaucu

SEQ ID NO: 1959174 - RNA, 19 nt, Homo sapiens
agcuggugccccacugaau

SEQ ID NO: 1959175 - RNA, 12 nt, Homo sapiens
cacaggugggag

SEQ ID NO: 1959176 - RNA, 15 nt, Homo sapiens
caccaggugccuuuc

SEQ ID NO: 1959177 - RNA, 14 nt, Homo sapiens
agcucuucagcaca

SEQ ID NO: 1959178 - RNA, 16 nt, Homo sapiens
caagcacuguggaacu

SEQ ID NO: 1959179 - RNA, 13 nt, Homo sapiens
gccugguguggug

SEQ ID NO: 1959180 - RNA, 16 nt, Homo sapiens
auauaaacacaaauau

SEQ ID NO: 1959181 - RNA, 12 nt, Homo sapiens
ggaaauucaaag

SEQ ID NO: 1959182 - RNA, 21 nt, Homo sapiens
auguaauaaccaaaugcaaug

SEQ ID NO: 1959183 - RNA, 12 nt, Homo sapiens
ucaugugcuaua

SEQ ID NO: 1959184 - RNA, 15 nt, Homo sapiens
ucaagaacacaguga

SEQ ID NO: 1959185 - RNA, 15 nt, Homo sapiens
acaagaccucagugc

SEQ ID NO: 1959186 - RNA, 12 nt, Homo sapiens
ugauccugugaa

SEQ ID NO: 1959187 - RNA, 15 nt, Homo sapiens
cauggccaugguccc

SEQ ID NO: 1959188 - RNA, 16 nt, Homo sapiens
uuguuuggagacagag

SEQ ID NO: 1959189 - RNA, 17 nt, Homo sapiens
uccagcuacuuuugcca

SEQ ID NO: 1959190 - RNA, 16 nt, Homo sapiens
agaaucacuggaaccu

SEQ ID NO: 1959191 - RNA, 18 nt, Homo sapiens
gagcuucaacuacuucuc

SEQ ID NO: 1959192 - RNA, 13 nt, Homo sapiens
auauaucaaggau

SEQ ID NO: 1959193 - RNA, 15 nt, Homo sapiens
acaaccaaccaauac

SEQ ID NO: 1959194 - RNA, 22 nt, Homo sapiens
aacagcguguucuaaguauuug

SEQ ID NO: 1959195 - RNA, 19 nt, Homo sapiens
gucugggugcuacugggga

SEQ ID NO: 1959196 - RNA, 16 nt, Homo sapiens
aguauuugcauauucu

SEQ ID NO: 1959197 - RNA, 14 nt, Homo sapiens
cucccucuguguca

SEQ ID NO: 1959198 - RNA, 21 nt, Homo sapiens
agcaccuacuuacaugcauua

SEQ ID NO: 1959199 - RNA, 17 nt, Homo sapiens
uucauucccccuuccua

SEQ ID NO: 1959200 - RNA, 15 nt, Homo sapiens
uuagaucuacccugc

SEQ ID NO: 1959201 - RNA, 15 nt, Homo sapiens
uaaucuaauacacuu

SEQ ID NO: 1959202 - RNA, 14 nt, Homo sapiens
agacugugauguau

SEQ ID NO: 1959203 - RNA, 23 nt, Homo sapiens
gcuuuuaaugcuccaaaugcuga

SEQ ID NO: 1959204 - RNA, 18 nt, Homo sapiens
uagcucaguuucccuccu

SEQ ID NO: 1959205 - RNA, 16 nt, Homo sapiens
ucugugauugccauuu

SEQ ID NO: 1959206 - RNA, 20 nt, Homo sapiens
agguggaaaaggaacccaau

SEQ ID NO: 1959207 - RNA, 21 nt, Homo sapiens
auuuagaaaauuuuguauuaa

SEQ ID NO: 1959208 - RNA, 22 nt, Homo sapiens
aagccagugcggcagguucaca

SEQ ID NO: 1959209 - RNA, 22 nt, Homo sapiens
caucagcauuuaauaaauguau

SEQ ID NO: 1959210 - RNA, 16 nt, Homo sapiens
ggacugaccagcagcu

SEQ ID NO: 1959211 - RNA, 13 nt, Homo sapiens
gauagacuuggga

SEQ ID NO: 1959212 - RNA, 16 nt, Homo sapiens
uccacuucaaucugag

SEQ ID NO: 1959213 - RNA, 21 nt, Homo sapiens
augaugcuagccagcaaagau

SEQ ID NO: 1959214 - RNA, 16 nt, Homo sapiens
uguaccaaaacauuga

SEQ ID NO: 1959215 - RNA, 22 nt, Homo sapiens
aaucaauaagagaacucuccuc

SEQ ID NO: 1959216 - RNA, 19 nt, Homo sapiens
cugauguagcuuauacaaa

SEQ ID NO: 1959217 - RNA, 16 nt, Homo sapiens
aauagaugaguccugu

SEQ ID NO: 1959218 - RNA, 20 nt, Homo sapiens
accucuccugcccugugaua

SEQ ID NO: 1959219 - RNA, 20 nt, Homo sapiens
cucugggcuggaugagcucc

SEQ ID NO: 1959220 - RNA, 12 nt, Homo sapiens
ugagccagguaa

SEQ ID NO: 1959221 - RNA, 17 nt, Homo sapiens
ucugcugaagacuugcc

SEQ ID NO: 1959222 - RNA, 14 nt, Homo sapiens
gaaaaaaauuacua

SEQ ID NO: 1959223 - RNA, 17 nt, Homo sapiens
acugggaagugacuuag

SEQ ID NO: 1959224 - RNA, 22 nt, Homo sapiens
auauguaucuaaaccauaugaa

SEQ ID NO: 1959225 - RNA, 22 nt, Homo sapiens
agaugucuucaucacuucuucc

SEQ ID NO: 1959226 - RNA, 16 nt, Homo sapiens
gucuuacuccuggcuu

SEQ ID NO: 1959227 - RNA, 19 nt, Homo sapiens
uaaaauuaggaacaguaaa

SEQ ID NO: 1959228 - RNA, 22 nt, Homo sapiens
ugagaaaagaaauuaguuucaa

SEQ ID NO: 1959229 - RNA, 22 nt, Homo sapiens
caguagcaucuguaacagcauu

SEQ ID NO: 1959230 - RNA, 13 nt, Homo sapiens
gauugaggccagg

SEQ ID NO: 1959231 - RNA, 22 nt, Homo sapiens
gaccaagucucucuaagacaaa

SEQ ID NO: 1959232 - RNA, 12 nt, Homo sapiens
cacagaggcagu

SEQ ID NO: 1959233 - RNA, 12 nt, Homo sapiens
cagucuuggaau

SEQ ID NO: 1959234 - RNA, 19 nt, Homo sapiens
cacaagaugcugcaaugug

SEQ ID NO: 1959235 - RNA, 16 nt, Homo sapiens
uucuuagaguguagcu

SEQ ID NO: 1959236 - RNA, 17 nt, Homo sapiens
cuugggagaggggcgca

SEQ ID NO: 1959237 - RNA, 17 nt, Homo sapiens
cagccacuggcugcuaa

SEQ ID NO: 1959238 - RNA, 20 nt, Homo sapiens
auacauuauuggacuuccau

SEQ ID NO: 1959239 - RNA, 13 nt, Homo sapiens
aagacuuugugac

SEQ ID NO: 1959240 - RNA, 23 nt, Homo sapiens
agcaaauugauuagaaaauggaa

SEQ ID NO: 1959241 - RNA, 13 nt, Homo sapiens
cuucaagugccuu

SEQ ID NO: 1959242 - RNA, 14 nt, Homo sapiens
aacuuacaaacugg

SEQ ID NO: 1959243 - RNA, 14 nt, Homo sapiens
auguugcaauguga

SEQ ID NO: 1959244 - RNA, 17 nt, Homo sapiens
aaaggcaccucccccaa

SEQ ID NO: 1959245 - RNA, 14 nt, Homo sapiens
ucaaaguaauaagu

SEQ ID NO: 1959246 - RNA, 12 nt, Homo sapiens
aaaugcugucuu

SEQ ID NO: 1959247 - RNA, 16 nt, Homo sapiens
cucuugucucacaugc

SEQ ID NO: 1959248 - RNA, 16 nt, Homo sapiens
cugcaaaugugcaguu

SEQ ID NO: 1959249 - RNA, 14 nt, Homo sapiens
acauucacuuccag

SEQ ID NO: 1959250 - RNA, 16 nt, Homo sapiens
aaaugaaacagggaaa

SEQ ID NO: 1959251 - RNA, 24 nt, Homo sapiens
cucaguccacugcugaggacacuc

SEQ ID NO: 1959252 - RNA, 14 nt, Homo sapiens
uauguauguaaaaa

SEQ ID NO: 1959253 - RNA, 10 nt, Homo sapiens
ucugagacag

SEQ ID NO: 1959254 - RNA, 15 nt, Homo sapiens
cugaugacuugcuua

SEQ ID NO: 1959255 - RNA, 15 nt, Homo sapiens
guaugagcugccaag

SEQ ID NO: 1959256 - RNA, 20 nt, Homo sapiens
augaaaaauaagucacuuau

SEQ ID NO: 1959257 - RNA, 20 nt, Homo sapiens
uuuuaauuaaugaaauaucu

SEQ ID NO: 1959258 - RNA, 23 nt, Homo sapiens
ggaaaguaaauauuucaggcaua

SEQ ID NO: 1959259 - RNA, 22 nt, Homo sapiens
guacuguugaauuuggcuuuac

SEQ ID NO: 1959260 - RNA, 12 nt, Homo sapiens
uuuagcugugaa

SEQ ID NO: 1959261 - RNA, 20 nt, Homo sapiens
aucaaucuuauuacugagag

SEQ ID NO: 1959262 - RNA, 19 nt, Homo sapiens
ucaaaaucuuaaccugaug

SEQ ID NO: 1959263 - RNA, 24 nt, Homo sapiens
gauaaaaugccagucucauuguca

SEQ ID NO: 1959264 - RNA, 23 nt, Homo sapiens
uguccacggggcucacucuggcc

SEQ ID NO: 1959265 - RNA, 18 nt, Homo sapiens
agauuccuuuccacucca

SEQ ID NO: 1959266 - RNA, 18 nt, Homo sapiens
uccacauuauacauuuga

SEQ ID NO: 1959267 - RNA, 19 nt, Homo sapiens
caucaggagcugcucaggc

SEQ ID NO: 1959268 - RNA, 12 nt, Homo sapiens
cccuuugccaua

SEQ ID NO: 1959269 - RNA, 16 nt, Homo sapiens
cuguacugagcacuga

SEQ ID NO: 1959270 - RNA, 23 nt, Homo sapiens
aaaucuuuuugcuucuacuuuca

SEQ ID NO: 1959271 - RNA, 14 nt, Homo sapiens
aaagcuuuccccca

SEQ ID NO: 1959272 - RNA, 20 nt, Homo sapiens
cugcucaggguucaucugaa

SEQ ID NO: 1959273 - RNA, 17 nt, Homo sapiens
auuguugaaauuuugca

SEQ ID NO: 1959274 - RNA, 16 nt, Homo sapiens
cacucagguacuuggu

SEQ ID NO: 1959275 - RNA, 11 nt, Homo sapiens
aaaacauucca

SEQ ID NO: 1959276 - RNA, 12 nt, Homo sapiens
auaacuaucaac

SEQ ID NO: 1959277 - RNA, 17 nt, Homo sapiens
uuucacaugagucaaaa

SEQ ID NO: 1959278 - RNA, 18 nt, Homo sapiens
ccaugugugaugcugaca

SEQ ID NO: 1959279 - RNA, 17 nt, Homo sapiens
cuguuuggcuuaacaca

SEQ ID NO: 1959280 - RNA, 15 nt, Homo sapiens
acccuccccacagug

SEQ ID NO: 1959281 - RNA, 17 nt, Homo sapiens
gagaugggauggcaaau

SEQ ID NO: 1959282 - RNA, 10 nt, Homo sapiens
uuaguuccca

SEQ ID NO: 1959283 - RNA, 11 nt, Homo sapiens
auacuaccucu

SEQ ID NO: 1959284 - RNA, 18 nt, Homo sapiens
gcaagaggaaaaugcccu

SEQ ID NO: 1959285 - RNA, 16 nt, Homo sapiens
gcuuugcuuucugcuc

SEQ ID NO: 1959286 - RNA, 16 nt, Homo sapiens
gccguguuuuuggccc

SEQ ID NO: 1959287 - RNA, 13 nt, Homo sapiens
aaccaacugccuu

SEQ ID NO: 1959288 - RNA, 16 nt, Homo sapiens
aucuguauuuuuuaca

SEQ ID NO: 1959289 - RNA, 21 nt, Homo sapiens
gaagcuaaaauaaaccagacu

SEQ ID NO: 1959290 - RNA, 12 nt, Homo sapiens
uugggcucugau

SEQ ID NO: 1959291 - RNA, 21 nt, Homo sapiens
gaguacaauuguuaugaucua

SEQ ID NO: 1959292 - RNA, 14 nt, Homo sapiens
caagucauccccuu

SEQ ID NO: 1959293 - RNA, 19 nt, Homo sapiens
gagaugguucccaauauca

SEQ ID NO: 1959294 - RNA, 14 nt, Homo sapiens
gccuugcugugaaa

SEQ ID NO: 1959295 - RNA, 14 nt, Homo sapiens
cccacccaucucca

SEQ ID NO: 1959296 - RNA, 18 nt, Homo sapiens
agcuguuuauggccucag

SEQ ID NO: 1959297 - RNA, 18 nt, Homo sapiens
gugguggcgugagccugu

SEQ ID NO: 1959298 - RNA, 18 nt, Homo sapiens
caaggcaaacccuguuca

SEQ ID NO: 1959299 - RNA, 19 nt, Homo sapiens
uagagaugguuucuacugg

SEQ ID NO: 1959300 - RNA, 15 nt, Homo sapiens
uugauacaaacugug

SEQ ID NO: 1959301 - RNA, 14 nt, Homo sapiens
ugggucuucaagga

SEQ ID NO: 1959302 - RNA, 13 nt, Homo sapiens
aaacguauguaaa

SEQ ID NO: 1959303 - RNA, 14 nt, Homo sapiens
ccuacacugccagc

SEQ ID NO: 1959304 - RNA, 12 nt, Homo sapiens
uuccuuuugcca

SEQ ID NO: 1959305 - RNA, 19 nt, Homo sapiens
auccaugugacucaagccu

SEQ ID NO: 1959306 - RNA, 23 nt, Homo sapiens
uguucccacucccucucuugccg

SEQ ID NO: 1959307 - RNA, 19 nt, Homo sapiens
ucuaccaguuuauuccugu

SEQ ID NO: 1959308 - RNA, 18 nt, Homo sapiens
auuucucacacacuggcu

SEQ ID NO: 1959309 - RNA, 14 nt, Homo sapiens
uguucugugcauau

SEQ ID NO: 1959310 - RNA, 19 nt, Homo sapiens
aggguggagaugaggugcu

SEQ ID NO: 1959311 - RNA, 18 nt, Homo sapiens
ccacaggagccucugcag

SEQ ID NO: 1959312 - RNA, 16 nt, Homo sapiens
uuaggaggcugaggug

SEQ ID NO: 1959313 - RNA, 15 nt, Homo sapiens
uuacuaucaugucaa

SEQ ID NO: 1959314 - RNA, 18 nt, Homo sapiens
uuucaugcuguucaugaa

SEQ ID NO: 1959315 - RNA, 16 nt, Homo sapiens
ugcccuagcccagacu

SEQ ID NO: 1959316 - RNA, 22 nt, Homo sapiens
uucuaugugaccagacugcaca

SEQ ID NO: 1959317 - RNA, 13 nt, Homo sapiens
gcauaaaugcauu

SEQ ID NO: 1959318 - RNA, 13 nt, Homo sapiens
gccaaaaugccau

SEQ ID NO: 1959319 - RNA, 21 nt, Homo sapiens
cugucugugaauauccagaaa

SEQ ID NO: 1959320 - RNA, 24 nt, Homo sapiens
cuugucauagaggaaaagcacaga

SEQ ID NO: 1959321 - RNA, 17 nt, Homo sapiens
aguucucuugguguuaa

SEQ ID NO: 1959322 - RNA, 13 nt, Homo sapiens
uccuuggagacag

SEQ ID NO: 1959323 - RNA, 13 nt, Homo sapiens
uugaaacuuguau

SEQ ID NO: 1959324 - RNA, 20 nt, Homo sapiens
uguauccccgugaaaucugg

SEQ ID NO: 1959325 - RNA, 17 nt, Homo sapiens
acuccugggcucaagcg

SEQ ID NO: 1959326 - RNA, 18 nt, Homo sapiens
ccaccuugucugcuaaau

SEQ ID NO: 1959327 - RNA, 10 nt, Homo sapiens
gcugcugaga

SEQ ID NO: 1959328 - RNA, 21 nt, Homo sapiens
cagggagacugcaucucaaaa

SEQ ID NO: 1959329 - RNA, 15 nt, Homo sapiens
cuccuuugcacuguu

SEQ ID NO: 1959330 - RNA, 16 nt, Homo sapiens
cugcaagucacaaagg

SEQ ID NO: 1959331 - RNA, 16 nt, Homo sapiens
cagcagagcucaagau

SEQ ID NO: 1959332 - RNA, 15 nt, Homo sapiens
cagagccccacuccc

SEQ ID NO: 1959333 - RNA, 21 nt, Homo sapiens
cauuuaggugaggaagcaaaa

SEQ ID NO: 1959334 - RNA, 21 nt, Homo sapiens
aguuuuuaauuuaucagagac

SEQ ID NO: 1959335 - RNA, 17 nt, Homo sapiens
guuuugugagaacuaau

SEQ ID NO: 1959336 - RNA, 17 nt, Homo sapiens
caguuagcucauuugag

SEQ ID NO: 1959337 - RNA, 22 nt, Homo sapiens
accauaaugagaugugagccuu

SEQ ID NO: 1959338 - RNA, 23 nt, Homo sapiens
cuggucaggcccuggugcgaaug

SEQ ID NO: 1959339 - RNA, 18 nt, Homo sapiens
caugucuccuacugagga

SEQ ID NO: 1959340 - RNA, 13 nt, Homo sapiens
gcucaaugcaaau

SEQ ID NO: 1959341 - RNA, 21 nt, Homo sapiens
ugucgagagcuggccaaagag

SEQ ID NO: 1959342 - RNA, 14 nt, Homo sapiens
agggcacaagcuca

SEQ ID NO: 1959343 - RNA, 18 nt, Homo sapiens
uauccaccucccuaccaa

SEQ ID NO: 1959344 - RNA, 19 nt, Homo sapiens
gugugaugcaaaugcucaa

SEQ ID NO: 1959345 - RNA, 15 nt, Homo sapiens
ugaaaugaaaacaug

SEQ ID NO: 1959346 - RNA, 19 nt, Homo sapiens
ccucugcgccucuccacug

SEQ ID NO: 1959347 - RNA, 20 nt, Homo sapiens
agccuugugggugugagcag

SEQ ID NO: 1959348 - RNA, 23 nt, Homo sapiens
agcugcaccagagcaaccucuca

SEQ ID NO: 1959349 - RNA, 19 nt, Homo sapiens
uuuugaacauaaagccuug

SEQ ID NO: 1959350 - RNA, 17 nt, Homo sapiens
uggcaggugauguccug

SEQ ID NO: 1959351 - RNA, 15 nt, Homo sapiens
gagccccacccagac

SEQ ID NO: 1959352 - RNA, 23 nt, Homo sapiens
ugagaagggacaagccaccuuga

SEQ ID NO: 1959353 - RNA, 20 nt, Homo sapiens
uuagcuaguuuuauucuugg

SEQ ID NO: 1959354 - RNA, 10 nt, Homo sapiens
agaaccaaaa

SEQ ID NO: 1959355 - RNA, 10 nt, Homo sapiens
aaaaccaaag

SEQ ID NO: 1959356 - RNA, 16 nt, Homo sapiens
auuaccaguguucccu

SEQ ID NO: 1959357 - RNA, 21 nt, Homo sapiens
ugguagguuugaaugacgugu

SEQ ID NO: 1959358 - RNA, 19 nt, Homo sapiens
auuauuuauucagcuucau

SEQ ID NO: 1959359 - RNA, 21 nt, Homo sapiens
gacgccacucauuucaucuca

SEQ ID NO: 1959360 - RNA, 22 nt, Homo sapiens
ucaguuuaucuguucauaugga

SEQ ID NO: 1959361 - RNA, 21 nt, Homo sapiens
agcuguggagacucuuguacu

SEQ ID NO: 1959362 - RNA, 18 nt, Homo sapiens
uaaauguugcaaugcaug

SEQ ID NO: 1959363 - RNA, 16 nt, Homo sapiens
cacagacccacaagag

SEQ ID NO: 1959364 - RNA, 16 nt, Homo sapiens
gauuacguuuacauuc

SEQ ID NO: 1959365 - RNA, 20 nt, Homo sapiens
gcaaaggggggaagggacau

SEQ ID NO: 1959366 - RNA, 12 nt, Homo sapiens
uuuggggagcag

SEQ ID NO: 1959367 - RNA, 14 nt, Homo sapiens
gguuuuguacugga

SEQ ID NO: 1959368 - RNA, 20 nt, Homo sapiens
aaccucugccucccggguuc

SEQ ID NO: 1959369 - RNA, 10 nt, Homo sapiens
uuuucuuaua

SEQ ID NO: 1959370 - RNA, 23 nt, Homo sapiens
gcuagccaucuugaucuguguuu

SEQ ID NO: 1959371 - RNA, 17 nt, Homo sapiens
auuaauaauccuuccag

SEQ ID NO: 1959372 - RNA, 14 nt, Homo sapiens
uauauaaacugugc

SEQ ID NO: 1959373 - RNA, 19 nt, Homo sapiens
uucuguagaaggcaagagu

SEQ ID NO: 1959374 - RNA, 23 nt, Homo sapiens
aaaccacaugggcugggggccag

SEQ ID NO: 1959375 - RNA, 20 nt, Homo sapiens
ccaaggaaauaaugugaaug

SEQ ID NO: 1959376 - RNA, 17 nt, Homo sapiens
auaaaaucagugugcuu

SEQ ID NO: 1959377 - RNA, 19 nt, Homo sapiens
cuggggauggaauuauugu

SEQ ID NO: 1959378 - RNA, 18 nt, Homo sapiens
ugcugggccccaucucca

SEQ ID NO: 1959379 - RNA, 21 nt, Homo sapiens
ccaguagcugcccuuccugcc

SEQ ID NO: 1959380 - RNA, 20 nt, Homo sapiens
guaagaguguucaacuguga

SEQ ID NO: 1959381 - RNA, 21 nt, Homo sapiens
acaauuuucagauuugcacaa

SEQ ID NO: 1959382 - RNA, 13 nt, Homo sapiens
uuucaauucaaaa

SEQ ID NO: 1959383 - RNA, 13 nt, Homo sapiens
guagaguggugcu

SEQ ID NO: 1959384 - RNA, 13 nt, Homo sapiens
uagaauaccccac

SEQ ID NO: 1959385 - RNA, 14 nt, Homo sapiens
uccuucaaacaaug

SEQ ID NO: 1959386 - RNA, 13 nt, Homo sapiens
caaggacugagca

SEQ ID NO: 1959387 - RNA, 13 nt, Homo sapiens
ucugaacauuucu

SEQ ID NO: 1959388 - RNA, 18 nt, Homo sapiens
cggugggcugaguacagu

SEQ ID NO: 1959389 - RNA, 20 nt, Homo sapiens
cccucaaaaugacagccaug

SEQ ID NO: 1959390 - RNA, 14 nt, Homo sapiens
agauuaaucuacca

SEQ ID NO: 1959391 - RNA, 16 nt, Homo sapiens
uacagacagagaauau

SEQ ID NO: 1959392 - RNA, 17 nt, Homo sapiens
auaucuauaaacacugu

SEQ ID NO: 1959393 - RNA, 17 nt, Homo sapiens
cacuuuuuuccugucaa

SEQ ID NO: 1959394 - RNA, 21 nt, Homo sapiens
aagucucuuaauucugaugcu

SEQ ID NO: 1959395 - RNA, 18 nt, Homo sapiens
auccacagccaacaaaca

SEQ ID NO: 1959396 - RNA, 13 nt, Homo sapiens
gagagcccuagaa

SEQ ID NO: 1959397 - RNA, 18 nt, Homo sapiens
auguuaagcucuuuauga

SEQ ID NO: 1959398 - RNA, 20 nt, Homo sapiens
aaaacagggugggcaaacuc

SEQ ID NO: 1959399 - RNA, 16 nt, Homo sapiens
cgcuguuccacaguga

SEQ ID NO: 1959400 - RNA, 18 nt, Homo sapiens
ucacgauuccagugcagu

SEQ ID NO: 1959401 - RNA, 18 nt, Homo sapiens
aauaaacaccacacccag

SEQ ID NO: 1959402 - RNA, 22 nt, Homo sapiens
gcugauacaaauugcagacugu

SEQ ID NO: 1959403 - RNA, 16 nt, Homo sapiens
guuggugaauuucaca

SEQ ID NO: 1959404 - RNA, 18 nt, Homo sapiens
agaugaauggucuggcaa

SEQ ID NO: 1959405 - RNA, 23 nt, Homo sapiens
ggaggccgggagaggaugucuuu

SEQ ID NO: 1959406 - RNA, 19 nt, Homo sapiens
cacaauauacgaaaagcca

SEQ ID NO: 1959407 - RNA, 12 nt, Homo sapiens
cuccugccccug

SEQ ID NO: 1959408 - RNA, 21 nt, Homo sapiens
aguggggaaaacuauggugga

SEQ ID NO: 1959409 - RNA, 18 nt, Homo sapiens
ggccugggaucuggcaca

SEQ ID NO: 1959410 - RNA, 14 nt, Homo sapiens
cucuuuuguccuca

SEQ ID NO: 1959411 - RNA, 14 nt, Homo sapiens
gaguuccucaggga

SEQ ID NO: 1959412 - RNA, 19 nt, Homo sapiens
ugaauaagauccaauucau

SEQ ID NO: 1959413 - RNA, 21 nt, Homo sapiens
caagguuuaaacuucucugaa

SEQ ID NO: 1959414 - RNA, 16 nt, Homo sapiens
cauaccuaaguacugu

SEQ ID NO: 1959415 - RNA, 21 nt, Homo sapiens
guguuuguuucgccauggcuu

SEQ ID NO: 1959416 - RNA, 18 nt, Homo sapiens
uugaacugguugugaaua

SEQ ID NO: 1959417 - RNA, 19 nt, Homo sapiens
ugcaaucgcuuuccuaaaa

SEQ ID NO: 1959418 - RNA, 17 nt, Homo sapiens
cucucacucagccuguu

SEQ ID NO: 1959419 - RNA, 15 nt, Homo sapiens
cagagcccaccagcc

SEQ ID NO: 1959420 - RNA, 21 nt, Homo sapiens
ugagccuggcccauagaaaca

SEQ ID NO: 1959421 - RNA, 22 nt, Homo sapiens
acucaguaacacagugcaguac

SEQ ID NO: 1959422 - RNA, 14 nt, Homo sapiens
caccaugcugcagg

SEQ ID NO: 1959423 - RNA, 14 nt, Homo sapiens
ugaacuuugcaaag

SEQ ID NO: 1959424 - RNA, 15 nt, Homo sapiens
cuuauagguuuccac

SEQ ID NO: 1959425 - RNA, 14 nt, Homo sapiens
cuccgcacuuggaa

SEQ ID NO: 1959426 - RNA, 14 nt, Homo sapiens
gcugauacgacagc

SEQ ID NO: 1959427 - RNA, 20 nt, Homo sapiens
auguacuaaaguagagcccu

SEQ ID NO: 1959428 - RNA, 20 nt, Homo sapiens
aaccaccuaccuuacaguga

SEQ ID NO: 1959429 - RNA, 18 nt, Homo sapiens
cagcugcagaugccacac

SEQ ID NO: 1959430 - RNA, 19 nt, Homo sapiens
auucaaccugugucuuaua

SEQ ID NO: 1959431 - RNA, 15 nt, Homo sapiens
aaauauauaugauau

SEQ ID NO: 1959432 - RNA, 17 nt, Homo sapiens
acuugcauacagagaca

SEQ ID NO: 1959433 - RNA, 15 nt, Homo sapiens
aagcugcacaugugc

SEQ ID NO: 1959434 - RNA, 23 nt, Homo sapiens
uuucaauacacucaagugccauu

SEQ ID NO: 1959435 - RNA, 20 nt, Homo sapiens
guugcccaccaaaacacaga

SEQ ID NO: 1959436 - RNA, 12 nt, Homo sapiens
gcucccaccagc

SEQ ID NO: 1959437 - RNA, 17 nt, Homo sapiens
uaaagagaccaucuucu

SEQ ID NO: 1959438 - RNA, 20 nt, Homo sapiens
agugggccugguagcacaug

SEQ ID NO: 1959439 - RNA, 20 nt, Homo sapiens
ccuggugggaaaaugcacac

SEQ ID NO: 1959440 - RNA, 15 nt, Homo sapiens
cauuucugcucucag

SEQ ID NO: 1959441 - RNA, 19 nt, Homo sapiens
aaagauugauuuguguguu

SEQ ID NO: 1959442 - RNA, 22 nt, Homo sapiens
agucuuuuguucgcauggucac

SEQ ID NO: 1959443 - RNA, 20 nt, Homo sapiens
cucucaaaagagaaaaacaa

SEQ ID NO: 1959444 - RNA, 19 nt, Homo sapiens
uagaaguagcaaaaaguau

SEQ ID NO: 1959445 - RNA, 17 nt, Homo sapiens
aagaccagccuggccaa

SEQ ID NO: 1959446 - RNA, 20 nt, Homo sapiens
cagcucccagccucuuccca

SEQ ID NO: 1959447 - RNA, 22 nt, Homo sapiens
cacggaguggcuugagcuucug

SEQ ID NO: 1959448 - RNA, 15 nt, Homo sapiens
ucagucuuugcucag

SEQ ID NO: 1959449 - RNA, 18 nt, Homo sapiens
agauauuuuuauauagac

SEQ ID NO: 1959450 - RNA, 17 nt, Homo sapiens
ugcaaacaucaaccugg

SEQ ID NO: 1959451 - RNA, 15 nt, Homo sapiens
gauucuucccauucu

SEQ ID NO: 1959452 - RNA, 17 nt, Homo sapiens
cagcagggacuguaaac

SEQ ID NO: 1959453 - RNA, 18 nt, Homo sapiens
augagauguuauuacugu

SEQ ID NO: 1959454 - RNA, 17 nt, Homo sapiens
auaguacagacagaagg

SEQ ID NO: 1959455 - RNA, 13 nt, Homo sapiens
caggcccaucuca

SEQ ID NO: 1959456 - RNA, 17 nt, Homo sapiens
cuauuuuggacguguga

SEQ ID NO: 1959457 - RNA, 17 nt, Homo sapiens
auugucaaagcuugccg

SEQ ID NO: 1959458 - RNA, 17 nt, Homo sapiens
cccagcguuugaugggu

SEQ ID NO: 1959459 - RNA, 15 nt, Homo sapiens
aggagcccugcagug

SEQ ID NO: 1959460 - RNA, 13 nt, Homo sapiens
agugcacaugccc

SEQ ID NO: 1959461 - RNA, 13 nt, Homo sapiens
agugcagugccac

SEQ ID NO: 1959462 - RNA, 22 nt, Homo sapiens
auuuaaccaaccuaagggccca

SEQ ID NO: 1959463 - RNA, 14 nt, Homo sapiens
aggaacauggagcu

SEQ ID NO: 1959464 - RNA, 13 nt, Homo sapiens
uuuccaaaaaagu

SEQ ID NO: 1959465 - RNA, 16 nt, Homo sapiens
uacauugugcaauuga

SEQ ID NO: 1959466 - RNA, 13 nt, Homo sapiens
caguucuugccac

SEQ ID NO: 1959467 - RNA, 23 nt, Homo sapiens
caaagcaaggaaacuauguaaca

SEQ ID NO: 1959468 - RNA, 13 nt, Homo sapiens
aggucugccaggc

SEQ ID NO: 1959469 - RNA, 13 nt, Homo sapiens
gccaggggugcuc

SEQ ID NO: 1959470 - RNA, 18 nt, Homo sapiens
cgcaccaauaaagccuuc

SEQ ID NO: 1959471 - RNA, 20 nt, Homo sapiens
gagcaggugcccccagguga

SEQ ID NO: 1959472 - RNA, 19 nt, Homo sapiens
agcaguuuccucagugaug

SEQ ID NO: 1959473 - RNA, 18 nt, Homo sapiens
ugaggcccauggccacau

SEQ ID NO: 1959474 - RNA, 15 nt, Homo sapiens
ccaacccccaucucc

SEQ ID NO: 1959475 - RNA, 22 nt, Homo sapiens
ccaucguccuuccucucaagcu

SEQ ID NO: 1959476 - RNA, 18 nt, Homo sapiens
uuaaauuuuauaugggcu

SEQ ID NO: 1959477 - RNA, 20 nt, Homo sapiens
ucccuccaaagggcaguggg

SEQ ID NO: 1959478 - RNA, 15 nt, Homo sapiens
ugcugucccugucag

SEQ ID NO: 1959479 - RNA, 12 nt, Homo sapiens
acgugcacagcu

SEQ ID NO: 1959480 - RNA, 13 nt, Homo sapiens
uguuccucuagua

SEQ ID NO: 1959481 - RNA, 14 nt, Homo sapiens
gaaacucaaaaaua

SEQ ID NO: 1959482 - RNA, 16 nt, Homo sapiens
gugaucugucuuguaa

SEQ ID NO: 1959483 - RNA, 19 nt, Homo sapiens
uauggaauuccagugccag

SEQ ID NO: 1959484 - RNA, 21 nt, Homo sapiens
cucagaagagggaacuaagca

SEQ ID NO: 1959485 - RNA, 13 nt, Homo sapiens
uugagaacugaca

SEQ ID NO: 1959486 - RNA, 13 nt, Homo sapiens
ugaaauugauguu

SEQ ID NO: 1959487 - RNA, 24 nt, Homo sapiens
gacaaaggcucuacacauacugca

SEQ ID NO: 1959488 - RNA, 17 nt, Homo sapiens
acuguaaccugauucau

SEQ ID NO: 1959489 - RNA, 17 nt, Homo sapiens
aaagcauuuauuaagaa

SEQ ID NO: 1959490 - RNA, 14 nt, Homo sapiens
ucaacuucaucagu

SEQ ID NO: 1959491 - RNA, 15 nt, Homo sapiens
cucccugccaucccc

SEQ ID NO: 1959492 - RNA, 14 nt, Homo sapiens
gcccuuacacacuc

SEQ ID NO: 1959493 - RNA, 18 nt, Homo sapiens
ugaccaaaggugugcccu

SEQ ID NO: 1959494 - RNA, 15 nt, Homo sapiens
agccaaaggggagcc

SEQ ID NO: 1959495 - RNA, 12 nt, Homo sapiens
gccuggcccuug

SEQ ID NO: 1959496 - RNA, 19 nt, Homo sapiens
acaggcauuuguucacuga

SEQ ID NO: 1959497 - RNA, 21 nt, Homo sapiens
ccaaggccuucuccuccccac

SEQ ID NO: 1959498 - RNA, 18 nt, Homo sapiens
agguugcagacucucucu

SEQ ID NO: 1959499 - RNA, 15 nt, Homo sapiens
gaguaacuugcaagu

SEQ ID NO: 1959500 - RNA, 18 nt, Homo sapiens
ucuuuucugaucugcagu

SEQ ID NO: 1959501 - RNA, 13 nt, Homo sapiens
caagucccaugau

SEQ ID NO: 1959502 - RNA, 15 nt, Homo sapiens
auauaaaacagucau

SEQ ID NO: 1959503 - RNA, 21 nt, Homo sapiens
guguugcaccaggcacugcug

SEQ ID NO: 1959504 - RNA, 23 nt, Homo sapiens
cugucugaguaagcccucaggag

SEQ ID NO: 1959505 - RNA, 17 nt, Homo sapiens
gaauuauuguaccauuu

SEQ ID NO: 1959506 - RNA, 21 nt, Homo sapiens
ccuagauuacaucugccuuaa

SEQ ID NO: 1959507 - RNA, 22 nt, Homo sapiens
ugucugacacgcaaguguguga

SEQ ID NO: 1959508 - RNA, 12 nt, Homo sapiens
ccugggugugcc

SEQ ID NO: 1959509 - RNA, 15 nt, Homo sapiens
gagauaaaagcaauu

SEQ ID NO: 1959510 - RNA, 16 nt, Homo sapiens
acaagcauuuguucca

SEQ ID NO: 1959511 - RNA, 14 nt, Homo sapiens
aauuuaauuccucu

SEQ ID NO: 1959512 - RNA, 15 nt, Homo sapiens
ucugaguccugagac

SEQ ID NO: 1959513 - RNA, 16 nt, Homo sapiens
ucaguuacaagugcag

SEQ ID NO: 1959514 - RNA, 23 nt, Homo sapiens
aaaugaauuuuuuuuauccuccu

SEQ ID NO: 1959515 - RNA, 17 nt, Homo sapiens
caaaauagaaaaguuau

SEQ ID NO: 1959516 - RNA, 22 nt, Homo sapiens
cuuagucuguuuucuaaagcca

SEQ ID NO: 1959517 - RNA, 23 nt, Homo sapiens
cagcugguugggggcaccaucug

SEQ ID NO: 1959518 - RNA, 17 nt, Homo sapiens
gguccucuguugcaaac

SEQ ID NO: 1959519 - RNA, 16 nt, Homo sapiens
agugaccucacuggcc

SEQ ID NO: 1959520 - RNA, 17 nt, Homo sapiens
cuguccuuacauacuca

SEQ ID NO: 1959521 - RNA, 21 nt, Homo sapiens
aaaguagaggaauccauguaa

SEQ ID NO: 1959522 - RNA, 14 nt, Homo sapiens
uuucacacagugaa

SEQ ID NO: 1959523 - RNA, 15 nt, Homo sapiens
acauuuaucacugaa

SEQ ID NO: 1959524 - RNA, 20 nt, Homo sapiens
caagcauggaaaaucaguga

SEQ ID NO: 1959525 - RNA, 19 nt, Homo sapiens
cauugagaucacuacucag

SEQ ID NO: 1959526 - RNA, 17 nt, Homo sapiens
cagcagagaucugcagg

SEQ ID NO: 1959527 - RNA, 11 nt, Homo sapiens
uuguucaggga

SEQ ID NO: 1959528 - RNA, 21 nt, Homo sapiens
ggacuggacgugcucagacau

SEQ ID NO: 1959529 - RNA, 18 nt, Homo sapiens
uguugguucuuagaccuc

SEQ ID NO: 1959530 - RNA, 17 nt, Homo sapiens
ugcuggaugcugcugua

SEQ ID NO: 1959531 - RNA, 18 nt, Homo sapiens
uaaagcuuauucuuuguc

SEQ ID NO: 1959532 - RNA, 14 nt, Homo sapiens
cuauacuugaacaa

SEQ ID NO: 1959533 - RNA, 18 nt, Homo sapiens
aguuagucaauccuguca

SEQ ID NO: 1959534 - RNA, 20 nt, Homo sapiens
auauauuuauaaauauguga

SEQ ID NO: 1959535 - RNA, 14 nt, Homo sapiens
auguacaacugcac

SEQ ID NO: 1959536 - RNA, 18 nt, Homo sapiens
ugccaagaaaguauuugg

SEQ ID NO: 1959537 - RNA, 15 nt, Homo sapiens
cccuuuggggagcag

SEQ ID NO: 1959538 - RNA, 13 nt, Homo sapiens
caagcaagacuga

SEQ ID NO: 1959539 - RNA, 18 nt, Homo sapiens
ggcccaaagaaagagcua

SEQ ID NO: 1959540 - RNA, 14 nt, Homo sapiens
agcucacgccuuag

SEQ ID NO: 1959541 - RNA, 14 nt, Homo sapiens
ugaaagauauguau

SEQ ID NO: 1959542 - RNA, 12 nt, Homo sapiens
ugguuugggauc

SEQ ID NO: 1959543 - RNA, 20 nt, Homo sapiens
ugcucugaacuggaugauac

SEQ ID NO: 1959544 - RNA, 19 nt, Homo sapiens
gagccaaacacacuguaaa

SEQ ID NO: 1959545 - RNA, 18 nt, Homo sapiens
cacuggcauaaaucugaa

SEQ ID NO: 1959546 - RNA, 12 nt, Homo sapiens
uaaaaguucuuu

SEQ ID NO: 1959547 - RNA, 12 nt, Homo sapiens
uuuaaguucaau

SEQ ID NO: 1959548 - RNA, 18 nt, Homo sapiens
gaaucuaaaaccaaauau

SEQ ID NO: 1959549 - RNA, 22 nt, Homo sapiens
caccaucuuggcucacugcaac

SEQ ID NO: 1959550 - RNA, 19 nt, Homo sapiens
uagggccccugcacacuca

SEQ ID NO: 1959551 - RNA, 18 nt, Homo sapiens
agcggguaaagugcaaug

SEQ ID NO: 1959552 - RNA, 19 nt, Homo sapiens
ugcuucuguguagucaaua

SEQ ID NO: 1959553 - RNA, 16 nt, Homo sapiens
aauaguuuacauguag

SEQ ID NO: 1959554 - RNA, 18 nt, Homo sapiens
caguuccugaguaccuuc

SEQ ID NO: 1959555 - RNA, 20 nt, Homo sapiens
gcuccuguuugucugaugug

SEQ ID NO: 1959556 - RNA, 14 nt, Homo sapiens
ggaggacauuuggu

SEQ ID NO: 1959557 - RNA, 16 nt, Homo sapiens
auggacgaagcaacaa

SEQ ID NO: 1959558 - RNA, 13 nt, Homo sapiens
cucuccaagcacu

SEQ ID NO: 1959559 - RNA, 16 nt, Homo sapiens
acugcgauaacugaga

SEQ ID NO: 1959560 - RNA, 20 nt, Homo sapiens
gguugugagagccugugauc

SEQ ID NO: 1959561 - RNA, 20 nt, Homo sapiens
cucuauauaccaaagcacau

SEQ ID NO: 1959562 - RNA, 11 nt, Homo sapiens
uaaaagccauc

SEQ ID NO: 1959563 - RNA, 16 nt, Homo sapiens
cugauguuuauguacu

SEQ ID NO: 1959564 - RNA, 19 nt, Homo sapiens
ugaaaaaauauauguauau

SEQ ID NO: 1959565 - RNA, 16 nt, Homo sapiens
gguaacuagcugagca

SEQ ID NO: 1959566 - RNA, 16 nt, Homo sapiens
cccugucuuuccagca

SEQ ID NO: 1959567 - RNA, 19 nt, Homo sapiens
gagaaguggguggggacag

SEQ ID NO: 1959568 - RNA, 21 nt, Homo sapiens
uggauaacuguaaaagggcuc

SEQ ID NO: 1959569 - RNA, 14 nt, Homo sapiens
caggcuaaaugcac

SEQ ID NO: 1959570 - RNA, 23 nt, Homo sapiens
auuaguacagaaauauccaugac

SEQ ID NO: 1959571 - RNA, 17 nt, Homo sapiens
aaauuguuuuucugaaa

SEQ ID NO: 1959572 - RNA, 22 nt, Homo sapiens
cuguaaucccagcuacuaggga

SEQ ID NO: 1959573 - RNA, 24 nt, Homo sapiens
uccccaacagugugaaguuagaau

SEQ ID NO: 1959574 - RNA, 16 nt, Homo sapiens
uauagaaugagugcag

SEQ ID NO: 1959575 - RNA, 11 nt, Homo sapiens
ugaagugcaga

SEQ ID NO: 1959576 - RNA, 11 nt, Homo sapiens
uauagugcaau

SEQ ID NO: 1959577 - RNA, 11 nt, Homo sapiens
uggagugcagg

SEQ ID NO: 1959578 - RNA, 15 nt, Homo sapiens
gugagguucuugggu

SEQ ID NO: 1959579 - RNA, 18 nt, Homo sapiens
uuuaacuugagcuuuaaa

SEQ ID NO: 1959580 - RNA, 23 nt, Homo sapiens
gugagcucuuccaggagccaccu

SEQ ID NO: 1959581 - RNA, 21 nt, Homo sapiens
uggugcuacgaccagggugag

SEQ ID NO: 1959582 - RNA, 22 nt, Homo sapiens
aggcaguucgaccagccaggga

SEQ ID NO: 1959583 - RNA, 19 nt, Homo sapiens
ggccucgucuuucauggac

SEQ ID NO: 1959584 - RNA, 16 nt, Homo sapiens
uaaaagcccuuuccaa

SEQ ID NO: 1959585 - RNA, 22 nt, Homo sapiens
ccauuuccaaauguggccucca

SEQ ID NO: 1959586 - RNA, 13 nt, Homo sapiens
aacaaagcccuua

SEQ ID NO: 1959587 - RNA, 22 nt, Homo sapiens
ugucuuugacuugguuaaagga

SEQ ID NO: 1959588 - RNA, 23 nt, Homo sapiens
auuuuccuaaaaauaagcuuuau

SEQ ID NO: 1959589 - RNA, 23 nt, Homo sapiens
ugccuaguuuuuaguaaucugua

SEQ ID NO: 1959590 - RNA, 20 nt, Homo sapiens
cugaaugaagccuucugacc

SEQ ID NO: 1959591 - RNA, 16 nt, Homo sapiens
cauuugcugcauuuca

SEQ ID NO: 1959592 - RNA, 20 nt, Homo sapiens
auguuggucugacaucaagg

SEQ ID NO: 1959593 - RNA, 20 nt, Homo sapiens
aauacgguggggguaggggg

SEQ ID NO: 1959594 - RNA, 15 nt, Homo sapiens
uccagaccucuacaa

SEQ ID NO: 1959595 - RNA, 15 nt, Homo sapiens
gaagcugggcugucu

SEQ ID NO: 1959596 - RNA, 22 nt, Homo sapiens
ucccucauguucucauguuugu

SEQ ID NO: 1959597 - RNA, 14 nt, Homo sapiens
ccuuccucuucaga

SEQ ID NO: 1959598 - RNA, 14 nt, Homo sapiens
ggaaagacuugaau

SEQ ID NO: 1959599 - RNA, 13 nt, Homo sapiens
ggccgcacugggg

SEQ ID NO: 1959600 - RNA, 20 nt, Homo sapiens
aucaaaagggagagaacaaa

SEQ ID NO: 1959601 - RNA, 19 nt, Homo sapiens
uguuguguccugacaccuc

SEQ ID NO: 1959602 - RNA, 21 nt, Homo sapiens
cugcagugacgugcaccugua

SEQ ID NO: 1959603 - RNA, 20 nt, Homo sapiens
gccauaugcaggacagcagu

SEQ ID NO: 1959604 - RNA, 11 nt, Homo sapiens
ccuuacucuga

SEQ ID NO: 1959605 - RNA, 17 nt, Homo sapiens
cagaggucugugcugag

SEQ ID NO: 1959606 - RNA, 17 nt, Homo sapiens
cugguaauagcuguaaa

SEQ ID NO: 1959607 - RNA, 13 nt, Homo sapiens
gagccaggguaga

SEQ ID NO: 1959608 - RNA, 15 nt, Homo sapiens
cacagaggagugcag

SEQ ID NO: 1959609 - RNA, 16 nt, Homo sapiens
cuuucagauacuggau

SEQ ID NO: 1959610 - RNA, 18 nt, Homo sapiens
ccucugcuaagguguauu

SEQ ID NO: 1959611 - RNA, 22 nt, Homo sapiens
uguauauauuauuauaaucuua

SEQ ID NO: 1959612 - RNA, 13 nt, Homo sapiens
aagauaucuugaa

SEQ ID NO: 1959613 - RNA, 15 nt, Homo sapiens
aaagauggaagugua

SEQ ID NO: 1959614 - RNA, 21 nt, Homo sapiens
acaauggcccaggucucucaa

SEQ ID NO: 1959615 - RNA, 23 nt, Homo sapiens
acauucucugaccuacucgaggg

SEQ ID NO: 1959616 - RNA, 19 nt, Homo sapiens
auauuucuaccugagugaa

SEQ ID NO: 1959617 - RNA, 16 nt, Homo sapiens
auacugugugcuaaaa

SEQ ID NO: 1959618 - RNA, 15 nt, Homo sapiens
uacuauuauuugcua

SEQ ID NO: 1959619 - RNA, 21 nt, Homo sapiens
cggacaagacccccagcacuu

SEQ ID NO: 1959620 - RNA, 19 nt, Homo sapiens
acauuuauuaagugaucca

SEQ ID NO: 1959621 - RNA, 19 nt, Homo sapiens
gcuguggggaacacagcua

SEQ ID NO: 1959622 - RNA, 15 nt, Homo sapiens
augcaaucagacaag

SEQ ID NO: 1959623 - RNA, 18 nt, Homo sapiens
auaccuuuauugugaucu

SEQ ID NO: 1959624 - RNA, 17 nt, Homo sapiens
auaaauuuuuauaagga

SEQ ID NO: 1959625 - RNA, 21 nt, Homo sapiens
aguggccuguaguccaucucc

SEQ ID NO: 1959626 - RNA, 18 nt, Homo sapiens
gcgaggccuauuguugaa

SEQ ID NO: 1959627 - RNA, 14 nt, Homo sapiens
accuaaaugaugcc

SEQ ID NO: 1959628 - RNA, 16 nt, Homo sapiens
aaaacugcaguuugau

SEQ ID NO: 1959629 - RNA, 23 nt, Homo sapiens
ugagaggagagagacuccagcug

SEQ ID NO: 1959630 - RNA, 16 nt, Homo sapiens
cauaaguuuaacugua

SEQ ID NO: 1959631 - RNA, 15 nt, Homo sapiens
cauuuaucaucacaa

SEQ ID NO: 1959632 - RNA, 23 nt, Homo sapiens
cagagggccccgcccagugcagu

SEQ ID NO: 1959633 - RNA, 12 nt, Homo sapiens
uaaucagcuguu

SEQ ID NO: 1959634 - RNA, 19 nt, Homo sapiens
uuuaaaaaaaaacauucaa

SEQ ID NO: 1959635 - RNA, 21 nt, Homo sapiens
cuaugggaacaauugaaguaa

SEQ ID NO: 1959636 - RNA, 17 nt, Homo sapiens
caaagauguggggaaaa

SEQ ID NO: 1959637 - RNA, 14 nt, Homo sapiens
cauaacuguucuca

SEQ ID NO: 1959638 - RNA, 14 nt, Homo sapiens
uauucuaauaagcu

SEQ ID NO: 1959639 - RNA, 21 nt, Homo sapiens
aagccccuggaaaugugcuaa

SEQ ID NO: 1959640 - RNA, 18 nt, Homo sapiens
gagaucuguguggcuccu

SEQ ID NO: 1959641 - RNA, 15 nt, Homo sapiens
ugaaauuauaaucug

SEQ ID NO: 1959642 - RNA, 21 nt, Homo sapiens
ucucacuacuugaccauucuc

SEQ ID NO: 1959643 - RNA, 14 nt, Homo sapiens
agcaagagccaggg

SEQ ID NO: 1959644 - RNA, 23 nt, Homo sapiens
aauauauguuuuaauaccacaaa

SEQ ID NO: 1959645 - RNA, 23 nt, Homo sapiens
gggugcuucucuccuaucugugc

SEQ ID NO: 1959646 - RNA, 14 nt, Homo sapiens
gcacuuuguaugau

SEQ ID NO: 1959647 - RNA, 22 nt, Homo sapiens
caagagacaugguauugacuca

SEQ ID NO: 1959648 - RNA, 22 nt, Homo sapiens
cuacuagucaagagaaguacag

SEQ ID NO: 1959649 - RNA, 18 nt, Homo sapiens
caugcuagcaacauacca

SEQ ID NO: 1959650 - RNA, 16 nt, Homo sapiens
ugaacagccaaaugca

SEQ ID NO: 1959651 - RNA, 18 nt, Homo sapiens
augcaguuuuaagaauug

SEQ ID NO: 1959652 - RNA, 21 nt, Homo sapiens
acccucccuccacuccucuca

SEQ ID NO: 1959653 - RNA, 16 nt, Homo sapiens
agggaggaagaagcuu

SEQ ID NO: 1959654 - RNA, 13 nt, Homo sapiens
uuucaaaaaccau

SEQ ID NO: 1959655 - RNA, 22 nt, Homo sapiens
gggccagcacuggaggggccca

SEQ ID NO: 1959656 - RNA, 22 nt, Homo sapiens
auccuugucugaauguauuuau

SEQ ID NO: 1959657 - RNA, 21 nt, Homo sapiens
accuggccccaggcugucacc

SEQ ID NO: 1959658 - RNA, 17 nt, Homo sapiens
uaagagaagaugugauu

SEQ ID NO: 1959659 - RNA, 19 nt, Homo sapiens
aggaauauuaaagggauuc

SEQ ID NO: 1959660 - RNA, 17 nt, Homo sapiens
uccacuauuuucaaaga

SEQ ID NO: 1959661 - RNA, 15 nt, Homo sapiens
agcugccaccaucac

SEQ ID NO: 1959662 - RNA, 22 nt, Homo sapiens
ucaaccugguggcaccagaugc

SEQ ID NO: 1959663 - RNA, 23 nt, Homo sapiens
aucuccaauggaaagcuuuucag

SEQ ID NO: 1959664 - RNA, 14 nt, Homo sapiens
cacauaaacuuuau

SEQ ID NO: 1959665 - RNA, 15 nt, Homo sapiens
gaagaaaaucaacca

SEQ ID NO: 1959666 - RNA, 18 nt, Homo sapiens
gugcuauaggcuggagaa

SEQ ID NO: 1959667 - RNA, 18 nt, Homo sapiens
gacugaaacgccuugcac

SEQ ID NO: 1959668 - RNA, 20 nt, Homo sapiens
gcaacuuauggacucgcuag

SEQ ID NO: 1959669 - RNA, 18 nt, Homo sapiens
auuaucuuaugaauaagc

SEQ ID NO: 1959670 - RNA, 15 nt, Homo sapiens
uucaauaaccaugau

SEQ ID NO: 1959671 - RNA, 20 nt, Homo sapiens
aguggagcaaucucggcuca

SEQ ID NO: 1959672 - RNA, 17 nt, Homo sapiens
gauugugcccagcccuu

SEQ ID NO: 1959673 - RNA, 15 nt, Homo sapiens
ugagcaucccaggau

SEQ ID NO: 1959674 - RNA, 13 nt, Homo sapiens
guaauuaucugug

SEQ ID NO: 1959675 - RNA, 21 nt, Homo sapiens
uucccaggagaaagaugaaac

SEQ ID NO: 1959676 - RNA, 16 nt, Homo sapiens
cgcugacugccaccca

SEQ ID NO: 1959677 - RNA, 22 nt, Homo sapiens
gaagucugcuuaccaaaacaua

SEQ ID NO: 1959678 - RNA, 13 nt, Homo sapiens
augcaacaauucu

SEQ ID NO: 1959679 - RNA, 20 nt, Homo sapiens
cuuuucaccuuaaugcauau

SEQ ID NO: 1959680 - RNA, 13 nt, Homo sapiens
uuaaaauuucacu

SEQ ID NO: 1959681 - RNA, 13 nt, Homo sapiens
cuaaaauuccacu

SEQ ID NO: 1959682 - RNA, 16 nt, Homo sapiens
gacuccucuaagccac

SEQ ID NO: 1959683 - RNA, 22 nt, Homo sapiens
uguuuauugagcuguacaugca

SEQ ID NO: 1959684 - RNA, 18 nt, Homo sapiens
cauccacaauaaccaaga

SEQ ID NO: 1959685 - RNA, 20 nt, Homo sapiens
ucuuuaagaaucuauuuccu

SEQ ID NO: 1959686 - RNA, 14 nt, Homo sapiens
aaguuacuuuguaa

SEQ ID NO: 1959687 - RNA, 22 nt, Homo sapiens
gauaaagggaaccacuuucuua

SEQ ID NO: 1959688 - RNA, 15 nt, Homo sapiens
uguaauaaacucucu

SEQ ID NO: 1959689 - RNA, 19 nt, Homo sapiens
cauucuaugacucuugucu

SEQ ID NO: 1959690 - RNA, 14 nt, Homo sapiens
uacauagcuguuug

SEQ ID NO: 1959691 - RNA, 13 nt, Homo sapiens
gccucgugccagc

SEQ ID NO: 1959692 - RNA, 20 nt, Homo sapiens
aaagaugaccauaaccacug

SEQ ID NO: 1959693 - RNA, 23 nt, Homo sapiens
aaauucuucuccacuuucuagcc

SEQ ID NO: 1959694 - RNA, 20 nt, Homo sapiens
ugaaacuccaucucuacuga

SEQ ID NO: 1959695 - RNA, 21 nt, Homo sapiens
caauuaaaaugacaagcacua

SEQ ID NO: 1959696 - RNA, 15 nt, Homo sapiens
ugaccuugcaauguu

SEQ ID NO: 1959697 - RNA, 18 nt, Homo sapiens
cauuuguugugacuggca

SEQ ID NO: 1959698 - RNA, 13 nt, Homo sapiens
caggauggagcug

SEQ ID NO: 1959699 - RNA, 22 nt, Homo sapiens
uaacaaagaaguguauuuacaa

SEQ ID NO: 1959700 - RNA, 16 nt, Homo sapiens
gaugagugaggacuug

SEQ ID NO: 1959701 - RNA, 19 nt, Homo sapiens
augaccagcagcagcuuuc

SEQ ID NO: 1959702 - RNA, 20 nt, Homo sapiens
aggagauggaaguugcagug

SEQ ID NO: 1959703 - RNA, 17 nt, Homo sapiens
cacauuaccauucauag

SEQ ID NO: 1959704 - RNA, 21 nt, Homo sapiens
agcauugcagucacuuugaca

SEQ ID NO: 1959705 - RNA, 21 nt, Homo sapiens
auuucagugggaaauaugcca

SEQ ID NO: 1959706 - RNA, 13 nt, Homo sapiens
aaaugauauuuag

SEQ ID NO: 1959707 - RNA, 18 nt, Homo sapiens
aacuuugcccuccaaagu

SEQ ID NO: 1959708 - RNA, 19 nt, Homo sapiens
auccuucuaacuaaacuaa

SEQ ID NO: 1959709 - RNA, 18 nt, Homo sapiens
gcaacuaacuaaccacau

SEQ ID NO: 1959710 - RNA, 14 nt, Homo sapiens
ccuucagccuuaau

SEQ ID NO: 1959711 - RNA, 22 nt, Homo sapiens
cucgauuuuuaagagccuucaa

SEQ ID NO: 1959712 - RNA, 12 nt, Homo sapiens
caacagccaugc

SEQ ID NO: 1959713 - RNA, 15 nt, Homo sapiens
guacaacuucugggc

SEQ ID NO: 1959714 - RNA, 16 nt, Homo sapiens
aagacuuuguccccac

SEQ ID NO: 1959715 - RNA, 17 nt, Homo sapiens
uaaaauguaucuuccau

SEQ ID NO: 1959716 - RNA, 21 nt, Homo sapiens
gcccaagauuauucaauuuau

SEQ ID NO: 1959717 - RNA, 19 nt, Homo sapiens
gcgcuauugcacuccaguc

SEQ ID NO: 1959718 - RNA, 17 nt, Homo sapiens
augaaaaggacuuuaua

SEQ ID NO: 1959719 - RNA, 16 nt, Homo sapiens
agaguauuaucacugc

SEQ ID NO: 1959720 - RNA, 18 nt, Homo sapiens
uguaauaaaaguuuacaa

SEQ ID NO: 1959721 - RNA, 19 nt, Homo sapiens
ugagaaugaaugaguagga

SEQ ID NO: 1959722 - RNA, 20 nt, Homo sapiens
cugaaguuucacaugagcua

SEQ ID NO: 1959723 - RNA, 22 nt, Homo sapiens
aacuccuggcuuuccaggagac

SEQ ID NO: 1959724 - RNA, 19 nt, Homo sapiens
acacucuacaaaaugacua

SEQ ID NO: 1959725 - RNA, 15 nt, Homo sapiens
cugauggugcaauga

SEQ ID NO: 1959726 - RNA, 17 nt, Homo sapiens
acuauguguucaaugaa

SEQ ID NO: 1959727 - RNA, 18 nt, Homo sapiens
aaagggauaguccaaaga

SEQ ID NO: 1959728 - RNA, 12 nt, Homo sapiens
cagcucuucaga

SEQ ID NO: 1959729 - RNA, 18 nt, Homo sapiens
gcccuucauguacaucca

SEQ ID NO: 1959730 - RNA, 19 nt, Homo sapiens
ccaagaggacugagacugg

SEQ ID NO: 1959731 - RNA, 21 nt, Homo sapiens
caagauagucuucaguuucau

SEQ ID NO: 1959732 - RNA, 14 nt, Homo sapiens
accagcaugucacu

SEQ ID NO: 1959733 - RNA, 17 nt, Homo sapiens
acagccucuaguguccg

SEQ ID NO: 1959734 - RNA, 13 nt, Homo sapiens
aaaagaaggaaaa

SEQ ID NO: 1959735 - RNA, 11 nt, Homo sapiens
uagaugggcau

SEQ ID NO: 1959736 - RNA, 20 nt, Homo sapiens
cagcuagacucccauggaau

SEQ ID NO: 1959737 - RNA, 16 nt, Homo sapiens
gccaaagaaccaaaga

SEQ ID NO: 1959738 - RNA, 16 nt, Homo sapiens
aacaccaucuggaguc

SEQ ID NO: 1959739 - RNA, 22 nt, Homo sapiens
ccugggcuuggugcguuucaaa

SEQ ID NO: 1959740 - RNA, 23 nt, Homo sapiens
uggcaguuacagggcccagguga

SEQ ID NO: 1959741 - RNA, 12 nt, Homo sapiens
aaugguuaucau

SEQ ID NO: 1959742 - RNA, 22 nt, Homo sapiens
auaauacaucuuuaucauuaaa

SEQ ID NO: 1959743 - RNA, 16 nt, Homo sapiens
ucgcagccacccugag

SEQ ID NO: 1959744 - RNA, 22 nt, Homo sapiens
cuaagaucuaaaaugauacugu

SEQ ID NO: 1959745 - RNA, 12 nt, Homo sapiens
gccuuuuguuaa

SEQ ID NO: 1959746 - RNA, 19 nt, Homo sapiens
agauguuugaggcuuucag

SEQ ID NO: 1959747 - RNA, 14 nt, Homo sapiens
ugagucuccuuuag

SEQ ID NO: 1959748 - RNA, 23 nt, Homo sapiens
ccaagcagugccugccuaugaaa

SEQ ID NO: 1959749 - RNA, 16 nt, Homo sapiens
aucccagacacauuca

SEQ ID NO: 1959750 - RNA, 19 nt, Homo sapiens
gcaagagcccccuugacac

SEQ ID NO: 1959751 - RNA, 22 nt, Homo sapiens
aagccuaccguauuucagccau

SEQ ID NO: 1959752 - RNA, 19 nt, Homo sapiens
gcgcuaccggccgggccua

SEQ ID NO: 1959753 - RNA, 14 nt, Homo sapiens
uguguaugugcauu

SEQ ID NO: 1959754 - RNA, 20 nt, Homo sapiens
ugucuuuaaaagucauucaa

SEQ ID NO: 1959755 - RNA, 15 nt, Homo sapiens
ugcgacccaagaccc

SEQ ID NO: 1959756 - RNA, 22 nt, Homo sapiens
uucuaguguaacacugcaagaa

SEQ ID NO: 1959757 - RNA, 14 nt, Homo sapiens
ugagggcuuccuuu

SEQ ID NO: 1959758 - RNA, 21 nt, Homo sapiens
agcauugccauaccauuccca

SEQ ID NO: 1959759 - RNA, 12 nt, Homo sapiens
aaaaucuaacag

SEQ ID NO: 1959760 - RNA, 12 nt, Homo sapiens
acaaucuaaaag

SEQ ID NO: 1959761 - RNA, 14 nt, Homo sapiens
aagcuagguguuua

SEQ ID NO: 1959762 - RNA, 21 nt, Homo sapiens
cauugauguaaggacuguaaa

SEQ ID NO: 1959763 - RNA, 22 nt, Homo sapiens
cugcauuacucacuugcugcga

SEQ ID NO: 1959764 - RNA, 14 nt, Homo sapiens
uaaaaaugcugcuc

SEQ ID NO: 1959765 - RNA, 17 nt, Homo sapiens
uaagaugaucaucucca

SEQ ID NO: 1959766 - RNA, 18 nt, Homo sapiens
gccccaguuauugugaaa

SEQ ID NO: 1959767 - RNA, 20 nt, Homo sapiens
cugaguagcauauauaauuu

SEQ ID NO: 1959768 - RNA, 13 nt, Homo sapiens
uaauucauuuacu

SEQ ID NO: 1959769 - RNA, 21 nt, Homo sapiens
auuaauaccacugagaccuuc

SEQ ID NO: 1959770 - RNA, 15 nt, Homo sapiens
guuuucuuucucacc

SEQ ID NO: 1959771 - RNA, 21 nt, Homo sapiens
ccagcaucugauugagucagu

SEQ ID NO: 1959772 - RNA, 23 nt, Homo sapiens
cuguugaauuauguuuugacaca

SEQ ID NO: 1959773 - RNA, 15 nt, Homo sapiens
aaucuguucaaggaa

SEQ ID NO: 1959774 - RNA, 18 nt, Homo sapiens
acacacugaguugcacau

SEQ ID NO: 1959775 - RNA, 16 nt, Homo sapiens
ccagcacgguggugcc

SEQ ID NO: 1959776 - RNA, 20 nt, Homo sapiens
agguugugcugccuguggug

SEQ ID NO: 1959777 - RNA, 19 nt, Homo sapiens
uccugaaagccacagacaa

SEQ ID NO: 1959778 - RNA, 14 nt, Homo sapiens
gccugaaagcaaga

SEQ ID NO: 1959779 - RNA, 14 nt, Homo sapiens
accuaaaaacaaaa

SEQ ID NO: 1959780 - RNA, 18 nt, Homo sapiens
gaaaauaaaaaugcuaua

SEQ ID NO: 1959781 - RNA, 21 nt, Homo sapiens
ggcaucagucccccugugcau

SEQ ID NO: 1959782 - RNA, 13 nt, Homo sapiens
agugccaucucaa

SEQ ID NO: 1959783 - RNA, 19 nt, Homo sapiens
aaggcacguucuuuccuua

SEQ ID NO: 1959784 - RNA, 19 nt, Homo sapiens
acaucuacaaucaguugac

SEQ ID NO: 1959785 - RNA, 18 nt, Homo sapiens
acagaggagggacucaga

SEQ ID NO: 1959786 - RNA, 18 nt, Homo sapiens
aucccgagguauggcaga

SEQ ID NO: 1959787 - RNA, 22 nt, Homo sapiens
uuaaguaguccuccuguaucua

SEQ ID NO: 1959788 - RNA, 21 nt, Homo sapiens
aaauuauguuuuaauuccaag

SEQ ID NO: 1959789 - RNA, 14 nt, Homo sapiens
aaauaaguggguca

SEQ ID NO: 1959790 - RNA, 20 nt, Homo sapiens
cccagugcccccacugacca

SEQ ID NO: 1959791 - RNA, 15 nt, Homo sapiens
gucuuggacccaccu

SEQ ID NO: 1959792 - RNA, 22 nt, Homo sapiens
uuguguaucuguuuacauccag

SEQ ID NO: 1959793 - RNA, 16 nt, Homo sapiens
cauggguucauccuau

SEQ ID NO: 1959794 - RNA, 16 nt, Homo sapiens
cuucuagagcuuagca

SEQ ID NO: 1959795 - RNA, 22 nt, Homo sapiens
ugggggcaccaagaccccaaag

SEQ ID NO: 1959796 - RNA, 12 nt, Homo sapiens
uuuuacugcuug

SEQ ID NO: 1959797 - RNA, 17 nt, Homo sapiens
ccaggcuccagcacauc

SEQ ID NO: 1959798 - RNA, 16 nt, Homo sapiens
cguccugcagugugag

SEQ ID NO: 1959799 - RNA, 22 nt, Homo sapiens
guauuauccacaauuauuggca

SEQ ID NO: 1959800 - RNA, 17 nt, Homo sapiens
uacaagaggccacuccc

SEQ ID NO: 1959801 - RNA, 16 nt, Homo sapiens
accaaacucaggugau

SEQ ID NO: 1959802 - RNA, 16 nt, Homo sapiens
uggcuccuccuaggaa

SEQ ID NO: 1959803 - RNA, 17 nt, Homo sapiens
cuuuuuccccugcaaug

SEQ ID NO: 1959804 - RNA, 11 nt, Homo sapiens
gaacaccaagu

SEQ ID NO: 1959805 - RNA, 22 nt, Homo sapiens
uuuccagucauaccaacuuuag

SEQ ID NO: 1959806 - RNA, 15 nt, Homo sapiens
ugccucagaccugac

SEQ ID NO: 1959807 - RNA, 18 nt, Homo sapiens
gagguggauucaugucca

SEQ ID NO: 1959808 - RNA, 20 nt, Homo sapiens
caccugggcugaggaggcag

SEQ ID NO: 1959809 - RNA, 17 nt, Homo sapiens
caggaggucugguccga

SEQ ID NO: 1959810 - RNA, 18 nt, Homo sapiens
gguccuucuguagugcca

SEQ ID NO: 1959811 - RNA, 13 nt, Homo sapiens
acauuaugaucua

SEQ ID NO: 1959812 - RNA, 20 nt, Homo sapiens
cucaaguucauugaugaccc

SEQ ID NO: 1959813 - RNA, 17 nt, Homo sapiens
guaaacauuaguucuau

SEQ ID NO: 1959814 - RNA, 15 nt, Homo sapiens
uuucuugaaagaaua

SEQ ID NO: 1959815 - RNA, 21 nt, Homo sapiens
augccuaauaguccuuugaua

SEQ ID NO: 1959816 - RNA, 19 nt, Homo sapiens
gcagccccaggaccaagcu

SEQ ID NO: 1959817 - RNA, 16 nt, Homo sapiens
acagucaucauuuauc

SEQ ID NO: 1959818 - RNA, 16 nt, Homo sapiens
ccagcaucaauuccau

SEQ ID NO: 1959819 - RNA, 19 nt, Homo sapiens
accucugagaagacacaag

SEQ ID NO: 1959820 - RNA, 23 nt, Homo sapiens
uuagacacguguuguuccaccuu

SEQ ID NO: 1959821 - RNA, 20 nt, Homo sapiens
ucuuggaaaaaaaccacagc

SEQ ID NO: 1959822 - RNA, 22 nt, Homo sapiens
ugguuuuuaaaaaacugcugac

SEQ ID NO: 1959823 - RNA, 21 nt, Homo sapiens
uucaaaccugcauauugugau

SEQ ID NO: 1959824 - RNA, 24 nt, Homo sapiens
gucauggcaccaaagccaccagac

SEQ ID NO: 1959825 - RNA, 15 nt, Homo sapiens
gucaaggugcucaau

SEQ ID NO: 1959826 - RNA, 23 nt, Homo sapiens
gagagacgcagcccugggggcca

SEQ ID NO: 1959827 - RNA, 16 nt, Homo sapiens
guuacuuucacuuuuu

SEQ ID NO: 1959828 - RNA, 11 nt, Homo sapiens
uccaguuugca

SEQ ID NO: 1959829 - RNA, 19 nt, Homo sapiens
guuaaauccuuugcuucau

SEQ ID NO: 1959830 - RNA, 16 nt, Homo sapiens
uccaugaaaaacagca

SEQ ID NO: 1959831 - RNA, 16 nt, Homo sapiens
uuugagaauacauaaa

SEQ ID NO: 1959832 - RNA, 21 nt, Homo sapiens
gaagcuuucaccagccacaca

SEQ ID NO: 1959833 - RNA, 20 nt, Homo sapiens
gccaggauuaaaagccauga

SEQ ID NO: 1959834 - RNA, 14 nt, Homo sapiens
auaaauauacuucu

SEQ ID NO: 1959835 - RNA, 16 nt, Homo sapiens
aaauacuuauggcuca

SEQ ID NO: 1959836 - RNA, 20 nt, Homo sapiens
acugcuucuaccaacuggaa

SEQ ID NO: 1959837 - RNA, 14 nt, Homo sapiens
acccacuaaugugu

SEQ ID NO: 1959838 - RNA, 13 nt, Homo sapiens
uagcaacauuauu

SEQ ID NO: 1959839 - RNA, 14 nt, Homo sapiens
ccuaggauuccucc

SEQ ID NO: 1959840 - RNA, 17 nt, Homo sapiens
augcagagccacagcug

SEQ ID NO: 1959841 - RNA, 21 nt, Homo sapiens
cacauguugauuuccuaugua

SEQ ID NO: 1959842 - RNA, 17 nt, Homo sapiens
uggguaucaugcuucua

SEQ ID NO: 1959843 - RNA, 22 nt, Homo sapiens
ggccaugcugugugagaccagg

SEQ ID NO: 1959844 - RNA, 21 nt, Homo sapiens
acucaugcugguggcauuguu

SEQ ID NO: 1959845 - RNA, 14 nt, Homo sapiens
cccauagcuuccau

SEQ ID NO: 1959846 - RNA, 17 nt, Homo sapiens
gaggcggcagugcaaca

SEQ ID NO: 1959847 - RNA, 16 nt, Homo sapiens
caaagguuggcaguga

SEQ ID NO: 1959848 - RNA, 15 nt, Homo sapiens
uagugucugucuucu

SEQ ID NO: 1959849 - RNA, 17 nt, Homo sapiens
ugauagaacuacuuuga

SEQ ID NO: 1959850 - RNA, 21 nt, Homo sapiens
ucaggggucgucccaacucug

SEQ ID NO: 1959851 - RNA, 17 nt, Homo sapiens
ugaaauuaagaaggcaa

SEQ ID NO: 1959852 - RNA, 18 nt, Homo sapiens
gccuguacugaagcugaa

SEQ ID NO: 1959853 - RNA, 13 nt, Homo sapiens
gagugccaugcuu

SEQ ID NO: 1959854 - RNA, 23 nt, Homo sapiens
aguggccccaucauagccugcag

SEQ ID NO: 1959855 - RNA, 20 nt, Homo sapiens
accccaacaauugugugaau

SEQ ID NO: 1959856 - RNA, 13 nt, Homo sapiens
ucauccaacguga

SEQ ID NO: 1959857 - RNA, 15 nt, Homo sapiens
gaguaagcaguguua

SEQ ID NO: 1959858 - RNA, 15 nt, Homo sapiens
ccaccugucugauuu

SEQ ID NO: 1959859 - RNA, 22 nt, Homo sapiens
aacagaccagcauaguucugca

SEQ ID NO: 1959860 - RNA, 18 nt, Homo sapiens
augauuuuccucccuggu

SEQ ID NO: 1959861 - RNA, 13 nt, Homo sapiens
gagcacucucacc

SEQ ID NO: 1959862 - RNA, 22 nt, Homo sapiens
ggagcauuuugugucuuaagaa

SEQ ID NO: 1959863 - RNA, 15 nt, Homo sapiens
uuucaauugucacuu

SEQ ID NO: 1959864 - RNA, 17 nt, Homo sapiens
gaugggcccugcaagac

SEQ ID NO: 1959865 - RNA, 21 nt, Homo sapiens
agugaacuugaaauauccugc

SEQ ID NO: 1959866 - RNA, 13 nt, Homo sapiens
uucuuagaccucc

SEQ ID NO: 1959867 - RNA, 20 nt, Homo sapiens
aguucuggucagaugauaua

SEQ ID NO: 1959868 - RNA, 12 nt, Homo sapiens
cugccuuccucu

SEQ ID NO: 1959869 - RNA, 18 nt, Homo sapiens
cauuaccaaguuacuuga

SEQ ID NO: 1959870 - RNA, 14 nt, Homo sapiens
acauuugcauucaa

SEQ ID NO: 1959871 - RNA, 20 nt, Homo sapiens
gcacuaaagaauacauuuaa

SEQ ID NO: 1959872 - RNA, 18 nt, Homo sapiens
uagaauagcgacaggaau

SEQ ID NO: 1959873 - RNA, 18 nt, Homo sapiens
ccaggagccuaguacaau

SEQ ID NO: 1959874 - RNA, 18 nt, Homo sapiens
acucaggcagugcaguac

SEQ ID NO: 1959875 - RNA, 22 nt, Homo sapiens
cagcucaaugcaguuagcugaa

SEQ ID NO: 1959876 - RNA, 22 nt, Homo sapiens
uguaauccuguacaauugcauc

SEQ ID NO: 1959877 - RNA, 22 nt, Homo sapiens
uuggccaguagcuaaagugcaa

SEQ ID NO: 1959878 - RNA, 19 nt, Homo sapiens
gcuugauccagaccucuac

SEQ ID NO: 1959879 - RNA, 13 nt, Homo sapiens
uccucccagacuu

SEQ ID NO: 1959880 - RNA, 14 nt, Homo sapiens
ucucucucugucuc

SEQ ID NO: 1959881 - RNA, 16 nt, Homo sapiens
cccugggauguccaca

SEQ ID NO: 1959882 - RNA, 23 nt, Homo sapiens
cacugacacaucagcauguuuuc

SEQ ID NO: 1959883 - RNA, 17 nt, Homo sapiens
gaaguguucugcugaga

SEQ ID NO: 1959884 - RNA, 24 nt, Homo sapiens
acguguucacaggcugcuaauauu

SEQ ID NO: 1959885 - RNA, 16 nt, Homo sapiens
aaggggacgcuuugaa

SEQ ID NO: 1959886 - RNA, 15 nt, Homo sapiens
uuccugcuccuccag

SEQ ID NO: 1959887 - RNA, 18 nt, Homo sapiens
gcagcuuauucacaagac

SEQ ID NO: 1959888 - RNA, 13 nt, Homo sapiens
uccgaguguuugc

SEQ ID NO: 1959889 - RNA, 18 nt, Homo sapiens
uaacaaaacaagugcaag

SEQ ID NO: 1959890 - RNA, 13 nt, Homo sapiens
acaguuuucuuca

SEQ ID NO: 1959891 - RNA, 22 nt, Homo sapiens
cuagaggacacuaggagacugg

SEQ ID NO: 1959892 - RNA, 20 nt, Homo sapiens
guugucagcugcagccacuu

SEQ ID NO: 1959893 - RNA, 21 nt, Homo sapiens
acaaaaauguaaugaucauaa

SEQ ID NO: 1959894 - RNA, 15 nt, Homo sapiens
ggccacucccugcca

SEQ ID NO: 1959895 - RNA, 18 nt, Homo sapiens
aaggagccccccaaagac

SEQ ID NO: 1959896 - RNA, 17 nt, Homo sapiens
augccauuuagcaauaa

SEQ ID NO: 1959897 - RNA, 17 nt, Homo sapiens
guuaaacuuuaucucac

SEQ ID NO: 1959898 - RNA, 21 nt, Homo sapiens
ccaucagcucucugcaaagau

SEQ ID NO: 1959899 - RNA, 24 nt, Homo sapiens
agaagcgcugauggucauauccaa

SEQ ID NO: 1959900 - RNA, 15 nt, Homo sapiens
caguaaaguguaaca

SEQ ID NO: 1959901 - RNA, 14 nt, Homo sapiens
accuguccuugcac

SEQ ID NO: 1959902 - RNA, 20 nt, Homo sapiens
ucccuaaaaacacagacauu

SEQ ID NO: 1959903 - RNA, 16 nt, Homo sapiens
uacccucccaccacuc

SEQ ID NO: 1959904 - RNA, 20 nt, Homo sapiens
aagacuaugaucucauccca

SEQ ID NO: 1959905 - RNA, 19 nt, Homo sapiens
gcaaagguugcagugaguu

SEQ ID NO: 1959906 - RNA, 18 nt, Homo sapiens
cagggauucuuccugcuu

SEQ ID NO: 1959907 - RNA, 18 nt, Homo sapiens
gcagguagugggugaaug

SEQ ID NO: 1959908 - RNA, 12 nt, Homo sapiens
ucaaagcaguag

SEQ ID NO: 1959909 - RNA, 23 nt, Homo sapiens
ugaaaugggauuguuuuuuacuc

SEQ ID NO: 1959910 - RNA, 16 nt, Homo sapiens
agcaacucuugauuau

SEQ ID NO: 1959911 - RNA, 20 nt, Homo sapiens
cuucucagauuucugaggaa

SEQ ID NO: 1959912 - RNA, 23 nt, Homo sapiens
aaagauguacaaaacaguuugaa

SEQ ID NO: 1959913 - RNA, 14 nt, Homo sapiens
uuuccagugcugcu

SEQ ID NO: 1959914 - RNA, 20 nt, Homo sapiens
gcauguguugcagcugucac

SEQ ID NO: 1959915 - RNA, 20 nt, Homo sapiens
cacccauggggagacaguug

SEQ ID NO: 1959916 - RNA, 20 nt, Homo sapiens
uugacacuuaaaaaugguuu

SEQ ID NO: 1959917 - RNA, 16 nt, Homo sapiens
cugccagaggaugcuc

SEQ ID NO: 1959918 - RNA, 14 nt, Homo sapiens
auguaaacugccau

SEQ ID NO: 1959919 - RNA, 16 nt, Homo sapiens
gaacuauaacauucaa

SEQ ID NO: 1959920 - RNA, 16 nt, Homo sapiens
aaccaugguaacaaua

SEQ ID NO: 1959921 - RNA, 12 nt, Homo sapiens
caacacauuuca

SEQ ID NO: 1959922 - RNA, 14 nt, Homo sapiens
cuguacugccaagg

SEQ ID NO: 1959923 - RNA, 21 nt, Homo sapiens
uaauaaaucuauucugcuaag

SEQ ID NO: 1959924 - RNA, 16 nt, Homo sapiens
guuucacuguacugca

SEQ ID NO: 1959925 - RNA, 22 nt, Homo sapiens
ucugaaagggauggccacaagu

SEQ ID NO: 1959926 - RNA, 17 nt, Homo sapiens
caauguuaaaugcaauu

SEQ ID NO: 1959927 - RNA, 12 nt, Homo sapiens
gaagaaagcaaa

SEQ ID NO: 1959928 - RNA, 17 nt, Homo sapiens
cuccagcuaacugugga

SEQ ID NO: 1959929 - RNA, 14 nt, Homo sapiens
ucacagcaccaaaa

SEQ ID NO: 1959930 - RNA, 17 nt, Homo sapiens
uuuguaagcuauaacau

SEQ ID NO: 1959931 - RNA, 15 nt, Homo sapiens
uaaaaaguauugcca

SEQ ID NO: 1959932 - RNA, 16 nt, Homo sapiens
augaagagacucucuu

SEQ ID NO: 1959933 - RNA, 20 nt, Homo sapiens
cugucgugcaaacccaguga

SEQ ID NO: 1959934 - RNA, 16 nt, Homo sapiens
aaaacaauguuuuaaa

SEQ ID NO: 1959935 - RNA, 21 nt, Homo sapiens
agauuuuccugaaaacccuug

SEQ ID NO: 1959936 - RNA, 18 nt, Homo sapiens
gcccuggggccuguacug

SEQ ID NO: 1959937 - RNA, 19 nt, Homo sapiens
cacagcaggagggacaaug

SEQ ID NO: 1959938 - RNA, 23 nt, Homo sapiens
ucccuggaaauaacugagcacuu

SEQ ID NO: 1959939 - RNA, 16 nt, Homo sapiens
aaucuguuagcauuau

SEQ ID NO: 1959940 - RNA, 14 nt, Homo sapiens
aacugagaucucca

SEQ ID NO: 1959941 - RNA, 12 nt, Homo sapiens
agguuggcagua

SEQ ID NO: 1959942 - RNA, 18 nt, Homo sapiens
acaaaugggccugccaaa

SEQ ID NO: 1959943 - RNA, 12 nt, Homo sapiens
cgaucuggguuc

SEQ ID NO: 1959944 - RNA, 23 nt, Homo sapiens
uaaugaugucguuugaaucacag

SEQ ID NO: 1959945 - RNA, 16 nt, Homo sapiens
auguauauuugcugca

SEQ ID NO: 1959946 - RNA, 19 nt, Homo sapiens
ccugggaauuuacagagcc

SEQ ID NO: 1959947 - RNA, 23 nt, Homo sapiens
acagaaugauuuuagauuuucca

SEQ ID NO: 1959948 - RNA, 13 nt, Homo sapiens
uuuauacacacag

SEQ ID NO: 1959949 - RNA, 13 nt, Homo sapiens
gaacauuuccuca

SEQ ID NO: 1959950 - RNA, 18 nt, Homo sapiens
uguuccacaaagcagugg

SEQ ID NO: 1959951 - RNA, 14 nt, Homo sapiens
gacucugguguucu

SEQ ID NO: 1959952 - RNA, 20 nt, Homo sapiens
auucccaagguuacuggaua

SEQ ID NO: 1959953 - RNA, 18 nt, Homo sapiens
cgggagggguggggagaa

SEQ ID NO: 1959954 - RNA, 17 nt, Homo sapiens
augaaccuugcuaucaa

SEQ ID NO: 1959955 - RNA, 19 nt, Homo sapiens
aaucuuaccagaugcuacu

SEQ ID NO: 1959956 - RNA, 22 nt, Homo sapiens
cuccagccccuguagaacucaa

SEQ ID NO: 1959957 - RNA, 17 nt, Homo sapiens
accaaccuuuucccaac

SEQ ID NO: 1959958 - RNA, 19 nt, Homo sapiens
agaggacuacucagcacug

SEQ ID NO: 1959959 - RNA, 16 nt, Homo sapiens
uugcuuuuuucugggg

SEQ ID NO: 1959960 - RNA, 17 nt, Homo sapiens
guuuuuguuuuuugcca

SEQ ID NO: 1959961 - RNA, 10 nt, Homo sapiens
ugaacagggc

SEQ ID NO: 1959962 - RNA, 17 nt, Homo sapiens
acaauggcgugaucuca

SEQ ID NO: 1959963 - RNA, 20 nt, Homo sapiens
caugaacaaugggagcacau

SEQ ID NO: 1959964 - RNA, 22 nt, Homo sapiens
ucuuggcauuaaaccacaucau

SEQ ID NO: 1959965 - RNA, 18 nt, Homo sapiens
augaaauguaugugcucu

SEQ ID NO: 1959966 - RNA, 13 nt, Homo sapiens
cagcucuacaggu

SEQ ID NO: 1959967 - RNA, 16 nt, Homo sapiens
caagcacugacacuca

SEQ ID NO: 1959968 - RNA, 18 nt, Homo sapiens
uagcucuguaguggaaua

SEQ ID NO: 1959969 - RNA, 13 nt, Homo sapiens
auguuucaaaaaa

SEQ ID NO: 1959970 - RNA, 15 nt, Homo sapiens
ccccaugccugucca

SEQ ID NO: 1959971 - RNA, 14 nt, Homo sapiens
agcuggaagcacau

SEQ ID NO: 1959972 - RNA, 22 nt, Homo sapiens
auggaagccagggcuugucaca

SEQ ID NO: 1959973 - RNA, 14 nt, Homo sapiens
gaggugagaccaaa

SEQ ID NO: 1959974 - RNA, 21 nt, Homo sapiens
gaugcaucacuggguguugau

SEQ ID NO: 1959975 - RNA, 11 nt, Homo sapiens
guuuucuuaua

SEQ ID NO: 1959976 - RNA, 16 nt, Homo sapiens
uccaguggacccugga

SEQ ID NO: 1959977 - RNA, 16 nt, Homo sapiens
guuuucaaugugaauu

SEQ ID NO: 1959978 - RNA, 13 nt, Homo sapiens
acucuauaaccaa

SEQ ID NO: 1959979 - RNA, 17 nt, Homo sapiens
ggagacacauucacaaa

SEQ ID NO: 1959980 - RNA, 20 nt, Homo sapiens
acaaaauuuaguuuuuguuc

SEQ ID NO: 1959981 - RNA, 12 nt, Homo sapiens
uugaaaacacuu

SEQ ID NO: 1959982 - RNA, 16 nt, Homo sapiens
cguauaaugcuuucug

SEQ ID NO: 1959983 - RNA, 19 nt, Homo sapiens
caguuacagaaaguggugc

SEQ ID NO: 1959984 - RNA, 18 nt, Homo sapiens
cauaccccggugugccug

SEQ ID NO: 1959985 - RNA, 13 nt, Homo sapiens
aaguuccuaucuu

SEQ ID NO: 1959986 - RNA, 22 nt, Homo sapiens
aauaacauuuaaauuccacaga

SEQ ID NO: 1959987 - RNA, 13 nt, Homo sapiens
ccccucagugcuc

SEQ ID NO: 1959988 - RNA, 17 nt, Homo sapiens
uucgauggcauccugca

SEQ ID NO: 1959989 - RNA, 12 nt, Homo sapiens
aacugagcacag

SEQ ID NO: 1959990 - RNA, 16 nt, Homo sapiens
agaaaugggccugccu

SEQ ID NO: 1959991 - RNA, 16 nt, Homo sapiens
caaagagaaugccauu

SEQ ID NO: 1959992 - RNA, 13 nt, Homo sapiens
ugcuggacuugcc

SEQ ID NO: 1959993 - RNA, 15 nt, Homo sapiens
gaaaucaaacugcuu

SEQ ID NO: 1959994 - RNA, 18 nt, Homo sapiens
auacuguucuauacgagu

SEQ ID NO: 1959995 - RNA, 14 nt, Homo sapiens
gugaucaagcaaua

SEQ ID NO: 1959996 - RNA, 17 nt, Homo sapiens
aaaccaggacucugccc

SEQ ID NO: 1959997 - RNA, 18 nt, Homo sapiens
guuauaucauauguauau

SEQ ID NO: 1959998 - RNA, 18 nt, Homo sapiens
cagccuggccaucuggau

SEQ ID NO: 1959999 - RNA, 18 nt, Homo sapiens
auuguuacagguguacua

SEQ ID NO: 1960000 - RNA, 17 nt, Homo sapiens
aucacuacucagugcau

SEQ ID NO: 1960001 - RNA, 17 nt, Homo sapiens
caauaaucaaugaagua

SEQ ID NO: 1960002 - RNA, 15 nt, Homo sapiens
gcuggggccagugua

SEQ ID NO: 1960003 - RNA, 17 nt, Homo sapiens
gauaccugugugucucc

SEQ ID NO: 1960004 - RNA, 15 nt, Homo sapiens
auaaugcauccagca

SEQ ID NO: 1960005 - RNA, 21 nt, Homo sapiens
uccacgaggugaaaaauauuc

SEQ ID NO: 1960006 - RNA, 18 nt, Homo sapiens
auauaaagaggacuugaa

SEQ ID NO: 1960007 - RNA, 17 nt, Homo sapiens
agugauggcuuucagga

SEQ ID NO: 1960008 - RNA, 17 nt, Homo sapiens
ucuucuccuaugcauuu

SEQ ID NO: 1960009 - RNA, 19 nt, Homo sapiens
caaaacggaugaguuauua

SEQ ID NO: 1960010 - RNA, 21 nt, Homo sapiens
cuaaaguacagccuggaccac

SEQ ID NO: 1960011 - RNA, 13 nt, Homo sapiens
uagagcugggaaa

SEQ ID NO: 1960012 - RNA, 14 nt, Homo sapiens
caucacuuugugaa

SEQ ID NO: 1960013 - RNA, 17 nt, Homo sapiens
augcgccaccaugcccu

SEQ ID NO: 1960014 - RNA, 16 nt, Homo sapiens
aguacaaggugguaug

SEQ ID NO: 1960015 - RNA, 12 nt, Homo sapiens
aaaaaugcugag

SEQ ID NO: 1960016 - RNA, 15 nt, Homo sapiens
agaacaaacaccucc

SEQ ID NO: 1960017 - RNA, 14 nt, Homo sapiens
cgggaccgugggcc

SEQ ID NO: 1960018 - RNA, 21 nt, Homo sapiens
uacggauccugcacugacucu

SEQ ID NO: 1960019 - RNA, 13 nt, Homo sapiens
uccacguaucuuu

SEQ ID NO: 1960020 - RNA, 23 nt, Homo sapiens
aucuuuguacagaagaggauuca

SEQ ID NO: 1960021 - RNA, 18 nt, Homo sapiens
ugaguggggaaaacagac

SEQ ID NO: 1960022 - RNA, 16 nt, Homo sapiens
agaauacuccacacau

SEQ ID NO: 1960023 - RNA, 20 nt, Homo sapiens
uggcucacuacugaacacau

SEQ ID NO: 1960024 - RNA, 12 nt, Homo sapiens
cugaagccacac

SEQ ID NO: 1960025 - RNA, 15 nt, Homo sapiens
ggccuuguuucaaaa

SEQ ID NO: 1960026 - RNA, 18 nt, Homo sapiens
uuuucaagaugguguuau

SEQ ID NO: 1960027 - RNA, 19 nt, Homo sapiens
uauuccaugggauguuaag

SEQ ID NO: 1960028 - RNA, 21 nt, Homo sapiens
ucaaaugaauaaugccuuugu

SEQ ID NO: 1960029 - RNA, 15 nt, Homo sapiens
agccuuauccagcau

SEQ ID NO: 1960030 - RNA, 17 nt, Homo sapiens
cauaauacaugauugca

SEQ ID NO: 1960031 - RNA, 19 nt, Homo sapiens
cacauccuucucacugcca

SEQ ID NO: 1960032 - RNA, 19 nt, Homo sapiens
gaaucuaauucuguugauu

SEQ ID NO: 1960033 - RNA, 18 nt, Homo sapiens
gccguccauggcaccagc

SEQ ID NO: 1960034 - RNA, 12 nt, Homo sapiens
guuuacuuauaa

SEQ ID NO: 1960035 - RNA, 16 nt, Homo sapiens
gcugucaucugugcac

SEQ ID NO: 1960036 - RNA, 23 nt, Homo sapiens
cuccugggcauuagcaaggcaga

SEQ ID NO: 1960037 - RNA, 20 nt, Homo sapiens
ugugacuucuccaggucuca

SEQ ID NO: 1960038 - RNA, 21 nt, Homo sapiens
agcaauggaguggcugccaug

SEQ ID NO: 1960039 - RNA, 13 nt, Homo sapiens
aauggcauguauu

SEQ ID NO: 1960040 - RNA, 14 nt, Homo sapiens
caugaaaacacuug

SEQ ID NO: 1960041 - RNA, 16 nt, Homo sapiens
cagagccuuuuacccc

SEQ ID NO: 1960042 - RNA, 22 nt, Homo sapiens
aaaucagugccugguguucuga

SEQ ID NO: 1960043 - RNA, 14 nt, Homo sapiens
aaaccacagucuua

SEQ ID NO: 1960044 - RNA, 14 nt, Homo sapiens
agucagacugacac

SEQ ID NO: 1960045 - RNA, 18 nt, Homo sapiens
ugcuacagaaagcacaaa

SEQ ID NO: 1960046 - RNA, 18 nt, Homo sapiens
gacccuagggauuugcac

SEQ ID NO: 1960047 - RNA, 20 nt, Homo sapiens
uauauuguguugacuuuaua

SEQ ID NO: 1960048 - RNA, 17 nt, Homo sapiens
gauuuuauuuaaacuau

SEQ ID NO: 1960049 - RNA, 21 nt, Homo sapiens
ugaaagucccagaucaagccu

SEQ ID NO: 1960050 - RNA, 18 nt, Homo sapiens
uccugcagaaagcuuuau

SEQ ID NO: 1960051 - RNA, 13 nt, Homo sapiens
gauucuccuguca

SEQ ID NO: 1960052 - RNA, 23 nt, Homo sapiens
caugauuguauauggaacaaaua

SEQ ID NO: 1960053 - RNA, 19 nt, Homo sapiens
uucacgcuguuuguuucau

SEQ ID NO: 1960054 - RNA, 15 nt, Homo sapiens
aaaugaggccaugga

SEQ ID NO: 1960055 - RNA, 19 nt, Homo sapiens
cugcauguuguuuggaauu

SEQ ID NO: 1960056 - RNA, 18 nt, Homo sapiens
agaggcucuuccucucuu

SEQ ID NO: 1960057 - RNA, 21 nt, Homo sapiens
aaccccagacucaaacucaag

SEQ ID NO: 1960058 - RNA, 17 nt, Homo sapiens
aaacuagaaagaugaaa

SEQ ID NO: 1960059 - RNA, 15 nt, Homo sapiens
cgccgccggagucca

SEQ ID NO: 1960060 - RNA, 12 nt, Homo sapiens
ucuccagaugag

SEQ ID NO: 1960061 - RNA, 17 nt, Homo sapiens
uaagaacacugagauau

SEQ ID NO: 1960062 - RNA, 22 nt, Homo sapiens
cauuuaccucgaggcucuucca

SEQ ID NO: 1960063 - RNA, 22 nt, Homo sapiens
aaagucuuaacaacagcuucuu

SEQ ID NO: 1960064 - RNA, 22 nt, Homo sapiens
uaauaaaguuuuuuuccaaaag

SEQ ID NO: 1960065 - RNA, 19 nt, Homo sapiens
ugcccagcuuggagugcca

SEQ ID NO: 1960066 - RNA, 19 nt, Homo sapiens
cccuaauuuaugugcuaua

SEQ ID NO: 1960067 - RNA, 14 nt, Homo sapiens
auuuacaugugauu

SEQ ID NO: 1960068 - RNA, 16 nt, Homo sapiens
uauaccaugacaugaa

SEQ ID NO: 1960069 - RNA, 16 nt, Homo sapiens
uaugugcuugugcuca

SEQ ID NO: 1960070 - RNA, 23 nt, Homo sapiens
gugcaaaguccguguccuaccuc

SEQ ID NO: 1960071 - RNA, 13 nt, Homo sapiens
ggucuaugauguc

SEQ ID NO: 1960072 - RNA, 13 nt, Homo sapiens
ccagaguggccca

SEQ ID NO: 1960073 - RNA, 23 nt, Homo sapiens
agagcuguccuccuggcaccuga

SEQ ID NO: 1960074 - RNA, 22 nt, Homo sapiens
accaggcugccaggcaccaucu

SEQ ID NO: 1960075 - RNA, 13 nt, Homo sapiens
agaaccuagaagg

SEQ ID NO: 1960076 - RNA, 14 nt, Homo sapiens
guaugguaggguaa

SEQ ID NO: 1960077 - RNA, 16 nt, Homo sapiens
cugcugaaggucagua

SEQ ID NO: 1960078 - RNA, 15 nt, Homo sapiens
aaaggaggacaggga

SEQ ID NO: 1960079 - RNA, 18 nt, Homo sapiens
ggacgccacucauuucau

SEQ ID NO: 1960080 - RNA, 15 nt, Homo sapiens
agccccccacucagu

SEQ ID NO: 1960081 - RNA, 13 nt, Homo sapiens
uugcccuuuccau

SEQ ID NO: 1960082 - RNA, 23 nt, Homo sapiens
augagcuuacauucuuacaauaa

SEQ ID NO: 1960083 - RNA, 16 nt, Homo sapiens
gaagauguucaauaga

SEQ ID NO: 1960084 - RNA, 16 nt, Homo sapiens
uaaacuuuauuuccuc

SEQ ID NO: 1960085 - RNA, 13 nt, Homo sapiens
caguggcaccugg

SEQ ID NO: 1960086 - RNA, 18 nt, Homo sapiens
ccaccagggaucacagac

SEQ ID NO: 1960087 - RNA, 12 nt, Homo sapiens
cugugaccaaag

SEQ ID NO: 1960088 - RNA, 22 nt, Homo sapiens
augaauuccuauauaccuaaua

SEQ ID NO: 1960089 - RNA, 16 nt, Homo sapiens
agcuuaucuacuucca

SEQ ID NO: 1960090 - RNA, 15 nt, Homo sapiens
cgucugggcucccug

SEQ ID NO: 1960091 - RNA, 24 nt, Homo sapiens
acucccucuucacuguggccacag

SEQ ID NO: 1960092 - RNA, 12 nt, Homo sapiens
agcauguaauau

SEQ ID NO: 1960093 - RNA, 18 nt, Homo sapiens
gaugaggucaccagggga

SEQ ID NO: 1960094 - RNA, 20 nt, Homo sapiens
aggggucugagcuccagcuc

SEQ ID NO: 1960095 - RNA, 23 nt, Homo sapiens
caccauuccuggaaaccacaguc

SEQ ID NO: 1960096 - RNA, 13 nt, Homo sapiens
ccugugcaaaaaa

SEQ ID NO: 1960097 - RNA, 20 nt, Homo sapiens
caucgguguggacuacagga

SEQ ID NO: 1960098 - RNA, 14 nt, Homo sapiens
agcaagacacaucc

SEQ ID NO: 1960099 - RNA, 14 nt, Homo sapiens
aggggucuuaccuu

SEQ ID NO: 1960100 - RNA, 14 nt, Homo sapiens
ucuccaucccugaa

SEQ ID NO: 1960101 - RNA, 18 nt, Homo sapiens
cugaaugcugcuacuuaa

SEQ ID NO: 1960102 - RNA, 16 nt, Homo sapiens
ucaguugccauugaca

SEQ ID NO: 1960103 - RNA, 18 nt, Homo sapiens
cauacauuuaugcacauu

SEQ ID NO: 1960104 - RNA, 16 nt, Homo sapiens
ccuuuucuauguugcu

SEQ ID NO: 1960105 - RNA, 16 nt, Homo sapiens
acuauucacugaugca

SEQ ID NO: 1960106 - RNA, 16 nt, Homo sapiens
ucauucucauugaauu

SEQ ID NO: 1960107 - RNA, 17 nt, Homo sapiens
ugcuaucucaaaguuua

SEQ ID NO: 1960108 - RNA, 22 nt, Homo sapiens
aaaucaaucuuauuacugagag

SEQ ID NO: 1960109 - RNA, 21 nt, Homo sapiens
agcccuugucccuuuuaauau

SEQ ID NO: 1960110 - RNA, 20 nt, Homo sapiens
gccgauaucaacacuuguau

SEQ ID NO: 1960111 - RNA, 21 nt, Homo sapiens
ccuuuaaaaauaugcaccaaa

SEQ ID NO: 1960112 - RNA, 21 nt, Homo sapiens
guacaugggacugauucuguu

SEQ ID NO: 1960113 - RNA, 17 nt, Homo sapiens
aaguaucccuacuguaa

SEQ ID NO: 1960114 - RNA, 15 nt, Homo sapiens
uauacaggcauaaaa

SEQ ID NO: 1960115 - RNA, 14 nt, Homo sapiens
aguguuuccaguga

SEQ ID NO: 1960116 - RNA, 17 nt, Homo sapiens
ccuuugaagccucagcu

SEQ ID NO: 1960117 - RNA, 15 nt, Homo sapiens
cagagccaugacuca

SEQ ID NO: 1960118 - RNA, 17 nt, Homo sapiens
cauuagaaagcaaagau

SEQ ID NO: 1960119 - RNA, 19 nt, Homo sapiens
cacaaaagcagauacuuga

SEQ ID NO: 1960120 - RNA, 22 nt, Homo sapiens
cacuaguucagaggaagcacau

SEQ ID NO: 1960121 - RNA, 15 nt, Homo sapiens
gccccugagccugug

SEQ ID NO: 1960122 - RNA, 16 nt, Homo sapiens
gcgcugaguggaacca

SEQ ID NO: 1960123 - RNA, 18 nt, Homo sapiens
aauggcaguuugaaguca

SEQ ID NO: 1960124 - RNA, 20 nt, Homo sapiens
cuaccuuagaaaacaaguau

SEQ ID NO: 1960125 - RNA, 20 nt, Homo sapiens
aaauggaggccuguccugac

SEQ ID NO: 1960126 - RNA, 18 nt, Homo sapiens
agcuuuuaugugauaugu

SEQ ID NO: 1960127 - RNA, 16 nt, Homo sapiens
uucaugcucugcaaaa

SEQ ID NO: 1960128 - RNA, 18 nt, Homo sapiens
agcguuugcugugccagg

SEQ ID NO: 1960129 - RNA, 14 nt, Homo sapiens
cuucuuccacagca

SEQ ID NO: 1960130 - RNA, 18 nt, Homo sapiens
gagccaccaaacccggcc

SEQ ID NO: 1960131 - RNA, 15 nt, Homo sapiens
gaaaaggcugguaca

SEQ ID NO: 1960132 - RNA, 15 nt, Homo sapiens
cuuugucuuaucuac

SEQ ID NO: 1960133 - RNA, 15 nt, Homo sapiens
gccuugugucuacag

SEQ ID NO: 1960134 - RNA, 18 nt, Homo sapiens
aaacuacacaucccuaau

SEQ ID NO: 1960135 - RNA, 14 nt, Homo sapiens
aacuguacaguuuc

SEQ ID NO: 1960136 - RNA, 15 nt, Homo sapiens
cauuaauacauuuca

SEQ ID NO: 1960137 - RNA, 21 nt, Homo sapiens
ugcccaaccuauccuguucuu

SEQ ID NO: 1960138 - RNA, 19 nt, Homo sapiens
cagggcauccaacugagaa

SEQ ID NO: 1960139 - RNA, 18 nt, Homo sapiens
aucaagacacuaguucag

SEQ ID NO: 1960140 - RNA, 21 nt, Homo sapiens
uuaaugccuagagaaugggau

SEQ ID NO: 1960141 - RNA, 18 nt, Homo sapiens
aucagaaaccccacuucc

SEQ ID NO: 1960142 - RNA, 13 nt, Homo sapiens
aaaacucuggguc

SEQ ID NO: 1960143 - RNA, 15 nt, Homo sapiens
caguuauugugaaaa

SEQ ID NO: 1960144 - RNA, 20 nt, Homo sapiens
augucugccuaugcacugaa

SEQ ID NO: 1960145 - RNA, 23 nt, Homo sapiens
cagggccuucugccugcugacca

SEQ ID NO: 1960146 - RNA, 17 nt, Homo sapiens
uuguaaauguacuggua

SEQ ID NO: 1960147 - RNA, 14 nt, Homo sapiens
ccauucugugcagg

SEQ ID NO: 1960148 - RNA, 16 nt, Homo sapiens
cagcucuuuggugcca

SEQ ID NO: 1960149 - RNA, 18 nt, Homo sapiens
ucagauugacagcauaua

SEQ ID NO: 1960150 - RNA, 16 nt, Homo sapiens
cauaaggauucaggga

SEQ ID NO: 1960151 - RNA, 16 nt, Homo sapiens
agaagucacugucaga

SEQ ID NO: 1960152 - RNA, 18 nt, Homo sapiens
cuauuuauucccuguuaa

SEQ ID NO: 1960153 - RNA, 13 nt, Homo sapiens
uguauauuacacc

SEQ ID NO: 1960154 - RNA, 18 nt, Homo sapiens
ugauaugcaagugcaaaa

SEQ ID NO: 1960155 - RNA, 14 nt, Homo sapiens
uaaucagaucuucu

SEQ ID NO: 1960156 - RNA, 14 nt, Homo sapiens
acuauugaaaaaua

SEQ ID NO: 1960157 - RNA, 20 nt, Homo sapiens
agcuaauuguacuaaucuga

SEQ ID NO: 1960158 - RNA, 18 nt, Homo sapiens
aguuuaauauuaaagcca

SEQ ID NO: 1960159 - RNA, 18 nt, Homo sapiens
ucacuggggcagacaaua

SEQ ID NO: 1960160 - RNA, 17 nt, Homo sapiens
guuagauguccucagaa

SEQ ID NO: 1960161 - RNA, 14 nt, Homo sapiens
acccauucuucccg

SEQ ID NO: 1960162 - RNA, 21 nt, Homo sapiens
cugaaagacaguaaagaccau

SEQ ID NO: 1960163 - RNA, 23 nt, Homo sapiens
cuuaccuggaaaaacaugcgaug

SEQ ID NO: 1960164 - RNA, 18 nt, Homo sapiens
cuugauuguguagcuguc

SEQ ID NO: 1960165 - RNA, 14 nt, Homo sapiens
aggaaccucagggc

SEQ ID NO: 1960166 - RNA, 13 nt, Homo sapiens
uuccugccccacc

SEQ ID NO: 1960167 - RNA, 15 nt, Homo sapiens
uaccuauauuacaca

SEQ ID NO: 1960168 - RNA, 16 nt, Homo sapiens
gcacaugcgcacucuc

SEQ ID NO: 1960169 - RNA, 13 nt, Homo sapiens
guuuccauuuaug

SEQ ID NO: 1960170 - RNA, 16 nt, Homo sapiens
ccaggggcagccacac

SEQ ID NO: 1960171 - RNA, 21 nt, Homo sapiens
gcccagcaggcccagcaugca

SEQ ID NO: 1960172 - RNA, 22 nt, Homo sapiens
ccuuacuggcuuaccuccucau

SEQ ID NO: 1960173 - RNA, 14 nt, Homo sapiens
gagaggaacaagcu

SEQ ID NO: 1960174 - RNA, 15 nt, Homo sapiens
uccaaagaaagauua

SEQ ID NO: 1960175 - RNA, 18 nt, Homo sapiens
cuccugccccaugcugcc

SEQ ID NO: 1960176 - RNA, 11 nt, Homo sapiens
aucacuugaac

SEQ ID NO: 1960177 - RNA, 20 nt, Homo sapiens
auauuuauuuaugcuaauau

SEQ ID NO: 1960178 - RNA, 16 nt, Homo sapiens
ccuaagacuaacaaag

SEQ ID NO: 1960179 - RNA, 16 nt, Homo sapiens
ucccacagcacaaccg

SEQ ID NO: 1960180 - RNA, 14 nt, Homo sapiens
cuuggcaguauucc

SEQ ID NO: 1960181 - RNA, 19 nt, Homo sapiens
ggaaacucgaauaaaggau

SEQ ID NO: 1960182 - RNA, 16 nt, Homo sapiens
uaaauauauauuuauc

SEQ ID NO: 1960183 - RNA, 17 nt, Homo sapiens
caaacagcccaaacugu

SEQ ID NO: 1960184 - RNA, 20 nt, Homo sapiens
gagaucacgccauugcacuc

SEQ ID NO: 1960185 - RNA, 18 nt, Homo sapiens
aaaacaaaaaaaacaaca

SEQ ID NO: 1960186 - RNA, 17 nt, Homo sapiens
gagccucacagcaguga

SEQ ID NO: 1960187 - RNA, 17 nt, Homo sapiens
agcccucaggccagugc

SEQ ID NO: 1960188 - RNA, 15 nt, Homo sapiens
caaaggucaccaggc

SEQ ID NO: 1960189 - RNA, 11 nt, Homo sapiens
uuaaccaccua

SEQ ID NO: 1960190 - RNA, 16 nt, Homo sapiens
acuuuauaaauucaua

SEQ ID NO: 1960191 - RNA, 16 nt, Homo sapiens
ucagggucggggcuag

SEQ ID NO: 1960192 - RNA, 17 nt, Homo sapiens
cuuacuaauguauuaau

SEQ ID NO: 1960193 - RNA, 15 nt, Homo sapiens
cccuguccuuucuca

SEQ ID NO: 1960194 - RNA, 19 nt, Homo sapiens
uucgcuuaguaacuaguga

SEQ ID NO: 1960195 - RNA, 13 nt, Homo sapiens
uugaaauguaauu

SEQ ID NO: 1960196 - RNA, 20 nt, Homo sapiens
uuugaaaaagagaacagaaa

SEQ ID NO: 1960197 - RNA, 17 nt, Homo sapiens
uuaggaugucuguaaua

SEQ ID NO: 1960198 - RNA, 15 nt, Homo sapiens
ucaaagcccagggau

SEQ ID NO: 1960199 - RNA, 23 nt, Homo sapiens
uagcacauguugauuuccuaugu

SEQ ID NO: 1960200 - RNA, 17 nt, Homo sapiens
ggaaagggauaguccaa

SEQ ID NO: 1960201 - RNA, 17 nt, Homo sapiens
uagcuguguccucacau

SEQ ID NO: 1960202 - RNA, 11 nt, Homo sapiens
auaagcaagag

SEQ ID NO: 1960203 - RNA, 18 nt, Homo sapiens
ucacacagacacuaacga

SEQ ID NO: 1960204 - RNA, 22 nt, Homo sapiens
aagaaugucucggucacaucag

SEQ ID NO: 1960205 - RNA, 20 nt, Homo sapiens
cagagggcaggggugcugug

SEQ ID NO: 1960206 - RNA, 14 nt, Homo sapiens
gaauccaauacugc

SEQ ID NO: 1960207 - RNA, 15 nt, Homo sapiens
cuuccuggcuguaaa

SEQ ID NO: 1960208 - RNA, 19 nt, Homo sapiens
cuagaaccaagcacuacca

SEQ ID NO: 1960209 - RNA, 15 nt, Homo sapiens
gguacucaauggagu

SEQ ID NO: 1960210 - RNA, 17 nt, Homo sapiens
aucugagagguaagaag

SEQ ID NO: 1960211 - RNA, 19 nt, Homo sapiens
cuccuuugguuaguguacu

SEQ ID NO: 1960212 - RNA, 13 nt, Homo sapiens
cuuuucugccaaa

SEQ ID NO: 1960213 - RNA, 20 nt, Homo sapiens
uuggacacccagugccaggg

SEQ ID NO: 1960214 - RNA, 16 nt, Homo sapiens
ucagccuggccagaca

SEQ ID NO: 1960215 - RNA, 19 nt, Homo sapiens
gguaaagaccagggaugcu

SEQ ID NO: 1960216 - RNA, 19 nt, Homo sapiens
acuuugcccccuugcccau

SEQ ID NO: 1960217 - RNA, 19 nt, Homo sapiens
aaacuuggaaccuuggaaa

SEQ ID NO: 1960218 - RNA, 21 nt, Homo sapiens
aauaccaacugaagucaauuu

SEQ ID NO: 1960219 - RNA, 18 nt, Homo sapiens
ucaguaaggcagugcagu

SEQ ID NO: 1960220 - RNA, 22 nt, Homo sapiens
ugucuugucauacaaauuuaua

SEQ ID NO: 1960221 - RNA, 14 nt, Homo sapiens
acaugacacccgug

SEQ ID NO: 1960222 - RNA, 18 nt, Homo sapiens
cuggggguggggcauggu

SEQ ID NO: 1960223 - RNA, 17 nt, Homo sapiens
auuuaccuauacauuau

SEQ ID NO: 1960224 - RNA, 19 nt, Homo sapiens
uaaacuuugaagcaacugu

SEQ ID NO: 1960225 - RNA, 21 nt, Homo sapiens
cucucauuucuggaaagugca

SEQ ID NO: 1960226 - RNA, 20 nt, Homo sapiens
ugcuagaaaagacauaauca

SEQ ID NO: 1960227 - RNA, 18 nt, Homo sapiens
cauauauauugaaaugca

SEQ ID NO: 1960228 - RNA, 19 nt, Homo sapiens
aucacauaugcuuacucuu

SEQ ID NO: 1960229 - RNA, 19 nt, Homo sapiens
gugacaguccuccauccac

SEQ ID NO: 1960230 - RNA, 21 nt, Homo sapiens
cugaaaggcagaacucagaac

SEQ ID NO: 1960231 - RNA, 16 nt, Homo sapiens
ucacucccaaaugcaa

SEQ ID NO: 1960232 - RNA, 20 nt, Homo sapiens
caaggaaccauaugugcuac

SEQ ID NO: 1960233 - RNA, 15 nt, Homo sapiens
cagaucacgaacuca

SEQ ID NO: 1960234 - RNA, 23 nt, Homo sapiens
uagaugugguuaauuuugcauau

SEQ ID NO: 1960235 - RNA, 15 nt, Homo sapiens
acaaaacaaacaaaa

SEQ ID NO: 1960236 - RNA, 17 nt, Homo sapiens
cuggccccggccuuuau

SEQ ID NO: 1960237 - RNA, 18 nt, Homo sapiens
cuuucaacucauugcauc

SEQ ID NO: 1960238 - RNA, 16 nt, Homo sapiens
guaaacaggauuauua

SEQ ID NO: 1960239 - RNA, 15 nt, Homo sapiens
uggagggauaagcca

SEQ ID NO: 1960240 - RNA, 13 nt, Homo sapiens
uucauggaacuca

SEQ ID NO: 1960241 - RNA, 13 nt, Homo sapiens
gaauaacuugaag

SEQ ID NO: 1960242 - RNA, 20 nt, Homo sapiens
ucugaggcccugcccaauga

SEQ ID NO: 1960243 - RNA, 22 nt, Homo sapiens
uuaaaguucucaaugcaaccau

SEQ ID NO: 1960244 - RNA, 14 nt, Homo sapiens
cugcccuuggcacc

SEQ ID NO: 1960245 - RNA, 17 nt, Homo sapiens
ugggaggucuccacuga

SEQ ID NO: 1960246 - RNA, 21 nt, Homo sapiens
ugcccaggcuagagugcaaug

SEQ ID NO: 1960247 - RNA, 18 nt, Homo sapiens
ugaaaauaauuguuccaa

SEQ ID NO: 1960248 - RNA, 13 nt, Homo sapiens
uaacuuguuucca

SEQ ID NO: 1960249 - RNA, 15 nt, Homo sapiens
gaagccagucagggc

SEQ ID NO: 1960250 - RNA, 21 nt, Homo sapiens
ccucuuagccucuggaucuag

SEQ ID NO: 1960251 - RNA, 12 nt, Homo sapiens
uaaaaucucuaa

SEQ ID NO: 1960252 - RNA, 12 nt, Homo sapiens
cagacacacaac

SEQ ID NO: 1960253 - RNA, 12 nt, Homo sapiens
agugggcugcug

SEQ ID NO: 1960254 - RNA, 15 nt, Homo sapiens
uggcaucacagggca

SEQ ID NO: 1960255 - RNA, 19 nt, Homo sapiens
aauugaaauauaaugcaaa

SEQ ID NO: 1960256 - RNA, 22 nt, Homo sapiens
acaaaaaaaaaacccuauuuaa

SEQ ID NO: 1960257 - RNA, 16 nt, Homo sapiens
gugucauaaacuuucu

SEQ ID NO: 1960258 - RNA, 15 nt, Homo sapiens
caucauuacuuauga

SEQ ID NO: 1960259 - RNA, 18 nt, Homo sapiens
ucugauuuuuauucucaa

SEQ ID NO: 1960260 - RNA, 17 nt, Homo sapiens
cagagaggggcagggaa

SEQ ID NO: 1960261 - RNA, 14 nt, Homo sapiens
uuccaaaugaauga

SEQ ID NO: 1960262 - RNA, 10 nt, Homo sapiens
augacaaaua

SEQ ID NO: 1960263 - RNA, 21 nt, Homo sapiens
caaagcccuuguccccaugaa

SEQ ID NO: 1960264 - RNA, 17 nt, Homo sapiens
cuccagaggaugacugg

SEQ ID NO: 1960265 - RNA, 16 nt, Homo sapiens
ucagaagugcccuucc

SEQ ID NO: 1960266 - RNA, 18 nt, Homo sapiens
uugacuuuagggacucaa

SEQ ID NO: 1960267 - RNA, 14 nt, Homo sapiens
caccuauaauacca

SEQ ID NO: 1960268 - RNA, 22 nt, Homo sapiens
aacgccuguaggaagaaaaagg

SEQ ID NO: 1960269 - RNA, 19 nt, Homo sapiens
uacuuuugacccaugugca

SEQ ID NO: 1960270 - RNA, 22 nt, Homo sapiens
uguucuaaagguggugaggcaa

SEQ ID NO: 1960271 - RNA, 11 nt, Homo sapiens
ccugccaagag

SEQ ID NO: 1960272 - RNA, 18 nt, Homo sapiens
aaggggguagaaguaguu

SEQ ID NO: 1960273 - RNA, 16 nt, Homo sapiens
aaagggccauguuuca

SEQ ID NO: 1960274 - RNA, 16 nt, Homo sapiens
cauuucccacccucca

SEQ ID NO: 1960275 - RNA, 16 nt, Homo sapiens
ugaugcaggcacuuau

SEQ ID NO: 1960276 - RNA, 14 nt, Homo sapiens
uuucuaaaaacaca

SEQ ID NO: 1960277 - RNA, 19 nt, Homo sapiens
gcccuuuucucucacccau

SEQ ID NO: 1960278 - RNA, 21 nt, Homo sapiens
gcaaaaacgaaagcugggcaa

SEQ ID NO: 1960279 - RNA, 15 nt, Homo sapiens
uguucucaacauacu

SEQ ID NO: 1960280 - RNA, 16 nt, Homo sapiens
uucaagaaacaaccuu

SEQ ID NO: 1960281 - RNA, 14 nt, Homo sapiens
auuguuuaccauag

SEQ ID NO: 1960282 - RNA, 18 nt, Homo sapiens
ugucuuuucaaaaggauu

SEQ ID NO: 1960283 - RNA, 20 nt, Homo sapiens
auuggccggcuaguguuucc

SEQ ID NO: 1960284 - RNA, 23 nt, Homo sapiens
ucuccagagcuccugaguggaau

SEQ ID NO: 1960285 - RNA, 20 nt, Homo sapiens
ucagaugcuccaagauucua

SEQ ID NO: 1960286 - RNA, 16 nt, Homo sapiens
ucauaauuaauguagu

SEQ ID NO: 1960287 - RNA, 15 nt, Homo sapiens
uauccugugacuguc

SEQ ID NO: 1960288 - RNA, 22 nt, Homo sapiens
ugcuucaaguguugcucuugga

SEQ ID NO: 1960289 - RNA, 15 nt, Homo sapiens
acagcaucagcucaa

SEQ ID NO: 1960290 - RNA, 13 nt, Homo sapiens
uucauuccccuga

SEQ ID NO: 1960291 - RNA, 18 nt, Homo sapiens
aagaaacugcucuaauau

SEQ ID NO: 1960292 - RNA, 18 nt, Homo sapiens
ccugccaggcacacugag

SEQ ID NO: 1960293 - RNA, 14 nt, Homo sapiens
cagggccugucuca

SEQ ID NO: 1960294 - RNA, 17 nt, Homo sapiens
ugugauauguguaauau

SEQ ID NO: 1960295 - RNA, 22 nt, Homo sapiens
uucuugucccucuguauacuga

SEQ ID NO: 1960296 - RNA, 16 nt, Homo sapiens
ucaacuuaaagugaau

SEQ ID NO: 1960297 - RNA, 18 nt, Homo sapiens
uacucugcucuaugccag

SEQ ID NO: 1960298 - RNA, 13 nt, Homo sapiens
uggcaaaagaaaa

SEQ ID NO: 1960299 - RNA, 22 nt, Homo sapiens
gauggccacugugaauaacugu

SEQ ID NO: 1960300 - RNA, 22 nt, Homo sapiens
ggauuucucuagaggcuggcaa

SEQ ID NO: 1960301 - RNA, 16 nt, Homo sapiens
ggcagucauacugggg

SEQ ID NO: 1960302 - RNA, 17 nt, Homo sapiens
uuuuacgcuuugcagac

SEQ ID NO: 1960303 - RNA, 21 nt, Homo sapiens
aacucccgaccucaggugauc

SEQ ID NO: 1960304 - RNA, 20 nt, Homo sapiens
gcauuugcugaauaacaaca

SEQ ID NO: 1960305 - RNA, 12 nt, Homo sapiens
uccaaagcaaau

SEQ ID NO: 1960306 - RNA, 12 nt, Homo sapiens
uccuaagcaaaa

SEQ ID NO: 1960307 - RNA, 23 nt, Homo sapiens
gauucagcgaagucucaugggaa

SEQ ID NO: 1960308 - RNA, 22 nt, Homo sapiens
ggagcucaguugagaaacaguu

SEQ ID NO: 1960309 - RNA, 20 nt, Homo sapiens
caaguguuuuacuaucucac

SEQ ID NO: 1960310 - RNA, 21 nt, Homo sapiens
agugugaccaguuuugauauu

SEQ ID NO: 1960311 - RNA, 20 nt, Homo sapiens
gacugcugguugacaucaga

SEQ ID NO: 1960312 - RNA, 16 nt, Homo sapiens
uggcucugcaccugua

SEQ ID NO: 1960313 - RNA, 23 nt, Homo sapiens
uucugucaagcuuacuacaguga

SEQ ID NO: 1960314 - RNA, 14 nt, Homo sapiens
caagcacaaaaacu

SEQ ID NO: 1960315 - RNA, 19 nt, Homo sapiens
aguuuguugaagugcacau

SEQ ID NO: 1960316 - RNA, 19 nt, Homo sapiens
gcugcaucuccccucagau

SEQ ID NO: 1960317 - RNA, 18 nt, Homo sapiens
aucaauggcgcagugccu

SEQ ID NO: 1960318 - RNA, 22 nt, Homo sapiens
cgcauacugagaaucuaggcca

SEQ ID NO: 1960319 - RNA, 12 nt, Homo sapiens
ucaaggugacag

SEQ ID NO: 1960320 - RNA, 20 nt, Homo sapiens
acacugacaaagucaucccc

SEQ ID NO: 1960321 - RNA, 20 nt, Homo sapiens
agcuacucuggaggcugaga

SEQ ID NO: 1960322 - RNA, 18 nt, Homo sapiens
caggcacuguucaucuca

SEQ ID NO: 1960323 - RNA, 13 nt, Homo sapiens
uccaaaaaugcac

SEQ ID NO: 1960324 - RNA, 19 nt, Homo sapiens
auguuccaauaaaacuuua

SEQ ID NO: 1960325 - RNA, 21 nt, Homo sapiens
cacacagaaaaggcugcugug

SEQ ID NO: 1960326 - RNA, 17 nt, Homo sapiens
ugccaucuccacccuga

SEQ ID NO: 1960327 - RNA, 20 nt, Homo sapiens
gcccugcugcccaaucucca

SEQ ID NO: 1960328 - RNA, 17 nt, Homo sapiens
aaagcuaccaucacuuc

SEQ ID NO: 1960329 - RNA, 18 nt, Homo sapiens
uguguuuacauuuacuga

SEQ ID NO: 1960330 - RNA, 14 nt, Homo sapiens
uacccagaauguca

SEQ ID NO: 1960331 - RNA, 14 nt, Homo sapiens
augcaugauacuau

SEQ ID NO: 1960332 - RNA, 12 nt, Homo sapiens
uauugcuucuag

SEQ ID NO: 1960333 - RNA, 13 nt, Homo sapiens
gcugcucagggaa

SEQ ID NO: 1960334 - RNA, 16 nt, Homo sapiens
gcagaaauguaucuau

SEQ ID NO: 1960335 - RNA, 12 nt, Homo sapiens
ucccauucugag

SEQ ID NO: 1960336 - RNA, 20 nt, Homo sapiens
ccuggagccacagcagccac

SEQ ID NO: 1960337 - RNA, 12 nt, Homo sapiens
caugugcugcag

SEQ ID NO: 1960338 - RNA, 16 nt, Homo sapiens
caccuugucaaccucu

SEQ ID NO: 1960339 - RNA, 17 nt, Homo sapiens
gaaaaaaacuucuuuaa

SEQ ID NO: 1960340 - RNA, 16 nt, Homo sapiens
ugucuguuuguuguau

SEQ ID NO: 1960341 - RNA, 13 nt, Homo sapiens
uaucuguucuguu

SEQ ID NO: 1960342 - RNA, 10 nt, Homo sapiens
uaauuucaaa

SEQ ID NO: 1960343 - RNA, 18 nt, Homo sapiens
gcguguacuaccccagga

SEQ ID NO: 1960344 - RNA, 23 nt, Homo sapiens
acccuuucuucaauacaaaaagc

SEQ ID NO: 1960345 - RNA, 23 nt, Homo sapiens
uagguuuuuccuacuguccucag

SEQ ID NO: 1960346 - RNA, 12 nt, Homo sapiens
gugggugccugu

SEQ ID NO: 1960347 - RNA, 18 nt, Homo sapiens
gccuucccugacuuacaa

SEQ ID NO: 1960348 - RNA, 19 nt, Homo sapiens
ucaugcuggccugugugau

SEQ ID NO: 1960349 - RNA, 21 nt, Homo sapiens
gccugucuuaauuuucuuuca

SEQ ID NO: 1960350 - RNA, 12 nt, Homo sapiens
agcacagguguc

SEQ ID NO: 1960351 - RNA, 23 nt, Homo sapiens
accuuucacaagggcaaacuuuu

SEQ ID NO: 1960352 - RNA, 14 nt, Homo sapiens
uguaaaagcacaug

SEQ ID NO: 1960353 - RNA, 19 nt, Homo sapiens
aaccaacaaugugauuuau

SEQ ID NO: 1960354 - RNA, 23 nt, Homo sapiens
cugucccucaaaugacccaaaga

SEQ ID NO: 1960355 - RNA, 15 nt, Homo sapiens
ugucccccucucgcc

SEQ ID NO: 1960356 - RNA, 15 nt, Homo sapiens
ugggcuucaguaagu

SEQ ID NO: 1960357 - RNA, 13 nt, Homo sapiens
acuuucagcugga

SEQ ID NO: 1960358 - RNA, 16 nt, Homo sapiens
ucagaaucugucaaac

SEQ ID NO: 1960359 - RNA, 13 nt, Homo sapiens
cuuugcacugagg

SEQ ID NO: 1960360 - RNA, 19 nt, Homo sapiens
cuucagucucuauaccaau

SEQ ID NO: 1960361 - RNA, 14 nt, Homo sapiens
ugaccgggcacugg

SEQ ID NO: 1960362 - RNA, 23 nt, Homo sapiens
auucuucaagaaagaauuccugc

SEQ ID NO: 1960363 - RNA, 21 nt, Homo sapiens
uuaagaacugcccagccucag

SEQ ID NO: 1960364 - RNA, 16 nt, Homo sapiens
acacugucaucuguag

SEQ ID NO: 1960365 - RNA, 22 nt, Homo sapiens
aauuuucccccuuagugaauua

SEQ ID NO: 1960366 - RNA, 17 nt, Homo sapiens
caagucagccuagagac

SEQ ID NO: 1960367 - RNA, 16 nt, Homo sapiens
caccccccaccauggu

SEQ ID NO: 1960368 - RNA, 17 nt, Homo sapiens
uaucaugcccugugcaa

SEQ ID NO: 1960369 - RNA, 20 nt, Homo sapiens
uucacugccuaaaauuuuag

SEQ ID NO: 1960370 - RNA, 13 nt, Homo sapiens
auuuugaaugaua

SEQ ID NO: 1960371 - RNA, 15 nt, Homo sapiens
ugcuugaauggagcu

SEQ ID NO: 1960372 - RNA, 22 nt, Homo sapiens
cauuucuaaaauguuaaaacau

SEQ ID NO: 1960373 - RNA, 11 nt, Homo sapiens
auuuuuugcca

SEQ ID NO: 1960374 - RNA, 22 nt, Homo sapiens
aaccccgagaaggaauggugcu

SEQ ID NO: 1960375 - RNA, 19 nt, Homo sapiens
augcagaauggcauuugca

SEQ ID NO: 1960376 - RNA, 16 nt, Homo sapiens
cagcgccagggcucag

SEQ ID NO: 1960377 - RNA, 15 nt, Homo sapiens
aauaaauuucgcaau

SEQ ID NO: 1960378 - RNA, 18 nt, Homo sapiens
gaggcaaagcuggcucac

SEQ ID NO: 1960379 - RNA, 19 nt, Homo sapiens
uagagcaagaacauucaaa

SEQ ID NO: 1960380 - RNA, 17 nt, Homo sapiens
uuaaacuuuagugcuac

SEQ ID NO: 1960381 - RNA, 20 nt, Homo sapiens
uccuauucugggcaaauaga

SEQ ID NO: 1960382 - RNA, 13 nt, Homo sapiens
augugcaaaguga

SEQ ID NO: 1960383 - RNA, 15 nt, Homo sapiens
cagcaggaagccuuc

SEQ ID NO: 1960384 - RNA, 15 nt, Homo sapiens
ccacggccacagcca

SEQ ID NO: 1960385 - RNA, 15 nt, Homo sapiens
uucaccgcauuccag

SEQ ID NO: 1960386 - RNA, 16 nt, Homo sapiens
gagccaaaaugacuuu

SEQ ID NO: 1960387 - RNA, 22 nt, Homo sapiens
aaaagcaagacuguugcucaaa

SEQ ID NO: 1960388 - RNA, 14 nt, Homo sapiens
acuaugucuagagc

SEQ ID NO: 1960389 - RNA, 15 nt, Homo sapiens
aaaaugaaacagaac

SEQ ID NO: 1960390 - RNA, 18 nt, Homo sapiens
gccaauaauaaaugcccu

SEQ ID NO: 1960391 - RNA, 21 nt, Homo sapiens
guguguauauaguaugaaugc

SEQ ID NO: 1960392 - RNA, 13 nt, Homo sapiens
aauaaacuccuac

SEQ ID NO: 1960393 - RNA, 13 nt, Homo sapiens
caugcacuacuga

SEQ ID NO: 1960394 - RNA, 15 nt, Homo sapiens
gcgggaggcagaguu

SEQ ID NO: 1960395 - RNA, 15 nt, Homo sapiens
ggggaaaacgggcag

SEQ ID NO: 1960396 - RNA, 19 nt, Homo sapiens
uccuggcacuaacguugag

SEQ ID NO: 1960397 - RNA, 14 nt, Homo sapiens
uccaucaacuguga

SEQ ID NO: 1960398 - RNA, 16 nt, Homo sapiens
ugugugccuuguucaa

SEQ ID NO: 1960399 - RNA, 16 nt, Homo sapiens
cucccagagagugaau

SEQ ID NO: 1960400 - RNA, 14 nt, Homo sapiens
aaaaugaacuccau

SEQ ID NO: 1960401 - RNA, 23 nt, Homo sapiens
uguacucuacgccaaagugcagc

SEQ ID NO: 1960402 - RNA, 21 nt, Homo sapiens
ugucuguuucaaugaccugua

SEQ ID NO: 1960403 - RNA, 18 nt, Homo sapiens
ucucuggacuuucuccaa

SEQ ID NO: 1960404 - RNA, 18 nt, Homo sapiens
uaugcccauucuuuucac

SEQ ID NO: 1960405 - RNA, 13 nt, Homo sapiens
cauaucaagagac

SEQ ID NO: 1960406 - RNA, 17 nt, Homo sapiens
aaucucugaauuugaga

SEQ ID NO: 1960407 - RNA, 14 nt, Homo sapiens
ugagggaaucaugg

SEQ ID NO: 1960408 - RNA, 23 nt, Homo sapiens
agagaauccaagccuaaaauuaa

SEQ ID NO: 1960409 - RNA, 19 nt, Homo sapiens
cucaaaccuccaaaagccc

SEQ ID NO: 1960410 - RNA, 16 nt, Homo sapiens
ugaauauuuagcauaa

SEQ ID NO: 1960411 - RNA, 19 nt, Homo sapiens
cugccucgggaaccucacu

SEQ ID NO: 1960412 - RNA, 17 nt, Homo sapiens
gcucugaggaguggagu

SEQ ID NO: 1960413 - RNA, 18 nt, Homo sapiens
uccguccauccauucaga

SEQ ID NO: 1960414 - RNA, 23 nt, Homo sapiens
aaaccguccccuccuucccucac

SEQ ID NO: 1960415 - RNA, 21 nt, Homo sapiens
gugcuucucuucuuuauugca

SEQ ID NO: 1960416 - RNA, 18 nt, Homo sapiens
ccccuaagauuugauaua

SEQ ID NO: 1960417 - RNA, 18 nt, Homo sapiens
aaaagaaagaaccacuca

SEQ ID NO: 1960418 - RNA, 19 nt, Homo sapiens
ccaguuguuacugaaguua

SEQ ID NO: 1960419 - RNA, 15 nt, Homo sapiens
cacguuagauuugcc

SEQ ID NO: 1960420 - RNA, 22 nt, Homo sapiens
caccauucugcauuuagcugua

SEQ ID NO: 1960421 - RNA, 19 nt, Homo sapiens
ggagugagcccauggugac

SEQ ID NO: 1960422 - RNA, 12 nt, Homo sapiens
aaagagugaaug

SEQ ID NO: 1960423 - RNA, 16 nt, Homo sapiens
guuagacuugcucccu

SEQ ID NO: 1960424 - RNA, 17 nt, Homo sapiens
ccucuucuugcggcacc

SEQ ID NO: 1960425 - RNA, 23 nt, Homo sapiens
uccuccauccuauccacugggca

SEQ ID NO: 1960426 - RNA, 15 nt, Homo sapiens
uuagugaugcaguua

SEQ ID NO: 1960427 - RNA, 21 nt, Homo sapiens
aacaaguucuuguugacucag

SEQ ID NO: 1960428 - RNA, 23 nt, Homo sapiens
auacucagguaccucuuucaggg

SEQ ID NO: 1960429 - RNA, 20 nt, Homo sapiens
aauaauugcucauaagcaau

SEQ ID NO: 1960430 - RNA, 18 nt, Homo sapiens
auccuucccgcagcacca

SEQ ID NO: 1960431 - RNA, 15 nt, Homo sapiens
uaaaucuuuuugcug

SEQ ID NO: 1960432 - RNA, 15 nt, Homo sapiens
gauagccgggcucca

SEQ ID NO: 1960433 - RNA, 23 nt, Homo sapiens
gaccccugugugacaucacaggg

SEQ ID NO: 1960434 - RNA, 16 nt, Homo sapiens
uuuuauaagcaaaaac

SEQ ID NO: 1960435 - RNA, 19 nt, Homo sapiens
gaaacuuuaauccaaagaa

SEQ ID NO: 1960436 - RNA, 20 nt, Homo sapiens
ugagcucaggaguuugagac

SEQ ID NO: 1960437 - RNA, 21 nt, Homo sapiens
acucuacuucccaguaacccu

SEQ ID NO: 1960438 - RNA, 21 nt, Homo sapiens
uacuuacaucuuuguuuacca

SEQ ID NO: 1960439 - RNA, 19 nt, Homo sapiens
ggaaggggugcccccaggc

SEQ ID NO: 1960440 - RNA, 19 nt, Homo sapiens
aauaaaccacgccaugagg

SEQ ID NO: 1960441 - RNA, 22 nt, Homo sapiens
aggaauucuaaauaaauuuccc

SEQ ID NO: 1960442 - RNA, 17 nt, Homo sapiens
gggcugcacauugccug

SEQ ID NO: 1960443 - RNA, 19 nt, Homo sapiens
ugaccuaaccuaagcaaaa

SEQ ID NO: 1960444 - RNA, 14 nt, Homo sapiens
ugaagaaacaaaga

SEQ ID NO: 1960445 - RNA, 17 nt, Homo sapiens
auaauuacuuaauguga

SEQ ID NO: 1960446 - RNA, 16 nt, Homo sapiens
caccuuggcaccagac

SEQ ID NO: 1960447 - RNA, 12 nt, Homo sapiens
ugaucugggaac

SEQ ID NO: 1960448 - RNA, 18 nt, Homo sapiens
uugcaggccaaaccguac

SEQ ID NO: 1960449 - RNA, 20 nt, Homo sapiens
uuuccaguguucuauuugcu

SEQ ID NO: 1960450 - RNA, 15 nt, Homo sapiens
aaucaugaaucuuug

SEQ ID NO: 1960451 - RNA, 15 nt, Homo sapiens
uauuugucugacaaa

SEQ ID NO: 1960452 - RNA, 18 nt, Homo sapiens
acaguaaaugaacugauu

SEQ ID NO: 1960453 - RNA, 20 nt, Homo sapiens
ccacuuggccaagcagggag

SEQ ID NO: 1960454 - RNA, 21 nt, Homo sapiens
gcauugcacagagugaacuua

SEQ ID NO: 1960455 - RNA, 12 nt, Homo sapiens
guugcacaaaaa

SEQ ID NO: 1960456 - RNA, 17 nt, Homo sapiens
uaaaugaaugagccaaa

SEQ ID NO: 1960457 - RNA, 16 nt, Homo sapiens
uccuaaaugcagugaa

SEQ ID NO: 1960458 - RNA, 16 nt, Homo sapiens
ggaauaugagcuuuau

SEQ ID NO: 1960459 - RNA, 20 nt, Homo sapiens
ggugacagcugcaagccagg

SEQ ID NO: 1960460 - RNA, 18 nt, Homo sapiens
ggccuccauuuguaccga

SEQ ID NO: 1960461 - RNA, 22 nt, Homo sapiens
uccuucccucuccccaagacuu

SEQ ID NO: 1960462 - RNA, 16 nt, Homo sapiens
accugcagauguucug

SEQ ID NO: 1960463 - RNA, 18 nt, Homo sapiens
caaauuaagugugcauga

SEQ ID NO: 1960464 - RNA, 16 nt, Homo sapiens
guauucucuuccucau

SEQ ID NO: 1960465 - RNA, 21 nt, Homo sapiens
gcaaagauuuucaaacaaaau

SEQ ID NO: 1960466 - RNA, 19 nt, Homo sapiens
aggcuuguggccacagugg

SEQ ID NO: 1960467 - RNA, 18 nt, Homo sapiens
cagacuugguccuaagca

SEQ ID NO: 1960468 - RNA, 15 nt, Homo sapiens
uauaucacucuagaa

SEQ ID NO: 1960469 - RNA, 12 nt, Homo sapiens
cacacccggcua

SEQ ID NO: 1960470 - RNA, 13 nt, Homo sapiens
uguuuaccuggug

SEQ ID NO: 1960471 - RNA, 22 nt, Homo sapiens
uucaucuggggaugacaaugga

SEQ ID NO: 1960472 - RNA, 16 nt, Homo sapiens
gaacccucaacugaca

SEQ ID NO: 1960473 - RNA, 15 nt, Homo sapiens
gcaugcgcaggcuca

SEQ ID NO: 1960474 - RNA, 15 nt, Homo sapiens
ucugaauauucuaga

SEQ ID NO: 1960475 - RNA, 19 nt, Homo sapiens
ccuuuaccuaccaccuucc

SEQ ID NO: 1960476 - RNA, 14 nt, Homo sapiens
ucaucccagugcac

SEQ ID NO: 1960477 - RNA, 16 nt, Homo sapiens
gcuccaguguaucuca

SEQ ID NO: 1960478 - RNA, 17 nt, Homo sapiens
ugcccaggcuggucuca

SEQ ID NO: 1960479 - RNA, 23 nt, Homo sapiens
augaugcaaauuuauacacugau

SEQ ID NO: 1960480 - RNA, 18 nt, Homo sapiens
caggacugugacucauuc

SEQ ID NO: 1960481 - RNA, 14 nt, Homo sapiens
ucaugaaugucucg

SEQ ID NO: 1960482 - RNA, 14 nt, Homo sapiens
aaaauauggcuaua

SEQ ID NO: 1960483 - RNA, 18 nt, Homo sapiens
auacuaagggaagaaaca

SEQ ID NO: 1960484 - RNA, 19 nt, Homo sapiens
aucuuuuauaaugauucau

SEQ ID NO: 1960485 - RNA, 22 nt, Homo sapiens
gcucugcacagggaugaccugg

SEQ ID NO: 1960486 - RNA, 13 nt, Homo sapiens
auuugagugcucu

SEQ ID NO: 1960487 - RNA, 18 nt, Homo sapiens
cuaggccacaccaucucc

SEQ ID NO: 1960488 - RNA, 13 nt, Homo sapiens
gacaaagugccaa

SEQ ID NO: 1960489 - RNA, 13 nt, Homo sapiens
aauaaaguacuaa

SEQ ID NO: 1960490 - RNA, 14 nt, Homo sapiens
uuuauaaugaauaa

SEQ ID NO: 1960491 - RNA, 19 nt, Homo sapiens
uucacguaaauauucauau

SEQ ID NO: 1960492 - RNA, 15 nt, Homo sapiens
auuaacuaugugaug

SEQ ID NO: 1960493 - RNA, 19 nt, Homo sapiens
gaguacuggcugauggagu

SEQ ID NO: 1960494 - RNA, 21 nt, Homo sapiens
gcuccauucacucccagguga

SEQ ID NO: 1960495 - RNA, 16 nt, Homo sapiens
gcgcugggcacuuccc

SEQ ID NO: 1960496 - RNA, 14 nt, Homo sapiens
cuccuuuugaggcu

SEQ ID NO: 1960497 - RNA, 14 nt, Homo sapiens
ucuguggaaugauu

SEQ ID NO: 1960498 - RNA, 22 nt, Homo sapiens
acuagggaaaugaucaguuuuu

SEQ ID NO: 1960499 - RNA, 14 nt, Homo sapiens
agaaauucuguggu

SEQ ID NO: 1960500 - RNA, 20 nt, Homo sapiens
gguugaacucugguggcaca

SEQ ID NO: 1960501 - RNA, 14 nt, Homo sapiens
cugcuaugaccaug

SEQ ID NO: 1960502 - RNA, 17 nt, Homo sapiens
auagcagcuuuagccaa

SEQ ID NO: 1960503 - RNA, 17 nt, Homo sapiens
gaccccccuauugcugc

SEQ ID NO: 1960504 - RNA, 19 nt, Homo sapiens
gucugcaggccaccagcug

SEQ ID NO: 1960505 - RNA, 23 nt, Homo sapiens
uuuuaaaaauaagccacauaucu

SEQ ID NO: 1960506 - RNA, 18 nt, Homo sapiens
ccaaauuugaguugcacc

SEQ ID NO: 1960507 - RNA, 12 nt, Homo sapiens
gacaaacacugc

SEQ ID NO: 1960508 - RNA, 21 nt, Homo sapiens
acagcuccuccucuuggagcu

SEQ ID NO: 1960509 - RNA, 15 nt, Homo sapiens
acaaccggaugccag

SEQ ID NO: 1960510 - RNA, 14 nt, Homo sapiens
ucuaggcucugccu

SEQ ID NO: 1960511 - RNA, 17 nt, Homo sapiens
gacacuaaaacaccuca

SEQ ID NO: 1960512 - RNA, 18 nt, Homo sapiens
cugcacucccaccugaca

SEQ ID NO: 1960513 - RNA, 22 nt, Homo sapiens
acucuggcuucaaaaagccaca

SEQ ID NO: 1960514 - RNA, 15 nt, Homo sapiens
gcaaaggcagaggaa

SEQ ID NO: 1960515 - RNA, 21 nt, Homo sapiens
agcugcuuugaggcaguucca

SEQ ID NO: 1960516 - RNA, 14 nt, Homo sapiens
acaagccauagugg

SEQ ID NO: 1960517 - RNA, 19 nt, Homo sapiens
auucuuuguauaugcauuc

SEQ ID NO: 1960518 - RNA, 12 nt, Homo sapiens
uguggucucagg

SEQ ID NO: 1960519 - RNA, 18 nt, Homo sapiens
cuuucuagcuaauggaaa

SEQ ID NO: 1960520 - RNA, 18 nt, Homo sapiens
augucuucauucccaagg

SEQ ID NO: 1960521 - RNA, 17 nt, Homo sapiens
uucagggauagcacuga

SEQ ID NO: 1960522 - RNA, 13 nt, Homo sapiens
gcguggaccaccc

SEQ ID NO: 1960523 - RNA, 19 nt, Homo sapiens
ucccugugccagaccucaa

SEQ ID NO: 1960524 - RNA, 17 nt, Homo sapiens
uuaagcuuuauugugau

SEQ ID NO: 1960525 - RNA, 20 nt, Homo sapiens
ccaaaagaauuaaauugauu

SEQ ID NO: 1960526 - RNA, 19 nt, Homo sapiens
cuuccauaaaaaaacaauu

SEQ ID NO: 1960527 - RNA, 15 nt, Homo sapiens
cuuaaaacaaauuca

SEQ ID NO: 1960528 - RNA, 20 nt, Homo sapiens
aaggcugacauucacugagu

SEQ ID NO: 1960529 - RNA, 16 nt, Homo sapiens
gcuaauguacuuucac

SEQ ID NO: 1960530 - RNA, 14 nt, Homo sapiens
aaguccacuguccu

SEQ ID NO: 1960531 - RNA, 13 nt, Homo sapiens
gacgacccggggc

SEQ ID NO: 1960532 - RNA, 14 nt, Homo sapiens
acgcuugcuaucau

SEQ ID NO: 1960533 - RNA, 19 nt, Homo sapiens
ccagugcaguagugccaaa

SEQ ID NO: 1960534 - RNA, 12 nt, Homo sapiens
cucacauucauu

SEQ ID NO: 1960535 - RNA, 12 nt, Homo sapiens
uuuacauuuacu

SEQ ID NO: 1960536 - RNA, 16 nt, Homo sapiens
ccccaggacucuggca

SEQ ID NO: 1960537 - RNA, 16 nt, Homo sapiens
uugcaaauaagacucu

SEQ ID NO: 1960538 - RNA, 20 nt, Homo sapiens
cagagugguuuccaaugugu

SEQ ID NO: 1960539 - RNA, 16 nt, Homo sapiens
ggccucaccccaggga

SEQ ID NO: 1960540 - RNA, 16 nt, Homo sapiens
aagagaauguauuucc

SEQ ID NO: 1960541 - RNA, 24 nt, Homo sapiens
gaaauccaaauuucucauguuccu

SEQ ID NO: 1960542 - RNA, 12 nt, Homo sapiens
acccuccagacc

SEQ ID NO: 1960543 - RNA, 17 nt, Homo sapiens
guucuuguccuggaguc

SEQ ID NO: 1960544 - RNA, 14 nt, Homo sapiens
ucacuuuuagggag

SEQ ID NO: 1960545 - RNA, 23 nt, Homo sapiens
ucaccaugguuuuucacauugca

SEQ ID NO: 1960546 - RNA, 17 nt, Homo sapiens
gacucauuacuacucag

SEQ ID NO: 1960547 - RNA, 21 nt, Homo sapiens
ccugaucagagccgugguccu

SEQ ID NO: 1960548 - RNA, 18 nt, Homo sapiens
gaaauuccuagugucuuu

SEQ ID NO: 1960549 - RNA, 23 nt, Homo sapiens
cuucucuucccugcgccugugau

SEQ ID NO: 1960550 - RNA, 23 nt, Homo sapiens
caucauaauauaaaacaggaugg

SEQ ID NO: 1960551 - RNA, 19 nt, Homo sapiens
cccuccugugcugggggaa

SEQ ID NO: 1960552 - RNA, 19 nt, Homo sapiens
ugguacagagaagccagcu

SEQ ID NO: 1960553 - RNA, 14 nt, Homo sapiens
gguuagcuaccugc

SEQ ID NO: 1960554 - RNA, 21 nt, Homo sapiens
uuaugauaacuauuuacauau

SEQ ID NO: 1960555 - RNA, 20 nt, Homo sapiens
auagacacuggagacuugga

SEQ ID NO: 1960556 - RNA, 20 nt, Homo sapiens
uaccuaauguuaaaugacga

SEQ ID NO: 1960557 - RNA, 22 nt, Homo sapiens
auguacacacacagaugcacac

SEQ ID NO: 1960558 - RNA, 14 nt, Homo sapiens
uaggaaaauuucac

SEQ ID NO: 1960559 - RNA, 18 nt, Homo sapiens
acauccugugccuccauc

SEQ ID NO: 1960560 - RNA, 22 nt, Homo sapiens
cauuuaggacuggguuccccac

SEQ ID NO: 1960561 - RNA, 13 nt, Homo sapiens
cgguguucugucc

SEQ ID NO: 1960562 - RNA, 16 nt, Homo sapiens
aacccguaagauuccu

SEQ ID NO: 1960563 - RNA, 16 nt, Homo sapiens
uuauccuucuacuugu

SEQ ID NO: 1960564 - RNA, 14 nt, Homo sapiens
agaacgauucaccu

SEQ ID NO: 1960565 - RNA, 19 nt, Homo sapiens
guugaagccaugucuacau

SEQ ID NO: 1960566 - RNA, 15 nt, Homo sapiens
uaccagacuguguau

SEQ ID NO: 1960567 - RNA, 19 nt, Homo sapiens
cacaaaauuaucaugacaa

SEQ ID NO: 1960568 - RNA, 14 nt, Homo sapiens
aagagaaaugagcu

SEQ ID NO: 1960569 - RNA, 20 nt, Homo sapiens
ugacaggacauuugacauga

SEQ ID NO: 1960570 - RNA, 17 nt, Homo sapiens
cucaggggugauucuga

SEQ ID NO: 1960571 - RNA, 17 nt, Homo sapiens
cauccaggacugugcca

SEQ ID NO: 1960572 - RNA, 17 nt, Homo sapiens
ucucagagucauugaag

SEQ ID NO: 1960573 - RNA, 16 nt, Homo sapiens
cuauaauucuauugaa

SEQ ID NO: 1960574 - RNA, 16 nt, Homo sapiens
agacuguuagacaaaa

SEQ ID NO: 1960575 - RNA, 18 nt, Homo sapiens
cauguugaaaaucaguuu

SEQ ID NO: 1960576 - RNA, 22 nt, Homo sapiens
uugcuccuggcuggggccuguu

SEQ ID NO: 1960577 - RNA, 13 nt, Homo sapiens
uccaucagcuaaa

SEQ ID NO: 1960578 - RNA, 18 nt, Homo sapiens
uacuaaagucacauauaa

SEQ ID NO: 1960579 - RNA, 19 nt, Homo sapiens
ugugcuucuuaauguguaa

SEQ ID NO: 1960580 - RNA, 24 nt, Homo sapiens
gugauuacauagaucagccauuaa

SEQ ID NO: 1960581 - RNA, 15 nt, Homo sapiens
gagggaguggcagcu

SEQ ID NO: 1960582 - RNA, 22 nt, Homo sapiens
uccgcugcgucugcacugauga

SEQ ID NO: 1960583 - RNA, 15 nt, Homo sapiens
ucucucuaccuccac

SEQ ID NO: 1960584 - RNA, 23 nt, Homo sapiens
uuccuuuggugacuucacaguga

SEQ ID NO: 1960585 - RNA, 17 nt, Homo sapiens
uccuguucuuucuuaca

SEQ ID NO: 1960586 - RNA, 18 nt, Homo sapiens
caaggugagaaaucacaa

SEQ ID NO: 1960587 - RNA, 19 nt, Homo sapiens
cguauuaaaaaacaauuaa

SEQ ID NO: 1960588 - RNA, 21 nt, Homo sapiens
cuugaaacagauucaggccag

SEQ ID NO: 1960589 - RNA, 18 nt, Homo sapiens
cagaaucccggcugucaa

SEQ ID NO: 1960590 - RNA, 17 nt, Homo sapiens
auuuagugcauuucaaa

SEQ ID NO: 1960591 - RNA, 14 nt, Homo sapiens
aaauccgcuucucc

SEQ ID NO: 1960592 - RNA, 16 nt, Homo sapiens
caugauuguuugacac

SEQ ID NO: 1960593 - RNA, 23 nt, Homo sapiens
cuggcuuugcccaaccucagcaa

SEQ ID NO: 1960594 - RNA, 14 nt, Homo sapiens
uucuaugaagccca

SEQ ID NO: 1960595 - RNA, 20 nt, Homo sapiens
gaaacuccaaaguccacaca

SEQ ID NO: 1960596 - RNA, 18 nt, Homo sapiens
ugagccaucaucauggca

SEQ ID NO: 1960597 - RNA, 15 nt, Homo sapiens
ccugagauucuggga

SEQ ID NO: 1960598 - RNA, 16 nt, Homo sapiens
cucuaccgggcgaguc

SEQ ID NO: 1960599 - RNA, 20 nt, Homo sapiens
uuugggaacugcaauaaccu

SEQ ID NO: 1960600 - RNA, 19 nt, Homo sapiens
uguguuuggauacaucugc

SEQ ID NO: 1960601 - RNA, 14 nt, Homo sapiens
agugaacacacuca

SEQ ID NO: 1960602 - RNA, 10 nt, Homo sapiens
auuagcugug

SEQ ID NO: 1960603 - RNA, 14 nt, Homo sapiens
ucuuuguauugaca

SEQ ID NO: 1960604 - RNA, 20 nt, Homo sapiens
uguggcucaacacaugagaa

SEQ ID NO: 1960605 - RNA, 21 nt, Homo sapiens
guugacuuauuaggacuuuga

SEQ ID NO: 1960606 - RNA, 23 nt, Homo sapiens
aaugccaagggggugacuggaag

SEQ ID NO: 1960607 - RNA, 12 nt, Homo sapiens
uugggauguacc

SEQ ID NO: 1960608 - RNA, 14 nt, Homo sapiens
gcaucagugacuga

SEQ ID NO: 1960609 - RNA, 14 nt, Homo sapiens
agcuggcacugaca

SEQ ID NO: 1960610 - RNA, 19 nt, Homo sapiens
cacaagacagcagagccau

SEQ ID NO: 1960611 - RNA, 21 nt, Homo sapiens
aagaugacgaguaacuccccu

SEQ ID NO: 1960612 - RNA, 16 nt, Homo sapiens
cgggcauacguuuucu

SEQ ID NO: 1960613 - RNA, 15 nt, Homo sapiens
uaacacuaauuauca

SEQ ID NO: 1960614 - RNA, 22 nt, Homo sapiens
cagcgaccucaaguguccugaa

SEQ ID NO: 1960615 - RNA, 23 nt, Homo sapiens
cuuucccgcccagccucacuucc

SEQ ID NO: 1960616 - RNA, 14 nt, Homo sapiens
gcacggcucugggg

SEQ ID NO: 1960617 - RNA, 23 nt, Homo sapiens
aacugugcucucccaaagccaua

SEQ ID NO: 1960618 - RNA, 13 nt, Homo sapiens
uugccugaugaca

SEQ ID NO: 1960619 - RNA, 20 nt, Homo sapiens
cucccacgugcacagcuucc

SEQ ID NO: 1960620 - RNA, 12 nt, Homo sapiens
guugcugacuua

SEQ ID NO: 1960621 - RNA, 13 nt, Homo sapiens
ugaagcauaguca

SEQ ID NO: 1960622 - RNA, 14 nt, Homo sapiens
gauauuacauuuau

SEQ ID NO: 1960623 - RNA, 21 nt, Homo sapiens
cugugcuuugagagggauuug

SEQ ID NO: 1960624 - RNA, 14 nt, Homo sapiens
agccgcagagaaua

SEQ ID NO: 1960625 - RNA, 13 nt, Homo sapiens
auggggccagauc

SEQ ID NO: 1960626 - RNA, 13 nt, Homo sapiens
gaugauaaaacac

SEQ ID NO: 1960627 - RNA, 17 nt, Homo sapiens
uccuauuccuucacaca

SEQ ID NO: 1960628 - RNA, 21 nt, Homo sapiens
ucugugcucaggacucagaag

SEQ ID NO: 1960629 - RNA, 19 nt, Homo sapiens
uucaaauuuuuacugagaa

SEQ ID NO: 1960630 - RNA, 15 nt, Homo sapiens
agagaauccaaacuc

SEQ ID NO: 1960631 - RNA, 19 nt, Homo sapiens
ugagcugguaggauguaag

SEQ ID NO: 1960632 - RNA, 22 nt, Homo sapiens
uagcucacacucauccacacuu

SEQ ID NO: 1960633 - RNA, 19 nt, Homo sapiens
ucugaaaucuacaacauaa

SEQ ID NO: 1960634 - RNA, 21 nt, Homo sapiens
acagagucucgcuauugucac

SEQ ID NO: 1960635 - RNA, 18 nt, Homo sapiens
cauuugcuuacuuugcau

SEQ ID NO: 1960636 - RNA, 14 nt, Homo sapiens
caaaguugcucacc

SEQ ID NO: 1960637 - RNA, 22 nt, Homo sapiens
ucccugagagcucacaguacaa

SEQ ID NO: 1960638 - RNA, 15 nt, Homo sapiens
acuaacguacauuca

SEQ ID NO: 1960639 - RNA, 15 nt, Homo sapiens
cgagaagcagcauuu

SEQ ID NO: 1960640 - RNA, 20 nt, Homo sapiens
ugauacuggaggaacacuug

SEQ ID NO: 1960641 - RNA, 15 nt, Homo sapiens
acgggagagggcagu

SEQ ID NO: 1960642 - RNA, 18 nt, Homo sapiens
cauccaaccacuguacac

SEQ ID NO: 1960643 - RNA, 18 nt, Homo sapiens
ccaaaggacgcacugagc

SEQ ID NO: 1960644 - RNA, 16 nt, Homo sapiens
ugcucggacacaguuu

SEQ ID NO: 1960645 - RNA, 16 nt, Homo sapiens
ugcaauauaagcauaa

SEQ ID NO: 1960646 - RNA, 16 nt, Homo sapiens
uuuucuaaaacuaaau

SEQ ID NO: 1960647 - RNA, 14 nt, Homo sapiens
ggacugauaaucuc

SEQ ID NO: 1960648 - RNA, 13 nt, Homo sapiens
agcagugaugaaa

SEQ ID NO: 1960649 - RNA, 16 nt, Homo sapiens
uacugcugucuuccaa

SEQ ID NO: 1960650 - RNA, 19 nt, Homo sapiens
guaauccaggcacagcuga

SEQ ID NO: 1960651 - RNA, 19 nt, Homo sapiens
ucuaaaaaaauaaacaaag

SEQ ID NO: 1960652 - RNA, 22 nt, Homo sapiens
uacauuguucuuauucuggcau

SEQ ID NO: 1960653 - RNA, 15 nt, Homo sapiens
gagagaucuaauccc

SEQ ID NO: 1960654 - RNA, 23 nt, Homo sapiens
auauguugaugaaaaauagcaac

SEQ ID NO: 1960655 - RNA, 20 nt, Homo sapiens
uacuucagucuugaugcagu

SEQ ID NO: 1960656 - RNA, 20 nt, Homo sapiens
uugcccagccuggaugccau

SEQ ID NO: 1960657 - RNA, 13 nt, Homo sapiens
caaaccaggauuu

SEQ ID NO: 1960658 - RNA, 21 nt, Homo sapiens
cacuggcuuuggguagugcca

SEQ ID NO: 1960659 - RNA, 12 nt, Homo sapiens
uuuacauuacug

SEQ ID NO: 1960660 - RNA, 13 nt, Homo sapiens
gcagaauaaucuu

SEQ ID NO: 1960661 - RNA, 22 nt, Homo sapiens
gguucaugcuucuacugugaca

SEQ ID NO: 1960662 - RNA, 16 nt, Homo sapiens
gcugcauacuggccga

SEQ ID NO: 1960663 - RNA, 16 nt, Homo sapiens
aaagaaaucuugucuu

SEQ ID NO: 1960664 - RNA, 22 nt, Homo sapiens
agggaacugacccucaggcaca

SEQ ID NO: 1960665 - RNA, 14 nt, Homo sapiens
ccaacaccaccucu

SEQ ID NO: 1960666 - RNA, 19 nt, Homo sapiens
gaucuaacaaaauaagguu

SEQ ID NO: 1960667 - RNA, 19 nt, Homo sapiens
cagaaauccugcaaugaaa

SEQ ID NO: 1960668 - RNA, 17 nt, Homo sapiens
cuauaacuacauauuga

SEQ ID NO: 1960669 - RNA, 18 nt, Homo sapiens
ugaauaaaugaaugcaca

SEQ ID NO: 1960670 - RNA, 16 nt, Homo sapiens
ccaucucugauuuuca

SEQ ID NO: 1960671 - RNA, 15 nt, Homo sapiens
aauuauaugaccaua

SEQ ID NO: 1960672 - RNA, 17 nt, Homo sapiens
auugaagccuuugccag

SEQ ID NO: 1960673 - RNA, 16 nt, Homo sapiens
auacaugaaugggcau

SEQ ID NO: 1960674 - RNA, 21 nt, Homo sapiens
auugauaacagcacugacuag

SEQ ID NO: 1960675 - RNA, 17 nt, Homo sapiens
cuguucauguuacucau

SEQ ID NO: 1960676 - RNA, 16 nt, Homo sapiens
ugugccaggacuguga

SEQ ID NO: 1960677 - RNA, 20 nt, Homo sapiens
aaguguuuucucagaacagc

SEQ ID NO: 1960678 - RNA, 14 nt, Homo sapiens
uugccaaccuguaa

SEQ ID NO: 1960679 - RNA, 17 nt, Homo sapiens
acuauucacugaugcag

SEQ ID NO: 1960680 - RNA, 18 nt, Homo sapiens
gcucagagcuuugucacu

SEQ ID NO: 1960681 - RNA, 22 nt, Homo sapiens
gcuuuuggugguccccacagcc

SEQ ID NO: 1960682 - RNA, 13 nt, Homo sapiens
auugauuccacau

SEQ ID NO: 1960683 - RNA, 22 nt, Homo sapiens
cccaaccuucacaucugucacg

SEQ ID NO: 1960684 - RNA, 14 nt, Homo sapiens
cucuaacaccacac

SEQ ID NO: 1960685 - RNA, 18 nt, Homo sapiens
caagagugaaaauagagg

SEQ ID NO: 1960686 - RNA, 16 nt, Homo sapiens
uacuuccaugauacuu

SEQ ID NO: 1960687 - RNA, 21 nt, Homo sapiens
gagcauuggauacagcaguag

SEQ ID NO: 1960688 - RNA, 12 nt, Homo sapiens
uacucuugccug

SEQ ID NO: 1960689 - RNA, 15 nt, Homo sapiens
aucauucagcaucua

SEQ ID NO: 1960690 - RNA, 14 nt, Homo sapiens
gcucucugaccucc

SEQ ID NO: 1960691 - RNA, 21 nt, Homo sapiens
gaacggaggaggacaugggga

SEQ ID NO: 1960692 - RNA, 18 nt, Homo sapiens
agccaugggaaaugagcc

SEQ ID NO: 1960693 - RNA, 17 nt, Homo sapiens
auucaugagcuacucau

SEQ ID NO: 1960694 - RNA, 21 nt, Homo sapiens
uggaaggcagcaggcauuugc

SEQ ID NO: 1960695 - RNA, 13 nt, Homo sapiens
aguccacugcuga

SEQ ID NO: 1960696 - RNA, 18 nt, Homo sapiens
cacuauucuuaagcacuu

SEQ ID NO: 1960697 - RNA, 16 nt, Homo sapiens
agccuucggacagaca

SEQ ID NO: 1960698 - RNA, 11 nt, Homo sapiens
cuccccugaag

SEQ ID NO: 1960699 - RNA, 11 nt, Homo sapiens
uuaaaauaacu

SEQ ID NO: 1960700 - RNA, 19 nt, Homo sapiens
aucaagcaauccagccuca

SEQ ID NO: 1960701 - RNA, 17 nt, Homo sapiens
ucauggcccaucagggg

SEQ ID NO: 1960702 - RNA, 14 nt, Homo sapiens
aaguuguugcauuc

SEQ ID NO: 1960703 - RNA, 12 nt, Homo sapiens
cccuacagaauu

SEQ ID NO: 1960704 - RNA, 21 nt, Homo sapiens
ggucacaggggugucuugucu

SEQ ID NO: 1960705 - RNA, 13 nt, Homo sapiens
cacuugagaggau

SEQ ID NO: 1960706 - RNA, 18 nt, Homo sapiens
caaaggcaggcacuucac

SEQ ID NO: 1960707 - RNA, 19 nt, Homo sapiens
cagccuggccaacauggca

SEQ ID NO: 1960708 - RNA, 17 nt, Homo sapiens
ugguuccaagcccugga

SEQ ID NO: 1960709 - RNA, 14 nt, Homo sapiens
uccuuugugaauau

SEQ ID NO: 1960710 - RNA, 13 nt, Homo sapiens
cuucuuuccaugg

SEQ ID NO: 1960711 - RNA, 19 nt, Homo sapiens
ugaccuggaaucagugaag

SEQ ID NO: 1960712 - RNA, 16 nt, Homo sapiens
ugguacaugccuguaa

SEQ ID NO: 1960713 - RNA, 23 nt, Homo sapiens
ugucagcuugguccacaucacca

SEQ ID NO: 1960714 - RNA, 14 nt, Homo sapiens
uagacaagccagaa

SEQ ID NO: 1960715 - RNA, 18 nt, Homo sapiens
acaccuguagucccagcu

SEQ ID NO: 1960716 - RNA, 23 nt, Homo sapiens
ucaguugauuuuucuuauuuaca

SEQ ID NO: 1960717 - RNA, 19 nt, Homo sapiens
gcuggaaaagggcucagag

SEQ ID NO: 1960718 - RNA, 19 nt, Homo sapiens
accuaagcaaucacugggc

SEQ ID NO: 1960719 - RNA, 23 nt, Homo sapiens
ucccacacagaauauacauuguc

SEQ ID NO: 1960720 - RNA, 16 nt, Homo sapiens
caaggaaagaaauaca

SEQ ID NO: 1960721 - RNA, 16 nt, Homo sapiens
ggugacuucacaguga

SEQ ID NO: 1960722 - RNA, 23 nt, Homo sapiens
gaggccuauaaugaagcuuuaua

SEQ ID NO: 1960723 - RNA, 22 nt, Homo sapiens
cuccaggcugucuuucacugaa

SEQ ID NO: 1960724 - RNA, 18 nt, Homo sapiens
agcuccacagaagacacg

SEQ ID NO: 1960725 - RNA, 16 nt, Homo sapiens
cuuucuagguucaaaa

SEQ ID NO: 1960726 - RNA, 21 nt, Homo sapiens
guguugggaauugcaugccau

SEQ ID NO: 1960727 - RNA, 21 nt, Homo sapiens
cucauaccagcauacgcucac

SEQ ID NO: 1960728 - RNA, 13 nt, Homo sapiens
accaagaacagag

SEQ ID NO: 1960729 - RNA, 15 nt, Homo sapiens
aaugagugugacuau

SEQ ID NO: 1960730 - RNA, 17 nt, Homo sapiens
cugaaagcaacuacaga

SEQ ID NO: 1960731 - RNA, 21 nt, Homo sapiens
acuuuaaugaacuaacugaca

SEQ ID NO: 1960732 - RNA, 18 nt, Homo sapiens
cuacaguauuacucuuac

SEQ ID NO: 1960733 - RNA, 21 nt, Homo sapiens
gcaauagcgcucccuuuucac

SEQ ID NO: 1960734 - RNA, 23 nt, Homo sapiens
uggauuuaucccccgcaaagaca

SEQ ID NO: 1960735 - RNA, 19 nt, Homo sapiens
uuuaucguccagugacuuu

SEQ ID NO: 1960736 - RNA, 16 nt, Homo sapiens
gccucaggaaugggcu

SEQ ID NO: 1960737 - RNA, 17 nt, Homo sapiens
gccucucucaggccaaa

SEQ ID NO: 1960738 - RNA, 20 nt, Homo sapiens
gaaggugccuggccauguca

SEQ ID NO: 1960739 - RNA, 19 nt, Homo sapiens
uucuccucucuaaaagugu

SEQ ID NO: 1960740 - RNA, 19 nt, Homo sapiens
uuucaaguguaacuuauua

SEQ ID NO: 1960741 - RNA, 23 nt, Homo sapiens
aguauuuccuuccacuguagcua

SEQ ID NO: 1960742 - RNA, 16 nt, Homo sapiens
cuucucuucuauccug

SEQ ID NO: 1960743 - RNA, 13 nt, Homo sapiens
uagagaagcugaa

SEQ ID NO: 1960744 - RNA, 13 nt, Homo sapiens
uuaaaaagcaaag

SEQ ID NO: 1960745 - RNA, 13 nt, Homo sapiens
aguccuguucuca

SEQ ID NO: 1960746 - RNA, 13 nt, Homo sapiens
ucaucuguagaua

SEQ ID NO: 1960747 - RNA, 15 nt, Homo sapiens
uaaaaaaaugcauag

SEQ ID NO: 1960748 - RNA, 17 nt, Homo sapiens
ucucagaaaugucauga

SEQ ID NO: 1960749 - RNA, 14 nt, Homo sapiens
cagccuggagaccc

SEQ ID NO: 1960750 - RNA, 18 nt, Homo sapiens
acugagggccuggucacc

SEQ ID NO: 1960751 - RNA, 14 nt, Homo sapiens
gaaacucgaauaaa

SEQ ID NO: 1960752 - RNA, 21 nt, Homo sapiens
ccuuaccccugccuuugggag

SEQ ID NO: 1960753 - RNA, 18 nt, Homo sapiens
aguuuaaguaauugccua

SEQ ID NO: 1960754 - RNA, 21 nt, Homo sapiens
caugacauccagagaugacua

SEQ ID NO: 1960755 - RNA, 17 nt, Homo sapiens
ggaugaagcccuaaaga

SEQ ID NO: 1960756 - RNA, 16 nt, Homo sapiens
acaggaaagggcaaag

SEQ ID NO: 1960757 - RNA, 15 nt, Homo sapiens
aaaucaguaaucugu

SEQ ID NO: 1960758 - RNA, 20 nt, Homo sapiens
uaagagggcacacacugugu

SEQ ID NO: 1960759 - RNA, 19 nt, Homo sapiens
auuuuguaagaaggcaaua

SEQ ID NO: 1960760 - RNA, 17 nt, Homo sapiens
uuugcagggcgugagac

SEQ ID NO: 1960761 - RNA, 18 nt, Homo sapiens
guaagaaagugaagcaaa

SEQ ID NO: 1960762 - RNA, 14 nt, Homo sapiens
agcagcagcuugua

SEQ ID NO: 1960763 - RNA, 14 nt, Homo sapiens
gcagaucugugcuc

SEQ ID NO: 1960764 - RNA, 14 nt, Homo sapiens
aaacaaaugaaaua

SEQ ID NO: 1960765 - RNA, 18 nt, Homo sapiens
uuguuaauaaaaauaaga

SEQ ID NO: 1960766 - RNA, 22 nt, Homo sapiens
cuauauagaauuuccuguaaua

SEQ ID NO: 1960767 - RNA, 16 nt, Homo sapiens
aagauaaucauugcuu

SEQ ID NO: 1960768 - RNA, 14 nt, Homo sapiens
aagaugaaguuuua

SEQ ID NO: 1960769 - RNA, 14 nt, Homo sapiens
gaaagugcugauaa

SEQ ID NO: 1960770 - RNA, 17 nt, Homo sapiens
gccggcaggccuggacu

SEQ ID NO: 1960771 - RNA, 18 nt, Homo sapiens
cugucuuugacugugauu

SEQ ID NO: 1960772 - RNA, 15 nt, Homo sapiens
uugcuuuuccuucag

SEQ ID NO: 1960773 - RNA, 14 nt, Homo sapiens
guaacaauguuugu

SEQ ID NO: 1960774 - RNA, 14 nt, Homo sapiens
uuaguacaucuuaa

SEQ ID NO: 1960775 - RNA, 13 nt, Homo sapiens
cacugacuauuac

SEQ ID NO: 1960776 - RNA, 16 nt, Homo sapiens
auauguaauauauaca

SEQ ID NO: 1960777 - RNA, 23 nt, Homo sapiens
acauagucuugaugacauuucac

SEQ ID NO: 1960778 - RNA, 20 nt, Homo sapiens
ccaaaucaauaagaagguag

SEQ ID NO: 1960779 - RNA, 15 nt, Homo sapiens
cauuuguuaucuggg

SEQ ID NO: 1960780 - RNA, 14 nt, Homo sapiens
agcccacacuugag

SEQ ID NO: 1960781 - RNA, 19 nt, Homo sapiens
agaggauaagccacugggc

SEQ ID NO: 1960782 - RNA, 17 nt, Homo sapiens
gccaagcuccucaauca

SEQ ID NO: 1960783 - RNA, 15 nt, Homo sapiens
guccucacucuucaa

SEQ ID NO: 1960784 - RNA, 24 nt, Homo sapiens
gaagauccuaaaacaaaagcucau

SEQ ID NO: 1960785 - RNA, 13 nt, Homo sapiens
gugucacccuuag

SEQ ID NO: 1960786 - RNA, 20 nt, Homo sapiens
uauugucggaagacuugcca

SEQ ID NO: 1960787 - RNA, 23 nt, Homo sapiens
cccagcggcucuagccacugagc

SEQ ID NO: 1960788 - RNA, 17 nt, Homo sapiens
gaagaccacacuuggug

SEQ ID NO: 1960789 - RNA, 16 nt, Homo sapiens
cuucagaguacaucca

SEQ ID NO: 1960790 - RNA, 16 nt, Homo sapiens
agcaugugugugucuc

SEQ ID NO: 1960791 - RNA, 12 nt, Homo sapiens
uuccucacauuu

SEQ ID NO: 1960792 - RNA, 23 nt, Homo sapiens
augcuaucucgcuagccauauau

SEQ ID NO: 1960793 - RNA, 16 nt, Homo sapiens
auuuguccaaacaggu

SEQ ID NO: 1960794 - RNA, 22 nt, Homo sapiens
caacugcuguucauguuacuca

SEQ ID NO: 1960795 - RNA, 17 nt, Homo sapiens
uuuaagcagcgccagug

SEQ ID NO: 1960796 - RNA, 15 nt, Homo sapiens
agcccuggucucagc

SEQ ID NO: 1960797 - RNA, 15 nt, Homo sapiens
uucugaauuugcaaa

SEQ ID NO: 1960798 - RNA, 17 nt, Homo sapiens
ucaagguugguucaaca

SEQ ID NO: 1960799 - RNA, 16 nt, Homo sapiens
acggagucucagucug

SEQ ID NO: 1960800 - RNA, 16 nt, Homo sapiens
auuucagaguaaguag

SEQ ID NO: 1960801 - RNA, 15 nt, Homo sapiens
uaucaaaacauccca

SEQ ID NO: 1960802 - RNA, 18 nt, Homo sapiens
uucccugccacauccagc

SEQ ID NO: 1960803 - RNA, 15 nt, Homo sapiens
gguuggaagacggau

SEQ ID NO: 1960804 - RNA, 15 nt, Homo sapiens
caguucugcuugcuc

SEQ ID NO: 1960805 - RNA, 14 nt, Homo sapiens
uuccucacuaccug

SEQ ID NO: 1960806 - RNA, 14 nt, Homo sapiens
ugucaaccccaaau

SEQ ID NO: 1960807 - RNA, 17 nt, Homo sapiens
gauuacaccagccucgu

SEQ ID NO: 1960808 - RNA, 15 nt, Homo sapiens
ugaauuaaaucuguu

SEQ ID NO: 1960809 - RNA, 16 nt, Homo sapiens
uauaaaugcaauaaga

SEQ ID NO: 1960810 - RNA, 20 nt, Homo sapiens
caaccugcacggggcauucc

SEQ ID NO: 1960811 - RNA, 23 nt, Homo sapiens
cuccaaauccaaggaaacaugca

SEQ ID NO: 1960812 - RNA, 16 nt, Homo sapiens
ugggguugcaucagaa

SEQ ID NO: 1960813 - RNA, 15 nt, Homo sapiens
ggacugugaccaaag

SEQ ID NO: 1960814 - RNA, 14 nt, Homo sapiens
cuugucucauuuag

SEQ ID NO: 1960815 - RNA, 22 nt, Homo sapiens
cauucuuuucuucugcuucccu

SEQ ID NO: 1960816 - RNA, 20 nt, Homo sapiens
gaaacguuugccccauggga

SEQ ID NO: 1960817 - RNA, 14 nt, Homo sapiens
ugaccucacuuuag

SEQ ID NO: 1960818 - RNA, 12 nt, Homo sapiens
agugacauguag

SEQ ID NO: 1960819 - RNA, 22 nt, Homo sapiens
ccuuacaaauauuucagagcag

SEQ ID NO: 1960820 - RNA, 19 nt, Homo sapiens
ugagaaugagggccaagaa

SEQ ID NO: 1960821 - RNA, 18 nt, Homo sapiens
uuggagcagcuucuggga

SEQ ID NO: 1960822 - RNA, 24 nt, Homo sapiens
agagggaccaugugucacuugugc

SEQ ID NO: 1960823 - RNA, 16 nt, Homo sapiens
cugcugcugggcucag

SEQ ID NO: 1960824 - RNA, 18 nt, Homo sapiens
uucaacaugacauccaga

SEQ ID NO: 1960825 - RNA, 19 nt, Homo sapiens
aaaucuauauacaaagccu

SEQ ID NO: 1960826 - RNA, 18 nt, Homo sapiens
cacauguaacauagauuu

SEQ ID NO: 1960827 - RNA, 16 nt, Homo sapiens
aaaugaguucccuuga

SEQ ID NO: 1960828 - RNA, 20 nt, Homo sapiens
gaaaauguuacggcaucaca

SEQ ID NO: 1960829 - RNA, 22 nt, Homo sapiens
ccaggcccugggucuugccaug

SEQ ID NO: 1960830 - RNA, 22 nt, Homo sapiens
auuuaguggugguagaaaugau

SEQ ID NO: 1960831 - RNA, 19 nt, Homo sapiens
gaagggggggcuacauuau

SEQ ID NO: 1960832 - RNA, 14 nt, Homo sapiens
auguuuugcucaau

SEQ ID NO: 1960833 - RNA, 24 nt, Homo sapiens
aauccuuauuuccucauagacuua

SEQ ID NO: 1960834 - RNA, 22 nt, Homo sapiens
cacauaggcaauaucuuuaaua

SEQ ID NO: 1960835 - RNA, 18 nt, Homo sapiens
gcucuuucccuuuaucag

SEQ ID NO: 1960836 - RNA, 17 nt, Homo sapiens
uauauuccucuugcauu

SEQ ID NO: 1960837 - RNA, 20 nt, Homo sapiens
ugcuauagugacaugcaguu

SEQ ID NO: 1960838 - RNA, 21 nt, Homo sapiens
accauacucccuuucagggcc

SEQ ID NO: 1960839 - RNA, 20 nt, Homo sapiens
acccuggcccagaugaucac

SEQ ID NO: 1960840 - RNA, 14 nt, Homo sapiens
uuucuacuuugcca

SEQ ID NO: 1960841 - RNA, 10 nt, Homo sapiens
aacacugcac

SEQ ID NO: 1960842 - RNA, 14 nt, Homo sapiens
cugccucucuucuu

SEQ ID NO: 1960843 - RNA, 20 nt, Homo sapiens
guuucaccauauuggucacg

SEQ ID NO: 1960844 - RNA, 15 nt, Homo sapiens
ccugagcagaaagag

SEQ ID NO: 1960845 - RNA, 21 nt, Homo sapiens
auaaaacaaaccagcaacuuu

SEQ ID NO: 1960846 - RNA, 14 nt, Homo sapiens
gaaacgcuucuuuu

SEQ ID NO: 1960847 - RNA, 18 nt, Homo sapiens
uagucaggaauggcugca

SEQ ID NO: 1960848 - RNA, 16 nt, Homo sapiens
caaaauaaguaaauaa

SEQ ID NO: 1960849 - RNA, 16 nt, Homo sapiens
caagugcaguagugca

SEQ ID NO: 1960850 - RNA, 12 nt, Homo sapiens
acaaacuaacag

SEQ ID NO: 1960851 - RNA, 19 nt, Homo sapiens
ucagcacauccgacaccuc

SEQ ID NO: 1960852 - RNA, 19 nt, Homo sapiens
augaaacccccacacacac

SEQ ID NO: 1960853 - RNA, 21 nt, Homo sapiens
aguuuacaggaaagaugcauu

SEQ ID NO: 1960854 - RNA, 22 nt, Homo sapiens
auguaauauacugagcugcuaa

SEQ ID NO: 1960855 - RNA, 22 nt, Homo sapiens
cagggggaagaugccaagggca

SEQ ID NO: 1960856 - RNA, 16 nt, Homo sapiens
guaucaaaaugcucuu

SEQ ID NO: 1960857 - RNA, 14 nt, Homo sapiens
guucaucucugcug

SEQ ID NO: 1960858 - RNA, 20 nt, Homo sapiens
cuuuagagccagcccauggc

SEQ ID NO: 1960859 - RNA, 19 nt, Homo sapiens
guugugccaaagugcauag

SEQ ID NO: 1960860 - RNA, 20 nt, Homo sapiens
auuuuggauaaaucauuuca

SEQ ID NO: 1960861 - RNA, 11 nt, Homo sapiens
cacuaauuccu

SEQ ID NO: 1960862 - RNA, 14 nt, Homo sapiens
aauuacagauguga

SEQ ID NO: 1960863 - RNA, 17 nt, Homo sapiens
aucuuaagagaauccac

SEQ ID NO: 1960864 - RNA, 15 nt, Homo sapiens
caagagaaaaugugu

SEQ ID NO: 1960865 - RNA, 18 nt, Homo sapiens
cgagaugugaguccuguu

SEQ ID NO: 1960866 - RNA, 14 nt, Homo sapiens
cccaaaucccacag

SEQ ID NO: 1960867 - RNA, 17 nt, Homo sapiens
cucacuuuuauugauaa

SEQ ID NO: 1960868 - RNA, 15 nt, Homo sapiens
agcccuugcucuacc

SEQ ID NO: 1960869 - RNA, 19 nt, Homo sapiens
auuuaugaccagagcaaaa

SEQ ID NO: 1960870 - RNA, 18 nt, Homo sapiens
ccagagaaugcuuugaaa

SEQ ID NO: 1960871 - RNA, 20 nt, Homo sapiens
cauuuuauacccaaaacccu

SEQ ID NO: 1960872 - RNA, 17 nt, Homo sapiens
uggccugugagcaagag

SEQ ID NO: 1960873 - RNA, 16 nt, Homo sapiens
ccaccagcugugucca

SEQ ID NO: 1960874 - RNA, 16 nt, Homo sapiens
guguaguagugcauag

SEQ ID NO: 1960875 - RNA, 16 nt, Homo sapiens
uacuauaguaccagua

SEQ ID NO: 1960876 - RNA, 18 nt, Homo sapiens
ucgacguuugacuagcca

SEQ ID NO: 1960877 - RNA, 16 nt, Homo sapiens
uccuguaggcuaaaag

SEQ ID NO: 1960878 - RNA, 12 nt, Homo sapiens
aucccuuuacaa

SEQ ID NO: 1960879 - RNA, 13 nt, Homo sapiens
auugaacugccaa

SEQ ID NO: 1960880 - RNA, 16 nt, Homo sapiens
ccagcagcagcacuua

SEQ ID NO: 1960881 - RNA, 21 nt, Homo sapiens
ugaaauuuuuaaaucauuuca

SEQ ID NO: 1960882 - RNA, 21 nt, Homo sapiens
aacaaauggcuuguucaguca

SEQ ID NO: 1960883 - RNA, 22 nt, Homo sapiens
ugaacaucccuuuuucaaugaa

SEQ ID NO: 1960884 - RNA, 15 nt, Homo sapiens
agaaucccugccugu

SEQ ID NO: 1960885 - RNA, 22 nt, Homo sapiens
ccccagaaaaaggccgggugac

SEQ ID NO: 1960886 - RNA, 14 nt, Homo sapiens
gcguucuucauuca

SEQ ID NO: 1960887 - RNA, 20 nt, Homo sapiens
uggaaaagucuucaagggcu

SEQ ID NO: 1960888 - RNA, 16 nt, Homo sapiens
ugaauauuuaagcaau

SEQ ID NO: 1960889 - RNA, 17 nt, Homo sapiens
agauggggacaggugaa

SEQ ID NO: 1960890 - RNA, 14 nt, Homo sapiens
auucccaagcuuuu

SEQ ID NO: 1960891 - RNA, 19 nt, Homo sapiens
gcaaauuuucagcauuaag

SEQ ID NO: 1960892 - RNA, 20 nt, Homo sapiens
cuagcugugucagaaucucc

SEQ ID NO: 1960893 - RNA, 20 nt, Homo sapiens
caggcacacacagccccuau

SEQ ID NO: 1960894 - RNA, 21 nt, Homo sapiens
ccgcugcauccgugagcagug

SEQ ID NO: 1960895 - RNA, 18 nt, Homo sapiens
ucugaagguaauacuaua

SEQ ID NO: 1960896 - RNA, 20 nt, Homo sapiens
ggacccuguagggugccauu

SEQ ID NO: 1960897 - RNA, 15 nt, Homo sapiens
agugucaucuauuua

SEQ ID NO: 1960898 - RNA, 19 nt, Homo sapiens
aauauauuuuaaagcacuu

SEQ ID NO: 1960899 - RNA, 17 nt, Homo sapiens
ucaauuuuuugcuaaac

SEQ ID NO: 1960900 - RNA, 19 nt, Homo sapiens
gcacguggagauagugcca

SEQ ID NO: 1960901 - RNA, 14 nt, Homo sapiens
uccauuaaccaaga

SEQ ID NO: 1960902 - RNA, 14 nt, Homo sapiens
uagcugacuugcac

SEQ ID NO: 1960903 - RNA, 13 nt, Homo sapiens
aaaaggaaauuug

SEQ ID NO: 1960904 - RNA, 12 nt, Homo sapiens
accccucuggcc

SEQ ID NO: 1960905 - RNA, 19 nt, Homo sapiens
accagagccguuacuacac

SEQ ID NO: 1960906 - RNA, 22 nt, Homo sapiens
ccaggagcagcagccagcacca

SEQ ID NO: 1960907 - RNA, 16 nt, Homo sapiens
aucuggcccugcugcc

SEQ ID NO: 1960908 - RNA, 16 nt, Homo sapiens
uauuguggcaccucaa

SEQ ID NO: 1960909 - RNA, 21 nt, Homo sapiens
aggcugggccccgacguuugc

SEQ ID NO: 1960910 - RNA, 14 nt, Homo sapiens
uccagguggcguga

SEQ ID NO: 1960911 - RNA, 18 nt, Homo sapiens
cuaagguccccacugccu

SEQ ID NO: 1960912 - RNA, 18 nt, Homo sapiens
uguaauggacuaugcaca

SEQ ID NO: 1960913 - RNA, 14 nt, Homo sapiens
cagacuuuagcuua

SEQ ID NO: 1960914 - RNA, 14 nt, Homo sapiens
cgcaccauucuccu

SEQ ID NO: 1960915 - RNA, 15 nt, Homo sapiens
ggauuaaauuuaauu

SEQ ID NO: 1960916 - RNA, 15 nt, Homo sapiens
uugaagaacugcacu

SEQ ID NO: 1960917 - RNA, 20 nt, Homo sapiens
cagagccuggggcaucccag

SEQ ID NO: 1960918 - RNA, 11 nt, Homo sapiens
accgcacucca

SEQ ID NO: 1960919 - RNA, 20 nt, Homo sapiens
acccauaggcccacacacag

SEQ ID NO: 1960920 - RNA, 22 nt, Homo sapiens
uaaguuuccuuccagcccagaa

SEQ ID NO: 1960921 - RNA, 17 nt, Homo sapiens
uuguguaauaugaaaua

SEQ ID NO: 1960922 - RNA, 19 nt, Homo sapiens
gagcuaggagcaaagccug

SEQ ID NO: 1960923 - RNA, 13 nt, Homo sapiens
cuuuacuucucac

SEQ ID NO: 1960924 - RNA, 13 nt, Homo sapiens
uuccucagaucau

SEQ ID NO: 1960925 - RNA, 18 nt, Homo sapiens
ucauugcugucuugcccc

SEQ ID NO: 1960926 - RNA, 16 nt, Homo sapiens
caucuuuugaaacaga

SEQ ID NO: 1960927 - RNA, 22 nt, Homo sapiens
caugaacuauuuacauuuucca

SEQ ID NO: 1960928 - RNA, 20 nt, Homo sapiens
cagaggagaauaaaaaaugg

SEQ ID NO: 1960929 - RNA, 17 nt, Homo sapiens
cgacauguguaccucag

SEQ ID NO: 1960930 - RNA, 17 nt, Homo sapiens
uggcauggcagaaugaa

SEQ ID NO: 1960931 - RNA, 21 nt, Homo sapiens
ucauggggaagcuuccaugau

SEQ ID NO: 1960932 - RNA, 16 nt, Homo sapiens
gaaaaugaacugcuuu

SEQ ID NO: 1960933 - RNA, 13 nt, Homo sapiens
uuuuguaugccaa

SEQ ID NO: 1960934 - RNA, 18 nt, Homo sapiens
aagaacugccccaucucc

SEQ ID NO: 1960935 - RNA, 17 nt, Homo sapiens
aaaucauauaagcuaua

SEQ ID NO: 1960936 - RNA, 17 nt, Homo sapiens
aauuauuaaaaaugccu

SEQ ID NO: 1960937 - RNA, 18 nt, Homo sapiens
ccuuuucugaaagcauuu

SEQ ID NO: 1960938 - RNA, 14 nt, Homo sapiens
uguaguucucagga

SEQ ID NO: 1960939 - RNA, 15 nt, Homo sapiens
ugccaggacaccugc

SEQ ID NO: 1960940 - RNA, 20 nt, Homo sapiens
aaggucacuacugcauuuau

SEQ ID NO: 1960941 - RNA, 22 nt, Homo sapiens
gauuacauuguaguuaaacaaa

SEQ ID NO: 1960942 - RNA, 19 nt, Homo sapiens
uacagaaagaaaaaugcau

SEQ ID NO: 1960943 - RNA, 20 nt, Homo sapiens
cagcacaccuguguccaaga

SEQ ID NO: 1960944 - RNA, 17 nt, Homo sapiens
cauguuauccacaagca

SEQ ID NO: 1960945 - RNA, 13 nt, Homo sapiens
gagugaccagcac

SEQ ID NO: 1960946 - RNA, 16 nt, Homo sapiens
agugaccggcugcuuu

SEQ ID NO: 1960947 - RNA, 18 nt, Homo sapiens
uacauauuuuuuguauau

SEQ ID NO: 1960948 - RNA, 15 nt, Homo sapiens
cuccuuuaccuuuca

SEQ ID NO: 1960949 - RNA, 14 nt, Homo sapiens
cagagaagcuggac

SEQ ID NO: 1960950 - RNA, 11 nt, Homo sapiens
aucuguacaau

SEQ ID NO: 1960951 - RNA, 11 nt, Homo sapiens
uacuguacuuu

SEQ ID NO: 1960952 - RNA, 18 nt, Homo sapiens
cugcuggauucaagugau

SEQ ID NO: 1960953 - RNA, 20 nt, Homo sapiens
uguguuuucccaaagcacuu

SEQ ID NO: 1960954 - RNA, 17 nt, Homo sapiens
uggcuucuguugcgcca

SEQ ID NO: 1960955 - RNA, 15 nt, Homo sapiens
ucaauaaauuugcuu

SEQ ID NO: 1960956 - RNA, 17 nt, Homo sapiens
caaauaauuugaacuuu

SEQ ID NO: 1960957 - RNA, 18 nt, Homo sapiens
accacugagccugagaug

SEQ ID NO: 1960958 - RNA, 22 nt, Homo sapiens
ucaauaagccuggucaauucua

SEQ ID NO: 1960959 - RNA, 21 nt, Homo sapiens
uuccgagucuuucucacugcc

SEQ ID NO: 1960960 - RNA, 14 nt, Homo sapiens
cuugacagggcaca

SEQ ID NO: 1960961 - RNA, 16 nt, Homo sapiens
ucagcccccaggauug

SEQ ID NO: 1960962 - RNA, 14 nt, Homo sapiens
cuuauuuccaugga

SEQ ID NO: 1960963 - RNA, 17 nt, Homo sapiens
gcuccagguacauauca

SEQ ID NO: 1960964 - RNA, 18 nt, Homo sapiens
auacaguaugaucucagu

SEQ ID NO: 1960965 - RNA, 20 nt, Homo sapiens
caaugugaagacacuacaga

SEQ ID NO: 1960966 - RNA, 14 nt, Homo sapiens
agagcaaccucuca

SEQ ID NO: 1960967 - RNA, 13 nt, Homo sapiens
agagucugcacuu

SEQ ID NO: 1960968 - RNA, 14 nt, Homo sapiens
uccaggcaggccag

SEQ ID NO: 1960969 - RNA, 14 nt, Homo sapiens
ucuucuugugaaau

SEQ ID NO: 1960970 - RNA, 12 nt, Homo sapiens
ccagugccagga

SEQ ID NO: 1960971 - RNA, 20 nt, Homo sapiens
ugucugauguggcaaaaggc

SEQ ID NO: 1960972 - RNA, 21 nt, Homo sapiens
auaaacuuuagaguagaguuu

SEQ ID NO: 1960973 - RNA, 12 nt, Homo sapiens
ugucagcaauaa

SEQ ID NO: 1960974 - RNA, 13 nt, Homo sapiens
uugucuucaugaa

SEQ ID NO: 1960975 - RNA, 15 nt, Homo sapiens
agcuguccugucagu

SEQ ID NO: 1960976 - RNA, 20 nt, Homo sapiens
cuccacccuccucuagccau

SEQ ID NO: 1960977 - RNA, 17 nt, Homo sapiens
gccugagcaacauggug

SEQ ID NO: 1960978 - RNA, 12 nt, Homo sapiens
ccugacuuccac

SEQ ID NO: 1960979 - RNA, 23 nt, Homo sapiens
guagaaaucucaucuuuguaaua

SEQ ID NO: 1960980 - RNA, 15 nt, Homo sapiens
augcugcuaauucaa

SEQ ID NO: 1960981 - RNA, 23 nt, Homo sapiens
cuuaggacuaccagccauacaaa

SEQ ID NO: 1960982 - RNA, 15 nt, Homo sapiens
uguuccuucacauuu

SEQ ID NO: 1960983 - RNA, 16 nt, Homo sapiens
auuuugauagcaaugu

SEQ ID NO: 1960984 - RNA, 20 nt, Homo sapiens
augagguagauuucauugaa

SEQ ID NO: 1960985 - RNA, 18 nt, Homo sapiens
cacaccgcuggucccugc

SEQ ID NO: 1960986 - RNA, 18 nt, Homo sapiens
cccugggcuggaggcuga

SEQ ID NO: 1960987 - RNA, 20 nt, Homo sapiens
uggaaaccacagucagugga

SEQ ID NO: 1960988 - RNA, 12 nt, Homo sapiens
auaacauuugcu

SEQ ID NO: 1960989 - RNA, 21 nt, Homo sapiens
caaguuuuucugucaagaaga

SEQ ID NO: 1960990 - RNA, 14 nt, Homo sapiens
auuagaagacauuu

SEQ ID NO: 1960991 - RNA, 19 nt, Homo sapiens
caguauuuguacaaauacu

SEQ ID NO: 1960992 - RNA, 14 nt, Homo sapiens
ugguuuuaaugcaa

SEQ ID NO: 1960993 - RNA, 16 nt, Homo sapiens
cccgaaguccugucac

SEQ ID NO: 1960994 - RNA, 15 nt, Homo sapiens
cccuuccccaugcuu

SEQ ID NO: 1960995 - RNA, 19 nt, Homo sapiens
aaagugagaaauuaugaaa

SEQ ID NO: 1960996 - RNA, 14 nt, Homo sapiens
uguugcacgugugu

SEQ ID NO: 1960997 - RNA, 15 nt, Homo sapiens
ccucgguaucuggcu

SEQ ID NO: 1960998 - RNA, 18 nt, Homo sapiens
uucuccauaucaaaacga

SEQ ID NO: 1960999 - RNA, 18 nt, Homo sapiens
gccuugcacacagguguu

SEQ ID NO: 1961000 - RNA, 18 nt, Homo sapiens
gaacagaaguguucacau

SEQ ID NO: 1961001 - RNA, 22 nt, Homo sapiens
ggaccaaaggaaggaagcaagc

SEQ ID NO: 1961002 - RNA, 16 nt, Homo sapiens
auuuauuuucaauuaa

SEQ ID NO: 1961003 - RNA, 14 nt, Homo sapiens
ggaggcugggcaca

SEQ ID NO: 1961004 - RNA, 15 nt, Homo sapiens
cacagaucccgggga

SEQ ID NO: 1961005 - RNA, 14 nt, Homo sapiens
auuuccucuuauca

SEQ ID NO: 1961006 - RNA, 13 nt, Homo sapiens
uaacuuccugcug

SEQ ID NO: 1961007 - RNA, 22 nt, Homo sapiens
agauucaaacucaaugaugcua

SEQ ID NO: 1961008 - RNA, 15 nt, Homo sapiens
uggagagaagcugau

SEQ ID NO: 1961009 - RNA, 14 nt, Homo sapiens
aguuguccaugaca

SEQ ID NO: 1961010 - RNA, 18 nt, Homo sapiens
cacacauugcugugaaca

SEQ ID NO: 1961011 - RNA, 19 nt, Homo sapiens
aaaaucaaguauuggcaaa

SEQ ID NO: 1961012 - RNA, 19 nt, Homo sapiens
aacuccuuaauaugaucug

SEQ ID NO: 1961013 - RNA, 23 nt, Homo sapiens
ccaaaggauagugcgauguuuca

SEQ ID NO: 1961014 - RNA, 20 nt, Homo sapiens
accccugagauccggcaaca

SEQ ID NO: 1961015 - RNA, 23 nt, Homo sapiens
ugaagcauaccccggccucucag

SEQ ID NO: 1961016 - RNA, 14 nt, Homo sapiens
cagaaucccggcug

SEQ ID NO: 1961017 - RNA, 18 nt, Homo sapiens
accaggugucucugagaa

SEQ ID NO: 1961018 - RNA, 19 nt, Homo sapiens
gaacaaaguccacaguuua

SEQ ID NO: 1961019 - RNA, 16 nt, Homo sapiens
aagacugugcugagaa

SEQ ID NO: 1961020 - RNA, 12 nt, Homo sapiens
cagccacaacca

SEQ ID NO: 1961021 - RNA, 16 nt, Homo sapiens
cuuuagccaagugcag

SEQ ID NO: 1961022 - RNA, 18 nt, Homo sapiens
guuuuucauucacuuuaa

SEQ ID NO: 1961023 - RNA, 16 nt, Homo sapiens
uugcuuuuccauuucg

SEQ ID NO: 1961024 - RNA, 19 nt, Homo sapiens
cagugagagucucccucca

SEQ ID NO: 1961025 - RNA, 21 nt, Homo sapiens
cuuuuaucaaucccagcauuu

SEQ ID NO: 1961026 - RNA, 20 nt, Homo sapiens
aaggucuuggaacuugccug

SEQ ID NO: 1961027 - RNA, 15 nt, Homo sapiens
gaaugaaauaauuca

SEQ ID NO: 1961028 - RNA, 17 nt, Homo sapiens
cuuccaaagacaagaaa

SEQ ID NO: 1961029 - RNA, 13 nt, Homo sapiens
augcaaccauaag

SEQ ID NO: 1961030 - RNA, 15 nt, Homo sapiens
caggaccugccugua

SEQ ID NO: 1961031 - RNA, 21 nt, Homo sapiens
caugaauuuuaaauaauguau

SEQ ID NO: 1961032 - RNA, 16 nt, Homo sapiens
ugauagcagauaucac

SEQ ID NO: 1961033 - RNA, 14 nt, Homo sapiens
ugccugcccaggga

SEQ ID NO: 1961034 - RNA, 17 nt, Homo sapiens
uaaaguuuguucacuua

SEQ ID NO: 1961035 - RNA, 16 nt, Homo sapiens
augggccagaacacac

SEQ ID NO: 1961036 - RNA, 20 nt, Homo sapiens
uaugauggguguuuuuagca

SEQ ID NO: 1961037 - RNA, 17 nt, Homo sapiens
ucagagcugagaugugg

SEQ ID NO: 1961038 - RNA, 21 nt, Homo sapiens
ugcauucaaaguaauauauca

SEQ ID NO: 1961039 - RNA, 16 nt, Homo sapiens
aaaaggugccaucuca

SEQ ID NO: 1961040 - RNA, 22 nt, Homo sapiens
uucuacgcugccucaacacuga

SEQ ID NO: 1961041 - RNA, 20 nt, Homo sapiens
aaaugucccuccaacacaga

SEQ ID NO: 1961042 - RNA, 16 nt, Homo sapiens
auccuggccuggcaca

SEQ ID NO: 1961043 - RNA, 22 nt, Homo sapiens
gaggacccagacccagugggga

SEQ ID NO: 1961044 - RNA, 14 nt, Homo sapiens
gagauagaaccugg

SEQ ID NO: 1961045 - RNA, 14 nt, Homo sapiens
gguccccagcauug

SEQ ID NO: 1961046 - RNA, 14 nt, Homo sapiens
ucuucccaugacug

SEQ ID NO: 1961047 - RNA, 16 nt, Homo sapiens
cagauggggucuguga

SEQ ID NO: 1961048 - RNA, 17 nt, Homo sapiens
agcaggucaggacucag

SEQ ID NO: 1961049 - RNA, 19 nt, Homo sapiens
ucuuaugccauauaauuca

SEQ ID NO: 1961050 - RNA, 20 nt, Homo sapiens
uccugaguaguugggauuac

SEQ ID NO: 1961051 - RNA, 15 nt, Homo sapiens
acacgauaaagggau

SEQ ID NO: 1961052 - RNA, 20 nt, Homo sapiens
cuaguucagaggaagcacau

SEQ ID NO: 1961053 - RNA, 16 nt, Homo sapiens
cccugccucagccagg

SEQ ID NO: 1961054 - RNA, 14 nt, Homo sapiens
caauuaacucugga

SEQ ID NO: 1961055 - RNA, 16 nt, Homo sapiens
ucugucccuuugcucc

SEQ ID NO: 1961056 - RNA, 16 nt, Homo sapiens
uucuuuucuccuccuc

SEQ ID NO: 1961057 - RNA, 14 nt, Homo sapiens
uugugaagauuuca

SEQ ID NO: 1961058 - RNA, 17 nt, Homo sapiens
guuuggaauaaagucaa

SEQ ID NO: 1961059 - RNA, 17 nt, Homo sapiens
gaccaguccuguuugca

SEQ ID NO: 1961060 - RNA, 17 nt, Homo sapiens
cucaaaaggagaacugu

SEQ ID NO: 1961061 - RNA, 15 nt, Homo sapiens
ugaucacugagccau

SEQ ID NO: 1961062 - RNA, 17 nt, Homo sapiens
cacuguauaacauuuaa

SEQ ID NO: 1961063 - RNA, 15 nt, Homo sapiens
augaacuauuguuaa

SEQ ID NO: 1961064 - RNA, 17 nt, Homo sapiens
gaugucugggugaccuc

SEQ ID NO: 1961065 - RNA, 16 nt, Homo sapiens
ggcucccucacucuca

SEQ ID NO: 1961066 - RNA, 16 nt, Homo sapiens
cacucccuggcucuca

SEQ ID NO: 1961067 - RNA, 19 nt, Homo sapiens
agaaaugauggaaguucau

SEQ ID NO: 1961068 - RNA, 15 nt, Homo sapiens
ggaugaggggugcug

SEQ ID NO: 1961069 - RNA, 20 nt, Homo sapiens
cauggaagguuagagguuug

SEQ ID NO: 1961070 - RNA, 21 nt, Homo sapiens
cucaauguuugaggagcaugu

SEQ ID NO: 1961071 - RNA, 15 nt, Homo sapiens
aauuuaaacagucuc

SEQ ID NO: 1961072 - RNA, 18 nt, Homo sapiens
uauuacacauuuauguaa

SEQ ID NO: 1961073 - RNA, 20 nt, Homo sapiens
cagaagccuccccagcucac

SEQ ID NO: 1961074 - RNA, 21 nt, Homo sapiens
auuaagaaaccuugcucuccu

SEQ ID NO: 1961075 - RNA, 16 nt, Homo sapiens
ucccacucaguacugu

SEQ ID NO: 1961076 - RNA, 17 nt, Homo sapiens
ucucuaauaaaaauaca

SEQ ID NO: 1961077 - RNA, 12 nt, Homo sapiens
cgaugcugcuau

SEQ ID NO: 1961078 - RNA, 15 nt, Homo sapiens
cacgccuccauccac

SEQ ID NO: 1961079 - RNA, 17 nt, Homo sapiens
ugccacuugucaaagaa

SEQ ID NO: 1961080 - RNA, 19 nt, Homo sapiens
uucucuuaggugucauguu

SEQ ID NO: 1961081 - RNA, 16 nt, Homo sapiens
aaauauuuuugcugua

SEQ ID NO: 1961082 - RNA, 17 nt, Homo sapiens
auuuaaugcuuccaggg

SEQ ID NO: 1961083 - RNA, 16 nt, Homo sapiens
cucuuccugcaaggac

SEQ ID NO: 1961084 - RNA, 13 nt, Homo sapiens
uccucacuuccau

SEQ ID NO: 1961085 - RNA, 16 nt, Homo sapiens
ucauacuaguagucau

SEQ ID NO: 1961086 - RNA, 21 nt, Homo sapiens
agcauggaaaaucagugacau

SEQ ID NO: 1961087 - RNA, 18 nt, Homo sapiens
aaucaguuaauggcucau

SEQ ID NO: 1961088 - RNA, 18 nt, Homo sapiens
agugcuucuuguaauauu

SEQ ID NO: 1961089 - RNA, 23 nt, Homo sapiens
auugagaaguuuuguacagagaa

SEQ ID NO: 1961090 - RNA, 15 nt, Homo sapiens
ugcuucuaauauuag

SEQ ID NO: 1961091 - RNA, 20 nt, Homo sapiens
cagaguggaaauucaugaga

SEQ ID NO: 1961092 - RNA, 16 nt, Homo sapiens
cauuuuccacgcugau

SEQ ID NO: 1961093 - RNA, 23 nt, Homo sapiens
gugccucuuuuaaugucaucucu

SEQ ID NO: 1961094 - RNA, 21 nt, Homo sapiens
uuaccugccaggaagccagca

SEQ ID NO: 1961095 - RNA, 23 nt, Homo sapiens
caagaugagcaaugcuguuggaa

SEQ ID NO: 1961096 - RNA, 14 nt, Homo sapiens
cuucauuucucugc

SEQ ID NO: 1961097 - RNA, 20 nt, Homo sapiens
ugaguauugauaaacuuuga

SEQ ID NO: 1961098 - RNA, 15 nt, Homo sapiens
cuugggcgggccauu

SEQ ID NO: 1961099 - RNA, 13 nt, Homo sapiens
uccuggccugaga

SEQ ID NO: 1961100 - RNA, 23 nt, Homo sapiens
uaaacagcugguccuccacuuug

SEQ ID NO: 1961101 - RNA, 20 nt, Homo sapiens
ugccaucaccacggcucacu

SEQ ID NO: 1961102 - RNA, 16 nt, Homo sapiens
uuggugucuguacuca

SEQ ID NO: 1961103 - RNA, 20 nt, Homo sapiens
cccuggaagcagugcccagg

SEQ ID NO: 1961104 - RNA, 23 nt, Homo sapiens
uuggcacucugacuuaaagugca

SEQ ID NO: 1961105 - RNA, 21 nt, Homo sapiens
ucucaagauggggcgagccag

SEQ ID NO: 1961106 - RNA, 12 nt, Homo sapiens
cagcucugagau

SEQ ID NO: 1961107 - RNA, 19 nt, Homo sapiens
cugggaaagggagauguca

SEQ ID NO: 1961108 - RNA, 22 nt, Homo sapiens
aacugucuuucauuuuugaacc

SEQ ID NO: 1961109 - RNA, 13 nt, Homo sapiens
ugcagugagccaa

SEQ ID NO: 1961110 - RNA, 14 nt, Homo sapiens
gaaagaagugggga

SEQ ID NO: 1961111 - RNA, 15 nt, Homo sapiens
accacuuaccucaaa

SEQ ID NO: 1961112 - RNA, 23 nt, Homo sapiens
caccuggauugcagacucaugaa

SEQ ID NO: 1961113 - RNA, 20 nt, Homo sapiens
ucagaggauggccagugucu

SEQ ID NO: 1961114 - RNA, 22 nt, Homo sapiens
cugaaauuuaagauaaugaguu

SEQ ID NO: 1961115 - RNA, 17 nt, Homo sapiens
auccaagcaaaugugaa

SEQ ID NO: 1961116 - RNA, 21 nt, Homo sapiens
cagcacacacaguggauucca

SEQ ID NO: 1961117 - RNA, 14 nt, Homo sapiens
acugcuaccaugaa

SEQ ID NO: 1961118 - RNA, 22 nt, Homo sapiens
auuucaaguggcaguuuuauca

SEQ ID NO: 1961119 - RNA, 14 nt, Homo sapiens
gaaacaaacuggag

SEQ ID NO: 1961120 - RNA, 13 nt, Homo sapiens
uguuuaacacuuc

SEQ ID NO: 1961121 - RNA, 16 nt, Homo sapiens
gguuuuaaugcaauga

SEQ ID NO: 1961122 - RNA, 19 nt, Homo sapiens
uauuugguaccauggugua

SEQ ID NO: 1961123 - RNA, 20 nt, Homo sapiens
ugaauuagcguuuaauccac

SEQ ID NO: 1961124 - RNA, 22 nt, Homo sapiens
ccaugucagauaaguguaaaua

SEQ ID NO: 1961125 - RNA, 21 nt, Homo sapiens
acccauguucucaauacccac

SEQ ID NO: 1961126 - RNA, 14 nt, Homo sapiens
aaagugccuuucag

SEQ ID NO: 1961127 - RNA, 22 nt, Homo sapiens
aaggagauaauuacugccuuga

SEQ ID NO: 1961128 - RNA, 21 nt, Homo sapiens
agaaccuauagcaucuucuca

SEQ ID NO: 1961129 - RNA, 17 nt, Homo sapiens
aaagacauuucaaauaa

SEQ ID NO: 1961130 - RNA, 19 nt, Homo sapiens
uucagagagcagugcuuuu

SEQ ID NO: 1961131 - RNA, 23 nt, Homo sapiens
acuuuugguaucuacuucuacau

SEQ ID NO: 1961132 - RNA, 16 nt, Homo sapiens
gaaauaagcugugauu

SEQ ID NO: 1961133 - RNA, 21 nt, Homo sapiens
cuucuaggucacuucucacaa

SEQ ID NO: 1961134 - RNA, 16 nt, Homo sapiens
gaaccucccuccuuuc

SEQ ID NO: 1961135 - RNA, 15 nt, Homo sapiens
gggcuuucauagugu

SEQ ID NO: 1961136 - RNA, 21 nt, Homo sapiens
agaguguuccuguugaaucuu

SEQ ID NO: 1961137 - RNA, 18 nt, Homo sapiens
ggcuucuccccacuguaa

SEQ ID NO: 1961138 - RNA, 11 nt, Homo sapiens
acuggucacag

SEQ ID NO: 1961139 - RNA, 16 nt, Homo sapiens
accuggccucugccau

SEQ ID NO: 1961140 - RNA, 23 nt, Homo sapiens
gucauaaaaugcauacuguugau

SEQ ID NO: 1961141 - RNA, 20 nt, Homo sapiens
gacuaggaaaagaccaucug

SEQ ID NO: 1961142 - RNA, 19 nt, Homo sapiens
gcuggagcugccucucuca

SEQ ID NO: 1961143 - RNA, 14 nt, Homo sapiens
accauguugcccag

SEQ ID NO: 1961144 - RNA, 22 nt, Homo sapiens
aauacuuuuuuuuuaaagccac

SEQ ID NO: 1961145 - RNA, 20 nt, Homo sapiens
uccuuuagucuuuucuuuag

SEQ ID NO: 1961146 - RNA, 23 nt, Homo sapiens
cagaggcgucucacauuuuuacu

SEQ ID NO: 1961147 - RNA, 14 nt, Homo sapiens
cucugcugaaggaa

SEQ ID NO: 1961148 - RNA, 16 nt, Homo sapiens
aguggagagagcuccu

SEQ ID NO: 1961149 - RNA, 18 nt, Homo sapiens
acaucucugcuugaguca

SEQ ID NO: 1961150 - RNA, 14 nt, Homo sapiens
gccugcugcacuuc

SEQ ID NO: 1961151 - RNA, 21 nt, Homo sapiens
uaccucccccugccuuccaac

SEQ ID NO: 1961152 - RNA, 21 nt, Homo sapiens
ggauggaaagacaaacugcac

SEQ ID NO: 1961153 - RNA, 14 nt, Homo sapiens
uccuuaagggacaa

SEQ ID NO: 1961154 - RNA, 14 nt, Homo sapiens
ccuuaaacuuucaa

SEQ ID NO: 1961155 - RNA, 16 nt, Homo sapiens
ucacaugaugcacuuc

SEQ ID NO: 1961156 - RNA, 13 nt, Homo sapiens
aauugguguauau

SEQ ID NO: 1961157 - RNA, 13 nt, Homo sapiens
aaaggaaucucca

SEQ ID NO: 1961158 - RNA, 14 nt, Homo sapiens
gguccaucucugaa

SEQ ID NO: 1961159 - RNA, 23 nt, Homo sapiens
cucccaagcugauggacaugaga

SEQ ID NO: 1961160 - RNA, 22 nt, Homo sapiens
gaaaggguucagggcaugggga

SEQ ID NO: 1961161 - RNA, 20 nt, Homo sapiens
cugugaucccagcuacucag

SEQ ID NO: 1961162 - RNA, 16 nt, Homo sapiens
aaaagaagcaaccuca

SEQ ID NO: 1961163 - RNA, 22 nt, Homo sapiens
gccagugaccaaccuuuuccca

SEQ ID NO: 1961164 - RNA, 18 nt, Homo sapiens
ccucaugugugcugugcu

SEQ ID NO: 1961165 - RNA, 21 nt, Homo sapiens
guguccugccuugaugaagcc

SEQ ID NO: 1961166 - RNA, 20 nt, Homo sapiens
ugcccagccccugguggugg

SEQ ID NO: 1961167 - RNA, 22 nt, Homo sapiens
cgauggaugggaugcacucuca

SEQ ID NO: 1961168 - RNA, 18 nt, Homo sapiens
ccuuugugagcugugagu

SEQ ID NO: 1961169 - RNA, 15 nt, Homo sapiens
gauccuccugccuca

SEQ ID NO: 1961170 - RNA, 19 nt, Homo sapiens
gcucauuuacacucagcug

SEQ ID NO: 1961171 - RNA, 17 nt, Homo sapiens
acccgugaccugagaug

SEQ ID NO: 1961172 - RNA, 16 nt, Homo sapiens
uguggucacccaugca

SEQ ID NO: 1961173 - RNA, 16 nt, Homo sapiens
aaaagaagacucugac

SEQ ID NO: 1961174 - RNA, 15 nt, Homo sapiens
uuagaucaaauacuu

SEQ ID NO: 1961175 - RNA, 23 nt, Homo sapiens
cuugagcacuauucuaaggagca

SEQ ID NO: 1961176 - RNA, 18 nt, Homo sapiens
ucauauggcccaguguca

SEQ ID NO: 1961177 - RNA, 18 nt, Homo sapiens
caaaacaucucugcaguu

SEQ ID NO: 1961178 - RNA, 14 nt, Homo sapiens
ccacuguguacugu

SEQ ID NO: 1961179 - RNA, 22 nt, Homo sapiens
ucucuuggaacugcaccaccga

SEQ ID NO: 1961180 - RNA, 10 nt, Homo sapiens
cucaguauua

SEQ ID NO: 1961181 - RNA, 21 nt, Homo sapiens
ucagaugauucagaaauuuuc

SEQ ID NO: 1961182 - RNA, 14 nt, Homo sapiens
caggaaaccacuua

SEQ ID NO: 1961183 - RNA, 13 nt, Homo sapiens
ccucacucuagag

SEQ ID NO: 1961184 - RNA, 15 nt, Homo sapiens
auuuuaaauggacag

SEQ ID NO: 1961185 - RNA, 20 nt, Homo sapiens
ccagacuugggagcuuuaaa

SEQ ID NO: 1961186 - RNA, 17 nt, Homo sapiens
ccaucaggauccagucu

SEQ ID NO: 1961187 - RNA, 12 nt, Homo sapiens
ugcaaacuaugc

SEQ ID NO: 1961188 - RNA, 16 nt, Homo sapiens
aaauuagugaaccaaa

SEQ ID NO: 1961189 - RNA, 15 nt, Homo sapiens
accaauugugcugcc

SEQ ID NO: 1961190 - RNA, 13 nt, Homo sapiens
agacacauucaca

SEQ ID NO: 1961191 - RNA, 16 nt, Homo sapiens
ucucaugggaagggga

SEQ ID NO: 1961192 - RNA, 16 nt, Homo sapiens
auauggacucugcaca

SEQ ID NO: 1961193 - RNA, 21 nt, Homo sapiens
gcaaggaagguaaaaaguuaa

SEQ ID NO: 1961194 - RNA, 23 nt, Homo sapiens
aucuucccuuuauuacaagaagg

SEQ ID NO: 1961195 - RNA, 21 nt, Homo sapiens
cucugccccucagggggccag

SEQ ID NO: 1961196 - RNA, 23 nt, Homo sapiens
gugcuccugugggagaucuucac

SEQ ID NO: 1961197 - RNA, 24 nt, Homo sapiens
uaucucagcaucagaaugagaaag

SEQ ID NO: 1961198 - RNA, 16 nt, Homo sapiens
caguagucagacugga

SEQ ID NO: 1961199 - RNA, 18 nt, Homo sapiens
uuggacuaugcauguguu

SEQ ID NO: 1961200 - RNA, 22 nt, Homo sapiens
uuuuacaaaacugcuuugugca

SEQ ID NO: 1961201 - RNA, 17 nt, Homo sapiens
guaaaauuuugucauau

SEQ ID NO: 1961202 - RNA, 17 nt, Homo sapiens
acaggcagcucugagcc

SEQ ID NO: 1961203 - RNA, 19 nt, Homo sapiens
ugugcauuaccacacucag

SEQ ID NO: 1961204 - RNA, 18 nt, Homo sapiens
augcauugucugcaaugg

SEQ ID NO: 1961205 - RNA, 21 nt, Homo sapiens
ggaaagacaugcagcuuucau

SEQ ID NO: 1961206 - RNA, 13 nt, Homo sapiens
uucucugguacaa

SEQ ID NO: 1961207 - RNA, 21 nt, Homo sapiens
aauuaaauauugaaacacugu

SEQ ID NO: 1961208 - RNA, 19 nt, Homo sapiens
cagaauugggcaacuauuc

SEQ ID NO: 1961209 - RNA, 16 nt, Homo sapiens
cagccaccccugagau

SEQ ID NO: 1961210 - RNA, 19 nt, Homo sapiens
cgugaaaguugugaucugu

SEQ ID NO: 1961211 - RNA, 20 nt, Homo sapiens
uuggaacaccuggcauguga

SEQ ID NO: 1961212 - RNA, 12 nt, Homo sapiens
aaaaacagguuu

SEQ ID NO: 1961213 - RNA, 18 nt, Homo sapiens
gccucagcugcaucugau

SEQ ID NO: 1961214 - RNA, 19 nt, Homo sapiens
acuuaauagaaacauugaa

SEQ ID NO: 1961215 - RNA, 16 nt, Homo sapiens
gauacagaaugaaucc

SEQ ID NO: 1961216 - RNA, 17 nt, Homo sapiens
augauguaggggccaag

SEQ ID NO: 1961217 - RNA, 12 nt, Homo sapiens
uguggugcuaca

SEQ ID NO: 1961218 - RNA, 21 nt, Homo sapiens
cuguaaaggaccuccuaaaua

SEQ ID NO: 1961219 - RNA, 14 nt, Homo sapiens
gcacuagaucuccc

SEQ ID NO: 1961220 - RNA, 15 nt, Homo sapiens
cucuaaaacucucaa

SEQ ID NO: 1961221 - RNA, 14 nt, Homo sapiens
uuaccuaguacaag

SEQ ID NO: 1961222 - RNA, 16 nt, Homo sapiens
ccugagagauuuaaca

SEQ ID NO: 1961223 - RNA, 13 nt, Homo sapiens
cucaacauugugu

SEQ ID NO: 1961224 - RNA, 21 nt, Homo sapiens
cagccggagucacugccugga

SEQ ID NO: 1961225 - RNA, 21 nt, Homo sapiens
cagaaaaguaggaaugcauuu

SEQ ID NO: 1961226 - RNA, 18 nt, Homo sapiens
aguuuguuuauuacuuau

SEQ ID NO: 1961227 - RNA, 22 nt, Homo sapiens
uuaaauaauuuuacaugucuca

SEQ ID NO: 1961228 - RNA, 23 nt, Homo sapiens
uuacaucuaucccagaguacaaa

SEQ ID NO: 1961229 - RNA, 19 nt, Homo sapiens
cucagugcauagcgaagac

SEQ ID NO: 1961230 - RNA, 23 nt, Homo sapiens
uucaaguguccuggaaauucugc

SEQ ID NO: 1961231 - RNA, 18 nt, Homo sapiens
uucccaccuacugcacuu

SEQ ID NO: 1961232 - RNA, 15 nt, Homo sapiens
uuagcauggauuuau

SEQ ID NO: 1961233 - RNA, 20 nt, Homo sapiens
cuggcucccucuucuuucag

SEQ ID NO: 1961234 - RNA, 15 nt, Homo sapiens
aagaaaacauuccag

SEQ ID NO: 1961235 - RNA, 18 nt, Homo sapiens
uucuuucaugcuccuuac

SEQ ID NO: 1961236 - RNA, 12 nt, Homo sapiens
gaacaguguuua

SEQ ID NO: 1961237 - RNA, 19 nt, Homo sapiens
acuguuuuuaauguucaca

SEQ ID NO: 1961238 - RNA, 18 nt, Homo sapiens
cugugcuucucuaugaua

SEQ ID NO: 1961239 - RNA, 15 nt, Homo sapiens
cugacuucuccuagc

SEQ ID NO: 1961240 - RNA, 17 nt, Homo sapiens
aaaaaaauauguguaca

SEQ ID NO: 1961241 - RNA, 17 nt, Homo sapiens
uuuguauaaaaguguga

SEQ ID NO: 1961242 - RNA, 14 nt, Homo sapiens
uaauauaacugccu

SEQ ID NO: 1961243 - RNA, 17 nt, Homo sapiens
uagugacuguaauuaau

SEQ ID NO: 1961244 - RNA, 22 nt, Homo sapiens
auuuguauucaugaacuuggcu

SEQ ID NO: 1961245 - RNA, 15 nt, Homo sapiens
cuucagaagugccau

SEQ ID NO: 1961246 - RNA, 17 nt, Homo sapiens
ugacacuguuuuccuua

SEQ ID NO: 1961247 - RNA, 13 nt, Homo sapiens
uuugcuauuacau

SEQ ID NO: 1961248 - RNA, 14 nt, Homo sapiens
cuaugaagcccacc

SEQ ID NO: 1961249 - RNA, 18 nt, Homo sapiens
ucugcuguucuucacuuc

SEQ ID NO: 1961250 - RNA, 17 nt, Homo sapiens
aggagccuaguacaaua

SEQ ID NO: 1961251 - RNA, 18 nt, Homo sapiens
uggacaacauuuuacuac

SEQ ID NO: 1961252 - RNA, 16 nt, Homo sapiens
cacccuccuucacucc

SEQ ID NO: 1961253 - RNA, 13 nt, Homo sapiens
gagcagugaccca

SEQ ID NO: 1961254 - RNA, 19 nt, Homo sapiens
uugauacuguugcacgugu

SEQ ID NO: 1961255 - RNA, 20 nt, Homo sapiens
gcuuuuucacagucacugau

SEQ ID NO: 1961256 - RNA, 13 nt, Homo sapiens
aaucaaaacagag

SEQ ID NO: 1961257 - RNA, 17 nt, Homo sapiens
cagguauauaccuccau

SEQ ID NO: 1961258 - RNA, 23 nt, Homo sapiens
ugcagaaaacagggucugggaca

SEQ ID NO: 1961259 - RNA, 16 nt, Homo sapiens
ucuuauaacauuguau

SEQ ID NO: 1961260 - RNA, 17 nt, Homo sapiens
uggcccagagaagccaa

SEQ ID NO: 1961261 - RNA, 18 nt, Homo sapiens
cacagggaccacauccac

SEQ ID NO: 1961262 - RNA, 15 nt, Homo sapiens
aaaacgcaccaauca

SEQ ID NO: 1961263 - RNA, 23 nt, Homo sapiens
uuguaccuuccacaagacucaga

SEQ ID NO: 1961264 - RNA, 12 nt, Homo sapiens
caccuccugucg

SEQ ID NO: 1961265 - RNA, 22 nt, Homo sapiens
aaaugacaucuacgaagccaca

SEQ ID NO: 1961266 - RNA, 17 nt, Homo sapiens
cuaagggaacaauccau

SEQ ID NO: 1961267 - RNA, 23 nt, Homo sapiens
gaacuuugcagcauaccaauuac

SEQ ID NO: 1961268 - RNA, 16 nt, Homo sapiens
gcugaccugguacuga

SEQ ID NO: 1961269 - RNA, 18 nt, Homo sapiens
uuuuaauuagaaauaucu

SEQ ID NO: 1961270 - RNA, 17 nt, Homo sapiens
aauuuaaaacacaguau

SEQ ID NO: 1961271 - RNA, 22 nt, Homo sapiens
cggggugagggggggcucccug

SEQ ID NO: 1961272 - RNA, 14 nt, Homo sapiens
accgcucaguauuu

SEQ ID NO: 1961273 - RNA, 23 nt, Homo sapiens
cagccugacugcacacagcuagg

SEQ ID NO: 1961274 - RNA, 13 nt, Homo sapiens
ucucuacugucag

SEQ ID NO: 1961275 - RNA, 16 nt, Homo sapiens
uuguagauacaaucag

SEQ ID NO: 1961276 - RNA, 19 nt, Homo sapiens
gagaagggccugcucugcu

SEQ ID NO: 1961277 - RNA, 17 nt, Homo sapiens
uauuacaugguuaacau

SEQ ID NO: 1961278 - RNA, 21 nt, Homo sapiens
ucauggaagccaccagugaga

SEQ ID NO: 1961279 - RNA, 13 nt, Homo sapiens
uugagcagcaucu

SEQ ID NO: 1961280 - RNA, 16 nt, Homo sapiens
cuggaaauaauaucau

SEQ ID NO: 1961281 - RNA, 17 nt, Homo sapiens
aagaaguaaaacuauuu

SEQ ID NO: 1961282 - RNA, 23 nt, Homo sapiens
gaacacuguaggguaccuuccag

SEQ ID NO: 1961283 - RNA, 15 nt, Homo sapiens
cugguggaagucuga

SEQ ID NO: 1961284 - RNA, 21 nt, Homo sapiens
gccacuagguuucaccuccca

SEQ ID NO: 1961285 - RNA, 22 nt, Homo sapiens
cauuuuuagagaaguaaaacau

SEQ ID NO: 1961286 - RNA, 14 nt, Homo sapiens
ggcuccaccccagg

SEQ ID NO: 1961287 - RNA, 17 nt, Homo sapiens
accaauugacucucaca

SEQ ID NO: 1961288 - RNA, 18 nt, Homo sapiens
uaaccuucaaauacauuc

SEQ ID NO: 1961289 - RNA, 15 nt, Homo sapiens
aacuaugcugaagag

SEQ ID NO: 1961290 - RNA, 14 nt, Homo sapiens
uauuccaaaugcca

SEQ ID NO: 1961291 - RNA, 19 nt, Homo sapiens
cguagcuccauauuggaca

SEQ ID NO: 1961292 - RNA, 20 nt, Homo sapiens
gccacucggggcaggccagc

SEQ ID NO: 1961293 - RNA, 18 nt, Homo sapiens
acuccagccugggcaaca

SEQ ID NO: 1961294 - RNA, 19 nt, Homo sapiens
ccaagaagucccaagaccu

SEQ ID NO: 1961295 - RNA, 22 nt, Homo sapiens
ugccucucugcuccaccuugug

SEQ ID NO: 1961296 - RNA, 20 nt, Homo sapiens
cuagaauuauaagucacaaa

SEQ ID NO: 1961297 - RNA, 15 nt, Homo sapiens
ucuucuaaccucagc

SEQ ID NO: 1961298 - RNA, 21 nt, Homo sapiens
auauuaugcccaguuucugcc

SEQ ID NO: 1961299 - RNA, 13 nt, Homo sapiens
gaauuguuuagaa

SEQ ID NO: 1961300 - RNA, 12 nt, Homo sapiens
aaaaauguucuu

SEQ ID NO: 1961301 - RNA, 14 nt, Homo sapiens
cuggccacacugga

SEQ ID NO: 1961302 - RNA, 17 nt, Homo sapiens
aacgggcagucugcucu

SEQ ID NO: 1961303 - RNA, 14 nt, Homo sapiens
cccuccuuaucaaa

SEQ ID NO: 1961304 - RNA, 21 nt, Homo sapiens
uaauauuaccaacuacauugg

SEQ ID NO: 1961305 - RNA, 17 nt, Homo sapiens
agauuauucaacagaga

SEQ ID NO: 1961306 - RNA, 22 nt, Homo sapiens
ugaagugcuguuuuauuacugu

SEQ ID NO: 1961307 - RNA, 18 nt, Homo sapiens
cuccauuucccacuucca

SEQ ID NO: 1961308 - RNA, 13 nt, Homo sapiens
ucguauccaccuu

SEQ ID NO: 1961309 - RNA, 16 nt, Homo sapiens
guguucugucacucag

SEQ ID NO: 1961310 - RNA, 13 nt, Homo sapiens
aggcauccugccu

SEQ ID NO: 1961311 - RNA, 16 nt, Homo sapiens
auaaauauacauauaa

SEQ ID NO: 1961312 - RNA, 19 nt, Homo sapiens
uaucagccugugccacgau

SEQ ID NO: 1961313 - RNA, 15 nt, Homo sapiens
gguggcccccucucc

SEQ ID NO: 1961314 - RNA, 20 nt, Homo sapiens
aaauuggaauuuucuuaccc

SEQ ID NO: 1961315 - RNA, 13 nt, Homo sapiens
ccaagaucugcca

SEQ ID NO: 1961316 - RNA, 17 nt, Homo sapiens
acccccuuugugcugug

SEQ ID NO: 1961317 - RNA, 21 nt, Homo sapiens
gauccacacuuucaaagagaa

SEQ ID NO: 1961318 - RNA, 14 nt, Homo sapiens
cucuucaucccauu

SEQ ID NO: 1961319 - RNA, 14 nt, Homo sapiens
uucuucauuccauu

SEQ ID NO: 1961320 - RNA, 17 nt, Homo sapiens
ugcuacugccaaccucg

SEQ ID NO: 1961321 - RNA, 20 nt, Homo sapiens
acagaaauauauauacauau

SEQ ID NO: 1961322 - RNA, 22 nt, Homo sapiens
cugguccacagggcaccugcca

SEQ ID NO: 1961323 - RNA, 14 nt, Homo sapiens
accaagagcacauu

SEQ ID NO: 1961324 - RNA, 13 nt, Homo sapiens
caucucuguaaaa

SEQ ID NO: 1961325 - RNA, 20 nt, Homo sapiens
cugucugaaggacacuuccu

SEQ ID NO: 1961326 - RNA, 18 nt, Homo sapiens
ugucugacacaugcucuc

SEQ ID NO: 1961327 - RNA, 16 nt, Homo sapiens
uucaaaauguuaacaa

SEQ ID NO: 1961328 - RNA, 21 nt, Homo sapiens
ucagcuggaucuccauucucu

SEQ ID NO: 1961329 - RNA, 21 nt, Homo sapiens
uccaaaguucccacuccuuca

SEQ ID NO: 1961330 - RNA, 18 nt, Homo sapiens
gagauccugagucaugug

SEQ ID NO: 1961331 - RNA, 15 nt, Homo sapiens
uccacccagcaaaga

SEQ ID NO: 1961332 - RNA, 14 nt, Homo sapiens
caagacccaucuca

SEQ ID NO: 1961333 - RNA, 13 nt, Homo sapiens
uugcuccugcuuc

SEQ ID NO: 1961334 - RNA, 18 nt, Homo sapiens
ccaaaauguggaaugcau

SEQ ID NO: 1961335 - RNA, 14 nt, Homo sapiens
uuuaaauaaaugga

SEQ ID NO: 1961336 - RNA, 14 nt, Homo sapiens
acugaagagcucuu

SEQ ID NO: 1961337 - RNA, 21 nt, Homo sapiens
gcccagagcaggaagcauuca

SEQ ID NO: 1961338 - RNA, 14 nt, Homo sapiens
agguggggcagcuu

SEQ ID NO: 1961339 - RNA, 16 nt, Homo sapiens
gcaaaugggaugguau

SEQ ID NO: 1961340 - RNA, 20 nt, Homo sapiens
uugugucaacaugaacaaau

SEQ ID NO: 1961341 - RNA, 17 nt, Homo sapiens
ugccuuguugaugugga

SEQ ID NO: 1961342 - RNA, 14 nt, Homo sapiens
agaaauagacuuug

SEQ ID NO: 1961343 - RNA, 16 nt, Homo sapiens
gagccagucccucagc

SEQ ID NO: 1961344 - RNA, 16 nt, Homo sapiens
gccaagggcagaucac

SEQ ID NO: 1961345 - RNA, 21 nt, Homo sapiens
aagaugucccccaggggccca

SEQ ID NO: 1961346 - RNA, 20 nt, Homo sapiens
uguaauggagcaucaagcca

SEQ ID NO: 1961347 - RNA, 15 nt, Homo sapiens
cuuaacaaaccaaca

SEQ ID NO: 1961348 - RNA, 22 nt, Homo sapiens
ccacgaggagcuuccagugcau

SEQ ID NO: 1961349 - RNA, 19 nt, Homo sapiens
aaugcacacacacagagau

SEQ ID NO: 1961350 - RNA, 19 nt, Homo sapiens
uucucuggucuccuugaga

SEQ ID NO: 1961351 - RNA, 23 nt, Homo sapiens
aauaucuuuaauagguuaauauc

SEQ ID NO: 1961352 - RNA, 22 nt, Homo sapiens
aauuguuuuucugaaaguauca

SEQ ID NO: 1961353 - RNA, 18 nt, Homo sapiens
ccaccucucucacuccuu

SEQ ID NO: 1961354 - RNA, 23 nt, Homo sapiens
ucaacuuuugaaauuuaaaaauc

SEQ ID NO: 1961355 - RNA, 19 nt, Homo sapiens
agcaaauggccucauguca

SEQ ID NO: 1961356 - RNA, 14 nt, Homo sapiens
gaaauauauuacuu

SEQ ID NO: 1961357 - RNA, 16 nt, Homo sapiens
gguuuuauccuuccuu

SEQ ID NO: 1961358 - RNA, 16 nt, Homo sapiens
uuagcaaggggcucag

SEQ ID NO: 1961359 - RNA, 14 nt, Homo sapiens
ucacuuguucuuaa

SEQ ID NO: 1961360 - RNA, 12 nt, Homo sapiens
aucaauuccauc

SEQ ID NO: 1961361 - RNA, 21 nt, Homo sapiens
guaauuucuucccccccaaga

SEQ ID NO: 1961362 - RNA, 13 nt, Homo sapiens
uggcuucugauga

SEQ ID NO: 1961363 - RNA, 20 nt, Homo sapiens
auguugaguuauuaauaugu

SEQ ID NO: 1961364 - RNA, 17 nt, Homo sapiens
ccccuaacuccugccua

SEQ ID NO: 1961365 - RNA, 19 nt, Homo sapiens
uuucugcuccuuucuccac

SEQ ID NO: 1961366 - RNA, 12 nt, Homo sapiens
caggcauggaaa

SEQ ID NO: 1961367 - RNA, 23 nt, Homo sapiens
cuggcaacaugaagaaugcauuc

SEQ ID NO: 1961368 - RNA, 19 nt, Homo sapiens
aggaacagcaguguucuca

SEQ ID NO: 1961369 - RNA, 17 nt, Homo sapiens
uucacuuggccaguuuc

SEQ ID NO: 1961370 - RNA, 13 nt, Homo sapiens
aggcgcucaggca

SEQ ID NO: 1961371 - RNA, 21 nt, Homo sapiens
uaagcuaucuucaaaugucua

SEQ ID NO: 1961372 - RNA, 16 nt, Homo sapiens
uccuguucagcauucu

SEQ ID NO: 1961373 - RNA, 19 nt, Homo sapiens
gcuggaauuacaaaacuca

SEQ ID NO: 1961374 - RNA, 15 nt, Homo sapiens
aagaagacacagaag

SEQ ID NO: 1961375 - RNA, 18 nt, Homo sapiens
agaggaacccagaugcuc

SEQ ID NO: 1961376 - RNA, 16 nt, Homo sapiens
uugagaaccuaaugca

SEQ ID NO: 1961377 - RNA, 16 nt, Homo sapiens
agaaugcccagugacc

SEQ ID NO: 1961378 - RNA, 18 nt, Homo sapiens
gccuuuauuugcuguuaa

SEQ ID NO: 1961379 - RNA, 19 nt, Homo sapiens
guaauuuugugaaagaagg

SEQ ID NO: 1961380 - RNA, 16 nt, Homo sapiens
aaauugcagagucugu

SEQ ID NO: 1961381 - RNA, 20 nt, Homo sapiens
uggugacuucacagugaagu

SEQ ID NO: 1961382 - RNA, 17 nt, Homo sapiens
uaaagcauucaauuuau

SEQ ID NO: 1961383 - RNA, 13 nt, Homo sapiens
cugucuccuuuga

SEQ ID NO: 1961384 - RNA, 23 nt, Homo sapiens
ucgggcauacuuaucuauaucca

SEQ ID NO: 1961385 - RNA, 15 nt, Homo sapiens
acucuuauucuuggc

SEQ ID NO: 1961386 - RNA, 14 nt, Homo sapiens
uuucuaagauucua

SEQ ID NO: 1961387 - RNA, 18 nt, Homo sapiens
aaguguuugauggugcca

SEQ ID NO: 1961388 - RNA, 16 nt, Homo sapiens
aaguggccccucguga

SEQ ID NO: 1961389 - RNA, 14 nt, Homo sapiens
auuuauauguuaau

SEQ ID NO: 1961390 - RNA, 16 nt, Homo sapiens
aaauuuucugaucuca

SEQ ID NO: 1961391 - RNA, 20 nt, Homo sapiens
aguuuguuuuagaaccagcc

SEQ ID NO: 1961392 - RNA, 13 nt, Homo sapiens
gaacacacugaga

SEQ ID NO: 1961393 - RNA, 23 nt, Homo sapiens
gugccugccugggagacuuccuu

SEQ ID NO: 1961394 - RNA, 19 nt, Homo sapiens
cucaggguucugagucaga

SEQ ID NO: 1961395 - RNA, 21 nt, Homo sapiens
acaggcucaugccaucaugcc

SEQ ID NO: 1961396 - RNA, 14 nt, Homo sapiens
ugucauuuccaaau

SEQ ID NO: 1961397 - RNA, 19 nt, Homo sapiens
acaucucucuggcuucuga

SEQ ID NO: 1961398 - RNA, 23 nt, Homo sapiens
caggggcaucuuccuggauacca

SEQ ID NO: 1961399 - RNA, 16 nt, Homo sapiens
cucuauugcuauugcc

SEQ ID NO: 1961400 - RNA, 16 nt, Homo sapiens
gaaccccucugucuuc

SEQ ID NO: 1961401 - RNA, 18 nt, Homo sapiens
uuugaaaaaauuacucaa

SEQ ID NO: 1961402 - RNA, 12 nt, Homo sapiens
aucacaacaaac

SEQ ID NO: 1961403 - RNA, 21 nt, Homo sapiens
acugguuuggucaguuacaaa

SEQ ID NO: 1961404 - RNA, 18 nt, Homo sapiens
uacuuuucuuacucugaa

SEQ ID NO: 1961405 - RNA, 22 nt, Homo sapiens
gauauuauuucagggucccauu

SEQ ID NO: 1961406 - RNA, 18 nt, Homo sapiens
gcaauucuccugccucag

SEQ ID NO: 1961407 - RNA, 19 nt, Homo sapiens
uguuaugcaaaagcaagcu

SEQ ID NO: 1961408 - RNA, 19 nt, Homo sapiens
aacucuagagagccuuaac

SEQ ID NO: 1961409 - RNA, 19 nt, Homo sapiens
guccuccacacaagggaag

SEQ ID NO: 1961410 - RNA, 12 nt, Homo sapiens
cccacuacugua

SEQ ID NO: 1961411 - RNA, 20 nt, Homo sapiens
augaggcuuggggcuggaga

SEQ ID NO: 1961412 - RNA, 16 nt, Homo sapiens
cuugagccuccaugcc

SEQ ID NO: 1961413 - RNA, 16 nt, Homo sapiens
ugugaucuauaccacc

SEQ ID NO: 1961414 - RNA, 19 nt, Homo sapiens
ugaguaaacugagacuuaa

SEQ ID NO: 1961415 - RNA, 19 nt, Homo sapiens
cauagugcuaacaugaaga

SEQ ID NO: 1961416 - RNA, 14 nt, Homo sapiens
guauauaauacuaa

SEQ ID NO: 1961417 - RNA, 21 nt, Homo sapiens
cucuauuuguaauugaacuua

SEQ ID NO: 1961418 - RNA, 18 nt, Homo sapiens
guuugcuacuucccucac

SEQ ID NO: 1961419 - RNA, 20 nt, Homo sapiens
ugcaauccaggcuguucuca

SEQ ID NO: 1961420 - RNA, 18 nt, Homo sapiens
aggaggagggaggccagg

SEQ ID NO: 1961421 - RNA, 12 nt, Homo sapiens
aaagcccagacu

SEQ ID NO: 1961422 - RNA, 22 nt, Homo sapiens
ugcaccccuccccauucacaga

SEQ ID NO: 1961423 - RNA, 15 nt, Homo sapiens
uuggauacaggagaa

SEQ ID NO: 1961424 - RNA, 15 nt, Homo sapiens
auaagaucugagauu

SEQ ID NO: 1961425 - RNA, 13 nt, Homo sapiens
ugugaacacugga

SEQ ID NO: 1961426 - RNA, 14 nt, Homo sapiens
acaaacauuaguau

SEQ ID NO: 1961427 - RNA, 12 nt, Homo sapiens
uucccaggcaaa

SEQ ID NO: 1961428 - RNA, 20 nt, Homo sapiens
ucaugauguauuguugcuuu

SEQ ID NO: 1961429 - RNA, 20 nt, Homo sapiens
uggccaguuucagcucacuu

SEQ ID NO: 1961430 - RNA, 18 nt, Homo sapiens
aaauucaauuaggauuaa

SEQ ID NO: 1961431 - RNA, 23 nt, Homo sapiens
acauagaaauggaaauuuugcua

SEQ ID NO: 1961432 - RNA, 23 nt, Homo sapiens
acaugcgcacucucauaugccac

SEQ ID NO: 1961433 - RNA, 22 nt, Homo sapiens
gaaccuguccuaaggaaccuuc

SEQ ID NO: 1961434 - RNA, 14 nt, Homo sapiens
uauucucuuuggug

SEQ ID NO: 1961435 - RNA, 18 nt, Homo sapiens
cacuuuggacuucucuga

SEQ ID NO: 1961436 - RNA, 18 nt, Homo sapiens
ugucccugaacucccaga

SEQ ID NO: 1961437 - RNA, 21 nt, Homo sapiens
aucugccagagcacacauaua

SEQ ID NO: 1961438 - RNA, 20 nt, Homo sapiens
cuccugaguagcugggacua

SEQ ID NO: 1961439 - RNA, 14 nt, Homo sapiens
acaaaacugaccuu

SEQ ID NO: 1961440 - RNA, 23 nt, Homo sapiens
aguaagaauguuaaaaagugaaa

SEQ ID NO: 1961441 - RNA, 22 nt, Homo sapiens
aaguuuccguggguucugucau

SEQ ID NO: 1961442 - RNA, 20 nt, Homo sapiens
uaaaaacuucgugcauuugu

SEQ ID NO: 1961443 - RNA, 17 nt, Homo sapiens
ugaaaccaaauguaacu

SEQ ID NO: 1961444 - RNA, 14 nt, Homo sapiens
ggucucagcaugua

SEQ ID NO: 1961445 - RNA, 17 nt, Homo sapiens
aaauacauguaccuaua

SEQ ID NO: 1961446 - RNA, 18 nt, Homo sapiens
cuaaauccuuuacuguua

SEQ ID NO: 1961447 - RNA, 21 nt, Homo sapiens
ucucagguagaagguugacac

SEQ ID NO: 1961448 - RNA, 14 nt, Homo sapiens
gaagagcuauggcc

SEQ ID NO: 1961449 - RNA, 17 nt, Homo sapiens
gcccuggugcuccugcc

SEQ ID NO: 1961450 - RNA, 23 nt, Homo sapiens
gccaucagacaacacccuggccu

SEQ ID NO: 1961451 - RNA, 20 nt, Homo sapiens
auagaacucugggcugccau

SEQ ID NO: 1961452 - RNA, 16 nt, Homo sapiens
uuggcacuccuggaca

SEQ ID NO: 1961453 - RNA, 21 nt, Homo sapiens
agucaaauuuggauuuuccac

SEQ ID NO: 1961454 - RNA, 20 nt, Homo sapiens
ugggauuacaggcaugugcc

SEQ ID NO: 1961455 - RNA, 19 nt, Homo sapiens
acaguaaaaauaaccacuu

SEQ ID NO: 1961456 - RNA, 19 nt, Homo sapiens
gcuccaguguccugagcuc

SEQ ID NO: 1961457 - RNA, 17 nt, Homo sapiens
accuuauuguaccucuc

SEQ ID NO: 1961458 - RNA, 13 nt, Homo sapiens
agugagacccugu

SEQ ID NO: 1961459 - RNA, 20 nt, Homo sapiens
ucagauccugggcacauucu

SEQ ID NO: 1961460 - RNA, 16 nt, Homo sapiens
uaaacuacaaacacaa

SEQ ID NO: 1961461 - RNA, 16 nt, Homo sapiens
uccccuacaccaacaa

SEQ ID NO: 1961462 - RNA, 23 nt, Homo sapiens
ccagcaaagaggacucgcuugua

SEQ ID NO: 1961463 - RNA, 13 nt, Homo sapiens
uaaccuauuccca

SEQ ID NO: 1961464 - RNA, 14 nt, Homo sapiens
cagacagaccucaa

SEQ ID NO: 1961465 - RNA, 21 nt, Homo sapiens
aauaauuaaccaccaauccaa

SEQ ID NO: 1961466 - RNA, 20 nt, Homo sapiens
augauuagcacuuaauaauu

SEQ ID NO: 1961467 - RNA, 14 nt, Homo sapiens
cucuuaaucacuac

SEQ ID NO: 1961468 - RNA, 20 nt, Homo sapiens
aauauauaguggacaguaac

SEQ ID NO: 1961469 - RNA, 18 nt, Homo sapiens
gcccccaggguccuggga

SEQ ID NO: 1961470 - RNA, 22 nt, Homo sapiens
cucauugaauuauaaaagccag

SEQ ID NO: 1961471 - RNA, 18 nt, Homo sapiens
cuucaaaauaucaagugu

SEQ ID NO: 1961472 - RNA, 21 nt, Homo sapiens
gucacaguaaugcaagcaaag

SEQ ID NO: 1961473 - RNA, 13 nt, Homo sapiens
uguuacugcaagu

SEQ ID NO: 1961474 - RNA, 12 nt, Homo sapiens
uggaacauuucu

SEQ ID NO: 1961475 - RNA, 17 nt, Homo sapiens
gccugaagaacaguaac

SEQ ID NO: 1961476 - RNA, 14 nt, Homo sapiens
uguuugaccccagu

SEQ ID NO: 1961477 - RNA, 17 nt, Homo sapiens
aauagauugaguuauua

SEQ ID NO: 1961478 - RNA, 17 nt, Homo sapiens
ucuuggugaacacacau

SEQ ID NO: 1961479 - RNA, 19 nt, Homo sapiens
acagggacaugcccugugu

SEQ ID NO: 1961480 - RNA, 19 nt, Homo sapiens
cuguggcucuacaacugag

SEQ ID NO: 1961481 - RNA, 15 nt, Homo sapiens
cgagauccaccagau

SEQ ID NO: 1961482 - RNA, 13 nt, Homo sapiens
uaaauauuucaag

SEQ ID NO: 1961483 - RNA, 16 nt, Homo sapiens
cuugaugauuuuuaac

SEQ ID NO: 1961484 - RNA, 17 nt, Homo sapiens
gagugcacugacuguga

SEQ ID NO: 1961485 - RNA, 16 nt, Homo sapiens
aggacuccauuucuuu

SEQ ID NO: 1961486 - RNA, 15 nt, Homo sapiens
ucucggucacaggga

SEQ ID NO: 1961487 - RNA, 21 nt, Homo sapiens
cauccuagagaaaacuugaau

SEQ ID NO: 1961488 - RNA, 18 nt, Homo sapiens
ucccgacccaaaggguga

SEQ ID NO: 1961489 - RNA, 14 nt, Homo sapiens
ugaaugaaaugcca

SEQ ID NO: 1961490 - RNA, 17 nt, Homo sapiens
ggggcuuuuacaccagu

SEQ ID NO: 1961491 - RNA, 15 nt, Homo sapiens
cauuuguguacacag

SEQ ID NO: 1961492 - RNA, 16 nt, Homo sapiens
uaagucuuaauauuaa

SEQ ID NO: 1961493 - RNA, 22 nt, Homo sapiens
uuguaagaaaccaaucaagaua

SEQ ID NO: 1961494 - RNA, 18 nt, Homo sapiens
agggucuucccuaccuca

SEQ ID NO: 1961495 - RNA, 22 nt, Homo sapiens
guaagaccucugagaccaaaau

SEQ ID NO: 1961496 - RNA, 19 nt, Homo sapiens
auugucagcuacuaaugau

SEQ ID NO: 1961497 - RNA, 13 nt, Homo sapiens
uuaacauaagaaa

SEQ ID NO: 1961498 - RNA, 21 nt, Homo sapiens
gcccugggguaugagcugcca

SEQ ID NO: 1961499 - RNA, 20 nt, Homo sapiens
gggucucacuguguugccca

SEQ ID NO: 1961500 - RNA, 19 nt, Homo sapiens
aaauaauagaaaugucuca

SEQ ID NO: 1961501 - RNA, 20 nt, Homo sapiens
ugccguucugcacccuaccc

SEQ ID NO: 1961502 - RNA, 20 nt, Homo sapiens
agcugaggcccauggccaca

SEQ ID NO: 1961503 - RNA, 16 nt, Homo sapiens
ccagugggcagugcau

SEQ ID NO: 1961504 - RNA, 13 nt, Homo sapiens
augggagccucau

SEQ ID NO: 1961505 - RNA, 23 nt, Homo sapiens
aacuaccauguggccauuaacaa

SEQ ID NO: 1961506 - RNA, 12 nt, Homo sapiens
auuaaauuuacu

SEQ ID NO: 1961507 - RNA, 14 nt, Homo sapiens
gguucaccagcccu

SEQ ID NO: 1961508 - RNA, 18 nt, Homo sapiens
ccuugcauguaaaaaccu

SEQ ID NO: 1961509 - RNA, 15 nt, Homo sapiens
gggccccaucuugau

SEQ ID NO: 1961510 - RNA, 11 nt, Homo sapiens
cacuuuugcca

SEQ ID NO: 1961511 - RNA, 20 nt, Homo sapiens
ccauuugcccuccuccucag

SEQ ID NO: 1961512 - RNA, 13 nt, Homo sapiens
ucccaguccauuu

SEQ ID NO: 1961513 - RNA, 19 nt, Homo sapiens
cccgggcugccugggcugu

SEQ ID NO: 1961514 - RNA, 19 nt, Homo sapiens
guuuggcaggcacugccug

SEQ ID NO: 1961515 - RNA, 15 nt, Homo sapiens
ggcccgggcacccac

SEQ ID NO: 1961516 - RNA, 13 nt, Homo sapiens
cacagcaaagggc

SEQ ID NO: 1961517 - RNA, 17 nt, Homo sapiens
uaaucaguaaauaccuu

SEQ ID NO: 1961518 - RNA, 22 nt, Homo sapiens
guccuugauuuaucacacaaag

SEQ ID NO: 1961519 - RNA, 17 nt, Homo sapiens
aagcugcgggcacccau

SEQ ID NO: 1961520 - RNA, 12 nt, Homo sapiens
gaugaugucuuc

SEQ ID NO: 1961521 - RNA, 20 nt, Homo sapiens
caguagggaugaguacccaa

SEQ ID NO: 1961522 - RNA, 19 nt, Homo sapiens
uaaagcguccucucaguaa

SEQ ID NO: 1961523 - RNA, 19 nt, Homo sapiens
ccugacauucacacagaga

SEQ ID NO: 1961524 - RNA, 21 nt, Homo sapiens
acucuucccucucucacuccc

SEQ ID NO: 1961525 - RNA, 15 nt, Homo sapiens
accuuuugcuccuau

SEQ ID NO: 1961526 - RNA, 22 nt, Homo sapiens
uagggugcaagaagccauuuag

SEQ ID NO: 1961527 - RNA, 15 nt, Homo sapiens
cugguugguuuugcc

SEQ ID NO: 1961528 - RNA, 14 nt, Homo sapiens
uaauaguguuuaca

SEQ ID NO: 1961529 - RNA, 10 nt, Homo sapiens
cucgcugcca

SEQ ID NO: 1961530 - RNA, 11 nt, Homo sapiens
gaccacugucu

SEQ ID NO: 1961531 - RNA, 21 nt, Homo sapiens
uccucaggguggggggugaca

SEQ ID NO: 1961532 - RNA, 16 nt, Homo sapiens
ucauaugaacuuucau

SEQ ID NO: 1961533 - RNA, 21 nt, Homo sapiens
acauuugugggcaagcagaug

SEQ ID NO: 1961534 - RNA, 16 nt, Homo sapiens
aauggacaaaauccau

SEQ ID NO: 1961535 - RNA, 12 nt, Homo sapiens
uuuuuuccuuaa

SEQ ID NO: 1961536 - RNA, 12 nt, Homo sapiens
acuucacaguga

SEQ ID NO: 1961537 - RNA, 20 nt, Homo sapiens
uuuuaagcauuuucuacaca

SEQ ID NO: 1961538 - RNA, 21 nt, Homo sapiens
uaaaaaauauugaaaugcugu

SEQ ID NO: 1961539 - RNA, 11 nt, Homo sapiens
acagcauuugc

SEQ ID NO: 1961540 - RNA, 22 nt, Homo sapiens
ugucccaacucgaugggcacag

SEQ ID NO: 1961541 - RNA, 22 nt, Homo sapiens
auuuguuguacuuuuuauucaa

SEQ ID NO: 1961542 - RNA, 19 nt, Homo sapiens
gguuucucugugcucugaa

SEQ ID NO: 1961543 - RNA, 17 nt, Homo sapiens
cucuuuuaguccauuga

SEQ ID NO: 1961544 - RNA, 20 nt, Homo sapiens
gucucucaaagaccccaugg

SEQ ID NO: 1961545 - RNA, 12 nt, Homo sapiens
acaucuggauau

SEQ ID NO: 1961546 - RNA, 20 nt, Homo sapiens
auguggcuggaagauccugc

SEQ ID NO: 1961547 - RNA, 21 nt, Homo sapiens
gcuuuuccaagcugccacugg

SEQ ID NO: 1961548 - RNA, 20 nt, Homo sapiens
ugguuguccucacugcugau

SEQ ID NO: 1961549 - RNA, 21 nt, Homo sapiens
cagcucuggcuuccugcugag

SEQ ID NO: 1961550 - RNA, 21 nt, Homo sapiens
aaauguaagaaagcauaguua

SEQ ID NO: 1961551 - RNA, 12 nt, Homo sapiens
uguuugucucac

SEQ ID NO: 1961552 - RNA, 21 nt, Homo sapiens
cacucucagaacccacaccag

SEQ ID NO: 1961553 - RNA, 22 nt, Homo sapiens
uuucugucacaucagcuccacu

SEQ ID NO: 1961554 - RNA, 18 nt, Homo sapiens
caacuccuggagauuuca

SEQ ID NO: 1961555 - RNA, 21 nt, Homo sapiens
uguagugccaugguagaagaa

SEQ ID NO: 1961556 - RNA, 18 nt, Homo sapiens
ggcauuugggcacuguag

SEQ ID NO: 1961557 - RNA, 15 nt, Homo sapiens
ugggaccgugcccac

SEQ ID NO: 1961558 - RNA, 22 nt, Homo sapiens
uuaaaauccaaagugucauauu

SEQ ID NO: 1961559 - RNA, 21 nt, Homo sapiens
uguucccaauauguagccuuu

SEQ ID NO: 1961560 - RNA, 13 nt, Homo sapiens
augcaugucugac

SEQ ID NO: 1961561 - RNA, 19 nt, Homo sapiens
cuuccauucacaccagcua

SEQ ID NO: 1961562 - RNA, 11 nt, Homo sapiens
cuacuucacag

SEQ ID NO: 1961563 - RNA, 19 nt, Homo sapiens
cacaccuagcgucaguauu

SEQ ID NO: 1961564 - RNA, 13 nt, Homo sapiens
cuauauagacuug

SEQ ID NO: 1961565 - RNA, 22 nt, Homo sapiens
cauauaguuaauugauaagcau

SEQ ID NO: 1961566 - RNA, 13 nt, Homo sapiens
cgugggaucugcc

SEQ ID NO: 1961567 - RNA, 20 nt, Homo sapiens
aaccaguuauaaauacauau

SEQ ID NO: 1961568 - RNA, 14 nt, Homo sapiens
cagggguacacaga

SEQ ID NO: 1961569 - RNA, 17 nt, Homo sapiens
ccuccaguaguggacaa

SEQ ID NO: 1961570 - RNA, 13 nt, Homo sapiens
uuggcucuaguaa

SEQ ID NO: 1961571 - RNA, 22 nt, Homo sapiens
acaaccucuuugagacguccuu

SEQ ID NO: 1961572 - RNA, 16 nt, Homo sapiens
auauaugcacuaugua

SEQ ID NO: 1961573 - RNA, 13 nt, Homo sapiens
uggaagcuggaag

SEQ ID NO: 1961574 - RNA, 14 nt, Homo sapiens
acaguaacacuggc

SEQ ID NO: 1961575 - RNA, 18 nt, Homo sapiens
gauguccccaaaguacca

SEQ ID NO: 1961576 - RNA, 18 nt, Homo sapiens
gucagaccaguacuggga

SEQ ID NO: 1961577 - RNA, 18 nt, Homo sapiens
cagcagucagucccccaa

SEQ ID NO: 1961578 - RNA, 15 nt, Homo sapiens
gcugucacuugccca

SEQ ID NO: 1961579 - RNA, 12 nt, Homo sapiens
ggccacacuggu

SEQ ID NO: 1961580 - RNA, 19 nt, Homo sapiens
cagaagaugccagcuucuc

SEQ ID NO: 1961581 - RNA, 23 nt, Homo sapiens
gugucuccuguuucagaccagcc

SEQ ID NO: 1961582 - RNA, 22 nt, Homo sapiens
uuauuaaauguagcuucaguca

SEQ ID NO: 1961583 - RNA, 16 nt, Homo sapiens
agaauguucaucucuc

SEQ ID NO: 1961584 - RNA, 20 nt, Homo sapiens
agugcacaggcgcaucccag

SEQ ID NO: 1961585 - RNA, 21 nt, Homo sapiens
uuucaucuguuguucuguggu

SEQ ID NO: 1961586 - RNA, 18 nt, Homo sapiens
aaggaggggaccucucca

SEQ ID NO: 1961587 - RNA, 14 nt, Homo sapiens
gucuagacauauuu

SEQ ID NO: 1961588 - RNA, 21 nt, Homo sapiens
auucucucaucuaacugauga

SEQ ID NO: 1961589 - RNA, 17 nt, Homo sapiens
auaccuaaaacauaaga

SEQ ID NO: 1961590 - RNA, 23 nt, Homo sapiens
cugcaugcacuucuuacaauaau

SEQ ID NO: 1961591 - RNA, 14 nt, Homo sapiens
cuguguaggcauuu

SEQ ID NO: 1961592 - RNA, 23 nt, Homo sapiens
aagucacaggaagaaagcagaaa

SEQ ID NO: 1961593 - RNA, 22 nt, Homo sapiens
gguacuauaaaagcuuucugcc

SEQ ID NO: 1961594 - RNA, 18 nt, Homo sapiens
gaaagucugaaucuccca

SEQ ID NO: 1961595 - RNA, 16 nt, Homo sapiens
acuccugcccuguugu

SEQ ID NO: 1961596 - RNA, 21 nt, Homo sapiens
acucccuucccccauccucca

SEQ ID NO: 1961597 - RNA, 13 nt, Homo sapiens
aggcccacugucc

SEQ ID NO: 1961598 - RNA, 15 nt, Homo sapiens
gcuuucuuguugcug

SEQ ID NO: 1961599 - RNA, 17 nt, Homo sapiens
cucaggaggccgaggca

SEQ ID NO: 1961600 - RNA, 17 nt, Homo sapiens
gcacagaccccuuccag

SEQ ID NO: 1961601 - RNA, 23 nt, Homo sapiens
ugaccugaggagacaucuacaca

SEQ ID NO: 1961602 - RNA, 19 nt, Homo sapiens
acaagaaugugcacucucu

SEQ ID NO: 1961603 - RNA, 19 nt, Homo sapiens
uccaaaugauuuucaucaa

SEQ ID NO: 1961604 - RNA, 14 nt, Homo sapiens
caauaaaaacaauu

SEQ ID NO: 1961605 - RNA, 12 nt, Homo sapiens
aauuccuaguca

SEQ ID NO: 1961606 - RNA, 15 nt, Homo sapiens
guaggaaacaauucu

SEQ ID NO: 1961607 - RNA, 22 nt, Homo sapiens
ucaacugaaaagacucaguguu

SEQ ID NO: 1961608 - RNA, 19 nt, Homo sapiens
gagcgagacuccaucucaa

SEQ ID NO: 1961609 - RNA, 22 nt, Homo sapiens
agcuuuuuaccguucacuuccc

SEQ ID NO: 1961610 - RNA, 15 nt, Homo sapiens
cgauucucaugccuc

SEQ ID NO: 1961611 - RNA, 21 nt, Homo sapiens
uaucugaaaggccagcagcug

SEQ ID NO: 1961612 - RNA, 15 nt, Homo sapiens
uuagaacauucacuu

SEQ ID NO: 1961613 - RNA, 21 nt, Homo sapiens
ugcuuaaaagguuaaauuuca

SEQ ID NO: 1961614 - RNA, 13 nt, Homo sapiens
uuauaacucugua

SEQ ID NO: 1961615 - RNA, 20 nt, Homo sapiens
gcacacacacggaugcacac

SEQ ID NO: 1961616 - RNA, 12 nt, Homo sapiens
gacugaugccag

SEQ ID NO: 1961617 - RNA, 20 nt, Homo sapiens
acauugcuugugccacaccc

SEQ ID NO: 1961618 - RNA, 15 nt, Homo sapiens
ucuuucauccuugac

SEQ ID NO: 1961619 - RNA, 17 nt, Homo sapiens
uaccaaagcugcugcac

SEQ ID NO: 1961620 - RNA, 19 nt, Homo sapiens
aacuugaagauauuuauuc

SEQ ID NO: 1961621 - RNA, 14 nt, Homo sapiens
acuccgugaggcug

SEQ ID NO: 1961622 - RNA, 19 nt, Homo sapiens
ccgagauaggguggcacau

SEQ ID NO: 1961623 - RNA, 13 nt, Homo sapiens
caacuguggcuua

SEQ ID NO: 1961624 - RNA, 16 nt, Homo sapiens
uccacuguuagcacau

SEQ ID NO: 1961625 - RNA, 16 nt, Homo sapiens
aauaucaggaugccuu

SEQ ID NO: 1961626 - RNA, 15 nt, Homo sapiens
ggugggguacuggag

SEQ ID NO: 1961627 - RNA, 15 nt, Homo sapiens
ggaccgcuacaccac

SEQ ID NO: 1961628 - RNA, 16 nt, Homo sapiens
acaaauuucauugcac

SEQ ID NO: 1961629 - RNA, 19 nt, Homo sapiens
gggggcauaucucagucag

SEQ ID NO: 1961630 - RNA, 22 nt, Homo sapiens
gcuugucacagucucuacuguu

SEQ ID NO: 1961631 - RNA, 14 nt, Homo sapiens
auugcuagccagca

SEQ ID NO: 1961632 - RNA, 22 nt, Homo sapiens
cuaacgcaggagaaucacuuga

SEQ ID NO: 1961633 - RNA, 23 nt, Homo sapiens
ccugcuggaaaccacacuucuug

SEQ ID NO: 1961634 - RNA, 18 nt, Homo sapiens
uuccaaggaaauacauau

SEQ ID NO: 1961635 - RNA, 15 nt, Homo sapiens
ucuugacauucacuu

SEQ ID NO: 1961636 - RNA, 23 nt, Homo sapiens
uccaaaaagaggagaugacuaca

SEQ ID NO: 1961637 - RNA, 17 nt, Homo sapiens
ucaugaguuuguuuaca

SEQ ID NO: 1961638 - RNA, 23 nt, Homo sapiens
cccugcgccaccucacugcagua

SEQ ID NO: 1961639 - RNA, 18 nt, Homo sapiens
gcauccuuuucaaaaccu

SEQ ID NO: 1961640 - RNA, 14 nt, Homo sapiens
ucuccucagaagaa

SEQ ID NO: 1961641 - RNA, 11 nt, Homo sapiens
ggccaccagag

SEQ ID NO: 1961642 - RNA, 13 nt, Homo sapiens
ucugaauugacug

SEQ ID NO: 1961643 - RNA, 16 nt, Homo sapiens
cuaagauacugaugac

SEQ ID NO: 1961644 - RNA, 19 nt, Homo sapiens
aagauaaagacuguggaaa

SEQ ID NO: 1961645 - RNA, 17 nt, Homo sapiens
aucucuuaauauugaga

SEQ ID NO: 1961646 - RNA, 20 nt, Homo sapiens
caccacuacaguaagcuggu

SEQ ID NO: 1961647 - RNA, 22 nt, Homo sapiens
gagaauuccuuuuucuucuuua

SEQ ID NO: 1961648 - RNA, 15 nt, Homo sapiens
gacaugggacauuug

SEQ ID NO: 1961649 - RNA, 21 nt, Homo sapiens
aaagugcugggauuacaggcg

SEQ ID NO: 1961650 - RNA, 21 nt, Homo sapiens
caguagcuccgcgugucucau

SEQ ID NO: 1961651 - RNA, 18 nt, Homo sapiens
uuguauuccucaugucau

SEQ ID NO: 1961652 - RNA, 18 nt, Homo sapiens
ggucuagccgcugcccug

SEQ ID NO: 1961653 - RNA, 18 nt, Homo sapiens
caugagugaauaaauguc

SEQ ID NO: 1961654 - RNA, 18 nt, Homo sapiens
uaaaagggaaagaaggcc

SEQ ID NO: 1961655 - RNA, 15 nt, Homo sapiens
cacuguuacagagau

SEQ ID NO: 1961656 - RNA, 18 nt, Homo sapiens
auuguuguuaauaggucu

SEQ ID NO: 1961657 - RNA, 18 nt, Homo sapiens
caguccucauuuacugga

SEQ ID NO: 1961658 - RNA, 23 nt, Homo sapiens
agaggaugaauguaugugcacug

SEQ ID NO: 1961659 - RNA, 15 nt, Homo sapiens
aaaucaaucacagcu

SEQ ID NO: 1961660 - RNA, 14 nt, Homo sapiens
cugagaacagcaua

SEQ ID NO: 1961661 - RNA, 19 nt, Homo sapiens
acuacgugacuguggcaca

SEQ ID NO: 1961662 - RNA, 19 nt, Homo sapiens
accaagucggaacagcaga

SEQ ID NO: 1961663 - RNA, 12 nt, Homo sapiens
uauaccaaaggu

SEQ ID NO: 1961664 - RNA, 21 nt, Homo sapiens
uaauggccuuccauaauaauu

SEQ ID NO: 1961665 - RNA, 15 nt, Homo sapiens
agcaucagggggaag

SEQ ID NO: 1961666 - RNA, 23 nt, Homo sapiens
caggcaugucccaugugagcugc

SEQ ID NO: 1961667 - RNA, 15 nt, Homo sapiens
uucuucucuuauccu

SEQ ID NO: 1961668 - RNA, 20 nt, Homo sapiens
uggacagacacuguugcaaa

SEQ ID NO: 1961669 - RNA, 23 nt, Homo sapiens
accaauuuauccuugaccaauaa

SEQ ID NO: 1961670 - RNA, 19 nt, Homo sapiens
cucacuuucccuuguguca

SEQ ID NO: 1961671 - RNA, 19 nt, Homo sapiens
uaccccuuccuguccugcc

SEQ ID NO: 1961672 - RNA, 14 nt, Homo sapiens
ccuugaagcaauaa

SEQ ID NO: 1961673 - RNA, 19 nt, Homo sapiens
agcuccagcuguuaccuga

SEQ ID NO: 1961674 - RNA, 19 nt, Homo sapiens
gagaugggguuucacuaug

SEQ ID NO: 1961675 - RNA, 16 nt, Homo sapiens
auuuucaguuauaugu

SEQ ID NO: 1961676 - RNA, 17 nt, Homo sapiens
gcaaagaacucauuuga

SEQ ID NO: 1961677 - RNA, 19 nt, Homo sapiens
guggggcaaugacuuuccu

SEQ ID NO: 1961678 - RNA, 16 nt, Homo sapiens
cagcuggacugcauug

SEQ ID NO: 1961679 - RNA, 21 nt, Homo sapiens
ccucacccccagguguugcca

SEQ ID NO: 1961680 - RNA, 23 nt, Homo sapiens
uauccaucuuucacuaucuguaa

SEQ ID NO: 1961681 - RNA, 17 nt, Homo sapiens
uucugacuuugccaaaa

SEQ ID NO: 1961682 - RNA, 15 nt, Homo sapiens
aaaucaaugucacuu

SEQ ID NO: 1961683 - RNA, 16 nt, Homo sapiens
cugcgccgucugcucg

SEQ ID NO: 1961684 - RNA, 19 nt, Homo sapiens
cuauccaaaacuaauuucc

SEQ ID NO: 1961685 - RNA, 13 nt, Homo sapiens
caugcuacaugua

SEQ ID NO: 1961686 - RNA, 20 nt, Homo sapiens
aaauauuuccuuaaacugug

SEQ ID NO: 1961687 - RNA, 11 nt, Homo sapiens
aaaugucuugc

SEQ ID NO: 1961688 - RNA, 17 nt, Homo sapiens
gcacaacauccucagaa

SEQ ID NO: 1961689 - RNA, 16 nt, Homo sapiens
uggugaaaucccaucu

SEQ ID NO: 1961690 - RNA, 13 nt, Homo sapiens
uccuuugugcuua

SEQ ID NO: 1961691 - RNA, 22 nt, Homo sapiens
ugaaauuuuugaugcccagaca

SEQ ID NO: 1961692 - RNA, 19 nt, Homo sapiens
ucugccuucugcugaaaga

SEQ ID NO: 1961693 - RNA, 14 nt, Homo sapiens
ccaaguguauuuua

SEQ ID NO: 1961694 - RNA, 16 nt, Homo sapiens
ccuccagguauuugag

SEQ ID NO: 1961695 - RNA, 11 nt, Homo sapiens
aucugccaaca

SEQ ID NO: 1961696 - RNA, 19 nt, Homo sapiens
uccccccgagucuccggga

SEQ ID NO: 1961697 - RNA, 15 nt, Homo sapiens
uucccuucugccacc

SEQ ID NO: 1961698 - RNA, 19 nt, Homo sapiens
ucuuccagaagaugcccuc

SEQ ID NO: 1961699 - RNA, 22 nt, Homo sapiens
gugccaggugugugguggggac

SEQ ID NO: 1961700 - RNA, 19 nt, Homo sapiens
agaaucuauuuccuuucca

SEQ ID NO: 1961701 - RNA, 20 nt, Homo sapiens
ugcacaggguccucagcuca

SEQ ID NO: 1961702 - RNA, 16 nt, Homo sapiens
ccaucccaacaccuca

SEQ ID NO: 1961703 - RNA, 20 nt, Homo sapiens
ccagccugggcaacauacca

SEQ ID NO: 1961704 - RNA, 15 nt, Homo sapiens
uuuauccagcaguca

SEQ ID NO: 1961705 - RNA, 22 nt, Homo sapiens
ucuguugcuggucuucucaguu

SEQ ID NO: 1961706 - RNA, 20 nt, Homo sapiens
cuaaagagagaugaaccaca

SEQ ID NO: 1961707 - RNA, 14 nt, Homo sapiens
cagagcuggcagca

SEQ ID NO: 1961708 - RNA, 13 nt, Homo sapiens
aaggaaaucuggc

SEQ ID NO: 1961709 - RNA, 15 nt, Homo sapiens
uucuagagugcauau

SEQ ID NO: 1961710 - RNA, 22 nt, Homo sapiens
agguucuuaaaguuugcaguau

SEQ ID NO: 1961711 - RNA, 17 nt, Homo sapiens
gagaaucacuugaacuc

SEQ ID NO: 1961712 - RNA, 21 nt, Homo sapiens
uuaguuacuuuggaacacuac

SEQ ID NO: 1961713 - RNA, 20 nt, Homo sapiens
uuaaacagaugugaauauuc

SEQ ID NO: 1961714 - RNA, 19 nt, Homo sapiens
acagauguacauuaaauac

SEQ ID NO: 1961715 - RNA, 18 nt, Homo sapiens
cagccaagggcagaucac

SEQ ID NO: 1961716 - RNA, 22 nt, Homo sapiens
uucccccuuccacccucacauc

SEQ ID NO: 1961717 - RNA, 18 nt, Homo sapiens
aaucauccaagacaguua

SEQ ID NO: 1961718 - RNA, 18 nt, Homo sapiens
cuccuguggcggugcagu

SEQ ID NO: 1961719 - RNA, 14 nt, Homo sapiens
cgcacugaguacaa

SEQ ID NO: 1961720 - RNA, 17 nt, Homo sapiens
uuuuacaugcagaguau

SEQ ID NO: 1961721 - RNA, 15 nt, Homo sapiens
cucaaaacaggguug

SEQ ID NO: 1961722 - RNA, 22 nt, Homo sapiens
agcugagggcccuguggagucc

SEQ ID NO: 1961723 - RNA, 16 nt, Homo sapiens
cugggggugucccugg

SEQ ID NO: 1961724 - RNA, 17 nt, Homo sapiens
aggugccaugucuuuac

SEQ ID NO: 1961725 - RNA, 18 nt, Homo sapiens
ugaauaucuuccacagag

SEQ ID NO: 1961726 - RNA, 17 nt, Homo sapiens
gacucagggccaugccu

SEQ ID NO: 1961727 - RNA, 17 nt, Homo sapiens
gccacagggacuugccu

SEQ ID NO: 1961728 - RNA, 14 nt, Homo sapiens
aaaugugucugcaa

SEQ ID NO: 1961729 - RNA, 12 nt, Homo sapiens
uuucuacauaca

SEQ ID NO: 1961730 - RNA, 15 nt, Homo sapiens
accuuuuccuugcug

SEQ ID NO: 1961731 - RNA, 16 nt, Homo sapiens
cacaaaacaaaugcca

SEQ ID NO: 1961732 - RNA, 18 nt, Homo sapiens
aucccauaugccugggca

SEQ ID NO: 1961733 - RNA, 12 nt, Homo sapiens
ucaaaacagaga

SEQ ID NO: 1961734 - RNA, 18 nt, Homo sapiens
uuuuaaaauuuauuugca

SEQ ID NO: 1961735 - RNA, 18 nt, Homo sapiens
uuuccuugucucucauuc

SEQ ID NO: 1961736 - RNA, 22 nt, Homo sapiens
agagcauuugguacacacuuga

SEQ ID NO: 1961737 - RNA, 20 nt, Homo sapiens
gccuccugggaacacaucug

SEQ ID NO: 1961738 - RNA, 21 nt, Homo sapiens
gagaucuaaggaugucacagg

SEQ ID NO: 1961739 - RNA, 20 nt, Homo sapiens
uggugaccucacacaccucu

SEQ ID NO: 1961740 - RNA, 13 nt, Homo sapiens
acgagguggcagu

SEQ ID NO: 1961741 - RNA, 21 nt, Homo sapiens
ucuuccaucagcucucugcaa

SEQ ID NO: 1961742 - RNA, 19 nt, Homo sapiens
cuucauuaggguaauauca

SEQ ID NO: 1961743 - RNA, 21 nt, Homo sapiens
cugguucccggagaagugugc

SEQ ID NO: 1961744 - RNA, 13 nt, Homo sapiens
uuaaagcuauucu

SEQ ID NO: 1961745 - RNA, 16 nt, Homo sapiens
uauguaugccuauuca

SEQ ID NO: 1961746 - RNA, 17 nt, Homo sapiens
gucccaauagcucuacu

SEQ ID NO: 1961747 - RNA, 19 nt, Homo sapiens
ucugccuguuauaacucug

SEQ ID NO: 1961748 - RNA, 10 nt, Homo sapiens
uuuuuaguuu

SEQ ID NO: 1961749 - RNA, 15 nt, Homo sapiens
aguaccaacugagcc

SEQ ID NO: 1961750 - RNA, 17 nt, Homo sapiens
cuguauaagcuguaaua

SEQ ID NO: 1961751 - RNA, 18 nt, Homo sapiens
gguggcacacaccuguag

SEQ ID NO: 1961752 - RNA, 16 nt, Homo sapiens
ucugccaggcucuaaa

SEQ ID NO: 1961753 - RNA, 17 nt, Homo sapiens
caaaacagaaaaugaag

SEQ ID NO: 1961754 - RNA, 14 nt, Homo sapiens
cgggaacuggaguc

SEQ ID NO: 1961755 - RNA, 15 nt, Homo sapiens
gaauaaaaugaaggu

SEQ ID NO: 1961756 - RNA, 20 nt, Homo sapiens
aaauaagcauguuuucacua

SEQ ID NO: 1961757 - RNA, 15 nt, Homo sapiens
uguuaauuucuugca

SEQ ID NO: 1961758 - RNA, 19 nt, Homo sapiens
acaucccagacacauucac

SEQ ID NO: 1961759 - RNA, 13 nt, Homo sapiens
cuacuucaguaca

SEQ ID NO: 1961760 - RNA, 22 nt, Homo sapiens
ucugcgucccacugagucucau

SEQ ID NO: 1961761 - RNA, 15 nt, Homo sapiens
ugggucaugacaaga

SEQ ID NO: 1961762 - RNA, 22 nt, Homo sapiens
gugcaaccuguggcucagggga

SEQ ID NO: 1961763 - RNA, 13 nt, Homo sapiens
ccuucaccaaaga

SEQ ID NO: 1961764 - RNA, 12 nt, Homo sapiens
cggucucaggcu

SEQ ID NO: 1961765 - RNA, 18 nt, Homo sapiens
uuaauuuuuuacuuucag

SEQ ID NO: 1961766 - RNA, 18 nt, Homo sapiens
caaacucaacaagugcuc

SEQ ID NO: 1961767 - RNA, 14 nt, Homo sapiens
acuuaucuuacaaa

SEQ ID NO: 1961768 - RNA, 16 nt, Homo sapiens
guggaaaugacccaaa

SEQ ID NO: 1961769 - RNA, 17 nt, Homo sapiens
ccagcagcccaagcuua

SEQ ID NO: 1961770 - RNA, 14 nt, Homo sapiens
acacagggcacuga

SEQ ID NO: 1961771 - RNA, 14 nt, Homo sapiens
cuauuuaagugaaa

SEQ ID NO: 1961772 - RNA, 21 nt, Homo sapiens
ugcuugcaagggaccaugccg

SEQ ID NO: 1961773 - RNA, 18 nt, Homo sapiens
gacugauugauuauucaa

SEQ ID NO: 1961774 - RNA, 20 nt, Homo sapiens
gacccucugaaugguccagg

SEQ ID NO: 1961775 - RNA, 19 nt, Homo sapiens
acuuucccuugugucaaga

SEQ ID NO: 1961776 - RNA, 13 nt, Homo sapiens
accaugcagaaca

SEQ ID NO: 1961777 - RNA, 14 nt, Homo sapiens
ggaguugaaacugc

SEQ ID NO: 1961778 - RNA, 23 nt, Homo sapiens
auuucaguucaaucaaacuuuca

SEQ ID NO: 1961779 - RNA, 13 nt, Homo sapiens
uacuuuaaaggaa

SEQ ID NO: 1961780 - RNA, 21 nt, Homo sapiens
ucugaauugcacaugugagca

SEQ ID NO: 1961781 - RNA, 17 nt, Homo sapiens
ugaaucugaaagagcau

SEQ ID NO: 1961782 - RNA, 15 nt, Homo sapiens
acccaugccauagaa

SEQ ID NO: 1961783 - RNA, 15 nt, Homo sapiens
aucaccucaggccag

SEQ ID NO: 1961784 - RNA, 15 nt, Homo sapiens
ggcaccgcgugccau

SEQ ID NO: 1961785 - RNA, 15 nt, Homo sapiens
uuauuacauagcucu

SEQ ID NO: 1961786 - RNA, 22 nt, Homo sapiens
auuacuacaaauggaugacaca

SEQ ID NO: 1961787 - RNA, 18 nt, Homo sapiens
auuuagcccauaaucucu

SEQ ID NO: 1961788 - RNA, 14 nt, Homo sapiens
acuuguucauucug

SEQ ID NO: 1961789 - RNA, 16 nt, Homo sapiens
ggccacagccagggga

SEQ ID NO: 1961790 - RNA, 13 nt, Homo sapiens
auuuucaccucca

SEQ ID NO: 1961791 - RNA, 12 nt, Homo sapiens
aagcugcuccag

SEQ ID NO: 1961792 - RNA, 13 nt, Homo sapiens
cuccuucgcuuaa

SEQ ID NO: 1961793 - RNA, 14 nt, Homo sapiens
acacccuucuccca

SEQ ID NO: 1961794 - RNA, 23 nt, Homo sapiens
aaacuuucuccauuuaagacaca

SEQ ID NO: 1961795 - RNA, 21 nt, Homo sapiens
ucaugccuugagaucuguggu

SEQ ID NO: 1961796 - RNA, 21 nt, Homo sapiens
aggccccccagaaagcugcca

SEQ ID NO: 1961797 - RNA, 17 nt, Homo sapiens
gagauccuuuaaauccu

SEQ ID NO: 1961798 - RNA, 23 nt, Homo sapiens
cuaguaucacauagaagcugucc

SEQ ID NO: 1961799 - RNA, 17 nt, Homo sapiens
ugaggucuggcugcuug

SEQ ID NO: 1961800 - RNA, 23 nt, Homo sapiens
uggcugggagggggcccuuccag

SEQ ID NO: 1961801 - RNA, 21 nt, Homo sapiens
gccuggcuccccacgagucac

SEQ ID NO: 1961802 - RNA, 20 nt, Homo sapiens
cugagucuuucuuagauuaa

SEQ ID NO: 1961803 - RNA, 20 nt, Homo sapiens
auuuguauaaauaagcacua

SEQ ID NO: 1961804 - RNA, 18 nt, Homo sapiens
auucucacccugugaaac

SEQ ID NO: 1961805 - RNA, 18 nt, Homo sapiens
ccaccagccugcacuacu

SEQ ID NO: 1961806 - RNA, 23 nt, Homo sapiens
cugacauaugcuaacccccaaau

SEQ ID NO: 1961807 - RNA, 21 nt, Homo sapiens
aauauagaaaauaucuagccc

SEQ ID NO: 1961808 - RNA, 13 nt, Homo sapiens
ucauucagcagaa

SEQ ID NO: 1961809 - RNA, 20 nt, Homo sapiens
ugggaaacaaauaauuugaa

SEQ ID NO: 1961810 - RNA, 13 nt, Homo sapiens
aagcuaauuccac

SEQ ID NO: 1961811 - RNA, 14 nt, Homo sapiens
uccaccacaguaaa

SEQ ID NO: 1961812 - RNA, 16 nt, Homo sapiens
gcugggccccugcuca

SEQ ID NO: 1961813 - RNA, 18 nt, Homo sapiens
ucgcacccacugugaaag

SEQ ID NO: 1961814 - RNA, 14 nt, Homo sapiens
aagcagaugaacua

SEQ ID NO: 1961815 - RNA, 14 nt, Homo sapiens
cuacauaauuuaga

SEQ ID NO: 1961816 - RNA, 23 nt, Homo sapiens
uacaggacaaagggagggagcaa

SEQ ID NO: 1961817 - RNA, 20 nt, Homo sapiens
guaaauaugugacauuccug

SEQ ID NO: 1961818 - RNA, 13 nt, Homo sapiens
augcuauauugca

SEQ ID NO: 1961819 - RNA, 17 nt, Homo sapiens
aggauccccccaugccc

SEQ ID NO: 1961820 - RNA, 19 nt, Homo sapiens
ggaggaaauaaauugcaga

SEQ ID NO: 1961821 - RNA, 13 nt, Homo sapiens
uaaagcaucaucu

SEQ ID NO: 1961822 - RNA, 14 nt, Homo sapiens
caaggucuuugguu

SEQ ID NO: 1961823 - RNA, 18 nt, Homo sapiens
auccuaaggggagcuaca

SEQ ID NO: 1961824 - RNA, 23 nt, Homo sapiens
uuagaauugccuuaaggccacac

SEQ ID NO: 1961825 - RNA, 16 nt, Homo sapiens
aucccugccuguuaag

SEQ ID NO: 1961826 - RNA, 19 nt, Homo sapiens
cucagucugauuaauuugu

SEQ ID NO: 1961827 - RNA, 19 nt, Homo sapiens
ccaggcuuuguugcuuccg

SEQ ID NO: 1961828 - RNA, 14 nt, Homo sapiens
ccugcugcucucag

SEQ ID NO: 1961829 - RNA, 18 nt, Homo sapiens
cccagacuagauguagua

SEQ ID NO: 1961830 - RNA, 13 nt, Homo sapiens
ccaucaccucucu

SEQ ID NO: 1961831 - RNA, 17 nt, Homo sapiens
guucaugggcaccucau

SEQ ID NO: 1961832 - RNA, 15 nt, Homo sapiens
cccaacccaaugggc

SEQ ID NO: 1961833 - RNA, 21 nt, Homo sapiens
uguaaauuucucuacugucuc

SEQ ID NO: 1961834 - RNA, 18 nt, Homo sapiens
uuggaugauugugugacu

SEQ ID NO: 1961835 - RNA, 20 nt, Homo sapiens
uauuucuggagggcaauuug

SEQ ID NO: 1961836 - RNA, 14 nt, Homo sapiens
aaaagccucaucca

SEQ ID NO: 1961837 - RNA, 14 nt, Homo sapiens
cugcuccacugggu

SEQ ID NO: 1961838 - RNA, 19 nt, Homo sapiens
caaacaaugcauaggauuc

SEQ ID NO: 1961839 - RNA, 17 nt, Homo sapiens
ugcuucagacauguaau

SEQ ID NO: 1961840 - RNA, 16 nt, Homo sapiens
gccccaaccacaggaa

SEQ ID NO: 1961841 - RNA, 19 nt, Homo sapiens
agacaguauuuugacaaaa

SEQ ID NO: 1961842 - RNA, 18 nt, Homo sapiens
caugaaaaacaggugaca

SEQ ID NO: 1961843 - RNA, 21 nt, Homo sapiens
uguauauuaagguguggcuuu

SEQ ID NO: 1961844 - RNA, 19 nt, Homo sapiens
uauuggaaagugauuuuau

SEQ ID NO: 1961845 - RNA, 22 nt, Homo sapiens
cuaguuuaauuaacuaugugau

SEQ ID NO: 1961846 - RNA, 16 nt, Homo sapiens
auuguguaacuguucu

SEQ ID NO: 1961847 - RNA, 19 nt, Homo sapiens
ucuaaugugaaaaucauca

SEQ ID NO: 1961848 - RNA, 15 nt, Homo sapiens
agccacuaaaacaca

SEQ ID NO: 1961849 - RNA, 20 nt, Homo sapiens
agucgaauguuagauuccuc

SEQ ID NO: 1961850 - RNA, 21 nt, Homo sapiens
uugacacaacaucugagacac

SEQ ID NO: 1961851 - RNA, 15 nt, Homo sapiens
uauucaugaguauuc

SEQ ID NO: 1961852 - RNA, 20 nt, Homo sapiens
uuccccauugccuucugggg

SEQ ID NO: 1961853 - RNA, 19 nt, Homo sapiens
agccgcagacaaguaauca

SEQ ID NO: 1961854 - RNA, 16 nt, Homo sapiens
guucugccagaaccag

SEQ ID NO: 1961855 - RNA, 19 nt, Homo sapiens
uugacagcugucauauaau

SEQ ID NO: 1961856 - RNA, 21 nt, Homo sapiens
auuuggacuguuuuccuucaa

SEQ ID NO: 1961857 - RNA, 12 nt, Homo sapiens
ugcacacuugua

SEQ ID NO: 1961858 - RNA, 16 nt, Homo sapiens
aacguucugcugcuug

SEQ ID NO: 1961859 - RNA, 14 nt, Homo sapiens
cguacuugaacuca

SEQ ID NO: 1961860 - RNA, 13 nt, Homo sapiens
ggugagucugugu

SEQ ID NO: 1961861 - RNA, 15 nt, Homo sapiens
agagaguuugccacu

SEQ ID NO: 1961862 - RNA, 17 nt, Homo sapiens
aggcagauuucagggaa

SEQ ID NO: 1961863 - RNA, 23 nt, Homo sapiens
augccaaaaggauaaaugucuuu

SEQ ID NO: 1961864 - RNA, 15 nt, Homo sapiens
cuguucuucuaucca

SEQ ID NO: 1961865 - RNA, 13 nt, Homo sapiens
ccaaaagcacuua

SEQ ID NO: 1961866 - RNA, 13 nt, Homo sapiens
ccaauagcacuuu

SEQ ID NO: 1961867 - RNA, 16 nt, Homo sapiens
agagagugaggcauug

SEQ ID NO: 1961868 - RNA, 14 nt, Homo sapiens
ggagguauuugaaa

SEQ ID NO: 1961869 - RNA, 17 nt, Homo sapiens
ugaggacguggugacuu

SEQ ID NO: 1961870 - RNA, 15 nt, Homo sapiens
uauaguugcuaauua

SEQ ID NO: 1961871 - RNA, 22 nt, Homo sapiens
acuucacacacaccucauguga

SEQ ID NO: 1961872 - RNA, 21 nt, Homo sapiens
ggagugcccccaacagcaccc

SEQ ID NO: 1961873 - RNA, 20 nt, Homo sapiens
gcuggagugcggugguguga

SEQ ID NO: 1961874 - RNA, 15 nt, Homo sapiens
cuauucacuugcuga

SEQ ID NO: 1961875 - RNA, 15 nt, Homo sapiens
uaaggccuuggugcc

SEQ ID NO: 1961876 - RNA, 16 nt, Homo sapiens
ccaaagugucuuuuga

SEQ ID NO: 1961877 - RNA, 21 nt, Homo sapiens
gaaaggaagugggacuggcac

SEQ ID NO: 1961878 - RNA, 20 nt, Homo sapiens
ggauccagcuucacugucau

SEQ ID NO: 1961879 - RNA, 12 nt, Homo sapiens
caacacacauuu

SEQ ID NO: 1961880 - RNA, 13 nt, Homo sapiens
uucuuauuucagu

SEQ ID NO: 1961881 - RNA, 18 nt, Homo sapiens
aaaaucuaccuguuccug

SEQ ID NO: 1961882 - RNA, 12 nt, Homo sapiens
caucucagccua

SEQ ID NO: 1961883 - RNA, 21 nt, Homo sapiens
agggaugugagguucugcuga

SEQ ID NO: 1961884 - RNA, 10 nt, Homo sapiens
gcuguuauac

SEQ ID NO: 1961885 - RNA, 18 nt, Homo sapiens
cagcuccucuccagacac

SEQ ID NO: 1961886 - RNA, 18 nt, Homo sapiens
ugagccagucuaguuccu

SEQ ID NO: 1961887 - RNA, 22 nt, Homo sapiens
cauaaaaaccaaacccagacaa

SEQ ID NO: 1961888 - RNA, 18 nt, Homo sapiens
acacgcacuggugccaaa

SEQ ID NO: 1961889 - RNA, 20 nt, Homo sapiens
gagcaggggcauugcugauu

SEQ ID NO: 1961890 - RNA, 18 nt, Homo sapiens
caacaguuaaacuugcaa

SEQ ID NO: 1961891 - RNA, 15 nt, Homo sapiens
ggugagugcuuguca

SEQ ID NO: 1961892 - RNA, 21 nt, Homo sapiens
cuggguucaacucugcuccca

SEQ ID NO: 1961893 - RNA, 19 nt, Homo sapiens
ggcugagagaggaagagcu

SEQ ID NO: 1961894 - RNA, 10 nt, Homo sapiens
accuuuucau

SEQ ID NO: 1961895 - RNA, 20 nt, Homo sapiens
uacgguggucggugggaccc

SEQ ID NO: 1961896 - RNA, 18 nt, Homo sapiens
acuggaggcaaauuucag

SEQ ID NO: 1961897 - RNA, 21 nt, Homo sapiens
uccaauccucaggauuucauu

SEQ ID NO: 1961898 - RNA, 23 nt, Homo sapiens
caauugguaaaacucacugugau

SEQ ID NO: 1961899 - RNA, 14 nt, Homo sapiens
aggaagccgugccc

SEQ ID NO: 1961900 - RNA, 19 nt, Homo sapiens
uuacuauuuauuuacauau

SEQ ID NO: 1961901 - RNA, 14 nt, Homo sapiens
cucauacacagaaa

SEQ ID NO: 1961902 - RNA, 13 nt, Homo sapiens
auagaaagcuaua

SEQ ID NO: 1961903 - RNA, 19 nt, Homo sapiens
cuucuaauaaacagacugu

SEQ ID NO: 1961904 - RNA, 14 nt, Homo sapiens
gagcucagccgugc

SEQ ID NO: 1961905 - RNA, 20 nt, Homo sapiens
accuguguucuugcugagca

SEQ ID NO: 1961906 - RNA, 14 nt, Homo sapiens
aaaguaccagguga

SEQ ID NO: 1961907 - RNA, 14 nt, Homo sapiens
uucuaaaaguuuga

SEQ ID NO: 1961908 - RNA, 20 nt, Homo sapiens
cagcuucccgaguaacugag

SEQ ID NO: 1961909 - RNA, 17 nt, Homo sapiens
gacaagaauaauucaau

SEQ ID NO: 1961910 - RNA, 23 nt, Homo sapiens
caaauacaaaggaagaacaucug

SEQ ID NO: 1961911 - RNA, 13 nt, Homo sapiens
cgguuuucauuga

SEQ ID NO: 1961912 - RNA, 18 nt, Homo sapiens
gcccaauauaaaaggcaa

SEQ ID NO: 1961913 - RNA, 16 nt, Homo sapiens
aauaaaucaaauauuc

SEQ ID NO: 1961914 - RNA, 18 nt, Homo sapiens
cgaccccaucccuaucca

SEQ ID NO: 1961915 - RNA, 19 nt, Homo sapiens
ugcaagugugugcacaugu

SEQ ID NO: 1961916 - RNA, 12 nt, Homo sapiens
aaggcaaggaac

SEQ ID NO: 1961917 - RNA, 13 nt, Homo sapiens
auauuaaaccucu

SEQ ID NO: 1961918 - RNA, 22 nt, Homo sapiens
caauaugccuaguuucuuacac

SEQ ID NO: 1961919 - RNA, 11 nt, Homo sapiens
caacauggcaa

SEQ ID NO: 1961920 - RNA, 11 nt, Homo sapiens
caccauggcac

SEQ ID NO: 1961921 - RNA, 20 nt, Homo sapiens
gaagauccuaaaacaaaagc

SEQ ID NO: 1961922 - RNA, 19 nt, Homo sapiens
gaauguuugucucauccca

SEQ ID NO: 1961923 - RNA, 15 nt, Homo sapiens
accagcaccgugaca

SEQ ID NO: 1961924 - RNA, 17 nt, Homo sapiens
ccucccaggaaccaaaa

SEQ ID NO: 1961925 - RNA, 21 nt, Homo sapiens
uaaggacauuaaaagcuauca

SEQ ID NO: 1961926 - RNA, 14 nt, Homo sapiens
cuagccaaaccuca

SEQ ID NO: 1961927 - RNA, 13 nt, Homo sapiens
cugaacacuccaa

SEQ ID NO: 1961928 - RNA, 20 nt, Homo sapiens
augccaccuucagauccuuu

SEQ ID NO: 1961929 - RNA, 21 nt, Homo sapiens
guaguuuaguacaauaaucuc

SEQ ID NO: 1961930 - RNA, 15 nt, Homo sapiens
accucaaaugaauuc

SEQ ID NO: 1961931 - RNA, 13 nt, Homo sapiens
aaagaugaugcuc

SEQ ID NO: 1961932 - RNA, 14 nt, Homo sapiens
ugauuuaugaauua

SEQ ID NO: 1961933 - RNA, 20 nt, Homo sapiens
uuaauuuauugaggcuuuaa

SEQ ID NO: 1961934 - RNA, 18 nt, Homo sapiens
uauguuacuacaugcacu

SEQ ID NO: 1961935 - RNA, 20 nt, Homo sapiens
acucauaauagacuucccac

SEQ ID NO: 1961936 - RNA, 19 nt, Homo sapiens
gaguguccuuaguguauaa

SEQ ID NO: 1961937 - RNA, 19 nt, Homo sapiens
gauuacagacaugagccac

SEQ ID NO: 1961938 - RNA, 13 nt, Homo sapiens
acaauauggccau

SEQ ID NO: 1961939 - RNA, 19 nt, Homo sapiens
auuaugugaauuuugccau

SEQ ID NO: 1961940 - RNA, 20 nt, Homo sapiens
ccccacacaggccuggccca

SEQ ID NO: 1961941 - RNA, 21 nt, Homo sapiens
guccaagucuucucaagaucc

SEQ ID NO: 1961942 - RNA, 23 nt, Homo sapiens
aacgcgacuuccacaaaccugga

SEQ ID NO: 1961943 - RNA, 17 nt, Homo sapiens
ugugauccuucaucgaa

SEQ ID NO: 1961944 - RNA, 21 nt, Homo sapiens
uccagcuuagaaugcaucuca

SEQ ID NO: 1961945 - RNA, 22 nt, Homo sapiens
uauauguugaauguuaacaggu

SEQ ID NO: 1961946 - RNA, 15 nt, Homo sapiens
cccuggcagugcuga

SEQ ID NO: 1961947 - RNA, 22 nt, Homo sapiens
ggaauaaauugcuccuugacau

SEQ ID NO: 1961948 - RNA, 19 nt, Homo sapiens
auguuuagaaaaguauucg

SEQ ID NO: 1961949 - RNA, 21 nt, Homo sapiens
cucccugcuuaaaaauguagc

SEQ ID NO: 1961950 - RNA, 23 nt, Homo sapiens
gaagcccuguucucguugcccua

SEQ ID NO: 1961951 - RNA, 19 nt, Homo sapiens
uaaucaagaaaagaauuac

SEQ ID NO: 1961952 - RNA, 22 nt, Homo sapiens
aagagacaauaacuuugaaccu

SEQ ID NO: 1961953 - RNA, 17 nt, Homo sapiens
uccaucacccaucucac

SEQ ID NO: 1961954 - RNA, 15 nt, Homo sapiens
uucaaaauguuaaca

SEQ ID NO: 1961955 - RNA, 15 nt, Homo sapiens
gguaacuuugcaaau

SEQ ID NO: 1961956 - RNA, 16 nt, Homo sapiens
ccucuguuuuccagaa

SEQ ID NO: 1961957 - RNA, 17 nt, Homo sapiens
gaacuguauuauugcaa

SEQ ID NO: 1961958 - RNA, 23 nt, Homo sapiens
aagggggugcaaagacucugagc

SEQ ID NO: 1961959 - RNA, 19 nt, Homo sapiens
ucaaaaaggccaacacaac

SEQ ID NO: 1961960 - RNA, 14 nt, Homo sapiens
ucacuaaauguaaa

SEQ ID NO: 1961961 - RNA, 20 nt, Homo sapiens
gcaguggcucaugcccauaa

SEQ ID NO: 1961962 - RNA, 16 nt, Homo sapiens
gucuguuagccaugug

SEQ ID NO: 1961963 - RNA, 23 nt, Homo sapiens
agccuucaaauuauaaaccaagg

SEQ ID NO: 1961964 - RNA, 14 nt, Homo sapiens
uggucgagugacac

SEQ ID NO: 1961965 - RNA, 17 nt, Homo sapiens
ucuccccagauauggac

SEQ ID NO: 1961966 - RNA, 21 nt, Homo sapiens
ccaagcuuguuaucagcuuuc

SEQ ID NO: 1961967 - RNA, 16 nt, Homo sapiens
cccuguccccugaaaa

SEQ ID NO: 1961968 - RNA, 19 nt, Homo sapiens
aagaguuucuccuuuugac

SEQ ID NO: 1961969 - RNA, 14 nt, Homo sapiens
aagagcccugucag

SEQ ID NO: 1961970 - RNA, 21 nt, Homo sapiens
aucuuucugcuccugaucaga

SEQ ID NO: 1961971 - RNA, 12 nt, Homo sapiens
acaggauuucac

SEQ ID NO: 1961972 - RNA, 19 nt, Homo sapiens
uaacauuagcuaaaacugc

SEQ ID NO: 1961973 - RNA, 21 nt, Homo sapiens
aaaguucuuaggcaccauaga

SEQ ID NO: 1961974 - RNA, 16 nt, Homo sapiens
cggcagucacuuccac

SEQ ID NO: 1961975 - RNA, 19 nt, Homo sapiens
uauuuuggauuagugaacu

SEQ ID NO: 1961976 - RNA, 15 nt, Homo sapiens
ugguggaggagcuga

SEQ ID NO: 1961977 - RNA, 18 nt, Homo sapiens
ucgcccuacucaccugag

SEQ ID NO: 1961978 - RNA, 18 nt, Homo sapiens
aggccugauucacuggcc

SEQ ID NO: 1961979 - RNA, 18 nt, Homo sapiens
ugcuugaaaaaugugcaa

SEQ ID NO: 1961980 - RNA, 18 nt, Homo sapiens
aucugagaaaagcuuuga

SEQ ID NO: 1961981 - RNA, 22 nt, Homo sapiens
auguccagaaauugugugugca

SEQ ID NO: 1961982 - RNA, 14 nt, Homo sapiens
guuaaugugccaaa

SEQ ID NO: 1961983 - RNA, 17 nt, Homo sapiens
gaauaccacuuaccuca

SEQ ID NO: 1961984 - RNA, 23 nt, Homo sapiens
ucagaaaagaugugcagauauca

SEQ ID NO: 1961985 - RNA, 21 nt, Homo sapiens
ugauacuguacauagcuguuu

SEQ ID NO: 1961986 - RNA, 16 nt, Homo sapiens
aaaugcaaaguucugu

SEQ ID NO: 1961987 - RNA, 15 nt, Homo sapiens
cccaggcugggaacu

SEQ ID NO: 1961988 - RNA, 20 nt, Homo sapiens
cugacaauuugugauaucua

SEQ ID NO: 1961989 - RNA, 17 nt, Homo sapiens
guccauuguccaauccu

SEQ ID NO: 1961990 - RNA, 20 nt, Homo sapiens
agcuggugguaucugaguug

SEQ ID NO: 1961991 - RNA, 14 nt, Homo sapiens
cauuccagcucucc

SEQ ID NO: 1961992 - RNA, 21 nt, Homo sapiens
accucaucuguggagcugcca

SEQ ID NO: 1961993 - RNA, 18 nt, Homo sapiens
auauuugcugagugaaug

SEQ ID NO: 1961994 - RNA, 20 nt, Homo sapiens
agugagccaucaucauggca

SEQ ID NO: 1961995 - RNA, 21 nt, Homo sapiens
acuggaguuuuggacuggaua

SEQ ID NO: 1961996 - RNA, 13 nt, Homo sapiens
gaccuuaagacag

SEQ ID NO: 1961997 - RNA, 21 nt, Homo sapiens
gugacagccccuuauuugcac

SEQ ID NO: 1961998 - RNA, 18 nt, Homo sapiens
ccuugcccccauuucacc

SEQ ID NO: 1961999 - RNA, 20 nt, Homo sapiens
ugacaaaauugugaaguuaa

SEQ ID NO: 1962000 - RNA, 23 nt, Homo sapiens
ccugcgcccaccccgcucugcau

SEQ ID NO: 1962001 - RNA, 14 nt, Homo sapiens
ccacgacaaagcag

SEQ ID NO: 1962002 - RNA, 15 nt, Homo sapiens
gccuugucauuuuau

SEQ ID NO: 1962003 - RNA, 19 nt, Homo sapiens
uccagauggagaaacaggc

SEQ ID NO: 1962004 - RNA, 13 nt, Homo sapiens
acucaccauagag

SEQ ID NO: 1962005 - RNA, 19 nt, Homo sapiens
gacaguguguccaguuacc

SEQ ID NO: 1962006 - RNA, 19 nt, Homo sapiens
uaggaaagagaagcuuuca

SEQ ID NO: 1962007 - RNA, 17 nt, Homo sapiens
agcugcauggagccugg

SEQ ID NO: 1962008 - RNA, 21 nt, Homo sapiens
agcaccuuugagccuuggccc

SEQ ID NO: 1962009 - RNA, 14 nt, Homo sapiens
acaaugcaugccca

SEQ ID NO: 1962010 - RNA, 22 nt, Homo sapiens
caacaaagugcuuccuuuucag

SEQ ID NO: 1962011 - RNA, 13 nt, Homo sapiens
ugugguacaagca

SEQ ID NO: 1962012 - RNA, 21 nt, Homo sapiens
cagagacccagaucucaugga

SEQ ID NO: 1962013 - RNA, 13 nt, Homo sapiens
gaucuggcuguga

SEQ ID NO: 1962014 - RNA, 23 nt, Homo sapiens
auaacuucagugcaagagacuuu

SEQ ID NO: 1962015 - RNA, 12 nt, Homo sapiens
cacugcucugcc

SEQ ID NO: 1962016 - RNA, 19 nt, Homo sapiens
aaacauuacuguuuuccau

SEQ ID NO: 1962017 - RNA, 12 nt, Homo sapiens
gcuguuaaccaa

SEQ ID NO: 1962018 - RNA, 12 nt, Homo sapiens
agagccaaacag

SEQ ID NO: 1962019 - RNA, 12 nt, Homo sapiens
accuccaaagcu

SEQ ID NO: 1962020 - RNA, 14 nt, Homo sapiens
uggaaagaaagggc

SEQ ID NO: 1962021 - RNA, 19 nt, Homo sapiens
aauccugaaagggcacuua

SEQ ID NO: 1962022 - RNA, 19 nt, Homo sapiens
cauguagguguuuguucau

SEQ ID NO: 1962023 - RNA, 19 nt, Homo sapiens
ugucucaggaaaacagcua

SEQ ID NO: 1962024 - RNA, 16 nt, Homo sapiens
gagaacuucucuuccc

SEQ ID NO: 1962025 - RNA, 23 nt, Homo sapiens
guagaaagauccuucgggugcug

SEQ ID NO: 1962026 - RNA, 15 nt, Homo sapiens
accucacucuugcca

SEQ ID NO: 1962027 - RNA, 18 nt, Homo sapiens
cuggcucccucacucuca

SEQ ID NO: 1962028 - RNA, 19 nt, Homo sapiens
aaccuguuauuucuaugaa

SEQ ID NO: 1962029 - RNA, 16 nt, Homo sapiens
ucaguuccaaacagac

SEQ ID NO: 1962030 - RNA, 20 nt, Homo sapiens
gugccccacaaaacuucagu

SEQ ID NO: 1962031 - RNA, 15 nt, Homo sapiens
ugaauagagccugau

SEQ ID NO: 1962032 - RNA, 21 nt, Homo sapiens
ucucaggcgcaugugccaguu

SEQ ID NO: 1962033 - RNA, 20 nt, Homo sapiens
ugacaaaagaaaauuuucca

SEQ ID NO: 1962034 - RNA, 11 nt, Homo sapiens
uuuauaugauu

SEQ ID NO: 1962035 - RNA, 16 nt, Homo sapiens
ucccugcucgcugaca

SEQ ID NO: 1962036 - RNA, 13 nt, Homo sapiens
gcuggacugacca

SEQ ID NO: 1962037 - RNA, 13 nt, Homo sapiens
gccucagggccca

SEQ ID NO: 1962038 - RNA, 19 nt, Homo sapiens
uuugugaaguauucacaaa

SEQ ID NO: 1962039 - RNA, 17 nt, Homo sapiens
gcucuucagaggagcau

SEQ ID NO: 1962040 - RNA, 17 nt, Homo sapiens
aauugagaaacaugaau

SEQ ID NO: 1962041 - RNA, 17 nt, Homo sapiens
aguccugacacuauuca

SEQ ID NO: 1962042 - RNA, 14 nt, Homo sapiens
ccaggugcugugac

SEQ ID NO: 1962043 - RNA, 21 nt, Homo sapiens
auauuuuaaauaucuuucaug

SEQ ID NO: 1962044 - RNA, 17 nt, Homo sapiens
uaacacugcuaaugaaa

SEQ ID NO: 1962045 - RNA, 21 nt, Homo sapiens
cagaaaucugcugcauuucac

SEQ ID NO: 1962046 - RNA, 18 nt, Homo sapiens
auucugagccacacugaa

SEQ ID NO: 1962047 - RNA, 13 nt, Homo sapiens
ggccaucacagga

SEQ ID NO: 1962048 - RNA, 19 nt, Homo sapiens
caggagguaaagaaauagc

SEQ ID NO: 1962049 - RNA, 14 nt, Homo sapiens
ccucuggacuggcc

SEQ ID NO: 1962050 - RNA, 18 nt, Homo sapiens
aauucuuuuccugaagaa

SEQ ID NO: 1962051 - RNA, 15 nt, Homo sapiens
gaaggaaccaaagcg

SEQ ID NO: 1962052 - RNA, 18 nt, Homo sapiens
aaccuugucucuaugcca

SEQ ID NO: 1962053 - RNA, 11 nt, Homo sapiens
ucagacuugcc

SEQ ID NO: 1962054 - RNA, 14 nt, Homo sapiens
aucaaaauugccuu

SEQ ID NO: 1962055 - RNA, 20 nt, Homo sapiens
acucaaaagacaaacaugca

SEQ ID NO: 1962056 - RNA, 20 nt, Homo sapiens
augguccaggaucuccacug

SEQ ID NO: 1962057 - RNA, 12 nt, Homo sapiens
ugggguucucag

SEQ ID NO: 1962058 - RNA, 15 nt, Homo sapiens
uagugccaccacagc

SEQ ID NO: 1962059 - RNA, 18 nt, Homo sapiens
acugugugugaaucugcu

SEQ ID NO: 1962060 - RNA, 22 nt, Homo sapiens
ucaagccagcccccuccagcuc

SEQ ID NO: 1962061 - RNA, 15 nt, Homo sapiens
cucuggcccaggcua

SEQ ID NO: 1962062 - RNA, 17 nt, Homo sapiens
cauguuuccaccaaaug

SEQ ID NO: 1962063 - RNA, 21 nt, Homo sapiens
uacaaauuuucacugcugcuc

SEQ ID NO: 1962064 - RNA, 16 nt, Homo sapiens
ucacauucauugcagu

SEQ ID NO: 1962065 - RNA, 22 nt, Homo sapiens
gucaacauccauaacucuguau

SEQ ID NO: 1962066 - RNA, 16 nt, Homo sapiens
auuuccucaucugggu

SEQ ID NO: 1962067 - RNA, 21 nt, Homo sapiens
aucccugaaggccuucaaccc

SEQ ID NO: 1962068 - RNA, 15 nt, Homo sapiens
gaguugguuacuuca

SEQ ID NO: 1962069 - RNA, 15 nt, Homo sapiens
gaugggcagcagcuu

SEQ ID NO: 1962070 - RNA, 13 nt, Homo sapiens
ccagacacugccu

SEQ ID NO: 1962071 - RNA, 19 nt, Homo sapiens
acuauugugaccacaggcu

SEQ ID NO: 1962072 - RNA, 15 nt, Homo sapiens
uuaguauaauauuuc

SEQ ID NO: 1962073 - RNA, 15 nt, Homo sapiens
cucuucuuccucacc

SEQ ID NO: 1962074 - RNA, 13 nt, Homo sapiens
gucgugcagucag

SEQ ID NO: 1962075 - RNA, 15 nt, Homo sapiens
gacccuucccuugag

SEQ ID NO: 1962076 - RNA, 13 nt, Homo sapiens
uauugcugugaau

SEQ ID NO: 1962077 - RNA, 17 nt, Homo sapiens
aaauauuagugcaguua

SEQ ID NO: 1962078 - RNA, 15 nt, Homo sapiens
ucacaaaaugucuca

SEQ ID NO: 1962079 - RNA, 14 nt, Homo sapiens
ggucacacaaaggc

SEQ ID NO: 1962080 - RNA, 11 nt, Homo sapiens
caguucagcuu

SEQ ID NO: 1962081 - RNA, 17 nt, Homo sapiens
accacaggccugagcca

SEQ ID NO: 1962082 - RNA, 17 nt, Homo sapiens
agauacauacagaauua

SEQ ID NO: 1962083 - RNA, 17 nt, Homo sapiens
cucccaccccagggauu

SEQ ID NO: 1962084 - RNA, 15 nt, Homo sapiens
auaaucugaugauau

SEQ ID NO: 1962085 - RNA, 22 nt, Homo sapiens
cauuuuuauuuuauggaauaga

SEQ ID NO: 1962086 - RNA, 14 nt, Homo sapiens
gucucucuucugcu

SEQ ID NO: 1962087 - RNA, 15 nt, Homo sapiens
gcugcugcacugccc

SEQ ID NO: 1962088 - RNA, 16 nt, Homo sapiens
uugacugagacuggaa

SEQ ID NO: 1962089 - RNA, 23 nt, Homo sapiens
cagccaccaagaaguggcugcca

SEQ ID NO: 1962090 - RNA, 13 nt, Homo sapiens
ccuaggugcucau

SEQ ID NO: 1962091 - RNA, 13 nt, Homo sapiens
cucgugugccugg

SEQ ID NO: 1962092 - RNA, 20 nt, Homo sapiens
ucuacuaaaaauacaaaagu

SEQ ID NO: 1962093 - RNA, 13 nt, Homo sapiens
gucagcuguuacu

SEQ ID NO: 1962094 - RNA, 11 nt, Homo sapiens
uaguaggagcu

SEQ ID NO: 1962095 - RNA, 23 nt, Homo sapiens
ggcuuccaucaaaccuuugccaa

SEQ ID NO: 1962096 - RNA, 16 nt, Homo sapiens
augauuguaacauauu

SEQ ID NO: 1962097 - RNA, 22 nt, Homo sapiens
gcucuguauauauauauacuua

SEQ ID NO: 1962098 - RNA, 16 nt, Homo sapiens
gagaagauucaauuua

SEQ ID NO: 1962099 - RNA, 12 nt, Homo sapiens
aaauaacacugu

SEQ ID NO: 1962100 - RNA, 18 nt, Homo sapiens
uuugaaguggccagauga

SEQ ID NO: 1962101 - RNA, 12 nt, Homo sapiens
cauuguuuauug

SEQ ID NO: 1962102 - RNA, 23 nt, Homo sapiens
ugggggugccgcugucucugagg

SEQ ID NO: 1962103 - RNA, 15 nt, Homo sapiens
aguggagacaguccu

SEQ ID NO: 1962104 - RNA, 18 nt, Homo sapiens
ucaaaaccucaaauccac

SEQ ID NO: 1962105 - RNA, 18 nt, Homo sapiens
aauuaaguaaaccaaaaa

SEQ ID NO: 1962106 - RNA, 22 nt, Homo sapiens
agcuaugaaggcuguacacugc

SEQ ID NO: 1962107 - RNA, 19 nt, Homo sapiens
caagauuaugugacuugca

SEQ ID NO: 1962108 - RNA, 18 nt, Homo sapiens
agguggccacagugucac

SEQ ID NO: 1962109 - RNA, 18 nt, Homo sapiens
auucuuauuucacuaaau

SEQ ID NO: 1962110 - RNA, 12 nt, Homo sapiens
uuucccagugaa

SEQ ID NO: 1962111 - RNA, 17 nt, Homo sapiens
accaaggagaugaagca

SEQ ID NO: 1962112 - RNA, 15 nt, Homo sapiens
gacugaauaaccacu

SEQ ID NO: 1962113 - RNA, 17 nt, Homo sapiens
caggcuacugucagcuc

SEQ ID NO: 1962114 - RNA, 13 nt, Homo sapiens
caacuuucuuaca

SEQ ID NO: 1962115 - RNA, 13 nt, Homo sapiens
uauauuuccuuaa

SEQ ID NO: 1962116 - RNA, 20 nt, Homo sapiens
auguuggacucugagcucau

SEQ ID NO: 1962117 - RNA, 13 nt, Homo sapiens
uaccugagcauuc

SEQ ID NO: 1962118 - RNA, 11 nt, Homo sapiens
aaaccaugacg

SEQ ID NO: 1962119 - RNA, 21 nt, Homo sapiens
uaaauguauuuaauuccauau

SEQ ID NO: 1962120 - RNA, 16 nt, Homo sapiens
cucucuauaccaaaga

SEQ ID NO: 1962121 - RNA, 17 nt, Homo sapiens
ccagaggaaacuugcau

SEQ ID NO: 1962122 - RNA, 18 nt, Homo sapiens
ugcucuuuuauacuguac

SEQ ID NO: 1962123 - RNA, 21 nt, Homo sapiens
ugaacaaacuuagaaagggaa

SEQ ID NO: 1962124 - RNA, 16 nt, Homo sapiens
accccaggcagcuccu

SEQ ID NO: 1962125 - RNA, 16 nt, Homo sapiens
auggcaucagcacuuu

SEQ ID NO: 1962126 - RNA, 16 nt, Homo sapiens
uggccacacugugaca

SEQ ID NO: 1962127 - RNA, 16 nt, Homo sapiens
ugcuggaacacagggg

SEQ ID NO: 1962128 - RNA, 21 nt, Homo sapiens
uaccugugaaucauauguugu

SEQ ID NO: 1962129 - RNA, 19 nt, Homo sapiens
agagcuuuacagugccacg

SEQ ID NO: 1962130 - RNA, 17 nt, Homo sapiens
aauaaguccacaucuuc

SEQ ID NO: 1962131 - RNA, 15 nt, Homo sapiens
gcugagggucuggga

SEQ ID NO: 1962132 - RNA, 14 nt, Homo sapiens
ccaacauguaucug

SEQ ID NO: 1962133 - RNA, 21 nt, Homo sapiens
cgccugacagcauaccucaaa

SEQ ID NO: 1962134 - RNA, 13 nt, Homo sapiens
guaaauggaacaa

SEQ ID NO: 1962135 - RNA, 17 nt, Homo sapiens
aauuuuugaucaaugua

SEQ ID NO: 1962136 - RNA, 16 nt, Homo sapiens
caaggagacugcauuc

SEQ ID NO: 1962137 - RNA, 21 nt, Homo sapiens
gagucauggcuaauuuaacac

SEQ ID NO: 1962138 - RNA, 19 nt, Homo sapiens
uuagggcuacccaaaacag

SEQ ID NO: 1962139 - RNA, 22 nt, Homo sapiens
aaaagauucccacccaauucaa

SEQ ID NO: 1962140 - RNA, 21 nt, Homo sapiens
uauauuguaagaaauacugua

SEQ ID NO: 1962141 - RNA, 17 nt, Homo sapiens
ugucccugaagugccag

SEQ ID NO: 1962142 - RNA, 18 nt, Homo sapiens
cuccaccaagccugguca

SEQ ID NO: 1962143 - RNA, 17 nt, Homo sapiens
aagagcguuacuguaga

SEQ ID NO: 1962144 - RNA, 14 nt, Homo sapiens
uuucuccagguuug

SEQ ID NO: 1962145 - RNA, 14 nt, Homo sapiens
cuuuauuguucaca

SEQ ID NO: 1962146 - RNA, 15 nt, Homo sapiens
aguucucccagggag

SEQ ID NO: 1962147 - RNA, 22 nt, Homo sapiens
ccagccuggccaguauggugaa

SEQ ID NO: 1962148 - RNA, 19 nt, Homo sapiens
augaggccuacucuaaaga

SEQ ID NO: 1962149 - RNA, 18 nt, Homo sapiens
cagucucacccacuagga

SEQ ID NO: 1962150 - RNA, 21 nt, Homo sapiens
caaaaguggggcuaaaugaag

SEQ ID NO: 1962151 - RNA, 17 nt, Homo sapiens
uguuuuuuaaagcaagu

SEQ ID NO: 1962152 - RNA, 23 nt, Homo sapiens
uaaaauuggauuauuacuacaaa

SEQ ID NO: 1962153 - RNA, 18 nt, Homo sapiens
gauuucuucgcugcucua

SEQ ID NO: 1962154 - RNA, 17 nt, Homo sapiens
uaaauacgaaacucgag

SEQ ID NO: 1962155 - RNA, 16 nt, Homo sapiens
gaaccugacaaaaaca

SEQ ID NO: 1962156 - RNA, 14 nt, Homo sapiens
auuuccacaccaag

SEQ ID NO: 1962157 - RNA, 15 nt, Homo sapiens
cuguuuccugggcac

SEQ ID NO: 1962158 - RNA, 22 nt, Homo sapiens
ggaaaucaaaagggccaaagaa

SEQ ID NO: 1962159 - RNA, 21 nt, Homo sapiens
gaaugagaagaggcugcugca

SEQ ID NO: 1962160 - RNA, 23 nt, Homo sapiens
caacuuguaacucuaugaacuua

SEQ ID NO: 1962161 - RNA, 16 nt, Homo sapiens
ugaaugcauucagggg

SEQ ID NO: 1962162 - RNA, 23 nt, Homo sapiens
auagucauguuucugcaguauuc

SEQ ID NO: 1962163 - RNA, 17 nt, Homo sapiens
uaauguaauaaagugaa

SEQ ID NO: 1962164 - RNA, 17 nt, Homo sapiens
auaauuacauauuugca

SEQ ID NO: 1962165 - RNA, 23 nt, Homo sapiens
uugugaagguggaaauaaacuau

SEQ ID NO: 1962166 - RNA, 18 nt, Homo sapiens
aucacugaacaaacuaaa

SEQ ID NO: 1962167 - RNA, 15 nt, Homo sapiens
uggcucuucagagga

SEQ ID NO: 1962168 - RNA, 21 nt, Homo sapiens
agggauccccaggaggccugg

SEQ ID NO: 1962169 - RNA, 12 nt, Homo sapiens
gccaggugcuuu

SEQ ID NO: 1962170 - RNA, 15 nt, Homo sapiens
ugcccuuucccugca

SEQ ID NO: 1962171 - RNA, 18 nt, Homo sapiens
ugccagggccaugucaga

SEQ ID NO: 1962172 - RNA, 19 nt, Homo sapiens
uagucuguaauacacucca

SEQ ID NO: 1962173 - RNA, 13 nt, Homo sapiens
aucagucugagag

SEQ ID NO: 1962174 - RNA, 15 nt, Homo sapiens
ccagugggcagugca

SEQ ID NO: 1962175 - RNA, 16 nt, Homo sapiens
uaaaguacuacaucag

SEQ ID NO: 1962176 - RNA, 12 nt, Homo sapiens
gaaaacauuguu

SEQ ID NO: 1962177 - RNA, 20 nt, Homo sapiens
aaaacuaauuuccucugaca

SEQ ID NO: 1962178 - RNA, 17 nt, Homo sapiens
cccuggcuacaugguca

SEQ ID NO: 1962179 - RNA, 18 nt, Homo sapiens
uauguuguugcuuguaua

SEQ ID NO: 1962180 - RNA, 15 nt, Homo sapiens
cuaucccugcacaua

SEQ ID NO: 1962181 - RNA, 17 nt, Homo sapiens
ugagucagguuugagua

SEQ ID NO: 1962182 - RNA, 16 nt, Homo sapiens
ucaggagaccuagguu

SEQ ID NO: 1962183 - RNA, 13 nt, Homo sapiens
caaaugucccugc

SEQ ID NO: 1962184 - RNA, 12 nt, Homo sapiens
acaaaugcaggg

SEQ ID NO: 1962185 - RNA, 19 nt, Homo sapiens
ggagguggcuggguuuaca

SEQ ID NO: 1962186 - RNA, 21 nt, Homo sapiens
aagaugcgcaggcugaucacc

SEQ ID NO: 1962187 - RNA, 23 nt, Homo sapiens
gauauauuuuccagggcaaucaa

SEQ ID NO: 1962188 - RNA, 21 nt, Homo sapiens
gaaagaccaugugguuugcug

SEQ ID NO: 1962189 - RNA, 12 nt, Homo sapiens
cuagcauuguaa

SEQ ID NO: 1962190 - RNA, 23 nt, Homo sapiens
ugaggccaaauauugaucuguau

SEQ ID NO: 1962191 - RNA, 12 nt, Homo sapiens
ucccacuggaag

SEQ ID NO: 1962192 - RNA, 21 nt, Homo sapiens
uggcuaaagagcuuugugaua

SEQ ID NO: 1962193 - RNA, 14 nt, Homo sapiens
ugcuaccccuuuga

SEQ ID NO: 1962194 - RNA, 19 nt, Homo sapiens
cuggugaccagcaccaucu

SEQ ID NO: 1962195 - RNA, 12 nt, Homo sapiens
auuccucugucc

SEQ ID NO: 1962196 - RNA, 19 nt, Homo sapiens
cucuaguaagaugcacuga

SEQ ID NO: 1962197 - RNA, 19 nt, Homo sapiens
uccgccaauggcuuccagc

SEQ ID NO: 1962198 - RNA, 20 nt, Homo sapiens
caagaauuaaucaagacucu

SEQ ID NO: 1962199 - RNA, 18 nt, Homo sapiens
caacagauccgacuuugg

SEQ ID NO: 1962200 - RNA, 12 nt, Homo sapiens
gaccaugcugcc

SEQ ID NO: 1962201 - RNA, 14 nt, Homo sapiens
acuuaucuugcucu

SEQ ID NO: 1962202 - RNA, 19 nt, Homo sapiens
acaagcagucuuuuucuac

SEQ ID NO: 1962203 - RNA, 21 nt, Homo sapiens
aagccaggguccugaguggcu

SEQ ID NO: 1962204 - RNA, 18 nt, Homo sapiens
acaugcuuagcuuaucuu

SEQ ID NO: 1962205 - RNA, 20 nt, Homo sapiens
ccugcagagcuuuggccauu

SEQ ID NO: 1962206 - RNA, 20 nt, Homo sapiens
gcugugcccacacacaccca

SEQ ID NO: 1962207 - RNA, 18 nt, Homo sapiens
gggacagggcucgccuca

SEQ ID NO: 1962208 - RNA, 16 nt, Homo sapiens
aagaagaguuugcaaa

SEQ ID NO: 1962209 - RNA, 15 nt, Homo sapiens
ccuuaagugcugcag

SEQ ID NO: 1962210 - RNA, 21 nt, Homo sapiens
cuagugccugagaugcacgau

SEQ ID NO: 1962211 - RNA, 19 nt, Homo sapiens
aagguggaacaagcacaga

SEQ ID NO: 1962212 - RNA, 23 nt, Homo sapiens
ccuuuccagaguccuccuuugcc

SEQ ID NO: 1962213 - RNA, 13 nt, Homo sapiens
aaggcaaaaagca

SEQ ID NO: 1962214 - RNA, 19 nt, Homo sapiens
cggccacacuguacucugc

SEQ ID NO: 1962215 - RNA, 17 nt, Homo sapiens
ccauuauuaugcaaaau

SEQ ID NO: 1962216 - RNA, 21 nt, Homo sapiens
gcucagaacaguaucuuugca

SEQ ID NO: 1962217 - RNA, 21 nt, Homo sapiens
ugaaauuuucuagacuuucug

SEQ ID NO: 1962218 - RNA, 16 nt, Homo sapiens
auggcuauaggugcua

SEQ ID NO: 1962219 - RNA, 19 nt, Homo sapiens
acauuuuucacuuuugcua

SEQ ID NO: 1962220 - RNA, 13 nt, Homo sapiens
cacuacucaguga

SEQ ID NO: 1962221 - RNA, 17 nt, Homo sapiens
ggccacagcaggacuga

SEQ ID NO: 1962222 - RNA, 17 nt, Homo sapiens
gaggucgggauggggcu

SEQ ID NO: 1962223 - RNA, 23 nt, Homo sapiens
agaggacugguucugaggccaga

SEQ ID NO: 1962224 - RNA, 20 nt, Homo sapiens
gauuaacccuauuaaucuau

SEQ ID NO: 1962225 - RNA, 14 nt, Homo sapiens
aguuuugccuuaaa

SEQ ID NO: 1962226 - RNA, 15 nt, Homo sapiens
uagacucacauuuac

SEQ ID NO: 1962227 - RNA, 17 nt, Homo sapiens
ugccaaccucacugaca

SEQ ID NO: 1962228 - RNA, 10 nt, Homo sapiens
uuuacuguug

SEQ ID NO: 1962229 - RNA, 19 nt, Homo sapiens
augcuggacugcauucaca

SEQ ID NO: 1962230 - RNA, 19 nt, Homo sapiens
uacuaaacuucaccuacau

SEQ ID NO: 1962231 - RNA, 15 nt, Homo sapiens
cuauaauacuugcaa

SEQ ID NO: 1962232 - RNA, 15 nt, Homo sapiens
ugaauuuacauauag

SEQ ID NO: 1962233 - RNA, 14 nt, Homo sapiens
auuucacugugaug

SEQ ID NO: 1962234 - RNA, 22 nt, Homo sapiens
aagcagugcaugcugucccuua

SEQ ID NO: 1962235 - RNA, 21 nt, Homo sapiens
auacuagauuccacagggaaa

SEQ ID NO: 1962236 - RNA, 22 nt, Homo sapiens
cuguagaaugauuucaugcuau

SEQ ID NO: 1962237 - RNA, 18 nt, Homo sapiens
uucccaaauuucauaccu

SEQ ID NO: 1962238 - RNA, 13 nt, Homo sapiens
gccucgacacaga

SEQ ID NO: 1962239 - RNA, 19 nt, Homo sapiens
caguucuuaacccaguguc

SEQ ID NO: 1962240 - RNA, 23 nt, Homo sapiens
aggguuggguucaucugagcaag

SEQ ID NO: 1962241 - RNA, 16 nt, Homo sapiens
ccucaaaugcaguauu

SEQ ID NO: 1962242 - RNA, 20 nt, Homo sapiens
auguacauaccggggcuccu

SEQ ID NO: 1962243 - RNA, 22 nt, Homo sapiens
auuuggaaagcacuggaauuca

SEQ ID NO: 1962244 - RNA, 16 nt, Homo sapiens
guucuucuucauugaa

SEQ ID NO: 1962245 - RNA, 20 nt, Homo sapiens
uucuauuagcuuacugauua

SEQ ID NO: 1962246 - RNA, 23 nt, Homo sapiens
auuuuuuuuuuuuaaauuaugca

SEQ ID NO: 1962247 - RNA, 17 nt, Homo sapiens
agaccaugccagaccca

SEQ ID NO: 1962248 - RNA, 21 nt, Homo sapiens
aaacuaaaggugcacugcuuu

SEQ ID NO: 1962249 - RNA, 18 nt, Homo sapiens
aacacauuacgugcuccc

SEQ ID NO: 1962250 - RNA, 14 nt, Homo sapiens
aacacauacaggaa

SEQ ID NO: 1962251 - RNA, 17 nt, Homo sapiens
uugaaauacuaaaagca

SEQ ID NO: 1962252 - RNA, 10 nt, Homo sapiens
gaugaugcug

SEQ ID NO: 1962253 - RNA, 23 nt, Homo sapiens
agcagguaugggacaggugccag

SEQ ID NO: 1962254 - RNA, 13 nt, Homo sapiens
gugccugugacuc

SEQ ID NO: 1962255 - RNA, 19 nt, Homo sapiens
aggauauuaacaacaauaa

SEQ ID NO: 1962256 - RNA, 12 nt, Homo sapiens
acuggaugcaug

SEQ ID NO: 1962257 - RNA, 14 nt, Homo sapiens
acacauuuguacag

SEQ ID NO: 1962258 - RNA, 12 nt, Homo sapiens
ugaugaagucac

SEQ ID NO: 1962259 - RNA, 14 nt, Homo sapiens
ggacacuuuugcca

SEQ ID NO: 1962260 - RNA, 23 nt, Homo sapiens
uuucaaaagcggggcuucaucug

SEQ ID NO: 1962261 - RNA, 20 nt, Homo sapiens
uauguucaaugaauauugua

SEQ ID NO: 1962262 - RNA, 18 nt, Homo sapiens
uacuaacugccaucaccu

SEQ ID NO: 1962263 - RNA, 15 nt, Homo sapiens
uuguuguuucuugcc

SEQ ID NO: 1962264 - RNA, 16 nt, Homo sapiens
auucuaaugucuucau

SEQ ID NO: 1962265 - RNA, 13 nt, Homo sapiens
gcucgucuuugca

SEQ ID NO: 1962266 - RNA, 22 nt, Homo sapiens
gccaggaacccuccuccuguca

SEQ ID NO: 1962267 - RNA, 16 nt, Homo sapiens
ggucccucugcagucu

SEQ ID NO: 1962268 - RNA, 16 nt, Homo sapiens
accaauuaauguagcu

SEQ ID NO: 1962269 - RNA, 18 nt, Homo sapiens
uauagguuuugguuccac

SEQ ID NO: 1962270 - RNA, 18 nt, Homo sapiens
augugagccuugugcaug

SEQ ID NO: 1962271 - RNA, 19 nt, Homo sapiens
uucaggaagcucucuuaaa

SEQ ID NO: 1962272 - RNA, 21 nt, Homo sapiens
ugcacuaccauugcuguucua

SEQ ID NO: 1962273 - RNA, 19 nt, Homo sapiens
cuacaaggcuggcagugac

SEQ ID NO: 1962274 - RNA, 21 nt, Homo sapiens
aggguuuggauuuuaacuuuu

SEQ ID NO: 1962275 - RNA, 13 nt, Homo sapiens
ucccaguacaaca

SEQ ID NO: 1962276 - RNA, 18 nt, Homo sapiens
caguggugauguaaaaau

SEQ ID NO: 1962277 - RNA, 17 nt, Homo sapiens
guaaauauucauuugcu

SEQ ID NO: 1962278 - RNA, 13 nt, Homo sapiens
accccagccuggg

SEQ ID NO: 1962279 - RNA, 23 nt, Homo sapiens
acuuagcagcuaucucucaguga

SEQ ID NO: 1962280 - RNA, 17 nt, Homo sapiens
uugauacaaaguacaga

SEQ ID NO: 1962281 - RNA, 14 nt, Homo sapiens
auuauuaacaaagu

SEQ ID NO: 1962282 - RNA, 15 nt, Homo sapiens
auucacaaauagcca

SEQ ID NO: 1962283 - RNA, 16 nt, Homo sapiens
uagugcagaaucucau

SEQ ID NO: 1962284 - RNA, 15 nt, Homo sapiens
ccuuauuaguuacaa

SEQ ID NO: 1962285 - RNA, 12 nt, Homo sapiens
ugcacacaccug

SEQ ID NO: 1962286 - RNA, 14 nt, Homo sapiens
aggcugaguguccg

SEQ ID NO: 1962287 - RNA, 14 nt, Homo sapiens
uugguaagauugca

SEQ ID NO: 1962288 - RNA, 22 nt, Homo sapiens
gguguguauacuuguauaacuu

SEQ ID NO: 1962289 - RNA, 18 nt, Homo sapiens
agacacugaaauauacac

SEQ ID NO: 1962290 - RNA, 10 nt, Homo sapiens
auaauacucu

SEQ ID NO: 1962291 - RNA, 15 nt, Homo sapiens
uuguaaauuuuggaa

SEQ ID NO: 1962292 - RNA, 20 nt, Homo sapiens
gaacuaugaacacugucauc

SEQ ID NO: 1962293 - RNA, 21 nt, Homo sapiens
ccuggggcacuuucauccuca

SEQ ID NO: 1962294 - RNA, 17 nt, Homo sapiens
ggaaauguguguauuua

SEQ ID NO: 1962295 - RNA, 15 nt, Homo sapiens
aaccucaaguuauuc

SEQ ID NO: 1962296 - RNA, 19 nt, Homo sapiens
aaauucuccaacccaaagu

SEQ ID NO: 1962297 - RNA, 13 nt, Homo sapiens
guauuaccaaagc

SEQ ID NO: 1962298 - RNA, 15 nt, Homo sapiens
aaaaaguaugugaau

SEQ ID NO: 1962299 - RNA, 21 nt, Homo sapiens
gagcugaaagaggccaaacag

SEQ ID NO: 1962300 - RNA, 21 nt, Homo sapiens
cuaggccuugccccaccucca

SEQ ID NO: 1962301 - RNA, 19 nt, Homo sapiens
ggcacgaucucgacucacu

SEQ ID NO: 1962302 - RNA, 13 nt, Homo sapiens
cggcucugcaguc

SEQ ID NO: 1962303 - RNA, 18 nt, Homo sapiens
caaaggaaaaccgaguau

SEQ ID NO: 1962304 - RNA, 12 nt, Homo sapiens
cuagaggugcuc

SEQ ID NO: 1962305 - RNA, 23 nt, Homo sapiens
acugccaccuccccuugccagcu

SEQ ID NO: 1962306 - RNA, 23 nt, Homo sapiens
uuugugccagugcuaaacuacug

SEQ ID NO: 1962307 - RNA, 16 nt, Homo sapiens
augagguuuuuccaaa

SEQ ID NO: 1962308 - RNA, 20 nt, Homo sapiens
cagcauucccaauuaucaaa

SEQ ID NO: 1962309 - RNA, 12 nt, Homo sapiens
uuauucuaguca

SEQ ID NO: 1962310 - RNA, 21 nt, Homo sapiens
gccacgaggagcuuccagugc

SEQ ID NO: 1962311 - RNA, 17 nt, Homo sapiens
gauucaacacugugcac

SEQ ID NO: 1962312 - RNA, 17 nt, Homo sapiens
ccugcuggggaccucac

SEQ ID NO: 1962313 - RNA, 15 nt, Homo sapiens
ucuguucacccugca

SEQ ID NO: 1962314 - RNA, 18 nt, Homo sapiens
accucaccugggcaggga

SEQ ID NO: 1962315 - RNA, 18 nt, Homo sapiens
accacuuuuaacagaaca

SEQ ID NO: 1962316 - RNA, 13 nt, Homo sapiens
gaccucagcuuug

SEQ ID NO: 1962317 - RNA, 19 nt, Homo sapiens
gcaauuuuuccaaaagcca

SEQ ID NO: 1962318 - RNA, 18 nt, Homo sapiens
ugacccuauucaugucuc

SEQ ID NO: 1962319 - RNA, 19 nt, Homo sapiens
ggcugaaggacugugacag

SEQ ID NO: 1962320 - RNA, 12 nt, Homo sapiens
aagaggggaaaa

SEQ ID NO: 1962321 - RNA, 14 nt, Homo sapiens
guaagacauuugua

SEQ ID NO: 1962322 - RNA, 19 nt, Homo sapiens
gacagauguggacaugcac

SEQ ID NO: 1962323 - RNA, 17 nt, Homo sapiens
gaauacuuuuaauuuca

SEQ ID NO: 1962324 - RNA, 12 nt, Homo sapiens
cugaacaugccu

SEQ ID NO: 1962325 - RNA, 13 nt, Homo sapiens
uccaccucuacca

SEQ ID NO: 1962326 - RNA, 22 nt, Homo sapiens
gagguaccagcaauauguaaau

SEQ ID NO: 1962327 - RNA, 17 nt, Homo sapiens
ccaccugcauugcucuc

SEQ ID NO: 1962328 - RNA, 17 nt, Homo sapiens
acuuucauuccuucaga

SEQ ID NO: 1962329 - RNA, 22 nt, Homo sapiens
aaguuagccuccaccacccuuu

SEQ ID NO: 1962330 - RNA, 21 nt, Homo sapiens
aggccaccuggccaggagcuu

SEQ ID NO: 1962331 - RNA, 15 nt, Homo sapiens
uguuucacagagugu

SEQ ID NO: 1962332 - RNA, 20 nt, Homo sapiens
caugucuaacaggacuugaa

SEQ ID NO: 1962333 - RNA, 18 nt, Homo sapiens
cagaaaacaaaacugcau

SEQ ID NO: 1962334 - RNA, 16 nt, Homo sapiens
aaaacccuugggccag

SEQ ID NO: 1962335 - RNA, 15 nt, Homo sapiens
gcaucauuauuuaug

SEQ ID NO: 1962336 - RNA, 15 nt, Homo sapiens
aagcuguauguacuu

SEQ ID NO: 1962337 - RNA, 22 nt, Homo sapiens
ucuggauuguuuuuaaaccucc

SEQ ID NO: 1962338 - RNA, 13 nt, Homo sapiens
cguuuuguacugu

SEQ ID NO: 1962339 - RNA, 14 nt, Homo sapiens
aaaaagcugcuauc

SEQ ID NO: 1962340 - RNA, 12 nt, Homo sapiens
ugcacaccugua

SEQ ID NO: 1962341 - RNA, 20 nt, Homo sapiens
agaucaugucucacuucaca

SEQ ID NO: 1962342 - RNA, 21 nt, Homo sapiens
cagaagcagcaacuuguccua

SEQ ID NO: 1962343 - RNA, 20 nt, Homo sapiens
cugcuccauuucgugacuuu

SEQ ID NO: 1962344 - RNA, 22 nt, Homo sapiens
auuucaccacucaaaggccaga

SEQ ID NO: 1962345 - RNA, 15 nt, Homo sapiens
acuuugugagccaaa

SEQ ID NO: 1962346 - RNA, 15 nt, Homo sapiens
agcgagcacccucau

SEQ ID NO: 1962347 - RNA, 15 nt, Homo sapiens
agaugcccauucucu

SEQ ID NO: 1962348 - RNA, 17 nt, Homo sapiens
ugucgaauuccuacuga

SEQ ID NO: 1962349 - RNA, 21 nt, Homo sapiens
agauaaaggaagucaccaaaa

SEQ ID NO: 1962350 - RNA, 11 nt, Homo sapiens
gagaugugauc

SEQ ID NO: 1962351 - RNA, 15 nt, Homo sapiens
auuccuguagcaucu

SEQ ID NO: 1962352 - RNA, 17 nt, Homo sapiens
ucaccaaaauagucuuc

SEQ ID NO: 1962353 - RNA, 22 nt, Homo sapiens
uauauagcucuacacaacaugu

SEQ ID NO: 1962354 - RNA, 15 nt, Homo sapiens
gcuucccacuauuua

SEQ ID NO: 1962355 - RNA, 13 nt, Homo sapiens
agccacagcauuu

SEQ ID NO: 1962356 - RNA, 22 nt, Homo sapiens
acuuaaugaaaacaaugcagua

SEQ ID NO: 1962357 - RNA, 18 nt, Homo sapiens
ugcaauaaaauaguagca

SEQ ID NO: 1962358 - RNA, 18 nt, Homo sapiens
gaaggagccagugcccac

SEQ ID NO: 1962359 - RNA, 14 nt, Homo sapiens
gcuucuaccuggaa

SEQ ID NO: 1962360 - RNA, 15 nt, Homo sapiens
uguuccugugaucuc

SEQ ID NO: 1962361 - RNA, 19 nt, Homo sapiens
cccugauuuaauaugcaaa

SEQ ID NO: 1962362 - RNA, 13 nt, Homo sapiens
agguucauggauu

SEQ ID NO: 1962363 - RNA, 13 nt, Homo sapiens
uugcccauauaaa

SEQ ID NO: 1962364 - RNA, 14 nt, Homo sapiens
uaggaaggauuuuc

SEQ ID NO: 1962365 - RNA, 17 nt, Homo sapiens
ccucaacugagaagcca

SEQ ID NO: 1962366 - RNA, 17 nt, Homo sapiens
accuuucaaauuucaca

SEQ ID NO: 1962367 - RNA, 21 nt, Homo sapiens
caggucuaccaaaaaucucaa

SEQ ID NO: 1962368 - RNA, 16 nt, Homo sapiens
uugauuaaaacauuau

SEQ ID NO: 1962369 - RNA, 17 nt, Homo sapiens
ucacggcugcgcacugu

SEQ ID NO: 1962370 - RNA, 17 nt, Homo sapiens
aagcccuguucuccugu

SEQ ID NO: 1962371 - RNA, 13 nt, Homo sapiens
augcagcuuugca

SEQ ID NO: 1962372 - RNA, 17 nt, Homo sapiens
gacuuugguuugaccca

SEQ ID NO: 1962373 - RNA, 17 nt, Homo sapiens
uaaauuguuugaccaug

SEQ ID NO: 1962374 - RNA, 20 nt, Homo sapiens
aucaagcgaugaaacuggaa

SEQ ID NO: 1962375 - RNA, 18 nt, Homo sapiens
cuccccugggacuuuccc

SEQ ID NO: 1962376 - RNA, 18 nt, Homo sapiens
ucuucccccuuucuaaaa

SEQ ID NO: 1962377 - RNA, 22 nt, Homo sapiens
caggugucuuuaacugucauug

SEQ ID NO: 1962378 - RNA, 19 nt, Homo sapiens
agcaaccuccacauguuca

SEQ ID NO: 1962379 - RNA, 15 nt, Homo sapiens
cacuccacagaguga

SEQ ID NO: 1962380 - RNA, 19 nt, Homo sapiens
aggccaaguacacugagag

SEQ ID NO: 1962381 - RNA, 11 nt, Homo sapiens
uccaguaccau

SEQ ID NO: 1962382 - RNA, 15 nt, Homo sapiens
aaucuguuaccucug

SEQ ID NO: 1962383 - RNA, 15 nt, Homo sapiens
gggaucacuaaggga

SEQ ID NO: 1962384 - RNA, 21 nt, Homo sapiens
cuggcaaugaaaaauucucag

SEQ ID NO: 1962385 - RNA, 22 nt, Homo sapiens
agaccguugguuccaucacugc

SEQ ID NO: 1962386 - RNA, 19 nt, Homo sapiens
ccuaaaaauaaacaaaaag

SEQ ID NO: 1962387 - RNA, 20 nt, Homo sapiens
ccuuucauaaagucuugccu

SEQ ID NO: 1962388 - RNA, 21 nt, Homo sapiens
uagacaauccccacauaccau

SEQ ID NO: 1962389 - RNA, 16 nt, Homo sapiens
auaucgagaacugcca

SEQ ID NO: 1962390 - RNA, 21 nt, Homo sapiens
cggaaggagggagcucugaug

SEQ ID NO: 1962391 - RNA, 13 nt, Homo sapiens
uacuugaauguag

SEQ ID NO: 1962392 - RNA, 16 nt, Homo sapiens
cuacaguggcugucac

SEQ ID NO: 1962393 - RNA, 13 nt, Homo sapiens
uaaucccagcacu

SEQ ID NO: 1962394 - RNA, 15 nt, Homo sapiens
uggaucacacacaug

SEQ ID NO: 1962395 - RNA, 17 nt, Homo sapiens
agggggacccuggugcu

SEQ ID NO: 1962396 - RNA, 19 nt, Homo sapiens
acuacuguagaacugcaau

SEQ ID NO: 1962397 - RNA, 13 nt, Homo sapiens
cccccgccaaaag

SEQ ID NO: 1962398 - RNA, 14 nt, Homo sapiens
ugacuugcauucag

SEQ ID NO: 1962399 - RNA, 22 nt, Homo sapiens
gagcaccugggccccacuggac

SEQ ID NO: 1962400 - RNA, 15 nt, Homo sapiens
uguguuuucagcaaa

SEQ ID NO: 1962401 - RNA, 23 nt, Homo sapiens
caggaucuguacaauaauaauua

SEQ ID NO: 1962402 - RNA, 15 nt, Homo sapiens
aagcucuucuuccca

SEQ ID NO: 1962403 - RNA, 21 nt, Homo sapiens
gaggcuccugaaugugacugg

SEQ ID NO: 1962404 - RNA, 17 nt, Homo sapiens
caccacuaacaugcccu

SEQ ID NO: 1962405 - RNA, 21 nt, Homo sapiens
accauuuuuuuuuaacacugu

SEQ ID NO: 1962406 - RNA, 13 nt, Homo sapiens
aaaccccagggua

SEQ ID NO: 1962407 - RNA, 13 nt, Homo sapiens
agcagggacaccc

SEQ ID NO: 1962408 - RNA, 14 nt, Homo sapiens
uugaauuucacugu

SEQ ID NO: 1962409 - RNA, 18 nt, Homo sapiens
cagagaagccagcuuguu

SEQ ID NO: 1962410 - RNA, 20 nt, Homo sapiens
aagaugaaaaauggucccuu

SEQ ID NO: 1962411 - RNA, 23 nt, Homo sapiens
ugugauuuccuaauaugaucuaa

SEQ ID NO: 1962412 - RNA, 14 nt, Homo sapiens
uguauacagaauga

SEQ ID NO: 1962413 - RNA, 13 nt, Homo sapiens
cugauggugcaau

SEQ ID NO: 1962414 - RNA, 17 nt, Homo sapiens
cugguucuccaacagag

SEQ ID NO: 1962415 - RNA, 16 nt, Homo sapiens
guuuauuaacuacuga

SEQ ID NO: 1962416 - RNA, 15 nt, Homo sapiens
cuggggcuuugccau

SEQ ID NO: 1962417 - RNA, 18 nt, Homo sapiens
cauagaaauauugacuca

SEQ ID NO: 1962418 - RNA, 17 nt, Homo sapiens
cuugagcugccugcucu

SEQ ID NO: 1962419 - RNA, 13 nt, Homo sapiens
acuguaguuuuga

SEQ ID NO: 1962420 - RNA, 14 nt, Homo sapiens
acagcacaugcaca

SEQ ID NO: 1962421 - RNA, 16 nt, Homo sapiens
uucuaucuccaaauga

SEQ ID NO: 1962422 - RNA, 13 nt, Homo sapiens
ucugagaccagug

SEQ ID NO: 1962423 - RNA, 22 nt, Homo sapiens
auaaaaacaaauaauaucucua

SEQ ID NO: 1962424 - RNA, 12 nt, Homo sapiens
aaauuaagcauu

SEQ ID NO: 1962425 - RNA, 17 nt, Homo sapiens
acaaauuauguuacauc

SEQ ID NO: 1962426 - RNA, 18 nt, Homo sapiens
gaagacucgcccucgcca

SEQ ID NO: 1962427 - RNA, 18 nt, Homo sapiens
uccguggccgacagucug

SEQ ID NO: 1962428 - RNA, 21 nt, Homo sapiens
uguaaauaaugcuuaacauaa

SEQ ID NO: 1962429 - RNA, 19 nt, Homo sapiens
aaggguaauagaaaugcau

SEQ ID NO: 1962430 - RNA, 17 nt, Homo sapiens
ccagggcaacacaguga

SEQ ID NO: 1962431 - RNA, 14 nt, Homo sapiens
auaauauacuguac

SEQ ID NO: 1962432 - RNA, 22 nt, Homo sapiens
uaaggaauuuccucccaauuca

SEQ ID NO: 1962433 - RNA, 13 nt, Homo sapiens
caugcuccucacc

SEQ ID NO: 1962434 - RNA, 14 nt, Homo sapiens
auagguaugagcca

SEQ ID NO: 1962435 - RNA, 17 nt, Homo sapiens
agcuaauaaaauaucau

SEQ ID NO: 1962436 - RNA, 17 nt, Homo sapiens
accaagucuacuucacu

SEQ ID NO: 1962437 - RNA, 19 nt, Homo sapiens
caggauggucucugccaug

SEQ ID NO: 1962438 - RNA, 23 nt, Homo sapiens
augauuucuagcaggcaggaagu

SEQ ID NO: 1962439 - RNA, 12 nt, Homo sapiens
agaagcccugau

SEQ ID NO: 1962440 - RNA, 20 nt, Homo sapiens
uagucaauccugucauauaa

SEQ ID NO: 1962441 - RNA, 15 nt, Homo sapiens
guacaaaaucuugca

SEQ ID NO: 1962442 - RNA, 22 nt, Homo sapiens
acucaaaagacaaacaugcaag

SEQ ID NO: 1962443 - RNA, 17 nt, Homo sapiens
uacuuauuaaucuguau

SEQ ID NO: 1962444 - RNA, 13 nt, Homo sapiens
auaggcagcuuuc

SEQ ID NO: 1962445 - RNA, 16 nt, Homo sapiens
uguauuuaagacauaa

SEQ ID NO: 1962446 - RNA, 16 nt, Homo sapiens
acugugcugugcagcu

SEQ ID NO: 1962447 - RNA, 16 nt, Homo sapiens
gugcaaaaacuguaaa

SEQ ID NO: 1962448 - RNA, 15 nt, Homo sapiens
auuauagauacuuaa

SEQ ID NO: 1962449 - RNA, 14 nt, Homo sapiens
acucaggcauuuga

SEQ ID NO: 1962450 - RNA, 13 nt, Homo sapiens
auaaaagaaucau

SEQ ID NO: 1962451 - RNA, 19 nt, Homo sapiens
cuuaucugaaaugcuugaa

SEQ ID NO: 1962452 - RNA, 17 nt, Homo sapiens
acaccaagugaggccau

SEQ ID NO: 1962453 - RNA, 14 nt, Homo sapiens
cucuaacaugcaau

SEQ ID NO: 1962454 - RNA, 17 nt, Homo sapiens
cagauucucuuggcuca

SEQ ID NO: 1962455 - RNA, 20 nt, Homo sapiens
uccagcuggaucccagggaa

SEQ ID NO: 1962456 - RNA, 19 nt, Homo sapiens
agcaucuccagcauucuca

SEQ ID NO: 1962457 - RNA, 21 nt, Homo sapiens
cucaggggagcaagcuuacac

SEQ ID NO: 1962458 - RNA, 14 nt, Homo sapiens
gaaugggagaaaau

SEQ ID NO: 1962459 - RNA, 18 nt, Homo sapiens
ucguuagaaugucugccu

SEQ ID NO: 1962460 - RNA, 14 nt, Homo sapiens
gaaaucuguaauuc

SEQ ID NO: 1962461 - RNA, 11 nt, Homo sapiens
aucauuacaau

SEQ ID NO: 1962462 - RNA, 22 nt, Homo sapiens
auucucugugguauccaagaau

SEQ ID NO: 1962463 - RNA, 20 nt, Homo sapiens
cgcaccggagugucuggaau

SEQ ID NO: 1962464 - RNA, 23 nt, Homo sapiens
aaugccagguggagaaaucacag

SEQ ID NO: 1962465 - RNA, 16 nt, Homo sapiens
cgagcggggagccagg

SEQ ID NO: 1962466 - RNA, 15 nt, Homo sapiens
acuaaacugauuaaa

SEQ ID NO: 1962467 - RNA, 22 nt, Homo sapiens
gccucccuggggaccaggagcu

SEQ ID NO: 1962468 - RNA, 20 nt, Homo sapiens
uucucagguguuucuagacc

SEQ ID NO: 1962469 - RNA, 21 nt, Homo sapiens
guguuuggaaauaaacugugc

SEQ ID NO: 1962470 - RNA, 19 nt, Homo sapiens
auucuuaugauuacuauca

SEQ ID NO: 1962471 - RNA, 19 nt, Homo sapiens
accaauacuacugacgucc

SEQ ID NO: 1962472 - RNA, 20 nt, Homo sapiens
agaguaggguagaccaaauc

SEQ ID NO: 1962473 - RNA, 16 nt, Homo sapiens
accgggaaaggcaucu

SEQ ID NO: 1962474 - RNA, 22 nt, Homo sapiens
agccuccaaaaauggcagugac

SEQ ID NO: 1962475 - RNA, 22 nt, Homo sapiens
uguggcauaaauuacagucauc

SEQ ID NO: 1962476 - RNA, 18 nt, Homo sapiens
ucacuguauccauucuac

SEQ ID NO: 1962477 - RNA, 16 nt, Homo sapiens
aaugucuuccuggauu

SEQ ID NO: 1962478 - RNA, 15 nt, Homo sapiens
aacucaguccugaca

SEQ ID NO: 1962479 - RNA, 22 nt, Homo sapiens
cacacucaaaagacaaacaugc

SEQ ID NO: 1962480 - RNA, 18 nt, Homo sapiens
uuccucugggcagcgcua

SEQ ID NO: 1962481 - RNA, 17 nt, Homo sapiens
agugaagacgucagggg

SEQ ID NO: 1962482 - RNA, 21 nt, Homo sapiens
acucccucuugguuuuuauca

SEQ ID NO: 1962483 - RNA, 16 nt, Homo sapiens
guagcucaaucugcaa

SEQ ID NO: 1962484 - RNA, 16 nt, Homo sapiens
acgcuugccuggucac

SEQ ID NO: 1962485 - RNA, 22 nt, Homo sapiens
agucuucuauuaaggacauuua

SEQ ID NO: 1962486 - RNA, 13 nt, Homo sapiens
auggaaucagauu

SEQ ID NO: 1962487 - RNA, 20 nt, Homo sapiens
caggauacaggugacaguga

SEQ ID NO: 1962488 - RNA, 13 nt, Homo sapiens
ggccaaucccuuc

SEQ ID NO: 1962489 - RNA, 15 nt, Homo sapiens
auagguugagcaauu

SEQ ID NO: 1962490 - RNA, 16 nt, Homo sapiens
aucaaaccucagggau

SEQ ID NO: 1962491 - RNA, 22 nt, Homo sapiens
gggcucuuccaacaaggaagaa

SEQ ID NO: 1962492 - RNA, 23 nt, Homo sapiens
ugcagguuggaacuaugcagugu

SEQ ID NO: 1962493 - RNA, 18 nt, Homo sapiens
uaugcucauugaacuuua

SEQ ID NO: 1962494 - RNA, 14 nt, Homo sapiens
agucugaaccuauu

SEQ ID NO: 1962495 - RNA, 16 nt, Homo sapiens
caaaaaaacaaaaaag

SEQ ID NO: 1962496 - RNA, 13 nt, Homo sapiens
acaauuccuuaca

SEQ ID NO: 1962497 - RNA, 22 nt, Homo sapiens
acugcucugcccccaacucccg

SEQ ID NO: 1962498 - RNA, 22 nt, Homo sapiens
caauuuuucaagagcuccuuga

SEQ ID NO: 1962499 - RNA, 18 nt, Homo sapiens
gacuuaaggggcugggau

SEQ ID NO: 1962500 - RNA, 13 nt, Homo sapiens
caagagcccuguc

SEQ ID NO: 1962501 - RNA, 18 nt, Homo sapiens
gcaaagauuugcuuuaau

SEQ ID NO: 1962502 - RNA, 17 nt, Homo sapiens
ucacugcaccucuuugu

SEQ ID NO: 1962503 - RNA, 15 nt, Homo sapiens
ccaaagcauggacua

SEQ ID NO: 1962504 - RNA, 18 nt, Homo sapiens
uaucccuagugcuccaua

SEQ ID NO: 1962505 - RNA, 16 nt, Homo sapiens
gccuguguaacagcuc

SEQ ID NO: 1962506 - RNA, 12 nt, Homo sapiens
ugaccaugugau

SEQ ID NO: 1962507 - RNA, 20 nt, Homo sapiens
cuauuuguaaaucugccaca

SEQ ID NO: 1962508 - RNA, 13 nt, Homo sapiens
gaaauuuugccuu

SEQ ID NO: 1962509 - RNA, 13 nt, Homo sapiens
cugccagugcaga

SEQ ID NO: 1962510 - RNA, 12 nt, Homo sapiens
ugcauauucaac

SEQ ID NO: 1962511 - RNA, 23 nt, Homo sapiens
augaauguuacuaaauuuucuaa

SEQ ID NO: 1962512 - RNA, 16 nt, Homo sapiens
uugcuggcucugagaa

SEQ ID NO: 1962513 - RNA, 16 nt, Homo sapiens
ccucacgacuggucac

SEQ ID NO: 1962514 - RNA, 16 nt, Homo sapiens
ugagagcgacacagac

SEQ ID NO: 1962515 - RNA, 13 nt, Homo sapiens
aaauuaauucuaa

SEQ ID NO: 1962516 - RNA, 16 nt, Homo sapiens
caucgaaauguauuca

SEQ ID NO: 1962517 - RNA, 16 nt, Homo sapiens
aagucugcuacccuca

SEQ ID NO: 1962518 - RNA, 16 nt, Homo sapiens
uaaauguauaccugua

SEQ ID NO: 1962519 - RNA, 16 nt, Homo sapiens
gacaacugcucccacc

SEQ ID NO: 1962520 - RNA, 15 nt, Homo sapiens
ccagcuuugcccaac

SEQ ID NO: 1962521 - RNA, 14 nt, Homo sapiens
ugccacgcuuugau

SEQ ID NO: 1962522 - RNA, 13 nt, Homo sapiens
gcauaaagcaauu

SEQ ID NO: 1962523 - RNA, 22 nt, Homo sapiens
uugaacauacucuagugaaugu

SEQ ID NO: 1962524 - RNA, 18 nt, Homo sapiens
aauguuccguucaucuga

SEQ ID NO: 1962525 - RNA, 16 nt, Homo sapiens
ggcuggcagcucucca

SEQ ID NO: 1962526 - RNA, 14 nt, Homo sapiens
auauuuuagcauuu

SEQ ID NO: 1962527 - RNA, 15 nt, Homo sapiens
cucacuucaaugugu

SEQ ID NO: 1962528 - RNA, 19 nt, Homo sapiens
ugaacagcugguguagcua

SEQ ID NO: 1962529 - RNA, 14 nt, Homo sapiens
cuccugauccacuu

SEQ ID NO: 1962530 - RNA, 15 nt, Homo sapiens
accaucauaguacag

SEQ ID NO: 1962531 - RNA, 13 nt, Homo sapiens
uuggguuccagac

SEQ ID NO: 1962532 - RNA, 14 nt, Homo sapiens
uguaaggugcuaca

SEQ ID NO: 1962533 - RNA, 22 nt, Homo sapiens
cuguccuuucagucugauccau

SEQ ID NO: 1962534 - RNA, 20 nt, Homo sapiens
uucccaacacuucagacugc

SEQ ID NO: 1962535 - RNA, 22 nt, Homo sapiens
aguccaaauaacaaguaccaaa

SEQ ID NO: 1962536 - RNA, 23 nt, Homo sapiens
ccucaagaaauaaaaggaagcca

SEQ ID NO: 1962537 - RNA, 23 nt, Homo sapiens
aaagagccauucuggcacuuuaa

SEQ ID NO: 1962538 - RNA, 19 nt, Homo sapiens
guuugacuuuagacuguaa

SEQ ID NO: 1962539 - RNA, 15 nt, Homo sapiens
aguaagaaacaucca

SEQ ID NO: 1962540 - RNA, 14 nt, Homo sapiens
acaugugcagucac

SEQ ID NO: 1962541 - RNA, 21 nt, Homo sapiens
ugaguaacgacauggaacuga

SEQ ID NO: 1962542 - RNA, 14 nt, Homo sapiens
gacuaaaugaacua

SEQ ID NO: 1962543 - RNA, 22 nt, Homo sapiens
agggucuugcuauauugcccag

SEQ ID NO: 1962544 - RNA, 15 nt, Homo sapiens
cuuccuggauuauuc

SEQ ID NO: 1962545 - RNA, 17 nt, Homo sapiens
ccuuaggaacagcucuu

SEQ ID NO: 1962546 - RNA, 18 nt, Homo sapiens
agauauuccagaccaaaa

SEQ ID NO: 1962547 - RNA, 17 nt, Homo sapiens
aaaacuaaccaucugaa

SEQ ID NO: 1962548 - RNA, 14 nt, Homo sapiens
cccaauccaugcuu

SEQ ID NO: 1962549 - RNA, 20 nt, Homo sapiens
uugguggcagugacuucuuu

SEQ ID NO: 1962550 - RNA, 15 nt, Homo sapiens
guaguuaagaauucc

SEQ ID NO: 1962551 - RNA, 17 nt, Homo sapiens
guuaccaugucacugug

SEQ ID NO: 1962552 - RNA, 18 nt, Homo sapiens
ugcuuccacaugugccag

SEQ ID NO: 1962553 - RNA, 20 nt, Homo sapiens
uuaaaacuuacuaugguaua

SEQ ID NO: 1962554 - RNA, 16 nt, Homo sapiens
cuuuccugaauccaaa

SEQ ID NO: 1962555 - RNA, 18 nt, Homo sapiens
ugcauaacgucugccuuc

SEQ ID NO: 1962556 - RNA, 21 nt, Homo sapiens
aggcugugcuagcaacaccca

SEQ ID NO: 1962557 - RNA, 19 nt, Homo sapiens
cugcugagcugcgugccac

SEQ ID NO: 1962558 - RNA, 16 nt, Homo sapiens
cagccacuuucugcca

SEQ ID NO: 1962559 - RNA, 22 nt, Homo sapiens
uauauuaaaauaagcacugugc

SEQ ID NO: 1962560 - RNA, 13 nt, Homo sapiens
cauuguguggaau

SEQ ID NO: 1962561 - RNA, 17 nt, Homo sapiens
guauacuaagugauaca

SEQ ID NO: 1962562 - RNA, 21 nt, Homo sapiens
caucauuugucuuugaacgua

SEQ ID NO: 1962563 - RNA, 13 nt, Homo sapiens
auuccaagucaac

SEQ ID NO: 1962564 - RNA, 9 nt, Homo sapiens
cuucacuuc

SEQ ID NO: 1962565 - RNA, 22 nt, Homo sapiens
ugauuaguauaauauuucuuaa

SEQ ID NO: 1962566 - RNA, 22 nt, Homo sapiens
acagaagcuuaaaaucugugaa

SEQ ID NO: 1962567 - RNA, 15 nt, Homo sapiens
uacauauauuuugca

SEQ ID NO: 1962568 - RNA, 12 nt, Homo sapiens
gccacacugguc

SEQ ID NO: 1962569 - RNA, 20 nt, Homo sapiens
gggaguauguugucauaaca

SEQ ID NO: 1962570 - RNA, 15 nt, Homo sapiens
cauccugugugcuga

SEQ ID NO: 1962571 - RNA, 15 nt, Homo sapiens
caaaugaaugccuuu

SEQ ID NO: 1962572 - RNA, 14 nt, Homo sapiens
uucuagaucucagc

SEQ ID NO: 1962573 - RNA, 12 nt, Homo sapiens
cugaggugggag

SEQ ID NO: 1962574 - RNA, 16 nt, Homo sapiens
agauugccauggacac

SEQ ID NO: 1962575 - RNA, 13 nt, Homo sapiens
ccaaccaaggaag

SEQ ID NO: 1962576 - RNA, 18 nt, Homo sapiens
ccgagcuugccucagggc

SEQ ID NO: 1962577 - RNA, 22 nt, Homo sapiens
gcugaacgcguguguacacggg

SEQ ID NO: 1962578 - RNA, 14 nt, Homo sapiens
caggcacgugccac

SEQ ID NO: 1962579 - RNA, 17 nt, Homo sapiens
ggguccaucucagagaa

SEQ ID NO: 1962580 - RNA, 22 nt, Homo sapiens
auguuacuagagaagaagccuu

SEQ ID NO: 1962581 - RNA, 22 nt, Homo sapiens
auuuauaaauuugaaauccaaa

SEQ ID NO: 1962582 - RNA, 22 nt, Homo sapiens
uucaguuccuuucaucccuuca

SEQ ID NO: 1962583 - RNA, 17 nt, Homo sapiens
cuggacugugugcaacg

SEQ ID NO: 1962584 - RNA, 17 nt, Homo sapiens
cugcuuauucaguccuu

SEQ ID NO: 1962585 - RNA, 19 nt, Homo sapiens
gaaccgaggggcucaggaa

SEQ ID NO: 1962586 - RNA, 16 nt, Homo sapiens
agaaaacaaucugccc

SEQ ID NO: 1962587 - RNA, 14 nt, Homo sapiens
cuacauauaugcaa

SEQ ID NO: 1962588 - RNA, 22 nt, Homo sapiens
gacuaagccccgucugacccca

SEQ ID NO: 1962589 - RNA, 16 nt, Homo sapiens
aagcccccccuuccac

SEQ ID NO: 1962590 - RNA, 17 nt, Homo sapiens
gcauguguucuguuaga

SEQ ID NO: 1962591 - RNA, 14 nt, Homo sapiens
cuaaauguguacac

SEQ ID NO: 1962592 - RNA, 14 nt, Homo sapiens
gagcagccucugcc

SEQ ID NO: 1962593 - RNA, 16 nt, Homo sapiens
aaagcuggcaauauua

SEQ ID NO: 1962594 - RNA, 18 nt, Homo sapiens
aagaagcguuaugugcag

SEQ ID NO: 1962595 - RNA, 22 nt, Homo sapiens
uguuauauuuccuucuguaaaa

SEQ ID NO: 1962596 - RNA, 18 nt, Homo sapiens
uauccuuucuaacaaaaa

SEQ ID NO: 1962597 - RNA, 19 nt, Homo sapiens
gccugggucaagggccagu

SEQ ID NO: 1962598 - RNA, 14 nt, Homo sapiens
agaugauuguucaa

SEQ ID NO: 1962599 - RNA, 16 nt, Homo sapiens
uauguggcugcugcug

SEQ ID NO: 1962600 - RNA, 20 nt, Homo sapiens
ggccuuuucugugccagaca

SEQ ID NO: 1962601 - RNA, 21 nt, Homo sapiens
auugcucuugagucuuugcag

SEQ ID NO: 1962602 - RNA, 20 nt, Homo sapiens
gaucaucuuuccuguuccag

SEQ ID NO: 1962603 - RNA, 23 nt, Homo sapiens
ccccuggaaugggcacagcacag

SEQ ID NO: 1962604 - RNA, 21 nt, Homo sapiens
ccaauaaaauaaaagcacuua

SEQ ID NO: 1962605 - RNA, 20 nt, Homo sapiens
ucccagaggggccugccacc

SEQ ID NO: 1962606 - RNA, 19 nt, Homo sapiens
acagucaauggauccacaa

SEQ ID NO: 1962607 - RNA, 22 nt, Homo sapiens
auggccaccccagaggccaccu

SEQ ID NO: 1962608 - RNA, 20 nt, Homo sapiens
augcagaagcauauuuugcu

SEQ ID NO: 1962609 - RNA, 18 nt, Homo sapiens
auuaaucuggaauaugca

SEQ ID NO: 1962610 - RNA, 14 nt, Homo sapiens
aucuguccacaucc

SEQ ID NO: 1962611 - RNA, 21 nt, Homo sapiens
aggaaccacauauaacacuua

SEQ ID NO: 1962612 - RNA, 17 nt, Homo sapiens
ucccauauccugccuca

SEQ ID NO: 1962613 - RNA, 12 nt, Homo sapiens
auauauucuaca

SEQ ID NO: 1962614 - RNA, 20 nt, Homo sapiens
ugcuuuuuaucgcuaaauga

SEQ ID NO: 1962615 - RNA, 21 nt, Homo sapiens
aacccacugaaccuucugagc

SEQ ID NO: 1962616 - RNA, 17 nt, Homo sapiens
uaagugaucguuacauu

SEQ ID NO: 1962617 - RNA, 21 nt, Homo sapiens
gacauguauacuccauagaaa

SEQ ID NO: 1962618 - RNA, 23 nt, Homo sapiens
ccccagccuggccagacaagaag

SEQ ID NO: 1962619 - RNA, 15 nt, Homo sapiens
aggccacauaccucu

SEQ ID NO: 1962620 - RNA, 23 nt, Homo sapiens
aauaucaagacugacuggcacca

SEQ ID NO: 1962621 - RNA, 21 nt, Homo sapiens
gcagucagcccuuauggccaa

SEQ ID NO: 1962622 - RNA, 14 nt, Homo sapiens
agagucacugaccc

SEQ ID NO: 1962623 - RNA, 16 nt, Homo sapiens
guggagcuccugcugg

SEQ ID NO: 1962624 - RNA, 19 nt, Homo sapiens
cauaggacucaaaguuuca

SEQ ID NO: 1962625 - RNA, 23 nt, Homo sapiens
agaaacagcggcuccacuacaga

SEQ ID NO: 1962626 - RNA, 14 nt, Homo sapiens
uccuagcaaccugc

SEQ ID NO: 1962627 - RNA, 23 nt, Homo sapiens
ccauucauacuaaauaaaacaau

SEQ ID NO: 1962628 - RNA, 23 nt, Homo sapiens
cuauaauuauaaucaaaaucaau

SEQ ID NO: 1962629 - RNA, 17 nt, Homo sapiens
agugccuauugauacuu

SEQ ID NO: 1962630 - RNA, 20 nt, Homo sapiens
ucacaguuuugguugcuuua

SEQ ID NO: 1962631 - RNA, 14 nt, Homo sapiens
cuaguaccaaaagu

SEQ ID NO: 1962632 - RNA, 18 nt, Homo sapiens
aucugccuguaucucuca

SEQ ID NO: 1962633 - RNA, 17 nt, Homo sapiens
ggagagugucaaccaga

SEQ ID NO: 1962634 - RNA, 22 nt, Homo sapiens
cagacuagacaccuucugugcu

SEQ ID NO: 1962635 - RNA, 23 nt, Homo sapiens
ccaaucccucuccacucuucucu

SEQ ID NO: 1962636 - RNA, 15 nt, Homo sapiens
aggcaggcacugugg

SEQ ID NO: 1962637 - RNA, 15 nt, Homo sapiens
acgcaugcaguguug

SEQ ID NO: 1962638 - RNA, 17 nt, Homo sapiens
uaauagucuuugccagu

SEQ ID NO: 1962639 - RNA, 18 nt, Homo sapiens
acuuuaguguauguucua

SEQ ID NO: 1962640 - RNA, 22 nt, Homo sapiens
cuccuuacgcuuugucacacaa

SEQ ID NO: 1962641 - RNA, 18 nt, Homo sapiens
acgaagccuuaagccaua

SEQ ID NO: 1962642 - RNA, 20 nt, Homo sapiens
cagggacuccaugcugccag

SEQ ID NO: 1962643 - RNA, 14 nt, Homo sapiens
uaaaaccacagcag

SEQ ID NO: 1962644 - RNA, 17 nt, Homo sapiens
uuuaagguaaaacucac

SEQ ID NO: 1962645 - RNA, 17 nt, Homo sapiens
uucacgaacaugggcau

SEQ ID NO: 1962646 - RNA, 22 nt, Homo sapiens
ggccccucuccuccguggcaca

SEQ ID NO: 1962647 - RNA, 20 nt, Homo sapiens
cuggaguacaguggugugau

SEQ ID NO: 1962648 - RNA, 13 nt, Homo sapiens
ggaccacauuuua

SEQ ID NO: 1962649 - RNA, 17 nt, Homo sapiens
uacaaucucccuucaca

SEQ ID NO: 1962650 - RNA, 22 nt, Homo sapiens
ugggcuaggcauaggucucuuu

SEQ ID NO: 1962651 - RNA, 20 nt, Homo sapiens
aggugucuagacugccaggg

SEQ ID NO: 1962652 - RNA, 19 nt, Homo sapiens
cuggccuccuaugccucau

SEQ ID NO: 1962653 - RNA, 16 nt, Homo sapiens
aaccucagacuucuca

SEQ ID NO: 1962654 - RNA, 20 nt, Homo sapiens
aagugcauaggccacacagc

SEQ ID NO: 1962655 - RNA, 17 nt, Homo sapiens
ccagcacacagggcagu

SEQ ID NO: 1962656 - RNA, 22 nt, Homo sapiens
acaucuuuccaguccuugguca

SEQ ID NO: 1962657 - RNA, 20 nt, Homo sapiens
uaaauuucagccuacauuga

SEQ ID NO: 1962658 - RNA, 15 nt, Homo sapiens
aaccauuauaaauau

SEQ ID NO: 1962659 - RNA, 20 nt, Homo sapiens
agauucccucuuccugccaa

SEQ ID NO: 1962660 - RNA, 18 nt, Homo sapiens
cucagaggaugaggucaa

SEQ ID NO: 1962661 - RNA, 17 nt, Homo sapiens
aacugcaacugaaugac

SEQ ID NO: 1962662 - RNA, 18 nt, Homo sapiens
ugcccaauccauccugcu

SEQ ID NO: 1962663 - RNA, 16 nt, Homo sapiens
agaagucuauaaugca

SEQ ID NO: 1962664 - RNA, 16 nt, Homo sapiens
uguaagacucauuccc

SEQ ID NO: 1962665 - RNA, 18 nt, Homo sapiens
cagugcaaaccacuucuc

SEQ ID NO: 1962666 - RNA, 15 nt, Homo sapiens
ggggaacaaugagca

SEQ ID NO: 1962667 - RNA, 15 nt, Homo sapiens
auaaaauccagcuca

SEQ ID NO: 1962668 - RNA, 20 nt, Homo sapiens
ucaagaccauccuggacuga

SEQ ID NO: 1962669 - RNA, 13 nt, Homo sapiens
uggcugugagcag

SEQ ID NO: 1962670 - RNA, 19 nt, Homo sapiens
gcucauccaggguguuaca

SEQ ID NO: 1962671 - RNA, 22 nt, Homo sapiens
uuuuauagcugcuuggauucuc

SEQ ID NO: 1962672 - RNA, 19 nt, Homo sapiens
augggcuuucccaacagcu

SEQ ID NO: 1962673 - RNA, 17 nt, Homo sapiens
gagcaacauggugagac

SEQ ID NO: 1962674 - RNA, 11 nt, Homo sapiens
aaacacuccac

SEQ ID NO: 1962675 - RNA, 22 nt, Homo sapiens
uggaucuuggagaaugugagaa

SEQ ID NO: 1962676 - RNA, 20 nt, Homo sapiens
ugaaguaaaggauugaucac

SEQ ID NO: 1962677 - RNA, 17 nt, Homo sapiens
guaucuuccauauuugg

SEQ ID NO: 1962678 - RNA, 13 nt, Homo sapiens
accacacugaguu

SEQ ID NO: 1962679 - RNA, 19 nt, Homo sapiens
ccgaggggcucauguucag

SEQ ID NO: 1962680 - RNA, 20 nt, Homo sapiens
uuuccaaauuacugauauca

SEQ ID NO: 1962681 - RNA, 17 nt, Homo sapiens
acugagcagacugguga

SEQ ID NO: 1962682 - RNA, 23 nt, Homo sapiens
gcaagaugcgcacugcauuccac

SEQ ID NO: 1962683 - RNA, 23 nt, Homo sapiens
gcacgagcuggaacccacgagga

SEQ ID NO: 1962684 - RNA, 23 nt, Homo sapiens
uuugcaacaauaaaguacuuuac

SEQ ID NO: 1962685 - RNA, 19 nt, Homo sapiens
uuccaggcgaugugcaagu

SEQ ID NO: 1962686 - RNA, 19 nt, Homo sapiens
uaauuguauaaaacagugu

SEQ ID NO: 1962687 - RNA, 13 nt, Homo sapiens
cugacuugcucac

SEQ ID NO: 1962688 - RNA, 14 nt, Homo sapiens
ggaaaugacccaaa

SEQ ID NO: 1962689 - RNA, 19 nt, Homo sapiens
gugaaagaaaauucuugga

SEQ ID NO: 1962690 - RNA, 19 nt, Homo sapiens
gaggcuaacccugauccau

SEQ ID NO: 1962691 - RNA, 21 nt, Homo sapiens
uccgcuuucucuugcugccac

SEQ ID NO: 1962692 - RNA, 16 nt, Homo sapiens
ucaaguacaccagcca

SEQ ID NO: 1962693 - RNA, 13 nt, Homo sapiens
auggccugugcug

SEQ ID NO: 1962694 - RNA, 21 nt, Homo sapiens
auaugccuuuucccaacucca

SEQ ID NO: 1962695 - RNA, 21 nt, Homo sapiens
gcacaggaguguccucuuccc

SEQ ID NO: 1962696 - RNA, 14 nt, Homo sapiens
cugaaggacuguga

SEQ ID NO: 1962697 - RNA, 24 nt, Homo sapiens
gugauuucaccccacagacacuua

SEQ ID NO: 1962698 - RNA, 14 nt, Homo sapiens
gauauuggcuuaaa

SEQ ID NO: 1962699 - RNA, 22 nt, Homo sapiens
gccauuuuuacuguuauccuau

SEQ ID NO: 1962700 - RNA, 12 nt, Homo sapiens
ugacuaaacaac

SEQ ID NO: 1962701 - RNA, 17 nt, Homo sapiens
caacggccaggaaaagc

SEQ ID NO: 1962702 - RNA, 14 nt, Homo sapiens
uuuccaacacacaa

SEQ ID NO: 1962703 - RNA, 15 nt, Homo sapiens
auuuuucaaaacaua

SEQ ID NO: 1962704 - RNA, 12 nt, Homo sapiens
ucaugcacugag

SEQ ID NO: 1962705 - RNA, 15 nt, Homo sapiens
gguagguagugauua

SEQ ID NO: 1962706 - RNA, 21 nt, Homo sapiens
acaccuccacaguucaguggc

SEQ ID NO: 1962707 - RNA, 12 nt, Homo sapiens
uucuaaguauuu

SEQ ID NO: 1962708 - RNA, 15 nt, Homo sapiens
aauucaagccagcau

SEQ ID NO: 1962709 - RNA, 13 nt, Homo sapiens
agauguccagggc

SEQ ID NO: 1962710 - RNA, 19 nt, Homo sapiens
cacaucccuacgugcccac

SEQ ID NO: 1962711 - RNA, 16 nt, Homo sapiens
uaggcgcaggugcaca

SEQ ID NO: 1962712 - RNA, 15 nt, Homo sapiens
ccauuuguauucaaa

SEQ ID NO: 1962713 - RNA, 15 nt, Homo sapiens
gacaucagaacacac

SEQ ID NO: 1962714 - RNA, 14 nt, Homo sapiens
cacacccuccccau

SEQ ID NO: 1962715 - RNA, 18 nt, Homo sapiens
cuuucauccaacuggaag

SEQ ID NO: 1962716 - RNA, 15 nt, Homo sapiens
aggcccccaguggga

SEQ ID NO: 1962717 - RNA, 19 nt, Homo sapiens
gaacuauacccgggaccaa

SEQ ID NO: 1962718 - RNA, 18 nt, Homo sapiens
agcaacaggccauuguga

SEQ ID NO: 1962719 - RNA, 15 nt, Homo sapiens
cacccuccaccucuc

SEQ ID NO: 1962720 - RNA, 21 nt, Homo sapiens
uuugagacgguguaccagcag

SEQ ID NO: 1962721 - RNA, 15 nt, Homo sapiens
caaagugaccuccag

SEQ ID NO: 1962722 - RNA, 23 nt, Homo sapiens
auauaacugucuuaguacaccau

SEQ ID NO: 1962723 - RNA, 15 nt, Homo sapiens
cagacccaucucucc

SEQ ID NO: 1962724 - RNA, 23 nt, Homo sapiens
auuuaagggaaugugagcacaau

SEQ ID NO: 1962725 - RNA, 13 nt, Homo sapiens
ugccucagcugug

SEQ ID NO: 1962726 - RNA, 14 nt, Homo sapiens
uaaaugcuauuaua

SEQ ID NO: 1962727 - RNA, 19 nt, Homo sapiens
uguggcagaucuacauguc

SEQ ID NO: 1962728 - RNA, 19 nt, Homo sapiens
ggcuuaaugaaggucauaa

SEQ ID NO: 1962729 - RNA, 16 nt, Homo sapiens
auuuuagacuuaccuu

SEQ ID NO: 1962730 - RNA, 19 nt, Homo sapiens
uuacugauuaggacuuuua

SEQ ID NO: 1962731 - RNA, 14 nt, Homo sapiens
uaaaacuguuucaa

SEQ ID NO: 1962732 - RNA, 18 nt, Homo sapiens
ugaauuucuuugauuuaa

SEQ ID NO: 1962733 - RNA, 17 nt, Homo sapiens
aaacccccaaaccagau

SEQ ID NO: 1962734 - RNA, 12 nt, Homo sapiens
aagaauacucca

SEQ ID NO: 1962735 - RNA, 23 nt, Homo sapiens
gauacuccgcugucggcacauuc

SEQ ID NO: 1962736 - RNA, 24 nt, Homo sapiens
cuuauguaaacaaucagaccacau

SEQ ID NO: 1962737 - RNA, 14 nt, Homo sapiens
caggcgccugccac

SEQ ID NO: 1962738 - RNA, 18 nt, Homo sapiens
gcuauucgccagcagaca

SEQ ID NO: 1962739 - RNA, 20 nt, Homo sapiens
gcucagugcaaaacugauga

SEQ ID NO: 1962740 - RNA, 20 nt, Homo sapiens
ggaaugggaagaagcaguuu

SEQ ID NO: 1962741 - RNA, 15 nt, Homo sapiens
cacccagagcuuucc

SEQ ID NO: 1962742 - RNA, 14 nt, Homo sapiens
uaaccaugucuguu

SEQ ID NO: 1962743 - RNA, 15 nt, Homo sapiens
uggaaaaaugaacug

SEQ ID NO: 1962744 - RNA, 23 nt, Homo sapiens
aguugaugggggccaggacacca

SEQ ID NO: 1962745 - RNA, 14 nt, Homo sapiens
uucgugaugggcag

SEQ ID NO: 1962746 - RNA, 23 nt, Homo sapiens
uccaaaaguuaaacuuuaucuca

SEQ ID NO: 1962747 - RNA, 16 nt, Homo sapiens
uuuuucccccaugaaa

SEQ ID NO: 1962748 - RNA, 16 nt, Homo sapiens
aaagcagucacugugg

SEQ ID NO: 1962749 - RNA, 21 nt, Homo sapiens
gguuggauggauggguggaug

SEQ ID NO: 1962750 - RNA, 19 nt, Homo sapiens
uguuagugugugugcaugu

SEQ ID NO: 1962751 - RNA, 23 nt, Homo sapiens
augaccaauccuaugucauuucu

SEQ ID NO: 1962752 - RNA, 23 nt, Homo sapiens
guaauuuuuuuaucgucacugcu

SEQ ID NO: 1962753 - RNA, 17 nt, Homo sapiens
agcaggaccugugcuuu

SEQ ID NO: 1962754 - RNA, 23 nt, Homo sapiens
ugcugaauauauagaauucagaa

SEQ ID NO: 1962755 - RNA, 20 nt, Homo sapiens
acagacauacauuuaugcac

SEQ ID NO: 1962756 - RNA, 19 nt, Homo sapiens
uauaaugauucauaagaca

SEQ ID NO: 1962757 - RNA, 17 nt, Homo sapiens
ccuucguuaacugugua

SEQ ID NO: 1962758 - RNA, 19 nt, Homo sapiens
cuaagagacuggugacauc

SEQ ID NO: 1962759 - RNA, 14 nt, Homo sapiens
augaguaaaaucac

SEQ ID NO: 1962760 - RNA, 14 nt, Homo sapiens
ucuggauaacaaga

SEQ ID NO: 1962761 - RNA, 13 nt, Homo sapiens
uuauuaacuaaga

SEQ ID NO: 1962762 - RNA, 23 nt, Homo sapiens
gccaggcugccucggacuccaug

SEQ ID NO: 1962763 - RNA, 16 nt, Homo sapiens
ggcagugccuguaauc

SEQ ID NO: 1962764 - RNA, 12 nt, Homo sapiens
aggggcucccac

SEQ ID NO: 1962765 - RNA, 21 nt, Homo sapiens
uggucccaggaagcagggaga

SEQ ID NO: 1962766 - RNA, 17 nt, Homo sapiens
uaaaugagcaaauauca

SEQ ID NO: 1962767 - RNA, 15 nt, Homo sapiens
augugacacacuggc

SEQ ID NO: 1962768 - RNA, 11 nt, Homo sapiens
aaaacuacagg

SEQ ID NO: 1962769 - RNA, 12 nt, Homo sapiens
gagaaccuucca

SEQ ID NO: 1962770 - RNA, 15 nt, Homo sapiens
agcugaggacacacc

SEQ ID NO: 1962771 - RNA, 20 nt, Homo sapiens
auucauuuauucaucauuca

SEQ ID NO: 1962772 - RNA, 16 nt, Homo sapiens
aauugucaaaugucau

SEQ ID NO: 1962773 - RNA, 20 nt, Homo sapiens
cucaauuuuuuucaccucuu

SEQ ID NO: 1962774 - RNA, 22 nt, Homo sapiens
cagagcccugaguuucuuggcu

SEQ ID NO: 1962775 - RNA, 21 nt, Homo sapiens
ugggcugagugacacaagcac

SEQ ID NO: 1962776 - RNA, 20 nt, Homo sapiens
uuaauaauaaagcuaccauu

SEQ ID NO: 1962777 - RNA, 19 nt, Homo sapiens
aucuccugugcauggguga

SEQ ID NO: 1962778 - RNA, 21 nt, Homo sapiens
uacuugugaaacacagcuguu

SEQ ID NO: 1962779 - RNA, 15 nt, Homo sapiens
aauguauaaugggaa

SEQ ID NO: 1962780 - RNA, 21 nt, Homo sapiens
accaaugccaaaaaaagacag

SEQ ID NO: 1962781 - RNA, 18 nt, Homo sapiens
gauccacuucucucagga

SEQ ID NO: 1962782 - RNA, 13 nt, Homo sapiens
ucuaaaccaaaaa

SEQ ID NO: 1962783 - RNA, 12 nt, Homo sapiens
aauacaauguga

SEQ ID NO: 1962784 - RNA, 17 nt, Homo sapiens
ggaaauaacauugcacu

SEQ ID NO: 1962785 - RNA, 16 nt, Homo sapiens
uguugaucagcaaauu

SEQ ID NO: 1962786 - RNA, 12 nt, Homo sapiens
cguugucccuga

SEQ ID NO: 1962787 - RNA, 22 nt, Homo sapiens
aaacacuuugccuccuguguac

SEQ ID NO: 1962788 - RNA, 21 nt, Homo sapiens
ugcuugaacccagaaggcaga

SEQ ID NO: 1962789 - RNA, 19 nt, Homo sapiens
cugagcaccgaauauugag

SEQ ID NO: 1962790 - RNA, 16 nt, Homo sapiens
augucuccugagcacc

SEQ ID NO: 1962791 - RNA, 13 nt, Homo sapiens
agcagcacuuuug

SEQ ID NO: 1962792 - RNA, 13 nt, Homo sapiens
uucuacacaguaa

SEQ ID NO: 1962793 - RNA, 20 nt, Homo sapiens
cuuccugggucaagugcuaa

SEQ ID NO: 1962794 - RNA, 18 nt, Homo sapiens
guauggcaugaacaucuu

SEQ ID NO: 1962795 - RNA, 24 nt, Homo sapiens
ugauuauauuucacccaucucuca

SEQ ID NO: 1962796 - RNA, 22 nt, Homo sapiens
ugaccaacauucaaaagcacaa

SEQ ID NO: 1962797 - RNA, 15 nt, Homo sapiens
ugggaggucuugcua

SEQ ID NO: 1962798 - RNA, 21 nt, Homo sapiens
gaagucagaggagaugugguc

SEQ ID NO: 1962799 - RNA, 18 nt, Homo sapiens
aagauuacccccaguccu

SEQ ID NO: 1962800 - RNA, 15 nt, Homo sapiens
uucuuguugcugcau

SEQ ID NO: 1962801 - RNA, 19 nt, Homo sapiens
aaaaacaugagcaucccca

SEQ ID NO: 1962802 - RNA, 14 nt, Homo sapiens
aaaauaaaacagua

SEQ ID NO: 1962803 - RNA, 15 nt, Homo sapiens
caucaguuacagaga

SEQ ID NO: 1962804 - RNA, 15 nt, Homo sapiens
uccugcagucuggcu

SEQ ID NO: 1962805 - RNA, 23 nt, Homo sapiens
uuuaaaugucaaaugugaauugg

SEQ ID NO: 1962806 - RNA, 15 nt, Homo sapiens
uaaacugaaucacaa

SEQ ID NO: 1962807 - RNA, 20 nt, Homo sapiens
gacaaagccuuaaaaugcau

SEQ ID NO: 1962808 - RNA, 16 nt, Homo sapiens
ccucggggcagggcag

SEQ ID NO: 1962809 - RNA, 23 nt, Homo sapiens
agugggaaacaagaacacucgga

SEQ ID NO: 1962810 - RNA, 23 nt, Homo sapiens
uagccgacaacagagacuggacu

SEQ ID NO: 1962811 - RNA, 15 nt, Homo sapiens
uaaauaaacaugacc

SEQ ID NO: 1962812 - RNA, 20 nt, Homo sapiens
aagagacucuggggcacuaa

SEQ ID NO: 1962813 - RNA, 18 nt, Homo sapiens
caaauaaugaacagcaga

SEQ ID NO: 1962814 - RNA, 15 nt, Homo sapiens
cugcugccccaaagg

SEQ ID NO: 1962815 - RNA, 15 nt, Homo sapiens
gaaggauaaaagccc

SEQ ID NO: 1962816 - RNA, 19 nt, Homo sapiens
uccuaggaggaaaauucca

SEQ ID NO: 1962817 - RNA, 15 nt, Homo sapiens
gccuuguaucuugca

SEQ ID NO: 1962818 - RNA, 13 nt, Homo sapiens
cucauguuugugc

SEQ ID NO: 1962819 - RNA, 16 nt, Homo sapiens
gaggaacucgccucag

SEQ ID NO: 1962820 - RNA, 21 nt, Homo sapiens
ccgggcgugguggcacaugcc

SEQ ID NO: 1962821 - RNA, 12 nt, Homo sapiens
uuaaaacagcug

SEQ ID NO: 1962822 - RNA, 20 nt, Homo sapiens
agauuauuaaaagaugucuc

SEQ ID NO: 1962823 - RNA, 17 nt, Homo sapiens
cccucugcugaagacuu

SEQ ID NO: 1962824 - RNA, 14 nt, Homo sapiens
ugccugacuaggga

SEQ ID NO: 1962825 - RNA, 22 nt, Homo sapiens
ugguuugggcuccacauugcaa

SEQ ID NO: 1962826 - RNA, 21 nt, Homo sapiens
gcugcugaaugcauucagggg

SEQ ID NO: 1962827 - RNA, 13 nt, Homo sapiens
gcauuacuuugaa

SEQ ID NO: 1962828 - RNA, 15 nt, Homo sapiens
cccuacugcugugaa

SEQ ID NO: 1962829 - RNA, 16 nt, Homo sapiens
auucugauauguaucc

SEQ ID NO: 1962830 - RNA, 12 nt, Homo sapiens
guguaugcagua

SEQ ID NO: 1962831 - RNA, 19 nt, Homo sapiens
ucugcuccaccuugugacc

SEQ ID NO: 1962832 - RNA, 13 nt, Homo sapiens
cccuaugcuccag

SEQ ID NO: 1962833 - RNA, 19 nt, Homo sapiens
uggucuucgcagccuagau

SEQ ID NO: 1962834 - RNA, 19 nt, Homo sapiens
cauaggcaauaucuuuaau

SEQ ID NO: 1962835 - RNA, 21 nt, Homo sapiens
aagguuggcccccacgugggg

SEQ ID NO: 1962836 - RNA, 19 nt, Homo sapiens
cucacugagugauacuuua

SEQ ID NO: 1962837 - RNA, 21 nt, Homo sapiens
gaauuaagaauugguugccau

SEQ ID NO: 1962838 - RNA, 18 nt, Homo sapiens
agccuucucauuugccau

SEQ ID NO: 1962839 - RNA, 21 nt, Homo sapiens
uaaaaaccaaauaagcaucug

SEQ ID NO: 1962840 - RNA, 21 nt, Homo sapiens
ucuuuugggggucaacaguuu

SEQ ID NO: 1962841 - RNA, 21 nt, Homo sapiens
caaauuaacuuuacauccuuu

SEQ ID NO: 1962842 - RNA, 23 nt, Homo sapiens
caacugcaucaagaugugacaug

SEQ ID NO: 1962843 - RNA, 19 nt, Homo sapiens
uucauucuuggguuaacag

SEQ ID NO: 1962844 - RNA, 12 nt, Homo sapiens
ugugccuauagu

SEQ ID NO: 1962845 - RNA, 22 nt, Homo sapiens
ggagcgaggaaggaaagcacag

SEQ ID NO: 1962846 - RNA, 20 nt, Homo sapiens
augaacaaauugaacucuuu

SEQ ID NO: 1962847 - RNA, 17 nt, Homo sapiens
aauugccuucauuuuau

SEQ ID NO: 1962848 - RNA, 18 nt, Homo sapiens
auggaauauaaauaucac

SEQ ID NO: 1962849 - RNA, 14 nt, Homo sapiens
cugagcaaggaguu

SEQ ID NO: 1962850 - RNA, 14 nt, Homo sapiens
aaguguaagcagaa

SEQ ID NO: 1962851 - RNA, 20 nt, Homo sapiens
accuugaugagcugugcaca

SEQ ID NO: 1962852 - RNA, 13 nt, Homo sapiens
aauucucuugcug

SEQ ID NO: 1962853 - RNA, 12 nt, Homo sapiens
cacacagcacuc

SEQ ID NO: 1962854 - RNA, 12 nt, Homo sapiens
ggaaacagagaa

SEQ ID NO: 1962855 - RNA, 17 nt, Homo sapiens
cguuaggguuugagaga

SEQ ID NO: 1962856 - RNA, 15 nt, Homo sapiens
cagggagaugucuag

SEQ ID NO: 1962857 - RNA, 15 nt, Homo sapiens
uggucuccacugggg

SEQ ID NO: 1962858 - RNA, 16 nt, Homo sapiens
aaaccccuucucugug

SEQ ID NO: 1962859 - RNA, 14 nt, Homo sapiens
uguuacuacaugca

SEQ ID NO: 1962860 - RNA, 14 nt, Homo sapiens
acuuccuccaggaa

SEQ ID NO: 1962861 - RNA, 23 nt, Homo sapiens
uccagaaucccguaacaccugau

SEQ ID NO: 1962862 - RNA, 19 nt, Homo sapiens
ucuuuuggauuauuccuca

SEQ ID NO: 1962863 - RNA, 14 nt, Homo sapiens
acacagcaguauug

SEQ ID NO: 1962864 - RNA, 17 nt, Homo sapiens
acgguuccuacacagga

SEQ ID NO: 1962865 - RNA, 12 nt, Homo sapiens
acuccacagugu

SEQ ID NO: 1962866 - RNA, 17 nt, Homo sapiens
gguacuggugagggcaa

SEQ ID NO: 1962867 - RNA, 14 nt, Homo sapiens
uauugaccuaauaa

SEQ ID NO: 1962868 - RNA, 15 nt, Homo sapiens
cuccccgagaguccu

SEQ ID NO: 1962869 - RNA, 15 nt, Homo sapiens
agaaaauaagugcuc

SEQ ID NO: 1962870 - RNA, 13 nt, Homo sapiens
gcuuaaaauaagc

SEQ ID NO: 1962871 - RNA, 17 nt, Homo sapiens
accuacaagauuccugg

SEQ ID NO: 1962872 - RNA, 10 nt, Homo sapiens
caggagcuca

SEQ ID NO: 1962873 - RNA, 11 nt, Homo sapiens
uuaauguaauc

SEQ ID NO: 1962874 - RNA, 17 nt, Homo sapiens
cguuugcuuaaugccag

SEQ ID NO: 1962875 - RNA, 15 nt, Homo sapiens
ucugccuaugcacug

SEQ ID NO: 1962876 - RNA, 22 nt, Homo sapiens
caaacgauuuggaucaaaagga

SEQ ID NO: 1962877 - RNA, 16 nt, Homo sapiens
auucuauccaucuccu

SEQ ID NO: 1962878 - RNA, 14 nt, Homo sapiens
acaggagcugggau

SEQ ID NO: 1962879 - RNA, 19 nt, Homo sapiens
augcuguuuaugacacaau

SEQ ID NO: 1962880 - RNA, 14 nt, Homo sapiens
gaccuucauuucau

SEQ ID NO: 1962881 - RNA, 14 nt, Homo sapiens
gauaugcauucaag

SEQ ID NO: 1962882 - RNA, 14 nt, Homo sapiens
cuuacaauucccug

SEQ ID NO: 1962883 - RNA, 14 nt, Homo sapiens
ccucugauuucaca

SEQ ID NO: 1962884 - RNA, 15 nt, Homo sapiens
uggcugugaaauuca

SEQ ID NO: 1962885 - RNA, 20 nt, Homo sapiens
ucugaagucacaucacagga

SEQ ID NO: 1962886 - RNA, 15 nt, Homo sapiens
gcaaggacauugccc

SEQ ID NO: 1962887 - RNA, 16 nt, Homo sapiens
ugaauaguaagcauaa

SEQ ID NO: 1962888 - RNA, 15 nt, Homo sapiens
uauagcguucccaac

SEQ ID NO: 1962889 - RNA, 19 nt, Homo sapiens
ugauacuuguuccagaugg

SEQ ID NO: 1962890 - RNA, 12 nt, Homo sapiens
uggcaugaucuc

SEQ ID NO: 1962891 - RNA, 16 nt, Homo sapiens
aaauacauacggucag

SEQ ID NO: 1962892 - RNA, 23 nt, Homo sapiens
ucccaugacauggagaccgugac

SEQ ID NO: 1962893 - RNA, 20 nt, Homo sapiens
uugaaggcuuaauugacuga

SEQ ID NO: 1962894 - RNA, 19 nt, Homo sapiens
ugaugcuuagauguuccag

SEQ ID NO: 1962895 - RNA, 17 nt, Homo sapiens
gcccccaccccucgggg

SEQ ID NO: 1962896 - RNA, 18 nt, Homo sapiens
uacuaugacacuguuaau

SEQ ID NO: 1962897 - RNA, 22 nt, Homo sapiens
uggacaaucaugaaauaugcau

SEQ ID NO: 1962898 - RNA, 13 nt, Homo sapiens
uuccgcaccaaua

SEQ ID NO: 1962899 - RNA, 19 nt, Homo sapiens
uagauuacgacagguuugg

SEQ ID NO: 1962900 - RNA, 21 nt, Homo sapiens
aacuagcacuuuauaagccaa

SEQ ID NO: 1962901 - RNA, 13 nt, Homo sapiens
ugcagcuggaaug

SEQ ID NO: 1962902 - RNA, 13 nt, Homo sapiens
ggcaccuguaauc

SEQ ID NO: 1962903 - RNA, 16 nt, Homo sapiens
uugcuguucacccaca

SEQ ID NO: 1962904 - RNA, 19 nt, Homo sapiens
caugugcucagccccagac

SEQ ID NO: 1962905 - RNA, 24 nt, Homo sapiens
aaguccagccacuugacuggcaca

SEQ ID NO: 1962906 - RNA, 14 nt, Homo sapiens
cuugaaaguuuucc

SEQ ID NO: 1962907 - RNA, 19 nt, Homo sapiens
ccucgcaacccugccuguc

SEQ ID NO: 1962908 - RNA, 13 nt, Homo sapiens
aaugaaccuucug

SEQ ID NO: 1962909 - RNA, 19 nt, Homo sapiens
acaccaaaccugccccuug

SEQ ID NO: 1962910 - RNA, 17 nt, Homo sapiens
uguuuggaaaccacagu

SEQ ID NO: 1962911 - RNA, 23 nt, Homo sapiens
aacccugugaucuauaccaccuu

SEQ ID NO: 1962912 - RNA, 17 nt, Homo sapiens
aaauaaagucucuuccu

SEQ ID NO: 1962913 - RNA, 17 nt, Homo sapiens
cagugaucucacuaaaa

SEQ ID NO: 1962914 - RNA, 22 nt, Homo sapiens
auuggaacuggaggcagggaac

SEQ ID NO: 1962915 - RNA, 21 nt, Homo sapiens
uugcugugaaaugacugcauc

SEQ ID NO: 1962916 - RNA, 16 nt, Homo sapiens
cucuucccccuuccac

SEQ ID NO: 1962917 - RNA, 19 nt, Homo sapiens
cacaugagacuuacugcuc

SEQ ID NO: 1962918 - RNA, 14 nt, Homo sapiens
aaauauuuucuaca

SEQ ID NO: 1962919 - RNA, 12 nt, Homo sapiens
auugucacucca

SEQ ID NO: 1962920 - RNA, 18 nt, Homo sapiens
aaacugaccaaacgcuua

SEQ ID NO: 1962921 - RNA, 11 nt, Homo sapiens
acugugcuccc

SEQ ID NO: 1962922 - RNA, 19 nt, Homo sapiens
agaaagcucauggcugugu

SEQ ID NO: 1962923 - RNA, 22 nt, Homo sapiens
ugucuuuaaaaguauccagaga

SEQ ID NO: 1962924 - RNA, 18 nt, Homo sapiens
uguauuuuccaagugugc

SEQ ID NO: 1962925 - RNA, 15 nt, Homo sapiens
agugccuuauucuca

SEQ ID NO: 1962926 - RNA, 14 nt, Homo sapiens
ugcccaccuuggcc

SEQ ID NO: 1962927 - RNA, 21 nt, Homo sapiens
ccugaaagucuguguccaauu

SEQ ID NO: 1962928 - RNA, 21 nt, Homo sapiens
cucuaacaaaaugguuuauuu

SEQ ID NO: 1962929 - RNA, 16 nt, Homo sapiens
ccggcagcacaagcug

SEQ ID NO: 1962930 - RNA, 17 nt, Homo sapiens
acuuuucuaacauaugu

SEQ ID NO: 1962931 - RNA, 22 nt, Homo sapiens
ccuuccacccucacauccccau

SEQ ID NO: 1962932 - RNA, 12 nt, Homo sapiens
gaacaugacauu

SEQ ID NO: 1962933 - RNA, 13 nt, Homo sapiens
uuacugauauuau

SEQ ID NO: 1962934 - RNA, 14 nt, Homo sapiens
ucucccaguccauu

SEQ ID NO: 1962935 - RNA, 23 nt, Homo sapiens
gcucuccggggccauuugcaaua

SEQ ID NO: 1962936 - RNA, 19 nt, Homo sapiens
ccagcaucgucucauguaa

SEQ ID NO: 1962937 - RNA, 23 nt, Homo sapiens
ucaauuauacugaagcuaguuca

SEQ ID NO: 1962938 - RNA, 21 nt, Homo sapiens
uguaacggaugaccauaugca

SEQ ID NO: 1962939 - RNA, 20 nt, Homo sapiens
auaguauucaugacuaugga

SEQ ID NO: 1962940 - RNA, 20 nt, Homo sapiens
uuuaaucuguauuuccccaa

SEQ ID NO: 1962941 - RNA, 13 nt, Homo sapiens
cagaagaucugaa

SEQ ID NO: 1962942 - RNA, 15 nt, Homo sapiens
caaacugaacacugc

SEQ ID NO: 1962943 - RNA, 18 nt, Homo sapiens
gccuccauccucaucucu

SEQ ID NO: 1962944 - RNA, 22 nt, Homo sapiens
ugcuauacagcugggaacagca

SEQ ID NO: 1962945 - RNA, 12 nt, Homo sapiens
cuccucugcacu

SEQ ID NO: 1962946 - RNA, 20 nt, Homo sapiens
gaaguagacucauucuucac

SEQ ID NO: 1962947 - RNA, 21 nt, Homo sapiens
ucuacccaaaggauacuguaa

SEQ ID NO: 1962948 - RNA, 15 nt, Homo sapiens
aucaaagagcacauu

SEQ ID NO: 1962949 - RNA, 18 nt, Homo sapiens
ccagagggagaguuugaa

SEQ ID NO: 1962950 - RNA, 18 nt, Homo sapiens
gaguuucacuguacugca

SEQ ID NO: 1962951 - RNA, 17 nt, Homo sapiens
caggauguggcacugcu

SEQ ID NO: 1962952 - RNA, 22 nt, Homo sapiens
gaaaccugggagagacuuggau

SEQ ID NO: 1962953 - RNA, 22 nt, Homo sapiens
gcuuugguaaaacaguuucauc

SEQ ID NO: 1962954 - RNA, 16 nt, Homo sapiens
cuguggcggugccugg

SEQ ID NO: 1962955 - RNA, 23 nt, Homo sapiens
guuuuuuuuuuccacuuagaaau

SEQ ID NO: 1962956 - RNA, 16 nt, Homo sapiens
ugugcuucauuccaau

SEQ ID NO: 1962957 - RNA, 17 nt, Homo sapiens
cuaaaauuauggaaaca

SEQ ID NO: 1962958 - RNA, 17 nt, Homo sapiens
aacuuaccuacugggga

SEQ ID NO: 1962959 - RNA, 17 nt, Homo sapiens
uguuuugcccaccagau

SEQ ID NO: 1962960 - RNA, 16 nt, Homo sapiens
ucaugcgcaacuggag

SEQ ID NO: 1962961 - RNA, 21 nt, Homo sapiens
uuuuuguuucuuccaaagcac

SEQ ID NO: 1962962 - RNA, 12 nt, Homo sapiens
uucuccaucucu

SEQ ID NO: 1962963 - RNA, 12 nt, Homo sapiens
cucaccauuuca

SEQ ID NO: 1962964 - RNA, 21 nt, Homo sapiens
ccuggugugcagggugaagca

SEQ ID NO: 1962965 - RNA, 20 nt, Homo sapiens
auaauuguuucauucauccu

SEQ ID NO: 1962966 - RNA, 23 nt, Homo sapiens
aggcuggagauccuaacugagaa

SEQ ID NO: 1962967 - RNA, 21 nt, Homo sapiens
aggucguuuuuuucauuccau

SEQ ID NO: 1962968 - RNA, 23 nt, Homo sapiens
ggcaaaaguaaucauguuuuaau

SEQ ID NO: 1962969 - RNA, 17 nt, Homo sapiens
cacacugagcugagggg

SEQ ID NO: 1962970 - RNA, 20 nt, Homo sapiens
ccugauggaaguaaagccuc

SEQ ID NO: 1962971 - RNA, 16 nt, Homo sapiens
agguucuuaucaacau

SEQ ID NO: 1962972 - RNA, 15 nt, Homo sapiens
acuauucaaacaguc

SEQ ID NO: 1962973 - RNA, 20 nt, Homo sapiens
gcgugcgccacuaugccuga

SEQ ID NO: 1962974 - RNA, 23 nt, Homo sapiens
acauauuuuaaccuuuugcuccu

SEQ ID NO: 1962975 - RNA, 18 nt, Homo sapiens
augagggccucguuuauu

SEQ ID NO: 1962976 - RNA, 13 nt, Homo sapiens
uuuagcccuaaaa

SEQ ID NO: 1962977 - RNA, 18 nt, Homo sapiens
accugcguuuucauuugu

SEQ ID NO: 1962978 - RNA, 15 nt, Homo sapiens
augauucuccugccu

SEQ ID NO: 1962979 - RNA, 15 nt, Homo sapiens
cagccucaccagcgc

SEQ ID NO: 1962980 - RNA, 15 nt, Homo sapiens
agacucacuguggga

SEQ ID NO: 1962981 - RNA, 12 nt, Homo sapiens
cacgucuuuucu

SEQ ID NO: 1962982 - RNA, 19 nt, Homo sapiens
uuuuuggugguucugcugu

SEQ ID NO: 1962983 - RNA, 16 nt, Homo sapiens
uaacauaccuaagaag

SEQ ID NO: 1962984 - RNA, 21 nt, Homo sapiens
cagaugaaauuuauuuccauc

SEQ ID NO: 1962985 - RNA, 20 nt, Homo sapiens
ccacuagggcucuuguguuu

SEQ ID NO: 1962986 - RNA, 12 nt, Homo sapiens
aaguacucauac

SEQ ID NO: 1962987 - RNA, 20 nt, Homo sapiens
auguuuggguauugugugag

SEQ ID NO: 1962988 - RNA, 15 nt, Homo sapiens
uuauucuacaucauu

SEQ ID NO: 1962989 - RNA, 19 nt, Homo sapiens
acugccuucucaacuccaa

SEQ ID NO: 1962990 - RNA, 22 nt, Homo sapiens
auauagaaugaucuauugcuca

SEQ ID NO: 1962991 - RNA, 22 nt, Homo sapiens
auaauucuaaguuauuuacuuu

SEQ ID NO: 1962992 - RNA, 12 nt, Homo sapiens
aacagcaaaauu

SEQ ID NO: 1962993 - RNA, 22 nt, Homo sapiens
aagggcagagaacugucuuuca

SEQ ID NO: 1962994 - RNA, 12 nt, Homo sapiens
aucagcaaauuu

SEQ ID NO: 1962995 - RNA, 22 nt, Homo sapiens
uuuaaaaaguaccacauuccau

SEQ ID NO: 1962996 - RNA, 16 nt, Homo sapiens
agaagaaaaauggaaa

SEQ ID NO: 1962997 - RNA, 20 nt, Homo sapiens
acaugguucaaaucuagaag

SEQ ID NO: 1962998 - RNA, 19 nt, Homo sapiens
auuugggagaagaucucaa

SEQ ID NO: 1962999 - RNA, 17 nt, Homo sapiens
cauaauucuaaggaguu

SEQ ID NO: 1963000 - RNA, 19 nt, Homo sapiens
augugccuauaaucccagc

SEQ ID NO: 1963001 - RNA, 19 nt, Homo sapiens
ggaaggaugacuugacaag

SEQ ID NO: 1963002 - RNA, 13 nt, Homo sapiens
guuucguguauau

SEQ ID NO: 1963003 - RNA, 17 nt, Homo sapiens
cggacaguuuauuuguu

SEQ ID NO: 1963004 - RNA, 15 nt, Homo sapiens
ggcucuuuccuugcu

SEQ ID NO: 1963005 - RNA, 14 nt, Homo sapiens
gcucuguuacccag

SEQ ID NO: 1963006 - RNA, 13 nt, Homo sapiens
auuaugugacuug

SEQ ID NO: 1963007 - RNA, 14 nt, Homo sapiens
ugcaguuuuacuaa

SEQ ID NO: 1963008 - RNA, 17 nt, Homo sapiens
aagcaucccucacccau

SEQ ID NO: 1963009 - RNA, 14 nt, Homo sapiens
uuggucacauggag

SEQ ID NO: 1963010 - RNA, 15 nt, Homo sapiens
agcucacaagcccag

SEQ ID NO: 1963011 - RNA, 11 nt, Homo sapiens
ccaggauuuug

SEQ ID NO: 1963012 - RNA, 20 nt, Homo sapiens
auugaucauuuuuauaacca

SEQ ID NO: 1963013 - RNA, 19 nt, Homo sapiens
aaauauccaaagacuguac

SEQ ID NO: 1963014 - RNA, 14 nt, Homo sapiens
cacucccuugagga

SEQ ID NO: 1963015 - RNA, 19 nt, Homo sapiens
gugcagaagcaugaucaca

SEQ ID NO: 1963016 - RNA, 15 nt, Homo sapiens
acuccauuauuccuc

SEQ ID NO: 1963017 - RNA, 23 nt, Homo sapiens
ucuuagcuugucugugaucucug

SEQ ID NO: 1963018 - RNA, 16 nt, Homo sapiens
ggaguccacaggcucc

SEQ ID NO: 1963019 - RNA, 14 nt, Homo sapiens
aucuugggggucac

SEQ ID NO: 1963020 - RNA, 19 nt, Homo sapiens
gccauagaccuacagaccu

SEQ ID NO: 1963021 - RNA, 13 nt, Homo sapiens
uguagaaggccag

SEQ ID NO: 1963022 - RNA, 17 nt, Homo sapiens
aggucuggaguuugaga

SEQ ID NO: 1963023 - RNA, 23 nt, Homo sapiens
uaaguauucuucaucagcauuua

SEQ ID NO: 1963024 - RNA, 12 nt, Homo sapiens
agugaugggagu

SEQ ID NO: 1963025 - RNA, 23 nt, Homo sapiens
agcucuggacagccccacccugg

SEQ ID NO: 1963026 - RNA, 22 nt, Homo sapiens
ccauuuaguuuuuggauauauu

SEQ ID NO: 1963027 - RNA, 13 nt, Homo sapiens
uuucaaguucaau

SEQ ID NO: 1963028 - RNA, 12 nt, Homo sapiens
gcaaaugaugcc

SEQ ID NO: 1963029 - RNA, 15 nt, Homo sapiens
gccugccuuuucuag

SEQ ID NO: 1963030 - RNA, 14 nt, Homo sapiens
uagauaugccuuaa

SEQ ID NO: 1963031 - RNA, 13 nt, Homo sapiens
aaaaacccagcgg

SEQ ID NO: 1963032 - RNA, 16 nt, Homo sapiens
cuaaacagauguaaug

SEQ ID NO: 1963033 - RNA, 22 nt, Homo sapiens
caauaucuuuaauagguuaaua

SEQ ID NO: 1963034 - RNA, 19 nt, Homo sapiens
caugcccccaguuacugua

SEQ ID NO: 1963035 - RNA, 23 nt, Homo sapiens
uccgaucaguggugucugugaag

SEQ ID NO: 1963036 - RNA, 23 nt, Homo sapiens
cucucaccccaacuaguagcuaa

SEQ ID NO: 1963037 - RNA, 21 nt, Homo sapiens
gcccccucccuggaugacauu

SEQ ID NO: 1963038 - RNA, 15 nt, Homo sapiens
ccucccgucuucaga

SEQ ID NO: 1963039 - RNA, 12 nt, Homo sapiens
caagucuucccu

SEQ ID NO: 1963040 - RNA, 21 nt, Homo sapiens
uucaugccagcuauaaucucc

SEQ ID NO: 1963041 - RNA, 23 nt, Homo sapiens
gaccaagugcaauaugggcgggc

SEQ ID NO: 1963042 - RNA, 15 nt, Homo sapiens
agugagggucagaga

SEQ ID NO: 1963043 - RNA, 13 nt, Homo sapiens
agcacagccucac

SEQ ID NO: 1963044 - RNA, 15 nt, Homo sapiens
guauuuuuuccuuaa

SEQ ID NO: 1963045 - RNA, 16 nt, Homo sapiens
ccugacggugggccug

SEQ ID NO: 1963046 - RNA, 16 nt, Homo sapiens
uugaucaaccaaaaac

SEQ ID NO: 1963047 - RNA, 14 nt, Homo sapiens
agguguggcuucaa

SEQ ID NO: 1963048 - RNA, 16 nt, Homo sapiens
acaguucaacauaaag

SEQ ID NO: 1963049 - RNA, 16 nt, Homo sapiens
gcacaccagagacaag

SEQ ID NO: 1963050 - RNA, 16 nt, Homo sapiens
uuuggauaugaucuuu

SEQ ID NO: 1963051 - RNA, 18 nt, Homo sapiens
cugcccugccaccugucu

SEQ ID NO: 1963052 - RNA, 15 nt, Homo sapiens
acggggcuuacagga

SEQ ID NO: 1963053 - RNA, 22 nt, Homo sapiens
auuccaaaggggaccccuauga

SEQ ID NO: 1963054 - RNA, 17 nt, Homo sapiens
caaaugucuaguuucua

SEQ ID NO: 1963055 - RNA, 15 nt, Homo sapiens
ugaucuuugagccca

SEQ ID NO: 1963056 - RNA, 16 nt, Homo sapiens
auuucccugugcugac

SEQ ID NO: 1963057 - RNA, 17 nt, Homo sapiens
cagaaaagcaauacugu

SEQ ID NO: 1963058 - RNA, 17 nt, Homo sapiens
uaggaaaaguacauuua

SEQ ID NO: 1963059 - RNA, 16 nt, Homo sapiens
uaacucagacucugga

SEQ ID NO: 1963060 - RNA, 20 nt, Homo sapiens
ucaguucccagacagcuuuu

SEQ ID NO: 1963061 - RNA, 12 nt, Homo sapiens
caggacacugau

SEQ ID NO: 1963062 - RNA, 14 nt, Homo sapiens
caccaaauucugaa

SEQ ID NO: 1963063 - RNA, 17 nt, Homo sapiens
cuuuuacuacagugaca

SEQ ID NO: 1963064 - RNA, 18 nt, Homo sapiens
aucuauagcuaaguacac

SEQ ID NO: 1963065 - RNA, 19 nt, Homo sapiens
ccuuugaggcaaaggccag

SEQ ID NO: 1963066 - RNA, 19 nt, Homo sapiens
auagaauuauaacuggaaa

SEQ ID NO: 1963067 - RNA, 24 nt, Homo sapiens
acccuggaaacuaccagugggcau

SEQ ID NO: 1963068 - RNA, 20 nt, Homo sapiens
auguugaggugaccacuuaa

SEQ ID NO: 1963069 - RNA, 16 nt, Homo sapiens
agcucuugcuaucucu

SEQ ID NO: 1963070 - RNA, 20 nt, Homo sapiens
ccuuccacuuugaguaccaa

SEQ ID NO: 1963071 - RNA, 17 nt, Homo sapiens
agucuggagcugagcua

SEQ ID NO: 1963072 - RNA, 23 nt, Homo sapiens
gcaacuuauguauuuucuuccac

SEQ ID NO: 1963073 - RNA, 14 nt, Homo sapiens
uugcaucaguucau

SEQ ID NO: 1963074 - RNA, 16 nt, Homo sapiens
cuccacugccuucgau

SEQ ID NO: 1963075 - RNA, 21 nt, Homo sapiens
ugagaauuuucauugucaaaa

SEQ ID NO: 1963076 - RNA, 16 nt, Homo sapiens
gaucuggaagggccaa

SEQ ID NO: 1963077 - RNA, 18 nt, Homo sapiens
ugccuccccccacaagaa

SEQ ID NO: 1963078 - RNA, 21 nt, Homo sapiens
gcugugcauagugguuggcac

SEQ ID NO: 1963079 - RNA, 14 nt, Homo sapiens
ccaaggagcuacac

SEQ ID NO: 1963080 - RNA, 16 nt, Homo sapiens
acuagccaaaccucac

SEQ ID NO: 1963081 - RNA, 15 nt, Homo sapiens
gaccacacagacagg

SEQ ID NO: 1963082 - RNA, 17 nt, Homo sapiens
cgaaacuggaaguuauu

SEQ ID NO: 1963083 - RNA, 23 nt, Homo sapiens
auggcuuuggcuuugcaaaauaa

SEQ ID NO: 1963084 - RNA, 23 nt, Homo sapiens
cugcaucccuguguccacugaga

SEQ ID NO: 1963085 - RNA, 22 nt, Homo sapiens
uacagacccacagagugccauc

SEQ ID NO: 1963086 - RNA, 16 nt, Homo sapiens
caccccuguccucacu

SEQ ID NO: 1963087 - RNA, 20 nt, Homo sapiens
uaaauucccauuccaccaca

SEQ ID NO: 1963088 - RNA, 16 nt, Homo sapiens
acacacauaccuucau

SEQ ID NO: 1963089 - RNA, 16 nt, Homo sapiens
caacagagcacuugag

SEQ ID NO: 1963090 - RNA, 20 nt, Homo sapiens
guauuuaggaugacugcugu

SEQ ID NO: 1963091 - RNA, 14 nt, Homo sapiens
aucuugcucugcau

SEQ ID NO: 1963092 - RNA, 14 nt, Homo sapiens
aaaugaauacugaa

SEQ ID NO: 1963093 - RNA, 20 nt, Homo sapiens
auguugcccaguguguuucu

SEQ ID NO: 1963094 - RNA, 18 nt, Homo sapiens
aaagaggauuaagcuuuu

SEQ ID NO: 1963095 - RNA, 21 nt, Homo sapiens
cauuuggugguacuuuauucu

SEQ ID NO: 1963096 - RNA, 17 nt, Homo sapiens
uagacaagcaagugcac

SEQ ID NO: 1963097 - RNA, 14 nt, Homo sapiens
gacaaugccaauag

SEQ ID NO: 1963098 - RNA, 13 nt, Homo sapiens
gucuaaagcuuug

SEQ ID NO: 1963099 - RNA, 19 nt, Homo sapiens
cccaucaaauugaucugca

SEQ ID NO: 1963100 - RNA, 19 nt, Homo sapiens
aucagccuuuuauguauuu

SEQ ID NO: 1963101 - RNA, 14 nt, Homo sapiens
uauguuuccauuug

SEQ ID NO: 1963102 - RNA, 14 nt, Homo sapiens
gugacuaugaacuu

SEQ ID NO: 1963103 - RNA, 13 nt, Homo sapiens
augcaacuuccuu

SEQ ID NO: 1963104 - RNA, 13 nt, Homo sapiens
auguaacuucccu

SEQ ID NO: 1963105 - RNA, 20 nt, Homo sapiens
gccagagggccccucacugg

SEQ ID NO: 1963106 - RNA, 19 nt, Homo sapiens
guguccuacacaauggugc

SEQ ID NO: 1963107 - RNA, 18 nt, Homo sapiens
ugccuuuccagugcugcu

SEQ ID NO: 1963108 - RNA, 22 nt, Homo sapiens
auuuuaacuuccuuggacucau

SEQ ID NO: 1963109 - RNA, 16 nt, Homo sapiens
acaaguuccugauaac

SEQ ID NO: 1963110 - RNA, 16 nt, Homo sapiens
cuggguuaacaguaaa

SEQ ID NO: 1963111 - RNA, 15 nt, Homo sapiens
acuuaucaaaucauu

SEQ ID NO: 1963112 - RNA, 13 nt, Homo sapiens
cccaggagcaaca

SEQ ID NO: 1963113 - RNA, 14 nt, Homo sapiens
gucugagucaucaa

SEQ ID NO: 1963114 - RNA, 17 nt, Homo sapiens
cccuagaacaagccacc

SEQ ID NO: 1963115 - RNA, 15 nt, Homo sapiens
uugaaccugugcaau

SEQ ID NO: 1963116 - RNA, 13 nt, Homo sapiens
gccagcgggcaca

SEQ ID NO: 1963117 - RNA, 20 nt, Homo sapiens
ucauauucuucauauccuuc

SEQ ID NO: 1963118 - RNA, 15 nt, Homo sapiens
caauuuucuguaaga

SEQ ID NO: 1963119 - RNA, 23 nt, Homo sapiens
uuccugauaauaaauguauuuag

SEQ ID NO: 1963120 - RNA, 17 nt, Homo sapiens
agucuguuguucuugaa

SEQ ID NO: 1963121 - RNA, 12 nt, Homo sapiens
uguuucucauau

SEQ ID NO: 1963122 - RNA, 21 nt, Homo sapiens
aucuacaagauccuccugcug

SEQ ID NO: 1963123 - RNA, 13 nt, Homo sapiens
agaagcagcucuu

SEQ ID NO: 1963124 - RNA, 23 nt, Homo sapiens
gcauggggauugcagagugacca

SEQ ID NO: 1963125 - RNA, 17 nt, Homo sapiens
ugucuggagcggcugcu

SEQ ID NO: 1963126 - RNA, 14 nt, Homo sapiens
uugaaaccuuugac

SEQ ID NO: 1963127 - RNA, 12 nt, Homo sapiens
aguagcaauuuc

SEQ ID NO: 1963128 - RNA, 15 nt, Homo sapiens
gccucgaaaaccauc

SEQ ID NO: 1963129 - RNA, 12 nt, Homo sapiens
uacaguaugugu

SEQ ID NO: 1963130 - RNA, 18 nt, Homo sapiens
auucuaugaacagugaca

SEQ ID NO: 1963131 - RNA, 12 nt, Homo sapiens
ggcagcuuucuu

SEQ ID NO: 1963132 - RNA, 12 nt, Homo sapiens
gcaggugcgauu

SEQ ID NO: 1963133 - RNA, 14 nt, Homo sapiens
aaaguagcaauuuc

SEQ ID NO: 1963134 - RNA, 18 nt, Homo sapiens
ugauggagaggacagagc

SEQ ID NO: 1963135 - RNA, 21 nt, Homo sapiens
auucaaggagaauaugauaaa

SEQ ID NO: 1963136 - RNA, 20 nt, Homo sapiens
augaauggacucaaacugcc

SEQ ID NO: 1963137 - RNA, 11 nt, Homo sapiens
uuuagucacug

SEQ ID NO: 1963138 - RNA, 21 nt, Homo sapiens
ugucucagaugguguguccag

SEQ ID NO: 1963139 - RNA, 14 nt, Homo sapiens
ucucccugugcugu

SEQ ID NO: 1963140 - RNA, 19 nt, Homo sapiens
agaaaagcugccauuuccc

SEQ ID NO: 1963141 - RNA, 15 nt, Homo sapiens
uccuugggacucagg

SEQ ID NO: 1963142 - RNA, 22 nt, Homo sapiens
ucuuaacuaaauuugucuuuca

SEQ ID NO: 1963143 - RNA, 15 nt, Homo sapiens
accccuaaugcugca

SEQ ID NO: 1963144 - RNA, 17 nt, Homo sapiens
gucaauggcuuguucau

SEQ ID NO: 1963145 - RNA, 24 nt, Homo sapiens
cauuugcuuuuugugauaugcaca

SEQ ID NO: 1963146 - RNA, 22 nt, Homo sapiens
cugcauuugucuauucuccagc

SEQ ID NO: 1963147 - RNA, 16 nt, Homo sapiens
aagcuuaagugggcag

SEQ ID NO: 1963148 - RNA, 22 nt, Homo sapiens
caagggaaaaauuuuuauguaa

SEQ ID NO: 1963149 - RNA, 20 nt, Homo sapiens
gcaugaucuuguuacuguga

SEQ ID NO: 1963150 - RNA, 18 nt, Homo sapiens
uguuuacagauccccaag

SEQ ID NO: 1963151 - RNA, 20 nt, Homo sapiens
ucugccugacagcauccucu

SEQ ID NO: 1963152 - RNA, 23 nt, Homo sapiens
cccugguuuguuuuccccaguug

SEQ ID NO: 1963153 - RNA, 13 nt, Homo sapiens
aagccagaaucac

SEQ ID NO: 1963154 - RNA, 14 nt, Homo sapiens
gccgcggcccagac

SEQ ID NO: 1963155 - RNA, 22 nt, Homo sapiens
aaggcaauccuaagcaaaaaga

SEQ ID NO: 1963156 - RNA, 15 nt, Homo sapiens
aauaacaggcauuug

SEQ ID NO: 1963157 - RNA, 22 nt, Homo sapiens
acccgccgcugccaccaucucc

SEQ ID NO: 1963158 - RNA, 14 nt, Homo sapiens
uugaguagaucugc

SEQ ID NO: 1963159 - RNA, 22 nt, Homo sapiens
cagcuacuucuccugcacuuug

SEQ ID NO: 1963160 - RNA, 14 nt, Homo sapiens
ccaaccuguucaag

SEQ ID NO: 1963161 - RNA, 15 nt, Homo sapiens
cugguagcugagggg

SEQ ID NO: 1963162 - RNA, 15 nt, Homo sapiens
cuaugcaauucuuaa

SEQ ID NO: 1963163 - RNA, 17 nt, Homo sapiens
auuccucugacuugcca

SEQ ID NO: 1963164 - RNA, 14 nt, Homo sapiens
cccccuucguggag

SEQ ID NO: 1963165 - RNA, 17 nt, Homo sapiens
ugaaaauaaacauguau

SEQ ID NO: 1963166 - RNA, 14 nt, Homo sapiens
ucuuaagccaagaa

SEQ ID NO: 1963167 - RNA, 16 nt, Homo sapiens
ugagcauuagcuacuu

SEQ ID NO: 1963168 - RNA, 22 nt, Homo sapiens
ccaagaccccaaaucaccacaa

SEQ ID NO: 1963169 - RNA, 16 nt, Homo sapiens
caggagugacucuggc

SEQ ID NO: 1963170 - RNA, 18 nt, Homo sapiens
acagaguuuuguaacaaa

SEQ ID NO: 1963171 - RNA, 23 nt, Homo sapiens
ugcucugggacguggacaugccu

SEQ ID NO: 1963172 - RNA, 22 nt, Homo sapiens
cugggcaaggaggccacgugau

SEQ ID NO: 1963173 - RNA, 16 nt, Homo sapiens
cucaguuccaaaguca

SEQ ID NO: 1963174 - RNA, 22 nt, Homo sapiens
aaaugugaagggucaacuccaa

SEQ ID NO: 1963175 - RNA, 19 nt, Homo sapiens
uuccaccagccugcacuac

SEQ ID NO: 1963176 - RNA, 16 nt, Homo sapiens
guucaaagaugcauuu

SEQ ID NO: 1963177 - RNA, 15 nt, Homo sapiens
cccagccacucggga

SEQ ID NO: 1963178 - RNA, 15 nt, Homo sapiens
uuaagccaucaggga

SEQ ID NO: 1963179 - RNA, 16 nt, Homo sapiens
uauuguagcucaauac

SEQ ID NO: 1963180 - RNA, 17 nt, Homo sapiens
cugguuccuuaaguggc

SEQ ID NO: 1963181 - RNA, 20 nt, Homo sapiens
acuucaaugggcucuuccaa

SEQ ID NO: 1963182 - RNA, 15 nt, Homo sapiens
gccugagucagcacc

SEQ ID NO: 1963183 - RNA, 17 nt, Homo sapiens
ugauuuuagauuuucca

SEQ ID NO: 1963184 - RNA, 20 nt, Homo sapiens
gaaggcaggagugcugcccu

SEQ ID NO: 1963185 - RNA, 17 nt, Homo sapiens
caguauggcggaggcca

SEQ ID NO: 1963186 - RNA, 18 nt, Homo sapiens
agcagcccuaaggaucuc

SEQ ID NO: 1963187 - RNA, 23 nt, Homo sapiens
ugacgugcaccuguacucaggag

SEQ ID NO: 1963188 - RNA, 20 nt, Homo sapiens
accauauuuacucuuucuaa

SEQ ID NO: 1963189 - RNA, 18 nt, Homo sapiens
aaauauaaaaacaacaaa

SEQ ID NO: 1963190 - RNA, 21 nt, Homo sapiens
cuccuuccuacccuccugcac

SEQ ID NO: 1963191 - RNA, 16 nt, Homo sapiens
agacaugaaaucugag

SEQ ID NO: 1963192 - RNA, 19 nt, Homo sapiens
uuaaaagauaaacaguuua

SEQ ID NO: 1963193 - RNA, 22 nt, Homo sapiens
uguaccucgggugggagggaug

SEQ ID NO: 1963194 - RNA, 16 nt, Homo sapiens
aauaugcaagcagcuu

SEQ ID NO: 1963195 - RNA, 19 nt, Homo sapiens
uucuuuauaaaauguauaa

SEQ ID NO: 1963196 - RNA, 13 nt, Homo sapiens
ucuuuuuugccaa

SEQ ID NO: 1963197 - RNA, 19 nt, Homo sapiens
gaacaccauugagggagcu

SEQ ID NO: 1963198 - RNA, 17 nt, Homo sapiens
uugaucuuuggaugugg

SEQ ID NO: 1963199 - RNA, 21 nt, Homo sapiens
aauuccuaauaaguuugauca

SEQ ID NO: 1963200 - RNA, 14 nt, Homo sapiens
uccacacgccaagc

SEQ ID NO: 1963201 - RNA, 13 nt, Homo sapiens
cuuuguacuuuag

SEQ ID NO: 1963202 - RNA, 14 nt, Homo sapiens
guggccugccuuca

SEQ ID NO: 1963203 - RNA, 14 nt, Homo sapiens
gauaaaugacuguu

SEQ ID NO: 1963204 - RNA, 16 nt, Homo sapiens
cuuucuccaaaggcac

SEQ ID NO: 1963205 - RNA, 16 nt, Homo sapiens
uccagggcauugcuca

SEQ ID NO: 1963206 - RNA, 18 nt, Homo sapiens
ugaauacgucuugaucag

SEQ ID NO: 1963207 - RNA, 15 nt, Homo sapiens
aaugagguaaauaag

SEQ ID NO: 1963208 - RNA, 13 nt, Homo sapiens
cuaugugcaugca

SEQ ID NO: 1963209 - RNA, 10 nt, Homo sapiens
uguugugaua

SEQ ID NO: 1963210 - RNA, 17 nt, Homo sapiens
acacaaguagauugauc

SEQ ID NO: 1963211 - RNA, 16 nt, Homo sapiens
ucccuuucuuggccag

SEQ ID NO: 1963212 - RNA, 21 nt, Homo sapiens
cugauggagacaguaacacug

SEQ ID NO: 1963213 - RNA, 18 nt, Homo sapiens
augugagugccuuuugca

SEQ ID NO: 1963214 - RNA, 15 nt, Homo sapiens
ucuuuuuucaaugua

SEQ ID NO: 1963215 - RNA, 18 nt, Homo sapiens
uuauguuuucuuucucac

SEQ ID NO: 1963216 - RNA, 19 nt, Homo sapiens
aauucccaaucccauuccu

SEQ ID NO: 1963217 - RNA, 19 nt, Homo sapiens
gccacacuguacucugcac

SEQ ID NO: 1963218 - RNA, 17 nt, Homo sapiens
acaaagcaucucacucc

SEQ ID NO: 1963219 - RNA, 12 nt, Homo sapiens
gccuuggcagcc

SEQ ID NO: 1963220 - RNA, 22 nt, Homo sapiens
accuugucucccagcucagggc

SEQ ID NO: 1963221 - RNA, 16 nt, Homo sapiens
cacauuggcugccuua

SEQ ID NO: 1963222 - RNA, 20 nt, Homo sapiens
ggucauucuuuucuccuccu

SEQ ID NO: 1963223 - RNA, 19 nt, Homo sapiens
aauaugagcuucaauauaa

SEQ ID NO: 1963224 - RNA, 19 nt, Homo sapiens
cagcucagaaaaucaaaga

SEQ ID NO: 1963225 - RNA, 18 nt, Homo sapiens
ccacacccacuuugucca

SEQ ID NO: 1963226 - RNA, 17 nt, Homo sapiens
ugggaaggcaauuucuc

SEQ ID NO: 1963227 - RNA, 13 nt, Homo sapiens
gcccagugcacug

SEQ ID NO: 1963228 - RNA, 17 nt, Homo sapiens
acaggcaccugccaaca

SEQ ID NO: 1963229 - RNA, 20 nt, Homo sapiens
cagggagaauugaaacugag

SEQ ID NO: 1963230 - RNA, 14 nt, Homo sapiens
caugauggugcuga

SEQ ID NO: 1963231 - RNA, 18 nt, Homo sapiens
aggagaagaaacagcagc

SEQ ID NO: 1963232 - RNA, 14 nt, Homo sapiens
cucccucuacuggg

SEQ ID NO: 1963233 - RNA, 22 nt, Homo sapiens
agaaauuccauacuucucucag

SEQ ID NO: 1963234 - RNA, 22 nt, Homo sapiens
gaccucccucccuccccagugu

SEQ ID NO: 1963235 - RNA, 12 nt, Homo sapiens
acauaguccagu

SEQ ID NO: 1963236 - RNA, 19 nt, Homo sapiens
uauuaugggaaugacucug

SEQ ID NO: 1963237 - RNA, 19 nt, Homo sapiens
ugagggaauaaaccuggca

SEQ ID NO: 1963238 - RNA, 15 nt, Homo sapiens
cagcccucucuugcc

SEQ ID NO: 1963239 - RNA, 16 nt, Homo sapiens
gaccucauaucuuccu

SEQ ID NO: 1963240 - RNA, 21 nt, Homo sapiens
gagaugaaauaugugauuuuc

SEQ ID NO: 1963241 - RNA, 15 nt, Homo sapiens
uaauauuaaagccau

SEQ ID NO: 1963242 - RNA, 16 nt, Homo sapiens
caucguaggcagccac

SEQ ID NO: 1963243 - RNA, 20 nt, Homo sapiens
agacugaaaugugcucaggc

SEQ ID NO: 1963244 - RNA, 22 nt, Homo sapiens
augggaucuugagggaccaagc

SEQ ID NO: 1963245 - RNA, 17 nt, Homo sapiens
aggcucuauugagccaa

SEQ ID NO: 1963246 - RNA, 14 nt, Homo sapiens
gacugugcugagaa

SEQ ID NO: 1963247 - RNA, 20 nt, Homo sapiens
uaaauuuuccaaccaagugg

SEQ ID NO: 1963248 - RNA, 17 nt, Homo sapiens
gccaaaccguacuguau

SEQ ID NO: 1963249 - RNA, 13 nt, Homo sapiens
guaaaagugcuuu

SEQ ID NO: 1963250 - RNA, 19 nt, Homo sapiens
cccuugacaaaauugugaa

SEQ ID NO: 1963251 - RNA, 20 nt, Homo sapiens
agcuguauuuauguaauauu

SEQ ID NO: 1963252 - RNA, 15 nt, Homo sapiens
gcaguggcucucaga

SEQ ID NO: 1963253 - RNA, 20 nt, Homo sapiens
agugacaguugcagcccuug

SEQ ID NO: 1963254 - RNA, 15 nt, Homo sapiens
accaauacuacugua

SEQ ID NO: 1963255 - RNA, 14 nt, Homo sapiens
aaaggaagacuaga

SEQ ID NO: 1963256 - RNA, 19 nt, Homo sapiens
agacaagaaugugcacucu

SEQ ID NO: 1963257 - RNA, 13 nt, Homo sapiens
uuuuaacuugaaa

SEQ ID NO: 1963258 - RNA, 17 nt, Homo sapiens
accuggagccaucuucc

SEQ ID NO: 1963259 - RNA, 12 nt, Homo sapiens
ucccaggcuucc

SEQ ID NO: 1963260 - RNA, 21 nt, Homo sapiens
auguaguaguuugggugugua

SEQ ID NO: 1963261 - RNA, 22 nt, Homo sapiens
cgagagaggcgcgucugcccca

SEQ ID NO: 1963262 - RNA, 18 nt, Homo sapiens
caugccacuugaagauuu

SEQ ID NO: 1963263 - RNA, 22 nt, Homo sapiens
cugagcaaagcauugagcaaag

SEQ ID NO: 1963264 - RNA, 16 nt, Homo sapiens
cucugcagucucuaua

SEQ ID NO: 1963265 - RNA, 12 nt, Homo sapiens
cagcucagcuca

SEQ ID NO: 1963266 - RNA, 14 nt, Homo sapiens
guagcaaauuccaa

SEQ ID NO: 1963267 - RNA, 22 nt, Homo sapiens
cucagcauuugauuaacauuug

SEQ ID NO: 1963268 - RNA, 16 nt, Homo sapiens
ucauguggcuaccugu

SEQ ID NO: 1963269 - RNA, 21 nt, Homo sapiens
agggggaggggugguacuugg

SEQ ID NO: 1963270 - RNA, 19 nt, Homo sapiens
agacugucuuaauuugcau

SEQ ID NO: 1963271 - RNA, 20 nt, Homo sapiens
acucagauccuccucauuca

SEQ ID NO: 1963272 - RNA, 14 nt, Homo sapiens
cagaaugagaccaa

SEQ ID NO: 1963273 - RNA, 12 nt, Homo sapiens
gguucucuccac

SEQ ID NO: 1963274 - RNA, 16 nt, Homo sapiens
caggcaugagccacug

SEQ ID NO: 1963275 - RNA, 12 nt, Homo sapiens
gcagaaccaaag

SEQ ID NO: 1963276 - RNA, 21 nt, Homo sapiens
uccaucaguuagagcugacac

SEQ ID NO: 1963277 - RNA, 15 nt, Homo sapiens
cauuuguuuaaaaag

SEQ ID NO: 1963278 - RNA, 22 nt, Homo sapiens
ccacauauauuuccacuucuuc

SEQ ID NO: 1963279 - RNA, 18 nt, Homo sapiens
ugaaguuuaauugacuua

SEQ ID NO: 1963280 - RNA, 22 nt, Homo sapiens
ucaagugauucucaugccucag

SEQ ID NO: 1963281 - RNA, 18 nt, Homo sapiens
guuuuucguuuugggguu

SEQ ID NO: 1963282 - RNA, 21 nt, Homo sapiens
auaguuuaaaaaucugccacc

SEQ ID NO: 1963283 - RNA, 20 nt, Homo sapiens
uccgaaguagcugggauuac

SEQ ID NO: 1963284 - RNA, 16 nt, Homo sapiens
aguauacaugacugca

SEQ ID NO: 1963285 - RNA, 12 nt, Homo sapiens
uacgugucaaaa

SEQ ID NO: 1963286 - RNA, 22 nt, Homo sapiens
gagcuggggaugucucucauga

SEQ ID NO: 1963287 - RNA, 19 nt, Homo sapiens
cucugcgagcaacagugcc

SEQ ID NO: 1963288 - RNA, 14 nt, Homo sapiens
cucuccagacauca

SEQ ID NO: 1963289 - RNA, 20 nt, Homo sapiens
agaagcucuuuuggguauca

SEQ ID NO: 1963290 - RNA, 16 nt, Homo sapiens
aguucauaaacaacag

SEQ ID NO: 1963291 - RNA, 16 nt, Homo sapiens
auccuaaauaauguua

SEQ ID NO: 1963292 - RNA, 22 nt, Homo sapiens
uaacccucccuguucaucccau

SEQ ID NO: 1963293 - RNA, 14 nt, Homo sapiens
gcagauucuagcac

SEQ ID NO: 1963294 - RNA, 17 nt, Homo sapiens
agggaccugcugcucag

SEQ ID NO: 1963295 - RNA, 13 nt, Homo sapiens
agcuugcaaugag

SEQ ID NO: 1963296 - RNA, 20 nt, Homo sapiens
caacgauaaaauuacaaaag

SEQ ID NO: 1963297 - RNA, 15 nt, Homo sapiens
cacagcuggagacac

SEQ ID NO: 1963298 - RNA, 23 nt, Homo sapiens
uccagugaugugugagcuaugca

SEQ ID NO: 1963299 - RNA, 14 nt, Homo sapiens
ucagcucacucugc

SEQ ID NO: 1963300 - RNA, 20 nt, Homo sapiens
ucaugcuaauauaaguuucu

SEQ ID NO: 1963301 - RNA, 15 nt, Homo sapiens
aguaaguuuauccaa

SEQ ID NO: 1963302 - RNA, 13 nt, Homo sapiens
caaaaucaguuua

SEQ ID NO: 1963303 - RNA, 21 nt, Homo sapiens
cagagggaucggaagagucuu

SEQ ID NO: 1963304 - RNA, 14 nt, Homo sapiens
gaaagauugcuaua

SEQ ID NO: 1963305 - RNA, 19 nt, Homo sapiens
ugcacuccccguguucaua

SEQ ID NO: 1963306 - RNA, 20 nt, Homo sapiens
caccagagauaauaugagaa

SEQ ID NO: 1963307 - RNA, 17 nt, Homo sapiens
cguggacuuaccgccug

SEQ ID NO: 1963308 - RNA, 22 nt, Homo sapiens
gcucuucugacauuuaucaggc

SEQ ID NO: 1963309 - RNA, 15 nt, Homo sapiens
gagccugaccuuucu

SEQ ID NO: 1963310 - RNA, 23 nt, Homo sapiens
uuucuuccagaaggcaaaaagac

SEQ ID NO: 1963311 - RNA, 21 nt, Homo sapiens
ggugggcuggccgcugugcca

SEQ ID NO: 1963312 - RNA, 16 nt, Homo sapiens
ugaauuuuuacauuug

SEQ ID NO: 1963313 - RNA, 16 nt, Homo sapiens
ugucacccagucuguu

SEQ ID NO: 1963314 - RNA, 14 nt, Homo sapiens
auucaacacauugg

SEQ ID NO: 1963315 - RNA, 14 nt, Homo sapiens
aagcagcacuguga

SEQ ID NO: 1963316 - RNA, 16 nt, Homo sapiens
acugggacgccuucag

SEQ ID NO: 1963317 - RNA, 14 nt, Homo sapiens
ccugccuggacugu

SEQ ID NO: 1963318 - RNA, 20 nt, Homo sapiens
uacaugucuacaugccauga

SEQ ID NO: 1963319 - RNA, 14 nt, Homo sapiens
caggagaagccagu

SEQ ID NO: 1963320 - RNA, 18 nt, Homo sapiens
caguuuguggaagcacag

SEQ ID NO: 1963321 - RNA, 18 nt, Homo sapiens
cuggaagcuguaugccac

SEQ ID NO: 1963322 - RNA, 16 nt, Homo sapiens
gugauggauaaggaug

SEQ ID NO: 1963323 - RNA, 14 nt, Homo sapiens
gacaggacuuucau

SEQ ID NO: 1963324 - RNA, 14 nt, Homo sapiens
agauugacuuugaa

SEQ ID NO: 1963325 - RNA, 14 nt, Homo sapiens
ccucaugcugccaa

SEQ ID NO: 1963326 - RNA, 22 nt, Homo sapiens
gaccacgggcgaggacgugaag

SEQ ID NO: 1963327 - RNA, 22 nt, Homo sapiens
auagccuccaaacauguuccca

SEQ ID NO: 1963328 - RNA, 16 nt, Homo sapiens
gaagcugagacacaaa

SEQ ID NO: 1963329 - RNA, 20 nt, Homo sapiens
aaaaugagacuuacugggug

SEQ ID NO: 1963330 - RNA, 17 nt, Homo sapiens
ugccuuguuuaauguua

SEQ ID NO: 1963331 - RNA, 13 nt, Homo sapiens
ugguacugugaug

SEQ ID NO: 1963332 - RNA, 15 nt, Homo sapiens
guccaucugaccguu

SEQ ID NO: 1963333 - RNA, 16 nt, Homo sapiens
ugagccuuugugcuuu

SEQ ID NO: 1963334 - RNA, 23 nt, Homo sapiens
aguuaacccugucugagaugcag

SEQ ID NO: 1963335 - RNA, 17 nt, Homo sapiens
ccugccccucucccgcc

SEQ ID NO: 1963336 - RNA, 17 nt, Homo sapiens
uugaaauaagaaagugc

SEQ ID NO: 1963337 - RNA, 20 nt, Homo sapiens
caaccugacuuccucugcca

SEQ ID NO: 1963338 - RNA, 17 nt, Homo sapiens
ccuacaucaaaugcuca

SEQ ID NO: 1963339 - RNA, 14 nt, Homo sapiens
guccuggguucugg

SEQ ID NO: 1963340 - RNA, 21 nt, Homo sapiens
gugugaacagggaacucagaa

SEQ ID NO: 1963341 - RNA, 14 nt, Homo sapiens
acaaauagcauaca

SEQ ID NO: 1963342 - RNA, 16 nt, Homo sapiens
aguuccagggcugcug

SEQ ID NO: 1963343 - RNA, 21 nt, Homo sapiens
cuaaggaagauaucuaguguu

SEQ ID NO: 1963344 - RNA, 15 nt, Homo sapiens
auugauuacaaauaa

SEQ ID NO: 1963345 - RNA, 15 nt, Homo sapiens
ccagccugagcaaca

SEQ ID NO: 1963346 - RNA, 16 nt, Homo sapiens
cuugucccuuucccua

SEQ ID NO: 1963347 - RNA, 16 nt, Homo sapiens
cuugccucuuucucca

SEQ ID NO: 1963348 - RNA, 18 nt, Homo sapiens
gaacuguuggauacagga

SEQ ID NO: 1963349 - RNA, 18 nt, Homo sapiens
aucuucauguccagugag

SEQ ID NO: 1963350 - RNA, 12 nt, Homo sapiens
caggaugcuaau

SEQ ID NO: 1963351 - RNA, 15 nt, Homo sapiens
caggcacacacagcc

SEQ ID NO: 1963352 - RNA, 19 nt, Homo sapiens
ucacaggaagaaagcagaa

SEQ ID NO: 1963353 - RNA, 17 nt, Homo sapiens
auuccccccaccuaacu

SEQ ID NO: 1963354 - RNA, 21 nt, Homo sapiens
ccugucccccaucuucucugg

SEQ ID NO: 1963355 - RNA, 14 nt, Homo sapiens
cuguccaugaagca

SEQ ID NO: 1963356 - RNA, 13 nt, Homo sapiens
ccuguucuggaca

SEQ ID NO: 1963357 - RNA, 19 nt, Homo sapiens
gacauaaaucuuccaaagu

SEQ ID NO: 1963358 - RNA, 16 nt, Homo sapiens
auaaacagauacauuc

SEQ ID NO: 1963359 - RNA, 12 nt, Homo sapiens
uggggcucucuc

SEQ ID NO: 1963360 - RNA, 18 nt, Homo sapiens
gucuaugggacucaaugc

SEQ ID NO: 1963361 - RNA, 19 nt, Homo sapiens
uccauugguggacagccuu

SEQ ID NO: 1963362 - RNA, 20 nt, Homo sapiens
guugcugggauuacaggugu

SEQ ID NO: 1963363 - RNA, 10 nt, Homo sapiens
aggagaagac

SEQ ID NO: 1963364 - RNA, 21 nt, Homo sapiens
acuauggauguguucucuagg

SEQ ID NO: 1963365 - RNA, 18 nt, Homo sapiens
ucuuuuucagauuuauga

SEQ ID NO: 1963366 - RNA, 22 nt, Homo sapiens
ggucugaaauuugugauggaau

SEQ ID NO: 1963367 - RNA, 17 nt, Homo sapiens
ccccagcccuaaucuca

SEQ ID NO: 1963368 - RNA, 17 nt, Homo sapiens
ucauauauuagcaccug

SEQ ID NO: 1963369 - RNA, 17 nt, Homo sapiens
ccucugcagcacuuuaa

SEQ ID NO: 1963370 - RNA, 19 nt, Homo sapiens
uaauuuaaaaagugcuaua

SEQ ID NO: 1963371 - RNA, 13 nt, Homo sapiens
cuccccacuccag

SEQ ID NO: 1963372 - RNA, 13 nt, Homo sapiens
cuucccacucuag

SEQ ID NO: 1963373 - RNA, 15 nt, Homo sapiens
agggaagcaccauga

SEQ ID NO: 1963374 - RNA, 19 nt, Homo sapiens
uugaaguccuccagacaac

SEQ ID NO: 1963375 - RNA, 22 nt, Homo sapiens
accugccgggcuguuguuuuaa

SEQ ID NO: 1963376 - RNA, 17 nt, Homo sapiens
gagaaugcccaacucuu

SEQ ID NO: 1963377 - RNA, 17 nt, Homo sapiens
gcaggaacugagccaga

SEQ ID NO: 1963378 - RNA, 22 nt, Homo sapiens
guucgcacaaucuacacugccu

SEQ ID NO: 1963379 - RNA, 14 nt, Homo sapiens
acauuuaacgacag

SEQ ID NO: 1963380 - RNA, 14 nt, Homo sapiens
ccccguaccaccau

SEQ ID NO: 1963381 - RNA, 14 nt, Homo sapiens
caaaaaacccaaga

SEQ ID NO: 1963382 - RNA, 15 nt, Homo sapiens
aaauaguuguccaua

SEQ ID NO: 1963383 - RNA, 12 nt, Homo sapiens
cagcacucugcc

SEQ ID NO: 1963384 - RNA, 16 nt, Homo sapiens
uacagcuccuuugaaa

SEQ ID NO: 1963385 - RNA, 16 nt, Homo sapiens
ugcuguguagcucugu

SEQ ID NO: 1963386 - RNA, 16 nt, Homo sapiens
agcuccucugcugcuc

SEQ ID NO: 1963387 - RNA, 20 nt, Homo sapiens
cuacagugaauuuaaucaaa

SEQ ID NO: 1963388 - RNA, 22 nt, Homo sapiens
cauagagaucuauguacuguaa

SEQ ID NO: 1963389 - RNA, 23 nt, Homo sapiens
aguggugggcccugaugcugcca

SEQ ID NO: 1963390 - RNA, 13 nt, Homo sapiens
uuauacacuguaa

SEQ ID NO: 1963391 - RNA, 15 nt, Homo sapiens
ugacacauuacaaag

SEQ ID NO: 1963392 - RNA, 12 nt, Homo sapiens
ugaacccacugc

SEQ ID NO: 1963393 - RNA, 21 nt, Homo sapiens
ugccaagacaugaaguuuuau

SEQ ID NO: 1963394 - RNA, 24 nt, Homo sapiens
gaggcuaugaagaaaacagcugca

SEQ ID NO: 1963395 - RNA, 23 nt, Homo sapiens
aucccacugcugacuauaaugcc

SEQ ID NO: 1963396 - RNA, 22 nt, Homo sapiens
ucagggaccugcugcucaguaa

SEQ ID NO: 1963397 - RNA, 18 nt, Homo sapiens
auugccacauaauucauu

SEQ ID NO: 1963398 - RNA, 20 nt, Homo sapiens
uagaucugggagauccugca

SEQ ID NO: 1963399 - RNA, 19 nt, Homo sapiens
uaauagcuuuuauuguaua

SEQ ID NO: 1963400 - RNA, 20 nt, Homo sapiens
cugagacauucuucaccucc

SEQ ID NO: 1963401 - RNA, 15 nt, Homo sapiens
gcugcgagcauuucc

SEQ ID NO: 1963402 - RNA, 19 nt, Homo sapiens
gagucucgcuauugucacc

SEQ ID NO: 1963403 - RNA, 20 nt, Homo sapiens
aaguagaagucauauguugu

SEQ ID NO: 1963404 - RNA, 14 nt, Homo sapiens
cucucugcuucugu

SEQ ID NO: 1963405 - RNA, 22 nt, Homo sapiens
cugggauuacaagcaugaguca

SEQ ID NO: 1963406 - RNA, 15 nt, Homo sapiens
guuuuaucacuucau

SEQ ID NO: 1963407 - RNA, 16 nt, Homo sapiens
caaccucauccaggcu

SEQ ID NO: 1963408 - RNA, 17 nt, Homo sapiens
gagcaugguguuuucau

SEQ ID NO: 1963409 - RNA, 20 nt, Homo sapiens
aagaggaucuccuguccauc

SEQ ID NO: 1963410 - RNA, 13 nt, Homo sapiens
agcacccauccac

SEQ ID NO: 1963411 - RNA, 20 nt, Homo sapiens
auaaagugacccugcucuca

SEQ ID NO: 1963412 - RNA, 17 nt, Homo sapiens
ggcugccugugugcaug

SEQ ID NO: 1963413 - RNA, 17 nt, Homo sapiens
cacagcuaugcaaaaag

SEQ ID NO: 1963414 - RNA, 21 nt, Homo sapiens
ucccaauccuuaucccaagcu

SEQ ID NO: 1963415 - RNA, 23 nt, Homo sapiens
ccacgccauccaucaugcaaaau

SEQ ID NO: 1963416 - RNA, 22 nt, Homo sapiens
caauuuuaccuaguuugcacua

SEQ ID NO: 1963417 - RNA, 23 nt, Homo sapiens
caugccuguaaucccagcacuug

SEQ ID NO: 1963418 - RNA, 18 nt, Homo sapiens
ccuugacugucuagccac

SEQ ID NO: 1963419 - RNA, 14 nt, Homo sapiens
aucuauuucauacc

SEQ ID NO: 1963420 - RNA, 11 nt, Homo sapiens
aguuguugaaa

SEQ ID NO: 1963421 - RNA, 19 nt, Homo sapiens
cauuauaaacauguuuuaa

SEQ ID NO: 1963422 - RNA, 19 nt, Homo sapiens
cccagcacugcccauccca

SEQ ID NO: 1963423 - RNA, 19 nt, Homo sapiens
cauuugagauaaagucaaa

SEQ ID NO: 1963424 - RNA, 21 nt, Homo sapiens
agaaaaguuauuagugguuua

SEQ ID NO: 1963425 - RNA, 19 nt, Homo sapiens
aaacauuguguugacauua

SEQ ID NO: 1963426 - RNA, 12 nt, Homo sapiens
uuacuacaugca

SEQ ID NO: 1963427 - RNA, 20 nt, Homo sapiens
ugaggcaggcaaucacuuga

SEQ ID NO: 1963428 - RNA, 17 nt, Homo sapiens
cuauguaauggugguca

SEQ ID NO: 1963429 - RNA, 23 nt, Homo sapiens
uccucuggaucacagacacugca

SEQ ID NO: 1963430 - RNA, 16 nt, Homo sapiens
cuaguccuuuacuaau

SEQ ID NO: 1963431 - RNA, 15 nt, Homo sapiens
gggauuugaaccagg

SEQ ID NO: 1963432 - RNA, 20 nt, Homo sapiens
accagcccgggcuggcccaa

SEQ ID NO: 1963433 - RNA, 15 nt, Homo sapiens
acaaguuucagacag

SEQ ID NO: 1963434 - RNA, 18 nt, Homo sapiens
uauagaaaaagcacagcu

SEQ ID NO: 1963435 - RNA, 17 nt, Homo sapiens
ccguggagacugagauc

SEQ ID NO: 1963436 - RNA, 13 nt, Homo sapiens
uuauauucaucca

SEQ ID NO: 1963437 - RNA, 21 nt, Homo sapiens
aguucacauacaaaucaucca

SEQ ID NO: 1963438 - RNA, 14 nt, Homo sapiens
guuggucaucucuc

SEQ ID NO: 1963439 - RNA, 19 nt, Homo sapiens
gaaaugcuuuuauauucua

SEQ ID NO: 1963440 - RNA, 13 nt, Homo sapiens
auuuauacauaca

SEQ ID NO: 1963441 - RNA, 20 nt, Homo sapiens
uucuaaccuuucuaacccac

SEQ ID NO: 1963442 - RNA, 16 nt, Homo sapiens
cuuuuccuucagugaa

SEQ ID NO: 1963443 - RNA, 14 nt, Homo sapiens
agacagcugucuug

SEQ ID NO: 1963444 - RNA, 17 nt, Homo sapiens
ccagggagaagcuccuc

SEQ ID NO: 1963445 - RNA, 19 nt, Homo sapiens
cauucgcaauaaguaccaa

SEQ ID NO: 1963446 - RNA, 11 nt, Homo sapiens
ucagacuguua

SEQ ID NO: 1963447 - RNA, 16 nt, Homo sapiens
uaccauuuuacauuuc

SEQ ID NO: 1963448 - RNA, 16 nt, Homo sapiens
uagaauucuagcuuuu

SEQ ID NO: 1963449 - RNA, 21 nt, Homo sapiens
ugggaacuaaggggguauuua

SEQ ID NO: 1963450 - RNA, 15 nt, Homo sapiens
aagguuaccucuauu

SEQ ID NO: 1963451 - RNA, 18 nt, Homo sapiens
uucccaagcgucaucugu

SEQ ID NO: 1963452 - RNA, 19 nt, Homo sapiens
uguauuccucaugucauca

SEQ ID NO: 1963453 - RNA, 23 nt, Homo sapiens
ugcccacaacuugucacccaaag

SEQ ID NO: 1963454 - RNA, 23 nt, Homo sapiens
auaaauauuuauugaagaaauga

SEQ ID NO: 1963455 - RNA, 15 nt, Homo sapiens
guaaucaguuuugua

SEQ ID NO: 1963456 - RNA, 11 nt, Homo sapiens
uucuucucaac

SEQ ID NO: 1963457 - RNA, 17 nt, Homo sapiens
agcacuaaagcagugga

SEQ ID NO: 1963458 - RNA, 13 nt, Homo sapiens
auauaauaucaua

SEQ ID NO: 1963459 - RNA, 19 nt, Homo sapiens
uagccacugaucauuuuua

SEQ ID NO: 1963460 - RNA, 21 nt, Homo sapiens
caaccaccaccuuauacauca

SEQ ID NO: 1963461 - RNA, 23 nt, Homo sapiens
auauuaaaauagcauacugugua

SEQ ID NO: 1963462 - RNA, 15 nt, Homo sapiens
ucuucugagcacaga

SEQ ID NO: 1963463 - RNA, 16 nt, Homo sapiens
gcaugugcgcacacac

SEQ ID NO: 1963464 - RNA, 21 nt, Homo sapiens
caagcauucagaagaaaaaga

SEQ ID NO: 1963465 - RNA, 15 nt, Homo sapiens
cuugaaaaaugacaa

SEQ ID NO: 1963466 - RNA, 14 nt, Homo sapiens
uccaggcuccucau

SEQ ID NO: 1963467 - RNA, 11 nt, Homo sapiens
uuaaugaauag

SEQ ID NO: 1963468 - RNA, 19 nt, Homo sapiens
cagggcacgcaggaccagu

SEQ ID NO: 1963469 - RNA, 15 nt, Homo sapiens
uggggggggugcugg

SEQ ID NO: 1963470 - RNA, 19 nt, Homo sapiens
gcuaccccucaaacugcac

SEQ ID NO: 1963471 - RNA, 16 nt, Homo sapiens
gaaaucaguguuuuag

SEQ ID NO: 1963472 - RNA, 17 nt, Homo sapiens
aauuuggcugcuucuac

SEQ ID NO: 1963473 - RNA, 22 nt, Homo sapiens
ucccguuguguggguuuacucu

SEQ ID NO: 1963474 - RNA, 22 nt, Homo sapiens
auucuccaccugccagggacag

SEQ ID NO: 1963475 - RNA, 18 nt, Homo sapiens
gauucucugugucuaaga

SEQ ID NO: 1963476 - RNA, 19 nt, Homo sapiens
aauguguacagugaacaaa

SEQ ID NO: 1963477 - RNA, 20 nt, Homo sapiens
uguacgacacggguggggaa

SEQ ID NO: 1963478 - RNA, 18 nt, Homo sapiens
auuuaaggugugcaauuu

SEQ ID NO: 1963479 - RNA, 23 nt, Homo sapiens
gagaggguguuggucagucuaca

SEQ ID NO: 1963480 - RNA, 16 nt, Homo sapiens
aaccuguccuugcaca

SEQ ID NO: 1963481 - RNA, 15 nt, Homo sapiens
uuuucuaacuguaaa

SEQ ID NO: 1963482 - RNA, 18 nt, Homo sapiens
ugaguagggacucagggc

SEQ ID NO: 1963483 - RNA, 21 nt, Homo sapiens
gccucccaaagugcugggaug

SEQ ID NO: 1963484 - RNA, 21 nt, Homo sapiens
gcucugagacccuuuucucag

SEQ ID NO: 1963485 - RNA, 20 nt, Homo sapiens
aaauauaaaacugcguuaaa

SEQ ID NO: 1963486 - RNA, 23 nt, Homo sapiens
aaagccugggcagaaaugugcug

SEQ ID NO: 1963487 - RNA, 18 nt, Homo sapiens
uccagggacauguggaaa

SEQ ID NO: 1963488 - RNA, 23 nt, Homo sapiens
cuguguaacuguaaaacauugaa

SEQ ID NO: 1963489 - RNA, 11 nt, Homo sapiens
uugucuuuaug

SEQ ID NO: 1963490 - RNA, 12 nt, Homo sapiens
acagcaaggugg

SEQ ID NO: 1963491 - RNA, 19 nt, Homo sapiens
acgccgauauaagccauag

SEQ ID NO: 1963492 - RNA, 12 nt, Homo sapiens
gcacugauugca

SEQ ID NO: 1963493 - RNA, 15 nt, Homo sapiens
agaaguugcccaugu

SEQ ID NO: 1963494 - RNA, 22 nt, Homo sapiens
cacuaauguuuuggucugaaaa

SEQ ID NO: 1963495 - RNA, 19 nt, Homo sapiens
acuggaacguuucacugca

SEQ ID NO: 1963496 - RNA, 18 nt, Homo sapiens
auugaggcauucaaggau

SEQ ID NO: 1963497 - RNA, 16 nt, Homo sapiens
auuuuuuucuacauaa

SEQ ID NO: 1963498 - RNA, 17 nt, Homo sapiens
cugcauuaucuugcuca

SEQ ID NO: 1963499 - RNA, 18 nt, Homo sapiens
guggagccaagauuugaa

SEQ ID NO: 1963500 - RNA, 15 nt, Homo sapiens
caggaacagggacca

SEQ ID NO: 1963501 - RNA, 14 nt, Homo sapiens
acuggcugauggag

SEQ ID NO: 1963502 - RNA, 19 nt, Homo sapiens
aauauucuauaugaauuua

SEQ ID NO: 1963503 - RNA, 21 nt, Homo sapiens
agcuaaaccaaggacugagca

SEQ ID NO: 1963504 - RNA, 13 nt, Homo sapiens
uguaauacacaua

SEQ ID NO: 1963505 - RNA, 14 nt, Homo sapiens
caucccuagccauu

SEQ ID NO: 1963506 - RNA, 15 nt, Homo sapiens
uugggcccuuugagu

SEQ ID NO: 1963507 - RNA, 18 nt, Homo sapiens
cugaaagacagaauguca

SEQ ID NO: 1963508 - RNA, 16 nt, Homo sapiens
acaugugcacaugcac

SEQ ID NO: 1963509 - RNA, 16 nt, Homo sapiens
acagauggacagacag

SEQ ID NO: 1963510 - RNA, 22 nt, Homo sapiens
ggaaugacuuggguuuaacaag

SEQ ID NO: 1963511 - RNA, 18 nt, Homo sapiens
accguuugugauugccau

SEQ ID NO: 1963512 - RNA, 18 nt, Homo sapiens
cccuucuucuugacccau

SEQ ID NO: 1963513 - RNA, 16 nt, Homo sapiens
ucagccugugccacac

SEQ ID NO: 1963514 - RNA, 23 nt, Homo sapiens
cuuuauuuuuuucuguguacugu

SEQ ID NO: 1963515 - RNA, 13 nt, Homo sapiens
agcccugccgagg

SEQ ID NO: 1963516 - RNA, 13 nt, Homo sapiens
accccugcccagg

SEQ ID NO: 1963517 - RNA, 18 nt, Homo sapiens
aaccuacugcccacauuu

SEQ ID NO: 1963518 - RNA, 20 nt, Homo sapiens
cccuggcauccaaauggcug

SEQ ID NO: 1963519 - RNA, 21 nt, Homo sapiens
cagagguuaucugucugcauu

SEQ ID NO: 1963520 - RNA, 18 nt, Homo sapiens
augcacacacagaugcac

SEQ ID NO: 1963521 - RNA, 23 nt, Homo sapiens
auuuuccucacacccaccugcug

SEQ ID NO: 1963522 - RNA, 14 nt, Homo sapiens
gggcccagccagcc

SEQ ID NO: 1963523 - RNA, 15 nt, Homo sapiens
ccacugcccaaagcc

SEQ ID NO: 1963524 - RNA, 19 nt, Homo sapiens
uuuaucugugaauucagau

SEQ ID NO: 1963525 - RNA, 19 nt, Homo sapiens
aacuugcaaugggcagcua

SEQ ID NO: 1963526 - RNA, 14 nt, Homo sapiens
gacuucacuguaua

SEQ ID NO: 1963527 - RNA, 22 nt, Homo sapiens
ucaucaauaaaauagugacaua

SEQ ID NO: 1963528 - RNA, 16 nt, Homo sapiens
ucccacaccagccucc

SEQ ID NO: 1963529 - RNA, 17 nt, Homo sapiens
ccagcacccugcaaaau

SEQ ID NO: 1963530 - RNA, 22 nt, Homo sapiens
aaaugauugacaguaaguuuau

SEQ ID NO: 1963531 - RNA, 21 nt, Homo sapiens
cgggcugagaacccugcgugg

SEQ ID NO: 1963532 - RNA, 14 nt, Homo sapiens
cauugcacuuuaua

SEQ ID NO: 1963533 - RNA, 15 nt, Homo sapiens
agccauuuagggcag

SEQ ID NO: 1963534 - RNA, 11 nt, Homo sapiens
aacucauaaag

SEQ ID NO: 1963535 - RNA, 20 nt, Homo sapiens
uagaagccaagggaaagggg

SEQ ID NO: 1963536 - RNA, 13 nt, Homo sapiens
aacauacccaucu

SEQ ID NO: 1963537 - RNA, 16 nt, Homo sapiens
cuuugauuaugcagac

SEQ ID NO: 1963538 - RNA, 20 nt, Homo sapiens
aauugcuacaaucccaaagc

SEQ ID NO: 1963539 - RNA, 14 nt, Homo sapiens
gucacccacuguca

SEQ ID NO: 1963540 - RNA, 20 nt, Homo sapiens
gcaauaaccucaaagugacu

SEQ ID NO: 1963541 - RNA, 17 nt, Homo sapiens
caucuuuguaauacaug

SEQ ID NO: 1963542 - RNA, 12 nt, Homo sapiens
acucucugcaag

SEQ ID NO: 1963543 - RNA, 19 nt, Homo sapiens
caucuauuauaaaaccaug

SEQ ID NO: 1963544 - RNA, 16 nt, Homo sapiens
uugcagccccacagac

SEQ ID NO: 1963545 - RNA, 19 nt, Homo sapiens
ccugcaucccgauaccuca

SEQ ID NO: 1963546 - RNA, 12 nt, Homo sapiens
agauagucacag

SEQ ID NO: 1963547 - RNA, 12 nt, Homo sapiens
ugagucaaguca

SEQ ID NO: 1963548 - RNA, 20 nt, Homo sapiens
ccagagccuggggcucuaac

SEQ ID NO: 1963549 - RNA, 15 nt, Homo sapiens
aaauauaauaugcac

SEQ ID NO: 1963550 - RNA, 22 nt, Homo sapiens
cccacagagguggaacuuaauu

SEQ ID NO: 1963551 - RNA, 22 nt, Homo sapiens
gaaacagggagccccuaggaaa

SEQ ID NO: 1963552 - RNA, 16 nt, Homo sapiens
guggcagacaucggcc

SEQ ID NO: 1963553 - RNA, 20 nt, Homo sapiens
cccaugugcacaagugugca

SEQ ID NO: 1963554 - RNA, 15 nt, Homo sapiens
cacgauuuugcacaa

SEQ ID NO: 1963555 - RNA, 19 nt, Homo sapiens
uguuaugucaaacugucuu

SEQ ID NO: 1963556 - RNA, 20 nt, Homo sapiens
cuuuucagaagcaagccaga

SEQ ID NO: 1963557 - RNA, 16 nt, Homo sapiens
cacaguagucuugaug

SEQ ID NO: 1963558 - RNA, 16 nt, Homo sapiens
auguagaaacauuuag

SEQ ID NO: 1963559 - RNA, 18 nt, Homo sapiens
cauuaacccaucucugaa

SEQ ID NO: 1963560 - RNA, 17 nt, Homo sapiens
cagacuggagugcagug

SEQ ID NO: 1963561 - RNA, 14 nt, Homo sapiens
cggcugccaagaca

SEQ ID NO: 1963562 - RNA, 15 nt, Homo sapiens
aggaugcacagucag

SEQ ID NO: 1963563 - RNA, 15 nt, Homo sapiens
agaugcuugguugug

SEQ ID NO: 1963564 - RNA, 16 nt, Homo sapiens
aguaaggcagugcagu

SEQ ID NO: 1963565 - RNA, 19 nt, Homo sapiens
auuaguucccauucuuuca

SEQ ID NO: 1963566 - RNA, 16 nt, Homo sapiens
cagauucuucacugug

SEQ ID NO: 1963567 - RNA, 17 nt, Homo sapiens
aagucacauuuuaccaa

SEQ ID NO: 1963568 - RNA, 21 nt, Homo sapiens
agucccuuuggacaaaugcau

SEQ ID NO: 1963569 - RNA, 21 nt, Homo sapiens
cagccuguagcuccccugcug

SEQ ID NO: 1963570 - RNA, 15 nt, Homo sapiens
ggcguccauguuuau

SEQ ID NO: 1963571 - RNA, 12 nt, Homo sapiens
cuuuaaugggag

SEQ ID NO: 1963572 - RNA, 13 nt, Homo sapiens
aaauauuaugaga

SEQ ID NO: 1963573 - RNA, 18 nt, Homo sapiens
gucuucccucagauuucc

SEQ ID NO: 1963574 - RNA, 15 nt, Homo sapiens
uuuaacaucugagaa

SEQ ID NO: 1963575 - RNA, 24 nt, Homo sapiens
ugaaacacccaucguucucugcua

SEQ ID NO: 1963576 - RNA, 19 nt, Homo sapiens
acacucccuucccaugacc

SEQ ID NO: 1963577 - RNA, 21 nt, Homo sapiens
agugaaucuuucuccugguga

SEQ ID NO: 1963578 - RNA, 13 nt, Homo sapiens
ggauuggggaccu

SEQ ID NO: 1963579 - RNA, 14 nt, Homo sapiens
ugaugaaggauuca

SEQ ID NO: 1963580 - RNA, 23 nt, Homo sapiens
uuauaaagggagauaacaaucug

SEQ ID NO: 1963581 - RNA, 16 nt, Homo sapiens
uggaacugaguguuag

SEQ ID NO: 1963582 - RNA, 15 nt, Homo sapiens
caauaaaacauuccu

SEQ ID NO: 1963583 - RNA, 15 nt, Homo sapiens
aaauuaauuuucucu

SEQ ID NO: 1963584 - RNA, 14 nt, Homo sapiens
agcuuuacuguggc

SEQ ID NO: 1963585 - RNA, 15 nt, Homo sapiens
uuauuauuaaucuca

SEQ ID NO: 1963586 - RNA, 15 nt, Homo sapiens
ggucuaaucagugau

SEQ ID NO: 1963587 - RNA, 16 nt, Homo sapiens
augguaaauccuuuug

SEQ ID NO: 1963588 - RNA, 18 nt, Homo sapiens
uaauuaaguacaaccaac

SEQ ID NO: 1963589 - RNA, 22 nt, Homo sapiens
cugugggcuuuggguuugucag

SEQ ID NO: 1963590 - RNA, 16 nt, Homo sapiens
uaaguauuaaguauua

SEQ ID NO: 1963591 - RNA, 15 nt, Homo sapiens
cagauuuacacuggg

SEQ ID NO: 1963592 - RNA, 23 nt, Homo sapiens
aacaaacuacauguaauccauca

SEQ ID NO: 1963593 - RNA, 22 nt, Homo sapiens
cuucugcuggcagaaagcaaau

SEQ ID NO: 1963594 - RNA, 18 nt, Homo sapiens
aguagggcuuggugaaug

SEQ ID NO: 1963595 - RNA, 17 nt, Homo sapiens
cuucacaccauaacuag

SEQ ID NO: 1963596 - RNA, 20 nt, Homo sapiens
aguauauagccuuaagucuu

SEQ ID NO: 1963597 - RNA, 23 nt, Homo sapiens
cugcuucugcaccuuaucuuaaa

SEQ ID NO: 1963598 - RNA, 15 nt, Homo sapiens
augucaccaagaagg

SEQ ID NO: 1963599 - RNA, 21 nt, Homo sapiens
ucaggugauccaccugccucg

SEQ ID NO: 1963600 - RNA, 20 nt, Homo sapiens
cugagcaucuccagcauucu

SEQ ID NO: 1963601 - RNA, 16 nt, Homo sapiens
ucagaccuggcugcuu

SEQ ID NO: 1963602 - RNA, 16 nt, Homo sapiens
uaugccucauacacau

SEQ ID NO: 1963603 - RNA, 18 nt, Homo sapiens
cauuucacugaugcuucu

SEQ ID NO: 1963604 - RNA, 16 nt, Homo sapiens
guaugaagaguguuau

SEQ ID NO: 1963605 - RNA, 18 nt, Homo sapiens
caaaaauguaaugaucau

SEQ ID NO: 1963606 - RNA, 18 nt, Homo sapiens
ugcgaaccacccaaaaca

SEQ ID NO: 1963607 - RNA, 17 nt, Homo sapiens
ccugcagacucacugug

SEQ ID NO: 1963608 - RNA, 14 nt, Homo sapiens
ugauucggccucuc

SEQ ID NO: 1963609 - RNA, 17 nt, Homo sapiens
cccagaagccugaucuu

SEQ ID NO: 1963610 - RNA, 19 nt, Homo sapiens
uaaagaauuaacagagauu

SEQ ID NO: 1963611 - RNA, 16 nt, Homo sapiens
cugaacugacaaugaa

SEQ ID NO: 1963612 - RNA, 20 nt, Homo sapiens
gucacccuccugagccucac

SEQ ID NO: 1963613 - RNA, 10 nt, Homo sapiens
aguggcauuu

SEQ ID NO: 1963614 - RNA, 15 nt, Homo sapiens
auuagguguacugua

SEQ ID NO: 1963615 - RNA, 11 nt, Homo sapiens
agccauccagg

SEQ ID NO: 1963616 - RNA, 23 nt, Homo sapiens
uuuuaaaaaaauaaaacaguauc

SEQ ID NO: 1963617 - RNA, 21 nt, Homo sapiens
ggaacccaucacugugucuca

SEQ ID NO: 1963618 - RNA, 16 nt, Homo sapiens
aucagugcuccaguau

SEQ ID NO: 1963619 - RNA, 17 nt, Homo sapiens
uagcaacuccccuacau

SEQ ID NO: 1963620 - RNA, 11 nt, Homo sapiens
ucuacacugcc

SEQ ID NO: 1963621 - RNA, 15 nt, Homo sapiens
gcucaucugcagccu

SEQ ID NO: 1963622 - RNA, 14 nt, Homo sapiens
uccaaagacuguac

SEQ ID NO: 1963623 - RNA, 14 nt, Homo sapiens
ccucugcagcacuu

SEQ ID NO: 1963624 - RNA, 19 nt, Homo sapiens
auaugcacacacauggaug

SEQ ID NO: 1963625 - RNA, 21 nt, Homo sapiens
accuuuuccccaaccacagag

SEQ ID NO: 1963626 - RNA, 15 nt, Homo sapiens
gagcuucucccagug

SEQ ID NO: 1963627 - RNA, 15 nt, Homo sapiens
cagcuaugcaaaaag

SEQ ID NO: 1963628 - RNA, 24 nt, Homo sapiens
ucuauauuuuuuguaacauaaugc

SEQ ID NO: 1963629 - RNA, 16 nt, Homo sapiens
uccauggaugcaugcc

SEQ ID NO: 1963630 - RNA, 16 nt, Homo sapiens
cauagauguuaugcaa

SEQ ID NO: 1963631 - RNA, 16 nt, Homo sapiens
uuuugaauacacaucu

SEQ ID NO: 1963632 - RNA, 23 nt, Homo sapiens
uccacuuggaaauggcaugcaaa

SEQ ID NO: 1963633 - RNA, 21 nt, Homo sapiens
cagaaaacagggucugggaca

SEQ ID NO: 1963634 - RNA, 15 nt, Homo sapiens
accugcccugugcau

SEQ ID NO: 1963635 - RNA, 14 nt, Homo sapiens
aagaaucaccuaau

SEQ ID NO: 1963636 - RNA, 21 nt, Homo sapiens
aagucacaggaagaaagcaga

SEQ ID NO: 1963637 - RNA, 22 nt, Homo sapiens
ccaagggacccuuugccuuucu

SEQ ID NO: 1963638 - RNA, 11 nt, Homo sapiens
aaaugugaugu

SEQ ID NO: 1963639 - RNA, 11 nt, Homo sapiens
cuagaguagag

SEQ ID NO: 1963640 - RNA, 13 nt, Homo sapiens
gucagcacagaga

SEQ ID NO: 1963641 - RNA, 14 nt, Homo sapiens
acugucugucucca

SEQ ID NO: 1963642 - RNA, 17 nt, Homo sapiens
ucgaauucucacaagga

SEQ ID NO: 1963643 - RNA, 22 nt, Homo sapiens
cuaaaauuguuuccuaaaucag

SEQ ID NO: 1963644 - RNA, 20 nt, Homo sapiens
acccgagcuagagugcagug

SEQ ID NO: 1963645 - RNA, 23 nt, Homo sapiens
acuugaaaccugggcaugguggc

SEQ ID NO: 1963646 - RNA, 22 nt, Homo sapiens
cuucauccucugagugugacca

SEQ ID NO: 1963647 - RNA, 20 nt, Homo sapiens
ccacagaccuaggauuucau

SEQ ID NO: 1963648 - RNA, 21 nt, Homo sapiens
auuuaggaaagcagugcagua

SEQ ID NO: 1963649 - RNA, 14 nt, Homo sapiens
auaaaauguuucau

SEQ ID NO: 1963650 - RNA, 14 nt, Homo sapiens
aguaauugugacaa

SEQ ID NO: 1963651 - RNA, 20 nt, Homo sapiens
gcagggcagcagggaacaaa

SEQ ID NO: 1963652 - RNA, 12 nt, Homo sapiens
gcagcaccucag

SEQ ID NO: 1963653 - RNA, 18 nt, Homo sapiens
caaaggacugaccugccc

SEQ ID NO: 1963654 - RNA, 19 nt, Homo sapiens
ucacacaugccuauauuau

SEQ ID NO: 1963655 - RNA, 20 nt, Homo sapiens
uuuuaugcagacagucuguu

SEQ ID NO: 1963656 - RNA, 14 nt, Homo sapiens
gccuucugaccugg

SEQ ID NO: 1963657 - RNA, 17 nt, Homo sapiens
acaauuuguuuuugcau

SEQ ID NO: 1963658 - RNA, 17 nt, Homo sapiens
gcagacaggccauguga

SEQ ID NO: 1963659 - RNA, 16 nt, Homo sapiens
gaacauuacauugcca

SEQ ID NO: 1963660 - RNA, 22 nt, Homo sapiens
ugguucucaacagacccaguga

SEQ ID NO: 1963661 - RNA, 13 nt, Homo sapiens
gcuuucucucuca

SEQ ID NO: 1963662 - RNA, 20 nt, Homo sapiens
ucauaaaugaagcagcuuua

SEQ ID NO: 1963663 - RNA, 15 nt, Homo sapiens
gucaugguuacaaac

SEQ ID NO: 1963664 - RNA, 16 nt, Homo sapiens
auuucaauuccuggcc

SEQ ID NO: 1963665 - RNA, 19 nt, Homo sapiens
ucagaaaauuagcaugaaa

SEQ ID NO: 1963666 - RNA, 19 nt, Homo sapiens
cacccaggucccccgacug

SEQ ID NO: 1963667 - RNA, 11 nt, Homo sapiens
gggacuggcac

SEQ ID NO: 1963668 - RNA, 14 nt, Homo sapiens
cgguaccuguguuu

SEQ ID NO: 1963669 - RNA, 17 nt, Homo sapiens
uuuagcagaaucaaaau

SEQ ID NO: 1963670 - RNA, 12 nt, Homo sapiens
acaccaccaucu

SEQ ID NO: 1963671 - RNA, 17 nt, Homo sapiens
agaacuuguugcugauu

SEQ ID NO: 1963672 - RNA, 16 nt, Homo sapiens
aggugugagccacugc

SEQ ID NO: 1963673 - RNA, 15 nt, Homo sapiens
cuccuuagaagugga

SEQ ID NO: 1963674 - RNA, 19 nt, Homo sapiens
ggcuuaagugagcagaaca

SEQ ID NO: 1963675 - RNA, 16 nt, Homo sapiens
auacccaugcuuuguu

SEQ ID NO: 1963676 - RNA, 14 nt, Homo sapiens
ucaauuucaaaagg

SEQ ID NO: 1963677 - RNA, 23 nt, Homo sapiens
aucuugggggucacccauggccu

SEQ ID NO: 1963678 - RNA, 17 nt, Homo sapiens
agaaaaugcucccugaa

SEQ ID NO: 1963679 - RNA, 12 nt, Homo sapiens
agcuggugacag

SEQ ID NO: 1963680 - RNA, 22 nt, Homo sapiens
accgcagucgucgcacagucuc

SEQ ID NO: 1963681 - RNA, 14 nt, Homo sapiens
aagagaaacuucaa

SEQ ID NO: 1963682 - RNA, 20 nt, Homo sapiens
cacacagacaguuucugaca

SEQ ID NO: 1963683 - RNA, 17 nt, Homo sapiens
auugauuuuuacuucaa

SEQ ID NO: 1963684 - RNA, 13 nt, Homo sapiens
cuuucagucccaa

SEQ ID NO: 1963685 - RNA, 21 nt, Homo sapiens
gcauugauaaucuucagguga

SEQ ID NO: 1963686 - RNA, 12 nt, Homo sapiens
aucaaccaaagu

SEQ ID NO: 1963687 - RNA, 20 nt, Homo sapiens
uacguuuccugagaaguguc

SEQ ID NO: 1963688 - RNA, 22 nt, Homo sapiens
auucuaguguaaaucaugcaag

SEQ ID NO: 1963689 - RNA, 15 nt, Homo sapiens
uucuaauccaugugc

SEQ ID NO: 1963690 - RNA, 23 nt, Homo sapiens
uuggguugaucucuuagaagcca

SEQ ID NO: 1963691 - RNA, 23 nt, Homo sapiens
auacacguuacugaucuuacuca

SEQ ID NO: 1963692 - RNA, 20 nt, Homo sapiens
gucccagagguuaucugccu

SEQ ID NO: 1963693 - RNA, 20 nt, Homo sapiens
gcacaaaaucagccaaagca

SEQ ID NO: 1963694 - RNA, 19 nt, Homo sapiens
uuccccaauuacaggguga

SEQ ID NO: 1963695 - RNA, 13 nt, Homo sapiens
cccagcaccacac

SEQ ID NO: 1963696 - RNA, 13 nt, Homo sapiens
cccugcaccacuc

SEQ ID NO: 1963697 - RNA, 14 nt, Homo sapiens
ugacuagugcugaa

SEQ ID NO: 1963698 - RNA, 20 nt, Homo sapiens
guuuugauaaaguaguaaaa

SEQ ID NO: 1963699 - RNA, 17 nt, Homo sapiens
aacuuauggaaagccca

SEQ ID NO: 1963700 - RNA, 20 nt, Homo sapiens
uugccaaauaaaguuaaaag

SEQ ID NO: 1963701 - RNA, 15 nt, Homo sapiens
agguuuacauuguca

SEQ ID NO: 1963702 - RNA, 21 nt, Homo sapiens
acagaacugcagucagcauga

SEQ ID NO: 1963703 - RNA, 19 nt, Homo sapiens
aaauggacuacaguagcuc

SEQ ID NO: 1963704 - RNA, 16 nt, Homo sapiens
ucccccacgugugaag

SEQ ID NO: 1963705 - RNA, 23 nt, Homo sapiens
ucagaaaacauaauauagcuuaa

SEQ ID NO: 1963706 - RNA, 20 nt, Homo sapiens
gggagccuaaggaagcgugg

SEQ ID NO: 1963707 - RNA, 21 nt, Homo sapiens
ccugagucugcaugugcacgg

SEQ ID NO: 1963708 - RNA, 14 nt, Homo sapiens
aguccugguuggga

SEQ ID NO: 1963709 - RNA, 11 nt, Homo sapiens
caaagacugua

SEQ ID NO: 1963710 - RNA, 18 nt, Homo sapiens
uuauauauaugcuacuuu

SEQ ID NO: 1963711 - RNA, 12 nt, Homo sapiens
ucagcucugagg

SEQ ID NO: 1963712 - RNA, 17 nt, Homo sapiens
ucugacuaaaaauacuu

SEQ ID NO: 1963713 - RNA, 17 nt, Homo sapiens
aagaagcccuccuugcc

SEQ ID NO: 1963714 - RNA, 22 nt, Homo sapiens
uaagcgggaucccagcaucuca

SEQ ID NO: 1963715 - RNA, 16 nt, Homo sapiens
cugaucucaguuuccu

SEQ ID NO: 1963716 - RNA, 13 nt, Homo sapiens
ucguacuuucaca

SEQ ID NO: 1963717 - RNA, 15 nt, Homo sapiens
ccguguggacugugc

SEQ ID NO: 1963718 - RNA, 20 nt, Homo sapiens
gcucaguuggugcugcuuuc

SEQ ID NO: 1963719 - RNA, 12 nt, Homo sapiens
cuuuaccaugcu

SEQ ID NO: 1963720 - RNA, 22 nt, Homo sapiens
augugccaauaaccaaguuuau

SEQ ID NO: 1963721 - RNA, 20 nt, Homo sapiens
cuuuuggugaaagcugagaa

SEQ ID NO: 1963722 - RNA, 16 nt, Homo sapiens
gguuaaacaaaccaga

SEQ ID NO: 1963723 - RNA, 16 nt, Homo sapiens
uuacuugccuaucuga

SEQ ID NO: 1963724 - RNA, 20 nt, Homo sapiens
aguguagaaaagaacuggaa

SEQ ID NO: 1963725 - RNA, 15 nt, Homo sapiens
caugcccuccaugug

SEQ ID NO: 1963726 - RNA, 21 nt, Homo sapiens
gagggcacuggagcugucuug

SEQ ID NO: 1963727 - RNA, 16 nt, Homo sapiens
agucuuguacacuuaa

SEQ ID NO: 1963728 - RNA, 23 nt, Homo sapiens
cacugugacacacuacaccacac

SEQ ID NO: 1963729 - RNA, 17 nt, Homo sapiens
guucuuugucucaaaau

SEQ ID NO: 1963730 - RNA, 23 nt, Homo sapiens
accaauggguuugccaagcccuu

SEQ ID NO: 1963731 - RNA, 21 nt, Homo sapiens
caugcugggcucacuacaugg

SEQ ID NO: 1963732 - RNA, 18 nt, Homo sapiens
uuggucccucucagauac

SEQ ID NO: 1963733 - RNA, 21 nt, Homo sapiens
cgagaucgugccauugcacuc

SEQ ID NO: 1963734 - RNA, 12 nt, Homo sapiens
cccagcacuuug

SEQ ID NO: 1963735 - RNA, 17 nt, Homo sapiens
uaucuaguacuucccag

SEQ ID NO: 1963736 - RNA, 18 nt, Homo sapiens
aguaaucucacacuucau

SEQ ID NO: 1963737 - RNA, 20 nt, Homo sapiens
aaggcuuugguuuccaaguc

SEQ ID NO: 1963738 - RNA, 17 nt, Homo sapiens
ccaggaaaugugcacaa

SEQ ID NO: 1963739 - RNA, 23 nt, Homo sapiens
cauagauuugcagcucaguagua

SEQ ID NO: 1963740 - RNA, 14 nt, Homo sapiens
acaauaugcuuuac

SEQ ID NO: 1963741 - RNA, 18 nt, Homo sapiens
uuaugucuagaaaguaag

SEQ ID NO: 1963742 - RNA, 22 nt, Homo sapiens
ucuuuucuucuccgccaguaug

SEQ ID NO: 1963743 - RNA, 19 nt, Homo sapiens
ccuauuuuuguaaacugga

SEQ ID NO: 1963744 - RNA, 16 nt, Homo sapiens
agguaaagucaaagcu

SEQ ID NO: 1963745 - RNA, 13 nt, Homo sapiens
uuuuaugucuuaa

SEQ ID NO: 1963746 - RNA, 19 nt, Homo sapiens
auagggaaaauaaucucaa

SEQ ID NO: 1963747 - RNA, 22 nt, Homo sapiens
uuaaaacuucaguuucacagaa

SEQ ID NO: 1963748 - RNA, 15 nt, Homo sapiens
acuguuucuuaccuu

SEQ ID NO: 1963749 - RNA, 21 nt, Homo sapiens
ggguauuuugguacugugaug

SEQ ID NO: 1963750 - RNA, 20 nt, Homo sapiens
ccuucacuggcgccuucucg

SEQ ID NO: 1963751 - RNA, 13 nt, Homo sapiens
caauagugaauga

SEQ ID NO: 1963752 - RNA, 16 nt, Homo sapiens
gagugcaguggcacaa

SEQ ID NO: 1963753 - RNA, 16 nt, Homo sapiens
gaucgcuguguuacua

SEQ ID NO: 1963754 - RNA, 14 nt, Homo sapiens
cugcuaagauuccu

SEQ ID NO: 1963755 - RNA, 19 nt, Homo sapiens
ggcauuucuuuucugcaug

SEQ ID NO: 1963756 - RNA, 16 nt, Homo sapiens
ggcaggugaaaagggu

SEQ ID NO: 1963757 - RNA, 17 nt, Homo sapiens
acacacaucuaucuaua

SEQ ID NO: 1963758 - RNA, 20 nt, Homo sapiens
aguccuuauguuaagcccug

SEQ ID NO: 1963759 - RNA, 23 nt, Homo sapiens
agagagucgcaucucagugcagg

SEQ ID NO: 1963760 - RNA, 16 nt, Homo sapiens
cugucugugugcugag

SEQ ID NO: 1963761 - RNA, 13 nt, Homo sapiens
acaauucuguccc

SEQ ID NO: 1963762 - RNA, 18 nt, Homo sapiens
gaauacguucuccucuga

SEQ ID NO: 1963763 - RNA, 13 nt, Homo sapiens
guuauuguaggca

SEQ ID NO: 1963764 - RNA, 17 nt, Homo sapiens
gaugccucccugacccu

SEQ ID NO: 1963765 - RNA, 21 nt, Homo sapiens
ccggucaccagaagugaaaag

SEQ ID NO: 1963766 - RNA, 20 nt, Homo sapiens
cauuagugggaaaaaguggg

SEQ ID NO: 1963767 - RNA, 13 nt, Homo sapiens
cgucaagacauuu

SEQ ID NO: 1963768 - RNA, 16 nt, Homo sapiens
gaaaaagugcuuauua

SEQ ID NO: 1963769 - RNA, 19 nt, Homo sapiens
uagaagcagaucauuuccc

SEQ ID NO: 1963770 - RNA, 14 nt, Homo sapiens
agucacugucagag

SEQ ID NO: 1963771 - RNA, 19 nt, Homo sapiens
uuugcaggcucauagggaa

SEQ ID NO: 1963772 - RNA, 20 nt, Homo sapiens
cuucaaaaacgcacugcaag

SEQ ID NO: 1963773 - RNA, 23 nt, Homo sapiens
ggcggaucuuuggacagaagcag

SEQ ID NO: 1963774 - RNA, 13 nt, Homo sapiens
cacuaccacauua

SEQ ID NO: 1963775 - RNA, 14 nt, Homo sapiens
ccaaauacauuaac

SEQ ID NO: 1963776 - RNA, 14 nt, Homo sapiens
aguaguaucaauga

SEQ ID NO: 1963777 - RNA, 17 nt, Homo sapiens
aagaaagguuaaggagu

SEQ ID NO: 1963778 - RNA, 11 nt, Homo sapiens
uuucacaaagg

SEQ ID NO: 1963779 - RNA, 20 nt, Homo sapiens
uggucagugguggucuucaa

SEQ ID NO: 1963780 - RNA, 16 nt, Homo sapiens
guccugaaagccacag

SEQ ID NO: 1963781 - RNA, 19 nt, Homo sapiens
ugaagauuucacuacuuag

SEQ ID NO: 1963782 - RNA, 18 nt, Homo sapiens
uuugugucaaaaggacau

SEQ ID NO: 1963783 - RNA, 17 nt, Homo sapiens
uuuaacuuuaccaugcu

SEQ ID NO: 1963784 - RNA, 23 nt, Homo sapiens
cuguggcuccugccuugaugaag

SEQ ID NO: 1963785 - RNA, 21 nt, Homo sapiens
augcaagagaacaauguuucu

SEQ ID NO: 1963786 - RNA, 17 nt, Homo sapiens
aaggaggggaagcugca

SEQ ID NO: 1963787 - RNA, 16 nt, Homo sapiens
ucugccucccuagcuu

SEQ ID NO: 1963788 - RNA, 22 nt, Homo sapiens
ugaagaacuggaaccccagcuu

SEQ ID NO: 1963789 - RNA, 22 nt, Homo sapiens
gaucugguguccagcauggaug

SEQ ID NO: 1963790 - RNA, 22 nt, Homo sapiens
aaugaagcagaaauguacuuag

SEQ ID NO: 1963791 - RNA, 20 nt, Homo sapiens
ucuucacuaaaaucagugac

SEQ ID NO: 1963792 - RNA, 12 nt, Homo sapiens
gugacaccacca

SEQ ID NO: 1963793 - RNA, 19 nt, Homo sapiens
auuugcacacugcacuguu

SEQ ID NO: 1963794 - RNA, 14 nt, Homo sapiens
agguuuucacaaau

SEQ ID NO: 1963795 - RNA, 21 nt, Homo sapiens
acaggcagauguuugccucau

SEQ ID NO: 1963796 - RNA, 20 nt, Homo sapiens
uuacaaagcaucucauucau

SEQ ID NO: 1963797 - RNA, 23 nt, Homo sapiens
aauuaaaacuaagcacaaagcca

SEQ ID NO: 1963798 - RNA, 14 nt, Homo sapiens
auuuggagugacca

SEQ ID NO: 1963799 - RNA, 22 nt, Homo sapiens
aaaguucuguauauaguauaaa

SEQ ID NO: 1963800 - RNA, 22 nt, Homo sapiens
ccucgccccagccaagccugac

SEQ ID NO: 1963801 - RNA, 14 nt, Homo sapiens
uuaaagacuaacua

SEQ ID NO: 1963802 - RNA, 17 nt, Homo sapiens
aagcaagaaaaccacaa

SEQ ID NO: 1963803 - RNA, 16 nt, Homo sapiens
uuccuaacguuuucua

SEQ ID NO: 1963804 - RNA, 13 nt, Homo sapiens
gcuccgaccucuc

SEQ ID NO: 1963805 - RNA, 23 nt, Homo sapiens
accuggcauuccuucugaccaca

SEQ ID NO: 1963806 - RNA, 18 nt, Homo sapiens
ccuuugugugugugguuc

SEQ ID NO: 1963807 - RNA, 20 nt, Homo sapiens
uguaaaacuuuggugcauug

SEQ ID NO: 1963808 - RNA, 17 nt, Homo sapiens
uacuugaggcugcaauc

SEQ ID NO: 1963809 - RNA, 12 nt, Homo sapiens
cugaccaagaga

SEQ ID NO: 1963810 - RNA, 23 nt, Homo sapiens
acuuaaguccagaagccuccugu

SEQ ID NO: 1963811 - RNA, 15 nt, Homo sapiens
gacccggggcagcug

SEQ ID NO: 1963812 - RNA, 19 nt, Homo sapiens
caauacggaacacugucaa

SEQ ID NO: 1963813 - RNA, 16 nt, Homo sapiens
ggccaccaugcacuca

SEQ ID NO: 1963814 - RNA, 22 nt, Homo sapiens
aacaaguauauaauuuacuuug

SEQ ID NO: 1963815 - RNA, 17 nt, Homo sapiens
cugcccuccuuguccac

SEQ ID NO: 1963816 - RNA, 12 nt, Homo sapiens
uucuuucacuca

SEQ ID NO: 1963817 - RNA, 20 nt, Homo sapiens
uaaacauuuuucacaucucu

SEQ ID NO: 1963818 - RNA, 20 nt, Homo sapiens
ugccuuguaaacaugaaggg

SEQ ID NO: 1963819 - RNA, 18 nt, Homo sapiens
gacccacucugcggcccg

SEQ ID NO: 1963820 - RNA, 18 nt, Homo sapiens
cucauuauuaccacuuag

SEQ ID NO: 1963821 - RNA, 23 nt, Homo sapiens
agcccgcuuuuguucuuccccac

SEQ ID NO: 1963822 - RNA, 15 nt, Homo sapiens
ugugaccucccaugg

SEQ ID NO: 1963823 - RNA, 13 nt, Homo sapiens
cuauguugcccaa

SEQ ID NO: 1963824 - RNA, 16 nt, Homo sapiens
uaugugcuucacauaa

SEQ ID NO: 1963825 - RNA, 20 nt, Homo sapiens
aaaugcaugaguaugugcac

SEQ ID NO: 1963826 - RNA, 17 nt, Homo sapiens
ggugaccccagggcaca

SEQ ID NO: 1963827 - RNA, 20 nt, Homo sapiens
cugaccauccaggcauauag

SEQ ID NO: 1963828 - RNA, 18 nt, Homo sapiens
uaguagccuuacugugaa

SEQ ID NO: 1963829 - RNA, 15 nt, Homo sapiens
aacaccaucacagcu

SEQ ID NO: 1963830 - RNA, 20 nt, Homo sapiens
acauuuucuuguccaaagcu

SEQ ID NO: 1963831 - RNA, 20 nt, Homo sapiens
agccauguaaucagauuuau

SEQ ID NO: 1963832 - RNA, 14 nt, Homo sapiens
cuuuucuccaugag

SEQ ID NO: 1963833 - RNA, 15 nt, Homo sapiens
ugagugugugcacag

SEQ ID NO: 1963834 - RNA, 13 nt, Homo sapiens
uuuuguaucucau

SEQ ID NO: 1963835 - RNA, 14 nt, Homo sapiens
aacauacaauuuac

SEQ ID NO: 1963836 - RNA, 17 nt, Homo sapiens
cuuaaauguuuauacug

SEQ ID NO: 1963837 - RNA, 19 nt, Homo sapiens
cugagucaucaaaaagagu

SEQ ID NO: 1963838 - RNA, 19 nt, Homo sapiens
aacucugguaaaugaucac

SEQ ID NO: 1963839 - RNA, 18 nt, Homo sapiens
acuguaacugacugccuu

SEQ ID NO: 1963840 - RNA, 19 nt, Homo sapiens
ccuguccugugaauggaag

SEQ ID NO: 1963841 - RNA, 23 nt, Homo sapiens
aggaugacuaacaagauuuguaa

SEQ ID NO: 1963842 - RNA, 20 nt, Homo sapiens
caggcucaacauuucuacac

SEQ ID NO: 1963843 - RNA, 14 nt, Homo sapiens
cagagggacuguca

SEQ ID NO: 1963844 - RNA, 18 nt, Homo sapiens
agcaucccuaauucuuca

SEQ ID NO: 1963845 - RNA, 20 nt, Homo sapiens
ggacuggggagcacaggugu

SEQ ID NO: 1963846 - RNA, 13 nt, Homo sapiens
ugugugugugcau

SEQ ID NO: 1963847 - RNA, 19 nt, Homo sapiens
acagaguugguguucauaa

SEQ ID NO: 1963848 - RNA, 20 nt, Homo sapiens
gcugaccuuucaaacccaga

SEQ ID NO: 1963849 - RNA, 20 nt, Homo sapiens
aaguuguuauuucaguuuua

SEQ ID NO: 1963850 - RNA, 20 nt, Homo sapiens
caggaguaucuuaccuguaa

SEQ ID NO: 1963851 - RNA, 22 nt, Homo sapiens
uccccgggggcagacaccugug

SEQ ID NO: 1963852 - RNA, 15 nt, Homo sapiens
ucaugcucauguaua

SEQ ID NO: 1963853 - RNA, 17 nt, Homo sapiens
guccauguguucuuauu

SEQ ID NO: 1963854 - RNA, 22 nt, Homo sapiens
gagacagguggccuagcaggca

SEQ ID NO: 1963855 - RNA, 20 nt, Homo sapiens
ucacaguuggcacuucugcc

SEQ ID NO: 1963856 - RNA, 23 nt, Homo sapiens
guucccgugacgaggcucaaaaa

SEQ ID NO: 1963857 - RNA, 20 nt, Homo sapiens
gcacacacacacaguccuca

SEQ ID NO: 1963858 - RNA, 18 nt, Homo sapiens
cugcaauaugaauucaag

SEQ ID NO: 1963859 - RNA, 23 nt, Homo sapiens
ugccccaccccaccucacagcua

SEQ ID NO: 1963860 - RNA, 15 nt, Homo sapiens
aaccuaccacauuca

SEQ ID NO: 1963861 - RNA, 21 nt, Homo sapiens
cucaccacgguguaccgggau

SEQ ID NO: 1963862 - RNA, 19 nt, Homo sapiens
gugauuuaagacacuuuuu

SEQ ID NO: 1963863 - RNA, 20 nt, Homo sapiens
ucugaguagacauucuuaua

SEQ ID NO: 1963864 - RNA, 17 nt, Homo sapiens
acugaauucugccuugg

SEQ ID NO: 1963865 - RNA, 15 nt, Homo sapiens
uucauuguguucucu

SEQ ID NO: 1963866 - RNA, 14 nt, Homo sapiens
cuuuuuuucuuugg

SEQ ID NO: 1963867 - RNA, 18 nt, Homo sapiens
aauuuucuuccauuucau

SEQ ID NO: 1963868 - RNA, 18 nt, Homo sapiens
uuuugguugggaaugagg

SEQ ID NO: 1963869 - RNA, 20 nt, Homo sapiens
gaggccaaggcgggcggauc

SEQ ID NO: 1963870 - RNA, 15 nt, Homo sapiens
cugagagcguggccu

SEQ ID NO: 1963871 - RNA, 19 nt, Homo sapiens
ugaagggccacugggaccc

SEQ ID NO: 1963872 - RNA, 20 nt, Homo sapiens
cucguuggaugucugugagu

SEQ ID NO: 1963873 - RNA, 18 nt, Homo sapiens
augaugcuagccagcaaa

SEQ ID NO: 1963874 - RNA, 13 nt, Homo sapiens
uuuugacugugau

SEQ ID NO: 1963875 - RNA, 16 nt, Homo sapiens
aguacauuugcuuuaa

SEQ ID NO: 1963876 - RNA, 14 nt, Homo sapiens
ccagcuuugcccaa

SEQ ID NO: 1963877 - RNA, 22 nt, Homo sapiens
ucagugucaaauaaacacugug

SEQ ID NO: 1963878 - RNA, 23 nt, Homo sapiens
aaauugaugguggccacagugug

SEQ ID NO: 1963879 - RNA, 16 nt, Homo sapiens
gacaccaaaacaaacc

SEQ ID NO: 1963880 - RNA, 18 nt, Homo sapiens
ugauuaaagaaaauaugc

SEQ ID NO: 1963881 - RNA, 22 nt, Homo sapiens
gucuccuaccugcugcugcuau

SEQ ID NO: 1963882 - RNA, 14 nt, Homo sapiens
uguucaaauagagc

SEQ ID NO: 1963883 - RNA, 23 nt, Homo sapiens
aagaggaggaagguuggaccuuc

SEQ ID NO: 1963884 - RNA, 11 nt, Homo sapiens
gaaaugagcuc

SEQ ID NO: 1963885 - RNA, 23 nt, Homo sapiens
acucuuaaguguaaauaauauaa

SEQ ID NO: 1963886 - RNA, 19 nt, Homo sapiens
agguuggugaauuucacaa

SEQ ID NO: 1963887 - RNA, 19 nt, Homo sapiens
agcuaugucucuagcagug

SEQ ID NO: 1963888 - RNA, 12 nt, Homo sapiens
ccucucucugua

SEQ ID NO: 1963889 - RNA, 21 nt, Homo sapiens
acagaaauaaagagcuguuau

SEQ ID NO: 1963890 - RNA, 17 nt, Homo sapiens
ucuggcaccaaagucca

SEQ ID NO: 1963891 - RNA, 14 nt, Homo sapiens
gggacucgggugcu

SEQ ID NO: 1963892 - RNA, 20 nt, Homo sapiens
gcacuuuaaaaacaggccag

SEQ ID NO: 1963893 - RNA, 14 nt, Homo sapiens
cggucccacacugg

SEQ ID NO: 1963894 - RNA, 20 nt, Homo sapiens
accucuucuaugcaagccuu

SEQ ID NO: 1963895 - RNA, 15 nt, Homo sapiens
aaguuugcuagugac

SEQ ID NO: 1963896 - RNA, 21 nt, Homo sapiens
cuuccccagguccuuccuuua

SEQ ID NO: 1963897 - RNA, 14 nt, Homo sapiens
acacccaccugcug

SEQ ID NO: 1963898 - RNA, 18 nt, Homo sapiens
aacuaaaguaucugagau

SEQ ID NO: 1963899 - RNA, 14 nt, Homo sapiens
cucgcacucuggug

SEQ ID NO: 1963900 - RNA, 14 nt, Homo sapiens
cggcugcucgccca

SEQ ID NO: 1963901 - RNA, 13 nt, Homo sapiens
uuggccguggcau

SEQ ID NO: 1963902 - RNA, 17 nt, Homo sapiens
acaagcagugucuguca

SEQ ID NO: 1963903 - RNA, 22 nt, Homo sapiens
cagaaaacgggaagcgcucaga

SEQ ID NO: 1963904 - RNA, 17 nt, Homo sapiens
agcccacccugcugcug

SEQ ID NO: 1963905 - RNA, 15 nt, Homo sapiens
aaguagugucauuca

SEQ ID NO: 1963906 - RNA, 20 nt, Homo sapiens
uguuggcuagacuagucuca

SEQ ID NO: 1963907 - RNA, 23 nt, Homo sapiens
gcuuugguauucugcuuccacau

SEQ ID NO: 1963908 - RNA, 21 nt, Homo sapiens
acucugucucauugaccuuca

SEQ ID NO: 1963909 - RNA, 14 nt, Homo sapiens
aaauuaucuuuaaa

SEQ ID NO: 1963910 - RNA, 21 nt, Homo sapiens
aucucuaauaaaaauacaaaa

SEQ ID NO: 1963911 - RNA, 21 nt, Homo sapiens
cauaugauuguauuuguguau

SEQ ID NO: 1963912 - RNA, 16 nt, Homo sapiens
caguuauuugauuugu

SEQ ID NO: 1963913 - RNA, 23 nt, Homo sapiens
cugccucggggacacuagugaca

SEQ ID NO: 1963914 - RNA, 15 nt, Homo sapiens
aggagcuuacugaaa

SEQ ID NO: 1963915 - RNA, 18 nt, Homo sapiens
guugccagguugcagcug

SEQ ID NO: 1963916 - RNA, 14 nt, Homo sapiens
gacuagagcacaac

SEQ ID NO: 1963917 - RNA, 14 nt, Homo sapiens
gacaggagcacugc

SEQ ID NO: 1963918 - RNA, 19 nt, Homo sapiens
uggaugcacagaugccaug

SEQ ID NO: 1963919 - RNA, 20 nt, Homo sapiens
agaaccccaggacgcccuca

SEQ ID NO: 1963920 - RNA, 17 nt, Homo sapiens
acucuugcaggucucaa

SEQ ID NO: 1963921 - RNA, 14 nt, Homo sapiens
uguuuaauggguau

SEQ ID NO: 1963922 - RNA, 14 nt, Homo sapiens
uuucuaaugugcau

SEQ ID NO: 1963923 - RNA, 20 nt, Homo sapiens
uucaugcgaugacacuugua

SEQ ID NO: 1963924 - RNA, 16 nt, Homo sapiens
caaauuuuguauuucu

SEQ ID NO: 1963925 - RNA, 12 nt, Homo sapiens
uugccaccauuu

SEQ ID NO: 1963926 - RNA, 13 nt, Homo sapiens
gggaaguucaggc

SEQ ID NO: 1963927 - RNA, 21 nt, Homo sapiens
uaaauacuguacauagaugua

SEQ ID NO: 1963928 - RNA, 22 nt, Homo sapiens
cugggggcugccgagccaccau

SEQ ID NO: 1963929 - RNA, 21 nt, Homo sapiens
aaguuagucaauccugucaua

SEQ ID NO: 1963930 - RNA, 20 nt, Homo sapiens
aguagaugcauuugggucca

SEQ ID NO: 1963931 - RNA, 20 nt, Homo sapiens
ugcaguaugaacuauugccu

SEQ ID NO: 1963932 - RNA, 22 nt, Homo sapiens
uccgggagggugcggcugugca

SEQ ID NO: 1963933 - RNA, 14 nt, Homo sapiens
ugaccccacugcca

SEQ ID NO: 1963934 - RNA, 20 nt, Homo sapiens
aggcuuuccaauguagcuca

SEQ ID NO: 1963935 - RNA, 19 nt, Homo sapiens
guguauaucucuuggaaaa

SEQ ID NO: 1963936 - RNA, 22 nt, Homo sapiens
cuguccguucacauguguggua

SEQ ID NO: 1963937 - RNA, 18 nt, Homo sapiens
ggcggguccuagcuguua

SEQ ID NO: 1963938 - RNA, 17 nt, Homo sapiens
aaauauugcuucaauaa

SEQ ID NO: 1963939 - RNA, 18 nt, Homo sapiens
guuccucucccuucccuu

SEQ ID NO: 1963940 - RNA, 15 nt, Homo sapiens
aaugcuaaaugcaaa

SEQ ID NO: 1963941 - RNA, 13 nt, Homo sapiens
gcuucugccucag

SEQ ID NO: 1963942 - RNA, 22 nt, Homo sapiens
ugcccaaaagaggugucaugcu

SEQ ID NO: 1963943 - RNA, 18 nt, Homo sapiens
auugcacugcaguuauuu

SEQ ID NO: 1963944 - RNA, 21 nt, Homo sapiens
aagccacggaccguugcacaa

SEQ ID NO: 1963945 - RNA, 15 nt, Homo sapiens
aucccuaucuugcag

SEQ ID NO: 1963946 - RNA, 14 nt, Homo sapiens
aaugucugccaggu

SEQ ID NO: 1963947 - RNA, 19 nt, Homo sapiens
uucaggccugcuagucacu

SEQ ID NO: 1963948 - RNA, 16 nt, Homo sapiens
acuugagggaccaaua

SEQ ID NO: 1963949 - RNA, 17 nt, Homo sapiens
accucagauggcagcuu

SEQ ID NO: 1963950 - RNA, 19 nt, Homo sapiens
agggugagggccaccucca

SEQ ID NO: 1963951 - RNA, 13 nt, Homo sapiens
auuuuggucacag

SEQ ID NO: 1963952 - RNA, 22 nt, Homo sapiens
gugaauccaugggucuggcuag

SEQ ID NO: 1963953 - RNA, 20 nt, Homo sapiens
cucacauagcuacccaaaag

SEQ ID NO: 1963954 - RNA, 22 nt, Homo sapiens
ccaguuaaagauuauugugacu

SEQ ID NO: 1963955 - RNA, 23 nt, Homo sapiens
guuaauggucaaugcuagcacaa

SEQ ID NO: 1963956 - RNA, 22 nt, Homo sapiens
acauauuucaugggaauauuca

SEQ ID NO: 1963957 - RNA, 15 nt, Homo sapiens
auguauccuuucaca

SEQ ID NO: 1963958 - RNA, 17 nt, Homo sapiens
auuuugugaugaugcug

SEQ ID NO: 1963959 - RNA, 12 nt, Homo sapiens
aaugacaaugau

SEQ ID NO: 1963960 - RNA, 23 nt, Homo sapiens
agaugccccagccugcuuucaca

SEQ ID NO: 1963961 - RNA, 20 nt, Homo sapiens
uccaaagguuuaaacuaccu

SEQ ID NO: 1963962 - RNA, 15 nt, Homo sapiens
ggaaagcagccguuu

SEQ ID NO: 1963963 - RNA, 19 nt, Homo sapiens
cuagggcuaguagaacugg

SEQ ID NO: 1963964 - RNA, 15 nt, Homo sapiens
ucacuaauauaguag

SEQ ID NO: 1963965 - RNA, 19 nt, Homo sapiens
aaagaacaacuugcuacug

SEQ ID NO: 1963966 - RNA, 17 nt, Homo sapiens
augaaauuuaaacauua

SEQ ID NO: 1963967 - RNA, 17 nt, Homo sapiens
cuagaaaacaggcaaau

SEQ ID NO: 1963968 - RNA, 13 nt, Homo sapiens
uuuaguauccaca

SEQ ID NO: 1963969 - RNA, 18 nt, Homo sapiens
ccacaaucugggacuuuc

SEQ ID NO: 1963970 - RNA, 18 nt, Homo sapiens
gcuccagaagaacaaaga

SEQ ID NO: 1963971 - RNA, 15 nt, Homo sapiens
acccagagccagugu

SEQ ID NO: 1963972 - RNA, 22 nt, Homo sapiens
ccuaggaucuucacugucuuac

SEQ ID NO: 1963973 - RNA, 12 nt, Homo sapiens
ucacaguauuau

SEQ ID NO: 1963974 - RNA, 14 nt, Homo sapiens
uagugaaacauuug

SEQ ID NO: 1963975 - RNA, 21 nt, Homo sapiens
uaaugcacuaaaaguaguauu

SEQ ID NO: 1963976 - RNA, 17 nt, Homo sapiens
ggauccccaacccugag

SEQ ID NO: 1963977 - RNA, 15 nt, Homo sapiens
gccugccaacaagcu

SEQ ID NO: 1963978 - RNA, 17 nt, Homo sapiens
uuucaucuggauucuac

SEQ ID NO: 1963979 - RNA, 15 nt, Homo sapiens
acucaagucuggauc

SEQ ID NO: 1963980 - RNA, 14 nt, Homo sapiens
aaugguagcauuua

SEQ ID NO: 1963981 - RNA, 19 nt, Homo sapiens
uauucauaaaaacugugaa

SEQ ID NO: 1963982 - RNA, 14 nt, Homo sapiens
caauugauacuuca

SEQ ID NO: 1963983 - RNA, 14 nt, Homo sapiens
cuucuacacugggu

SEQ ID NO: 1963984 - RNA, 22 nt, Homo sapiens
auaggcugggccagguggcucc

SEQ ID NO: 1963985 - RNA, 22 nt, Homo sapiens
gcaaaggaaaaauugaugaaua

SEQ ID NO: 1963986 - RNA, 22 nt, Homo sapiens
aguaauagauuguuuugccacu

SEQ ID NO: 1963987 - RNA, 23 nt, Homo sapiens
augaagcuuuauacguguagcua

SEQ ID NO: 1963988 - RNA, 19 nt, Homo sapiens
ccccaaguagucugcucac

SEQ ID NO: 1963989 - RNA, 23 nt, Homo sapiens
uacaucuguaaagaaaaccauaa

SEQ ID NO: 1963990 - RNA, 18 nt, Homo sapiens
guagacugauuacacuga

SEQ ID NO: 1963991 - RNA, 18 nt, Homo sapiens
uaagauuuccaagugcca

SEQ ID NO: 1963992 - RNA, 21 nt, Homo sapiens
agaugggguuucacuguguug

SEQ ID NO: 1963993 - RNA, 18 nt, Homo sapiens
uacuguugcacguguguu

SEQ ID NO: 1963994 - RNA, 22 nt, Homo sapiens
ccacaauuauuggcaaaguuua

SEQ ID NO: 1963995 - RNA, 23 nt, Homo sapiens
cugcuucuuggagcuuuggaaua

SEQ ID NO: 1963996 - RNA, 20 nt, Homo sapiens
aauaaaacagcugucucuaa

SEQ ID NO: 1963997 - RNA, 17 nt, Homo sapiens
caaugcaaaguaaaaaa

SEQ ID NO: 1963998 - RNA, 17 nt, Homo sapiens
acaugacauagcacuug

SEQ ID NO: 1963999 - RNA, 19 nt, Homo sapiens
ccuguucucuaguuuucca

SEQ ID NO: 1964000 - RNA, 15 nt, Homo sapiens
uguaaaggccuuuaa

SEQ ID NO: 1964001 - RNA, 20 nt, Homo sapiens
cagggaugccaacaccuucu

SEQ ID NO: 1964002 - RNA, 21 nt, Homo sapiens
ugauucuauaaaacacaucau

SEQ ID NO: 1964003 - RNA, 16 nt, Homo sapiens
cgugacagccucugac

SEQ ID NO: 1964004 - RNA, 18 nt, Homo sapiens
ccuccgccuccuggguuc

SEQ ID NO: 1964005 - RNA, 16 nt, Homo sapiens
uuuuauucuugaucag

SEQ ID NO: 1964006 - RNA, 15 nt, Homo sapiens
ggagaggcauggcug

SEQ ID NO: 1964007 - RNA, 14 nt, Homo sapiens
cuacagauuuuaga

SEQ ID NO: 1964008 - RNA, 14 nt, Homo sapiens
uacuugcacaagcu

SEQ ID NO: 1964009 - RNA, 11 nt, Homo sapiens
ggcaacugaga

SEQ ID NO: 1964010 - RNA, 13 nt, Homo sapiens
aagcauuuugcaa

SEQ ID NO: 1964011 - RNA, 16 nt, Homo sapiens
gaacauagaacucugg

SEQ ID NO: 1964012 - RNA, 19 nt, Homo sapiens
ugaaguggugugaucccag

SEQ ID NO: 1964013 - RNA, 22 nt, Homo sapiens
aaugagaagcuuugguucugcc

SEQ ID NO: 1964014 - RNA, 23 nt, Homo sapiens
auauaggcuucucacggcgacca

SEQ ID NO: 1964015 - RNA, 18 nt, Homo sapiens
cugagcuuucuagccuaa

SEQ ID NO: 1964016 - RNA, 21 nt, Homo sapiens
ucaccugcccaagaaacaccg

SEQ ID NO: 1964017 - RNA, 13 nt, Homo sapiens
ucaaaaacauucu

SEQ ID NO: 1964018 - RNA, 23 nt, Homo sapiens
gccaagucauuugaggaucucac

SEQ ID NO: 1964019 - RNA, 15 nt, Homo sapiens
aguguucugcuccug

SEQ ID NO: 1964020 - RNA, 14 nt, Homo sapiens
cucuguugcacaug

SEQ ID NO: 1964021 - RNA, 13 nt, Homo sapiens
aagaagagaagcu

SEQ ID NO: 1964022 - RNA, 15 nt, Homo sapiens
gaguguuguguuaaa

SEQ ID NO: 1964023 - RNA, 13 nt, Homo sapiens
agcuuuccgggga

SEQ ID NO: 1964024 - RNA, 22 nt, Homo sapiens
auauugugaacccuagcugugu

SEQ ID NO: 1964025 - RNA, 17 nt, Homo sapiens
acaauuggcacuaaaga

SEQ ID NO: 1964026 - RNA, 23 nt, Homo sapiens
aucaguaguguacauuaccauau

SEQ ID NO: 1964027 - RNA, 17 nt, Homo sapiens
auacauaauacaugauu

SEQ ID NO: 1964028 - RNA, 20 nt, Homo sapiens
ugaaucagagugcacaagca

SEQ ID NO: 1964029 - RNA, 22 nt, Homo sapiens
ugaaauggaggaucucuaaaga

SEQ ID NO: 1964030 - RNA, 18 nt, Homo sapiens
agccaccacccucaggug

SEQ ID NO: 1964031 - RNA, 15 nt, Homo sapiens
ucgggaaaauauuca

SEQ ID NO: 1964032 - RNA, 23 nt, Homo sapiens
acagagucgcuggcauguuucac

SEQ ID NO: 1964033 - RNA, 19 nt, Homo sapiens
aucacuuuucagaagacuu

SEQ ID NO: 1964034 - RNA, 21 nt, Homo sapiens
aauuuggccagacacaggugc

SEQ ID NO: 1964035 - RNA, 15 nt, Homo sapiens
acuccaugagugucu

SEQ ID NO: 1964036 - RNA, 13 nt, Homo sapiens
gcugagcucugag

SEQ ID NO: 1964037 - RNA, 18 nt, Homo sapiens
uagcaaaaucaagagaug

SEQ ID NO: 1964038 - RNA, 15 nt, Homo sapiens
auaaagacaggguuu

SEQ ID NO: 1964039 - RNA, 21 nt, Homo sapiens
gugcucaauacacagaaaagu

SEQ ID NO: 1964040 - RNA, 22 nt, Homo sapiens
gcaagugugcuggccucucuga

SEQ ID NO: 1964041 - RNA, 18 nt, Homo sapiens
uucacagagacacguggc

SEQ ID NO: 1964042 - RNA, 20 nt, Homo sapiens
ccuugucguaggaaaaccau

SEQ ID NO: 1964043 - RNA, 20 nt, Homo sapiens
aaccuuguauaaauuauuca

SEQ ID NO: 1964044 - RNA, 16 nt, Homo sapiens
ugcaagcuccaucucu

SEQ ID NO: 1964045 - RNA, 18 nt, Homo sapiens
aguuuaagacaccaaaua

SEQ ID NO: 1964046 - RNA, 18 nt, Homo sapiens
uagcaggccuaagacaug

SEQ ID NO: 1964047 - RNA, 14 nt, Homo sapiens
gcuugaagccaaag

SEQ ID NO: 1964048 - RNA, 22 nt, Homo sapiens
aacaacuccuagggccacugaa

SEQ ID NO: 1964049 - RNA, 14 nt, Homo sapiens
ugcuugauggaauu

SEQ ID NO: 1964050 - RNA, 14 nt, Homo sapiens
uaaagcauugcaac

SEQ ID NO: 1964051 - RNA, 20 nt, Homo sapiens
gagaauauacaugaagaaua

SEQ ID NO: 1964052 - RNA, 18 nt, Homo sapiens
guuccugauagcuaccca

SEQ ID NO: 1964053 - RNA, 19 nt, Homo sapiens
ucccuuggggccuaugcag

SEQ ID NO: 1964054 - RNA, 17 nt, Homo sapiens
ggacaaagaaauagcaa

SEQ ID NO: 1964055 - RNA, 18 nt, Homo sapiens
cagaacuguuguuuacuu

SEQ ID NO: 1964056 - RNA, 17 nt, Homo sapiens
cuugaucucucuugucc

SEQ ID NO: 1964057 - RNA, 15 nt, Homo sapiens
ccacacuaugcacag

SEQ ID NO: 1964058 - RNA, 13 nt, Homo sapiens
aagucauuccuuc

SEQ ID NO: 1964059 - RNA, 20 nt, Homo sapiens
aaaaugaaaugacugucuaa

SEQ ID NO: 1964060 - RNA, 14 nt, Homo sapiens
acaauaaacgucau

SEQ ID NO: 1964061 - RNA, 12 nt, Homo sapiens
uauuguuuccaa

SEQ ID NO: 1964062 - RNA, 23 nt, Homo sapiens
cagagaucacaccacugcacucu

SEQ ID NO: 1964063 - RNA, 14 nt, Homo sapiens
uuucucagcuccca

SEQ ID NO: 1964064 - RNA, 22 nt, Homo sapiens
auguggagugagaacagcauuu

SEQ ID NO: 1964065 - RNA, 16 nt, Homo sapiens
aaagaucuucuuccaa

SEQ ID NO: 1964066 - RNA, 15 nt, Homo sapiens
agagucucacucugu

SEQ ID NO: 1964067 - RNA, 15 nt, Homo sapiens
uaacacaaguuuacu

SEQ ID NO: 1964068 - RNA, 13 nt, Homo sapiens
gcagccugugaag

SEQ ID NO: 1964069 - RNA, 18 nt, Homo sapiens
ccggaaagccuuccucaa

SEQ ID NO: 1964070 - RNA, 17 nt, Homo sapiens
auacaaaaauaccuacu

SEQ ID NO: 1964071 - RNA, 17 nt, Homo sapiens
ucuuuaauaaauugcuu

SEQ ID NO: 1964072 - RNA, 14 nt, Homo sapiens
cgauauacagauga

SEQ ID NO: 1964073 - RNA, 19 nt, Homo sapiens
cagagugcuggacuguucc

SEQ ID NO: 1964074 - RNA, 18 nt, Homo sapiens
cacuagaggaauauaaug

SEQ ID NO: 1964075 - RNA, 16 nt, Homo sapiens
auaugcucugauuuau

SEQ ID NO: 1964076 - RNA, 22 nt, Homo sapiens
uagagcuaagauacugaugaca

SEQ ID NO: 1964077 - RNA, 22 nt, Homo sapiens
cuccaugcugucacuugugauu

SEQ ID NO: 1964078 - RNA, 15 nt, Homo sapiens
gugcaucccugagac

SEQ ID NO: 1964079 - RNA, 20 nt, Homo sapiens
gggcuugaauuugcaugucu

SEQ ID NO: 1964080 - RNA, 15 nt, Homo sapiens
uaaucaaguagaaca

SEQ ID NO: 1964081 - RNA, 19 nt, Homo sapiens
auuuuauugcuggaaucua

SEQ ID NO: 1964082 - RNA, 18 nt, Homo sapiens
ggaugcccauuccugccu

SEQ ID NO: 1964083 - RNA, 20 nt, Homo sapiens
aagccuuuuugucaccucaa

SEQ ID NO: 1964084 - RNA, 16 nt, Homo sapiens
caguaugcaaagcaau

SEQ ID NO: 1964085 - RNA, 18 nt, Homo sapiens
aacaucuguuacauucua

SEQ ID NO: 1964086 - RNA, 21 nt, Homo sapiens
accaguuuaaggaacuucuga

SEQ ID NO: 1964087 - RNA, 18 nt, Homo sapiens
aacagcuaggaaauauca

SEQ ID NO: 1964088 - RNA, 22 nt, Homo sapiens
caacaggcaguggaagcaguuu

SEQ ID NO: 1964089 - RNA, 20 nt, Homo sapiens
ugcauaaaauguuaaguuga

SEQ ID NO: 1964090 - RNA, 22 nt, Homo sapiens
cagagaaccugaguucccggga

SEQ ID NO: 1964091 - RNA, 15 nt, Homo sapiens
uacuggaaagcuuuu

SEQ ID NO: 1964092 - RNA, 13 nt, Homo sapiens
uacugccuagaaa

SEQ ID NO: 1964093 - RNA, 17 nt, Homo sapiens
gcauagcuggacuugau

SEQ ID NO: 1964094 - RNA, 17 nt, Homo sapiens
aaaaccuaccagccaga

SEQ ID NO: 1964095 - RNA, 18 nt, Homo sapiens
auucugaaauacuuuuga

SEQ ID NO: 1964096 - RNA, 16 nt, Homo sapiens
uucaucucucuaccuc

SEQ ID NO: 1964097 - RNA, 19 nt, Homo sapiens
gggccuccuucccaugccu

SEQ ID NO: 1964098 - RNA, 12 nt, Homo sapiens
gaauaaggccca

SEQ ID NO: 1964099 - RNA, 15 nt, Homo sapiens
uucuucuugguucug

SEQ ID NO: 1964100 - RNA, 14 nt, Homo sapiens
uugaccacugacag

SEQ ID NO: 1964101 - RNA, 18 nt, Homo sapiens
aagccucucaucccccau

SEQ ID NO: 1964102 - RNA, 18 nt, Homo sapiens
aaugcaaaguacauguau

SEQ ID NO: 1964103 - RNA, 15 nt, Homo sapiens
auucugcauuuagcu

SEQ ID NO: 1964104 - RNA, 17 nt, Homo sapiens
accuucugaagaucuca

SEQ ID NO: 1964105 - RNA, 14 nt, Homo sapiens
uaauaucaucagua

SEQ ID NO: 1964106 - RNA, 18 nt, Homo sapiens
aggggcuugggccugcac

SEQ ID NO: 1964107 - RNA, 16 nt, Homo sapiens
cucuccccucaaaguc

SEQ ID NO: 1964108 - RNA, 18 nt, Homo sapiens
ccagugucauuuugaucu

SEQ ID NO: 1964109 - RNA, 14 nt, Homo sapiens
acacugcuugugaa

SEQ ID NO: 1964110 - RNA, 22 nt, Homo sapiens
agaugguguggguguccugccu

SEQ ID NO: 1964111 - RNA, 11 nt, Homo sapiens
ggaacagggaa

SEQ ID NO: 1964112 - RNA, 18 nt, Homo sapiens
aaauacuuuauagcacau

SEQ ID NO: 1964113 - RNA, 17 nt, Homo sapiens
auagcaaggugcucaca

SEQ ID NO: 1964114 - RNA, 22 nt, Homo sapiens
gaccugguacugagguugggcu

SEQ ID NO: 1964115 - RNA, 23 nt, Homo sapiens
uuccacccacguggagacagcuu

SEQ ID NO: 1964116 - RNA, 20 nt, Homo sapiens
ucauguuuuuucugcaauga

SEQ ID NO: 1964117 - RNA, 18 nt, Homo sapiens
gaaagacucuuaaugcag

SEQ ID NO: 1964118 - RNA, 14 nt, Homo sapiens
acaguauaucuaau

SEQ ID NO: 1964119 - RNA, 19 nt, Homo sapiens
uacagcuuaaaguaugcua

SEQ ID NO: 1964120 - RNA, 14 nt, Homo sapiens
uuucaaugugaaac

SEQ ID NO: 1964121 - RNA, 19 nt, Homo sapiens
ugaacauuguacuguugcu

SEQ ID NO: 1964122 - RNA, 16 nt, Homo sapiens
ugcagugaacugagac

SEQ ID NO: 1964123 - RNA, 20 nt, Homo sapiens
uucagacuucaucuucaaaa

SEQ ID NO: 1964124 - RNA, 21 nt, Homo sapiens
guccuuccuaccucuguggug

SEQ ID NO: 1964125 - RNA, 23 nt, Homo sapiens
cccucaacaccucugcacaagcu

SEQ ID NO: 1964126 - RNA, 17 nt, Homo sapiens
ugguaguucgaagaauu

SEQ ID NO: 1964127 - RNA, 21 nt, Homo sapiens
gaucagccuccgccauuccaa

SEQ ID NO: 1964128 - RNA, 20 nt, Homo sapiens
gcaugugugcgagugugugc

SEQ ID NO: 1964129 - RNA, 17 nt, Homo sapiens
acgugaggcccauucuu

SEQ ID NO: 1964130 - RNA, 22 nt, Homo sapiens
gcuucaagaguccuuacugaag

SEQ ID NO: 1964131 - RNA, 19 nt, Homo sapiens
aauguuugcccuguucaaa

SEQ ID NO: 1964132 - RNA, 23 nt, Homo sapiens
caguuauuaaucuggacauucga

SEQ ID NO: 1964133 - RNA, 21 nt, Homo sapiens
agcuggauagacuugggaugg

SEQ ID NO: 1964134 - RNA, 18 nt, Homo sapiens
uaugcagauuauuugccc

SEQ ID NO: 1964135 - RNA, 20 nt, Homo sapiens
uugucagaauuucuuuguca

SEQ ID NO: 1964136 - RNA, 13 nt, Homo sapiens
cccauagugugca

SEQ ID NO: 1964137 - RNA, 22 nt, Homo sapiens
cuaaccuucacgauuaacugug

SEQ ID NO: 1964138 - RNA, 14 nt, Homo sapiens
uauaauaaccuggu

SEQ ID NO: 1964139 - RNA, 17 nt, Homo sapiens
ccucuuuuccuucccaa

SEQ ID NO: 1964140 - RNA, 16 nt, Homo sapiens
cccaucagcuccagcu

SEQ ID NO: 1964141 - RNA, 19 nt, Homo sapiens
aggugcguguucagcagaa

SEQ ID NO: 1964142 - RNA, 13 nt, Homo sapiens
gugauccucccac

SEQ ID NO: 1964143 - RNA, 14 nt, Homo sapiens
aagacaacuuccuc

SEQ ID NO: 1964144 - RNA, 18 nt, Homo sapiens
ugagauccgggagacuga

SEQ ID NO: 1964145 - RNA, 18 nt, Homo sapiens
aaccagucucucaaguga

SEQ ID NO: 1964146 - RNA, 11 nt, Homo sapiens
accugggaccu

SEQ ID NO: 1964147 - RNA, 15 nt, Homo sapiens
auauacaagcuacag

SEQ ID NO: 1964148 - RNA, 22 nt, Homo sapiens
uggugcccagcacaugugcugc

SEQ ID NO: 1964149 - RNA, 15 nt, Homo sapiens
cucccccaaccaagg

SEQ ID NO: 1964150 - RNA, 17 nt, Homo sapiens
aaguccagaagggucau

SEQ ID NO: 1964151 - RNA, 19 nt, Homo sapiens
ucagaccugcauugaacag

SEQ ID NO: 1964152 - RNA, 16 nt, Homo sapiens
uggagcagcagccacu

SEQ ID NO: 1964153 - RNA, 20 nt, Homo sapiens
gagaacacguuggcucaguc

SEQ ID NO: 1964154 - RNA, 22 nt, Homo sapiens
acuuauggccacagcccaucca

SEQ ID NO: 1964155 - RNA, 20 nt, Homo sapiens
gcacgaacaccaagugucug

SEQ ID NO: 1964156 - RNA, 16 nt, Homo sapiens
cagcccuuuccagggc

SEQ ID NO: 1964157 - RNA, 15 nt, Homo sapiens
uuaagaaacacaggg

SEQ ID NO: 1964158 - RNA, 22 nt, Homo sapiens
gccccacuucucuacucuggaa

SEQ ID NO: 1964159 - RNA, 15 nt, Homo sapiens
caucugugccagaga

SEQ ID NO: 1964160 - RNA, 17 nt, Homo sapiens
uagaagacaacaggcau

SEQ ID NO: 1964161 - RNA, 13 nt, Homo sapiens
auccagagcaauu

SEQ ID NO: 1964162 - RNA, 13 nt, Homo sapiens
ucuuauguugaau

SEQ ID NO: 1964163 - RNA, 17 nt, Homo sapiens
aaagaauucucuugcug

SEQ ID NO: 1964164 - RNA, 13 nt, Homo sapiens
acacuaacgugug

SEQ ID NO: 1964165 - RNA, 19 nt, Homo sapiens
cugcaccggggccugggca

SEQ ID NO: 1964166 - RNA, 15 nt, Homo sapiens
gccuccugggaccau

SEQ ID NO: 1964167 - RNA, 21 nt, Homo sapiens
aucaaauauuagaugugauuu

SEQ ID NO: 1964168 - RNA, 14 nt, Homo sapiens
ggcccccugccagu

SEQ ID NO: 1964169 - RNA, 17 nt, Homo sapiens
cuugcaggagugacuca

SEQ ID NO: 1964170 - RNA, 18 nt, Homo sapiens
ugggagacaugugacauu

SEQ ID NO: 1964171 - RNA, 16 nt, Homo sapiens
ccugggcaggugggag

SEQ ID NO: 1964172 - RNA, 13 nt, Homo sapiens
agcagauucccug

SEQ ID NO: 1964173 - RNA, 15 nt, Homo sapiens
gcuggaggaaccaga

SEQ ID NO: 1964174 - RNA, 16 nt, Homo sapiens
ugccucgaaaguguca

SEQ ID NO: 1964175 - RNA, 21 nt, Homo sapiens
uuacaauugcaguuuugccua

SEQ ID NO: 1964176 - RNA, 22 nt, Homo sapiens
agcaugagaggaggcagcagga

SEQ ID NO: 1964177 - RNA, 16 nt, Homo sapiens
cucagcuaagcucacg

SEQ ID NO: 1964178 - RNA, 19 nt, Homo sapiens
aagaaggugcuuucugcuu

SEQ ID NO: 1964179 - RNA, 19 nt, Homo sapiens
cuucaaagaggaaccagga

SEQ ID NO: 1964180 - RNA, 16 nt, Homo sapiens
cccuucaugcauggaa

SEQ ID NO: 1964181 - RNA, 20 nt, Homo sapiens
aagccaggcaccguggcuca

SEQ ID NO: 1964182 - RNA, 20 nt, Homo sapiens
uauaguuuucccuauugaau

SEQ ID NO: 1964183 - RNA, 14 nt, Homo sapiens
auguaugcaccuca

SEQ ID NO: 1964184 - RNA, 18 nt, Homo sapiens
gccacgcuccaaacccca

SEQ ID NO: 1964185 - RNA, 22 nt, Homo sapiens
aaagccugagaagaaagaacca

SEQ ID NO: 1964186 - RNA, 16 nt, Homo sapiens
gccucauuacugugag

SEQ ID NO: 1964187 - RNA, 17 nt, Homo sapiens
cuucucuugagcaguua

SEQ ID NO: 1964188 - RNA, 17 nt, Homo sapiens
auccaaugaguguuaca

SEQ ID NO: 1964189 - RNA, 16 nt, Homo sapiens
accugcuuugugagcc

SEQ ID NO: 1964190 - RNA, 22 nt, Homo sapiens
uuucacuaggaaaaucaugugc

SEQ ID NO: 1964191 - RNA, 17 nt, Homo sapiens
caguccucccuagcucu

SEQ ID NO: 1964192 - RNA, 18 nt, Homo sapiens
cuaguaagaugcacugaa

SEQ ID NO: 1964193 - RNA, 15 nt, Homo sapiens
uccucucuuccacag

SEQ ID NO: 1964194 - RNA, 23 nt, Homo sapiens
agaaacaaccguuggaaacauaa

SEQ ID NO: 1964195 - RNA, 17 nt, Homo sapiens
guuuccaaauggucaac

SEQ ID NO: 1964196 - RNA, 16 nt, Homo sapiens
guuaacugauuugcaa

SEQ ID NO: 1964197 - RNA, 23 nt, Homo sapiens
gagcacguggagauagugccagg

SEQ ID NO: 1964198 - RNA, 15 nt, Homo sapiens
cuuuuguucauggga

SEQ ID NO: 1964199 - RNA, 19 nt, Homo sapiens
guacuuacaaaugacuccu

SEQ ID NO: 1964200 - RNA, 19 nt, Homo sapiens
caaggugggcggaucaccu

SEQ ID NO: 1964201 - RNA, 21 nt, Homo sapiens
guuacagcgagaggcagagaa

SEQ ID NO: 1964202 - RNA, 23 nt, Homo sapiens
cuuguuuugagguagaaaugcaa

SEQ ID NO: 1964203 - RNA, 18 nt, Homo sapiens
acacugcggaagccaaag

SEQ ID NO: 1964204 - RNA, 20 nt, Homo sapiens
uuaaaaagcucacugcugau

SEQ ID NO: 1964205 - RNA, 23 nt, Homo sapiens
accugcaugcagcaacacccaag

SEQ ID NO: 1964206 - RNA, 17 nt, Homo sapiens
cucaucaucaacccuaa

SEQ ID NO: 1964207 - RNA, 17 nt, Homo sapiens
agaagcucagcugccuu

SEQ ID NO: 1964208 - RNA, 19 nt, Homo sapiens
aguacuccaagacagagac

SEQ ID NO: 1964209 - RNA, 21 nt, Homo sapiens
ucgccucugcuccuguggucc

SEQ ID NO: 1964210 - RNA, 19 nt, Homo sapiens
uucauguauuuuacacaaa

SEQ ID NO: 1964211 - RNA, 22 nt, Homo sapiens
agaaagcuuaaauacaccuuuu

SEQ ID NO: 1964212 - RNA, 13 nt, Homo sapiens
uuuaacaaguaua

SEQ ID NO: 1964213 - RNA, 20 nt, Homo sapiens
cugcuguuccugcuccauga

SEQ ID NO: 1964214 - RNA, 11 nt, Homo sapiens
ucucugugaag

SEQ ID NO: 1964215 - RNA, 15 nt, Homo sapiens
ucuuaaugucucaaa

SEQ ID NO: 1964216 - RNA, 15 nt, Homo sapiens
ccuuucugccucuca

SEQ ID NO: 1964217 - RNA, 15 nt, Homo sapiens
ugcuuaagugccuau

SEQ ID NO: 1964218 - RNA, 15 nt, Homo sapiens
uauuuuuguaucuua

SEQ ID NO: 1964219 - RNA, 18 nt, Homo sapiens
cuccugugggagaucuuc

SEQ ID NO: 1964220 - RNA, 19 nt, Homo sapiens
uaccaaagcaucaauacaa

SEQ ID NO: 1964221 - RNA, 19 nt, Homo sapiens
uuccucggugggccagagc

SEQ ID NO: 1964222 - RNA, 16 nt, Homo sapiens
auaggcuaaccacuuu

SEQ ID NO: 1964223 - RNA, 19 nt, Homo sapiens
aucugucuuucacuggaau

SEQ ID NO: 1964224 - RNA, 22 nt, Homo sapiens
cuggcuguccaaccagacuuug

SEQ ID NO: 1964225 - RNA, 22 nt, Homo sapiens
aguauuuaaauguuugccaaaa

SEQ ID NO: 1964226 - RNA, 16 nt, Homo sapiens
guuuucaccauucaaa

SEQ ID NO: 1964227 - RNA, 20 nt, Homo sapiens
cagggaagccccagugagua

SEQ ID NO: 1964228 - RNA, 18 nt, Homo sapiens
agugcgcagaucugugcc

SEQ ID NO: 1964229 - RNA, 17 nt, Homo sapiens
cugagagaauuggcuca

SEQ ID NO: 1964230 - RNA, 17 nt, Homo sapiens
ugggagcagcuaaagau

SEQ ID NO: 1964231 - RNA, 18 nt, Homo sapiens
auaggccugcucagccuc

SEQ ID NO: 1964232 - RNA, 15 nt, Homo sapiens
uucaaacaauucaau

SEQ ID NO: 1964233 - RNA, 13 nt, Homo sapiens
accgauaaugcau

SEQ ID NO: 1964234 - RNA, 22 nt, Homo sapiens
ccaauggaugaagacccccucc

SEQ ID NO: 1964235 - RNA, 15 nt, Homo sapiens
ccuguuuugcaaauu

SEQ ID NO: 1964236 - RNA, 21 nt, Homo sapiens
gggcccaggccucagcccagg

SEQ ID NO: 1964237 - RNA, 15 nt, Homo sapiens
aagaagaauauguau

SEQ ID NO: 1964238 - RNA, 17 nt, Homo sapiens
gaccugucucuaccuaa

SEQ ID NO: 1964239 - RNA, 18 nt, Homo sapiens
aaacacugauggcaccua

SEQ ID NO: 1964240 - RNA, 14 nt, Homo sapiens
ggaaugacaacacc

SEQ ID NO: 1964241 - RNA, 16 nt, Homo sapiens
ccagccuggccaauac

SEQ ID NO: 1964242 - RNA, 13 nt, Homo sapiens
uggacaacacuga

SEQ ID NO: 1964243 - RNA, 18 nt, Homo sapiens
aguucuauuucuaucugc

SEQ ID NO: 1964244 - RNA, 20 nt, Homo sapiens
uaacuuuucaaugacauuuu

SEQ ID NO: 1964245 - RNA, 18 nt, Homo sapiens
ccugagucugcaugugca

SEQ ID NO: 1964246 - RNA, 23 nt, Homo sapiens
agccaucuuccugccuacuggau

SEQ ID NO: 1964247 - RNA, 22 nt, Homo sapiens
uuuguaaagcauccucuaccuc

SEQ ID NO: 1964248 - RNA, 14 nt, Homo sapiens
acuuaucaacauuu

SEQ ID NO: 1964249 - RNA, 14 nt, Homo sapiens
ggaguacaggugaa

SEQ ID NO: 1964250 - RNA, 20 nt, Homo sapiens
aaguaccuauauugauuuaa

SEQ ID NO: 1964251 - RNA, 10 nt, Homo sapiens
uucaaugauc

SEQ ID NO: 1964252 - RNA, 15 nt, Homo sapiens
gacuuuugcuuuaug

SEQ ID NO: 1964253 - RNA, 16 nt, Homo sapiens
acgcggagcacuuucg

SEQ ID NO: 1964254 - RNA, 16 nt, Homo sapiens
uguaacuuccauguga

SEQ ID NO: 1964255 - RNA, 14 nt, Homo sapiens
cuucagauuugccu

SEQ ID NO: 1964256 - RNA, 17 nt, Homo sapiens
caggaggaacuggucca

SEQ ID NO: 1964257 - RNA, 21 nt, Homo sapiens
agcuuaaguccagcucauuuc

SEQ ID NO: 1964258 - RNA, 21 nt, Homo sapiens
gcccaugacaccaaaccugcc

SEQ ID NO: 1964259 - RNA, 17 nt, Homo sapiens
guuaauaaacugcaaau

SEQ ID NO: 1964260 - RNA, 14 nt, Homo sapiens
acuuguuugugcau

SEQ ID NO: 1964261 - RNA, 21 nt, Homo sapiens
agcuccuccccacuagcauuu

SEQ ID NO: 1964262 - RNA, 16 nt, Homo sapiens
ugcggauggauggaag

SEQ ID NO: 1964263 - RNA, 20 nt, Homo sapiens
gagaguccucuggauggcac

SEQ ID NO: 1964264 - RNA, 21 nt, Homo sapiens
uuuaucccccaccaaaaacac

SEQ ID NO: 1964265 - RNA, 21 nt, Homo sapiens
gaccaccuagucuguaacucu

SEQ ID NO: 1964266 - RNA, 18 nt, Homo sapiens
aaucgcauuuccugagaa

SEQ ID NO: 1964267 - RNA, 19 nt, Homo sapiens
gaaaugucaucaaacucca

SEQ ID NO: 1964268 - RNA, 20 nt, Homo sapiens
aaauagcaacuuguguuaca

SEQ ID NO: 1964269 - RNA, 17 nt, Homo sapiens
acuuggagguagcuuug

SEQ ID NO: 1964270 - RNA, 19 nt, Homo sapiens
uacacuaaaaaucugagaa

SEQ ID NO: 1964271 - RNA, 22 nt, Homo sapiens
agucagaaacugccauuugaaa

SEQ ID NO: 1964272 - RNA, 18 nt, Homo sapiens
gguuuagaggaccaguga

SEQ ID NO: 1964273 - RNA, 20 nt, Homo sapiens
ggggcccagugcuggccaca

SEQ ID NO: 1964274 - RNA, 14 nt, Homo sapiens
ucccucuugucagu

SEQ ID NO: 1964275 - RNA, 21 nt, Homo sapiens
aauucauaaaaauaaccaaaa

SEQ ID NO: 1964276 - RNA, 14 nt, Homo sapiens
ucaccgugagcagc

SEQ ID NO: 1964277 - RNA, 23 nt, Homo sapiens
guugacugcugaauuaaugugau

SEQ ID NO: 1964278 - RNA, 16 nt, Homo sapiens
uccuugaauguucucu

SEQ ID NO: 1964279 - RNA, 15 nt, Homo sapiens
ggaauuguguuuaua

SEQ ID NO: 1964280 - RNA, 14 nt, Homo sapiens
gagagcagccucuu

SEQ ID NO: 1964281 - RNA, 14 nt, Homo sapiens
uggggccagaucca

SEQ ID NO: 1964282 - RNA, 20 nt, Homo sapiens
aacuggcuucugcuugucau

SEQ ID NO: 1964283 - RNA, 16 nt, Homo sapiens
agugggccuccaagga

SEQ ID NO: 1964284 - RNA, 17 nt, Homo sapiens
cauuuagucuugccagg

SEQ ID NO: 1964285 - RNA, 21 nt, Homo sapiens
uuuuaagacuuuucuuuccuu

SEQ ID NO: 1964286 - RNA, 23 nt, Homo sapiens
cacaggaccaccuccucugccag

SEQ ID NO: 1964287 - RNA, 18 nt, Homo sapiens
gcucagaggcccaggaau

SEQ ID NO: 1964288 - RNA, 15 nt, Homo sapiens
aggugaugcucuggc

SEQ ID NO: 1964289 - RNA, 21 nt, Homo sapiens
uaaacaguagugauaguugua

SEQ ID NO: 1964290 - RNA, 22 nt, Homo sapiens
uguucuaguaacaauacaugag

SEQ ID NO: 1964291 - RNA, 13 nt, Homo sapiens
ucaaucagccuuu

SEQ ID NO: 1964292 - RNA, 23 nt, Homo sapiens
uuguacucuuguuuuugcauaac

SEQ ID NO: 1964293 - RNA, 15 nt, Homo sapiens
uuuggagagugcuau

SEQ ID NO: 1964294 - RNA, 22 nt, Homo sapiens
aacucuuggccucugcuuucuc

SEQ ID NO: 1964295 - RNA, 12 nt, Homo sapiens
ugugccugagaa

SEQ ID NO: 1964296 - RNA, 16 nt, Homo sapiens
acgugauuuccaguga

SEQ ID NO: 1964297 - RNA, 11 nt, Homo sapiens
ccacaucccag

SEQ ID NO: 1964298 - RNA, 18 nt, Homo sapiens
aaaauaagccacauaucu

SEQ ID NO: 1964299 - RNA, 17 nt, Homo sapiens
aagugaaaaacauccag

SEQ ID NO: 1964300 - RNA, 13 nt, Homo sapiens
ucccaaaaauaaa

SEQ ID NO: 1964301 - RNA, 20 nt, Homo sapiens
aaguggggagagagcccuuc

SEQ ID NO: 1964302 - RNA, 21 nt, Homo sapiens
agcuuccuccccccgacuccc

SEQ ID NO: 1964303 - RNA, 21 nt, Homo sapiens
gauguauguugaagccuuugu

SEQ ID NO: 1964304 - RNA, 14 nt, Homo sapiens
uauuuaaucuuaau

SEQ ID NO: 1964305 - RNA, 14 nt, Homo sapiens
uugaaaaucaguuu

SEQ ID NO: 1964306 - RNA, 18 nt, Homo sapiens
acucaucuuagugccuga

SEQ ID NO: 1964307 - RNA, 17 nt, Homo sapiens
ucagacaccuguucaca

SEQ ID NO: 1964308 - RNA, 14 nt, Homo sapiens
aaguuaugaggguc

SEQ ID NO: 1964309 - RNA, 15 nt, Homo sapiens
uaaaucaaauuugaa

SEQ ID NO: 1964310 - RNA, 14 nt, Homo sapiens
caccgagacaguug

SEQ ID NO: 1964311 - RNA, 21 nt, Homo sapiens
uucccuuugaguccagugugg

SEQ ID NO: 1964312 - RNA, 22 nt, Homo sapiens
ugacaccaagaaaccacugggc

SEQ ID NO: 1964313 - RNA, 21 nt, Homo sapiens
cucuaugguguggcaaagccu

SEQ ID NO: 1964314 - RNA, 16 nt, Homo sapiens
uagugagacuagacau

SEQ ID NO: 1964315 - RNA, 16 nt, Homo sapiens
agaauccacaaggacc

SEQ ID NO: 1964316 - RNA, 16 nt, Homo sapiens
aaaaugauggaaugac

SEQ ID NO: 1964317 - RNA, 18 nt, Homo sapiens
gcccacuuuccugagcug

SEQ ID NO: 1964318 - RNA, 20 nt, Homo sapiens
aagcugcugaaugcauucag

SEQ ID NO: 1964319 - RNA, 13 nt, Homo sapiens
augucacacuggc

SEQ ID NO: 1964320 - RNA, 13 nt, Homo sapiens
gccccucacccac

SEQ ID NO: 1964321 - RNA, 17 nt, Homo sapiens
gcuccccuaaagccagg

SEQ ID NO: 1964322 - RNA, 13 nt, Homo sapiens
cuggcugcaauug

SEQ ID NO: 1964323 - RNA, 14 nt, Homo sapiens
gcggacaucagcug

SEQ ID NO: 1964324 - RNA, 22 nt, Homo sapiens
ucaaaggugauugugccaggcu

SEQ ID NO: 1964325 - RNA, 15 nt, Homo sapiens
auuuuucucaucucc

SEQ ID NO: 1964326 - RNA, 21 nt, Homo sapiens
uauggcccugggagagccaga

SEQ ID NO: 1964327 - RNA, 16 nt, Homo sapiens
caucuuuuuccacuuu

SEQ ID NO: 1964328 - RNA, 15 nt, Homo sapiens
accauuucuagccuc

SEQ ID NO: 1964329 - RNA, 22 nt, Homo sapiens
gggcauagaucagaagacuaca

SEQ ID NO: 1964330 - RNA, 12 nt, Homo sapiens
auaaacacuggu

SEQ ID NO: 1964331 - RNA, 13 nt, Homo sapiens
cuauuuggugcua

SEQ ID NO: 1964332 - RNA, 21 nt, Homo sapiens
uugcacaaguacuugagaaua

SEQ ID NO: 1964333 - RNA, 14 nt, Homo sapiens
gucacaaaaauuca

SEQ ID NO: 1964334 - RNA, 14 nt, Homo sapiens
cugcaagacuuaaa

SEQ ID NO: 1964335 - RNA, 14 nt, Homo sapiens
uuguauccaaggaa

SEQ ID NO: 1964336 - RNA, 22 nt, Homo sapiens
caccuaggucgccagugaaaua

SEQ ID NO: 1964337 - RNA, 13 nt, Homo sapiens
cauaucugugcaa

SEQ ID NO: 1964338 - RNA, 13 nt, Homo sapiens
aggacuugaaccc

SEQ ID NO: 1964339 - RNA, 16 nt, Homo sapiens
uugagcccuggacuca

SEQ ID NO: 1964340 - RNA, 18 nt, Homo sapiens
cagcuaacaaacuagaaa

SEQ ID NO: 1964341 - RNA, 17 nt, Homo sapiens
gaagguuggaccuucau

SEQ ID NO: 1964342 - RNA, 18 nt, Homo sapiens
aagauuccaaaaagcaca

SEQ ID NO: 1964343 - RNA, 18 nt, Homo sapiens
gcagauugguucaugccu

SEQ ID NO: 1964344 - RNA, 15 nt, Homo sapiens
uagagagaaacagcu

SEQ ID NO: 1964345 - RNA, 23 nt, Homo sapiens
ugcauucaccugcccugugcaug

SEQ ID NO: 1964346 - RNA, 20 nt, Homo sapiens
ugugggguccccaucauccc

SEQ ID NO: 1964347 - RNA, 16 nt, Homo sapiens
agugauuggcucugug

SEQ ID NO: 1964348 - RNA, 20 nt, Homo sapiens
cagagucucauucuguugcc

SEQ ID NO: 1964349 - RNA, 23 nt, Homo sapiens
uauuaagauuuccaagugccaau

SEQ ID NO: 1964350 - RNA, 17 nt, Homo sapiens
uuuccucacuaccacuu

SEQ ID NO: 1964351 - RNA, 14 nt, Homo sapiens
aauuuguaguuaca

SEQ ID NO: 1964352 - RNA, 16 nt, Homo sapiens
auccaggcuuaccaaa

SEQ ID NO: 1964353 - RNA, 13 nt, Homo sapiens
ucagaaagucaua

SEQ ID NO: 1964354 - RNA, 15 nt, Homo sapiens
acugcugcuccccac

SEQ ID NO: 1964355 - RNA, 18 nt, Homo sapiens
ugcaauaugaggggacug

SEQ ID NO: 1964356 - RNA, 13 nt, Homo sapiens
uuucaaagccauu

SEQ ID NO: 1964357 - RNA, 21 nt, Homo sapiens
ugagcuauaauguuucccuca

SEQ ID NO: 1964358 - RNA, 19 nt, Homo sapiens
aaaaugaguugugaugaau

SEQ ID NO: 1964359 - RNA, 23 nt, Homo sapiens
uaaaacauuauagauuuucaugu

SEQ ID NO: 1964360 - RNA, 14 nt, Homo sapiens
uggggaccaggugc

SEQ ID NO: 1964361 - RNA, 11 nt, Homo sapiens
ccagugccuuc

SEQ ID NO: 1964362 - RNA, 21 nt, Homo sapiens
gauagacuuugugaaucugaa

SEQ ID NO: 1964363 - RNA, 22 nt, Homo sapiens
ggucugcugagggccgugucug

SEQ ID NO: 1964364 - RNA, 10 nt, Homo sapiens
gaccaaagcu

SEQ ID NO: 1964365 - RNA, 12 nt, Homo sapiens
aucugagugaaa

SEQ ID NO: 1964366 - RNA, 21 nt, Homo sapiens
gggagagagccaagcccugug

SEQ ID NO: 1964367 - RNA, 21 nt, Homo sapiens
cuuggcaucgaccacaccagc

SEQ ID NO: 1964368 - RNA, 17 nt, Homo sapiens
uacaaguuucagacagg

SEQ ID NO: 1964369 - RNA, 22 nt, Homo sapiens
acuguguguguccuacacaaug

SEQ ID NO: 1964370 - RNA, 16 nt, Homo sapiens
aacaaaaauuagcuua

SEQ ID NO: 1964371 - RNA, 22 nt, Homo sapiens
uagaaagugaggcucagauuaa

SEQ ID NO: 1964372 - RNA, 15 nt, Homo sapiens
agaacauuaauuaua

SEQ ID NO: 1964373 - RNA, 18 nt, Homo sapiens
aagugcuauuucuugcau

SEQ ID NO: 1964374 - RNA, 13 nt, Homo sapiens
acucagggcuccu

SEQ ID NO: 1964375 - RNA, 13 nt, Homo sapiens
acucugggcucca

SEQ ID NO: 1964376 - RNA, 12 nt, Homo sapiens
aaauuccaagga

SEQ ID NO: 1964377 - RNA, 17 nt, Homo sapiens
ucuaaucaagaaaagaa

SEQ ID NO: 1964378 - RNA, 16 nt, Homo sapiens
agggagggcugucauc

SEQ ID NO: 1964379 - RNA, 21 nt, Homo sapiens
ucagaaugggaggacuccaga

SEQ ID NO: 1964380 - RNA, 14 nt, Homo sapiens
ucagaggaguuuaa

SEQ ID NO: 1964381 - RNA, 18 nt, Homo sapiens
gaccaucgcacaccaaau

SEQ ID NO: 1964382 - RNA, 16 nt, Homo sapiens
uuauaaagucaaggac

SEQ ID NO: 1964383 - RNA, 18 nt, Homo sapiens
aaaagauuuguuuuguca

SEQ ID NO: 1964384 - RNA, 22 nt, Homo sapiens
acauacaccuaugucauuucau

SEQ ID NO: 1964385 - RNA, 23 nt, Homo sapiens
ucuaugugaccagacugcacagg

SEQ ID NO: 1964386 - RNA, 17 nt, Homo sapiens
ucagucuaguugccaaa

SEQ ID NO: 1964387 - RNA, 19 nt, Homo sapiens
uaaacacuagacuguauca

SEQ ID NO: 1964388 - RNA, 17 nt, Homo sapiens
cagcacucuuaucuaca

SEQ ID NO: 1964389 - RNA, 17 nt, Homo sapiens
uuaguacagaaauaucc

SEQ ID NO: 1964390 - RNA, 16 nt, Homo sapiens
cuggaacuugaguuau

SEQ ID NO: 1964391 - RNA, 18 nt, Homo sapiens
aucucuacuaaaaacaca

SEQ ID NO: 1964392 - RNA, 20 nt, Homo sapiens
aaacugcauuuccuuucuac

SEQ ID NO: 1964393 - RNA, 21 nt, Homo sapiens
aucuuugcuguauacuuuuaa

SEQ ID NO: 1964394 - RNA, 14 nt, Homo sapiens
aggucagcacaaga

SEQ ID NO: 1964395 - RNA, 12 nt, Homo sapiens
uaagcagcauuu

SEQ ID NO: 1964396 - RNA, 20 nt, Homo sapiens
gcaguucugcagcuguuuua

SEQ ID NO: 1964397 - RNA, 9 nt, Homo sapiens
uuccuccag

SEQ ID NO: 1964398 - RNA, 14 nt, Homo sapiens
cagccugcuagcua

SEQ ID NO: 1964399 - RNA, 17 nt, Homo sapiens
caaaaugaauucuggga

SEQ ID NO: 1964400 - RNA, 16 nt, Homo sapiens
aaagaaacuuaccaau

SEQ ID NO: 1964401 - RNA, 23 nt, Homo sapiens
aaacuaugcaagagaaauuccaa

SEQ ID NO: 1964402 - RNA, 14 nt, Homo sapiens
cauccuccacugac

SEQ ID NO: 1964403 - RNA, 21 nt, Homo sapiens
cagaagcacauaugaacugga

SEQ ID NO: 1964404 - RNA, 20 nt, Homo sapiens
cuacccaggaggcugaggca

SEQ ID NO: 1964405 - RNA, 16 nt, Homo sapiens
gacagagcgagacucc

SEQ ID NO: 1964406 - RNA, 22 nt, Homo sapiens
aguucccgcucugcauugccug

SEQ ID NO: 1964407 - RNA, 16 nt, Homo sapiens
aaguauauugugaguu

SEQ ID NO: 1964408 - RNA, 15 nt, Homo sapiens
ccuucccccugcaaa

SEQ ID NO: 1964409 - RNA, 19 nt, Homo sapiens
gcucggacuauacugcuga

SEQ ID NO: 1964410 - RNA, 18 nt, Homo sapiens
cacgcccccagcugugac

SEQ ID NO: 1964411 - RNA, 21 nt, Homo sapiens
aggugaugcucuggcuugccc

SEQ ID NO: 1964412 - RNA, 12 nt, Homo sapiens
cucuguagaaau

SEQ ID NO: 1964413 - RNA, 22 nt, Homo sapiens
ugaaaacauaacccacucuguc

SEQ ID NO: 1964414 - RNA, 15 nt, Homo sapiens
aggucagcgugcuua

SEQ ID NO: 1964415 - RNA, 20 nt, Homo sapiens
gccaucaauauucagcaaaa

SEQ ID NO: 1964416 - RNA, 11 nt, Homo sapiens
auuacauuuca

SEQ ID NO: 1964417 - RNA, 21 nt, Homo sapiens
aagaacaugauuuuacaagua

SEQ ID NO: 1964418 - RNA, 12 nt, Homo sapiens
ucccuucuccca

SEQ ID NO: 1964419 - RNA, 17 nt, Homo sapiens
gugcaccgaguggccau

SEQ ID NO: 1964420 - RNA, 16 nt, Homo sapiens
agcugggcagcuggaa

SEQ ID NO: 1964421 - RNA, 17 nt, Homo sapiens
ucucagguggugauaug

SEQ ID NO: 1964422 - RNA, 20 nt, Homo sapiens
uaccauugcuguucuacuuu

SEQ ID NO: 1964423 - RNA, 12 nt, Homo sapiens
agacugccaaag

SEQ ID NO: 1964424 - RNA, 20 nt, Homo sapiens
aacaggaauccuuacugaua

SEQ ID NO: 1964425 - RNA, 17 nt, Homo sapiens
uuugcaugcaugcaaau

SEQ ID NO: 1964426 - RNA, 17 nt, Homo sapiens
acgauacuccaaccaua

SEQ ID NO: 1964427 - RNA, 14 nt, Homo sapiens
augcaagccagcuu

SEQ ID NO: 1964428 - RNA, 14 nt, Homo sapiens
aauuuugccuuuaa

SEQ ID NO: 1964429 - RNA, 20 nt, Homo sapiens
augucauugucuacuccuag

SEQ ID NO: 1964430 - RNA, 18 nt, Homo sapiens
uaaguggggaaaauccua

SEQ ID NO: 1964431 - RNA, 23 nt, Homo sapiens
aaagcagaaguggaauccagugu

SEQ ID NO: 1964432 - RNA, 18 nt, Homo sapiens
ggugauguuugcauuuac

SEQ ID NO: 1964433 - RNA, 21 nt, Homo sapiens
uccauccaaacucagaaggcu

SEQ ID NO: 1964434 - RNA, 23 nt, Homo sapiens
uccuuuuuucaaaauccaaaaag

SEQ ID NO: 1964435 - RNA, 16 nt, Homo sapiens
cacuagaaugcaagua

SEQ ID NO: 1964436 - RNA, 23 nt, Homo sapiens
ccaaguagcugggaguacaggcg

SEQ ID NO: 1964437 - RNA, 16 nt, Homo sapiens
accuagcgucaguauu

SEQ ID NO: 1964438 - RNA, 21 nt, Homo sapiens
cucaaguguccugaaagcuua

SEQ ID NO: 1964439 - RNA, 13 nt, Homo sapiens
cagaauggcauuu

SEQ ID NO: 1964440 - RNA, 17 nt, Homo sapiens
acagugacuggugccag

SEQ ID NO: 1964441 - RNA, 15 nt, Homo sapiens
cuuuucuggaaugga

SEQ ID NO: 1964442 - RNA, 15 nt, Homo sapiens
uacccuuucauucag

SEQ ID NO: 1964443 - RNA, 19 nt, Homo sapiens
ugaguaaugguuacuaggc

SEQ ID NO: 1964444 - RNA, 22 nt, Homo sapiens
acaaccacauguauuuauuccu

SEQ ID NO: 1964445 - RNA, 15 nt, Homo sapiens
cuagacucauacuca

SEQ ID NO: 1964446 - RNA, 14 nt, Homo sapiens
uggacacagaggaa

SEQ ID NO: 1964447 - RNA, 14 nt, Homo sapiens
guaagagguguuau

SEQ ID NO: 1964448 - RNA, 16 nt, Homo sapiens
cugagcagccucugga

SEQ ID NO: 1964449 - RNA, 17 nt, Homo sapiens
ugauucauuuucugccu

SEQ ID NO: 1964450 - RNA, 21 nt, Homo sapiens
cuugucaagccugugcaaaaa

SEQ ID NO: 1964451 - RNA, 12 nt, Homo sapiens
aaugaccaaaga

SEQ ID NO: 1964452 - RNA, 17 nt, Homo sapiens
cuaucauauauacugua

SEQ ID NO: 1964453 - RNA, 12 nt, Homo sapiens
guccaacaaacc

SEQ ID NO: 1964454 - RNA, 20 nt, Homo sapiens
aucuuagcuuuccacaggag

SEQ ID NO: 1964455 - RNA, 12 nt, Homo sapiens
gagaaacaauga

SEQ ID NO: 1964456 - RNA, 12 nt, Homo sapiens
aauaaacaguua

SEQ ID NO: 1964457 - RNA, 20 nt, Homo sapiens
ucauaauuccuacagcacua

SEQ ID NO: 1964458 - RNA, 20 nt, Homo sapiens
uguuccuuuuugcagcaauu

SEQ ID NO: 1964459 - RNA, 15 nt, Homo sapiens
ugcaacucccuccca

SEQ ID NO: 1964460 - RNA, 21 nt, Homo sapiens
cuuaagccuuuugcucacaaa

SEQ ID NO: 1964461 - RNA, 20 nt, Homo sapiens
ccagccaucaaaaugcuuuu

SEQ ID NO: 1964462 - RNA, 19 nt, Homo sapiens
augaguaaacugagacuua

SEQ ID NO: 1964463 - RNA, 21 nt, Homo sapiens
auuuuauaggcauaccuccua

SEQ ID NO: 1964464 - RNA, 16 nt, Homo sapiens
gauaugugaaacaaug

SEQ ID NO: 1964465 - RNA, 21 nt, Homo sapiens
gauagaacacaaaacuugaaa

SEQ ID NO: 1964466 - RNA, 19 nt, Homo sapiens
acauuuccgccacaucccu

SEQ ID NO: 1964467 - RNA, 16 nt, Homo sapiens
ccucugcuacuccauc

SEQ ID NO: 1964468 - RNA, 23 nt, Homo sapiens
guuuccuagcgcagccaugugau

SEQ ID NO: 1964469 - RNA, 13 nt, Homo sapiens
gagcagccagcug

SEQ ID NO: 1964470 - RNA, 13 nt, Homo sapiens
aucuucugaauuu

SEQ ID NO: 1964471 - RNA, 13 nt, Homo sapiens
cauuccugcucuc

SEQ ID NO: 1964472 - RNA, 19 nt, Homo sapiens
ucacccucuuccugugauc

SEQ ID NO: 1964473 - RNA, 13 nt, Homo sapiens
cucagacauucca

SEQ ID NO: 1964474 - RNA, 19 nt, Homo sapiens
auuucuuuuguuguacuuu

SEQ ID NO: 1964475 - RNA, 17 nt, Homo sapiens
aguuuauuuuguuacac

SEQ ID NO: 1964476 - RNA, 20 nt, Homo sapiens
ccagggcaccguauuccucu

SEQ ID NO: 1964477 - RNA, 14 nt, Homo sapiens
auggccucuggcca

SEQ ID NO: 1964478 - RNA, 14 nt, Homo sapiens
aacugauuuaucua

SEQ ID NO: 1964479 - RNA, 20 nt, Homo sapiens
guacucuuguuuuugcauaa

SEQ ID NO: 1964480 - RNA, 15 nt, Homo sapiens
cauuuccaugcauaa

SEQ ID NO: 1964481 - RNA, 20 nt, Homo sapiens
uuacagagauacuguugucc

SEQ ID NO: 1964482 - RNA, 19 nt, Homo sapiens
uucucagcucccauuucua

SEQ ID NO: 1964483 - RNA, 19 nt, Homo sapiens
ugugguuccaugcagccuu

SEQ ID NO: 1964484 - RNA, 23 nt, Homo sapiens
cacuggaggggucuccucugcag

SEQ ID NO: 1964485 - RNA, 17 nt, Homo sapiens
aaagggagcacuggguu

SEQ ID NO: 1964486 - RNA, 14 nt, Homo sapiens
auuucugcuuucuu

SEQ ID NO: 1964487 - RNA, 21 nt, Homo sapiens
agccccaacccaaaccuggag

SEQ ID NO: 1964488 - RNA, 17 nt, Homo sapiens
caaauccuaugugauuu

SEQ ID NO: 1964489 - RNA, 16 nt, Homo sapiens
aucuagcuucaugccu

SEQ ID NO: 1964490 - RNA, 17 nt, Homo sapiens
ccgugggcugugccaag

SEQ ID NO: 1964491 - RNA, 18 nt, Homo sapiens
uccuaagacacaaaugca

SEQ ID NO: 1964492 - RNA, 23 nt, Homo sapiens
guaguccucccaagcugugcugg

SEQ ID NO: 1964493 - RNA, 20 nt, Homo sapiens
gguggccccaaccacaggaa

SEQ ID NO: 1964494 - RNA, 14 nt, Homo sapiens
aaucuaugaugaag

SEQ ID NO: 1964495 - RNA, 20 nt, Homo sapiens
ucuagaaccuucuagaaccu

SEQ ID NO: 1964496 - RNA, 16 nt, Homo sapiens
uuaaugcagauggcaa

SEQ ID NO: 1964497 - RNA, 14 nt, Homo sapiens
accaauccuaugca

SEQ ID NO: 1964498 - RNA, 23 nt, Homo sapiens
ugaaguuuugcaaauauaaucca

SEQ ID NO: 1964499 - RNA, 12 nt, Homo sapiens
gaaggagccagc

SEQ ID NO: 1964500 - RNA, 20 nt, Homo sapiens
uagaaacuaagagaaugaua

SEQ ID NO: 1964501 - RNA, 16 nt, Homo sapiens
cuaagaagcugcaaua

SEQ ID NO: 1964502 - RNA, 20 nt, Homo sapiens
acuuguagcauuaaacaauc

SEQ ID NO: 1964503 - RNA, 14 nt, Homo sapiens
gggggagcuggaaa

SEQ ID NO: 1964504 - RNA, 16 nt, Homo sapiens
gguuucggagcacgua

SEQ ID NO: 1964505 - RNA, 15 nt, Homo sapiens
cucugcugacuccau

SEQ ID NO: 1964506 - RNA, 14 nt, Homo sapiens
ggacucagagaaaa

SEQ ID NO: 1964507 - RNA, 19 nt, Homo sapiens
ugugugcccuggacuguuu

SEQ ID NO: 1964508 - RNA, 20 nt, Homo sapiens
aagcaauccaccugccuugg

SEQ ID NO: 1964509 - RNA, 15 nt, Homo sapiens
guccauucaucucau

SEQ ID NO: 1964510 - RNA, 13 nt, Homo sapiens
aacugagagucau

SEQ ID NO: 1964511 - RNA, 16 nt, Homo sapiens
ugcaggcgauggggca

SEQ ID NO: 1964512 - RNA, 12 nt, Homo sapiens
ucagcacauguu

SEQ ID NO: 1964513 - RNA, 22 nt, Homo sapiens
aacaauuaaaaucucaacuaua

SEQ ID NO: 1964514 - RNA, 16 nt, Homo sapiens
aucaagugcaccuaca

SEQ ID NO: 1964515 - RNA, 18 nt, Homo sapiens
ccucuuccagcaacugaa

SEQ ID NO: 1964516 - RNA, 23 nt, Homo sapiens
uaauaugugggaauuagugagac

SEQ ID NO: 1964517 - RNA, 14 nt, Homo sapiens
uauguaaugcuuua

SEQ ID NO: 1964518 - RNA, 14 nt, Homo sapiens
aaauauacauucaa

SEQ ID NO: 1964519 - RNA, 22 nt, Homo sapiens
auucucccagcguuaacacaaa

SEQ ID NO: 1964520 - RNA, 15 nt, Homo sapiens
ugucgcaucucagcg

SEQ ID NO: 1964521 - RNA, 13 nt, Homo sapiens
agggaccugcuca

SEQ ID NO: 1964522 - RNA, 15 nt, Homo sapiens
cacuguggagcucag

SEQ ID NO: 1964523 - RNA, 15 nt, Homo sapiens
gcaaaagagcuacuc

SEQ ID NO: 1964524 - RNA, 14 nt, Homo sapiens
agauuuuccugaaa

SEQ ID NO: 1964525 - RNA, 16 nt, Homo sapiens
cuccccugaggcucag

SEQ ID NO: 1964526 - RNA, 16 nt, Homo sapiens
aggauaucacauugga

SEQ ID NO: 1964527 - RNA, 16 nt, Homo sapiens
ccggcugaggccugag

SEQ ID NO: 1964528 - RNA, 21 nt, Homo sapiens
aagagcugccuggaugagaaa

SEQ ID NO: 1964529 - RNA, 15 nt, Homo sapiens
uugacuuaaguagaa

SEQ ID NO: 1964530 - RNA, 17 nt, Homo sapiens
cuguaagcaacacuuua

SEQ ID NO: 1964531 - RNA, 13 nt, Homo sapiens
ucaguggggacag

SEQ ID NO: 1964532 - RNA, 15 nt, Homo sapiens
cuugccuaucugacu

SEQ ID NO: 1964533 - RNA, 16 nt, Homo sapiens
gggucaaccugggaug

SEQ ID NO: 1964534 - RNA, 21 nt, Homo sapiens
cauguuaggaaaauuucacau

SEQ ID NO: 1964535 - RNA, 17 nt, Homo sapiens
ucucagaagguagggga

SEQ ID NO: 1964536 - RNA, 17 nt, Homo sapiens
uuuaaacaaaugugaua

SEQ ID NO: 1964537 - RNA, 13 nt, Homo sapiens
aaugaggcacaug

SEQ ID NO: 1964538 - RNA, 15 nt, Homo sapiens
aaugguccuguuaug

SEQ ID NO: 1964539 - RNA, 18 nt, Homo sapiens
auacugagaauauacaau

SEQ ID NO: 1964540 - RNA, 21 nt, Homo sapiens
aacuuggauguagccaugacc

SEQ ID NO: 1964541 - RNA, 16 nt, Homo sapiens
uauucuuccgucacau

SEQ ID NO: 1964542 - RNA, 14 nt, Homo sapiens
acaaccacugggau

SEQ ID NO: 1964543 - RNA, 20 nt, Homo sapiens
aaacugauuuaucuauuuaa

SEQ ID NO: 1964544 - RNA, 14 nt, Homo sapiens
agaaucugcucuga

SEQ ID NO: 1964545 - RNA, 14 nt, Homo sapiens
uuugacuugaauau

SEQ ID NO: 1964546 - RNA, 19 nt, Homo sapiens
ccucuuauugggauaucau

SEQ ID NO: 1964547 - RNA, 22 nt, Homo sapiens
agaucacaguggccacggccac

SEQ ID NO: 1964548 - RNA, 16 nt, Homo sapiens
acacuuaugggccaag

SEQ ID NO: 1964549 - RNA, 20 nt, Homo sapiens
cuggaucugugaggggcucu

SEQ ID NO: 1964550 - RNA, 20 nt, Homo sapiens
aaggcuucugggacuugaaa

SEQ ID NO: 1964551 - RNA, 19 nt, Homo sapiens
acuucuuucagcagacuga

SEQ ID NO: 1964552 - RNA, 23 nt, Homo sapiens
aagauucugaccuuaaaugcaac

SEQ ID NO: 1964553 - RNA, 19 nt, Homo sapiens
ucugcacaacugacuucca

SEQ ID NO: 1964554 - RNA, 12 nt, Homo sapiens
accuagauucca

SEQ ID NO: 1964555 - RNA, 22 nt, Homo sapiens
aggugguucagacaagacagag

SEQ ID NO: 1964556 - RNA, 18 nt, Homo sapiens
cagacagcaggcuggagc

SEQ ID NO: 1964557 - RNA, 18 nt, Homo sapiens
aagaauaauaauggcuaa

SEQ ID NO: 1964558 - RNA, 21 nt, Homo sapiens
cauauuuaagagauacuugau

SEQ ID NO: 1964559 - RNA, 23 nt, Homo sapiens
gcuuaugcuuguuucauacaugu

SEQ ID NO: 1964560 - RNA, 17 nt, Homo sapiens
uaauucugcuucuagua

SEQ ID NO: 1964561 - RNA, 21 nt, Homo sapiens
uuuuauaggccuguguguaua

SEQ ID NO: 1964562 - RNA, 13 nt, Homo sapiens
uguuccugucuca

SEQ ID NO: 1964563 - RNA, 16 nt, Homo sapiens
cuaaagguuguauugc

SEQ ID NO: 1964564 - RNA, 20 nt, Homo sapiens
acugauugcucccaggaucu

SEQ ID NO: 1964565 - RNA, 11 nt, Homo sapiens
aaaaugaacuu

SEQ ID NO: 1964566 - RNA, 20 nt, Homo sapiens
aaccuucucuguccgagugu

SEQ ID NO: 1964567 - RNA, 14 nt, Homo sapiens
uuacacaagaaucu

SEQ ID NO: 1964568 - RNA, 12 nt, Homo sapiens
auauuaucauaa

SEQ ID NO: 1964569 - RNA, 14 nt, Homo sapiens
aacucacugugcuc

SEQ ID NO: 1964570 - RNA, 14 nt, Homo sapiens
gccaaucugcauuu

SEQ ID NO: 1964571 - RNA, 19 nt, Homo sapiens
ugaggaggaggacacagca

SEQ ID NO: 1964572 - RNA, 11 nt, Homo sapiens
guuaucuguga

SEQ ID NO: 1964573 - RNA, 21 nt, Homo sapiens
caccagucucacccacuagga

SEQ ID NO: 1964574 - RNA, 13 nt, Homo sapiens
uacaggugugaac

SEQ ID NO: 1964575 - RNA, 18 nt, Homo sapiens
auuuccauuguguggccu

SEQ ID NO: 1964576 - RNA, 15 nt, Homo sapiens
uuaagaguaacaguu

SEQ ID NO: 1964577 - RNA, 15 nt, Homo sapiens
agucaccacugugcu

SEQ ID NO: 1964578 - RNA, 14 nt, Homo sapiens
ggcagacauugugc

SEQ ID NO: 1964579 - RNA, 20 nt, Homo sapiens
ugggcagccguuuuccucau

SEQ ID NO: 1964580 - RNA, 14 nt, Homo sapiens
agcagccagccauu

SEQ ID NO: 1964581 - RNA, 19 nt, Homo sapiens
uaugaucuggcccuugcuu

SEQ ID NO: 1964582 - RNA, 21 nt, Homo sapiens
ucagcaaaaaucucccaguga

SEQ ID NO: 1964583 - RNA, 16 nt, Homo sapiens
acagguuuguucucag

SEQ ID NO: 1964584 - RNA, 13 nt, Homo sapiens
aaccugaccagug

SEQ ID NO: 1964585 - RNA, 16 nt, Homo sapiens
acauuugagccauguc

SEQ ID NO: 1964586 - RNA, 13 nt, Homo sapiens
agccccacccugg

SEQ ID NO: 1964587 - RNA, 21 nt, Homo sapiens
uaacucacugccuaggaggcu

SEQ ID NO: 1964588 - RNA, 17 nt, Homo sapiens
uacaaagcaaacaaacu

SEQ ID NO: 1964589 - RNA, 22 nt, Homo sapiens
aaaggaacuaugaaaaccagaa

SEQ ID NO: 1964590 - RNA, 20 nt, Homo sapiens
cuaagaagcgagcacugacc

SEQ ID NO: 1964591 - RNA, 18 nt, Homo sapiens
agguauuagcaaagcaaa

SEQ ID NO: 1964592 - RNA, 23 nt, Homo sapiens
cugcugcgcguggugcugagucu

SEQ ID NO: 1964593 - RNA, 18 nt, Homo sapiens
uuccccgaaucacacaga

SEQ ID NO: 1964594 - RNA, 18 nt, Homo sapiens
aauggauucucuauucaa

SEQ ID NO: 1964595 - RNA, 14 nt, Homo sapiens
cuauguugcccagg

SEQ ID NO: 1964596 - RNA, 16 nt, Homo sapiens
agagaaaguuggugcu

SEQ ID NO: 1964597 - RNA, 21 nt, Homo sapiens
aaauguucauggacuauucca

SEQ ID NO: 1964598 - RNA, 15 nt, Homo sapiens
accgcuguccuggca

SEQ ID NO: 1964599 - RNA, 14 nt, Homo sapiens
ccagacuugccuua

SEQ ID NO: 1964600 - RNA, 15 nt, Homo sapiens
auuuuugcaacuauu

SEQ ID NO: 1964601 - RNA, 20 nt, Homo sapiens
gccugcaaaccuuccuggga

SEQ ID NO: 1964602 - RNA, 19 nt, Homo sapiens
gcagcuaucucucagugaa

SEQ ID NO: 1964603 - RNA, 15 nt, Homo sapiens
accacacccugccug

SEQ ID NO: 1964604 - RNA, 20 nt, Homo sapiens
agcgcaguggggugaucuca

SEQ ID NO: 1964605 - RNA, 15 nt, Homo sapiens
agaaagccucuccag

SEQ ID NO: 1964606 - RNA, 11 nt, Homo sapiens
gaaacugagua

SEQ ID NO: 1964607 - RNA, 19 nt, Homo sapiens
aggauuuauauucaaggau

SEQ ID NO: 1964608 - RNA, 13 nt, Homo sapiens
gauuuaaaugcca

SEQ ID NO: 1964609 - RNA, 19 nt, Homo sapiens
cuggacccuggccuaaaga

SEQ ID NO: 1964610 - RNA, 21 nt, Homo sapiens
ugauauauucuugaagacauc

SEQ ID NO: 1964611 - RNA, 22 nt, Homo sapiens
ccuuucuuucuaacuccaguga

SEQ ID NO: 1964612 - RNA, 13 nt, Homo sapiens
cagccuugaacuc

SEQ ID NO: 1964613 - RNA, 19 nt, Homo sapiens
uucuaccaaggcauaucau

SEQ ID NO: 1964614 - RNA, 16 nt, Homo sapiens
cccacugcuuuuccca

SEQ ID NO: 1964615 - RNA, 15 nt, Homo sapiens
ugccuacauucccug

SEQ ID NO: 1964616 - RNA, 15 nt, Homo sapiens
uuuaagugacauaau

SEQ ID NO: 1964617 - RNA, 17 nt, Homo sapiens
gccccuccucugugcuc

SEQ ID NO: 1964618 - RNA, 17 nt, Homo sapiens
caccuaugucauuucau

SEQ ID NO: 1964619 - RNA, 15 nt, Homo sapiens
cccaauccccagacu

SEQ ID NO: 1964620 - RNA, 14 nt, Homo sapiens
ugggguagggugag

SEQ ID NO: 1964621 - RNA, 16 nt, Homo sapiens
ugccuccaagauuuca

SEQ ID NO: 1964622 - RNA, 22 nt, Homo sapiens
auuuugugaucuguaacagggu

SEQ ID NO: 1964623 - RNA, 24 nt, Homo sapiens
gagaacgggaguggccaucuggaa

SEQ ID NO: 1964624 - RNA, 15 nt, Homo sapiens
cuuuugcacaccuuu

SEQ ID NO: 1964625 - RNA, 14 nt, Homo sapiens
aaaauaguuuagau

SEQ ID NO: 1964626 - RNA, 19 nt, Homo sapiens
cugguggauaaagauggau

SEQ ID NO: 1964627 - RNA, 18 nt, Homo sapiens
gaauuguagauaauacug

SEQ ID NO: 1964628 - RNA, 13 nt, Homo sapiens
gcggaagugacca

SEQ ID NO: 1964629 - RNA, 15 nt, Homo sapiens
agguuugcaccccuc

SEQ ID NO: 1964630 - RNA, 15 nt, Homo sapiens
aggaaaccagagcuu

SEQ ID NO: 1964631 - RNA, 14 nt, Homo sapiens
agcagaaggccauc

SEQ ID NO: 1964632 - RNA, 21 nt, Homo sapiens
acacauuuagaugcacuacca

SEQ ID NO: 1964633 - RNA, 22 nt, Homo sapiens
uuacuggacaaagaauuccaaa

SEQ ID NO: 1964634 - RNA, 17 nt, Homo sapiens
uuguuggccaaagccaa

SEQ ID NO: 1964635 - RNA, 15 nt, Homo sapiens
ugaauauauggucug

SEQ ID NO: 1964636 - RNA, 18 nt, Homo sapiens
ugcacaaacucaccaucu

SEQ ID NO: 1964637 - RNA, 21 nt, Homo sapiens
acaaaggaagaacaucuggau

SEQ ID NO: 1964638 - RNA, 15 nt, Homo sapiens
gucuguacacguguc

SEQ ID NO: 1964639 - RNA, 20 nt, Homo sapiens
auccggcagccuggauguuu

SEQ ID NO: 1964640 - RNA, 22 nt, Homo sapiens
ucauuccaaucagccaacuaag

SEQ ID NO: 1964641 - RNA, 16 nt, Homo sapiens
accaaccgauugccuu

SEQ ID NO: 1964642 - RNA, 19 nt, Homo sapiens
uuuucauguagaacucagc

SEQ ID NO: 1964643 - RNA, 23 nt, Homo sapiens
gccagcagacauugucagcaaau

SEQ ID NO: 1964644 - RNA, 15 nt, Homo sapiens
aauuacuguguaaau

SEQ ID NO: 1964645 - RNA, 18 nt, Homo sapiens
agaccaaaucuugcucug

SEQ ID NO: 1964646 - RNA, 18 nt, Homo sapiens
cauuuacuguggcuucuu

SEQ ID NO: 1964647 - RNA, 17 nt, Homo sapiens
ccuucuccacagggaca

SEQ ID NO: 1964648 - RNA, 13 nt, Homo sapiens
uagcuuaccugac

SEQ ID NO: 1964649 - RNA, 21 nt, Homo sapiens
ggcuuuguugcuuccguucau

SEQ ID NO: 1964650 - RNA, 16 nt, Homo sapiens
gaagcaccccaugcca

SEQ ID NO: 1964651 - RNA, 15 nt, Homo sapiens
ugcaagucacauaaa

SEQ ID NO: 1964652 - RNA, 15 nt, Homo sapiens
ccuggacaaccagag

SEQ ID NO: 1964653 - RNA, 15 nt, Homo sapiens
aaugcacacacacag

SEQ ID NO: 1964654 - RNA, 13 nt, Homo sapiens
cucagaaagggau

SEQ ID NO: 1964655 - RNA, 13 nt, Homo sapiens
cuauucuuugcca

SEQ ID NO: 1964656 - RNA, 17 nt, Homo sapiens
ugaagccccucccugag

SEQ ID NO: 1964657 - RNA, 22 nt, Homo sapiens
caaagucaucccucuguucaca

SEQ ID NO: 1964658 - RNA, 16 nt, Homo sapiens
aaccuuccucuuccag

SEQ ID NO: 1964659 - RNA, 11 nt, Homo sapiens
uauauuugcua

SEQ ID NO: 1964660 - RNA, 15 nt, Homo sapiens
cagucuuaauauuca

SEQ ID NO: 1964661 - RNA, 23 nt, Homo sapiens
aguauaacuuuacagauaaccua

SEQ ID NO: 1964662 - RNA, 23 nt, Homo sapiens
agucgaaccauggugaacuccac

SEQ ID NO: 1964663 - RNA, 20 nt, Homo sapiens
gguccucaguccacugcuga

SEQ ID NO: 1964664 - RNA, 16 nt, Homo sapiens
cuuccaaaaccugcuu

SEQ ID NO: 1964665 - RNA, 16 nt, Homo sapiens
gguuuuuuagugcaau

SEQ ID NO: 1964666 - RNA, 19 nt, Homo sapiens
uggccuggaugcacagugc

SEQ ID NO: 1964667 - RNA, 12 nt, Homo sapiens
aggcagugcagu

SEQ ID NO: 1964668 - RNA, 24 nt, Homo sapiens
auaauaaaaaaauuagugaguaua

SEQ ID NO: 1964669 - RNA, 14 nt, Homo sapiens
gcagucucagucca

SEQ ID NO: 1964670 - RNA, 21 nt, Homo sapiens
ggacuccagacucucugugaa

SEQ ID NO: 1964671 - RNA, 20 nt, Homo sapiens
cagccucugggggguggcca

SEQ ID NO: 1964672 - RNA, 15 nt, Homo sapiens
agugaaggagccagu

SEQ ID NO: 1964673 - RNA, 14 nt, Homo sapiens
aagagcgaguacag

SEQ ID NO: 1964674 - RNA, 21 nt, Homo sapiens
ggccuccuacacguacuucua

SEQ ID NO: 1964675 - RNA, 17 nt, Homo sapiens
agaaauggauguguuau

SEQ ID NO: 1964676 - RNA, 16 nt, Homo sapiens
auaaagaugauugaau

SEQ ID NO: 1964677 - RNA, 17 nt, Homo sapiens
gugccccccuccuccag

SEQ ID NO: 1964678 - RNA, 23 nt, Homo sapiens
aaacuuuuuuucuguaccaguua

SEQ ID NO: 1964679 - RNA, 15 nt, Homo sapiens
agcuuacaaucgcaa

SEQ ID NO: 1964680 - RNA, 21 nt, Homo sapiens
agcucaauaaaagaaucugau

SEQ ID NO: 1964681 - RNA, 16 nt, Homo sapiens
aaucucugcaggaugg

SEQ ID NO: 1964682 - RNA, 17 nt, Homo sapiens
uuccucgcaggucucag

SEQ ID NO: 1964683 - RNA, 23 nt, Homo sapiens
aaaacaaauucaagaaugcagua

SEQ ID NO: 1964684 - RNA, 19 nt, Homo sapiens
ucugugggccccacccacu

SEQ ID NO: 1964685 - RNA, 19 nt, Homo sapiens
ucaugccauugcauuccag

SEQ ID NO: 1964686 - RNA, 19 nt, Homo sapiens
uugccuauaauacuugcaa

SEQ ID NO: 1964687 - RNA, 18 nt, Homo sapiens
aaaguggggguggaggac

SEQ ID NO: 1964688 - RNA, 12 nt, Homo sapiens
aucccucauacc

SEQ ID NO: 1964689 - RNA, 13 nt, Homo sapiens
aauauagugacua

SEQ ID NO: 1964690 - RNA, 15 nt, Homo sapiens
ucauggguacccaga

SEQ ID NO: 1964691 - RNA, 16 nt, Homo sapiens
cccuucccaaucagca

SEQ ID NO: 1964692 - RNA, 20 nt, Homo sapiens
gcuuucaacauguacaggaa

SEQ ID NO: 1964693 - RNA, 20 nt, Homo sapiens
gugugcaagugugugcaugu

SEQ ID NO: 1964694 - RNA, 20 nt, Homo sapiens
uaaucccagcauuuugagag

SEQ ID NO: 1964695 - RNA, 19 nt, Homo sapiens
aucaugaaagccuauucca

SEQ ID NO: 1964696 - RNA, 13 nt, Homo sapiens
gauugcacuugau

SEQ ID NO: 1964697 - RNA, 14 nt, Homo sapiens
aguauguguaugua

SEQ ID NO: 1964698 - RNA, 12 nt, Homo sapiens
aguauugugcau

SEQ ID NO: 1964699 - RNA, 14 nt, Homo sapiens
ugagccuccaugcc

SEQ ID NO: 1964700 - RNA, 20 nt, Homo sapiens
caugaaaucuuuaugugaua

SEQ ID NO: 1964701 - RNA, 18 nt, Homo sapiens
acacuauuuuugauagca

SEQ ID NO: 1964702 - RNA, 12 nt, Homo sapiens
uccaguguccug

SEQ ID NO: 1964703 - RNA, 17 nt, Homo sapiens
uaugaguuucuuuuugc

SEQ ID NO: 1964704 - RNA, 16 nt, Homo sapiens
aaaaguuucuuaagga

SEQ ID NO: 1964705 - RNA, 17 nt, Homo sapiens
gcuacuggggaaacugg

SEQ ID NO: 1964706 - RNA, 22 nt, Homo sapiens
ucccagcacuuugggaggcaaa

SEQ ID NO: 1964707 - RNA, 22 nt, Homo sapiens
ucugcaagaugucaagggccaa

SEQ ID NO: 1964708 - RNA, 15 nt, Homo sapiens
cuaaauggcagugag

SEQ ID NO: 1964709 - RNA, 14 nt, Homo sapiens
acagcaaaagaaga

SEQ ID NO: 1964710 - RNA, 21 nt, Homo sapiens
uugcccagccuggaugccauc

SEQ ID NO: 1964711 - RNA, 16 nt, Homo sapiens
ugcuucgcagaugucc

SEQ ID NO: 1964712 - RNA, 14 nt, Homo sapiens
caccaccaccugac

SEQ ID NO: 1964713 - RNA, 21 nt, Homo sapiens
guucaucagacuccugugcaa

SEQ ID NO: 1964714 - RNA, 17 nt, Homo sapiens
auuuugcugagaugaag

SEQ ID NO: 1964715 - RNA, 22 nt, Homo sapiens
ugcagaaugagccagaguucac

SEQ ID NO: 1964716 - RNA, 20 nt, Homo sapiens
uccccacauucuauagccau

SEQ ID NO: 1964717 - RNA, 12 nt, Homo sapiens
ucuuggggacua

SEQ ID NO: 1964718 - RNA, 16 nt, Homo sapiens
caaaacagagauguga

SEQ ID NO: 1964719 - RNA, 22 nt, Homo sapiens
caaauuguuguguugagaugau

SEQ ID NO: 1964720 - RNA, 19 nt, Homo sapiens
cucuacaaaaaaaauauaa

SEQ ID NO: 1964721 - RNA, 16 nt, Homo sapiens
cacuaugccugacuaa

SEQ ID NO: 1964722 - RNA, 13 nt, Homo sapiens
cggaaaugauuga

SEQ ID NO: 1964723 - RNA, 22 nt, Homo sapiens
uauaaccacaaagcacaguuug

SEQ ID NO: 1964724 - RNA, 16 nt, Homo sapiens
cucagcaucgugcugu

SEQ ID NO: 1964725 - RNA, 15 nt, Homo sapiens
aauuaaaacuuugua

SEQ ID NO: 1964726 - RNA, 22 nt, Homo sapiens
agagguuugcugacaggugaug

SEQ ID NO: 1964727 - RNA, 16 nt, Homo sapiens
cacacagaucuguaau

SEQ ID NO: 1964728 - RNA, 15 nt, Homo sapiens
aggggugcugugagg

SEQ ID NO: 1964729 - RNA, 16 nt, Homo sapiens
gugcucagccccagac

SEQ ID NO: 1964730 - RNA, 12 nt, Homo sapiens
aaauaugaagcu

SEQ ID NO: 1964731 - RNA, 23 nt, Homo sapiens
acucacugggaagcucccacccc

SEQ ID NO: 1964732 - RNA, 18 nt, Homo sapiens
caugcucucucaccugcu

SEQ ID NO: 1964733 - RNA, 22 nt, Homo sapiens
guaauuguaaacuaguacuauu

SEQ ID NO: 1964734 - RNA, 13 nt, Homo sapiens
guaaauauugcua

SEQ ID NO: 1964735 - RNA, 13 nt, Homo sapiens
uuaucuauggcac

SEQ ID NO: 1964736 - RNA, 20 nt, Homo sapiens
gaaucaacagggcagcagau

SEQ ID NO: 1964737 - RNA, 23 nt, Homo sapiens
ugccccugcuacugccaaccucg

SEQ ID NO: 1964738 - RNA, 15 nt, Homo sapiens
agauagaaagcauua

SEQ ID NO: 1964739 - RNA, 22 nt, Homo sapiens
uggugccuggcugguuugccca

SEQ ID NO: 1964740 - RNA, 21 nt, Homo sapiens
acaauugcuuuaacagucaaa

SEQ ID NO: 1964741 - RNA, 16 nt, Homo sapiens
ugaggcgugggaucca

SEQ ID NO: 1964742 - RNA, 22 nt, Homo sapiens
ugcuuaacauaaacuuguacuu

SEQ ID NO: 1964743 - RNA, 20 nt, Homo sapiens
agcacugagcaaagcauuga

SEQ ID NO: 1964744 - RNA, 21 nt, Homo sapiens
ucgucuccugacaugucucac

SEQ ID NO: 1964745 - RNA, 12 nt, Homo sapiens
gcaaaaugucau

SEQ ID NO: 1964746 - RNA, 22 nt, Homo sapiens
ucuacacugcaaucauauguga

SEQ ID NO: 1964747 - RNA, 17 nt, Homo sapiens
gccugacucagugacca

SEQ ID NO: 1964748 - RNA, 22 nt, Homo sapiens
cuuuggacuugucccgggacac

SEQ ID NO: 1964749 - RNA, 22 nt, Homo sapiens
cugacuccuuagagacaucaaa

SEQ ID NO: 1964750 - RNA, 18 nt, Homo sapiens
ccagggagugagcagcua

SEQ ID NO: 1964751 - RNA, 17 nt, Homo sapiens
aucuuuaaagacuugau

SEQ ID NO: 1964752 - RNA, 19 nt, Homo sapiens
gcggccuccuucugagcuc

SEQ ID NO: 1964753 - RNA, 20 nt, Homo sapiens
cagggcucuaaugugucucu

SEQ ID NO: 1964754 - RNA, 13 nt, Homo sapiens
auuuuacuaaaaa

SEQ ID NO: 1964755 - RNA, 22 nt, Homo sapiens
aacaccuuuccuuaugucuccu

SEQ ID NO: 1964756 - RNA, 14 nt, Homo sapiens
guuuauuacaauuu

SEQ ID NO: 1964757 - RNA, 18 nt, Homo sapiens
agagcccagggcauccca

SEQ ID NO: 1964758 - RNA, 16 nt, Homo sapiens
ucgccuccuacucuga

SEQ ID NO: 1964759 - RNA, 19 nt, Homo sapiens
cagcaaagugucaguguug

SEQ ID NO: 1964760 - RNA, 15 nt, Homo sapiens
guuuagauuugccau

SEQ ID NO: 1964761 - RNA, 13 nt, Homo sapiens
gcuccuaccagca

SEQ ID NO: 1964762 - RNA, 12 nt, Homo sapiens
cuucucacauag

SEQ ID NO: 1964763 - RNA, 19 nt, Homo sapiens
uccacaaagaaaauuccua

SEQ ID NO: 1964764 - RNA, 22 nt, Homo sapiens
ucacuagccaugauaacugcaa

SEQ ID NO: 1964765 - RNA, 17 nt, Homo sapiens
uaauagaguaugugaaa

SEQ ID NO: 1964766 - RNA, 22 nt, Homo sapiens
cucuucagacuuaaagcacuga

SEQ ID NO: 1964767 - RNA, 19 nt, Homo sapiens
gggcuacugccacugugug

SEQ ID NO: 1964768 - RNA, 16 nt, Homo sapiens
uaauguuauuuccacu

SEQ ID NO: 1964769 - RNA, 22 nt, Homo sapiens
auuaaggauuuuaugcuuuaaa

SEQ ID NO: 1964770 - RNA, 23 nt, Homo sapiens
uuucaauaaaaguaaagacugua

SEQ ID NO: 1964771 - RNA, 15 nt, Homo sapiens
ccauaagaaagcacu

SEQ ID NO: 1964772 - RNA, 17 nt, Homo sapiens
uuagauaauguugucaa

SEQ ID NO: 1964773 - RNA, 14 nt, Homo sapiens
ccuagaauguuuca

SEQ ID NO: 1964774 - RNA, 18 nt, Homo sapiens
cuguagauucagguaaua

SEQ ID NO: 1964775 - RNA, 16 nt, Homo sapiens
cauguaaaugcucaaa

SEQ ID NO: 1964776 - RNA, 21 nt, Homo sapiens
ccaacagaagcuuccauucca

SEQ ID NO: 1964777 - RNA, 14 nt, Homo sapiens
cucuccugcuuccu

SEQ ID NO: 1964778 - RNA, 17 nt, Homo sapiens
uauaauuuuuccuuuaa

SEQ ID NO: 1964779 - RNA, 12 nt, Homo sapiens
gcagugcaacaa

SEQ ID NO: 1964780 - RNA, 16 nt, Homo sapiens
gccauccaauuucucu

SEQ ID NO: 1964781 - RNA, 19 nt, Homo sapiens
cucuuaucugggugccuua

SEQ ID NO: 1964782 - RNA, 14 nt, Homo sapiens
gggaccggccaggc

SEQ ID NO: 1964783 - RNA, 17 nt, Homo sapiens
accuugcuccuccuucu

SEQ ID NO: 1964784 - RNA, 18 nt, Homo sapiens
cucuagguccauuuuccu

SEQ ID NO: 1964785 - RNA, 15 nt, Homo sapiens
auuuacaauuugaca

SEQ ID NO: 1964786 - RNA, 22 nt, Homo sapiens
aagcauugccuggacugaccac

SEQ ID NO: 1964787 - RNA, 21 nt, Homo sapiens
agaaaauuccuagaaauugaa

SEQ ID NO: 1964788 - RNA, 15 nt, Homo sapiens
caaagcucaauagga

SEQ ID NO: 1964789 - RNA, 17 nt, Homo sapiens
cuggcugucugccugua

SEQ ID NO: 1964790 - RNA, 14 nt, Homo sapiens
cuaagggggaccau

SEQ ID NO: 1964791 - RNA, 15 nt, Homo sapiens
acauuuuaaacacuu

SEQ ID NO: 1964792 - RNA, 22 nt, Homo sapiens
uagaaaaaggauggaagaaaga

SEQ ID NO: 1964793 - RNA, 16 nt, Homo sapiens
uuagcgagggugguaa

SEQ ID NO: 1964794 - RNA, 17 nt, Homo sapiens
uuccucccuucugcuac

SEQ ID NO: 1964795 - RNA, 13 nt, Homo sapiens
gccucaagccauc

SEQ ID NO: 1964796 - RNA, 13 nt, Homo sapiens
gcccuaagccacu

SEQ ID NO: 1964797 - RNA, 13 nt, Homo sapiens
uaccuugguauau

SEQ ID NO: 1964798 - RNA, 20 nt, Homo sapiens
aaacaagggguuacuuuaca

SEQ ID NO: 1964799 - RNA, 18 nt, Homo sapiens
caauuaaaggcaaaggca

SEQ ID NO: 1964800 - RNA, 17 nt, Homo sapiens
cugggagagccuuccag

SEQ ID NO: 1964801 - RNA, 18 nt, Homo sapiens
gccuuggggaggacaaaa

SEQ ID NO: 1964802 - RNA, 18 nt, Homo sapiens
aacugugauuuuuaucac

SEQ ID NO: 1964803 - RNA, 18 nt, Homo sapiens
ucaccucagauggcagcu

SEQ ID NO: 1964804 - RNA, 19 nt, Homo sapiens
auuucuggaaaacugccuu

SEQ ID NO: 1964805 - RNA, 19 nt, Homo sapiens
auauaaggaauaaagccuu

SEQ ID NO: 1964806 - RNA, 13 nt, Homo sapiens
cagcuuaaaccca

SEQ ID NO: 1964807 - RNA, 21 nt, Homo sapiens
cauguguguguguuguguuaa

SEQ ID NO: 1964808 - RNA, 13 nt, Homo sapiens
ucacuagucuuug

SEQ ID NO: 1964809 - RNA, 14 nt, Homo sapiens
gccauucucuugca

SEQ ID NO: 1964810 - RNA, 22 nt, Homo sapiens
uguuucugaaccauuacuguaa

SEQ ID NO: 1964811 - RNA, 24 nt, Homo sapiens
uccuuccaaccuguucacgugacu

SEQ ID NO: 1964812 - RNA, 20 nt, Homo sapiens
guggcaucaggagcugcuca

SEQ ID NO: 1964813 - RNA, 17 nt, Homo sapiens
cugcuuugggaagccgu

SEQ ID NO: 1964814 - RNA, 15 nt, Homo sapiens
ugcuuacaaaugucu

SEQ ID NO: 1964815 - RNA, 16 nt, Homo sapiens
gaugagucaguccuug

SEQ ID NO: 1964816 - RNA, 22 nt, Homo sapiens
uaaaauauuuuuaugugcaaua

SEQ ID NO: 1964817 - RNA, 20 nt, Homo sapiens
cuaucaauccaaauucccuc

SEQ ID NO: 1964818 - RNA, 21 nt, Homo sapiens
cuggcuguguugucagcacug

SEQ ID NO: 1964819 - RNA, 19 nt, Homo sapiens
gcuucacuggggcccuguc

SEQ ID NO: 1964820 - RNA, 23 nt, Homo sapiens
uucccuuuaacccucacacugcu

SEQ ID NO: 1964821 - RNA, 18 nt, Homo sapiens
cuguuaaaucaguucugu

SEQ ID NO: 1964822 - RNA, 14 nt, Homo sapiens
guguaaaauguaau

SEQ ID NO: 1964823 - RNA, 14 nt, Homo sapiens
uaugaccagugaua

SEQ ID NO: 1964824 - RNA, 14 nt, Homo sapiens
aaauuucaauaacc

SEQ ID NO: 1964825 - RNA, 23 nt, Homo sapiens
aauauauauauauaucaguuuga

SEQ ID NO: 1964826 - RNA, 14 nt, Homo sapiens
ccuaggucaugaag

SEQ ID NO: 1964827 - RNA, 12 nt, Homo sapiens
acugccaagaaa

SEQ ID NO: 1964828 - RNA, 17 nt, Homo sapiens
aggacaguggcagacag

SEQ ID NO: 1964829 - RNA, 14 nt, Homo sapiens
agcaauacucauca

SEQ ID NO: 1964830 - RNA, 20 nt, Homo sapiens
aacaugcucaguaccugugu

SEQ ID NO: 1964831 - RNA, 18 nt, Homo sapiens
aguucugagauuccagaa

SEQ ID NO: 1964832 - RNA, 16 nt, Homo sapiens
aggcugcccccaucca

SEQ ID NO: 1964833 - RNA, 19 nt, Homo sapiens
agcccggaugcuucuccau

SEQ ID NO: 1964834 - RNA, 20 nt, Homo sapiens
uuuaaguauggaauauucau

SEQ ID NO: 1964835 - RNA, 15 nt, Homo sapiens
augccggugaucccu

SEQ ID NO: 1964836 - RNA, 22 nt, Homo sapiens
agaauuuguugcuaauuugcca

SEQ ID NO: 1964837 - RNA, 19 nt, Homo sapiens
caucuccccucucaccuca

SEQ ID NO: 1964838 - RNA, 16 nt, Homo sapiens
cagcaacauugaccca

SEQ ID NO: 1964839 - RNA, 23 nt, Homo sapiens
ucacagaguaugaucucagggca

SEQ ID NO: 1964840 - RNA, 16 nt, Homo sapiens
uaaacucaucuaucca

SEQ ID NO: 1964841 - RNA, 14 nt, Homo sapiens
caucauaauggacu

SEQ ID NO: 1964842 - RNA, 22 nt, Homo sapiens
agaaauuaacaaaugugcugcu

SEQ ID NO: 1964843 - RNA, 13 nt, Homo sapiens
aguguaaacugaa

SEQ ID NO: 1964844 - RNA, 16 nt, Homo sapiens
guaucaccgggggcau

SEQ ID NO: 1964845 - RNA, 21 nt, Homo sapiens
agucuacuugaggcugcaauc

SEQ ID NO: 1964846 - RNA, 14 nt, Homo sapiens
aaguaucuuuccag

SEQ ID NO: 1964847 - RNA, 17 nt, Homo sapiens
aacugccauugugauca

SEQ ID NO: 1964848 - RNA, 21 nt, Homo sapiens
ucuuugucaaugcucuaacaa

SEQ ID NO: 1964849 - RNA, 16 nt, Homo sapiens
caccugggaagccugg

SEQ ID NO: 1964850 - RNA, 12 nt, Homo sapiens
uaugcuagugau

SEQ ID NO: 1964851 - RNA, 22 nt, Homo sapiens
caaaccaagucggaacagcaga

SEQ ID NO: 1964852 - RNA, 13 nt, Homo sapiens
caauggaauguga

SEQ ID NO: 1964853 - RNA, 22 nt, Homo sapiens
aagucaggaguccaagaccaga

SEQ ID NO: 1964854 - RNA, 23 nt, Homo sapiens
cccggagagggagucagucuuca

SEQ ID NO: 1964855 - RNA, 18 nt, Homo sapiens
ugcuauauugcacuguga

SEQ ID NO: 1964856 - RNA, 21 nt, Homo sapiens
cagucugcuucagugcaguga

SEQ ID NO: 1964857 - RNA, 15 nt, Homo sapiens
auaagccaauauucc

SEQ ID NO: 1964858 - RNA, 15 nt, Homo sapiens
gcuauuuccaaagcu

SEQ ID NO: 1964859 - RNA, 17 nt, Homo sapiens
cagcgaaugaaugcugu

SEQ ID NO: 1964860 - RNA, 14 nt, Homo sapiens
gccuggcacaucag

SEQ ID NO: 1964861 - RNA, 22 nt, Homo sapiens
agucgucuggcaucucccacac

SEQ ID NO: 1964862 - RNA, 17 nt, Homo sapiens
accuggggaguuuacua

SEQ ID NO: 1964863 - RNA, 20 nt, Homo sapiens
ucaagcgauucuccugccuc

SEQ ID NO: 1964864 - RNA, 19 nt, Homo sapiens
gggccauggcucagggugg

SEQ ID NO: 1964865 - RNA, 15 nt, Homo sapiens
auuaaaugcaugucc

SEQ ID NO: 1964866 - RNA, 17 nt, Homo sapiens
aaacugugucacaguuu

SEQ ID NO: 1964867 - RNA, 15 nt, Homo sapiens
cauaacccacuuguc

SEQ ID NO: 1964868 - RNA, 17 nt, Homo sapiens
guacccagcaaaugggc

SEQ ID NO: 1964869 - RNA, 12 nt, Homo sapiens
auuuaagacaua

SEQ ID NO: 1964870 - RNA, 13 nt, Homo sapiens
uagaaagcacuac

SEQ ID NO: 1964871 - RNA, 21 nt, Homo sapiens
uugauuuaauaacauaacaaa

SEQ ID NO: 1964872 - RNA, 22 nt, Homo sapiens
cuguguacagaauucugcuacc

SEQ ID NO: 1964873 - RNA, 18 nt, Homo sapiens
acucuuccaccucccaac

SEQ ID NO: 1964874 - RNA, 11 nt, Homo sapiens
uaaaccaaaaa

SEQ ID NO: 1964875 - RNA, 11 nt, Homo sapiens
ucaaccaaaca

SEQ ID NO: 1964876 - RNA, 14 nt, Homo sapiens
cagacuugaauaca

SEQ ID NO: 1964877 - RNA, 18 nt, Homo sapiens
cgcccgagggauggugcc

SEQ ID NO: 1964878 - RNA, 14 nt, Homo sapiens
gcuggggaugucuc

SEQ ID NO: 1964879 - RNA, 23 nt, Homo sapiens
uuuccauugcuuauucuugagca

SEQ ID NO: 1964880 - RNA, 23 nt, Homo sapiens
cucagaugauggauauguuuuca

SEQ ID NO: 1964881 - RNA, 16 nt, Homo sapiens
ccuauauuguuuucag

SEQ ID NO: 1964882 - RNA, 21 nt, Homo sapiens
aguuaaaauucuggacacauu

SEQ ID NO: 1964883 - RNA, 19 nt, Homo sapiens
uggccgacagucuggaaau

SEQ ID NO: 1964884 - RNA, 12 nt, Homo sapiens
auaaagugcuuu

SEQ ID NO: 1964885 - RNA, 23 nt, Homo sapiens
gcuuucuguugauguuaacugag

SEQ ID NO: 1964886 - RNA, 19 nt, Homo sapiens
uggcccuuucuggaccaga

SEQ ID NO: 1964887 - RNA, 17 nt, Homo sapiens
auuuuacuuccaugaua

SEQ ID NO: 1964888 - RNA, 19 nt, Homo sapiens
auacaauauggacauguaa

SEQ ID NO: 1964889 - RNA, 20 nt, Homo sapiens
cuuaaaggggagaccucaga

SEQ ID NO: 1964890 - RNA, 20 nt, Homo sapiens
ucaagugcaccuacaccaac

SEQ ID NO: 1964891 - RNA, 18 nt, Homo sapiens
cugcuggcccacagcucu

SEQ ID NO: 1964892 - RNA, 12 nt, Homo sapiens
ccugcuaccugu

SEQ ID NO: 1964893 - RNA, 10 nt, Homo sapiens
ugcacuauug

SEQ ID NO: 1964894 - RNA, 14 nt, Homo sapiens
gcucccggguccug

SEQ ID NO: 1964895 - RNA, 20 nt, Homo sapiens
ucuccucugcagcucaggga

SEQ ID NO: 1964896 - RNA, 18 nt, Homo sapiens
gagcacacaacaggcugu

SEQ ID NO: 1964897 - RNA, 14 nt, Homo sapiens
ugcaguccuacuca

SEQ ID NO: 1964898 - RNA, 14 nt, Homo sapiens
cacagaaacacugc

SEQ ID NO: 1964899 - RNA, 14 nt, Homo sapiens
aucucgacucacug

SEQ ID NO: 1964900 - RNA, 15 nt, Homo sapiens
uaaaagauucacuaa

SEQ ID NO: 1964901 - RNA, 18 nt, Homo sapiens
cuuugcaaaucaguguuu

SEQ ID NO: 1964902 - RNA, 22 nt, Homo sapiens
gcuuuguacugcuguuguugaa

SEQ ID NO: 1964903 - RNA, 17 nt, Homo sapiens
caaucuguccacaaaua

SEQ ID NO: 1964904 - RNA, 13 nt, Homo sapiens
caaacccauuccc

SEQ ID NO: 1964905 - RNA, 18 nt, Homo sapiens
ggaauaaugcggacacuu

SEQ ID NO: 1964906 - RNA, 11 nt, Homo sapiens
uaguaugcagu

SEQ ID NO: 1964907 - RNA, 19 nt, Homo sapiens
aaaauauuauguguuucca

SEQ ID NO: 1964908 - RNA, 20 nt, Homo sapiens
ccagacauacgaaacacaaa

SEQ ID NO: 1964909 - RNA, 17 nt, Homo sapiens
caugaacagcucugaga

SEQ ID NO: 1964910 - RNA, 22 nt, Homo sapiens
gcaaagauuuuuggcacuuugu

SEQ ID NO: 1964911 - RNA, 23 nt, Homo sapiens
aauuuugucagauucacacaugc

SEQ ID NO: 1964912 - RNA, 10 nt, Homo sapiens
ccaaagggaa

SEQ ID NO: 1964913 - RNA, 18 nt, Homo sapiens
uuccaaagaaaaguauug

SEQ ID NO: 1964914 - RNA, 16 nt, Homo sapiens
gcagugccuugugcaa

SEQ ID NO: 1964915 - RNA, 17 nt, Homo sapiens
accuggccuuucacuuu

SEQ ID NO: 1964916 - RNA, 11 nt, Homo sapiens
cuucgcugcca

SEQ ID NO: 1964917 - RNA, 12 nt, Homo sapiens
uugggagcaaaa

SEQ ID NO: 1964918 - RNA, 14 nt, Homo sapiens
acugauucaagaac

SEQ ID NO: 1964919 - RNA, 17 nt, Homo sapiens
aaagccuccucaucccg

SEQ ID NO: 1964920 - RNA, 16 nt, Homo sapiens
gucccccuucaaucuc

SEQ ID NO: 1964921 - RNA, 14 nt, Homo sapiens
uucauuauuuugau

SEQ ID NO: 1964922 - RNA, 14 nt, Homo sapiens
agccugggccacug

SEQ ID NO: 1964923 - RNA, 20 nt, Homo sapiens
ugaacauacuaauucuaugu

SEQ ID NO: 1964924 - RNA, 23 nt, Homo sapiens
ucaugccuguaaucccagcacuu

SEQ ID NO: 1964925 - RNA, 20 nt, Homo sapiens
aauuuugaaaaacugcucau

SEQ ID NO: 1964926 - RNA, 21 nt, Homo sapiens
aacauaaaaaauaaaguacca

SEQ ID NO: 1964927 - RNA, 21 nt, Homo sapiens
aguucacaggccagaaaacau

SEQ ID NO: 1964928 - RNA, 21 nt, Homo sapiens
guuugagacuauggaauccaa

SEQ ID NO: 1964929 - RNA, 16 nt, Homo sapiens
gcacuggcucucucca

SEQ ID NO: 1964930 - RNA, 18 nt, Homo sapiens
augaaguagcugagaaaa

SEQ ID NO: 1964931 - RNA, 14 nt, Homo sapiens
uuagagcacagcuu

SEQ ID NO: 1964932 - RNA, 19 nt, Homo sapiens
ucauguccugaugccaugg

SEQ ID NO: 1964933 - RNA, 23 nt, Homo sapiens
uauugauaauaaaauucauucca

SEQ ID NO: 1964934 - RNA, 16 nt, Homo sapiens
aggcugacagacucac

SEQ ID NO: 1964935 - RNA, 15 nt, Homo sapiens
caacauuuauuucaa

SEQ ID NO: 1964936 - RNA, 23 nt, Homo sapiens
caucagucaacagagaggggcag

SEQ ID NO: 1964937 - RNA, 17 nt, Homo sapiens
aucucuucuuauacaga

SEQ ID NO: 1964938 - RNA, 20 nt, Homo sapiens
gaacauggagccugcugaga

SEQ ID NO: 1964939 - RNA, 13 nt, Homo sapiens
gaucugagcaaaa

SEQ ID NO: 1964940 - RNA, 19 nt, Homo sapiens
caauaaggauuuauucuca

SEQ ID NO: 1964941 - RNA, 17 nt, Homo sapiens
aauauucacugggccaa

SEQ ID NO: 1964942 - RNA, 16 nt, Homo sapiens
ucaucaaaaagccuua

SEQ ID NO: 1964943 - RNA, 19 nt, Homo sapiens
cuggcaaaugccugacuca

SEQ ID NO: 1964944 - RNA, 23 nt, Homo sapiens
ccacucugccucugccugcauuc

SEQ ID NO: 1964945 - RNA, 23 nt, Homo sapiens
cuuucaguauguccccauaagac

SEQ ID NO: 1964946 - RNA, 16 nt, Homo sapiens
auguugcaucccugaa

SEQ ID NO: 1964947 - RNA, 15 nt, Homo sapiens
acuucaguugaucuu

SEQ ID NO: 1964948 - RNA, 17 nt, Homo sapiens
cuguggccuucacuuug

SEQ ID NO: 1964949 - RNA, 12 nt, Homo sapiens
uaaaacagggau

SEQ ID NO: 1964950 - RNA, 20 nt, Homo sapiens
gccuuuuauaugggucuuca

SEQ ID NO: 1964951 - RNA, 21 nt, Homo sapiens
ccucaacaaagaagaaccauc

SEQ ID NO: 1964952 - RNA, 18 nt, Homo sapiens
cacagagauucuggaucu

SEQ ID NO: 1964953 - RNA, 11 nt, Homo sapiens
ucaaugaucua

SEQ ID NO: 1964954 - RNA, 18 nt, Homo sapiens
auugacuuguuacaugaa

SEQ ID NO: 1964955 - RNA, 20 nt, Homo sapiens
caccagcacuuuauacacuu

SEQ ID NO: 1964956 - RNA, 18 nt, Homo sapiens
gcauugguuuuccaugac

SEQ ID NO: 1964957 - RNA, 21 nt, Homo sapiens
aucuuugcaccagauacucau

SEQ ID NO: 1964958 - RNA, 17 nt, Homo sapiens
guacguugugcauuugg

SEQ ID NO: 1964959 - RNA, 16 nt, Homo sapiens
agaacaacaugggagc

SEQ ID NO: 1964960 - RNA, 21 nt, Homo sapiens
gagagaaaaagaaagaacugu

SEQ ID NO: 1964961 - RNA, 19 nt, Homo sapiens
guauauauaguagcauuuc

SEQ ID NO: 1964962 - RNA, 12 nt, Homo sapiens
gucugagguccu

SEQ ID NO: 1964963 - RNA, 16 nt, Homo sapiens
aacacaccucucuccu

SEQ ID NO: 1964964 - RNA, 19 nt, Homo sapiens
gaggccugaggaguggcag

SEQ ID NO: 1964965 - RNA, 14 nt, Homo sapiens
uccaggcaccaucu

SEQ ID NO: 1964966 - RNA, 17 nt, Homo sapiens
auuauaaauaaauacca

SEQ ID NO: 1964967 - RNA, 13 nt, Homo sapiens
ucuacuuguaaaa

SEQ ID NO: 1964968 - RNA, 16 nt, Homo sapiens
ccuucagaagcuauuu

SEQ ID NO: 1964969 - RNA, 20 nt, Homo sapiens
accaacugcucucaaaaugu

SEQ ID NO: 1964970 - RNA, 21 nt, Homo sapiens
ucauggcaucauccauucucu

SEQ ID NO: 1964971 - RNA, 23 nt, Homo sapiens
ugcagcauugccauaccauuccc

SEQ ID NO: 1964972 - RNA, 16 nt, Homo sapiens
aaaagauacugaugca

SEQ ID NO: 1964973 - RNA, 16 nt, Homo sapiens
gcaggcuaacgcagga

SEQ ID NO: 1964974 - RNA, 17 nt, Homo sapiens
gcaccaaaugucagaag

SEQ ID NO: 1964975 - RNA, 13 nt, Homo sapiens
auagagccugagg

SEQ ID NO: 1964976 - RNA, 20 nt, Homo sapiens
ugcuugaacccaggaggcag

SEQ ID NO: 1964977 - RNA, 21 nt, Homo sapiens
ucuucuuuuuuuaaacauuca

SEQ ID NO: 1964978 - RNA, 17 nt, Homo sapiens
ggcacacgccuguaauc

SEQ ID NO: 1964979 - RNA, 16 nt, Homo sapiens
acccagaggcccugaa

SEQ ID NO: 1964980 - RNA, 23 nt, Homo sapiens
auaugugcagaagguuacuaccu

SEQ ID NO: 1964981 - RNA, 22 nt, Homo sapiens
ugucagcaaacggugaccagca

SEQ ID NO: 1964982 - RNA, 20 nt, Homo sapiens
ccuggaacaucaucaaggca

SEQ ID NO: 1964983 - RNA, 16 nt, Homo sapiens
cuucuaagucauucau

SEQ ID NO: 1964984 - RNA, 13 nt, Homo sapiens
gaucauugcaaac

SEQ ID NO: 1964985 - RNA, 15 nt, Homo sapiens
guuuaugaugcaaau

SEQ ID NO: 1964986 - RNA, 22 nt, Homo sapiens
acauucuuccaucaucacugua

SEQ ID NO: 1964987 - RNA, 15 nt, Homo sapiens
cuguucccuugcagg

SEQ ID NO: 1964988 - RNA, 15 nt, Homo sapiens
caaagacuucuguca

SEQ ID NO: 1964989 - RNA, 13 nt, Homo sapiens
ucaagauccuguc

SEQ ID NO: 1964990 - RNA, 15 nt, Homo sapiens
ucaagauuugaccaa

SEQ ID NO: 1964991 - RNA, 14 nt, Homo sapiens
agccugguuugcaa

SEQ ID NO: 1964992 - RNA, 14 nt, Homo sapiens
cacugaaaauguca

SEQ ID NO: 1964993 - RNA, 21 nt, Homo sapiens
ucaaauacauuuaaaacauua

SEQ ID NO: 1964994 - RNA, 15 nt, Homo sapiens
gcugacuguuucauu

SEQ ID NO: 1964995 - RNA, 17 nt, Homo sapiens
aagguggggaccugggg

SEQ ID NO: 1964996 - RNA, 14 nt, Homo sapiens
acuuuaauucucau

SEQ ID NO: 1964997 - RNA, 22 nt, Homo sapiens
acaccccuggccugacucccau

SEQ ID NO: 1964998 - RNA, 22 nt, Homo sapiens
gugcaagagccugagacuggaa

SEQ ID NO: 1964999 - RNA, 14 nt, Homo sapiens
cccccaguguaaua

SEQ ID NO: 1965000 - RNA, 13 nt, Homo sapiens
guucccagcagcu

SEQ ID NO: 1965001 - RNA, 15 nt, Homo sapiens
ucaguccuuccacac

SEQ ID NO: 1965002 - RNA, 17 nt, Homo sapiens
gaaacagcuugaugcug

SEQ ID NO: 1965003 - RNA, 13 nt, Homo sapiens
auuuaagugcaau

SEQ ID NO: 1965004 - RNA, 18 nt, Homo sapiens
uuccccacgggaacauua

SEQ ID NO: 1965005 - RNA, 15 nt, Homo sapiens
aagcucgagugaauu

SEQ ID NO: 1965006 - RNA, 20 nt, Homo sapiens
cugcccccagacccauguga

SEQ ID NO: 1965007 - RNA, 19 nt, Homo sapiens
uccucuugcuauauaaaua

SEQ ID NO: 1965008 - RNA, 22 nt, Homo sapiens
uguuuuuaaaacuucaaauauc

SEQ ID NO: 1965009 - RNA, 14 nt, Homo sapiens
agaagcacuguucc

SEQ ID NO: 1965010 - RNA, 12 nt, Homo sapiens
uguuugugauug

SEQ ID NO: 1965011 - RNA, 24 nt, Homo sapiens
ucuaaauuugaauguuaagcagau

SEQ ID NO: 1965012 - RNA, 17 nt, Homo sapiens
ccuguacuguauggaaa

SEQ ID NO: 1965013 - RNA, 19 nt, Homo sapiens
gcugugaucacuccagugc

SEQ ID NO: 1965014 - RNA, 12 nt, Homo sapiens
caauaguauuaa

SEQ ID NO: 1965015 - RNA, 15 nt, Homo sapiens
uucuccccacugugc

SEQ ID NO: 1965016 - RNA, 21 nt, Homo sapiens
aggaauucaagguuuguucaa

SEQ ID NO: 1965017 - RNA, 23 nt, Homo sapiens
aaaauuuguuugucacugccaaa

SEQ ID NO: 1965018 - RNA, 21 nt, Homo sapiens
auagaaugagcacccauucca

SEQ ID NO: 1965019 - RNA, 15 nt, Homo sapiens
ggugcuuauuaagac

SEQ ID NO: 1965020 - RNA, 16 nt, Homo sapiens
cuaccucuaccuucaa

SEQ ID NO: 1965021 - RNA, 20 nt, Homo sapiens
cuaaaaucuguuaccauucu

SEQ ID NO: 1965022 - RNA, 20 nt, Homo sapiens
cauaaaaaagaagcacuuug

SEQ ID NO: 1965023 - RNA, 17 nt, Homo sapiens
cuccgcccuucccugac

SEQ ID NO: 1965024 - RNA, 16 nt, Homo sapiens
gacuggaucucagccu

SEQ ID NO: 1965025 - RNA, 14 nt, Homo sapiens
agaagguccuuaau

SEQ ID NO: 1965026 - RNA, 16 nt, Homo sapiens
caaauaagaggacaga

SEQ ID NO: 1965027 - RNA, 18 nt, Homo sapiens
cuaggcugcccacucucc

SEQ ID NO: 1965028 - RNA, 14 nt, Homo sapiens
uacccaacucugua

SEQ ID NO: 1965029 - RNA, 21 nt, Homo sapiens
ugugaaggaacucugcaguua

SEQ ID NO: 1965030 - RNA, 20 nt, Homo sapiens
acuucggacaccugccaugg

SEQ ID NO: 1965031 - RNA, 15 nt, Homo sapiens
caugguuauugauga

SEQ ID NO: 1965032 - RNA, 21 nt, Homo sapiens
cuuuacuccuuuggcuucaaa

SEQ ID NO: 1965033 - RNA, 20 nt, Homo sapiens
cuuucuguccuaaucauaca

SEQ ID NO: 1965034 - RNA, 20 nt, Homo sapiens
agcugaugaacuguggugcc

SEQ ID NO: 1965035 - RNA, 20 nt, Homo sapiens
cgggagacugacacgaagcc

SEQ ID NO: 1965036 - RNA, 24 nt, Homo sapiens
ggaguagcugagaggaagaugaag

SEQ ID NO: 1965037 - RNA, 17 nt, Homo sapiens
gagcgagaccgucucaa

SEQ ID NO: 1965038 - RNA, 20 nt, Homo sapiens
gaaaaucaagcaguuucuau

SEQ ID NO: 1965039 - RNA, 19 nt, Homo sapiens
aaaggagcauauaaggcua

SEQ ID NO: 1965040 - RNA, 23 nt, Homo sapiens
ugaagcaaacacacagacucugu

SEQ ID NO: 1965041 - RNA, 17 nt, Homo sapiens
agaucaacugaguucag

SEQ ID NO: 1965042 - RNA, 21 nt, Homo sapiens
cggggacguagggcuaaggga

SEQ ID NO: 1965043 - RNA, 15 nt, Homo sapiens
gaaggagagugcuug

SEQ ID NO: 1965044 - RNA, 21 nt, Homo sapiens
cuucccacgugggccucccaa

SEQ ID NO: 1965045 - RNA, 21 nt, Homo sapiens
auguguguagauuucaugcuc

SEQ ID NO: 1965046 - RNA, 20 nt, Homo sapiens
aacuuugaauaaagaauacu

SEQ ID NO: 1965047 - RNA, 13 nt, Homo sapiens
uguaucaacacac

SEQ ID NO: 1965048 - RNA, 21 nt, Homo sapiens
uacacagguuuaguugacuaa

SEQ ID NO: 1965049 - RNA, 20 nt, Homo sapiens
gggccaguccuccugggagc

SEQ ID NO: 1965050 - RNA, 18 nt, Homo sapiens
cacauacauauauacauu

SEQ ID NO: 1965051 - RNA, 20 nt, Homo sapiens
auugacaagcacgcacacac

SEQ ID NO: 1965052 - RNA, 17 nt, Homo sapiens
uggaaugcuucuucuca

SEQ ID NO: 1965053 - RNA, 18 nt, Homo sapiens
uugcuuaaaauagacucc

SEQ ID NO: 1965054 - RNA, 19 nt, Homo sapiens
gccacugugcccagcaguu

SEQ ID NO: 1965055 - RNA, 14 nt, Homo sapiens
uguuacuaaugauc

SEQ ID NO: 1965056 - RNA, 17 nt, Homo sapiens
cagguuccuccuaggcg

SEQ ID NO: 1965057 - RNA, 22 nt, Homo sapiens
ucacuuaaacuugcaucacuua

SEQ ID NO: 1965058 - RNA, 16 nt, Homo sapiens
auaaacagugagcaua

SEQ ID NO: 1965059 - RNA, 19 nt, Homo sapiens
aaauggaccauccuugaca

SEQ ID NO: 1965060 - RNA, 21 nt, Homo sapiens
uggcauccaagacucuuuaug

SEQ ID NO: 1965061 - RNA, 18 nt, Homo sapiens
gcaauagauuacugaugu

SEQ ID NO: 1965062 - RNA, 15 nt, Homo sapiens
aagaugucaaauauc

SEQ ID NO: 1965063 - RNA, 15 nt, Homo sapiens
agaauuuaaaccuau

SEQ ID NO: 1965064 - RNA, 16 nt, Homo sapiens
cagagcuccucacuua

SEQ ID NO: 1965065 - RNA, 13 nt, Homo sapiens
gcuucuuauauua

SEQ ID NO: 1965066 - RNA, 20 nt, Homo sapiens
uuccaucccaaccagugcca

SEQ ID NO: 1965067 - RNA, 13 nt, Homo sapiens
cgugcaugcacac

SEQ ID NO: 1965068 - RNA, 22 nt, Homo sapiens
uacacauccccagaauccauaa

SEQ ID NO: 1965069 - RNA, 19 nt, Homo sapiens
uuuccucugugcaaaggga

SEQ ID NO: 1965070 - RNA, 16 nt, Homo sapiens
ucaggcagaucucagc

SEQ ID NO: 1965071 - RNA, 20 nt, Homo sapiens
uugcauggaaaucagccaag

SEQ ID NO: 1965072 - RNA, 19 nt, Homo sapiens
gauauuugaagcaucacau

SEQ ID NO: 1965073 - RNA, 22 nt, Homo sapiens
caacaggauuacaguguagcua

SEQ ID NO: 1965074 - RNA, 19 nt, Homo sapiens
gaggcucacacugugcuca

SEQ ID NO: 1965075 - RNA, 20 nt, Homo sapiens
ugguggagagaagugagaau

SEQ ID NO: 1965076 - RNA, 14 nt, Homo sapiens
cagcccagugcaaa

SEQ ID NO: 1965077 - RNA, 14 nt, Homo sapiens
cagaaagcuuugaa

SEQ ID NO: 1965078 - RNA, 16 nt, Homo sapiens
uuuaucuuuauaugaa

SEQ ID NO: 1965079 - RNA, 18 nt, Homo sapiens
cccagucuccagggaccc

SEQ ID NO: 1965080 - RNA, 17 nt, Homo sapiens
aaaauagccacuuaccu

SEQ ID NO: 1965081 - RNA, 14 nt, Homo sapiens
ugagaauguacuaa

SEQ ID NO: 1965082 - RNA, 15 nt, Homo sapiens
guacaccccaccucu

SEQ ID NO: 1965083 - RNA, 14 nt, Homo sapiens
gcugccaccagccc

SEQ ID NO: 1965084 - RNA, 14 nt, Homo sapiens
auuugcaagacaua

SEQ ID NO: 1965085 - RNA, 13 nt, Homo sapiens
ggcagcuugcccc

SEQ ID NO: 1965086 - RNA, 15 nt, Homo sapiens
ccugggugccagucc

SEQ ID NO: 1965087 - RNA, 16 nt, Homo sapiens
auaggaaggucauuuc

SEQ ID NO: 1965088 - RNA, 17 nt, Homo sapiens
cuuaagcaacaauggau

SEQ ID NO: 1965089 - RNA, 13 nt, Homo sapiens
guauaugcugaug

SEQ ID NO: 1965090 - RNA, 22 nt, Homo sapiens
cagcucacggaagggaugcuag

SEQ ID NO: 1965091 - RNA, 16 nt, Homo sapiens
cuuuuuucuaguuuca

SEQ ID NO: 1965092 - RNA, 16 nt, Homo sapiens
uguccuccacacaagg

SEQ ID NO: 1965093 - RNA, 18 nt, Homo sapiens
cagcuaaaguaacagagc

SEQ ID NO: 1965094 - RNA, 23 nt, Homo sapiens
cugcagaucaagaaaucccugag

SEQ ID NO: 1965095 - RNA, 14 nt, Homo sapiens
gcacugacagagaa

SEQ ID NO: 1965096 - RNA, 22 nt, Homo sapiens
ucuggcuguguugucagcacug

SEQ ID NO: 1965097 - RNA, 21 nt, Homo sapiens
acuucauuuauccaucaauau

SEQ ID NO: 1965098 - RNA, 21 nt, Homo sapiens
gagccagcuuggggccaccaa

SEQ ID NO: 1965099 - RNA, 12 nt, Homo sapiens
uagaugugcauu

SEQ ID NO: 1965100 - RNA, 16 nt, Homo sapiens
ucccagacuacuucag

SEQ ID NO: 1965101 - RNA, 19 nt, Homo sapiens
ucuuugcucccugcaagaa

SEQ ID NO: 1965102 - RNA, 17 nt, Homo sapiens
ucccugaaaccuaguac

SEQ ID NO: 1965103 - RNA, 18 nt, Homo sapiens
acacaaaggaccucagcu

SEQ ID NO: 1965104 - RNA, 16 nt, Homo sapiens
uacuagucaaacaaaa

SEQ ID NO: 1965105 - RNA, 13 nt, Homo sapiens
aaaccugaccaca

SEQ ID NO: 1965106 - RNA, 19 nt, Homo sapiens
cuuaccagguucacuuaaa

SEQ ID NO: 1965107 - RNA, 18 nt, Homo sapiens
ggcugaggguaccuuuuu

SEQ ID NO: 1965108 - RNA, 18 nt, Homo sapiens
acugucucguacuagaau

SEQ ID NO: 1965109 - RNA, 17 nt, Homo sapiens
cugauaugggacugagc

SEQ ID NO: 1965110 - RNA, 17 nt, Homo sapiens
ugugcagggcacagaag

SEQ ID NO: 1965111 - RNA, 19 nt, Homo sapiens
uuucacauacacucaaaca

SEQ ID NO: 1965112 - RNA, 20 nt, Homo sapiens
uuaggguucugccucuccag

SEQ ID NO: 1965113 - RNA, 22 nt, Homo sapiens
cugccuguucugaggauucagg

SEQ ID NO: 1965114 - RNA, 20 nt, Homo sapiens
gcccucaggccauuccccaa

SEQ ID NO: 1965115 - RNA, 13 nt, Homo sapiens
uuaaacagcagau

SEQ ID NO: 1965116 - RNA, 18 nt, Homo sapiens
cuauagcacugagcucac

SEQ ID NO: 1965117 - RNA, 21 nt, Homo sapiens
cgggguuucaccauguuggcc

SEQ ID NO: 1965118 - RNA, 18 nt, Homo sapiens
ugagcaggguccacagcu

SEQ ID NO: 1965119 - RNA, 20 nt, Homo sapiens
gcuggcaccucagacaaucc

SEQ ID NO: 1965120 - RNA, 21 nt, Homo sapiens
cggggucuggcuguguugccc

SEQ ID NO: 1965121 - RNA, 23 nt, Homo sapiens
aggauggucccagcggaugcugc

SEQ ID NO: 1965122 - RNA, 19 nt, Homo sapiens
acauugaugcugacaguca

SEQ ID NO: 1965123 - RNA, 20 nt, Homo sapiens
uaagcaaccuuaaagcaaua

SEQ ID NO: 1965124 - RNA, 22 nt, Homo sapiens
augucuccucucccauucgcaa

SEQ ID NO: 1965125 - RNA, 13 nt, Homo sapiens
aaagaggcauuca

SEQ ID NO: 1965126 - RNA, 17 nt, Homo sapiens
aguaaaagcuacuaugu

SEQ ID NO: 1965127 - RNA, 12 nt, Homo sapiens
gaucugcuccau

SEQ ID NO: 1965128 - RNA, 12 nt, Homo sapiens
gcucugcucaau

SEQ ID NO: 1965129 - RNA, 13 nt, Homo sapiens
ccuggcucuguca

SEQ ID NO: 1965130 - RNA, 22 nt, Homo sapiens
accucccaggcucaagcugucc

SEQ ID NO: 1965131 - RNA, 15 nt, Homo sapiens
uacauuucccugugc

SEQ ID NO: 1965132 - RNA, 19 nt, Homo sapiens
ucaaaggcuuccaaugugg

SEQ ID NO: 1965133 - RNA, 13 nt, Homo sapiens
acugcgacuguga

SEQ ID NO: 1965134 - RNA, 16 nt, Homo sapiens
cggauccagcaauucc

SEQ ID NO: 1965135 - RNA, 15 nt, Homo sapiens
agagagccucagggc

SEQ ID NO: 1965136 - RNA, 11 nt, Homo sapiens
aaaaacuggaa

SEQ ID NO: 1965137 - RNA, 14 nt, Homo sapiens
auuaagaaugccag

SEQ ID NO: 1965138 - RNA, 17 nt, Homo sapiens
gacacgccuaaggucac

SEQ ID NO: 1965139 - RNA, 17 nt, Homo sapiens
auuuuguaaccuuccaa

SEQ ID NO: 1965140 - RNA, 17 nt, Homo sapiens
uuagucagaaaugauuc

SEQ ID NO: 1965141 - RNA, 21 nt, Homo sapiens
ccagauuguaguuauacuuuu

SEQ ID NO: 1965142 - RNA, 15 nt, Homo sapiens
gaauuauuacagugu

SEQ ID NO: 1965143 - RNA, 15 nt, Homo sapiens
gcuuuaguaaugugg

SEQ ID NO: 1965144 - RNA, 16 nt, Homo sapiens
agacaaauuguuaaga

SEQ ID NO: 1965145 - RNA, 16 nt, Homo sapiens
ugaugcucacauauga

SEQ ID NO: 1965146 - RNA, 14 nt, Homo sapiens
cuucaacccagugg

SEQ ID NO: 1965147 - RNA, 21 nt, Homo sapiens
uuuguacaucccaaaggauga

SEQ ID NO: 1965148 - RNA, 20 nt, Homo sapiens
cccuccuuucauuugcuaga

SEQ ID NO: 1965149 - RNA, 17 nt, Homo sapiens
aaugacaugcacugacc

SEQ ID NO: 1965150 - RNA, 17 nt, Homo sapiens
uauugcugaaugacuac

SEQ ID NO: 1965151 - RNA, 12 nt, Homo sapiens
ugcugugccuga

SEQ ID NO: 1965152 - RNA, 15 nt, Homo sapiens
ucagcccaucucaac

SEQ ID NO: 1965153 - RNA, 15 nt, Homo sapiens
cuggugggacagugg

SEQ ID NO: 1965154 - RNA, 13 nt, Homo sapiens
gaaaauucaggug

SEQ ID NO: 1965155 - RNA, 23 nt, Homo sapiens
uucuggauugugguuccaugcag

SEQ ID NO: 1965156 - RNA, 13 nt, Homo sapiens
ugaguauaaucaa

SEQ ID NO: 1965157 - RNA, 14 nt, Homo sapiens
gacaguaaacacuc

SEQ ID NO: 1965158 - RNA, 14 nt, Homo sapiens
ugcugcgcaccaau

SEQ ID NO: 1965159 - RNA, 13 nt, Homo sapiens
gagagcacagccc

SEQ ID NO: 1965160 - RNA, 13 nt, Homo sapiens
cucuccugccuca

SEQ ID NO: 1965161 - RNA, 17 nt, Homo sapiens
ugaaaugcucaagaaug

SEQ ID NO: 1965162 - RNA, 18 nt, Homo sapiens
ccuggagggcagagacaa

SEQ ID NO: 1965163 - RNA, 22 nt, Homo sapiens
caguuccugccuuaacugauga

SEQ ID NO: 1965164 - RNA, 13 nt, Homo sapiens
caaaaucuuuuca

SEQ ID NO: 1965165 - RNA, 22 nt, Homo sapiens
acagacgcugcugucacaacca

SEQ ID NO: 1965166 - RNA, 16 nt, Homo sapiens
gagacacauugccuuc

SEQ ID NO: 1965167 - RNA, 21 nt, Homo sapiens
gcccccaauaaaccaguguga

SEQ ID NO: 1965168 - RNA, 21 nt, Homo sapiens
aucacuugaggccaggacuuu

SEQ ID NO: 1965169 - RNA, 16 nt, Homo sapiens
augagaaagaugggca

SEQ ID NO: 1965170 - RNA, 12 nt, Homo sapiens
ucccugggaugg

SEQ ID NO: 1965171 - RNA, 19 nt, Homo sapiens
ggcugagccauugagugcu

SEQ ID NO: 1965172 - RNA, 18 nt, Homo sapiens
uucccguauugacaggaa

SEQ ID NO: 1965173 - RNA, 15 nt, Homo sapiens
aaauuaucacaucau

SEQ ID NO: 1965174 - RNA, 15 nt, Homo sapiens
caucccacccucuca

SEQ ID NO: 1965175 - RNA, 14 nt, Homo sapiens
cuucacgcuuucag

SEQ ID NO: 1965176 - RNA, 15 nt, Homo sapiens
acagaacaagccaca

SEQ ID NO: 1965177 - RNA, 20 nt, Homo sapiens
uauuucagcugcuuugacaa

SEQ ID NO: 1965178 - RNA, 18 nt, Homo sapiens
agguuaucaaccauauga

SEQ ID NO: 1965179 - RNA, 20 nt, Homo sapiens
ccucauugcauuuauugcag

SEQ ID NO: 1965180 - RNA, 13 nt, Homo sapiens
gggacagccugca

SEQ ID NO: 1965181 - RNA, 14 nt, Homo sapiens
ucuaaagagaguga

SEQ ID NO: 1965182 - RNA, 17 nt, Homo sapiens
aauguuaucauagaauu

SEQ ID NO: 1965183 - RNA, 21 nt, Homo sapiens
aagccacugggcacugggcug

SEQ ID NO: 1965184 - RNA, 14 nt, Homo sapiens
caguagaugccacc

SEQ ID NO: 1965185 - RNA, 15 nt, Homo sapiens
cauauaacaugcaaa

SEQ ID NO: 1965186 - RNA, 17 nt, Homo sapiens
uccgagugggauuuucu

SEQ ID NO: 1965187 - RNA, 15 nt, Homo sapiens
uuuguacauaucaaa

SEQ ID NO: 1965188 - RNA, 21 nt, Homo sapiens
auauuuaugagaaaguucuca

SEQ ID NO: 1965189 - RNA, 21 nt, Homo sapiens
uccagugacauuggaacaugc

SEQ ID NO: 1965190 - RNA, 14 nt, Homo sapiens
ugguuuuuccucau

SEQ ID NO: 1965191 - RNA, 14 nt, Homo sapiens
augcucucuggucu

SEQ ID NO: 1965192 - RNA, 20 nt, Homo sapiens
gggcuaguuaauccaaacau

SEQ ID NO: 1965193 - RNA, 15 nt, Homo sapiens
auuuggggugaauga

SEQ ID NO: 1965194 - RNA, 17 nt, Homo sapiens
auuucugguucugaugc

SEQ ID NO: 1965195 - RNA, 22 nt, Homo sapiens
gugcacauuucuuugcauucca

SEQ ID NO: 1965196 - RNA, 13 nt, Homo sapiens
aaacaccaaaaau

SEQ ID NO: 1965197 - RNA, 14 nt, Homo sapiens
auguauacugccac

SEQ ID NO: 1965198 - RNA, 21 nt, Homo sapiens
aaacaugaugaguugagcucu

SEQ ID NO: 1965199 - RNA, 12 nt, Homo sapiens
ucuucagcauuu

SEQ ID NO: 1965200 - RNA, 20 nt, Homo sapiens
uacuagacuagacaucacaa

SEQ ID NO: 1965201 - RNA, 12 nt, Homo sapiens
ggcuuccuccuc

SEQ ID NO: 1965202 - RNA, 16 nt, Homo sapiens
uauauaugugugugua

SEQ ID NO: 1965203 - RNA, 16 nt, Homo sapiens
ucuccucugauuauca

SEQ ID NO: 1965204 - RNA, 14 nt, Homo sapiens
cugauggaccagga

SEQ ID NO: 1965205 - RNA, 20 nt, Homo sapiens
gcaugcaccuguagucucac

SEQ ID NO: 1965206 - RNA, 23 nt, Homo sapiens
ugucugguguuugucauggugaa

SEQ ID NO: 1965207 - RNA, 23 nt, Homo sapiens
gaaugacguguccuacagccuca

SEQ ID NO: 1965208 - RNA, 20 nt, Homo sapiens
agcuaugcaaaucagucuca

SEQ ID NO: 1965209 - RNA, 20 nt, Homo sapiens
cugaugauccagaacagugg

SEQ ID NO: 1965210 - RNA, 11 nt, Homo sapiens
cucagugucca

SEQ ID NO: 1965211 - RNA, 17 nt, Homo sapiens
agauagcucaauacucu

SEQ ID NO: 1965212 - RNA, 18 nt, Homo sapiens
gcacaguugccacauuua

SEQ ID NO: 1965213 - RNA, 21 nt, Homo sapiens
gauggaugucuucuagcugca

SEQ ID NO: 1965214 - RNA, 23 nt, Homo sapiens
ucuccccuuccuccucugcucuu

SEQ ID NO: 1965215 - RNA, 18 nt, Homo sapiens
acacgcauacacacauau

SEQ ID NO: 1965216 - RNA, 18 nt, Homo sapiens
auuggcaaagugacaaag

SEQ ID NO: 1965217 - RNA, 19 nt, Homo sapiens
uggccuaaaaaugcaacuu

SEQ ID NO: 1965218 - RNA, 19 nt, Homo sapiens
cacauuugcguguaucuaa

SEQ ID NO: 1965219 - RNA, 18 nt, Homo sapiens
augaucaugccacugcac

SEQ ID NO: 1965220 - RNA, 16 nt, Homo sapiens
acacugugggacucuu

SEQ ID NO: 1965221 - RNA, 17 nt, Homo sapiens
ggaauauacgugcuugg

SEQ ID NO: 1965222 - RNA, 23 nt, Homo sapiens
cggccaggcugggcucugggauu

SEQ ID NO: 1965223 - RNA, 19 nt, Homo sapiens
gcccugcaagacacaggcu

SEQ ID NO: 1965224 - RNA, 15 nt, Homo sapiens
aaugucuuuaaugca

SEQ ID NO: 1965225 - RNA, 18 nt, Homo sapiens
ucauguaaaaagugcagu

SEQ ID NO: 1965226 - RNA, 18 nt, Homo sapiens
cuguguguacaccagcag

SEQ ID NO: 1965227 - RNA, 19 nt, Homo sapiens
ugaguaacacccccaucac

SEQ ID NO: 1965228 - RNA, 16 nt, Homo sapiens
ccccucguuagccuuc

SEQ ID NO: 1965229 - RNA, 23 nt, Homo sapiens
accaugcugcuggggaagacagu

SEQ ID NO: 1965230 - RNA, 14 nt, Homo sapiens
uacacugcauuugc

SEQ ID NO: 1965231 - RNA, 17 nt, Homo sapiens
gaugugauuaaagcuaa

SEQ ID NO: 1965232 - RNA, 21 nt, Homo sapiens
cacagacccacacauguuuac

SEQ ID NO: 1965233 - RNA, 23 nt, Homo sapiens
augggguucuggaaauccagaua

SEQ ID NO: 1965234 - RNA, 23 nt, Homo sapiens
accagugugcuugcccaccacag

SEQ ID NO: 1965235 - RNA, 20 nt, Homo sapiens
ucugguuacuaauuagcuuc

SEQ ID NO: 1965236 - RNA, 14 nt, Homo sapiens
uguauacaugccag

SEQ ID NO: 1965237 - RNA, 12 nt, Homo sapiens
uuacacauagca

SEQ ID NO: 1965238 - RNA, 17 nt, Homo sapiens
cuggaagccugccgaaa

SEQ ID NO: 1965239 - RNA, 18 nt, Homo sapiens
guaucuguaacccuugaa

SEQ ID NO: 1965240 - RNA, 23 nt, Homo sapiens
cacaucauggcagugggaccaag

SEQ ID NO: 1965241 - RNA, 18 nt, Homo sapiens
gaaaauagagcaauacuu

SEQ ID NO: 1965242 - RNA, 18 nt, Homo sapiens
guaacuccuccauccaug

SEQ ID NO: 1965243 - RNA, 16 nt, Homo sapiens
uuucauauaucuauau

SEQ ID NO: 1965244 - RNA, 15 nt, Homo sapiens
gccucagugacccau

SEQ ID NO: 1965245 - RNA, 16 nt, Homo sapiens
caguuccaauacuuca

SEQ ID NO: 1965246 - RNA, 17 nt, Homo sapiens
uccuccagggacagcaa

SEQ ID NO: 1965247 - RNA, 20 nt, Homo sapiens
cugccugccgcugcaccugc

SEQ ID NO: 1965248 - RNA, 13 nt, Homo sapiens
ccuugcacaccca

SEQ ID NO: 1965249 - RNA, 13 nt, Homo sapiens
cccugcacacuca

SEQ ID NO: 1965250 - RNA, 23 nt, Homo sapiens
uuuucuuuuuuaaagacaggguc

SEQ ID NO: 1965251 - RNA, 12 nt, Homo sapiens
ucacccaugaaa

SEQ ID NO: 1965252 - RNA, 21 nt, Homo sapiens
aaaugucucaauggugcuaua

SEQ ID NO: 1965253 - RNA, 12 nt, Homo sapiens
aauuaaagcaaa

SEQ ID NO: 1965254 - RNA, 13 nt, Homo sapiens
auuugaaauccaa

SEQ ID NO: 1965255 - RNA, 21 nt, Homo sapiens
aaacuucaccuacauuaucuc

SEQ ID NO: 1965256 - RNA, 20 nt, Homo sapiens
uccacuaugagcugcuggca

SEQ ID NO: 1965257 - RNA, 21 nt, Homo sapiens
aggagaugaccagugccuugg

SEQ ID NO: 1965258 - RNA, 19 nt, Homo sapiens
ugaaccugggaaccaugaa

SEQ ID NO: 1965259 - RNA, 19 nt, Homo sapiens
ucugggugaaagggauacu

SEQ ID NO: 1965260 - RNA, 17 nt, Homo sapiens
acuugaugccacccaga

SEQ ID NO: 1965261 - RNA, 14 nt, Homo sapiens
uuuaaggugcuaaa

SEQ ID NO: 1965262 - RNA, 18 nt, Homo sapiens
caccucaagacccccauu

SEQ ID NO: 1965263 - RNA, 22 nt, Homo sapiens
auguacuuugauuuacagugcc

SEQ ID NO: 1965264 - RNA, 23 nt, Homo sapiens
uacauauagcugauaaagccuaa

SEQ ID NO: 1965265 - RNA, 16 nt, Homo sapiens
cuggaaccugcaaaaa

SEQ ID NO: 1965266 - RNA, 13 nt, Homo sapiens
aacaagacagacu

SEQ ID NO: 1965267 - RNA, 23 nt, Homo sapiens
uuaugcuccaucccauucacuuc

SEQ ID NO: 1965268 - RNA, 19 nt, Homo sapiens
cuggcuucaaaaagccaca

SEQ ID NO: 1965269 - RNA, 15 nt, Homo sapiens
cugcuugcugcucau

SEQ ID NO: 1965270 - RNA, 15 nt, Homo sapiens
aaauaaaucaucuuu

SEQ ID NO: 1965271 - RNA, 19 nt, Homo sapiens
augauucaagccauuccaa

SEQ ID NO: 1965272 - RNA, 20 nt, Homo sapiens
cgcucuuggggacauggguc

SEQ ID NO: 1965273 - RNA, 23 nt, Homo sapiens
ugcacagucacuggcccaaccag

SEQ ID NO: 1965274 - RNA, 18 nt, Homo sapiens
cccaggaggaaaagccca

SEQ ID NO: 1965275 - RNA, 19 nt, Homo sapiens
ggaauggccugugccauaa

SEQ ID NO: 1965276 - RNA, 23 nt, Homo sapiens
gccugauggugcucacgacucuu

SEQ ID NO: 1965277 - RNA, 15 nt, Homo sapiens
gugaaucagucccau

SEQ ID NO: 1965278 - RNA, 20 nt, Homo sapiens
gacuggaguucaguggugca

SEQ ID NO: 1965279 - RNA, 15 nt, Homo sapiens
ugaauaaaaacccug

SEQ ID NO: 1965280 - RNA, 14 nt, Homo sapiens
aacucuuccuccaa

SEQ ID NO: 1965281 - RNA, 20 nt, Homo sapiens
ucagaaacaggugcaucugg

SEQ ID NO: 1965282 - RNA, 17 nt, Homo sapiens
gccuguaauuccagcca

SEQ ID NO: 1965283 - RNA, 12 nt, Homo sapiens
aaugucaucaaa

SEQ ID NO: 1965284 - RNA, 21 nt, Homo sapiens
uggggauacuggcaaagcaga

SEQ ID NO: 1965285 - RNA, 14 nt, Homo sapiens
cucugacaacagac

SEQ ID NO: 1965286 - RNA, 22 nt, Homo sapiens
uacugaugugugcaaccuuuua

SEQ ID NO: 1965287 - RNA, 19 nt, Homo sapiens
uaaaauguuauugccuaau

SEQ ID NO: 1965288 - RNA, 18 nt, Homo sapiens
auuucagauaaacaacaa

SEQ ID NO: 1965289 - RNA, 13 nt, Homo sapiens
cggagcaucucag

SEQ ID NO: 1965290 - RNA, 18 nt, Homo sapiens
ggcuuuaaacaugauuau

SEQ ID NO: 1965291 - RNA, 19 nt, Homo sapiens
ucagagaaaggacugugga

SEQ ID NO: 1965292 - RNA, 18 nt, Homo sapiens
uaagccaagagucauguc

SEQ ID NO: 1965293 - RNA, 14 nt, Homo sapiens
auauccugugacug

SEQ ID NO: 1965294 - RNA, 16 nt, Homo sapiens
cugcccaggcaaggaa

SEQ ID NO: 1965295 - RNA, 16 nt, Homo sapiens
uuaucaugcauguuau

SEQ ID NO: 1965296 - RNA, 14 nt, Homo sapiens
ggugacagagcaag

SEQ ID NO: 1965297 - RNA, 21 nt, Homo sapiens
aucacuaucuuucugauaaca

SEQ ID NO: 1965298 - RNA, 14 nt, Homo sapiens
uguauuaguaauaa

SEQ ID NO: 1965299 - RNA, 19 nt, Homo sapiens
ucacaaccguacaguuucu

SEQ ID NO: 1965300 - RNA, 22 nt, Homo sapiens
uaucacucaauuucucugagga

SEQ ID NO: 1965301 - RNA, 14 nt, Homo sapiens
gccacccucugcag

SEQ ID NO: 1965302 - RNA, 17 nt, Homo sapiens
uacuagcaacaaacaau

SEQ ID NO: 1965303 - RNA, 23 nt, Homo sapiens
aaauguguauuuuucaaggcauu

SEQ ID NO: 1965304 - RNA, 21 nt, Homo sapiens
uaaauugcaguuuacaguauu

SEQ ID NO: 1965305 - RNA, 17 nt, Homo sapiens
guggauacagucauuau

SEQ ID NO: 1965306 - RNA, 20 nt, Homo sapiens
uccaggaugaguuacuugaa

SEQ ID NO: 1965307 - RNA, 19 nt, Homo sapiens
aaauuauugcuguauguaa

SEQ ID NO: 1965308 - RNA, 13 nt, Homo sapiens
cugcaguccagua

SEQ ID NO: 1965309 - RNA, 14 nt, Homo sapiens
cucccuggcuguga

SEQ ID NO: 1965310 - RNA, 18 nt, Homo sapiens
uccaacugcaacucauca

SEQ ID NO: 1965311 - RNA, 19 nt, Homo sapiens
ccauucacuucauaaucca

SEQ ID NO: 1965312 - RNA, 18 nt, Homo sapiens
cuaccugagucccaaagc

SEQ ID NO: 1965313 - RNA, 18 nt, Homo sapiens
acuguucgaguagcucag

SEQ ID NO: 1965314 - RNA, 20 nt, Homo sapiens
ccucugggcagccugcuuug

SEQ ID NO: 1965315 - RNA, 14 nt, Homo sapiens
cucaaaacuuucaa

SEQ ID NO: 1965316 - RNA, 15 nt, Homo sapiens
uccagucuacuugag

SEQ ID NO: 1965317 - RNA, 16 nt, Homo sapiens
augccaggaaccuguc

SEQ ID NO: 1965318 - RNA, 20 nt, Homo sapiens
ucuuauguauuuuggucaua

SEQ ID NO: 1965319 - RNA, 18 nt, Homo sapiens
uguaaacauuucuuucaa

SEQ ID NO: 1965320 - RNA, 14 nt, Homo sapiens
uuucaaaaugauag

SEQ ID NO: 1965321 - RNA, 14 nt, Homo sapiens
uuuauugcaugaga

SEQ ID NO: 1965322 - RNA, 18 nt, Homo sapiens
auccaugcaccuaccuua

SEQ ID NO: 1965323 - RNA, 16 nt, Homo sapiens
auaguccagacacuua

SEQ ID NO: 1965324 - RNA, 22 nt, Homo sapiens
uccugagacaaauuuuaacuuc

SEQ ID NO: 1965325 - RNA, 16 nt, Homo sapiens
uauguauauacauuua

SEQ ID NO: 1965326 - RNA, 15 nt, Homo sapiens
ucaugugguacuuga

SEQ ID NO: 1965327 - RNA, 14 nt, Homo sapiens
auugcucucagugc

SEQ ID NO: 1965328 - RNA, 19 nt, Homo sapiens
caaaaucacuggauuauaa

SEQ ID NO: 1965329 - RNA, 17 nt, Homo sapiens
uaaguugcuaaccucaa

SEQ ID NO: 1965330 - RNA, 17 nt, Homo sapiens
ggacaacgaacauggca

SEQ ID NO: 1965331 - RNA, 13 nt, Homo sapiens
caaggugugaaug

SEQ ID NO: 1965332 - RNA, 14 nt, Homo sapiens
cugucugcucuuau

SEQ ID NO: 1965333 - RNA, 14 nt, Homo sapiens
uucgcccugugcac

SEQ ID NO: 1965334 - RNA, 14 nt, Homo sapiens
accuuucucugaga

SEQ ID NO: 1965335 - RNA, 15 nt, Homo sapiens
gaugacugcugugaa

SEQ ID NO: 1965336 - RNA, 21 nt, Homo sapiens
cccagcaggugcugacuucau

SEQ ID NO: 1965337 - RNA, 17 nt, Homo sapiens
aauaaucauucuggaua

SEQ ID NO: 1965338 - RNA, 18 nt, Homo sapiens
ugcccauuuaaugugguu

SEQ ID NO: 1965339 - RNA, 12 nt, Homo sapiens
auccugccaacu

SEQ ID NO: 1965340 - RNA, 21 nt, Homo sapiens
aaaaauaaacucugcacuuau

SEQ ID NO: 1965341 - RNA, 14 nt, Homo sapiens
ugaaaacaauguaa

SEQ ID NO: 1965342 - RNA, 16 nt, Homo sapiens
cuggcguucucaagaa

SEQ ID NO: 1965343 - RNA, 21 nt, Homo sapiens
uucuucagauacaaacugcag

SEQ ID NO: 1965344 - RNA, 18 nt, Homo sapiens
cucucugccauucugugc

SEQ ID NO: 1965345 - RNA, 15 nt, Homo sapiens
ucauguaacacuguu

SEQ ID NO: 1965346 - RNA, 18 nt, Homo sapiens
gguagauauucaggaaau

SEQ ID NO: 1965347 - RNA, 14 nt, Homo sapiens
agugcacagcuguc

SEQ ID NO: 1965348 - RNA, 15 nt, Homo sapiens
guuuccaaucugucc

SEQ ID NO: 1965349 - RNA, 18 nt, Homo sapiens
aguuggagugagaugaag

SEQ ID NO: 1965350 - RNA, 16 nt, Homo sapiens
aguacaggucaucugc

SEQ ID NO: 1965351 - RNA, 19 nt, Homo sapiens
aauaccccuguuaagcaau

SEQ ID NO: 1965352 - RNA, 12 nt, Homo sapiens
uuccucaggcaa

SEQ ID NO: 1965353 - RNA, 23 nt, Homo sapiens
ggauuuuguauaugcauagucau

SEQ ID NO: 1965354 - RNA, 18 nt, Homo sapiens
ugaaauuuccuaauuuau

SEQ ID NO: 1965355 - RNA, 14 nt, Homo sapiens
aaugcauuccagaa

SEQ ID NO: 1965356 - RNA, 22 nt, Homo sapiens
gcaagaaagccguacugucuau

SEQ ID NO: 1965357 - RNA, 14 nt, Homo sapiens
ucccgaguaccagu

SEQ ID NO: 1965358 - RNA, 14 nt, Homo sapiens
auuaauguuuucaa

SEQ ID NO: 1965359 - RNA, 14 nt, Homo sapiens
acagcccucagcgu

SEQ ID NO: 1965360 - RNA, 17 nt, Homo sapiens
ucuccuuaaaugcuucu

SEQ ID NO: 1965361 - RNA, 18 nt, Homo sapiens
cugauacugggucugcga

SEQ ID NO: 1965362 - RNA, 20 nt, Homo sapiens
uggacacagaucccacugga

SEQ ID NO: 1965363 - RNA, 13 nt, Homo sapiens
uuuuuauaauuca

SEQ ID NO: 1965364 - RNA, 22 nt, Homo sapiens
ggggaauaaacuccagccucuc

SEQ ID NO: 1965365 - RNA, 16 nt, Homo sapiens
gacccuguccggccca

SEQ ID NO: 1965366 - RNA, 16 nt, Homo sapiens
ccaccagaaauuccag

SEQ ID NO: 1965367 - RNA, 17 nt, Homo sapiens
ugugagaacuuuucaua

SEQ ID NO: 1965368 - RNA, 13 nt, Homo sapiens
gagcacugaacca

SEQ ID NO: 1965369 - RNA, 20 nt, Homo sapiens
caaagugguucccucucuua

SEQ ID NO: 1965370 - RNA, 20 nt, Homo sapiens
caggcuggagugcaaugaca

SEQ ID NO: 1965371 - RNA, 16 nt, Homo sapiens
uucuuuagaugccaaa

SEQ ID NO: 1965372 - RNA, 20 nt, Homo sapiens
gccagcacuaguaaaggagg

SEQ ID NO: 1965373 - RNA, 22 nt, Homo sapiens
agcagucacacuguuacuccac

SEQ ID NO: 1965374 - RNA, 19 nt, Homo sapiens
acucaacccauuguuguca

SEQ ID NO: 1965375 - RNA, 21 nt, Homo sapiens
ccacccuagccaaugucuccu

SEQ ID NO: 1965376 - RNA, 22 nt, Homo sapiens
uuucucccccuuuccaaaaacu

SEQ ID NO: 1965377 - RNA, 23 nt, Homo sapiens
gaccccuucggcagcuacucaga

SEQ ID NO: 1965378 - RNA, 13 nt, Homo sapiens
ccuuguguuccuu

SEQ ID NO: 1965379 - RNA, 13 nt, Homo sapiens
cacgcagggccau

SEQ ID NO: 1965380 - RNA, 18 nt, Homo sapiens
cuccagcccacagugcuc

SEQ ID NO: 1965381 - RNA, 13 nt, Homo sapiens
ugauugugauuau

SEQ ID NO: 1965382 - RNA, 14 nt, Homo sapiens
aaggaugucugcca

SEQ ID NO: 1965383 - RNA, 14 nt, Homo sapiens
auguaccagcagcu

SEQ ID NO: 1965384 - RNA, 15 nt, Homo sapiens
gggucucacucucug

SEQ ID NO: 1965385 - RNA, 15 nt, Homo sapiens
acauguguaccucag

SEQ ID NO: 1965386 - RNA, 18 nt, Homo sapiens
gaaaaauguaaauacuca

SEQ ID NO: 1965387 - RNA, 12 nt, Homo sapiens
ugagaacaacca

SEQ ID NO: 1965388 - RNA, 23 nt, Homo sapiens
caauucugaaggggaaaaccuca

SEQ ID NO: 1965389 - RNA, 20 nt, Homo sapiens
accucacuggccugccaugc

SEQ ID NO: 1965390 - RNA, 21 nt, Homo sapiens
aggcagggaaggaucccauga

SEQ ID NO: 1965391 - RNA, 14 nt, Homo sapiens
acuuagauauuuca

SEQ ID NO: 1965392 - RNA, 21 nt, Homo sapiens
cucuuaggcuaagagauguga

SEQ ID NO: 1965393 - RNA, 17 nt, Homo sapiens
acugcuggggagacaaa

SEQ ID NO: 1965394 - RNA, 18 nt, Homo sapiens
aacugauucacaucucau

SEQ ID NO: 1965395 - RNA, 18 nt, Homo sapiens
gagcuccaaauugaauca

SEQ ID NO: 1965396 - RNA, 23 nt, Homo sapiens
augaaagguacuauauuugcuag

SEQ ID NO: 1965397 - RNA, 14 nt, Homo sapiens
ggcccugcaggguc

SEQ ID NO: 1965398 - RNA, 18 nt, Homo sapiens
caggugauccgccuaccu

SEQ ID NO: 1965399 - RNA, 13 nt, Homo sapiens
agguuagaaugau

SEQ ID NO: 1965400 - RNA, 13 nt, Homo sapiens
gcaguccuacuca

SEQ ID NO: 1965401 - RNA, 18 nt, Homo sapiens
gaguuaucuucuuuauua

SEQ ID NO: 1965402 - RNA, 21 nt, Homo sapiens
acuucuccaaggagcauguca

SEQ ID NO: 1965403 - RNA, 17 nt, Homo sapiens
ccuuacacauagauaua

SEQ ID NO: 1965404 - RNA, 16 nt, Homo sapiens
ugcaauaugaauucaa

SEQ ID NO: 1965405 - RNA, 22 nt, Homo sapiens
aggugcuuaagcagaagcauua

SEQ ID NO: 1965406 - RNA, 20 nt, Homo sapiens
ucuggacuggaaagcacaag

SEQ ID NO: 1965407 - RNA, 10 nt, Homo sapiens
caguauuuaa

SEQ ID NO: 1965408 - RNA, 18 nt, Homo sapiens
gaugcaaccaaaagggaa

SEQ ID NO: 1965409 - RNA, 16 nt, Homo sapiens
gugaaguuuugcaaau

SEQ ID NO: 1965410 - RNA, 23 nt, Homo sapiens
cagaagcagguucuugaugucau

SEQ ID NO: 1965411 - RNA, 17 nt, Homo sapiens
ccacccacgagcacuuu

SEQ ID NO: 1965412 - RNA, 17 nt, Homo sapiens
auuagucugucacucca

SEQ ID NO: 1965413 - RNA, 15 nt, Homo sapiens
cuaaagauguuuuaa

SEQ ID NO: 1965414 - RNA, 14 nt, Homo sapiens
gcaguuaacaucug

SEQ ID NO: 1965415 - RNA, 20 nt, Homo sapiens
ugaagggggaacaagucaaa

SEQ ID NO: 1965416 - RNA, 16 nt, Homo sapiens
aaauaauuuuucacuu

SEQ ID NO: 1965417 - RNA, 16 nt, Homo sapiens
caaaugagagugguua

SEQ ID NO: 1965418 - RNA, 19 nt, Homo sapiens
gacagccugggcacccgcg

SEQ ID NO: 1965419 - RNA, 18 nt, Homo sapiens
uuaacauugcaucaugaa

SEQ ID NO: 1965420 - RNA, 23 nt, Homo sapiens
acuacuaugugcaggaacccuug

SEQ ID NO: 1965421 - RNA, 13 nt, Homo sapiens
gacauugucagaa

SEQ ID NO: 1965422 - RNA, 14 nt, Homo sapiens
uuaccuucacuuaa

SEQ ID NO: 1965423 - RNA, 18 nt, Homo sapiens
ugucgggcccuucuugcu

SEQ ID NO: 1965424 - RNA, 12 nt, Homo sapiens
gaaccucagggc

SEQ ID NO: 1965425 - RNA, 19 nt, Homo sapiens
agugauagagugcagugau

SEQ ID NO: 1965426 - RNA, 22 nt, Homo sapiens
ucugcaacauuugacaaaacua

SEQ ID NO: 1965427 - RNA, 15 nt, Homo sapiens
ggccugagugaccuc

SEQ ID NO: 1965428 - RNA, 21 nt, Homo sapiens
cugcauugccugcggucaagg

SEQ ID NO: 1965429 - RNA, 12 nt, Homo sapiens
agaaucaauaaa

SEQ ID NO: 1965430 - RNA, 21 nt, Homo sapiens
uugaacucuuugaaugacaaa

SEQ ID NO: 1965431 - RNA, 21 nt, Homo sapiens
ucccucaaagcacacgucaug

SEQ ID NO: 1965432 - RNA, 18 nt, Homo sapiens
uucaagguaacuguacug

SEQ ID NO: 1965433 - RNA, 15 nt, Homo sapiens
cucugagaucuaagg

SEQ ID NO: 1965434 - RNA, 15 nt, Homo sapiens
ugugcagcuuuccag

SEQ ID NO: 1965435 - RNA, 13 nt, Homo sapiens
gauagaaccugga

SEQ ID NO: 1965436 - RNA, 15 nt, Homo sapiens
aaaucccagccaggg

SEQ ID NO: 1965437 - RNA, 20 nt, Homo sapiens
cacugaggcagguucgugcc

SEQ ID NO: 1965438 - RNA, 20 nt, Homo sapiens
uauuuacggaggcguuguga

SEQ ID NO: 1965439 - RNA, 13 nt, Homo sapiens
uuaacauguauuc

SEQ ID NO: 1965440 - RNA, 19 nt, Homo sapiens
aagauucuguaagaauuaa

SEQ ID NO: 1965441 - RNA, 22 nt, Homo sapiens
ggguucaagcaauugucugccu

SEQ ID NO: 1965442 - RNA, 12 nt, Homo sapiens
auauuagcuuua

SEQ ID NO: 1965443 - RNA, 20 nt, Homo sapiens
gaaguauuuuccuccaggca

SEQ ID NO: 1965444 - RNA, 14 nt, Homo sapiens
ccccacacagggca

SEQ ID NO: 1965445 - RNA, 21 nt, Homo sapiens
ucagaauaaggcaggcauuga

SEQ ID NO: 1965446 - RNA, 15 nt, Homo sapiens
ggaaaaugugcaaua

SEQ ID NO: 1965447 - RNA, 11 nt, Homo sapiens
agcggggagcc

SEQ ID NO: 1965448 - RNA, 23 nt, Homo sapiens
uccaaggaggucgggauggggcu

SEQ ID NO: 1965449 - RNA, 15 nt, Homo sapiens
gccaaggacacugau

SEQ ID NO: 1965450 - RNA, 15 nt, Homo sapiens
gccaaguacacugag

SEQ ID NO: 1965451 - RNA, 17 nt, Homo sapiens
cuugcccccucaucuca

SEQ ID NO: 1965452 - RNA, 23 nt, Homo sapiens
uguucugaauaauuucuuacuaa

SEQ ID NO: 1965453 - RNA, 13 nt, Homo sapiens
agcaauaccaguu

SEQ ID NO: 1965454 - RNA, 14 nt, Homo sapiens
cuggcaacaucuuu

SEQ ID NO: 1965455 - RNA, 17 nt, Homo sapiens
uuagcaacaacaugcua

SEQ ID NO: 1965456 - RNA, 19 nt, Homo sapiens
gaaaagcuaccaucacuuc

SEQ ID NO: 1965457 - RNA, 17 nt, Homo sapiens
uccaccagccugcugac

SEQ ID NO: 1965458 - RNA, 14 nt, Homo sapiens
agguuuguccacau

SEQ ID NO: 1965459 - RNA, 15 nt, Homo sapiens
cacgucacacagggg

SEQ ID NO: 1965460 - RNA, 19 nt, Homo sapiens
gccaauaggugccuaguaa

SEQ ID NO: 1965461 - RNA, 20 nt, Homo sapiens
caaccuccccggcucaagug

SEQ ID NO: 1965462 - RNA, 14 nt, Homo sapiens
ugacucugacucau

SEQ ID NO: 1965463 - RNA, 15 nt, Homo sapiens
gauggauggacacaa

SEQ ID NO: 1965464 - RNA, 21 nt, Homo sapiens
uggcugaaagguuaauucucu

SEQ ID NO: 1965465 - RNA, 17 nt, Homo sapiens
gguacaaaaaauucagu

SEQ ID NO: 1965466 - RNA, 14 nt, Homo sapiens
uacaggugcgaaug

SEQ ID NO: 1965467 - RNA, 17 nt, Homo sapiens
accucagggcacaaaga

SEQ ID NO: 1965468 - RNA, 20 nt, Homo sapiens
ucucgaacuccuggacucaa

SEQ ID NO: 1965469 - RNA, 23 nt, Homo sapiens
ggauuguuuaaagaagcucucca

SEQ ID NO: 1965470 - RNA, 11 nt, Homo sapiens
auaauuugcac

SEQ ID NO: 1965471 - RNA, 19 nt, Homo sapiens
cuuggucuguguucucaac

SEQ ID NO: 1965472 - RNA, 16 nt, Homo sapiens
cagagcagagucugaa

SEQ ID NO: 1965473 - RNA, 20 nt, Homo sapiens
gggcugcccaccuggcugcc

SEQ ID NO: 1965474 - RNA, 14 nt, Homo sapiens
gccuaggaccucag

SEQ ID NO: 1965475 - RNA, 21 nt, Homo sapiens
agaaaacagcccccacuccag

SEQ ID NO: 1965476 - RNA, 15 nt, Homo sapiens
gcauaaccgcacaga

SEQ ID NO: 1965477 - RNA, 22 nt, Homo sapiens
gaccuuuguagccacuucacuu

SEQ ID NO: 1965478 - RNA, 20 nt, Homo sapiens
cuccagauaguguagcugag

SEQ ID NO: 1965479 - RNA, 13 nt, Homo sapiens
gaaagagccugaa

SEQ ID NO: 1965480 - RNA, 17 nt, Homo sapiens
caguaaaagaugaaguu

SEQ ID NO: 1965481 - RNA, 14 nt, Homo sapiens
uauggugcaaaaau

SEQ ID NO: 1965482 - RNA, 20 nt, Homo sapiens
ugcgcccagcuauacuguau

SEQ ID NO: 1965483 - RNA, 21 nt, Homo sapiens
ucugucuucagcuguacauac

SEQ ID NO: 1965484 - RNA, 13 nt, Homo sapiens
cugggccaccagc

SEQ ID NO: 1965485 - RNA, 13 nt, Homo sapiens
cugccccaccacg

SEQ ID NO: 1965486 - RNA, 13 nt, Homo sapiens
ccagcccacuggg

SEQ ID NO: 1965487 - RNA, 14 nt, Homo sapiens
gacgcaccaguuac

SEQ ID NO: 1965488 - RNA, 20 nt, Homo sapiens
uguggagcagccaacaagca

SEQ ID NO: 1965489 - RNA, 20 nt, Homo sapiens
aaauacuguacauagaugua

SEQ ID NO: 1965490 - RNA, 21 nt, Homo sapiens
gaaugaccugacuuuuagcca

SEQ ID NO: 1965491 - RNA, 21 nt, Homo sapiens
cgccuaugaucccagcacuuu

SEQ ID NO: 1965492 - RNA, 14 nt, Homo sapiens
ugaggguuagcaag

SEQ ID NO: 1965493 - RNA, 16 nt, Homo sapiens
ugucccucacuguuga

SEQ ID NO: 1965494 - RNA, 16 nt, Homo sapiens
cugaugcuuuggugug

SEQ ID NO: 1965495 - RNA, 14 nt, Homo sapiens
aacucaucuguuau

SEQ ID NO: 1965496 - RNA, 15 nt, Homo sapiens
caagacaaaaagcca

SEQ ID NO: 1965497 - RNA, 23 nt, Homo sapiens
uaaguugcugggauuacaggugu

SEQ ID NO: 1965498 - RNA, 20 nt, Homo sapiens
ucuguacguauauaaauaua

SEQ ID NO: 1965499 - RNA, 18 nt, Homo sapiens
cauuguugucuucacuua

SEQ ID NO: 1965500 - RNA, 23 nt, Homo sapiens
ccuucaagggcaaggagaggcca

SEQ ID NO: 1965501 - RNA, 19 nt, Homo sapiens
uugaagaccccacugccac

SEQ ID NO: 1965502 - RNA, 20 nt, Homo sapiens
uagcaaacuuuguaugucau

SEQ ID NO: 1965503 - RNA, 23 nt, Homo sapiens
aacucaccuuauucuucauuucg

SEQ ID NO: 1965504 - RNA, 12 nt, Homo sapiens
uuccaccagagc

SEQ ID NO: 1965505 - RNA, 21 nt, Homo sapiens
ugcagcaaacacuccacccuc

SEQ ID NO: 1965506 - RNA, 15 nt, Homo sapiens
caacugaguucagga

SEQ ID NO: 1965507 - RNA, 12 nt, Homo sapiens
acaaacugugaa

SEQ ID NO: 1965508 - RNA, 12 nt, Homo sapiens
acagacugugag

SEQ ID NO: 1965509 - RNA, 17 nt, Homo sapiens
auguguuggagccuuaa

SEQ ID NO: 1965510 - RNA, 19 nt, Homo sapiens
acacagaucuguaauucac

SEQ ID NO: 1965511 - RNA, 16 nt, Homo sapiens
aggugcuaaacuugca

SEQ ID NO: 1965512 - RNA, 22 nt, Homo sapiens
cauccuggagaguaucugagaa

SEQ ID NO: 1965513 - RNA, 13 nt, Homo sapiens
uggagaugaagcc

SEQ ID NO: 1965514 - RNA, 16 nt, Homo sapiens
gcuaaaauaaaccaga

SEQ ID NO: 1965515 - RNA, 18 nt, Homo sapiens
aggcugugggguggagca

SEQ ID NO: 1965516 - RNA, 15 nt, Homo sapiens
ucaucagaacagcug

SEQ ID NO: 1965517 - RNA, 21 nt, Homo sapiens
aacagaggaccagcacacucc

SEQ ID NO: 1965518 - RNA, 15 nt, Homo sapiens
aagauauuccugagu

SEQ ID NO: 1965519 - RNA, 15 nt, Homo sapiens
cugaucuaacaaaau

SEQ ID NO: 1965520 - RNA, 19 nt, Homo sapiens
cuaucuauggcccugcaaa

SEQ ID NO: 1965521 - RNA, 12 nt, Homo sapiens
cgaccaggaaag

SEQ ID NO: 1965522 - RNA, 18 nt, Homo sapiens
gcggcagguucucuuuga

SEQ ID NO: 1965523 - RNA, 14 nt, Homo sapiens
uauaauucugggaa

SEQ ID NO: 1965524 - RNA, 12 nt, Homo sapiens
cccaguccccau

SEQ ID NO: 1965525 - RNA, 12 nt, Homo sapiens
cccuguccccaa

SEQ ID NO: 1965526 - RNA, 21 nt, Homo sapiens
cuuucagguuuacuauguuua

SEQ ID NO: 1965527 - RNA, 13 nt, Homo sapiens
ucuacuacagagu

SEQ ID NO: 1965528 - RNA, 17 nt, Homo sapiens
cauuucacagaaaacau

SEQ ID NO: 1965529 - RNA, 13 nt, Homo sapiens
uuaaaaaaacaca

SEQ ID NO: 1965530 - RNA, 21 nt, Homo sapiens
acagagaucccacacuacuuc

SEQ ID NO: 1965531 - RNA, 21 nt, Homo sapiens
uguuguguuuuuaacauguca

SEQ ID NO: 1965532 - RNA, 14 nt, Homo sapiens
ucugugaugauccu

SEQ ID NO: 1965533 - RNA, 22 nt, Homo sapiens
ucuucaaaugccugacuaggga

SEQ ID NO: 1965534 - RNA, 15 nt, Homo sapiens
aaagaggaaaacccu

SEQ ID NO: 1965535 - RNA, 20 nt, Homo sapiens
guaacaggguagugugguau

SEQ ID NO: 1965536 - RNA, 21 nt, Homo sapiens
accuucaguaaacaccaugaa

SEQ ID NO: 1965537 - RNA, 14 nt, Homo sapiens
aaaacuccgucuca

SEQ ID NO: 1965538 - RNA, 24 nt, Homo sapiens
aacuggugcaugacaaguacugua

SEQ ID NO: 1965539 - RNA, 22 nt, Homo sapiens
augcacagauuaaacuucaccu

SEQ ID NO: 1965540 - RNA, 21 nt, Homo sapiens
acagaccgaccaccagcacag

SEQ ID NO: 1965541 - RNA, 14 nt, Homo sapiens
uuagaauacaguuu

SEQ ID NO: 1965542 - RNA, 21 nt, Homo sapiens
aauacguacuuuagcuggaau

SEQ ID NO: 1965543 - RNA, 17 nt, Homo sapiens
aggaucauuugagccca

SEQ ID NO: 1965544 - RNA, 17 nt, Homo sapiens
agauguauauauuuccu

SEQ ID NO: 1965545 - RNA, 16 nt, Homo sapiens
agucaccccucugucc

SEQ ID NO: 1965546 - RNA, 23 nt, Homo sapiens
uuuaggaaugcucaaugugcugu

SEQ ID NO: 1965547 - RNA, 16 nt, Homo sapiens
cugucugucccaaaga

SEQ ID NO: 1965548 - RNA, 20 nt, Homo sapiens
aaacagacucgcuagcacuc

SEQ ID NO: 1965549 - RNA, 10 nt, Homo sapiens
ccucagggcu

SEQ ID NO: 1965550 - RNA, 18 nt, Homo sapiens
aaauuauuagaacauuca

SEQ ID NO: 1965551 - RNA, 18 nt, Homo sapiens
uauuuauauguacauaca

SEQ ID NO: 1965552 - RNA, 13 nt, Homo sapiens
agauauaugcucu

SEQ ID NO: 1965553 - RNA, 12 nt, Homo sapiens
aaugacauauuu

SEQ ID NO: 1965554 - RNA, 21 nt, Homo sapiens
cucuaguaaauuuaaguccac

SEQ ID NO: 1965555 - RNA, 20 nt, Homo sapiens
aucuccuggaggcugguucu

SEQ ID NO: 1965556 - RNA, 20 nt, Homo sapiens
auuaaacagacuuuagcuua

SEQ ID NO: 1965557 - RNA, 21 nt, Homo sapiens
cagacuugaaugcuaguuaua

SEQ ID NO: 1965558 - RNA, 16 nt, Homo sapiens
aauggaacuacuguac

SEQ ID NO: 1965559 - RNA, 13 nt, Homo sapiens
ugagcugcuccau

SEQ ID NO: 1965560 - RNA, 17 nt, Homo sapiens
aaccaugggcucagggc

SEQ ID NO: 1965561 - RNA, 15 nt, Homo sapiens
gggucacuugcaauu

SEQ ID NO: 1965562 - RNA, 17 nt, Homo sapiens
gucuacuguggugaucu

SEQ ID NO: 1965563 - RNA, 15 nt, Homo sapiens
cuagagcuacagggg

SEQ ID NO: 1965564 - RNA, 11 nt, Homo sapiens
uccagccauga

SEQ ID NO: 1965565 - RNA, 16 nt, Homo sapiens
caacagcgcuuuaaaa

SEQ ID NO: 1965566 - RNA, 20 nt, Homo sapiens
gcugagguccugaucagcuu

SEQ ID NO: 1965567 - RNA, 12 nt, Homo sapiens
cuccugccaugu

SEQ ID NO: 1965568 - RNA, 16 nt, Homo sapiens
ugacagacacaggccc

SEQ ID NO: 1965569 - RNA, 22 nt, Homo sapiens
gcauagcuuuucccuguccuga

SEQ ID NO: 1965570 - RNA, 19 nt, Homo sapiens
gucuuugcauggagacuug

SEQ ID NO: 1965571 - RNA, 19 nt, Homo sapiens
gagucucacucuguugccu

SEQ ID NO: 1965572 - RNA, 15 nt, Homo sapiens
auucaccaagagcca

SEQ ID NO: 1965573 - RNA, 18 nt, Homo sapiens
cuaggccagagcgggggu

SEQ ID NO: 1965574 - RNA, 23 nt, Homo sapiens
aaugugauucaccucuucuuucc

SEQ ID NO: 1965575 - RNA, 14 nt, Homo sapiens
ugugacuucacugu

SEQ ID NO: 1965576 - RNA, 18 nt, Homo sapiens
augaaaaaauaacacugu

SEQ ID NO: 1965577 - RNA, 15 nt, Homo sapiens
cauuuuuaaaaugca

SEQ ID NO: 1965578 - RNA, 16 nt, Homo sapiens
uccuuccaucccuacc

SEQ ID NO: 1965579 - RNA, 20 nt, Homo sapiens
cuuucuacuuuuucuagcua

SEQ ID NO: 1965580 - RNA, 18 nt, Homo sapiens
ucaguugagaaacaguuc

SEQ ID NO: 1965581 - RNA, 20 nt, Homo sapiens
cuggguaaaugcagcgugaa

SEQ ID NO: 1965582 - RNA, 18 nt, Homo sapiens
cccgagcaacccucugaa

SEQ ID NO: 1965583 - RNA, 21 nt, Homo sapiens
auuccuuggcaugccuuccag

SEQ ID NO: 1965584 - RNA, 15 nt, Homo sapiens
ccucaguuauauaac

SEQ ID NO: 1965585 - RNA, 14 nt, Homo sapiens
cuaauaaaggacau

SEQ ID NO: 1965586 - RNA, 20 nt, Homo sapiens
cagggcgagacuccgucuca

SEQ ID NO: 1965587 - RNA, 16 nt, Homo sapiens
gagaauggauccucau

SEQ ID NO: 1965588 - RNA, 19 nt, Homo sapiens
cucugccaagauacuugaa

SEQ ID NO: 1965589 - RNA, 18 nt, Homo sapiens
gcaggggaguaguggaga

SEQ ID NO: 1965590 - RNA, 13 nt, Homo sapiens
gguugaaaaccac

SEQ ID NO: 1965591 - RNA, 15 nt, Homo sapiens
gugaggaagcaaaag

SEQ ID NO: 1965592 - RNA, 15 nt, Homo sapiens
accaugccucuccaa

SEQ ID NO: 1965593 - RNA, 24 nt, Homo sapiens
uaauccaguuuagaaaguaacuua

SEQ ID NO: 1965594 - RNA, 15 nt, Homo sapiens
agcucuaaguuuuga

SEQ ID NO: 1965595 - RNA, 15 nt, Homo sapiens
ugccacuacacucaa

SEQ ID NO: 1965596 - RNA, 23 nt, Homo sapiens
uugacacaacguaacaccagcau

SEQ ID NO: 1965597 - RNA, 18 nt, Homo sapiens
cccuguccugcacacccu

SEQ ID NO: 1965598 - RNA, 20 nt, Homo sapiens
gccugcggaguugugcacgu

SEQ ID NO: 1965599 - RNA, 13 nt, Homo sapiens
uucuucucauaaa

SEQ ID NO: 1965600 - RNA, 16 nt, Homo sapiens
uccccaagcaguguga

SEQ ID NO: 1965601 - RNA, 16 nt, Homo sapiens
acacaaagacauggaa

SEQ ID NO: 1965602 - RNA, 21 nt, Homo sapiens
guaaaagcaucacaugaacuu

SEQ ID NO: 1965603 - RNA, 21 nt, Homo sapiens
acugaugaguuucacuguacu

SEQ ID NO: 1965604 - RNA, 17 nt, Homo sapiens
ccuguaauauuuagcug

SEQ ID NO: 1965605 - RNA, 20 nt, Homo sapiens
aggugggaggauugcuugag

SEQ ID NO: 1965606 - RNA, 16 nt, Homo sapiens
aacaaugcaacuuuua

SEQ ID NO: 1965607 - RNA, 19 nt, Homo sapiens
acuugggccacacuaccca

SEQ ID NO: 1965608 - RNA, 23 nt, Homo sapiens
gagcuacugccgucagugcugug

SEQ ID NO: 1965609 - RNA, 19 nt, Homo sapiens
aucauuuuagcugguguca

SEQ ID NO: 1965610 - RNA, 22 nt, Homo sapiens
gcaaugaaaagaaaaugugcca

SEQ ID NO: 1965611 - RNA, 14 nt, Homo sapiens
cuuugaacuuugaa

SEQ ID NO: 1965612 - RNA, 19 nt, Homo sapiens
gaaaccagaacaaauaaaa

SEQ ID NO: 1965613 - RNA, 19 nt, Homo sapiens
aaauaauaauauccagguc

SEQ ID NO: 1965614 - RNA, 14 nt, Homo sapiens
cuugcccuuaauau

SEQ ID NO: 1965615 - RNA, 14 nt, Homo sapiens
augucuuuccaaaa

SEQ ID NO: 1965616 - RNA, 16 nt, Homo sapiens
aggccugugauuauuc

SEQ ID NO: 1965617 - RNA, 19 nt, Homo sapiens
ucugugacccacuucucau

SEQ ID NO: 1965618 - RNA, 18 nt, Homo sapiens
cugcuuaaaaauguagca

SEQ ID NO: 1965619 - RNA, 18 nt, Homo sapiens
uaaucaucuauaaagaag

SEQ ID NO: 1965620 - RNA, 22 nt, Homo sapiens
gaugguucuucuccaguuagaa

SEQ ID NO: 1965621 - RNA, 15 nt, Homo sapiens
ccuacugcuuacugu

SEQ ID NO: 1965622 - RNA, 23 nt, Homo sapiens
uuccacuggaacguuucacugca

SEQ ID NO: 1965623 - RNA, 18 nt, Homo sapiens
aggaacaucucuguaauu

SEQ ID NO: 1965624 - RNA, 21 nt, Homo sapiens
aaacaagacuccucaucauga

SEQ ID NO: 1965625 - RNA, 15 nt, Homo sapiens
uucauguaaccaaga

SEQ ID NO: 1965626 - RNA, 18 nt, Homo sapiens
cacgcuuuuaauucucau

SEQ ID NO: 1965627 - RNA, 21 nt, Homo sapiens
uaugaaaaucuccaucucaaa

SEQ ID NO: 1965628 - RNA, 16 nt, Homo sapiens
guucaaguuaggagcu

SEQ ID NO: 1965629 - RNA, 16 nt, Homo sapiens
acgugccaccaugacu

SEQ ID NO: 1965630 - RNA, 16 nt, Homo sapiens
cuauaaauauguacaa

SEQ ID NO: 1965631 - RNA, 21 nt, Homo sapiens
aaguuuacuucucgaauugaa

SEQ ID NO: 1965632 - RNA, 12 nt, Homo sapiens
cacccacaucuu

SEQ ID NO: 1965633 - RNA, 15 nt, Homo sapiens
uguaguuaaugaugg

SEQ ID NO: 1965634 - RNA, 16 nt, Homo sapiens
uucuuuggaacuuuaa

SEQ ID NO: 1965635 - RNA, 15 nt, Homo sapiens
ccuuuaacacagacc

SEQ ID NO: 1965636 - RNA, 21 nt, Homo sapiens
guuugauuugucucauauauu

SEQ ID NO: 1965637 - RNA, 22 nt, Homo sapiens
ucauuuuuaaccucuagaguca

SEQ ID NO: 1965638 - RNA, 22 nt, Homo sapiens
aauacaguauaccgcaguggcu

SEQ ID NO: 1965639 - RNA, 17 nt, Homo sapiens
uguucuaaguccacuua

SEQ ID NO: 1965640 - RNA, 14 nt, Homo sapiens
agagggaguacaaa

SEQ ID NO: 1965641 - RNA, 13 nt, Homo sapiens
cacauucugccuu

SEQ ID NO: 1965642 - RNA, 14 nt, Homo sapiens
cagccucagaauaa

SEQ ID NO: 1965643 - RNA, 15 nt, Homo sapiens
ugagcuacuucagga

SEQ ID NO: 1965644 - RNA, 22 nt, Homo sapiens
acuccggcacuggguuugcucc

SEQ ID NO: 1965645 - RNA, 16 nt, Homo sapiens
uuuaaaauuacauucu

SEQ ID NO: 1965646 - RNA, 17 nt, Homo sapiens
ugccauuccacuccacu

SEQ ID NO: 1965647 - RNA, 23 nt, Homo sapiens
agguuuuaaccgcacaugcacac

SEQ ID NO: 1965648 - RNA, 16 nt, Homo sapiens
aaaggaaagauuugcc

SEQ ID NO: 1965649 - RNA, 16 nt, Homo sapiens
ugcauguuuccugcuc

SEQ ID NO: 1965650 - RNA, 18 nt, Homo sapiens
uuuucuaagaaaagcauu

SEQ ID NO: 1965651 - RNA, 14 nt, Homo sapiens
uggaagaaauuccu

SEQ ID NO: 1965652 - RNA, 16 nt, Homo sapiens
augucaacagagcaag

SEQ ID NO: 1965653 - RNA, 17 nt, Homo sapiens
agaucauuuucuuaucu

SEQ ID NO: 1965654 - RNA, 15 nt, Homo sapiens
gaugcaauacaagau

SEQ ID NO: 1965655 - RNA, 15 nt, Homo sapiens
gcaugcacacugaga

SEQ ID NO: 1965656 - RNA, 12 nt, Homo sapiens
cccaagccacag

SEQ ID NO: 1965657 - RNA, 19 nt, Homo sapiens
ccuuugccuuccaccccca

SEQ ID NO: 1965658 - RNA, 17 nt, Homo sapiens
cuucagcuguacauacu

SEQ ID NO: 1965659 - RNA, 20 nt, Homo sapiens
ugguugguuuugacuucaga

SEQ ID NO: 1965660 - RNA, 18 nt, Homo sapiens
cauguacucuguugagua

SEQ ID NO: 1965661 - RNA, 15 nt, Homo sapiens
acuauauccuuccua

SEQ ID NO: 1965662 - RNA, 20 nt, Homo sapiens
gugcagugagccgagaucac

SEQ ID NO: 1965663 - RNA, 18 nt, Homo sapiens
uagacaaauagaaaaugg

SEQ ID NO: 1965664 - RNA, 22 nt, Homo sapiens
ccugggugcaucaaacaaaaca

SEQ ID NO: 1965665 - RNA, 20 nt, Homo sapiens
gugugucuuuuuguaucuca

SEQ ID NO: 1965666 - RNA, 15 nt, Homo sapiens
aacuggcccuguuuc

SEQ ID NO: 1965667 - RNA, 21 nt, Homo sapiens
ugagaagaagcacgaagcagu

SEQ ID NO: 1965668 - RNA, 14 nt, Homo sapiens
caggggacuguucu

SEQ ID NO: 1965669 - RNA, 16 nt, Homo sapiens
aacccauuuuggugca

SEQ ID NO: 1965670 - RNA, 19 nt, Homo sapiens
uaacaaaacaagugcaaga

SEQ ID NO: 1965671 - RNA, 17 nt, Homo sapiens
ucuacaaucaguugacu

SEQ ID NO: 1965672 - RNA, 20 nt, Homo sapiens
gaaacccaaguuaugcaucc

SEQ ID NO: 1965673 - RNA, 18 nt, Homo sapiens
aguucgaaagccucucac

SEQ ID NO: 1965674 - RNA, 13 nt, Homo sapiens
guuuuaacugaau

SEQ ID NO: 1965675 - RNA, 18 nt, Homo sapiens
uacucgaguuacagacaa

SEQ ID NO: 1965676 - RNA, 18 nt, Homo sapiens
uccauaaguuuaacuuua

SEQ ID NO: 1965677 - RNA, 19 nt, Homo sapiens
uaauguauuucaaaaucac

SEQ ID NO: 1965678 - RNA, 16 nt, Homo sapiens
aaguauguugguggga

SEQ ID NO: 1965679 - RNA, 13 nt, Homo sapiens
gcaggggagacag

SEQ ID NO: 1965680 - RNA, 19 nt, Homo sapiens
gcggcgggucaaucugccu

SEQ ID NO: 1965681 - RNA, 19 nt, Homo sapiens
cagcuggucuucagcaaaa

SEQ ID NO: 1965682 - RNA, 18 nt, Homo sapiens
gcuacauggggucugggu

SEQ ID NO: 1965683 - RNA, 20 nt, Homo sapiens
accugguuccggcucugcac

SEQ ID NO: 1965684 - RNA, 23 nt, Homo sapiens
ccguggugugaggcccccggagg

SEQ ID NO: 1965685 - RNA, 12 nt, Homo sapiens
auggguggacca

SEQ ID NO: 1965686 - RNA, 20 nt, Homo sapiens
uccuuacuaagcauagcaaa

SEQ ID NO: 1965687 - RNA, 20 nt, Homo sapiens
acuuuggccaaaaccuuuca

SEQ ID NO: 1965688 - RNA, 13 nt, Homo sapiens
aaaaaucuagaca

SEQ ID NO: 1965689 - RNA, 16 nt, Homo sapiens
ccucuaagugcugcug

SEQ ID NO: 1965690 - RNA, 16 nt, Homo sapiens
gcaaggucaugaagga

SEQ ID NO: 1965691 - RNA, 15 nt, Homo sapiens
gugggagaucuucac

SEQ ID NO: 1965692 - RNA, 13 nt, Homo sapiens
aaagucuucuuuc

SEQ ID NO: 1965693 - RNA, 17 nt, Homo sapiens
aguaaucaauacagaca

SEQ ID NO: 1965694 - RNA, 18 nt, Homo sapiens
guccugggugcugucaug

SEQ ID NO: 1965695 - RNA, 15 nt, Homo sapiens
auguaucuaccucac

SEQ ID NO: 1965696 - RNA, 20 nt, Homo sapiens
agcaaaugccacucugggca

SEQ ID NO: 1965697 - RNA, 14 nt, Homo sapiens
cuccuuggcuuuau

SEQ ID NO: 1965698 - RNA, 12 nt, Homo sapiens
ugcuaccuugcc

SEQ ID NO: 1965699 - RNA, 18 nt, Homo sapiens
gaaaguuucuuugaaaau

SEQ ID NO: 1965700 - RNA, 13 nt, Homo sapiens
ugucuuucacuga

SEQ ID NO: 1965701 - RNA, 13 nt, Homo sapiens
acuguuucuguca

SEQ ID NO: 1965702 - RNA, 18 nt, Homo sapiens
aacacaauuguaaguaau

SEQ ID NO: 1965703 - RNA, 12 nt, Homo sapiens
ccaaaacuuaaa

SEQ ID NO: 1965704 - RNA, 18 nt, Homo sapiens
uggaugcauuucuaucaa

SEQ ID NO: 1965705 - RNA, 21 nt, Homo sapiens
gccugagugcuuuaccuuuaa

SEQ ID NO: 1965706 - RNA, 21 nt, Homo sapiens
ucacuuuuaauuagugaugca

SEQ ID NO: 1965707 - RNA, 21 nt, Homo sapiens
cuccuguggccacagcagcuu

SEQ ID NO: 1965708 - RNA, 13 nt, Homo sapiens
uguaaaguucaau

SEQ ID NO: 1965709 - RNA, 16 nt, Homo sapiens
acuucuguaugcauca

SEQ ID NO: 1965710 - RNA, 14 nt, Homo sapiens
aauccacugugacu

SEQ ID NO: 1965711 - RNA, 19 nt, Homo sapiens
uuacaguaaucccauuucc

SEQ ID NO: 1965712 - RNA, 17 nt, Homo sapiens
auaauaaugaugaugau

SEQ ID NO: 1965713 - RNA, 22 nt, Homo sapiens
acuuagcucaggugccuuacau

SEQ ID NO: 1965714 - RNA, 17 nt, Homo sapiens
gaccuaaaugaccucag

SEQ ID NO: 1965715 - RNA, 17 nt, Homo sapiens
aacucaccagauuuacu

SEQ ID NO: 1965716 - RNA, 20 nt, Homo sapiens
caggugcgcgccaccgugcc

SEQ ID NO: 1965717 - RNA, 19 nt, Homo sapiens
aggacggcccugccugccu

SEQ ID NO: 1965718 - RNA, 18 nt, Homo sapiens
cuccccagcaagugagag

SEQ ID NO: 1965719 - RNA, 19 nt, Homo sapiens
gaauacugaguauguggaa

SEQ ID NO: 1965720 - RNA, 17 nt, Homo sapiens
gaaggcaccugcuccca

SEQ ID NO: 1965721 - RNA, 19 nt, Homo sapiens
cagaacugcuuuaucccac

SEQ ID NO: 1965722 - RNA, 15 nt, Homo sapiens
auagagauuaaguca

SEQ ID NO: 1965723 - RNA, 15 nt, Homo sapiens
ggccugugauccagg

SEQ ID NO: 1965724 - RNA, 22 nt, Homo sapiens
augagaaucaccccucucagug

SEQ ID NO: 1965725 - RNA, 16 nt, Homo sapiens
gccuacguuaacccau

SEQ ID NO: 1965726 - RNA, 22 nt, Homo sapiens
aaugaagaaaagagucuauaca

SEQ ID NO: 1965727 - RNA, 18 nt, Homo sapiens
aauuuacuugccauuacu

SEQ ID NO: 1965728 - RNA, 22 nt, Homo sapiens
cuaagucaagaucaacauucca

SEQ ID NO: 1965729 - RNA, 23 nt, Homo sapiens
gcccaugugugagugugugcaag

SEQ ID NO: 1965730 - RNA, 22 nt, Homo sapiens
aacagcacccucuccagaugag

SEQ ID NO: 1965731 - RNA, 21 nt, Homo sapiens
aaacccugcugaacacagugu

SEQ ID NO: 1965732 - RNA, 17 nt, Homo sapiens
gaauuaaaauaaaacac

SEQ ID NO: 1965733 - RNA, 22 nt, Homo sapiens
cugaguuucuuggcugcaugaa

SEQ ID NO: 1965734 - RNA, 17 nt, Homo sapiens
ugauaagcugagcuccu

SEQ ID NO: 1965735 - RNA, 11 nt, Homo sapiens
cucugcuccuu

SEQ ID NO: 1965736 - RNA, 11 nt, Homo sapiens
ccuugcucccc

SEQ ID NO: 1965737 - RNA, 22 nt, Homo sapiens
uccagccuuaauagacuucucu

SEQ ID NO: 1965738 - RNA, 20 nt, Homo sapiens
caccuuuaacacagaccccu

SEQ ID NO: 1965739 - RNA, 15 nt, Homo sapiens
agguagggacuggag

SEQ ID NO: 1965740 - RNA, 21 nt, Homo sapiens
aaaaggaaacuguacuacauc

SEQ ID NO: 1965741 - RNA, 21 nt, Homo sapiens
caaaucuggguaucuuuccag

SEQ ID NO: 1965742 - RNA, 18 nt, Homo sapiens
uauuucucuuucuuuaca

SEQ ID NO: 1965743 - RNA, 16 nt, Homo sapiens
uucuguugaucucagu

SEQ ID NO: 1965744 - RNA, 17 nt, Homo sapiens
agacucuggaggucauc

SEQ ID NO: 1965745 - RNA, 21 nt, Homo sapiens
caacugcccccgccacaaccc

SEQ ID NO: 1965746 - RNA, 21 nt, Homo sapiens
aaauucugauguuucugugaa

SEQ ID NO: 1965747 - RNA, 11 nt, Homo sapiens
cccugccauca

SEQ ID NO: 1965748 - RNA, 13 nt, Homo sapiens
gauuauucagugu

SEQ ID NO: 1965749 - RNA, 15 nt, Homo sapiens
cagaaacagugugca

SEQ ID NO: 1965750 - RNA, 21 nt, Homo sapiens
cucagaaauuuucugaucuca

SEQ ID NO: 1965751 - RNA, 15 nt, Homo sapiens
caagaagccuuuccu

SEQ ID NO: 1965752 - RNA, 14 nt, Homo sapiens
cugguggcucugug

SEQ ID NO: 1965753 - RNA, 17 nt, Homo sapiens
cagaagccuggacucug

SEQ ID NO: 1965754 - RNA, 17 nt, Homo sapiens
ccugaaacaacccaaag

SEQ ID NO: 1965755 - RNA, 14 nt, Homo sapiens
aacaacuuacuaaa

SEQ ID NO: 1965756 - RNA, 23 nt, Homo sapiens
gggggcaacuggccauuugccaa

SEQ ID NO: 1965757 - RNA, 16 nt, Homo sapiens
ugugcuggugaacacu

SEQ ID NO: 1965758 - RNA, 15 nt, Homo sapiens
acccagaguagccau

SEQ ID NO: 1965759 - RNA, 17 nt, Homo sapiens
ugucagcccacagcagc

SEQ ID NO: 1965760 - RNA, 14 nt, Homo sapiens
aaaaagccugugaa

SEQ ID NO: 1965761 - RNA, 16 nt, Homo sapiens
agucagcaacaugaua

SEQ ID NO: 1965762 - RNA, 21 nt, Homo sapiens
cauauuggugcugagugcuau

SEQ ID NO: 1965763 - RNA, 16 nt, Homo sapiens
auauugaaaagauagg

SEQ ID NO: 1965764 - RNA, 20 nt, Homo sapiens
cuaguucuuuucauuuggaa

SEQ ID NO: 1965765 - RNA, 17 nt, Homo sapiens
agaacccaggacagcca

SEQ ID NO: 1965766 - RNA, 21 nt, Homo sapiens
agcuugcaggguuucucgcca

SEQ ID NO: 1965767 - RNA, 21 nt, Homo sapiens
gugaccagcggaaacaggugu

SEQ ID NO: 1965768 - RNA, 20 nt, Homo sapiens
uaguuuuuaaaaaggccuuu

SEQ ID NO: 1965769 - RNA, 19 nt, Homo sapiens
ugaggcccaauaauauuug

SEQ ID NO: 1965770 - RNA, 19 nt, Homo sapiens
cuacucucccauggcuuaa

SEQ ID NO: 1965771 - RNA, 23 nt, Homo sapiens
ggcccguccggcaguucugggug

SEQ ID NO: 1965772 - RNA, 15 nt, Homo sapiens
auuggacuccaggcc

SEQ ID NO: 1965773 - RNA, 15 nt, Homo sapiens
uccauugcuguuguu

SEQ ID NO: 1965774 - RNA, 12 nt, Homo sapiens
agcagaguugcu

SEQ ID NO: 1965775 - RNA, 14 nt, Homo sapiens
uauauguugcuaua

SEQ ID NO: 1965776 - RNA, 16 nt, Homo sapiens
caguuuacaaaugaca

SEQ ID NO: 1965777 - RNA, 15 nt, Homo sapiens
acaugacacauuuga

SEQ ID NO: 1965778 - RNA, 12 nt, Homo sapiens
ugaaaaugcaaa

SEQ ID NO: 1965779 - RNA, 14 nt, Homo sapiens
uucagaagacacug

SEQ ID NO: 1965780 - RNA, 17 nt, Homo sapiens
ucucuaacauuuccuua

SEQ ID NO: 1965781 - RNA, 23 nt, Homo sapiens
aacaaaauuuaugucauuuucag

SEQ ID NO: 1965782 - RNA, 19 nt, Homo sapiens
agaaaguaaaaaguugcuu

SEQ ID NO: 1965783 - RNA, 22 nt, Homo sapiens
cucuucacagggaagcauguga

SEQ ID NO: 1965784 - RNA, 15 nt, Homo sapiens
aaacacccaagcaca

SEQ ID NO: 1965785 - RNA, 16 nt, Homo sapiens
cugauacccuuugaaa

SEQ ID NO: 1965786 - RNA, 15 nt, Homo sapiens
gcucauuugagauaa

SEQ ID NO: 1965787 - RNA, 18 nt, Homo sapiens
aaguaauccaccugccuc

SEQ ID NO: 1965788 - RNA, 16 nt, Homo sapiens
cuguuacuugcuucag

SEQ ID NO: 1965789 - RNA, 21 nt, Homo sapiens
aaggugagcugggggcgagaa

SEQ ID NO: 1965790 - RNA, 15 nt, Homo sapiens
uagggagugugccuu

SEQ ID NO: 1965791 - RNA, 21 nt, Homo sapiens
uauaaucugcagugaugcaau

SEQ ID NO: 1965792 - RNA, 19 nt, Homo sapiens
cgugccaaauccugggcau

SEQ ID NO: 1965793 - RNA, 14 nt, Homo sapiens
gauaugggacugag

SEQ ID NO: 1965794 - RNA, 15 nt, Homo sapiens
aucucagcacucugu

SEQ ID NO: 1965795 - RNA, 22 nt, Homo sapiens
caggguuugcuguuugcgugaa

SEQ ID NO: 1965796 - RNA, 17 nt, Homo sapiens
aguaacggaacaguauc

SEQ ID NO: 1965797 - RNA, 23 nt, Homo sapiens
caugugagauaguuuucauuuua

SEQ ID NO: 1965798 - RNA, 22 nt, Homo sapiens
augcuggaacucuugacagcua

SEQ ID NO: 1965799 - RNA, 18 nt, Homo sapiens
ccuccuuuccuauuuccc

SEQ ID NO: 1965800 - RNA, 16 nt, Homo sapiens
aaauugaccaagugau

SEQ ID NO: 1965801 - RNA, 16 nt, Homo sapiens
ucucugaaccagagaa

SEQ ID NO: 1965802 - RNA, 23 nt, Homo sapiens
ccagacccaguggacucuuccac

SEQ ID NO: 1965803 - RNA, 19 nt, Homo sapiens
cgaagaaaauaauucucua

SEQ ID NO: 1965804 - RNA, 13 nt, Homo sapiens
uggaguuucugac

SEQ ID NO: 1965805 - RNA, 20 nt, Homo sapiens
agagcaagacuccauuucaa

SEQ ID NO: 1965806 - RNA, 21 nt, Homo sapiens
cauagucuuuguuuacaugag

SEQ ID NO: 1965807 - RNA, 22 nt, Homo sapiens
acaucucaaggguuaaccagac

SEQ ID NO: 1965808 - RNA, 16 nt, Homo sapiens
acuguuagcugggaag

SEQ ID NO: 1965809 - RNA, 15 nt, Homo sapiens
gucuaagagugaagu

SEQ ID NO: 1965810 - RNA, 18 nt, Homo sapiens
aucccacuuagcagggac

SEQ ID NO: 1965811 - RNA, 15 nt, Homo sapiens
gagcauacaucuuaa

SEQ ID NO: 1965812 - RNA, 14 nt, Homo sapiens
auaaugaacacuca

SEQ ID NO: 1965813 - RNA, 16 nt, Homo sapiens
ucagauaucaaaauuc

SEQ ID NO: 1965814 - RNA, 20 nt, Homo sapiens
aauaucaaaaaggagcucuu

SEQ ID NO: 1965815 - RNA, 14 nt, Homo sapiens
cuauaaaguguuua

SEQ ID NO: 1965816 - RNA, 22 nt, Homo sapiens
aaaguauucguuacaucuugua

SEQ ID NO: 1965817 - RNA, 17 nt, Homo sapiens
aucagucuauccacaga

SEQ ID NO: 1965818 - RNA, 21 nt, Homo sapiens
cuaccaaagcaccuuagcugg

SEQ ID NO: 1965819 - RNA, 16 nt, Homo sapiens
aggcugacauucacug

SEQ ID NO: 1965820 - RNA, 17 nt, Homo sapiens
gccucuuagaugcaguu

SEQ ID NO: 1965821 - RNA, 17 nt, Homo sapiens
ugccugcagugccacua

SEQ ID NO: 1965822 - RNA, 15 nt, Homo sapiens
ugcccuggcauuaag

SEQ ID NO: 1965823 - RNA, 18 nt, Homo sapiens
cucuagaugcaaauacau

SEQ ID NO: 1965824 - RNA, 21 nt, Homo sapiens
caccugucaaacaaagccaga

SEQ ID NO: 1965825 - RNA, 19 nt, Homo sapiens
caaccacaggcagcauuua

SEQ ID NO: 1965826 - RNA, 12 nt, Homo sapiens
accccaaccuca

SEQ ID NO: 1965827 - RNA, 14 nt, Homo sapiens
ucccaaagcucaga

SEQ ID NO: 1965828 - RNA, 14 nt, Homo sapiens
aacuauaugccaua

SEQ ID NO: 1965829 - RNA, 23 nt, Homo sapiens
uccugcccccccaccccacuccc

SEQ ID NO: 1965830 - RNA, 15 nt, Homo sapiens
gucauguaauacuga

SEQ ID NO: 1965831 - RNA, 14 nt, Homo sapiens
uccaguggacacuu

SEQ ID NO: 1965832 - RNA, 19 nt, Homo sapiens
cauugcccccaccucuggu

SEQ ID NO: 1965833 - RNA, 18 nt, Homo sapiens
ggcacuguggcacugcca

SEQ ID NO: 1965834 - RNA, 17 nt, Homo sapiens
uugguggccuaauuuac

SEQ ID NO: 1965835 - RNA, 20 nt, Homo sapiens
uuacugcccaauaugcaguu

SEQ ID NO: 1965836 - RNA, 23 nt, Homo sapiens
agaaaauuuuguaaaacaaugcc

SEQ ID NO: 1965837 - RNA, 19 nt, Homo sapiens
augccuaauauuuaggcaa

SEQ ID NO: 1965838 - RNA, 23 nt, Homo sapiens
cucccaugugagucccugugaug

SEQ ID NO: 1965839 - RNA, 17 nt, Homo sapiens
cucguguuucacagugg

SEQ ID NO: 1965840 - RNA, 14 nt, Homo sapiens
aaagaccugagaac

SEQ ID NO: 1965841 - RNA, 23 nt, Homo sapiens
acaugagucaaaacaaagcagcu

SEQ ID NO: 1965842 - RNA, 19 nt, Homo sapiens
cucuccuuuggccauucca

SEQ ID NO: 1965843 - RNA, 14 nt, Homo sapiens
agcugagacaggcc

SEQ ID NO: 1965844 - RNA, 13 nt, Homo sapiens
ccuagcaacauau

SEQ ID NO: 1965845 - RNA, 20 nt, Homo sapiens
uccccugaaaaacugaucaa

SEQ ID NO: 1965846 - RNA, 18 nt, Homo sapiens
uguucacacacacaguuu

SEQ ID NO: 1965847 - RNA, 12 nt, Homo sapiens
ccuucuguaaua

SEQ ID NO: 1965848 - RNA, 22 nt, Homo sapiens
aaagcuaguguaccuccucuca

SEQ ID NO: 1965849 - RNA, 16 nt, Homo sapiens
ugcucuugcauugcaa

SEQ ID NO: 1965850 - RNA, 18 nt, Homo sapiens
auaugcagcugugauacu

SEQ ID NO: 1965851 - RNA, 12 nt, Homo sapiens
ugcaaacacagc

SEQ ID NO: 1965852 - RNA, 22 nt, Homo sapiens
gcuuuuauuuuuuaaguucaau

SEQ ID NO: 1965853 - RNA, 20 nt, Homo sapiens
ugucccagcaccuggcacac

SEQ ID NO: 1965854 - RNA, 15 nt, Homo sapiens
agaauggaccacuga

SEQ ID NO: 1965855 - RNA, 18 nt, Homo sapiens
caaagcuaaauacaugga

SEQ ID NO: 1965856 - RNA, 21 nt, Homo sapiens
uugauuuuauuuuuucucugu

SEQ ID NO: 1965857 - RNA, 11 nt, Homo sapiens
uccagcccagc

SEQ ID NO: 1965858 - RNA, 15 nt, Homo sapiens
cuuuacuaacacugg

SEQ ID NO: 1965859 - RNA, 13 nt, Homo sapiens
aacugcgugccag

SEQ ID NO: 1965860 - RNA, 16 nt, Homo sapiens
gucuucuugacugucu

SEQ ID NO: 1965861 - RNA, 18 nt, Homo sapiens
ccuccucugcuugccauc

SEQ ID NO: 1965862 - RNA, 15 nt, Homo sapiens
cuacaacaaccugaa

SEQ ID NO: 1965863 - RNA, 20 nt, Homo sapiens
uucaagugcaauccauguau

SEQ ID NO: 1965864 - RNA, 23 nt, Homo sapiens
auaguugaugagaauccugacca

SEQ ID NO: 1965865 - RNA, 20 nt, Homo sapiens
gauauuaagauucuugacuu

SEQ ID NO: 1965866 - RNA, 18 nt, Homo sapiens
aaccuugugagcaaggug

SEQ ID NO: 1965867 - RNA, 16 nt, Homo sapiens
aauguauaaacuuuag

SEQ ID NO: 1965868 - RNA, 23 nt, Homo sapiens
aaauaguuuaucauuuacugugu

SEQ ID NO: 1965869 - RNA, 16 nt, Homo sapiens
cugggccuccaccucu

SEQ ID NO: 1965870 - RNA, 15 nt, Homo sapiens
gaaaaagacauaaaa

SEQ ID NO: 1965871 - RNA, 16 nt, Homo sapiens
gauaaaaagauggccu

SEQ ID NO: 1965872 - RNA, 15 nt, Homo sapiens
cauuuguugcugcug

SEQ ID NO: 1965873 - RNA, 16 nt, Homo sapiens
gagucucucacugucg

SEQ ID NO: 1965874 - RNA, 19 nt, Homo sapiens
uuucauuuaucaagcagag

SEQ ID NO: 1965875 - RNA, 14 nt, Homo sapiens
uuuaguucagugac

SEQ ID NO: 1965876 - RNA, 18 nt, Homo sapiens
caagcgauucucaugccu

SEQ ID NO: 1965877 - RNA, 20 nt, Homo sapiens
agaggacuucuggcagggaa

SEQ ID NO: 1965878 - RNA, 18 nt, Homo sapiens
ggacuaagaagauguuuu

SEQ ID NO: 1965879 - RNA, 20 nt, Homo sapiens
ccugagauacugaagugcag

SEQ ID NO: 1965880 - RNA, 23 nt, Homo sapiens
ggcuaaguguccauuauuuaccu

SEQ ID NO: 1965881 - RNA, 21 nt, Homo sapiens
uugaggacauuuaugaugcag

SEQ ID NO: 1965882 - RNA, 11 nt, Homo sapiens
cugcuuucuac

SEQ ID NO: 1965883 - RNA, 20 nt, Homo sapiens
aucuccaaaauaaaacuuuu

SEQ ID NO: 1965884 - RNA, 16 nt, Homo sapiens
aaagaauguacauuac

SEQ ID NO: 1965885 - RNA, 14 nt, Homo sapiens
caauacuucauuaa

SEQ ID NO: 1965886 - RNA, 22 nt, Homo sapiens
ucaucacuuaauuacuuacuca

SEQ ID NO: 1965887 - RNA, 19 nt, Homo sapiens
uuggcauuagcacuaccau

SEQ ID NO: 1965888 - RNA, 13 nt, Homo sapiens
acugcguaggcaa

SEQ ID NO: 1965889 - RNA, 22 nt, Homo sapiens
aaagguucuaaggggaccuaca

SEQ ID NO: 1965890 - RNA, 11 nt, Homo sapiens
gaucagaucaa

SEQ ID NO: 1965891 - RNA, 20 nt, Homo sapiens
cacuugugugugggcuguga

SEQ ID NO: 1965892 - RNA, 16 nt, Homo sapiens
agcuacguggcacuau

SEQ ID NO: 1965893 - RNA, 22 nt, Homo sapiens
cuggagcggggaucugaugaaa

SEQ ID NO: 1965894 - RNA, 22 nt, Homo sapiens
cacagagccacucuucaaguag

SEQ ID NO: 1965895 - RNA, 20 nt, Homo sapiens
cuuuccugaucacuaugcau

SEQ ID NO: 1965896 - RNA, 21 nt, Homo sapiens
gcuaaagaggaagugcacugg

SEQ ID NO: 1965897 - RNA, 18 nt, Homo sapiens
auuuuugaagcaaagaag

SEQ ID NO: 1965898 - RNA, 22 nt, Homo sapiens
gaaucggcgacggagcacugca

SEQ ID NO: 1965899 - RNA, 19 nt, Homo sapiens
uucuccuaaugcucugaaa

SEQ ID NO: 1965900 - RNA, 19 nt, Homo sapiens
gccaaguuggagugcaaug

SEQ ID NO: 1965901 - RNA, 23 nt, Homo sapiens
ccugaggugggagaaucacuuaa

SEQ ID NO: 1965902 - RNA, 14 nt, Homo sapiens
aaugacugacccaa

SEQ ID NO: 1965903 - RNA, 15 nt, Homo sapiens
cuguuccacagugac

SEQ ID NO: 1965904 - RNA, 21 nt, Homo sapiens
ucagugugauaaggacuuuag

SEQ ID NO: 1965905 - RNA, 21 nt, Homo sapiens
ucuauuauguuaucauccucc

SEQ ID NO: 1965906 - RNA, 13 nt, Homo sapiens
aaucagcugcuca

SEQ ID NO: 1965907 - RNA, 15 nt, Homo sapiens
cuuucuaaucuccug

SEQ ID NO: 1965908 - RNA, 18 nt, Homo sapiens
ugaccuaugaugaaguca

SEQ ID NO: 1965909 - RNA, 20 nt, Homo sapiens
uggugcccaguuagccucug

SEQ ID NO: 1965910 - RNA, 16 nt, Homo sapiens
guaaucccaacacuuu

SEQ ID NO: 1965911 - RNA, 17 nt, Homo sapiens
cuucagaccaucaguua

SEQ ID NO: 1965912 - RNA, 18 nt, Homo sapiens
ugcugcuuuaauucauaa

SEQ ID NO: 1965913 - RNA, 17 nt, Homo sapiens
aacacacgauaccuguu

SEQ ID NO: 1965914 - RNA, 20 nt, Homo sapiens
caggccaaaccguacuguau

SEQ ID NO: 1965915 - RNA, 17 nt, Homo sapiens
acuaauguacuguacau

SEQ ID NO: 1965916 - RNA, 21 nt, Homo sapiens
cgaucaaguuguugacuguga

SEQ ID NO: 1965917 - RNA, 16 nt, Homo sapiens
auauuuuuagccuaaa

SEQ ID NO: 1965918 - RNA, 17 nt, Homo sapiens
uuacacaaauuugccug

SEQ ID NO: 1965919 - RNA, 21 nt, Homo sapiens
cuagggagacgccaugugaug

SEQ ID NO: 1965920 - RNA, 14 nt, Homo sapiens
cuguccaagacagg

SEQ ID NO: 1965921 - RNA, 13 nt, Homo sapiens
caagagcaugcac

SEQ ID NO: 1965922 - RNA, 14 nt, Homo sapiens
gaacuagugaugua

SEQ ID NO: 1965923 - RNA, 16 nt, Homo sapiens
acacacccaggcccau

SEQ ID NO: 1965924 - RNA, 13 nt, Homo sapiens
uugcauuccagaa

SEQ ID NO: 1965925 - RNA, 20 nt, Homo sapiens
uaggaauucaauuuggcaaa

SEQ ID NO: 1965926 - RNA, 19 nt, Homo sapiens
gagccugugccuuccuccc

SEQ ID NO: 1965927 - RNA, 20 nt, Homo sapiens
cuggaguuagggacugacca

SEQ ID NO: 1965928 - RNA, 11 nt, Homo sapiens
aacccccagag

SEQ ID NO: 1965929 - RNA, 21 nt, Homo sapiens
ugaguacucauaaaggacacu

SEQ ID NO: 1965930 - RNA, 20 nt, Homo sapiens
auccuuccuuuugagggagc

SEQ ID NO: 1965931 - RNA, 21 nt, Homo sapiens
uggacagcuaaaucauuugag

SEQ ID NO: 1965932 - RNA, 12 nt, Homo sapiens
caucuuucaagg

SEQ ID NO: 1965933 - RNA, 14 nt, Homo sapiens
gaacacguggguau

SEQ ID NO: 1965934 - RNA, 22 nt, Homo sapiens
acuuuaaggaagggauacauga

SEQ ID NO: 1965935 - RNA, 23 nt, Homo sapiens
ugcugucuucagucucacagaga

SEQ ID NO: 1965936 - RNA, 17 nt, Homo sapiens
cagaugagucagucucu

SEQ ID NO: 1965937 - RNA, 16 nt, Homo sapiens
aauauaguuuaggagu

SEQ ID NO: 1965938 - RNA, 21 nt, Homo sapiens
agcaauuucccccuaaaccaa

SEQ ID NO: 1965939 - RNA, 14 nt, Homo sapiens
ggccuggggcugcc

SEQ ID NO: 1965940 - RNA, 22 nt, Homo sapiens
uuccuguguccacaucuaacaa

SEQ ID NO: 1965941 - RNA, 22 nt, Homo sapiens
uuagaugugccaauaaccaagu

SEQ ID NO: 1965942 - RNA, 23 nt, Homo sapiens
caauuuuuuguucuucagagauc

SEQ ID NO: 1965943 - RNA, 17 nt, Homo sapiens
auggagagguuugucaa

SEQ ID NO: 1965944 - RNA, 14 nt, Homo sapiens
ugggucuaccucau

SEQ ID NO: 1965945 - RNA, 18 nt, Homo sapiens
gaugaacuuugucauuau

SEQ ID NO: 1965946 - RNA, 16 nt, Homo sapiens
uucuugaguugcggca

SEQ ID NO: 1965947 - RNA, 21 nt, Homo sapiens
uuucacugcuguuauauuuca

SEQ ID NO: 1965948 - RNA, 21 nt, Homo sapiens
cagugcaacacugaagcucuu

SEQ ID NO: 1965949 - RNA, 14 nt, Homo sapiens
gucuucauuaucuu

SEQ ID NO: 1965950 - RNA, 23 nt, Homo sapiens
ggcuuaaggagaggagaaacuga

SEQ ID NO: 1965951 - RNA, 17 nt, Homo sapiens
gaacuuaauaacugugu

SEQ ID NO: 1965952 - RNA, 21 nt, Homo sapiens
gcucagggaaaagcagcucuc

SEQ ID NO: 1965953 - RNA, 20 nt, Homo sapiens
ccaggccucucucugcucca

SEQ ID NO: 1965954 - RNA, 13 nt, Homo sapiens
uuccuuugaucuc

SEQ ID NO: 1965955 - RNA, 18 nt, Homo sapiens
cccuuggacauuuuaugu

SEQ ID NO: 1965956 - RNA, 17 nt, Homo sapiens
caucugaaacccacaga

SEQ ID NO: 1965957 - RNA, 16 nt, Homo sapiens
uacucuagacuaaaga

SEQ ID NO: 1965958 - RNA, 16 nt, Homo sapiens
accucaggugauccac

SEQ ID NO: 1965959 - RNA, 17 nt, Homo sapiens
aagguagcccagcacug

SEQ ID NO: 1965960 - RNA, 19 nt, Homo sapiens
uaggaaauguaagauuuca

SEQ ID NO: 1965961 - RNA, 21 nt, Homo sapiens
cauuuccccugugguuuguua

SEQ ID NO: 1965962 - RNA, 17 nt, Homo sapiens
aaacaucauuacuauaa

SEQ ID NO: 1965963 - RNA, 20 nt, Homo sapiens
caagaccagccugggcaaca

SEQ ID NO: 1965964 - RNA, 19 nt, Homo sapiens
gacccugccacagccagag

SEQ ID NO: 1965965 - RNA, 15 nt, Homo sapiens
uccagaacugucuua

SEQ ID NO: 1965966 - RNA, 15 nt, Homo sapiens
ggaggcugacacaga

SEQ ID NO: 1965967 - RNA, 13 nt, Homo sapiens
uuggucaugcuuc

SEQ ID NO: 1965968 - RNA, 17 nt, Homo sapiens
aaaaaugaaauccagug

SEQ ID NO: 1965969 - RNA, 14 nt, Homo sapiens
guaauaaaaagcca

SEQ ID NO: 1965970 - RNA, 16 nt, Homo sapiens
uguaaauuauuguaaa

SEQ ID NO: 1965971 - RNA, 18 nt, Homo sapiens
uggucuguacugauucaa

SEQ ID NO: 1965972 - RNA, 20 nt, Homo sapiens
agcugagaucacaccacugu

SEQ ID NO: 1965973 - RNA, 20 nt, Homo sapiens
agccaagaucacgccacugc

SEQ ID NO: 1965974 - RNA, 18 nt, Homo sapiens
ggucuucugccagcccau

SEQ ID NO: 1965975 - RNA, 21 nt, Homo sapiens
accuccuaagaaggcaccucu

SEQ ID NO: 1965976 - RNA, 22 nt, Homo sapiens
uacauacauucauacuguagaa

SEQ ID NO: 1965977 - RNA, 22 nt, Homo sapiens
aacgacaaaucaccauguaaca

SEQ ID NO: 1965978 - RNA, 13 nt, Homo sapiens
gaaauaccaguuc

SEQ ID NO: 1965979 - RNA, 19 nt, Homo sapiens
acauguacuguuacugugu

SEQ ID NO: 1965980 - RNA, 23 nt, Homo sapiens
uuaacguauauuaaaccuguuga

SEQ ID NO: 1965981 - RNA, 16 nt, Homo sapiens
ggcccugugagcacaa

SEQ ID NO: 1965982 - RNA, 14 nt, Homo sapiens
cucuuauucuuggc

SEQ ID NO: 1965983 - RNA, 18 nt, Homo sapiens
aaagacugagcucaaggu

SEQ ID NO: 1965984 - RNA, 15 nt, Homo sapiens
ccuucuacauuugag

SEQ ID NO: 1965985 - RNA, 15 nt, Homo sapiens
agaagccgugggaag

SEQ ID NO: 1965986 - RNA, 21 nt, Homo sapiens
guaccuuuugagcuucauuuc

SEQ ID NO: 1965987 - RNA, 20 nt, Homo sapiens
cuuucugugaagcuaauaca

SEQ ID NO: 1965988 - RNA, 18 nt, Homo sapiens
cuuuaccugagaccaguu

SEQ ID NO: 1965989 - RNA, 18 nt, Homo sapiens
uugaaaugccacgugcca

SEQ ID NO: 1965990 - RNA, 12 nt, Homo sapiens
ccauuugcagac

SEQ ID NO: 1965991 - RNA, 13 nt, Homo sapiens
uuuccuaugcaaa

SEQ ID NO: 1965992 - RNA, 14 nt, Homo sapiens
uaaacuacauuuua

SEQ ID NO: 1965993 - RNA, 18 nt, Homo sapiens
cccagcuaccucaaccaa

SEQ ID NO: 1965994 - RNA, 18 nt, Homo sapiens
gcuauagucuaugcaguc

SEQ ID NO: 1965995 - RNA, 20 nt, Homo sapiens
acauuggcuacaaagaccua

SEQ ID NO: 1965996 - RNA, 20 nt, Homo sapiens
cgucagaccaguacugggaa

SEQ ID NO: 1965997 - RNA, 16 nt, Homo sapiens
guaauacaucaaagag

SEQ ID NO: 1965998 - RNA, 18 nt, Homo sapiens
aggaaacaauucuuucaa

SEQ ID NO: 1965999 - RNA, 23 nt, Homo sapiens
ugggacuacaggcucaugccauc

SEQ ID NO: 1966000 - RNA, 18 nt, Homo sapiens
cucugauugcuuuaucca

SEQ ID NO: 1966001 - RNA, 23 nt, Homo sapiens
ugggauuucucccucucagugga

SEQ ID NO: 1966002 - RNA, 22 nt, Homo sapiens
uguuucauacauguagaauucg

SEQ ID NO: 1966003 - RNA, 18 nt, Homo sapiens
guuugggagcaauacuuu

SEQ ID NO: 1966004 - RNA, 20 nt, Homo sapiens
agcuaaccccaagcugccuc

SEQ ID NO: 1966005 - RNA, 21 nt, Homo sapiens
uccccuguagcagucacugac

SEQ ID NO: 1966006 - RNA, 15 nt, Homo sapiens
caaagcccaugcccu

SEQ ID NO: 1966007 - RNA, 21 nt, Homo sapiens
ugcucucuucaauaaaccaca

SEQ ID NO: 1966008 - RNA, 14 nt, Homo sapiens
gcuggagcagcgga

SEQ ID NO: 1966009 - RNA, 13 nt, Homo sapiens
ggccaacugccuc

SEQ ID NO: 1966010 - RNA, 19 nt, Homo sapiens
gaguguuugaaaacugaca

SEQ ID NO: 1966011 - RNA, 15 nt, Homo sapiens
uuagggacagaauua

SEQ ID NO: 1966012 - RNA, 16 nt, Homo sapiens
aaagcauuugcaauca

SEQ ID NO: 1966013 - RNA, 16 nt, Homo sapiens
ugcuaugaaugauacc

SEQ ID NO: 1966014 - RNA, 15 nt, Homo sapiens
auugcccccacauug

SEQ ID NO: 1966015 - RNA, 14 nt, Homo sapiens
gcaacccuuuccaa

SEQ ID NO: 1966016 - RNA, 22 nt, Homo sapiens
cuccacaggcaggcucauuuca

SEQ ID NO: 1966017 - RNA, 16 nt, Homo sapiens
agauagaaagcauuac

SEQ ID NO: 1966018 - RNA, 14 nt, Homo sapiens
gcucccagcacuca

SEQ ID NO: 1966019 - RNA, 20 nt, Homo sapiens
ucuguauauagcucuacaca

SEQ ID NO: 1966020 - RNA, 15 nt, Homo sapiens
ucauuucauuaguau

SEQ ID NO: 1966021 - RNA, 16 nt, Homo sapiens
ccacuuuuaaaacuau

SEQ ID NO: 1966022 - RNA, 20 nt, Homo sapiens
acucuagucaaugacaugaa

SEQ ID NO: 1966023 - RNA, 14 nt, Homo sapiens
gcucucaacccagg

SEQ ID NO: 1966024 - RNA, 19 nt, Homo sapiens
uacuuuguccuaagagauu

SEQ ID NO: 1966025 - RNA, 22 nt, Homo sapiens
agcaucucccaguucauaauca

SEQ ID NO: 1966026 - RNA, 11 nt, Homo sapiens
cugcagagcca

SEQ ID NO: 1966027 - RNA, 16 nt, Homo sapiens
ggaaggcugcugugua

SEQ ID NO: 1966028 - RNA, 17 nt, Homo sapiens
gucugcuuaguaucuca

SEQ ID NO: 1966029 - RNA, 20 nt, Homo sapiens
cagaaaaaugggaacaaggc

SEQ ID NO: 1966030 - RNA, 16 nt, Homo sapiens
uccuuuuaagcaguga

SEQ ID NO: 1966031 - RNA, 18 nt, Homo sapiens
cuaaaacagggauuuuga

SEQ ID NO: 1966032 - RNA, 20 nt, Homo sapiens
uuuaaaagcacgacagugga

SEQ ID NO: 1966033 - RNA, 20 nt, Homo sapiens
agcuucaccagagcauuucc

SEQ ID NO: 1966034 - RNA, 15 nt, Homo sapiens
accaaaggucaggga

SEQ ID NO: 1966035 - RNA, 18 nt, Homo sapiens
ucuggguacuucuugaag

SEQ ID NO: 1966036 - RNA, 18 nt, Homo sapiens
aagccagcaggcucucag

SEQ ID NO: 1966037 - RNA, 14 nt, Homo sapiens
cccaggaguuugag

SEQ ID NO: 1966038 - RNA, 22 nt, Homo sapiens
ccuaagagacugcguucugcaa

SEQ ID NO: 1966039 - RNA, 18 nt, Homo sapiens
uguggcaucaccaggguu

SEQ ID NO: 1966040 - RNA, 20 nt, Homo sapiens
gaacacauuucccuacccua

SEQ ID NO: 1966041 - RNA, 17 nt, Homo sapiens
cuuucucuuaacagcug

SEQ ID NO: 1966042 - RNA, 16 nt, Homo sapiens
acaguuccuucagcuu

SEQ ID NO: 1966043 - RNA, 13 nt, Homo sapiens
agcagagacuuua

SEQ ID NO: 1966044 - RNA, 16 nt, Homo sapiens
agggcucacaagacac

SEQ ID NO: 1966045 - RNA, 14 nt, Homo sapiens
agaaugagacugaa

SEQ ID NO: 1966046 - RNA, 22 nt, Homo sapiens
aggcaaaauaccagcugaugaa

SEQ ID NO: 1966047 - RNA, 18 nt, Homo sapiens
agggaucaucaugcagcu

SEQ ID NO: 1966048 - RNA, 23 nt, Homo sapiens
agguugaggugcgcucaccucag

SEQ ID NO: 1966049 - RNA, 13 nt, Homo sapiens
ccauaacagccaa

SEQ ID NO: 1966050 - RNA, 17 nt, Homo sapiens
ccacaacugacacagga

SEQ ID NO: 1966051 - RNA, 22 nt, Homo sapiens
aggcuuauauacaaugcuucuu

SEQ ID NO: 1966052 - RNA, 15 nt, Homo sapiens
gccccugccaaggcc

SEQ ID NO: 1966053 - RNA, 20 nt, Homo sapiens
gagaaggcgggguauuccca

SEQ ID NO: 1966054 - RNA, 19 nt, Homo sapiens
guuccuguuaagugaauaa

SEQ ID NO: 1966055 - RNA, 18 nt, Homo sapiens
uccauuccccacuucucu

SEQ ID NO: 1966056 - RNA, 19 nt, Homo sapiens
cuguguauguauaagugug

SEQ ID NO: 1966057 - RNA, 18 nt, Homo sapiens
ccagcuuacuagcacuuu

SEQ ID NO: 1966058 - RNA, 23 nt, Homo sapiens
uggcucagggcccaccuccucca

SEQ ID NO: 1966059 - RNA, 13 nt, Homo sapiens
agcaaaaugugau

SEQ ID NO: 1966060 - RNA, 22 nt, Homo sapiens
ugugagaagucacucacacugg

SEQ ID NO: 1966061 - RNA, 23 nt, Homo sapiens
cagcaucucccucacugaaacca

SEQ ID NO: 1966062 - RNA, 17 nt, Homo sapiens
gaaggaagccccuggau

SEQ ID NO: 1966063 - RNA, 21 nt, Homo sapiens
cccaagccugggcuugagcug

SEQ ID NO: 1966064 - RNA, 16 nt, Homo sapiens
agagucggauuaccaa

SEQ ID NO: 1966065 - RNA, 13 nt, Homo sapiens
aaccccuccacuc

SEQ ID NO: 1966066 - RNA, 10 nt, Homo sapiens
acccccagaa

SEQ ID NO: 1966067 - RNA, 14 nt, Homo sapiens
ccugccacagccag

SEQ ID NO: 1966068 - RNA, 13 nt, Homo sapiens
uaccacucuggca

SEQ ID NO: 1966069 - RNA, 15 nt, Homo sapiens
uccagcucaccagcc

SEQ ID NO: 1966070 - RNA, 23 nt, Homo sapiens
uaucaacuggggggaccaaauag

SEQ ID NO: 1966071 - RNA, 15 nt, Homo sapiens
uaccugugagauaac

SEQ ID NO: 1966072 - RNA, 17 nt, Homo sapiens
cagccagugccauucca

SEQ ID NO: 1966073 - RNA, 14 nt, Homo sapiens
uaacggguggcauu

SEQ ID NO: 1966074 - RNA, 15 nt, Homo sapiens
gguccugcacugucc

SEQ ID NO: 1966075 - RNA, 19 nt, Homo sapiens
gacccucuauuuaccugcg

SEQ ID NO: 1966076 - RNA, 17 nt, Homo sapiens
gagacugcaggggucca

SEQ ID NO: 1966077 - RNA, 13 nt, Homo sapiens
aauauuguugaca

SEQ ID NO: 1966078 - RNA, 19 nt, Homo sapiens
agcaagacccugucuuaaa

SEQ ID NO: 1966079 - RNA, 12 nt, Homo sapiens
uuuuugcuaaac

SEQ ID NO: 1966080 - RNA, 23 nt, Homo sapiens
ccaggcccaccuggaaucccaca

SEQ ID NO: 1966081 - RNA, 13 nt, Homo sapiens
ugugagcacaaag

SEQ ID NO: 1966082 - RNA, 13 nt, Homo sapiens
uauaggcauuugg

SEQ ID NO: 1966083 - RNA, 15 nt, Homo sapiens
ucggcagugugcagu

SEQ ID NO: 1966084 - RNA, 13 nt, Homo sapiens
agaaggcaccucu

SEQ ID NO: 1966085 - RNA, 21 nt, Homo sapiens
ccuucauuuuuaagacuguaa

SEQ ID NO: 1966086 - RNA, 23 nt, Homo sapiens
gugagaugaaggaaggacuauga

SEQ ID NO: 1966087 - RNA, 21 nt, Homo sapiens
aaaugagcagcccuuacagua

SEQ ID NO: 1966088 - RNA, 20 nt, Homo sapiens
cuccugauccugacacauuc

SEQ ID NO: 1966089 - RNA, 15 nt, Homo sapiens
agucauucugggaac

SEQ ID NO: 1966090 - RNA, 22 nt, Homo sapiens
agaaauuuaaaagcagagcauu

SEQ ID NO: 1966091 - RNA, 19 nt, Homo sapiens
uaaguugauggugaugaaa

SEQ ID NO: 1966092 - RNA, 22 nt, Homo sapiens
ggugggcaccugaggcccaaua

SEQ ID NO: 1966093 - RNA, 20 nt, Homo sapiens
caaaaggaaagaaacuaccu

SEQ ID NO: 1966094 - RNA, 16 nt, Homo sapiens
aggaaacugcuuuauu

SEQ ID NO: 1966095 - RNA, 12 nt, Homo sapiens
cccgaguagcau

SEQ ID NO: 1966096 - RNA, 20 nt, Homo sapiens
acagauuuuuacacuaauau

SEQ ID NO: 1966097 - RNA, 21 nt, Homo sapiens
ucauuagggcaaagaucucag

SEQ ID NO: 1966098 - RNA, 16 nt, Homo sapiens
uuguuugagacagggu

SEQ ID NO: 1966099 - RNA, 14 nt, Homo sapiens
gaaauucagacuug

SEQ ID NO: 1966100 - RNA, 17 nt, Homo sapiens
guggaugcuagugcugu

SEQ ID NO: 1966101 - RNA, 13 nt, Homo sapiens
gcuuuucuuccua

SEQ ID NO: 1966102 - RNA, 16 nt, Homo sapiens
gcacuggccuugccuc

SEQ ID NO: 1966103 - RNA, 14 nt, Homo sapiens
cuucacaagugugu

SEQ ID NO: 1966104 - RNA, 19 nt, Homo sapiens
ucucaaaaccgaguugcca

SEQ ID NO: 1966105 - RNA, 19 nt, Homo sapiens
uguuccuugaaaugcuaaa

SEQ ID NO: 1966106 - RNA, 14 nt, Homo sapiens
caucugcucagcag

SEQ ID NO: 1966107 - RNA, 14 nt, Homo sapiens
uccucuauuuccua

SEQ ID NO: 1966108 - RNA, 13 nt, Homo sapiens
auucuuuuaguuu

SEQ ID NO: 1966109 - RNA, 19 nt, Homo sapiens
gaauuaaccuggugcugga

SEQ ID NO: 1966110 - RNA, 12 nt, Homo sapiens
acccagccaggc

SEQ ID NO: 1966111 - RNA, 14 nt, Homo sapiens
acaggccugagauu

SEQ ID NO: 1966112 - RNA, 18 nt, Homo sapiens
ucacccuggauaggcaag

SEQ ID NO: 1966113 - RNA, 20 nt, Homo sapiens
accugggcccacagagccug

SEQ ID NO: 1966114 - RNA, 17 nt, Homo sapiens
agaaaauaaauuuaacu

SEQ ID NO: 1966115 - RNA, 17 nt, Homo sapiens
caaaacccaacaugacu

SEQ ID NO: 1966116 - RNA, 18 nt, Homo sapiens
cuagacuagacaucacaa

SEQ ID NO: 1966117 - RNA, 14 nt, Homo sapiens
uuacuagacuuuga

SEQ ID NO: 1966118 - RNA, 18 nt, Homo sapiens
caugucagcaucagcuca

SEQ ID NO: 1966119 - RNA, 21 nt, Homo sapiens
agcucuaaaguagcaacugcu

SEQ ID NO: 1966120 - RNA, 17 nt, Homo sapiens
acuucaucacacacuga

SEQ ID NO: 1966121 - RNA, 16 nt, Homo sapiens
caauaugagucucaau

SEQ ID NO: 1966122 - RNA, 15 nt, Homo sapiens
auuguccguuuacuu

SEQ ID NO: 1966123 - RNA, 24 nt, Homo sapiens
gcaacagauggauagucuguccaa

SEQ ID NO: 1966124 - RNA, 16 nt, Homo sapiens
acagacacacccagug

SEQ ID NO: 1966125 - RNA, 20 nt, Homo sapiens
ucugaagacuaucuuugaag

SEQ ID NO: 1966126 - RNA, 18 nt, Homo sapiens
auuuuccauaagcuauuu

SEQ ID NO: 1966127 - RNA, 14 nt, Homo sapiens
cugacaggccuucu

SEQ ID NO: 1966128 - RNA, 17 nt, Homo sapiens
cugccuuguccugaugc

SEQ ID NO: 1966129 - RNA, 16 nt, Homo sapiens
cgcaaauuuucuucca

SEQ ID NO: 1966130 - RNA, 23 nt, Homo sapiens
caaaggaagcauacuugugaacu

SEQ ID NO: 1966131 - RNA, 16 nt, Homo sapiens
acucccagcagguaug

SEQ ID NO: 1966132 - RNA, 12 nt, Homo sapiens
ggguagugccau

SEQ ID NO: 1966133 - RNA, 23 nt, Homo sapiens
caaacaaaacgcaaaacccagua

SEQ ID NO: 1966134 - RNA, 14 nt, Homo sapiens
cuccuaaauuucca

SEQ ID NO: 1966135 - RNA, 17 nt, Homo sapiens
gucaaagugaugaauau

SEQ ID NO: 1966136 - RNA, 23 nt, Homo sapiens
caugcaggaaggaaaacuaugua

SEQ ID NO: 1966137 - RNA, 13 nt, Homo sapiens
cacuccuccguga

SEQ ID NO: 1966138 - RNA, 17 nt, Homo sapiens
ggaucuggccacagacu

SEQ ID NO: 1966139 - RNA, 23 nt, Homo sapiens
ucccaaguagcugggaguacagg

SEQ ID NO: 1966140 - RNA, 19 nt, Homo sapiens
caagauacacgucacaaag

SEQ ID NO: 1966141 - RNA, 16 nt, Homo sapiens
aggccucaagaacaaa

SEQ ID NO: 1966142 - RNA, 20 nt, Homo sapiens
ucacauuuuacgacaaggau

SEQ ID NO: 1966143 - RNA, 14 nt, Homo sapiens
acaugaagaagcua

SEQ ID NO: 1966144 - RNA, 21 nt, Homo sapiens
auuugcugaauaugcaauuug

SEQ ID NO: 1966145 - RNA, 18 nt, Homo sapiens
ccaagcaggaaccccagg

SEQ ID NO: 1966146 - RNA, 15 nt, Homo sapiens
ucgggccagaaggcg

SEQ ID NO: 1966147 - RNA, 15 nt, Homo sapiens
aaggagaaaaugcau

SEQ ID NO: 1966148 - RNA, 14 nt, Homo sapiens
gaauccucugggag

SEQ ID NO: 1966149 - RNA, 15 nt, Homo sapiens
aaguaaacagucaga

SEQ ID NO: 1966150 - RNA, 21 nt, Homo sapiens
uugguuugugauccaggaaua

SEQ ID NO: 1966151 - RNA, 14 nt, Homo sapiens
gccugagaaauccc

SEQ ID NO: 1966152 - RNA, 17 nt, Homo sapiens
ucuucacugcuacaugu

SEQ ID NO: 1966153 - RNA, 16 nt, Homo sapiens
acuaugauuccaauua

SEQ ID NO: 1966154 - RNA, 20 nt, Homo sapiens
aaaacaaaugugaaggggag

SEQ ID NO: 1966155 - RNA, 22 nt, Homo sapiens
caaacuuugcaucucaguauga

SEQ ID NO: 1966156 - RNA, 19 nt, Homo sapiens
cuucuaaaugagucacuga

SEQ ID NO: 1966157 - RNA, 20 nt, Homo sapiens
auuguacccuucuugucucu

SEQ ID NO: 1966158 - RNA, 20 nt, Homo sapiens
aaacauucuccaguaagcag

SEQ ID NO: 1966159 - RNA, 12 nt, Homo sapiens
aauucaugaaca

SEQ ID NO: 1966160 - RNA, 17 nt, Homo sapiens
aggugccugcucaggug

SEQ ID NO: 1966161 - RNA, 21 nt, Homo sapiens
cagccuccuaggcucccugag

SEQ ID NO: 1966162 - RNA, 21 nt, Homo sapiens
cauguuaccaucuuacuugag

SEQ ID NO: 1966163 - RNA, 19 nt, Homo sapiens
ccuguuuccuccccaucag

SEQ ID NO: 1966164 - RNA, 17 nt, Homo sapiens
ccaauucauuucaucua

SEQ ID NO: 1966165 - RNA, 18 nt, Homo sapiens
uaguccccaaggccucuc

SEQ ID NO: 1966166 - RNA, 22 nt, Homo sapiens
uccaaaugauaguguauaugcu

SEQ ID NO: 1966167 - RNA, 19 nt, Homo sapiens
caucccacucacaacagcu

SEQ ID NO: 1966168 - RNA, 20 nt, Homo sapiens
agaugacaagaaaggcugcu

SEQ ID NO: 1966169 - RNA, 19 nt, Homo sapiens
auguaaacuuuaacuucca

SEQ ID NO: 1966170 - RNA, 21 nt, Homo sapiens
uacuuuugcccuuugauuaaa

SEQ ID NO: 1966171 - RNA, 14 nt, Homo sapiens
ugaaacuaacagau

SEQ ID NO: 1966172 - RNA, 13 nt, Homo sapiens
cgaccccaucuca

SEQ ID NO: 1966173 - RNA, 16 nt, Homo sapiens
acaguuugcuguacua

SEQ ID NO: 1966174 - RNA, 21 nt, Homo sapiens
ucaauaaaacuuuuccaauga

SEQ ID NO: 1966175 - RNA, 14 nt, Homo sapiens
agccucccagugug

SEQ ID NO: 1966176 - RNA, 23 nt, Homo sapiens
gaaaggggaagugguccagaaac

SEQ ID NO: 1966177 - RNA, 22 nt, Homo sapiens
ucccccgagcucuuggccuuug

SEQ ID NO: 1966178 - RNA, 21 nt, Homo sapiens
uuauaaacauuuaaagacaaa

SEQ ID NO: 1966179 - RNA, 16 nt, Homo sapiens
cuaacugucugacuua

SEQ ID NO: 1966180 - RNA, 16 nt, Homo sapiens
ugauuguaagucccau

SEQ ID NO: 1966181 - RNA, 19 nt, Homo sapiens
gccaccagggaguggccau

SEQ ID NO: 1966182 - RNA, 22 nt, Homo sapiens
auggaggccagugccagcaccu

SEQ ID NO: 1966183 - RNA, 22 nt, Homo sapiens
uccaucuuccacgaaaugggcc

SEQ ID NO: 1966184 - RNA, 20 nt, Homo sapiens
gcaugcuuaaauauugaaua

SEQ ID NO: 1966185 - RNA, 19 nt, Homo sapiens
agaucgccuggcucaguca

SEQ ID NO: 1966186 - RNA, 20 nt, Homo sapiens
aagaagcagucaauuuucac

SEQ ID NO: 1966187 - RNA, 21 nt, Homo sapiens
aguccaaaauaucgagugaau

SEQ ID NO: 1966188 - RNA, 21 nt, Homo sapiens
auauuuguuaaauauuuacau

SEQ ID NO: 1966189 - RNA, 21 nt, Homo sapiens
auuuuagauguuauuaugcua

SEQ ID NO: 1966190 - RNA, 19 nt, Homo sapiens
acaacuuggguucuucuca

SEQ ID NO: 1966191 - RNA, 21 nt, Homo sapiens
acugaaaaacuguugguucau

SEQ ID NO: 1966192 - RNA, 18 nt, Homo sapiens
ugcccacacggcagguag

SEQ ID NO: 1966193 - RNA, 23 nt, Homo sapiens
gcaucacggauggugcaugggcu

SEQ ID NO: 1966194 - RNA, 13 nt, Homo sapiens
cuuaguaagugcu

SEQ ID NO: 1966195 - RNA, 22 nt, Homo sapiens
ugugacgcagacagaggggaug

SEQ ID NO: 1966196 - RNA, 15 nt, Homo sapiens
uuuagcucccuccau

SEQ ID NO: 1966197 - RNA, 20 nt, Homo sapiens
aucauuggggggagaaaaag

SEQ ID NO: 1966198 - RNA, 19 nt, Homo sapiens
aaauaggcagaauggaauc

SEQ ID NO: 1966199 - RNA, 15 nt, Homo sapiens
uccacuauggaaaag

SEQ ID NO: 1966200 - RNA, 15 nt, Homo sapiens
gcaucaguugcuaua

SEQ ID NO: 1966201 - RNA, 12 nt, Homo sapiens
aaugucaagcca

SEQ ID NO: 1966202 - RNA, 16 nt, Homo sapiens
cuggucaguugccaaa

SEQ ID NO: 1966203 - RNA, 14 nt, Homo sapiens
ccaacaacugucag

SEQ ID NO: 1966204 - RNA, 18 nt, Homo sapiens
cuccccugcccuggucca

SEQ ID NO: 1966205 - RNA, 23 nt, Homo sapiens
cuccauuggcuuccucacuccaa

SEQ ID NO: 1966206 - RNA, 19 nt, Homo sapiens
gcaguuuaugagacagcug

SEQ ID NO: 1966207 - RNA, 19 nt, Homo sapiens
aaaacaccuuguacuuuau

SEQ ID NO: 1966208 - RNA, 15 nt, Homo sapiens
caaccacagugccac

SEQ ID NO: 1966209 - RNA, 19 nt, Homo sapiens
uuuaaauaaaugugagaac

SEQ ID NO: 1966210 - RNA, 16 nt, Homo sapiens
aacuugcaaguuuuca

SEQ ID NO: 1966211 - RNA, 23 nt, Homo sapiens
caaacagaggaggccagccucac

SEQ ID NO: 1966212 - RNA, 18 nt, Homo sapiens
uucagugguccugucaag

SEQ ID NO: 1966213 - RNA, 19 nt, Homo sapiens
gaaagguacuauauuugcu

SEQ ID NO: 1966214 - RNA, 17 nt, Homo sapiens
uuagcucaccuugagau

SEQ ID NO: 1966215 - RNA, 16 nt, Homo sapiens
uggagaaaauuuauca

SEQ ID NO: 1966216 - RNA, 13 nt, Homo sapiens
uagaauugccuua

SEQ ID NO: 1966217 - RNA, 22 nt, Homo sapiens
gccuucugacggcccugcaaug

SEQ ID NO: 1966218 - RNA, 13 nt, Homo sapiens
caaucagcacuga

SEQ ID NO: 1966219 - RNA, 20 nt, Homo sapiens
uuuaaggucuaaucagugau

SEQ ID NO: 1966220 - RNA, 18 nt, Homo sapiens
acagcucagccacuguga

SEQ ID NO: 1966221 - RNA, 20 nt, Homo sapiens
ucagcaacuguuagcuggga

SEQ ID NO: 1966222 - RNA, 16 nt, Homo sapiens
uaaaauacauguaccu

SEQ ID NO: 1966223 - RNA, 17 nt, Homo sapiens
uucugucaucuaccuuu

SEQ ID NO: 1966224 - RNA, 14 nt, Homo sapiens
ugaggucacugggu

SEQ ID NO: 1966225 - RNA, 23 nt, Homo sapiens
guguuccccaaaggacuugacuu

SEQ ID NO: 1966226 - RNA, 15 nt, Homo sapiens
ucuucccccuuccaa

SEQ ID NO: 1966227 - RNA, 21 nt, Homo sapiens
cagcuguauuuuggcuuucuc

SEQ ID NO: 1966228 - RNA, 13 nt, Homo sapiens
uauagcuaaguac

SEQ ID NO: 1966229 - RNA, 15 nt, Homo sapiens
aaacagaauguucau

SEQ ID NO: 1966230 - RNA, 20 nt, Homo sapiens
aaacccccacccuucugccu

SEQ ID NO: 1966231 - RNA, 12 nt, Homo sapiens
caaucuguguuc

SEQ ID NO: 1966232 - RNA, 16 nt, Homo sapiens
ucccaaccccagugga

SEQ ID NO: 1966233 - RNA, 21 nt, Homo sapiens
gaagacaaagcacaccauaug

SEQ ID NO: 1966234 - RNA, 20 nt, Homo sapiens
guauauuuuugaucuuugag

SEQ ID NO: 1966235 - RNA, 20 nt, Homo sapiens
ucacaggcauauucccugca

SEQ ID NO: 1966236 - RNA, 16 nt, Homo sapiens
ugacaccaaaccugcc

SEQ ID NO: 1966237 - RNA, 18 nt, Homo sapiens
acagcagucccaguauuc

SEQ ID NO: 1966238 - RNA, 19 nt, Homo sapiens
uacugagcauuugcaccuc

SEQ ID NO: 1966239 - RNA, 20 nt, Homo sapiens
acuaugaacugaaggcagca

SEQ ID NO: 1966240 - RNA, 15 nt, Homo sapiens
gcacaguacccggug

SEQ ID NO: 1966241 - RNA, 24 nt, Homo sapiens
aucauggagaacagcaugacagcu

SEQ ID NO: 1966242 - RNA, 15 nt, Homo sapiens
gcaugacaaaaguga

SEQ ID NO: 1966243 - RNA, 18 nt, Homo sapiens
aguaauaaaacauuagua

SEQ ID NO: 1966244 - RNA, 21 nt, Homo sapiens
uaaguacaacuaccuaugcca

SEQ ID NO: 1966245 - RNA, 22 nt, Homo sapiens
augggcagcccaacagcacuuu

SEQ ID NO: 1966246 - RNA, 22 nt, Homo sapiens
aauccaugguguuauuuucuga

SEQ ID NO: 1966247 - RNA, 13 nt, Homo sapiens
aacuguagcuauc

SEQ ID NO: 1966248 - RNA, 14 nt, Homo sapiens
cauuguaaaagcau

SEQ ID NO: 1966249 - RNA, 18 nt, Homo sapiens
augcucuuuugcacaagg

SEQ ID NO: 1966250 - RNA, 14 nt, Homo sapiens
guaucaaugaguaa

SEQ ID NO: 1966251 - RNA, 15 nt, Homo sapiens
guagaacccaggucu

SEQ ID NO: 1966252 - RNA, 13 nt, Homo sapiens
aacucuuaagcaa

SEQ ID NO: 1966253 - RNA, 21 nt, Homo sapiens
aauagaauauaauuaucggaa

SEQ ID NO: 1966254 - RNA, 17 nt, Homo sapiens
uccuaugcuguucacug

SEQ ID NO: 1966255 - RNA, 21 nt, Homo sapiens
ucccaugagggagaugccaug

SEQ ID NO: 1966256 - RNA, 12 nt, Homo sapiens
acccauuugcca

SEQ ID NO: 1966257 - RNA, 18 nt, Homo sapiens
acccacuucccugcaagg

SEQ ID NO: 1966258 - RNA, 13 nt, Homo sapiens
ugaggagugccag

SEQ ID NO: 1966259 - RNA, 11 nt, Homo sapiens
ucuuugccucu

SEQ ID NO: 1966260 - RNA, 18 nt, Homo sapiens
uucuguaucauugauuca

SEQ ID NO: 1966261 - RNA, 19 nt, Homo sapiens
cagugauguauacaucuua

SEQ ID NO: 1966262 - RNA, 15 nt, Homo sapiens
ucaaggaaagccagg

SEQ ID NO: 1966263 - RNA, 14 nt, Homo sapiens
gaagaagaguuucu

SEQ ID NO: 1966264 - RNA, 11 nt, Homo sapiens
ggcucaucucu

SEQ ID NO: 1966265 - RNA, 20 nt, Homo sapiens
cccacccaacuccacagggc

SEQ ID NO: 1966266 - RNA, 17 nt, Homo sapiens
gagacuuggggaccaga

SEQ ID NO: 1966267 - RNA, 17 nt, Homo sapiens
ucaaagugguacaggaa

SEQ ID NO: 1966268 - RNA, 12 nt, Homo sapiens
aucccagccuug

SEQ ID NO: 1966269 - RNA, 23 nt, Homo sapiens
cuugccaagcagugcacauuuca

SEQ ID NO: 1966270 - RNA, 20 nt, Homo sapiens
aagaccagucacagccauuu

SEQ ID NO: 1966271 - RNA, 20 nt, Homo sapiens
gacaccugggagaaaucugg

SEQ ID NO: 1966272 - RNA, 16 nt, Homo sapiens
aagggaauaugcauug

SEQ ID NO: 1966273 - RNA, 21 nt, Homo sapiens
aaagauuauccuguuacugaa

SEQ ID NO: 1966274 - RNA, 13 nt, Homo sapiens
gucagagccaaca

SEQ ID NO: 1966275 - RNA, 15 nt, Homo sapiens
cgucgcacagucucu

SEQ ID NO: 1966276 - RNA, 13 nt, Homo sapiens
agcaucuucucac

SEQ ID NO: 1966277 - RNA, 21 nt, Homo sapiens
acagcacccaggcuccauggg

SEQ ID NO: 1966278 - RNA, 19 nt, Homo sapiens
ucacaaugaguuugggcau

SEQ ID NO: 1966279 - RNA, 12 nt, Homo sapiens
auucuaagccag

SEQ ID NO: 1966280 - RNA, 22 nt, Homo sapiens
agcuggggaccugguacccucc

SEQ ID NO: 1966281 - RNA, 14 nt, Homo sapiens
agauuugagcacaa

SEQ ID NO: 1966282 - RNA, 18 nt, Homo sapiens
uauugaaucauguaguau

SEQ ID NO: 1966283 - RNA, 19 nt, Homo sapiens
acagagcuucccugacuca

SEQ ID NO: 1966284 - RNA, 16 nt, Homo sapiens
aaaauuaaauugcaga

SEQ ID NO: 1966285 - RNA, 16 nt, Homo sapiens
augcaccucauuccag

SEQ ID NO: 1966286 - RNA, 22 nt, Homo sapiens
gaccaaagggaagugaggccca

SEQ ID NO: 1966287 - RNA, 19 nt, Homo sapiens
aguccaucucaagugccau

SEQ ID NO: 1966288 - RNA, 18 nt, Homo sapiens
augggcucccacccuccc

SEQ ID NO: 1966289 - RNA, 21 nt, Homo sapiens
uacaggacuucugugcauugu

SEQ ID NO: 1966290 - RNA, 18 nt, Homo sapiens
uaaggcaguugaaccuga

SEQ ID NO: 1966291 - RNA, 16 nt, Homo sapiens
aagggaaacaggcuaa

SEQ ID NO: 1966292 - RNA, 14 nt, Homo sapiens
ugcaagccagggau

SEQ ID NO: 1966293 - RNA, 18 nt, Homo sapiens
ccaccugaccucugcaag

SEQ ID NO: 1966294 - RNA, 22 nt, Homo sapiens
aggggcagguguuucuuuccug

SEQ ID NO: 1966295 - RNA, 18 nt, Homo sapiens
guuguaagagaagguuua

SEQ ID NO: 1966296 - RNA, 15 nt, Homo sapiens
caucucugucucaaa

SEQ ID NO: 1966297 - RNA, 21 nt, Homo sapiens
cuccugccucccaauaccagc

SEQ ID NO: 1966298 - RNA, 22 nt, Homo sapiens
acuaccucugugccuugccaca

SEQ ID NO: 1966299 - RNA, 22 nt, Homo sapiens
cuucaggggcucccugccugag

SEQ ID NO: 1966300 - RNA, 16 nt, Homo sapiens
uggcuauaaucuuauc

SEQ ID NO: 1966301 - RNA, 15 nt, Homo sapiens
accaaacaccuucag

SEQ ID NO: 1966302 - RNA, 21 nt, Homo sapiens
cuaagggaaauaacaguauuu

SEQ ID NO: 1966303 - RNA, 15 nt, Homo sapiens
ccacuccuguuccuu

SEQ ID NO: 1966304 - RNA, 21 nt, Homo sapiens
auggucacccaacucaaggac

SEQ ID NO: 1966305 - RNA, 20 nt, Homo sapiens
aguccccccagcucuaagca

SEQ ID NO: 1966306 - RNA, 20 nt, Homo sapiens
cacccuccuggccucauaca

SEQ ID NO: 1966307 - RNA, 15 nt, Homo sapiens
gggacuugggucuca

SEQ ID NO: 1966308 - RNA, 18 nt, Homo sapiens
uuaaaaaguucauaacag

SEQ ID NO: 1966309 - RNA, 11 nt, Homo sapiens
accugacaaug

SEQ ID NO: 1966310 - RNA, 18 nt, Homo sapiens
aauagauuuaauuaugaa

SEQ ID NO: 1966311 - RNA, 20 nt, Homo sapiens
acuccgaaagucugaaucuc

SEQ ID NO: 1966312 - RNA, 19 nt, Homo sapiens
uaggauccaugcagcuuuu

SEQ ID NO: 1966313 - RNA, 15 nt, Homo sapiens
gucuguggacugcaa

SEQ ID NO: 1966314 - RNA, 15 nt, Homo sapiens
gugaaagcuuucaug

SEQ ID NO: 1966315 - RNA, 22 nt, Homo sapiens
agaaagugaggcucagauuaaa

SEQ ID NO: 1966316 - RNA, 18 nt, Homo sapiens
acacaaggauagaugcug

SEQ ID NO: 1966317 - RNA, 21 nt, Homo sapiens
cuaagagucucuauuucacaa

SEQ ID NO: 1966318 - RNA, 19 nt, Homo sapiens
cuguguggacuucaucuca

SEQ ID NO: 1966319 - RNA, 17 nt, Homo sapiens
cuuucauaaaaacacuc

SEQ ID NO: 1966320 - RNA, 22 nt, Homo sapiens
ucauguauuuaauaaguacaac

SEQ ID NO: 1966321 - RNA, 20 nt, Homo sapiens
cacguggagauagugccagg

SEQ ID NO: 1966322 - RNA, 17 nt, Homo sapiens
ccaggcaggcaaaggcc

SEQ ID NO: 1966323 - RNA, 13 nt, Homo sapiens
ugucuucuguaua

SEQ ID NO: 1966324 - RNA, 21 nt, Homo sapiens
ugagacuagacauaguaccga

SEQ ID NO: 1966325 - RNA, 14 nt, Homo sapiens
gggcaacaaaguga

SEQ ID NO: 1966326 - RNA, 22 nt, Homo sapiens
cucagcaccacucaagaccaaa

SEQ ID NO: 1966327 - RNA, 14 nt, Homo sapiens
aacgaugcacuuug

SEQ ID NO: 1966328 - RNA, 15 nt, Homo sapiens
uaaaauauacuacua

SEQ ID NO: 1966329 - RNA, 22 nt, Homo sapiens
gccugguuuuuaaguacucacu

SEQ ID NO: 1966330 - RNA, 22 nt, Homo sapiens
augaagcuuuggcccucagugg

SEQ ID NO: 1966331 - RNA, 18 nt, Homo sapiens
uauauaaaugugauugca

SEQ ID NO: 1966332 - RNA, 16 nt, Homo sapiens
augugugauucacagu

SEQ ID NO: 1966333 - RNA, 21 nt, Homo sapiens
ugaauauagaugcuggccagc

SEQ ID NO: 1966334 - RNA, 22 nt, Homo sapiens
gaaaauugaauuuaacaaugcg

SEQ ID NO: 1966335 - RNA, 21 nt, Homo sapiens
gccuugucuucuuagcuguca

SEQ ID NO: 1966336 - RNA, 20 nt, Homo sapiens
uggaugccugggucucuggg

SEQ ID NO: 1966337 - RNA, 17 nt, Homo sapiens
gaaugaccccaucgaga

SEQ ID NO: 1966338 - RNA, 18 nt, Homo sapiens
acucucugugaccugccc

SEQ ID NO: 1966339 - RNA, 18 nt, Homo sapiens
ugaaccugaauauugcca

SEQ ID NO: 1966340 - RNA, 18 nt, Homo sapiens
uaaaacuccuguuucacu

SEQ ID NO: 1966341 - RNA, 13 nt, Homo sapiens
aaugcacugacca

SEQ ID NO: 1966342 - RNA, 17 nt, Homo sapiens
aguugggcucgcacugc

SEQ ID NO: 1966343 - RNA, 23 nt, Homo sapiens
ugacaaaaaggugcagaaggcaa

SEQ ID NO: 1966344 - RNA, 14 nt, Homo sapiens
ugcaguggugccau

SEQ ID NO: 1966345 - RNA, 13 nt, Homo sapiens
gggccaagcccag

SEQ ID NO: 1966346 - RNA, 23 nt, Homo sapiens
gagagcagcuucugccacuuccc

SEQ ID NO: 1966347 - RNA, 17 nt, Homo sapiens
uuuaagauguacauuua

SEQ ID NO: 1966348 - RNA, 22 nt, Homo sapiens
gucaccaaaucagcugcuacua

SEQ ID NO: 1966349 - RNA, 21 nt, Homo sapiens
agaucauauuguauauaguua

SEQ ID NO: 1966350 - RNA, 21 nt, Homo sapiens
acguucuuggauccucagaac

SEQ ID NO: 1966351 - RNA, 14 nt, Homo sapiens
aggcagggcaagaa

SEQ ID NO: 1966352 - RNA, 17 nt, Homo sapiens
cugcaucuuggggacau

SEQ ID NO: 1966353 - RNA, 17 nt, Homo sapiens
uguggaguuuucaugac

SEQ ID NO: 1966354 - RNA, 13 nt, Homo sapiens
ugcaaauucucag

SEQ ID NO: 1966355 - RNA, 23 nt, Homo sapiens
aaccauaaaucaauucauugugu

SEQ ID NO: 1966356 - RNA, 21 nt, Homo sapiens
cacaugaagguaaauaaaaag

SEQ ID NO: 1966357 - RNA, 22 nt, Homo sapiens
guaauaauaaucccaaggcaaa

SEQ ID NO: 1966358 - RNA, 16 nt, Homo sapiens
auuagacauaccucuc

SEQ ID NO: 1966359 - RNA, 13 nt, Homo sapiens
ucaacaugugcuc

SEQ ID NO: 1966360 - RNA, 15 nt, Homo sapiens
ugccuccccuccucu

SEQ ID NO: 1966361 - RNA, 16 nt, Homo sapiens
ucguagcuuguacaga

SEQ ID NO: 1966362 - RNA, 14 nt, Homo sapiens
uaaauaaacaugug

SEQ ID NO: 1966363 - RNA, 22 nt, Homo sapiens
ccaucucuacugaaaguacaaa

SEQ ID NO: 1966364 - RNA, 22 nt, Homo sapiens
uucugccucacaucagcccugu

SEQ ID NO: 1966365 - RNA, 21 nt, Homo sapiens
ggaaaacaugcugcucuggug

SEQ ID NO: 1966366 - RNA, 21 nt, Homo sapiens
cuuuguucucccaaaucugaa

SEQ ID NO: 1966367 - RNA, 19 nt, Homo sapiens
cuguuaccauaagucugau

SEQ ID NO: 1966368 - RNA, 15 nt, Homo sapiens
aaaacugacaucaga

SEQ ID NO: 1966369 - RNA, 22 nt, Homo sapiens
auuuuuaugucuggggcagaaa

SEQ ID NO: 1966370 - RNA, 14 nt, Homo sapiens
auaacaaugcugua

SEQ ID NO: 1966371 - RNA, 21 nt, Homo sapiens
uagaagcuaauguaggacugu

SEQ ID NO: 1966372 - RNA, 23 nt, Homo sapiens
ugguaugaaacaaacuacugugu

SEQ ID NO: 1966373 - RNA, 12 nt, Homo sapiens
accaugcauggu

SEQ ID NO: 1966374 - RNA, 23 nt, Homo sapiens
caaagcaaguuucaucagucaau

SEQ ID NO: 1966375 - RNA, 18 nt, Homo sapiens
aacuguccaguccaguga

SEQ ID NO: 1966376 - RNA, 15 nt, Homo sapiens
aaaucaccucccacc

SEQ ID NO: 1966377 - RNA, 16 nt, Homo sapiens
gcgcauugagccagug

SEQ ID NO: 1966378 - RNA, 21 nt, Homo sapiens
gaucucaauuugcaguauuca

SEQ ID NO: 1966379 - RNA, 18 nt, Homo sapiens
uacauuuucguccuguag

SEQ ID NO: 1966380 - RNA, 21 nt, Homo sapiens
cugaggggcacucuccccuga

SEQ ID NO: 1966381 - RNA, 19 nt, Homo sapiens
ugccaggccagagggcagu

SEQ ID NO: 1966382 - RNA, 23 nt, Homo sapiens
ugggauauuuccauauggcaaua

SEQ ID NO: 1966383 - RNA, 16 nt, Homo sapiens
aagcgcuucuuucuga

SEQ ID NO: 1966384 - RNA, 23 nt, Homo sapiens
gacauggcucauuguagcacaau

SEQ ID NO: 1966385 - RNA, 21 nt, Homo sapiens
guuguauucauuguggucaua

SEQ ID NO: 1966386 - RNA, 19 nt, Homo sapiens
caaaguaacagccuuucaa

SEQ ID NO: 1966387 - RNA, 14 nt, Homo sapiens
caauggacugcacc

SEQ ID NO: 1966388 - RNA, 12 nt, Homo sapiens
caaggugggggu

SEQ ID NO: 1966389 - RNA, 19 nt, Homo sapiens
auauaaaaauggguguuau

SEQ ID NO: 1966390 - RNA, 18 nt, Homo sapiens
guaccaggugaacaaagu

SEQ ID NO: 1966391 - RNA, 22 nt, Homo sapiens
ugcaaacccgaaaauaaaagac

SEQ ID NO: 1966392 - RNA, 23 nt, Homo sapiens
gcuuguuaacugagugccuuuug

SEQ ID NO: 1966393 - RNA, 14 nt, Homo sapiens
agugcuuugugaua

SEQ ID NO: 1966394 - RNA, 15 nt, Homo sapiens
uggcccauaauguga

SEQ ID NO: 1966395 - RNA, 20 nt, Homo sapiens
ucagcauaaaugggaacuga

SEQ ID NO: 1966396 - RNA, 18 nt, Homo sapiens
uuaaacuguuagcacugu

SEQ ID NO: 1966397 - RNA, 22 nt, Homo sapiens
ggagggcgugacucacccaagc

SEQ ID NO: 1966398 - RNA, 15 nt, Homo sapiens
auaaauaacagugca

SEQ ID NO: 1966399 - RNA, 19 nt, Homo sapiens
uaccuugggggaaccugga

SEQ ID NO: 1966400 - RNA, 16 nt, Homo sapiens
augugaaaacaucuca

SEQ ID NO: 1966401 - RNA, 21 nt, Homo sapiens
ucucucccugccucacaucuc

SEQ ID NO: 1966402 - RNA, 16 nt, Homo sapiens
agcccucugucuaccu

SEQ ID NO: 1966403 - RNA, 16 nt, Homo sapiens
ccugacccugcuccua

SEQ ID NO: 1966404 - RNA, 14 nt, Homo sapiens
aauacuuacuauaa

SEQ ID NO: 1966405 - RNA, 16 nt, Homo sapiens
uucagauuguuuaaau

SEQ ID NO: 1966406 - RNA, 19 nt, Homo sapiens
caugaaaaugaaccauuca

SEQ ID NO: 1966407 - RNA, 19 nt, Homo sapiens
cuuaagaaaaugaugcugg

SEQ ID NO: 1966408 - RNA, 22 nt, Homo sapiens
aaacacuguuucuaacucaggg

SEQ ID NO: 1966409 - RNA, 15 nt, Homo sapiens
ccgauauaagccaua

SEQ ID NO: 1966410 - RNA, 22 nt, Homo sapiens
caaagcaucuugcauuaugcaa

SEQ ID NO: 1966411 - RNA, 16 nt, Homo sapiens
uaagaggcgacuuccu

SEQ ID NO: 1966412 - RNA, 22 nt, Homo sapiens
aacacagacccaaaccauacca

SEQ ID NO: 1966413 - RNA, 16 nt, Homo sapiens
cacugagucagaauuc

SEQ ID NO: 1966414 - RNA, 20 nt, Homo sapiens
ugggaaugauuaagggagcu

SEQ ID NO: 1966415 - RNA, 15 nt, Homo sapiens
ccagcguguggagca

SEQ ID NO: 1966416 - RNA, 15 nt, Homo sapiens
cacacucuacaaaau

SEQ ID NO: 1966417 - RNA, 16 nt, Homo sapiens
auucuuuagcuguacu

SEQ ID NO: 1966418 - RNA, 14 nt, Homo sapiens
cuccuccucuccag

SEQ ID NO: 1966419 - RNA, 18 nt, Homo sapiens
augaucuuguuaaugcau

SEQ ID NO: 1966420 - RNA, 17 nt, Homo sapiens
agcuguguucacacugu

SEQ ID NO: 1966421 - RNA, 14 nt, Homo sapiens
gggcacagccagaa

SEQ ID NO: 1966422 - RNA, 13 nt, Homo sapiens
ggcaaaaugucau

SEQ ID NO: 1966423 - RNA, 17 nt, Homo sapiens
augaugcuaccaugccu

SEQ ID NO: 1966424 - RNA, 14 nt, Homo sapiens
auccuauggcagag

SEQ ID NO: 1966425 - RNA, 17 nt, Homo sapiens
gugucugggauaaccuc

SEQ ID NO: 1966426 - RNA, 14 nt, Homo sapiens
ggaggccuucccac

SEQ ID NO: 1966427 - RNA, 18 nt, Homo sapiens
uaaauaaaucuaaagucu

SEQ ID NO: 1966428 - RNA, 22 nt, Homo sapiens
aaucacacugaggaacucacaa

SEQ ID NO: 1966429 - RNA, 21 nt, Homo sapiens
uccaucagcucucugcaaaga

SEQ ID NO: 1966430 - RNA, 21 nt, Homo sapiens
uccaguuggaugaacauucaa

SEQ ID NO: 1966431 - RNA, 19 nt, Homo sapiens
auguccugauuacaaugcu

SEQ ID NO: 1966432 - RNA, 19 nt, Homo sapiens
ccaguaccacacucaugaa

SEQ ID NO: 1966433 - RNA, 23 nt, Homo sapiens
gugcucuccugacgcagcacaag

SEQ ID NO: 1966434 - RNA, 22 nt, Homo sapiens
ggucucacucugucgcucaggc

SEQ ID NO: 1966435 - RNA, 22 nt, Homo sapiens
accacugaauucacuccaguca

SEQ ID NO: 1966436 - RNA, 22 nt, Homo sapiens
uccuggcuggaccagccacugu

SEQ ID NO: 1966437 - RNA, 17 nt, Homo sapiens
acgccuccccuuuguga

SEQ ID NO: 1966438 - RNA, 21 nt, Homo sapiens
ugcagggugaagcaccaggga

SEQ ID NO: 1966439 - RNA, 16 nt, Homo sapiens
ggaaaccacagucagu

SEQ ID NO: 1966440 - RNA, 14 nt, Homo sapiens
gcugagaucgugcu

SEQ ID NO: 1966441 - RNA, 15 nt, Homo sapiens
ccaaucuaucuagua

SEQ ID NO: 1966442 - RNA, 13 nt, Homo sapiens
ugcaucugacccc

SEQ ID NO: 1966443 - RNA, 14 nt, Homo sapiens
acagcucagcugcc

SEQ ID NO: 1966444 - RNA, 14 nt, Homo sapiens
gaagaccaaaugau

SEQ ID NO: 1966445 - RNA, 19 nt, Homo sapiens
cuuucaauugcagaugcca

SEQ ID NO: 1966446 - RNA, 23 nt, Homo sapiens
uccugcuugguuuagcugugcag

SEQ ID NO: 1966447 - RNA, 20 nt, Homo sapiens
agacuauggccucgccuccc

SEQ ID NO: 1966448 - RNA, 13 nt, Homo sapiens
agagagaaaaaga

SEQ ID NO: 1966449 - RNA, 21 nt, Homo sapiens
uguggaagcauguagacugug

SEQ ID NO: 1966450 - RNA, 15 nt, Homo sapiens
cagcuucuuuugcca

SEQ ID NO: 1966451 - RNA, 14 nt, Homo sapiens
gugguacuuggcac

SEQ ID NO: 1966452 - RNA, 14 nt, Homo sapiens
guuguaccaaaaca

SEQ ID NO: 1966453 - RNA, 22 nt, Homo sapiens
aaaaggcaagucaaauaccaca

SEQ ID NO: 1966454 - RNA, 18 nt, Homo sapiens
cacccaaagcccacuuca

SEQ ID NO: 1966455 - RNA, 14 nt, Homo sapiens
uagcggagcccagc

SEQ ID NO: 1966456 - RNA, 18 nt, Homo sapiens
gggacauagccagcauuu

SEQ ID NO: 1966457 - RNA, 18 nt, Homo sapiens
aagcaggagaaucacuug

SEQ ID NO: 1966458 - RNA, 14 nt, Homo sapiens
uugcaucagcaaca

SEQ ID NO: 1966459 - RNA, 15 nt, Homo sapiens
uaauauccacugcaa

SEQ ID NO: 1966460 - RNA, 14 nt, Homo sapiens
gccgaggagagcaa

SEQ ID NO: 1966461 - RNA, 14 nt, Homo sapiens
cccaacaugcacug

SEQ ID NO: 1966462 - RNA, 20 nt, Homo sapiens
ucggauuagaaauaaagcau

SEQ ID NO: 1966463 - RNA, 16 nt, Homo sapiens
cccaccuacugcacuu

SEQ ID NO: 1966464 - RNA, 20 nt, Homo sapiens
gcaagguuauaugcacuuuc

SEQ ID NO: 1966465 - RNA, 18 nt, Homo sapiens
auccauagacacaguauu

SEQ ID NO: 1966466 - RNA, 13 nt, Homo sapiens
aggccugucugug

SEQ ID NO: 1966467 - RNA, 18 nt, Homo sapiens
gagucucugaaugaagcu

SEQ ID NO: 1966468 - RNA, 14 nt, Homo sapiens
ccuuuuaaucagag

SEQ ID NO: 1966469 - RNA, 16 nt, Homo sapiens
cuguuaccaaaucuca

SEQ ID NO: 1966470 - RNA, 17 nt, Homo sapiens
caugcacagaguccuua

SEQ ID NO: 1966471 - RNA, 18 nt, Homo sapiens
agaguucuggaaaagaac

SEQ ID NO: 1966472 - RNA, 21 nt, Homo sapiens
cagcucuugcuaaucaguguc

SEQ ID NO: 1966473 - RNA, 13 nt, Homo sapiens
acaaaggagccuu

SEQ ID NO: 1966474 - RNA, 15 nt, Homo sapiens
gcagacacuaaagac

SEQ ID NO: 1966475 - RNA, 14 nt, Homo sapiens
cccaugaagccaca

SEQ ID NO: 1966476 - RNA, 16 nt, Homo sapiens
agguuaaugaacuuca

SEQ ID NO: 1966477 - RNA, 13 nt, Homo sapiens
cucugcugcauuu

SEQ ID NO: 1966478 - RNA, 20 nt, Homo sapiens
caguggagaggggacuugga

SEQ ID NO: 1966479 - RNA, 13 nt, Homo sapiens
uggagacugacaa

SEQ ID NO: 1966480 - RNA, 22 nt, Homo sapiens
acccaggaguauccucuugcca

SEQ ID NO: 1966481 - RNA, 20 nt, Homo sapiens
aauucuagauuaccaugaag

SEQ ID NO: 1966482 - RNA, 20 nt, Homo sapiens
auuguaguccuguaauggaa

SEQ ID NO: 1966483 - RNA, 16 nt, Homo sapiens
ccaucgguagcuugaa

SEQ ID NO: 1966484 - RNA, 16 nt, Homo sapiens
ggagucccuuuggcaa

SEQ ID NO: 1966485 - RNA, 15 nt, Homo sapiens
accccaccacaaaaa

SEQ ID NO: 1966486 - RNA, 15 nt, Homo sapiens
ucaacuccucccaua

SEQ ID NO: 1966487 - RNA, 23 nt, Homo sapiens
cauaucacccuucccugcuccca

SEQ ID NO: 1966488 - RNA, 14 nt, Homo sapiens
uaaucccagcauuu

SEQ ID NO: 1966489 - RNA, 21 nt, Homo sapiens
cucuugggaacugaacucacu

SEQ ID NO: 1966490 - RNA, 16 nt, Homo sapiens
aauauuguaaaacuuu

SEQ ID NO: 1966491 - RNA, 17 nt, Homo sapiens
cagcaucaauuccauca

SEQ ID NO: 1966492 - RNA, 15 nt, Homo sapiens
ucaaaaacacucuca

SEQ ID NO: 1966493 - RNA, 18 nt, Homo sapiens
agccuuaagucuuaauau

SEQ ID NO: 1966494 - RNA, 19 nt, Homo sapiens
uugauauuuuccaaaugga

SEQ ID NO: 1966495 - RNA, 18 nt, Homo sapiens
cuguaugguauaugcaug

SEQ ID NO: 1966496 - RNA, 22 nt, Homo sapiens
guuaugauuuguaacauucaca

SEQ ID NO: 1966497 - RNA, 12 nt, Homo sapiens
aguuguaguguu

SEQ ID NO: 1966498 - RNA, 22 nt, Homo sapiens
accuugugccuggcucagagcc

SEQ ID NO: 1966499 - RNA, 14 nt, Homo sapiens
gaaauaaccacugc

SEQ ID NO: 1966500 - RNA, 21 nt, Homo sapiens
cagaggcaguaggaacccagc

SEQ ID NO: 1966501 - RNA, 12 nt, Homo sapiens
uuacaguuucca

SEQ ID NO: 1966502 - RNA, 12 nt, Homo sapiens
acucauugcaac

SEQ ID NO: 1966503 - RNA, 15 nt, Homo sapiens
cuuuccugcacauuc

SEQ ID NO: 1966504 - RNA, 23 nt, Homo sapiens
agggcugacucuaggugcccuug

SEQ ID NO: 1966505 - RNA, 20 nt, Homo sapiens
uugggguagguagauaccaa

SEQ ID NO: 1966506 - RNA, 14 nt, Homo sapiens
uuaccuuuguuccu

SEQ ID NO: 1966507 - RNA, 16 nt, Homo sapiens
caccaggggugcacaa

SEQ ID NO: 1966508 - RNA, 21 nt, Homo sapiens
aaguauauguucagcagugug

SEQ ID NO: 1966509 - RNA, 22 nt, Homo sapiens
cugaagucucaagaacugccau

SEQ ID NO: 1966510 - RNA, 18 nt, Homo sapiens
acaccucaugcuagccuc

SEQ ID NO: 1966511 - RNA, 19 nt, Homo sapiens
aauuuucuuuccagccagu

SEQ ID NO: 1966512 - RNA, 16 nt, Homo sapiens
uuuucacaaucuuggg

SEQ ID NO: 1966513 - RNA, 19 nt, Homo sapiens
aggacuugugucucugugc

SEQ ID NO: 1966514 - RNA, 16 nt, Homo sapiens
gccaacugcccaagcc

SEQ ID NO: 1966515 - RNA, 14 nt, Homo sapiens
gauaucucaucucu

SEQ ID NO: 1966516 - RNA, 16 nt, Homo sapiens
aagucuuccaugaccc

SEQ ID NO: 1966517 - RNA, 16 nt, Homo sapiens
uucagaaauauaugca

SEQ ID NO: 1966518 - RNA, 22 nt, Homo sapiens
uucccacacugugaacuaauga

SEQ ID NO: 1966519 - RNA, 17 nt, Homo sapiens
aaaggagagacucccau

SEQ ID NO: 1966520 - RNA, 16 nt, Homo sapiens
agggagcuagccagag

SEQ ID NO: 1966521 - RNA, 14 nt, Homo sapiens
acauugcaccagau

SEQ ID NO: 1966522 - RNA, 15 nt, Homo sapiens
accuucacucuccag

SEQ ID NO: 1966523 - RNA, 19 nt, Homo sapiens
gaggcagcuguugcaguga

SEQ ID NO: 1966524 - RNA, 20 nt, Homo sapiens
cuuccaacccgccggucuca

SEQ ID NO: 1966525 - RNA, 22 nt, Homo sapiens
gggaaaccccucccuacuguug

SEQ ID NO: 1966526 - RNA, 23 nt, Homo sapiens
caaaagucuggcccacugugcag

SEQ ID NO: 1966527 - RNA, 16 nt, Homo sapiens
aguuuggagucacugu

SEQ ID NO: 1966528 - RNA, 11 nt, Homo sapiens
uuugugucauu

SEQ ID NO: 1966529 - RNA, 22 nt, Homo sapiens
gagaucacaccacugcacucca

SEQ ID NO: 1966530 - RNA, 14 nt, Homo sapiens
auaaaauacauuua

SEQ ID NO: 1966531 - RNA, 20 nt, Homo sapiens
aaggccuuugggauuugccg

SEQ ID NO: 1966532 - RNA, 15 nt, Homo sapiens
gccagguccuugccc

SEQ ID NO: 1966533 - RNA, 17 nt, Homo sapiens
ugccccccuugccagac

SEQ ID NO: 1966534 - RNA, 15 nt, Homo sapiens
uggggauuguacacg

SEQ ID NO: 1966535 - RNA, 18 nt, Homo sapiens
ggucuggcugcuugcccc

SEQ ID NO: 1966536 - RNA, 19 nt, Homo sapiens
agaacugaacuuauuaccu

SEQ ID NO: 1966537 - RNA, 16 nt, Homo sapiens
ucauuuucaccuccau

SEQ ID NO: 1966538 - RNA, 15 nt, Homo sapiens
gcuagggaaagggau

SEQ ID NO: 1966539 - RNA, 15 nt, Homo sapiens
ucucaugugugcuca

SEQ ID NO: 1966540 - RNA, 22 nt, Homo sapiens
ccauuauucuauuuuagacuuu

SEQ ID NO: 1966541 - RNA, 21 nt, Homo sapiens
aaagucuggcuaugcucacag

SEQ ID NO: 1966542 - RNA, 18 nt, Homo sapiens
cuggacccuccacuucaa

SEQ ID NO: 1966543 - RNA, 17 nt, Homo sapiens
ugagaggguuugaguca

SEQ ID NO: 1966544 - RNA, 14 nt, Homo sapiens
aaacauugccuuug

SEQ ID NO: 1966545 - RNA, 17 nt, Homo sapiens
auccucaugguucccaa

SEQ ID NO: 1966546 - RNA, 15 nt, Homo sapiens
acauagcugagguaa

SEQ ID NO: 1966547 - RNA, 20 nt, Homo sapiens
aguguuugaagucugcucau

SEQ ID NO: 1966548 - RNA, 22 nt, Homo sapiens
aauucagacaagcugcauuuca

SEQ ID NO: 1966549 - RNA, 21 nt, Homo sapiens
aggcgugccccccuccuccag

SEQ ID NO: 1966550 - RNA, 21 nt, Homo sapiens
cccacguaugugaaacacaca

SEQ ID NO: 1966551 - RNA, 14 nt, Homo sapiens
gggcuggccagcca

SEQ ID NO: 1966552 - RNA, 19 nt, Homo sapiens
ucgugccauuacacuccag

SEQ ID NO: 1966553 - RNA, 16 nt, Homo sapiens
aaacacagcuuuacaa

SEQ ID NO: 1966554 - RNA, 19 nt, Homo sapiens
ugcaguuguggugugccau

SEQ ID NO: 1966555 - RNA, 14 nt, Homo sapiens
caaaaacauuucau

SEQ ID NO: 1966556 - RNA, 18 nt, Homo sapiens
cgccugucugugugcauc

SEQ ID NO: 1966557 - RNA, 13 nt, Homo sapiens
augacaguagcau

SEQ ID NO: 1966558 - RNA, 18 nt, Homo sapiens
acagugcagcuugcaguc

SEQ ID NO: 1966559 - RNA, 23 nt, Homo sapiens
cccaaagcacaugcuuagcuuau

SEQ ID NO: 1966560 - RNA, 24 nt, Homo sapiens
cccagauccauucccuacaauuca

SEQ ID NO: 1966561 - RNA, 20 nt, Homo sapiens
aacuugauucuugugauuga

SEQ ID NO: 1966562 - RNA, 16 nt, Homo sapiens
aaccuguaacucacau

SEQ ID NO: 1966563 - RNA, 14 nt, Homo sapiens
acccaaaacaaacg

SEQ ID NO: 1966564 - RNA, 22 nt, Homo sapiens
uuugagacaacaguacauauaa

SEQ ID NO: 1966565 - RNA, 10 nt, Homo sapiens
acacacuccc

SEQ ID NO: 1966566 - RNA, 13 nt, Homo sapiens
auaaauugccaua

SEQ ID NO: 1966567 - RNA, 16 nt, Homo sapiens
gucuaaaaugcagugg

SEQ ID NO: 1966568 - RNA, 19 nt, Homo sapiens
ucuguaucccccacccacu

SEQ ID NO: 1966569 - RNA, 19 nt, Homo sapiens
aguggcaggggacaggagu

SEQ ID NO: 1966570 - RNA, 13 nt, Homo sapiens
caacagcacacag

SEQ ID NO: 1966571 - RNA, 19 nt, Homo sapiens
gggcccccaauaaaccagu

SEQ ID NO: 1966572 - RNA, 13 nt, Homo sapiens
ccccuccauuccc

SEQ ID NO: 1966573 - RNA, 15 nt, Homo sapiens
caagaguuuucuucc

SEQ ID NO: 1966574 - RNA, 15 nt, Homo sapiens
cuguggcucacguga

SEQ ID NO: 1966575 - RNA, 13 nt, Homo sapiens
cuucuccaucucc

SEQ ID NO: 1966576 - RNA, 16 nt, Homo sapiens
ccccugggauggcuca

SEQ ID NO: 1966577 - RNA, 20 nt, Homo sapiens
ugagcauuacuauucacuga

SEQ ID NO: 1966578 - RNA, 19 nt, Homo sapiens
accuaaacuauaugccaua

SEQ ID NO: 1966579 - RNA, 22 nt, Homo sapiens
gaacuacugaggaucagaguaa

SEQ ID NO: 1966580 - RNA, 14 nt, Homo sapiens
uugcuucugugcaa

SEQ ID NO: 1966581 - RNA, 23 nt, Homo sapiens
uugagucuauccuagucuucaca

SEQ ID NO: 1966582 - RNA, 22 nt, Homo sapiens
cacgaucucaacucacugcaag

SEQ ID NO: 1966583 - RNA, 13 nt, Homo sapiens
cuauaaccucagc

SEQ ID NO: 1966584 - RNA, 19 nt, Homo sapiens
ccuugugagagcccauucc

SEQ ID NO: 1966585 - RNA, 15 nt, Homo sapiens
uaauauuaccaacua

SEQ ID NO: 1966586 - RNA, 22 nt, Homo sapiens
guugaaaaauguugcucuggga

SEQ ID NO: 1966587 - RNA, 16 nt, Homo sapiens
aagcuauauaagacaa

SEQ ID NO: 1966588 - RNA, 21 nt, Homo sapiens
aggcuuaacucgcugaugagu

SEQ ID NO: 1966589 - RNA, 16 nt, Homo sapiens
uguauagacagcacuu

SEQ ID NO: 1966590 - RNA, 18 nt, Homo sapiens
ucagcgcugucaggauug

SEQ ID NO: 1966591 - RNA, 11 nt, Homo sapiens
ccucucuccau

SEQ ID NO: 1966592 - RNA, 15 nt, Homo sapiens
ugaccaagaacugca

SEQ ID NO: 1966593 - RNA, 21 nt, Homo sapiens
uuuacauaucaccucauggcc

SEQ ID NO: 1966594 - RNA, 19 nt, Homo sapiens
uucauucuuuuugaaaugu

SEQ ID NO: 1966595 - RNA, 20 nt, Homo sapiens
aaacugccaguuuuguuucc

SEQ ID NO: 1966596 - RNA, 19 nt, Homo sapiens
ccugcggaguugugcacgu

SEQ ID NO: 1966597 - RNA, 19 nt, Homo sapiens
uaaagcaguagacaauccc

SEQ ID NO: 1966598 - RNA, 12 nt, Homo sapiens
ccaaaugacuga

SEQ ID NO: 1966599 - RNA, 15 nt, Homo sapiens
ccuggcugagggcag

SEQ ID NO: 1966600 - RNA, 20 nt, Homo sapiens
ccugggauguagcggugaag

SEQ ID NO: 1966601 - RNA, 20 nt, Homo sapiens
acuuguuucuccaugggcuc

SEQ ID NO: 1966602 - RNA, 22 nt, Homo sapiens
cagaaacaugucuugacuguua

SEQ ID NO: 1966603 - RNA, 18 nt, Homo sapiens
gaaaaacauuccaggaaa

SEQ ID NO: 1966604 - RNA, 18 nt, Homo sapiens
cagucuuguacugugacc

SEQ ID NO: 1966605 - RNA, 12 nt, Homo sapiens
gcucuugcucaa

SEQ ID NO: 1966606 - RNA, 13 nt, Homo sapiens
uuuaaccauucca

SEQ ID NO: 1966607 - RNA, 21 nt, Homo sapiens
ccaaaaguucaacaacaccag

SEQ ID NO: 1966608 - RNA, 23 nt, Homo sapiens
cugaggcaagccauggagugaga

SEQ ID NO: 1966609 - RNA, 13 nt, Homo sapiens
ccugauacauuaa

SEQ ID NO: 1966610 - RNA, 16 nt, Homo sapiens
gguugcagugcugagc

SEQ ID NO: 1966611 - RNA, 24 nt, Homo sapiens
uaacacauucaauagcauaucaca

SEQ ID NO: 1966612 - RNA, 22 nt, Homo sapiens
aaagggaaauacucuuaauuca

SEQ ID NO: 1966613 - RNA, 14 nt, Homo sapiens
cagguccugcggaa

SEQ ID NO: 1966614 - RNA, 14 nt, Homo sapiens
uaacacacuggcca

SEQ ID NO: 1966615 - RNA, 11 nt, Homo sapiens
ugcaacauaua

SEQ ID NO: 1966616 - RNA, 19 nt, Homo sapiens
cuggccagaugcaccagcc

SEQ ID NO: 1966617 - RNA, 16 nt, Homo sapiens
aaauauuuagucugca

SEQ ID NO: 1966618 - RNA, 21 nt, Homo sapiens
uguuagauauuaggucccauc

SEQ ID NO: 1966619 - RNA, 17 nt, Homo sapiens
gaugugaaaaucaugaa

SEQ ID NO: 1966620 - RNA, 20 nt, Homo sapiens
ggccucggcagaacucucug

SEQ ID NO: 1966621 - RNA, 17 nt, Homo sapiens
cuacauuucugcagauc

SEQ ID NO: 1966622 - RNA, 16 nt, Homo sapiens
cugaaucugcuaccaa

SEQ ID NO: 1966623 - RNA, 19 nt, Homo sapiens
uccguuugguagacuccuu

SEQ ID NO: 1966624 - RNA, 13 nt, Homo sapiens
aguagaauuuuag

SEQ ID NO: 1966625 - RNA, 16 nt, Homo sapiens
aaagaugaaguuuuau

SEQ ID NO: 1966626 - RNA, 22 nt, Homo sapiens
acucaaagaaaacugucuggga

SEQ ID NO: 1966627 - RNA, 20 nt, Homo sapiens
ugcuauaaaauuaacaguau

SEQ ID NO: 1966628 - RNA, 23 nt, Homo sapiens
ggcagauggggcacugacccagg

SEQ ID NO: 1966629 - RNA, 13 nt, Homo sapiens
agcugauccugcg

SEQ ID NO: 1966630 - RNA, 17 nt, Homo sapiens
auacaucaaaauauacu

SEQ ID NO: 1966631 - RNA, 18 nt, Homo sapiens
ccuucuggggcuuugcca

SEQ ID NO: 1966632 - RNA, 19 nt, Homo sapiens
gccccuggaccuucuggac

SEQ ID NO: 1966633 - RNA, 15 nt, Homo sapiens
uagccaaguguggua

SEQ ID NO: 1966634 - RNA, 22 nt, Homo sapiens
uauuuuauacugcacuuuagug

SEQ ID NO: 1966635 - RNA, 16 nt, Homo sapiens
auuaauuaaagcaaau

SEQ ID NO: 1966636 - RNA, 22 nt, Homo sapiens
aauuuuguaugccaaucuuaaa

SEQ ID NO: 1966637 - RNA, 22 nt, Homo sapiens
acaucaaguguaauuagcuuuu

SEQ ID NO: 1966638 - RNA, 16 nt, Homo sapiens
uaaauaugcagugaua

SEQ ID NO: 1966639 - RNA, 15 nt, Homo sapiens
cacuagugacaguau

SEQ ID NO: 1966640 - RNA, 17 nt, Homo sapiens
agagguucugugcaaaa

SEQ ID NO: 1966641 - RNA, 19 nt, Homo sapiens
cucuuaauugccaccucua

SEQ ID NO: 1966642 - RNA, 15 nt, Homo sapiens
gcuuuacugcaugaa

SEQ ID NO: 1966643 - RNA, 21 nt, Homo sapiens
ugaggaaaagcggacaucagc

SEQ ID NO: 1966644 - RNA, 14 nt, Homo sapiens
gagguugcagggag

SEQ ID NO: 1966645 - RNA, 22 nt, Homo sapiens
gugcagacagaaaacugcagug

SEQ ID NO: 1966646 - RNA, 15 nt, Homo sapiens
aauguuggcuagucu

SEQ ID NO: 1966647 - RNA, 15 nt, Homo sapiens
guaaaacauaaugua

SEQ ID NO: 1966648 - RNA, 17 nt, Homo sapiens
ugagaaagaaacuaaua

SEQ ID NO: 1966649 - RNA, 19 nt, Homo sapiens
aguauuuuugcugcuucug

SEQ ID NO: 1966650 - RNA, 19 nt, Homo sapiens
uggggucuugcuauauugc

SEQ ID NO: 1966651 - RNA, 15 nt, Homo sapiens
guaaagcaaauauag

SEQ ID NO: 1966652 - RNA, 13 nt, Homo sapiens
ggggaaaggcuug

SEQ ID NO: 1966653 - RNA, 20 nt, Homo sapiens
aaaaagccugguuuuucuca

SEQ ID NO: 1966654 - RNA, 12 nt, Homo sapiens
aaaccugugauu

SEQ ID NO: 1966655 - RNA, 20 nt, Homo sapiens
accaauucuggacagacaga

SEQ ID NO: 1966656 - RNA, 21 nt, Homo sapiens
gggagugugaguuuugccuuu

SEQ ID NO: 1966657 - RNA, 14 nt, Homo sapiens
ucacgucucucuuc

SEQ ID NO: 1966658 - RNA, 16 nt, Homo sapiens
uccaucucuucugcaa

SEQ ID NO: 1966659 - RNA, 15 nt, Homo sapiens
cagcuagacauugca

SEQ ID NO: 1966660 - RNA, 16 nt, Homo sapiens
gacuggacuguguuuu

SEQ ID NO: 1966661 - RNA, 21 nt, Homo sapiens
uuuaucacuacaagcuuuuaa

SEQ ID NO: 1966662 - RNA, 19 nt, Homo sapiens
cccauucuacucaaaguca

SEQ ID NO: 1966663 - RNA, 18 nt, Homo sapiens
cuuaugagauacuuugca

SEQ ID NO: 1966664 - RNA, 21 nt, Homo sapiens
gacucaaguuucuucaaucug

SEQ ID NO: 1966665 - RNA, 13 nt, Homo sapiens
ugugcugugacaa

SEQ ID NO: 1966666 - RNA, 22 nt, Homo sapiens
agaaaggagaacuauccaaaac

SEQ ID NO: 1966667 - RNA, 18 nt, Homo sapiens
uauuauguuaacauguaa

SEQ ID NO: 1966668 - RNA, 23 nt, Homo sapiens
ucuuccacuggaaaaguguaaua

SEQ ID NO: 1966669 - RNA, 17 nt, Homo sapiens
ucuauaauugccacuga

SEQ ID NO: 1966670 - RNA, 19 nt, Homo sapiens
uucucuucuuuauugcacu

SEQ ID NO: 1966671 - RNA, 12 nt, Homo sapiens
cugcaguuuccu

SEQ ID NO: 1966672 - RNA, 16 nt, Homo sapiens
gaucugcucgcugaga

SEQ ID NO: 1966673 - RNA, 18 nt, Homo sapiens
uguggaucagguuuacua

SEQ ID NO: 1966674 - RNA, 21 nt, Homo sapiens
uccauuuuacagaagcauuuu

SEQ ID NO: 1966675 - RNA, 18 nt, Homo sapiens
auaaacagcaacuugugu

SEQ ID NO: 1966676 - RNA, 18 nt, Homo sapiens
caaaggcguauguauuaa

SEQ ID NO: 1966677 - RNA, 13 nt, Homo sapiens
cagggaaaacugc

SEQ ID NO: 1966678 - RNA, 14 nt, Homo sapiens
agcccaagugccau

SEQ ID NO: 1966679 - RNA, 21 nt, Homo sapiens
uccuguuguuauggaaacugu

SEQ ID NO: 1966680 - RNA, 16 nt, Homo sapiens
ggauguguggggcaug

SEQ ID NO: 1966681 - RNA, 17 nt, Homo sapiens
cagagaaguuuguagcc

SEQ ID NO: 1966682 - RNA, 18 nt, Homo sapiens
agauuggccagcaaaaac

SEQ ID NO: 1966683 - RNA, 15 nt, Homo sapiens
acagcugguucgugg

SEQ ID NO: 1966684 - RNA, 17 nt, Homo sapiens
ucucuggcuggggagca

SEQ ID NO: 1966685 - RNA, 15 nt, Homo sapiens
auguguuguacaaua

SEQ ID NO: 1966686 - RNA, 13 nt, Homo sapiens
ccaccccacacuu

SEQ ID NO: 1966687 - RNA, 17 nt, Homo sapiens
uaagcagcgccagugac

SEQ ID NO: 1966688 - RNA, 18 nt, Homo sapiens
guucucucucucugucuc

SEQ ID NO: 1966689 - RNA, 15 nt, Homo sapiens
gagcuggaucacuug

SEQ ID NO: 1966690 - RNA, 18 nt, Homo sapiens
aaaaguauccugcuucug

SEQ ID NO: 1966691 - RNA, 20 nt, Homo sapiens
ucaagcucaugucauuauga

SEQ ID NO: 1966692 - RNA, 13 nt, Homo sapiens
ucccauguuaaau

SEQ ID NO: 1966693 - RNA, 19 nt, Homo sapiens
acgccgcucuucacugugg

SEQ ID NO: 1966694 - RNA, 21 nt, Homo sapiens
gacuacauuuugcucugugaa

SEQ ID NO: 1966695 - RNA, 19 nt, Homo sapiens
ucuugggcccgguccacag

SEQ ID NO: 1966696 - RNA, 18 nt, Homo sapiens
aacucuuauuugaauuga

SEQ ID NO: 1966697 - RNA, 13 nt, Homo sapiens
uaugucauacucu

SEQ ID NO: 1966698 - RNA, 15 nt, Homo sapiens
gccacuuggccucac

SEQ ID NO: 1966699 - RNA, 18 nt, Homo sapiens
aaacugucuuuuuccuca

SEQ ID NO: 1966700 - RNA, 18 nt, Homo sapiens
aaacauaaggcacauugu

SEQ ID NO: 1966701 - RNA, 18 nt, Homo sapiens
agguggcccuucacuguc

SEQ ID NO: 1966702 - RNA, 19 nt, Homo sapiens
ccaaggcaaugauauggca

SEQ ID NO: 1966703 - RNA, 12 nt, Homo sapiens
ggagccuggaac

SEQ ID NO: 1966704 - RNA, 13 nt, Homo sapiens
caccaucugccaa

SEQ ID NO: 1966705 - RNA, 21 nt, Homo sapiens
uuggagagucagaucuuucuc

SEQ ID NO: 1966706 - RNA, 23 nt, Homo sapiens
uugaagagccugacaagugaagu

SEQ ID NO: 1966707 - RNA, 17 nt, Homo sapiens
aaacacuauuucuggaa

SEQ ID NO: 1966708 - RNA, 20 nt, Homo sapiens
uuucuuauccuagcacaugc

SEQ ID NO: 1966709 - RNA, 20 nt, Homo sapiens
gauuuaaacucaucaaugug

SEQ ID NO: 1966710 - RNA, 21 nt, Homo sapiens
agaaguggaguuuucugugag

SEQ ID NO: 1966711 - RNA, 17 nt, Homo sapiens
cagcuggggagcagcug

SEQ ID NO: 1966712 - RNA, 20 nt, Homo sapiens
accccuuacaauucccucua

SEQ ID NO: 1966713 - RNA, 19 nt, Homo sapiens
auuaccaccaccugcucac

SEQ ID NO: 1966714 - RNA, 12 nt, Homo sapiens
acaccugccuag

SEQ ID NO: 1966715 - RNA, 17 nt, Homo sapiens
acuugauuguacuugga

SEQ ID NO: 1966716 - RNA, 18 nt, Homo sapiens
aggguuaauguguggcau

SEQ ID NO: 1966717 - RNA, 15 nt, Homo sapiens
auaaaguacuacugu

SEQ ID NO: 1966718 - RNA, 17 nt, Homo sapiens
cugaacguuugguucaa

SEQ ID NO: 1966719 - RNA, 18 nt, Homo sapiens
agcccccacccaguuccu

SEQ ID NO: 1966720 - RNA, 14 nt, Homo sapiens
ugaguuuucagugg

SEQ ID NO: 1966721 - RNA, 18 nt, Homo sapiens
caucugccaaugccauga

SEQ ID NO: 1966722 - RNA, 23 nt, Homo sapiens
aggcucuuccguuccacauccac

SEQ ID NO: 1966723 - RNA, 17 nt, Homo sapiens
gcagugugaaaaguccu

SEQ ID NO: 1966724 - RNA, 17 nt, Homo sapiens
gugccuuccauacuguu

SEQ ID NO: 1966725 - RNA, 13 nt, Homo sapiens
aaaucuuuaaugg

SEQ ID NO: 1966726 - RNA, 14 nt, Homo sapiens
aguucacggcaaaa

SEQ ID NO: 1966727 - RNA, 17 nt, Homo sapiens
cuauuucuagagacaac

SEQ ID NO: 1966728 - RNA, 15 nt, Homo sapiens
cucacucuucaagga

SEQ ID NO: 1966729 - RNA, 21 nt, Homo sapiens
aggcccugggucuugccaugu

SEQ ID NO: 1966730 - RNA, 14 nt, Homo sapiens
ccuauuucuuaaac

SEQ ID NO: 1966731 - RNA, 22 nt, Homo sapiens
uucugacacacuuagggcagaa

SEQ ID NO: 1966732 - RNA, 17 nt, Homo sapiens
accuugaaccugucacc

SEQ ID NO: 1966733 - RNA, 22 nt, Homo sapiens
uucuguuguaauaguccaugga

SEQ ID NO: 1966734 - RNA, 16 nt, Homo sapiens
aaucugugccugcacu

SEQ ID NO: 1966735 - RNA, 14 nt, Homo sapiens
ugugaaaacagcag

SEQ ID NO: 1966736 - RNA, 15 nt, Homo sapiens
ucccucucagugccu

SEQ ID NO: 1966737 - RNA, 16 nt, Homo sapiens
agacucuuuaugaucu

SEQ ID NO: 1966738 - RNA, 20 nt, Homo sapiens
cagccggcuaugaaagggag

SEQ ID NO: 1966739 - RNA, 12 nt, Homo sapiens
aaauaaagacaa

SEQ ID NO: 1966740 - RNA, 12 nt, Homo sapiens
acuaaaagaauu

SEQ ID NO: 1966741 - RNA, 14 nt, Homo sapiens
cagcucaucugcca

SEQ ID NO: 1966742 - RNA, 15 nt, Homo sapiens
auuucaaucaaccaa

SEQ ID NO: 1966743 - RNA, 12 nt, Homo sapiens
gcgucugagcug

SEQ ID NO: 1966744 - RNA, 22 nt, Homo sapiens
gugcuuucuuuagaaacacaag

SEQ ID NO: 1966745 - RNA, 17 nt, Homo sapiens
uaacaaagugagaccuc

SEQ ID NO: 1966746 - RNA, 21 nt, Homo sapiens
ucccacggccacugcagucac

SEQ ID NO: 1966747 - RNA, 18 nt, Homo sapiens
uaagaaauccagcuucau

SEQ ID NO: 1966748 - RNA, 13 nt, Homo sapiens
gcaauuguggaag

SEQ ID NO: 1966749 - RNA, 20 nt, Homo sapiens
ucacauuuuucuacagugaa

SEQ ID NO: 1966750 - RNA, 15 nt, Homo sapiens
auugacuuuccccac

SEQ ID NO: 1966751 - RNA, 18 nt, Homo sapiens
agaagacugugcggcaca

SEQ ID NO: 1966752 - RNA, 22 nt, Homo sapiens
uuaccuucauggugcuguugcc

SEQ ID NO: 1966753 - RNA, 20 nt, Homo sapiens
aguaaugccucugucuagca

SEQ ID NO: 1966754 - RNA, 14 nt, Homo sapiens
caggcaucccaucc

SEQ ID NO: 1966755 - RNA, 14 nt, Homo sapiens
acgugccuaccucu

SEQ ID NO: 1966756 - RNA, 15 nt, Homo sapiens
ugcagucccuggaaa

SEQ ID NO: 1966757 - RNA, 20 nt, Homo sapiens
gcauucaucucucaaacuua

SEQ ID NO: 1966758 - RNA, 19 nt, Homo sapiens
uucccaggaguucugcuca

SEQ ID NO: 1966759 - RNA, 21 nt, Homo sapiens
gugucuuacauugccaaguca

SEQ ID NO: 1966760 - RNA, 23 nt, Homo sapiens
acaauuagucaaaccacuguuau

SEQ ID NO: 1966761 - RNA, 19 nt, Homo sapiens
cacugcaccgccucagggu

SEQ ID NO: 1966762 - RNA, 16 nt, Homo sapiens
guaauaaaacaaguua

SEQ ID NO: 1966763 - RNA, 17 nt, Homo sapiens
uggcauaauucaggggc

SEQ ID NO: 1966764 - RNA, 21 nt, Homo sapiens
uacaagaacaaugacaccaca

SEQ ID NO: 1966765 - RNA, 17 nt, Homo sapiens
uguaaucucacuacaca

SEQ ID NO: 1966766 - RNA, 23 nt, Homo sapiens
cuguggguaucaggacugugacc

SEQ ID NO: 1966767 - RNA, 18 nt, Homo sapiens
cuggcucccagggccaug

SEQ ID NO: 1966768 - RNA, 16 nt, Homo sapiens
uagaauggaccacuga

SEQ ID NO: 1966769 - RNA, 14 nt, Homo sapiens
aauaaaacugagcu

SEQ ID NO: 1966770 - RNA, 13 nt, Homo sapiens
cagaacagucuga

SEQ ID NO: 1966771 - RNA, 22 nt, Homo sapiens
ugagaguuucuggauuagcuuu

SEQ ID NO: 1966772 - RNA, 22 nt, Homo sapiens
ggauggaaagacaaacugcaca

SEQ ID NO: 1966773 - RNA, 19 nt, Homo sapiens
auuucuuaucaccacagua

SEQ ID NO: 1966774 - RNA, 17 nt, Homo sapiens
ggaaaugaucaguuuuu

SEQ ID NO: 1966775 - RNA, 22 nt, Homo sapiens
uauaaucuuguagacacuuacu

SEQ ID NO: 1966776 - RNA, 16 nt, Homo sapiens
ccuggacacgcuggug

SEQ ID NO: 1966777 - RNA, 18 nt, Homo sapiens
cugacaacugugaagcca

SEQ ID NO: 1966778 - RNA, 24 nt, Homo sapiens
uugguauuugcaccaacauaguca

SEQ ID NO: 1966779 - RNA, 20 nt, Homo sapiens
aucuuagugccuuuaucugu

SEQ ID NO: 1966780 - RNA, 13 nt, Homo sapiens
aaugccagcauaa

SEQ ID NO: 1966781 - RNA, 22 nt, Homo sapiens
uaagccgcagagacccucucag

SEQ ID NO: 1966782 - RNA, 20 nt, Homo sapiens
caguuaggguuuugcaauaa

SEQ ID NO: 1966783 - RNA, 20 nt, Homo sapiens
uagaugcauggcuggcacau

SEQ ID NO: 1966784 - RNA, 18 nt, Homo sapiens
uaacaaaucguccaaaga

SEQ ID NO: 1966785 - RNA, 21 nt, Homo sapiens
uccaucugcuuguauuuucca

SEQ ID NO: 1966786 - RNA, 19 nt, Homo sapiens
agcugguugggaagacaug

SEQ ID NO: 1966787 - RNA, 14 nt, Homo sapiens
ugagagccugugau

SEQ ID NO: 1966788 - RNA, 19 nt, Homo sapiens
augccugccaaauuuuaga

SEQ ID NO: 1966789 - RNA, 16 nt, Homo sapiens
cagaacuguuguuuac

SEQ ID NO: 1966790 - RNA, 15 nt, Homo sapiens
guaacacauccacau

SEQ ID NO: 1966791 - RNA, 14 nt, Homo sapiens
uagcuauaacaacu

SEQ ID NO: 1966792 - RNA, 20 nt, Homo sapiens
ugaacaugcucauguguaca

SEQ ID NO: 1966793 - RNA, 16 nt, Homo sapiens
ccaccucccugcaaua

SEQ ID NO: 1966794 - RNA, 24 nt, Homo sapiens
uguuuugauucccgggcuuaccag

SEQ ID NO: 1966795 - RNA, 18 nt, Homo sapiens
ucccagguucaagugcuu

SEQ ID NO: 1966796 - RNA, 13 nt, Homo sapiens
aaccauucuggac

SEQ ID NO: 1966797 - RNA, 15 nt, Homo sapiens
gcucaugagcgucug

SEQ ID NO: 1966798 - RNA, 23 nt, Homo sapiens
uuuugacaucaaugaugaggcuc

SEQ ID NO: 1966799 - RNA, 14 nt, Homo sapiens
aggcacgaggcagu

SEQ ID NO: 1966800 - RNA, 16 nt, Homo sapiens
cuuguuucugcaucuu

SEQ ID NO: 1966801 - RNA, 20 nt, Homo sapiens
uagaauguggauuugauuca

SEQ ID NO: 1966802 - RNA, 21 nt, Homo sapiens
gcuuucccugugccacuuuga

SEQ ID NO: 1966803 - RNA, 17 nt, Homo sapiens
uagggcagcagaucuuc

SEQ ID NO: 1966804 - RNA, 14 nt, Homo sapiens
cucugccacucuua

SEQ ID NO: 1966805 - RNA, 18 nt, Homo sapiens
cuauucugagcauacuca

SEQ ID NO: 1966806 - RNA, 18 nt, Homo sapiens
aaacauguuugcacuugu

SEQ ID NO: 1966807 - RNA, 15 nt, Homo sapiens
aacauucaucaagcu

SEQ ID NO: 1966808 - RNA, 22 nt, Homo sapiens
cagagaaccuuuagaauaucuu

SEQ ID NO: 1966809 - RNA, 12 nt, Homo sapiens
uaaaagugcuuu

SEQ ID NO: 1966810 - RNA, 13 nt, Homo sapiens
aacauugugaugu

SEQ ID NO: 1966811 - RNA, 12 nt, Homo sapiens
ucagcacaaaga

SEQ ID NO: 1966812 - RNA, 16 nt, Homo sapiens
gagaaaauuccuagaa

SEQ ID NO: 1966813 - RNA, 13 nt, Homo sapiens
cuaaacauuuccu

SEQ ID NO: 1966814 - RNA, 15 nt, Homo sapiens
cuguccccaccucca

SEQ ID NO: 1966815 - RNA, 11 nt, Homo sapiens
uagaccaaauc

SEQ ID NO: 1966816 - RNA, 22 nt, Homo sapiens
gcugcugggacuugaacaaaga

SEQ ID NO: 1966817 - RNA, 21 nt, Homo sapiens
gugccuccucccucccucucc

SEQ ID NO: 1966818 - RNA, 17 nt, Homo sapiens
aauuuaaugcuuaaaaa

SEQ ID NO: 1966819 - RNA, 15 nt, Homo sapiens
agaacaacuacugug

SEQ ID NO: 1966820 - RNA, 17 nt, Homo sapiens
uggggugggacagggag

SEQ ID NO: 1966821 - RNA, 16 nt, Homo sapiens
caaugccaugaacaaa

SEQ ID NO: 1966822 - RNA, 12 nt, Homo sapiens
caaaagcuuuuu

SEQ ID NO: 1966823 - RNA, 14 nt, Homo sapiens
ccuuucuaaaccuc

SEQ ID NO: 1966824 - RNA, 16 nt, Homo sapiens
agcaauuccagggugg

SEQ ID NO: 1966825 - RNA, 19 nt, Homo sapiens
gcucuguacaucagacaau

SEQ ID NO: 1966826 - RNA, 23 nt, Homo sapiens
cuuaaaauagaaauaagugguua

SEQ ID NO: 1966827 - RNA, 17 nt, Homo sapiens
uggcaagggaugugcuu

SEQ ID NO: 1966828 - RNA, 18 nt, Homo sapiens
auaugggaggaacaaaga

SEQ ID NO: 1966829 - RNA, 19 nt, Homo sapiens
ugaagggaguggcucugua

SEQ ID NO: 1966830 - RNA, 19 nt, Homo sapiens
auauggaguucuuacuuga

SEQ ID NO: 1966831 - RNA, 21 nt, Homo sapiens
caaagcuuaaaugccuccuuc

SEQ ID NO: 1966832 - RNA, 21 nt, Homo sapiens
caguacacccaguugccaaag

SEQ ID NO: 1966833 - RNA, 21 nt, Homo sapiens
gucgcccaggcuggagugcag

SEQ ID NO: 1966834 - RNA, 21 nt, Homo sapiens
aauccaucuaaauaccugccc

SEQ ID NO: 1966835 - RNA, 15 nt, Homo sapiens
acacaaagacaugga

SEQ ID NO: 1966836 - RNA, 15 nt, Homo sapiens
agguggugaggcaau

SEQ ID NO: 1966837 - RNA, 17 nt, Homo sapiens
gcaacugacagaugacc

SEQ ID NO: 1966838 - RNA, 13 nt, Homo sapiens
aggaaucauucug

SEQ ID NO: 1966839 - RNA, 14 nt, Homo sapiens
caauauacaagcuu

SEQ ID NO: 1966840 - RNA, 18 nt, Homo sapiens
ugugcgagucugagucag

SEQ ID NO: 1966841 - RNA, 21 nt, Homo sapiens
aguaaugaauuuuuaugauau

SEQ ID NO: 1966842 - RNA, 13 nt, Homo sapiens
acugcucaagaac

SEQ ID NO: 1966843 - RNA, 17 nt, Homo sapiens
aaaguggggaguaguca

SEQ ID NO: 1966844 - RNA, 14 nt, Homo sapiens
gcccagugauggca

SEQ ID NO: 1966845 - RNA, 17 nt, Homo sapiens
uggaaacaaaaauguac

SEQ ID NO: 1966846 - RNA, 22 nt, Homo sapiens
uaagacugcuucuaggcuuuau

SEQ ID NO: 1966847 - RNA, 18 nt, Homo sapiens
acuuggaauucucucacc

SEQ ID NO: 1966848 - RNA, 14 nt, Homo sapiens
gccuggaggcuccu

SEQ ID NO: 1966849 - RNA, 15 nt, Homo sapiens
ccucaggcggggugg

SEQ ID NO: 1966850 - RNA, 19 nt, Homo sapiens
ugguuaccaccagccuuuc

SEQ ID NO: 1966851 - RNA, 19 nt, Homo sapiens
uuauaauaaaauugguguu

SEQ ID NO: 1966852 - RNA, 20 nt, Homo sapiens
cuugggaacuguaagcucaa

SEQ ID NO: 1966853 - RNA, 15 nt, Homo sapiens
uuacaaacugcaaua

SEQ ID NO: 1966854 - RNA, 17 nt, Homo sapiens
ucaccucguuacucuca

SEQ ID NO: 1966855 - RNA, 15 nt, Homo sapiens
cgugcacggggccag

SEQ ID NO: 1966856 - RNA, 19 nt, Homo sapiens
cacuuuuuuuuuuucugcc

SEQ ID NO: 1966857 - RNA, 20 nt, Homo sapiens
agaugaggccccggggcaug

SEQ ID NO: 1966858 - RNA, 22 nt, Homo sapiens
uguuucuggggacaccagccau

SEQ ID NO: 1966859 - RNA, 17 nt, Homo sapiens
uucacauugaaacccag

SEQ ID NO: 1966860 - RNA, 23 nt, Homo sapiens
gaugugccuacucccaaggacac

SEQ ID NO: 1966861 - RNA, 21 nt, Homo sapiens
acuuuuuguaaaaagcuucau

SEQ ID NO: 1966862 - RNA, 21 nt, Homo sapiens
gcaccuagaauuggcugaacu

SEQ ID NO: 1966863 - RNA, 20 nt, Homo sapiens
ggaagccggaggguguuuau

SEQ ID NO: 1966864 - RNA, 21 nt, Homo sapiens
cucaguuggugcugcuuucuu

SEQ ID NO: 1966865 - RNA, 15 nt, Homo sapiens
aauucaagcauuuag

SEQ ID NO: 1966866 - RNA, 18 nt, Homo sapiens
gaaaagaaaaaaaauaau

SEQ ID NO: 1966867 - RNA, 15 nt, Homo sapiens
gcaucaaugcugagu

SEQ ID NO: 1966868 - RNA, 13 nt, Homo sapiens
ucuugaaagcugu

SEQ ID NO: 1966869 - RNA, 21 nt, Homo sapiens
ucaccugugcagggcccucug

SEQ ID NO: 1966870 - RNA, 12 nt, Homo sapiens
caaauguucaau

SEQ ID NO: 1966871 - RNA, 14 nt, Homo sapiens
uaaaaucagacucu

SEQ ID NO: 1966872 - RNA, 17 nt, Homo sapiens
cccacacacacuggccu

SEQ ID NO: 1966873 - RNA, 22 nt, Homo sapiens
cuccugugacgcacagcacucc

SEQ ID NO: 1966874 - RNA, 17 nt, Homo sapiens
gaacacuagacaugcca

SEQ ID NO: 1966875 - RNA, 15 nt, Homo sapiens
auuuaugguucucag

SEQ ID NO: 1966876 - RNA, 15 nt, Homo sapiens
caauaaaugaagauu

SEQ ID NO: 1966877 - RNA, 15 nt, Homo sapiens
cagaaguaagccuca

SEQ ID NO: 1966878 - RNA, 18 nt, Homo sapiens
ugugacaccuaacucuuu

SEQ ID NO: 1966879 - RNA, 20 nt, Homo sapiens
gcccaugcuaugaguuuucu

SEQ ID NO: 1966880 - RNA, 18 nt, Homo sapiens
cccccaccucaagugccu

SEQ ID NO: 1966881 - RNA, 14 nt, Homo sapiens
acacacaguccuca

SEQ ID NO: 1966882 - RNA, 17 nt, Homo sapiens
ugacuuuuucagaguug

SEQ ID NO: 1966883 - RNA, 18 nt, Homo sapiens
gcccucacuaacaaagaa

SEQ ID NO: 1966884 - RNA, 16 nt, Homo sapiens
aaagagccacuuucaa

SEQ ID NO: 1966885 - RNA, 14 nt, Homo sapiens
gucuuguucuguga

SEQ ID NO: 1966886 - RNA, 20 nt, Homo sapiens
caguuuauggauaugcugcu

SEQ ID NO: 1966887 - RNA, 11 nt, Homo sapiens
uuggugcugcg

SEQ ID NO: 1966888 - RNA, 23 nt, Homo sapiens
aaaauuaguaauaaaaauaagaa

SEQ ID NO: 1966889 - RNA, 14 nt, Homo sapiens
guacacaccagaag

SEQ ID NO: 1966890 - RNA, 14 nt, Homo sapiens
ccaaaauacagcua

SEQ ID NO: 1966891 - RNA, 23 nt, Homo sapiens
cuuagauauuaaaauuuggugcu

SEQ ID NO: 1966892 - RNA, 15 nt, Homo sapiens
uaugggggcacugag

SEQ ID NO: 1966893 - RNA, 21 nt, Homo sapiens
gaagcccuccaaaagcacuua

SEQ ID NO: 1966894 - RNA, 24 nt, Homo sapiens
agauccacccuaucccuguacaga

SEQ ID NO: 1966895 - RNA, 23 nt, Homo sapiens
uaaaaggacucuccaaauagcau

SEQ ID NO: 1966896 - RNA, 23 nt, Homo sapiens
ugggauuacaggcgugagccacc

SEQ ID NO: 1966897 - RNA, 15 nt, Homo sapiens
ugauuaaagcaagag

SEQ ID NO: 1966898 - RNA, 23 nt, Homo sapiens
uauauuuuuaaaaaucuaccugu

SEQ ID NO: 1966899 - RNA, 21 nt, Homo sapiens
auuuccaucagcccaucucaa

SEQ ID NO: 1966900 - RNA, 23 nt, Homo sapiens
aaauaguguucccagagcacuuu

SEQ ID NO: 1966901 - RNA, 22 nt, Homo sapiens
cagccuggggggucguggcaga

SEQ ID NO: 1966902 - RNA, 21 nt, Homo sapiens
gcucccucccucccagaucca

SEQ ID NO: 1966903 - RNA, 15 nt, Homo sapiens
aauuuuuuaaauuga

SEQ ID NO: 1966904 - RNA, 14 nt, Homo sapiens
ucaaacauuuguca

SEQ ID NO: 1966905 - RNA, 13 nt, Homo sapiens
cauuaacacaaag

SEQ ID NO: 1966906 - RNA, 21 nt, Homo sapiens
caccuggugcuacgaccaggg

SEQ ID NO: 1966907 - RNA, 13 nt, Homo sapiens
uggauuuuuacca

SEQ ID NO: 1966908 - RNA, 13 nt, Homo sapiens
uuuaaaaagcuag

SEQ ID NO: 1966909 - RNA, 16 nt, Homo sapiens
aagggaugcugcaaug

SEQ ID NO: 1966910 - RNA, 20 nt, Homo sapiens
agauuggcucacacugagaa

SEQ ID NO: 1966911 - RNA, 23 nt, Homo sapiens
cccgccuuggccucccaaagugc

SEQ ID NO: 1966912 - RNA, 20 nt, Homo sapiens
uuuccacuugcccuguucuc

SEQ ID NO: 1966913 - RNA, 14 nt, Homo sapiens
gagacugcgggaug

SEQ ID NO: 1966914 - RNA, 15 nt, Homo sapiens
gaaagucuaacuuuu

SEQ ID NO: 1966915 - RNA, 21 nt, Homo sapiens
gccgagauugcgccacugcag

SEQ ID NO: 1966916 - RNA, 17 nt, Homo sapiens
cccucaggcucugugga

SEQ ID NO: 1966917 - RNA, 17 nt, Homo sapiens
uaugacuguaucuugau

SEQ ID NO: 1966918 - RNA, 22 nt, Homo sapiens
aggaucaagucacucaucucag

SEQ ID NO: 1966919 - RNA, 22 nt, Homo sapiens
ugcaccagugccgccugugccc

SEQ ID NO: 1966920 - RNA, 19 nt, Homo sapiens
cuuuaaaaaaacacauaau

SEQ ID NO: 1966921 - RNA, 15 nt, Homo sapiens
guacuaccccaggac

SEQ ID NO: 1966922 - RNA, 20 nt, Homo sapiens
cgaaacuccauugagucauu

SEQ ID NO: 1966923 - RNA, 16 nt, Homo sapiens
cagaugaauaaacuga

SEQ ID NO: 1966924 - RNA, 16 nt, Homo sapiens
aagcuucauguuugau

SEQ ID NO: 1966925 - RNA, 13 nt, Homo sapiens
aaacucuggggcu

SEQ ID NO: 1966926 - RNA, 16 nt, Homo sapiens
cuugaaccugugagua

SEQ ID NO: 1966927 - RNA, 14 nt, Homo sapiens
aucucccaccagcu

SEQ ID NO: 1966928 - RNA, 13 nt, Homo sapiens
agaggagguuugg

SEQ ID NO: 1966929 - RNA, 18 nt, Homo sapiens
uauucggugaugacucuu

SEQ ID NO: 1966930 - RNA, 20 nt, Homo sapiens
gggcccgccucacaccccag

SEQ ID NO: 1966931 - RNA, 18 nt, Homo sapiens
cuuugcugcuggugcuaa

SEQ ID NO: 1966932 - RNA, 11 nt, Homo sapiens
auucccacugc

SEQ ID NO: 1966933 - RNA, 15 nt, Homo sapiens
ggagcaguuugccac

SEQ ID NO: 1966934 - RNA, 11 nt, Homo sapiens
auccccacugu

SEQ ID NO: 1966935 - RNA, 18 nt, Homo sapiens
cuaaagguuaccuguugu

SEQ ID NO: 1966936 - RNA, 15 nt, Homo sapiens
cauucugcccugugg

SEQ ID NO: 1966937 - RNA, 14 nt, Homo sapiens
caccgacuagccag

SEQ ID NO: 1966938 - RNA, 20 nt, Homo sapiens
cuuaaaauuagugagauuaa

SEQ ID NO: 1966939 - RNA, 14 nt, Homo sapiens
aggugcacugcuuu

SEQ ID NO: 1966940 - RNA, 16 nt, Homo sapiens
gacaguuaaguauuuu

SEQ ID NO: 1966941 - RNA, 14 nt, Homo sapiens
uugcugcagauucc

SEQ ID NO: 1966942 - RNA, 15 nt, Homo sapiens
uccugggcuauauuc

SEQ ID NO: 1966943 - RNA, 19 nt, Homo sapiens
ccacuggacagacccaggu

SEQ ID NO: 1966944 - RNA, 18 nt, Homo sapiens
gauuguuuccucuuccaa

SEQ ID NO: 1966945 - RNA, 11 nt, Homo sapiens
gccaaggagcu

SEQ ID NO: 1966946 - RNA, 13 nt, Homo sapiens
ucaggcccaguuc

SEQ ID NO: 1966947 - RNA, 20 nt, Homo sapiens
gccacgcacuuccucucucg

SEQ ID NO: 1966948 - RNA, 15 nt, Homo sapiens
uucacaaauacauaa

SEQ ID NO: 1966949 - RNA, 13 nt, Homo sapiens
aggaugcugucaa

SEQ ID NO: 1966950 - RNA, 16 nt, Homo sapiens
acauggggcucacuca

SEQ ID NO: 1966951 - RNA, 22 nt, Homo sapiens
uugcacgugcucuucuguucuc

SEQ ID NO: 1966952 - RNA, 21 nt, Homo sapiens
uuuaauguagccaugggacca

SEQ ID NO: 1966953 - RNA, 14 nt, Homo sapiens
aguuaauucaccua

SEQ ID NO: 1966954 - RNA, 14 nt, Homo sapiens
cugaauccaucagg

SEQ ID NO: 1966955 - RNA, 15 nt, Homo sapiens
ucaaaauuguuacaa

SEQ ID NO: 1966956 - RNA, 18 nt, Homo sapiens
gcaaugacuguucuugcg

SEQ ID NO: 1966957 - RNA, 16 nt, Homo sapiens
gaauugcaguucagaa

SEQ ID NO: 1966958 - RNA, 21 nt, Homo sapiens
ggaguacaaugcccagaucaa

SEQ ID NO: 1966959 - RNA, 10 nt, Homo sapiens
aaaacauuca

SEQ ID NO: 1966960 - RNA, 13 nt, Homo sapiens
gcucacuaugaau

SEQ ID NO: 1966961 - RNA, 14 nt, Homo sapiens
ccaugauguuacau

SEQ ID NO: 1966962 - RNA, 19 nt, Homo sapiens
uggugucuugcgccuguac

SEQ ID NO: 1966963 - RNA, 21 nt, Homo sapiens
uucuauacuuucucacaugug

SEQ ID NO: 1966964 - RNA, 17 nt, Homo sapiens
gugcucugaucauccac

SEQ ID NO: 1966965 - RNA, 22 nt, Homo sapiens
ugaauagguuccccaauccauc

SEQ ID NO: 1966966 - RNA, 14 nt, Homo sapiens
aaguugcaaucugu

SEQ ID NO: 1966967 - RNA, 23 nt, Homo sapiens
ucuaguuaacauuucaagggcaa

SEQ ID NO: 1966968 - RNA, 21 nt, Homo sapiens
agcacacacacauaagcacug

SEQ ID NO: 1966969 - RNA, 16 nt, Homo sapiens
cuaccgcaaggaccug

SEQ ID NO: 1966970 - RNA, 22 nt, Homo sapiens
aauuaaauauauguauguaaaa

SEQ ID NO: 1966971 - RNA, 16 nt, Homo sapiens
aaagcugcuaaaucuc

SEQ ID NO: 1966972 - RNA, 15 nt, Homo sapiens
uaccagucuauuucc

SEQ ID NO: 1966973 - RNA, 14 nt, Homo sapiens
auagcuuccaugag

SEQ ID NO: 1966974 - RNA, 19 nt, Homo sapiens
uucuccauggaguugcuaa

SEQ ID NO: 1966975 - RNA, 13 nt, Homo sapiens
ugcucaugcugcu

SEQ ID NO: 1966976 - RNA, 18 nt, Homo sapiens
aacugacaagcuccauuu

SEQ ID NO: 1966977 - RNA, 20 nt, Homo sapiens
uggaaaaaaagacugaugaa

SEQ ID NO: 1966978 - RNA, 16 nt, Homo sapiens
aucaucggaguugaca

SEQ ID NO: 1966979 - RNA, 12 nt, Homo sapiens
gcacucuagccu

SEQ ID NO: 1966980 - RNA, 14 nt, Homo sapiens
guucaggugagaaa

SEQ ID NO: 1966981 - RNA, 21 nt, Homo sapiens
agaggugcuucugccugugca

SEQ ID NO: 1966982 - RNA, 14 nt, Homo sapiens
caaaacucaggcag

SEQ ID NO: 1966983 - RNA, 17 nt, Homo sapiens
uagcauuauaccaagag

SEQ ID NO: 1966984 - RNA, 19 nt, Homo sapiens
uaugaguggcuucugggag

SEQ ID NO: 1966985 - RNA, 15 nt, Homo sapiens
auccucccuaucaag

SEQ ID NO: 1966986 - RNA, 23 nt, Homo sapiens
ccaagacucuuuaugaucuggcc

SEQ ID NO: 1966987 - RNA, 18 nt, Homo sapiens
uguugcauguauguguaa

SEQ ID NO: 1966988 - RNA, 20 nt, Homo sapiens
uuccuccagagacacugagc

SEQ ID NO: 1966989 - RNA, 13 nt, Homo sapiens
cagauuucucacc

SEQ ID NO: 1966990 - RNA, 17 nt, Homo sapiens
cuugacuccuugugaug

SEQ ID NO: 1966991 - RNA, 12 nt, Homo sapiens
uuagaaccacaa

SEQ ID NO: 1966992 - RNA, 12 nt, Homo sapiens
auaaaaccucag

SEQ ID NO: 1966993 - RNA, 15 nt, Homo sapiens
aaagcacuuacagau

SEQ ID NO: 1966994 - RNA, 19 nt, Homo sapiens
auccauauagaaaucuaga

SEQ ID NO: 1966995 - RNA, 19 nt, Homo sapiens
ugcaccuacugcuuacugu

SEQ ID NO: 1966996 - RNA, 14 nt, Homo sapiens
agcauugcuuucgu

SEQ ID NO: 1966997 - RNA, 17 nt, Homo sapiens
agcagaguucuuugcaa

SEQ ID NO: 1966998 - RNA, 21 nt, Homo sapiens
uuuugagcacuuuucaaacaa

SEQ ID NO: 1966999 - RNA, 22 nt, Homo sapiens
uaacaauuucccccuguucuua

SEQ ID NO: 1967000 - RNA, 19 nt, Homo sapiens
uaauagacuuaauacaugc

SEQ ID NO: 1967001 - RNA, 20 nt, Homo sapiens
guguugcccucgugcccauc

SEQ ID NO: 1967002 - RNA, 18 nt, Homo sapiens
gucuuuuuuauguuaaaa

SEQ ID NO: 1967003 - RNA, 19 nt, Homo sapiens
agggggcccucugccucau

SEQ ID NO: 1967004 - RNA, 13 nt, Homo sapiens
uuuuuuugcugcu

SEQ ID NO: 1967005 - RNA, 21 nt, Homo sapiens
gauacaucacugcuugaugaa

SEQ ID NO: 1967006 - RNA, 21 nt, Homo sapiens
cccacguagggcggcacucac

SEQ ID NO: 1967007 - RNA, 22 nt, Homo sapiens
cacugugagugguucaagcaca

SEQ ID NO: 1967008 - RNA, 22 nt, Homo sapiens
cugagacuuaagggaacugaau

SEQ ID NO: 1967009 - RNA, 20 nt, Homo sapiens
aagacuggaauauaauuuca

SEQ ID NO: 1967010 - RNA, 22 nt, Homo sapiens
agaaacaauacuguucuauacg

SEQ ID NO: 1967011 - RNA, 16 nt, Homo sapiens
auggcaccuuuugcac

SEQ ID NO: 1967012 - RNA, 23 nt, Homo sapiens
agccaccaugcccagcucagagg

SEQ ID NO: 1967013 - RNA, 18 nt, Homo sapiens
ccaggauugucacuccaa

SEQ ID NO: 1967014 - RNA, 21 nt, Homo sapiens
acaauuucucauacuuagaaa

SEQ ID NO: 1967015 - RNA, 13 nt, Homo sapiens
cuugcuguuuuca

SEQ ID NO: 1967016 - RNA, 23 nt, Homo sapiens
ucaguuagcagacagaaguguag

SEQ ID NO: 1967017 - RNA, 17 nt, Homo sapiens
aggcagagggucacuuu

SEQ ID NO: 1967018 - RNA, 19 nt, Homo sapiens
ccccuucauuuggcauucc

SEQ ID NO: 1967019 - RNA, 15 nt, Homo sapiens
gaaguccuccagaca

SEQ ID NO: 1967020 - RNA, 15 nt, Homo sapiens
caugagacuauguaa

SEQ ID NO: 1967021 - RNA, 20 nt, Homo sapiens
gcacuaggucaaaacauuca

SEQ ID NO: 1967022 - RNA, 19 nt, Homo sapiens
uguguggugucgucuguga

SEQ ID NO: 1967023 - RNA, 22 nt, Homo sapiens
auuguagaaagcuaauacaaaa

SEQ ID NO: 1967024 - RNA, 13 nt, Homo sapiens
augccaucuguuu

SEQ ID NO: 1967025 - RNA, 16 nt, Homo sapiens
ucucgaagcaguauuc

SEQ ID NO: 1967026 - RNA, 20 nt, Homo sapiens
gcuaauuauuuuagcacaaa

SEQ ID NO: 1967027 - RNA, 16 nt, Homo sapiens
acaggcaccacugcuu

SEQ ID NO: 1967028 - RNA, 17 nt, Homo sapiens
gugauauggcggccugc

SEQ ID NO: 1967029 - RNA, 16 nt, Homo sapiens
uagagggaacagggcg

SEQ ID NO: 1967030 - RNA, 13 nt, Homo sapiens
caccaccccagcu

SEQ ID NO: 1967031 - RNA, 19 nt, Homo sapiens
ugcaacccugucauuacgu

SEQ ID NO: 1967032 - RNA, 23 nt, Homo sapiens
aaauggccucucuccacuacccc

SEQ ID NO: 1967033 - RNA, 21 nt, Homo sapiens
ccuugcacuauuggacuuugg

SEQ ID NO: 1967034 - RNA, 19 nt, Homo sapiens
acggacuuacaaccuuguc

SEQ ID NO: 1967035 - RNA, 17 nt, Homo sapiens
caagccacugagcaaug

SEQ ID NO: 1967036 - RNA, 14 nt, Homo sapiens
ccuaauucuuguag

SEQ ID NO: 1967037 - RNA, 13 nt, Homo sapiens
auugguuucuuaa

SEQ ID NO: 1967038 - RNA, 13 nt, Homo sapiens
auuucuaguagca

SEQ ID NO: 1967039 - RNA, 22 nt, Homo sapiens
uuaccuagaagaagcuauguca

SEQ ID NO: 1967040 - RNA, 15 nt, Homo sapiens
cucagagaagaccac

SEQ ID NO: 1967041 - RNA, 16 nt, Homo sapiens
ccuuucaccacaugug

SEQ ID NO: 1967042 - RNA, 15 nt, Homo sapiens
acuuauuaacuaaga

SEQ ID NO: 1967043 - RNA, 15 nt, Homo sapiens
cuuaaauauuuccau

SEQ ID NO: 1967044 - RNA, 15 nt, Homo sapiens
acuacaucugggacu

SEQ ID NO: 1967045 - RNA, 16 nt, Homo sapiens
gacccaggucuuccag

SEQ ID NO: 1967046 - RNA, 20 nt, Homo sapiens
aaucauuguauguggucaug

SEQ ID NO: 1967047 - RNA, 18 nt, Homo sapiens
agcugaaugggcagugua

SEQ ID NO: 1967048 - RNA, 15 nt, Homo sapiens
gaaacacuccuugca

SEQ ID NO: 1967049 - RNA, 15 nt, Homo sapiens
auagaguagaccuga

SEQ ID NO: 1967050 - RNA, 16 nt, Homo sapiens
aggcagcacagugugu

SEQ ID NO: 1967051 - RNA, 21 nt, Homo sapiens
uaugaguguugugccuacuua

SEQ ID NO: 1967052 - RNA, 20 nt, Homo sapiens
cagagugaaauucaauucau

SEQ ID NO: 1967053 - RNA, 18 nt, Homo sapiens
uugccauuuguagcuuug

SEQ ID NO: 1967054 - RNA, 11 nt, Homo sapiens
cacuguacuua

SEQ ID NO: 1967055 - RNA, 22 nt, Homo sapiens
cacuuuguugcaagaugugaau

SEQ ID NO: 1967056 - RNA, 12 nt, Homo sapiens
augugugauuca

SEQ ID NO: 1967057 - RNA, 21 nt, Homo sapiens
cugagcaccuacuuacaugca

SEQ ID NO: 1967058 - RNA, 16 nt, Homo sapiens
uggcucugccucagga

SEQ ID NO: 1967059 - RNA, 14 nt, Homo sapiens
auguacaacauuua

SEQ ID NO: 1967060 - RNA, 19 nt, Homo sapiens
aauaacccuuucuguggua

SEQ ID NO: 1967061 - RNA, 15 nt, Homo sapiens
ggaccugagaccuga

SEQ ID NO: 1967062 - RNA, 15 nt, Homo sapiens
agauggcaauuucac

SEQ ID NO: 1967063 - RNA, 14 nt, Homo sapiens
agagaacaacuacu

SEQ ID NO: 1967064 - RNA, 23 nt, Homo sapiens
agagcuuuuauuugguguguucg

SEQ ID NO: 1967065 - RNA, 14 nt, Homo sapiens
uggucugacuccuu

SEQ ID NO: 1967066 - RNA, 18 nt, Homo sapiens
caauacucaaaagagaga

SEQ ID NO: 1967067 - RNA, 14 nt, Homo sapiens
uguggaaauaugca

SEQ ID NO: 1967068 - RNA, 15 nt, Homo sapiens
cugaugggcaucauu

SEQ ID NO: 1967069 - RNA, 22 nt, Homo sapiens
agauuuuucggaggccccacug

SEQ ID NO: 1967070 - RNA, 20 nt, Homo sapiens
ucugaucugcccccacuguc

SEQ ID NO: 1967071 - RNA, 15 nt, Homo sapiens
guuccugauaaacag

SEQ ID NO: 1967072 - RNA, 16 nt, Homo sapiens
auucacacauggcaug

SEQ ID NO: 1967073 - RNA, 12 nt, Homo sapiens
aaauucaccccc

SEQ ID NO: 1967074 - RNA, 12 nt, Homo sapiens
aaaaacucugaa

SEQ ID NO: 1967075 - RNA, 23 nt, Homo sapiens
cauuacucugcacuauagccauu

SEQ ID NO: 1967076 - RNA, 12 nt, Homo sapiens
cacuauaucaug

SEQ ID NO: 1967077 - RNA, 17 nt, Homo sapiens
uagaaccucaccuguua

SEQ ID NO: 1967078 - RNA, 17 nt, Homo sapiens
aucucuuauuuuacaau

SEQ ID NO: 1967079 - RNA, 19 nt, Homo sapiens
cuguggcuucccaugucuu

SEQ ID NO: 1967080 - RNA, 21 nt, Homo sapiens
ucuggacuauccucuuuggaa

SEQ ID NO: 1967081 - RNA, 14 nt, Homo sapiens
guuuacagacugug

SEQ ID NO: 1967082 - RNA, 23 nt, Homo sapiens
uacaaaugucuucaugaccuacu

SEQ ID NO: 1967083 - RNA, 18 nt, Homo sapiens
aagacugucagcuuccaa

SEQ ID NO: 1967084 - RNA, 23 nt, Homo sapiens
ugaggcacaagaaucacuugaac

SEQ ID NO: 1967085 - RNA, 22 nt, Homo sapiens
gcagaacugcuugaacccagga

SEQ ID NO: 1967086 - RNA, 14 nt, Homo sapiens
ugccgccuacugga

SEQ ID NO: 1967087 - RNA, 13 nt, Homo sapiens
auaaucaaccugg

SEQ ID NO: 1967088 - RNA, 14 nt, Homo sapiens
uuuguaaugcugca

SEQ ID NO: 1967089 - RNA, 14 nt, Homo sapiens
ucgauuaugugacu

SEQ ID NO: 1967090 - RNA, 12 nt, Homo sapiens
uuuuugggacca

SEQ ID NO: 1967091 - RNA, 22 nt, Homo sapiens
gauggggcaugaccucagucag

SEQ ID NO: 1967092 - RNA, 23 nt, Homo sapiens
guaaaggcucuugguaucuuucu

SEQ ID NO: 1967093 - RNA, 17 nt, Homo sapiens
cacucaaagacauuugu

SEQ ID NO: 1967094 - RNA, 18 nt, Homo sapiens
caaucccugacccuuuga

SEQ ID NO: 1967095 - RNA, 23 nt, Homo sapiens
aagacuggaaaauaguccuccaa

SEQ ID NO: 1967096 - RNA, 15 nt, Homo sapiens
auuuuugcucugccc

SEQ ID NO: 1967097 - RNA, 14 nt, Homo sapiens
uucuuuaagaaccu

SEQ ID NO: 1967098 - RNA, 14 nt, Homo sapiens
cuauaaguuuuaga

SEQ ID NO: 1967099 - RNA, 15 nt, Homo sapiens
gagcaagaaaugaac

SEQ ID NO: 1967100 - RNA, 16 nt, Homo sapiens
uuagcugaagaaguua

SEQ ID NO: 1967101 - RNA, 14 nt, Homo sapiens
agucacccuuccac

SEQ ID NO: 1967102 - RNA, 14 nt, Homo sapiens
auuuaucaucucga

SEQ ID NO: 1967103 - RNA, 19 nt, Homo sapiens
agucucgcucugucaccca

SEQ ID NO: 1967104 - RNA, 21 nt, Homo sapiens
gcccucccuggcugugagcag

SEQ ID NO: 1967105 - RNA, 18 nt, Homo sapiens
ugucccaguacaaaaagg

SEQ ID NO: 1967106 - RNA, 16 nt, Homo sapiens
ugcuguggguuuccaa

SEQ ID NO: 1967107 - RNA, 23 nt, Homo sapiens
accgcgaggccuauuguugaaua

SEQ ID NO: 1967108 - RNA, 15 nt, Homo sapiens
uguccuggcauuugu

SEQ ID NO: 1967109 - RNA, 22 nt, Homo sapiens
agauugugccacuucacuccag

SEQ ID NO: 1967110 - RNA, 16 nt, Homo sapiens
gagcucagccugccug

SEQ ID NO: 1967111 - RNA, 17 nt, Homo sapiens
uggaguucucuguucua

SEQ ID NO: 1967112 - RNA, 13 nt, Homo sapiens
ccaucaaaugcug

SEQ ID NO: 1967113 - RNA, 17 nt, Homo sapiens
aaccaucaaaguggcaa

SEQ ID NO: 1967114 - RNA, 21 nt, Homo sapiens
uauaggcauuucacaaaaaca

SEQ ID NO: 1967115 - RNA, 23 nt, Homo sapiens
acccaacagcagugaucucaggg

SEQ ID NO: 1967116 - RNA, 23 nt, Homo sapiens
cauggccguugccucucugccag

SEQ ID NO: 1967117 - RNA, 16 nt, Homo sapiens
aagcaaggugucccug

SEQ ID NO: 1967118 - RNA, 17 nt, Homo sapiens
ggcuucgcgcuggaauc

SEQ ID NO: 1967119 - RNA, 14 nt, Homo sapiens
ccacccccuguucc

SEQ ID NO: 1967120 - RNA, 16 nt, Homo sapiens
auauuuaagugaagga

SEQ ID NO: 1967121 - RNA, 13 nt, Homo sapiens
uaagaauucucuc

SEQ ID NO: 1967122 - RNA, 15 nt, Homo sapiens
gcagggaaacagcua

SEQ ID NO: 1967123 - RNA, 11 nt, Homo sapiens
gugagugcaag

SEQ ID NO: 1967124 - RNA, 14 nt, Homo sapiens
cugaugacaacuuc

SEQ ID NO: 1967125 - RNA, 15 nt, Homo sapiens
gacuauuuagacaaa

SEQ ID NO: 1967126 - RNA, 18 nt, Homo sapiens
gcuccccagaacuggcug

SEQ ID NO: 1967127 - RNA, 22 nt, Homo sapiens
cagguaggcccuuguccugcca

SEQ ID NO: 1967128 - RNA, 21 nt, Homo sapiens
acuguggcacugccaccagca

SEQ ID NO: 1967129 - RNA, 21 nt, Homo sapiens
gagcuggggcugccagccuga

SEQ ID NO: 1967130 - RNA, 18 nt, Homo sapiens
ggaaugucgcagacuccu

SEQ ID NO: 1967131 - RNA, 21 nt, Homo sapiens
ggcucaaggaaaggggguccc

SEQ ID NO: 1967132 - RNA, 15 nt, Homo sapiens
acccugcaaucacuu

SEQ ID NO: 1967133 - RNA, 14 nt, Homo sapiens
aggugugacuugaa

SEQ ID NO: 1967134 - RNA, 20 nt, Homo sapiens
gucuuggcauuaaaccacau

SEQ ID NO: 1967135 - RNA, 20 nt, Homo sapiens
guuuguggccucagaauuga

SEQ ID NO: 1967136 - RNA, 17 nt, Homo sapiens
cuauaccuuacugcaau

SEQ ID NO: 1967137 - RNA, 20 nt, Homo sapiens
accuuagagcaaccucugua

SEQ ID NO: 1967138 - RNA, 17 nt, Homo sapiens
ggaacugcuugugcacu

SEQ ID NO: 1967139 - RNA, 21 nt, Homo sapiens
guugggcuuaugaaaccccaa

SEQ ID NO: 1967140 - RNA, 13 nt, Homo sapiens
gaggcugcaguga

SEQ ID NO: 1967141 - RNA, 23 nt, Homo sapiens
auauaggcuuuaaaaaagcauag

SEQ ID NO: 1967142 - RNA, 18 nt, Homo sapiens
gcacauguguaagacacu

SEQ ID NO: 1967143 - RNA, 14 nt, Homo sapiens
uaaucauauaucaa

SEQ ID NO: 1967144 - RNA, 20 nt, Homo sapiens
uggggagccauaagggacau

SEQ ID NO: 1967145 - RNA, 10 nt, Homo sapiens
ugcaucucau

SEQ ID NO: 1967146 - RNA, 23 nt, Homo sapiens
auuugcaccaguuuuauccauaa

SEQ ID NO: 1967147 - RNA, 20 nt, Homo sapiens
gaacagucagauuuauuuau

SEQ ID NO: 1967148 - RNA, 15 nt, Homo sapiens
gaaagagcauaauga

SEQ ID NO: 1967149 - RNA, 15 nt, Homo sapiens
gaggaagccuucuua

SEQ ID NO: 1967150 - RNA, 17 nt, Homo sapiens
gagcccgugucacagau

SEQ ID NO: 1967151 - RNA, 20 nt, Homo sapiens
acagaacacacugagacuug

SEQ ID NO: 1967152 - RNA, 18 nt, Homo sapiens
aaguacaggucaucugcu

SEQ ID NO: 1967153 - RNA, 16 nt, Homo sapiens
ccaggcaacgugcgug

SEQ ID NO: 1967154 - RNA, 18 nt, Homo sapiens
ggcgauggccaccccaga

SEQ ID NO: 1967155 - RNA, 14 nt, Homo sapiens
accagauaguuaua

SEQ ID NO: 1967156 - RNA, 21 nt, Homo sapiens
uucaaucuuaacaaaagugaa

SEQ ID NO: 1967157 - RNA, 18 nt, Homo sapiens
gauggugacauugaaacu

SEQ ID NO: 1967158 - RNA, 15 nt, Homo sapiens
gcuucuacugugaca

SEQ ID NO: 1967159 - RNA, 15 nt, Homo sapiens
uaaauuuuauaucau

SEQ ID NO: 1967160 - RNA, 19 nt, Homo sapiens
cuccucacccaccucuggg

SEQ ID NO: 1967161 - RNA, 20 nt, Homo sapiens
aucccacuugccccuguuac

SEQ ID NO: 1967162 - RNA, 16 nt, Homo sapiens
cauguuccucaaaagc

SEQ ID NO: 1967163 - RNA, 19 nt, Homo sapiens
acacaugugcagucacugg

SEQ ID NO: 1967164 - RNA, 13 nt, Homo sapiens
uuuugaaaacacu

SEQ ID NO: 1967165 - RNA, 13 nt, Homo sapiens
aaaucauguguug

SEQ ID NO: 1967166 - RNA, 20 nt, Homo sapiens
auacacuuuuuaaaaucuca

SEQ ID NO: 1967167 - RNA, 14 nt, Homo sapiens
gacauuaaaccugg

SEQ ID NO: 1967168 - RNA, 14 nt, Homo sapiens
aaauggaagcaauu

SEQ ID NO: 1967169 - RNA, 15 nt, Homo sapiens
aagcccaaucugcaa

SEQ ID NO: 1967170 - RNA, 19 nt, Homo sapiens
guaaucuguguacaaagaa

SEQ ID NO: 1967171 - RNA, 13 nt, Homo sapiens
acaucuacuacag

SEQ ID NO: 1967172 - RNA, 12 nt, Homo sapiens
caaaacucuccu

SEQ ID NO: 1967173 - RNA, 23 nt, Homo sapiens
aagccucagcaacagccagugga

SEQ ID NO: 1967174 - RNA, 21 nt, Homo sapiens
caaaauguuuucuucaucugu

SEQ ID NO: 1967175 - RNA, 22 nt, Homo sapiens
ccaccccggcccccgaacugug

SEQ ID NO: 1967176 - RNA, 22 nt, Homo sapiens
uccuuauauuuggcccaaacuc

SEQ ID NO: 1967177 - RNA, 16 nt, Homo sapiens
uaaaguaugcauuauu

SEQ ID NO: 1967178 - RNA, 14 nt, Homo sapiens
uucgaacaccaaaa

SEQ ID NO: 1967179 - RNA, 22 nt, Homo sapiens
ccuucaugaucaucacaaucau

SEQ ID NO: 1967180 - RNA, 13 nt, Homo sapiens
aggcuuugagaag

SEQ ID NO: 1967181 - RNA, 18 nt, Homo sapiens
ucaguuaaaucuuugaag

SEQ ID NO: 1967182 - RNA, 17 nt, Homo sapiens
uccacucggagugcccu

SEQ ID NO: 1967183 - RNA, 13 nt, Homo sapiens
uacgaaagcacag

SEQ ID NO: 1967184 - RNA, 17 nt, Homo sapiens
acuuugggauucuuucc

SEQ ID NO: 1967185 - RNA, 12 nt, Homo sapiens
acacucaucaca

SEQ ID NO: 1967186 - RNA, 20 nt, Homo sapiens
gucucaaaggagcuuucuca

SEQ ID NO: 1967187 - RNA, 17 nt, Homo sapiens
agaaauacuuucaggca

SEQ ID NO: 1967188 - RNA, 13 nt, Homo sapiens
auauauucaagag

SEQ ID NO: 1967189 - RNA, 17 nt, Homo sapiens
agugagacuguacauaa

SEQ ID NO: 1967190 - RNA, 21 nt, Homo sapiens
ugccaacuauucucaggccaa

SEQ ID NO: 1967191 - RNA, 16 nt, Homo sapiens
uuaucuuaaaacuccu

SEQ ID NO: 1967192 - RNA, 21 nt, Homo sapiens
aauuaagcagaaagucuucau

SEQ ID NO: 1967193 - RNA, 21 nt, Homo sapiens
agaagaaccauuuacaugcac

SEQ ID NO: 1967194 - RNA, 21 nt, Homo sapiens
gccaggucuagcaaacauaau

SEQ ID NO: 1967195 - RNA, 22 nt, Homo sapiens
uaaguucuaugaagaguauuaa

SEQ ID NO: 1967196 - RNA, 15 nt, Homo sapiens
ugcaugaugaaugac

SEQ ID NO: 1967197 - RNA, 11 nt, Homo sapiens
gaugugcaaca

SEQ ID NO: 1967198 - RNA, 19 nt, Homo sapiens
ccaggcuaguccggaccca

SEQ ID NO: 1967199 - RNA, 20 nt, Homo sapiens
gccuggggcagaaagccaca

SEQ ID NO: 1967200 - RNA, 22 nt, Homo sapiens
cauuucacaggcuaaugggaua

SEQ ID NO: 1967201 - RNA, 21 nt, Homo sapiens
augcuaugcugaagacauuca

SEQ ID NO: 1967202 - RNA, 16 nt, Homo sapiens
cagacuggagugcagu

SEQ ID NO: 1967203 - RNA, 20 nt, Homo sapiens
ucugcaaaaauggauauuau

SEQ ID NO: 1967204 - RNA, 19 nt, Homo sapiens
cagauugaaggaagacaug

SEQ ID NO: 1967205 - RNA, 23 nt, Homo sapiens
ugugcacgcgcgcgugcacacac

SEQ ID NO: 1967206 - RNA, 15 nt, Homo sapiens
cuggaggaacacaga

SEQ ID NO: 1967207 - RNA, 16 nt, Homo sapiens
aacacaaaacuugaaa

SEQ ID NO: 1967208 - RNA, 22 nt, Homo sapiens
agggggugcugggguacccggg

SEQ ID NO: 1967209 - RNA, 20 nt, Homo sapiens
auuguuuuguguaacauauu

SEQ ID NO: 1967210 - RNA, 15 nt, Homo sapiens
agucgggacuuguaa

SEQ ID NO: 1967211 - RNA, 16 nt, Homo sapiens
caaguuguggugcuga

SEQ ID NO: 1967212 - RNA, 19 nt, Homo sapiens
ggcggucaauaauugugga

SEQ ID NO: 1967213 - RNA, 22 nt, Homo sapiens
uuacagugacugucguguuuac

SEQ ID NO: 1967214 - RNA, 16 nt, Homo sapiens
ugcaaguauacuaggg

SEQ ID NO: 1967215 - RNA, 12 nt, Homo sapiens
uugcuaacauau

SEQ ID NO: 1967216 - RNA, 15 nt, Homo sapiens
ugggaacugugccuu

SEQ ID NO: 1967217 - RNA, 23 nt, Homo sapiens
uaaauauccagccaguacaguau

SEQ ID NO: 1967218 - RNA, 20 nt, Homo sapiens
acagagcaagacucugucuc

SEQ ID NO: 1967219 - RNA, 20 nt, Homo sapiens
acagagugagacuccaucuc

SEQ ID NO: 1967220 - RNA, 22 nt, Homo sapiens
cagcggcccugucauccagcuc

SEQ ID NO: 1967221 - RNA, 14 nt, Homo sapiens
ccccuggcucugac

SEQ ID NO: 1967222 - RNA, 14 nt, Homo sapiens
auaaccucuggccc

SEQ ID NO: 1967223 - RNA, 23 nt, Homo sapiens
cuccccuuuuagaauuuaccucu

SEQ ID NO: 1967224 - RNA, 16 nt, Homo sapiens
accagacacguacaaa

SEQ ID NO: 1967225 - RNA, 12 nt, Homo sapiens
agugaaaacuga

SEQ ID NO: 1967226 - RNA, 21 nt, Homo sapiens
ugugaauagcaguggcaaaau

SEQ ID NO: 1967227 - RNA, 14 nt, Homo sapiens
cuguacccaguuuc

SEQ ID NO: 1967228 - RNA, 16 nt, Homo sapiens
gaacauaaaugcacaa

SEQ ID NO: 1967229 - RNA, 12 nt, Homo sapiens
gauaaugggaga

SEQ ID NO: 1967230 - RNA, 12 nt, Homo sapiens
auguauggauuu

SEQ ID NO: 1967231 - RNA, 18 nt, Homo sapiens
caagcuguaucacugccu

SEQ ID NO: 1967232 - RNA, 13 nt, Homo sapiens
ugaaaaguuuuca

SEQ ID NO: 1967233 - RNA, 16 nt, Homo sapiens
uaacaucuagcccuuu

SEQ ID NO: 1967234 - RNA, 13 nt, Homo sapiens
aauaaacuacucu

SEQ ID NO: 1967235 - RNA, 13 nt, Homo sapiens
aaaauacuacaca

SEQ ID NO: 1967236 - RNA, 14 nt, Homo sapiens
uacuggcaauuugu

SEQ ID NO: 1967237 - RNA, 15 nt, Homo sapiens
uuugaaacuaucuca

SEQ ID NO: 1967238 - RNA, 16 nt, Homo sapiens
uccuacccacaccucu

SEQ ID NO: 1967239 - RNA, 15 nt, Homo sapiens
ugggacauggcacag

SEQ ID NO: 1967240 - RNA, 13 nt, Homo sapiens
gaaauaugucaaa

SEQ ID NO: 1967241 - RNA, 13 nt, Homo sapiens
guuauacuccuca

SEQ ID NO: 1967242 - RNA, 19 nt, Homo sapiens
accaagaugaucacaugga

SEQ ID NO: 1967243 - RNA, 17 nt, Homo sapiens
cauaaagucaucaaagu

SEQ ID NO: 1967244 - RNA, 20 nt, Homo sapiens
gcugcuuuucccuaagccaa

SEQ ID NO: 1967245 - RNA, 16 nt, Homo sapiens
cucuagagagccuuaa

SEQ ID NO: 1967246 - RNA, 15 nt, Homo sapiens
augucucugacaaag

SEQ ID NO: 1967247 - RNA, 19 nt, Homo sapiens
aacaacaggcacacaccac

SEQ ID NO: 1967248 - RNA, 13 nt, Homo sapiens
gcacacucagugg

SEQ ID NO: 1967249 - RNA, 19 nt, Homo sapiens
uuuaaaauauuuagucuaa

SEQ ID NO: 1967250 - RNA, 17 nt, Homo sapiens
aggucauaaacacugca

SEQ ID NO: 1967251 - RNA, 14 nt, Homo sapiens
ccuguuaucaguag

SEQ ID NO: 1967252 - RNA, 23 nt, Homo sapiens
aagcauuuaaccccccuguacac

SEQ ID NO: 1967253 - RNA, 22 nt, Homo sapiens
acugagaaauagugcacuccaa

SEQ ID NO: 1967254 - RNA, 17 nt, Homo sapiens
aagguggggacagggau

SEQ ID NO: 1967255 - RNA, 18 nt, Homo sapiens
aaugauaugcaagugcaa

SEQ ID NO: 1967256 - RNA, 17 nt, Homo sapiens
uucaaaaaaucagcaau

SEQ ID NO: 1967257 - RNA, 17 nt, Homo sapiens
ugaauggaaaacacaug

SEQ ID NO: 1967258 - RNA, 20 nt, Homo sapiens
gcuacuuaacaaaguaaaca

SEQ ID NO: 1967259 - RNA, 21 nt, Homo sapiens
ugugcaguggccccauccagc

SEQ ID NO: 1967260 - RNA, 17 nt, Homo sapiens
uuauaaauaaauaucuc

SEQ ID NO: 1967261 - RNA, 22 nt, Homo sapiens
uugacaucauucaugacaacau

SEQ ID NO: 1967262 - RNA, 18 nt, Homo sapiens
uuucugucuugucuucaa

SEQ ID NO: 1967263 - RNA, 19 nt, Homo sapiens
uacaguuaaagaagcaauc

SEQ ID NO: 1967264 - RNA, 17 nt, Homo sapiens
auuuccuguuugaaaua

SEQ ID NO: 1967265 - RNA, 21 nt, Homo sapiens
agauugcuagaaaagacauaa

SEQ ID NO: 1967266 - RNA, 15 nt, Homo sapiens
agccgggaaggggaa

SEQ ID NO: 1967267 - RNA, 16 nt, Homo sapiens
cuggcucacaguacag

SEQ ID NO: 1967268 - RNA, 14 nt, Homo sapiens
uaugcugugcuaaa

SEQ ID NO: 1967269 - RNA, 16 nt, Homo sapiens
ccagccugggagauag

SEQ ID NO: 1967270 - RNA, 19 nt, Homo sapiens
gccagguaugcaaauaucg

SEQ ID NO: 1967271 - RNA, 17 nt, Homo sapiens
gugaccuaaccacuuag

SEQ ID NO: 1967272 - RNA, 24 nt, Homo sapiens
auuugcacaaacuugugagcauca

SEQ ID NO: 1967273 - RNA, 23 nt, Homo sapiens
ucaugccaccauggccagccaac

SEQ ID NO: 1967274 - RNA, 23 nt, Homo sapiens
aguuuccucagaacccacaguga

SEQ ID NO: 1967275 - RNA, 23 nt, Homo sapiens
cacugacauuauaucauggcauu

SEQ ID NO: 1967276 - RNA, 14 nt, Homo sapiens
gacagaaacagggg

SEQ ID NO: 1967277 - RNA, 19 nt, Homo sapiens
auaaaaaaguguccuauaa

SEQ ID NO: 1967278 - RNA, 17 nt, Homo sapiens
gaagaucuaauaccauc

SEQ ID NO: 1967279 - RNA, 15 nt, Homo sapiens
aaauagaacauucca

SEQ ID NO: 1967280 - RNA, 22 nt, Homo sapiens
gugcuaauaaaguuaaauugca

SEQ ID NO: 1967281 - RNA, 22 nt, Homo sapiens
cucauucuuuauucuauuuuag

SEQ ID NO: 1967282 - RNA, 13 nt, Homo sapiens
augccacuaugag

SEQ ID NO: 1967283 - RNA, 20 nt, Homo sapiens
uagcuaauaacaugugaaaa

SEQ ID NO: 1967284 - RNA, 11 nt, Homo sapiens
aaucauuugag

SEQ ID NO: 1967285 - RNA, 13 nt, Homo sapiens
caugaaaacuggg

SEQ ID NO: 1967286 - RNA, 14 nt, Homo sapiens
ugaggaacugucuc

SEQ ID NO: 1967287 - RNA, 15 nt, Homo sapiens
caccagucacugucc

SEQ ID NO: 1967288 - RNA, 15 nt, Homo sapiens
ugauaaauaaaguca

SEQ ID NO: 1967289 - RNA, 15 nt, Homo sapiens
agccugagccuuaga

SEQ ID NO: 1967290 - RNA, 19 nt, Homo sapiens
gaaaucuauuucauaccau

SEQ ID NO: 1967291 - RNA, 21 nt, Homo sapiens
gaugcggaaggauugcaaugc

SEQ ID NO: 1967292 - RNA, 21 nt, Homo sapiens
aacaucucccauggcucuccc

SEQ ID NO: 1967293 - RNA, 22 nt, Homo sapiens
ugggggcaccuuaagauuuugc

SEQ ID NO: 1967294 - RNA, 18 nt, Homo sapiens
ucuuagcugaacaaugaa

SEQ ID NO: 1967295 - RNA, 17 nt, Homo sapiens
augucuuaaugcaaauu

SEQ ID NO: 1967296 - RNA, 14 nt, Homo sapiens
aucuuuaacugacu

SEQ ID NO: 1967297 - RNA, 21 nt, Homo sapiens
accuugcucccaauggugcuu

SEQ ID NO: 1967298 - RNA, 15 nt, Homo sapiens
aauugcaacuucuaa

SEQ ID NO: 1967299 - RNA, 23 nt, Homo sapiens
agugccuuaucaaauaauauuca

SEQ ID NO: 1967300 - RNA, 17 nt, Homo sapiens
ggcuccuuuacaaaaga

SEQ ID NO: 1967301 - RNA, 22 nt, Homo sapiens
guuucggggugaagcaaguuca

SEQ ID NO: 1967302 - RNA, 20 nt, Homo sapiens
gcccugcccuccuuugccuu

SEQ ID NO: 1967303 - RNA, 13 nt, Homo sapiens
gggagacugagcu

SEQ ID NO: 1967304 - RNA, 17 nt, Homo sapiens
caugaauuaguucuccu

SEQ ID NO: 1967305 - RNA, 22 nt, Homo sapiens
ccccaggccuggcacgucaaag

SEQ ID NO: 1967306 - RNA, 19 nt, Homo sapiens
gaaauuccaggaaccaaaa

SEQ ID NO: 1967307 - RNA, 14 nt, Homo sapiens
uauuuuaugaucca

SEQ ID NO: 1967308 - RNA, 16 nt, Homo sapiens
ugagaucauucacuca

SEQ ID NO: 1967309 - RNA, 16 nt, Homo sapiens
cugcaaaaaaagccuc

SEQ ID NO: 1967310 - RNA, 19 nt, Homo sapiens
acuuccaauuuauaaugaa

SEQ ID NO: 1967311 - RNA, 14 nt, Homo sapiens
caacccccaucucc

SEQ ID NO: 1967312 - RNA, 16 nt, Homo sapiens
agaaaaaaaguugcaa

SEQ ID NO: 1967313 - RNA, 14 nt, Homo sapiens
agugacaaggcccu

SEQ ID NO: 1967314 - RNA, 22 nt, Homo sapiens
gauggacuugugauuggcugca

SEQ ID NO: 1967315 - RNA, 22 nt, Homo sapiens
cuccuugucacagaaucuccau

SEQ ID NO: 1967316 - RNA, 14 nt, Homo sapiens
agggcuggguguau

SEQ ID NO: 1967317 - RNA, 19 nt, Homo sapiens
agacaccuuuuguauuuaa

SEQ ID NO: 1967318 - RNA, 11 nt, Homo sapiens
augagcaugaa

SEQ ID NO: 1967319 - RNA, 16 nt, Homo sapiens
uagaucuacacucucg

SEQ ID NO: 1967320 - RNA, 20 nt, Homo sapiens
agguauauaaauuuucccaa

SEQ ID NO: 1967321 - RNA, 13 nt, Homo sapiens
auacacagaggag

SEQ ID NO: 1967322 - RNA, 17 nt, Homo sapiens
accaaguuaucaucuca

SEQ ID NO: 1967323 - RNA, 18 nt, Homo sapiens
acaaguagccaccugagu

SEQ ID NO: 1967324 - RNA, 15 nt, Homo sapiens
ucauauugugccaau

SEQ ID NO: 1967325 - RNA, 13 nt, Homo sapiens
uaaaaaccgaaua

SEQ ID NO: 1967326 - RNA, 19 nt, Homo sapiens
caagugauuugggggugca

SEQ ID NO: 1967327 - RNA, 18 nt, Homo sapiens
uccauuuccuaauguaua

SEQ ID NO: 1967328 - RNA, 21 nt, Homo sapiens
cuugggugaacuaaccaaaua

SEQ ID NO: 1967329 - RNA, 15 nt, Homo sapiens
gacguggguugcacu

SEQ ID NO: 1967330 - RNA, 22 nt, Homo sapiens
auuaauuuuuaaggauguugcc

SEQ ID NO: 1967331 - RNA, 18 nt, Homo sapiens
auuuaaccuguuauuucu

SEQ ID NO: 1967332 - RNA, 14 nt, Homo sapiens
uguaaucagcaaua

SEQ ID NO: 1967333 - RNA, 22 nt, Homo sapiens
aagaaguguuccuucauuaacu

SEQ ID NO: 1967334 - RNA, 16 nt, Homo sapiens
gccagaggacugugau

SEQ ID NO: 1967335 - RNA, 18 nt, Homo sapiens
cagcuuuaaaaucuguuc

SEQ ID NO: 1967336 - RNA, 17 nt, Homo sapiens
ggcccacagcccagcga

SEQ ID NO: 1967337 - RNA, 21 nt, Homo sapiens
uggccuacccagauuguauca

SEQ ID NO: 1967338 - RNA, 14 nt, Homo sapiens
caauaucaugugau

SEQ ID NO: 1967339 - RNA, 16 nt, Homo sapiens
uccagcggcccuguca

SEQ ID NO: 1967340 - RNA, 23 nt, Homo sapiens
gaaaaauaaaaugcaaaugcacu

SEQ ID NO: 1967341 - RNA, 20 nt, Homo sapiens
ucaaguuuuucauacuguac

SEQ ID NO: 1967342 - RNA, 16 nt, Homo sapiens
agaacaagucaccucc

SEQ ID NO: 1967343 - RNA, 15 nt, Homo sapiens
gaaaaguaucacucu

SEQ ID NO: 1967344 - RNA, 23 nt, Homo sapiens
cacuuuggguuuuuaacucaucu

SEQ ID NO: 1967345 - RNA, 23 nt, Homo sapiens
cucccauagcgcuggcucaggaa

SEQ ID NO: 1967346 - RNA, 20 nt, Homo sapiens
uugcagugagccaagaucac

SEQ ID NO: 1967347 - RNA, 18 nt, Homo sapiens
gauaacucugagcaguuu

SEQ ID NO: 1967348 - RNA, 17 nt, Homo sapiens
uacugccaaccuggaau

SEQ ID NO: 1967349 - RNA, 17 nt, Homo sapiens
uucaugggaaaacagac

SEQ ID NO: 1967350 - RNA, 14 nt, Homo sapiens
gccccacccaagcc

SEQ ID NO: 1967351 - RNA, 20 nt, Homo sapiens
cucaagccggaaacucggca

SEQ ID NO: 1967352 - RNA, 16 nt, Homo sapiens
cagggccucugucaau

SEQ ID NO: 1967353 - RNA, 17 nt, Homo sapiens
auguacgauucacuccu

SEQ ID NO: 1967354 - RNA, 18 nt, Homo sapiens
agagcaaaccuaacagga

SEQ ID NO: 1967355 - RNA, 19 nt, Homo sapiens
auguguucaggcauuccag

SEQ ID NO: 1967356 - RNA, 15 nt, Homo sapiens
ucaaaacuguacugu

SEQ ID NO: 1967357 - RNA, 18 nt, Homo sapiens
agauacaggacauucuca

SEQ ID NO: 1967358 - RNA, 23 nt, Homo sapiens
agcaucagagguuugcuuccuca

SEQ ID NO: 1967359 - RNA, 17 nt, Homo sapiens
agcuugagcugccucug

SEQ ID NO: 1967360 - RNA, 17 nt, Homo sapiens
agaugaagaagccuuug

SEQ ID NO: 1967361 - RNA, 19 nt, Homo sapiens
cuuauuucucaucacauca

SEQ ID NO: 1967362 - RNA, 23 nt, Homo sapiens
ugauggccaggccucagggacca

SEQ ID NO: 1967363 - RNA, 17 nt, Homo sapiens
auauaaaaaaucuuuag

SEQ ID NO: 1967364 - RNA, 15 nt, Homo sapiens
accaggucaucuccu

SEQ ID NO: 1967365 - RNA, 21 nt, Homo sapiens
auuaaugcuugaauauuacug

SEQ ID NO: 1967366 - RNA, 13 nt, Homo sapiens
aaagucucucuuc

SEQ ID NO: 1967367 - RNA, 15 nt, Homo sapiens
augcaucuggcccag

SEQ ID NO: 1967368 - RNA, 23 nt, Homo sapiens
ucgccauccgucaccagaauuag

SEQ ID NO: 1967369 - RNA, 21 nt, Homo sapiens
augauuccuuccuguucugaa

SEQ ID NO: 1967370 - RNA, 18 nt, Homo sapiens
agcugagaauagaaggaa

SEQ ID NO: 1967371 - RNA, 22 nt, Homo sapiens
uguauucuacccuguugcaaag

SEQ ID NO: 1967372 - RNA, 20 nt, Homo sapiens
ucccacuuugugccaaauga

SEQ ID NO: 1967373 - RNA, 17 nt, Homo sapiens
cagccugaggugcccac

SEQ ID NO: 1967374 - RNA, 12 nt, Homo sapiens
caccccuaccac

SEQ ID NO: 1967375 - RNA, 19 nt, Homo sapiens
cuucaagagcaucuggaac

SEQ ID NO: 1967376 - RNA, 15 nt, Homo sapiens
ugccugaaccuucca

SEQ ID NO: 1967377 - RNA, 14 nt, Homo sapiens
gauugcuggggcca

SEQ ID NO: 1967378 - RNA, 16 nt, Homo sapiens
ccuucuagacacugaa

SEQ ID NO: 1967379 - RNA, 17 nt, Homo sapiens
aaucuuucugugucuuc

SEQ ID NO: 1967380 - RNA, 18 nt, Homo sapiens
uuuagauaugacauuuau

SEQ ID NO: 1967381 - RNA, 14 nt, Homo sapiens
aaaguguuuucaca

SEQ ID NO: 1967382 - RNA, 17 nt, Homo sapiens
acgacaguacacuguca

SEQ ID NO: 1967383 - RNA, 22 nt, Homo sapiens
auguuaacacucaugaagcaua

SEQ ID NO: 1967384 - RNA, 18 nt, Homo sapiens
cggaagugaccacagaag

SEQ ID NO: 1967385 - RNA, 23 nt, Homo sapiens
gcccaagugauccuuccaccuca

SEQ ID NO: 1967386 - RNA, 17 nt, Homo sapiens
acauuaaggaauuugau

SEQ ID NO: 1967387 - RNA, 16 nt, Homo sapiens
accagauuaaacuuca

SEQ ID NO: 1967388 - RNA, 16 nt, Homo sapiens
acaggagcguguccua

SEQ ID NO: 1967389 - RNA, 17 nt, Homo sapiens
uaccugcucaugguuau

SEQ ID NO: 1967390 - RNA, 12 nt, Homo sapiens
augggaucugua

SEQ ID NO: 1967391 - RNA, 16 nt, Homo sapiens
ggggucacuugcaauu

SEQ ID NO: 1967392 - RNA, 23 nt, Homo sapiens
uugggauuacaggugacugccac

SEQ ID NO: 1967393 - RNA, 21 nt, Homo sapiens
agaacuuagccuuuaccugug

SEQ ID NO: 1967394 - RNA, 18 nt, Homo sapiens
caccuccugacaguauua

SEQ ID NO: 1967395 - RNA, 14 nt, Homo sapiens
aguauucucagagc

SEQ ID NO: 1967396 - RNA, 15 nt, Homo sapiens
uaaaaaagccuuccu

SEQ ID NO: 1967397 - RNA, 18 nt, Homo sapiens
uaggcuaagucagcugaa

SEQ ID NO: 1967398 - RNA, 12 nt, Homo sapiens
uggaauucuucu

SEQ ID NO: 1967399 - RNA, 12 nt, Homo sapiens
cuugaaauacca

SEQ ID NO: 1967400 - RNA, 15 nt, Homo sapiens
gucagagccacucua

SEQ ID NO: 1967401 - RNA, 16 nt, Homo sapiens
uuaucaugguauuuga

SEQ ID NO: 1967402 - RNA, 23 nt, Homo sapiens
aggcuucaauuuauugcacaaaa

SEQ ID NO: 1967403 - RNA, 14 nt, Homo sapiens
ucaccaaacaugaa

SEQ ID NO: 1967404 - RNA, 17 nt, Homo sapiens
cagggaugccaacaccu

SEQ ID NO: 1967405 - RNA, 11 nt, Homo sapiens
agaaugcucuu

SEQ ID NO: 1967406 - RNA, 20 nt, Homo sapiens
uaacugacaaaccauugaaa

SEQ ID NO: 1967407 - RNA, 12 nt, Homo sapiens
agauucugggaa

SEQ ID NO: 1967408 - RNA, 12 nt, Homo sapiens
aaguucuggaga

SEQ ID NO: 1967409 - RNA, 18 nt, Homo sapiens
ugugagucuucacuaaaa

SEQ ID NO: 1967410 - RNA, 22 nt, Homo sapiens
caaggaguuuauuacaauguau

SEQ ID NO: 1967411 - RNA, 19 nt, Homo sapiens
cacuauggggggaggugua

SEQ ID NO: 1967412 - RNA, 16 nt, Homo sapiens
ccagccuccaugcugc

SEQ ID NO: 1967413 - RNA, 21 nt, Homo sapiens
acuucucugccuuugacauuu

SEQ ID NO: 1967414 - RNA, 12 nt, Homo sapiens
ggaaugccugag

SEQ ID NO: 1967415 - RNA, 16 nt, Homo sapiens
uauccaaagacuguac

SEQ ID NO: 1967416 - RNA, 19 nt, Homo sapiens
aggcucugggcucagggcu

SEQ ID NO: 1967417 - RNA, 16 nt, Homo sapiens
caagaucauagcucau

SEQ ID NO: 1967418 - RNA, 11 nt, Homo sapiens
uuaagauaucu

SEQ ID NO: 1967419 - RNA, 13 nt, Homo sapiens
cccaaauguauug

SEQ ID NO: 1967420 - RNA, 18 nt, Homo sapiens
uauaauuugcuggaacac

SEQ ID NO: 1967421 - RNA, 20 nt, Homo sapiens
accaagcuggcuuguuucuu

SEQ ID NO: 1967422 - RNA, 20 nt, Homo sapiens
aagugcugcgauuacaggca

SEQ ID NO: 1967423 - RNA, 22 nt, Homo sapiens
gagguggcuucauguggcacuu

SEQ ID NO: 1967424 - RNA, 15 nt, Homo sapiens
caugauuuuuuacaa

SEQ ID NO: 1967425 - RNA, 13 nt, Homo sapiens
cuggugggacagu

SEQ ID NO: 1967426 - RNA, 23 nt, Homo sapiens
aggcuuuguagcaagaugagcaa

SEQ ID NO: 1967427 - RNA, 13 nt, Homo sapiens
uuacucuuugaac

SEQ ID NO: 1967428 - RNA, 22 nt, Homo sapiens
gcugggaagcccggacugacca

SEQ ID NO: 1967429 - RNA, 16 nt, Homo sapiens
uacuuugauaucugau

SEQ ID NO: 1967430 - RNA, 21 nt, Homo sapiens
ucacucccaggugagaauuca

SEQ ID NO: 1967431 - RNA, 19 nt, Homo sapiens
cucaaaaacaaagaguauc

SEQ ID NO: 1967432 - RNA, 21 nt, Homo sapiens
ucucagccauaaagugccagu

SEQ ID NO: 1967433 - RNA, 22 nt, Homo sapiens
accauguuggcuagacuagucu

SEQ ID NO: 1967434 - RNA, 15 nt, Homo sapiens
augaggaaaugaucc

SEQ ID NO: 1967435 - RNA, 20 nt, Homo sapiens
accacgaggaaaagaacaaa

SEQ ID NO: 1967436 - RNA, 20 nt, Homo sapiens
gauugugccacugcucucca

SEQ ID NO: 1967437 - RNA, 16 nt, Homo sapiens
cuuuucccacucucau

SEQ ID NO: 1967438 - RNA, 13 nt, Homo sapiens
uuucagaacaaac

SEQ ID NO: 1967439 - RNA, 22 nt, Homo sapiens
aacgccuaaaccucgguauuag

SEQ ID NO: 1967440 - RNA, 19 nt, Homo sapiens
uaccacccucgcugccacc

SEQ ID NO: 1967441 - RNA, 15 nt, Homo sapiens
agcuccaauuucaag

SEQ ID NO: 1967442 - RNA, 15 nt, Homo sapiens
acuaugugcaaaaau

SEQ ID NO: 1967443 - RNA, 22 nt, Homo sapiens
aagauguuuacucauugccccc

SEQ ID NO: 1967444 - RNA, 23 nt, Homo sapiens
uacagguuagaagcaaggcacaa

SEQ ID NO: 1967445 - RNA, 14 nt, Homo sapiens
ggaagcgagcuuug

SEQ ID NO: 1967446 - RNA, 14 nt, Homo sapiens
ccuuuggggagcag

SEQ ID NO: 1967447 - RNA, 12 nt, Homo sapiens
cuguuuguacug

SEQ ID NO: 1967448 - RNA, 14 nt, Homo sapiens
uccuuaucagugcc

SEQ ID NO: 1967449 - RNA, 14 nt, Homo sapiens
ucugucucagcuca

SEQ ID NO: 1967450 - RNA, 19 nt, Homo sapiens
ccagagaggguggugaccu

SEQ ID NO: 1967451 - RNA, 17 nt, Homo sapiens
cucuaagucauguaugu

SEQ ID NO: 1967452 - RNA, 18 nt, Homo sapiens
aaagcuugaagcugugga

SEQ ID NO: 1967453 - RNA, 22 nt, Homo sapiens
aaaggugaauguugagggcccu

SEQ ID NO: 1967454 - RNA, 16 nt, Homo sapiens
cucuucaauaaaccac

SEQ ID NO: 1967455 - RNA, 12 nt, Homo sapiens
cugcccucccaa

SEQ ID NO: 1967456 - RNA, 15 nt, Homo sapiens
gagaguaagcacuua

SEQ ID NO: 1967457 - RNA, 19 nt, Homo sapiens
augaagauggacauuuuag

SEQ ID NO: 1967458 - RNA, 24 nt, Homo sapiens
cuaaagagcugcacagcaaaagaa

SEQ ID NO: 1967459 - RNA, 16 nt, Homo sapiens
auguauuaugagccaa

SEQ ID NO: 1967460 - RNA, 19 nt, Homo sapiens
ggaaucuuuuacuguggag

SEQ ID NO: 1967461 - RNA, 19 nt, Homo sapiens
aguuauacaucuucauuaa

SEQ ID NO: 1967462 - RNA, 15 nt, Homo sapiens
aggacacauuuggac

SEQ ID NO: 1967463 - RNA, 21 nt, Homo sapiens
ucccuugugggaaacugaggc

SEQ ID NO: 1967464 - RNA, 18 nt, Homo sapiens
agcccccugaccuuccaa

SEQ ID NO: 1967465 - RNA, 15 nt, Homo sapiens
ccagccuacauucac

SEQ ID NO: 1967466 - RNA, 17 nt, Homo sapiens
acgcucauucagcaucu

SEQ ID NO: 1967467 - RNA, 22 nt, Homo sapiens
ugcaacugggucugacaugaac

SEQ ID NO: 1967468 - RNA, 19 nt, Homo sapiens
gaagaagaucaacgccuca

SEQ ID NO: 1967469 - RNA, 14 nt, Homo sapiens
cuaguaucacuuuu

SEQ ID NO: 1967470 - RNA, 13 nt, Homo sapiens
aagucaucuugcu

SEQ ID NO: 1967471 - RNA, 13 nt, Homo sapiens
cugcugaggcucc

SEQ ID NO: 1967472 - RNA, 15 nt, Homo sapiens
gugucacagcuuugu

SEQ ID NO: 1967473 - RNA, 12 nt, Homo sapiens
ugcaacuggaga

SEQ ID NO: 1967474 - RNA, 18 nt, Homo sapiens
cuuugaaucuaguuguua

SEQ ID NO: 1967475 - RNA, 21 nt, Homo sapiens
agcccuugcacagcuggagaa

SEQ ID NO: 1967476 - RNA, 18 nt, Homo sapiens
aggcuguucucagcguuu

SEQ ID NO: 1967477 - RNA, 13 nt, Homo sapiens
aaagagacaggga

SEQ ID NO: 1967478 - RNA, 14 nt, Homo sapiens
uguacaaguugaaa

SEQ ID NO: 1967479 - RNA, 19 nt, Homo sapiens
caugguacuccaugcauuc

SEQ ID NO: 1967480 - RNA, 15 nt, Homo sapiens
cucugaaaguuguca

SEQ ID NO: 1967481 - RNA, 19 nt, Homo sapiens
aggcacaagaaucacuuga

SEQ ID NO: 1967482 - RNA, 12 nt, Homo sapiens
aaaauacaugau

SEQ ID NO: 1967483 - RNA, 18 nt, Homo sapiens
cucccuguuuuaauucaa

SEQ ID NO: 1967484 - RNA, 15 nt, Homo sapiens
gcuucucagccccuu

SEQ ID NO: 1967485 - RNA, 15 nt, Homo sapiens
aaaacucugcaugua

SEQ ID NO: 1967486 - RNA, 16 nt, Homo sapiens
aaauaaagaguucucc

SEQ ID NO: 1967487 - RNA, 17 nt, Homo sapiens
cuaggagguaaugacca

SEQ ID NO: 1967488 - RNA, 18 nt, Homo sapiens
ccaaagagaccagccucc

SEQ ID NO: 1967489 - RNA, 14 nt, Homo sapiens
ucagcucaccucaa

SEQ ID NO: 1967490 - RNA, 23 nt, Homo sapiens
aaugccauccagaugugugcaau

SEQ ID NO: 1967491 - RNA, 22 nt, Homo sapiens
ucccuaauucucuucgcuguga

SEQ ID NO: 1967492 - RNA, 21 nt, Homo sapiens
guauguugguuuuuuagugca

SEQ ID NO: 1967493 - RNA, 16 nt, Homo sapiens
ccagccagcaguucag

SEQ ID NO: 1967494 - RNA, 23 nt, Homo sapiens
gacaggaauucucccuggcauug

SEQ ID NO: 1967495 - RNA, 16 nt, Homo sapiens
aaagcucugucaauaa

SEQ ID NO: 1967496 - RNA, 20 nt, Homo sapiens
ugauaauuguguaccuuaag

SEQ ID NO: 1967497 - RNA, 18 nt, Homo sapiens
auacucuguguaaucucu

SEQ ID NO: 1967498 - RNA, 18 nt, Homo sapiens
cagauucuucucucucaa

SEQ ID NO: 1967499 - RNA, 13 nt, Homo sapiens
aaucucauuucaa

SEQ ID NO: 1967500 - RNA, 14 nt, Homo sapiens
uuuaucccauggaa

SEQ ID NO: 1967501 - RNA, 14 nt, Homo sapiens
uuauauaauucuga

SEQ ID NO: 1967502 - RNA, 14 nt, Homo sapiens
ucgguccuggugcc

SEQ ID NO: 1967503 - RNA, 17 nt, Homo sapiens
cucaguucccucuugcu

SEQ ID NO: 1967504 - RNA, 18 nt, Homo sapiens
ccucagcuucuucacagg

SEQ ID NO: 1967505 - RNA, 15 nt, Homo sapiens
cuguuaguguuaaaa

SEQ ID NO: 1967506 - RNA, 12 nt, Homo sapiens
acuuugugaaaa

SEQ ID NO: 1967507 - RNA, 17 nt, Homo sapiens
cuuugcugcagucaucu

SEQ ID NO: 1967508 - RNA, 23 nt, Homo sapiens
ccuuaguguuuggguauauucau

SEQ ID NO: 1967509 - RNA, 15 nt, Homo sapiens
aguuagauuauugaa

SEQ ID NO: 1967510 - RNA, 13 nt, Homo sapiens
uaaaagcugcaua

SEQ ID NO: 1967511 - RNA, 12 nt, Homo sapiens
cccugguccuuc

SEQ ID NO: 1967512 - RNA, 13 nt, Homo sapiens
gaggauugcacua

SEQ ID NO: 1967513 - RNA, 15 nt, Homo sapiens
auagcaaugugauuu

SEQ ID NO: 1967514 - RNA, 15 nt, Homo sapiens
acugccaaccagagc

SEQ ID NO: 1967515 - RNA, 17 nt, Homo sapiens
aaaguuuguuuuacuuu

SEQ ID NO: 1967516 - RNA, 12 nt, Homo sapiens
uuucuagaagac

SEQ ID NO: 1967517 - RNA, 19 nt, Homo sapiens
ggagacugcauucccugcc

SEQ ID NO: 1967518 - RNA, 16 nt, Homo sapiens
guaauuguacaagcag

SEQ ID NO: 1967519 - RNA, 20 nt, Homo sapiens
ucuguuucuucaaugguucu

SEQ ID NO: 1967520 - RNA, 18 nt, Homo sapiens
gaaguaaacagauggcac

SEQ ID NO: 1967521 - RNA, 13 nt, Homo sapiens
aagugugugcaca

SEQ ID NO: 1967522 - RNA, 20 nt, Homo sapiens
cucccaggccccaggggaga

SEQ ID NO: 1967523 - RNA, 20 nt, Homo sapiens
gaggcaggucugggccagau

SEQ ID NO: 1967524 - RNA, 18 nt, Homo sapiens
uccauuccccugcugcca

SEQ ID NO: 1967525 - RNA, 20 nt, Homo sapiens
acguuucugggcggccagug

SEQ ID NO: 1967526 - RNA, 14 nt, Homo sapiens
cagugagcucuuua

SEQ ID NO: 1967527 - RNA, 13 nt, Homo sapiens
aauuuccaugugu

SEQ ID NO: 1967528 - RNA, 18 nt, Homo sapiens
aacgggccagcucuagua

SEQ ID NO: 1967529 - RNA, 21 nt, Homo sapiens
uuacaaggaguaacaaaacag

SEQ ID NO: 1967530 - RNA, 16 nt, Homo sapiens
cuuuuuauugccuucu

SEQ ID NO: 1967531 - RNA, 18 nt, Homo sapiens
gugcuugagugugugaac

SEQ ID NO: 1967532 - RNA, 22 nt, Homo sapiens
ccaccuggggaguuuacuaccu

SEQ ID NO: 1967533 - RNA, 15 nt, Homo sapiens
cuagaaccaagcacu

SEQ ID NO: 1967534 - RNA, 11 nt, Homo sapiens
aaaauggucaa

SEQ ID NO: 1967535 - RNA, 12 nt, Homo sapiens
uuguuguuucuu

SEQ ID NO: 1967536 - RNA, 22 nt, Homo sapiens
cuaccacauucacuacugcaaa

SEQ ID NO: 1967537 - RNA, 19 nt, Homo sapiens
uguauuuaauaaguacaac

SEQ ID NO: 1967538 - RNA, 14 nt, Homo sapiens
aaauuugugucaua

SEQ ID NO: 1967539 - RNA, 19 nt, Homo sapiens
ccuguauuuaacaaaaagu

SEQ ID NO: 1967540 - RNA, 21 nt, Homo sapiens
uauaauagaugacaguggcaa

SEQ ID NO: 1967541 - RNA, 24 nt, Homo sapiens
acacgcacgcacacgcacacaucu

SEQ ID NO: 1967542 - RNA, 15 nt, Homo sapiens
aaaauggaauacucu

SEQ ID NO: 1967543 - RNA, 19 nt, Homo sapiens
ccgccacugggccugucac

SEQ ID NO: 1967544 - RNA, 23 nt, Homo sapiens
ucauugacuuaggggaguucagu

SEQ ID NO: 1967545 - RNA, 18 nt, Homo sapiens
uuauccuagucauucuuc

SEQ ID NO: 1967546 - RNA, 15 nt, Homo sapiens
acuguagcuuuacaa

SEQ ID NO: 1967547 - RNA, 22 nt, Homo sapiens
uucaaugguugggacaauggca

SEQ ID NO: 1967548 - RNA, 19 nt, Homo sapiens
ucucaagcuaguguuucua

SEQ ID NO: 1967549 - RNA, 19 nt, Homo sapiens
gucacagugauaccaguuc

SEQ ID NO: 1967550 - RNA, 15 nt, Homo sapiens
ggccuugcucuucuc

SEQ ID NO: 1967551 - RNA, 14 nt, Homo sapiens
aagcccacuuuguu

SEQ ID NO: 1967552 - RNA, 12 nt, Homo sapiens
agggcuugccua

SEQ ID NO: 1967553 - RNA, 14 nt, Homo sapiens
gaaagugcauauga

SEQ ID NO: 1967554 - RNA, 22 nt, Homo sapiens
aggaguugugagcccucuaggg

SEQ ID NO: 1967555 - RNA, 17 nt, Homo sapiens
ucacguaguucuagcag

SEQ ID NO: 1967556 - RNA, 10 nt, Homo sapiens
agagcucuau

SEQ ID NO: 1967557 - RNA, 14 nt, Homo sapiens
aucuuugugccaaa

SEQ ID NO: 1967558 - RNA, 18 nt, Homo sapiens
aguuccugcacuccagaa

SEQ ID NO: 1967559 - RNA, 17 nt, Homo sapiens
gaauguuuuacugugaa

SEQ ID NO: 1967560 - RNA, 15 nt, Homo sapiens
gauacagaacucuuu

SEQ ID NO: 1967561 - RNA, 15 nt, Homo sapiens
aaacuuuagcaacag

SEQ ID NO: 1967562 - RNA, 20 nt, Homo sapiens
cuggagccugcaauaaggga

SEQ ID NO: 1967563 - RNA, 16 nt, Homo sapiens
cucuuaguucuuaccu

SEQ ID NO: 1967564 - RNA, 13 nt, Homo sapiens
aucagaucuuaca

SEQ ID NO: 1967565 - RNA, 20 nt, Homo sapiens
acaccugccucuuccugcag

SEQ ID NO: 1967566 - RNA, 15 nt, Homo sapiens
uucccaaggccaguc

SEQ ID NO: 1967567 - RNA, 19 nt, Homo sapiens
gaagcugaggcugcugcca

SEQ ID NO: 1967568 - RNA, 19 nt, Homo sapiens
ucuaccacaagggcucucu

SEQ ID NO: 1967569 - RNA, 18 nt, Homo sapiens
gcuacccaucugccagau

SEQ ID NO: 1967570 - RNA, 22 nt, Homo sapiens
auauuacacaucaagcgaugaa

SEQ ID NO: 1967571 - RNA, 13 nt, Homo sapiens
auucuggacuaaa

SEQ ID NO: 1967572 - RNA, 20 nt, Homo sapiens
aaccuggaaucuacaagcca

SEQ ID NO: 1967573 - RNA, 20 nt, Homo sapiens
cuuggcuucuuaaaaacugu

SEQ ID NO: 1967574 - RNA, 14 nt, Homo sapiens
gguugcuacuuuau

SEQ ID NO: 1967575 - RNA, 23 nt, Homo sapiens
uucaugugccgugccuuaucuga

SEQ ID NO: 1967576 - RNA, 14 nt, Homo sapiens
ugaccugagccaga

SEQ ID NO: 1967577 - RNA, 16 nt, Homo sapiens
auuucauuagaggaag

SEQ ID NO: 1967578 - RNA, 17 nt, Homo sapiens
guagcugggacuacagg

SEQ ID NO: 1967579 - RNA, 20 nt, Homo sapiens
caacaauugugugaauuaau

SEQ ID NO: 1967580 - RNA, 16 nt, Homo sapiens
guugcaucauguugaa

SEQ ID NO: 1967581 - RNA, 17 nt, Homo sapiens
ugccuaaaucccaagaa

SEQ ID NO: 1967582 - RNA, 22 nt, Homo sapiens
agcauggcauauuuuucacaua

SEQ ID NO: 1967583 - RNA, 16 nt, Homo sapiens
aggaggguugugcuac

SEQ ID NO: 1967584 - RNA, 17 nt, Homo sapiens
guauugugucuuuugca

SEQ ID NO: 1967585 - RNA, 20 nt, Homo sapiens
uccuauucaacacacacaug

SEQ ID NO: 1967586 - RNA, 13 nt, Homo sapiens
guccucuugccuc

SEQ ID NO: 1967587 - RNA, 21 nt, Homo sapiens
gugaaccauggugaagugcuu

SEQ ID NO: 1967588 - RNA, 19 nt, Homo sapiens
ggcucguguuucacagugg

SEQ ID NO: 1967589 - RNA, 23 nt, Homo sapiens
augguuugaaguggagucucaug

SEQ ID NO: 1967590 - RNA, 20 nt, Homo sapiens
cuuucagacaagaaugugca

SEQ ID NO: 1967591 - RNA, 19 nt, Homo sapiens
uguuucucagacuggucuc

SEQ ID NO: 1967592 - RNA, 15 nt, Homo sapiens
uucugguuacugugg

SEQ ID NO: 1967593 - RNA, 22 nt, Homo sapiens
uuaaugauaaacucagaucuga

SEQ ID NO: 1967594 - RNA, 21 nt, Homo sapiens
ggagacagggcugcuccccaa

SEQ ID NO: 1967595 - RNA, 13 nt, Homo sapiens
uagcagcugugau

SEQ ID NO: 1967596 - RNA, 15 nt, Homo sapiens
ucaguccaugucucg

SEQ ID NO: 1967597 - RNA, 20 nt, Homo sapiens
gaaaccccccagagcucuuu

SEQ ID NO: 1967598 - RNA, 23 nt, Homo sapiens
gugauccuucaucgaacaaacug

SEQ ID NO: 1967599 - RNA, 19 nt, Homo sapiens
aaucuaacuacaaggacaa

SEQ ID NO: 1967600 - RNA, 21 nt, Homo sapiens
gagaagguuuaugggcauccu

SEQ ID NO: 1967601 - RNA, 21 nt, Homo sapiens
aaagcccacgucaggaccaca

SEQ ID NO: 1967602 - RNA, 22 nt, Homo sapiens
ccagguaggaugaacacaggca

SEQ ID NO: 1967603 - RNA, 14 nt, Homo sapiens
gucuuaaucguccu

SEQ ID NO: 1967604 - RNA, 21 nt, Homo sapiens
gauguaugaggaaaaagcgag

SEQ ID NO: 1967605 - RNA, 15 nt, Homo sapiens
augucucagaccacu

SEQ ID NO: 1967606 - RNA, 21 nt, Homo sapiens
acauaugucuuacuacuuuaa

SEQ ID NO: 1967607 - RNA, 14 nt, Homo sapiens
gaagccaccucucu

SEQ ID NO: 1967608 - RNA, 21 nt, Homo sapiens
auuuccccccuccgccuccag

SEQ ID NO: 1967609 - RNA, 21 nt, Homo sapiens
gacagcacagccaaccuagcu

SEQ ID NO: 1967610 - RNA, 21 nt, Homo sapiens
auaguuaauaacuggaaaaag

SEQ ID NO: 1967611 - RNA, 16 nt, Homo sapiens
agcucuugugaacugu

SEQ ID NO: 1967612 - RNA, 12 nt, Homo sapiens
uugaaagacauc

SEQ ID NO: 1967613 - RNA, 22 nt, Homo sapiens
ugugcaguauaauuuucuaauu

SEQ ID NO: 1967614 - RNA, 15 nt, Homo sapiens
uuagcaaaacuggac

SEQ ID NO: 1967615 - RNA, 20 nt, Homo sapiens
agccugcucuagugggacag

SEQ ID NO: 1967616 - RNA, 20 nt, Homo sapiens
cugaccuucuccagggacag

SEQ ID NO: 1967617 - RNA, 18 nt, Homo sapiens
cccaugggggugcugcag

SEQ ID NO: 1967618 - RNA, 22 nt, Homo sapiens
uacaauaaaaccuuugccacuu

SEQ ID NO: 1967619 - RNA, 22 nt, Homo sapiens
aauggcaugcugaaacucgaag

SEQ ID NO: 1967620 - RNA, 18 nt, Homo sapiens
aaauuuauauuacuggca

SEQ ID NO: 1967621 - RNA, 21 nt, Homo sapiens
auguugcccacauuaagcacu

SEQ ID NO: 1967622 - RNA, 17 nt, Homo sapiens
aauuccaugucagauaa

SEQ ID NO: 1967623 - RNA, 23 nt, Homo sapiens
uugaauucauguacaugguauua

SEQ ID NO: 1967624 - RNA, 22 nt, Homo sapiens
aagcaaaccuguaagugucuug

SEQ ID NO: 1967625 - RNA, 15 nt, Homo sapiens
acccacaacaccuca

SEQ ID NO: 1967626 - RNA, 22 nt, Homo sapiens
gcugccuuguuucaccuuccau

SEQ ID NO: 1967627 - RNA, 14 nt, Homo sapiens
aaaaucaugaauau

SEQ ID NO: 1967628 - RNA, 17 nt, Homo sapiens
auaaugaaugucaugca

SEQ ID NO: 1967629 - RNA, 20 nt, Homo sapiens
cuuuugagugugugugugca

SEQ ID NO: 1967630 - RNA, 16 nt, Homo sapiens
aaaaugcugcauucua

SEQ ID NO: 1967631 - RNA, 17 nt, Homo sapiens
ucgaacauggaacucau

SEQ ID NO: 1967632 - RNA, 16 nt, Homo sapiens
uggagaguugguuuca

SEQ ID NO: 1967633 - RNA, 20 nt, Homo sapiens
ccaucucacaccaguccaaa

SEQ ID NO: 1967634 - RNA, 14 nt, Homo sapiens
cgcuuaagcuuuca

SEQ ID NO: 1967635 - RNA, 21 nt, Homo sapiens
aaauauaucuagaacuaucau

SEQ ID NO: 1967636 - RNA, 20 nt, Homo sapiens
aagcacaagcagagugcaca

SEQ ID NO: 1967637 - RNA, 14 nt, Homo sapiens
auuggaagagcaca

SEQ ID NO: 1967638 - RNA, 12 nt, Homo sapiens
uaguuuuuaccu

SEQ ID NO: 1967639 - RNA, 23 nt, Homo sapiens
cuguguugcccugacuggaguuc

SEQ ID NO: 1967640 - RNA, 22 nt, Homo sapiens
ucagaaguaacucccacuccua

SEQ ID NO: 1967641 - RNA, 19 nt, Homo sapiens
uuuguagauguauuuucaa

SEQ ID NO: 1967642 - RNA, 13 nt, Homo sapiens
cugucagcugcaa

SEQ ID NO: 1967643 - RNA, 15 nt, Homo sapiens
aagucaucauaaaag

SEQ ID NO: 1967644 - RNA, 22 nt, Homo sapiens
agacccccaucucugcaaaaaa

SEQ ID NO: 1967645 - RNA, 23 nt, Homo sapiens
gcuucaggaaccucgaguacugu

SEQ ID NO: 1967646 - RNA, 16 nt, Homo sapiens
guuugacuagccaucu

SEQ ID NO: 1967647 - RNA, 16 nt, Homo sapiens
gucugugaagucaaga

SEQ ID NO: 1967648 - RNA, 18 nt, Homo sapiens
gcccaggacacugccuuu

SEQ ID NO: 1967649 - RNA, 19 nt, Homo sapiens
uaagacauaaacaaagaca

SEQ ID NO: 1967650 - RNA, 21 nt, Homo sapiens
ucuccugaggaucagaaagua

SEQ ID NO: 1967651 - RNA, 14 nt, Homo sapiens
gacacuuaauacua

SEQ ID NO: 1967652 - RNA, 11 nt, Homo sapiens
agggucacugu

SEQ ID NO: 1967653 - RNA, 23 nt, Homo sapiens
acauaccaaagcugcugcacagc

SEQ ID NO: 1967654 - RNA, 19 nt, Homo sapiens
uuugcccuuggaggauccc

SEQ ID NO: 1967655 - RNA, 14 nt, Homo sapiens
agaaucaggcacuu

SEQ ID NO: 1967656 - RNA, 18 nt, Homo sapiens
uaggcuuguguaauuucc

SEQ ID NO: 1967657 - RNA, 12 nt, Homo sapiens
cucucucugagg

SEQ ID NO: 1967658 - RNA, 16 nt, Homo sapiens
uccauuaaauugccuu

SEQ ID NO: 1967659 - RNA, 23 nt, Homo sapiens
gaguccaggacaggagaugcugu

SEQ ID NO: 1967660 - RNA, 24 nt, Homo sapiens
ugggaugaaacuaaagcaauagaa

SEQ ID NO: 1967661 - RNA, 21 nt, Homo sapiens
cagggcauuguguucacugua

SEQ ID NO: 1967662 - RNA, 21 nt, Homo sapiens
ccaaaccuuacucugagcuca

SEQ ID NO: 1967663 - RNA, 20 nt, Homo sapiens
ugagaagaaagaaccaacca

SEQ ID NO: 1967664 - RNA, 13 nt, Homo sapiens
ucuuuucacaaau

SEQ ID NO: 1967665 - RNA, 13 nt, Homo sapiens
auaauuaauuacu

SEQ ID NO: 1967666 - RNA, 12 nt, Homo sapiens
gcaugacugugc

SEQ ID NO: 1967667 - RNA, 14 nt, Homo sapiens
ccagaccaccugcc

SEQ ID NO: 1967668 - RNA, 14 nt, Homo sapiens
guaaaacaguuaca

SEQ ID NO: 1967669 - RNA, 16 nt, Homo sapiens
ucagauucugugagac

SEQ ID NO: 1967670 - RNA, 17 nt, Homo sapiens
agagucucauguagcug

SEQ ID NO: 1967671 - RNA, 17 nt, Homo sapiens
gugucuccuguuucaga

SEQ ID NO: 1967672 - RNA, 12 nt, Homo sapiens
agaagcacuuga

SEQ ID NO: 1967673 - RNA, 12 nt, Homo sapiens
augugcacugau

SEQ ID NO: 1967674 - RNA, 20 nt, Homo sapiens
uugucuuuccuggcacuaac

SEQ ID NO: 1967675 - RNA, 21 nt, Homo sapiens
uccaucucccaaggcugccag

SEQ ID NO: 1967676 - RNA, 22 nt, Homo sapiens
augauugcuaugucaggcuuuc

SEQ ID NO: 1967677 - RNA, 17 nt, Homo sapiens
cagccuuggaucaggac

SEQ ID NO: 1967678 - RNA, 13 nt, Homo sapiens
gauaggcuuuauu

SEQ ID NO: 1967679 - RNA, 15 nt, Homo sapiens
uaacuauugcugcuu

SEQ ID NO: 1967680 - RNA, 16 nt, Homo sapiens
acaccgucccucagug

SEQ ID NO: 1967681 - RNA, 16 nt, Homo sapiens
aaacauuccauccuug

SEQ ID NO: 1967682 - RNA, 13 nt, Homo sapiens
aggggacauuucc

SEQ ID NO: 1967683 - RNA, 23 nt, Homo sapiens
ccaaguaugacaaccucuuugag

SEQ ID NO: 1967684 - RNA, 16 nt, Homo sapiens
aguguggacaugagca

SEQ ID NO: 1967685 - RNA, 12 nt, Homo sapiens
uuaaacugauua

SEQ ID NO: 1967686 - RNA, 15 nt, Homo sapiens
ucagugauaccuccu

SEQ ID NO: 1967687 - RNA, 18 nt, Homo sapiens
ggcaagagaugaauugca

SEQ ID NO: 1967688 - RNA, 13 nt, Homo sapiens
cagggcugugcuu

SEQ ID NO: 1967689 - RNA, 23 nt, Homo sapiens
uucaucucauuuuuaagaacaag

SEQ ID NO: 1967690 - RNA, 15 nt, Homo sapiens
cgcaacaacaaggac

SEQ ID NO: 1967691 - RNA, 21 nt, Homo sapiens
aucuuaggauuuaccaaauag

SEQ ID NO: 1967692 - RNA, 13 nt, Homo sapiens
gggcacugucaug

SEQ ID NO: 1967693 - RNA, 18 nt, Homo sapiens
acaaaagugaucucuggu

SEQ ID NO: 1967694 - RNA, 21 nt, Homo sapiens
cuguaaucucagcacuuuggg

SEQ ID NO: 1967695 - RNA, 23 nt, Homo sapiens
cagaagguguguccuugaacuga

SEQ ID NO: 1967696 - RNA, 23 nt, Homo sapiens
auauuauauaaauaguauuucag

SEQ ID NO: 1967697 - RNA, 17 nt, Homo sapiens
aaaccacagucuuccca

SEQ ID NO: 1967698 - RNA, 20 nt, Homo sapiens
accuaaaauuucaaguuuaa

SEQ ID NO: 1967699 - RNA, 16 nt, Homo sapiens
cacagcugcuggagaa

SEQ ID NO: 1967700 - RNA, 14 nt, Homo sapiens
gcugucuccaugcu

SEQ ID NO: 1967701 - RNA, 14 nt, Homo sapiens
ccuacccucacuca

SEQ ID NO: 1967702 - RNA, 15 nt, Homo sapiens
uacuuaaaaugacaa

SEQ ID NO: 1967703 - RNA, 10 nt, Homo sapiens
acccaaagau

SEQ ID NO: 1967704 - RNA, 10 nt, Homo sapiens
ccccaaagcu

SEQ ID NO: 1967705 - RNA, 17 nt, Homo sapiens
cucucugugcucuugca

SEQ ID NO: 1967706 - RNA, 13 nt, Homo sapiens
gaaaaaaacugaa

SEQ ID NO: 1967707 - RNA, 14 nt, Homo sapiens
auaaaaucuggcca

SEQ ID NO: 1967708 - RNA, 16 nt, Homo sapiens
uguccucuuucagcuc

SEQ ID NO: 1967709 - RNA, 12 nt, Homo sapiens
aaugugcuauaa

SEQ ID NO: 1967710 - RNA, 21 nt, Homo sapiens
uugauauggagggaacacuga

SEQ ID NO: 1967711 - RNA, 15 nt, Homo sapiens
ggaugcgcagugccu

SEQ ID NO: 1967712 - RNA, 15 nt, Homo sapiens
cugcucccuagccag

SEQ ID NO: 1967713 - RNA, 15 nt, Homo sapiens
auucucccuugcucu

SEQ ID NO: 1967714 - RNA, 16 nt, Homo sapiens
ucgaagccaugugcug

SEQ ID NO: 1967715 - RNA, 23 nt, Homo sapiens
gaaacuuuccuuugucauuauua

SEQ ID NO: 1967716 - RNA, 12 nt, Homo sapiens
ugcugggaccug

SEQ ID NO: 1967717 - RNA, 19 nt, Homo sapiens
uugccuaagacuugcccaa

SEQ ID NO: 1967718 - RNA, 15 nt, Homo sapiens
uuggggagacaucaa

SEQ ID NO: 1967719 - RNA, 16 nt, Homo sapiens
gcccauuuaauguggu

SEQ ID NO: 1967720 - RNA, 20 nt, Homo sapiens
cuuguggagaacaugcauac

SEQ ID NO: 1967721 - RNA, 13 nt, Homo sapiens
ugagaucaugcca

SEQ ID NO: 1967722 - RNA, 16 nt, Homo sapiens
aauucugggaauccac

SEQ ID NO: 1967723 - RNA, 22 nt, Homo sapiens
uaaaagcacacucauccccuca

SEQ ID NO: 1967724 - RNA, 19 nt, Homo sapiens
gcccucucauucucacucc

SEQ ID NO: 1967725 - RNA, 19 nt, Homo sapiens
gagucccuuugcgccucuu

SEQ ID NO: 1967726 - RNA, 22 nt, Homo sapiens
ugaaguguucugcugagacuga

SEQ ID NO: 1967727 - RNA, 15 nt, Homo sapiens
aacauagacucacuc

SEQ ID NO: 1967728 - RNA, 15 nt, Homo sapiens
uggcgugagccuguc

SEQ ID NO: 1967729 - RNA, 18 nt, Homo sapiens
ccagagaacaagcacugu

SEQ ID NO: 1967730 - RNA, 14 nt, Homo sapiens
gccaaagugccugg

SEQ ID NO: 1967731 - RNA, 18 nt, Homo sapiens
gacgaauuugcacaguga

SEQ ID NO: 1967732 - RNA, 19 nt, Homo sapiens
cauuuauuuaagacacugu

SEQ ID NO: 1967733 - RNA, 14 nt, Homo sapiens
caauaaaccaauga

SEQ ID NO: 1967734 - RNA, 18 nt, Homo sapiens
caaggggucaaugucaua

SEQ ID NO: 1967735 - RNA, 13 nt, Homo sapiens
aagucucuucucu

SEQ ID NO: 1967736 - RNA, 20 nt, Homo sapiens
agguagccagggggacuagc

SEQ ID NO: 1967737 - RNA, 23 nt, Homo sapiens
ggaugccaaccggucacccagga

SEQ ID NO: 1967738 - RNA, 22 nt, Homo sapiens
gauguguccaguuugugcucua

SEQ ID NO: 1967739 - RNA, 16 nt, Homo sapiens
caggccagggcugggu

SEQ ID NO: 1967740 - RNA, 18 nt, Homo sapiens
cacugccugucccagaga

SEQ ID NO: 1967741 - RNA, 16 nt, Homo sapiens
gagaguuugaaaaaug

SEQ ID NO: 1967742 - RNA, 20 nt, Homo sapiens
ccagcuucucucuccagggu

SEQ ID NO: 1967743 - RNA, 21 nt, Homo sapiens
auugucccuguguugucccau

SEQ ID NO: 1967744 - RNA, 16 nt, Homo sapiens
aaacaaggaagccaaa

SEQ ID NO: 1967745 - RNA, 12 nt, Homo sapiens
uccaugugcuag

SEQ ID NO: 1967746 - RNA, 23 nt, Homo sapiens
ucuuaguaaaaagcccuauguga

SEQ ID NO: 1967747 - RNA, 23 nt, Homo sapiens
gcaacugggucugacaugaacac

SEQ ID NO: 1967748 - RNA, 15 nt, Homo sapiens
ucagguaccaaggaa

SEQ ID NO: 1967749 - RNA, 19 nt, Homo sapiens
accuguagaagaugaccuc

SEQ ID NO: 1967750 - RNA, 18 nt, Homo sapiens
agauauggaccaucagug

SEQ ID NO: 1967751 - RNA, 22 nt, Homo sapiens
gcaaagccuagccugcauauca

SEQ ID NO: 1967752 - RNA, 11 nt, Homo sapiens
cugagccaugg

SEQ ID NO: 1967753 - RNA, 19 nt, Homo sapiens
acugcuuauaaacauuuaa

SEQ ID NO: 1967754 - RNA, 18 nt, Homo sapiens
uagauuuauuuuuccauc

SEQ ID NO: 1967755 - RNA, 23 nt, Homo sapiens
uaguuguaaaccaagugaucaaa

SEQ ID NO: 1967756 - RNA, 13 nt, Homo sapiens
cauuggagcauuu

SEQ ID NO: 1967757 - RNA, 20 nt, Homo sapiens
gcuucccugucuauugccuu

SEQ ID NO: 1967758 - RNA, 12 nt, Homo sapiens
aaccuagaauuu

SEQ ID NO: 1967759 - RNA, 17 nt, Homo sapiens
gccagugggcagugcau

SEQ ID NO: 1967760 - RNA, 23 nt, Homo sapiens
ucacuguagaaugauuucaugcu

SEQ ID NO: 1967761 - RNA, 16 nt, Homo sapiens
aaaaaugcauauacuu

SEQ ID NO: 1967762 - RNA, 21 nt, Homo sapiens
ucuacagccucagaaaccaga

SEQ ID NO: 1967763 - RNA, 15 nt, Homo sapiens
gauuacacauuucac

SEQ ID NO: 1967764 - RNA, 16 nt, Homo sapiens
cccaccuccaucaaac

SEQ ID NO: 1967765 - RNA, 22 nt, Homo sapiens
gcuuuggcuuuuuccaucucaa

SEQ ID NO: 1967766 - RNA, 12 nt, Homo sapiens
cuuauccugaca

SEQ ID NO: 1967767 - RNA, 12 nt, Homo sapiens
cuucuccugacc

SEQ ID NO: 1967768 - RNA, 12 nt, Homo sapiens
auacauugcaau

SEQ ID NO: 1967769 - RNA, 22 nt, Homo sapiens
ugcaauuucucccgaauccuga

SEQ ID NO: 1967770 - RNA, 17 nt, Homo sapiens
aaggcaaugcucaaaca

SEQ ID NO: 1967771 - RNA, 23 nt, Homo sapiens
aaagacugugcugagaagcagua

SEQ ID NO: 1967772 - RNA, 23 nt, Homo sapiens
ucugcauaaauauuagcaaagca

SEQ ID NO: 1967773 - RNA, 23 nt, Homo sapiens
gaaggaaacggaagcugacauaa

SEQ ID NO: 1967774 - RNA, 15 nt, Homo sapiens
aagcuucaugcacuu

SEQ ID NO: 1967775 - RNA, 13 nt, Homo sapiens
uccuccucuguga

SEQ ID NO: 1967776 - RNA, 11 nt, Homo sapiens
cucacuuuaaa

SEQ ID NO: 1967777 - RNA, 20 nt, Homo sapiens
uacaacaucuguuacauucu

SEQ ID NO: 1967778 - RNA, 22 nt, Homo sapiens
uugaaccugugcucauuuugca

SEQ ID NO: 1967779 - RNA, 21 nt, Homo sapiens
ucuuacuaauguaaaaugauu

SEQ ID NO: 1967780 - RNA, 22 nt, Homo sapiens
auuucccuggaauuuaauucaa

SEQ ID NO: 1967781 - RNA, 13 nt, Homo sapiens
cuaauauuuacua

SEQ ID NO: 1967782 - RNA, 14 nt, Homo sapiens
uaaaaaaacuucca

SEQ ID NO: 1967783 - RNA, 16 nt, Homo sapiens
auggacaucuugucau

SEQ ID NO: 1967784 - RNA, 17 nt, Homo sapiens
acagugcucaaggccag

SEQ ID NO: 1967785 - RNA, 21 nt, Homo sapiens
cccacgggaaaggagcugcuu

SEQ ID NO: 1967786 - RNA, 13 nt, Homo sapiens
gcaaugcacugaa

SEQ ID NO: 1967787 - RNA, 17 nt, Homo sapiens
uccagacagagcccugu

SEQ ID NO: 1967788 - RNA, 14 nt, Homo sapiens
ggcccuccugcugg

SEQ ID NO: 1967789 - RNA, 20 nt, Homo sapiens
aagugaguguuucuaugagu

SEQ ID NO: 1967790 - RNA, 19 nt, Homo sapiens
guuaauaaaucaagccaua

SEQ ID NO: 1967791 - RNA, 13 nt, Homo sapiens
aucccuaugauga

SEQ ID NO: 1967792 - RNA, 19 nt, Homo sapiens
agcugggauuacaggcaca

SEQ ID NO: 1967793 - RNA, 15 nt, Homo sapiens
aacuggaagcacagc

SEQ ID NO: 1967794 - RNA, 22 nt, Homo sapiens
cauuuaauaauuauaugcuauu

SEQ ID NO: 1967795 - RNA, 19 nt, Homo sapiens
uccuaaaaauaagcuuuau

SEQ ID NO: 1967796 - RNA, 12 nt, Homo sapiens
agauauuucaca

SEQ ID NO: 1967797 - RNA, 17 nt, Homo sapiens
uacuuaucuauauccau

SEQ ID NO: 1967798 - RNA, 22 nt, Homo sapiens
acaaauaauuuuuaaauauaag

SEQ ID NO: 1967799 - RNA, 20 nt, Homo sapiens
cagaggcuguggucagagag

SEQ ID NO: 1967800 - RNA, 20 nt, Homo sapiens
aaaucaauaaagaccacuuu

SEQ ID NO: 1967801 - RNA, 20 nt, Homo sapiens
accauccucucccuucuuac

SEQ ID NO: 1967802 - RNA, 16 nt, Homo sapiens
uuaaaaucaugauccu

SEQ ID NO: 1967803 - RNA, 18 nt, Homo sapiens
cuugagagacacugggac

SEQ ID NO: 1967804 - RNA, 13 nt, Homo sapiens
ucuccuacuuuac

SEQ ID NO: 1967805 - RNA, 19 nt, Homo sapiens
cuaagucaaacacuuguga

SEQ ID NO: 1967806 - RNA, 19 nt, Homo sapiens
gucugcuuauccuuggaag

SEQ ID NO: 1967807 - RNA, 14 nt, Homo sapiens
aucacccucugggu

SEQ ID NO: 1967808 - RNA, 16 nt, Homo sapiens
uggaugggggaacuca

SEQ ID NO: 1967809 - RNA, 19 nt, Homo sapiens
uccggccuccacaugacag

SEQ ID NO: 1967810 - RNA, 15 nt, Homo sapiens
cagaaacuuggaugu

SEQ ID NO: 1967811 - RNA, 17 nt, Homo sapiens
gacuucugucuucacaa

SEQ ID NO: 1967812 - RNA, 18 nt, Homo sapiens
ugaaccacccaugugagg

SEQ ID NO: 1967813 - RNA, 23 nt, Homo sapiens
caagugagcagagauguacugca

SEQ ID NO: 1967814 - RNA, 16 nt, Homo sapiens
cucaggggucauucau

SEQ ID NO: 1967815 - RNA, 22 nt, Homo sapiens
ugucccuuccauuucuacugua

SEQ ID NO: 1967816 - RNA, 15 nt, Homo sapiens
cucauuccagaggaa

SEQ ID NO: 1967817 - RNA, 22 nt, Homo sapiens
ccucucgucuuucgcacauucu

SEQ ID NO: 1967818 - RNA, 22 nt, Homo sapiens
uauagcaacuuuaagaaguaau

SEQ ID NO: 1967819 - RNA, 22 nt, Homo sapiens
cucuggcaucucuuucugcaaa

SEQ ID NO: 1967820 - RNA, 22 nt, Homo sapiens
cugggcccggaagggcuuuggu

SEQ ID NO: 1967821 - RNA, 17 nt, Homo sapiens
uccccaaggaagagcca

SEQ ID NO: 1967822 - RNA, 16 nt, Homo sapiens
ccaaaaauuacuuugg

SEQ ID NO: 1967823 - RNA, 13 nt, Homo sapiens
acauuaggggauu

SEQ ID NO: 1967824 - RNA, 16 nt, Homo sapiens
uggacaugcacagcua

SEQ ID NO: 1967825 - RNA, 15 nt, Homo sapiens
caugcucauguguac

SEQ ID NO: 1967826 - RNA, 10 nt, Homo sapiens
uauguauaca

SEQ ID NO: 1967827 - RNA, 17 nt, Homo sapiens
acucgggggcugucuca

SEQ ID NO: 1967828 - RNA, 18 nt, Homo sapiens
auuacacggagugugcua

SEQ ID NO: 1967829 - RNA, 14 nt, Homo sapiens
cacaucucccccau

SEQ ID NO: 1967830 - RNA, 20 nt, Homo sapiens
ggcagucugaacccuugugc

SEQ ID NO: 1967831 - RNA, 15 nt, Homo sapiens
ucuaaaacuacugcc

SEQ ID NO: 1967832 - RNA, 13 nt, Homo sapiens
uggaaaugaccag

SEQ ID NO: 1967833 - RNA, 16 nt, Homo sapiens
ucuaaauaugaaugaa

SEQ ID NO: 1967834 - RNA, 13 nt, Homo sapiens
accucggugaugc

SEQ ID NO: 1967835 - RNA, 22 nt, Homo sapiens
ugaagaggaagggcaaaaccac

SEQ ID NO: 1967836 - RNA, 12 nt, Homo sapiens
uaaaaguuggcu

SEQ ID NO: 1967837 - RNA, 16 nt, Homo sapiens
uccgcuuucaugaaca

SEQ ID NO: 1967838 - RNA, 22 nt, Homo sapiens
cauacgugugcaugugucuuua

SEQ ID NO: 1967839 - RNA, 15 nt, Homo sapiens
cuggcaggaugcuga

SEQ ID NO: 1967840 - RNA, 21 nt, Homo sapiens
guuugcugccauggacauaaa

SEQ ID NO: 1967841 - RNA, 22 nt, Homo sapiens
uaacaugaaaaacacggcagcu

SEQ ID NO: 1967842 - RNA, 12 nt, Homo sapiens
aaagcagugcag

SEQ ID NO: 1967843 - RNA, 12 nt, Homo sapiens
acugcagugaug

SEQ ID NO: 1967844 - RNA, 22 nt, Homo sapiens
ugcauguuaagugccauuacua

SEQ ID NO: 1967845 - RNA, 22 nt, Homo sapiens
uggcauaguggcuuaacuggac

SEQ ID NO: 1967846 - RNA, 17 nt, Homo sapiens
auggaaaagggagauuc

SEQ ID NO: 1967847 - RNA, 15 nt, Homo sapiens
ucacuaccugucagc

SEQ ID NO: 1967848 - RNA, 15 nt, Homo sapiens
agugagacacaguaa

SEQ ID NO: 1967849 - RNA, 12 nt, Homo sapiens
accaugaaguca

SEQ ID NO: 1967850 - RNA, 18 nt, Homo sapiens
cauucaguucuuaucaaa

SEQ ID NO: 1967851 - RNA, 16 nt, Homo sapiens
gaaguagacauggaau

SEQ ID NO: 1967852 - RNA, 20 nt, Homo sapiens
caugaguggaaauacacuca

SEQ ID NO: 1967853 - RNA, 16 nt, Homo sapiens
acuaccauugcuguuc

SEQ ID NO: 1967854 - RNA, 19 nt, Homo sapiens
uuugugcaucuuaaaguag

SEQ ID NO: 1967855 - RNA, 22 nt, Homo sapiens
ugaccguguuggucuguacuga

SEQ ID NO: 1967856 - RNA, 11 nt, Homo sapiens
accaccuccaa

SEQ ID NO: 1967857 - RNA, 13 nt, Homo sapiens
uuagcaaacugaa

SEQ ID NO: 1967858 - RNA, 15 nt, Homo sapiens
ucauuaucuccauga

SEQ ID NO: 1967859 - RNA, 17 nt, Homo sapiens
auggcucaaucuauccu

SEQ ID NO: 1967860 - RNA, 22 nt, Homo sapiens
aacagaguuuuuguauaagaag

SEQ ID NO: 1967861 - RNA, 17 nt, Homo sapiens
ccacgcuggagcugugu

SEQ ID NO: 1967862 - RNA, 11 nt, Homo sapiens
cuuuuucacac

SEQ ID NO: 1967863 - RNA, 18 nt, Homo sapiens
agcucaggugguccucuu

SEQ ID NO: 1967864 - RNA, 17 nt, Homo sapiens
gugacaggacuuucauu

SEQ ID NO: 1967865 - RNA, 23 nt, Homo sapiens
ggccucugcucuccgaccucucu

SEQ ID NO: 1967866 - RNA, 19 nt, Homo sapiens
cuuuccucagaucauccag

SEQ ID NO: 1967867 - RNA, 15 nt, Homo sapiens
uauauaaaaauccca

SEQ ID NO: 1967868 - RNA, 20 nt, Homo sapiens
agggagaauguuguugucua

SEQ ID NO: 1967869 - RNA, 24 nt, Homo sapiens
ugcacaugugugcgugugcgugca

SEQ ID NO: 1967870 - RNA, 22 nt, Homo sapiens
uggaaccaacgaucauaucugu

SEQ ID NO: 1967871 - RNA, 17 nt, Homo sapiens
caaugauacaguugcau

SEQ ID NO: 1967872 - RNA, 15 nt, Homo sapiens
acucaucagagcagc

SEQ ID NO: 1967873 - RNA, 23 nt, Homo sapiens
gaagaaaucguucaucauaagaa

SEQ ID NO: 1967874 - RNA, 20 nt, Homo sapiens
guuucccccuucuacauuuc

SEQ ID NO: 1967875 - RNA, 12 nt, Homo sapiens
uuauugcauaau

SEQ ID NO: 1967876 - RNA, 12 nt, Homo sapiens
aauuugcaauuu

SEQ ID NO: 1967877 - RNA, 12 nt, Homo sapiens
auauugcaaaau

SEQ ID NO: 1967878 - RNA, 12 nt, Homo sapiens
cagaugcacuga

SEQ ID NO: 1967879 - RNA, 14 nt, Homo sapiens
uuguauaucaugaa

SEQ ID NO: 1967880 - RNA, 21 nt, Homo sapiens
cagccccaccucacagccaga

SEQ ID NO: 1967881 - RNA, 14 nt, Homo sapiens
gcuggagugcagug

SEQ ID NO: 1967882 - RNA, 16 nt, Homo sapiens
uugguaaauucacaaa

SEQ ID NO: 1967883 - RNA, 14 nt, Homo sapiens
gcuagagugcaaug

SEQ ID NO: 1967884 - RNA, 14 nt, Homo sapiens
cagugcuggauuug

SEQ ID NO: 1967885 - RNA, 13 nt, Homo sapiens
ccagccaggcuau

SEQ ID NO: 1967886 - RNA, 19 nt, Homo sapiens
aguauggccccaccugcuc

SEQ ID NO: 1967887 - RNA, 16 nt, Homo sapiens
gcuguaccaagccccu

SEQ ID NO: 1967888 - RNA, 11 nt, Homo sapiens
aaauugcacaa

SEQ ID NO: 1967889 - RNA, 17 nt, Homo sapiens
aagcagagaaaauaauu

SEQ ID NO: 1967890 - RNA, 12 nt, Homo sapiens
caagaauggagg

SEQ ID NO: 1967891 - RNA, 20 nt, Homo sapiens
aaaauaaacuggggaguuau

SEQ ID NO: 1967892 - RNA, 13 nt, Homo sapiens
aacaguggugugg

SEQ ID NO: 1967893 - RNA, 15 nt, Homo sapiens
caggcuugugcaaca

SEQ ID NO: 1967894 - RNA, 13 nt, Homo sapiens
uuaauacugagaa

SEQ ID NO: 1967895 - RNA, 17 nt, Homo sapiens
accucagaggaguuuaa

SEQ ID NO: 1967896 - RNA, 23 nt, Homo sapiens
uccaucuagagauuuucuuggca

SEQ ID NO: 1967897 - RNA, 22 nt, Homo sapiens
cugagaucaaaaaaauauauga

SEQ ID NO: 1967898 - RNA, 22 nt, Homo sapiens
cauucaaaacaaccauccugcu

SEQ ID NO: 1967899 - RNA, 21 nt, Homo sapiens
cucuuuaaugcugccugccuu

SEQ ID NO: 1967900 - RNA, 12 nt, Homo sapiens
acaguaagcaua

SEQ ID NO: 1967901 - RNA, 17 nt, Homo sapiens
gccaacacgccuggcua

SEQ ID NO: 1967902 - RNA, 12 nt, Homo sapiens
aaggaaccagaa

SEQ ID NO: 1967903 - RNA, 12 nt, Homo sapiens
aggaaaccaaag

SEQ ID NO: 1967904 - RNA, 18 nt, Homo sapiens
gacacaaaacuccgcccc

SEQ ID NO: 1967905 - RNA, 22 nt, Homo sapiens
caagaaaagggcugacauuuuc

SEQ ID NO: 1967906 - RNA, 21 nt, Homo sapiens
uguucuuagguuuacugugaa

SEQ ID NO: 1967907 - RNA, 17 nt, Homo sapiens
ucacuggaccacugggc

SEQ ID NO: 1967908 - RNA, 17 nt, Homo sapiens
uacacacacacacacgc

SEQ ID NO: 1967909 - RNA, 22 nt, Homo sapiens
agaaaauaaacaucugagucau

SEQ ID NO: 1967910 - RNA, 14 nt, Homo sapiens
ucaucuuuguggau

SEQ ID NO: 1967911 - RNA, 20 nt, Homo sapiens
cugaagucuuacuacagaaa

SEQ ID NO: 1967912 - RNA, 20 nt, Homo sapiens
ugaguuggcaggugggagaa

SEQ ID NO: 1967913 - RNA, 16 nt, Homo sapiens
gcccaggcucugggaa

SEQ ID NO: 1967914 - RNA, 12 nt, Homo sapiens
uuaacaaagcaa

SEQ ID NO: 1967915 - RNA, 22 nt, Homo sapiens
gcagccaccauucccaccagcu

SEQ ID NO: 1967916 - RNA, 15 nt, Homo sapiens
ccaggccguccuccc

SEQ ID NO: 1967917 - RNA, 21 nt, Homo sapiens
acugaguguggcgggaagggu

SEQ ID NO: 1967918 - RNA, 14 nt, Homo sapiens
agcccgcccacugg

SEQ ID NO: 1967919 - RNA, 19 nt, Homo sapiens
auaugaagaagacaccucu

SEQ ID NO: 1967920 - RNA, 22 nt, Homo sapiens
ggccauacuucuguuuccaucu

SEQ ID NO: 1967921 - RNA, 15 nt, Homo sapiens
uauucugugcgcuac

SEQ ID NO: 1967922 - RNA, 22 nt, Homo sapiens
gaagcccaggagccucacuggg

SEQ ID NO: 1967923 - RNA, 13 nt, Homo sapiens
cuaaagccaggaa

SEQ ID NO: 1967924 - RNA, 22 nt, Homo sapiens
ugagguugggguguacuaguua

SEQ ID NO: 1967925 - RNA, 19 nt, Homo sapiens
aagauccagccucauaccu

SEQ ID NO: 1967926 - RNA, 22 nt, Homo sapiens
gacgcaaugggaggcagggaca

SEQ ID NO: 1967927 - RNA, 15 nt, Homo sapiens
acuaggaaauuccaa

SEQ ID NO: 1967928 - RNA, 12 nt, Homo sapiens
cccugagccaug

SEQ ID NO: 1967929 - RNA, 19 nt, Homo sapiens
aacagcuuggcuguuccac

SEQ ID NO: 1967930 - RNA, 17 nt, Homo sapiens
auaugaggcuugauaau

SEQ ID NO: 1967931 - RNA, 23 nt, Homo sapiens
ucuggcacuugcaagucccauga

SEQ ID NO: 1967932 - RNA, 23 nt, Homo sapiens
cugaggguuuccuucggggacca

SEQ ID NO: 1967933 - RNA, 13 nt, Homo sapiens
cuguaauacuaaa

SEQ ID NO: 1967934 - RNA, 16 nt, Homo sapiens
ugcgcauggugcagug

SEQ ID NO: 1967935 - RNA, 21 nt, Homo sapiens
agccaguuguugccaaccuua

SEQ ID NO: 1967936 - RNA, 19 nt, Homo sapiens
acagaccacaugagacuaa

SEQ ID NO: 1967937 - RNA, 16 nt, Homo sapiens
gaagccucuauugcca

SEQ ID NO: 1967938 - RNA, 21 nt, Homo sapiens
ccucaacucccagccaucugu

SEQ ID NO: 1967939 - RNA, 11 nt, Homo sapiens
uggugucuguc

SEQ ID NO: 1967940 - RNA, 19 nt, Homo sapiens
ggucuccccuccugcacac

SEQ ID NO: 1967941 - RNA, 17 nt, Homo sapiens
augacugugaacugggc

SEQ ID NO: 1967942 - RNA, 16 nt, Homo sapiens
uaagugcucaguauug

SEQ ID NO: 1967943 - RNA, 20 nt, Homo sapiens
aaggcaucagaaacaucuga

SEQ ID NO: 1967944 - RNA, 16 nt, Homo sapiens
ugagauaggaucacuu

SEQ ID NO: 1967945 - RNA, 17 nt, Homo sapiens
uuaaauacagucuucca

SEQ ID NO: 1967946 - RNA, 20 nt, Homo sapiens
gccuuccauaauuaugacag

SEQ ID NO: 1967947 - RNA, 16 nt, Homo sapiens
cugcguugugagcucu

SEQ ID NO: 1967948 - RNA, 18 nt, Homo sapiens
uucuaggcccauuguccu

SEQ ID NO: 1967949 - RNA, 14 nt, Homo sapiens
accauacacacugu

SEQ ID NO: 1967950 - RNA, 18 nt, Homo sapiens
cuggguuuaagcaaugcu

SEQ ID NO: 1967951 - RNA, 22 nt, Homo sapiens
ugcacaaaccuucuuuucaaug

SEQ ID NO: 1967952 - RNA, 15 nt, Homo sapiens
cucaggaucucuuag

SEQ ID NO: 1967953 - RNA, 17 nt, Homo sapiens
cccucgcgcccaaaaga

SEQ ID NO: 1967954 - RNA, 18 nt, Homo sapiens
aggccugaggagcagugu

SEQ ID NO: 1967955 - RNA, 19 nt, Homo sapiens
gagccuucaagugccaaac

SEQ ID NO: 1967956 - RNA, 14 nt, Homo sapiens
accuuccugggaaa

SEQ ID NO: 1967957 - RNA, 14 nt, Homo sapiens
cuggcuugccugaa

SEQ ID NO: 1967958 - RNA, 19 nt, Homo sapiens
gcuauauaaauaaagcaaa

SEQ ID NO: 1967959 - RNA, 15 nt, Homo sapiens
uggcuaaagugcuuu

SEQ ID NO: 1967960 - RNA, 15 nt, Homo sapiens
ggcagagccaugggc

SEQ ID NO: 1967961 - RNA, 24 nt, Homo sapiens
auuuucaagaauaaucacgcuuuc

SEQ ID NO: 1967962 - RNA, 14 nt, Homo sapiens
uuaaugacaaugaa

SEQ ID NO: 1967963 - RNA, 18 nt, Homo sapiens
aaaccugggaaggccagc

SEQ ID NO: 1967964 - RNA, 20 nt, Homo sapiens
aaaccauucuagguguuuca

SEQ ID NO: 1967965 - RNA, 17 nt, Homo sapiens
guaagcuaucugugcag

SEQ ID NO: 1967966 - RNA, 13 nt, Homo sapiens
uagcucugcugcu

SEQ ID NO: 1967967 - RNA, 22 nt, Homo sapiens
uuuuggugguccccacagccuc

SEQ ID NO: 1967968 - RNA, 13 nt, Homo sapiens
ggcagugcaacaa

SEQ ID NO: 1967969 - RNA, 19 nt, Homo sapiens
acacccagucuguucccca

SEQ ID NO: 1967970 - RNA, 20 nt, Homo sapiens
aacaggcucugagauuucac

SEQ ID NO: 1967971 - RNA, 22 nt, Homo sapiens
agccaggguggucuugaucucc

SEQ ID NO: 1967972 - RNA, 17 nt, Homo sapiens
uagcacauagaugucug

SEQ ID NO: 1967973 - RNA, 17 nt, Homo sapiens
uagugcauggacaucua

SEQ ID NO: 1967974 - RNA, 21 nt, Homo sapiens
cagcuacaaaaguuaaugaau

SEQ ID NO: 1967975 - RNA, 17 nt, Homo sapiens
cagacuugguccuaagc

SEQ ID NO: 1967976 - RNA, 15 nt, Homo sapiens
ccuggagaaggcauu

SEQ ID NO: 1967977 - RNA, 22 nt, Homo sapiens
ccagcagagccagggcagggcg

SEQ ID NO: 1967978 - RNA, 20 nt, Homo sapiens
acugcauagcagaccacaca

SEQ ID NO: 1967979 - RNA, 13 nt, Homo sapiens
acuagguuucacc

SEQ ID NO: 1967980 - RNA, 11 nt, Homo sapiens
aacacugccuc

SEQ ID NO: 1967981 - RNA, 11 nt, Homo sapiens
aaaacugccua

SEQ ID NO: 1967982 - RNA, 15 nt, Homo sapiens
cugcuccaacuccau

SEQ ID NO: 1967983 - RNA, 14 nt, Homo sapiens
agugguacaaucug

SEQ ID NO: 1967984 - RNA, 16 nt, Homo sapiens
ccugcagugauucagc

SEQ ID NO: 1967985 - RNA, 18 nt, Homo sapiens
guuuauuaaauugcaaga

SEQ ID NO: 1967986 - RNA, 17 nt, Homo sapiens
aauuucuaaaaaacaga

SEQ ID NO: 1967987 - RNA, 15 nt, Homo sapiens
cuuuucuagccuauu

SEQ ID NO: 1967988 - RNA, 16 nt, Homo sapiens
uacuauuuucauucuc

SEQ ID NO: 1967989 - RNA, 19 nt, Homo sapiens
accgagagagauggaauaa

SEQ ID NO: 1967990 - RNA, 19 nt, Homo sapiens
uauggcuuuuagcauuuau

SEQ ID NO: 1967991 - RNA, 16 nt, Homo sapiens
ucuccuuuuaugcuca

SEQ ID NO: 1967992 - RNA, 17 nt, Homo sapiens
auuauuuucuucaucca

SEQ ID NO: 1967993 - RNA, 22 nt, Homo sapiens
gauuacaugcccaucccagugu

SEQ ID NO: 1967994 - RNA, 21 nt, Homo sapiens
ggagugagugaucacugguau

SEQ ID NO: 1967995 - RNA, 20 nt, Homo sapiens
aaagaugugcagauaucaca

SEQ ID NO: 1967996 - RNA, 17 nt, Homo sapiens
caaacuaaugaguuuaa

SEQ ID NO: 1967997 - RNA, 13 nt, Homo sapiens
uguaaagugccuu

SEQ ID NO: 1967998 - RNA, 21 nt, Homo sapiens
uaaaaugaaggaaaagcaugu

SEQ ID NO: 1967999 - RNA, 21 nt, Homo sapiens
guaucuucuuuagugguggua

SEQ ID NO: 1968000 - RNA, 17 nt, Homo sapiens
auuaguuacuugcuaua

SEQ ID NO: 1968001 - RNA, 18 nt, Homo sapiens
ccagcccuccucugucaa

SEQ ID NO: 1968002 - RNA, 21 nt, Homo sapiens
ccucauuaguagagcaguaua

SEQ ID NO: 1968003 - RNA, 16 nt, Homo sapiens
ucuugcuuauucacug

SEQ ID NO: 1968004 - RNA, 14 nt, Homo sapiens
caguguguguaaca

SEQ ID NO: 1968005 - RNA, 16 nt, Homo sapiens
guagauuaccugccac

SEQ ID NO: 1968006 - RNA, 15 nt, Homo sapiens
cucugagccacagau

SEQ ID NO: 1968007 - RNA, 22 nt, Homo sapiens
uaguuuacagaauggaaccaaa

SEQ ID NO: 1968008 - RNA, 22 nt, Homo sapiens
cuggggagccagggcuauggga

SEQ ID NO: 1968009 - RNA, 16 nt, Homo sapiens
auuaauaaaaaucaac

SEQ ID NO: 1968010 - RNA, 19 nt, Homo sapiens
acagcucacuacaguuuca

SEQ ID NO: 1968011 - RNA, 19 nt, Homo sapiens
uaaauuccacagauuauca

SEQ ID NO: 1968012 - RNA, 15 nt, Homo sapiens
cacgagcagacaccc

SEQ ID NO: 1968013 - RNA, 21 nt, Homo sapiens
acuucuaaaugaagugcaaau

SEQ ID NO: 1968014 - RNA, 20 nt, Homo sapiens
gcccuugagugcuuguuaga

SEQ ID NO: 1968015 - RNA, 20 nt, Homo sapiens
ucucuagacaucuagucuca

SEQ ID NO: 1968016 - RNA, 16 nt, Homo sapiens
augccugcagugccac

SEQ ID NO: 1968017 - RNA, 21 nt, Homo sapiens
gccuggaaagcccuucggaga

SEQ ID NO: 1968018 - RNA, 16 nt, Homo sapiens
ucaaaauguccagcuu

SEQ ID NO: 1968019 - RNA, 21 nt, Homo sapiens
caggccaguuugaagacuaca

SEQ ID NO: 1968020 - RNA, 13 nt, Homo sapiens
cuuaaacugccaa

SEQ ID NO: 1968021 - RNA, 14 nt, Homo sapiens
ccaauuuacuuugu

SEQ ID NO: 1968022 - RNA, 22 nt, Homo sapiens
gaacagcacuggggagucuuug

SEQ ID NO: 1968023 - RNA, 16 nt, Homo sapiens
gaaaggaacacgcggg

SEQ ID NO: 1968024 - RNA, 13 nt, Homo sapiens
auaggucacuggc

SEQ ID NO: 1968025 - RNA, 12 nt, Homo sapiens
aagcaagcagau

SEQ ID NO: 1968026 - RNA, 15 nt, Homo sapiens
cuugcuauucugucc

SEQ ID NO: 1968027 - RNA, 22 nt, Homo sapiens
cauagggcaugauuaacaaagc

SEQ ID NO: 1968028 - RNA, 18 nt, Homo sapiens
agcgauucuccugccuca

SEQ ID NO: 1968029 - RNA, 22 nt, Homo sapiens
augauggcucauuuacacucag

SEQ ID NO: 1968030 - RNA, 17 nt, Homo sapiens
aacuucuuaacuggcaa

SEQ ID NO: 1968031 - RNA, 22 nt, Homo sapiens
aaaagaacauaaguuaucaugg

SEQ ID NO: 1968032 - RNA, 16 nt, Homo sapiens
ugugacaucuuugguc

SEQ ID NO: 1968033 - RNA, 16 nt, Homo sapiens
aguauuuucuaauaau

SEQ ID NO: 1968034 - RNA, 20 nt, Homo sapiens
agucccacccggacaggugg

SEQ ID NO: 1968035 - RNA, 19 nt, Homo sapiens
ccacugcccccugcugcca

SEQ ID NO: 1968036 - RNA, 22 nt, Homo sapiens
gcuucuuucucgguggcagaaa

SEQ ID NO: 1968037 - RNA, 17 nt, Homo sapiens
uaauuauacuacuuugu

SEQ ID NO: 1968038 - RNA, 14 nt, Homo sapiens
acagaaacugaugc

SEQ ID NO: 1968039 - RNA, 16 nt, Homo sapiens
aaauauggacugcuca

SEQ ID NO: 1968040 - RNA, 14 nt, Homo sapiens
agaaagcaggugca

SEQ ID NO: 1968041 - RNA, 12 nt, Homo sapiens
caaugauaugca

SEQ ID NO: 1968042 - RNA, 15 nt, Homo sapiens
acauauacauaugau

SEQ ID NO: 1968043 - RNA, 19 nt, Homo sapiens
ccuuuuuacuauacagcau

SEQ ID NO: 1968044 - RNA, 20 nt, Homo sapiens
aauggccugguaggucugga

SEQ ID NO: 1968045 - RNA, 17 nt, Homo sapiens
aggcuuccuucauuucc

SEQ ID NO: 1968046 - RNA, 16 nt, Homo sapiens
guaagaugacucugag

SEQ ID NO: 1968047 - RNA, 13 nt, Homo sapiens
ucacuggcuuuag

SEQ ID NO: 1968048 - RNA, 17 nt, Homo sapiens
cacaccgcagggacaag

SEQ ID NO: 1968049 - RNA, 22 nt, Homo sapiens
uuuuagaauuaaaaaagcauac

SEQ ID NO: 1968050 - RNA, 21 nt, Homo sapiens
cuguucuguuuggcacuugua

SEQ ID NO: 1968051 - RNA, 22 nt, Homo sapiens
caagccagcuuacuagcacuuu

SEQ ID NO: 1968052 - RNA, 18 nt, Homo sapiens
cucagcacugugccagug

SEQ ID NO: 1968053 - RNA, 14 nt, Homo sapiens
uaugaggcauuugu

SEQ ID NO: 1968054 - RNA, 15 nt, Homo sapiens
uguuauuauucuuga

SEQ ID NO: 1968055 - RNA, 16 nt, Homo sapiens
cagaaugugucucagg

SEQ ID NO: 1968056 - RNA, 13 nt, Homo sapiens
ucuucacuugguu

SEQ ID NO: 1968057 - RNA, 14 nt, Homo sapiens
agccuguuauauuc

SEQ ID NO: 1968058 - RNA, 19 nt, Homo sapiens
guugaauauagccugccuc

SEQ ID NO: 1968059 - RNA, 23 nt, Homo sapiens
uggaacuacauuaguacacagca

SEQ ID NO: 1968060 - RNA, 14 nt, Homo sapiens
aagcaacuguuaug

SEQ ID NO: 1968061 - RNA, 19 nt, Homo sapiens
aucaaaacuaaccaucuga

SEQ ID NO: 1968062 - RNA, 22 nt, Homo sapiens
uccuccucugacuuggggaccu

SEQ ID NO: 1968063 - RNA, 16 nt, Homo sapiens
gcaccacugcacucca

SEQ ID NO: 1968064 - RNA, 20 nt, Homo sapiens
uaguccagaaaucuauuaca

SEQ ID NO: 1968065 - RNA, 23 nt, Homo sapiens
ugggccgggaggcagugcugauc

SEQ ID NO: 1968066 - RNA, 18 nt, Homo sapiens
gaaaaucacuugccaaaa

SEQ ID NO: 1968067 - RNA, 22 nt, Homo sapiens
guuuacaagcccccccuuccac

SEQ ID NO: 1968068 - RNA, 12 nt, Homo sapiens
cucuccuaacau

SEQ ID NO: 1968069 - RNA, 20 nt, Homo sapiens
gcucaccccccacacucacu

SEQ ID NO: 1968070 - RNA, 14 nt, Homo sapiens
gaaaugauuucaca

SEQ ID NO: 1968071 - RNA, 17 nt, Homo sapiens
gucauaguuaugugauu

SEQ ID NO: 1968072 - RNA, 12 nt, Homo sapiens
uuucccaccacc

SEQ ID NO: 1968073 - RNA, 14 nt, Homo sapiens
augcuucaguugua

SEQ ID NO: 1968074 - RNA, 23 nt, Homo sapiens
uaaaaagcgggcacgggcccgug

SEQ ID NO: 1968075 - RNA, 18 nt, Homo sapiens
gacuagugacacauugua

SEQ ID NO: 1968076 - RNA, 20 nt, Homo sapiens
gaauucucucuucuggaauc

SEQ ID NO: 1968077 - RNA, 14 nt, Homo sapiens
accugagacauauu

SEQ ID NO: 1968078 - RNA, 22 nt, Homo sapiens
gcccagagcagggucucucuaa

SEQ ID NO: 1968079 - RNA, 18 nt, Homo sapiens
cuuuuuccagauucuucc

SEQ ID NO: 1968080 - RNA, 18 nt, Homo sapiens
aaccucacucuugccaac

SEQ ID NO: 1968081 - RNA, 14 nt, Homo sapiens
cuaauucaacauau

SEQ ID NO: 1968082 - RNA, 13 nt, Homo sapiens
cuauuucuuuaaa

SEQ ID NO: 1968083 - RNA, 12 nt, Homo sapiens
ucuacacucauu

SEQ ID NO: 1968084 - RNA, 22 nt, Homo sapiens
ggauagagcagauucaguguua

SEQ ID NO: 1968085 - RNA, 18 nt, Homo sapiens
ggaagaagccagacuggu

SEQ ID NO: 1968086 - RNA, 13 nt, Homo sapiens
gcuaugcauuuga

SEQ ID NO: 1968087 - RNA, 13 nt, Homo sapiens
ucaaagcaguagu

SEQ ID NO: 1968088 - RNA, 20 nt, Homo sapiens
augguggcgggcaccuguaa

SEQ ID NO: 1968089 - RNA, 20 nt, Homo sapiens
ggcagugccuccugggacca

SEQ ID NO: 1968090 - RNA, 22 nt, Homo sapiens
gaauauauuugugugugugaua

SEQ ID NO: 1968091 - RNA, 14 nt, Homo sapiens
uuggauguggagcu

SEQ ID NO: 1968092 - RNA, 14 nt, Homo sapiens
cucaauacccacug

SEQ ID NO: 1968093 - RNA, 14 nt, Homo sapiens
cuguuucuaugucc

SEQ ID NO: 1968094 - RNA, 14 nt, Homo sapiens
uaucugccauguga

SEQ ID NO: 1968095 - RNA, 16 nt, Homo sapiens
agaagucggaauguca

SEQ ID NO: 1968096 - RNA, 16 nt, Homo sapiens
uagaaaggacuguaaa

SEQ ID NO: 1968097 - RNA, 21 nt, Homo sapiens
aaauacaaaaaauuagccaga

SEQ ID NO: 1968098 - RNA, 14 nt, Homo sapiens
uguugaagccuuug

SEQ ID NO: 1968099 - RNA, 17 nt, Homo sapiens
cagauaauguccuugcu

SEQ ID NO: 1968100 - RNA, 15 nt, Homo sapiens
agucagaaguucugg

SEQ ID NO: 1968101 - RNA, 19 nt, Homo sapiens
ugggaacaugcgugugacc

SEQ ID NO: 1968102 - RNA, 13 nt, Homo sapiens
gacuagaauuuag

SEQ ID NO: 1968103 - RNA, 19 nt, Homo sapiens
ucauucccuagaucuuucu

SEQ ID NO: 1968104 - RNA, 16 nt, Homo sapiens
gcugccucuaccugac

SEQ ID NO: 1968105 - RNA, 21 nt, Homo sapiens
cuuuggacuguucaagcaaaa

SEQ ID NO: 1968106 - RNA, 16 nt, Homo sapiens
uuaacagaaccagagg

SEQ ID NO: 1968107 - RNA, 17 nt, Homo sapiens
ucauccgcacuguaaau

SEQ ID NO: 1968108 - RNA, 21 nt, Homo sapiens
ugaugggccacaacugucuua

SEQ ID NO: 1968109 - RNA, 21 nt, Homo sapiens
uugagucuguguuguguccug

SEQ ID NO: 1968110 - RNA, 12 nt, Homo sapiens
gccgccugucaa

SEQ ID NO: 1968111 - RNA, 14 nt, Homo sapiens
uauaaaaauuacau

SEQ ID NO: 1968112 - RNA, 23 nt, Homo sapiens
agugccauagccaggcucucugc

SEQ ID NO: 1968113 - RNA, 13 nt, Homo sapiens
cacaucacacaaa

SEQ ID NO: 1968114 - RNA, 19 nt, Homo sapiens
gaacucucugccuguaaau

SEQ ID NO: 1968115 - RNA, 23 nt, Homo sapiens
ggccgggcugcgccugcugcacu

SEQ ID NO: 1968116 - RNA, 17 nt, Homo sapiens
acguaacuugcaauuug

SEQ ID NO: 1968117 - RNA, 14 nt, Homo sapiens
ggcuguugagaugc

SEQ ID NO: 1968118 - RNA, 24 nt, Homo sapiens
ucugauccacagccucaucaguau

SEQ ID NO: 1968119 - RNA, 13 nt, Homo sapiens
ugaugacacugag

SEQ ID NO: 1968120 - RNA, 19 nt, Homo sapiens
acauguauugcacauugua

SEQ ID NO: 1968121 - RNA, 18 nt, Homo sapiens
cucagaagucaguugcaa

SEQ ID NO: 1968122 - RNA, 15 nt, Homo sapiens
aguauaauuaauaga

SEQ ID NO: 1968123 - RNA, 21 nt, Homo sapiens
cucguuggaugucugugagua

SEQ ID NO: 1968124 - RNA, 16 nt, Homo sapiens
gucacuggcaucucac

SEQ ID NO: 1968125 - RNA, 22 nt, Homo sapiens
ccugcuugcuggaaaacugcca

SEQ ID NO: 1968126 - RNA, 22 nt, Homo sapiens
uuguuuagucuuuauacugcaa

SEQ ID NO: 1968127 - RNA, 14 nt, Homo sapiens
caccaagcuggugg

SEQ ID NO: 1968128 - RNA, 20 nt, Homo sapiens
acugcagccacugauucucu

SEQ ID NO: 1968129 - RNA, 14 nt, Homo sapiens
auguggcauguuca

SEQ ID NO: 1968130 - RNA, 18 nt, Homo sapiens
agcaccguucugugcaca

SEQ ID NO: 1968131 - RNA, 22 nt, Homo sapiens
auccucuuaaugugcagcaaaa

SEQ ID NO: 1968132 - RNA, 17 nt, Homo sapiens
cuggaguccugcucugu

SEQ ID NO: 1968133 - RNA, 20 nt, Homo sapiens
gcagagggccuuugcuacac

SEQ ID NO: 1968134 - RNA, 22 nt, Homo sapiens
aagguuuucucuaacuucucaa

SEQ ID NO: 1968135 - RNA, 20 nt, Homo sapiens
cauuguucuugugaacccaa

SEQ ID NO: 1968136 - RNA, 14 nt, Homo sapiens
gaaacaugauguga

SEQ ID NO: 1968137 - RNA, 17 nt, Homo sapiens
aucccccaccaaaaaca

SEQ ID NO: 1968138 - RNA, 15 nt, Homo sapiens
cugcaaacgcugccu

SEQ ID NO: 1968139 - RNA, 13 nt, Homo sapiens
auuuugcauuaga

SEQ ID NO: 1968140 - RNA, 16 nt, Homo sapiens
ucuuccuuucuaaucc

SEQ ID NO: 1968141 - RNA, 16 nt, Homo sapiens
cuaucuucuuuggacu

SEQ ID NO: 1968142 - RNA, 21 nt, Homo sapiens
aggggaagagugcucugcuac

SEQ ID NO: 1968143 - RNA, 14 nt, Homo sapiens
ucaauuugccauug

SEQ ID NO: 1968144 - RNA, 18 nt, Homo sapiens
gaauaaaauuagcuugag

SEQ ID NO: 1968145 - RNA, 17 nt, Homo sapiens
aucuaauuaaauggcau

SEQ ID NO: 1968146 - RNA, 16 nt, Homo sapiens
gcaaaaucuuguuaau

SEQ ID NO: 1968147 - RNA, 19 nt, Homo sapiens
ugaaaaaaaguacauguau

SEQ ID NO: 1968148 - RNA, 17 nt, Homo sapiens
gccaucccuucauuuaa

SEQ ID NO: 1968149 - RNA, 17 nt, Homo sapiens
cagaccccaaaccagcc

SEQ ID NO: 1968150 - RNA, 21 nt, Homo sapiens
ccugggugaucugcugcugag

SEQ ID NO: 1968151 - RNA, 14 nt, Homo sapiens
aaaagagcagcaca

SEQ ID NO: 1968152 - RNA, 23 nt, Homo sapiens
agccauuguggaagacagugugg

SEQ ID NO: 1968153 - RNA, 20 nt, Homo sapiens
uuccugccaccacugggcaa

SEQ ID NO: 1968154 - RNA, 12 nt, Homo sapiens
agacacaggccg

SEQ ID NO: 1968155 - RNA, 20 nt, Homo sapiens
cuuuuccagagcauuccagu

SEQ ID NO: 1968156 - RNA, 21 nt, Homo sapiens
auuuccacaaaaucuguccaa

SEQ ID NO: 1968157 - RNA, 16 nt, Homo sapiens
cuguaauuaagugcaa

SEQ ID NO: 1968158 - RNA, 17 nt, Homo sapiens
aucauguucacugcaau

SEQ ID NO: 1968159 - RNA, 16 nt, Homo sapiens
ggcaacauuccucaga

SEQ ID NO: 1968160 - RNA, 21 nt, Homo sapiens
aguggccccucgugaccuaca

SEQ ID NO: 1968161 - RNA, 16 nt, Homo sapiens
cauaauguuccagaca

SEQ ID NO: 1968162 - RNA, 18 nt, Homo sapiens
ucacaugguuacauauca

SEQ ID NO: 1968163 - RNA, 13 nt, Homo sapiens
gcaccccuacuca

SEQ ID NO: 1968164 - RNA, 16 nt, Homo sapiens
guauauacuuugccac

SEQ ID NO: 1968165 - RNA, 18 nt, Homo sapiens
cagggagugggcuaagca

SEQ ID NO: 1968166 - RNA, 12 nt, Homo sapiens
acauuugccaaa

SEQ ID NO: 1968167 - RNA, 18 nt, Homo sapiens
ugcacaucuacaugccau

SEQ ID NO: 1968168 - RNA, 15 nt, Homo sapiens
cuuugaagaaaaaga

SEQ ID NO: 1968169 - RNA, 21 nt, Homo sapiens
auuccaauuguccaccccuuu

SEQ ID NO: 1968170 - RNA, 16 nt, Homo sapiens
ugaagauuucauggac

SEQ ID NO: 1968171 - RNA, 21 nt, Homo sapiens
ugaaaaaccuauuacuacuaa

SEQ ID NO: 1968172 - RNA, 17 nt, Homo sapiens
cuucacagggaagcaug

SEQ ID NO: 1968173 - RNA, 20 nt, Homo sapiens
uccuaaauuugaaauaguga

SEQ ID NO: 1968174 - RNA, 20 nt, Homo sapiens
ugagaaggaacuuugucaca

SEQ ID NO: 1968175 - RNA, 18 nt, Homo sapiens
aaugugauuuccggguga

SEQ ID NO: 1968176 - RNA, 13 nt, Homo sapiens
gaauaaagcaauu

SEQ ID NO: 1968177 - RNA, 19 nt, Homo sapiens
agaucaaugaaaugauguc

SEQ ID NO: 1968178 - RNA, 16 nt, Homo sapiens
gcuauuugcaauuccu

SEQ ID NO: 1968179 - RNA, 22 nt, Homo sapiens
agaguuuuuguuaguacuuugg

SEQ ID NO: 1968180 - RNA, 17 nt, Homo sapiens
agaaaacagcucuggca

SEQ ID NO: 1968181 - RNA, 16 nt, Homo sapiens
uuugcuauuuacaaau

SEQ ID NO: 1968182 - RNA, 13 nt, Homo sapiens
cauaccaugugcc

SEQ ID NO: 1968183 - RNA, 22 nt, Homo sapiens
agauuguguucuuccucucuca

SEQ ID NO: 1968184 - RNA, 13 nt, Homo sapiens
cugucaccaagga

SEQ ID NO: 1968185 - RNA, 20 nt, Homo sapiens
aaucagauucuucucucuca

SEQ ID NO: 1968186 - RNA, 16 nt, Homo sapiens
cucaauaguucuuaaa

SEQ ID NO: 1968187 - RNA, 15 nt, Homo sapiens
auccuguaguacaag

SEQ ID NO: 1968188 - RNA, 16 nt, Homo sapiens
ugaaacauuugccaaa

SEQ ID NO: 1968189 - RNA, 18 nt, Homo sapiens
ucaagaaaaauucacagu

SEQ ID NO: 1968190 - RNA, 15 nt, Homo sapiens
cacagguacauagcu

SEQ ID NO: 1968191 - RNA, 22 nt, Homo sapiens
gguuugcucagccccagcuuau

SEQ ID NO: 1968192 - RNA, 21 nt, Homo sapiens
ggccugucccuggccaucucu

SEQ ID NO: 1968193 - RNA, 16 nt, Homo sapiens
ucuauccuguuuaaua

SEQ ID NO: 1968194 - RNA, 13 nt, Homo sapiens
acccaugacuuua

SEQ ID NO: 1968195 - RNA, 23 nt, Homo sapiens
ggccauaaacgguuccuggugac

SEQ ID NO: 1968196 - RNA, 15 nt, Homo sapiens
auuccuaugauggau

SEQ ID NO: 1968197 - RNA, 13 nt, Homo sapiens
uagaauuccucuu

SEQ ID NO: 1968198 - RNA, 13 nt, Homo sapiens
ucugccauuucau

SEQ ID NO: 1968199 - RNA, 14 nt, Homo sapiens
caacaggacagagu

SEQ ID NO: 1968200 - RNA, 15 nt, Homo sapiens
ccugguaaaagggau

SEQ ID NO: 1968201 - RNA, 14 nt, Homo sapiens
uccacaacagaagu

SEQ ID NO: 1968202 - RNA, 17 nt, Homo sapiens
auuaaacaugacuccau

SEQ ID NO: 1968203 - RNA, 20 nt, Homo sapiens
guuuaugcauagauaaucuc

SEQ ID NO: 1968204 - RNA, 16 nt, Homo sapiens
ugguggcugugucucu

SEQ ID NO: 1968205 - RNA, 14 nt, Homo sapiens
ccccuccugcugca

SEQ ID NO: 1968206 - RNA, 22 nt, Homo sapiens
aaggcaucagucccccugugca

SEQ ID NO: 1968207 - RNA, 13 nt, Homo sapiens
gaaaagcuuuccu

SEQ ID NO: 1968208 - RNA, 17 nt, Homo sapiens
gcuuugcggcaucucca

SEQ ID NO: 1968209 - RNA, 13 nt, Homo sapiens
uuugucucugcaa

SEQ ID NO: 1968210 - RNA, 15 nt, Homo sapiens
cauuuauuauuucaa

SEQ ID NO: 1968211 - RNA, 15 nt, Homo sapiens
auuuuagaucuuuca

SEQ ID NO: 1968212 - RNA, 15 nt, Homo sapiens
ugauuagacagaaca

SEQ ID NO: 1968213 - RNA, 17 nt, Homo sapiens
guaaaucaaauuugaau

SEQ ID NO: 1968214 - RNA, 15 nt, Homo sapiens
cagaaauucuagcgc

SEQ ID NO: 1968215 - RNA, 14 nt, Homo sapiens
acugggcucugagg

SEQ ID NO: 1968216 - RNA, 13 nt, Homo sapiens
aggacucagaaca

SEQ ID NO: 1968217 - RNA, 14 nt, Homo sapiens
accuguagacugug

SEQ ID NO: 1968218 - RNA, 14 nt, Homo sapiens
aaugugagaacugu

SEQ ID NO: 1968219 - RNA, 20 nt, Homo sapiens
uugcauuacgauaaacauua

SEQ ID NO: 1968220 - RNA, 20 nt, Homo sapiens
accaugugauaauugcguua

SEQ ID NO: 1968221 - RNA, 13 nt, Homo sapiens
acuucaucugcca

SEQ ID NO: 1968222 - RNA, 16 nt, Homo sapiens
gacacagcccagagac

SEQ ID NO: 1968223 - RNA, 20 nt, Homo sapiens
uuguucagggcuuuucuuaa

SEQ ID NO: 1968224 - RNA, 14 nt, Homo sapiens
gcuaucagugcuuu

SEQ ID NO: 1968225 - RNA, 13 nt, Homo sapiens
ggaacuacuguac

SEQ ID NO: 1968226 - RNA, 13 nt, Homo sapiens
aagaucaggcaca

SEQ ID NO: 1968227 - RNA, 16 nt, Homo sapiens
aucagggguuagggug

SEQ ID NO: 1968228 - RNA, 13 nt, Homo sapiens
auccagcccaaac

SEQ ID NO: 1968229 - RNA, 13 nt, Homo sapiens
uuagaaaauucag

SEQ ID NO: 1968230 - RNA, 18 nt, Homo sapiens
cccaucuugggggucacc

SEQ ID NO: 1968231 - RNA, 12 nt, Homo sapiens
uaauacuuccaa

SEQ ID NO: 1968232 - RNA, 13 nt, Homo sapiens
aaugggcauuucu

SEQ ID NO: 1968233 - RNA, 15 nt, Homo sapiens
auuacagacaugaac

SEQ ID NO: 1968234 - RNA, 20 nt, Homo sapiens
cacauuuuuauaucuguaca

SEQ ID NO: 1968235 - RNA, 16 nt, Homo sapiens
auacuuaaggucauau

SEQ ID NO: 1968236 - RNA, 16 nt, Homo sapiens
gauauccacuuaccug

SEQ ID NO: 1968237 - RNA, 18 nt, Homo sapiens
uguuuucuucguggauug

SEQ ID NO: 1968238 - RNA, 15 nt, Homo sapiens
gcucuacgggugaug

SEQ ID NO: 1968239 - RNA, 16 nt, Homo sapiens
gccgcagggacgggga

SEQ ID NO: 1968240 - RNA, 19 nt, Homo sapiens
uuugaaaaauaacugacaa

SEQ ID NO: 1968241 - RNA, 10 nt, Homo sapiens
uuugagacaa

SEQ ID NO: 1968242 - RNA, 21 nt, Homo sapiens
caauugucugccucagccucc

SEQ ID NO: 1968243 - RNA, 17 nt, Homo sapiens
agaacaaauuguuuaca

SEQ ID NO: 1968244 - RNA, 20 nt, Homo sapiens
cacagugacuuccuggggau

SEQ ID NO: 1968245 - RNA, 22 nt, Homo sapiens
aguaccucuguauagaaaucua

SEQ ID NO: 1968246 - RNA, 16 nt, Homo sapiens
acuaauuuuacuucua

SEQ ID NO: 1968247 - RNA, 23 nt, Homo sapiens
aauuuccaggguugcuugaucau

SEQ ID NO: 1968248 - RNA, 14 nt, Homo sapiens
gugcuuaugucaua

SEQ ID NO: 1968249 - RNA, 18 nt, Homo sapiens
cucccuuccucaccucca

SEQ ID NO: 1968250 - RNA, 20 nt, Homo sapiens
uguuccuuuaagguacugaa

SEQ ID NO: 1968251 - RNA, 16 nt, Homo sapiens
uucaccgcauuccagg

SEQ ID NO: 1968252 - RNA, 16 nt, Homo sapiens
cauguuacucaugacu

SEQ ID NO: 1968253 - RNA, 23 nt, Homo sapiens
aucaagugugcuuuagcuugaaa

SEQ ID NO: 1968254 - RNA, 15 nt, Homo sapiens
uaucaaauaacucaa

SEQ ID NO: 1968255 - RNA, 19 nt, Homo sapiens
cuccccauuugggacauca

SEQ ID NO: 1968256 - RNA, 18 nt, Homo sapiens
aagcagugccuuccauaa

SEQ ID NO: 1968257 - RNA, 16 nt, Homo sapiens
ucuucggagguggcag

SEQ ID NO: 1968258 - RNA, 20 nt, Homo sapiens
auacauaucgcugacuucau

SEQ ID NO: 1968259 - RNA, 20 nt, Homo sapiens
uaccccaguuccuagcacug

SEQ ID NO: 1968260 - RNA, 22 nt, Homo sapiens
gaaaaucaguuauauucuuuaa

SEQ ID NO: 1968261 - RNA, 17 nt, Homo sapiens
cagaauacaauucaguu

SEQ ID NO: 1968262 - RNA, 22 nt, Homo sapiens
aggaguucgagaccagccugac

SEQ ID NO: 1968263 - RNA, 13 nt, Homo sapiens
acaauuaauuaaa

SEQ ID NO: 1968264 - RNA, 21 nt, Homo sapiens
acgugcaauacggaacacugu

SEQ ID NO: 1968265 - RNA, 20 nt, Homo sapiens
caacccaaaugguggccauu

SEQ ID NO: 1968266 - RNA, 19 nt, Homo sapiens
auuauauaaaucauuucaa

SEQ ID NO: 1968267 - RNA, 19 nt, Homo sapiens
cuacaucuuuuauacauuu

SEQ ID NO: 1968268 - RNA, 22 nt, Homo sapiens
cagaaggguagguuagaugcua

SEQ ID NO: 1968269 - RNA, 21 nt, Homo sapiens
uaacauuccuaaaaugcuuca

SEQ ID NO: 1968270 - RNA, 11 nt, Homo sapiens
uaaaacacuuc

SEQ ID NO: 1968271 - RNA, 21 nt, Homo sapiens
gcuauaugcauuugccuucau

SEQ ID NO: 1968272 - RNA, 23 nt, Homo sapiens
cgcucccauggcucuugcaacau

SEQ ID NO: 1968273 - RNA, 17 nt, Homo sapiens
cuguguuucuuuuugcc

SEQ ID NO: 1968274 - RNA, 22 nt, Homo sapiens
ccucuguauacugagucuuuac

SEQ ID NO: 1968275 - RNA, 13 nt, Homo sapiens
uauacacauaguu

SEQ ID NO: 1968276 - RNA, 20 nt, Homo sapiens
uaacugguggacauggcugu

SEQ ID NO: 1968277 - RNA, 17 nt, Homo sapiens
cugaggaaucaugaaaa

SEQ ID NO: 1968278 - RNA, 19 nt, Homo sapiens
ugagaaccaaccaaugaaa

SEQ ID NO: 1968279 - RNA, 20 nt, Homo sapiens
cauagcuacguggcacuaua

SEQ ID NO: 1968280 - RNA, 20 nt, Homo sapiens
gugaggucagcacaucucaa

SEQ ID NO: 1968281 - RNA, 20 nt, Homo sapiens
ucuuaaugaaccuuagaaag

SEQ ID NO: 1968282 - RNA, 12 nt, Homo sapiens
uuaaaagacaaa

SEQ ID NO: 1968283 - RNA, 14 nt, Homo sapiens
aucaucuuauucag

SEQ ID NO: 1968284 - RNA, 14 nt, Homo sapiens
uccauguuucucac

SEQ ID NO: 1968285 - RNA, 11 nt, Homo sapiens
gaaugccacag

SEQ ID NO: 1968286 - RNA, 23 nt, Homo sapiens
agccaaaccccuagagacaguga

SEQ ID NO: 1968287 - RNA, 19 nt, Homo sapiens
uaagaaccugucuuauuaa

SEQ ID NO: 1968288 - RNA, 20 nt, Homo sapiens
auuaaugauuaaacuauuaa

SEQ ID NO: 1968289 - RNA, 20 nt, Homo sapiens
aaagagaaaaacaacuuuau

SEQ ID NO: 1968290 - RNA, 22 nt, Homo sapiens
cucgggucccagaugucugcag

SEQ ID NO: 1968291 - RNA, 17 nt, Homo sapiens
ucuuguauacacauaua

SEQ ID NO: 1968292 - RNA, 20 nt, Homo sapiens
cuggcagaucguggacccuc

SEQ ID NO: 1968293 - RNA, 16 nt, Homo sapiens
aaagcaaaaaacaaaa

SEQ ID NO: 1968294 - RNA, 18 nt, Homo sapiens
cucuucaacugaccagcc

SEQ ID NO: 1968295 - RNA, 18 nt, Homo sapiens
uggauuuuuaccagucuc

SEQ ID NO: 1968296 - RNA, 19 nt, Homo sapiens
aagcagccuguuuucacuc

SEQ ID NO: 1968297 - RNA, 23 nt, Homo sapiens
uggugcagugccgcucuguagag

SEQ ID NO: 1968298 - RNA, 17 nt, Homo sapiens
uuuggcauuuuacugua

SEQ ID NO: 1968299 - RNA, 22 nt, Homo sapiens
uggcagugugcggagcugauaa

SEQ ID NO: 1968300 - RNA, 15 nt, Homo sapiens
ccuuuagcuuucuaa

SEQ ID NO: 1968301 - RNA, 22 nt, Homo sapiens
aguauuaucauugcuccccuga

SEQ ID NO: 1968302 - RNA, 16 nt, Homo sapiens
agcaaaaacauguaug

SEQ ID NO: 1968303 - RNA, 16 nt, Homo sapiens
gaaugacaacaccugg

SEQ ID NO: 1968304 - RNA, 19 nt, Homo sapiens
agcuuguuaucagcuuuca

SEQ ID NO: 1968305 - RNA, 14 nt, Homo sapiens
cuacauucugcucu

SEQ ID NO: 1968306 - RNA, 13 nt, Homo sapiens
ugauuaaugcuaa

SEQ ID NO: 1968307 - RNA, 17 nt, Homo sapiens
ccacuuguagauuugau

SEQ ID NO: 1968308 - RNA, 13 nt, Homo sapiens
uguuauggugcua

SEQ ID NO: 1968309 - RNA, 22 nt, Homo sapiens
gaacacagugcuauuugcauuu

SEQ ID NO: 1968310 - RNA, 14 nt, Homo sapiens
uugcuaccaaaaac

SEQ ID NO: 1968311 - RNA, 14 nt, Homo sapiens
uucaaaaccuugca

SEQ ID NO: 1968312 - RNA, 23 nt, Homo sapiens
accuuuucucuucauuuucccau

SEQ ID NO: 1968313 - RNA, 20 nt, Homo sapiens
caauuaacugcccucugaaa

SEQ ID NO: 1968314 - RNA, 20 nt, Homo sapiens
cacuugccccuguuaccuaa

SEQ ID NO: 1968315 - RNA, 19 nt, Homo sapiens
gcacaggucccacugcccu

SEQ ID NO: 1968316 - RNA, 18 nt, Homo sapiens
acuucugcaacucaugaa

SEQ ID NO: 1968317 - RNA, 15 nt, Homo sapiens
caggaggaucacuug

SEQ ID NO: 1968318 - RNA, 15 nt, Homo sapiens
aauuuuauaauguca

SEQ ID NO: 1968319 - RNA, 23 nt, Homo sapiens
ugaaauguaugugcucuuagcaa

SEQ ID NO: 1968320 - RNA, 17 nt, Homo sapiens
uuggggagauuugccac

SEQ ID NO: 1968321 - RNA, 18 nt, Homo sapiens
uaaaucccacaucccagu

SEQ ID NO: 1968322 - RNA, 14 nt, Homo sapiens
uuggcgcucucagc

SEQ ID NO: 1968323 - RNA, 16 nt, Homo sapiens
acgagacccagaggaa

SEQ ID NO: 1968324 - RNA, 23 nt, Homo sapiens
aggucagaaaccauuguucagaa

SEQ ID NO: 1968325 - RNA, 13 nt, Homo sapiens
agcuacaaaacaa

SEQ ID NO: 1968326 - RNA, 13 nt, Homo sapiens
cuacaagugcagc

SEQ ID NO: 1968327 - RNA, 15 nt, Homo sapiens
uaucuauauccauaa

SEQ ID NO: 1968328 - RNA, 17 nt, Homo sapiens
cuguuaugucagaggaa

SEQ ID NO: 1968329 - RNA, 17 nt, Homo sapiens
aaaagauuuaaguaauu

SEQ ID NO: 1968330 - RNA, 17 nt, Homo sapiens
augguaaguugagaugu

SEQ ID NO: 1968331 - RNA, 12 nt, Homo sapiens
ucgagaucucag

SEQ ID NO: 1968332 - RNA, 22 nt, Homo sapiens
aagugggcugcagcagccggaa

SEQ ID NO: 1968333 - RNA, 13 nt, Homo sapiens
ugugaggcacugu

SEQ ID NO: 1968334 - RNA, 20 nt, Homo sapiens
cuagguggagguugugcaug

SEQ ID NO: 1968335 - RNA, 11 nt, Homo sapiens
ucuacauucac

SEQ ID NO: 1968336 - RNA, 11 nt, Homo sapiens
uccacauucau

SEQ ID NO: 1968337 - RNA, 17 nt, Homo sapiens
aaauuaaauuguaccua

SEQ ID NO: 1968338 - RNA, 12 nt, Homo sapiens
aacacugucauc

SEQ ID NO: 1968339 - RNA, 16 nt, Homo sapiens
aaugcuguguugggua

SEQ ID NO: 1968340 - RNA, 20 nt, Homo sapiens
uggcccccacccucugccac

SEQ ID NO: 1968341 - RNA, 23 nt, Homo sapiens
ccuuguuggggaguggguggcag

SEQ ID NO: 1968342 - RNA, 22 nt, Homo sapiens
gagccuccccuggguuaacaaa

SEQ ID NO: 1968343 - RNA, 22 nt, Homo sapiens
ugcaagccuucuaaaugaguca

SEQ ID NO: 1968344 - RNA, 21 nt, Homo sapiens
accuuuguaagaaaaccaaaa

SEQ ID NO: 1968345 - RNA, 14 nt, Homo sapiens
caagcuccaucucu

SEQ ID NO: 1968346 - RNA, 15 nt, Homo sapiens
auuaaauauauacug

SEQ ID NO: 1968347 - RNA, 16 nt, Homo sapiens
cucccagguaccagcu

SEQ ID NO: 1968348 - RNA, 22 nt, Homo sapiens
uucaucagaacucuuccuccuc

SEQ ID NO: 1968349 - RNA, 15 nt, Homo sapiens
aaagcugcugucacu

SEQ ID NO: 1968350 - RNA, 14 nt, Homo sapiens
ucuaaucagugauu

SEQ ID NO: 1968351 - RNA, 16 nt, Homo sapiens
ucagugcuccuggaaa

SEQ ID NO: 1968352 - RNA, 17 nt, Homo sapiens
accaacaggcccagcuu

SEQ ID NO: 1968353 - RNA, 23 nt, Homo sapiens
agccugaaugucuuacugugauc

SEQ ID NO: 1968354 - RNA, 14 nt, Homo sapiens
gcaugccagagccu

SEQ ID NO: 1968355 - RNA, 19 nt, Homo sapiens
acuuugcuaaagacaugaa

SEQ ID NO: 1968356 - RNA, 17 nt, Homo sapiens
ccagggcugaugcugua

SEQ ID NO: 1968357 - RNA, 14 nt, Homo sapiens
ccucccacugcccc

SEQ ID NO: 1968358 - RNA, 19 nt, Homo sapiens
ucuucacugcuacaugugc

SEQ ID NO: 1968359 - RNA, 22 nt, Homo sapiens
ggaccccagcauuuaagugacc

SEQ ID NO: 1968360 - RNA, 17 nt, Homo sapiens
uuuccaaaggccaugga

SEQ ID NO: 1968361 - RNA, 16 nt, Homo sapiens
agggaccuuguuaaca

SEQ ID NO: 1968362 - RNA, 14 nt, Homo sapiens
gcauccuccagggg

SEQ ID NO: 1968363 - RNA, 14 nt, Homo sapiens
aauccaacuuucac

SEQ ID NO: 1968364 - RNA, 13 nt, Homo sapiens
uuguaaaccugga

SEQ ID NO: 1968365 - RNA, 22 nt, Homo sapiens
accucuauauaccaaagcacau

SEQ ID NO: 1968366 - RNA, 17 nt, Homo sapiens
auuuugcacugaggaua

SEQ ID NO: 1968367 - RNA, 19 nt, Homo sapiens
ccccagcccagagacauac

SEQ ID NO: 1968368 - RNA, 17 nt, Homo sapiens
cgcaggagccauugcuc

SEQ ID NO: 1968369 - RNA, 14 nt, Homo sapiens
uuuauaaugccauu

SEQ ID NO: 1968370 - RNA, 23 nt, Homo sapiens
cagaguggagcccagggugcugg

SEQ ID NO: 1968371 - RNA, 15 nt, Homo sapiens
acuucugacuacuug

SEQ ID NO: 1968372 - RNA, 13 nt, Homo sapiens
gacugcaguugaa

SEQ ID NO: 1968373 - RNA, 13 nt, Homo sapiens
uagauuucaggga

SEQ ID NO: 1968374 - RNA, 21 nt, Homo sapiens
aauaaugaauggacucaucuu

SEQ ID NO: 1968375 - RNA, 19 nt, Homo sapiens
ugaguuaaaucaguaaucu

SEQ ID NO: 1968376 - RNA, 13 nt, Homo sapiens
gaauuuaccucuu

SEQ ID NO: 1968377 - RNA, 18 nt, Homo sapiens
caggccuccccagcaccu

SEQ ID NO: 1968378 - RNA, 17 nt, Homo sapiens
uuaagugcuucacauuu

SEQ ID NO: 1968379 - RNA, 20 nt, Homo sapiens
aagcccuccgccauucucaa

SEQ ID NO: 1968380 - RNA, 20 nt, Homo sapiens
gcuguguggacuucaucuca

SEQ ID NO: 1968381 - RNA, 20 nt, Homo sapiens
uucuaaaaauaaaaguauug

SEQ ID NO: 1968382 - RNA, 19 nt, Homo sapiens
ugacagcagaggcuuugcu

SEQ ID NO: 1968383 - RNA, 14 nt, Homo sapiens
agaaaauauucuuu

SEQ ID NO: 1968384 - RNA, 11 nt, Homo sapiens
agcuguugcua

SEQ ID NO: 1968385 - RNA, 23 nt, Homo sapiens
agugaggucacaguccacccacc

SEQ ID NO: 1968386 - RNA, 15 nt, Homo sapiens
uauucugguucuuga

SEQ ID NO: 1968387 - RNA, 16 nt, Homo sapiens
aaccgcacaugcacac

SEQ ID NO: 1968388 - RNA, 12 nt, Homo sapiens
ucucccaugcac

SEQ ID NO: 1968389 - RNA, 19 nt, Homo sapiens
ccuccaugucuaugcuccc

SEQ ID NO: 1968390 - RNA, 15 nt, Homo sapiens
aagaaacaguugaau

SEQ ID NO: 1968391 - RNA, 12 nt, Homo sapiens
uugaaaaacuaa

SEQ ID NO: 1968392 - RNA, 17 nt, Homo sapiens
gcuacaaagaagacaug

SEQ ID NO: 1968393 - RNA, 23 nt, Homo sapiens
uaaaccuguuccugacuguucuc

SEQ ID NO: 1968394 - RNA, 15 nt, Homo sapiens
caaugaaaccaaagc

SEQ ID NO: 1968395 - RNA, 23 nt, Homo sapiens
uuaucucaaaaagugacuuccaa

SEQ ID NO: 1968396 - RNA, 14 nt, Homo sapiens
uuaaaugacaauuu

SEQ ID NO: 1968397 - RNA, 13 nt, Homo sapiens
uuaaccuuuccag

SEQ ID NO: 1968398 - RNA, 22 nt, Homo sapiens
auagccaccuggaaacacuagg

SEQ ID NO: 1968399 - RNA, 17 nt, Homo sapiens
acuuauuucagauucac

SEQ ID NO: 1968400 - RNA, 18 nt, Homo sapiens
aaauaaaaccaccaaagu

SEQ ID NO: 1968401 - RNA, 21 nt, Homo sapiens
gccgagaguccaucagccucc

SEQ ID NO: 1968402 - RNA, 14 nt, Homo sapiens
uauuguaguucaua

SEQ ID NO: 1968403 - RNA, 21 nt, Homo sapiens
uaaaccaacucuaauauugcu

SEQ ID NO: 1968404 - RNA, 18 nt, Homo sapiens
agccacaggcaccucucc

SEQ ID NO: 1968405 - RNA, 20 nt, Homo sapiens
cagccaccccucagacuggg

SEQ ID NO: 1968406 - RNA, 20 nt, Homo sapiens
ugaagagaaccgagcaaaga

SEQ ID NO: 1968407 - RNA, 20 nt, Homo sapiens
ucccacaacuacuaguguga

SEQ ID NO: 1968408 - RNA, 12 nt, Homo sapiens
auccccagugaa

SEQ ID NO: 1968409 - RNA, 12 nt, Homo sapiens
uuccccagagaa

SEQ ID NO: 1968410 - RNA, 11 nt, Homo sapiens
uuucauugcac

SEQ ID NO: 1968411 - RNA, 17 nt, Homo sapiens
aggacuucugcagcuau

SEQ ID NO: 1968412 - RNA, 21 nt, Homo sapiens
agcugauuugauaccauggca

SEQ ID NO: 1968413 - RNA, 13 nt, Homo sapiens
aucaauuccauca

SEQ ID NO: 1968414 - RNA, 14 nt, Homo sapiens
cagaagguauuccu

SEQ ID NO: 1968415 - RNA, 13 nt, Homo sapiens
aaaucaucaaagu

SEQ ID NO: 1968416 - RNA, 12 nt, Homo sapiens
guggucuugggg

SEQ ID NO: 1968417 - RNA, 19 nt, Homo sapiens
auaucuuaaagaaacagcu

SEQ ID NO: 1968418 - RNA, 13 nt, Homo sapiens
uaagagccuucaa

SEQ ID NO: 1968419 - RNA, 17 nt, Homo sapiens
cugcccccacacccacu

SEQ ID NO: 1968420 - RNA, 23 nt, Homo sapiens
ugcuuucacuucccaccucucua

SEQ ID NO: 1968421 - RNA, 21 nt, Homo sapiens
cucuguuaauguggacuggaa

SEQ ID NO: 1968422 - RNA, 12 nt, Homo sapiens
ggagggguggua

SEQ ID NO: 1968423 - RNA, 22 nt, Homo sapiens
uaagccugauuuuccugaugcu

SEQ ID NO: 1968424 - RNA, 14 nt, Homo sapiens
guauuuuggucaca

SEQ ID NO: 1968425 - RNA, 15 nt, Homo sapiens
gaacacacauuauua

SEQ ID NO: 1968426 - RNA, 14 nt, Homo sapiens
uuauagucuuccag

SEQ ID NO: 1968427 - RNA, 16 nt, Homo sapiens
ccaacuauaauuauaa

SEQ ID NO: 1968428 - RNA, 24 nt, Homo sapiens
agucacucuagucaaugacaugaa

SEQ ID NO: 1968429 - RNA, 20 nt, Homo sapiens
cauauaagcuauaucauaaa

SEQ ID NO: 1968430 - RNA, 15 nt, Homo sapiens
acccaccaccaugcc

SEQ ID NO: 1968431 - RNA, 15 nt, Homo sapiens
caacaggaaacuggg

SEQ ID NO: 1968432 - RNA, 16 nt, Homo sapiens
gaauaacaacugcugg

SEQ ID NO: 1968433 - RNA, 19 nt, Homo sapiens
ggccccuuaggccagugau

SEQ ID NO: 1968434 - RNA, 14 nt, Homo sapiens
cauucagauuuacc

SEQ ID NO: 1968435 - RNA, 21 nt, Homo sapiens
acauauggacgaggauggguu

SEQ ID NO: 1968436 - RNA, 22 nt, Homo sapiens
ccuucaccccaguggccacuca

SEQ ID NO: 1968437 - RNA, 14 nt, Homo sapiens
augccaccauccaa

SEQ ID NO: 1968438 - RNA, 18 nt, Homo sapiens
agggaacgggguccuuca

SEQ ID NO: 1968439 - RNA, 17 nt, Homo sapiens
aaugcugauaugaucuu

SEQ ID NO: 1968440 - RNA, 14 nt, Homo sapiens
ugagggaagcaaua

SEQ ID NO: 1968441 - RNA, 21 nt, Homo sapiens
uaccuguagacuguggaacua

SEQ ID NO: 1968442 - RNA, 21 nt, Homo sapiens
agagcccugaguuucuuggcu

SEQ ID NO: 1968443 - RNA, 17 nt, Homo sapiens
gaaaucacugauagaau

SEQ ID NO: 1968444 - RNA, 17 nt, Homo sapiens
uagcgcucccuuuucac

SEQ ID NO: 1968445 - RNA, 22 nt, Homo sapiens
caucuagggaaugggacuguga

SEQ ID NO: 1968446 - RNA, 13 nt, Homo sapiens
acagcaaaugugu

SEQ ID NO: 1968447 - RNA, 17 nt, Homo sapiens
cuugguagcacuuuaaa

SEQ ID NO: 1968448 - RNA, 11 nt, Homo sapiens
uuacugccaaa

SEQ ID NO: 1968449 - RNA, 23 nt, Homo sapiens
accucugacgcaccacugccaau

SEQ ID NO: 1968450 - RNA, 23 nt, Homo sapiens
gagcaaugggagggggcuccaug

SEQ ID NO: 1968451 - RNA, 13 nt, Homo sapiens
uuaauaacagcuc

SEQ ID NO: 1968452 - RNA, 19 nt, Homo sapiens
aggucuguacuaacaaagc

SEQ ID NO: 1968453 - RNA, 18 nt, Homo sapiens
gccacauuucugaucaga

SEQ ID NO: 1968454 - RNA, 14 nt, Homo sapiens
acuccucucuaggg

SEQ ID NO: 1968455 - RNA, 19 nt, Homo sapiens
acgugaauagcgcccucaa

SEQ ID NO: 1968456 - RNA, 19 nt, Homo sapiens
gaauuuauugcacauuguu

SEQ ID NO: 1968457 - RNA, 17 nt, Homo sapiens
acaagugugaugccaua

SEQ ID NO: 1968458 - RNA, 22 nt, Homo sapiens
ucagucacuguucgucacucaa

SEQ ID NO: 1968459 - RNA, 19 nt, Homo sapiens
cacuucuaguuuggcauuu

SEQ ID NO: 1968460 - RNA, 18 nt, Homo sapiens
cccaggagcccauuugga

SEQ ID NO: 1968461 - RNA, 19 nt, Homo sapiens
ugacaccagaauaaugagu

SEQ ID NO: 1968462 - RNA, 19 nt, Homo sapiens
acacucuucuaugacccag

SEQ ID NO: 1968463 - RNA, 19 nt, Homo sapiens
uuugguagaugcaugacuu

SEQ ID NO: 1968464 - RNA, 16 nt, Homo sapiens
acaguccuugggguua

SEQ ID NO: 1968465 - RNA, 13 nt, Homo sapiens
uacucagcauuug

SEQ ID NO: 1968466 - RNA, 21 nt, Homo sapiens
aaaaggucugaggacugagcc

SEQ ID NO: 1968467 - RNA, 21 nt, Homo sapiens
gcuuugcggcaucuccauuuc

SEQ ID NO: 1968468 - RNA, 18 nt, Homo sapiens
ucccauaaacacugaauu

SEQ ID NO: 1968469 - RNA, 17 nt, Homo sapiens
ggguccacacaucuccc

SEQ ID NO: 1968470 - RNA, 14 nt, Homo sapiens
caauaccagaucac

SEQ ID NO: 1968471 - RNA, 14 nt, Homo sapiens
gcacuucaccuuuu

SEQ ID NO: 1968472 - RNA, 22 nt, Homo sapiens
cagcuuaucucaggggugugcg

SEQ ID NO: 1968473 - RNA, 18 nt, Homo sapiens
aaauguuaaagaacugcu

SEQ ID NO: 1968474 - RNA, 17 nt, Homo sapiens
ccugcuccgcugcuccu

SEQ ID NO: 1968475 - RNA, 22 nt, Homo sapiens
gucaggggcggggagggugaca

SEQ ID NO: 1968476 - RNA, 22 nt, Homo sapiens
uuuucuuuugugguuucucugg

SEQ ID NO: 1968477 - RNA, 12 nt, Homo sapiens
caaaagugcucc

SEQ ID NO: 1968478 - RNA, 15 nt, Homo sapiens
ccuccaauguacaac

SEQ ID NO: 1968479 - RNA, 21 nt, Homo sapiens
aguacuuuucuguucaucacc

SEQ ID NO: 1968480 - RNA, 19 nt, Homo sapiens
cccucuccaggcauuuauu

SEQ ID NO: 1968481 - RNA, 14 nt, Homo sapiens
agccaccugggaac

SEQ ID NO: 1968482 - RNA, 15 nt, Homo sapiens
ugaguggccugcuaa

SEQ ID NO: 1968483 - RNA, 17 nt, Homo sapiens
gacucaggauccaguga

SEQ ID NO: 1968484 - RNA, 17 nt, Homo sapiens
gaaaggaugcacaguca

SEQ ID NO: 1968485 - RNA, 21 nt, Homo sapiens
ccugauggccuuuggacccag

SEQ ID NO: 1968486 - RNA, 20 nt, Homo sapiens
accauguacaugaagaagcu

SEQ ID NO: 1968487 - RNA, 14 nt, Homo sapiens
gccaugggcaaagc

SEQ ID NO: 1968488 - RNA, 19 nt, Homo sapiens
ucaaagagggagugcauuu

SEQ ID NO: 1968489 - RNA, 22 nt, Homo sapiens
cagagagggaacagcauaugca

SEQ ID NO: 1968490 - RNA, 19 nt, Homo sapiens
ucagauuacacuucuccag

SEQ ID NO: 1968491 - RNA, 23 nt, Homo sapiens
uuuuaaaaggcaagucaaauacc

SEQ ID NO: 1968492 - RNA, 16 nt, Homo sapiens
cuugugacgugcacug

SEQ ID NO: 1968493 - RNA, 21 nt, Homo sapiens
caugcucaggagccaccagca

SEQ ID NO: 1968494 - RNA, 15 nt, Homo sapiens
ucauuuuauucuuau

SEQ ID NO: 1968495 - RNA, 16 nt, Homo sapiens
caagcugaggugccca

SEQ ID NO: 1968496 - RNA, 21 nt, Homo sapiens
uaugagguuucuuugacuuca

SEQ ID NO: 1968497 - RNA, 20 nt, Homo sapiens
augacaacuucuaauugcca

SEQ ID NO: 1968498 - RNA, 14 nt, Homo sapiens
ugccccgcacugug

SEQ ID NO: 1968499 - RNA, 15 nt, Homo sapiens
cuuuggagacuuucu

SEQ ID NO: 1968500 - RNA, 19 nt, Homo sapiens
acauucuuaccauuucaca

SEQ ID NO: 1968501 - RNA, 13 nt, Homo sapiens
uaacacuaccaau

SEQ ID NO: 1968502 - RNA, 18 nt, Homo sapiens
ccaccaaauacaauucaa

SEQ ID NO: 1968503 - RNA, 22 nt, Homo sapiens
cagcaaacguacgggaaugugc

SEQ ID NO: 1968504 - RNA, 17 nt, Homo sapiens
aagcuguaggacuguuu

SEQ ID NO: 1968505 - RNA, 20 nt, Homo sapiens
gauuuuuaaaaugucaagac

SEQ ID NO: 1968506 - RNA, 14 nt, Homo sapiens
guacccuuccaccu

SEQ ID NO: 1968507 - RNA, 17 nt, Homo sapiens
aggaagggaucugagaa

SEQ ID NO: 1968508 - RNA, 22 nt, Homo sapiens
ugcuucacucaugcaaacugcu

SEQ ID NO: 1968509 - RNA, 17 nt, Homo sapiens
auacccaggaagacuuu

SEQ ID NO: 1968510 - RNA, 23 nt, Homo sapiens
uauccuaaauaaaaaaagacaaa

SEQ ID NO: 1968511 - RNA, 14 nt, Homo sapiens
gagauaaugcaguc

SEQ ID NO: 1968512 - RNA, 20 nt, Homo sapiens
cacuugggguuuaaauaucc

SEQ ID NO: 1968513 - RNA, 23 nt, Homo sapiens
cagucuccucacucugucccugu

SEQ ID NO: 1968514 - RNA, 15 nt, Homo sapiens
augauagaugacaaa

SEQ ID NO: 1968515 - RNA, 17 nt, Homo sapiens
ucaccuacauuaucuca

SEQ ID NO: 1968516 - RNA, 13 nt, Homo sapiens
cuccucgcaagcu

SEQ ID NO: 1968517 - RNA, 16 nt, Homo sapiens
gcaguugaauucagug

SEQ ID NO: 1968518 - RNA, 18 nt, Homo sapiens
cagugcccauuccucacc

SEQ ID NO: 1968519 - RNA, 21 nt, Homo sapiens
uggucuucacugccaugccuc

SEQ ID NO: 1968520 - RNA, 12 nt, Homo sapiens
agagugcacugc

SEQ ID NO: 1968521 - RNA, 17 nt, Homo sapiens
augguauggaaucugag

SEQ ID NO: 1968522 - RNA, 14 nt, Homo sapiens
acccccagugcagc

SEQ ID NO: 1968523 - RNA, 19 nt, Homo sapiens
cugcccacacagguucacg

SEQ ID NO: 1968524 - RNA, 20 nt, Homo sapiens
ugcucccucuccaagacagc

SEQ ID NO: 1968525 - RNA, 16 nt, Homo sapiens
augagugaggacuugg

SEQ ID NO: 1968526 - RNA, 15 nt, Homo sapiens
ugagaucagucagcu

SEQ ID NO: 1968527 - RNA, 15 nt, Homo sapiens
ucuggggcaucagcc

SEQ ID NO: 1968528 - RNA, 20 nt, Homo sapiens
uaccuaaguggauauagaua

SEQ ID NO: 1968529 - RNA, 18 nt, Homo sapiens
uccaaacaauucugauga

SEQ ID NO: 1968530 - RNA, 17 nt, Homo sapiens
uaaacauuucaauguca

SEQ ID NO: 1968531 - RNA, 15 nt, Homo sapiens
uaugaaccuucuuaa

SEQ ID NO: 1968532 - RNA, 12 nt, Homo sapiens
aaucuuugccaa

SEQ ID NO: 1968533 - RNA, 14 nt, Homo sapiens
agcagcaacugugu

SEQ ID NO: 1968534 - RNA, 17 nt, Homo sapiens
guuuuucuuuucauuua

SEQ ID NO: 1968535 - RNA, 17 nt, Homo sapiens
uaauaccagaacucuaa

SEQ ID NO: 1968536 - RNA, 18 nt, Homo sapiens
guugaaaaccacagucag

SEQ ID NO: 1968537 - RNA, 22 nt, Homo sapiens
gaaugcaaaaggugcugagaaa

SEQ ID NO: 1968538 - RNA, 13 nt, Homo sapiens
gaccuauugccag

SEQ ID NO: 1968539 - RNA, 17 nt, Homo sapiens
auucuacuauacuguac

SEQ ID NO: 1968540 - RNA, 12 nt, Homo sapiens
cuacaucugccu

SEQ ID NO: 1968541 - RNA, 12 nt, Homo sapiens
uuucauugcugg

SEQ ID NO: 1968542 - RNA, 19 nt, Homo sapiens
agcugacuuuuaacuacaa

SEQ ID NO: 1968543 - RNA, 17 nt, Homo sapiens
caguauuuucuccacuu

SEQ ID NO: 1968544 - RNA, 12 nt, Homo sapiens
ccuuucuaaucc

SEQ ID NO: 1968545 - RNA, 22 nt, Homo sapiens
uacagaccacaaaauguaauau

SEQ ID NO: 1968546 - RNA, 14 nt, Homo sapiens
caaucccuuugcaa

SEQ ID NO: 1968547 - RNA, 17 nt, Homo sapiens
uguggggaagaggggcu

SEQ ID NO: 1968548 - RNA, 17 nt, Homo sapiens
aaugacccaaagaccaa

SEQ ID NO: 1968549 - RNA, 17 nt, Homo sapiens
cuuauauacuaauauca

SEQ ID NO: 1968550 - RNA, 17 nt, Homo sapiens
auaaacgaaacauuuag

SEQ ID NO: 1968551 - RNA, 23 nt, Homo sapiens
caggggcugcaguagccauguua

SEQ ID NO: 1968552 - RNA, 16 nt, Homo sapiens
uggcucagaugccacu

SEQ ID NO: 1968553 - RNA, 18 nt, Homo sapiens
uguucucaaaugcuaaau

SEQ ID NO: 1968554 - RNA, 20 nt, Homo sapiens
cuuugcugcuggugcuaaaa

SEQ ID NO: 1968555 - RNA, 16 nt, Homo sapiens
uccugcuagcuguaga

SEQ ID NO: 1968556 - RNA, 20 nt, Homo sapiens
cacacgccuucaugccagug

SEQ ID NO: 1968557 - RNA, 19 nt, Homo sapiens
gauuucccacugcacucca

SEQ ID NO: 1968558 - RNA, 19 nt, Homo sapiens
agggucuuguguugcaagu

SEQ ID NO: 1968559 - RNA, 15 nt, Homo sapiens
ucugauaaugcucac

SEQ ID NO: 1968560 - RNA, 15 nt, Homo sapiens
aaucccaguucaugu

SEQ ID NO: 1968561 - RNA, 15 nt, Homo sapiens
ucuggcuacucccug

SEQ ID NO: 1968562 - RNA, 13 nt, Homo sapiens
ugccaaaaugcaa

SEQ ID NO: 1968563 - RNA, 20 nt, Homo sapiens
gccacuuggccaccaggacu

SEQ ID NO: 1968564 - RNA, 13 nt, Homo sapiens
ugcaauaaugaca

SEQ ID NO: 1968565 - RNA, 18 nt, Homo sapiens
ggaccaagcagagcucac

SEQ ID NO: 1968566 - RNA, 16 nt, Homo sapiens
aggagagccacugggc

SEQ ID NO: 1968567 - RNA, 19 nt, Homo sapiens
aacuaucagacuaagccag

SEQ ID NO: 1968568 - RNA, 20 nt, Homo sapiens
cugcacucuaacccuaggca

SEQ ID NO: 1968569 - RNA, 21 nt, Homo sapiens
ucugaggaguaaguguacaau

SEQ ID NO: 1968570 - RNA, 22 nt, Homo sapiens
cuagcaaccuccacauguucaa

SEQ ID NO: 1968571 - RNA, 17 nt, Homo sapiens
agucguggaaucaaauc

SEQ ID NO: 1968572 - RNA, 12 nt, Homo sapiens
cguacaguucuu

SEQ ID NO: 1968573 - RNA, 20 nt, Homo sapiens
gcgcaauugaaggaucaucu

SEQ ID NO: 1968574 - RNA, 22 nt, Homo sapiens
aggacugcaggggccacuccaa

SEQ ID NO: 1968575 - RNA, 17 nt, Homo sapiens
caaagggcucaagggug

SEQ ID NO: 1968576 - RNA, 20 nt, Homo sapiens
acauuuuugugccauuauau

SEQ ID NO: 1968577 - RNA, 21 nt, Homo sapiens
cuuguacagacaugugcucug

SEQ ID NO: 1968578 - RNA, 19 nt, Homo sapiens
aaaucucuucaaauucuuc

SEQ ID NO: 1968579 - RNA, 14 nt, Homo sapiens
ggcgugugugacac

SEQ ID NO: 1968580 - RNA, 23 nt, Homo sapiens
aaacuaccauguggccauuaaca

SEQ ID NO: 1968581 - RNA, 22 nt, Homo sapiens
uguccaacaagccccacagccc

SEQ ID NO: 1968582 - RNA, 16 nt, Homo sapiens
guaauaaauuguuauu

SEQ ID NO: 1968583 - RNA, 17 nt, Homo sapiens
ucuggggggauauuucc

SEQ ID NO: 1968584 - RNA, 22 nt, Homo sapiens
ggcccucacucaggaacccugg

SEQ ID NO: 1968585 - RNA, 12 nt, Homo sapiens
gcuaacaaaaga

SEQ ID NO: 1968586 - RNA, 22 nt, Homo sapiens
ggcagcuggggggcuguccuga

SEQ ID NO: 1968587 - RNA, 19 nt, Homo sapiens
ccaucagcuggguggugua

SEQ ID NO: 1968588 - RNA, 21 nt, Homo sapiens
ucuucagagagcuaaauuaca

SEQ ID NO: 1968589 - RNA, 18 nt, Homo sapiens
accugcugguuguugcca

SEQ ID NO: 1968590 - RNA, 17 nt, Homo sapiens
cuauuuuuaguuugcua

SEQ ID NO: 1968591 - RNA, 22 nt, Homo sapiens
cagggaguccaggguuucucug

SEQ ID NO: 1968592 - RNA, 20 nt, Homo sapiens
uagcucaaauaggucaucau

SEQ ID NO: 1968593 - RNA, 23 nt, Homo sapiens
aagcaacacccacccacuucuca

SEQ ID NO: 1968594 - RNA, 18 nt, Homo sapiens
caaggauccugugcugcu

SEQ ID NO: 1968595 - RNA, 19 nt, Homo sapiens
aacuaaaacccccaauaaa

SEQ ID NO: 1968596 - RNA, 13 nt, Homo sapiens
aacaacaacgaga

SEQ ID NO: 1968597 - RNA, 13 nt, Homo sapiens
gaugaaugagaug

SEQ ID NO: 1968598 - RNA, 19 nt, Homo sapiens
uucccguuagucucugaac

SEQ ID NO: 1968599 - RNA, 15 nt, Homo sapiens
ugguauaauaaagua

SEQ ID NO: 1968600 - RNA, 13 nt, Homo sapiens
cuuggggacuaac

SEQ ID NO: 1968601 - RNA, 16 nt, Homo sapiens
ucaugaucauucucag

SEQ ID NO: 1968602 - RNA, 20 nt, Homo sapiens
gaacuuuguuaacgcacuug

SEQ ID NO: 1968603 - RNA, 21 nt, Homo sapiens
uuuuugagguaucacugcagu

SEQ ID NO: 1968604 - RNA, 17 nt, Homo sapiens
uggagaaacuguagucu

SEQ ID NO: 1968605 - RNA, 18 nt, Homo sapiens
acaguguacaaugccuuu

SEQ ID NO: 1968606 - RNA, 22 nt, Homo sapiens
caacucacccccuacacacaca

SEQ ID NO: 1968607 - RNA, 15 nt, Homo sapiens
uguccuccaagccag

SEQ ID NO: 1968608 - RNA, 14 nt, Homo sapiens
acucuuaucuacau

SEQ ID NO: 1968609 - RNA, 14 nt, Homo sapiens
ucucaagacuuuag

SEQ ID NO: 1968610 - RNA, 16 nt, Homo sapiens
ucagauuuugugaacu

SEQ ID NO: 1968611 - RNA, 21 nt, Homo sapiens
gccuccuucccucggggccau

SEQ ID NO: 1968612 - RNA, 17 nt, Homo sapiens
ugcaccagugugacauc

SEQ ID NO: 1968613 - RNA, 15 nt, Homo sapiens
acucaaugccaacuu

SEQ ID NO: 1968614 - RNA, 22 nt, Homo sapiens
accagugugaccacacuguuac

SEQ ID NO: 1968615 - RNA, 15 nt, Homo sapiens
aagugauacuaucca

SEQ ID NO: 1968616 - RNA, 13 nt, Homo sapiens
ucacugacacaca

SEQ ID NO: 1968617 - RNA, 13 nt, Homo sapiens
uuuuugacauuua

SEQ ID NO: 1968618 - RNA, 16 nt, Homo sapiens
aagucaugaacacauc

SEQ ID NO: 1968619 - RNA, 12 nt, Homo sapiens
ugcucacugcag

SEQ ID NO: 1968620 - RNA, 16 nt, Homo sapiens
caucacaucacauuua

SEQ ID NO: 1968621 - RNA, 19 nt, Homo sapiens
cacaauuauuaccaucucu

SEQ ID NO: 1968622 - RNA, 14 nt, Homo sapiens
gccacucacacagc

SEQ ID NO: 1968623 - RNA, 21 nt, Homo sapiens
uacagaccacaaaauguaaua

SEQ ID NO: 1968624 - RNA, 17 nt, Homo sapiens
augcacuuucccuagaa

SEQ ID NO: 1968625 - RNA, 11 nt, Homo sapiens
auuuugcccag

SEQ ID NO: 1968626 - RNA, 14 nt, Homo sapiens
uuauuucagauuca

SEQ ID NO: 1968627 - RNA, 19 nt, Homo sapiens
ggccgcagcucuugcccuu

SEQ ID NO: 1968628 - RNA, 17 nt, Homo sapiens
agcaagccaauuuggaa

SEQ ID NO: 1968629 - RNA, 16 nt, Homo sapiens
aucauuccauuuugcu

SEQ ID NO: 1968630 - RNA, 20 nt, Homo sapiens
cagagaccaagauggcccau

SEQ ID NO: 1968631 - RNA, 14 nt, Homo sapiens
uuuaaacugcagcg

SEQ ID NO: 1968632 - RNA, 16 nt, Homo sapiens
gccucucucaggccaa

SEQ ID NO: 1968633 - RNA, 19 nt, Homo sapiens
uagguuaaaaacagggaaa

SEQ ID NO: 1968634 - RNA, 12 nt, Homo sapiens
acacaaucaaaa

SEQ ID NO: 1968635 - RNA, 16 nt, Homo sapiens
aggaaggcagagaccu

SEQ ID NO: 1968636 - RNA, 17 nt, Homo sapiens
cuuuuuaaccauuccaa

SEQ ID NO: 1968637 - RNA, 16 nt, Homo sapiens
ccuguuuuauaauuca

SEQ ID NO: 1968638 - RNA, 21 nt, Homo sapiens
cacuucacccacccuccagga

SEQ ID NO: 1968639 - RNA, 19 nt, Homo sapiens
acaaaauagccuauccuua

SEQ ID NO: 1968640 - RNA, 16 nt, Homo sapiens
gccauaauauauauga

SEQ ID NO: 1968641 - RNA, 13 nt, Homo sapiens
gucacagaugaag

SEQ ID NO: 1968642 - RNA, 15 nt, Homo sapiens
agcugggauuugaac

SEQ ID NO: 1968643 - RNA, 12 nt, Homo sapiens
gcaccaccaaga

SEQ ID NO: 1968644 - RNA, 20 nt, Homo sapiens
uaauucacucaagcacugau

SEQ ID NO: 1968645 - RNA, 21 nt, Homo sapiens
auuuccggaaguaaauacagc

SEQ ID NO: 1968646 - RNA, 21 nt, Homo sapiens
uauuuauaauuccuauauccu

SEQ ID NO: 1968647 - RNA, 18 nt, Homo sapiens
cucuuauuucaucauuca

SEQ ID NO: 1968648 - RNA, 13 nt, Homo sapiens
uaaagacaggguc

SEQ ID NO: 1968649 - RNA, 15 nt, Homo sapiens
cucaucagcuuuauu

SEQ ID NO: 1968650 - RNA, 15 nt, Homo sapiens
accucacgcaccucc

SEQ ID NO: 1968651 - RNA, 16 nt, Homo sapiens
aaucagacuaugaagu

SEQ ID NO: 1968652 - RNA, 19 nt, Homo sapiens
ccugggacaaccagacucu

SEQ ID NO: 1968653 - RNA, 14 nt, Homo sapiens
agucagaggaggga

SEQ ID NO: 1968654 - RNA, 19 nt, Homo sapiens
ucaguuucccuaucugcaa

SEQ ID NO: 1968655 - RNA, 21 nt, Homo sapiens
acuuuaguguauuuucuguca

SEQ ID NO: 1968656 - RNA, 18 nt, Homo sapiens
agggcacugcugcugccu

SEQ ID NO: 1968657 - RNA, 21 nt, Homo sapiens
uucuccagacuuuuaccuacc

SEQ ID NO: 1968658 - RNA, 17 nt, Homo sapiens
uuuuuagucuggcugca

SEQ ID NO: 1968659 - RNA, 20 nt, Homo sapiens
uaugaaaacagcuaucucac

SEQ ID NO: 1968660 - RNA, 21 nt, Homo sapiens
guguauauuuguauauuacac

SEQ ID NO: 1968661 - RNA, 12 nt, Homo sapiens
aggccacacugg

SEQ ID NO: 1968662 - RNA, 22 nt, Homo sapiens
ugcccaccaccgugucaugaga

SEQ ID NO: 1968663 - RNA, 14 nt, Homo sapiens
auggaugagcacac

SEQ ID NO: 1968664 - RNA, 20 nt, Homo sapiens
gucuaaaaaaggaauccucu

SEQ ID NO: 1968665 - RNA, 23 nt, Homo sapiens
augguuuuacagugaauuucuga

SEQ ID NO: 1968666 - RNA, 21 nt, Homo sapiens
uguuuggaaagcugaaaggga

SEQ ID NO: 1968667 - RNA, 20 nt, Homo sapiens
gagaccuuugauuuuugccc

SEQ ID NO: 1968668 - RNA, 23 nt, Homo sapiens
uaguuuaaacccaagaagggcac

SEQ ID NO: 1968669 - RNA, 22 nt, Homo sapiens
uaacuucagauguuuccaagau

SEQ ID NO: 1968670 - RNA, 16 nt, Homo sapiens
aaaaggauuaggcaaa

SEQ ID NO: 1968671 - RNA, 18 nt, Homo sapiens
ccacaugggagcagucca

SEQ ID NO: 1968672 - RNA, 17 nt, Homo sapiens
uaccaggaugugcuauu

SEQ ID NO: 1968673 - RNA, 20 nt, Homo sapiens
ucucagcucacuacaaccuc

SEQ ID NO: 1968674 - RNA, 20 nt, Homo sapiens
ucucggcucacugcaaccuc

SEQ ID NO: 1968675 - RNA, 15 nt, Homo sapiens
cugacuaacgccauc

SEQ ID NO: 1968676 - RNA, 19 nt, Homo sapiens
cugcagggugggaucagcc

SEQ ID NO: 1968677 - RNA, 19 nt, Homo sapiens
caaagaaacagagugcuaa

SEQ ID NO: 1968678 - RNA, 15 nt, Homo sapiens
ucccuuucacacugu

SEQ ID NO: 1968679 - RNA, 16 nt, Homo sapiens
uacaaaugacuccuaa

SEQ ID NO: 1968680 - RNA, 13 nt, Homo sapiens
aucacgaggucag

SEQ ID NO: 1968681 - RNA, 21 nt, Homo sapiens
cuaugauuuuaagauagaaca

SEQ ID NO: 1968682 - RNA, 15 nt, Homo sapiens
uaggugacugaaauu

SEQ ID NO: 1968683 - RNA, 18 nt, Homo sapiens
gccaaacccuugucagug

SEQ ID NO: 1968684 - RNA, 19 nt, Homo sapiens
cagaacacugcagucagau

SEQ ID NO: 1968685 - RNA, 21 nt, Homo sapiens
cuuugaguacagauacuguga

SEQ ID NO: 1968686 - RNA, 23 nt, Homo sapiens
gcaacaaacugcacaugauuuca

SEQ ID NO: 1968687 - RNA, 16 nt, Homo sapiens
cucacucacucugauu

SEQ ID NO: 1968688 - RNA, 14 nt, Homo sapiens
aauugaugaugcag

SEQ ID NO: 1968689 - RNA, 22 nt, Homo sapiens
aaauuuauuuuguguuguucau

SEQ ID NO: 1968690 - RNA, 14 nt, Homo sapiens
cucauacucaccuc

SEQ ID NO: 1968691 - RNA, 19 nt, Homo sapiens
uggauccacaaggccugag

SEQ ID NO: 1968692 - RNA, 14 nt, Homo sapiens
auagacaccaagga

SEQ ID NO: 1968693 - RNA, 18 nt, Homo sapiens
agaugacauaaaauuuac

SEQ ID NO: 1968694 - RNA, 19 nt, Homo sapiens
gagauuucauagcuauuua

SEQ ID NO: 1968695 - RNA, 22 nt, Homo sapiens
aauugcagaugguuaaauauca

SEQ ID NO: 1968696 - RNA, 16 nt, Homo sapiens
aaacagaaaaccugau

SEQ ID NO: 1968697 - RNA, 22 nt, Homo sapiens
ccuuucaaauuuuuacugagaa

SEQ ID NO: 1968698 - RNA, 15 nt, Homo sapiens
uaauguuugcauuuc

SEQ ID NO: 1968699 - RNA, 18 nt, Homo sapiens
augugaccgaacacugca

SEQ ID NO: 1968700 - RNA, 13 nt, Homo sapiens
gccagccacagga

SEQ ID NO: 1968701 - RNA, 18 nt, Homo sapiens
acuuugcaaagacagugu

SEQ ID NO: 1968702 - RNA, 21 nt, Homo sapiens
aacuccugaccucaggugaug

SEQ ID NO: 1968703 - RNA, 21 nt, Homo sapiens
ucuguggagggagggcagcug

SEQ ID NO: 1968704 - RNA, 14 nt, Homo sapiens
guucacugcaaugc

SEQ ID NO: 1968705 - RNA, 15 nt, Homo sapiens
caaauacacauacau

SEQ ID NO: 1968706 - RNA, 16 nt, Homo sapiens
cuauuguuucuuucaa

SEQ ID NO: 1968707 - RNA, 14 nt, Homo sapiens
ugcugcugcucauu

SEQ ID NO: 1968708 - RNA, 14 nt, Homo sapiens
gaggcgcggaguga

SEQ ID NO: 1968709 - RNA, 21 nt, Homo sapiens
agucccuaaaaacacagacau

SEQ ID NO: 1968710 - RNA, 18 nt, Homo sapiens
uagcaauagcuagcuaua

SEQ ID NO: 1968711 - RNA, 13 nt, Homo sapiens
aaaggcaucacuu

SEQ ID NO: 1968712 - RNA, 21 nt, Homo sapiens
cucccaagccccugacccgcu

SEQ ID NO: 1968713 - RNA, 23 nt, Homo sapiens
cagccagagaaugcccacugccu

SEQ ID NO: 1968714 - RNA, 24 nt, Homo sapiens
cuaucaaaacucuaucaaauguga

SEQ ID NO: 1968715 - RNA, 11 nt, Homo sapiens
auaagccaaaa

SEQ ID NO: 1968716 - RNA, 23 nt, Homo sapiens
gaacuguuaaaggucauaugcac

SEQ ID NO: 1968717 - RNA, 20 nt, Homo sapiens
agacucgauaguggugguga

SEQ ID NO: 1968718 - RNA, 18 nt, Homo sapiens
uguaaauauacacuauuu

SEQ ID NO: 1968719 - RNA, 13 nt, Homo sapiens
gaauucuugaguu

SEQ ID NO: 1968720 - RNA, 20 nt, Homo sapiens
caggcuugaaucaaagaacu

SEQ ID NO: 1968721 - RNA, 12 nt, Homo sapiens
ugccgcauuugg

SEQ ID NO: 1968722 - RNA, 17 nt, Homo sapiens
gucuguaaaaaauggag

SEQ ID NO: 1968723 - RNA, 12 nt, Homo sapiens
uaaaucuaacaa

SEQ ID NO: 1968724 - RNA, 23 nt, Homo sapiens
ucacucaaugccaggcagugcag

SEQ ID NO: 1968725 - RNA, 15 nt, Homo sapiens
ugcacaguacuguuu

SEQ ID NO: 1968726 - RNA, 19 nt, Homo sapiens
gcauuucaaggaacagcca

SEQ ID NO: 1968727 - RNA, 16 nt, Homo sapiens
aauuuguucugugcaa

SEQ ID NO: 1968728 - RNA, 15 nt, Homo sapiens
accuggugcucucaa

SEQ ID NO: 1968729 - RNA, 13 nt, Homo sapiens
auuuggcugcacu

SEQ ID NO: 1968730 - RNA, 16 nt, Homo sapiens
cuuccugccaccaguc

SEQ ID NO: 1968731 - RNA, 20 nt, Homo sapiens
augcuguuugacaaaguuac

SEQ ID NO: 1968732 - RNA, 15 nt, Homo sapiens
ucucaugcagaagag

SEQ ID NO: 1968733 - RNA, 15 nt, Homo sapiens
ucaaaagagucuuaa

SEQ ID NO: 1968734 - RNA, 21 nt, Homo sapiens
gcuggcagagagcacagugau

SEQ ID NO: 1968735 - RNA, 13 nt, Homo sapiens
ggcgcucuuccag

SEQ ID NO: 1968736 - RNA, 18 nt, Homo sapiens
agacaacagcccugucuc

SEQ ID NO: 1968737 - RNA, 17 nt, Homo sapiens
augcugucuuagaucag

SEQ ID NO: 1968738 - RNA, 14 nt, Homo sapiens
cagcccccucacag

SEQ ID NO: 1968739 - RNA, 14 nt, Homo sapiens
gucagccacuguuu

SEQ ID NO: 1968740 - RNA, 21 nt, Homo sapiens
aauagcccaggauauauuuua

SEQ ID NO: 1968741 - RNA, 12 nt, Homo sapiens
gugccugugauc

SEQ ID NO: 1968742 - RNA, 19 nt, Homo sapiens
cugaccuggcuggugacag

SEQ ID NO: 1968743 - RNA, 14 nt, Homo sapiens
uugcccacauuaag

SEQ ID NO: 1968744 - RNA, 18 nt, Homo sapiens
uggacguggguugcacug

SEQ ID NO: 1968745 - RNA, 16 nt, Homo sapiens
uccugcagugugagau

SEQ ID NO: 1968746 - RNA, 16 nt, Homo sapiens
ggggcugaugcaguug

SEQ ID NO: 1968747 - RNA, 14 nt, Homo sapiens
cuuacuaugaccuu

SEQ ID NO: 1968748 - RNA, 15 nt, Homo sapiens
uauuaccuuccacuu

SEQ ID NO: 1968749 - RNA, 13 nt, Homo sapiens
accauugcccuag

SEQ ID NO: 1968750 - RNA, 17 nt, Homo sapiens
ggacuauuucuggcacu

SEQ ID NO: 1968751 - RNA, 13 nt, Homo sapiens
cugcucuacugcu

SEQ ID NO: 1968752 - RNA, 21 nt, Homo sapiens
aggcuccuuccugucuuccug

SEQ ID NO: 1968753 - RNA, 20 nt, Homo sapiens
uacuucaaaaguauuuuccu

SEQ ID NO: 1968754 - RNA, 16 nt, Homo sapiens
aggaaugaucccacuc

SEQ ID NO: 1968755 - RNA, 16 nt, Homo sapiens
uaucccaacauucugc

SEQ ID NO: 1968756 - RNA, 21 nt, Homo sapiens
ccucaacaagaagaauuugaa

SEQ ID NO: 1968757 - RNA, 23 nt, Homo sapiens
acaauggaccggagagugggggu

SEQ ID NO: 1968758 - RNA, 20 nt, Homo sapiens
uuggccucagcuggcuguau

SEQ ID NO: 1968759 - RNA, 22 nt, Homo sapiens
gucuucagaguccgccaguguu

SEQ ID NO: 1968760 - RNA, 19 nt, Homo sapiens
guggggaccccaccccuca

SEQ ID NO: 1968761 - RNA, 12 nt, Homo sapiens
auuaaacacagg

SEQ ID NO: 1968762 - RNA, 12 nt, Homo sapiens
aauaaacacugg

SEQ ID NO: 1968763 - RNA, 19 nt, Homo sapiens
gaggucaccagcugcugug

SEQ ID NO: 1968764 - RNA, 17 nt, Homo sapiens
aucacuuuaacucagga

SEQ ID NO: 1968765 - RNA, 16 nt, Homo sapiens
cauggccacacuguga

SEQ ID NO: 1968766 - RNA, 22 nt, Homo sapiens
ccagcauacccuuacucugcca

SEQ ID NO: 1968767 - RNA, 22 nt, Homo sapiens
uaaccuuccuucuaaacauuuu

SEQ ID NO: 1968768 - RNA, 19 nt, Homo sapiens
gaggguggaucacaccuca

SEQ ID NO: 1968769 - RNA, 16 nt, Homo sapiens
uguaauuugcaaagaa

SEQ ID NO: 1968770 - RNA, 11 nt, Homo sapiens
aaaagccaaaa

SEQ ID NO: 1968771 - RNA, 11 nt, Homo sapiens
cagagccacag

SEQ ID NO: 1968772 - RNA, 19 nt, Homo sapiens
auuggccagggcaacaaua

SEQ ID NO: 1968773 - RNA, 16 nt, Homo sapiens
ggggcaggggugcuuc

SEQ ID NO: 1968774 - RNA, 20 nt, Homo sapiens
augcuguauccacaaaucau

SEQ ID NO: 1968775 - RNA, 13 nt, Homo sapiens
auaaagcuuuaua

SEQ ID NO: 1968776 - RNA, 20 nt, Homo sapiens
ugcccuggcagcaugacuca

SEQ ID NO: 1968777 - RNA, 18 nt, Homo sapiens
auuucugaaaaccuacca

SEQ ID NO: 1968778 - RNA, 18 nt, Homo sapiens
ucaccugggcugaggcau

SEQ ID NO: 1968779 - RNA, 18 nt, Homo sapiens
cugggauuacagguguga

SEQ ID NO: 1968780 - RNA, 23 nt, Homo sapiens
acagaauagaauacauugauaca

SEQ ID NO: 1968781 - RNA, 18 nt, Homo sapiens
ugagcaguggacacguga

SEQ ID NO: 1968782 - RNA, 13 nt, Homo sapiens
aacuucauuugau

SEQ ID NO: 1968783 - RNA, 16 nt, Homo sapiens
agcuuccgccgucuca

SEQ ID NO: 1968784 - RNA, 17 nt, Homo sapiens
ccagcuugggccugucu

SEQ ID NO: 1968785 - RNA, 12 nt, Homo sapiens
gcauuacaggug

SEQ ID NO: 1968786 - RNA, 15 nt, Homo sapiens
auuucaugugaucua

SEQ ID NO: 1968787 - RNA, 21 nt, Homo sapiens
uguuauaacucugcacuacuc

SEQ ID NO: 1968788 - RNA, 14 nt, Homo sapiens
uggccagaagucaa

SEQ ID NO: 1968789 - RNA, 20 nt, Homo sapiens
uaaaucagagagcaaggcau

SEQ ID NO: 1968790 - RNA, 19 nt, Homo sapiens
uugguccgguuauucacuu

SEQ ID NO: 1968791 - RNA, 15 nt, Homo sapiens
agauaccucucuugu

SEQ ID NO: 1968792 - RNA, 14 nt, Homo sapiens
cuuuugaaaugcca

SEQ ID NO: 1968793 - RNA, 16 nt, Homo sapiens
ugcaguaucucaagau

SEQ ID NO: 1968794 - RNA, 14 nt, Homo sapiens
ugaauguugcauua

SEQ ID NO: 1968795 - RNA, 16 nt, Homo sapiens
cagacuuuuuuaaaca

SEQ ID NO: 1968796 - RNA, 14 nt, Homo sapiens
cucaaaaggguuaa

SEQ ID NO: 1968797 - RNA, 21 nt, Homo sapiens
gugccaucaggaugagcagua

SEQ ID NO: 1968798 - RNA, 16 nt, Homo sapiens
auauugugcaugcaaa

SEQ ID NO: 1968799 - RNA, 21 nt, Homo sapiens
cugaacguagcauaagggcuu

SEQ ID NO: 1968800 - RNA, 13 nt, Homo sapiens
aggaagaacaaau

SEQ ID NO: 1968801 - RNA, 17 nt, Homo sapiens
uuguuuuggacuacaua

SEQ ID NO: 1968802 - RNA, 16 nt, Homo sapiens
guuuuuuaacuugcag

SEQ ID NO: 1968803 - RNA, 18 nt, Homo sapiens
aggccaggggagacauca

SEQ ID NO: 1968804 - RNA, 23 nt, Homo sapiens
cagcaagucccagacaaggagag

SEQ ID NO: 1968805 - RNA, 13 nt, Homo sapiens
cugcuugccaucc

SEQ ID NO: 1968806 - RNA, 21 nt, Homo sapiens
gacacaccugcagccucccuc

SEQ ID NO: 1968807 - RNA, 15 nt, Homo sapiens
gccagcagccuucca

SEQ ID NO: 1968808 - RNA, 17 nt, Homo sapiens
agaacccagauuuccua

SEQ ID NO: 1968809 - RNA, 12 nt, Homo sapiens
uguccuuuauga

SEQ ID NO: 1968810 - RNA, 18 nt, Homo sapiens
ggacccccaacauucugc

SEQ ID NO: 1968811 - RNA, 12 nt, Homo sapiens
ucuaggaacucc

SEQ ID NO: 1968812 - RNA, 15 nt, Homo sapiens
aaagccauaucacca

SEQ ID NO: 1968813 - RNA, 23 nt, Homo sapiens
aucacacuguauauaaacauauc

SEQ ID NO: 1968814 - RNA, 22 nt, Homo sapiens
uccuucuggggcuuugccauua

SEQ ID NO: 1968815 - RNA, 14 nt, Homo sapiens
gaugugucuugggg

SEQ ID NO: 1968816 - RNA, 23 nt, Homo sapiens
uagagaaagaaaugucugccauu

SEQ ID NO: 1968817 - RNA, 21 nt, Homo sapiens
caauaugcuuauucuauccac

SEQ ID NO: 1968818 - RNA, 18 nt, Homo sapiens
cuuuacuguuagucauuu

SEQ ID NO: 1968819 - RNA, 21 nt, Homo sapiens
auaugaucauguaaaugauua

SEQ ID NO: 1968820 - RNA, 19 nt, Homo sapiens
gugcuuagccuccugaccu

SEQ ID NO: 1968821 - RNA, 12 nt, Homo sapiens
cuacucagggaa

SEQ ID NO: 1968822 - RNA, 15 nt, Homo sapiens
guauguguaucucac

SEQ ID NO: 1968823 - RNA, 23 nt, Homo sapiens
aagaaucuaaaccuuacaugugu

SEQ ID NO: 1968824 - RNA, 12 nt, Homo sapiens
cggccacggcca

SEQ ID NO: 1968825 - RNA, 21 nt, Homo sapiens
aaaccagcuuuaggucccaau

SEQ ID NO: 1968826 - RNA, 18 nt, Homo sapiens
aucuuuuuuaaacuguaa

SEQ ID NO: 1968827 - RNA, 17 nt, Homo sapiens
aauauuaaggcuuacua

SEQ ID NO: 1968828 - RNA, 12 nt, Homo sapiens
cgagaugagccc

SEQ ID NO: 1968829 - RNA, 15 nt, Homo sapiens
acaggcuucgucuca

SEQ ID NO: 1968830 - RNA, 12 nt, Homo sapiens
uauuuuauucaa

SEQ ID NO: 1968831 - RNA, 15 nt, Homo sapiens
auauacacauggaug

SEQ ID NO: 1968832 - RNA, 20 nt, Homo sapiens
acccagugcgugaagaccaa

SEQ ID NO: 1968833 - RNA, 19 nt, Homo sapiens
ucaugaagaaagaacacag

SEQ ID NO: 1968834 - RNA, 14 nt, Homo sapiens
aacucaaggacagc

SEQ ID NO: 1968835 - RNA, 14 nt, Homo sapiens
gucaccagaucuga

SEQ ID NO: 1968836 - RNA, 17 nt, Homo sapiens
augugcgcacacacaga

SEQ ID NO: 1968837 - RNA, 16 nt, Homo sapiens
agauaguuacauuuau

SEQ ID NO: 1968838 - RNA, 17 nt, Homo sapiens
uagaccuaggccucagc

SEQ ID NO: 1968839 - RNA, 14 nt, Homo sapiens
cacuggucugggaa

SEQ ID NO: 1968840 - RNA, 14 nt, Homo sapiens
acacuaaaacaccu

SEQ ID NO: 1968841 - RNA, 14 nt, Homo sapiens
aaucuaaaaauccu

SEQ ID NO: 1968842 - RNA, 21 nt, Homo sapiens
ucaguguucccaaagugaacu

SEQ ID NO: 1968843 - RNA, 14 nt, Homo sapiens
uaaucuucagguga

SEQ ID NO: 1968844 - RNA, 20 nt, Homo sapiens
aaagcaguucaugucugaaa

SEQ ID NO: 1968845 - RNA, 17 nt, Homo sapiens
ugccauacuaaugauga

SEQ ID NO: 1968846 - RNA, 14 nt, Homo sapiens
aaugaugggucagu

SEQ ID NO: 1968847 - RNA, 13 nt, Homo sapiens
agccauaugaaug

SEQ ID NO: 1968848 - RNA, 23 nt, Homo sapiens
gcuuggcucccucugcugaucuc

SEQ ID NO: 1968849 - RNA, 13 nt, Homo sapiens
cuguagcacuuaa

SEQ ID NO: 1968850 - RNA, 15 nt, Homo sapiens
gaggaguaaaauuca

SEQ ID NO: 1968851 - RNA, 23 nt, Homo sapiens
uuggaaaugcuacaaacauauca

SEQ ID NO: 1968852 - RNA, 20 nt, Homo sapiens
cgaggagcuuccagugcaug

SEQ ID NO: 1968853 - RNA, 22 nt, Homo sapiens
ggacuugauccuucuccaggaa

SEQ ID NO: 1968854 - RNA, 21 nt, Homo sapiens
uggauauaaauuaauugugcc

SEQ ID NO: 1968855 - RNA, 21 nt, Homo sapiens
agaagccugugcccugaucca

SEQ ID NO: 1968856 - RNA, 14 nt, Homo sapiens
uaaauaagcacuau

SEQ ID NO: 1968857 - RNA, 18 nt, Homo sapiens
ugaaucaagcacacugua

SEQ ID NO: 1968858 - RNA, 18 nt, Homo sapiens
aggccauuggcuacugac

SEQ ID NO: 1968859 - RNA, 13 nt, Homo sapiens
agcgguccauggg

SEQ ID NO: 1968860 - RNA, 21 nt, Homo sapiens
aauaugagaugcguuguuaca

SEQ ID NO: 1968861 - RNA, 21 nt, Homo sapiens
cucaguggcucacaccuguaa

SEQ ID NO: 1968862 - RNA, 21 nt, Homo sapiens
uaugagugcaagcaaagcaga

SEQ ID NO: 1968863 - RNA, 14 nt, Homo sapiens
agcccgagcagggu

SEQ ID NO: 1968864 - RNA, 19 nt, Homo sapiens
ucccaaagugcugaauuaa

SEQ ID NO: 1968865 - RNA, 12 nt, Homo sapiens
aaugaccaagac

SEQ ID NO: 1968866 - RNA, 13 nt, Homo sapiens
cauaauucagggg

SEQ ID NO: 1968867 - RNA, 15 nt, Homo sapiens
auugagauacuugac

SEQ ID NO: 1968868 - RNA, 12 nt, Homo sapiens
aggguggcacau

SEQ ID NO: 1968869 - RNA, 20 nt, Homo sapiens
cuuucuugaaagacagucca

SEQ ID NO: 1968870 - RNA, 15 nt, Homo sapiens
cugacuuugccaaaa

SEQ ID NO: 1968871 - RNA, 11 nt, Homo sapiens
acguugcccaa

SEQ ID NO: 1968872 - RNA, 24 nt, Homo sapiens
aaauaaaguaccacacauauugca

SEQ ID NO: 1968873 - RNA, 19 nt, Homo sapiens
augcaaauacaaucagccc

SEQ ID NO: 1968874 - RNA, 15 nt, Homo sapiens
ugcuaaucuucaggg

SEQ ID NO: 1968875 - RNA, 11 nt, Homo sapiens
aguucuuaggc

SEQ ID NO: 1968876 - RNA, 19 nt, Homo sapiens
uaaaugaccccacugcagc

SEQ ID NO: 1968877 - RNA, 14 nt, Homo sapiens
agaagucaacgccu

SEQ ID NO: 1968878 - RNA, 15 nt, Homo sapiens
uccgcccccagguag

SEQ ID NO: 1968879 - RNA, 21 nt, Homo sapiens
ucccccuaugcuccaguaugg

SEQ ID NO: 1968880 - RNA, 13 nt, Homo sapiens
ccugcaucaccac

SEQ ID NO: 1968881 - RNA, 18 nt, Homo sapiens
ccuuuuucuucugugaau

SEQ ID NO: 1968882 - RNA, 23 nt, Homo sapiens
gagcaaagacuuaaucauaucaa

SEQ ID NO: 1968883 - RNA, 17 nt, Homo sapiens
gggcccccacaggggau

SEQ ID NO: 1968884 - RNA, 16 nt, Homo sapiens
cuuuuaccacugacag

SEQ ID NO: 1968885 - RNA, 12 nt, Homo sapiens
uuucuaccacac

SEQ ID NO: 1968886 - RNA, 19 nt, Homo sapiens
uggauuuugaaauuuacug

SEQ ID NO: 1968887 - RNA, 22 nt, Homo sapiens
cacaaaauccaugggcaguaug

SEQ ID NO: 1968888 - RNA, 17 nt, Homo sapiens
uaaaaagcccaaccucu

SEQ ID NO: 1968889 - RNA, 15 nt, Homo sapiens
auucuguuuccuuaa

SEQ ID NO: 1968890 - RNA, 13 nt, Homo sapiens
acucuaaguucua

SEQ ID NO: 1968891 - RNA, 22 nt, Homo sapiens
uuccuugugguugaaaaccaca

SEQ ID NO: 1968892 - RNA, 17 nt, Homo sapiens
ugagggcaccaccaaga

SEQ ID NO: 1968893 - RNA, 18 nt, Homo sapiens
ugagcuauugcuguucuc

SEQ ID NO: 1968894 - RNA, 20 nt, Homo sapiens
uuuaauccuuaacacauuca

SEQ ID NO: 1968895 - RNA, 21 nt, Homo sapiens
ucuugaacugguugugaauaa

SEQ ID NO: 1968896 - RNA, 20 nt, Homo sapiens
ggagauuccagucuacuuga

SEQ ID NO: 1968897 - RNA, 14 nt, Homo sapiens
uggcccuucuugcc

SEQ ID NO: 1968898 - RNA, 20 nt, Homo sapiens
ugcuuuuaauguuugcacug

SEQ ID NO: 1968899 - RNA, 16 nt, Homo sapiens
aacuaaugacaaguga

SEQ ID NO: 1968900 - RNA, 22 nt, Homo sapiens
cucuugagguggugccuucuca

SEQ ID NO: 1968901 - RNA, 21 nt, Homo sapiens
cagaagacucuccacugaccu

SEQ ID NO: 1968902 - RNA, 16 nt, Homo sapiens
uaccaaggaacaggaa

SEQ ID NO: 1968903 - RNA, 23 nt, Homo sapiens
gcuaccagggcucacccacugcu

SEQ ID NO: 1968904 - RNA, 19 nt, Homo sapiens
gauuagucaaaaauaccau

SEQ ID NO: 1968905 - RNA, 20 nt, Homo sapiens
aaucaagguagaacaaagaa

SEQ ID NO: 1968906 - RNA, 12 nt, Homo sapiens
uacccucccacc

SEQ ID NO: 1968907 - RNA, 19 nt, Homo sapiens
aggucuuaagaugcaaauc

SEQ ID NO: 1968908 - RNA, 20 nt, Homo sapiens
agccuacccgauuauagcag

SEQ ID NO: 1968909 - RNA, 15 nt, Homo sapiens
auggccagagccucu

SEQ ID NO: 1968910 - RNA, 14 nt, Homo sapiens
ucccacccaacagc

SEQ ID NO: 1968911 - RNA, 12 nt, Homo sapiens
auugugaauauu

SEQ ID NO: 1968912 - RNA, 15 nt, Homo sapiens
ccaaucagugaguca

SEQ ID NO: 1968913 - RNA, 18 nt, Homo sapiens
agcacuccucaucaucac

SEQ ID NO: 1968914 - RNA, 16 nt, Homo sapiens
agucccuccaaagggc

SEQ ID NO: 1968915 - RNA, 21 nt, Homo sapiens
cagaaaauaaucugguguucu

SEQ ID NO: 1968916 - RNA, 17 nt, Homo sapiens
ucaaaucgaauagggaa

SEQ ID NO: 1968917 - RNA, 21 nt, Homo sapiens
aaugugccucggccuccaagg

SEQ ID NO: 1968918 - RNA, 23 nt, Homo sapiens
uacacucuugacuagugcaauuu

SEQ ID NO: 1968919 - RNA, 19 nt, Homo sapiens
gcugcccacagggaacaca

SEQ ID NO: 1968920 - RNA, 23 nt, Homo sapiens
cuggauuccucuaagaucuugcc

SEQ ID NO: 1968921 - RNA, 20 nt, Homo sapiens
uuaacacuaaccaaacaaug

SEQ ID NO: 1968922 - RNA, 23 nt, Homo sapiens
uggagauucucauaacuugagac

SEQ ID NO: 1968923 - RNA, 23 nt, Homo sapiens
cccgaaguccugucacugagcac

SEQ ID NO: 1968924 - RNA, 21 nt, Homo sapiens
ugccuggcguccccucccucu

SEQ ID NO: 1968925 - RNA, 23 nt, Homo sapiens
uucugaaaggguuuuuaaucucc

SEQ ID NO: 1968926 - RNA, 13 nt, Homo sapiens
uccugucugaaaa

SEQ ID NO: 1968927 - RNA, 16 nt, Homo sapiens
aguggucagcaggugu

SEQ ID NO: 1968928 - RNA, 18 nt, Homo sapiens
ucucuucagacucaugga

SEQ ID NO: 1968929 - RNA, 19 nt, Homo sapiens
gccuguaaucucagcacuu

SEQ ID NO: 1968930 - RNA, 12 nt, Homo sapiens
uacagcuguaac

SEQ ID NO: 1968931 - RNA, 18 nt, Homo sapiens
augcuacccacagcguca

SEQ ID NO: 1968932 - RNA, 21 nt, Homo sapiens
cauggccuuccacgucuuccu

SEQ ID NO: 1968933 - RNA, 16 nt, Homo sapiens
aauuauacuacuuugu

SEQ ID NO: 1968934 - RNA, 15 nt, Homo sapiens
uuagaggggggaaau

SEQ ID NO: 1968935 - RNA, 16 nt, Homo sapiens
uuaauuuuauuccagu

SEQ ID NO: 1968936 - RNA, 20 nt, Homo sapiens
aguuaaacuggcuuaacuua

SEQ ID NO: 1968937 - RNA, 21 nt, Homo sapiens
cuucuggagaaaaaggugcca

SEQ ID NO: 1968938 - RNA, 16 nt, Homo sapiens
aucauuggaauacagg

SEQ ID NO: 1968939 - RNA, 20 nt, Homo sapiens
ucaucuauucaagcacuuac

SEQ ID NO: 1968940 - RNA, 21 nt, Homo sapiens
cugguguuuuucucucuggac

SEQ ID NO: 1968941 - RNA, 14 nt, Homo sapiens
cauguaccacugag

SEQ ID NO: 1968942 - RNA, 19 nt, Homo sapiens
uacuuaggaaauacucagc

SEQ ID NO: 1968943 - RNA, 19 nt, Homo sapiens
caaguagcugggacugcag

SEQ ID NO: 1968944 - RNA, 23 nt, Homo sapiens
aucuaacgcuuuaaauggcuacu

SEQ ID NO: 1968945 - RNA, 17 nt, Homo sapiens
aaugcuucauuauucaa

SEQ ID NO: 1968946 - RNA, 12 nt, Homo sapiens
gccaacacuuaa

SEQ ID NO: 1968947 - RNA, 21 nt, Homo sapiens
uuccacuuguucauucuguga

SEQ ID NO: 1968948 - RNA, 18 nt, Homo sapiens
accaagcacccacugugc

SEQ ID NO: 1968949 - RNA, 13 nt, Homo sapiens
acagcauaccuca

SEQ ID NO: 1968950 - RNA, 16 nt, Homo sapiens
uggcauuagcucucau

SEQ ID NO: 1968951 - RNA, 16 nt, Homo sapiens
caggcgaugugcaagu

SEQ ID NO: 1968952 - RNA, 13 nt, Homo sapiens
aaagacaucaaac

SEQ ID NO: 1968953 - RNA, 18 nt, Homo sapiens
uacguuaaaauuacuuug

SEQ ID NO: 1968954 - RNA, 12 nt, Homo sapiens
augcaagugcaa

SEQ ID NO: 1968955 - RNA, 13 nt, Homo sapiens
ggcgugaucucag

SEQ ID NO: 1968956 - RNA, 14 nt, Homo sapiens
gauuuacacagguu

SEQ ID NO: 1968957 - RNA, 14 nt, Homo sapiens
agccugugaagucc

SEQ ID NO: 1968958 - RNA, 15 nt, Homo sapiens
guacugcaugaucuu

SEQ ID NO: 1968959 - RNA, 13 nt, Homo sapiens
augugaaacacac

SEQ ID NO: 1968960 - RNA, 13 nt, Homo sapiens
ugagaguggguaa

SEQ ID NO: 1968961 - RNA, 19 nt, Homo sapiens
agcacccuuccacuuccau

SEQ ID NO: 1968962 - RNA, 18 nt, Homo sapiens
accgugggucaugcagcg

SEQ ID NO: 1968963 - RNA, 15 nt, Homo sapiens
gaagggcuaacucag

SEQ ID NO: 1968964 - RNA, 18 nt, Homo sapiens
caaaaauggcuaguugaa

SEQ ID NO: 1968965 - RNA, 20 nt, Homo sapiens
cacauuuugcauuagacaga

SEQ ID NO: 1968966 - RNA, 14 nt, Homo sapiens
agcaccagggacua

SEQ ID NO: 1968967 - RNA, 13 nt, Homo sapiens
aaauucaaggccu

SEQ ID NO: 1968968 - RNA, 15 nt, Homo sapiens
accuagacaaccaga

SEQ ID NO: 1968969 - RNA, 19 nt, Homo sapiens
aguuuacauuguccuguag

SEQ ID NO: 1968970 - RNA, 16 nt, Homo sapiens
cacaguggugaccccc

SEQ ID NO: 1968971 - RNA, 22 nt, Homo sapiens
aggacuaacacucagaagccug

SEQ ID NO: 1968972 - RNA, 23 nt, Homo sapiens
gcaaaaggguaagaugaaagcuu

SEQ ID NO: 1968973 - RNA, 17 nt, Homo sapiens
aguucucauccacagag

SEQ ID NO: 1968974 - RNA, 18 nt, Homo sapiens
agagaaguggagugacua

SEQ ID NO: 1968975 - RNA, 13 nt, Homo sapiens
gacucauuucacu

SEQ ID NO: 1968976 - RNA, 15 nt, Homo sapiens
gacugaauucugccu

SEQ ID NO: 1968977 - RNA, 13 nt, Homo sapiens
uuacuguuuuuga

SEQ ID NO: 1968978 - RNA, 20 nt, Homo sapiens
ggucagaaagauaagccagu

SEQ ID NO: 1968979 - RNA, 11 nt, Homo sapiens
aaaacacauau

SEQ ID NO: 1968980 - RNA, 15 nt, Homo sapiens
caccagcccuagcug

SEQ ID NO: 1968981 - RNA, 17 nt, Homo sapiens
gacuuggauuaauucau

SEQ ID NO: 1968982 - RNA, 13 nt, Homo sapiens
ugggcagagccca

SEQ ID NO: 1968983 - RNA, 15 nt, Homo sapiens
caccuuuuacuguga

SEQ ID NO: 1968984 - RNA, 15 nt, Homo sapiens
ccagauuuacacugg

SEQ ID NO: 1968985 - RNA, 19 nt, Homo sapiens
gcuaccccauucucuagac

SEQ ID NO: 1968986 - RNA, 18 nt, Homo sapiens
uguuuagaaaaguauucg

SEQ ID NO: 1968987 - RNA, 17 nt, Homo sapiens
cccaaaucacaucucac

SEQ ID NO: 1968988 - RNA, 18 nt, Homo sapiens
gcugcaucaaaugcaugc

SEQ ID NO: 1968989 - RNA, 19 nt, Homo sapiens
cuccuggaagcgagcuuug

SEQ ID NO: 1968990 - RNA, 23 nt, Homo sapiens
uuuaggaugaguuucuauguugu

SEQ ID NO: 1968991 - RNA, 15 nt, Homo sapiens
ugagccaagaucgca

SEQ ID NO: 1968992 - RNA, 16 nt, Homo sapiens
aaaauucucaagugau

SEQ ID NO: 1968993 - RNA, 22 nt, Homo sapiens
ccugggguggggaucaccaggg

SEQ ID NO: 1968994 - RNA, 19 nt, Homo sapiens
uacacuuuuucucuuucca

SEQ ID NO: 1968995 - RNA, 19 nt, Homo sapiens
uaugucccuucacauaguu

SEQ ID NO: 1968996 - RNA, 21 nt, Homo sapiens
aagcaggcuugcccaguacau

SEQ ID NO: 1968997 - RNA, 22 nt, Homo sapiens
augcacacgggaaagccuuaaa

SEQ ID NO: 1968998 - RNA, 23 nt, Homo sapiens
gaacugggcuucuucagaacaau

SEQ ID NO: 1968999 - RNA, 16 nt, Homo sapiens
ugcuauuuccaaagcu

SEQ ID NO: 1969000 - RNA, 22 nt, Homo sapiens
ccuguccuuucuugcagauucu

SEQ ID NO: 1969001 - RNA, 20 nt, Homo sapiens
aggccaccucagucucaccu

SEQ ID NO: 1969002 - RNA, 15 nt, Homo sapiens
gaaugcggaaccaua

SEQ ID NO: 1969003 - RNA, 15 nt, Homo sapiens
gaaacucucuguuca

SEQ ID NO: 1969004 - RNA, 14 nt, Homo sapiens
acauccccaaaggu

SEQ ID NO: 1969005 - RNA, 20 nt, Homo sapiens
aacgagaagcagcauuugau

SEQ ID NO: 1969006 - RNA, 19 nt, Homo sapiens
aaggagccugugaacccag

SEQ ID NO: 1969007 - RNA, 18 nt, Homo sapiens
ggaauugaacgacuguau

SEQ ID NO: 1969008 - RNA, 21 nt, Homo sapiens
augaacugcaucaagacuuca

SEQ ID NO: 1969009 - RNA, 21 nt, Homo sapiens
agcugaugccuccuuggccac

SEQ ID NO: 1969010 - RNA, 21 nt, Homo sapiens
uuccauuuugcuaauauuuac

SEQ ID NO: 1969011 - RNA, 15 nt, Homo sapiens
cacccaccagggcuc

SEQ ID NO: 1969012 - RNA, 17 nt, Homo sapiens
cuucuccuguguucccu

SEQ ID NO: 1969013 - RNA, 17 nt, Homo sapiens
caguccaugaucccacu

SEQ ID NO: 1969014 - RNA, 15 nt, Homo sapiens
cuagugcugaagcuu

SEQ ID NO: 1969015 - RNA, 15 nt, Homo sapiens
auuagagucagagau

SEQ ID NO: 1969016 - RNA, 19 nt, Homo sapiens
cagcauggaugugucucag

SEQ ID NO: 1969017 - RNA, 14 nt, Homo sapiens
aaagugcugagauu

SEQ ID NO: 1969018 - RNA, 17 nt, Homo sapiens
acaugaagggaugcugc

SEQ ID NO: 1969019 - RNA, 21 nt, Homo sapiens
uaaugaaguuugaauguuaaa

SEQ ID NO: 1969020 - RNA, 19 nt, Homo sapiens
ccauuauauuuauuguuua

SEQ ID NO: 1969021 - RNA, 17 nt, Homo sapiens
cccccagccugccaaau

SEQ ID NO: 1969022 - RNA, 13 nt, Homo sapiens
ugcagaacagggg

SEQ ID NO: 1969023 - RNA, 21 nt, Homo sapiens
cuagauucauggcuuuaacag

SEQ ID NO: 1969024 - RNA, 18 nt, Homo sapiens
agcaagggcugugcugag

SEQ ID NO: 1969025 - RNA, 23 nt, Homo sapiens
cuuucauaugguaggaaccaaca

SEQ ID NO: 1969026 - RNA, 15 nt, Homo sapiens
ugauuguccugccag

SEQ ID NO: 1969027 - RNA, 18 nt, Homo sapiens
aaugugauauaaacagcu

SEQ ID NO: 1969028 - RNA, 17 nt, Homo sapiens
gccagauuucauucuca

SEQ ID NO: 1969029 - RNA, 18 nt, Homo sapiens
ccucuaggaaaagggaua

SEQ ID NO: 1969030 - RNA, 16 nt, Homo sapiens
ucaucaggacccugga

SEQ ID NO: 1969031 - RNA, 14 nt, Homo sapiens
aacgacacauucag

SEQ ID NO: 1969032 - RNA, 13 nt, Homo sapiens
aucccugccaaaa

SEQ ID NO: 1969033 - RNA, 18 nt, Homo sapiens
ggucacuucauuuuuauu

SEQ ID NO: 1969034 - RNA, 15 nt, Homo sapiens
gucauuuccagacaa

SEQ ID NO: 1969035 - RNA, 16 nt, Homo sapiens
auuaaaauaugcacua

SEQ ID NO: 1969036 - RNA, 20 nt, Homo sapiens
ucagagacuauguagcaaua

SEQ ID NO: 1969037 - RNA, 22 nt, Homo sapiens
gccccaggcugcggcuugccca

SEQ ID NO: 1969038 - RNA, 19 nt, Homo sapiens
aauauuuuguucugcaaau

SEQ ID NO: 1969039 - RNA, 15 nt, Homo sapiens
ucauucagccuucaa

SEQ ID NO: 1969040 - RNA, 16 nt, Homo sapiens
ugaccacaccuuggcc

SEQ ID NO: 1969041 - RNA, 14 nt, Homo sapiens
gcugauguuuacaa

SEQ ID NO: 1969042 - RNA, 18 nt, Homo sapiens
cgacguuugacuagccau

SEQ ID NO: 1969043 - RNA, 14 nt, Homo sapiens
uccuucgucuuugc

SEQ ID NO: 1969044 - RNA, 14 nt, Homo sapiens
cucagaguucuaua

SEQ ID NO: 1969045 - RNA, 15 nt, Homo sapiens
guggauucaugucca

SEQ ID NO: 1969046 - RNA, 21 nt, Homo sapiens
uaauuauuccacucaauaugu

SEQ ID NO: 1969047 - RNA, 14 nt, Homo sapiens
caacaacaacaaua

SEQ ID NO: 1969048 - RNA, 13 nt, Homo sapiens
cucaugacagcaa

SEQ ID NO: 1969049 - RNA, 21 nt, Homo sapiens
cauauucuuucacuuguaugu

SEQ ID NO: 1969050 - RNA, 18 nt, Homo sapiens
gcaguuuccucagugaug

SEQ ID NO: 1969051 - RNA, 15 nt, Homo sapiens
aaaacuaaccaucug

SEQ ID NO: 1969052 - RNA, 15 nt, Homo sapiens
caggcaccugaagug

SEQ ID NO: 1969053 - RNA, 17 nt, Homo sapiens
gauggaucugugguccu

SEQ ID NO: 1969054 - RNA, 22 nt, Homo sapiens
agugcaaaagugaaacauacaa

SEQ ID NO: 1969055 - RNA, 18 nt, Homo sapiens
ggugcugugguggggaga

SEQ ID NO: 1969056 - RNA, 20 nt, Homo sapiens
uggcccaguuguccaugaca

SEQ ID NO: 1969057 - RNA, 17 nt, Homo sapiens
cucagggccucaggcac

SEQ ID NO: 1969058 - RNA, 18 nt, Homo sapiens
acaagaagggacugagag

SEQ ID NO: 1969059 - RNA, 21 nt, Homo sapiens
uugaaaguaaaagcagcauaa

SEQ ID NO: 1969060 - RNA, 13 nt, Homo sapiens
cagcgaccucaag

SEQ ID NO: 1969061 - RNA, 17 nt, Homo sapiens
ggcagcagagcauucag

SEQ ID NO: 1969062 - RNA, 17 nt, Homo sapiens
uaaauaaucuuacucua

SEQ ID NO: 1969063 - RNA, 17 nt, Homo sapiens
gcuggaggaaguggggu

SEQ ID NO: 1969064 - RNA, 18 nt, Homo sapiens
cugauggccuuaauuucc

SEQ ID NO: 1969065 - RNA, 19 nt, Homo sapiens
uugcucucggugcuuccaa

SEQ ID NO: 1969066 - RNA, 22 nt, Homo sapiens
caggccuguguagcugugaccu

SEQ ID NO: 1969067 - RNA, 14 nt, Homo sapiens
acaaguccagcugg

SEQ ID NO: 1969068 - RNA, 19 nt, Homo sapiens
aaaaugucauuguucuccc

SEQ ID NO: 1969069 - RNA, 19 nt, Homo sapiens
aaacauuuuauacuguaca

SEQ ID NO: 1969070 - RNA, 15 nt, Homo sapiens
uauauggggggccaa

SEQ ID NO: 1969071 - RNA, 15 nt, Homo sapiens
uauguaauauauugu

SEQ ID NO: 1969072 - RNA, 15 nt, Homo sapiens
uacuuuguuuacuua

SEQ ID NO: 1969073 - RNA, 17 nt, Homo sapiens
cauuacuguguucaauu

SEQ ID NO: 1969074 - RNA, 13 nt, Homo sapiens
cugccagugccag

SEQ ID NO: 1969075 - RNA, 16 nt, Homo sapiens
cauuuagaacuuuccu

SEQ ID NO: 1969076 - RNA, 20 nt, Homo sapiens
uuaauccugaggcaaaguag

SEQ ID NO: 1969077 - RNA, 15 nt, Homo sapiens
ugacccaaugauuca

SEQ ID NO: 1969078 - RNA, 13 nt, Homo sapiens
ucuuuguuuaugc

SEQ ID NO: 1969079 - RNA, 14 nt, Homo sapiens
agcugcugcugcuc

SEQ ID NO: 1969080 - RNA, 18 nt, Homo sapiens
gcacucuucccaccucag

SEQ ID NO: 1969081 - RNA, 14 nt, Homo sapiens
uuccucugaacaaa

SEQ ID NO: 1969082 - RNA, 14 nt, Homo sapiens
ggaagucacuucac

SEQ ID NO: 1969083 - RNA, 10 nt, Homo sapiens
uucacugagu

SEQ ID NO: 1969084 - RNA, 16 nt, Homo sapiens
agggaugaugugguuu

SEQ ID NO: 1969085 - RNA, 13 nt, Homo sapiens
guuagaaaauuca

SEQ ID NO: 1969086 - RNA, 23 nt, Homo sapiens
gcuuuuaugacaaauagcauaca

SEQ ID NO: 1969087 - RNA, 15 nt, Homo sapiens
auuccuucuguagug

SEQ ID NO: 1969088 - RNA, 20 nt, Homo sapiens
cuccauaaacagacuguuaa

SEQ ID NO: 1969089 - RNA, 21 nt, Homo sapiens
uauaaccuuaauuuauuauua

SEQ ID NO: 1969090 - RNA, 19 nt, Homo sapiens
cauauaauguuguuauuua

SEQ ID NO: 1969091 - RNA, 12 nt, Homo sapiens
aucgaccacagu

SEQ ID NO: 1969092 - RNA, 17 nt, Homo sapiens
ugggcucacauucccaa

SEQ ID NO: 1969093 - RNA, 21 nt, Homo sapiens
aagcucagaggcgcacuguga

SEQ ID NO: 1969094 - RNA, 17 nt, Homo sapiens
acagagacacuuuacca

SEQ ID NO: 1969095 - RNA, 18 nt, Homo sapiens
ccuggagcaaucacagau

SEQ ID NO: 1969096 - RNA, 15 nt, Homo sapiens
uuaguauagccacaa

SEQ ID NO: 1969097 - RNA, 13 nt, Homo sapiens
ugauagcuuuauu

SEQ ID NO: 1969098 - RNA, 15 nt, Homo sapiens
gucugugugguggag

SEQ ID NO: 1969099 - RNA, 15 nt, Homo sapiens
uucuauuuugugaau

SEQ ID NO: 1969100 - RNA, 15 nt, Homo sapiens
gucucaauggugcua

SEQ ID NO: 1969101 - RNA, 16 nt, Homo sapiens
aaaugggaagcauuag

SEQ ID NO: 1969102 - RNA, 13 nt, Homo sapiens
caagucaaauacc

SEQ ID NO: 1969103 - RNA, 19 nt, Homo sapiens
uugaaguccaguguuucca

SEQ ID NO: 1969104 - RNA, 16 nt, Homo sapiens
gcuucuuccccagccu

SEQ ID NO: 1969105 - RNA, 19 nt, Homo sapiens
aauauggacucagccuugc

SEQ ID NO: 1969106 - RNA, 15 nt, Homo sapiens
uccagcugauccaga

SEQ ID NO: 1969107 - RNA, 22 nt, Homo sapiens
agagguggagugucacaucucu

SEQ ID NO: 1969108 - RNA, 17 nt, Homo sapiens
ccagcguggcaacaggc

SEQ ID NO: 1969109 - RNA, 13 nt, Homo sapiens
aucaaaaggccca

SEQ ID NO: 1969110 - RNA, 15 nt, Homo sapiens
uccuacuuuacauau

SEQ ID NO: 1969111 - RNA, 11 nt, Homo sapiens
cucuuuccacc

SEQ ID NO: 1969112 - RNA, 19 nt, Homo sapiens
gcaggauacuacaugcuuu

SEQ ID NO: 1969113 - RNA, 21 nt, Homo sapiens
aaauauauguaauauauacau

SEQ ID NO: 1969114 - RNA, 17 nt, Homo sapiens
gcgaaguugaacccaga

SEQ ID NO: 1969115 - RNA, 18 nt, Homo sapiens
cagaauccacaguguccc

SEQ ID NO: 1969116 - RNA, 12 nt, Homo sapiens
caguaaauccaa

SEQ ID NO: 1969117 - RNA, 19 nt, Homo sapiens
ggccuuacuuaaacccagc

SEQ ID NO: 1969118 - RNA, 21 nt, Homo sapiens
acuuaauguuugguaacuuuu

SEQ ID NO: 1969119 - RNA, 16 nt, Homo sapiens
aagcuuuuaaugcucc

SEQ ID NO: 1969120 - RNA, 20 nt, Homo sapiens
cauccuacaagacacaguga

SEQ ID NO: 1969121 - RNA, 23 nt, Homo sapiens
gauuaccuucauagagcuuugga

SEQ ID NO: 1969122 - RNA, 18 nt, Homo sapiens
ugauauuauggcaaguga

SEQ ID NO: 1969123 - RNA, 22 nt, Homo sapiens
cagaugcuggggagaaugaaga

SEQ ID NO: 1969124 - RNA, 12 nt, Homo sapiens
aggagacugggc

SEQ ID NO: 1969125 - RNA, 16 nt, Homo sapiens
acugccaggcugccuc

SEQ ID NO: 1969126 - RNA, 23 nt, Homo sapiens
auuuuauaguguguugugcuuuc

SEQ ID NO: 1969127 - RNA, 23 nt, Homo sapiens
uuugagggugggggugcucucuc

SEQ ID NO: 1969128 - RNA, 17 nt, Homo sapiens
acacauuacuugcacaa

SEQ ID NO: 1969129 - RNA, 17 nt, Homo sapiens
ucacagcccugagaguc

SEQ ID NO: 1969130 - RNA, 17 nt, Homo sapiens
ugcaaucacagcucacu

SEQ ID NO: 1969131 - RNA, 14 nt, Homo sapiens
ccucuagaagccaa

SEQ ID NO: 1969132 - RNA, 14 nt, Homo sapiens
uagguuucaccucc

SEQ ID NO: 1969133 - RNA, 22 nt, Homo sapiens
ccucgaggacugauacugcagu

SEQ ID NO: 1969134 - RNA, 20 nt, Homo sapiens
cacauguuauccacaagcaa

SEQ ID NO: 1969135 - RNA, 15 nt, Homo sapiens
auaauauauuaggca

SEQ ID NO: 1969136 - RNA, 23 nt, Homo sapiens
cuuauuugagugauuauuuguua

SEQ ID NO: 1969137 - RNA, 12 nt, Homo sapiens
uacgugccacuc

SEQ ID NO: 1969138 - RNA, 16 nt, Homo sapiens
ucagguaacacuacag

SEQ ID NO: 1969139 - RNA, 22 nt, Homo sapiens
aaacaucacagaacauccugga

SEQ ID NO: 1969140 - RNA, 19 nt, Homo sapiens
acuuucauugccagugucu

SEQ ID NO: 1969141 - RNA, 17 nt, Homo sapiens
auuaaagugcacugugu

SEQ ID NO: 1969142 - RNA, 11 nt, Homo sapiens
agagcaugcua

SEQ ID NO: 1969143 - RNA, 21 nt, Homo sapiens
acuggcaguaaccuagugaau

SEQ ID NO: 1969144 - RNA, 17 nt, Homo sapiens
uuucuaagaaccaaaaa

SEQ ID NO: 1969145 - RNA, 16 nt, Homo sapiens
gaauuuguuuuagcca

SEQ ID NO: 1969146 - RNA, 22 nt, Homo sapiens
gcaccaaucuuguuuauagcaa

SEQ ID NO: 1969147 - RNA, 13 nt, Homo sapiens
aaaucaaguccuu

SEQ ID NO: 1969148 - RNA, 18 nt, Homo sapiens
agccacagccccugccug

SEQ ID NO: 1969149 - RNA, 19 nt, Homo sapiens
agccuggucaacauaguga

SEQ ID NO: 1969150 - RNA, 13 nt, Homo sapiens
uuuguuuaacaaa

SEQ ID NO: 1969151 - RNA, 12 nt, Homo sapiens
ggaucagcuuug

SEQ ID NO: 1969152 - RNA, 15 nt, Homo sapiens
aauguaguugaugua

SEQ ID NO: 1969153 - RNA, 23 nt, Homo sapiens
caacaauccuucuauucuagccu

SEQ ID NO: 1969154 - RNA, 21 nt, Homo sapiens
acacuagcauagagaaugugu

SEQ ID NO: 1969155 - RNA, 22 nt, Homo sapiens
gagccuucacaaccagccacac

SEQ ID NO: 1969156 - RNA, 21 nt, Homo sapiens
aggcaagguugggcuggugcu

SEQ ID NO: 1969157 - RNA, 18 nt, Homo sapiens
gagggaauccauaucagc

SEQ ID NO: 1969158 - RNA, 18 nt, Homo sapiens
gagcccugguggaucuug

SEQ ID NO: 1969159 - RNA, 20 nt, Homo sapiens
caugugugcgugugcgugca

SEQ ID NO: 1969160 - RNA, 17 nt, Homo sapiens
gcucuuuugagcauuua

SEQ ID NO: 1969161 - RNA, 19 nt, Homo sapiens
cuccuccuuuuuccuucca

SEQ ID NO: 1969162 - RNA, 19 nt, Homo sapiens
uuacaauuuaaugcacuaa

SEQ ID NO: 1969163 - RNA, 14 nt, Homo sapiens
aaaucaugugauaa

SEQ ID NO: 1969164 - RNA, 15 nt, Homo sapiens
ggaguccacugccuc

SEQ ID NO: 1969165 - RNA, 12 nt, Homo sapiens
aauuuuucuucc

SEQ ID NO: 1969166 - RNA, 21 nt, Homo sapiens
uuuaaugugagacagcaaguu

SEQ ID NO: 1969167 - RNA, 22 nt, Homo sapiens
aauucauaaaaauaaccaaaaa

SEQ ID NO: 1969168 - RNA, 20 nt, Homo sapiens
gaugguucauaucaugaaga

SEQ ID NO: 1969169 - RNA, 15 nt, Homo sapiens
cuuccucacaccccu

SEQ ID NO: 1969170 - RNA, 17 nt, Homo sapiens
uacaaaaacacagcaag

SEQ ID NO: 1969171 - RNA, 14 nt, Homo sapiens
acuccauugcuuaa

SEQ ID NO: 1969172 - RNA, 21 nt, Homo sapiens
gaaaacuccauaacaguuuua

SEQ ID NO: 1969173 - RNA, 14 nt, Homo sapiens
augagcauucugca

SEQ ID NO: 1969174 - RNA, 19 nt, Homo sapiens
ucagggggccaggugcaca

SEQ ID NO: 1969175 - RNA, 12 nt, Homo sapiens
uguaaaaagccc

SEQ ID NO: 1969176 - RNA, 17 nt, Homo sapiens
cagugccaccaagcuca

SEQ ID NO: 1969177 - RNA, 21 nt, Homo sapiens
ccaguacucuguaaguuucug

SEQ ID NO: 1969178 - RNA, 22 nt, Homo sapiens
ccccucugcuggccgggcacag

SEQ ID NO: 1969179 - RNA, 21 nt, Homo sapiens
ggaguuccucaucagugucau

SEQ ID NO: 1969180 - RNA, 18 nt, Homo sapiens
cuucauuugaugcuaaau

SEQ ID NO: 1969181 - RNA, 19 nt, Homo sapiens
guuuacuuaucuuaugcca

SEQ ID NO: 1969182 - RNA, 21 nt, Homo sapiens
cuuuuccgcacuaccugaaca

SEQ ID NO: 1969183 - RNA, 19 nt, Homo sapiens
gcuagaauggaaaacugcc

SEQ ID NO: 1969184 - RNA, 17 nt, Homo sapiens
agggcagcuguggcuuc

SEQ ID NO: 1969185 - RNA, 12 nt, Homo sapiens
auuuuaccauac

SEQ ID NO: 1969186 - RNA, 20 nt, Homo sapiens
gacacugcgaacucucagga

SEQ ID NO: 1969187 - RNA, 20 nt, Homo sapiens
uccguucaauaagcauuuca

SEQ ID NO: 1969188 - RNA, 13 nt, Homo sapiens
aauuagaccuagg

SEQ ID NO: 1969189 - RNA, 13 nt, Homo sapiens
gccgccagggaga

SEQ ID NO: 1969190 - RNA, 13 nt, Homo sapiens
uccaccagugaaa

SEQ ID NO: 1969191 - RNA, 17 nt, Homo sapiens
guucucauagugguaua

SEQ ID NO: 1969192 - RNA, 17 nt, Homo sapiens
ugugcaccuguaauccc

SEQ ID NO: 1969193 - RNA, 17 nt, Homo sapiens
cuagaacacuaacucac

SEQ ID NO: 1969194 - RNA, 23 nt, Homo sapiens
uggagggcgccaucuauggugug

SEQ ID NO: 1969195 - RNA, 12 nt, Homo sapiens
ugcaaugagcca

SEQ ID NO: 1969196 - RNA, 19 nt, Homo sapiens
agccaaggagucacugaga

SEQ ID NO: 1969197 - RNA, 16 nt, Homo sapiens
cacauagagauaugca

SEQ ID NO: 1969198 - RNA, 20 nt, Homo sapiens
gaccagaucagggacuugaa

SEQ ID NO: 1969199 - RNA, 17 nt, Homo sapiens
ugggauuaacauaaaag

SEQ ID NO: 1969200 - RNA, 22 nt, Homo sapiens
ggcucagccaggugcugugaca

SEQ ID NO: 1969201 - RNA, 20 nt, Homo sapiens
agagcacugccucuaugccc

SEQ ID NO: 1969202 - RNA, 18 nt, Homo sapiens
caaguaagaauguuaaaa

SEQ ID NO: 1969203 - RNA, 18 nt, Homo sapiens
ccuaugugcguauuuucu

SEQ ID NO: 1969204 - RNA, 15 nt, Homo sapiens
gagauaauuguuuca

SEQ ID NO: 1969205 - RNA, 21 nt, Homo sapiens
aaaauuagccaggcgcauugg

SEQ ID NO: 1969206 - RNA, 21 nt, Homo sapiens
ccuacugccucuccagcacuu

SEQ ID NO: 1969207 - RNA, 16 nt, Homo sapiens
auaucaacucugaaag

SEQ ID NO: 1969208 - RNA, 13 nt, Homo sapiens
uuuuucaguauua

SEQ ID NO: 1969209 - RNA, 16 nt, Homo sapiens
aaagaagaaaccuuca

SEQ ID NO: 1969210 - RNA, 19 nt, Homo sapiens
gcaucucagaguccaguca

SEQ ID NO: 1969211 - RNA, 16 nt, Homo sapiens
uccccaccuccugucg

SEQ ID NO: 1969212 - RNA, 23 nt, Homo sapiens
gggcacccaaaacucaagcaaga

SEQ ID NO: 1969213 - RNA, 16 nt, Homo sapiens
cuggccgucacacgua

SEQ ID NO: 1969214 - RNA, 15 nt, Homo sapiens
gucgucuuuuuccaa

SEQ ID NO: 1969215 - RNA, 20 nt, Homo sapiens
agagcacauuuaguccaaug

SEQ ID NO: 1969216 - RNA, 17 nt, Homo sapiens
uuaaaggaauaaggugu

SEQ ID NO: 1969217 - RNA, 23 nt, Homo sapiens
cauaggauccgaagugcaaugau

SEQ ID NO: 1969218 - RNA, 21 nt, Homo sapiens
auucuaaaagauaaguguguu

SEQ ID NO: 1969219 - RNA, 18 nt, Homo sapiens
aauaugaaggacuauuaa

SEQ ID NO: 1969220 - RNA, 19 nt, Homo sapiens
gcccugggucuaugcacag

SEQ ID NO: 1969221 - RNA, 22 nt, Homo sapiens
aagcuagauacuggaaaccuaa

SEQ ID NO: 1969222 - RNA, 17 nt, Homo sapiens
gucagaaacaaugacau

SEQ ID NO: 1969223 - RNA, 14 nt, Homo sapiens
agaaauagaauuau

SEQ ID NO: 1969224 - RNA, 21 nt, Homo sapiens
ucuggaagccucuauugccau

SEQ ID NO: 1969225 - RNA, 22 nt, Homo sapiens
acaguccaaacuguucugagaa

SEQ ID NO: 1969226 - RNA, 14 nt, Homo sapiens
auauaaaaguuuaa

SEQ ID NO: 1969227 - RNA, 22 nt, Homo sapiens
cuuucuacaacugauugcaaca

SEQ ID NO: 1969228 - RNA, 14 nt, Homo sapiens
acaguuuuaacugu

SEQ ID NO: 1969229 - RNA, 18 nt, Homo sapiens
cuuguugaugaagcacau

SEQ ID NO: 1969230 - RNA, 22 nt, Homo sapiens
agucuggagugaaccacggguu

SEQ ID NO: 1969231 - RNA, 13 nt, Homo sapiens
cugaccucaggua

SEQ ID NO: 1969232 - RNA, 16 nt, Homo sapiens
uugcagucucccagau

SEQ ID NO: 1969233 - RNA, 16 nt, Homo sapiens
augaccaguucuggcc

SEQ ID NO: 1969234 - RNA, 22 nt, Homo sapiens
aucucaaggauccagacucuca

SEQ ID NO: 1969235 - RNA, 12 nt, Homo sapiens
aguuuguuucau

SEQ ID NO: 1969236 - RNA, 21 nt, Homo sapiens
cuguuuauugaaagaauuauc

SEQ ID NO: 1969237 - RNA, 23 nt, Homo sapiens
ugugccccuccaagucacaaaga

SEQ ID NO: 1969238 - RNA, 19 nt, Homo sapiens
cauacacucaaacaaucau

SEQ ID NO: 1969239 - RNA, 18 nt, Homo sapiens
aacaccaacauguuggga

SEQ ID NO: 1969240 - RNA, 11 nt, Homo sapiens
cucagaagcca

SEQ ID NO: 1969241 - RNA, 19 nt, Homo sapiens
uuuaaauguaacuugcugu

SEQ ID NO: 1969242 - RNA, 16 nt, Homo sapiens
guguuuaaaugcucuu

SEQ ID NO: 1969243 - RNA, 20 nt, Homo sapiens
auacugucucuccagugaaa

SEQ ID NO: 1969244 - RNA, 16 nt, Homo sapiens
gggauuggcugugagg

SEQ ID NO: 1969245 - RNA, 13 nt, Homo sapiens
guaaacauuuuaa

SEQ ID NO: 1969246 - RNA, 13 nt, Homo sapiens
guaagcauuuuag

SEQ ID NO: 1969247 - RNA, 17 nt, Homo sapiens
auguucuugucauaaaa

SEQ ID NO: 1969248 - RNA, 22 nt, Homo sapiens
uccuucuaagaggauacaaauu

SEQ ID NO: 1969249 - RNA, 11 nt, Homo sapiens
ccuaugcaugg

SEQ ID NO: 1969250 - RNA, 18 nt, Homo sapiens
gggccgcucugauuucag

SEQ ID NO: 1969251 - RNA, 17 nt, Homo sapiens
ggcucacaccuguaauc

SEQ ID NO: 1969252 - RNA, 16 nt, Homo sapiens
caccauuuguauccac

SEQ ID NO: 1969253 - RNA, 15 nt, Homo sapiens
cacugggcacaggcc

SEQ ID NO: 1969254 - RNA, 14 nt, Homo sapiens
uacuugaaggucua

SEQ ID NO: 1969255 - RNA, 15 nt, Homo sapiens
cccccaccacaggcc

SEQ ID NO: 1969256 - RNA, 22 nt, Homo sapiens
acaaaugccacacggcucucac

SEQ ID NO: 1969257 - RNA, 23 nt, Homo sapiens
gcccugagcccagaaaaaaggac

SEQ ID NO: 1969258 - RNA, 15 nt, Homo sapiens
ucugccacucagggu

SEQ ID NO: 1969259 - RNA, 18 nt, Homo sapiens
acccucuccccacugcuc

SEQ ID NO: 1969260 - RNA, 23 nt, Homo sapiens
aauaaauucuuuggaacuuuaau

SEQ ID NO: 1969261 - RNA, 20 nt, Homo sapiens
aauggcaggaucucagauca

SEQ ID NO: 1969262 - RNA, 20 nt, Homo sapiens
gugaucauaggggcauagcc

SEQ ID NO: 1969263 - RNA, 13 nt, Homo sapiens
cugggaugcagug

SEQ ID NO: 1969264 - RNA, 16 nt, Homo sapiens
ccagacaaaauuugag

SEQ ID NO: 1969265 - RNA, 15 nt, Homo sapiens
gauagaucauaacag

SEQ ID NO: 1969266 - RNA, 21 nt, Homo sapiens
caagggcagguugaucaguga

SEQ ID NO: 1969267 - RNA, 10 nt, Homo sapiens
aaaacaaaga

SEQ ID NO: 1969268 - RNA, 23 nt, Homo sapiens
agaaacuccuggaucccuuucac

SEQ ID NO: 1969269 - RNA, 15 nt, Homo sapiens
auaaaauuuaacuca

SEQ ID NO: 1969270 - RNA, 15 nt, Homo sapiens
ugcaccaacgagcug

SEQ ID NO: 1969271 - RNA, 20 nt, Homo sapiens
uaaaaugugaggaagaacua

SEQ ID NO: 1969272 - RNA, 19 nt, Homo sapiens
uaaauugcuaauguugcug

SEQ ID NO: 1969273 - RNA, 15 nt, Homo sapiens
auuuuaguuccuuua

SEQ ID NO: 1969274 - RNA, 19 nt, Homo sapiens
aaugggaagguuguucuug

SEQ ID NO: 1969275 - RNA, 14 nt, Homo sapiens
cucuuuaacugugu

SEQ ID NO: 1969276 - RNA, 16 nt, Homo sapiens
cuccacaccaguaaua

SEQ ID NO: 1969277 - RNA, 19 nt, Homo sapiens
caucuccaaacuaaacccu

SEQ ID NO: 1969278 - RNA, 18 nt, Homo sapiens
cagcaugcagaagugcau

SEQ ID NO: 1969279 - RNA, 14 nt, Homo sapiens
cuuuacagcacugu

SEQ ID NO: 1969280 - RNA, 17 nt, Homo sapiens
cuggaggcaaauuucag

SEQ ID NO: 1969281 - RNA, 20 nt, Homo sapiens
aaaauuggcauuaaaacuua

SEQ ID NO: 1969282 - RNA, 15 nt, Homo sapiens
uauggauaaucugag

SEQ ID NO: 1969283 - RNA, 13 nt, Homo sapiens
gcucccagggugg

SEQ ID NO: 1969284 - RNA, 23 nt, Homo sapiens
augauccaagcaagacugagggg

SEQ ID NO: 1969285 - RNA, 21 nt, Homo sapiens
uaagccuugaaaaagaacaaa

SEQ ID NO: 1969286 - RNA, 23 nt, Homo sapiens
cucuaucagaacuggaccaucuc

SEQ ID NO: 1969287 - RNA, 15 nt, Homo sapiens
gcccccucuccuucu

SEQ ID NO: 1969288 - RNA, 14 nt, Homo sapiens
aguugcauuuucau

SEQ ID NO: 1969289 - RNA, 13 nt, Homo sapiens
ugcugcugccacc

SEQ ID NO: 1969290 - RNA, 18 nt, Homo sapiens
gucaaggcugacuacuca

SEQ ID NO: 1969291 - RNA, 16 nt, Homo sapiens
uguuccuugcuuuuau

SEQ ID NO: 1969292 - RNA, 19 nt, Homo sapiens
ccaacuguuggauucagaa

SEQ ID NO: 1969293 - RNA, 12 nt, Homo sapiens
uuugcucuugcc

SEQ ID NO: 1969294 - RNA, 19 nt, Homo sapiens
augauuuggggugauuucu

SEQ ID NO: 1969295 - RNA, 19 nt, Homo sapiens
gacagcaggccacuaguga

SEQ ID NO: 1969296 - RNA, 13 nt, Homo sapiens
cauuucaggugca

SEQ ID NO: 1969297 - RNA, 20 nt, Homo sapiens
ucuguggaaaguggugcaug

SEQ ID NO: 1969298 - RNA, 14 nt, Homo sapiens
acgcuccccugaga

SEQ ID NO: 1969299 - RNA, 17 nt, Homo sapiens
uguuuucacuuguauug

SEQ ID NO: 1969300 - RNA, 17 nt, Homo sapiens
gaaaucaaguuaaugua

SEQ ID NO: 1969301 - RNA, 23 nt, Homo sapiens
aacugcuuugguuccuaaggaag

SEQ ID NO: 1969302 - RNA, 22 nt, Homo sapiens
gcagacaggaggaaucauguca

SEQ ID NO: 1969303 - RNA, 14 nt, Homo sapiens
acacaaguuuaaaa

SEQ ID NO: 1969304 - RNA, 15 nt, Homo sapiens
cucugacucuugccu

SEQ ID NO: 1969305 - RNA, 19 nt, Homo sapiens
agccucaccagcgcuugaa

SEQ ID NO: 1969306 - RNA, 21 nt, Homo sapiens
agggauuuuagucacacgugg

SEQ ID NO: 1969307 - RNA, 19 nt, Homo sapiens
uggucauccaaauggacug

SEQ ID NO: 1969308 - RNA, 22 nt, Homo sapiens
aggaucccuacugccaaccugg

SEQ ID NO: 1969309 - RNA, 17 nt, Homo sapiens
gucccucacagcacuag

SEQ ID NO: 1969310 - RNA, 15 nt, Homo sapiens
aaguucugacuugac

SEQ ID NO: 1969311 - RNA, 18 nt, Homo sapiens
gacgcagggguugcagug

SEQ ID NO: 1969312 - RNA, 16 nt, Homo sapiens
guguaguaaaguauca

SEQ ID NO: 1969313 - RNA, 12 nt, Homo sapiens
cugucauccacu

SEQ ID NO: 1969314 - RNA, 16 nt, Homo sapiens
uacagacaaccuauca

SEQ ID NO: 1969315 - RNA, 20 nt, Homo sapiens
agaucgcgccacugcacucc

SEQ ID NO: 1969316 - RNA, 21 nt, Homo sapiens
acuuaucccugcccauuucau

SEQ ID NO: 1969317 - RNA, 14 nt, Homo sapiens
uacauacuuuuugg

SEQ ID NO: 1969318 - RNA, 12 nt, Homo sapiens
cuaagcacaaag

SEQ ID NO: 1969319 - RNA, 20 nt, Homo sapiens
gaguagggacucagggccau

SEQ ID NO: 1969320 - RNA, 22 nt, Homo sapiens
guaaacuuaacuguucuuugcc

SEQ ID NO: 1969321 - RNA, 22 nt, Homo sapiens
gcauuugacugaagaugcagcu

SEQ ID NO: 1969322 - RNA, 17 nt, Homo sapiens
aaaguucucaauguucu

SEQ ID NO: 1969323 - RNA, 14 nt, Homo sapiens
gaccaggugcucag

SEQ ID NO: 1969324 - RNA, 22 nt, Homo sapiens
guagaguaacgagaagugcuuu

SEQ ID NO: 1969325 - RNA, 23 nt, Homo sapiens
uucugacccaugcugcccuguga

SEQ ID NO: 1969326 - RNA, 23 nt, Homo sapiens
cugcugccauacuguaugcagua

SEQ ID NO: 1969327 - RNA, 19 nt, Homo sapiens
caguuugaguuaaugugcu

SEQ ID NO: 1969328 - RNA, 19 nt, Homo sapiens
aagaugcccuaauccaucu

SEQ ID NO: 1969329 - RNA, 12 nt, Homo sapiens
ucauauugcauc

SEQ ID NO: 1969330 - RNA, 15 nt, Homo sapiens
caggccuugagcaca

SEQ ID NO: 1969331 - RNA, 22 nt, Homo sapiens
augaagaacacagcaugugcca

SEQ ID NO: 1969332 - RNA, 16 nt, Homo sapiens
uauuuuuuuccuaaga

SEQ ID NO: 1969333 - RNA, 16 nt, Homo sapiens
ucugagagcacagcgu

SEQ ID NO: 1969334 - RNA, 18 nt, Homo sapiens
gagcccccaacacaggca

SEQ ID NO: 1969335 - RNA, 22 nt, Homo sapiens
cagccguccucccuccuagggu

SEQ ID NO: 1969336 - RNA, 17 nt, Homo sapiens
aggggccucccugugac

SEQ ID NO: 1969337 - RNA, 14 nt, Homo sapiens
augcagugugcucc

SEQ ID NO: 1969338 - RNA, 21 nt, Homo sapiens
gcgauucuggauaaagccacu

SEQ ID NO: 1969339 - RNA, 20 nt, Homo sapiens
aauuuguuggagaugcagcc

SEQ ID NO: 1969340 - RNA, 16 nt, Homo sapiens
cuccaugagacacauc

SEQ ID NO: 1969341 - RNA, 18 nt, Homo sapiens
ucaguguuucauauucau

SEQ ID NO: 1969342 - RNA, 22 nt, Homo sapiens
agccuuuuaagcuucauuagcu

SEQ ID NO: 1969343 - RNA, 22 nt, Homo sapiens
ugaguuacaauuuggagcauaa

SEQ ID NO: 1969344 - RNA, 13 nt, Homo sapiens
cuacacagccugg

SEQ ID NO: 1969345 - RNA, 13 nt, Homo sapiens
aaacaaauucauu

SEQ ID NO: 1969346 - RNA, 14 nt, Homo sapiens
uaaaacaucucugu

SEQ ID NO: 1969347 - RNA, 18 nt, Homo sapiens
cacugaaaacuaugcaag

SEQ ID NO: 1969348 - RNA, 16 nt, Homo sapiens
uuguacagaauauuuc

SEQ ID NO: 1969349 - RNA, 19 nt, Homo sapiens
aauuauuaugacucaauaa

SEQ ID NO: 1969350 - RNA, 21 nt, Homo sapiens
aaagaugugcuuauaucauug

SEQ ID NO: 1969351 - RNA, 20 nt, Homo sapiens
cucaguucuuccuccaccuc

SEQ ID NO: 1969352 - RNA, 21 nt, Homo sapiens
gaccucagcuuugauauuuca

SEQ ID NO: 1969353 - RNA, 17 nt, Homo sapiens
aggaagccagcuggcuu

SEQ ID NO: 1969354 - RNA, 15 nt, Homo sapiens
aaacacaaccugccu

SEQ ID NO: 1969355 - RNA, 12 nt, Homo sapiens
caguuucaggag

SEQ ID NO: 1969356 - RNA, 21 nt, Homo sapiens
uaccagauauuugaaucuuuc

SEQ ID NO: 1969357 - RNA, 13 nt, Homo sapiens
agaaguugcccuc

SEQ ID NO: 1969358 - RNA, 16 nt, Homo sapiens
ucuccaaguacuuuug

SEQ ID NO: 1969359 - RNA, 12 nt, Homo sapiens
ccaaacacuucu

SEQ ID NO: 1969360 - RNA, 17 nt, Homo sapiens
aaacuaaggagugacua

SEQ ID NO: 1969361 - RNA, 15 nt, Homo sapiens
accugcucuucaaga

SEQ ID NO: 1969362 - RNA, 13 nt, Homo sapiens
ccacaguuuuagu

SEQ ID NO: 1969363 - RNA, 23 nt, Homo sapiens
uuguaauaaauacugcagcuuga

SEQ ID NO: 1969364 - RNA, 19 nt, Homo sapiens
acuuuguauauuuguuaca

SEQ ID NO: 1969365 - RNA, 21 nt, Homo sapiens
gaacagagggugaaagggaca

SEQ ID NO: 1969366 - RNA, 18 nt, Homo sapiens
cuuuaaaaaaacacauaa

SEQ ID NO: 1969367 - RNA, 14 nt, Homo sapiens
ccucaaaagcacuu

SEQ ID NO: 1969368 - RNA, 15 nt, Homo sapiens
ugggaacugcaauaa

SEQ ID NO: 1969369 - RNA, 17 nt, Homo sapiens
ucgugugauuuccuaca

SEQ ID NO: 1969370 - RNA, 17 nt, Homo sapiens
uugccugcaugaaacau

SEQ ID NO: 1969371 - RNA, 18 nt, Homo sapiens
gaggucccugccaguguu

SEQ ID NO: 1969372 - RNA, 18 nt, Homo sapiens
caauggcaacaauuugag

SEQ ID NO: 1969373 - RNA, 20 nt, Homo sapiens
acgaaauaugaagagcaaaa

SEQ ID NO: 1969374 - RNA, 18 nt, Homo sapiens
ggcacaggccaggacaaa

SEQ ID NO: 1969375 - RNA, 17 nt, Homo sapiens
uaaauaauuugcacuga

SEQ ID NO: 1969376 - RNA, 15 nt, Homo sapiens
ccaaucuguacaaaa

SEQ ID NO: 1969377 - RNA, 17 nt, Homo sapiens
uucuccuguagcacaaa

SEQ ID NO: 1969378 - RNA, 14 nt, Homo sapiens
uagacagagacaau

SEQ ID NO: 1969379 - RNA, 22 nt, Homo sapiens
ugucguuuucacauaugacaau

SEQ ID NO: 1969380 - RNA, 15 nt, Homo sapiens
cuuauucauuccuca

SEQ ID NO: 1969381 - RNA, 11 nt, Homo sapiens
gucacuugcug

SEQ ID NO: 1969382 - RNA, 22 nt, Homo sapiens
aaagagagcccugguccuagac

SEQ ID NO: 1969383 - RNA, 14 nt, Homo sapiens
agggauaagcaaaa

SEQ ID NO: 1969384 - RNA, 15 nt, Homo sapiens
gaccauggaggccag

SEQ ID NO: 1969385 - RNA, 21 nt, Homo sapiens
agcuccgaguggcucccgugu

SEQ ID NO: 1969386 - RNA, 16 nt, Homo sapiens
gacuauaaagcuguua

SEQ ID NO: 1969387 - RNA, 15 nt, Homo sapiens
agccuacagaugaac

SEQ ID NO: 1969388 - RNA, 23 nt, Homo sapiens
accaagaguguguccacugagaa

SEQ ID NO: 1969389 - RNA, 15 nt, Homo sapiens
acaguaaugugucau

SEQ ID NO: 1969390 - RNA, 21 nt, Homo sapiens
caaauacauacaaccuaugua

SEQ ID NO: 1969391 - RNA, 21 nt, Homo sapiens
auuucuuagugcuucagaguu

SEQ ID NO: 1969392 - RNA, 14 nt, Homo sapiens
guucucauaacucu

SEQ ID NO: 1969393 - RNA, 15 nt, Homo sapiens
agccagaggcucuaa

SEQ ID NO: 1969394 - RNA, 23 nt, Homo sapiens
guaaauacaauucaaacaauuca

SEQ ID NO: 1969395 - RNA, 14 nt, Homo sapiens
aaggacacuuguau

SEQ ID NO: 1969396 - RNA, 16 nt, Homo sapiens
cccagagccacagaaa

SEQ ID NO: 1969397 - RNA, 13 nt, Homo sapiens
ucagaacaaacau

SEQ ID NO: 1969398 - RNA, 23 nt, Homo sapiens
auguaugcuguuuguacaaacua

SEQ ID NO: 1969399 - RNA, 20 nt, Homo sapiens
agcauccggcaugagggcug

SEQ ID NO: 1969400 - RNA, 22 nt, Homo sapiens
gcguaucaggaaagcauggcuc

SEQ ID NO: 1969401 - RNA, 21 nt, Homo sapiens
uuuaggagacagucucaagca

SEQ ID NO: 1969402 - RNA, 18 nt, Homo sapiens
cacaaccuacucugcaaa

SEQ ID NO: 1969403 - RNA, 14 nt, Homo sapiens
uaaaguagugcuua

SEQ ID NO: 1969404 - RNA, 17 nt, Homo sapiens
uagaaagccauauucca

SEQ ID NO: 1969405 - RNA, 12 nt, Homo sapiens
agucuagcuuuu

SEQ ID NO: 1969406 - RNA, 13 nt, Homo sapiens
aaaauacauaacu

SEQ ID NO: 1969407 - RNA, 19 nt, Homo sapiens
accuaauucgaugaaggcu

SEQ ID NO: 1969408 - RNA, 12 nt, Homo sapiens
gauuuacauaua

SEQ ID NO: 1969409 - RNA, 17 nt, Homo sapiens
ugucucagaccacuauu

SEQ ID NO: 1969410 - RNA, 13 nt, Homo sapiens
uauaagaugacaa

SEQ ID NO: 1969411 - RNA, 18 nt, Homo sapiens
gauuucuggucaacccca

SEQ ID NO: 1969412 - RNA, 16 nt, Homo sapiens
aaccugaugagcaaga

SEQ ID NO: 1969413 - RNA, 16 nt, Homo sapiens
cucuggcuuggccaca

SEQ ID NO: 1969414 - RNA, 20 nt, Homo sapiens
gacccuuuggggguugaaua

SEQ ID NO: 1969415 - RNA, 23 nt, Homo sapiens
gcugcuuuugauuuuagccaugc

SEQ ID NO: 1969416 - RNA, 15 nt, Homo sapiens
gcccgucuguccauc

SEQ ID NO: 1969417 - RNA, 23 nt, Homo sapiens
cuaaaacagaaaaaaaaauggaa

SEQ ID NO: 1969418 - RNA, 20 nt, Homo sapiens
aaaccugcuccaaggcagug

SEQ ID NO: 1969419 - RNA, 16 nt, Homo sapiens
uguauuuuaagugaau

SEQ ID NO: 1969420 - RNA, 13 nt, Homo sapiens
uuucugaccaaaa

SEQ ID NO: 1969421 - RNA, 21 nt, Homo sapiens
aacaaggcauucagcaguuuc

SEQ ID NO: 1969422 - RNA, 16 nt, Homo sapiens
gcagcuucaggugagc

SEQ ID NO: 1969423 - RNA, 12 nt, Homo sapiens
caaaaauuugaa

SEQ ID NO: 1969424 - RNA, 15 nt, Homo sapiens
ccuacguauccugca

SEQ ID NO: 1969425 - RNA, 20 nt, Homo sapiens
gcacucacccaugugccaag

SEQ ID NO: 1969426 - RNA, 16 nt, Homo sapiens
uacugaaagucugugg

SEQ ID NO: 1969427 - RNA, 19 nt, Homo sapiens
uggugcacaaguaacacau

SEQ ID NO: 1969428 - RNA, 21 nt, Homo sapiens
gagaauaauucuuuccaugcc

SEQ ID NO: 1969429 - RNA, 16 nt, Homo sapiens
cccaaauuucauaccu

SEQ ID NO: 1969430 - RNA, 20 nt, Homo sapiens
cagcaaugacaucucagggg

SEQ ID NO: 1969431 - RNA, 19 nt, Homo sapiens
ucuggucuaguuaaccuag

SEQ ID NO: 1969432 - RNA, 20 nt, Homo sapiens
acccacuuccugaucccuca

SEQ ID NO: 1969433 - RNA, 13 nt, Homo sapiens
gauuggcacagac

SEQ ID NO: 1969434 - RNA, 20 nt, Homo sapiens
cuuuccuagcuccacucuaa

SEQ ID NO: 1969435 - RNA, 15 nt, Homo sapiens
aagaccucaucugcc

SEQ ID NO: 1969436 - RNA, 22 nt, Homo sapiens
ggaagacgccuuucuccuccaa

SEQ ID NO: 1969437 - RNA, 19 nt, Homo sapiens
ccuauuuuaacuaccucaa

SEQ ID NO: 1969438 - RNA, 17 nt, Homo sapiens
ggggaauuaaguuucaa

SEQ ID NO: 1969439 - RNA, 22 nt, Homo sapiens
ggaagccccauccaacacugga

SEQ ID NO: 1969440 - RNA, 16 nt, Homo sapiens
augagagacacacuga

SEQ ID NO: 1969441 - RNA, 19 nt, Homo sapiens
guugugcauuuugugugau

SEQ ID NO: 1969442 - RNA, 18 nt, Homo sapiens
ucucugcccucuucucau

SEQ ID NO: 1969443 - RNA, 17 nt, Homo sapiens
gucugggucuaccagga

SEQ ID NO: 1969444 - RNA, 21 nt, Homo sapiens
cugcugaaggcagucauauca

SEQ ID NO: 1969445 - RNA, 22 nt, Homo sapiens
cucucgcacaccucugcaccuu

SEQ ID NO: 1969446 - RNA, 17 nt, Homo sapiens
uaaaaggcacugcacau

SEQ ID NO: 1969447 - RNA, 23 nt, Homo sapiens
aaucuucucuuugacaauuccua

SEQ ID NO: 1969448 - RNA, 16 nt, Homo sapiens
cuuuccucgccugaca

SEQ ID NO: 1969449 - RNA, 23 nt, Homo sapiens
gucaggaguucaagacuagccug

SEQ ID NO: 1969450 - RNA, 23 nt, Homo sapiens
uccagaauugguaaaaacagcag

SEQ ID NO: 1969451 - RNA, 12 nt, Homo sapiens
agauuugaauau

SEQ ID NO: 1969452 - RNA, 11 nt, Homo sapiens
uggauuacaaa

SEQ ID NO: 1969453 - RNA, 14 nt, Homo sapiens
agcucuuacuuuua

SEQ ID NO: 1969454 - RNA, 23 nt, Homo sapiens
agauaccuucaugguguucauga

SEQ ID NO: 1969455 - RNA, 14 nt, Homo sapiens
accauggccagcua

SEQ ID NO: 1969456 - RNA, 21 nt, Homo sapiens
aucugggagacccugaacuca

SEQ ID NO: 1969457 - RNA, 16 nt, Homo sapiens
agucacguagcacaga

SEQ ID NO: 1969458 - RNA, 15 nt, Homo sapiens
gcuguugacaucagc

SEQ ID NO: 1969459 - RNA, 18 nt, Homo sapiens
gaauuuagaaaaagucaa

SEQ ID NO: 1969460 - RNA, 20 nt, Homo sapiens
caauacacggacacaaccaa

SEQ ID NO: 1969461 - RNA, 20 nt, Homo sapiens
uauuguggaauugacucaaa

SEQ ID NO: 1969462 - RNA, 13 nt, Homo sapiens
aaguaacacucac

SEQ ID NO: 1969463 - RNA, 21 nt, Homo sapiens
agaugcuggccagcauuuuca

SEQ ID NO: 1969464 - RNA, 21 nt, Homo sapiens
cauuugggagaagaucucaag

SEQ ID NO: 1969465 - RNA, 17 nt, Homo sapiens
gaccaguagugaccaau

SEQ ID NO: 1969466 - RNA, 20 nt, Homo sapiens
gcacaggcuggagugcagug

SEQ ID NO: 1969467 - RNA, 21 nt, Homo sapiens
uauugcagagacucauuucac

SEQ ID NO: 1969468 - RNA, 21 nt, Homo sapiens
cuccacuggaggggucuccuc

SEQ ID NO: 1969469 - RNA, 16 nt, Homo sapiens
ucaccaugaaagaaga

SEQ ID NO: 1969470 - RNA, 15 nt, Homo sapiens
agagaagcauucuca

SEQ ID NO: 1969471 - RNA, 23 nt, Homo sapiens
ucaccaugcaaugccucuggaau

SEQ ID NO: 1969472 - RNA, 13 nt, Homo sapiens
caagagacaguau

SEQ ID NO: 1969473 - RNA, 16 nt, Homo sapiens
cuauuccuucuggccu

SEQ ID NO: 1969474 - RNA, 23 nt, Homo sapiens
ccagcuccuccgugcuuccucag

SEQ ID NO: 1969475 - RNA, 16 nt, Homo sapiens
ucauucuagcaccuug

SEQ ID NO: 1969476 - RNA, 11 nt, Homo sapiens
uuggcuugcuu

SEQ ID NO: 1969477 - RNA, 17 nt, Homo sapiens
ggcgcuagcacagcucc

SEQ ID NO: 1969478 - RNA, 12 nt, Homo sapiens
uuaagacuuuaa

SEQ ID NO: 1969479 - RNA, 12 nt, Homo sapiens
acaugacuacau

SEQ ID NO: 1969480 - RNA, 22 nt, Homo sapiens
caccaaaucaucucucaucacu

SEQ ID NO: 1969481 - RNA, 21 nt, Homo sapiens
gaugauagugguggaguuaau

SEQ ID NO: 1969482 - RNA, 11 nt, Homo sapiens
uuuguugacau

SEQ ID NO: 1969483 - RNA, 15 nt, Homo sapiens
augugucacuugugc

SEQ ID NO: 1969484 - RNA, 14 nt, Homo sapiens
aucccugcagcuca

SEQ ID NO: 1969485 - RNA, 18 nt, Homo sapiens
caacaugugcucagggaa

SEQ ID NO: 1969486 - RNA, 22 nt, Homo sapiens
ugccaaggaaacccccagugua

SEQ ID NO: 1969487 - RNA, 15 nt, Homo sapiens
agaugcgcacugcau

SEQ ID NO: 1969488 - RNA, 22 nt, Homo sapiens
acucauacagucucuauuugau

SEQ ID NO: 1969489 - RNA, 22 nt, Homo sapiens
accagugaccaucacaucccuu

SEQ ID NO: 1969490 - RNA, 17 nt, Homo sapiens
ggacuaaaugaucucug

SEQ ID NO: 1969491 - RNA, 18 nt, Homo sapiens
ucagaaacugaauucugg

SEQ ID NO: 1969492 - RNA, 19 nt, Homo sapiens
ugucauucaagccugugaa

SEQ ID NO: 1969493 - RNA, 23 nt, Homo sapiens
ugucuuauuuuaaugguggguuu

SEQ ID NO: 1969494 - RNA, 19 nt, Homo sapiens
aucugaauuuugcaaugua

SEQ ID NO: 1969495 - RNA, 20 nt, Homo sapiens
auuuuuaaaaaguuugaaua

SEQ ID NO: 1969496 - RNA, 21 nt, Homo sapiens
aggaugaauguaugugcacug

SEQ ID NO: 1969497 - RNA, 22 nt, Homo sapiens
uugauugguuuaaaagucacau

SEQ ID NO: 1969498 - RNA, 15 nt, Homo sapiens
ccuacgaaagcacag

SEQ ID NO: 1969499 - RNA, 24 nt, Homo sapiens
uucugugaucuuuuaaaguguuac

SEQ ID NO: 1969500 - RNA, 13 nt, Homo sapiens
auucacaccucac

SEQ ID NO: 1969501 - RNA, 19 nt, Homo sapiens
cccuuuucuguauguccuu

SEQ ID NO: 1969502 - RNA, 19 nt, Homo sapiens
ucacaaccucucugaucuu

SEQ ID NO: 1969503 - RNA, 16 nt, Homo sapiens
agaacacucagcugcu

SEQ ID NO: 1969504 - RNA, 13 nt, Homo sapiens
uuucacaauguga

SEQ ID NO: 1969505 - RNA, 11 nt, Homo sapiens
agaaaccauga

SEQ ID NO: 1969506 - RNA, 11 nt, Homo sapiens
uggaaccaagg

SEQ ID NO: 1969507 - RNA, 20 nt, Homo sapiens
ugucacuguuucacuacuca

SEQ ID NO: 1969508 - RNA, 13 nt, Homo sapiens
gcaccuucugacg

SEQ ID NO: 1969509 - RNA, 18 nt, Homo sapiens
ucacaguacagcaugugc

SEQ ID NO: 1969510 - RNA, 16 nt, Homo sapiens
aaguuuuauacuugau

SEQ ID NO: 1969511 - RNA, 19 nt, Homo sapiens
aagaagugacuaggguuca

SEQ ID NO: 1969512 - RNA, 19 nt, Homo sapiens
cacaauauaaaacuguacu

SEQ ID NO: 1969513 - RNA, 15 nt, Homo sapiens
ugcugcccccagaaa

SEQ ID NO: 1969514 - RNA, 15 nt, Homo sapiens
caucucacugcagua

SEQ ID NO: 1969515 - RNA, 22 nt, Homo sapiens
aaagaugcauuaucuaugauau

SEQ ID NO: 1969516 - RNA, 21 nt, Homo sapiens
accucugccucuaguccccaa

SEQ ID NO: 1969517 - RNA, 17 nt, Homo sapiens
auuacauuucacuucaa

SEQ ID NO: 1969518 - RNA, 16 nt, Homo sapiens
ccgcaccuugucaugu

SEQ ID NO: 1969519 - RNA, 17 nt, Homo sapiens
cauacaucauucuguga

SEQ ID NO: 1969520 - RNA, 20 nt, Homo sapiens
acacuuuuccacauuccagu

SEQ ID NO: 1969521 - RNA, 22 nt, Homo sapiens
gagcuccauguugcuucacucu

SEQ ID NO: 1969522 - RNA, 17 nt, Homo sapiens
uaaagaauaaaugaauc

SEQ ID NO: 1969523 - RNA, 17 nt, Homo sapiens
aauaugaccauuugacu

SEQ ID NO: 1969524 - RNA, 20 nt, Homo sapiens
ggaaacuagcuuacaugaga

SEQ ID NO: 1969525 - RNA, 20 nt, Homo sapiens
ugcacuuuccaaugccacag

SEQ ID NO: 1969526 - RNA, 15 nt, Homo sapiens
aguaaaaauugaacu

SEQ ID NO: 1969527 - RNA, 15 nt, Homo sapiens
aggggaaauuuggcu

SEQ ID NO: 1969528 - RNA, 12 nt, Homo sapiens
uucucagaaaag

SEQ ID NO: 1969529 - RNA, 15 nt, Homo sapiens
cuuugaguccagugu

SEQ ID NO: 1969530 - RNA, 18 nt, Homo sapiens
ugaaaaaaacauauccaa

SEQ ID NO: 1969531 - RNA, 18 nt, Homo sapiens
auuuuaaugaagugcaau

SEQ ID NO: 1969532 - RNA, 15 nt, Homo sapiens
cugggacucauucac

SEQ ID NO: 1969533 - RNA, 14 nt, Homo sapiens
aaaccaggagcauu

SEQ ID NO: 1969534 - RNA, 17 nt, Homo sapiens
agaucaguagugcuauc

SEQ ID NO: 1969535 - RNA, 17 nt, Homo sapiens
aaaguaaaaauuuugac

SEQ ID NO: 1969536 - RNA, 21 nt, Homo sapiens
gccuauuguugaauaaaugua

SEQ ID NO: 1969537 - RNA, 15 nt, Homo sapiens
uugcuuugccagagc

SEQ ID NO: 1969538 - RNA, 18 nt, Homo sapiens
acauuuaagggaauguga

SEQ ID NO: 1969539 - RNA, 17 nt, Homo sapiens
ccuuuggaaacaacauu

SEQ ID NO: 1969540 - RNA, 11 nt, Homo sapiens
accaugacugu

SEQ ID NO: 1969541 - RNA, 19 nt, Homo sapiens
cagaaguauuucuguggau

SEQ ID NO: 1969542 - RNA, 13 nt, Homo sapiens
uucguaaacacca

SEQ ID NO: 1969543 - RNA, 16 nt, Homo sapiens
agccuuggauacucca

SEQ ID NO: 1969544 - RNA, 14 nt, Homo sapiens
ggcaccaaccugca

SEQ ID NO: 1969545 - RNA, 21 nt, Homo sapiens
ugauaggaagcgucuggcaga

SEQ ID NO: 1969546 - RNA, 12 nt, Homo sapiens
ggaggcgcagga

SEQ ID NO: 1969547 - RNA, 20 nt, Homo sapiens
cuuguagcuagaacuucucu

SEQ ID NO: 1969548 - RNA, 22 nt, Homo sapiens
cagauuuacaucccagacacau

SEQ ID NO: 1969549 - RNA, 20 nt, Homo sapiens
auugaugucaaaaacuucaa

SEQ ID NO: 1969550 - RNA, 14 nt, Homo sapiens
caggagccaugaca

SEQ ID NO: 1969551 - RNA, 14 nt, Homo sapiens
acagagacuggcau

SEQ ID NO: 1969552 - RNA, 17 nt, Homo sapiens
aucaacaaacacuugag

SEQ ID NO: 1969553 - RNA, 20 nt, Homo sapiens
agugccuggccaaagggaua

SEQ ID NO: 1969554 - RNA, 19 nt, Homo sapiens
cauuugguacacacuugac

SEQ ID NO: 1969555 - RNA, 12 nt, Homo sapiens
auaacaucucac

SEQ ID NO: 1969556 - RNA, 15 nt, Homo sapiens
uaaguguucauuuua

SEQ ID NO: 1969557 - RNA, 17 nt, Homo sapiens
uccagugcaguugugau

SEQ ID NO: 1969558 - RNA, 24 nt, Homo sapiens
ucuguguaaaucuaacuacaagga

SEQ ID NO: 1969559 - RNA, 16 nt, Homo sapiens
acugcagggcacugug

SEQ ID NO: 1969560 - RNA, 17 nt, Homo sapiens
ucaaagacuuccucugg

SEQ ID NO: 1969561 - RNA, 13 nt, Homo sapiens
gcaaucaacugag

SEQ ID NO: 1969562 - RNA, 12 nt, Homo sapiens
agucacagugau

SEQ ID NO: 1969563 - RNA, 17 nt, Homo sapiens
guauuuuuauccaugac

SEQ ID NO: 1969564 - RNA, 19 nt, Homo sapiens
acuucugaaaccucugggu

SEQ ID NO: 1969565 - RNA, 16 nt, Homo sapiens
acccuacaguauauaa

SEQ ID NO: 1969566 - RNA, 13 nt, Homo sapiens
ucgugaaacccug

SEQ ID NO: 1969567 - RNA, 19 nt, Homo sapiens
uuuaaaaggcaagucaaau

SEQ ID NO: 1969568 - RNA, 19 nt, Homo sapiens
agagcggcugcccgacuca

SEQ ID NO: 1969569 - RNA, 13 nt, Homo sapiens
agcguguccagua

SEQ ID NO: 1969570 - RNA, 17 nt, Homo sapiens
gacaagcugcauuucag

SEQ ID NO: 1969571 - RNA, 22 nt, Homo sapiens
aacacagauccgcaagaguaaa

SEQ ID NO: 1969572 - RNA, 16 nt, Homo sapiens
auuuauuuaugugcaa

SEQ ID NO: 1969573 - RNA, 23 nt, Homo sapiens
ugggcuacagaaaccacagucuu

SEQ ID NO: 1969574 - RNA, 11 nt, Homo sapiens
cuugcauugac

SEQ ID NO: 1969575 - RNA, 19 nt, Homo sapiens
uguccuagaaguucuuuga

SEQ ID NO: 1969576 - RNA, 21 nt, Homo sapiens
agucacccggcccccaugcaa

SEQ ID NO: 1969577 - RNA, 19 nt, Homo sapiens
uacauuuaauaauaucaaa

SEQ ID NO: 1969578 - RNA, 12 nt, Homo sapiens
augacuaaagag

SEQ ID NO: 1969579 - RNA, 19 nt, Homo sapiens
auuucucuuucucucucac

SEQ ID NO: 1969580 - RNA, 19 nt, Homo sapiens
ugugaacaagugaacacau

SEQ ID NO: 1969581 - RNA, 20 nt, Homo sapiens
ucaugucgaggcuagaggca

SEQ ID NO: 1969582 - RNA, 22 nt, Homo sapiens
auuuaacacccuuuagaaccuu

SEQ ID NO: 1969583 - RNA, 18 nt, Homo sapiens
gccgggcaugauggugca

SEQ ID NO: 1969584 - RNA, 11 nt, Homo sapiens
uuuaugaaaug

SEQ ID NO: 1969585 - RNA, 12 nt, Homo sapiens
gcucacuguucu

SEQ ID NO: 1969586 - RNA, 23 nt, Homo sapiens
uuacauccagaguucugugacac

SEQ ID NO: 1969587 - RNA, 15 nt, Homo sapiens
uggucacugugcacu

SEQ ID NO: 1969588 - RNA, 17 nt, Homo sapiens
auuagccguaguggaau

SEQ ID NO: 1969589 - RNA, 21 nt, Homo sapiens
auucagucucagcugcugaaa

SEQ ID NO: 1969590 - RNA, 16 nt, Homo sapiens
ggugcaaccagggagc

SEQ ID NO: 1969591 - RNA, 14 nt, Homo sapiens
caccccagaccuca

SEQ ID NO: 1969592 - RNA, 24 nt, Homo sapiens
aagcuauguauuuaaauuaucaca

SEQ ID NO: 1969593 - RNA, 19 nt, Homo sapiens
ugcccaggcuagagugcaa

SEQ ID NO: 1969594 - RNA, 20 nt, Homo sapiens
ccccaagggggcugcugcuc

SEQ ID NO: 1969595 - RNA, 20 nt, Homo sapiens
uaacucuucuaacacaaaau

SEQ ID NO: 1969596 - RNA, 15 nt, Homo sapiens
uauuugcugauacua

SEQ ID NO: 1969597 - RNA, 19 nt, Homo sapiens
auggaucuccauauuucaa

SEQ ID NO: 1969598 - RNA, 17 nt, Homo sapiens
gaagcccuccuugccac

SEQ ID NO: 1969599 - RNA, 14 nt, Homo sapiens
cccuugcccggcug

SEQ ID NO: 1969600 - RNA, 21 nt, Homo sapiens
ccaccacucaggccacagugg

SEQ ID NO: 1969601 - RNA, 17 nt, Homo sapiens
uacuuuguaucaaucca

SEQ ID NO: 1969602 - RNA, 19 nt, Homo sapiens
uacaugucuacaugccaug

SEQ ID NO: 1969603 - RNA, 17 nt, Homo sapiens
cuaauaaacauccuuca

SEQ ID NO: 1969604 - RNA, 16 nt, Homo sapiens
ugugaaacucaucuca

SEQ ID NO: 1969605 - RNA, 15 nt, Homo sapiens
agacauugcaaugua

SEQ ID NO: 1969606 - RNA, 15 nt, Homo sapiens
cauugucugcaaugg

SEQ ID NO: 1969607 - RNA, 19 nt, Homo sapiens
aaggaaauaacauugcacu

SEQ ID NO: 1969608 - RNA, 19 nt, Homo sapiens
agaccaaaggauccagaga

SEQ ID NO: 1969609 - RNA, 20 nt, Homo sapiens
cagauguguguucucaguga

SEQ ID NO: 1969610 - RNA, 16 nt, Homo sapiens
ccucaggaccauguga

SEQ ID NO: 1969611 - RNA, 20 nt, Homo sapiens
acaacucuuacacaaauacu

SEQ ID NO: 1969612 - RNA, 18 nt, Homo sapiens
cuccuggugcucuaucca

SEQ ID NO: 1969613 - RNA, 22 nt, Homo sapiens
guuuuggacacacggucagggu

SEQ ID NO: 1969614 - RNA, 21 nt, Homo sapiens
cugaacuuuaucuguucuguu

SEQ ID NO: 1969615 - RNA, 18 nt, Homo sapiens
cuguugguaaagcacaug

SEQ ID NO: 1969616 - RNA, 20 nt, Homo sapiens
uccuguucgguuccagacac

SEQ ID NO: 1969617 - RNA, 17 nt, Homo sapiens
ugugcaagucuugucag

SEQ ID NO: 1969618 - RNA, 19 nt, Homo sapiens
guuuauccuguauguaaua

SEQ ID NO: 1969619 - RNA, 12 nt, Homo sapiens
uguuuuagccau

SEQ ID NO: 1969620 - RNA, 22 nt, Homo sapiens
auaugauuuuuagaaaucagcu

SEQ ID NO: 1969621 - RNA, 18 nt, Homo sapiens
ucugcauuuuucagagaa

SEQ ID NO: 1969622 - RNA, 22 nt, Homo sapiens
gaauaaaagaugauuucucaaa

SEQ ID NO: 1969623 - RNA, 21 nt, Homo sapiens
gagagucuggauaacuuccac

SEQ ID NO: 1969624 - RNA, 20 nt, Homo sapiens
ccaggguccugaguggcuga

SEQ ID NO: 1969625 - RNA, 20 nt, Homo sapiens
ggcccuuucggauccaggga

SEQ ID NO: 1969626 - RNA, 19 nt, Homo sapiens
ugaccaaccuuuucccaac

SEQ ID NO: 1969627 - RNA, 19 nt, Homo sapiens
auguaauaaagugaacuuu

SEQ ID NO: 1969628 - RNA, 15 nt, Homo sapiens
cuuauuuuuacuugu

SEQ ID NO: 1969629 - RNA, 17 nt, Homo sapiens
acucugcugaggccaga

SEQ ID NO: 1969630 - RNA, 18 nt, Homo sapiens
ccuggaggccgcagccaa

SEQ ID NO: 1969631 - RNA, 13 nt, Homo sapiens
uuauguaacuuga

SEQ ID NO: 1969632 - RNA, 16 nt, Homo sapiens
cagaugagcuuacaag

SEQ ID NO: 1969633 - RNA, 20 nt, Homo sapiens
uguugguuaguagacacuaa

SEQ ID NO: 1969634 - RNA, 14 nt, Homo sapiens
auuuuucugaagga

SEQ ID NO: 1969635 - RNA, 22 nt, Homo sapiens
ggguggcugccagcccacugcc

SEQ ID NO: 1969636 - RNA, 22 nt, Homo sapiens
ugcaagaaggauaccaaauacc

SEQ ID NO: 1969637 - RNA, 15 nt, Homo sapiens
aguugcuagcaacaa

SEQ ID NO: 1969638 - RNA, 12 nt, Homo sapiens
ucguggguccca

SEQ ID NO: 1969639 - RNA, 21 nt, Homo sapiens
cugcugaaaauaacacaacaa

SEQ ID NO: 1969640 - RNA, 22 nt, Homo sapiens
aucuguuacugaaaugaggaga

SEQ ID NO: 1969641 - RNA, 18 nt, Homo sapiens
uugagauguaagucucaa

SEQ ID NO: 1969642 - RNA, 17 nt, Homo sapiens
ugacuucauacuuugaa

SEQ ID NO: 1969643 - RNA, 15 nt, Homo sapiens
uucagcaucacuaaa

SEQ ID NO: 1969644 - RNA, 15 nt, Homo sapiens
cauccugugaagucc

SEQ ID NO: 1969645 - RNA, 16 nt, Homo sapiens
augcaguuccaaucaa

SEQ ID NO: 1969646 - RNA, 16 nt, Homo sapiens
aaagccuuaagcaaau

SEQ ID NO: 1969647 - RNA, 15 nt, Homo sapiens
cuucacagauuuguc

SEQ ID NO: 1969648 - RNA, 20 nt, Homo sapiens
cucugugcugacauggcucu

SEQ ID NO: 1969649 - RNA, 21 nt, Homo sapiens
ugaauuguaaaagcaacauca

SEQ ID NO: 1969650 - RNA, 23 nt, Homo sapiens
cugaaccucuucaagagcaucug

SEQ ID NO: 1969651 - RNA, 14 nt, Homo sapiens
cccacagacugguu

SEQ ID NO: 1969652 - RNA, 22 nt, Homo sapiens
acuucucuccuccacucugagc

SEQ ID NO: 1969653 - RNA, 17 nt, Homo sapiens
gauaaugauuugcucuu

SEQ ID NO: 1969654 - RNA, 18 nt, Homo sapiens
agcuuuaggggaccauga

SEQ ID NO: 1969655 - RNA, 11 nt, Homo sapiens
auuugaugcuu

SEQ ID NO: 1969656 - RNA, 14 nt, Homo sapiens
guacauauuugaaa

SEQ ID NO: 1969657 - RNA, 22 nt, Homo sapiens
agcacaaccuuuuccucaccag

SEQ ID NO: 1969658 - RNA, 19 nt, Homo sapiens
cagugaaagaguagugcau

SEQ ID NO: 1969659 - RNA, 12 nt, Homo sapiens
uacugcucucaa

SEQ ID NO: 1969660 - RNA, 17 nt, Homo sapiens
uuauucugucuggcauu

SEQ ID NO: 1969661 - RNA, 17 nt, Homo sapiens
gccagaaauugauuaag

SEQ ID NO: 1969662 - RNA, 16 nt, Homo sapiens
acccagcccugaacaa

SEQ ID NO: 1969663 - RNA, 15 nt, Homo sapiens
caccagucuguaaaa

SEQ ID NO: 1969664 - RNA, 19 nt, Homo sapiens
cugccgggcugagggccug

SEQ ID NO: 1969665 - RNA, 23 nt, Homo sapiens
cuaagcacuuuaucuauaucuca

SEQ ID NO: 1969666 - RNA, 23 nt, Homo sapiens
ugaagucaguuucuaucauucug

SEQ ID NO: 1969667 - RNA, 19 nt, Homo sapiens
cagcaggaggaaaggguuc

SEQ ID NO: 1969668 - RNA, 13 nt, Homo sapiens
cagauguguuugc

SEQ ID NO: 1969669 - RNA, 11 nt, Homo sapiens
gaugaauuauu

SEQ ID NO: 1969670 - RNA, 18 nt, Homo sapiens
cccaguccaccugaggaa

SEQ ID NO: 1969671 - RNA, 16 nt, Homo sapiens
cuuucaugucuuucca

SEQ ID NO: 1969672 - RNA, 15 nt, Homo sapiens
ccaacagccagugug

SEQ ID NO: 1969673 - RNA, 13 nt, Homo sapiens
accucccacuccu

SEQ ID NO: 1969674 - RNA, 18 nt, Homo sapiens
cauguccuccaucagggg

SEQ ID NO: 1969675 - RNA, 13 nt, Homo sapiens
gagaucaacaaca

SEQ ID NO: 1969676 - RNA, 14 nt, Homo sapiens
ucuuagaauaucua

SEQ ID NO: 1969677 - RNA, 19 nt, Homo sapiens
aaaugguuuuguuuugcac

SEQ ID NO: 1969678 - RNA, 11 nt, Homo sapiens
ggcagugucac

SEQ ID NO: 1969679 - RNA, 20 nt, Homo sapiens
agggggagcaaaucgugccu

SEQ ID NO: 1969680 - RNA, 14 nt, Homo sapiens
agaauaaagcaauu

SEQ ID NO: 1969681 - RNA, 13 nt, Homo sapiens
cauuuuaaaaaca

SEQ ID NO: 1969682 - RNA, 21 nt, Homo sapiens
aagcagaaaaauuaaauugua

SEQ ID NO: 1969683 - RNA, 20 nt, Homo sapiens
gagggcuggcuggccucacc

SEQ ID NO: 1969684 - RNA, 15 nt, Homo sapiens
caggacauuugacau

SEQ ID NO: 1969685 - RNA, 22 nt, Homo sapiens
cauauugucaccucagcacugu

SEQ ID NO: 1969686 - RNA, 22 nt, Homo sapiens
acacccuggccugaacugagga

SEQ ID NO: 1969687 - RNA, 20 nt, Homo sapiens
auguauacuugaaaaauguu

SEQ ID NO: 1969688 - RNA, 16 nt, Homo sapiens
uguauuucaacuuguc

SEQ ID NO: 1969689 - RNA, 13 nt, Homo sapiens
ugcacaggucucu

SEQ ID NO: 1969690 - RNA, 14 nt, Homo sapiens
aaagucaucuuuac

SEQ ID NO: 1969691 - RNA, 20 nt, Homo sapiens
auaaauguaccuucacacca

SEQ ID NO: 1969692 - RNA, 22 nt, Homo sapiens
cucugccaagauacuugaacac

SEQ ID NO: 1969693 - RNA, 18 nt, Homo sapiens
agauguggaacaacagca

SEQ ID NO: 1969694 - RNA, 17 nt, Homo sapiens
aggcacuauucuaauca

SEQ ID NO: 1969695 - RNA, 21 nt, Homo sapiens
aagccugcggcgccagccuca

SEQ ID NO: 1969696 - RNA, 20 nt, Homo sapiens
guugcagagauuuccuccau

SEQ ID NO: 1969697 - RNA, 21 nt, Homo sapiens
gaaaaaaaaauguucauucua

SEQ ID NO: 1969698 - RNA, 16 nt, Homo sapiens
agucucuaucauuaaa

SEQ ID NO: 1969699 - RNA, 13 nt, Homo sapiens
auaaggcccagag

SEQ ID NO: 1969700 - RNA, 13 nt, Homo sapiens
aagaugcccuaau

SEQ ID NO: 1969701 - RNA, 18 nt, Homo sapiens
gcuaaaccaccauuuuau

SEQ ID NO: 1969702 - RNA, 15 nt, Homo sapiens
aaugugugcuuuauu

SEQ ID NO: 1969703 - RNA, 12 nt, Homo sapiens
ugaaaucauauu

SEQ ID NO: 1969704 - RNA, 18 nt, Homo sapiens
caauaguuucuuguuaau

SEQ ID NO: 1969705 - RNA, 13 nt, Homo sapiens
agaucuugaauag

SEQ ID NO: 1969706 - RNA, 15 nt, Homo sapiens
uaagaaugucaauuu

SEQ ID NO: 1969707 - RNA, 13 nt, Homo sapiens
agauacggcccau

SEQ ID NO: 1969708 - RNA, 16 nt, Homo sapiens
aagaagucaaacuacu

SEQ ID NO: 1969709 - RNA, 22 nt, Homo sapiens
aggacucacccuccacaaagca

SEQ ID NO: 1969710 - RNA, 13 nt, Homo sapiens
uaaaggucccuua

SEQ ID NO: 1969711 - RNA, 12 nt, Homo sapiens
ccacaccaccua

SEQ ID NO: 1969712 - RNA, 19 nt, Homo sapiens
caugggaaccucauaugca

SEQ ID NO: 1969713 - RNA, 22 nt, Homo sapiens
uagaaaaggccuucuucccaau

SEQ ID NO: 1969714 - RNA, 17 nt, Homo sapiens
agccugggcaacaaagu

SEQ ID NO: 1969715 - RNA, 19 nt, Homo sapiens
cagaauauuaagcacauua

SEQ ID NO: 1969716 - RNA, 20 nt, Homo sapiens
accuccgagacaguccagug

SEQ ID NO: 1969717 - RNA, 20 nt, Homo sapiens
cuuuguauccucugaccuac

SEQ ID NO: 1969718 - RNA, 17 nt, Homo sapiens
ucaaaguacugggauua

SEQ ID NO: 1969719 - RNA, 22 nt, Homo sapiens
aaguguaagaaacacacugagg

SEQ ID NO: 1969720 - RNA, 19 nt, Homo sapiens
uguggccccacccuuuccu

SEQ ID NO: 1969721 - RNA, 15 nt, Homo sapiens
ucugcuccuguucac

SEQ ID NO: 1969722 - RNA, 16 nt, Homo sapiens
cagcccugaaucagau

SEQ ID NO: 1969723 - RNA, 10 nt, Homo sapiens
uucuuuccaa

SEQ ID NO: 1969724 - RNA, 14 nt, Homo sapiens
uccucugcuugcau

SEQ ID NO: 1969725 - RNA, 16 nt, Homo sapiens
ggaaagucaugcaauc

SEQ ID NO: 1969726 - RNA, 13 nt, Homo sapiens
cuaccucuaguaa

SEQ ID NO: 1969727 - RNA, 13 nt, Homo sapiens
uucagcagugccu

SEQ ID NO: 1969728 - RNA, 12 nt, Homo sapiens
uugaauucuuga

SEQ ID NO: 1969729 - RNA, 15 nt, Homo sapiens
gaaaacacugugcac

SEQ ID NO: 1969730 - RNA, 20 nt, Homo sapiens
aaguuuaauauuaaagccau

SEQ ID NO: 1969731 - RNA, 12 nt, Homo sapiens
ccauugugcauu

SEQ ID NO: 1969732 - RNA, 20 nt, Homo sapiens
agacuaucaucaguacauuc

SEQ ID NO: 1969733 - RNA, 17 nt, Homo sapiens
aauuauggcaguaccuu

SEQ ID NO: 1969734 - RNA, 17 nt, Homo sapiens
cuuauuuuuaugugguc

SEQ ID NO: 1969735 - RNA, 18 nt, Homo sapiens
agugcuugccaccaccag

SEQ ID NO: 1969736 - RNA, 16 nt, Homo sapiens
uuuggucaguuacaaa

SEQ ID NO: 1969737 - RNA, 23 nt, Homo sapiens
cauaugacaauuucaaaaugcau

SEQ ID NO: 1969738 - RNA, 15 nt, Homo sapiens
cuccuucccaaguga

SEQ ID NO: 1969739 - RNA, 20 nt, Homo sapiens
gcaaagacaguuucuugcaa

SEQ ID NO: 1969740 - RNA, 12 nt, Homo sapiens
ucucaacugagg

SEQ ID NO: 1969741 - RNA, 10 nt, Homo sapiens
uaagauuuau

SEQ ID NO: 1969742 - RNA, 17 nt, Homo sapiens
gaacugacccucaggca

SEQ ID NO: 1969743 - RNA, 23 nt, Homo sapiens
uguuguaaauaaaaguauuuaau

SEQ ID NO: 1969744 - RNA, 19 nt, Homo sapiens
uuuauacucaccuuuuaug

SEQ ID NO: 1969745 - RNA, 18 nt, Homo sapiens
cagaagccuccccagcuc

SEQ ID NO: 1969746 - RNA, 22 nt, Homo sapiens
ugaacaauuguggucucucuua

SEQ ID NO: 1969747 - RNA, 19 nt, Homo sapiens
cagcuguguggugcuucug

SEQ ID NO: 1969748 - RNA, 19 nt, Homo sapiens
acaugaagacaucuuaucc

SEQ ID NO: 1969749 - RNA, 22 nt, Homo sapiens
ggaccaggacuauagcccaggu

SEQ ID NO: 1969750 - RNA, 23 nt, Homo sapiens
ccugccagaggccuggugcccug

SEQ ID NO: 1969751 - RNA, 14 nt, Homo sapiens
uuaagagugaaguc

SEQ ID NO: 1969752 - RNA, 13 nt, Homo sapiens
agaagcagcauca

SEQ ID NO: 1969753 - RNA, 13 nt, Homo sapiens
gaguaaaaccaaa

SEQ ID NO: 1969754 - RNA, 13 nt, Homo sapiens
cccugugguugcc

SEQ ID NO: 1969755 - RNA, 19 nt, Homo sapiens
uccaaacucaaacuugaga

SEQ ID NO: 1969756 - RNA, 13 nt, Homo sapiens
aaacaacaccucc

SEQ ID NO: 1969757 - RNA, 15 nt, Homo sapiens
agucucacagagaag

SEQ ID NO: 1969758 - RNA, 15 nt, Homo sapiens
ccacacccagcucag

SEQ ID NO: 1969759 - RNA, 14 nt, Homo sapiens
cacugccacugugg

SEQ ID NO: 1969760 - RNA, 19 nt, Homo sapiens
ucggagcgcaaugccaucu

SEQ ID NO: 1969761 - RNA, 22 nt, Homo sapiens
gaaaugcaaaagauacggccca

SEQ ID NO: 1969762 - RNA, 19 nt, Homo sapiens
uacagcucugacuuuacac

SEQ ID NO: 1969763 - RNA, 22 nt, Homo sapiens
acuccuuguaaagacuguagaa

SEQ ID NO: 1969764 - RNA, 16 nt, Homo sapiens
cuugcucuguugccca

SEQ ID NO: 1969765 - RNA, 19 nt, Homo sapiens
cgcacauagagauaugcac

SEQ ID NO: 1969766 - RNA, 19 nt, Homo sapiens
cuuauaauuugcauaccau

SEQ ID NO: 1969767 - RNA, 15 nt, Homo sapiens
cuuuugccuacguga

SEQ ID NO: 1969768 - RNA, 13 nt, Homo sapiens
ucaucugacucau

SEQ ID NO: 1969769 - RNA, 15 nt, Homo sapiens
gguagccuccuaucc

SEQ ID NO: 1969770 - RNA, 22 nt, Homo sapiens
cacuaaaaaaccaacaauguga

SEQ ID NO: 1969771 - RNA, 14 nt, Homo sapiens
uucccgaugaacaa

SEQ ID NO: 1969772 - RNA, 18 nt, Homo sapiens
agcuguuuugaauaacau

SEQ ID NO: 1969773 - RNA, 23 nt, Homo sapiens
cuaggaguuggacggaauggagg

SEQ ID NO: 1969774 - RNA, 17 nt, Homo sapiens
aggucuguaugucaugg

SEQ ID NO: 1969775 - RNA, 23 nt, Homo sapiens
gaggccagggcuauagcucagga

SEQ ID NO: 1969776 - RNA, 21 nt, Homo sapiens
guuccaguaccgcccucgggg

SEQ ID NO: 1969777 - RNA, 16 nt, Homo sapiens
gaccugcgcaaagggc

SEQ ID NO: 1969778 - RNA, 19 nt, Homo sapiens
ucugcauaaccgcacagac

SEQ ID NO: 1969779 - RNA, 13 nt, Homo sapiens
ggcaucagugucu

SEQ ID NO: 1969780 - RNA, 15 nt, Homo sapiens
uucuauucuaaguaa

SEQ ID NO: 1969781 - RNA, 23 nt, Homo sapiens
gaauagugccucagcgcugccca

SEQ ID NO: 1969782 - RNA, 21 nt, Homo sapiens
uacugucagcgagcugugcaa

SEQ ID NO: 1969783 - RNA, 21 nt, Homo sapiens
agccuggcaaggcauuccuca

SEQ ID NO: 1969784 - RNA, 21 nt, Homo sapiens
agccuaauaacgugaaacuua

SEQ ID NO: 1969785 - RNA, 18 nt, Homo sapiens
ccuuauucagaauuucua

SEQ ID NO: 1969786 - RNA, 19 nt, Homo sapiens
ugaacuucagaagugccau

SEQ ID NO: 1969787 - RNA, 15 nt, Homo sapiens
gaaucacugcacuua

SEQ ID NO: 1969788 - RNA, 21 nt, Homo sapiens
cagaauaggaaaacauugcaa

SEQ ID NO: 1969789 - RNA, 20 nt, Homo sapiens
augacugcauuuuacuguac

SEQ ID NO: 1969790 - RNA, 22 nt, Homo sapiens
cauagagcuuuuuaauagcacu

SEQ ID NO: 1969791 - RNA, 21 nt, Homo sapiens
caugaaauaaaauauaucuua

SEQ ID NO: 1969792 - RNA, 16 nt, Homo sapiens
cuguaaaucacuugua

SEQ ID NO: 1969793 - RNA, 21 nt, Homo sapiens
gagaacuuuuugcaugcuuau

SEQ ID NO: 1969794 - RNA, 21 nt, Homo sapiens
uuauugaguucgaggacuaca

SEQ ID NO: 1969795 - RNA, 22 nt, Homo sapiens
uuaaaaaagaaagaaauuugaa

SEQ ID NO: 1969796 - RNA, 22 nt, Homo sapiens
aaauauauaugcauaccuggau

SEQ ID NO: 1969797 - RNA, 21 nt, Homo sapiens
guacuguuuuuaauguucaca

SEQ ID NO: 1969798 - RNA, 17 nt, Homo sapiens
ucaaagccacacucugg

SEQ ID NO: 1969799 - RNA, 13 nt, Homo sapiens
caucaaugcaguu

SEQ ID NO: 1969800 - RNA, 14 nt, Homo sapiens
aacagaucuuuacu

SEQ ID NO: 1969801 - RNA, 15 nt, Homo sapiens
aaggguaaauacugg

SEQ ID NO: 1969802 - RNA, 18 nt, Homo sapiens
aguuuccuaugggaacaa

SEQ ID NO: 1969803 - RNA, 21 nt, Homo sapiens
auuuuccuggugccaauuuca

SEQ ID NO: 1969804 - RNA, 22 nt, Homo sapiens
ucuaauuuuggauggaguccag

SEQ ID NO: 1969805 - RNA, 21 nt, Homo sapiens
caacguucgauuucuaccuca

SEQ ID NO: 1969806 - RNA, 14 nt, Homo sapiens
uugucuuugcugua

SEQ ID NO: 1969807 - RNA, 20 nt, Homo sapiens
cccagagaagcaaguggcuu

SEQ ID NO: 1969808 - RNA, 13 nt, Homo sapiens
cuuuaauguacau

SEQ ID NO: 1969809 - RNA, 17 nt, Homo sapiens
acauuugcuagugacau

SEQ ID NO: 1969810 - RNA, 15 nt, Homo sapiens
uaacuugagcuuuaa

SEQ ID NO: 1969811 - RNA, 16 nt, Homo sapiens
aaucccagcauuuuga

SEQ ID NO: 1969812 - RNA, 20 nt, Homo sapiens
ccuuccuucuugcuucucau

SEQ ID NO: 1969813 - RNA, 20 nt, Homo sapiens
cccccaguggacaccaauga

SEQ ID NO: 1969814 - RNA, 14 nt, Homo sapiens
cucuuguugcugag

SEQ ID NO: 1969815 - RNA, 22 nt, Homo sapiens
uauauuuccacuucuucauucu

SEQ ID NO: 1969816 - RNA, 18 nt, Homo sapiens
cauccugucaucugagaa

SEQ ID NO: 1969817 - RNA, 19 nt, Homo sapiens
cucugaaaucucagaauuc

SEQ ID NO: 1969818 - RNA, 18 nt, Homo sapiens
ccauaaauacaagauucu

SEQ ID NO: 1969819 - RNA, 23 nt, Homo sapiens
auguucuuuuaaaugauugaauu

SEQ ID NO: 1969820 - RNA, 23 nt, Homo sapiens
auacccaaauuuuaauauuccag

SEQ ID NO: 1969821 - RNA, 18 nt, Homo sapiens
guugcaccguucucugua

SEQ ID NO: 1969822 - RNA, 18 nt, Homo sapiens
gcucuccggcugcaucua

SEQ ID NO: 1969823 - RNA, 21 nt, Homo sapiens
caacuugguuauuguaggcaa

SEQ ID NO: 1969824 - RNA, 12 nt, Homo sapiens
aauaaaccuccu

SEQ ID NO: 1969825 - RNA, 20 nt, Homo sapiens
agcuucccccccaccacagg

SEQ ID NO: 1969826 - RNA, 21 nt, Homo sapiens
ucugcaaaggcgucugaaugu

SEQ ID NO: 1969827 - RNA, 21 nt, Homo sapiens
guauaauucaaagcaccaaaa

SEQ ID NO: 1969828 - RNA, 16 nt, Homo sapiens
aauauguaaaugguau

SEQ ID NO: 1969829 - RNA, 18 nt, Homo sapiens
guauuuugaaguuuacau

SEQ ID NO: 1969830 - RNA, 20 nt, Homo sapiens
cagaaauaaaaugaaauguc

SEQ ID NO: 1969831 - RNA, 18 nt, Homo sapiens
gcuuuguuuacucucuuc

SEQ ID NO: 1969832 - RNA, 17 nt, Homo sapiens
cagauuugccauucaag

SEQ ID NO: 1969833 - RNA, 17 nt, Homo sapiens
caggaacccuggagaca

SEQ ID NO: 1969834 - RNA, 17 nt, Homo sapiens
augcacccucccuccug

SEQ ID NO: 1969835 - RNA, 13 nt, Homo sapiens
uugggagggucag

SEQ ID NO: 1969836 - RNA, 14 nt, Homo sapiens
cuaccuaccaagau

SEQ ID NO: 1969837 - RNA, 14 nt, Homo sapiens
caggacaccugccc

SEQ ID NO: 1969838 - RNA, 13 nt, Homo sapiens
uguauccacuuuc

SEQ ID NO: 1969839 - RNA, 14 nt, Homo sapiens
caaccccucuccag

SEQ ID NO: 1969840 - RNA, 12 nt, Homo sapiens
cucacagaccug

SEQ ID NO: 1969841 - RNA, 22 nt, Homo sapiens
cccuuauccaggacucugucaa

SEQ ID NO: 1969842 - RNA, 21 nt, Homo sapiens
auccuccaugggggcucagcc

SEQ ID NO: 1969843 - RNA, 13 nt, Homo sapiens
auccaacacugga

SEQ ID NO: 1969844 - RNA, 18 nt, Homo sapiens
cauuauuucucucugacc

SEQ ID NO: 1969845 - RNA, 18 nt, Homo sapiens
cucgauauccugaucucg

SEQ ID NO: 1969846 - RNA, 14 nt, Homo sapiens
acuuaaaauuacca

SEQ ID NO: 1969847 - RNA, 17 nt, Homo sapiens
aaccccuccccuccauc

SEQ ID NO: 1969848 - RNA, 21 nt, Homo sapiens
cugugcccacggagccuaccc

SEQ ID NO: 1969849 - RNA, 17 nt, Homo sapiens
uuaacaaacccaacuaa

SEQ ID NO: 1969850 - RNA, 20 nt, Homo sapiens
aaagucauccccucucagga

SEQ ID NO: 1969851 - RNA, 22 nt, Homo sapiens
acuuacaaguuucuagcucuca

SEQ ID NO: 1969852 - RNA, 13 nt, Homo sapiens
acuaacccaaugc

SEQ ID NO: 1969853 - RNA, 23 nt, Homo sapiens
ccugacaaggccagcacccaaag

SEQ ID NO: 1969854 - RNA, 17 nt, Homo sapiens
uauaaacaaaagaaucu

SEQ ID NO: 1969855 - RNA, 17 nt, Homo sapiens
auuaagccuuagaguau

SEQ ID NO: 1969856 - RNA, 15 nt, Homo sapiens
cuagagacucuguga

SEQ ID NO: 1969857 - RNA, 15 nt, Homo sapiens
uuuaaaauucaauua

SEQ ID NO: 1969858 - RNA, 21 nt, Homo sapiens
cucugccccaggcccuacuac

SEQ ID NO: 1969859 - RNA, 22 nt, Homo sapiens
ucaugcccccuuucagaugucu

SEQ ID NO: 1969860 - RNA, 15 nt, Homo sapiens
acugcaggaccucca

SEQ ID NO: 1969861 - RNA, 23 nt, Homo sapiens
cuuaucuauauccauaaccucua

SEQ ID NO: 1969862 - RNA, 22 nt, Homo sapiens
cuggggugggggccaagucaca

SEQ ID NO: 1969863 - RNA, 14 nt, Homo sapiens
agacaucucuggag

SEQ ID NO: 1969864 - RNA, 13 nt, Homo sapiens
cuuccuaaucacc

SEQ ID NO: 1969865 - RNA, 12 nt, Homo sapiens
aguauauguuaa

SEQ ID NO: 1969866 - RNA, 14 nt, Homo sapiens
uaguaauguagauu

SEQ ID NO: 1969867 - RNA, 19 nt, Homo sapiens
gccuucaguuuauuuccac

SEQ ID NO: 1969868 - RNA, 16 nt, Homo sapiens
caaaauggauaugaca

SEQ ID NO: 1969869 - RNA, 14 nt, Homo sapiens
cuaggaggucucua

SEQ ID NO: 1969870 - RNA, 14 nt, Homo sapiens
aaucaaacuguaaa

SEQ ID NO: 1969871 - RNA, 14 nt, Homo sapiens
aacauuacugccuu

SEQ ID NO: 1969872 - RNA, 14 nt, Homo sapiens
aaauaaacacuggu

SEQ ID NO: 1969873 - RNA, 13 nt, Homo sapiens
ggccuuucaggaa

SEQ ID NO: 1969874 - RNA, 12 nt, Homo sapiens
uaagacauguga

SEQ ID NO: 1969875 - RNA, 19 nt, Homo sapiens
ugccaucuuggacuuguca

SEQ ID NO: 1969876 - RNA, 17 nt, Homo sapiens
aguuucuugaggccaaa

SEQ ID NO: 1969877 - RNA, 18 nt, Homo sapiens
ucuucccccuuccaaaua

SEQ ID NO: 1969878 - RNA, 19 nt, Homo sapiens
ugaccaauuugcaccaguu

SEQ ID NO: 1969879 - RNA, 20 nt, Homo sapiens
cugccugguccucacacuca

SEQ ID NO: 1969880 - RNA, 19 nt, Homo sapiens
gaaaaaucuaaguguuuca

SEQ ID NO: 1969881 - RNA, 20 nt, Homo sapiens
gauuaggaaucauucuguaa

SEQ ID NO: 1969882 - RNA, 13 nt, Homo sapiens
ugaccacacugua

SEQ ID NO: 1969883 - RNA, 18 nt, Homo sapiens
uguccucucccugccaag

SEQ ID NO: 1969884 - RNA, 22 nt, Homo sapiens
gacucaauguggaaaaaauauu

SEQ ID NO: 1969885 - RNA, 18 nt, Homo sapiens
auagcaguugaaacaaga

SEQ ID NO: 1969886 - RNA, 22 nt, Homo sapiens
ccgcauaauuuuuuucugcaac

SEQ ID NO: 1969887 - RNA, 16 nt, Homo sapiens
aagaaucuacuggaau

SEQ ID NO: 1969888 - RNA, 16 nt, Homo sapiens
uauaaccugucuauac

SEQ ID NO: 1969889 - RNA, 12 nt, Homo sapiens
cuucaauucaaa

SEQ ID NO: 1969890 - RNA, 15 nt, Homo sapiens
cucugaggcuaugga

SEQ ID NO: 1969891 - RNA, 13 nt, Homo sapiens
agggucuuucaug

SEQ ID NO: 1969892 - RNA, 13 nt, Homo sapiens
gaaagggaagccu

SEQ ID NO: 1969893 - RNA, 18 nt, Homo sapiens
cacauugccccaugagac

SEQ ID NO: 1969894 - RNA, 15 nt, Homo sapiens
gagaaauugacagau

SEQ ID NO: 1969895 - RNA, 15 nt, Homo sapiens
ugcuaauguacuuuc

SEQ ID NO: 1969896 - RNA, 14 nt, Homo sapiens
cgaggucagaggag

SEQ ID NO: 1969897 - RNA, 17 nt, Homo sapiens
cuuuaacccucacuggg

SEQ ID NO: 1969898 - RNA, 13 nt, Homo sapiens
auauuuuauacau

SEQ ID NO: 1969899 - RNA, 22 nt, Homo sapiens
augucuaagguccccacugccu

SEQ ID NO: 1969900 - RNA, 20 nt, Homo sapiens
gcuuaaacccauacaaugua

SEQ ID NO: 1969901 - RNA, 16 nt, Homo sapiens
agaguaaaaacugaau

SEQ ID NO: 1969902 - RNA, 17 nt, Homo sapiens
gcaaauaaauuaugcaa

SEQ ID NO: 1969903 - RNA, 14 nt, Homo sapiens
aagcucauccauuu

SEQ ID NO: 1969904 - RNA, 18 nt, Homo sapiens
uaacuuggucagagccac

SEQ ID NO: 1969905 - RNA, 17 nt, Homo sapiens
caggcccacucaggggu

SEQ ID NO: 1969906 - RNA, 20 nt, Homo sapiens
aucccugcagccugguagaa

SEQ ID NO: 1969907 - RNA, 13 nt, Homo sapiens
aaccagcacauuc

SEQ ID NO: 1969908 - RNA, 21 nt, Homo sapiens
uuggucucccaauacaggcau

SEQ ID NO: 1969909 - RNA, 22 nt, Homo sapiens
cugaggauaccuuccaucucaa

SEQ ID NO: 1969910 - RNA, 23 nt, Homo sapiens
gccuguggcgccgucuccagggg

SEQ ID NO: 1969911 - RNA, 21 nt, Homo sapiens
guuucuggggacaccagccau

SEQ ID NO: 1969912 - RNA, 20 nt, Homo sapiens
guuuugauuuguagcacuga

SEQ ID NO: 1969913 - RNA, 14 nt, Homo sapiens
cuuugcaccaaaga

SEQ ID NO: 1969914 - RNA, 14 nt, Homo sapiens
ugaauuacagugaa

SEQ ID NO: 1969915 - RNA, 21 nt, Homo sapiens
uaaauggauaugggcuggaua

SEQ ID NO: 1969916 - RNA, 23 nt, Homo sapiens
aucauucuccuuguaaaagccua

SEQ ID NO: 1969917 - RNA, 21 nt, Homo sapiens
aucuuucuacagggcugacau

SEQ ID NO: 1969918 - RNA, 19 nt, Homo sapiens
aacacuuggcauacaaaau

SEQ ID NO: 1969919 - RNA, 13 nt, Homo sapiens
uuccucuacuuaa

SEQ ID NO: 1969920 - RNA, 15 nt, Homo sapiens
aauuccuaccucccu

SEQ ID NO: 1969921 - RNA, 12 nt, Homo sapiens
gaaacugaugcc

SEQ ID NO: 1969922 - RNA, 16 nt, Homo sapiens
caucaguauucugcca

SEQ ID NO: 1969923 - RNA, 20 nt, Homo sapiens
ccauuuuacagaagcauuuu

SEQ ID NO: 1969924 - RNA, 16 nt, Homo sapiens
auucgggccacagggc

SEQ ID NO: 1969925 - RNA, 22 nt, Homo sapiens
acgaagccuuauuucuagaagc

SEQ ID NO: 1969926 - RNA, 17 nt, Homo sapiens
caguuuaggaguacuga

SEQ ID NO: 1969927 - RNA, 13 nt, Homo sapiens
uagaaacugaguc

SEQ ID NO: 1969928 - RNA, 13 nt, Homo sapiens
guuucacuuuuaa

SEQ ID NO: 1969929 - RNA, 24 nt, Homo sapiens
cugccucgggaaccucacucuugc

SEQ ID NO: 1969930 - RNA, 14 nt, Homo sapiens
auuuaacauuuccu

SEQ ID NO: 1969931 - RNA, 22 nt, Homo sapiens
gaacucuucucauuacuuguug

SEQ ID NO: 1969932 - RNA, 15 nt, Homo sapiens
uucagcacacacaaa

SEQ ID NO: 1969933 - RNA, 18 nt, Homo sapiens
acaaagccuuugcuuugu

SEQ ID NO: 1969934 - RNA, 20 nt, Homo sapiens
auccuguguagcauacuggc

SEQ ID NO: 1969935 - RNA, 16 nt, Homo sapiens
gugcaaagacucugag

SEQ ID NO: 1969936 - RNA, 10 nt, Homo sapiens
gggucccugu

SEQ ID NO: 1969937 - RNA, 23 nt, Homo sapiens
uuaaaaaaaugggguuauagaag

SEQ ID NO: 1969938 - RNA, 23 nt, Homo sapiens
uuaaggauaaaucauaaagucag

SEQ ID NO: 1969939 - RNA, 13 nt, Homo sapiens
acccucuccagca

SEQ ID NO: 1969940 - RNA, 22 nt, Homo sapiens
cugcucaggcugcagcuggaca

SEQ ID NO: 1969941 - RNA, 17 nt, Homo sapiens
acauaugaucugucugu

SEQ ID NO: 1969942 - RNA, 16 nt, Homo sapiens
cccaugcgugcugaga

SEQ ID NO: 1969943 - RNA, 13 nt, Homo sapiens
ucccucuguccac

SEQ ID NO: 1969944 - RNA, 16 nt, Homo sapiens
uggcacagaugcccac

SEQ ID NO: 1969945 - RNA, 21 nt, Homo sapiens
agugaccauaaaggcauggca

SEQ ID NO: 1969946 - RNA, 16 nt, Homo sapiens
gacuguaaaugcucca

SEQ ID NO: 1969947 - RNA, 18 nt, Homo sapiens
guauuacaacaugaaaua

SEQ ID NO: 1969948 - RNA, 14 nt, Homo sapiens
auguugaggugacc

SEQ ID NO: 1969949 - RNA, 16 nt, Homo sapiens
ccugcuggugggcaug

SEQ ID NO: 1969950 - RNA, 16 nt, Homo sapiens
cugaacaaaagcucag

SEQ ID NO: 1969951 - RNA, 14 nt, Homo sapiens
uauauguacauaca

SEQ ID NO: 1969952 - RNA, 15 nt, Homo sapiens
cagccaccccugcca

SEQ ID NO: 1969953 - RNA, 23 nt, Homo sapiens
cauggguuauguguaugugccau

SEQ ID NO: 1969954 - RNA, 15 nt, Homo sapiens
gaugagaugacagau

SEQ ID NO: 1969955 - RNA, 17 nt, Homo sapiens
cuccucuccuaacauau

SEQ ID NO: 1969956 - RNA, 16 nt, Homo sapiens
uaugagagaacuauug

SEQ ID NO: 1969957 - RNA, 22 nt, Homo sapiens
uaggagguuccggugucuggaa

SEQ ID NO: 1969958 - RNA, 22 nt, Homo sapiens
cuuagugagcagugagcacuga

SEQ ID NO: 1969959 - RNA, 16 nt, Homo sapiens
gguucggccugugucc

SEQ ID NO: 1969960 - RNA, 14 nt, Homo sapiens
uauuaugcauauau

SEQ ID NO: 1969961 - RNA, 14 nt, Homo sapiens
ccacuuugcagcua

SEQ ID NO: 1969962 - RNA, 13 nt, Homo sapiens
ccccccaccacag

SEQ ID NO: 1969963 - RNA, 21 nt, Homo sapiens
ucugcuugcucccaagccccu

SEQ ID NO: 1969964 - RNA, 18 nt, Homo sapiens
cugagacaaagcaaugga

SEQ ID NO: 1969965 - RNA, 16 nt, Homo sapiens
cuuugguguaaucucu

SEQ ID NO: 1969966 - RNA, 15 nt, Homo sapiens
uuaacaaaugagcca

SEQ ID NO: 1969967 - RNA, 16 nt, Homo sapiens
cccagaaccuugaugg

SEQ ID NO: 1969968 - RNA, 15 nt, Homo sapiens
gucccgucgugcagu

SEQ ID NO: 1969969 - RNA, 23 nt, Homo sapiens
aaugugguuacuuccuacuguag

SEQ ID NO: 1969970 - RNA, 15 nt, Homo sapiens
uccuugugcaauugu

SEQ ID NO: 1969971 - RNA, 15 nt, Homo sapiens
cuuagcuuacaggaa

SEQ ID NO: 1969972 - RNA, 21 nt, Homo sapiens
aaacugugacugcagugcugu

SEQ ID NO: 1969973 - RNA, 15 nt, Homo sapiens
gaacugcuugcauuu

SEQ ID NO: 1969974 - RNA, 21 nt, Homo sapiens
acuguguaauuagugccacuu

SEQ ID NO: 1969975 - RNA, 16 nt, Homo sapiens
auuuugucccaucucu

SEQ ID NO: 1969976 - RNA, 15 nt, Homo sapiens
ucauacccaugcaca

SEQ ID NO: 1969977 - RNA, 18 nt, Homo sapiens
gcccuguucugggugcag

SEQ ID NO: 1969978 - RNA, 14 nt, Homo sapiens
ugaccuaaccacuu

SEQ ID NO: 1969979 - RNA, 15 nt, Homo sapiens
guauacccacugcau

SEQ ID NO: 1969980 - RNA, 21 nt, Homo sapiens
ccaucugauuuacuuaauuca

SEQ ID NO: 1969981 - RNA, 22 nt, Homo sapiens
aaaauugcuucuuuaccaagga

SEQ ID NO: 1969982 - RNA, 23 nt, Homo sapiens
aguuaugaaaaauaagucacuua

SEQ ID NO: 1969983 - RNA, 18 nt, Homo sapiens
ggcuggggccaccauccc

SEQ ID NO: 1969984 - RNA, 17 nt, Homo sapiens
gcacuucuuaacagaca

SEQ ID NO: 1969985 - RNA, 15 nt, Homo sapiens
augauuagugcaaua

SEQ ID NO: 1969986 - RNA, 14 nt, Homo sapiens
gaugggagaguaaa

SEQ ID NO: 1969987 - RNA, 13 nt, Homo sapiens
cuacuauauugau

SEQ ID NO: 1969988 - RNA, 19 nt, Homo sapiens
cuuggggauuucuggucaa

SEQ ID NO: 1969989 - RNA, 16 nt, Homo sapiens
aacaguaacugccauc

SEQ ID NO: 1969990 - RNA, 16 nt, Homo sapiens
uuaugacagugaacau

SEQ ID NO: 1969991 - RNA, 12 nt, Homo sapiens
acagaaacugca

SEQ ID NO: 1969992 - RNA, 14 nt, Homo sapiens
ccugucaaauauca

SEQ ID NO: 1969993 - RNA, 16 nt, Homo sapiens
ugcuagaacagucucu

SEQ ID NO: 1969994 - RNA, 19 nt, Homo sapiens
acaguccuucaaacuucca

SEQ ID NO: 1969995 - RNA, 22 nt, Homo sapiens
cugauugcagcacagagcagug

SEQ ID NO: 1969996 - RNA, 22 nt, Homo sapiens
cuaauuuuguacauacuguauu

SEQ ID NO: 1969997 - RNA, 14 nt, Homo sapiens
gaagaaagaacaca

SEQ ID NO: 1969998 - RNA, 16 nt, Homo sapiens
acucacaauuccaaac

SEQ ID NO: 1969999 - RNA, 13 nt, Homo sapiens
gaggccugugcua

SEQ ID NO: 1970000 - RNA, 18 nt, Homo sapiens
accagccacaguacauau

SEQ ID NO: 1970001 - RNA, 18 nt, Homo sapiens
agcugaauuaucuauaca

SEQ ID NO: 1970002 - RNA, 17 nt, Homo sapiens
ugccucaucacugcucc

SEQ ID NO: 1970003 - RNA, 20 nt, Homo sapiens
uucgagaagcugcucuggaa

SEQ ID NO: 1970004 - RNA, 17 nt, Homo sapiens
acccaaaaugugaauga

SEQ ID NO: 1970005 - RNA, 15 nt, Homo sapiens
aauuggguugugaaa

SEQ ID NO: 1970006 - RNA, 17 nt, Homo sapiens
acacaaugguagcucug

SEQ ID NO: 1970007 - RNA, 18 nt, Homo sapiens
caugucccauuuuagcca

SEQ ID NO: 1970008 - RNA, 17 nt, Homo sapiens
ccggaugaaacuucuca

SEQ ID NO: 1970009 - RNA, 17 nt, Homo sapiens
cugaugccaauacuagu

SEQ ID NO: 1970010 - RNA, 15 nt, Homo sapiens
aaaugaaaugcauuu

SEQ ID NO: 1970011 - RNA, 16 nt, Homo sapiens
gacauuaaaauaacua

SEQ ID NO: 1970012 - RNA, 23 nt, Homo sapiens
uacaguguacuuuguuaaaaaca

SEQ ID NO: 1970013 - RNA, 14 nt, Homo sapiens
cagcacacuggacu

SEQ ID NO: 1970014 - RNA, 15 nt, Homo sapiens
ugcugcagucaucua

SEQ ID NO: 1970015 - RNA, 11 nt, Homo sapiens
aacuccaucuc

SEQ ID NO: 1970016 - RNA, 18 nt, Homo sapiens
agggaguucaaaacauuc

SEQ ID NO: 1970017 - RNA, 16 nt, Homo sapiens
uacacggagugugcua

SEQ ID NO: 1970018 - RNA, 13 nt, Homo sapiens
aauugaaaaccaa

SEQ ID NO: 1970019 - RNA, 18 nt, Homo sapiens
aaggaaauacccuucuuu

SEQ ID NO: 1970020 - RNA, 13 nt, Homo sapiens
cagauuggaccag

SEQ ID NO: 1970021 - RNA, 17 nt, Homo sapiens
uaccuugaacacugggg

SEQ ID NO: 1970022 - RNA, 17 nt, Homo sapiens
gcccccggguguaaaua

SEQ ID NO: 1970023 - RNA, 13 nt, Homo sapiens
ggguucaccagcc

SEQ ID NO: 1970024 - RNA, 18 nt, Homo sapiens
gcuaacagaaauuaauuu

SEQ ID NO: 1970025 - RNA, 18 nt, Homo sapiens
ugcaguggugccaucacc

SEQ ID NO: 1970026 - RNA, 13 nt, Homo sapiens
ugauaaugagcag

SEQ ID NO: 1970027 - RNA, 18 nt, Homo sapiens
uccaauuguccaccccuu

SEQ ID NO: 1970028 - RNA, 16 nt, Homo sapiens
gccauucaacucggaa

SEQ ID NO: 1970029 - RNA, 20 nt, Homo sapiens
ccucccagaguauugggauu

SEQ ID NO: 1970030 - RNA, 21 nt, Homo sapiens
acuucaggucagguggcugug

SEQ ID NO: 1970031 - RNA, 19 nt, Homo sapiens
cucuuaagccuaaaugccu

SEQ ID NO: 1970032 - RNA, 15 nt, Homo sapiens
cugcauuguugaauu

SEQ ID NO: 1970033 - RNA, 15 nt, Homo sapiens
cuggugcccaccagc

SEQ ID NO: 1970034 - RNA, 18 nt, Homo sapiens
uggaagcaggacagacac

SEQ ID NO: 1970035 - RNA, 23 nt, Homo sapiens
acguagacugauggaacagaaua

SEQ ID NO: 1970036 - RNA, 18 nt, Homo sapiens
accccaggaaaagcacaa

SEQ ID NO: 1970037 - RNA, 23 nt, Homo sapiens
uuccauagcuucauccacugaau

SEQ ID NO: 1970038 - RNA, 19 nt, Homo sapiens
uaaacuuuuuuucaaugug

SEQ ID NO: 1970039 - RNA, 17 nt, Homo sapiens
uucccuuccacugccuc

SEQ ID NO: 1970040 - RNA, 20 nt, Homo sapiens
gggucucacaguguugccca

SEQ ID NO: 1970041 - RNA, 14 nt, Homo sapiens
auaacaacaacuua

SEQ ID NO: 1970042 - RNA, 12 nt, Homo sapiens
aucugaguuuag

SEQ ID NO: 1970043 - RNA, 18 nt, Homo sapiens
acuugcaagucccaugau

SEQ ID NO: 1970044 - RNA, 14 nt, Homo sapiens
cugaaccauuggaa

SEQ ID NO: 1970045 - RNA, 16 nt, Homo sapiens
agaugccagcuucucu

SEQ ID NO: 1970046 - RNA, 15 nt, Homo sapiens
acaaaagcaguuucu

SEQ ID NO: 1970047 - RNA, 20 nt, Homo sapiens
cucuaauuguccauucuugc

SEQ ID NO: 1970048 - RNA, 17 nt, Homo sapiens
ccuuauccagacagugg

SEQ ID NO: 1970049 - RNA, 13 nt, Homo sapiens
cuuuacuuucucu

SEQ ID NO: 1970050 - RNA, 13 nt, Homo sapiens
cuuuucuuucuca

SEQ ID NO: 1970051 - RNA, 19 nt, Homo sapiens
uagaucaggagaaacucgg

SEQ ID NO: 1970052 - RNA, 21 nt, Homo sapiens
cuuuuguggauugacaguagu

SEQ ID NO: 1970053 - RNA, 23 nt, Homo sapiens
caguguaaucccccaggagaaca

SEQ ID NO: 1970054 - RNA, 21 nt, Homo sapiens
guaaagaaaaaagcaccaaag

SEQ ID NO: 1970055 - RNA, 15 nt, Homo sapiens
ugaacucuccagcuu

SEQ ID NO: 1970056 - RNA, 23 nt, Homo sapiens
uccacagccaacaaacauagaaa

SEQ ID NO: 1970057 - RNA, 16 nt, Homo sapiens
accuauucacugcuua

SEQ ID NO: 1970058 - RNA, 15 nt, Homo sapiens
cagacggacgggaca

SEQ ID NO: 1970059 - RNA, 15 nt, Homo sapiens
agaaccaaaaagagg

SEQ ID NO: 1970060 - RNA, 15 nt, Homo sapiens
cccuuggacauuuua

SEQ ID NO: 1970061 - RNA, 17 nt, Homo sapiens
ccugacuaacagccuca

SEQ ID NO: 1970062 - RNA, 20 nt, Homo sapiens
uugugcacaagucuuuccag

SEQ ID NO: 1970063 - RNA, 14 nt, Homo sapiens
ucccaacauaugcc

SEQ ID NO: 1970064 - RNA, 15 nt, Homo sapiens
uggcaccgagacaau

SEQ ID NO: 1970065 - RNA, 18 nt, Homo sapiens
uguuuuaaaugaaccaaa

SEQ ID NO: 1970066 - RNA, 12 nt, Homo sapiens
aaccaaugcaag

SEQ ID NO: 1970067 - RNA, 13 nt, Homo sapiens
ucauccaucacag

SEQ ID NO: 1970068 - RNA, 21 nt, Homo sapiens
cucucccagugacaaccaaaa

SEQ ID NO: 1970069 - RNA, 20 nt, Homo sapiens
uacagccacuaauugccuua

SEQ ID NO: 1970070 - RNA, 17 nt, Homo sapiens
gcccggcugaguguacu

SEQ ID NO: 1970071 - RNA, 15 nt, Homo sapiens
cuggaaucccagcuc

SEQ ID NO: 1970072 - RNA, 15 nt, Homo sapiens
ucccaagaguauccu

SEQ ID NO: 1970073 - RNA, 15 nt, Homo sapiens
gaugaaacagggcac

SEQ ID NO: 1970074 - RNA, 19 nt, Homo sapiens
agcuaccccggccggccac

SEQ ID NO: 1970075 - RNA, 23 nt, Homo sapiens
gaagauauuacuacuuaccauuu

SEQ ID NO: 1970076 - RNA, 24 nt, Homo sapiens
cagccuggggcggugugugugcca

SEQ ID NO: 1970077 - RNA, 16 nt, Homo sapiens
cccugcuugcacuuug

SEQ ID NO: 1970078 - RNA, 15 nt, Homo sapiens
ugauuacugcucuau

SEQ ID NO: 1970079 - RNA, 16 nt, Homo sapiens
guucagauugcuuuga

SEQ ID NO: 1970080 - RNA, 19 nt, Homo sapiens
uaacugugacugaugacuu

SEQ ID NO: 1970081 - RNA, 18 nt, Homo sapiens
uggcagagacagugggca

SEQ ID NO: 1970082 - RNA, 23 nt, Homo sapiens
uaauacagccaaagauaaucucu

SEQ ID NO: 1970083 - RNA, 20 nt, Homo sapiens
acacaguggauuccagugca

SEQ ID NO: 1970084 - RNA, 17 nt, Homo sapiens
augccugguggcagcug

SEQ ID NO: 1970085 - RNA, 22 nt, Homo sapiens
uaaaaaaaaaauucuugcauau

SEQ ID NO: 1970086 - RNA, 15 nt, Homo sapiens
augaccuuugucuca

SEQ ID NO: 1970087 - RNA, 20 nt, Homo sapiens
aaacaccguguuuucugaca

SEQ ID NO: 1970088 - RNA, 15 nt, Homo sapiens
agauucccacugccg

SEQ ID NO: 1970089 - RNA, 15 nt, Homo sapiens
cgugccaccaugacu

SEQ ID NO: 1970090 - RNA, 15 nt, Homo sapiens
acuuuaaucacugcu

SEQ ID NO: 1970091 - RNA, 11 nt, Homo sapiens
auucacuuccc

SEQ ID NO: 1970092 - RNA, 21 nt, Homo sapiens
auuucagcuggagauacugau

SEQ ID NO: 1970093 - RNA, 19 nt, Homo sapiens
gagacaggaggucagcaca

SEQ ID NO: 1970094 - RNA, 14 nt, Homo sapiens
ucuucuuugcagcc

SEQ ID NO: 1970095 - RNA, 22 nt, Homo sapiens
cugucuucguauucccauuaga

SEQ ID NO: 1970096 - RNA, 21 nt, Homo sapiens
gaauaacauuuaaauuccaca

SEQ ID NO: 1970097 - RNA, 11 nt, Homo sapiens
auggcugccau

SEQ ID NO: 1970098 - RNA, 22 nt, Homo sapiens
uggccuauccgcugccagccuu

SEQ ID NO: 1970099 - RNA, 17 nt, Homo sapiens
caucaucuccugccuuc

SEQ ID NO: 1970100 - RNA, 13 nt, Homo sapiens
uucaggggcuccc

SEQ ID NO: 1970101 - RNA, 14 nt, Homo sapiens
uaaaacacaugaua

SEQ ID NO: 1970102 - RNA, 16 nt, Homo sapiens
uccugcuccucaggaa

SEQ ID NO: 1970103 - RNA, 19 nt, Homo sapiens
uauggaaauaaaaggcauu

SEQ ID NO: 1970104 - RNA, 12 nt, Homo sapiens
cgaacuuucaaa

SEQ ID NO: 1970105 - RNA, 17 nt, Homo sapiens
augcaggugcaaauggu

SEQ ID NO: 1970106 - RNA, 16 nt, Homo sapiens
agaugacauggugaaa

SEQ ID NO: 1970107 - RNA, 18 nt, Homo sapiens
caaaaucccuuaaucuau

SEQ ID NO: 1970108 - RNA, 16 nt, Homo sapiens
ugggacacagagaccc

SEQ ID NO: 1970109 - RNA, 19 nt, Homo sapiens
cagucuacugacuuuuccc

SEQ ID NO: 1970110 - RNA, 19 nt, Homo sapiens
agccucccaaguagcugag

SEQ ID NO: 1970111 - RNA, 21 nt, Homo sapiens
cacagaagggccuggaugcaa

SEQ ID NO: 1970112 - RNA, 19 nt, Homo sapiens
ccacgcagugugcuuaggg

SEQ ID NO: 1970113 - RNA, 20 nt, Homo sapiens
uaauguagauaaagcacugu

SEQ ID NO: 1970114 - RNA, 18 nt, Homo sapiens
uguuuggguauccugccc

SEQ ID NO: 1970115 - RNA, 15 nt, Homo sapiens
auggccacaaaggga

SEQ ID NO: 1970116 - RNA, 22 nt, Homo sapiens
acacaggggcccuguacaguga

SEQ ID NO: 1970117 - RNA, 22 nt, Homo sapiens
gucacacaaaauuaucaugaca

SEQ ID NO: 1970118 - RNA, 10 nt, Homo sapiens
uccacuguca

SEQ ID NO: 1970119 - RNA, 13 nt, Homo sapiens
uuaguaacauuca

SEQ ID NO: 1970120 - RNA, 21 nt, Homo sapiens
ccaggcuggucucaaacuccu

SEQ ID NO: 1970121 - RNA, 10 nt, Homo sapiens
aucaguugau

SEQ ID NO: 1970122 - RNA, 20 nt, Homo sapiens
ccucaguauuuauguaauuu

SEQ ID NO: 1970123 - RNA, 20 nt, Homo sapiens
aaacagccucuuugcccaaa

SEQ ID NO: 1970124 - RNA, 13 nt, Homo sapiens
gagggcuguggug

SEQ ID NO: 1970125 - RNA, 14 nt, Homo sapiens
cuguccuucuuaga

SEQ ID NO: 1970126 - RNA, 22 nt, Homo sapiens
ucccaccccaaccugcucuccu

SEQ ID NO: 1970127 - RNA, 13 nt, Homo sapiens
caaacuacugugu

SEQ ID NO: 1970128 - RNA, 22 nt, Homo sapiens
gccagagucaaugccuucaugg

SEQ ID NO: 1970129 - RNA, 14 nt, Homo sapiens
agcugccucacuuc

SEQ ID NO: 1970130 - RNA, 14 nt, Homo sapiens
acaguacagcaugu

SEQ ID NO: 1970131 - RNA, 19 nt, Homo sapiens
guguuacauauucuuucac

SEQ ID NO: 1970132 - RNA, 15 nt, Homo sapiens
cagcccccaaagagc

SEQ ID NO: 1970133 - RNA, 16 nt, Homo sapiens
gcugagauuacaggug

SEQ ID NO: 1970134 - RNA, 16 nt, Homo sapiens
agaaguggcauaaaug

SEQ ID NO: 1970135 - RNA, 14 nt, Homo sapiens
ucagcccaucucaa

SEQ ID NO: 1970136 - RNA, 20 nt, Homo sapiens
cuugacaguaaaucacacaa

SEQ ID NO: 1970137 - RNA, 15 nt, Homo sapiens
uuuggccuccuccag

SEQ ID NO: 1970138 - RNA, 17 nt, Homo sapiens
accuacuucagcaaugg

SEQ ID NO: 1970139 - RNA, 13 nt, Homo sapiens
gguccuacccauc

SEQ ID NO: 1970140 - RNA, 18 nt, Homo sapiens
agguaucaaaauguuguc

SEQ ID NO: 1970141 - RNA, 21 nt, Homo sapiens
agccucuuuguuccagaagcu

SEQ ID NO: 1970142 - RNA, 22 nt, Homo sapiens
caaaaaaaguuuguuacuuuga

SEQ ID NO: 1970143 - RNA, 20 nt, Homo sapiens
cugaaggugauucaccaaaa

SEQ ID NO: 1970144 - RNA, 20 nt, Homo sapiens
agcuuuuuguccuguaccca

SEQ ID NO: 1970145 - RNA, 17 nt, Homo sapiens
gcuuuccaucugaggac

SEQ ID NO: 1970146 - RNA, 13 nt, Homo sapiens
acagacacuuuaa

SEQ ID NO: 1970147 - RNA, 13 nt, Homo sapiens
acaagcacuuugg

SEQ ID NO: 1970148 - RNA, 20 nt, Homo sapiens
cauguaucacucacugccaa

SEQ ID NO: 1970149 - RNA, 19 nt, Homo sapiens
ccaaagacgaccagcauuu

SEQ ID NO: 1970150 - RNA, 10 nt, Homo sapiens
caaugauuca

SEQ ID NO: 1970151 - RNA, 17 nt, Homo sapiens
gcuggagaaaucuugaa

SEQ ID NO: 1970152 - RNA, 23 nt, Homo sapiens
uuuauggaccaauuagcauucca

SEQ ID NO: 1970153 - RNA, 20 nt, Homo sapiens
gaagguugguggggggucca

SEQ ID NO: 1970154 - RNA, 18 nt, Homo sapiens
cggaagcccuugccugaa

SEQ ID NO: 1970155 - RNA, 15 nt, Homo sapiens
auccugcaucugggu

SEQ ID NO: 1970156 - RNA, 21 nt, Homo sapiens
auuaaggguaggauguugcuu

SEQ ID NO: 1970157 - RNA, 18 nt, Homo sapiens
cagcagcacccacccaug

SEQ ID NO: 1970158 - RNA, 13 nt, Homo sapiens
uacucucuugcac

SEQ ID NO: 1970159 - RNA, 14 nt, Homo sapiens
ucuuaaaacaaauu

SEQ ID NO: 1970160 - RNA, 12 nt, Homo sapiens
uggauaugugua

SEQ ID NO: 1970161 - RNA, 15 nt, Homo sapiens
gccaugauguauauc

SEQ ID NO: 1970162 - RNA, 16 nt, Homo sapiens
ggccagugccauuuca

SEQ ID NO: 1970163 - RNA, 15 nt, Homo sapiens
auuuuauuaaacaca

SEQ ID NO: 1970164 - RNA, 16 nt, Homo sapiens
aggcagaggacagauc

SEQ ID NO: 1970165 - RNA, 17 nt, Homo sapiens
uagucauuaauguguaa

SEQ ID NO: 1970166 - RNA, 14 nt, Homo sapiens
acguuuugcacauu

SEQ ID NO: 1970167 - RNA, 18 nt, Homo sapiens
agaagaccacaccaagga

SEQ ID NO: 1970168 - RNA, 22 nt, Homo sapiens
uuauuucaaagggaaacuuuaa

SEQ ID NO: 1970169 - RNA, 20 nt, Homo sapiens
aucugucuugucauuccagg

SEQ ID NO: 1970170 - RNA, 20 nt, Homo sapiens
guaaaggaacagccccagug

SEQ ID NO: 1970171 - RNA, 15 nt, Homo sapiens
ucuagaauacuaaua

SEQ ID NO: 1970172 - RNA, 13 nt, Homo sapiens
auugcacuuuaug

SEQ ID NO: 1970173 - RNA, 23 nt, Homo sapiens
cuugacaccaaccagacagcaca

SEQ ID NO: 1970174 - RNA, 17 nt, Homo sapiens
gaugucuuugcugcagu

SEQ ID NO: 1970175 - RNA, 13 nt, Homo sapiens
aaacauguagaaa

SEQ ID NO: 1970176 - RNA, 19 nt, Homo sapiens
augagagauuuuccugaga

SEQ ID NO: 1970177 - RNA, 13 nt, Homo sapiens
ggauccagccacu

SEQ ID NO: 1970178 - RNA, 14 nt, Homo sapiens
uggagugagacuga

SEQ ID NO: 1970179 - RNA, 14 nt, Homo sapiens
gacugagauggagu

SEQ ID NO: 1970180 - RNA, 14 nt, Homo sapiens
uacgaaagugcaga

SEQ ID NO: 1970181 - RNA, 22 nt, Homo sapiens
aaacuaauuuaguaauagccug

SEQ ID NO: 1970182 - RNA, 16 nt, Homo sapiens
gagaauguucaucucu

SEQ ID NO: 1970183 - RNA, 23 nt, Homo sapiens
gcucuuucagagaggucucaggu

SEQ ID NO: 1970184 - RNA, 21 nt, Homo sapiens
acuuauauuaaauaaaugugc

SEQ ID NO: 1970185 - RNA, 15 nt, Homo sapiens
guaauagccaaaaag

SEQ ID NO: 1970186 - RNA, 17 nt, Homo sapiens
ugacgguguccaugccu

SEQ ID NO: 1970187 - RNA, 22 nt, Homo sapiens
auaacucuuuauuuuuugccau

SEQ ID NO: 1970188 - RNA, 16 nt, Homo sapiens
cuauuuccuaucauuu

SEQ ID NO: 1970189 - RNA, 18 nt, Homo sapiens
caugggcuacagugucug

SEQ ID NO: 1970190 - RNA, 20 nt, Homo sapiens
cugagcuuuguccugaagga

SEQ ID NO: 1970191 - RNA, 18 nt, Homo sapiens
ggagggaagggagccaag

SEQ ID NO: 1970192 - RNA, 12 nt, Homo sapiens
ucuguaccuuca

SEQ ID NO: 1970193 - RNA, 12 nt, Homo sapiens
cuugcuuucaca

SEQ ID NO: 1970194 - RNA, 20 nt, Homo sapiens
ucaauuccaccugcaaucaa

SEQ ID NO: 1970195 - RNA, 21 nt, Homo sapiens
gagaaaauuggaacucuacuc

SEQ ID NO: 1970196 - RNA, 20 nt, Homo sapiens
aguguguaucuagcuucuuc

SEQ ID NO: 1970197 - RNA, 19 nt, Homo sapiens
ucaggcacgucuccugcug

SEQ ID NO: 1970198 - RNA, 21 nt, Homo sapiens
guuacugcuguuuaggaauau

SEQ ID NO: 1970199 - RNA, 23 nt, Homo sapiens
augggcacugccgagaacagcau

SEQ ID NO: 1970200 - RNA, 18 nt, Homo sapiens
acaguaggauaagccacu

SEQ ID NO: 1970201 - RNA, 16 nt, Homo sapiens
gauaauagauucucuu

SEQ ID NO: 1970202 - RNA, 17 nt, Homo sapiens
aaugcuggcauuugcac

SEQ ID NO: 1970203 - RNA, 19 nt, Homo sapiens
guuuaagccagaguguauu

SEQ ID NO: 1970204 - RNA, 17 nt, Homo sapiens
gaagcaaagaagggaau

SEQ ID NO: 1970205 - RNA, 15 nt, Homo sapiens
gcggugaacauuucc

SEQ ID NO: 1970206 - RNA, 22 nt, Homo sapiens
uccaaaauaaauggacugaagu

SEQ ID NO: 1970207 - RNA, 21 nt, Homo sapiens
ccucuguucugcacacagcac

SEQ ID NO: 1970208 - RNA, 14 nt, Homo sapiens
auucucuccuguac

SEQ ID NO: 1970209 - RNA, 16 nt, Homo sapiens
agagaagccaucaccu

SEQ ID NO: 1970210 - RNA, 14 nt, Homo sapiens
guaaauuacauuaa

SEQ ID NO: 1970211 - RNA, 19 nt, Homo sapiens
aggugaguuuucaccucga

SEQ ID NO: 1970212 - RNA, 18 nt, Homo sapiens
gagguggccccaccugag

SEQ ID NO: 1970213 - RNA, 18 nt, Homo sapiens
aauuuuucuaaaggugcu

SEQ ID NO: 1970214 - RNA, 16 nt, Homo sapiens
gcauuggugacucacu

SEQ ID NO: 1970215 - RNA, 13 nt, Homo sapiens
aggggcccagugc

SEQ ID NO: 1970216 - RNA, 19 nt, Homo sapiens
aucugacauccccacucac

SEQ ID NO: 1970217 - RNA, 21 nt, Homo sapiens
uauucaauuugauucuaugac

SEQ ID NO: 1970218 - RNA, 18 nt, Homo sapiens
ugcuuaguaucucaucaa

SEQ ID NO: 1970219 - RNA, 23 nt, Homo sapiens
cuaacucuucuggaaaccaaaua

SEQ ID NO: 1970220 - RNA, 19 nt, Homo sapiens
uccacauuauacauuugau

SEQ ID NO: 1970221 - RNA, 18 nt, Homo sapiens
uggcuuccucugcugcau

SEQ ID NO: 1970222 - RNA, 13 nt, Homo sapiens
ugcccucucucag

SEQ ID NO: 1970223 - RNA, 14 nt, Homo sapiens
ccacgucugugcuc

SEQ ID NO: 1970224 - RNA, 12 nt, Homo sapiens
ugcaccaaagac

SEQ ID NO: 1970225 - RNA, 23 nt, Homo sapiens
uguaauaauggaagccaaaguau

SEQ ID NO: 1970226 - RNA, 22 nt, Homo sapiens
cuuuucagcgauguaugcagcu

SEQ ID NO: 1970227 - RNA, 15 nt, Homo sapiens
cagacuacacaggau

SEQ ID NO: 1970228 - RNA, 17 nt, Homo sapiens
guucaccucugccuugg

SEQ ID NO: 1970229 - RNA, 13 nt, Homo sapiens
cccauacagggca

SEQ ID NO: 1970230 - RNA, 18 nt, Homo sapiens
guauauuuuuaacugcuu

SEQ ID NO: 1970231 - RNA, 14 nt, Homo sapiens
ucaaguaccaaaac

SEQ ID NO: 1970232 - RNA, 16 nt, Homo sapiens
cccuagaugcacgugg

SEQ ID NO: 1970233 - RNA, 15 nt, Homo sapiens
aaacugcaccaguug

SEQ ID NO: 1970234 - RNA, 22 nt, Homo sapiens
cuuggugcgagggaagcaauug

SEQ ID NO: 1970235 - RNA, 14 nt, Homo sapiens
cugaccugguccac

SEQ ID NO: 1970236 - RNA, 23 nt, Homo sapiens
ugaaugagccaaaaugacuuuga

SEQ ID NO: 1970237 - RNA, 23 nt, Homo sapiens
gcugaccaggcgcccgggaucca

SEQ ID NO: 1970238 - RNA, 21 nt, Homo sapiens
caggaagcaggggguccccau

SEQ ID NO: 1970239 - RNA, 14 nt, Homo sapiens
aucagccuuuucag

SEQ ID NO: 1970240 - RNA, 15 nt, Homo sapiens
aggacaaaaugcaaa

SEQ ID NO: 1970241 - RNA, 17 nt, Homo sapiens
ccuauccacaauaguca

SEQ ID NO: 1970242 - RNA, 18 nt, Homo sapiens
ugcuccagugcaggagac

SEQ ID NO: 1970243 - RNA, 17 nt, Homo sapiens
ugagaucguuguuuaca

SEQ ID NO: 1970244 - RNA, 14 nt, Homo sapiens
guccuccagacaac

SEQ ID NO: 1970245 - RNA, 18 nt, Homo sapiens
agacugugugugcccucu

SEQ ID NO: 1970246 - RNA, 14 nt, Homo sapiens
auuuuaucugcuau

SEQ ID NO: 1970247 - RNA, 17 nt, Homo sapiens
guucacauuaacucagg

SEQ ID NO: 1970248 - RNA, 19 nt, Homo sapiens
gauuuuuaugccaccugaa

SEQ ID NO: 1970249 - RNA, 15 nt, Homo sapiens
ucaauggacuggaag

SEQ ID NO: 1970250 - RNA, 19 nt, Homo sapiens
uguuugucaaaaagucauu

SEQ ID NO: 1970251 - RNA, 14 nt, Homo sapiens
cuggucuucaauua

SEQ ID NO: 1970252 - RNA, 19 nt, Homo sapiens
gagcacauacuaccuagaa

SEQ ID NO: 1970253 - RNA, 13 nt, Homo sapiens
cugaauuucucag

SEQ ID NO: 1970254 - RNA, 18 nt, Homo sapiens
uuacaaagggggaggcua

SEQ ID NO: 1970255 - RNA, 14 nt, Homo sapiens
cccaaaggcaucca

SEQ ID NO: 1970256 - RNA, 21 nt, Homo sapiens
uauaccgcuaucauuccaaag

SEQ ID NO: 1970257 - RNA, 18 nt, Homo sapiens
guaagaaaagcugaugag

SEQ ID NO: 1970258 - RNA, 18 nt, Homo sapiens
gagaaggacggugccaag

SEQ ID NO: 1970259 - RNA, 18 nt, Homo sapiens
auguacaugaagaagcua

SEQ ID NO: 1970260 - RNA, 20 nt, Homo sapiens
ggaccuccucccucauucau

SEQ ID NO: 1970261 - RNA, 23 nt, Homo sapiens
uguauuuuugugaaguauucaca

SEQ ID NO: 1970262 - RNA, 13 nt, Homo sapiens
gugcauguuaaaa

SEQ ID NO: 1970263 - RNA, 22 nt, Homo sapiens
gaggccagggugcugacuguca

SEQ ID NO: 1970264 - RNA, 15 nt, Homo sapiens
uguguaacugcccaa

SEQ ID NO: 1970265 - RNA, 20 nt, Homo sapiens
guccagucucuccagcauca

SEQ ID NO: 1970266 - RNA, 16 nt, Homo sapiens
uguagugagcccagau

SEQ ID NO: 1970267 - RNA, 18 nt, Homo sapiens
aacucugacaagggcuga

SEQ ID NO: 1970268 - RNA, 20 nt, Homo sapiens
uacaucccagacacauucac

SEQ ID NO: 1970269 - RNA, 16 nt, Homo sapiens
gggucugggccagugc

SEQ ID NO: 1970270 - RNA, 23 nt, Homo sapiens
gccacaucccuauagaccacugg

SEQ ID NO: 1970271 - RNA, 14 nt, Homo sapiens
agaugggugcaacu

SEQ ID NO: 1970272 - RNA, 21 nt, Homo sapiens
gggagcccacaagauccaggc

SEQ ID NO: 1970273 - RNA, 15 nt, Homo sapiens
gacccugaggcccug

SEQ ID NO: 1970274 - RNA, 15 nt, Homo sapiens
aacaauaaagcaaua

SEQ ID NO: 1970275 - RNA, 15 nt, Homo sapiens
gagggugagggggug

SEQ ID NO: 1970276 - RNA, 15 nt, Homo sapiens
caagagugauugcag

SEQ ID NO: 1970277 - RNA, 22 nt, Homo sapiens
ggacgcacgcucgcugccauca

SEQ ID NO: 1970278 - RNA, 12 nt, Homo sapiens
gugaaaugugag

SEQ ID NO: 1970279 - RNA, 22 nt, Homo sapiens
agagaaccaugaaaacaaugcc

SEQ ID NO: 1970280 - RNA, 18 nt, Homo sapiens
gcaaaauuaaauacauaa

SEQ ID NO: 1970281 - RNA, 14 nt, Homo sapiens
ggccccaaaagccu

SEQ ID NO: 1970282 - RNA, 17 nt, Homo sapiens
accuaccuuacuauuua

SEQ ID NO: 1970283 - RNA, 20 nt, Homo sapiens
cugggggccugagagacccu

SEQ ID NO: 1970284 - RNA, 19 nt, Homo sapiens
cugcagaugaucagggauc

SEQ ID NO: 1970285 - RNA, 15 nt, Homo sapiens
ugcauauaugauggu

SEQ ID NO: 1970286 - RNA, 13 nt, Homo sapiens
gcaugugccaguu

SEQ ID NO: 1970287 - RNA, 21 nt, Homo sapiens
cuuccauuugugugugugcaa

SEQ ID NO: 1970288 - RNA, 13 nt, Homo sapiens
aauggaagcaauu

SEQ ID NO: 1970289 - RNA, 13 nt, Homo sapiens
ccaggaagacuuu

SEQ ID NO: 1970290 - RNA, 14 nt, Homo sapiens
cuugugguguaaag

SEQ ID NO: 1970291 - RNA, 14 nt, Homo sapiens
guugagccuaauau

SEQ ID NO: 1970292 - RNA, 17 nt, Homo sapiens
auggcccaucuguaugc

SEQ ID NO: 1970293 - RNA, 22 nt, Homo sapiens
caggugcugacuucaucuccca

SEQ ID NO: 1970294 - RNA, 20 nt, Homo sapiens
uacuggauuuaacuaccuuu

SEQ ID NO: 1970295 - RNA, 18 nt, Homo sapiens
aaacuguugguucaucca

SEQ ID NO: 1970296 - RNA, 17 nt, Homo sapiens
aucuccauauguuacac

SEQ ID NO: 1970297 - RNA, 15 nt, Homo sapiens
aucugagaaacaaug

SEQ ID NO: 1970298 - RNA, 20 nt, Homo sapiens
accuguaaucccagcacuuu

SEQ ID NO: 1970299 - RNA, 15 nt, Homo sapiens
aauaaauuccuacaa

SEQ ID NO: 1970300 - RNA, 22 nt, Homo sapiens
uccacagugacugggcccuguc

SEQ ID NO: 1970301 - RNA, 18 nt, Homo sapiens
accacaggcagcauuuag

SEQ ID NO: 1970302 - RNA, 22 nt, Homo sapiens
cuugccucugcucugugcacuc

SEQ ID NO: 1970303 - RNA, 23 nt, Homo sapiens
cucaaaaauccuuaugcaugaaa

SEQ ID NO: 1970304 - RNA, 14 nt, Homo sapiens
acuucaaagaagcu

SEQ ID NO: 1970305 - RNA, 18 nt, Homo sapiens
aagcgugguggacaugca

SEQ ID NO: 1970306 - RNA, 14 nt, Homo sapiens
cauuggaagcuuug

SEQ ID NO: 1970307 - RNA, 19 nt, Homo sapiens
ugagaaguacuuuaccuga

SEQ ID NO: 1970308 - RNA, 17 nt, Homo sapiens
acuugcuuaaauugugg

SEQ ID NO: 1970309 - RNA, 18 nt, Homo sapiens
augcacaauuccaugaau

SEQ ID NO: 1970310 - RNA, 19 nt, Homo sapiens
uccauaguaguaugaugau

SEQ ID NO: 1970311 - RNA, 13 nt, Homo sapiens
gcuuuguuuggau

SEQ ID NO: 1970312 - RNA, 20 nt, Homo sapiens
cuagccgcgugugacagucu

SEQ ID NO: 1970313 - RNA, 22 nt, Homo sapiens
ccugaucauggucagcucacac

SEQ ID NO: 1970314 - RNA, 19 nt, Homo sapiens
gccuacacccgucuugggg

SEQ ID NO: 1970315 - RNA, 18 nt, Homo sapiens
ccugccauggacacuuca

SEQ ID NO: 1970316 - RNA, 12 nt, Homo sapiens
agccuugcacua

SEQ ID NO: 1970317 - RNA, 23 nt, Homo sapiens
gaagcagggaauuccugggguaa

SEQ ID NO: 1970318 - RNA, 15 nt, Homo sapiens
gucaggcaauugauu

SEQ ID NO: 1970319 - RNA, 18 nt, Homo sapiens
caacaucuggucuuccag

SEQ ID NO: 1970320 - RNA, 16 nt, Homo sapiens
ggcuacacucaucuga

SEQ ID NO: 1970321 - RNA, 18 nt, Homo sapiens
ucaaauuuuaucaugcca

SEQ ID NO: 1970322 - RNA, 16 nt, Homo sapiens
ggguacaaaaagucaa

SEQ ID NO: 1970323 - RNA, 13 nt, Homo sapiens
gacacaucaggaa

SEQ ID NO: 1970324 - RNA, 18 nt, Homo sapiens
augugucuuuacaccucg

SEQ ID NO: 1970325 - RNA, 19 nt, Homo sapiens
acagggcaugcauuuugca

SEQ ID NO: 1970326 - RNA, 18 nt, Homo sapiens
ucuaagucuccaagaaua

SEQ ID NO: 1970327 - RNA, 16 nt, Homo sapiens
caacuuacugucuucu

SEQ ID NO: 1970328 - RNA, 14 nt, Homo sapiens
cccacagcuguaug

SEQ ID NO: 1970329 - RNA, 22 nt, Homo sapiens
aggauucuuuaaucauggagca

SEQ ID NO: 1970330 - RNA, 17 nt, Homo sapiens
aucccagcucacugcag

SEQ ID NO: 1970331 - RNA, 10 nt, Homo sapiens
ccacagugaa

SEQ ID NO: 1970332 - RNA, 19 nt, Homo sapiens
ccuucuuugcugcugcuuc

SEQ ID NO: 1970333 - RNA, 20 nt, Homo sapiens
cuaguacuaugucaaagcaa

SEQ ID NO: 1970334 - RNA, 16 nt, Homo sapiens
gaaaggcauucucuga

SEQ ID NO: 1970335 - RNA, 17 nt, Homo sapiens
auuaacauuuugagcua

SEQ ID NO: 1970336 - RNA, 22 nt, Homo sapiens
cgugggucacuacagggagaaa

SEQ ID NO: 1970337 - RNA, 21 nt, Homo sapiens
gaugauggcucauuuacacuc

SEQ ID NO: 1970338 - RNA, 20 nt, Homo sapiens
uccuuaaauaugugaaagga

SEQ ID NO: 1970339 - RNA, 18 nt, Homo sapiens
cucauggagggggcugca

SEQ ID NO: 1970340 - RNA, 21 nt, Homo sapiens
cucccacucuccuaggcauuc

SEQ ID NO: 1970341 - RNA, 21 nt, Homo sapiens
ccagccccuccagcaccacuu

SEQ ID NO: 1970342 - RNA, 14 nt, Homo sapiens
gccgggcaggcgug

SEQ ID NO: 1970343 - RNA, 13 nt, Homo sapiens
uguguugccaaag

SEQ ID NO: 1970344 - RNA, 21 nt, Homo sapiens
aaaauuaagaaauucacuucc

SEQ ID NO: 1970345 - RNA, 15 nt, Homo sapiens
uucuguagugccaug

SEQ ID NO: 1970346 - RNA, 15 nt, Homo sapiens
guuuugcuuaggcac

SEQ ID NO: 1970347 - RNA, 22 nt, Homo sapiens
agcuuaggcauucuaagucaca

SEQ ID NO: 1970348 - RNA, 13 nt, Homo sapiens
ugcccacuggaga

SEQ ID NO: 1970349 - RNA, 18 nt, Homo sapiens
aucaccuuaggcagggaa

SEQ ID NO: 1970350 - RNA, 18 nt, Homo sapiens
aaacuuuaucucacaggg

SEQ ID NO: 1970351 - RNA, 22 nt, Homo sapiens
acauggacaugcuucagugcug

SEQ ID NO: 1970352 - RNA, 20 nt, Homo sapiens
aaagaaggagaugaauagaa

SEQ ID NO: 1970353 - RNA, 17 nt, Homo sapiens
caugccaguaacugugc

SEQ ID NO: 1970354 - RNA, 11 nt, Homo sapiens
uccaugucucg

SEQ ID NO: 1970355 - RNA, 14 nt, Homo sapiens
aaaaucguuuugcc

SEQ ID NO: 1970356 - RNA, 20 nt, Homo sapiens
agaugggcaaagcugugcac

SEQ ID NO: 1970357 - RNA, 17 nt, Homo sapiens
ucacaucagcaauuuca

SEQ ID NO: 1970358 - RNA, 15 nt, Homo sapiens
ucguugccucugauu

SEQ ID NO: 1970359 - RNA, 16 nt, Homo sapiens
agauacauuucaucug

SEQ ID NO: 1970360 - RNA, 19 nt, Homo sapiens
cuguguuuucgaugaugau

SEQ ID NO: 1970361 - RNA, 13 nt, Homo sapiens
aguucccaugacu

SEQ ID NO: 1970362 - RNA, 17 nt, Homo sapiens
guuuuaaaauacuauau

SEQ ID NO: 1970363 - RNA, 21 nt, Homo sapiens
cagccucacuccauuucccac

SEQ ID NO: 1970364 - RNA, 13 nt, Homo sapiens
uuuaauuaucuaa

SEQ ID NO: 1970365 - RNA, 13 nt, Homo sapiens
cuucauuaccuca

SEQ ID NO: 1970366 - RNA, 13 nt, Homo sapiens
ccagcuuacuagc

SEQ ID NO: 1970367 - RNA, 20 nt, Homo sapiens
uuaauacugacucagugucu

SEQ ID NO: 1970368 - RNA, 21 nt, Homo sapiens
acccuagggauuugcacuaaa

SEQ ID NO: 1970369 - RNA, 17 nt, Homo sapiens
uccucauccccacaauc

SEQ ID NO: 1970370 - RNA, 11 nt, Homo sapiens
ccugcccaguc

SEQ ID NO: 1970371 - RNA, 21 nt, Homo sapiens
uggugaagaguaguuuacuag

SEQ ID NO: 1970372 - RNA, 21 nt, Homo sapiens
ugccauugacuucuucccaag

SEQ ID NO: 1970373 - RNA, 19 nt, Homo sapiens
agguaaggagggucacugg

SEQ ID NO: 1970374 - RNA, 20 nt, Homo sapiens
uauuuaauuuuaacugccaa

SEQ ID NO: 1970375 - RNA, 20 nt, Homo sapiens
uaguugagaaagaagagaag

SEQ ID NO: 1970376 - RNA, 20 nt, Homo sapiens
gaacuuucuggucccuucag

SEQ ID NO: 1970377 - RNA, 19 nt, Homo sapiens
ucuuccccuaaugccuauc

SEQ ID NO: 1970378 - RNA, 15 nt, Homo sapiens
augaggaaacugagu

SEQ ID NO: 1970379 - RNA, 21 nt, Homo sapiens
auucacuuuguuuaugcauau

SEQ ID NO: 1970380 - RNA, 18 nt, Homo sapiens
ucugcaggccaccagcug

SEQ ID NO: 1970381 - RNA, 12 nt, Homo sapiens
gcaaaguggaau

SEQ ID NO: 1970382 - RNA, 16 nt, Homo sapiens
aguuuucuaauuugca

SEQ ID NO: 1970383 - RNA, 15 nt, Homo sapiens
auuuggaaacuaaua

SEQ ID NO: 1970384 - RNA, 17 nt, Homo sapiens
uuacuuuucugccaaaa

SEQ ID NO: 1970385 - RNA, 16 nt, Homo sapiens
aauuauuuugacaaau

SEQ ID NO: 1970386 - RNA, 17 nt, Homo sapiens
cugaagaucaagccagu

SEQ ID NO: 1970387 - RNA, 23 nt, Homo sapiens
ccucuuucuuucuuuuguguugg

SEQ ID NO: 1970388 - RNA, 13 nt, Homo sapiens
cagcuuugcucau

SEQ ID NO: 1970389 - RNA, 13 nt, Homo sapiens
gucccuuggagac

SEQ ID NO: 1970390 - RNA, 22 nt, Homo sapiens
aucuuuggcaaaggucccugag

SEQ ID NO: 1970391 - RNA, 19 nt, Homo sapiens
aaacuuguacuuacacuga

SEQ ID NO: 1970392 - RNA, 16 nt, Homo sapiens
gaaaacagacccuccc

SEQ ID NO: 1970393 - RNA, 16 nt, Homo sapiens
cugcauguaaaaucuu

SEQ ID NO: 1970394 - RNA, 22 nt, Homo sapiens
aacucagagucggaacggagaa

SEQ ID NO: 1970395 - RNA, 12 nt, Homo sapiens
uccuaaaccauu

SEQ ID NO: 1970396 - RNA, 18 nt, Homo sapiens
aucugacaugauuccuuc

SEQ ID NO: 1970397 - RNA, 13 nt, Homo sapiens
cuguccuaccaau

SEQ ID NO: 1970398 - RNA, 17 nt, Homo sapiens
agccaaccaacagagaa

SEQ ID NO: 1970399 - RNA, 12 nt, Homo sapiens
cuucugccugag

SEQ ID NO: 1970400 - RNA, 15 nt, Homo sapiens
uuaaauacauaugga

SEQ ID NO: 1970401 - RNA, 16 nt, Homo sapiens
ucucgcuacauuuccg

SEQ ID NO: 1970402 - RNA, 15 nt, Homo sapiens
agugcaguggcacaa

SEQ ID NO: 1970403 - RNA, 13 nt, Homo sapiens
cauuacaguucuu

SEQ ID NO: 1970404 - RNA, 15 nt, Homo sapiens
ccccuuccuagugaa

SEQ ID NO: 1970405 - RNA, 16 nt, Homo sapiens
augccaagcacugugc

SEQ ID NO: 1970406 - RNA, 21 nt, Homo sapiens
ccuaacuguucccuuaucugu

SEQ ID NO: 1970407 - RNA, 23 nt, Homo sapiens
caccuuccucugccuuuguucac

SEQ ID NO: 1970408 - RNA, 17 nt, Homo sapiens
auagcuuaagaaguauc

SEQ ID NO: 1970409 - RNA, 18 nt, Homo sapiens
aacuagguuuuaauaauu

SEQ ID NO: 1970410 - RNA, 15 nt, Homo sapiens
auucacuaaggacuu

SEQ ID NO: 1970411 - RNA, 13 nt, Homo sapiens
agauucuaaagau

SEQ ID NO: 1970412 - RNA, 23 nt, Homo sapiens
cacuucccuguuuauaaaaccuc

SEQ ID NO: 1970413 - RNA, 22 nt, Homo sapiens
aucacugcccuuuuugaaauca

SEQ ID NO: 1970414 - RNA, 16 nt, Homo sapiens
ccucacucagcaccac

SEQ ID NO: 1970415 - RNA, 18 nt, Homo sapiens
aagcuaguuaaugucagu

SEQ ID NO: 1970416 - RNA, 20 nt, Homo sapiens
aauggguacaauguacauua

SEQ ID NO: 1970417 - RNA, 23 nt, Homo sapiens
uguucaucucagcuuuucugucc

SEQ ID NO: 1970418 - RNA, 13 nt, Homo sapiens
accaaugcuguug

SEQ ID NO: 1970419 - RNA, 20 nt, Homo sapiens
auugcuguguccaacuccag

SEQ ID NO: 1970420 - RNA, 21 nt, Homo sapiens
cacuauuuaaaauaagcacac

SEQ ID NO: 1970421 - RNA, 18 nt, Homo sapiens
ucucucccccucugucuc

SEQ ID NO: 1970422 - RNA, 23 nt, Homo sapiens
ucucuaucccaagccaaccaaga

SEQ ID NO: 1970423 - RNA, 17 nt, Homo sapiens
agaauugaaaaaccauu

SEQ ID NO: 1970424 - RNA, 22 nt, Homo sapiens
acagggcaugccuggccugagg

SEQ ID NO: 1970425 - RNA, 13 nt, Homo sapiens
acuuacccucacc

SEQ ID NO: 1970426 - RNA, 20 nt, Homo sapiens
uccccgagggcgaaggccau

SEQ ID NO: 1970427 - RNA, 19 nt, Homo sapiens
gccuggagccccacugccc

SEQ ID NO: 1970428 - RNA, 21 nt, Homo sapiens
cuagaauuugggcuuggacca

SEQ ID NO: 1970429 - RNA, 13 nt, Homo sapiens
accuaccaucagg

SEQ ID NO: 1970430 - RNA, 14 nt, Homo sapiens
uguuuuagauaucc

SEQ ID NO: 1970431 - RNA, 21 nt, Homo sapiens
acaguuggauuuauucugcca

SEQ ID NO: 1970432 - RNA, 22 nt, Homo sapiens
aacauaugucacgaacuugaaa

SEQ ID NO: 1970433 - RNA, 22 nt, Homo sapiens
cucuaagccacucuuccaaagg

SEQ ID NO: 1970434 - RNA, 17 nt, Homo sapiens
aguaauucuagcuuuca

SEQ ID NO: 1970435 - RNA, 15 nt, Homo sapiens
aauuaauaaauguca

SEQ ID NO: 1970436 - RNA, 18 nt, Homo sapiens
ggugcggcugcagcucac

SEQ ID NO: 1970437 - RNA, 14 nt, Homo sapiens
agagaccuuggcug

SEQ ID NO: 1970438 - RNA, 14 nt, Homo sapiens
augaaagugcgaua

SEQ ID NO: 1970439 - RNA, 14 nt, Homo sapiens
acugcgcgcggggc

SEQ ID NO: 1970440 - RNA, 15 nt, Homo sapiens
ugcauuuugcuauug

SEQ ID NO: 1970441 - RNA, 13 nt, Homo sapiens
ugcaguaguauuu

SEQ ID NO: 1970442 - RNA, 19 nt, Homo sapiens
cguucagcugugacgaagg

SEQ ID NO: 1970443 - RNA, 11 nt, Homo sapiens
cagcugucauc

SEQ ID NO: 1970444 - RNA, 15 nt, Homo sapiens
gcaugcucagcccuu

SEQ ID NO: 1970445 - RNA, 18 nt, Homo sapiens
caaacucaaguuauguca

SEQ ID NO: 1970446 - RNA, 23 nt, Homo sapiens
ccauuccaaaguucuuaucucua

SEQ ID NO: 1970447 - RNA, 23 nt, Homo sapiens
uaaauagcuagacuggugacuga

SEQ ID NO: 1970448 - RNA, 15 nt, Homo sapiens
ucuuguuucccagau

SEQ ID NO: 1970449 - RNA, 16 nt, Homo sapiens
ggacauggcugacuuu

SEQ ID NO: 1970450 - RNA, 18 nt, Homo sapiens
accacugggcaaacagaa

SEQ ID NO: 1970451 - RNA, 20 nt, Homo sapiens
augaaacagggcaccccagc

SEQ ID NO: 1970452 - RNA, 20 nt, Homo sapiens
gaucugagcucccaccuccc

SEQ ID NO: 1970453 - RNA, 17 nt, Homo sapiens
cugcucauuacaguucu

SEQ ID NO: 1970454 - RNA, 18 nt, Homo sapiens
aaaugacccaaagaccaa

SEQ ID NO: 1970455 - RNA, 15 nt, Homo sapiens
uuugauucagcaaaa

SEQ ID NO: 1970456 - RNA, 21 nt, Homo sapiens
cagggucucacucuguugacc

SEQ ID NO: 1970457 - RNA, 23 nt, Homo sapiens
ccauggcccccaauaaaggcagc

SEQ ID NO: 1970458 - RNA, 13 nt, Homo sapiens
uaggcugcugcug

SEQ ID NO: 1970459 - RNA, 21 nt, Homo sapiens
aguguaagauuuuguuugcau

SEQ ID NO: 1970460 - RNA, 22 nt, Homo sapiens
cugccugguaugaguugcccau

SEQ ID NO: 1970461 - RNA, 22 nt, Homo sapiens
guguaugugcgugugugcaagu

SEQ ID NO: 1970462 - RNA, 17 nt, Homo sapiens
guggacaugcgugacca

SEQ ID NO: 1970463 - RNA, 18 nt, Homo sapiens
uuggagugcgggugggcu

SEQ ID NO: 1970464 - RNA, 15 nt, Homo sapiens
acagcagccuggggc

SEQ ID NO: 1970465 - RNA, 17 nt, Homo sapiens
gugaggagguucacuga

SEQ ID NO: 1970466 - RNA, 22 nt, Homo sapiens
caccaaguucuggaaaccacgu

SEQ ID NO: 1970467 - RNA, 17 nt, Homo sapiens
aucacgacgcugcagag

SEQ ID NO: 1970468 - RNA, 20 nt, Homo sapiens
augaaaccccguuucuacua

SEQ ID NO: 1970469 - RNA, 19 nt, Homo sapiens
cguuccuauugucauuaaa

SEQ ID NO: 1970470 - RNA, 22 nt, Homo sapiens
aauuuuaaauguucacaacaua

SEQ ID NO: 1970471 - RNA, 15 nt, Homo sapiens
cuuuucaccaaugag

SEQ ID NO: 1970472 - RNA, 19 nt, Homo sapiens
cacuuugcaaagacagugu

SEQ ID NO: 1970473 - RNA, 24 nt, Homo sapiens
auuaauaugcuacaguacuaugua

SEQ ID NO: 1970474 - RNA, 22 nt, Homo sapiens
aacaaugccgccugucaauaaa

SEQ ID NO: 1970475 - RNA, 14 nt, Homo sapiens
aguagggaccugcc

SEQ ID NO: 1970476 - RNA, 15 nt, Homo sapiens
cuuacuuaguguuau

SEQ ID NO: 1970477 - RNA, 13 nt, Homo sapiens
gaaauaaagcaca

SEQ ID NO: 1970478 - RNA, 17 nt, Homo sapiens
ucucacuagcacaugga

SEQ ID NO: 1970479 - RNA, 19 nt, Homo sapiens
ucuagccuggcaacagagc

SEQ ID NO: 1970480 - RNA, 15 nt, Homo sapiens
cagauguaaaugcca

SEQ ID NO: 1970481 - RNA, 16 nt, Homo sapiens
accagguuaccucacu

SEQ ID NO: 1970482 - RNA, 16 nt, Homo sapiens
cuguacaucagacaga

SEQ ID NO: 1970483 - RNA, 15 nt, Homo sapiens
aggaaaggcacauua

SEQ ID NO: 1970484 - RNA, 22 nt, Homo sapiens
uauuaauugccuuugagguuau

SEQ ID NO: 1970485 - RNA, 14 nt, Homo sapiens
acugacauggugcu

SEQ ID NO: 1970486 - RNA, 17 nt, Homo sapiens
accuacuuucauacuga

SEQ ID NO: 1970487 - RNA, 22 nt, Homo sapiens
auuaauccugcauuugcagaug

SEQ ID NO: 1970488 - RNA, 13 nt, Homo sapiens
uuaauuuuugcaa

SEQ ID NO: 1970489 - RNA, 12 nt, Homo sapiens
uaaugaaagcac

SEQ ID NO: 1970490 - RNA, 21 nt, Homo sapiens
uggacugucuaugaacuugca

SEQ ID NO: 1970491 - RNA, 13 nt, Homo sapiens
cccacuccagaag

SEQ ID NO: 1970492 - RNA, 14 nt, Homo sapiens
guagcucuguccac

SEQ ID NO: 1970493 - RNA, 14 nt, Homo sapiens
ccagcccuccccau

SEQ ID NO: 1970494 - RNA, 22 nt, Homo sapiens
ugaaucccucuaucucuaaaga

SEQ ID NO: 1970495 - RNA, 21 nt, Homo sapiens
uaaaaugauuuuaucugugaa

SEQ ID NO: 1970496 - RNA, 14 nt, Homo sapiens
gucacaucucaggg

SEQ ID NO: 1970497 - RNA, 18 nt, Homo sapiens
ucagccaaaacauaccau

SEQ ID NO: 1970498 - RNA, 13 nt, Homo sapiens
auagaugcugcug

SEQ ID NO: 1970499 - RNA, 17 nt, Homo sapiens
aguugguuuaaugauug

SEQ ID NO: 1970500 - RNA, 15 nt, Homo sapiens
uauguaacagccaaa

SEQ ID NO: 1970501 - RNA, 20 nt, Homo sapiens
cuugaguugccugaugcuca

SEQ ID NO: 1970502 - RNA, 13 nt, Homo sapiens
uaaacuauauucu

SEQ ID NO: 1970503 - RNA, 14 nt, Homo sapiens
aauuagacaucuuc

SEQ ID NO: 1970504 - RNA, 13 nt, Homo sapiens
uacaucacuuugu

SEQ ID NO: 1970505 - RNA, 16 nt, Homo sapiens
acaagaacacugaaaa

SEQ ID NO: 1970506 - RNA, 16 nt, Homo sapiens
acagaugugcugacaa

SEQ ID NO: 1970507 - RNA, 17 nt, Homo sapiens
auugucuugguugccag

SEQ ID NO: 1970508 - RNA, 11 nt, Homo sapiens
gcuaucucugu

SEQ ID NO: 1970509 - RNA, 18 nt, Homo sapiens
cugucuguuacacuggag

SEQ ID NO: 1970510 - RNA, 17 nt, Homo sapiens
ccuggugcugagugcac

SEQ ID NO: 1970511 - RNA, 20 nt, Homo sapiens
aacuuggagccccagugcca

SEQ ID NO: 1970512 - RNA, 19 nt, Homo sapiens
ccucaaaugucagagcuau

SEQ ID NO: 1970513 - RNA, 14 nt, Homo sapiens
ucugaaccaugugg

SEQ ID NO: 1970514 - RNA, 17 nt, Homo sapiens
cacucauuccuucacuc

SEQ ID NO: 1970515 - RNA, 14 nt, Homo sapiens
uaacuaugcuguua

SEQ ID NO: 1970516 - RNA, 15 nt, Homo sapiens
cuuguuugucuucca

SEQ ID NO: 1970517 - RNA, 16 nt, Homo sapiens
cguggaaagggugcug

SEQ ID NO: 1970518 - RNA, 20 nt, Homo sapiens
auuuucagaaaauauuaugu

SEQ ID NO: 1970519 - RNA, 23 nt, Homo sapiens
aguuuuauccccugccuaaugcu

SEQ ID NO: 1970520 - RNA, 12 nt, Homo sapiens
cuucuguuccag

SEQ ID NO: 1970521 - RNA, 14 nt, Homo sapiens
cccucuucccagaa

SEQ ID NO: 1970522 - RNA, 21 nt, Homo sapiens
aggcaggcgggggcugcucag

SEQ ID NO: 1970523 - RNA, 14 nt, Homo sapiens
uaucuuucgugaua

SEQ ID NO: 1970524 - RNA, 15 nt, Homo sapiens
aacauaauucucuca

SEQ ID NO: 1970525 - RNA, 14 nt, Homo sapiens
cauuccuguauuca

SEQ ID NO: 1970526 - RNA, 14 nt, Homo sapiens
cugccauguugccc

SEQ ID NO: 1970527 - RNA, 23 nt, Homo sapiens
ccauauggagcuuuuccugaugu

SEQ ID NO: 1970528 - RNA, 18 nt, Homo sapiens
cucacugggacuuuguaa

SEQ ID NO: 1970529 - RNA, 17 nt, Homo sapiens
cgugaccuugcaauguu

SEQ ID NO: 1970530 - RNA, 13 nt, Homo sapiens
ggaaagccaguga

SEQ ID NO: 1970531 - RNA, 16 nt, Homo sapiens
uauaugucagugauga

SEQ ID NO: 1970532 - RNA, 22 nt, Homo sapiens
uuauuuugucacccaaccuggc

SEQ ID NO: 1970533 - RNA, 16 nt, Homo sapiens
uugcccuuuccauauu

SEQ ID NO: 1970534 - RNA, 13 nt, Homo sapiens
ggaagaguguuuc

SEQ ID NO: 1970535 - RNA, 22 nt, Homo sapiens
ucaccaucaauuuuaguuguca

SEQ ID NO: 1970536 - RNA, 14 nt, Homo sapiens
acauugccaaaaag

SEQ ID NO: 1970537 - RNA, 14 nt, Homo sapiens
aaccuggagaugau

SEQ ID NO: 1970538 - RNA, 18 nt, Homo sapiens
uuuaauaauuaugugcca

SEQ ID NO: 1970539 - RNA, 20 nt, Homo sapiens
aaacagaauuuuccauuuau

SEQ ID NO: 1970540 - RNA, 20 nt, Homo sapiens
ccaaaaaauaaacacuuccu

SEQ ID NO: 1970541 - RNA, 23 nt, Homo sapiens
aacccagccucuagaacagccag

SEQ ID NO: 1970542 - RNA, 13 nt, Homo sapiens
gcucaaucucagg

SEQ ID NO: 1970543 - RNA, 14 nt, Homo sapiens
auuuaucugaauau

SEQ ID NO: 1970544 - RNA, 23 nt, Homo sapiens
ucaacacagugaaacuccaucuc

SEQ ID NO: 1970545 - RNA, 22 nt, Homo sapiens
agauuuggaugcacucauuuaa

SEQ ID NO: 1970546 - RNA, 16 nt, Homo sapiens
uuagaugaugacucaa

SEQ ID NO: 1970547 - RNA, 14 nt, Homo sapiens
ugugacuguggcau

SEQ ID NO: 1970548 - RNA, 12 nt, Homo sapiens
uagaaugugauu

SEQ ID NO: 1970549 - RNA, 14 nt, Homo sapiens
uuuccucagucucc

SEQ ID NO: 1970550 - RNA, 17 nt, Homo sapiens
uuuaaagaagugcauga

SEQ ID NO: 1970551 - RNA, 12 nt, Homo sapiens
cacucucaggug

SEQ ID NO: 1970552 - RNA, 20 nt, Homo sapiens
acucugagugcaaacuucag

SEQ ID NO: 1970553 - RNA, 18 nt, Homo sapiens
cugccagaagacucacug

SEQ ID NO: 1970554 - RNA, 18 nt, Homo sapiens
uauauuuguaaagcuauu

SEQ ID NO: 1970555 - RNA, 23 nt, Homo sapiens
uguggagcuaaggacacagugga

SEQ ID NO: 1970556 - RNA, 11 nt, Homo sapiens
uaucugucaca

SEQ ID NO: 1970557 - RNA, 15 nt, Homo sapiens
cacugcacagagcuc

SEQ ID NO: 1970558 - RNA, 17 nt, Homo sapiens
aauuuucuaauuaaaga

SEQ ID NO: 1970559 - RNA, 19 nt, Homo sapiens
uccuggggcacaagugucu

SEQ ID NO: 1970560 - RNA, 17 nt, Homo sapiens
ucuugauucauaaugac

SEQ ID NO: 1970561 - RNA, 22 nt, Homo sapiens
ggaugugaacaaccugcucaca

SEQ ID NO: 1970562 - RNA, 12 nt, Homo sapiens
gagaaugccauu

SEQ ID NO: 1970563 - RNA, 17 nt, Homo sapiens
ugggcuuuugaacugua

SEQ ID NO: 1970564 - RNA, 12 nt, Homo sapiens
uaagagccuuaa

SEQ ID NO: 1970565 - RNA, 13 nt, Homo sapiens
gccucaccucuca

SEQ ID NO: 1970566 - RNA, 20 nt, Homo sapiens
gaaauuccauacuucucuca

SEQ ID NO: 1970567 - RNA, 17 nt, Homo sapiens
ucacuaucuguaaugcc

SEQ ID NO: 1970568 - RNA, 15 nt, Homo sapiens
auucugugaccaaaa

SEQ ID NO: 1970569 - RNA, 17 nt, Homo sapiens
acuuuaccaugcucaau

SEQ ID NO: 1970570 - RNA, 17 nt, Homo sapiens
agacuagauucucaccu

SEQ ID NO: 1970571 - RNA, 19 nt, Homo sapiens
uccauugguuuaccuguga

SEQ ID NO: 1970572 - RNA, 22 nt, Homo sapiens
cuuaaagcacugauaggacuua

SEQ ID NO: 1970573 - RNA, 21 nt, Homo sapiens
aaggcuucucuccacaguguu

SEQ ID NO: 1970574 - RNA, 24 nt, Homo sapiens
cuguuuuugaagaagggaaauuca

SEQ ID NO: 1970575 - RNA, 17 nt, Homo sapiens
acauccaacuccagcaa

SEQ ID NO: 1970576 - RNA, 22 nt, Homo sapiens
caaucaacagaaaagcuguaaa

SEQ ID NO: 1970577 - RNA, 12 nt, Homo sapiens
ggccuccaugac

SEQ ID NO: 1970578 - RNA, 12 nt, Homo sapiens
ucccuccagcac

SEQ ID NO: 1970579 - RNA, 23 nt, Homo sapiens
agaccacuauucuuaacuauuca

SEQ ID NO: 1970580 - RNA, 21 nt, Homo sapiens
agaccauucaggacacaggga

SEQ ID NO: 1970581 - RNA, 21 nt, Homo sapiens
cagcugugcacuuucuucucu

SEQ ID NO: 1970582 - RNA, 23 nt, Homo sapiens
augucuuaaugaaguuugaaugu

SEQ ID NO: 1970583 - RNA, 16 nt, Homo sapiens
cccuggggcugugcau

SEQ ID NO: 1970584 - RNA, 21 nt, Homo sapiens
acccuggcuucuccccacugu

SEQ ID NO: 1970585 - RNA, 15 nt, Homo sapiens
ccauuaauccaggga

SEQ ID NO: 1970586 - RNA, 20 nt, Homo sapiens
ugagaagaucggaacagcuc

SEQ ID NO: 1970587 - RNA, 21 nt, Homo sapiens
gaaccacgucugcuaacuugg

SEQ ID NO: 1970588 - RNA, 22 nt, Homo sapiens
aguaucuagcaaucacaacacu

SEQ ID NO: 1970589 - RNA, 15 nt, Homo sapiens
uaucuauagcugcua

SEQ ID NO: 1970590 - RNA, 15 nt, Homo sapiens
cagcaacugaccuga

SEQ ID NO: 1970591 - RNA, 23 nt, Homo sapiens
caguagcagccuacaacugaaua

SEQ ID NO: 1970592 - RNA, 23 nt, Homo sapiens
aucauguauggugauagguaucu

SEQ ID NO: 1970593 - RNA, 15 nt, Homo sapiens
ugaagcccucugucu

SEQ ID NO: 1970594 - RNA, 22 nt, Homo sapiens
cuugcccagccuggaugccauc

SEQ ID NO: 1970595 - RNA, 21 nt, Homo sapiens
aguggcccccacccucagccc

SEQ ID NO: 1970596 - RNA, 19 nt, Homo sapiens
cacccuuuacuccccagag

SEQ ID NO: 1970597 - RNA, 20 nt, Homo sapiens
cuuuggugacuucacaguga

SEQ ID NO: 1970598 - RNA, 15 nt, Homo sapiens
gaaagugaugacaua

SEQ ID NO: 1970599 - RNA, 19 nt, Homo sapiens
uaugcaaaucagucucaca

SEQ ID NO: 1970600 - RNA, 12 nt, Homo sapiens
gccugaccuccc

SEQ ID NO: 1970601 - RNA, 14 nt, Homo sapiens
gaauccucagagag

SEQ ID NO: 1970602 - RNA, 19 nt, Homo sapiens
auauaaagauuaacacuca

SEQ ID NO: 1970603 - RNA, 18 nt, Homo sapiens
guagaucuucaauuugga

SEQ ID NO: 1970604 - RNA, 12 nt, Homo sapiens
agacagauacua

SEQ ID NO: 1970605 - RNA, 14 nt, Homo sapiens
ucccaccccuaccu

SEQ ID NO: 1970606 - RNA, 15 nt, Homo sapiens
cuaggugucugggau

SEQ ID NO: 1970607 - RNA, 22 nt, Homo sapiens
uucaaaaaguaaucauauauca

SEQ ID NO: 1970608 - RNA, 15 nt, Homo sapiens
uguacuuccaccucc

SEQ ID NO: 1970609 - RNA, 17 nt, Homo sapiens
cagagguuugagaccga

SEQ ID NO: 1970610 - RNA, 22 nt, Homo sapiens
acaugcacaguuugcaaucuua

SEQ ID NO: 1970611 - RNA, 19 nt, Homo sapiens
gccucccuguucacgguga

SEQ ID NO: 1970612 - RNA, 14 nt, Homo sapiens
agagaaugugaaca

SEQ ID NO: 1970613 - RNA, 17 nt, Homo sapiens
cuuucuuuaccugagac

SEQ ID NO: 1970614 - RNA, 13 nt, Homo sapiens
augguaugaucaa

SEQ ID NO: 1970615 - RNA, 17 nt, Homo sapiens
uggcagcucagcuuccc

SEQ ID NO: 1970616 - RNA, 22 nt, Homo sapiens
aacaaaaccuacacacauaccu

SEQ ID NO: 1970617 - RNA, 21 nt, Homo sapiens
cuaucaucauccuacaacuca

SEQ ID NO: 1970618 - RNA, 18 nt, Homo sapiens
uuagaaguagaauugaca

SEQ ID NO: 1970619 - RNA, 13 nt, Homo sapiens
cacccgacuccag

SEQ ID NO: 1970620 - RNA, 15 nt, Homo sapiens
auaaagagaacucug

SEQ ID NO: 1970621 - RNA, 16 nt, Homo sapiens
ggguugcuugggccac

SEQ ID NO: 1970622 - RNA, 17 nt, Homo sapiens
gcugugaaagaaccaaa

SEQ ID NO: 1970623 - RNA, 22 nt, Homo sapiens
caauacuaggaaguaaagugaa

SEQ ID NO: 1970624 - RNA, 15 nt, Homo sapiens
uagccauaugcaaua

SEQ ID NO: 1970625 - RNA, 17 nt, Homo sapiens
uucuauuucucuuccua

SEQ ID NO: 1970626 - RNA, 15 nt, Homo sapiens
agcugaaaggaugau

SEQ ID NO: 1970627 - RNA, 15 nt, Homo sapiens
ugcuauuucacucua

SEQ ID NO: 1970628 - RNA, 14 nt, Homo sapiens
agcccggggccagc

SEQ ID NO: 1970629 - RNA, 15 nt, Homo sapiens
cuucuacagaagcca

SEQ ID NO: 1970630 - RNA, 21 nt, Homo sapiens
agcacucccaagucuacagag

SEQ ID NO: 1970631 - RNA, 19 nt, Homo sapiens
ucccaccacagucccucac

SEQ ID NO: 1970632 - RNA, 13 nt, Homo sapiens
uaagaaaauucua

SEQ ID NO: 1970633 - RNA, 20 nt, Homo sapiens
guacugagguugggcugaga

SEQ ID NO: 1970634 - RNA, 20 nt, Homo sapiens
cacuccgcgccgaugccacc

SEQ ID NO: 1970635 - RNA, 16 nt, Homo sapiens
ugucagugcugccagu

SEQ ID NO: 1970636 - RNA, 17 nt, Homo sapiens
cuuugccucucuugcca

SEQ ID NO: 1970637 - RNA, 16 nt, Homo sapiens
auaauuauuacauggu

SEQ ID NO: 1970638 - RNA, 17 nt, Homo sapiens
aucuuaucauggucuca

SEQ ID NO: 1970639 - RNA, 14 nt, Homo sapiens
uaaaauuucacuua

SEQ ID NO: 1970640 - RNA, 19 nt, Homo sapiens
gaacauugauuucauugaa

SEQ ID NO: 1970641 - RNA, 17 nt, Homo sapiens
cacauucccaucuguca

SEQ ID NO: 1970642 - RNA, 20 nt, Homo sapiens
aguucauggauauccacuga

SEQ ID NO: 1970643 - RNA, 16 nt, Homo sapiens
uuauaguccuccugga

SEQ ID NO: 1970644 - RNA, 15 nt, Homo sapiens
agguugaaacauauc

SEQ ID NO: 1970645 - RNA, 17 nt, Homo sapiens
guaauaaaaagccucuu

SEQ ID NO: 1970646 - RNA, 19 nt, Homo sapiens
aggcuggagugcaguggcu

SEQ ID NO: 1970647 - RNA, 18 nt, Homo sapiens
ugaauguaaacucggggg

SEQ ID NO: 1970648 - RNA, 19 nt, Homo sapiens
acccaggguggagugcagu

SEQ ID NO: 1970649 - RNA, 13 nt, Homo sapiens
aauuugucuuaaa

SEQ ID NO: 1970650 - RNA, 14 nt, Homo sapiens
cucugaugcagcuu

SEQ ID NO: 1970651 - RNA, 19 nt, Homo sapiens
acaguguuuuuccuuggau

SEQ ID NO: 1970652 - RNA, 20 nt, Homo sapiens
uuccagcuaagccugaugau

SEQ ID NO: 1970653 - RNA, 22 nt, Homo sapiens
cuugcaauccaggcuguucuca

SEQ ID NO: 1970654 - RNA, 15 nt, Homo sapiens
cacuacaugaugacu

SEQ ID NO: 1970655 - RNA, 18 nt, Homo sapiens
gcaauuucagaaccaaaa

SEQ ID NO: 1970656 - RNA, 12 nt, Homo sapiens
acacugugaugu

SEQ ID NO: 1970657 - RNA, 13 nt, Homo sapiens
uaguagcaaugug

SEQ ID NO: 1970658 - RNA, 13 nt, Homo sapiens
uuaaggcaaaaaa

SEQ ID NO: 1970659 - RNA, 19 nt, Homo sapiens
acuccuguaggaagguuaa

SEQ ID NO: 1970660 - RNA, 19 nt, Homo sapiens
uaucuuugucuuaucuacc

SEQ ID NO: 1970661 - RNA, 13 nt, Homo sapiens
auauucaugaaga

SEQ ID NO: 1970662 - RNA, 11 nt, Homo sapiens
aguaacaugug

SEQ ID NO: 1970663 - RNA, 13 nt, Homo sapiens
aagguaauacuuu

SEQ ID NO: 1970664 - RNA, 16 nt, Homo sapiens
cugagagacccaagga

SEQ ID NO: 1970665 - RNA, 21 nt, Homo sapiens
ugaucaauauuuuuauaucau

SEQ ID NO: 1970666 - RNA, 19 nt, Homo sapiens
uaaauuuccccaacagugu

SEQ ID NO: 1970667 - RNA, 14 nt, Homo sapiens
guggaaaagaaaua

SEQ ID NO: 1970668 - RNA, 19 nt, Homo sapiens
cagcuaauucaggucauuu

SEQ ID NO: 1970669 - RNA, 14 nt, Homo sapiens
cauugcugcauauu

SEQ ID NO: 1970670 - RNA, 16 nt, Homo sapiens
agacagacauacauag

SEQ ID NO: 1970671 - RNA, 20 nt, Homo sapiens
cucaugccucuaaucucagc

SEQ ID NO: 1970672 - RNA, 17 nt, Homo sapiens
uccaacuggagcucucc

SEQ ID NO: 1970673 - RNA, 11 nt, Homo sapiens
cccucuuccaa

SEQ ID NO: 1970674 - RNA, 20 nt, Homo sapiens
uaaaacuucuuuaguacuua

SEQ ID NO: 1970675 - RNA, 20 nt, Homo sapiens
aggagauguggucaauggaa

SEQ ID NO: 1970676 - RNA, 17 nt, Homo sapiens
uguucacucagcacuuu

SEQ ID NO: 1970677 - RNA, 20 nt, Homo sapiens
cuccuagccacccaccacac

SEQ ID NO: 1970678 - RNA, 21 nt, Homo sapiens
ggagggacuuuuaaucaguga

SEQ ID NO: 1970679 - RNA, 17 nt, Homo sapiens
gaaggauccaucuuugu

SEQ ID NO: 1970680 - RNA, 16 nt, Homo sapiens
aaauuaaaaccugaua

SEQ ID NO: 1970681 - RNA, 15 nt, Homo sapiens
aaauagucucauuca

SEQ ID NO: 1970682 - RNA, 17 nt, Homo sapiens
gcauguucauugcaaac

SEQ ID NO: 1970683 - RNA, 14 nt, Homo sapiens
gucaaccaggaaca

SEQ ID NO: 1970684 - RNA, 15 nt, Homo sapiens
ucuauccacacuguc

SEQ ID NO: 1970685 - RNA, 17 nt, Homo sapiens
ccccgggagacucaaag

SEQ ID NO: 1970686 - RNA, 18 nt, Homo sapiens
agacuguaagcuccauga

SEQ ID NO: 1970687 - RNA, 13 nt, Homo sapiens
cugugcacauucu

SEQ ID NO: 1970688 - RNA, 15 nt, Homo sapiens
ucccugagcucuugc

SEQ ID NO: 1970689 - RNA, 16 nt, Homo sapiens
ccugcugggacugaga

SEQ ID NO: 1970690 - RNA, 23 nt, Homo sapiens
agauugcucuggggcuugcuauu

SEQ ID NO: 1970691 - RNA, 14 nt, Homo sapiens
uucauauucucaga

SEQ ID NO: 1970692 - RNA, 21 nt, Homo sapiens
agacucucucugggaggccau

SEQ ID NO: 1970693 - RNA, 13 nt, Homo sapiens
auccauuccucuu

SEQ ID NO: 1970694 - RNA, 13 nt, Homo sapiens
aaucauuccauuu

SEQ ID NO: 1970695 - RNA, 18 nt, Homo sapiens
ucgccccaguggcacuga

SEQ ID NO: 1970696 - RNA, 15 nt, Homo sapiens
auagaaugucaauau

SEQ ID NO: 1970697 - RNA, 13 nt, Homo sapiens
auaggacugagug

SEQ ID NO: 1970698 - RNA, 21 nt, Homo sapiens
ugaggcccauucuucacucuu

SEQ ID NO: 1970699 - RNA, 20 nt, Homo sapiens
cagggugggaucagcccugc

SEQ ID NO: 1970700 - RNA, 19 nt, Homo sapiens
aaggucugcacuccuuuau

SEQ ID NO: 1970701 - RNA, 22 nt, Homo sapiens
cagacaucgguguucuucuucc

SEQ ID NO: 1970702 - RNA, 17 nt, Homo sapiens
auacugcauuuacagug

SEQ ID NO: 1970703 - RNA, 17 nt, Homo sapiens
acuguagcgaccccaga

SEQ ID NO: 1970704 - RNA, 22 nt, Homo sapiens
ccuugucguaggaaaaccauga

SEQ ID NO: 1970705 - RNA, 12 nt, Homo sapiens
uuucuuccugca

SEQ ID NO: 1970706 - RNA, 15 nt, Homo sapiens
uccauaauaaacuuc

SEQ ID NO: 1970707 - RNA, 15 nt, Homo sapiens
gcuuauuacauuuaa

SEQ ID NO: 1970708 - RNA, 16 nt, Homo sapiens
ucccugcuaccaaggc

SEQ ID NO: 1970709 - RNA, 15 nt, Homo sapiens
cgguggcucaugccu

SEQ ID NO: 1970710 - RNA, 16 nt, Homo sapiens
ccaggcaggcaaaggc

SEQ ID NO: 1970711 - RNA, 22 nt, Homo sapiens
uagcagcagggagggcuucugc

SEQ ID NO: 1970712 - RNA, 16 nt, Homo sapiens
acuaguuuuacuuuga

SEQ ID NO: 1970713 - RNA, 16 nt, Homo sapiens
aagcaaaacugcaaau

SEQ ID NO: 1970714 - RNA, 15 nt, Homo sapiens
aaauccuuacuucca

SEQ ID NO: 1970715 - RNA, 17 nt, Homo sapiens
aaacaaucuuccaaaga

SEQ ID NO: 1970716 - RNA, 15 nt, Homo sapiens
gagugugugucuuuc

SEQ ID NO: 1970717 - RNA, 15 nt, Homo sapiens
uguggaauuaccuga

SEQ ID NO: 1970718 - RNA, 20 nt, Homo sapiens
caacugcucucaaaauguga

SEQ ID NO: 1970719 - RNA, 20 nt, Homo sapiens
acgacuucugcccauucucu

SEQ ID NO: 1970720 - RNA, 17 nt, Homo sapiens
cccugggccucagccuc

SEQ ID NO: 1970721 - RNA, 16 nt, Homo sapiens
uaagaaagaucaaaga

SEQ ID NO: 1970722 - RNA, 22 nt, Homo sapiens
cauuuaacugccuuacagacag

SEQ ID NO: 1970723 - RNA, 19 nt, Homo sapiens
ccuaaugagagugcacugc

SEQ ID NO: 1970724 - RNA, 14 nt, Homo sapiens
uaaauggacaaugg

SEQ ID NO: 1970725 - RNA, 20 nt, Homo sapiens
caccgagaagaggcggcaga

SEQ ID NO: 1970726 - RNA, 17 nt, Homo sapiens
cugaccuugcacaaacu

SEQ ID NO: 1970727 - RNA, 21 nt, Homo sapiens
uuucuaaauaaggaauuuccu

SEQ ID NO: 1970728 - RNA, 20 nt, Homo sapiens
gaagaccuaaaugaccucag

SEQ ID NO: 1970729 - RNA, 16 nt, Homo sapiens
uacacugccuuaccuu

SEQ ID NO: 1970730 - RNA, 17 nt, Homo sapiens
ccagcucagggcucuuu

SEQ ID NO: 1970731 - RNA, 16 nt, Homo sapiens
aagacacguucuugcc

SEQ ID NO: 1970732 - RNA, 21 nt, Homo sapiens
gcaauugaaggaucaucugaa

SEQ ID NO: 1970733 - RNA, 15 nt, Homo sapiens
ggccagcagcaccug

SEQ ID NO: 1970734 - RNA, 19 nt, Homo sapiens
agcucccgaggaagcacag

SEQ ID NO: 1970735 - RNA, 17 nt, Homo sapiens
cuauuuauguucaucuu

SEQ ID NO: 1970736 - RNA, 15 nt, Homo sapiens
cuugcacauauuuga

SEQ ID NO: 1970737 - RNA, 22 nt, Homo sapiens
aacaaucuaauuaaauggcauc

SEQ ID NO: 1970738 - RNA, 15 nt, Homo sapiens
cccagggaaugccag

SEQ ID NO: 1970739 - RNA, 18 nt, Homo sapiens
gcagccaaguagccucuc

SEQ ID NO: 1970740 - RNA, 16 nt, Homo sapiens
cuacacucacaaucau

SEQ ID NO: 1970741 - RNA, 19 nt, Homo sapiens
auccuagcuacuuggcagg

SEQ ID NO: 1970742 - RNA, 13 nt, Homo sapiens
ugauuugcaacuu

SEQ ID NO: 1970743 - RNA, 15 nt, Homo sapiens
uaagcaugacagaaa

SEQ ID NO: 1970744 - RNA, 12 nt, Homo sapiens
acaugugcacau

SEQ ID NO: 1970745 - RNA, 12 nt, Homo sapiens
cauagugccaua

SEQ ID NO: 1970746 - RNA, 15 nt, Homo sapiens
ggguuggacaucucu

SEQ ID NO: 1970747 - RNA, 15 nt, Homo sapiens
uacaucaauaagcuc

SEQ ID NO: 1970748 - RNA, 13 nt, Homo sapiens
uuuaugcauguau

SEQ ID NO: 1970749 - RNA, 13 nt, Homo sapiens
uucuagcaugcua

SEQ ID NO: 1970750 - RNA, 14 nt, Homo sapiens
ugaaacuuaggaag

SEQ ID NO: 1970751 - RNA, 19 nt, Homo sapiens
uaaaugaacaaaaacauca

SEQ ID NO: 1970752 - RNA, 16 nt, Homo sapiens
cucuuagaagccaugg

SEQ ID NO: 1970753 - RNA, 22 nt, Homo sapiens
auuuucuccgaaaggcaaaaau

SEQ ID NO: 1970754 - RNA, 20 nt, Homo sapiens
aauucacagaauagcacaaa

SEQ ID NO: 1970755 - RNA, 13 nt, Homo sapiens
acucuguugaaua

SEQ ID NO: 1970756 - RNA, 20 nt, Homo sapiens
cucgcuuccgcauccuaguc

SEQ ID NO: 1970757 - RNA, 18 nt, Homo sapiens
cagccaugccucaugcca

SEQ ID NO: 1970758 - RNA, 22 nt, Homo sapiens
uaguugugcaugccuggcacaa

SEQ ID NO: 1970759 - RNA, 17 nt, Homo sapiens
gacucugucacaaaggg

SEQ ID NO: 1970760 - RNA, 17 nt, Homo sapiens
uuucuguguguuccugg

SEQ ID NO: 1970761 - RNA, 18 nt, Homo sapiens
acaguugaaagcuguauu

SEQ ID NO: 1970762 - RNA, 21 nt, Homo sapiens
ucccacccaacagcucagaga

SEQ ID NO: 1970763 - RNA, 15 nt, Homo sapiens
uaccucaacugguca

SEQ ID NO: 1970764 - RNA, 19 nt, Homo sapiens
auccaggaggcaguggaca

SEQ ID NO: 1970765 - RNA, 21 nt, Homo sapiens
acuaacuccugagaaauguua

SEQ ID NO: 1970766 - RNA, 19 nt, Homo sapiens
cccagugggcauagucagu

SEQ ID NO: 1970767 - RNA, 19 nt, Homo sapiens
aguuaagagguuuguauau

SEQ ID NO: 1970768 - RNA, 20 nt, Homo sapiens
acagaaggaggaaguggaag

SEQ ID NO: 1970769 - RNA, 13 nt, Homo sapiens
cacuggacacuuc

SEQ ID NO: 1970770 - RNA, 23 nt, Homo sapiens
uaacauuucuuugugaaagguaa

SEQ ID NO: 1970771 - RNA, 18 nt, Homo sapiens
augguuagaaccagcaga

SEQ ID NO: 1970772 - RNA, 17 nt, Homo sapiens
gcucugauccgagcuca

SEQ ID NO: 1970773 - RNA, 16 nt, Homo sapiens
gucauuucagcucuug

SEQ ID NO: 1970774 - RNA, 21 nt, Homo sapiens
agagguuugguuuccuguguc

SEQ ID NO: 1970775 - RNA, 21 nt, Homo sapiens
caagauuuuuuaauuguuuaa

SEQ ID NO: 1970776 - RNA, 15 nt, Homo sapiens
agcaaacccaaagau

SEQ ID NO: 1970777 - RNA, 17 nt, Homo sapiens
uuugaaauaaagaacca

SEQ ID NO: 1970778 - RNA, 14 nt, Homo sapiens
ccaauuuacauacu

SEQ ID NO: 1970779 - RNA, 23 nt, Homo sapiens
guacucaguuaggcagugcagua

SEQ ID NO: 1970780 - RNA, 12 nt, Homo sapiens
ccugacuuugac

SEQ ID NO: 1970781 - RNA, 20 nt, Homo sapiens
auaagaaacaugaugugaga

SEQ ID NO: 1970782 - RNA, 20 nt, Homo sapiens
ccuuuccagucauuucaaua

SEQ ID NO: 1970783 - RNA, 17 nt, Homo sapiens
acaugacaacuuugcca

SEQ ID NO: 1970784 - RNA, 16 nt, Homo sapiens
aguaauguuaauucuu

SEQ ID NO: 1970785 - RNA, 17 nt, Homo sapiens
ucccuggacuucuggga

SEQ ID NO: 1970786 - RNA, 15 nt, Homo sapiens
cauggcuggugccug

SEQ ID NO: 1970787 - RNA, 18 nt, Homo sapiens
cuucaaaugauccuuccu

SEQ ID NO: 1970788 - RNA, 14 nt, Homo sapiens
cccuaagauugaaa

SEQ ID NO: 1970789 - RNA, 13 nt, Homo sapiens
uaaccuaccucgc

SEQ ID NO: 1970790 - RNA, 15 nt, Homo sapiens
ugacuaaaaaugcau

SEQ ID NO: 1970791 - RNA, 22 nt, Homo sapiens
auuuuaggaaacucuccaugau

SEQ ID NO: 1970792 - RNA, 23 nt, Homo sapiens
uaauacuugaccucugugaccaa

SEQ ID NO: 1970793 - RNA, 13 nt, Homo sapiens
agagaccuuugcc

SEQ ID NO: 1970794 - RNA, 15 nt, Homo sapiens
gaaaaugacucuggg

SEQ ID NO: 1970795 - RNA, 24 nt, Homo sapiens
uaagcagaagacucuccacugacc

SEQ ID NO: 1970796 - RNA, 14 nt, Homo sapiens
cacugcucauuugg

SEQ ID NO: 1970797 - RNA, 20 nt, Homo sapiens
uucauuauuggaauuaaccu

SEQ ID NO: 1970798 - RNA, 19 nt, Homo sapiens
augccaacaagaaugcauu

SEQ ID NO: 1970799 - RNA, 12 nt, Homo sapiens
augagccuuagu

SEQ ID NO: 1970800 - RNA, 20 nt, Homo sapiens
ugaagcaaguuaacacucua

SEQ ID NO: 1970801 - RNA, 21 nt, Homo sapiens
cucuguagcugcuagugagcc

SEQ ID NO: 1970802 - RNA, 23 nt, Homo sapiens
ccugucagcuccuugaccuauga

SEQ ID NO: 1970803 - RNA, 20 nt, Homo sapiens
gccugugcgccgggggaccu

SEQ ID NO: 1970804 - RNA, 18 nt, Homo sapiens
cacacugugcguuuuaga

SEQ ID NO: 1970805 - RNA, 17 nt, Homo sapiens
agucuugaaacaagcaa

SEQ ID NO: 1970806 - RNA, 21 nt, Homo sapiens
acucaaucucugauucuguca

SEQ ID NO: 1970807 - RNA, 13 nt, Homo sapiens
uggaauuucuugu

SEQ ID NO: 1970808 - RNA, 23 nt, Homo sapiens
uagaggaauccauguaaauugca

SEQ ID NO: 1970809 - RNA, 15 nt, Homo sapiens
ucgccacaaacucua

SEQ ID NO: 1970810 - RNA, 18 nt, Homo sapiens
ccuucaaagcaaaugucu

SEQ ID NO: 1970811 - RNA, 17 nt, Homo sapiens
uggauaaccacagggcu

SEQ ID NO: 1970812 - RNA, 23 nt, Homo sapiens
cuaugucgucguuuucaccagca

SEQ ID NO: 1970813 - RNA, 15 nt, Homo sapiens
ccgggguguggaauc

SEQ ID NO: 1970814 - RNA, 16 nt, Homo sapiens
ugugcaucuguacuca

SEQ ID NO: 1970815 - RNA, 21 nt, Homo sapiens
auuuauacucacugagucuua

SEQ ID NO: 1970816 - RNA, 14 nt, Homo sapiens
auaugucugauaau

SEQ ID NO: 1970817 - RNA, 16 nt, Homo sapiens
ucaauaaaucuuucaa

SEQ ID NO: 1970818 - RNA, 18 nt, Homo sapiens
uccccuguggucuuggaa

SEQ ID NO: 1970819 - RNA, 13 nt, Homo sapiens
aauucaaauccau

SEQ ID NO: 1970820 - RNA, 19 nt, Homo sapiens
cguuuaaucccagcacuuu

SEQ ID NO: 1970821 - RNA, 19 nt, Homo sapiens
cccugauaguuucccauaa

SEQ ID NO: 1970822 - RNA, 21 nt, Homo sapiens
gcgacagaagucuugucucaa

SEQ ID NO: 1970823 - RNA, 17 nt, Homo sapiens
caucuucauagcccaaa

SEQ ID NO: 1970824 - RNA, 18 nt, Homo sapiens
agauucuucccauucucc

SEQ ID NO: 1970825 - RNA, 23 nt, Homo sapiens
cuuuuucguguggaucuugccac

SEQ ID NO: 1970826 - RNA, 16 nt, Homo sapiens
uugccugugugagcau

SEQ ID NO: 1970827 - RNA, 23 nt, Homo sapiens
gcccacguggaggcccaccugcc

SEQ ID NO: 1970828 - RNA, 19 nt, Homo sapiens
ccaagcucugcagucccag

SEQ ID NO: 1970829 - RNA, 20 nt, Homo sapiens
uucuggcacgaaauggcuga

SEQ ID NO: 1970830 - RNA, 14 nt, Homo sapiens
guauauaugaauga

SEQ ID NO: 1970831 - RNA, 12 nt, Homo sapiens
gcuggucagggu

SEQ ID NO: 1970832 - RNA, 16 nt, Homo sapiens
gccaagagaaaggccu

SEQ ID NO: 1970833 - RNA, 19 nt, Homo sapiens
auaaaccuugucuaugaaa

SEQ ID NO: 1970834 - RNA, 20 nt, Homo sapiens
uccuacccuccugcacuguu

SEQ ID NO: 1970835 - RNA, 17 nt, Homo sapiens
gacccugagaaggcaaa

SEQ ID NO: 1970836 - RNA, 17 nt, Homo sapiens
cuuaauaauguguacau

SEQ ID NO: 1970837 - RNA, 22 nt, Homo sapiens
ugguuauggccgaaaaggauau

SEQ ID NO: 1970838 - RNA, 20 nt, Homo sapiens
uauugacgaccuacaucuga

SEQ ID NO: 1970839 - RNA, 17 nt, Homo sapiens
aagugcuuugcauugaa

SEQ ID NO: 1970840 - RNA, 22 nt, Homo sapiens
gaggaggauggucaucgugaca

SEQ ID NO: 1970841 - RNA, 22 nt, Homo sapiens
guaugaaacaaacuacuguguc

SEQ ID NO: 1970842 - RNA, 16 nt, Homo sapiens
ugcuugcaugugcugc

SEQ ID NO: 1970843 - RNA, 12 nt, Homo sapiens
cuccugcuccaa

SEQ ID NO: 1970844 - RNA, 15 nt, Homo sapiens
cauauauacccacau

SEQ ID NO: 1970845 - RNA, 12 nt, Homo sapiens
ggugaggacaca

SEQ ID NO: 1970846 - RNA, 20 nt, Homo sapiens
gcgagcuccuccagaccucc

SEQ ID NO: 1970847 - RNA, 20 nt, Homo sapiens
cacacugaggaacucacaau

SEQ ID NO: 1970848 - RNA, 15 nt, Homo sapiens
agcagcugaugcugu

SEQ ID NO: 1970849 - RNA, 13 nt, Homo sapiens
cagagauuugaga

SEQ ID NO: 1970850 - RNA, 13 nt, Homo sapiens
agccucaacuuac

SEQ ID NO: 1970851 - RNA, 16 nt, Homo sapiens
aaaaacaugucaugua

SEQ ID NO: 1970852 - RNA, 20 nt, Homo sapiens
caaccuggguaacaaaguga

SEQ ID NO: 1970853 - RNA, 18 nt, Homo sapiens
accacaccuacccagggc

SEQ ID NO: 1970854 - RNA, 16 nt, Homo sapiens
caggccuuucgauccc

SEQ ID NO: 1970855 - RNA, 14 nt, Homo sapiens
uaauaggaggacag

SEQ ID NO: 1970856 - RNA, 15 nt, Homo sapiens
cauacugcauacaug

SEQ ID NO: 1970857 - RNA, 15 nt, Homo sapiens
auaauugacaugggc

SEQ ID NO: 1970858 - RNA, 19 nt, Homo sapiens
uaacagcauaauugccuuu

SEQ ID NO: 1970859 - RNA, 23 nt, Homo sapiens
ggccuacaugguugaaaccccau

SEQ ID NO: 1970860 - RNA, 16 nt, Homo sapiens
gaacuguagggccagg

SEQ ID NO: 1970861 - RNA, 18 nt, Homo sapiens
aggccaaaccguacugua

SEQ ID NO: 1970862 - RNA, 18 nt, Homo sapiens
gugcacuugcuggaagac

SEQ ID NO: 1970863 - RNA, 18 nt, Homo sapiens
aaggcauuuauugccaua

SEQ ID NO: 1970864 - RNA, 22 nt, Homo sapiens
ccuuuaaaugguaagaguuucu

SEQ ID NO: 1970865 - RNA, 18 nt, Homo sapiens
cucuagagaaaagucuac

SEQ ID NO: 1970866 - RNA, 22 nt, Homo sapiens
acugugacaaugacuaagccaa

SEQ ID NO: 1970867 - RNA, 22 nt, Homo sapiens
gaagacacguucuugccagcuu

SEQ ID NO: 1970868 - RNA, 15 nt, Homo sapiens
ccuaucccaucccau

SEQ ID NO: 1970869 - RNA, 15 nt, Homo sapiens
agaaccuucaaccca

SEQ ID NO: 1970870 - RNA, 17 nt, Homo sapiens
guugucuguccugguca

SEQ ID NO: 1970871 - RNA, 12 nt, Homo sapiens
uuguuagguuuu

SEQ ID NO: 1970872 - RNA, 11 nt, Homo sapiens
uccuguaagaa

SEQ ID NO: 1970873 - RNA, 22 nt, Homo sapiens
uuucauguggcuguagauccca

SEQ ID NO: 1970874 - RNA, 19 nt, Homo sapiens
cuugacgaauauugcuuac

SEQ ID NO: 1970875 - RNA, 12 nt, Homo sapiens
ccucugcuaaag

SEQ ID NO: 1970876 - RNA, 22 nt, Homo sapiens
acaaaugagugagagaguucag

SEQ ID NO: 1970877 - RNA, 18 nt, Homo sapiens
cugagagaccucagggau

SEQ ID NO: 1970878 - RNA, 20 nt, Homo sapiens
aacugacuucauuugugcca

SEQ ID NO: 1970879 - RNA, 16 nt, Homo sapiens
aaaaauaaaacuucac

SEQ ID NO: 1970880 - RNA, 18 nt, Homo sapiens
guuacugaugcuccugaa

SEQ ID NO: 1970881 - RNA, 13 nt, Homo sapiens
agaauauuuuucc

SEQ ID NO: 1970882 - RNA, 19 nt, Homo sapiens
aauuauaaucaaaaucaau

SEQ ID NO: 1970883 - RNA, 11 nt, Homo sapiens
gagaaggcauu

SEQ ID NO: 1970884 - RNA, 14 nt, Homo sapiens
caucuugugaaaug

SEQ ID NO: 1970885 - RNA, 21 nt, Homo sapiens
ucacaauuuguugaaucucag

SEQ ID NO: 1970886 - RNA, 19 nt, Homo sapiens
gugacuguguuugcauugu

SEQ ID NO: 1970887 - RNA, 21 nt, Homo sapiens
agcugacucucgugcauuuca

SEQ ID NO: 1970888 - RNA, 12 nt, Homo sapiens
uaggaaucaccc

SEQ ID NO: 1970889 - RNA, 15 nt, Homo sapiens
auggacacuuuucac

SEQ ID NO: 1970890 - RNA, 21 nt, Homo sapiens
uagauguugccauguguuuua

SEQ ID NO: 1970891 - RNA, 16 nt, Homo sapiens
uaaggcagugcagugc

SEQ ID NO: 1970892 - RNA, 16 nt, Homo sapiens
auugacaacugcacau

SEQ ID NO: 1970893 - RNA, 16 nt, Homo sapiens
uccucuguaaacuuuu

SEQ ID NO: 1970894 - RNA, 18 nt, Homo sapiens
uaggcaauguaguacuca

SEQ ID NO: 1970895 - RNA, 14 nt, Homo sapiens
cuggaaucgcuuga

SEQ ID NO: 1970896 - RNA, 16 nt, Homo sapiens
auguggccuccaugug

SEQ ID NO: 1970897 - RNA, 12 nt, Homo sapiens
ucuggucugucc

SEQ ID NO: 1970898 - RNA, 22 nt, Homo sapiens
uugcauggguggccagccagcu

SEQ ID NO: 1970899 - RNA, 16 nt, Homo sapiens
uuugugcuucaaauga

SEQ ID NO: 1970900 - RNA, 14 nt, Homo sapiens
agauggagcuuugu

SEQ ID NO: 1970901 - RNA, 16 nt, Homo sapiens
acaauaagaguucuug

SEQ ID NO: 1970902 - RNA, 16 nt, Homo sapiens
cggcugcggcacugug

SEQ ID NO: 1970903 - RNA, 15 nt, Homo sapiens
uugugggcacugugc

SEQ ID NO: 1970904 - RNA, 23 nt, Homo sapiens
augaugacucuucuuaucacacu

SEQ ID NO: 1970905 - RNA, 21 nt, Homo sapiens
agucacauggccuaugcacau

SEQ ID NO: 1970906 - RNA, 18 nt, Homo sapiens
aguaguaaauucauaucc

SEQ ID NO: 1970907 - RNA, 21 nt, Homo sapiens
gggcuuggcugccccauucca

SEQ ID NO: 1970908 - RNA, 14 nt, Homo sapiens
auguauguauuuau

SEQ ID NO: 1970909 - RNA, 14 nt, Homo sapiens
uugauucaacacuu

SEQ ID NO: 1970910 - RNA, 17 nt, Homo sapiens
ucccaggaggugcagug

SEQ ID NO: 1970911 - RNA, 15 nt, Homo sapiens
aagacaaacugcaca

SEQ ID NO: 1970912 - RNA, 21 nt, Homo sapiens
aaaccugugcugaccaaagau

SEQ ID NO: 1970913 - RNA, 15 nt, Homo sapiens
cugccaaaaagaaca

SEQ ID NO: 1970914 - RNA, 20 nt, Homo sapiens
gacauccccccgccaaaagc

SEQ ID NO: 1970915 - RNA, 15 nt, Homo sapiens
cuucuagugccucug

SEQ ID NO: 1970916 - RNA, 15 nt, Homo sapiens
uguucaucaauaccu

SEQ ID NO: 1970917 - RNA, 15 nt, Homo sapiens
aguauuuuucuugac

SEQ ID NO: 1970918 - RNA, 16 nt, Homo sapiens
uaaauauuucaggcau

SEQ ID NO: 1970919 - RNA, 15 nt, Homo sapiens
uuuggaauucaaugg

SEQ ID NO: 1970920 - RNA, 13 nt, Homo sapiens
uuuuaucugccuu

SEQ ID NO: 1970921 - RNA, 18 nt, Homo sapiens
cagcagccucacugcauc

SEQ ID NO: 1970922 - RNA, 14 nt, Homo sapiens
gcaauaaugcagua

SEQ ID NO: 1970923 - RNA, 14 nt, Homo sapiens
uauaaaauuaugaa

SEQ ID NO: 1970924 - RNA, 16 nt, Homo sapiens
uagaauuguguguuaa

SEQ ID NO: 1970925 - RNA, 19 nt, Homo sapiens
gcggaaagcagucagcgga

SEQ ID NO: 1970926 - RNA, 15 nt, Homo sapiens
ugaaaccccaucucu

SEQ ID NO: 1970927 - RNA, 20 nt, Homo sapiens
gcagauacuguccguggacu

SEQ ID NO: 1970928 - RNA, 16 nt, Homo sapiens
uaaacacuaaucacaa

SEQ ID NO: 1970929 - RNA, 14 nt, Homo sapiens
cugacugcaagccc

SEQ ID NO: 1970930 - RNA, 14 nt, Homo sapiens
ccucuggggcucag

SEQ ID NO: 1970931 - RNA, 16 nt, Homo sapiens
ccccucagacaguuug

SEQ ID NO: 1970932 - RNA, 14 nt, Homo sapiens
aauaaccugcacag

SEQ ID NO: 1970933 - RNA, 20 nt, Homo sapiens
acuaaaaaguggauuacaaa

SEQ ID NO: 1970934 - RNA, 18 nt, Homo sapiens
ugugaacauugucuggau

SEQ ID NO: 1970935 - RNA, 16 nt, Homo sapiens
caguuccuuucaaugg

SEQ ID NO: 1970936 - RNA, 13 nt, Homo sapiens
cagaguguaugca

SEQ ID NO: 1970937 - RNA, 18 nt, Homo sapiens
ugacgcuugugacagugc

SEQ ID NO: 1970938 - RNA, 16 nt, Homo sapiens
ugcaccuguaauccca

SEQ ID NO: 1970939 - RNA, 14 nt, Homo sapiens
aaacacacauacac

SEQ ID NO: 1970940 - RNA, 14 nt, Homo sapiens
aaguguacaugugu

SEQ ID NO: 1970941 - RNA, 20 nt, Homo sapiens
agggaagcuccuccagugaa

SEQ ID NO: 1970942 - RNA, 20 nt, Homo sapiens
cagugcugugucauuccaaa

SEQ ID NO: 1970943 - RNA, 15 nt, Homo sapiens
guuuuuaagccuuaa

SEQ ID NO: 1970944 - RNA, 12 nt, Homo sapiens
gaacccaucacu

SEQ ID NO: 1970945 - RNA, 19 nt, Homo sapiens
agauguucccccaucucgc

SEQ ID NO: 1970946 - RNA, 18 nt, Homo sapiens
ugaaauguuagucauugu

SEQ ID NO: 1970947 - RNA, 12 nt, Homo sapiens
auuauauagaaa

SEQ ID NO: 1970948 - RNA, 14 nt, Homo sapiens
cuaguuucucucaa

SEQ ID NO: 1970949 - RNA, 13 nt, Homo sapiens
aaacacacucaaa

SEQ ID NO: 1970950 - RNA, 18 nt, Homo sapiens
acaguaaugugucauauc

SEQ ID NO: 1970951 - RNA, 13 nt, Homo sapiens
caccaaagcugcc

SEQ ID NO: 1970952 - RNA, 23 nt, Homo sapiens
caaaacugguuuaggauuacuua

SEQ ID NO: 1970953 - RNA, 16 nt, Homo sapiens
ucaugucuugugcaua

SEQ ID NO: 1970954 - RNA, 17 nt, Homo sapiens
cucacccagucuucuac

SEQ ID NO: 1970955 - RNA, 16 nt, Homo sapiens
aacaauucaguggucu

SEQ ID NO: 1970956 - RNA, 15 nt, Homo sapiens
uucagcaaaugccuu

SEQ ID NO: 1970957 - RNA, 18 nt, Homo sapiens
aauccucccuacuuccaa

SEQ ID NO: 1970958 - RNA, 20 nt, Homo sapiens
cucuccccucagagugcaag

SEQ ID NO: 1970959 - RNA, 15 nt, Homo sapiens
agcaaguuagaacua

SEQ ID NO: 1970960 - RNA, 16 nt, Homo sapiens
ugcuuugcugaccaaa

SEQ ID NO: 1970961 - RNA, 14 nt, Homo sapiens
aaaacauagcuuuc

SEQ ID NO: 1970962 - RNA, 15 nt, Homo sapiens
uccacgagcuauauu

SEQ ID NO: 1970963 - RNA, 14 nt, Homo sapiens
guuaagcauuccuu

SEQ ID NO: 1970964 - RNA, 22 nt, Homo sapiens
aggcugcccccuuccucaccua

SEQ ID NO: 1970965 - RNA, 22 nt, Homo sapiens
ccucuuggccugaucagaccac

SEQ ID NO: 1970966 - RNA, 15 nt, Homo sapiens
cguuuguugugauau

SEQ ID NO: 1970967 - RNA, 13 nt, Homo sapiens
aggacccaugaaa

SEQ ID NO: 1970968 - RNA, 21 nt, Homo sapiens
uaaucugcuuuguuaaugaaa

SEQ ID NO: 1970969 - RNA, 15 nt, Homo sapiens
aucucauuccacugu

SEQ ID NO: 1970970 - RNA, 18 nt, Homo sapiens
uucauaauaucaugugca

SEQ ID NO: 1970971 - RNA, 21 nt, Homo sapiens
uaacuuccauuuuauuacuaa

SEQ ID NO: 1970972 - RNA, 13 nt, Homo sapiens
gaggcauuauuug

SEQ ID NO: 1970973 - RNA, 13 nt, Homo sapiens
uuuucaccauaau

SEQ ID NO: 1970974 - RNA, 21 nt, Homo sapiens
uucuuaagauggcuacaccuc

SEQ ID NO: 1970975 - RNA, 22 nt, Homo sapiens
ucuggagggcuggucauucaca

SEQ ID NO: 1970976 - RNA, 23 nt, Homo sapiens
acgugcaauacggaacacuguca

SEQ ID NO: 1970977 - RNA, 23 nt, Homo sapiens
uguccccgccuucccucacucuu

SEQ ID NO: 1970978 - RNA, 16 nt, Homo sapiens
cuuccuugccugauga

SEQ ID NO: 1970979 - RNA, 23 nt, Homo sapiens
uguaacucacccccaccaccaua

SEQ ID NO: 1970980 - RNA, 18 nt, Homo sapiens
gauuuuuuccucugcauu

SEQ ID NO: 1970981 - RNA, 23 nt, Homo sapiens
cuuaagcaugacgggaaaaccaa

SEQ ID NO: 1970982 - RNA, 18 nt, Homo sapiens
gaaccucucguaguccau

SEQ ID NO: 1970983 - RNA, 15 nt, Homo sapiens
ccagcucucuucuaa

SEQ ID NO: 1970984 - RNA, 23 nt, Homo sapiens
uuccagauguggauuuggcaaaa

SEQ ID NO: 1970985 - RNA, 19 nt, Homo sapiens
cagagaccuuccagaaaua

SEQ ID NO: 1970986 - RNA, 18 nt, Homo sapiens
cuuggaaccucauugcua

SEQ ID NO: 1970987 - RNA, 16 nt, Homo sapiens
aaaagaggcuauguga

SEQ ID NO: 1970988 - RNA, 21 nt, Homo sapiens
caguaauacaguacaguacuc

SEQ ID NO: 1970989 - RNA, 15 nt, Homo sapiens
agcauccccagccac

SEQ ID NO: 1970990 - RNA, 14 nt, Homo sapiens
gugaaaagcuccau

SEQ ID NO: 1970991 - RNA, 18 nt, Homo sapiens
aaaggguuuuaagccagg

SEQ ID NO: 1970992 - RNA, 16 nt, Homo sapiens
gauagaaagcauuaca

SEQ ID NO: 1970993 - RNA, 14 nt, Homo sapiens
uggccucugccuuu

SEQ ID NO: 1970994 - RNA, 14 nt, Homo sapiens
gaaugugugucaau

SEQ ID NO: 1970995 - RNA, 23 nt, Homo sapiens
uguggauggugucuccuuuacua

SEQ ID NO: 1970996 - RNA, 19 nt, Homo sapiens
cccucuagaaauuuuucag

SEQ ID NO: 1970997 - RNA, 13 nt, Homo sapiens
gcuucuuggagcu

SEQ ID NO: 1970998 - RNA, 23 nt, Homo sapiens
gccugagucgugaccugcuaggc

SEQ ID NO: 1970999 - RNA, 14 nt, Homo sapiens
augaugucugcaaa

SEQ ID NO: 1971000 - RNA, 14 nt, Homo sapiens
caaagccuuacaaa

SEQ ID NO: 1971001 - RNA, 17 nt, Homo sapiens
cuccucuuccagaguca

SEQ ID NO: 1971002 - RNA, 19 nt, Homo sapiens
aauaaaaguuuuacaaagg

SEQ ID NO: 1971003 - RNA, 15 nt, Homo sapiens
gaauuaacagagauu

SEQ ID NO: 1971004 - RNA, 17 nt, Homo sapiens
cuaggucuccucagggu

SEQ ID NO: 1971005 - RNA, 16 nt, Homo sapiens
gugucagcaugucuca

SEQ ID NO: 1971006 - RNA, 20 nt, Homo sapiens
auacuucuuguguguaugca

SEQ ID NO: 1971007 - RNA, 14 nt, Homo sapiens
ccucccaagguccu

SEQ ID NO: 1971008 - RNA, 22 nt, Homo sapiens
aaaugcuacugaaacuuaccug

SEQ ID NO: 1971009 - RNA, 16 nt, Homo sapiens
ccucucccaacuauaa

SEQ ID NO: 1971010 - RNA, 16 nt, Homo sapiens
ugcuaagacuaacuca

SEQ ID NO: 1971011 - RNA, 17 nt, Homo sapiens
aauguugaaacugacuu

SEQ ID NO: 1971012 - RNA, 16 nt, Homo sapiens
aacucagugcuguuuc

SEQ ID NO: 1971013 - RNA, 20 nt, Homo sapiens
uuugggggucagcauccagu

SEQ ID NO: 1971014 - RNA, 18 nt, Homo sapiens
aguuguauuugaagacug

SEQ ID NO: 1971015 - RNA, 23 nt, Homo sapiens
aagcaguacaucuugugcaugca

SEQ ID NO: 1971016 - RNA, 20 nt, Homo sapiens
ucugagucuggggugagaua

SEQ ID NO: 1971017 - RNA, 16 nt, Homo sapiens
guggcauuuucacuuu

SEQ ID NO: 1971018 - RNA, 19 nt, Homo sapiens
ggcccaccuggaaucccac

SEQ ID NO: 1971019 - RNA, 22 nt, Homo sapiens
gcaguguuuguuagagugcaca

SEQ ID NO: 1971020 - RNA, 15 nt, Homo sapiens
acacgcacuggugcc

SEQ ID NO: 1971021 - RNA, 14 nt, Homo sapiens
aagaaugaggaaua

SEQ ID NO: 1971022 - RNA, 15 nt, Homo sapiens
cagucagcagucaug

SEQ ID NO: 1971023 - RNA, 14 nt, Homo sapiens
ccuggagugcaguu

SEQ ID NO: 1971024 - RNA, 22 nt, Homo sapiens
gaauccuggaccaagcacaaaa

SEQ ID NO: 1971025 - RNA, 11 nt, Homo sapiens
uuuccaucucu

SEQ ID NO: 1971026 - RNA, 14 nt, Homo sapiens
gugugguugcucac

SEQ ID NO: 1971027 - RNA, 21 nt, Homo sapiens
auuauuguuuucuacugcuau

SEQ ID NO: 1971028 - RNA, 13 nt, Homo sapiens
gcagagguugcag

SEQ ID NO: 1971029 - RNA, 19 nt, Homo sapiens
auuuaacagggucucuagu

SEQ ID NO: 1971030 - RNA, 17 nt, Homo sapiens
ugggccacuguaggggu

SEQ ID NO: 1971031 - RNA, 17 nt, Homo sapiens
aaaaaguauguucuaaa

SEQ ID NO: 1971032 - RNA, 18 nt, Homo sapiens
cagaagggggccaugagg

SEQ ID NO: 1971033 - RNA, 22 nt, Homo sapiens
gacuuauacuugccuucugaua

SEQ ID NO: 1971034 - RNA, 22 nt, Homo sapiens
ccuaauaugaaagaaaaaugga

SEQ ID NO: 1971035 - RNA, 21 nt, Homo sapiens
uugcucacucccuaaagcccu

SEQ ID NO: 1971036 - RNA, 24 nt, Homo sapiens
aagcuauugauguuuccagaaaau

SEQ ID NO: 1971037 - RNA, 21 nt, Homo sapiens
auuuuccuucagaauaucuua

SEQ ID NO: 1971038 - RNA, 15 nt, Homo sapiens
caggagucucuggua

SEQ ID NO: 1971039 - RNA, 16 nt, Homo sapiens
aauaaaggcucuggaa

SEQ ID NO: 1971040 - RNA, 12 nt, Homo sapiens
aggucacuggaa

SEQ ID NO: 1971041 - RNA, 16 nt, Homo sapiens
gcagaaaaucuaccaa

SEQ ID NO: 1971042 - RNA, 15 nt, Homo sapiens
acagagucucacucu

SEQ ID NO: 1971043 - RNA, 18 nt, Homo sapiens
cagauagagaaauaguga

SEQ ID NO: 1971044 - RNA, 21 nt, Homo sapiens
uaagaaacauucuuuuccacu

SEQ ID NO: 1971045 - RNA, 15 nt, Homo sapiens
acacuccucuaucau

SEQ ID NO: 1971046 - RNA, 22 nt, Homo sapiens
acugucgucuuuuuccaaacaa

SEQ ID NO: 1971047 - RNA, 23 nt, Homo sapiens
gcaccagugggacuguggugacu

SEQ ID NO: 1971048 - RNA, 14 nt, Homo sapiens
auuaaucucuaaaa

SEQ ID NO: 1971049 - RNA, 21 nt, Homo sapiens
aacagucaaacccauggagac

SEQ ID NO: 1971050 - RNA, 19 nt, Homo sapiens
cagaggggaaagacuucca

SEQ ID NO: 1971051 - RNA, 17 nt, Homo sapiens
cuguggaccacugcaug

SEQ ID NO: 1971052 - RNA, 11 nt, Homo sapiens
uccaaguacau

SEQ ID NO: 1971053 - RNA, 15 nt, Homo sapiens
auuuggucucuugua

SEQ ID NO: 1971054 - RNA, 13 nt, Homo sapiens
aaacaucacuugu

SEQ ID NO: 1971055 - RNA, 11 nt, Homo sapiens
aagauucuucu

SEQ ID NO: 1971056 - RNA, 18 nt, Homo sapiens
ccuggcaagugggugaaa

SEQ ID NO: 1971057 - RNA, 16 nt, Homo sapiens
uggggagcccacugag

SEQ ID NO: 1971058 - RNA, 14 nt, Homo sapiens
auggugauaaggga

SEQ ID NO: 1971059 - RNA, 22 nt, Homo sapiens
gaaccacgaaugagguaggcac

SEQ ID NO: 1971060 - RNA, 11 nt, Homo sapiens
ugaugugacau

SEQ ID NO: 1971061 - RNA, 14 nt, Homo sapiens
ugcugaggccucuc

SEQ ID NO: 1971062 - RNA, 21 nt, Homo sapiens
aauguuauuuuuuaauuauua

SEQ ID NO: 1971063 - RNA, 18 nt, Homo sapiens
ccucuccagacacagaga

SEQ ID NO: 1971064 - RNA, 15 nt, Homo sapiens
gcccgcugcaaugcc

SEQ ID NO: 1971065 - RNA, 20 nt, Homo sapiens
gaaaaugccucaauucacau

SEQ ID NO: 1971066 - RNA, 21 nt, Homo sapiens
cugcauuuauccuauaucauu

SEQ ID NO: 1971067 - RNA, 17 nt, Homo sapiens
cucauuuagaacuugca

SEQ ID NO: 1971068 - RNA, 13 nt, Homo sapiens
ccacgcugaccau

SEQ ID NO: 1971069 - RNA, 14 nt, Homo sapiens
caccugacaugucc

SEQ ID NO: 1971070 - RNA, 18 nt, Homo sapiens
uaacuacaugaacacaaa

SEQ ID NO: 1971071 - RNA, 15 nt, Homo sapiens
cccagcaacucuggc

SEQ ID NO: 1971072 - RNA, 16 nt, Homo sapiens
augcuuagagggguga

SEQ ID NO: 1971073 - RNA, 18 nt, Homo sapiens
gcaaucagaguguacaaa

SEQ ID NO: 1971074 - RNA, 15 nt, Homo sapiens
cuaugcaaaugccuc

SEQ ID NO: 1971075 - RNA, 23 nt, Homo sapiens
cucagccugcuuuccugcagcag

SEQ ID NO: 1971076 - RNA, 13 nt, Homo sapiens
aauugacaggauu

SEQ ID NO: 1971077 - RNA, 21 nt, Homo sapiens
accuuuaggccaucucagcuu

SEQ ID NO: 1971078 - RNA, 18 nt, Homo sapiens
agcuuguuucuauacugu

SEQ ID NO: 1971079 - RNA, 14 nt, Homo sapiens
guugggcaugauuc

SEQ ID NO: 1971080 - RNA, 13 nt, Homo sapiens
acugagaugcaaa

SEQ ID NO: 1971081 - RNA, 13 nt, Homo sapiens
ggaaugauagugu

SEQ ID NO: 1971082 - RNA, 17 nt, Homo sapiens
cuuugguauuucacuga

SEQ ID NO: 1971083 - RNA, 22 nt, Homo sapiens
gaaaaaugcugcuucuccuccc

SEQ ID NO: 1971084 - RNA, 17 nt, Homo sapiens
cacaguuguguuccuga

SEQ ID NO: 1971085 - RNA, 21 nt, Homo sapiens
ggaagccacccucccagcucu

SEQ ID NO: 1971086 - RNA, 17 nt, Homo sapiens
ucuaaaauacaaaccca

SEQ ID NO: 1971087 - RNA, 20 nt, Homo sapiens
cauaccucuucuuacuccaa

SEQ ID NO: 1971088 - RNA, 17 nt, Homo sapiens
ccacauuccugaugcuu

SEQ ID NO: 1971089 - RNA, 17 nt, Homo sapiens
uaacacugaaauugccu

SEQ ID NO: 1971090 - RNA, 12 nt, Homo sapiens
aaacaaaaccac

SEQ ID NO: 1971091 - RNA, 17 nt, Homo sapiens
ugguuuauuucccagua

SEQ ID NO: 1971092 - RNA, 19 nt, Homo sapiens
caggauuauugucaaagaa

SEQ ID NO: 1971093 - RNA, 16 nt, Homo sapiens
guucucuauugcugcu

SEQ ID NO: 1971094 - RNA, 19 nt, Homo sapiens
cacuugaaggaagaagucu

SEQ ID NO: 1971095 - RNA, 19 nt, Homo sapiens
caguuuuacucugcugcaa

SEQ ID NO: 1971096 - RNA, 16 nt, Homo sapiens
caaaaauucacaaaug

SEQ ID NO: 1971097 - RNA, 23 nt, Homo sapiens
ugacuuugcccccuugcccauca

SEQ ID NO: 1971098 - RNA, 20 nt, Homo sapiens
uuuugaaguaccaccaaaaa

SEQ ID NO: 1971099 - RNA, 13 nt, Homo sapiens
uauucaauggaaa

SEQ ID NO: 1971100 - RNA, 22 nt, Homo sapiens
guuacaugguaauuaugugaua

SEQ ID NO: 1971101 - RNA, 22 nt, Homo sapiens
cagaucaucuccaaaucuugcc

SEQ ID NO: 1971102 - RNA, 12 nt, Homo sapiens
gaugacauuccc

SEQ ID NO: 1971103 - RNA, 13 nt, Homo sapiens
agggccaugucag

SEQ ID NO: 1971104 - RNA, 18 nt, Homo sapiens
acagagugagacugucuc

SEQ ID NO: 1971105 - RNA, 14 nt, Homo sapiens
agaguaacagucau

SEQ ID NO: 1971106 - RNA, 17 nt, Homo sapiens
ucuagacauauuugcau

SEQ ID NO: 1971107 - RNA, 14 nt, Homo sapiens
acagauuucaguaa

SEQ ID NO: 1971108 - RNA, 16 nt, Homo sapiens
augcuacucuaguauu

SEQ ID NO: 1971109 - RNA, 21 nt, Homo sapiens
aaagaaaaaagcaccaaaggg

SEQ ID NO: 1971110 - RNA, 19 nt, Homo sapiens
cagaauuaacuccauucca

SEQ ID NO: 1971111 - RNA, 17 nt, Homo sapiens
cacccuuucuacuucca

SEQ ID NO: 1971112 - RNA, 15 nt, Homo sapiens
aaaucccuccuucau

SEQ ID NO: 1971113 - RNA, 15 nt, Homo sapiens
gaacauaaagcaaau

SEQ ID NO: 1971114 - RNA, 14 nt, Homo sapiens
cuaaggaaaggaau

SEQ ID NO: 1971115 - RNA, 15 nt, Homo sapiens
uccauuuuauuacua

SEQ ID NO: 1971116 - RNA, 21 nt, Homo sapiens
aauaagcuaaacgcaauguca

SEQ ID NO: 1971117 - RNA, 19 nt, Homo sapiens
uccuuccucaguccuggaa

SEQ ID NO: 1971118 - RNA, 18 nt, Homo sapiens
aauaguuagaucuacccu

SEQ ID NO: 1971119 - RNA, 21 nt, Homo sapiens
gugggaggggaaugccacagu

SEQ ID NO: 1971120 - RNA, 22 nt, Homo sapiens
auuggauaucaacugcuuguaa

SEQ ID NO: 1971121 - RNA, 19 nt, Homo sapiens
cugggaggguguggugcuu

SEQ ID NO: 1971122 - RNA, 23 nt, Homo sapiens
cuuccauaggacauacugcaugu

SEQ ID NO: 1971123 - RNA, 22 nt, Homo sapiens
ucuggggggacccagugcagaa

SEQ ID NO: 1971124 - RNA, 17 nt, Homo sapiens
aacugucucucuucuca

SEQ ID NO: 1971125 - RNA, 15 nt, Homo sapiens
gaccaccuugcacua

SEQ ID NO: 1971126 - RNA, 18 nt, Homo sapiens
guuugauaccugcacugu

SEQ ID NO: 1971127 - RNA, 13 nt, Homo sapiens
aauucccagcugu

SEQ ID NO: 1971128 - RNA, 22 nt, Homo sapiens
uaaucccccuugccaaauucca

SEQ ID NO: 1971129 - RNA, 19 nt, Homo sapiens
acugguuauccugugcuac

SEQ ID NO: 1971130 - RNA, 14 nt, Homo sapiens
caaaaaacuuuuaa

SEQ ID NO: 1971131 - RNA, 17 nt, Homo sapiens
gucagccagacuggaca

SEQ ID NO: 1971132 - RNA, 23 nt, Homo sapiens
uaguggggacccaaagauucuag

SEQ ID NO: 1971133 - RNA, 21 nt, Homo sapiens
caugaaguggaaaaaggagag

SEQ ID NO: 1971134 - RNA, 16 nt, Homo sapiens
aguuccccuacuacac

SEQ ID NO: 1971135 - RNA, 14 nt, Homo sapiens
auccuggaguucug

SEQ ID NO: 1971136 - RNA, 15 nt, Homo sapiens
uaaauuuuaugucau

SEQ ID NO: 1971137 - RNA, 15 nt, Homo sapiens
gugaguccuguugaa

SEQ ID NO: 1971138 - RNA, 21 nt, Homo sapiens
cuauuuagaaauggauuuauc

SEQ ID NO: 1971139 - RNA, 15 nt, Homo sapiens
ggauggguguggaug

SEQ ID NO: 1971140 - RNA, 16 nt, Homo sapiens
aaccuuuaaauuuuca

SEQ ID NO: 1971141 - RNA, 16 nt, Homo sapiens
ucucgaucuccugacc

SEQ ID NO: 1971142 - RNA, 16 nt, Homo sapiens
cuucugcgcuguuguu

SEQ ID NO: 1971143 - RNA, 15 nt, Homo sapiens
auaaauaaaguuucu

SEQ ID NO: 1971144 - RNA, 13 nt, Homo sapiens
cuugagggaccaa

SEQ ID NO: 1971145 - RNA, 17 nt, Homo sapiens
cacaugugacacauaug

SEQ ID NO: 1971146 - RNA, 15 nt, Homo sapiens
cugugggcccaguca

SEQ ID NO: 1971147 - RNA, 19 nt, Homo sapiens
ccagccugccuguccucca

SEQ ID NO: 1971148 - RNA, 24 nt, Homo sapiens
gggugaagcugugaugugccuacu

SEQ ID NO: 1971149 - RNA, 14 nt, Homo sapiens
gcaacaagaucuga

SEQ ID NO: 1971150 - RNA, 14 nt, Homo sapiens
ggcagucacuucca

SEQ ID NO: 1971151 - RNA, 23 nt, Homo sapiens
caacuuuucucauguugaagcca

SEQ ID NO: 1971152 - RNA, 20 nt, Homo sapiens
uagggagaaacaaaaauaca

SEQ ID NO: 1971153 - RNA, 14 nt, Homo sapiens
ucaccucuccaggu

SEQ ID NO: 1971154 - RNA, 21 nt, Homo sapiens
caccaaaugccucugccuuga

SEQ ID NO: 1971155 - RNA, 22 nt, Homo sapiens
aaaguucagggaccguccaggg

SEQ ID NO: 1971156 - RNA, 23 nt, Homo sapiens
uuuuuaaaaaacucuuuggugca

SEQ ID NO: 1971157 - RNA, 16 nt, Homo sapiens
gagugcucaccgccuc

SEQ ID NO: 1971158 - RNA, 14 nt, Homo sapiens
uugaaauccaggaa

SEQ ID NO: 1971159 - RNA, 21 nt, Homo sapiens
gagguggguggaucaccugag

SEQ ID NO: 1971160 - RNA, 14 nt, Homo sapiens
caugauucuuuaau

SEQ ID NO: 1971161 - RNA, 14 nt, Homo sapiens
uguaagaaaaccaa

SEQ ID NO: 1971162 - RNA, 14 nt, Homo sapiens
ccucuagaggcaag

SEQ ID NO: 1971163 - RNA, 12 nt, Homo sapiens
gaaggcuuugug

SEQ ID NO: 1971164 - RNA, 15 nt, Homo sapiens
caaauuacagcccag

SEQ ID NO: 1971165 - RNA, 18 nt, Homo sapiens
uagaauguaaaugucuca

SEQ ID NO: 1971166 - RNA, 18 nt, Homo sapiens
gauuaggugagguuuaua

SEQ ID NO: 1971167 - RNA, 19 nt, Homo sapiens
cuucugccuugagucccca

SEQ ID NO: 1971168 - RNA, 19 nt, Homo sapiens
cacaaagaagaaguuuaaa

SEQ ID NO: 1971169 - RNA, 22 nt, Homo sapiens
uacaacaugcaucaugcucaug

SEQ ID NO: 1971170 - RNA, 15 nt, Homo sapiens
gaccagucugacccu

SEQ ID NO: 1971171 - RNA, 14 nt, Homo sapiens
ccaugccugagggu

SEQ ID NO: 1971172 - RNA, 15 nt, Homo sapiens
uacuacacugaggag

SEQ ID NO: 1971173 - RNA, 13 nt, Homo sapiens
aaaggaaaagcca

SEQ ID NO: 1971174 - RNA, 21 nt, Homo sapiens
uuuuaauccuuaacacauuca

SEQ ID NO: 1971175 - RNA, 18 nt, Homo sapiens
aguuugaagcauugaccu

SEQ ID NO: 1971176 - RNA, 19 nt, Homo sapiens
uggucugcauuagucucau

SEQ ID NO: 1971177 - RNA, 19 nt, Homo sapiens
agaugcagccagcauuacc

SEQ ID NO: 1971178 - RNA, 13 nt, Homo sapiens
auucgccucugga

SEQ ID NO: 1971179 - RNA, 15 nt, Homo sapiens
acuguccccaugccc

SEQ ID NO: 1971180 - RNA, 14 nt, Homo sapiens
cauuccauuugcuu

SEQ ID NO: 1971181 - RNA, 21 nt, Homo sapiens
gcugucuggguggcucacuca

SEQ ID NO: 1971182 - RNA, 22 nt, Homo sapiens
ugcugugggugcagcugucaca

SEQ ID NO: 1971183 - RNA, 17 nt, Homo sapiens
uuggaaaaaacucugaa

SEQ ID NO: 1971184 - RNA, 18 nt, Homo sapiens
uaagacuaaaaguugcau

SEQ ID NO: 1971185 - RNA, 18 nt, Homo sapiens
ucaggcccgcuaggucca

SEQ ID NO: 1971186 - RNA, 19 nt, Homo sapiens
agccugggaggcacagcaa

SEQ ID NO: 1971187 - RNA, 23 nt, Homo sapiens
aaggauacuguaacacuuuacaa

SEQ ID NO: 1971188 - RNA, 14 nt, Homo sapiens
cuggugagguccug

SEQ ID NO: 1971189 - RNA, 20 nt, Homo sapiens
cuccuaaacaaaaacacauu

SEQ ID NO: 1971190 - RNA, 16 nt, Homo sapiens
ucuggggcuuugccau

SEQ ID NO: 1971191 - RNA, 22 nt, Homo sapiens
ugggugcuuaguaaguacuuaa

SEQ ID NO: 1971192 - RNA, 12 nt, Homo sapiens
agucauuaccac

SEQ ID NO: 1971193 - RNA, 15 nt, Homo sapiens
caucccuguguccac

SEQ ID NO: 1971194 - RNA, 13 nt, Homo sapiens
aaugcuucugccu

SEQ ID NO: 1971195 - RNA, 14 nt, Homo sapiens
cagaccgucuuccu

SEQ ID NO: 1971196 - RNA, 21 nt, Homo sapiens
acaugguggcaugcaccugca

SEQ ID NO: 1971197 - RNA, 17 nt, Homo sapiens
cugaggacaaaguggag

SEQ ID NO: 1971198 - RNA, 22 nt, Homo sapiens
uggucaaacaaacucucugaac

SEQ ID NO: 1971199 - RNA, 19 nt, Homo sapiens
aguuucuggcuggcuucau

SEQ ID NO: 1971200 - RNA, 18 nt, Homo sapiens
aaagcagaagaagacaga

SEQ ID NO: 1971201 - RNA, 22 nt, Homo sapiens
cagugccuccugggaccaugga

SEQ ID NO: 1971202 - RNA, 15 nt, Homo sapiens
aggaauggcccucau

SEQ ID NO: 1971203 - RNA, 18 nt, Homo sapiens
ugggcagcugucauggaa

SEQ ID NO: 1971204 - RNA, 16 nt, Homo sapiens
guuauaguaacaucaa

SEQ ID NO: 1971205 - RNA, 14 nt, Homo sapiens
aacugaguacaauu

SEQ ID NO: 1971206 - RNA, 13 nt, Homo sapiens
gcagaagugcaau

SEQ ID NO: 1971207 - RNA, 23 nt, Homo sapiens
ggccaacauggugaaacccuguc

SEQ ID NO: 1971208 - RNA, 15 nt, Homo sapiens
ccugacuaagccuuu

SEQ ID NO: 1971209 - RNA, 18 nt, Homo sapiens
ucuucaacgccaucucca

SEQ ID NO: 1971210 - RNA, 19 nt, Homo sapiens
gcucccaggaucuccugcc

SEQ ID NO: 1971211 - RNA, 13 nt, Homo sapiens
accauuccucaag

SEQ ID NO: 1971212 - RNA, 12 nt, Homo sapiens
aggugcugccac

SEQ ID NO: 1971213 - RNA, 19 nt, Homo sapiens
auuacaugcccaucccagu

SEQ ID NO: 1971214 - RNA, 13 nt, Homo sapiens
agugaacacacuc

SEQ ID NO: 1971215 - RNA, 22 nt, Homo sapiens
ccguuuaccuagaagaagcuau

SEQ ID NO: 1971216 - RNA, 22 nt, Homo sapiens
cgcauacaggcguacacaugca

SEQ ID NO: 1971217 - RNA, 22 nt, Homo sapiens
gcucaacugaggauguggcuua

SEQ ID NO: 1971218 - RNA, 18 nt, Homo sapiens
ucuggacagcuaaaucau

SEQ ID NO: 1971219 - RNA, 18 nt, Homo sapiens
caggggcgugggauugaa

SEQ ID NO: 1971220 - RNA, 20 nt, Homo sapiens
aaauccauccugcucuucca

SEQ ID NO: 1971221 - RNA, 15 nt, Homo sapiens
agguuucaacaaauu

SEQ ID NO: 1971222 - RNA, 14 nt, Homo sapiens
uggaugugucucag

SEQ ID NO: 1971223 - RNA, 19 nt, Homo sapiens
ugcccuuucuguaccauuu

SEQ ID NO: 1971224 - RNA, 16 nt, Homo sapiens
aggcccugcugaguca

SEQ ID NO: 1971225 - RNA, 18 nt, Homo sapiens
cauuaaagaaggguugag

SEQ ID NO: 1971226 - RNA, 17 nt, Homo sapiens
acugcacccaccuacuu

SEQ ID NO: 1971227 - RNA, 15 nt, Homo sapiens
uuaauucauguugcc

SEQ ID NO: 1971228 - RNA, 14 nt, Homo sapiens
aggugaguucucac

SEQ ID NO: 1971229 - RNA, 14 nt, Homo sapiens
cuccugccuacuca

SEQ ID NO: 1971230 - RNA, 18 nt, Homo sapiens
caaguuugaccagugcag

SEQ ID NO: 1971231 - RNA, 12 nt, Homo sapiens
cucagugagaua

SEQ ID NO: 1971232 - RNA, 13 nt, Homo sapiens
cacgcaggccacc

SEQ ID NO: 1971233 - RNA, 14 nt, Homo sapiens
uucuuuccauaaua

SEQ ID NO: 1971234 - RNA, 23 nt, Homo sapiens
acucacauucuauuaaaauuuag

SEQ ID NO: 1971235 - RNA, 14 nt, Homo sapiens
auuuuaacucuguc

SEQ ID NO: 1971236 - RNA, 18 nt, Homo sapiens
ggccggagucagugccag

SEQ ID NO: 1971237 - RNA, 12 nt, Homo sapiens
uaggugagacag

SEQ ID NO: 1971238 - RNA, 18 nt, Homo sapiens
cucugagcccgugucaca

SEQ ID NO: 1971239 - RNA, 18 nt, Homo sapiens
uucaggccuacagccaca

SEQ ID NO: 1971240 - RNA, 14 nt, Homo sapiens
uauaccaacuaaaa

SEQ ID NO: 1971241 - RNA, 13 nt, Homo sapiens
gaaguaucugucu

SEQ ID NO: 1971242 - RNA, 14 nt, Homo sapiens
uuucaaaagagauu

SEQ ID NO: 1971243 - RNA, 23 nt, Homo sapiens
uguauucacgccauugguuggaa

SEQ ID NO: 1971244 - RNA, 17 nt, Homo sapiens
uagcagcuaucucucag

SEQ ID NO: 1971245 - RNA, 18 nt, Homo sapiens
uccaauuccaaagccaga

SEQ ID NO: 1971246 - RNA, 14 nt, Homo sapiens
cuuuuccaaggcaa

SEQ ID NO: 1971247 - RNA, 17 nt, Homo sapiens
caacuuuuuguuacaga

SEQ ID NO: 1971248 - RNA, 15 nt, Homo sapiens
aggaagagucucuaa

SEQ ID NO: 1971249 - RNA, 14 nt, Homo sapiens
agugaaacuaugau

SEQ ID NO: 1971250 - RNA, 17 nt, Homo sapiens
uccgugaaggugaccuc

SEQ ID NO: 1971251 - RNA, 20 nt, Homo sapiens
ccacacgacugcaacauaca

SEQ ID NO: 1971252 - RNA, 14 nt, Homo sapiens
uaaggaaaugugcg

SEQ ID NO: 1971253 - RNA, 21 nt, Homo sapiens
uaaaauauuuuuaugugcaau

SEQ ID NO: 1971254 - RNA, 16 nt, Homo sapiens
acuuagagauauguau

SEQ ID NO: 1971255 - RNA, 16 nt, Homo sapiens
auggccagugucuguc

SEQ ID NO: 1971256 - RNA, 23 nt, Homo sapiens
ggugggcaggaucucaagccagc

SEQ ID NO: 1971257 - RNA, 14 nt, Homo sapiens
caucagcauaccuu

SEQ ID NO: 1971258 - RNA, 15 nt, Homo sapiens
ucgugggaaagggga

SEQ ID NO: 1971259 - RNA, 12 nt, Homo sapiens
agcucagguggg

SEQ ID NO: 1971260 - RNA, 22 nt, Homo sapiens
acuuugucaugguuuccauuua

SEQ ID NO: 1971261 - RNA, 18 nt, Homo sapiens
cccacgugucuuccacuu

SEQ ID NO: 1971262 - RNA, 16 nt, Homo sapiens
auguacuacagcuaua

SEQ ID NO: 1971263 - RNA, 12 nt, Homo sapiens
caagcacugaca

SEQ ID NO: 1971264 - RNA, 17 nt, Homo sapiens
cuguauucucagcacuu

SEQ ID NO: 1971265 - RNA, 14 nt, Homo sapiens
cucuaggcuguucu

SEQ ID NO: 1971266 - RNA, 20 nt, Homo sapiens
cuccuggaaccuugcugucc

SEQ ID NO: 1971267 - RNA, 15 nt, Homo sapiens
ucucaaaguguacaa

SEQ ID NO: 1971268 - RNA, 21 nt, Homo sapiens
gggcaagaggaaaaugcccug

SEQ ID NO: 1971269 - RNA, 13 nt, Homo sapiens
ugugucuuuccag

SEQ ID NO: 1971270 - RNA, 12 nt, Homo sapiens
uggacacuugcg

SEQ ID NO: 1971271 - RNA, 15 nt, Homo sapiens
guacauacgauuuaa

SEQ ID NO: 1971272 - RNA, 20 nt, Homo sapiens
gggcugucaucugugcacug

SEQ ID NO: 1971273 - RNA, 13 nt, Homo sapiens
acagauaugcaca

SEQ ID NO: 1971274 - RNA, 18 nt, Homo sapiens
auuaguaaaagugcuuuc

SEQ ID NO: 1971275 - RNA, 18 nt, Homo sapiens
ggacccugagaagccagu

SEQ ID NO: 1971276 - RNA, 23 nt, Homo sapiens
acccauagagggcuccucucaga

SEQ ID NO: 1971277 - RNA, 14 nt, Homo sapiens
ugagaaaaaaacag

SEQ ID NO: 1971278 - RNA, 19 nt, Homo sapiens
uguaaacuuugcuucucca

SEQ ID NO: 1971279 - RNA, 18 nt, Homo sapiens
cccagaaacaaaucucaa

SEQ ID NO: 1971280 - RNA, 18 nt, Homo sapiens
ggaauuaugucugcugaa

SEQ ID NO: 1971281 - RNA, 22 nt, Homo sapiens
agguaggcacaaauacauuccu

SEQ ID NO: 1971282 - RNA, 22 nt, Homo sapiens
gugcugggauuauaggcaugag

SEQ ID NO: 1971283 - RNA, 17 nt, Homo sapiens
uggaucuaccagcauaa

SEQ ID NO: 1971284 - RNA, 13 nt, Homo sapiens
ccucucugcuccu

SEQ ID NO: 1971285 - RNA, 15 nt, Homo sapiens
gaguccaagaaucca

SEQ ID NO: 1971286 - RNA, 22 nt, Homo sapiens
agcuuggggcuuuuuccaucuu

SEQ ID NO: 1971287 - RNA, 20 nt, Homo sapiens
guuuaaguaauugccuacaa

SEQ ID NO: 1971288 - RNA, 22 nt, Homo sapiens
cccugaaucugaccacagacac

SEQ ID NO: 1971289 - RNA, 16 nt, Homo sapiens
ugagacugaagaccag

SEQ ID NO: 1971290 - RNA, 14 nt, Homo sapiens
gaaauaucugugaa

SEQ ID NO: 1971291 - RNA, 15 nt, Homo sapiens
caaggugacacauua

SEQ ID NO: 1971292 - RNA, 17 nt, Homo sapiens
agcauuuguucuuugcc

SEQ ID NO: 1971293 - RNA, 21 nt, Homo sapiens
ggguguggucuccacugggga

SEQ ID NO: 1971294 - RNA, 22 nt, Homo sapiens
agcuuuaguccccugagcccca

SEQ ID NO: 1971295 - RNA, 13 nt, Homo sapiens
uuggcugcuggag

SEQ ID NO: 1971296 - RNA, 14 nt, Homo sapiens
gagacuccaucucu

SEQ ID NO: 1971297 - RNA, 10 nt, Homo sapiens
cucaauguuu

SEQ ID NO: 1971298 - RNA, 17 nt, Homo sapiens
uuuugugguccuguaaa

SEQ ID NO: 1971299 - RNA, 17 nt, Homo sapiens
caacugaacugaacuaa

SEQ ID NO: 1971300 - RNA, 13 nt, Homo sapiens
aaagcacagauuu

SEQ ID NO: 1971301 - RNA, 23 nt, Homo sapiens
cauguuuuuucugcaaugacugu

SEQ ID NO: 1971302 - RNA, 22 nt, Homo sapiens
cacuagcccuccucucccagug

SEQ ID NO: 1971303 - RNA, 15 nt, Homo sapiens
aggugacugaaggcu

SEQ ID NO: 1971304 - RNA, 16 nt, Homo sapiens
agcaaugggucuuagc

SEQ ID NO: 1971305 - RNA, 12 nt, Homo sapiens
caugucacugug

SEQ ID NO: 1971306 - RNA, 14 nt, Homo sapiens
gauucugacauuua

SEQ ID NO: 1971307 - RNA, 14 nt, Homo sapiens
cuuuuugaguuuca

SEQ ID NO: 1971308 - RNA, 17 nt, Homo sapiens
cugcagucaucuacuuu

SEQ ID NO: 1971309 - RNA, 13 nt, Homo sapiens
gagaaucacuuga

SEQ ID NO: 1971310 - RNA, 18 nt, Homo sapiens
gacuagauuucaagcuaa

SEQ ID NO: 1971311 - RNA, 15 nt, Homo sapiens
ucucacaagcacuuu

SEQ ID NO: 1971312 - RNA, 23 nt, Homo sapiens
cauggugagccuagcccugggac

SEQ ID NO: 1971313 - RNA, 17 nt, Homo sapiens
caucaucuucuggguua

SEQ ID NO: 1971314 - RNA, 23 nt, Homo sapiens
aaguagcaaauguuuacuguauc

SEQ ID NO: 1971315 - RNA, 22 nt, Homo sapiens
cugaagagaccuuggcugcuca

SEQ ID NO: 1971316 - RNA, 21 nt, Homo sapiens
uaucuguuuuuauuagccaau

SEQ ID NO: 1971317 - RNA, 17 nt, Homo sapiens
guguacagagagauauu

SEQ ID NO: 1971318 - RNA, 17 nt, Homo sapiens
aaaguuuuuaauuugau

SEQ ID NO: 1971319 - RNA, 21 nt, Homo sapiens
uaagaugugcagcauuucacu

SEQ ID NO: 1971320 - RNA, 21 nt, Homo sapiens
uuagaaauaaugaaggugcca

SEQ ID NO: 1971321 - RNA, 16 nt, Homo sapiens
cagacugugucuuauu

SEQ ID NO: 1971322 - RNA, 20 nt, Homo sapiens
accuucuguggcucacagaa

SEQ ID NO: 1971323 - RNA, 19 nt, Homo sapiens
ucccauuucuacucuccca

SEQ ID NO: 1971324 - RNA, 19 nt, Homo sapiens
ccuuggagggacaugacua

SEQ ID NO: 1971325 - RNA, 15 nt, Homo sapiens
aacaggccauuguga

SEQ ID NO: 1971326 - RNA, 16 nt, Homo sapiens
uaauugcacgugugua

SEQ ID NO: 1971327 - RNA, 19 nt, Homo sapiens
gggccagcaggagccagcc

SEQ ID NO: 1971328 - RNA, 20 nt, Homo sapiens
ugucaauaaggagcaucagc

SEQ ID NO: 1971329 - RNA, 14 nt, Homo sapiens
gaacuucuuugcag

SEQ ID NO: 1971330 - RNA, 16 nt, Homo sapiens
uuccauucucaccuau

SEQ ID NO: 1971331 - RNA, 12 nt, Homo sapiens
ugaaauccacac

SEQ ID NO: 1971332 - RNA, 24 nt, Homo sapiens
acaacaccuuccuccugcagacac

SEQ ID NO: 1971333 - RNA, 15 nt, Homo sapiens
cuugauuuuuaucuc

SEQ ID NO: 1971334 - RNA, 20 nt, Homo sapiens
cccuaaguaaguuucuuccu

SEQ ID NO: 1971335 - RNA, 23 nt, Homo sapiens
gccaaacagcaagaagcuguuac

SEQ ID NO: 1971336 - RNA, 22 nt, Homo sapiens
cuaggaaaagggauacuuugau

SEQ ID NO: 1971337 - RNA, 23 nt, Homo sapiens
ggagaaccucguugacaugcaca

SEQ ID NO: 1971338 - RNA, 18 nt, Homo sapiens
acccuacuuucauuccuc

SEQ ID NO: 1971339 - RNA, 20 nt, Homo sapiens
cuucacgguuucacuuuuaa

SEQ ID NO: 1971340 - RNA, 15 nt, Homo sapiens
auggauucacuucua

SEQ ID NO: 1971341 - RNA, 15 nt, Homo sapiens
aacaacuuacacuua

SEQ ID NO: 1971342 - RNA, 21 nt, Homo sapiens
uccugcugccuuuucuggagu

SEQ ID NO: 1971343 - RNA, 19 nt, Homo sapiens
acagauguucccccaucuc

SEQ ID NO: 1971344 - RNA, 20 nt, Homo sapiens
aauuucugagaacagugcac

SEQ ID NO: 1971345 - RNA, 20 nt, Homo sapiens
uuaucauggagaacagcaug

SEQ ID NO: 1971346 - RNA, 16 nt, Homo sapiens
gacggaaaaggggugg

SEQ ID NO: 1971347 - RNA, 17 nt, Homo sapiens
ugcugcaaauacuguau

SEQ ID NO: 1971348 - RNA, 22 nt, Homo sapiens
agaacaaaggacagaguaugaa

SEQ ID NO: 1971349 - RNA, 17 nt, Homo sapiens
gggcugcgccugcugca

SEQ ID NO: 1971350 - RNA, 19 nt, Homo sapiens
gaguuacuuagaaugccau

SEQ ID NO: 1971351 - RNA, 19 nt, Homo sapiens
gcuuagccccgcugagcuu

SEQ ID NO: 1971352 - RNA, 22 nt, Homo sapiens
cucagguagaagguugacacag

SEQ ID NO: 1971353 - RNA, 19 nt, Homo sapiens
ucuuccgucuaaucucuca

SEQ ID NO: 1971354 - RNA, 16 nt, Homo sapiens
uauggugaacccacaa

SEQ ID NO: 1971355 - RNA, 18 nt, Homo sapiens
aaagaagaaaacaguaca

SEQ ID NO: 1971356 - RNA, 13 nt, Homo sapiens
acgaaggggcccc

SEQ ID NO: 1971357 - RNA, 14 nt, Homo sapiens
ucagcaucugugau

SEQ ID NO: 1971358 - RNA, 22 nt, Homo sapiens
ggcacuuaggggagaugacauu

SEQ ID NO: 1971359 - RNA, 17 nt, Homo sapiens
gaucucacaagcacuuu

SEQ ID NO: 1971360 - RNA, 13 nt, Homo sapiens
aucagaagcacaa

SEQ ID NO: 1971361 - RNA, 13 nt, Homo sapiens
augagaagcagaa

SEQ ID NO: 1971362 - RNA, 16 nt, Homo sapiens
uuuccguaaaugcaaa

SEQ ID NO: 1971363 - RNA, 15 nt, Homo sapiens
cauucuauauuccuu

SEQ ID NO: 1971364 - RNA, 19 nt, Homo sapiens
ucagaaguuaguuuguaua

SEQ ID NO: 1971365 - RNA, 18 nt, Homo sapiens
ucuauuuuugaugacuca

SEQ ID NO: 1971366 - RNA, 17 nt, Homo sapiens
aggacgucuucuaggga

SEQ ID NO: 1971367 - RNA, 15 nt, Homo sapiens
cuuucacaagcaaca

SEQ ID NO: 1971368 - RNA, 13 nt, Homo sapiens
caacagccggcug

SEQ ID NO: 1971369 - RNA, 22 nt, Homo sapiens
aggggaaaagaaaaucuuuuaa

SEQ ID NO: 1971370 - RNA, 18 nt, Homo sapiens
auuccagguagcucggca

SEQ ID NO: 1971371 - RNA, 19 nt, Homo sapiens
cuccucuuuuuucuuguca

SEQ ID NO: 1971372 - RNA, 23 nt, Homo sapiens
uggccaguugcccagagcacuuu

SEQ ID NO: 1971373 - RNA, 15 nt, Homo sapiens
ccuguaauucagugu

SEQ ID NO: 1971374 - RNA, 14 nt, Homo sapiens
cccuuuagaucucu

SEQ ID NO: 1971375 - RNA, 19 nt, Homo sapiens
cagauuccaccuagagcua

SEQ ID NO: 1971376 - RNA, 15 nt, Homo sapiens
aacaaugaauugaau

SEQ ID NO: 1971377 - RNA, 15 nt, Homo sapiens
aaugauuaaucaaag

SEQ ID NO: 1971378 - RNA, 19 nt, Homo sapiens
caaaaugcacuucuauuua

SEQ ID NO: 1971379 - RNA, 19 nt, Homo sapiens
ucccaggccccaugaccuc

SEQ ID NO: 1971380 - RNA, 20 nt, Homo sapiens
agcuccaaaacuggaccacc

SEQ ID NO: 1971381 - RNA, 19 nt, Homo sapiens
uguucucaacuucaaaagu

SEQ ID NO: 1971382 - RNA, 14 nt, Homo sapiens
ggccuugcuugccc

SEQ ID NO: 1971383 - RNA, 19 nt, Homo sapiens
uugccacccaagagagaac

SEQ ID NO: 1971384 - RNA, 13 nt, Homo sapiens
gaggccuuggaaa

SEQ ID NO: 1971385 - RNA, 14 nt, Homo sapiens
cugggcagcauagc

SEQ ID NO: 1971386 - RNA, 20 nt, Homo sapiens
cuaucuauggcccugcaaaa

SEQ ID NO: 1971387 - RNA, 19 nt, Homo sapiens
ucuauaauuuuacaaggga

SEQ ID NO: 1971388 - RNA, 19 nt, Homo sapiens
gcacuauguuuccauuugu

SEQ ID NO: 1971389 - RNA, 16 nt, Homo sapiens
uugaauucauuucacu

SEQ ID NO: 1971390 - RNA, 15 nt, Homo sapiens
cauacuuucucuuca

SEQ ID NO: 1971391 - RNA, 16 nt, Homo sapiens
uuuaacauuuaucuaa

SEQ ID NO: 1971392 - RNA, 23 nt, Homo sapiens
ugcaguauauuucugaaaugaca

SEQ ID NO: 1971393 - RNA, 17 nt, Homo sapiens
ugguguugccaguuguc

SEQ ID NO: 1971394 - RNA, 17 nt, Homo sapiens
auggagacuccaugaga

SEQ ID NO: 1971395 - RNA, 13 nt, Homo sapiens
gcugaacuggauu

SEQ ID NO: 1971396 - RNA, 17 nt, Homo sapiens
uagugcacacuuguaua

SEQ ID NO: 1971397 - RNA, 20 nt, Homo sapiens
ggucaggagauggagaccau

SEQ ID NO: 1971398 - RNA, 21 nt, Homo sapiens
agacauuggcaccuaauccag

SEQ ID NO: 1971399 - RNA, 21 nt, Homo sapiens
ggggcuuguccugugcuugcu

SEQ ID NO: 1971400 - RNA, 22 nt, Homo sapiens
aguuucuaucccuuaccugcuu

SEQ ID NO: 1971401 - RNA, 20 nt, Homo sapiens
augugguguauauccuucca

SEQ ID NO: 1971402 - RNA, 16 nt, Homo sapiens
augcugccuggugggg

SEQ ID NO: 1971403 - RNA, 18 nt, Homo sapiens
cauauuuuuugcacagcu

SEQ ID NO: 1971404 - RNA, 21 nt, Homo sapiens
gcuaguucccaugacuccugg

SEQ ID NO: 1971405 - RNA, 19 nt, Homo sapiens
acaagaguggacucagugg

SEQ ID NO: 1971406 - RNA, 14 nt, Homo sapiens
gacaaaagaaacuu

SEQ ID NO: 1971407 - RNA, 21 nt, Homo sapiens
ucaugcccgccagugcacagg

SEQ ID NO: 1971408 - RNA, 21 nt, Homo sapiens
gcaaauacaaucagcccagug

SEQ ID NO: 1971409 - RNA, 18 nt, Homo sapiens
aguauauggcauaugaau

SEQ ID NO: 1971410 - RNA, 19 nt, Homo sapiens
gaaccagcagaaaugcccc

SEQ ID NO: 1971411 - RNA, 18 nt, Homo sapiens
ccauccagggucuggcag

SEQ ID NO: 1971412 - RNA, 21 nt, Homo sapiens
ccagggugauuuuaugaucag

SEQ ID NO: 1971413 - RNA, 18 nt, Homo sapiens
ugagaaaugccagugugc

SEQ ID NO: 1971414 - RNA, 23 nt, Homo sapiens
uguugguaccuuucuagccuuag

SEQ ID NO: 1971415 - RNA, 17 nt, Homo sapiens
cucaccucucccucgau

SEQ ID NO: 1971416 - RNA, 14 nt, Homo sapiens
agugggcagugcau

SEQ ID NO: 1971417 - RNA, 14 nt, Homo sapiens
ucagacaccugugu

SEQ ID NO: 1971418 - RNA, 20 nt, Homo sapiens
gagaagaaagugaaagcaaa

SEQ ID NO: 1971419 - RNA, 23 nt, Homo sapiens
cgaaacugacuugcucaccugga

SEQ ID NO: 1971420 - RNA, 20 nt, Homo sapiens
aaucuccauuucuacugugu

SEQ ID NO: 1971421 - RNA, 15 nt, Homo sapiens
augggggcaucucuu

SEQ ID NO: 1971422 - RNA, 17 nt, Homo sapiens
gcuguguaaaugcucca

SEQ ID NO: 1971423 - RNA, 22 nt, Homo sapiens
cagacauacauuuaugcacauu

SEQ ID NO: 1971424 - RNA, 17 nt, Homo sapiens
ugggucuucacucugac

SEQ ID NO: 1971425 - RNA, 16 nt, Homo sapiens
cugggggacagaggaa

SEQ ID NO: 1971426 - RNA, 13 nt, Homo sapiens
cuuuuugaucuca

SEQ ID NO: 1971427 - RNA, 13 nt, Homo sapiens
ucgcaugacuguu

SEQ ID NO: 1971428 - RNA, 18 nt, Homo sapiens
ccuguuguuuuggcucaa

SEQ ID NO: 1971429 - RNA, 17 nt, Homo sapiens
ugcuggugaacacugug

SEQ ID NO: 1971430 - RNA, 15 nt, Homo sapiens
auuaccagaaccaca

SEQ ID NO: 1971431 - RNA, 16 nt, Homo sapiens
gucgagacauuccugc

SEQ ID NO: 1971432 - RNA, 11 nt, Homo sapiens
aacauguaauu

SEQ ID NO: 1971433 - RNA, 21 nt, Homo sapiens
uagucauuaacccaucucuga

SEQ ID NO: 1971434 - RNA, 16 nt, Homo sapiens
aggagacgacaggcga

SEQ ID NO: 1971435 - RNA, 15 nt, Homo sapiens
caccagcagcacugg

SEQ ID NO: 1971436 - RNA, 23 nt, Homo sapiens
aacugaggaaugcgguucagggc

SEQ ID NO: 1971437 - RNA, 18 nt, Homo sapiens
auuaagcaaacacuugaa

SEQ ID NO: 1971438 - RNA, 14 nt, Homo sapiens
uugacucagcacug

SEQ ID NO: 1971439 - RNA, 15 nt, Homo sapiens
cuucugaugucauau

SEQ ID NO: 1971440 - RNA, 19 nt, Homo sapiens
aaagauuugcaacauuaga

SEQ ID NO: 1971441 - RNA, 19 nt, Homo sapiens
auuaacaugauguacuaaa

SEQ ID NO: 1971442 - RNA, 16 nt, Homo sapiens
agcccaccuuggcuca

SEQ ID NO: 1971443 - RNA, 13 nt, Homo sapiens
gguggaugugaug

SEQ ID NO: 1971444 - RNA, 18 nt, Homo sapiens
cugagauaggagauacaa

SEQ ID NO: 1971445 - RNA, 17 nt, Homo sapiens
accccugaaaugcucuc

SEQ ID NO: 1971446 - RNA, 19 nt, Homo sapiens
aggaacaaaaaaaccacaa

SEQ ID NO: 1971447 - RNA, 18 nt, Homo sapiens
uguauuugcaaggcugau

SEQ ID NO: 1971448 - RNA, 17 nt, Homo sapiens
ggcgagcagccacuggc

SEQ ID NO: 1971449 - RNA, 19 nt, Homo sapiens
aauuaucuuuuuucuuccu

SEQ ID NO: 1971450 - RNA, 19 nt, Homo sapiens
gcugagaaaaguauucuca

SEQ ID NO: 1971451 - RNA, 22 nt, Homo sapiens
gucccauggguuaagagcucac

SEQ ID NO: 1971452 - RNA, 14 nt, Homo sapiens
aggggccacaccaa

SEQ ID NO: 1971453 - RNA, 19 nt, Homo sapiens
caaccgaacaugaccaaaa

SEQ ID NO: 1971454 - RNA, 15 nt, Homo sapiens
ugagccaugcuacag

SEQ ID NO: 1971455 - RNA, 22 nt, Homo sapiens
uaacauuaccuuacuguggagg

SEQ ID NO: 1971456 - RNA, 22 nt, Homo sapiens
ccgcccuucccacagcauuccu

SEQ ID NO: 1971457 - RNA, 16 nt, Homo sapiens
auaggaaugcuaacag

SEQ ID NO: 1971458 - RNA, 19 nt, Homo sapiens
accaacgcacaacaggaaa

SEQ ID NO: 1971459 - RNA, 21 nt, Homo sapiens
uuucaaagugucucauucuca

SEQ ID NO: 1971460 - RNA, 12 nt, Homo sapiens
accucuguggac

SEQ ID NO: 1971461 - RNA, 18 nt, Homo sapiens
agaccuuuucacaaugga

SEQ ID NO: 1971462 - RNA, 14 nt, Homo sapiens
agcaguaguggcau

SEQ ID NO: 1971463 - RNA, 14 nt, Homo sapiens
ugcagcagaggcac

SEQ ID NO: 1971464 - RNA, 15 nt, Homo sapiens
aagagaaaugagcug

SEQ ID NO: 1971465 - RNA, 17 nt, Homo sapiens
agugaaacuaugauccc

SEQ ID NO: 1971466 - RNA, 17 nt, Homo sapiens
uggacaaacagugcacu

SEQ ID NO: 1971467 - RNA, 21 nt, Homo sapiens
cccugcugccacagcaaggaa

SEQ ID NO: 1971468 - RNA, 16 nt, Homo sapiens
gacaggaggcggcccg

SEQ ID NO: 1971469 - RNA, 13 nt, Homo sapiens
ugccgacacuguu

SEQ ID NO: 1971470 - RNA, 22 nt, Homo sapiens
uuccaugauguuacauuaggaa

SEQ ID NO: 1971471 - RNA, 14 nt, Homo sapiens
aggcauggcucaga

SEQ ID NO: 1971472 - RNA, 20 nt, Homo sapiens
cagacuggugggcuagccaa

SEQ ID NO: 1971473 - RNA, 14 nt, Homo sapiens
ugacaugugcuuug

SEQ ID NO: 1971474 - RNA, 21 nt, Homo sapiens
caaaaucuuguuaaugucauu

SEQ ID NO: 1971475 - RNA, 14 nt, Homo sapiens
aaccauaacacuug

SEQ ID NO: 1971476 - RNA, 19 nt, Homo sapiens
acaccguccuccacgccau

SEQ ID NO: 1971477 - RNA, 21 nt, Homo sapiens
auacuuuuaaagccuauucac

SEQ ID NO: 1971478 - RNA, 15 nt, Homo sapiens
gcaauaccagugaca

SEQ ID NO: 1971479 - RNA, 13 nt, Homo sapiens
agggccucuggga

SEQ ID NO: 1971480 - RNA, 13 nt, Homo sapiens
agauccucugaua

SEQ ID NO: 1971481 - RNA, 18 nt, Homo sapiens
ggcuucacuguauaaaua

SEQ ID NO: 1971482 - RNA, 22 nt, Homo sapiens
agcucuuccccaucucacucuu

SEQ ID NO: 1971483 - RNA, 17 nt, Homo sapiens
gacauguaaaaagacaa

SEQ ID NO: 1971484 - RNA, 23 nt, Homo sapiens
ggagcagucggcacagugcagca

SEQ ID NO: 1971485 - RNA, 23 nt, Homo sapiens
cugggauuacagguguaagccac

SEQ ID NO: 1971486 - RNA, 12 nt, Homo sapiens
ccaaagugcaug

SEQ ID NO: 1971487 - RNA, 18 nt, Homo sapiens
ccgauguacacacacaga

SEQ ID NO: 1971488 - RNA, 15 nt, Homo sapiens
gacccugugcaucug

SEQ ID NO: 1971489 - RNA, 15 nt, Homo sapiens
cccuagaucaacaga

SEQ ID NO: 1971490 - RNA, 23 nt, Homo sapiens
cugcagucccauccucuugucag

SEQ ID NO: 1971491 - RNA, 14 nt, Homo sapiens
ugccucggccuccc

SEQ ID NO: 1971492 - RNA, 23 nt, Homo sapiens
ccauacacacacacaaaaacaga

SEQ ID NO: 1971493 - RNA, 23 nt, Homo sapiens
caaagcaccugaaccacuguggc

SEQ ID NO: 1971494 - RNA, 16 nt, Homo sapiens
ucaucaccacagggau

SEQ ID NO: 1971495 - RNA, 20 nt, Homo sapiens
guuggucaaaugaccuagaa

SEQ ID NO: 1971496 - RNA, 13 nt, Homo sapiens
ucaaacaaagcca

SEQ ID NO: 1971497 - RNA, 19 nt, Homo sapiens
uggaaaaugcuucuuggcu

SEQ ID NO: 1971498 - RNA, 19 nt, Homo sapiens
gcccaggcugggugcaguc

SEQ ID NO: 1971499 - RNA, 17 nt, Homo sapiens
caucucuaguguagcug

SEQ ID NO: 1971500 - RNA, 15 nt, Homo sapiens
auucuagugagucaa

SEQ ID NO: 1971501 - RNA, 23 nt, Homo sapiens
ggcuucagcccccaccaggggaa

SEQ ID NO: 1971502 - RNA, 17 nt, Homo sapiens
uugcaugaguauuugcu

SEQ ID NO: 1971503 - RNA, 17 nt, Homo sapiens
uugcaucaguauuuccu

SEQ ID NO: 1971504 - RNA, 23 nt, Homo sapiens
agagauuuucuuggcaguauucc

SEQ ID NO: 1971505 - RNA, 19 nt, Homo sapiens
gaaacccaccaaucuacuu

SEQ ID NO: 1971506 - RNA, 22 nt, Homo sapiens
aagucagcuccagcuuucugcc

SEQ ID NO: 1971507 - RNA, 17 nt, Homo sapiens
ugcaagguauuucucca

SEQ ID NO: 1971508 - RNA, 16 nt, Homo sapiens
agcacacaugugcaca

SEQ ID NO: 1971509 - RNA, 14 nt, Homo sapiens
gaaauuucacuuca

SEQ ID NO: 1971510 - RNA, 21 nt, Homo sapiens
aggcugugagccaaggaggga

SEQ ID NO: 1971511 - RNA, 14 nt, Homo sapiens
cugugaauuucaaa

SEQ ID NO: 1971512 - RNA, 18 nt, Homo sapiens
caccccgccugcccucau

SEQ ID NO: 1971513 - RNA, 18 nt, Homo sapiens
ugcucugcuggucuucaa

SEQ ID NO: 1971514 - RNA, 14 nt, Homo sapiens
ccucagggacaacu

SEQ ID NO: 1971515 - RNA, 17 nt, Homo sapiens
ccuucucugugcaguag

SEQ ID NO: 1971516 - RNA, 17 nt, Homo sapiens
cuaaaaaugcaucacau

SEQ ID NO: 1971517 - RNA, 22 nt, Homo sapiens
ccuguucauuguaagcacuuuu

SEQ ID NO: 1971518 - RNA, 22 nt, Homo sapiens
uucacaaguacuaucuguuccc

SEQ ID NO: 1971519 - RNA, 17 nt, Homo sapiens
accucgaccugaugcag

SEQ ID NO: 1971520 - RNA, 19 nt, Homo sapiens
uaaugacuuuauguauuau

SEQ ID NO: 1971521 - RNA, 17 nt, Homo sapiens
gaaccauuuucaccuau

SEQ ID NO: 1971522 - RNA, 22 nt, Homo sapiens
agauaaguuugcaguuggcuaa

SEQ ID NO: 1971523 - RNA, 14 nt, Homo sapiens
cugagagaccucag

SEQ ID NO: 1971524 - RNA, 21 nt, Homo sapiens
auuacaugcccaucccagugu

SEQ ID NO: 1971525 - RNA, 15 nt, Homo sapiens
cuuuccaucugagga

SEQ ID NO: 1971526 - RNA, 17 nt, Homo sapiens
aaauaaaaugaaauguc

SEQ ID NO: 1971527 - RNA, 14 nt, Homo sapiens
cccaugugagggaa

SEQ ID NO: 1971528 - RNA, 15 nt, Homo sapiens
auuuccggccaacag

SEQ ID NO: 1971529 - RNA, 16 nt, Homo sapiens
gacucuuugauaugcc

SEQ ID NO: 1971530 - RNA, 11 nt, Homo sapiens
uacugauucuc

SEQ ID NO: 1971531 - RNA, 16 nt, Homo sapiens
cuguaaugcacuccug

SEQ ID NO: 1971532 - RNA, 14 nt, Homo sapiens
auacuacacauuca

SEQ ID NO: 1971533 - RNA, 12 nt, Homo sapiens
auuauguacaaa

SEQ ID NO: 1971534 - RNA, 12 nt, Homo sapiens
auuuuguacaau

SEQ ID NO: 1971535 - RNA, 16 nt, Homo sapiens
caucauaugccugacc

SEQ ID NO: 1971536 - RNA, 22 nt, Homo sapiens
cgugaguaguuguuggucugua

SEQ ID NO: 1971537 - RNA, 11 nt, Homo sapiens
acccaugaccg

SEQ ID NO: 1971538 - RNA, 16 nt, Homo sapiens
cagcacggacaauaaa

SEQ ID NO: 1971539 - RNA, 22 nt, Homo sapiens
cccauccaucuucccuacccuu

SEQ ID NO: 1971540 - RNA, 18 nt, Homo sapiens
aggcugaucccugagauc

SEQ ID NO: 1971541 - RNA, 17 nt, Homo sapiens
uggggcaggcugcuuca

SEQ ID NO: 1971542 - RNA, 14 nt, Homo sapiens
gauggcccuggaca

SEQ ID NO: 1971543 - RNA, 17 nt, Homo sapiens
auaugacaauaagccac

SEQ ID NO: 1971544 - RNA, 18 nt, Homo sapiens
agcaaguguucacugcuc

SEQ ID NO: 1971545 - RNA, 17 nt, Homo sapiens
aaagggagaaaugccag

SEQ ID NO: 1971546 - RNA, 18 nt, Homo sapiens
gaaacucacgaugaaauu

SEQ ID NO: 1971547 - RNA, 13 nt, Homo sapiens
ucuugcaaaagau

SEQ ID NO: 1971548 - RNA, 21 nt, Homo sapiens
auccgguccccugccuggaac

SEQ ID NO: 1971549 - RNA, 12 nt, Homo sapiens
gcacacacagau

SEQ ID NO: 1971550 - RNA, 16 nt, Homo sapiens
gaauuuuaaaagcaua

SEQ ID NO: 1971551 - RNA, 23 nt, Homo sapiens
cucccuucaacuguauaccgugu

SEQ ID NO: 1971552 - RNA, 13 nt, Homo sapiens
aauacaaaaagca

SEQ ID NO: 1971553 - RNA, 19 nt, Homo sapiens
ucagcucuggagaacagug

SEQ ID NO: 1971554 - RNA, 13 nt, Homo sapiens
cuccauccaugug

SEQ ID NO: 1971555 - RNA, 16 nt, Homo sapiens
ggggcgagcacuguga

SEQ ID NO: 1971556 - RNA, 22 nt, Homo sapiens
uuugaagcuacuguguguguga

SEQ ID NO: 1971557 - RNA, 22 nt, Homo sapiens
ccagcaucugaagacucaggca

SEQ ID NO: 1971558 - RNA, 17 nt, Homo sapiens
gcugucagaugucacau

SEQ ID NO: 1971559 - RNA, 14 nt, Homo sapiens
augagauuggaaaa

SEQ ID NO: 1971560 - RNA, 16 nt, Homo sapiens
uuucauuuuuaggaau

SEQ ID NO: 1971561 - RNA, 13 nt, Homo sapiens
uggaaucuuguaa

SEQ ID NO: 1971562 - RNA, 19 nt, Homo sapiens
ucugaucaagaacauguca

SEQ ID NO: 1971563 - RNA, 22 nt, Homo sapiens
gaaaaucuuuauaugcaguaua

SEQ ID NO: 1971564 - RNA, 15 nt, Homo sapiens
ggggguggacacaga

SEQ ID NO: 1971565 - RNA, 16 nt, Homo sapiens
gcagaaucuuugcaag

SEQ ID NO: 1971566 - RNA, 23 nt, Homo sapiens
caauuucauacuaaacugauuaa

SEQ ID NO: 1971567 - RNA, 21 nt, Homo sapiens
ccucgucaagagcaugcacau

SEQ ID NO: 1971568 - RNA, 15 nt, Homo sapiens
guugcaugauguauu

SEQ ID NO: 1971569 - RNA, 23 nt, Homo sapiens
ugaugucauaagcgaucacuucc

SEQ ID NO: 1971570 - RNA, 21 nt, Homo sapiens
uugcccccugugcccucugga

SEQ ID NO: 1971571 - RNA, 15 nt, Homo sapiens
cauacggagcagaau

SEQ ID NO: 1971572 - RNA, 14 nt, Homo sapiens
gcuuacuccacuuc

SEQ ID NO: 1971573 - RNA, 18 nt, Homo sapiens
uccccuuuguguagaaag

SEQ ID NO: 1971574 - RNA, 16 nt, Homo sapiens
cacccuggacaaagaa

SEQ ID NO: 1971575 - RNA, 15 nt, Homo sapiens
agaaugucauuugcu

SEQ ID NO: 1971576 - RNA, 18 nt, Homo sapiens
agcaaaggagacaaagca

SEQ ID NO: 1971577 - RNA, 16 nt, Homo sapiens
caagagccacaguaua

SEQ ID NO: 1971578 - RNA, 19 nt, Homo sapiens
gaagaguuaagaagaaaau

SEQ ID NO: 1971579 - RNA, 18 nt, Homo sapiens
ccucaucccuccaucuca

SEQ ID NO: 1971580 - RNA, 20 nt, Homo sapiens
cgcuggguauuggaaaugga

SEQ ID NO: 1971581 - RNA, 18 nt, Homo sapiens
ugugugaggacuucugca

SEQ ID NO: 1971582 - RNA, 13 nt, Homo sapiens
aacauuucucacu

SEQ ID NO: 1971583 - RNA, 15 nt, Homo sapiens
auuucugucucucuc

SEQ ID NO: 1971584 - RNA, 22 nt, Homo sapiens
acauaaaauaaacugaacauau

SEQ ID NO: 1971585 - RNA, 12 nt, Homo sapiens
gcauuacuuuau

SEQ ID NO: 1971586 - RNA, 22 nt, Homo sapiens
cacagacuggcaauaaacuccu

SEQ ID NO: 1971587 - RNA, 21 nt, Homo sapiens
cugaagcccucugucuaccug

SEQ ID NO: 1971588 - RNA, 14 nt, Homo sapiens
gagugauccuccaa

SEQ ID NO: 1971589 - RNA, 23 nt, Homo sapiens
uccuugaccagcagaucccagcu

SEQ ID NO: 1971590 - RNA, 24 nt, Homo sapiens
ccuuguccacccaccuaugugcca

SEQ ID NO: 1971591 - RNA, 18 nt, Homo sapiens
caagauuaucaacugugu

SEQ ID NO: 1971592 - RNA, 13 nt, Homo sapiens
gugucccauagaa

SEQ ID NO: 1971593 - RNA, 16 nt, Homo sapiens
ucuguuuucuaaagga

SEQ ID NO: 1971594 - RNA, 16 nt, Homo sapiens
cccggccacaacuaca

SEQ ID NO: 1971595 - RNA, 18 nt, Homo sapiens
auggggagucucaugcaa

SEQ ID NO: 1971596 - RNA, 19 nt, Homo sapiens
ccacagcugugcaugcuca

SEQ ID NO: 1971597 - RNA, 11 nt, Homo sapiens
ugagcacacac

SEQ ID NO: 1971598 - RNA, 17 nt, Homo sapiens
cuuuccuaaagccaaag

SEQ ID NO: 1971599 - RNA, 15 nt, Homo sapiens
gauauuccaagggcu

SEQ ID NO: 1971600 - RNA, 19 nt, Homo sapiens
ggcuacaguaaccaaaaca

SEQ ID NO: 1971601 - RNA, 20 nt, Homo sapiens
gcagccuccgucauccaugc

SEQ ID NO: 1971602 - RNA, 18 nt, Homo sapiens
gucacaaagaccuugcug

SEQ ID NO: 1971603 - RNA, 16 nt, Homo sapiens
auguaugacaagacaa

SEQ ID NO: 1971604 - RNA, 12 nt, Homo sapiens
acuguauacauu

SEQ ID NO: 1971605 - RNA, 21 nt, Homo sapiens
ucuuucaccuuucccuaaaga

SEQ ID NO: 1971606 - RNA, 22 nt, Homo sapiens
uccuagugccuacaaugggaaa

SEQ ID NO: 1971607 - RNA, 14 nt, Homo sapiens
gaauccuacagccu

SEQ ID NO: 1971608 - RNA, 20 nt, Homo sapiens
aucuguuucugugucuuaau

SEQ ID NO: 1971609 - RNA, 18 nt, Homo sapiens
cccaggugcaggugcuga

SEQ ID NO: 1971610 - RNA, 21 nt, Homo sapiens
auaaaucuaaugacauucaau

SEQ ID NO: 1971611 - RNA, 20 nt, Homo sapiens
ggacuccuccuuuauuucag

SEQ ID NO: 1971612 - RNA, 17 nt, Homo sapiens
gaggcugggaucugcga

SEQ ID NO: 1971613 - RNA, 16 nt, Homo sapiens
aaacaccuucucugga

SEQ ID NO: 1971614 - RNA, 16 nt, Homo sapiens
caagaauguaacucca

SEQ ID NO: 1971615 - RNA, 16 nt, Homo sapiens
caaaaucacacagcca

SEQ ID NO: 1971616 - RNA, 15 nt, Homo sapiens
acaagcuuacuucca

SEQ ID NO: 1971617 - RNA, 23 nt, Homo sapiens
ggacagcucagaaaaucaaagag

SEQ ID NO: 1971618 - RNA, 14 nt, Homo sapiens
ucuauuauacugua

SEQ ID NO: 1971619 - RNA, 14 nt, Homo sapiens
cugauuuccaucca

SEQ ID NO: 1971620 - RNA, 19 nt, Homo sapiens
cauaauguugaacauucau

SEQ ID NO: 1971621 - RNA, 13 nt, Homo sapiens
uauggcuagacag

SEQ ID NO: 1971622 - RNA, 18 nt, Homo sapiens
aacugccuguucaauaaa

SEQ ID NO: 1971623 - RNA, 13 nt, Homo sapiens
gaaauauucucuc

SEQ ID NO: 1971624 - RNA, 13 nt, Homo sapiens
uacccaccccagc

SEQ ID NO: 1971625 - RNA, 15 nt, Homo sapiens
aucagugugcaauac

SEQ ID NO: 1971626 - RNA, 18 nt, Homo sapiens
cuagaaacaacacuguag

SEQ ID NO: 1971627 - RNA, 17 nt, Homo sapiens
cuaccuauaacacucua

SEQ ID NO: 1971628 - RNA, 14 nt, Homo sapiens
cuugaauuucuaga

SEQ ID NO: 1971629 - RNA, 19 nt, Homo sapiens
ccacagaugcuugugauuu

SEQ ID NO: 1971630 - RNA, 16 nt, Homo sapiens
uguuuccagcacuauc

SEQ ID NO: 1971631 - RNA, 18 nt, Homo sapiens
ggguucugcuacucccca

SEQ ID NO: 1971632 - RNA, 21 nt, Homo sapiens
agccagccaucaaauagugaa

SEQ ID NO: 1971633 - RNA, 17 nt, Homo sapiens
auuuaguuuugucuuuc

SEQ ID NO: 1971634 - RNA, 18 nt, Homo sapiens
ggaaauguaaaagcacau

SEQ ID NO: 1971635 - RNA, 17 nt, Homo sapiens
aguacagauuguucuca

SEQ ID NO: 1971636 - RNA, 16 nt, Homo sapiens
gacuggacugugggcc

SEQ ID NO: 1971637 - RNA, 18 nt, Homo sapiens
agugguuaaaacauagcu

SEQ ID NO: 1971638 - RNA, 12 nt, Homo sapiens
aucacaaaaaca

SEQ ID NO: 1971639 - RNA, 17 nt, Homo sapiens
uaagaagcuucuaauaa

SEQ ID NO: 1971640 - RNA, 15 nt, Homo sapiens
auuaaaacugcacug

SEQ ID NO: 1971641 - RNA, 14 nt, Homo sapiens
cagagaugggaaaa

SEQ ID NO: 1971642 - RNA, 17 nt, Homo sapiens
auauaauggugauguca

SEQ ID NO: 1971643 - RNA, 18 nt, Homo sapiens
aaaugagaaagguauaua

SEQ ID NO: 1971644 - RNA, 20 nt, Homo sapiens
ccaauauuucucagacaucg

SEQ ID NO: 1971645 - RNA, 13 nt, Homo sapiens
agugguucagucu

SEQ ID NO: 1971646 - RNA, 21 nt, Homo sapiens
caucucaaagaaggcauuugc

SEQ ID NO: 1971647 - RNA, 14 nt, Homo sapiens
cagcaaaccucagu

SEQ ID NO: 1971648 - RNA, 12 nt, Homo sapiens
acauuguagccu

SEQ ID NO: 1971649 - RNA, 18 nt, Homo sapiens
uuaguaguuuuuacaaaa

SEQ ID NO: 1971650 - RNA, 13 nt, Homo sapiens
accucuaccaaaa

SEQ ID NO: 1971651 - RNA, 19 nt, Homo sapiens
agcauccuuggcaguggga

SEQ ID NO: 1971652 - RNA, 13 nt, Homo sapiens
gccauuuguacug

SEQ ID NO: 1971653 - RNA, 13 nt, Homo sapiens
ucugauggccagc

SEQ ID NO: 1971654 - RNA, 14 nt, Homo sapiens
acuucagacuuuca

SEQ ID NO: 1971655 - RNA, 12 nt, Homo sapiens
aagucaccuaca

SEQ ID NO: 1971656 - RNA, 21 nt, Homo sapiens
acuauucccacuuucauucaa

SEQ ID NO: 1971657 - RNA, 21 nt, Homo sapiens
uucagcauuuguucuuugcca

SEQ ID NO: 1971658 - RNA, 20 nt, Homo sapiens
aguuacuuuuuuacacugau

SEQ ID NO: 1971659 - RNA, 15 nt, Homo sapiens
ggaccauccuugaca

SEQ ID NO: 1971660 - RNA, 22 nt, Homo sapiens
ugauccaagcaagacugagggg

SEQ ID NO: 1971661 - RNA, 22 nt, Homo sapiens
uauuuaaagaaaaaaaaggcag

SEQ ID NO: 1971662 - RNA, 13 nt, Homo sapiens
auuaaaguuauaa

SEQ ID NO: 1971663 - RNA, 22 nt, Homo sapiens
agggaggugggggccuccucag

SEQ ID NO: 1971664 - RNA, 15 nt, Homo sapiens
cuuaauaccaaacau

SEQ ID NO: 1971665 - RNA, 16 nt, Homo sapiens
ucaacauaaagagcaa

SEQ ID NO: 1971666 - RNA, 22 nt, Homo sapiens
acuggugcaugacaaguacugu

SEQ ID NO: 1971667 - RNA, 16 nt, Homo sapiens
uccucaucagucucca

SEQ ID NO: 1971668 - RNA, 14 nt, Homo sapiens
aguggcaaaacacu

SEQ ID NO: 1971669 - RNA, 22 nt, Homo sapiens
aaaaaccaaacuguagcaagau

SEQ ID NO: 1971670 - RNA, 17 nt, Homo sapiens
uuguguuacugcaguga

SEQ ID NO: 1971671 - RNA, 19 nt, Homo sapiens
ugcuucaaaaacauucuua

SEQ ID NO: 1971672 - RNA, 23 nt, Homo sapiens
uuuacauguguagccuauguugu

SEQ ID NO: 1971673 - RNA, 15 nt, Homo sapiens
aacuaacuccagaag

SEQ ID NO: 1971674 - RNA, 19 nt, Homo sapiens
aucccucgggaagcagcca

SEQ ID NO: 1971675 - RNA, 11 nt, Homo sapiens
uguggccacaa

SEQ ID NO: 1971676 - RNA, 15 nt, Homo sapiens
gaaggaaaaacaugc

SEQ ID NO: 1971677 - RNA, 18 nt, Homo sapiens
agacacgacagcacacac

SEQ ID NO: 1971678 - RNA, 15 nt, Homo sapiens
ugguaaacauucucu

SEQ ID NO: 1971679 - RNA, 20 nt, Homo sapiens
uuagagcugagcacuuuuga

SEQ ID NO: 1971680 - RNA, 15 nt, Homo sapiens
cauaauacauuccau

SEQ ID NO: 1971681 - RNA, 23 nt, Homo sapiens
uccuuuccucuggcccagugaau

SEQ ID NO: 1971682 - RNA, 18 nt, Homo sapiens
gcugaugucuucuugggg

SEQ ID NO: 1971683 - RNA, 17 nt, Homo sapiens
gcuaaaugcagggaaac

SEQ ID NO: 1971684 - RNA, 17 nt, Homo sapiens
cuucuuguguaauguaa

SEQ ID NO: 1971685 - RNA, 16 nt, Homo sapiens
gaaccuggagggcuag

SEQ ID NO: 1971686 - RNA, 14 nt, Homo sapiens
ccagugggacccca

SEQ ID NO: 1971687 - RNA, 20 nt, Homo sapiens
acuaaaagcagcgucacucu

SEQ ID NO: 1971688 - RNA, 20 nt, Homo sapiens
cccccugacauuaucuugga

SEQ ID NO: 1971689 - RNA, 17 nt, Homo sapiens
guacuuaagaguggcau

SEQ ID NO: 1971690 - RNA, 20 nt, Homo sapiens
acucagcuauaccucauuca

SEQ ID NO: 1971691 - RNA, 21 nt, Homo sapiens
gcccagauugugccacugcuc

SEQ ID NO: 1971692 - RNA, 20 nt, Homo sapiens
uuuaacaucugcaguguucu

SEQ ID NO: 1971693 - RNA, 14 nt, Homo sapiens
cgacaaaauuccag

SEQ ID NO: 1971694 - RNA, 15 nt, Homo sapiens
gcucucacagacaua

SEQ ID NO: 1971695 - RNA, 22 nt, Homo sapiens
aauaugugggaauuagugagac

SEQ ID NO: 1971696 - RNA, 13 nt, Homo sapiens
uuagcugaacaau

SEQ ID NO: 1971697 - RNA, 15 nt, Homo sapiens
cuguuucaaacugag

SEQ ID NO: 1971698 - RNA, 15 nt, Homo sapiens
gcauuacaguauuuu

SEQ ID NO: 1971699 - RNA, 17 nt, Homo sapiens
gccaagccagucaagga

SEQ ID NO: 1971700 - RNA, 23 nt, Homo sapiens
gaacccugggacguggcuaguca

SEQ ID NO: 1971701 - RNA, 19 nt, Homo sapiens
gaccaaauggaaauaaagc

SEQ ID NO: 1971702 - RNA, 12 nt, Homo sapiens
ggcugcaaaaug

SEQ ID NO: 1971703 - RNA, 20 nt, Homo sapiens
agugaagagguuuuguugcu

SEQ ID NO: 1971704 - RNA, 18 nt, Homo sapiens
gaagagccccccacugca

SEQ ID NO: 1971705 - RNA, 22 nt, Homo sapiens
auguaguuugaauauuuuccac

SEQ ID NO: 1971706 - RNA, 14 nt, Homo sapiens
ucuauucucaaagu

SEQ ID NO: 1971707 - RNA, 16 nt, Homo sapiens
aaaauuuuaguccaaa

SEQ ID NO: 1971708 - RNA, 16 nt, Homo sapiens
cuagcuaagcaagcca

SEQ ID NO: 1971709 - RNA, 11 nt, Homo sapiens
acuucagucuu

SEQ ID NO: 1971710 - RNA, 13 nt, Homo sapiens
aucacugucaaua

SEQ ID NO: 1971711 - RNA, 14 nt, Homo sapiens
ugcaucuguuacuu

SEQ ID NO: 1971712 - RNA, 21 nt, Homo sapiens
ugcaauuuuauuaaaugcauc

SEQ ID NO: 1971713 - RNA, 10 nt, Homo sapiens
agaagaccuc

SEQ ID NO: 1971714 - RNA, 15 nt, Homo sapiens
gaggugggaggacag

SEQ ID NO: 1971715 - RNA, 13 nt, Homo sapiens
accaaugugugaa

SEQ ID NO: 1971716 - RNA, 18 nt, Homo sapiens
cugcggaccccucgucau

SEQ ID NO: 1971717 - RNA, 17 nt, Homo sapiens
ccugaguuggagcucau

SEQ ID NO: 1971718 - RNA, 14 nt, Homo sapiens
auucaaaaugaugu

SEQ ID NO: 1971719 - RNA, 23 nt, Homo sapiens
augcucaguuuaagguacacugu

SEQ ID NO: 1971720 - RNA, 21 nt, Homo sapiens
caauuucaccuugaaaaagca

SEQ ID NO: 1971721 - RNA, 23 nt, Homo sapiens
augaaccugcccugcucccacag

SEQ ID NO: 1971722 - RNA, 11 nt, Homo sapiens
aaacuugcauc

SEQ ID NO: 1971723 - RNA, 21 nt, Homo sapiens
uuaauguauuugauguauucu

SEQ ID NO: 1971724 - RNA, 17 nt, Homo sapiens
gcaagugugaauacugc

SEQ ID NO: 1971725 - RNA, 18 nt, Homo sapiens
ggcacaucauuucaagaa

SEQ ID NO: 1971726 - RNA, 17 nt, Homo sapiens
gugaagauuucauggac

SEQ ID NO: 1971727 - RNA, 18 nt, Homo sapiens
gucucucuuuggcuggaa

SEQ ID NO: 1971728 - RNA, 20 nt, Homo sapiens
guuccacacccaaugcugcu

SEQ ID NO: 1971729 - RNA, 23 nt, Homo sapiens
acugaagagaccacagcaauugg

SEQ ID NO: 1971730 - RNA, 20 nt, Homo sapiens
auacauguuguaaauggcau

SEQ ID NO: 1971731 - RNA, 18 nt, Homo sapiens
cugugcugggugagcucu

SEQ ID NO: 1971732 - RNA, 15 nt, Homo sapiens
auagaaguagcaaaa

SEQ ID NO: 1971733 - RNA, 17 nt, Homo sapiens
uucuuugcauucguccu

SEQ ID NO: 1971734 - RNA, 19 nt, Homo sapiens
uccaagaagccagcaccac

SEQ ID NO: 1971735 - RNA, 14 nt, Homo sapiens
aaccuagcuagcaa

SEQ ID NO: 1971736 - RNA, 16 nt, Homo sapiens
augucaacagaaggga

SEQ ID NO: 1971737 - RNA, 19 nt, Homo sapiens
uccauucuguagacuuuug

SEQ ID NO: 1971738 - RNA, 20 nt, Homo sapiens
uguaucuacaauacauauau

SEQ ID NO: 1971739 - RNA, 20 nt, Homo sapiens
cagcaaagaggacucgcuug

SEQ ID NO: 1971740 - RNA, 15 nt, Homo sapiens
cugacuucagggaag

SEQ ID NO: 1971741 - RNA, 13 nt, Homo sapiens
gccucucugcucc

SEQ ID NO: 1971742 - RNA, 13 nt, Homo sapiens
ucucuucuuccuu

SEQ ID NO: 1971743 - RNA, 16 nt, Homo sapiens
aagugaagcuggugga

SEQ ID NO: 1971744 - RNA, 16 nt, Homo sapiens
acgugucaggugguua

SEQ ID NO: 1971745 - RNA, 20 nt, Homo sapiens
augcauagccuggacacaga

SEQ ID NO: 1971746 - RNA, 16 nt, Homo sapiens
uucacaccuaugacau

SEQ ID NO: 1971747 - RNA, 15 nt, Homo sapiens
aaaguguguauuuaa

SEQ ID NO: 1971748 - RNA, 19 nt, Homo sapiens
cugcaaauacuuccaaaga

SEQ ID NO: 1971749 - RNA, 16 nt, Homo sapiens
ccgcaacagccaagug

SEQ ID NO: 1971750 - RNA, 15 nt, Homo sapiens
uaagagucugugcug

SEQ ID NO: 1971751 - RNA, 16 nt, Homo sapiens
ugucccaaguccugcu

SEQ ID NO: 1971752 - RNA, 12 nt, Homo sapiens
ucguaugcacuc

SEQ ID NO: 1971753 - RNA, 14 nt, Homo sapiens
cuaucuugauuuga

SEQ ID NO: 1971754 - RNA, 14 nt, Homo sapiens
augagugaucucaa

SEQ ID NO: 1971755 - RNA, 23 nt, Homo sapiens
cauucccaacgugcaaagccaag

SEQ ID NO: 1971756 - RNA, 24 nt, Homo sapiens
cccauccccuuccuaaauauccaa

SEQ ID NO: 1971757 - RNA, 17 nt, Homo sapiens
gaaagcccugugcucca

SEQ ID NO: 1971758 - RNA, 13 nt, Homo sapiens
agccugaccaaaa

SEQ ID NO: 1971759 - RNA, 14 nt, Homo sapiens
ccagcacacagggc

SEQ ID NO: 1971760 - RNA, 22 nt, Homo sapiens
cucauaugugaaauggccaaag

SEQ ID NO: 1971761 - RNA, 22 nt, Homo sapiens
cuuuaugaaaacugaagcauca

SEQ ID NO: 1971762 - RNA, 15 nt, Homo sapiens
ugaucacaauuugca

SEQ ID NO: 1971763 - RNA, 21 nt, Homo sapiens
gcagucccagcuacucaggag

SEQ ID NO: 1971764 - RNA, 17 nt, Homo sapiens
uaagaaacccucuguca

SEQ ID NO: 1971765 - RNA, 22 nt, Homo sapiens
aaauuagccuugauauucucca

SEQ ID NO: 1971766 - RNA, 16 nt, Homo sapiens
ccugacagggccagug

SEQ ID NO: 1971767 - RNA, 14 nt, Homo sapiens
aucaaauaauaccu

SEQ ID NO: 1971768 - RNA, 14 nt, Homo sapiens
cauuuccuagacgu

SEQ ID NO: 1971769 - RNA, 12 nt, Homo sapiens
cucucaucccag

SEQ ID NO: 1971770 - RNA, 22 nt, Homo sapiens
ccuucaccaagcuuagaagcca

SEQ ID NO: 1971771 - RNA, 17 nt, Homo sapiens
guagccagacaguuuau

SEQ ID NO: 1971772 - RNA, 15 nt, Homo sapiens
aagcacaaagccauu

SEQ ID NO: 1971773 - RNA, 22 nt, Homo sapiens
gaaagcacaggugggcuuccca

SEQ ID NO: 1971774 - RNA, 14 nt, Homo sapiens
gaaaaacauacauu

SEQ ID NO: 1971775 - RNA, 17 nt, Homo sapiens
ccaguccaagaccccaa

SEQ ID NO: 1971776 - RNA, 23 nt, Homo sapiens
gcucugcuugccgaaacuggaag

SEQ ID NO: 1971777 - RNA, 13 nt, Homo sapiens
auaugcacuugaa

SEQ ID NO: 1971778 - RNA, 21 nt, Homo sapiens
ccugguccgugcacuggagaa

SEQ ID NO: 1971779 - RNA, 16 nt, Homo sapiens
guuccuucacauuuaa

SEQ ID NO: 1971780 - RNA, 17 nt, Homo sapiens
acaaagggacuuuggaa

SEQ ID NO: 1971781 - RNA, 19 nt, Homo sapiens
augaccauuugacuguuca

SEQ ID NO: 1971782 - RNA, 22 nt, Homo sapiens
agcguguguggggguacuagaa

SEQ ID NO: 1971783 - RNA, 17 nt, Homo sapiens
gagaggaagagcugcaa

SEQ ID NO: 1971784 - RNA, 15 nt, Homo sapiens
ucucuuuaccuccua

SEQ ID NO: 1971785 - RNA, 22 nt, Homo sapiens
uuccccugucuucaccugccac

SEQ ID NO: 1971786 - RNA, 18 nt, Homo sapiens
aauugggaauaugcacaa

SEQ ID NO: 1971787 - RNA, 18 nt, Homo sapiens
uucagcaccgauggccau

SEQ ID NO: 1971788 - RNA, 17 nt, Homo sapiens
caccacuaagagaauac

SEQ ID NO: 1971789 - RNA, 13 nt, Homo sapiens
auuuuuauauuca

SEQ ID NO: 1971790 - RNA, 13 nt, Homo sapiens
cauugacccucac

SEQ ID NO: 1971791 - RNA, 18 nt, Homo sapiens
aaauagcaugccuuucuc

SEQ ID NO: 1971792 - RNA, 13 nt, Homo sapiens
cccucaugaaaac

SEQ ID NO: 1971793 - RNA, 22 nt, Homo sapiens
acaaacuggcagguaccgugcu

SEQ ID NO: 1971794 - RNA, 15 nt, Homo sapiens
guaucguguggugua

SEQ ID NO: 1971795 - RNA, 18 nt, Homo sapiens
uaaaacacaagacuguca

SEQ ID NO: 1971796 - RNA, 23 nt, Homo sapiens
cccaaugcauagagcccuggcca

SEQ ID NO: 1971797 - RNA, 16 nt, Homo sapiens
cuuuuugcaugcuuau

SEQ ID NO: 1971798 - RNA, 19 nt, Homo sapiens
uagacuuucuuaucacuua

SEQ ID NO: 1971799 - RNA, 13 nt, Homo sapiens
aaacacagauuau

SEQ ID NO: 1971800 - RNA, 18 nt, Homo sapiens
aaacugcuuuauuuuccc

SEQ ID NO: 1971801 - RNA, 23 nt, Homo sapiens
ucuaggaaaagggauacuuugau

SEQ ID NO: 1971802 - RNA, 12 nt, Homo sapiens
ccuacauguauu

SEQ ID NO: 1971803 - RNA, 14 nt, Homo sapiens
ccugacaaccacug

SEQ ID NO: 1971804 - RNA, 14 nt, Homo sapiens
ucugucaaucacag

SEQ ID NO: 1971805 - RNA, 19 nt, Homo sapiens
aacccaaagugugacucau

SEQ ID NO: 1971806 - RNA, 12 nt, Homo sapiens
ucuguggucaca

SEQ ID NO: 1971807 - RNA, 14 nt, Homo sapiens
auuuaccaaaguag

SEQ ID NO: 1971808 - RNA, 22 nt, Homo sapiens
caccugagacaugcugaaauua

SEQ ID NO: 1971809 - RNA, 23 nt, Homo sapiens
acgcaggccacccgggcugccug

SEQ ID NO: 1971810 - RNA, 19 nt, Homo sapiens
guccuagaggcuccagcuc

SEQ ID NO: 1971811 - RNA, 13 nt, Homo sapiens
cacauugcaaugu

SEQ ID NO: 1971812 - RNA, 16 nt, Homo sapiens
uucugggacuacaggc

SEQ ID NO: 1971813 - RNA, 19 nt, Homo sapiens
gcuuacacggaugccuucc

SEQ ID NO: 1971814 - RNA, 19 nt, Homo sapiens
uuugaaacaauuaugugaa

SEQ ID NO: 1971815 - RNA, 21 nt, Homo sapiens
aagugaagaacacuacugcua

SEQ ID NO: 1971816 - RNA, 13 nt, Homo sapiens
caaaccaagccau

SEQ ID NO: 1971817 - RNA, 15 nt, Homo sapiens
ugcuucuuuaccaag

SEQ ID NO: 1971818 - RNA, 16 nt, Homo sapiens
acagcgcuguauuuac

SEQ ID NO: 1971819 - RNA, 21 nt, Homo sapiens
cccacaacguccccucaagcc

SEQ ID NO: 1971820 - RNA, 14 nt, Homo sapiens
uucuacaugacugg

SEQ ID NO: 1971821 - RNA, 14 nt, Homo sapiens
uuagacaugaaggg

SEQ ID NO: 1971822 - RNA, 15 nt, Homo sapiens
caugauaucacuucu

SEQ ID NO: 1971823 - RNA, 15 nt, Homo sapiens
ucugaagugcugcuc

SEQ ID NO: 1971824 - RNA, 15 nt, Homo sapiens
ccgagaagccagugc

SEQ ID NO: 1971825 - RNA, 16 nt, Homo sapiens
cugcuucccacugggg

SEQ ID NO: 1971826 - RNA, 20 nt, Homo sapiens
ucagguggcccuacugggag

SEQ ID NO: 1971827 - RNA, 19 nt, Homo sapiens
cuaucccaacagucauguu

SEQ ID NO: 1971828 - RNA, 22 nt, Homo sapiens
uagagccagcuguccugucagu

SEQ ID NO: 1971829 - RNA, 22 nt, Homo sapiens
uaaugcuguucuuuaguagcaa

SEQ ID NO: 1971830 - RNA, 23 nt, Homo sapiens
agaauuauuuuuaagugguuuua

SEQ ID NO: 1971831 - RNA, 19 nt, Homo sapiens
ucacacuguaaacauucau

SEQ ID NO: 1971832 - RNA, 19 nt, Homo sapiens
auaucgcuggccagcauua

SEQ ID NO: 1971833 - RNA, 12 nt, Homo sapiens
aaaucugugaug

SEQ ID NO: 1971834 - RNA, 14 nt, Homo sapiens
agaugaaauugcca

SEQ ID NO: 1971835 - RNA, 13 nt, Homo sapiens
ucuugaucauucc

SEQ ID NO: 1971836 - RNA, 23 nt, Homo sapiens
ucuuaaaggagaaguagcuguga

SEQ ID NO: 1971837 - RNA, 21 nt, Homo sapiens
ugagccugccaaagugccugg

SEQ ID NO: 1971838 - RNA, 14 nt, Homo sapiens
guguuccauuugaa

SEQ ID NO: 1971839 - RNA, 12 nt, Homo sapiens
gccccacugcca

SEQ ID NO: 1971840 - RNA, 12 nt, Homo sapiens
gagacacugagc

SEQ ID NO: 1971841 - RNA, 22 nt, Homo sapiens
agcuacuguuuauuauuuuauu

SEQ ID NO: 1971842 - RNA, 22 nt, Homo sapiens
uauaacuaagacauaugcauuu

SEQ ID NO: 1971843 - RNA, 19 nt, Homo sapiens
uucccuccauccaccccuc

SEQ ID NO: 1971844 - RNA, 20 nt, Homo sapiens
guacccagugccuacagggc

SEQ ID NO: 1971845 - RNA, 23 nt, Homo sapiens
uggcgacagagggagacuccauc

SEQ ID NO: 1971846 - RNA, 10 nt, Homo sapiens
cucucagggg

SEQ ID NO: 1971847 - RNA, 21 nt, Homo sapiens
uccuaaugauuagcacuuaau

SEQ ID NO: 1971848 - RNA, 21 nt, Homo sapiens
accuccucccuaaugcucacc

SEQ ID NO: 1971849 - RNA, 21 nt, Homo sapiens
aaaguucucuguggcaaagca

SEQ ID NO: 1971850 - RNA, 17 nt, Homo sapiens
cccugacuggccaaacc

SEQ ID NO: 1971851 - RNA, 23 nt, Homo sapiens
ugcaguccugggauguggcugca

SEQ ID NO: 1971852 - RNA, 13 nt, Homo sapiens
acacaccugcaca

SEQ ID NO: 1971853 - RNA, 14 nt, Homo sapiens
gaggcuacuguaag

SEQ ID NO: 1971854 - RNA, 16 nt, Homo sapiens
accauaacaacuucau

SEQ ID NO: 1971855 - RNA, 18 nt, Homo sapiens
ccuuuguaagaaaaccaa

SEQ ID NO: 1971856 - RNA, 13 nt, Homo sapiens
auaaaaacucuua

SEQ ID NO: 1971857 - RNA, 13 nt, Homo sapiens
uacaauauucuca

SEQ ID NO: 1971858 - RNA, 14 nt, Homo sapiens
ggucaguugccaaa

SEQ ID NO: 1971859 - RNA, 15 nt, Homo sapiens
cagcagcugauucca

SEQ ID NO: 1971860 - RNA, 19 nt, Homo sapiens
ugaaccaaugcaagacgcc

SEQ ID NO: 1971861 - RNA, 15 nt, Homo sapiens
gcagugagcacugaa

SEQ ID NO: 1971862 - RNA, 21 nt, Homo sapiens
guguccccgaugcugaccuca

SEQ ID NO: 1971863 - RNA, 17 nt, Homo sapiens
caguaugugauggacug

SEQ ID NO: 1971864 - RNA, 21 nt, Homo sapiens
aaccauuuucaaaagcaauuc

SEQ ID NO: 1971865 - RNA, 14 nt, Homo sapiens
gcguagacaggugu

SEQ ID NO: 1971866 - RNA, 12 nt, Homo sapiens
auacacaguguu

SEQ ID NO: 1971867 - RNA, 15 nt, Homo sapiens
cagaugcagcacaua

SEQ ID NO: 1971868 - RNA, 17 nt, Homo sapiens
auuuguauuaauaaagc

SEQ ID NO: 1971869 - RNA, 15 nt, Homo sapiens
aaauacaugcacagu

SEQ ID NO: 1971870 - RNA, 22 nt, Homo sapiens
ccauucugcguaugagucccau

SEQ ID NO: 1971871 - RNA, 12 nt, Homo sapiens
cucgugugcaac

SEQ ID NO: 1971872 - RNA, 21 nt, Homo sapiens
gaauuuuaaaaaagauggauu

SEQ ID NO: 1971873 - RNA, 22 nt, Homo sapiens
guaaagguuauaucauucacuu

SEQ ID NO: 1971874 - RNA, 14 nt, Homo sapiens
gcugaggcugagaa

SEQ ID NO: 1971875 - RNA, 18 nt, Homo sapiens
ugucccccuaugcuccag

SEQ ID NO: 1971876 - RNA, 13 nt, Homo sapiens
ugccuaaguauuc

SEQ ID NO: 1971877 - RNA, 22 nt, Homo sapiens
cuuaugaacagauauuuuuaac

SEQ ID NO: 1971878 - RNA, 23 nt, Homo sapiens
uccauauggguaguuaugggguu

SEQ ID NO: 1971879 - RNA, 22 nt, Homo sapiens
uuguaaaaucuauuuaugaaag

SEQ ID NO: 1971880 - RNA, 24 nt, Homo sapiens
cugucucccuccccaaauggcugc

SEQ ID NO: 1971881 - RNA, 16 nt, Homo sapiens
uguggcaacugcugau

SEQ ID NO: 1971882 - RNA, 19 nt, Homo sapiens
uauuuuuuaaaaaucuaua

SEQ ID NO: 1971883 - RNA, 15 nt, Homo sapiens
gcacaaagaugugca

SEQ ID NO: 1971884 - RNA, 14 nt, Homo sapiens
ucauucaauuugcg

SEQ ID NO: 1971885 - RNA, 20 nt, Homo sapiens
guccuuuuauaaacauuggu

SEQ ID NO: 1971886 - RNA, 19 nt, Homo sapiens
cauagcacugggcucugau

SEQ ID NO: 1971887 - RNA, 19 nt, Homo sapiens
cuagagauaaaacagaauc

SEQ ID NO: 1971888 - RNA, 18 nt, Homo sapiens
ugauguuugaaguuacaa

SEQ ID NO: 1971889 - RNA, 18 nt, Homo sapiens
ucaagcaguagacaagca

SEQ ID NO: 1971890 - RNA, 18 nt, Homo sapiens
gugaccaguuuugauauu

SEQ ID NO: 1971891 - RNA, 15 nt, Homo sapiens
ggcgcugagacugug

SEQ ID NO: 1971892 - RNA, 14 nt, Homo sapiens
uccaaaagcacuua

SEQ ID NO: 1971893 - RNA, 18 nt, Homo sapiens
aaaacagauuguuugcaa

SEQ ID NO: 1971894 - RNA, 13 nt, Homo sapiens
guucaccuugccg

SEQ ID NO: 1971895 - RNA, 20 nt, Homo sapiens
agcugguggauggugacuuu

SEQ ID NO: 1971896 - RNA, 21 nt, Homo sapiens
aucuucaacaugucacacugg

SEQ ID NO: 1971897 - RNA, 22 nt, Homo sapiens
cuaacccuaggcaucacaugcu

SEQ ID NO: 1971898 - RNA, 20 nt, Homo sapiens
aauguccaaauacucugaaa

SEQ ID NO: 1971899 - RNA, 16 nt, Homo sapiens
cugauccucacacuuc

SEQ ID NO: 1971900 - RNA, 20 nt, Homo sapiens
gcccuccucaccgcccuucc

SEQ ID NO: 1971901 - RNA, 16 nt, Homo sapiens
gagcaauucauuucac

SEQ ID NO: 1971902 - RNA, 18 nt, Homo sapiens
cuaaagcuuucugacaag

SEQ ID NO: 1971903 - RNA, 21 nt, Homo sapiens
caaauuauguuuuaauuccaa

SEQ ID NO: 1971904 - RNA, 13 nt, Homo sapiens
accauuuuaucuu

SEQ ID NO: 1971905 - RNA, 21 nt, Homo sapiens
acucuacagauggcauaccug

SEQ ID NO: 1971906 - RNA, 13 nt, Homo sapiens
uucaacucugauc

SEQ ID NO: 1971907 - RNA, 19 nt, Homo sapiens
cauguaguuuuacuuggug

SEQ ID NO: 1971908 - RNA, 14 nt, Homo sapiens
agcugcucacuuaa

SEQ ID NO: 1971909 - RNA, 21 nt, Homo sapiens
cauggaggaacaguauuacag

SEQ ID NO: 1971910 - RNA, 14 nt, Homo sapiens
gacauacauuucuc

SEQ ID NO: 1971911 - RNA, 15 nt, Homo sapiens
acuucagcaggggug

SEQ ID NO: 1971912 - RNA, 22 nt, Homo sapiens
aaagugcaaguggaugcauucc

SEQ ID NO: 1971913 - RNA, 22 nt, Homo sapiens
cucuuaaucacuacuguaugua

SEQ ID NO: 1971914 - RNA, 21 nt, Homo sapiens
accaggcaccaggcagggucu

SEQ ID NO: 1971915 - RNA, 21 nt, Homo sapiens
gcacuauuauggaugaaggac

SEQ ID NO: 1971916 - RNA, 12 nt, Homo sapiens
uauaauaugcaa

SEQ ID NO: 1971917 - RNA, 20 nt, Homo sapiens
cauaucacuugauaugugca

SEQ ID NO: 1971918 - RNA, 21 nt, Homo sapiens
acaccugggcaaacuuucuuc

SEQ ID NO: 1971919 - RNA, 15 nt, Homo sapiens
agcugcugggccagu

SEQ ID NO: 1971920 - RNA, 21 nt, Homo sapiens
gugcucaauaaacuugugccu

SEQ ID NO: 1971921 - RNA, 18 nt, Homo sapiens
gcccuccccacaaugcca

SEQ ID NO: 1971922 - RNA, 18 nt, Homo sapiens
cuuugacauaacuaggau

SEQ ID NO: 1971923 - RNA, 17 nt, Homo sapiens
auaaguaaaugucuuca

SEQ ID NO: 1971924 - RNA, 20 nt, Homo sapiens
aaacggucacgagacccaga

SEQ ID NO: 1971925 - RNA, 15 nt, Homo sapiens
cacaccgaguuucca

SEQ ID NO: 1971926 - RNA, 18 nt, Homo sapiens
ugccucagccuuccaaag

SEQ ID NO: 1971927 - RNA, 17 nt, Homo sapiens
cugagaacacugugaaa

SEQ ID NO: 1971928 - RNA, 20 nt, Homo sapiens
auccagcaauuccugagcca

SEQ ID NO: 1971929 - RNA, 23 nt, Homo sapiens
ugacauuucacuaaaagucucca

SEQ ID NO: 1971930 - RNA, 15 nt, Homo sapiens
cugaaccacuuugcc

SEQ ID NO: 1971931 - RNA, 16 nt, Homo sapiens
ucucaucuuucuugau

SEQ ID NO: 1971932 - RNA, 22 nt, Homo sapiens
cacagcuguaaucccagcacuu

SEQ ID NO: 1971933 - RNA, 20 nt, Homo sapiens
acaguagagagaacauggag

SEQ ID NO: 1971934 - RNA, 17 nt, Homo sapiens
ggaguucccacccaagc

SEQ ID NO: 1971935 - RNA, 19 nt, Homo sapiens
aucugccuguucugaggau

SEQ ID NO: 1971936 - RNA, 19 nt, Homo sapiens
auaguuucacccugcacua

SEQ ID NO: 1971937 - RNA, 19 nt, Homo sapiens
uguccaaucggagacaaaa

SEQ ID NO: 1971938 - RNA, 21 nt, Homo sapiens
uuuugaggccuuuuuugccag

SEQ ID NO: 1971939 - RNA, 21 nt, Homo sapiens
acaagagaagaaagugaaagc

SEQ ID NO: 1971940 - RNA, 22 nt, Homo sapiens
uguucaugugauuaacucuuag

SEQ ID NO: 1971941 - RNA, 18 nt, Homo sapiens
gaaacuccuguucaugcc

SEQ ID NO: 1971942 - RNA, 23 nt, Homo sapiens
guucugcacccagccaaacacau

SEQ ID NO: 1971943 - RNA, 22 nt, Homo sapiens
aacuguuuuugaagaagggaaa

SEQ ID NO: 1971944 - RNA, 15 nt, Homo sapiens
cugccuuacuguaca

SEQ ID NO: 1971945 - RNA, 23 nt, Homo sapiens
ugaguugacuucugacaaaggug

SEQ ID NO: 1971946 - RNA, 21 nt, Homo sapiens
ugauucaaaccaaagcugccu

SEQ ID NO: 1971947 - RNA, 22 nt, Homo sapiens
aguguaacgaugcacuuuggaa

SEQ ID NO: 1971948 - RNA, 18 nt, Homo sapiens
aguagaauuaucucucau

SEQ ID NO: 1971949 - RNA, 14 nt, Homo sapiens
uaaauuacaugcau

SEQ ID NO: 1971950 - RNA, 13 nt, Homo sapiens
cuuuccucagugu

SEQ ID NO: 1971951 - RNA, 16 nt, Homo sapiens
gauuaguacacacuug

SEQ ID NO: 1971952 - RNA, 23 nt, Homo sapiens
uugacuucugacaaaggugguaa

SEQ ID NO: 1971953 - RNA, 23 nt, Homo sapiens
aaaacuuuucuaauacucuaccc

SEQ ID NO: 1971954 - RNA, 21 nt, Homo sapiens
cugauaauuauuuuaaagggg

SEQ ID NO: 1971955 - RNA, 14 nt, Homo sapiens
cagucccacacugu

SEQ ID NO: 1971956 - RNA, 14 nt, Homo sapiens
aacauggaaguacu

SEQ ID NO: 1971957 - RNA, 13 nt, Homo sapiens
gucaguaauuccg

SEQ ID NO: 1971958 - RNA, 15 nt, Homo sapiens
ccuugcaagccauaa

SEQ ID NO: 1971959 - RNA, 19 nt, Homo sapiens
acuguuuaagcccagccaa

SEQ ID NO: 1971960 - RNA, 16 nt, Homo sapiens
uacccuauacauccac

SEQ ID NO: 1971961 - RNA, 12 nt, Homo sapiens
uccccugcugaa

SEQ ID NO: 1971962 - RNA, 18 nt, Homo sapiens
uagagguacacuugugaa

SEQ ID NO: 1971963 - RNA, 23 nt, Homo sapiens
gcaugaggugagagaaagccaca

SEQ ID NO: 1971964 - RNA, 23 nt, Homo sapiens
gaaaagcccccaguuaauacucc

SEQ ID NO: 1971965 - RNA, 21 nt, Homo sapiens
cuauuauuuggagccugccaa

SEQ ID NO: 1971966 - RNA, 14 nt, Homo sapiens
uagagggauugacu

SEQ ID NO: 1971967 - RNA, 16 nt, Homo sapiens
ggacaggaagcacagc

SEQ ID NO: 1971968 - RNA, 17 nt, Homo sapiens
aucacuuaaacuugcau

SEQ ID NO: 1971969 - RNA, 14 nt, Homo sapiens
aaucuaccauuuau

SEQ ID NO: 1971970 - RNA, 15 nt, Homo sapiens
gucagaugaggcaaa

SEQ ID NO: 1971971 - RNA, 16 nt, Homo sapiens
cccaauucacaucuaa

SEQ ID NO: 1971972 - RNA, 13 nt, Homo sapiens
uuauguaaucuca

SEQ ID NO: 1971973 - RNA, 23 nt, Homo sapiens
auacucuagaugaaguuuuacau

SEQ ID NO: 1971974 - RNA, 17 nt, Homo sapiens
cucaggcugugcuuacc

SEQ ID NO: 1971975 - RNA, 12 nt, Homo sapiens
auuucacaaaaa

SEQ ID NO: 1971976 - RNA, 21 nt, Homo sapiens
ucauuaaaaaugaaagccaaa

SEQ ID NO: 1971977 - RNA, 19 nt, Homo sapiens
gucaucaacaauuugacca

SEQ ID NO: 1971978 - RNA, 20 nt, Homo sapiens
uguguauuuucuuugggggu

SEQ ID NO: 1971979 - RNA, 22 nt, Homo sapiens
ccuuuuuuaagauuuuucucaa

SEQ ID NO: 1971980 - RNA, 16 nt, Homo sapiens
aacuuaaacauauucu

SEQ ID NO: 1971981 - RNA, 22 nt, Homo sapiens
guaaaggaaauaauugccaaau

SEQ ID NO: 1971982 - RNA, 22 nt, Homo sapiens
cucuggaugccugauugccaag

SEQ ID NO: 1971983 - RNA, 18 nt, Homo sapiens
cuauugcaauacauuucu

SEQ ID NO: 1971984 - RNA, 17 nt, Homo sapiens
aaugccuugacaacaga

SEQ ID NO: 1971985 - RNA, 21 nt, Homo sapiens
cccggccgcuccaccagcauc

SEQ ID NO: 1971986 - RNA, 15 nt, Homo sapiens
auuaugaaaguagua

SEQ ID NO: 1971987 - RNA, 13 nt, Homo sapiens
cacaacuuuucaa

SEQ ID NO: 1971988 - RNA, 19 nt, Homo sapiens
uuggaaaggaccaguaugc

SEQ ID NO: 1971989 - RNA, 17 nt, Homo sapiens
gcccagauugugccacu

SEQ ID NO: 1971990 - RNA, 19 nt, Homo sapiens
ccacucggggcaggccagc

SEQ ID NO: 1971991 - RNA, 15 nt, Homo sapiens
cauucccaauuauca

SEQ ID NO: 1971992 - RNA, 23 nt, Homo sapiens
uaagaccaccuucccuuccucag

SEQ ID NO: 1971993 - RNA, 14 nt, Homo sapiens
cauuuucugccuau

SEQ ID NO: 1971994 - RNA, 17 nt, Homo sapiens
aaaagcaaaagcucugu

SEQ ID NO: 1971995 - RNA, 12 nt, Homo sapiens
cuuuccuuucau

SEQ ID NO: 1971996 - RNA, 21 nt, Homo sapiens
guugccuuaauauucugcuau

SEQ ID NO: 1971997 - RNA, 22 nt, Homo sapiens
ucccaauaaaagugacucucag

SEQ ID NO: 1971998 - RNA, 20 nt, Homo sapiens
ugauguugucuuagcauggu

SEQ ID NO: 1971999 - RNA, 18 nt, Homo sapiens
aagcagaaaaucuaccaa

SEQ ID NO: 1972000 - RNA, 21 nt, Homo sapiens
aaacagccccucuggacacag

SEQ ID NO: 1972001 - RNA, 19 nt, Homo sapiens
agccgcucuccugccacau

SEQ ID NO: 1972002 - RNA, 11 nt, Homo sapiens
ugcccucucag

SEQ ID NO: 1972003 - RNA, 12 nt, Homo sapiens
uguaaacugcca

SEQ ID NO: 1972004 - RNA, 17 nt, Homo sapiens
gauguugagaauguuca

SEQ ID NO: 1972005 - RNA, 14 nt, Homo sapiens
uuaggaaaaccaga

SEQ ID NO: 1972006 - RNA, 14 nt, Homo sapiens
agugcaugguggcc

SEQ ID NO: 1972007 - RNA, 17 nt, Homo sapiens
auguggagccaggcgug

SEQ ID NO: 1972008 - RNA, 18 nt, Homo sapiens
cuuuuaaaaacauaacau

SEQ ID NO: 1972009 - RNA, 12 nt, Homo sapiens
cuaaaauucagg

SEQ ID NO: 1972010 - RNA, 18 nt, Homo sapiens
uaccucucagcugcugaa

SEQ ID NO: 1972011 - RNA, 15 nt, Homo sapiens
ggacggcaggcucac

SEQ ID NO: 1972012 - RNA, 16 nt, Homo sapiens
agcacagcuugaccug

SEQ ID NO: 1972013 - RNA, 21 nt, Homo sapiens
acuccaagcuccucugugaag

SEQ ID NO: 1972014 - RNA, 11 nt, Homo sapiens
aggcugugagc

SEQ ID NO: 1972015 - RNA, 11 nt, Homo sapiens
aaccugugaag

SEQ ID NO: 1972016 - RNA, 14 nt, Homo sapiens
gauuuccauuugca

SEQ ID NO: 1972017 - RNA, 20 nt, Homo sapiens
cccugaccucacugugaccu

SEQ ID NO: 1972018 - RNA, 12 nt, Homo sapiens
ucccuuuuacau

SEQ ID NO: 1972019 - RNA, 20 nt, Homo sapiens
cuggagugcaguggcacaau

SEQ ID NO: 1972020 - RNA, 20 nt, Homo sapiens
cuggaaugcagugacacaau

SEQ ID NO: 1972021 - RNA, 14 nt, Homo sapiens
acauuauuccugca

SEQ ID NO: 1972022 - RNA, 18 nt, Homo sapiens
acauugcuucugcuaaau

SEQ ID NO: 1972023 - RNA, 12 nt, Homo sapiens
ucguuacucuaa

SEQ ID NO: 1972024 - RNA, 17 nt, Homo sapiens
aagugccacucauuccu

SEQ ID NO: 1972025 - RNA, 14 nt, Homo sapiens
ugcagaacugccau

SEQ ID NO: 1972026 - RNA, 14 nt, Homo sapiens
agcagaacagccau

SEQ ID NO: 1972027 - RNA, 19 nt, Homo sapiens
uguaacuuaaauuccaaac

SEQ ID NO: 1972028 - RNA, 23 nt, Homo sapiens
augguggagggccacaugggagg

SEQ ID NO: 1972029 - RNA, 15 nt, Homo sapiens
acagggcaaccaaua

SEQ ID NO: 1972030 - RNA, 14 nt, Homo sapiens
acccaagggucaga

SEQ ID NO: 1972031 - RNA, 22 nt, Homo sapiens
cuccauuuucuugucaauggaa

SEQ ID NO: 1972032 - RNA, 21 nt, Homo sapiens
uuagcaugacccuaaaauucu

SEQ ID NO: 1972033 - RNA, 19 nt, Homo sapiens
ucucaauaauuuccuccac

SEQ ID NO: 1972034 - RNA, 22 nt, Homo sapiens
uguauauuuguuuuaugcuacu

SEQ ID NO: 1972035 - RNA, 12 nt, Homo sapiens
aucucaggugag

SEQ ID NO: 1972036 - RNA, 21 nt, Homo sapiens
cugcccagacacagacuggca

SEQ ID NO: 1972037 - RNA, 23 nt, Homo sapiens
aaugguuucacuugcucuuugac

SEQ ID NO: 1972038 - RNA, 13 nt, Homo sapiens
auauauuucacuu

SEQ ID NO: 1972039 - RNA, 14 nt, Homo sapiens
gguccagugggaac

SEQ ID NO: 1972040 - RNA, 19 nt, Homo sapiens
guuucuguuugaauuuuca

SEQ ID NO: 1972041 - RNA, 15 nt, Homo sapiens
cuguuggaaauguga

SEQ ID NO: 1972042 - RNA, 16 nt, Homo sapiens
cuugacuggcucaaga

SEQ ID NO: 1972043 - RNA, 16 nt, Homo sapiens
caggggugcugggacc

SEQ ID NO: 1972044 - RNA, 13 nt, Homo sapiens
gcugaguccagag

SEQ ID NO: 1972045 - RNA, 16 nt, Homo sapiens
gaacuagcauauagcc

SEQ ID NO: 1972046 - RNA, 17 nt, Homo sapiens
cugaaugggagccagaa

SEQ ID NO: 1972047 - RNA, 15 nt, Homo sapiens
ucuguagggaacucu

SEQ ID NO: 1972048 - RNA, 11 nt, Homo sapiens
ugggaacucac

SEQ ID NO: 1972049 - RNA, 20 nt, Homo sapiens
uauuucuaguuauuacccag

SEQ ID NO: 1972050 - RNA, 16 nt, Homo sapiens
cuuuuucaaugaauuu

SEQ ID NO: 1972051 - RNA, 16 nt, Homo sapiens
uauuggaaaaaucaca

SEQ ID NO: 1972052 - RNA, 20 nt, Homo sapiens
acaggauguuugcucagcuu

SEQ ID NO: 1972053 - RNA, 13 nt, Homo sapiens
agugaaucugauu

SEQ ID NO: 1972054 - RNA, 22 nt, Homo sapiens
aacagcugaggcugucauucca

SEQ ID NO: 1972055 - RNA, 15 nt, Homo sapiens
cucuguacuuuucau

SEQ ID NO: 1972056 - RNA, 20 nt, Homo sapiens
agccugccauauuugucaua

SEQ ID NO: 1972057 - RNA, 23 nt, Homo sapiens
aaagaaggcauuugcaggguccu

SEQ ID NO: 1972058 - RNA, 17 nt, Homo sapiens
aaucauuuuaauuauua

SEQ ID NO: 1972059 - RNA, 21 nt, Homo sapiens
agccaagcaaaccaaugguga

SEQ ID NO: 1972060 - RNA, 20 nt, Homo sapiens
accuucauuuuuaagacugu

SEQ ID NO: 1972061 - RNA, 21 nt, Homo sapiens
ucauguccagugagcaguguu

SEQ ID NO: 1972062 - RNA, 22 nt, Homo sapiens
gcucccaacucccuucugcuug

SEQ ID NO: 1972063 - RNA, 17 nt, Homo sapiens
uuucccaaaacugccac

SEQ ID NO: 1972064 - RNA, 16 nt, Homo sapiens
cccaguugcugucaca

SEQ ID NO: 1972065 - RNA, 20 nt, Homo sapiens
acuucaguucucaucuugua

SEQ ID NO: 1972066 - RNA, 16 nt, Homo sapiens
guguccccuccacugu

SEQ ID NO: 1972067 - RNA, 12 nt, Homo sapiens
gaaaaccauaug

SEQ ID NO: 1972068 - RNA, 15 nt, Homo sapiens
ggacgcuuccagacc

SEQ ID NO: 1972069 - RNA, 20 nt, Homo sapiens
uuugugcaaaagcaggcuug

SEQ ID NO: 1972070 - RNA, 14 nt, Homo sapiens
uuuguucucucuca

SEQ ID NO: 1972071 - RNA, 19 nt, Homo sapiens
auuuaaauguuuaacauca

SEQ ID NO: 1972072 - RNA, 19 nt, Homo sapiens
cagcuuuuguuguuuauau

SEQ ID NO: 1972073 - RNA, 13 nt, Homo sapiens
cauguauucccuu

SEQ ID NO: 1972074 - RNA, 20 nt, Homo sapiens
acaguggcaguauugacaau

SEQ ID NO: 1972075 - RNA, 21 nt, Homo sapiens
uccugugcuugaugcuagaaa

SEQ ID NO: 1972076 - RNA, 13 nt, Homo sapiens
uaagguacuuaaa

SEQ ID NO: 1972077 - RNA, 14 nt, Homo sapiens
acuacagcucuuaa

SEQ ID NO: 1972078 - RNA, 19 nt, Homo sapiens
caaccugguaugggagcca

SEQ ID NO: 1972079 - RNA, 20 nt, Homo sapiens
acccuaaaaagcagagcuuu

SEQ ID NO: 1972080 - RNA, 16 nt, Homo sapiens
aauaaaugucauuuca

SEQ ID NO: 1972081 - RNA, 19 nt, Homo sapiens
cagggagauaaacaccacc

SEQ ID NO: 1972082 - RNA, 18 nt, Homo sapiens
uguucacuaaacucugaa

SEQ ID NO: 1972083 - RNA, 19 nt, Homo sapiens
ucuugugagggacugagau

SEQ ID NO: 1972084 - RNA, 16 nt, Homo sapiens
gacccccccccaacuc

SEQ ID NO: 1972085 - RNA, 16 nt, Homo sapiens
gcuuugaacgugccag

SEQ ID NO: 1972086 - RNA, 14 nt, Homo sapiens
uguaaaaaauggag

SEQ ID NO: 1972087 - RNA, 14 nt, Homo sapiens
aggacgaauuugca

SEQ ID NO: 1972088 - RNA, 11 nt, Homo sapiens
uaccucaaggg

SEQ ID NO: 1972089 - RNA, 15 nt, Homo sapiens
aacauuucuuuguga

SEQ ID NO: 1972090 - RNA, 23 nt, Homo sapiens
acuagggacuggaucucagccuc

SEQ ID NO: 1972091 - RNA, 17 nt, Homo sapiens
guugcagccagggcugu

SEQ ID NO: 1972092 - RNA, 23 nt, Homo sapiens
cuaucaaagugucguaucuggga

SEQ ID NO: 1972093 - RNA, 19 nt, Homo sapiens
aaggcucaagggacauguu

SEQ ID NO: 1972094 - RNA, 12 nt, Homo sapiens
uaggccucucac

SEQ ID NO: 1972095 - RNA, 12 nt, Homo sapiens
ccagauccagcc

SEQ ID NO: 1972096 - RNA, 19 nt, Homo sapiens
uccaucccaaccagugcca

SEQ ID NO: 1972097 - RNA, 22 nt, Homo sapiens
caguccucaccacaguuuauug

SEQ ID NO: 1972098 - RNA, 14 nt, Homo sapiens
uagcuauccuaaau

SEQ ID NO: 1972099 - RNA, 17 nt, Homo sapiens
ucgaaauacaagccauu

SEQ ID NO: 1972100 - RNA, 15 nt, Homo sapiens
uugaacaagguuuca

SEQ ID NO: 1972101 - RNA, 21 nt, Homo sapiens
acuggugaaaauuuaccuaaa

SEQ ID NO: 1972102 - RNA, 15 nt, Homo sapiens
cacaguuaauucccu

SEQ ID NO: 1972103 - RNA, 22 nt, Homo sapiens
agcccaaggcacugagaccucc

SEQ ID NO: 1972104 - RNA, 15 nt, Homo sapiens
uucccagcgcugcug

SEQ ID NO: 1972105 - RNA, 15 nt, Homo sapiens
agguacaaguggcug

SEQ ID NO: 1972106 - RNA, 15 nt, Homo sapiens
cuuaaaaaucuuggu

SEQ ID NO: 1972107 - RNA, 17 nt, Homo sapiens
acccugccccuugccau

SEQ ID NO: 1972108 - RNA, 12 nt, Homo sapiens
agcuguggcaca

SEQ ID NO: 1972109 - RNA, 21 nt, Homo sapiens
ugaccccuucccuguccuugc

SEQ ID NO: 1972110 - RNA, 20 nt, Homo sapiens
auuugggccugcuccagacc

SEQ ID NO: 1972111 - RNA, 23 nt, Homo sapiens
ggccaguuucagcucacuuccuc

SEQ ID NO: 1972112 - RNA, 16 nt, Homo sapiens
guagccagcuggucuu

SEQ ID NO: 1972113 - RNA, 18 nt, Homo sapiens
cagcuggggaaaucaaaa

SEQ ID NO: 1972114 - RNA, 16 nt, Homo sapiens
cacgagaucaagagau

SEQ ID NO: 1972115 - RNA, 15 nt, Homo sapiens
ucgcacuacaucuga

SEQ ID NO: 1972116 - RNA, 14 nt, Homo sapiens
aucgccaugcccau

SEQ ID NO: 1972117 - RNA, 13 nt, Homo sapiens
gaaguuuuacuag

SEQ ID NO: 1972118 - RNA, 23 nt, Homo sapiens
cacagcucuccuccuccaucuca

SEQ ID NO: 1972119 - RNA, 16 nt, Homo sapiens
ugaguucccaaaggga

SEQ ID NO: 1972120 - RNA, 16 nt, Homo sapiens
aaccaaacacaaugau

SEQ ID NO: 1972121 - RNA, 19 nt, Homo sapiens
guccccacucccuguccau

SEQ ID NO: 1972122 - RNA, 15 nt, Homo sapiens
aagacaagugaugcu

SEQ ID NO: 1972123 - RNA, 15 nt, Homo sapiens
ugacccacccagugu

SEQ ID NO: 1972124 - RNA, 15 nt, Homo sapiens
auuaagucaagaaua

SEQ ID NO: 1972125 - RNA, 14 nt, Homo sapiens
cucuguucacaaac

SEQ ID NO: 1972126 - RNA, 18 nt, Homo sapiens
augcuucaguacuuguga

SEQ ID NO: 1972127 - RNA, 18 nt, Homo sapiens
agccuaggugacagagug

SEQ ID NO: 1972128 - RNA, 19 nt, Homo sapiens
cuucccgaaccccaaggag

SEQ ID NO: 1972129 - RNA, 16 nt, Homo sapiens
caaaguugaaaauuca

SEQ ID NO: 1972130 - RNA, 21 nt, Homo sapiens
aacagaaauugcaauauggau

SEQ ID NO: 1972131 - RNA, 21 nt, Homo sapiens
aaaucagacccacaacgaaug

SEQ ID NO: 1972132 - RNA, 18 nt, Homo sapiens
gccucaagucacucccaa

SEQ ID NO: 1972133 - RNA, 17 nt, Homo sapiens
aaucauaugauucugcu

SEQ ID NO: 1972134 - RNA, 18 nt, Homo sapiens
ucugagucucugaaugaa

SEQ ID NO: 1972135 - RNA, 20 nt, Homo sapiens
ccaagugaggagugccagcu

SEQ ID NO: 1972136 - RNA, 14 nt, Homo sapiens
uuaacgucaucuca

SEQ ID NO: 1972137 - RNA, 21 nt, Homo sapiens
ugaaguuguguuaacaaugca

SEQ ID NO: 1972138 - RNA, 16 nt, Homo sapiens
uuguacagacaacaaa

SEQ ID NO: 1972139 - RNA, 18 nt, Homo sapiens
ccaagacagugcugagau

SEQ ID NO: 1972140 - RNA, 19 nt, Homo sapiens
gauuccauuuuacuuccau

SEQ ID NO: 1972141 - RNA, 19 nt, Homo sapiens
cugccagccgagauagcca

SEQ ID NO: 1972142 - RNA, 22 nt, Homo sapiens
uugcaggccaaaccguacugua

SEQ ID NO: 1972143 - RNA, 14 nt, Homo sapiens
acaccuauugcacu

SEQ ID NO: 1972144 - RNA, 17 nt, Homo sapiens
aaaaugggaagcauuag

SEQ ID NO: 1972145 - RNA, 19 nt, Homo sapiens
aucuaagacauucaccaac

SEQ ID NO: 1972146 - RNA, 20 nt, Homo sapiens
ucuccauguguuugauuucu

SEQ ID NO: 1972147 - RNA, 20 nt, Homo sapiens
auagaggcuauccuggagac

SEQ ID NO: 1972148 - RNA, 21 nt, Homo sapiens
gauuaguugaaaggccucaag

SEQ ID NO: 1972149 - RNA, 23 nt, Homo sapiens
cauggaggccaagaacuugcaau

SEQ ID NO: 1972150 - RNA, 15 nt, Homo sapiens
cacagauaugcacac

SEQ ID NO: 1972151 - RNA, 15 nt, Homo sapiens
cuugguucucuccac

SEQ ID NO: 1972152 - RNA, 16 nt, Homo sapiens
uccuccucugugaaac

SEQ ID NO: 1972153 - RNA, 22 nt, Homo sapiens
aaaauuaaauuuuagaucuuuc

SEQ ID NO: 1972154 - RNA, 14 nt, Homo sapiens
cauguaugucugca

SEQ ID NO: 1972155 - RNA, 15 nt, Homo sapiens
uucagguaacacuac

SEQ ID NO: 1972156 - RNA, 21 nt, Homo sapiens
uaccauugaaggaaagcuaua

SEQ ID NO: 1972157 - RNA, 22 nt, Homo sapiens
cccuccacgugauuuccaguga

SEQ ID NO: 1972158 - RNA, 18 nt, Homo sapiens
cuauacaaaaugauuuug

SEQ ID NO: 1972159 - RNA, 15 nt, Homo sapiens
uacagaaacugaugc

SEQ ID NO: 1972160 - RNA, 16 nt, Homo sapiens
uagaagagucuauugu

SEQ ID NO: 1972161 - RNA, 13 nt, Homo sapiens
auggaaauagcca

SEQ ID NO: 1972162 - RNA, 22 nt, Homo sapiens
aagcucaguaacugugcaucug

SEQ ID NO: 1972163 - RNA, 21 nt, Homo sapiens
ggagauauuuuccaacagcuu

SEQ ID NO: 1972164 - RNA, 21 nt, Homo sapiens
gccaaggcuggagugcagugg

SEQ ID NO: 1972165 - RNA, 23 nt, Homo sapiens
aggcccacucuguuccuacugga

SEQ ID NO: 1972166 - RNA, 15 nt, Homo sapiens
guacuguaaacaguu

SEQ ID NO: 1972167 - RNA, 19 nt, Homo sapiens
gaggcacaagaaucacuug

SEQ ID NO: 1972168 - RNA, 16 nt, Homo sapiens
ucugaauaacuugaag

SEQ ID NO: 1972169 - RNA, 16 nt, Homo sapiens
gaaacguggcaggacu

SEQ ID NO: 1972170 - RNA, 20 nt, Homo sapiens
aauacuauaaauauauugua

SEQ ID NO: 1972171 - RNA, 16 nt, Homo sapiens
aaacauucuuauuuca

SEQ ID NO: 1972172 - RNA, 16 nt, Homo sapiens
aaauauccuuacuuua

SEQ ID NO: 1972173 - RNA, 16 nt, Homo sapiens
cuaaugcucaccuuua

SEQ ID NO: 1972174 - RNA, 12 nt, Homo sapiens
cuccucuaguaa

SEQ ID NO: 1972175 - RNA, 14 nt, Homo sapiens
cugggaggggcaau

SEQ ID NO: 1972176 - RNA, 21 nt, Homo sapiens
uagcaguggcuggugcccaug

SEQ ID NO: 1972177 - RNA, 13 nt, Homo sapiens
cuugcaaagccuu

SEQ ID NO: 1972178 - RNA, 20 nt, Homo sapiens
cucgcccagcggcaucaggc

SEQ ID NO: 1972179 - RNA, 20 nt, Homo sapiens
auaagcugcucccugucuau

SEQ ID NO: 1972180 - RNA, 19 nt, Homo sapiens
agacacaugccagggccau

SEQ ID NO: 1972181 - RNA, 17 nt, Homo sapiens
aagugggaaaguugcau

SEQ ID NO: 1972182 - RNA, 12 nt, Homo sapiens
caaaacauacca

SEQ ID NO: 1972183 - RNA, 12 nt, Homo sapiens
uuuuaauuccau

SEQ ID NO: 1972184 - RNA, 21 nt, Homo sapiens
cuugugccucccuucccagug

SEQ ID NO: 1972185 - RNA, 14 nt, Homo sapiens
ucauccauguccaa

SEQ ID NO: 1972186 - RNA, 17 nt, Homo sapiens
cugguuagguagaggga

SEQ ID NO: 1972187 - RNA, 23 nt, Homo sapiens
auugugauuauagugacaaugaa

SEQ ID NO: 1972188 - RNA, 15 nt, Homo sapiens
gcaagagggggaccu

SEQ ID NO: 1972189 - RNA, 19 nt, Homo sapiens
gcagaggagcaaauugagg

SEQ ID NO: 1972190 - RNA, 20 nt, Homo sapiens
cuacucuuaaauauacaacu

SEQ ID NO: 1972191 - RNA, 22 nt, Homo sapiens
gggugccgcugucucugagggg

SEQ ID NO: 1972192 - RNA, 22 nt, Homo sapiens
aucagcaacuucuagcauauag

SEQ ID NO: 1972193 - RNA, 17 nt, Homo sapiens
aaaagaugauuucucaa

SEQ ID NO: 1972194 - RNA, 18 nt, Homo sapiens
auuacauggggucuagaa

SEQ ID NO: 1972195 - RNA, 17 nt, Homo sapiens
gcucuguauggucagga

SEQ ID NO: 1972196 - RNA, 16 nt, Homo sapiens
cuuagaauaaugaagg

SEQ ID NO: 1972197 - RNA, 18 nt, Homo sapiens
agguuucuuugacuucaa

SEQ ID NO: 1972198 - RNA, 16 nt, Homo sapiens
caccuguguuccagcc

SEQ ID NO: 1972199 - RNA, 21 nt, Homo sapiens
caguaacggguagcagcagau

SEQ ID NO: 1972200 - RNA, 17 nt, Homo sapiens
guuaauuuaaagcuguu

SEQ ID NO: 1972201 - RNA, 15 nt, Homo sapiens
cggcugccucaggag

SEQ ID NO: 1972202 - RNA, 23 nt, Homo sapiens
augauggcacugagaaagccaau

SEQ ID NO: 1972203 - RNA, 13 nt, Homo sapiens
cugagcagcaucc

SEQ ID NO: 1972204 - RNA, 22 nt, Homo sapiens
uauauuuuuuaaaauaacuuca

SEQ ID NO: 1972205 - RNA, 12 nt, Homo sapiens
cuuuucagggcc

SEQ ID NO: 1972206 - RNA, 15 nt, Homo sapiens
uuaaaaaaacacaua

SEQ ID NO: 1972207 - RNA, 13 nt, Homo sapiens
gaugaucaucucc

SEQ ID NO: 1972208 - RNA, 12 nt, Homo sapiens
cauggucuucag

SEQ ID NO: 1972209 - RNA, 17 nt, Homo sapiens
gcacacugcacacaugc

SEQ ID NO: 1972210 - RNA, 20 nt, Homo sapiens
aagaagcuggcuaguccuuu

SEQ ID NO: 1972211 - RNA, 19 nt, Homo sapiens
uggauuccagcauuugcca

SEQ ID NO: 1972212 - RNA, 20 nt, Homo sapiens
gccggccacacuggucacag

SEQ ID NO: 1972213 - RNA, 22 nt, Homo sapiens
aggccugaccucaagcaaccau

SEQ ID NO: 1972214 - RNA, 13 nt, Homo sapiens
uuccugacacuca

SEQ ID NO: 1972215 - RNA, 12 nt, Homo sapiens
aacuacuucuuu

SEQ ID NO: 1972216 - RNA, 15 nt, Homo sapiens
auucaagagucucau

SEQ ID NO: 1972217 - RNA, 21 nt, Homo sapiens
gcuccaacccccgccaccuca

SEQ ID NO: 1972218 - RNA, 22 nt, Homo sapiens
aggugugaggagagaggaggaa

SEQ ID NO: 1972219 - RNA, 22 nt, Homo sapiens
cuuuaaaacuguauuuaaggaa

SEQ ID NO: 1972220 - RNA, 17 nt, Homo sapiens
ugauuuugucacugucu

SEQ ID NO: 1972221 - RNA, 11 nt, Homo sapiens
gggguggcacc

SEQ ID NO: 1972222 - RNA, 15 nt, Homo sapiens
caaacauuauuccaa

SEQ ID NO: 1972223 - RNA, 15 nt, Homo sapiens
cuuccauuaaaacaa

SEQ ID NO: 1972224 - RNA, 16 nt, Homo sapiens
gaauuuuuacugggga

SEQ ID NO: 1972225 - RNA, 12 nt, Homo sapiens
cucugaauucca

SEQ ID NO: 1972226 - RNA, 13 nt, Homo sapiens
ccacucacugcau

SEQ ID NO: 1972227 - RNA, 21 nt, Homo sapiens
gacccccauucugacauccac

SEQ ID NO: 1972228 - RNA, 12 nt, Homo sapiens
auagcucuugcu

SEQ ID NO: 1972229 - RNA, 19 nt, Homo sapiens
ugcugucagccaagucaug

SEQ ID NO: 1972230 - RNA, 19 nt, Homo sapiens
uggggccaauuacuugaag

SEQ ID NO: 1972231 - RNA, 20 nt, Homo sapiens
uucauugagcaguuagcuca

SEQ ID NO: 1972232 - RNA, 19 nt, Homo sapiens
cucugcuuccagcaguauu

SEQ ID NO: 1972233 - RNA, 20 nt, Homo sapiens
uuucucauaggcuaugccau

SEQ ID NO: 1972234 - RNA, 23 nt, Homo sapiens
agcuuugugcuugucauuccaga

SEQ ID NO: 1972235 - RNA, 18 nt, Homo sapiens
agcacaacugauaauauu

SEQ ID NO: 1972236 - RNA, 13 nt, Homo sapiens
guugagauuugac

SEQ ID NO: 1972237 - RNA, 16 nt, Homo sapiens
aggcucagagacugca

SEQ ID NO: 1972238 - RNA, 20 nt, Homo sapiens
cagggugaagaguccaagaa

SEQ ID NO: 1972239 - RNA, 20 nt, Homo sapiens
uagcaauuuaauauuuugca

SEQ ID NO: 1972240 - RNA, 16 nt, Homo sapiens
gacagugcagugcuca

SEQ ID NO: 1972241 - RNA, 15 nt, Homo sapiens
caaaaguagcuuccu

SEQ ID NO: 1972242 - RNA, 23 nt, Homo sapiens
agagucugaaagacagaauguca

SEQ ID NO: 1972243 - RNA, 17 nt, Homo sapiens
aauggggugcaugaagg

SEQ ID NO: 1972244 - RNA, 15 nt, Homo sapiens
cuguacaagcugaug

SEQ ID NO: 1972245 - RNA, 19 nt, Homo sapiens
cuugugagcaagguggugu

SEQ ID NO: 1972246 - RNA, 12 nt, Homo sapiens
caaaaagucaag

SEQ ID NO: 1972247 - RNA, 22 nt, Homo sapiens
aacuggcccguggagacugaga

SEQ ID NO: 1972248 - RNA, 17 nt, Homo sapiens
uguugcacugaaaugga

SEQ ID NO: 1972249 - RNA, 11 nt, Homo sapiens
cuuugcugcua

SEQ ID NO: 1972250 - RNA, 12 nt, Homo sapiens
aacucacuguga

SEQ ID NO: 1972251 - RNA, 20 nt, Homo sapiens
ccggggcagggacuugccuc

SEQ ID NO: 1972252 - RNA, 21 nt, Homo sapiens
cuucucccgauggccacuggg

SEQ ID NO: 1972253 - RNA, 21 nt, Homo sapiens
agagcuuuccuacuugcacuc

SEQ ID NO: 1972254 - RNA, 14 nt, Homo sapiens
ugccuguugaucua

SEQ ID NO: 1972255 - RNA, 14 nt, Homo sapiens
ugccaguugaucaa

SEQ ID NO: 1972256 - RNA, 22 nt, Homo sapiens
accuggacgaagagcaggccag

SEQ ID NO: 1972257 - RNA, 22 nt, Homo sapiens
gcugagcagcauggauucugca

SEQ ID NO: 1972258 - RNA, 17 nt, Homo sapiens
gcacaaugcauaauguc

SEQ ID NO: 1972259 - RNA, 17 nt, Homo sapiens
cauccuggccaacauug

SEQ ID NO: 1972260 - RNA, 19 nt, Homo sapiens
gauugcgccauugcacucc

SEQ ID NO: 1972261 - RNA, 14 nt, Homo sapiens
cuuguuuguugcag

SEQ ID NO: 1972262 - RNA, 13 nt, Homo sapiens
ccgggaagagcca

SEQ ID NO: 1972263 - RNA, 13 nt, Homo sapiens
acuacaccagggu

SEQ ID NO: 1972264 - RNA, 20 nt, Homo sapiens
guaagguguguacucagggc

SEQ ID NO: 1972265 - RNA, 23 nt, Homo sapiens
gcuggucccggggccagcacuuc

SEQ ID NO: 1972266 - RNA, 15 nt, Homo sapiens
guauaauaaaaccaa

SEQ ID NO: 1972267 - RNA, 19 nt, Homo sapiens
guggccaaggagcugcuau

SEQ ID NO: 1972268 - RNA, 12 nt, Homo sapiens
caggaagcacag

SEQ ID NO: 1972269 - RNA, 12 nt, Homo sapiens
acagaagccagg

SEQ ID NO: 1972270 - RNA, 12 nt, Homo sapiens
cagaaagcacaa

SEQ ID NO: 1972271 - RNA, 14 nt, Homo sapiens
uugcccucucgcca

SEQ ID NO: 1972272 - RNA, 15 nt, Homo sapiens
gccccaacugugauc

SEQ ID NO: 1972273 - RNA, 21 nt, Homo sapiens
gagguggugggggcagggaug

SEQ ID NO: 1972274 - RNA, 18 nt, Homo sapiens
auccugucugaggaguaa

SEQ ID NO: 1972275 - RNA, 17 nt, Homo sapiens
gugccacgcagggcaga

SEQ ID NO: 1972276 - RNA, 12 nt, Homo sapiens
gagccaagggau

SEQ ID NO: 1972277 - RNA, 15 nt, Homo sapiens
aaaauuacuuacaca

SEQ ID NO: 1972278 - RNA, 16 nt, Homo sapiens
caaauguuaugcauaa

SEQ ID NO: 1972279 - RNA, 20 nt, Homo sapiens
ggacauuguaugcagggagc

SEQ ID NO: 1972280 - RNA, 17 nt, Homo sapiens
aggucuccaccccucaa

SEQ ID NO: 1972281 - RNA, 13 nt, Homo sapiens
acuuuagaaauaa

SEQ ID NO: 1972282 - RNA, 21 nt, Homo sapiens
guuaucccuauuuugcugaug

SEQ ID NO: 1972283 - RNA, 13 nt, Homo sapiens
uaaaucaagagcu

SEQ ID NO: 1972284 - RNA, 18 nt, Homo sapiens
gccagcuccucucugaag

SEQ ID NO: 1972285 - RNA, 17 nt, Homo sapiens
uucccauaguggggccu

SEQ ID NO: 1972286 - RNA, 14 nt, Homo sapiens
cacacagacuccac

SEQ ID NO: 1972287 - RNA, 15 nt, Homo sapiens
cauucugugauuaaa

SEQ ID NO: 1972288 - RNA, 15 nt, Homo sapiens
cggggaagacuugaa

SEQ ID NO: 1972289 - RNA, 16 nt, Homo sapiens
ucuagugccacacucc

SEQ ID NO: 1972290 - RNA, 22 nt, Homo sapiens
acuugcaccucugaccuaucac

SEQ ID NO: 1972291 - RNA, 17 nt, Homo sapiens
cuccuagauccagggau

SEQ ID NO: 1972292 - RNA, 23 nt, Homo sapiens
cuaugcacauauggacucugcac

SEQ ID NO: 1972293 - RNA, 13 nt, Homo sapiens
augacucacauga

SEQ ID NO: 1972294 - RNA, 15 nt, Homo sapiens
uauuuuuucuugcaa

SEQ ID NO: 1972295 - RNA, 17 nt, Homo sapiens
aacaaaugggucccuca

SEQ ID NO: 1972296 - RNA, 16 nt, Homo sapiens
uccuucuuacuugcca

SEQ ID NO: 1972297 - RNA, 16 nt, Homo sapiens
aggaaaaaugcugcuu

SEQ ID NO: 1972298 - RNA, 20 nt, Homo sapiens
cagaguggauuaaaggcaaa

SEQ ID NO: 1972299 - RNA, 21 nt, Homo sapiens
cucacucccgcugagcccacu

SEQ ID NO: 1972300 - RNA, 19 nt, Homo sapiens
aguguucaaauaaacugaa

SEQ ID NO: 1972301 - RNA, 21 nt, Homo sapiens
aaauaacgugcaugcuuuaaa

SEQ ID NO: 1972302 - RNA, 23 nt, Homo sapiens
cugcaguggacaguccccaccuu

SEQ ID NO: 1972303 - RNA, 15 nt, Homo sapiens
aagauagcaucccau

SEQ ID NO: 1972304 - RNA, 21 nt, Homo sapiens
cagcggaaagcccugugcucc

SEQ ID NO: 1972305 - RNA, 16 nt, Homo sapiens
cacauaaagaaauuca

SEQ ID NO: 1972306 - RNA, 14 nt, Homo sapiens
auucuuuccaugac

SEQ ID NO: 1972307 - RNA, 13 nt, Homo sapiens
uucgagcaaacaa

SEQ ID NO: 1972308 - RNA, 18 nt, Homo sapiens
acaaauguggccaagccu

SEQ ID NO: 1972309 - RNA, 18 nt, Homo sapiens
uuaguguggcuaaccaag

SEQ ID NO: 1972310 - RNA, 18 nt, Homo sapiens
agcaaguuucaucagccc

SEQ ID NO: 1972311 - RNA, 19 nt, Homo sapiens
cccuaaugcauaagcuuuu

SEQ ID NO: 1972312 - RNA, 23 nt, Homo sapiens
ucaguaauagcugaaccuguuca

SEQ ID NO: 1972313 - RNA, 16 nt, Homo sapiens
cccugagaacccaaac

SEQ ID NO: 1972314 - RNA, 18 nt, Homo sapiens
accuguagauagugauau

SEQ ID NO: 1972315 - RNA, 21 nt, Homo sapiens
uugugaaggccucgcaggaag

SEQ ID NO: 1972316 - RNA, 14 nt, Homo sapiens
ccuggaacaccagc

SEQ ID NO: 1972317 - RNA, 16 nt, Homo sapiens
uaaaguaauugacaaa

SEQ ID NO: 1972318 - RNA, 19 nt, Homo sapiens
acaugcauacacucucaaa

SEQ ID NO: 1972319 - RNA, 21 nt, Homo sapiens
ugugccuggcucagagccagu

SEQ ID NO: 1972320 - RNA, 18 nt, Homo sapiens
gaacugcgugccaguguc

SEQ ID NO: 1972321 - RNA, 19 nt, Homo sapiens
gccuggcauagaguaggua

SEQ ID NO: 1972322 - RNA, 13 nt, Homo sapiens
ccgagacauggcu

SEQ ID NO: 1972323 - RNA, 22 nt, Homo sapiens
ugcaaaauuguuuucacuugua

SEQ ID NO: 1972324 - RNA, 19 nt, Homo sapiens
cccuggguaagaagggugg

SEQ ID NO: 1972325 - RNA, 13 nt, Homo sapiens
gggguggagcaug

SEQ ID NO: 1972326 - RNA, 14 nt, Homo sapiens
uucaugaagcaaga

SEQ ID NO: 1972327 - RNA, 19 nt, Homo sapiens
cauguacuacacuucugaa

SEQ ID NO: 1972328 - RNA, 16 nt, Homo sapiens
ccagaugaacugagaa

SEQ ID NO: 1972329 - RNA, 13 nt, Homo sapiens
gccaaucauugca

SEQ ID NO: 1972330 - RNA, 13 nt, Homo sapiens
uauagucacauuu

SEQ ID NO: 1972331 - RNA, 18 nt, Homo sapiens
uaaaccaaaaauuaugug

SEQ ID NO: 1972332 - RNA, 18 nt, Homo sapiens
gagcuuggggcagagggc

SEQ ID NO: 1972333 - RNA, 14 nt, Homo sapiens
uuuauuuuaaacau

SEQ ID NO: 1972334 - RNA, 14 nt, Homo sapiens
acugcacacagggu

SEQ ID NO: 1972335 - RNA, 12 nt, Homo sapiens
ggagcucagaga

SEQ ID NO: 1972336 - RNA, 16 nt, Homo sapiens
gcaaaaaguagacuug

SEQ ID NO: 1972337 - RNA, 19 nt, Homo sapiens
ggucaaacaaacucucuga

SEQ ID NO: 1972338 - RNA, 21 nt, Homo sapiens
aacaggaauccuuacugauau

SEQ ID NO: 1972339 - RNA, 20 nt, Homo sapiens
caaauucuuuuucacacuga

SEQ ID NO: 1972340 - RNA, 14 nt, Homo sapiens
cuaucaauagucaa

SEQ ID NO: 1972341 - RNA, 14 nt, Homo sapiens
caccucugauuaca

SEQ ID NO: 1972342 - RNA, 14 nt, Homo sapiens
ccaugcuuugcuua

SEQ ID NO: 1972343 - RNA, 18 nt, Homo sapiens
accaauauucuuuuguuc

SEQ ID NO: 1972344 - RNA, 17 nt, Homo sapiens
aagaguucugaucugua

SEQ ID NO: 1972345 - RNA, 18 nt, Homo sapiens
uccaauccccacuccucc

SEQ ID NO: 1972346 - RNA, 19 nt, Homo sapiens
aacauucguucucuaacca

SEQ ID NO: 1972347 - RNA, 22 nt, Homo sapiens
cuaggacuccaaccucagggac

SEQ ID NO: 1972348 - RNA, 18 nt, Homo sapiens
gcacccaugccauagaaa

SEQ ID NO: 1972349 - RNA, 20 nt, Homo sapiens
uccugggagaaccucaggcu

SEQ ID NO: 1972350 - RNA, 17 nt, Homo sapiens
cguaucuuuccuaggca

SEQ ID NO: 1972351 - RNA, 22 nt, Homo sapiens
aagacugaguacguugugcauu

SEQ ID NO: 1972352 - RNA, 23 nt, Homo sapiens
auacuuucucuucaaauuuagca

SEQ ID NO: 1972353 - RNA, 16 nt, Homo sapiens
aaaggcagcaaccauu

SEQ ID NO: 1972354 - RNA, 23 nt, Homo sapiens
gcuugccuguaaucccagcacuu

SEQ ID NO: 1972355 - RNA, 21 nt, Homo sapiens
ccaggcugagugagccacaga

SEQ ID NO: 1972356 - RNA, 17 nt, Homo sapiens
uuuuauauugaucuguu

SEQ ID NO: 1972357 - RNA, 15 nt, Homo sapiens
gaagaaucugcucug

SEQ ID NO: 1972358 - RNA, 22 nt, Homo sapiens
ccucaagaucaaacccaggcag

SEQ ID NO: 1972359 - RNA, 16 nt, Homo sapiens
cccucacucucaggaa

SEQ ID NO: 1972360 - RNA, 19 nt, Homo sapiens
auaccauggcacugacaau

SEQ ID NO: 1972361 - RNA, 23 nt, Homo sapiens
auugcuugagccuggcuguccaa

SEQ ID NO: 1972362 - RNA, 24 nt, Homo sapiens
cuaagccaggaccccaaugcgaca

SEQ ID NO: 1972363 - RNA, 23 nt, Homo sapiens
gagccucugcagucgcuugccaa

SEQ ID NO: 1972364 - RNA, 20 nt, Homo sapiens
cauuuccaacaccacagaca

SEQ ID NO: 1972365 - RNA, 14 nt, Homo sapiens
guggacggagccaa

SEQ ID NO: 1972366 - RNA, 15 nt, Homo sapiens
gaucagcacugccag

SEQ ID NO: 1972367 - RNA, 14 nt, Homo sapiens
cucuuucuucaauu

SEQ ID NO: 1972368 - RNA, 22 nt, Homo sapiens
cucaggacccagggaaugccag

SEQ ID NO: 1972369 - RNA, 11 nt, Homo sapiens
agaaucugugc

SEQ ID NO: 1972370 - RNA, 16 nt, Homo sapiens
uuagggugaagcauua

SEQ ID NO: 1972371 - RNA, 17 nt, Homo sapiens
aauugugcaaaggauaa

SEQ ID NO: 1972372 - RNA, 22 nt, Homo sapiens
gcacaagcucaggacauggagg

SEQ ID NO: 1972373 - RNA, 14 nt, Homo sapiens
gacaacauuguaag

SEQ ID NO: 1972374 - RNA, 14 nt, Homo sapiens
aguauuggggcccu

SEQ ID NO: 1972375 - RNA, 14 nt, Homo sapiens
gcuauuacugcaga

SEQ ID NO: 1972376 - RNA, 19 nt, Homo sapiens
cucaauaaaagaaucugau

SEQ ID NO: 1972377 - RNA, 12 nt, Homo sapiens
guuuaucuagca

SEQ ID NO: 1972378 - RNA, 12 nt, Homo sapiens
cucucagccuua

SEQ ID NO: 1972379 - RNA, 13 nt, Homo sapiens
agauguacugcaa

SEQ ID NO: 1972380 - RNA, 18 nt, Homo sapiens
aauacuuuacaaaccauu

SEQ ID NO: 1972381 - RNA, 22 nt, Homo sapiens
agcucuaucccaaccucuccca

SEQ ID NO: 1972382 - RNA, 12 nt, Homo sapiens
uauaucucucau

SEQ ID NO: 1972383 - RNA, 16 nt, Homo sapiens
uguacaggcagaugaa

SEQ ID NO: 1972384 - RNA, 19 nt, Homo sapiens
auuaguugccaauaugcca

SEQ ID NO: 1972385 - RNA, 17 nt, Homo sapiens
ggccagcugggaucuga

SEQ ID NO: 1972386 - RNA, 18 nt, Homo sapiens
uggacaauggaccggaga

SEQ ID NO: 1972387 - RNA, 14 nt, Homo sapiens
cuguacacagaauu

SEQ ID NO: 1972388 - RNA, 17 nt, Homo sapiens
uccugguggauacugua

SEQ ID NO: 1972389 - RNA, 14 nt, Homo sapiens
aguguuucuuccac

SEQ ID NO: 1972390 - RNA, 20 nt, Homo sapiens
uucaggugcuggagaaucug

SEQ ID NO: 1972391 - RNA, 12 nt, Homo sapiens
ggccuggcacau

SEQ ID NO: 1972392 - RNA, 22 nt, Homo sapiens
gaggaauucucagccacugcgg

SEQ ID NO: 1972393 - RNA, 16 nt, Homo sapiens
gacaucaaauuugcca

SEQ ID NO: 1972394 - RNA, 21 nt, Homo sapiens
aagcgcggacccuucuggguc

SEQ ID NO: 1972395 - RNA, 19 nt, Homo sapiens
cuuaugguuuuaaugcaau

SEQ ID NO: 1972396 - RNA, 18 nt, Homo sapiens
cugcugaaacaacaaaua

SEQ ID NO: 1972397 - RNA, 18 nt, Homo sapiens
gccucucccaaguccagu

SEQ ID NO: 1972398 - RNA, 14 nt, Homo sapiens
uuccaucagcccau

SEQ ID NO: 1972399 - RNA, 22 nt, Homo sapiens
aaaguuguauuucaaauaucua

SEQ ID NO: 1972400 - RNA, 16 nt, Homo sapiens
gggauuugccagaugc

SEQ ID NO: 1972401 - RNA, 13 nt, Homo sapiens
aagcaagcucucu

SEQ ID NO: 1972402 - RNA, 17 nt, Homo sapiens
cacuuacccacgugcug

SEQ ID NO: 1972403 - RNA, 15 nt, Homo sapiens
aaucucauuguacaa

SEQ ID NO: 1972404 - RNA, 21 nt, Homo sapiens
cgcgagccaugauguggagug

SEQ ID NO: 1972405 - RNA, 17 nt, Homo sapiens
acucuuugaaugacaaa

SEQ ID NO: 1972406 - RNA, 18 nt, Homo sapiens
cacugaugggcaaccccc

SEQ ID NO: 1972407 - RNA, 20 nt, Homo sapiens
gcugccucuuggcuucucag

SEQ ID NO: 1972408 - RNA, 15 nt, Homo sapiens
acccucaaaugucag

SEQ ID NO: 1972409 - RNA, 13 nt, Homo sapiens
gccucaccugcug

SEQ ID NO: 1972410 - RNA, 16 nt, Homo sapiens
ggugauauguccuaua

SEQ ID NO: 1972411 - RNA, 14 nt, Homo sapiens
caguaaauccacag

SEQ ID NO: 1972412 - RNA, 17 nt, Homo sapiens
uguaagguggucacugu

SEQ ID NO: 1972413 - RNA, 17 nt, Homo sapiens
aguguuaucagucauaa

SEQ ID NO: 1972414 - RNA, 23 nt, Homo sapiens
aaacaguuuagcccaucucucca

SEQ ID NO: 1972415 - RNA, 16 nt, Homo sapiens
gccucagaguccugcc

SEQ ID NO: 1972416 - RNA, 16 nt, Homo sapiens
aggccuggcacagugu

SEQ ID NO: 1972417 - RNA, 21 nt, Homo sapiens
ccauuaaauucacuuucaauu

SEQ ID NO: 1972418 - RNA, 17 nt, Homo sapiens
ccuccagggacaaagag

SEQ ID NO: 1972419 - RNA, 21 nt, Homo sapiens
ucuggggaggcaggcauuccu

SEQ ID NO: 1972420 - RNA, 15 nt, Homo sapiens
augugagcaugucac

SEQ ID NO: 1972421 - RNA, 14 nt, Homo sapiens
auguacauuacaga

SEQ ID NO: 1972422 - RNA, 18 nt, Homo sapiens
accaugcugucuggcaca

SEQ ID NO: 1972423 - RNA, 15 nt, Homo sapiens
cuauccauaguccug

SEQ ID NO: 1972424 - RNA, 12 nt, Homo sapiens
cgaaaguggaaa

SEQ ID NO: 1972425 - RNA, 16 nt, Homo sapiens
agccuaagaaacacuc

SEQ ID NO: 1972426 - RNA, 17 nt, Homo sapiens
gacuuuuuccuugggcu

SEQ ID NO: 1972427 - RNA, 16 nt, Homo sapiens
aggcaugauguuaacc

SEQ ID NO: 1972428 - RNA, 18 nt, Homo sapiens
gcccacgguuucagcuag

SEQ ID NO: 1972429 - RNA, 23 nt, Homo sapiens
uccgcucuguagugcuacagggu

SEQ ID NO: 1972430 - RNA, 20 nt, Homo sapiens
ucuuuaacccucacugggac

SEQ ID NO: 1972431 - RNA, 14 nt, Homo sapiens
ucaaauucuucaca

SEQ ID NO: 1972432 - RNA, 14 nt, Homo sapiens
gagaacaaccaaaa

SEQ ID NO: 1972433 - RNA, 12 nt, Homo sapiens
agacugauuucu

SEQ ID NO: 1972434 - RNA, 12 nt, Homo sapiens
aucuauucugcu

SEQ ID NO: 1972435 - RNA, 19 nt, Homo sapiens
ccuugcacagcuggagaaa

SEQ ID NO: 1972436 - RNA, 19 nt, Homo sapiens
cacaugccccaucccaugc

SEQ ID NO: 1972437 - RNA, 21 nt, Homo sapiens
cuuuggacagaagcagcucuu

SEQ ID NO: 1972438 - RNA, 22 nt, Homo sapiens
cauuuguaaucuaguugucaau

SEQ ID NO: 1972439 - RNA, 20 nt, Homo sapiens
gacucccagcagagcccacc

SEQ ID NO: 1972440 - RNA, 20 nt, Homo sapiens
agacucucgcaucuucccaa

SEQ ID NO: 1972441 - RNA, 22 nt, Homo sapiens
ucccuugccuauuugcugacca

SEQ ID NO: 1972442 - RNA, 12 nt, Homo sapiens
accugaggucag

SEQ ID NO: 1972443 - RNA, 16 nt, Homo sapiens
augugaaaagauccca

SEQ ID NO: 1972444 - RNA, 11 nt, Homo sapiens
agaaugcacaa

SEQ ID NO: 1972445 - RNA, 23 nt, Homo sapiens
cugcagugggccauccagagcau

SEQ ID NO: 1972446 - RNA, 18 nt, Homo sapiens
uauauaaguuuacaccuu

SEQ ID NO: 1972447 - RNA, 16 nt, Homo sapiens
gagaaaauguuguaua

SEQ ID NO: 1972448 - RNA, 14 nt, Homo sapiens
ucagaggagcugca

SEQ ID NO: 1972449 - RNA, 14 nt, Homo sapiens
caagugaaaacuga

SEQ ID NO: 1972450 - RNA, 13 nt, Homo sapiens
gagaaucacugca

SEQ ID NO: 1972451 - RNA, 19 nt, Homo sapiens
cuuuuaauccaauccacua

SEQ ID NO: 1972452 - RNA, 12 nt, Homo sapiens
acgaaauccuaa

SEQ ID NO: 1972453 - RNA, 17 nt, Homo sapiens
uauguuaagaguacuau

SEQ ID NO: 1972454 - RNA, 17 nt, Homo sapiens
caaggacauugccccaa

SEQ ID NO: 1972455 - RNA, 15 nt, Homo sapiens
auagucccacuacuu

SEQ ID NO: 1972456 - RNA, 17 nt, Homo sapiens
ucucccgggaagccacc

SEQ ID NO: 1972457 - RNA, 13 nt, Homo sapiens
caaaaaguuccau

SEQ ID NO: 1972458 - RNA, 13 nt, Homo sapiens
aaacuccauucau

SEQ ID NO: 1972459 - RNA, 13 nt, Homo sapiens
gcucacucuucca

SEQ ID NO: 1972460 - RNA, 16 nt, Homo sapiens
acuuaugccgucucau

SEQ ID NO: 1972461 - RNA, 16 nt, Homo sapiens
cgggaggcugggcaca

SEQ ID NO: 1972462 - RNA, 21 nt, Homo sapiens
gucaauaaaaugaaccugauc

SEQ ID NO: 1972463 - RNA, 16 nt, Homo sapiens
aaccagcuucaugugg

SEQ ID NO: 1972464 - RNA, 17 nt, Homo sapiens
aaaugagagcagaaagu

SEQ ID NO: 1972465 - RNA, 20 nt, Homo sapiens
aauaaggauuuauucucaga

SEQ ID NO: 1972466 - RNA, 11 nt, Homo sapiens
auuggcaaagu

SEQ ID NO: 1972467 - RNA, 23 nt, Homo sapiens
uaccuccuaauuccacacccuca

SEQ ID NO: 1972468 - RNA, 22 nt, Homo sapiens
aaacgucgauucgcaccgucca

SEQ ID NO: 1972469 - RNA, 14 nt, Homo sapiens
gaagucuugcaguu

SEQ ID NO: 1972470 - RNA, 14 nt, Homo sapiens
accgccgggguccu

SEQ ID NO: 1972471 - RNA, 19 nt, Homo sapiens
cauagcuacuauaugcaua

SEQ ID NO: 1972472 - RNA, 23 nt, Homo sapiens
agccugggcaacauaccaagacc

SEQ ID NO: 1972473 - RNA, 11 nt, Homo sapiens
aaaacuuguag

SEQ ID NO: 1972474 - RNA, 11 nt, Homo sapiens
uagacuugaaa

SEQ ID NO: 1972475 - RNA, 15 nt, Homo sapiens
cuucugggacugugc

SEQ ID NO: 1972476 - RNA, 16 nt, Homo sapiens
aauaaaauauucacuc

SEQ ID NO: 1972477 - RNA, 22 nt, Homo sapiens
ccuuagcuggcauuacagcugg

SEQ ID NO: 1972478 - RNA, 20 nt, Homo sapiens
ggcucaagggacauguuuuc

SEQ ID NO: 1972479 - RNA, 21 nt, Homo sapiens
aauggcauguauuccaaguac

SEQ ID NO: 1972480 - RNA, 22 nt, Homo sapiens
caggguguguacugcacaagga

SEQ ID NO: 1972481 - RNA, 16 nt, Homo sapiens
agagugagagcacaaa

SEQ ID NO: 1972482 - RNA, 17 nt, Homo sapiens
agcaggaggaguggaag

SEQ ID NO: 1972483 - RNA, 19 nt, Homo sapiens
agacagagcgagacucuug

SEQ ID NO: 1972484 - RNA, 15 nt, Homo sapiens
ugcuuaaaauuguga

SEQ ID NO: 1972485 - RNA, 18 nt, Homo sapiens
cagaagcucccagcugac

SEQ ID NO: 1972486 - RNA, 14 nt, Homo sapiens
cuguggacaaaagu

SEQ ID NO: 1972487 - RNA, 15 nt, Homo sapiens
aaaucaacucagugg

SEQ ID NO: 1972488 - RNA, 14 nt, Homo sapiens
uccuaagggcucac

SEQ ID NO: 1972489 - RNA, 17 nt, Homo sapiens
cacaaucugggacuuuc

SEQ ID NO: 1972490 - RNA, 13 nt, Homo sapiens
guuacucaugacu

SEQ ID NO: 1972491 - RNA, 15 nt, Homo sapiens
ccugugcacagccau

SEQ ID NO: 1972492 - RNA, 14 nt, Homo sapiens
ucuacugcaagagc

SEQ ID NO: 1972493 - RNA, 15 nt, Homo sapiens
uccccucucaccuca

SEQ ID NO: 1972494 - RNA, 20 nt, Homo sapiens
gcguggugcucuuugcugca

SEQ ID NO: 1972495 - RNA, 23 nt, Homo sapiens
ucagacuugcggccacagcacua

SEQ ID NO: 1972496 - RNA, 18 nt, Homo sapiens
cagccugcgccugcugca

SEQ ID NO: 1972497 - RNA, 16 nt, Homo sapiens
gaaaaguuaugagggu

SEQ ID NO: 1972498 - RNA, 19 nt, Homo sapiens
auuucccauuugugccaga

SEQ ID NO: 1972499 - RNA, 15 nt, Homo sapiens
uggcgugaaccuggg

SEQ ID NO: 1972500 - RNA, 23 nt, Homo sapiens
acccacucggauggaccaaccug

SEQ ID NO: 1972501 - RNA, 15 nt, Homo sapiens
agaauguuccuacuc

SEQ ID NO: 1972502 - RNA, 17 nt, Homo sapiens
aaccccgcggugcucug

SEQ ID NO: 1972503 - RNA, 13 nt, Homo sapiens
auaccaacuuuag

SEQ ID NO: 1972504 - RNA, 13 nt, Homo sapiens
ggaaagaugugaa

SEQ ID NO: 1972505 - RNA, 16 nt, Homo sapiens
gaccaaauaaaguacc

SEQ ID NO: 1972506 - RNA, 20 nt, Homo sapiens
cccuugacaaagucaagcca

SEQ ID NO: 1972507 - RNA, 12 nt, Homo sapiens
cuaacugaucaa

SEQ ID NO: 1972508 - RNA, 14 nt, Homo sapiens
ucagugcuuugcau

SEQ ID NO: 1972509 - RNA, 14 nt, Homo sapiens
uaucuugcuucauu

SEQ ID NO: 1972510 - RNA, 19 nt, Homo sapiens
cuaggggggucagccagcc

SEQ ID NO: 1972511 - RNA, 15 nt, Homo sapiens
agucuguaaaaccag

SEQ ID NO: 1972512 - RNA, 15 nt, Homo sapiens
acugucaauuuggca

SEQ ID NO: 1972513 - RNA, 15 nt, Homo sapiens
uccuucuaaucugcu

SEQ ID NO: 1972514 - RNA, 16 nt, Homo sapiens
ccagccaugugccuua

SEQ ID NO: 1972515 - RNA, 23 nt, Homo sapiens
ucuuagauauucacuaaggacuu

SEQ ID NO: 1972516 - RNA, 16 nt, Homo sapiens
aaacuuuagugcuaca

SEQ ID NO: 1972517 - RNA, 24 nt, Homo sapiens
auaaaaggagcaaucauacugaca

SEQ ID NO: 1972518 - RNA, 18 nt, Homo sapiens
uucagcgaacaugccuga

SEQ ID NO: 1972519 - RNA, 14 nt, Homo sapiens
auaaaucuuccuaa

SEQ ID NO: 1972520 - RNA, 18 nt, Homo sapiens
ccccaugugccuugucca

SEQ ID NO: 1972521 - RNA, 19 nt, Homo sapiens
cuugguaaaaacugcagug

SEQ ID NO: 1972522 - RNA, 15 nt, Homo sapiens
gaucugauaagcaag

SEQ ID NO: 1972523 - RNA, 18 nt, Homo sapiens
ucugggucaucucucaca

SEQ ID NO: 1972524 - RNA, 15 nt, Homo sapiens
ucccuuccagcaaua

SEQ ID NO: 1972525 - RNA, 19 nt, Homo sapiens
guauuugauguauucugug

SEQ ID NO: 1972526 - RNA, 14 nt, Homo sapiens
ccuccaaagcccau

SEQ ID NO: 1972527 - RNA, 22 nt, Homo sapiens
gccgucuccauggcaucuucgu

SEQ ID NO: 1972528 - RNA, 12 nt, Homo sapiens
uuuacagucucu

SEQ ID NO: 1972529 - RNA, 21 nt, Homo sapiens
gcuucugaagcugcugcagcu

SEQ ID NO: 1972530 - RNA, 23 nt, Homo sapiens
cuuguaccuugaguugaguauua

SEQ ID NO: 1972531 - RNA, 18 nt, Homo sapiens
auaccuggcccaaccaga

SEQ ID NO: 1972532 - RNA, 16 nt, Homo sapiens
ucccauccugauccca

SEQ ID NO: 1972533 - RNA, 17 nt, Homo sapiens
uaaucguacauuuucau

SEQ ID NO: 1972534 - RNA, 22 nt, Homo sapiens
cuagugauuugccucaacaacg

SEQ ID NO: 1972535 - RNA, 17 nt, Homo sapiens
auauugccauuucuucc

SEQ ID NO: 1972536 - RNA, 14 nt, Homo sapiens
ccaagaaugagcuu

SEQ ID NO: 1972537 - RNA, 19 nt, Homo sapiens
gcuucucauggauggcacu

SEQ ID NO: 1972538 - RNA, 23 nt, Homo sapiens
aaucacccaccauagggcaugau

SEQ ID NO: 1972539 - RNA, 14 nt, Homo sapiens
ugauacacuaugaa

SEQ ID NO: 1972540 - RNA, 23 nt, Homo sapiens
uguaucuaaaaaauaacugugca

SEQ ID NO: 1972541 - RNA, 16 nt, Homo sapiens
agugggucccacuucc

SEQ ID NO: 1972542 - RNA, 19 nt, Homo sapiens
uguuagauuccucuugccu

SEQ ID NO: 1972543 - RNA, 18 nt, Homo sapiens
ugccaguaauguauuuua

SEQ ID NO: 1972544 - RNA, 13 nt, Homo sapiens
uguguuugcugag

SEQ ID NO: 1972545 - RNA, 20 nt, Homo sapiens
gguuucugagagagugccau

SEQ ID NO: 1972546 - RNA, 13 nt, Homo sapiens
uuagcaugcacaa

SEQ ID NO: 1972547 - RNA, 16 nt, Homo sapiens
auauagaggagcacua

SEQ ID NO: 1972548 - RNA, 13 nt, Homo sapiens
acagacugugagu

SEQ ID NO: 1972549 - RNA, 17 nt, Homo sapiens
acauauuaggaaaauau

SEQ ID NO: 1972550 - RNA, 13 nt, Homo sapiens
cugaaggaaccaa

SEQ ID NO: 1972551 - RNA, 23 nt, Homo sapiens
ccucuccaaggguggugaccaau

SEQ ID NO: 1972552 - RNA, 21 nt, Homo sapiens
gacaaacaauaugauuugcug

SEQ ID NO: 1972553 - RNA, 18 nt, Homo sapiens
cagcuccugaccaaagac

SEQ ID NO: 1972554 - RNA, 16 nt, Homo sapiens
agacuuacucuaagau

SEQ ID NO: 1972555 - RNA, 14 nt, Homo sapiens
cugagccaccgugu

SEQ ID NO: 1972556 - RNA, 16 nt, Homo sapiens
ugaaaaugaaucuuca

SEQ ID NO: 1972557 - RNA, 15 nt, Homo sapiens
aggggccaggacaaa

SEQ ID NO: 1972558 - RNA, 17 nt, Homo sapiens
caguguugcucagcucc

SEQ ID NO: 1972559 - RNA, 22 nt, Homo sapiens
uguguguuuaggccucauuucu

SEQ ID NO: 1972560 - RNA, 21 nt, Homo sapiens
agcagcucuucuggcuguguu

SEQ ID NO: 1972561 - RNA, 20 nt, Homo sapiens
gggacauugggaaggggacc

SEQ ID NO: 1972562 - RNA, 14 nt, Homo sapiens
guauuucuuuacag

SEQ ID NO: 1972563 - RNA, 20 nt, Homo sapiens
caaacguuaagaauuguuaa

SEQ ID NO: 1972564 - RNA, 13 nt, Homo sapiens
uucagggggccag

SEQ ID NO: 1972565 - RNA, 17 nt, Homo sapiens
uggcagcaaagugucag

SEQ ID NO: 1972566 - RNA, 23 nt, Homo sapiens
guucuucccuuuuacauacugcu

SEQ ID NO: 1972567 - RNA, 17 nt, Homo sapiens
cuuuuagaaauacugca

SEQ ID NO: 1972568 - RNA, 19 nt, Homo sapiens
acuuuucuuauaaugcaau

SEQ ID NO: 1972569 - RNA, 17 nt, Homo sapiens
uuuuccaaaucaaggau

SEQ ID NO: 1972570 - RNA, 22 nt, Homo sapiens
uccagucccucccucaccagcc

SEQ ID NO: 1972571 - RNA, 16 nt, Homo sapiens
ucuauauaaccacauu

SEQ ID NO: 1972572 - RNA, 19 nt, Homo sapiens
ugucgugcaaacccaguga

SEQ ID NO: 1972573 - RNA, 16 nt, Homo sapiens
acccucagcacuguua

SEQ ID NO: 1972574 - RNA, 12 nt, Homo sapiens
guucagugccac

SEQ ID NO: 1972575 - RNA, 12 nt, Homo sapiens
guugagugccag

SEQ ID NO: 1972576 - RNA, 21 nt, Homo sapiens
auagaacaagacccugucuca

SEQ ID NO: 1972577 - RNA, 21 nt, Homo sapiens
aggaaagugauuuuuuuccac

SEQ ID NO: 1972578 - RNA, 13 nt, Homo sapiens
cuuaaaacagaaa

SEQ ID NO: 1972579 - RNA, 18 nt, Homo sapiens
uggaaacuagaucgucuc

SEQ ID NO: 1972580 - RNA, 16 nt, Homo sapiens
auaucaucagcauacc

SEQ ID NO: 1972581 - RNA, 23 nt, Homo sapiens
cugugaaaauugaccaagugaug

SEQ ID NO: 1972582 - RNA, 13 nt, Homo sapiens
aauuuaauaccag

SEQ ID NO: 1972583 - RNA, 15 nt, Homo sapiens
gacagacagccaccc

SEQ ID NO: 1972584 - RNA, 12 nt, Homo sapiens
ugcaggguccca

SEQ ID NO: 1972585 - RNA, 24 nt, Homo sapiens
cuggaagagccaaagaauauucca

SEQ ID NO: 1972586 - RNA, 17 nt, Homo sapiens
acucagcuaaugucaca

SEQ ID NO: 1972587 - RNA, 18 nt, Homo sapiens
aaugucuuguaagcaaaa

SEQ ID NO: 1972588 - RNA, 13 nt, Homo sapiens
gcucaggcagcuc

SEQ ID NO: 1972589 - RNA, 23 nt, Homo sapiens
uuccugacuuaaaacaaaaggaa

SEQ ID NO: 1972590 - RNA, 16 nt, Homo sapiens
gaacaaaauaagcaac

SEQ ID NO: 1972591 - RNA, 20 nt, Homo sapiens
aaauaaacaugaagcacaaa

SEQ ID NO: 1972592 - RNA, 19 nt, Homo sapiens
aggguaacuggggggccac

SEQ ID NO: 1972593 - RNA, 14 nt, Homo sapiens
uccacuguggaaaa

SEQ ID NO: 1972594 - RNA, 21 nt, Homo sapiens
uaauucacagaauagcacaaa

SEQ ID NO: 1972595 - RNA, 24 nt, Homo sapiens
gcaccagugccucagugcugcaau

SEQ ID NO: 1972596 - RNA, 20 nt, Homo sapiens
acaggaaacuacuucacagu

SEQ ID NO: 1972597 - RNA, 16 nt, Homo sapiens
uuucucugccagugac

SEQ ID NO: 1972598 - RNA, 21 nt, Homo sapiens
acacccaaaaauaucuccucc

SEQ ID NO: 1972599 - RNA, 22 nt, Homo sapiens
uuacuuuuggauaauauccacu

SEQ ID NO: 1972600 - RNA, 17 nt, Homo sapiens
augcccaguaaaauuuc

SEQ ID NO: 1972601 - RNA, 19 nt, Homo sapiens
ucugcggggcagggccuuc

SEQ ID NO: 1972602 - RNA, 21 nt, Homo sapiens
caggaaagcuggugucugauu

SEQ ID NO: 1972603 - RNA, 17 nt, Homo sapiens
ccaaaccaaauuuuaau

SEQ ID NO: 1972604 - RNA, 17 nt, Homo sapiens
uccauguuugcugccuu

SEQ ID NO: 1972605 - RNA, 22 nt, Homo sapiens
ggcuuucuggagaggagggaug

SEQ ID NO: 1972606 - RNA, 14 nt, Homo sapiens
caugagcucggggu

SEQ ID NO: 1972607 - RNA, 21 nt, Homo sapiens
ucuuucaagucaguucuguga

SEQ ID NO: 1972608 - RNA, 21 nt, Homo sapiens
uggucauacucuuuuucccaa

SEQ ID NO: 1972609 - RNA, 11 nt, Homo sapiens
accaccagggu

SEQ ID NO: 1972610 - RNA, 15 nt, Homo sapiens
uugguggccaaagau

SEQ ID NO: 1972611 - RNA, 14 nt, Homo sapiens
uacagcuucaguga

SEQ ID NO: 1972612 - RNA, 22 nt, Homo sapiens
augaaggggcucuucaucugcc

SEQ ID NO: 1972613 - RNA, 17 nt, Homo sapiens
aauuuuccauuacauga

SEQ ID NO: 1972614 - RNA, 18 nt, Homo sapiens
gagugcgcccugcacucc

SEQ ID NO: 1972615 - RNA, 19 nt, Homo sapiens
gaauuuguuugugacaacu

SEQ ID NO: 1972616 - RNA, 18 nt, Homo sapiens
cuccuguccccugcuaca

SEQ ID NO: 1972617 - RNA, 19 nt, Homo sapiens
ggagagagggcaaagggau

SEQ ID NO: 1972618 - RNA, 14 nt, Homo sapiens
uuaauauaacugcc

SEQ ID NO: 1972619 - RNA, 18 nt, Homo sapiens
ccaggcuggcgugcagca

SEQ ID NO: 1972620 - RNA, 20 nt, Homo sapiens
acaauauuaugaaauuucac

SEQ ID NO: 1972621 - RNA, 15 nt, Homo sapiens
uuauuuuauggaaua

SEQ ID NO: 1972622 - RNA, 13 nt, Homo sapiens
ucauggcaucaca

SEQ ID NO: 1972623 - RNA, 19 nt, Homo sapiens
gccaauauuuuaagguaaa

SEQ ID NO: 1972624 - RNA, 14 nt, Homo sapiens
ugcauauagacaca

SEQ ID NO: 1972625 - RNA, 16 nt, Homo sapiens
uucuaagccuauauga

SEQ ID NO: 1972626 - RNA, 21 nt, Homo sapiens
agagggaaguuuaaaacccaa

SEQ ID NO: 1972627 - RNA, 18 nt, Homo sapiens
aggcagagguugcagugu

SEQ ID NO: 1972628 - RNA, 12 nt, Homo sapiens
uuauugcaaugc

SEQ ID NO: 1972629 - RNA, 13 nt, Homo sapiens
gcaccuacugcuu

SEQ ID NO: 1972630 - RNA, 17 nt, Homo sapiens
augcugagaagaucuga

SEQ ID NO: 1972631 - RNA, 20 nt, Homo sapiens
auggagugcucacaaaggau

SEQ ID NO: 1972632 - RNA, 18 nt, Homo sapiens
gugucauguucugugcau

SEQ ID NO: 1972633 - RNA, 13 nt, Homo sapiens
ccugccccuggug

SEQ ID NO: 1972634 - RNA, 15 nt, Homo sapiens
cggaauugcucuccc

SEQ ID NO: 1972635 - RNA, 18 nt, Homo sapiens
guccccucacucugucag

SEQ ID NO: 1972636 - RNA, 14 nt, Homo sapiens
guaaaaucuuggca

SEQ ID NO: 1972637 - RNA, 18 nt, Homo sapiens
gaguuuuauugacucauu

SEQ ID NO: 1972638 - RNA, 17 nt, Homo sapiens
cccccaaauugccuuca

SEQ ID NO: 1972639 - RNA, 18 nt, Homo sapiens
aaacuuuggguacuuaua

SEQ ID NO: 1972640 - RNA, 18 nt, Homo sapiens
aauuucaauguccaguga

SEQ ID NO: 1972641 - RNA, 22 nt, Homo sapiens
gaacauagaugcuacaguauuu

SEQ ID NO: 1972642 - RNA, 16 nt, Homo sapiens
caucucuuacuugaua

SEQ ID NO: 1972643 - RNA, 13 nt, Homo sapiens
agacucucucuua

SEQ ID NO: 1972644 - RNA, 23 nt, Homo sapiens
ggaggugguccuccuaucucccu

SEQ ID NO: 1972645 - RNA, 16 nt, Homo sapiens
ucauuaugacucuuaa

SEQ ID NO: 1972646 - RNA, 19 nt, Homo sapiens
ugcauucuuccgcacccuc

SEQ ID NO: 1972647 - RNA, 22 nt, Homo sapiens
uaaguugaaugauaauagcuca

SEQ ID NO: 1972648 - RNA, 12 nt, Homo sapiens
cuuaagcaaagg

SEQ ID NO: 1972649 - RNA, 22 nt, Homo sapiens
uuagggaagaaaaagcaagugu

SEQ ID NO: 1972650 - RNA, 19 nt, Homo sapiens
cccucucucacacaucaca

SEQ ID NO: 1972651 - RNA, 17 nt, Homo sapiens
cuuuuaauaaacugcaa

SEQ ID NO: 1972652 - RNA, 18 nt, Homo sapiens
ggcggaacucucagggga

SEQ ID NO: 1972653 - RNA, 20 nt, Homo sapiens
ugaguuuuugauagcuuuau

SEQ ID NO: 1972654 - RNA, 15 nt, Homo sapiens
guaagugccugcugu

SEQ ID NO: 1972655 - RNA, 12 nt, Homo sapiens
caucccaaagga

SEQ ID NO: 1972656 - RNA, 19 nt, Homo sapiens
ugcagggaaugcaauccuu

SEQ ID NO: 1972657 - RNA, 13 nt, Homo sapiens
uaucaguuuccag

SEQ ID NO: 1972658 - RNA, 14 nt, Homo sapiens
uucuauuuacuuga

SEQ ID NO: 1972659 - RNA, 15 nt, Homo sapiens
ucaugaugaacucac

SEQ ID NO: 1972660 - RNA, 22 nt, Homo sapiens
uucccauaacauaaaagugcua

SEQ ID NO: 1972661 - RNA, 18 nt, Homo sapiens
cuuacccuccuccagacc

SEQ ID NO: 1972662 - RNA, 16 nt, Homo sapiens
aguggggaacuacugc

SEQ ID NO: 1972663 - RNA, 14 nt, Homo sapiens
acucuccuugcagu

SEQ ID NO: 1972664 - RNA, 21 nt, Homo sapiens
uaacucgaggagcucaggguu

SEQ ID NO: 1972665 - RNA, 15 nt, Homo sapiens
gcgcccucuaccucc

SEQ ID NO: 1972666 - RNA, 11 nt, Homo sapiens
accagcacauu

SEQ ID NO: 1972667 - RNA, 23 nt, Homo sapiens
uuuucucccgucaccacccagua

SEQ ID NO: 1972668 - RNA, 14 nt, Homo sapiens
accauacugaggga

SEQ ID NO: 1972669 - RNA, 14 nt, Homo sapiens
acuucaaaucagag

SEQ ID NO: 1972670 - RNA, 19 nt, Homo sapiens
aaaaucaguguuuaaauaa

SEQ ID NO: 1972671 - RNA, 12 nt, Homo sapiens
agaagugagcuc

SEQ ID NO: 1972672 - RNA, 13 nt, Homo sapiens
acacuaaaacuuu

SEQ ID NO: 1972673 - RNA, 17 nt, Homo sapiens
auggcacuuuugaugaa

SEQ ID NO: 1972674 - RNA, 18 nt, Homo sapiens
uaaaucaguuaauggcuc

SEQ ID NO: 1972675 - RNA, 16 nt, Homo sapiens
acaccuccuucuuccu

SEQ ID NO: 1972676 - RNA, 19 nt, Homo sapiens
agugagaaaccauauuucc

SEQ ID NO: 1972677 - RNA, 16 nt, Homo sapiens
accugaugcagugcuc

SEQ ID NO: 1972678 - RNA, 18 nt, Homo sapiens
gauugagauguguucaca

SEQ ID NO: 1972679 - RNA, 17 nt, Homo sapiens
ccugggggcugcugcac

SEQ ID NO: 1972680 - RNA, 15 nt, Homo sapiens
gauuaaguccagaaa

SEQ ID NO: 1972681 - RNA, 17 nt, Homo sapiens
gacaagacccucucagg

SEQ ID NO: 1972682 - RNA, 23 nt, Homo sapiens
ugugaaauucaaccugugucuua

SEQ ID NO: 1972683 - RNA, 18 nt, Homo sapiens
aauuuuuuucaguauuau

SEQ ID NO: 1972684 - RNA, 22 nt, Homo sapiens
caaugggagggggcuccaugga

SEQ ID NO: 1972685 - RNA, 13 nt, Homo sapiens
auguuucagacca

SEQ ID NO: 1972686 - RNA, 19 nt, Homo sapiens
guuacaguacuguucccaa

SEQ ID NO: 1972687 - RNA, 14 nt, Homo sapiens
aauagaaguuuucc

SEQ ID NO: 1972688 - RNA, 15 nt, Homo sapiens
acgaaggccucugaa

SEQ ID NO: 1972689 - RNA, 22 nt, Homo sapiens
gaagucaugggaacgcagccuc

SEQ ID NO: 1972690 - RNA, 19 nt, Homo sapiens
uguucaacuaggaucagaa

SEQ ID NO: 1972691 - RNA, 17 nt, Homo sapiens
accuugugucuguacac

SEQ ID NO: 1972692 - RNA, 21 nt, Homo sapiens
uuuucaaaauauuacucaguu

SEQ ID NO: 1972693 - RNA, 18 nt, Homo sapiens
auaucaucagcauaccuu

SEQ ID NO: 1972694 - RNA, 17 nt, Homo sapiens
auuucuagaagcacaug

SEQ ID NO: 1972695 - RNA, 16 nt, Homo sapiens
caaaauuuaauugugu

SEQ ID NO: 1972696 - RNA, 14 nt, Homo sapiens
acaaguuucccaaa

SEQ ID NO: 1972697 - RNA, 18 nt, Homo sapiens
agauacauaaaagugcuu

SEQ ID NO: 1972698 - RNA, 22 nt, Homo sapiens
uaguucccugaaaacccagaga

SEQ ID NO: 1972699 - RNA, 15 nt, Homo sapiens
gcugguuguugccag

SEQ ID NO: 1972700 - RNA, 19 nt, Homo sapiens
cucugauauacaaagggau

SEQ ID NO: 1972701 - RNA, 21 nt, Homo sapiens
guggggguaaggugcaucugu

SEQ ID NO: 1972702 - RNA, 13 nt, Homo sapiens
agacauaaagcca

SEQ ID NO: 1972703 - RNA, 14 nt, Homo sapiens
agcaaaacuuuacu

SEQ ID NO: 1972704 - RNA, 15 nt, Homo sapiens
cggguuacuuucaca

SEQ ID NO: 1972705 - RNA, 19 nt, Homo sapiens
aggcugaggggaggaucac

SEQ ID NO: 1972706 - RNA, 14 nt, Homo sapiens
uaaucaaugaagua

SEQ ID NO: 1972707 - RNA, 15 nt, Homo sapiens
ccuagagcuagaugu

SEQ ID NO: 1972708 - RNA, 18 nt, Homo sapiens
aaaugcagucuuaccaau

SEQ ID NO: 1972709 - RNA, 15 nt, Homo sapiens
aauuugaugaaauca

SEQ ID NO: 1972710 - RNA, 18 nt, Homo sapiens
acgcaguauugagcugcc

SEQ ID NO: 1972711 - RNA, 20 nt, Homo sapiens
ugagcuaagaucacaccacu

SEQ ID NO: 1972712 - RNA, 14 nt, Homo sapiens
cagccagacuggca

SEQ ID NO: 1972713 - RNA, 14 nt, Homo sapiens
uaagcugauuaccu

SEQ ID NO: 1972714 - RNA, 19 nt, Homo sapiens
agugccagguggcucagug

SEQ ID NO: 1972715 - RNA, 18 nt, Homo sapiens
uuaaggugaaccaaagaa

SEQ ID NO: 1972716 - RNA, 21 nt, Homo sapiens
gccaucacucuuguacugccu

SEQ ID NO: 1972717 - RNA, 19 nt, Homo sapiens
agcuauguggcugcugcug

SEQ ID NO: 1972718 - RNA, 22 nt, Homo sapiens
ugaccuaccucaaagggcaguu

SEQ ID NO: 1972719 - RNA, 19 nt, Homo sapiens
guucuuguaaaacugugac

SEQ ID NO: 1972720 - RNA, 22 nt, Homo sapiens
aaugggacugaugucaucuuga

SEQ ID NO: 1972721 - RNA, 15 nt, Homo sapiens
aaauaacugaucuca

SEQ ID NO: 1972722 - RNA, 14 nt, Homo sapiens
agagguuucaguga

SEQ ID NO: 1972723 - RNA, 18 nt, Homo sapiens
uggcagaagcauugccug

SEQ ID NO: 1972724 - RNA, 19 nt, Homo sapiens
ucuugggcugagugcagcc

SEQ ID NO: 1972725 - RNA, 12 nt, Homo sapiens
auuaagagcaaa

SEQ ID NO: 1972726 - RNA, 16 nt, Homo sapiens
gucagacaagccugag

SEQ ID NO: 1972727 - RNA, 19 nt, Homo sapiens
accugagccuuuucuuaua

SEQ ID NO: 1972728 - RNA, 14 nt, Homo sapiens
aaauacacaacaca

SEQ ID NO: 1972729 - RNA, 12 nt, Homo sapiens
caaccaccaggu

SEQ ID NO: 1972730 - RNA, 12 nt, Homo sapiens
ugaguggaguua

SEQ ID NO: 1972731 - RNA, 20 nt, Homo sapiens
cugaaguacuuaaacuucca

SEQ ID NO: 1972732 - RNA, 16 nt, Homo sapiens
ccauccugcucuucca

SEQ ID NO: 1972733 - RNA, 21 nt, Homo sapiens
aacucagaaugaaaauucauu

SEQ ID NO: 1972734 - RNA, 14 nt, Homo sapiens
uggaaggcucccua

SEQ ID NO: 1972735 - RNA, 14 nt, Homo sapiens
aucuuagcuuucca

SEQ ID NO: 1972736 - RNA, 13 nt, Homo sapiens
uguaacauucaca

SEQ ID NO: 1972737 - RNA, 23 nt, Homo sapiens
uaagggacuuuggaauucugcuu

SEQ ID NO: 1972738 - RNA, 16 nt, Homo sapiens
caagggacccaugagu

SEQ ID NO: 1972739 - RNA, 13 nt, Homo sapiens
ccaaccccagugg

SEQ ID NO: 1972740 - RNA, 18 nt, Homo sapiens
cagcaggcuuuuguguuc

SEQ ID NO: 1972741 - RNA, 16 nt, Homo sapiens
ugacacauaugcaccu

SEQ ID NO: 1972742 - RNA, 20 nt, Homo sapiens
agcaucucugagcacccaag

SEQ ID NO: 1972743 - RNA, 17 nt, Homo sapiens
caguuaagccuuuggaa

SEQ ID NO: 1972744 - RNA, 21 nt, Homo sapiens
aaacuugcauacagagacaga

SEQ ID NO: 1972745 - RNA, 18 nt, Homo sapiens
uuaaauuguuucauaucu

SEQ ID NO: 1972746 - RNA, 15 nt, Homo sapiens
uccuaaaaaacacug

SEQ ID NO: 1972747 - RNA, 22 nt, Homo sapiens
acagucacgccugaaacuuuga

SEQ ID NO: 1972748 - RNA, 16 nt, Homo sapiens
agcaaggugcucuuga

SEQ ID NO: 1972749 - RNA, 21 nt, Homo sapiens
agccaaguuuuauaauccuua

SEQ ID NO: 1972750 - RNA, 22 nt, Homo sapiens
agcucuggggugggcaguuuuu

SEQ ID NO: 1972751 - RNA, 17 nt, Homo sapiens
gccaucaggaugagcag

SEQ ID NO: 1972752 - RNA, 15 nt, Homo sapiens
augaagaugaugcua

SEQ ID NO: 1972753 - RNA, 13 nt, Homo sapiens
uuuuuuaccacaa

SEQ ID NO: 1972754 - RNA, 13 nt, Homo sapiens
uuaaggucacuaa

SEQ ID NO: 1972755 - RNA, 23 nt, Homo sapiens
gacuugaaaugcucuuuugcaca

SEQ ID NO: 1972756 - RNA, 22 nt, Homo sapiens
uuacauuaaaauaaaccaaaua

SEQ ID NO: 1972757 - RNA, 15 nt, Homo sapiens
ccucccugcaucuga

SEQ ID NO: 1972758 - RNA, 18 nt, Homo sapiens
acucuugaucaucuguag

SEQ ID NO: 1972759 - RNA, 19 nt, Homo sapiens
aaugauucauaacaaugua

SEQ ID NO: 1972760 - RNA, 15 nt, Homo sapiens
cuggaauuacaggcg

SEQ ID NO: 1972761 - RNA, 19 nt, Homo sapiens
uagcuuacaggaagcuuuu

SEQ ID NO: 1972762 - RNA, 21 nt, Homo sapiens
ggccuucugccugcugaccau

SEQ ID NO: 1972763 - RNA, 21 nt, Homo sapiens
uuugaauguuaagcagaugga

SEQ ID NO: 1972764 - RNA, 20 nt, Homo sapiens
gcuaacugagagaaguacua

SEQ ID NO: 1972765 - RNA, 16 nt, Homo sapiens
aaauauaaacuugugu

SEQ ID NO: 1972766 - RNA, 19 nt, Homo sapiens
uaguuguucuagcagugaa

SEQ ID NO: 1972767 - RNA, 12 nt, Homo sapiens
ggaaucacuguu

SEQ ID NO: 1972768 - RNA, 12 nt, Homo sapiens
guuaucacuuau

SEQ ID NO: 1972769 - RNA, 13 nt, Homo sapiens
gaugcugucugaa

SEQ ID NO: 1972770 - RNA, 22 nt, Homo sapiens
ggagaauaaaauuccuaucuca

SEQ ID NO: 1972771 - RNA, 22 nt, Homo sapiens
auugaccgcgacuaauuucaaa

SEQ ID NO: 1972772 - RNA, 14 nt, Homo sapiens
auccaaacacugag

SEQ ID NO: 1972773 - RNA, 21 nt, Homo sapiens
aaaagggauccguacauucaa

SEQ ID NO: 1972774 - RNA, 18 nt, Homo sapiens
gagagaaugcugaccuga

SEQ ID NO: 1972775 - RNA, 14 nt, Homo sapiens
uaacguggcacugg

SEQ ID NO: 1972776 - RNA, 17 nt, Homo sapiens
agcccuccuuaucaaag

SEQ ID NO: 1972777 - RNA, 11 nt, Homo sapiens
gagugcugaua

SEQ ID NO: 1972778 - RNA, 22 nt, Homo sapiens
gcacacucacuggcaucuuugc

SEQ ID NO: 1972779 - RNA, 18 nt, Homo sapiens
ccgaggggcucaguucug

SEQ ID NO: 1972780 - RNA, 13 nt, Homo sapiens
gaaaaagcaccaa

SEQ ID NO: 1972781 - RNA, 13 nt, Homo sapiens
cugagaaggcuca

SEQ ID NO: 1972782 - RNA, 14 nt, Homo sapiens
accaugacccuaca

SEQ ID NO: 1972783 - RNA, 19 nt, Homo sapiens
cacugccggcaggaugcag

SEQ ID NO: 1972784 - RNA, 14 nt, Homo sapiens
caagagucugauga

SEQ ID NO: 1972785 - RNA, 22 nt, Homo sapiens
cccugaccacccugccugugga

SEQ ID NO: 1972786 - RNA, 21 nt, Homo sapiens
ugcacauucucccuugauucc

SEQ ID NO: 1972787 - RNA, 20 nt, Homo sapiens
ugacuucauagauuaugcuu

SEQ ID NO: 1972788 - RNA, 15 nt, Homo sapiens
agaaggccaggaaaa

SEQ ID NO: 1972789 - RNA, 14 nt, Homo sapiens
acugaacauuugcu

SEQ ID NO: 1972790 - RNA, 13 nt, Homo sapiens
cagcccucaggcc

SEQ ID NO: 1972791 - RNA, 13 nt, Homo sapiens
caggacucaggga

SEQ ID NO: 1972792 - RNA, 19 nt, Homo sapiens
guagaaaagggaacugaac

SEQ ID NO: 1972793 - RNA, 17 nt, Homo sapiens
gccacagcacucggccu

SEQ ID NO: 1972794 - RNA, 18 nt, Homo sapiens
ugcuaccugcaccucugg

SEQ ID NO: 1972795 - RNA, 18 nt, Homo sapiens
acucccaccccagggauu

SEQ ID NO: 1972796 - RNA, 17 nt, Homo sapiens
uggcuuagggcuggaag

SEQ ID NO: 1972797 - RNA, 22 nt, Homo sapiens
uucucugcgagcaacagugccc

SEQ ID NO: 1972798 - RNA, 19 nt, Homo sapiens
gcuggucuggaguugcuga

SEQ ID NO: 1972799 - RNA, 19 nt, Homo sapiens
aggucucauucauccuuau

SEQ ID NO: 1972800 - RNA, 14 nt, Homo sapiens
cuggaggugcugcu

SEQ ID NO: 1972801 - RNA, 16 nt, Homo sapiens
aaguuauacucacaaa

SEQ ID NO: 1972802 - RNA, 17 nt, Homo sapiens
ucacacgggaagaucau

SEQ ID NO: 1972803 - RNA, 17 nt, Homo sapiens
ucucauuaucuccauga

SEQ ID NO: 1972804 - RNA, 18 nt, Homo sapiens
agauaaucgaagcaaaag

SEQ ID NO: 1972805 - RNA, 13 nt, Homo sapiens
aguguuuaacugg

SEQ ID NO: 1972806 - RNA, 16 nt, Homo sapiens
uguaaacacucagcug

SEQ ID NO: 1972807 - RNA, 21 nt, Homo sapiens
caggaucagugggucuaagug

SEQ ID NO: 1972808 - RNA, 18 nt, Homo sapiens
auguccaaacccacucau

SEQ ID NO: 1972809 - RNA, 13 nt, Homo sapiens
uaaauacugucaa

SEQ ID NO: 1972810 - RNA, 14 nt, Homo sapiens
caauguuuuagaau

SEQ ID NO: 1972811 - RNA, 12 nt, Homo sapiens
ugauaucugauc

SEQ ID NO: 1972812 - RNA, 22 nt, Homo sapiens
ccuguacccaguagaugccacc

SEQ ID NO: 1972813 - RNA, 23 nt, Homo sapiens
ugguccccugcccugucuuucca

SEQ ID NO: 1972814 - RNA, 18 nt, Homo sapiens
uuauugauaaguucauac

SEQ ID NO: 1972815 - RNA, 15 nt, Homo sapiens
aaaaacuguuaauca

SEQ ID NO: 1972816 - RNA, 21 nt, Homo sapiens
agggaacucuccccauuggca

SEQ ID NO: 1972817 - RNA, 16 nt, Homo sapiens
gcgaacugugcaguua

SEQ ID NO: 1972818 - RNA, 22 nt, Homo sapiens
gauauagaaaggagaccuguau

SEQ ID NO: 1972819 - RNA, 17 nt, Homo sapiens
uuucagcgauguaugca

SEQ ID NO: 1972820 - RNA, 21 nt, Homo sapiens
cugacuuggaucccaaagcaa

SEQ ID NO: 1972821 - RNA, 18 nt, Homo sapiens
ugaaaauaaagcagaagc

SEQ ID NO: 1972822 - RNA, 21 nt, Homo sapiens
auaaaauauauugguauguaa

SEQ ID NO: 1972823 - RNA, 12 nt, Homo sapiens
caagaacuugga

SEQ ID NO: 1972824 - RNA, 15 nt, Homo sapiens
uaagugauacauacc

SEQ ID NO: 1972825 - RNA, 16 nt, Homo sapiens
ccacccagaacugggc

SEQ ID NO: 1972826 - RNA, 13 nt, Homo sapiens
agaaugucacugu

SEQ ID NO: 1972827 - RNA, 17 nt, Homo sapiens
agcaaacaaaauggacu

SEQ ID NO: 1972828 - RNA, 15 nt, Homo sapiens
gagauuuucuuggca

SEQ ID NO: 1972829 - RNA, 20 nt, Homo sapiens
acaccguguaaaccaaagcc

SEQ ID NO: 1972830 - RNA, 16 nt, Homo sapiens
augggaccuauaacug

SEQ ID NO: 1972831 - RNA, 23 nt, Homo sapiens
cucaccacgaugacgccucugga

SEQ ID NO: 1972832 - RNA, 13 nt, Homo sapiens
auaccaugugcca

SEQ ID NO: 1972833 - RNA, 13 nt, Homo sapiens
agaaaauguucac

SEQ ID NO: 1972834 - RNA, 15 nt, Homo sapiens
gagccccucagacag

SEQ ID NO: 1972835 - RNA, 13 nt, Homo sapiens
agagggaggaaga

SEQ ID NO: 1972836 - RNA, 20 nt, Homo sapiens
aaacccaaccuuucauuucc

SEQ ID NO: 1972837 - RNA, 15 nt, Homo sapiens
gcuuaagugacaaag

SEQ ID NO: 1972838 - RNA, 22 nt, Homo sapiens
uaaaccaauuuuuuauucauuu

SEQ ID NO: 1972839 - RNA, 12 nt, Homo sapiens
auagauaaguca

SEQ ID NO: 1972840 - RNA, 17 nt, Homo sapiens
ucaaaaacgaccaccuc

SEQ ID NO: 1972841 - RNA, 10 nt, Homo sapiens
cuuucaggaa

SEQ ID NO: 1972842 - RNA, 14 nt, Homo sapiens
uguaagccaucaca

SEQ ID NO: 1972843 - RNA, 20 nt, Homo sapiens
gccuggcagccgugccuuca

SEQ ID NO: 1972844 - RNA, 13 nt, Homo sapiens
gugucuuuugaca

SEQ ID NO: 1972845 - RNA, 14 nt, Homo sapiens
gggugucugcuaaa

SEQ ID NO: 1972846 - RNA, 18 nt, Homo sapiens
ugugagaauaaacuagac

SEQ ID NO: 1972847 - RNA, 13 nt, Homo sapiens
accuccuccuuca

SEQ ID NO: 1972848 - RNA, 14 nt, Homo sapiens
aucagagaaggaac

SEQ ID NO: 1972849 - RNA, 14 nt, Homo sapiens
cucggagacgggac

SEQ ID NO: 1972850 - RNA, 18 nt, Homo sapiens
uacaggugcgugccacca

SEQ ID NO: 1972851 - RNA, 16 nt, Homo sapiens
gaaugugcagugucuu

SEQ ID NO: 1972852 - RNA, 20 nt, Homo sapiens
uuugacuuucugucugugga

SEQ ID NO: 1972853 - RNA, 16 nt, Homo sapiens
auuaggaaaguacugc

SEQ ID NO: 1972854 - RNA, 15 nt, Homo sapiens
cgagcggcaaaggcc

SEQ ID NO: 1972855 - RNA, 18 nt, Homo sapiens
accugcuaggccagagcc

SEQ ID NO: 1972856 - RNA, 13 nt, Homo sapiens
ugucuucugggca

SEQ ID NO: 1972857 - RNA, 19 nt, Homo sapiens
agaggccgcugcagggugg

SEQ ID NO: 1972858 - RNA, 17 nt, Homo sapiens
aguucugaguccugaga

SEQ ID NO: 1972859 - RNA, 14 nt, Homo sapiens
cccuucugaaugaa

SEQ ID NO: 1972860 - RNA, 15 nt, Homo sapiens
agugcaagagccuga

SEQ ID NO: 1972861 - RNA, 20 nt, Homo sapiens
ccagcaaauaaagcagucau

SEQ ID NO: 1972862 - RNA, 14 nt, Homo sapiens
acuuuccauuaaau

SEQ ID NO: 1972863 - RNA, 15 nt, Homo sapiens
uuuccccagugacac

SEQ ID NO: 1972864 - RNA, 22 nt, Homo sapiens
uggagaaggccuggaagagcug

SEQ ID NO: 1972865 - RNA, 13 nt, Homo sapiens
cuuugccacugaa

SEQ ID NO: 1972866 - RNA, 18 nt, Homo sapiens
cugaaccguuacaaaaga

SEQ ID NO: 1972867 - RNA, 18 nt, Homo sapiens
aauuuucgaaaacuuccc

SEQ ID NO: 1972868 - RNA, 13 nt, Homo sapiens
cuucauagaaacu

SEQ ID NO: 1972869 - RNA, 20 nt, Homo sapiens
uagaaacacacuuuugcaca

SEQ ID NO: 1972870 - RNA, 18 nt, Homo sapiens
ccauacccccacaugcca

SEQ ID NO: 1972871 - RNA, 20 nt, Homo sapiens
aaaugaaaaauuccacucaa

SEQ ID NO: 1972872 - RNA, 15 nt, Homo sapiens
gauccgcuccagcgu

SEQ ID NO: 1972873 - RNA, 14 nt, Homo sapiens
cuugcacuguaucc

SEQ ID NO: 1972874 - RNA, 15 nt, Homo sapiens
guuaaaggucuccca

SEQ ID NO: 1972875 - RNA, 14 nt, Homo sapiens
ugcuugagccuuug

SEQ ID NO: 1972876 - RNA, 21 nt, Homo sapiens
ggaagucaggggagaagcuga

SEQ ID NO: 1972877 - RNA, 14 nt, Homo sapiens
uauacauaugauca

SEQ ID NO: 1972878 - RNA, 14 nt, Homo sapiens
cccaccaacucugc

SEQ ID NO: 1972879 - RNA, 18 nt, Homo sapiens
cuuaaauuuuauaucauu

SEQ ID NO: 1972880 - RNA, 18 nt, Homo sapiens
ccaaaacaaacaaacaga

SEQ ID NO: 1972881 - RNA, 14 nt, Homo sapiens
uauguaaucucacc

SEQ ID NO: 1972882 - RNA, 13 nt, Homo sapiens
auuauuugcacag

SEQ ID NO: 1972883 - RNA, 14 nt, Homo sapiens
gcguucaccucccu

SEQ ID NO: 1972884 - RNA, 17 nt, Homo sapiens
caaagaccaaguuauca

SEQ ID NO: 1972885 - RNA, 17 nt, Homo sapiens
ccaccucuugugcaagg

SEQ ID NO: 1972886 - RNA, 15 nt, Homo sapiens
gcauagugcugggau

SEQ ID NO: 1972887 - RNA, 22 nt, Homo sapiens
ucaaaauuguuuaccauagaaa

SEQ ID NO: 1972888 - RNA, 22 nt, Homo sapiens
aucagaugcuuuccugcacauu

SEQ ID NO: 1972889 - RNA, 22 nt, Homo sapiens
ccacgagguuaaagaagcugca

SEQ ID NO: 1972890 - RNA, 15 nt, Homo sapiens
gugagccaagauugc

SEQ ID NO: 1972891 - RNA, 15 nt, Homo sapiens
aauugggccaaagaa

SEQ ID NO: 1972892 - RNA, 15 nt, Homo sapiens
ucacugccaacuuuu

SEQ ID NO: 1972893 - RNA, 15 nt, Homo sapiens
aguaacuuguuuaca

SEQ ID NO: 1972894 - RNA, 23 nt, Homo sapiens
gacaauaaaccuccgccaaugca

SEQ ID NO: 1972895 - RNA, 19 nt, Homo sapiens
acaguuugaugcugaguca

SEQ ID NO: 1972896 - RNA, 20 nt, Homo sapiens
agccugaggaaguuuugcau

SEQ ID NO: 1972897 - RNA, 22 nt, Homo sapiens
aaugcccucaggggacuugaau

SEQ ID NO: 1972898 - RNA, 21 nt, Homo sapiens
aaaagugccuuagcauguguu

SEQ ID NO: 1972899 - RNA, 23 nt, Homo sapiens
cagucugugccuacauguucuca

SEQ ID NO: 1972900 - RNA, 16 nt, Homo sapiens
auggcuguguuugcag

SEQ ID NO: 1972901 - RNA, 16 nt, Homo sapiens
ggaaagaacugucaug

SEQ ID NO: 1972902 - RNA, 13 nt, Homo sapiens
guucugacacugu

SEQ ID NO: 1972903 - RNA, 21 nt, Homo sapiens
gaauacuagaaugguagcacu

SEQ ID NO: 1972904 - RNA, 21 nt, Homo sapiens
cuaugaaauaucaugcuccau

SEQ ID NO: 1972905 - RNA, 19 nt, Homo sapiens
accccacaacgugcaacug

SEQ ID NO: 1972906 - RNA, 18 nt, Homo sapiens
ugucauugucuacuccua

SEQ ID NO: 1972907 - RNA, 14 nt, Homo sapiens
agcaaugccugagc

SEQ ID NO: 1972908 - RNA, 16 nt, Homo sapiens
ucuaccuugcagugua

SEQ ID NO: 1972909 - RNA, 14 nt, Homo sapiens
caguggaacuaaga

SEQ ID NO: 1972910 - RNA, 19 nt, Homo sapiens
cucgacugcucaaccucac

SEQ ID NO: 1972911 - RNA, 14 nt, Homo sapiens
gccccuugcuucua

SEQ ID NO: 1972912 - RNA, 14 nt, Homo sapiens
cucucguguuugau

SEQ ID NO: 1972913 - RNA, 21 nt, Homo sapiens
aagcaucuguguaaccuccac

SEQ ID NO: 1972914 - RNA, 12 nt, Homo sapiens
gccuccaugacu

SEQ ID NO: 1972915 - RNA, 22 nt, Homo sapiens
guggaggguggggggcgcugag

SEQ ID NO: 1972916 - RNA, 13 nt, Homo sapiens
uucugaaagggac

SEQ ID NO: 1972917 - RNA, 15 nt, Homo sapiens
guucugcccauggga

SEQ ID NO: 1972918 - RNA, 14 nt, Homo sapiens
cucuaaaugcaguu

SEQ ID NO: 1972919 - RNA, 16 nt, Homo sapiens
aaucuugauaccaccu

SEQ ID NO: 1972920 - RNA, 14 nt, Homo sapiens
uuaaauuaugggaa

SEQ ID NO: 1972921 - RNA, 14 nt, Homo sapiens
ccauuacacuccag

SEQ ID NO: 1972922 - RNA, 18 nt, Homo sapiens
acuucucucuaaggagaa

SEQ ID NO: 1972923 - RNA, 19 nt, Homo sapiens
ugcuugcuguaauguauau

SEQ ID NO: 1972924 - RNA, 17 nt, Homo sapiens
gcuagcauuaccacuuc

SEQ ID NO: 1972925 - RNA, 12 nt, Homo sapiens
cugauaccucaa

SEQ ID NO: 1972926 - RNA, 12 nt, Homo sapiens
cugcuaccucac

SEQ ID NO: 1972927 - RNA, 19 nt, Homo sapiens
uggaaguugcauggcauca

SEQ ID NO: 1972928 - RNA, 17 nt, Homo sapiens
uagccucaguacuggug

SEQ ID NO: 1972929 - RNA, 19 nt, Homo sapiens
ggacaaaacuucuugucag

SEQ ID NO: 1972930 - RNA, 16 nt, Homo sapiens
cuccaggaucuauuga

SEQ ID NO: 1972931 - RNA, 19 nt, Homo sapiens
uacuguccuuaaagccauu

SEQ ID NO: 1972932 - RNA, 19 nt, Homo sapiens
gacauacauuuaugcacau

SEQ ID NO: 1972933 - RNA, 15 nt, Homo sapiens
gcaaacacuguguau

SEQ ID NO: 1972934 - RNA, 19 nt, Homo sapiens
agcugccucugccacugac

SEQ ID NO: 1972935 - RNA, 14 nt, Homo sapiens
ucagcgcugcccac

SEQ ID NO: 1972936 - RNA, 19 nt, Homo sapiens
gcaccuaccaucagggaca

SEQ ID NO: 1972937 - RNA, 13 nt, Homo sapiens
uccagaagccagu

SEQ ID NO: 1972938 - RNA, 15 nt, Homo sapiens
gaguauaacucuaac

SEQ ID NO: 1972939 - RNA, 22 nt, Homo sapiens
gaacgcacuuuauaaaagcaaa

SEQ ID NO: 1972940 - RNA, 20 nt, Homo sapiens
gacucugcacaugucuugua

SEQ ID NO: 1972941 - RNA, 15 nt, Homo sapiens
aaugacaacaaagua

SEQ ID NO: 1972942 - RNA, 19 nt, Homo sapiens
gggacagcaagugagcaga

SEQ ID NO: 1972943 - RNA, 22 nt, Homo sapiens
gcuuuggguggcucacuacuga

SEQ ID NO: 1972944 - RNA, 14 nt, Homo sapiens
cagcuuuugcaacu

SEQ ID NO: 1972945 - RNA, 15 nt, Homo sapiens
guccuagcuuuauau

SEQ ID NO: 1972946 - RNA, 13 nt, Homo sapiens
caaaauucaccca

SEQ ID NO: 1972947 - RNA, 17 nt, Homo sapiens
auuaucgggagcagugu

SEQ ID NO: 1972948 - RNA, 14 nt, Homo sapiens
uuuaaaagauaaaa

SEQ ID NO: 1972949 - RNA, 14 nt, Homo sapiens
ucugaaagacagaa

SEQ ID NO: 1972950 - RNA, 15 nt, Homo sapiens
agccacagcauuuau

SEQ ID NO: 1972951 - RNA, 12 nt, Homo sapiens
ggcauugcaaag

SEQ ID NO: 1972952 - RNA, 22 nt, Homo sapiens
auaugccuaaaugcacagucau

SEQ ID NO: 1972953 - RNA, 19 nt, Homo sapiens
aacuauuucuacacagugg

SEQ ID NO: 1972954 - RNA, 15 nt, Homo sapiens
agcugagcuuuccag

SEQ ID NO: 1972955 - RNA, 18 nt, Homo sapiens
aaaaagucuguauggcau

SEQ ID NO: 1972956 - RNA, 13 nt, Homo sapiens
cuucuaaacauuu

SEQ ID NO: 1972957 - RNA, 21 nt, Homo sapiens
aggugccuccaauuggugcuu

SEQ ID NO: 1972958 - RNA, 21 nt, Homo sapiens
aagaggagauuggccagugag

SEQ ID NO: 1972959 - RNA, 21 nt, Homo sapiens
uaacuacuguccuuaaagcca

SEQ ID NO: 1972960 - RNA, 17 nt, Homo sapiens
cagaggucacacagccu

SEQ ID NO: 1972961 - RNA, 23 nt, Homo sapiens
ccuucccucuccugcuuccucuu

SEQ ID NO: 1972962 - RNA, 14 nt, Homo sapiens
cucagacccaacag

SEQ ID NO: 1972963 - RNA, 14 nt, Homo sapiens
uaaagaccuuccag

SEQ ID NO: 1972964 - RNA, 20 nt, Homo sapiens
cuccauaugcuguacaugac

SEQ ID NO: 1972965 - RNA, 20 nt, Homo sapiens
cuggugagaucaacaacacu

SEQ ID NO: 1972966 - RNA, 13 nt, Homo sapiens
cuagaacagccag

SEQ ID NO: 1972967 - RNA, 17 nt, Homo sapiens
gaaacccaggaguggau

SEQ ID NO: 1972968 - RNA, 23 nt, Homo sapiens
ugggagauccugcauuucuaaca

SEQ ID NO: 1972969 - RNA, 22 nt, Homo sapiens
uggauuuuaaaaaaucaaucaa

SEQ ID NO: 1972970 - RNA, 18 nt, Homo sapiens
aggcugaggcaggaggau

SEQ ID NO: 1972971 - RNA, 15 nt, Homo sapiens
caaccaagaggauuu

SEQ ID NO: 1972972 - RNA, 15 nt, Homo sapiens
acccaguagaugcca

SEQ ID NO: 1972973 - RNA, 20 nt, Homo sapiens
cuuccugcugggacugagaa

SEQ ID NO: 1972974 - RNA, 17 nt, Homo sapiens
ugcccaggacugcauug

SEQ ID NO: 1972975 - RNA, 17 nt, Homo sapiens
aagauugagaagccaug

SEQ ID NO: 1972976 - RNA, 18 nt, Homo sapiens
caaauggcaaagacugga

SEQ ID NO: 1972977 - RNA, 15 nt, Homo sapiens
accuuuuuauuugca

SEQ ID NO: 1972978 - RNA, 18 nt, Homo sapiens
ucaucagccaaaacgugg

SEQ ID NO: 1972979 - RNA, 22 nt, Homo sapiens
cugucguuccgguuauguugug

SEQ ID NO: 1972980 - RNA, 20 nt, Homo sapiens
ugcccuggggcaucaugggc

SEQ ID NO: 1972981 - RNA, 21 nt, Homo sapiens
agaccagugaaagaguagugc

SEQ ID NO: 1972982 - RNA, 10 nt, Homo sapiens
aaucuacauu

SEQ ID NO: 1972983 - RNA, 14 nt, Homo sapiens
cgaggucaggagau

SEQ ID NO: 1972984 - RNA, 12 nt, Homo sapiens
cacauaaaggua

SEQ ID NO: 1972985 - RNA, 22 nt, Homo sapiens
accacggccacuggccaucucc

SEQ ID NO: 1972986 - RNA, 16 nt, Homo sapiens
caugcauguuugguua

SEQ ID NO: 1972987 - RNA, 16 nt, Homo sapiens
aaguauuuacagggug

SEQ ID NO: 1972988 - RNA, 23 nt, Homo sapiens
gaacaauguauacaaugcacuuu

SEQ ID NO: 1972989 - RNA, 14 nt, Homo sapiens
aacuaacuacugua

SEQ ID NO: 1972990 - RNA, 21 nt, Homo sapiens
cuggucaacauagugagacac

SEQ ID NO: 1972991 - RNA, 23 nt, Homo sapiens
aaaccaauuuguucugugcaaca

SEQ ID NO: 1972992 - RNA, 15 nt, Homo sapiens
uauucuuuuuugccc

SEQ ID NO: 1972993 - RNA, 13 nt, Homo sapiens
gaacagcugugag

SEQ ID NO: 1972994 - RNA, 20 nt, Homo sapiens
uuuuacccugaggucacugc

SEQ ID NO: 1972995 - RNA, 21 nt, Homo sapiens
aaacccuuuuuauggcucaca

SEQ ID NO: 1972996 - RNA, 22 nt, Homo sapiens
gagugauuuuggccacacuguc

SEQ ID NO: 1972997 - RNA, 16 nt, Homo sapiens
ugauggccaggccaga

SEQ ID NO: 1972998 - RNA, 18 nt, Homo sapiens
uagcuuuaagcacccuag

SEQ ID NO: 1972999 - RNA, 20 nt, Homo sapiens
cuccccacgacaaccccacu

SEQ ID NO: 1973000 - RNA, 17 nt, Homo sapiens
cacccaaggauucuguu

SEQ ID NO: 1973001 - RNA, 18 nt, Homo sapiens
cauaaaucuuuuuacuuu

SEQ ID NO: 1973002 - RNA, 17 nt, Homo sapiens
uuucuggaccuugagca

SEQ ID NO: 1973003 - RNA, 18 nt, Homo sapiens
aaagauaauuuauuucaa

SEQ ID NO: 1973004 - RNA, 13 nt, Homo sapiens
aaucugcucugaa

SEQ ID NO: 1973005 - RNA, 21 nt, Homo sapiens
cuuagagggaaucuagcccaa

SEQ ID NO: 1973006 - RNA, 22 nt, Homo sapiens
cucucauguuuucaacugccaa

SEQ ID NO: 1973007 - RNA, 13 nt, Homo sapiens
gcugcaugaaggu

SEQ ID NO: 1973008 - RNA, 19 nt, Homo sapiens
ugguauccugugacaugua

SEQ ID NO: 1973009 - RNA, 10 nt, Homo sapiens
aaugagucag

SEQ ID NO: 1973010 - RNA, 22 nt, Homo sapiens
uucuacaacugauugcaacaga

SEQ ID NO: 1973011 - RNA, 16 nt, Homo sapiens
aacuucuuccugugaa

SEQ ID NO: 1973012 - RNA, 14 nt, Homo sapiens
cagagaccucauca

SEQ ID NO: 1973013 - RNA, 22 nt, Homo sapiens
agcaguuacaaaaaccuucccc

SEQ ID NO: 1973014 - RNA, 14 nt, Homo sapiens
acugaaaguuuaac

SEQ ID NO: 1973015 - RNA, 20 nt, Homo sapiens
gacucuaccagacuguguau

SEQ ID NO: 1973016 - RNA, 12 nt, Homo sapiens
cacaccaaucag

SEQ ID NO: 1973017 - RNA, 15 nt, Homo sapiens
aucuucuuccaagaa

SEQ ID NO: 1973018 - RNA, 16 nt, Homo sapiens
aaguuauugauguuuu

SEQ ID NO: 1973019 - RNA, 18 nt, Homo sapiens
uugccccugguaugcauu

SEQ ID NO: 1973020 - RNA, 17 nt, Homo sapiens
guggcucugcccuggaa

SEQ ID NO: 1973021 - RNA, 15 nt, Homo sapiens
ccagccuggcccacc

SEQ ID NO: 1973022 - RNA, 23 nt, Homo sapiens
cucccuuuuuacacuuuauggua

SEQ ID NO: 1973023 - RNA, 21 nt, Homo sapiens
ccucaguuuccugaccuauga

SEQ ID NO: 1973024 - RNA, 19 nt, Homo sapiens
guacauguggaaaacucac

SEQ ID NO: 1973025 - RNA, 13 nt, Homo sapiens
gaagcaggaccua

SEQ ID NO: 1973026 - RNA, 14 nt, Homo sapiens
ccgcaugugaucuc

SEQ ID NO: 1973027 - RNA, 19 nt, Homo sapiens
gaggggagugugugcagcg

SEQ ID NO: 1973028 - RNA, 14 nt, Homo sapiens
guaacuugcugcuu

SEQ ID NO: 1973029 - RNA, 16 nt, Homo sapiens
cuccuccccucuccua

SEQ ID NO: 1973030 - RNA, 17 nt, Homo sapiens
ugguucauauaugcaaa

SEQ ID NO: 1973031 - RNA, 22 nt, Homo sapiens
cucagaguugagaccuuugauu

SEQ ID NO: 1973032 - RNA, 16 nt, Homo sapiens
uaacauggaaguacua

SEQ ID NO: 1973033 - RNA, 14 nt, Homo sapiens
gcacagauggccag

SEQ ID NO: 1973034 - RNA, 21 nt, Homo sapiens
aauauuucuguugucaauaaa

SEQ ID NO: 1973035 - RNA, 17 nt, Homo sapiens
ccagaaccucagcauuu

SEQ ID NO: 1973036 - RNA, 15 nt, Homo sapiens
acgauacuccaacca

SEQ ID NO: 1973037 - RNA, 21 nt, Homo sapiens
auaugaaaaucuccaucucaa

SEQ ID NO: 1973038 - RNA, 20 nt, Homo sapiens
gugccuucucacaucugucc

SEQ ID NO: 1973039 - RNA, 17 nt, Homo sapiens
uaggauugaacuucaau

SEQ ID NO: 1973040 - RNA, 15 nt, Homo sapiens
uaauacaugauugca

SEQ ID NO: 1973041 - RNA, 17 nt, Homo sapiens
agacaagagaucuacac

SEQ ID NO: 1973042 - RNA, 16 nt, Homo sapiens
aagccaggauuguguu

SEQ ID NO: 1973043 - RNA, 14 nt, Homo sapiens
ugaaaaaguauugu

SEQ ID NO: 1973044 - RNA, 17 nt, Homo sapiens
guagaagguaacucuuu

SEQ ID NO: 1973045 - RNA, 17 nt, Homo sapiens
ccucagggaccaaggag

SEQ ID NO: 1973046 - RNA, 19 nt, Homo sapiens
gaguucugacuaaagguua

SEQ ID NO: 1973047 - RNA, 13 nt, Homo sapiens
uccacaacucaag

SEQ ID NO: 1973048 - RNA, 12 nt, Homo sapiens
ccagcucuagua

SEQ ID NO: 1973049 - RNA, 17 nt, Homo sapiens
uccauccugcucaggaa

SEQ ID NO: 1973050 - RNA, 18 nt, Homo sapiens
auguagcugaaugugaua

SEQ ID NO: 1973051 - RNA, 16 nt, Homo sapiens
gauuucuuaguucaua

SEQ ID NO: 1973052 - RNA, 16 nt, Homo sapiens
gggacagucaccucau

SEQ ID NO: 1973053 - RNA, 19 nt, Homo sapiens
uugaaaugcagauugcuac

SEQ ID NO: 1973054 - RNA, 14 nt, Homo sapiens
aaguuugaaaggaa

SEQ ID NO: 1973055 - RNA, 18 nt, Homo sapiens
auucauucucucugaaca

SEQ ID NO: 1973056 - RNA, 23 nt, Homo sapiens
cuucauacuggcaggagggugag

SEQ ID NO: 1973057 - RNA, 16 nt, Homo sapiens
aauucuugaaguucau

SEQ ID NO: 1973058 - RNA, 16 nt, Homo sapiens
aggucuugaguuucau

SEQ ID NO: 1973059 - RNA, 23 nt, Homo sapiens
acagaucuuuacucuugagaaau

SEQ ID NO: 1973060 - RNA, 13 nt, Homo sapiens
ggcacacacugug

SEQ ID NO: 1973061 - RNA, 19 nt, Homo sapiens
gccccagaaccccaacucc

SEQ ID NO: 1973062 - RNA, 23 nt, Homo sapiens
acuuucaggggcugacucuccag

SEQ ID NO: 1973063 - RNA, 12 nt, Homo sapiens
aagaacuaugaa

SEQ ID NO: 1973064 - RNA, 14 nt, Homo sapiens
ucaaaccacaugga

SEQ ID NO: 1973065 - RNA, 23 nt, Homo sapiens
gagacagcacagccaaccuagcu

SEQ ID NO: 1973066 - RNA, 20 nt, Homo sapiens
cccauuugcacagguuuuca

SEQ ID NO: 1973067 - RNA, 14 nt, Homo sapiens
ucagaacacuccaa

SEQ ID NO: 1973068 - RNA, 22 nt, Homo sapiens
ccuccuauggguugucaccaag

SEQ ID NO: 1973069 - RNA, 17 nt, Homo sapiens
ugccuucucaccagcug

SEQ ID NO: 1973070 - RNA, 15 nt, Homo sapiens
uauaacaguuauauu

SEQ ID NO: 1973071 - RNA, 21 nt, Homo sapiens
cucuccggggccauuugcaau

SEQ ID NO: 1973072 - RNA, 14 nt, Homo sapiens
uguaaguacccuga

SEQ ID NO: 1973073 - RNA, 21 nt, Homo sapiens
gccaggcuaucuggccugaga

SEQ ID NO: 1973074 - RNA, 18 nt, Homo sapiens
aauucuuuaaaauuacaa

SEQ ID NO: 1973075 - RNA, 20 nt, Homo sapiens
acuugauucauaaagauuca

SEQ ID NO: 1973076 - RNA, 16 nt, Homo sapiens
aaucccagacugacag

SEQ ID NO: 1973077 - RNA, 22 nt, Homo sapiens
gcaagggcugugcugaggucac

SEQ ID NO: 1973078 - RNA, 21 nt, Homo sapiens
cccagggacugcaaguggcca

SEQ ID NO: 1973079 - RNA, 19 nt, Homo sapiens
aauacucugcuauuucucu

SEQ ID NO: 1973080 - RNA, 19 nt, Homo sapiens
auacuuaguucauggcuuu

SEQ ID NO: 1973081 - RNA, 18 nt, Homo sapiens
ccuuuuccaugacugugg

SEQ ID NO: 1973082 - RNA, 22 nt, Homo sapiens
ucagauugauagggaguuuuaa

SEQ ID NO: 1973083 - RNA, 15 nt, Homo sapiens
uucaauuaaaaccau

SEQ ID NO: 1973084 - RNA, 19 nt, Homo sapiens
uucuuuugaacauccccac

SEQ ID NO: 1973085 - RNA, 23 nt, Homo sapiens
augcauccaaauaggagucuucu

SEQ ID NO: 1973086 - RNA, 16 nt, Homo sapiens
uaaaaaucaaguuauu

SEQ ID NO: 1973087 - RNA, 14 nt, Homo sapiens
gggaguguguaauu

SEQ ID NO: 1973088 - RNA, 22 nt, Homo sapiens
uucuacacaguaaaaacuugua

SEQ ID NO: 1973089 - RNA, 21 nt, Homo sapiens
agaucuaaggaugucacaggg

SEQ ID NO: 1973090 - RNA, 23 nt, Homo sapiens
cuccuggaccugaaggcaucuga

SEQ ID NO: 1973091 - RNA, 14 nt, Homo sapiens
agaaugucauuugc

SEQ ID NO: 1973092 - RNA, 20 nt, Homo sapiens
acagaacagaauaauaugaa

SEQ ID NO: 1973093 - RNA, 19 nt, Homo sapiens
uguaaacuguacuagucug

SEQ ID NO: 1973094 - RNA, 16 nt, Homo sapiens
ccugaccagacugugg

SEQ ID NO: 1973095 - RNA, 18 nt, Homo sapiens
cuaaaauacucaccaaaa

SEQ ID NO: 1973096 - RNA, 23 nt, Homo sapiens
cuaauuauaaaauuaacaugaua

SEQ ID NO: 1973097 - RNA, 19 nt, Homo sapiens
aauacauuguacuuauaca

SEQ ID NO: 1973098 - RNA, 17 nt, Homo sapiens
cugcagaagaugugaug

SEQ ID NO: 1973099 - RNA, 16 nt, Homo sapiens
aauuauaugaccauau

SEQ ID NO: 1973100 - RNA, 21 nt, Homo sapiens
acaugaaucaagcaauccagc

SEQ ID NO: 1973101 - RNA, 21 nt, Homo sapiens
uaucacugguccaccuccuga

SEQ ID NO: 1973102 - RNA, 18 nt, Homo sapiens
uuucagacugugcaauac

SEQ ID NO: 1973103 - RNA, 16 nt, Homo sapiens
ggcuccacuucaucca

SEQ ID NO: 1973104 - RNA, 12 nt, Homo sapiens
cuuccagugcag

SEQ ID NO: 1973105 - RNA, 14 nt, Homo sapiens
caaggugugauggu

SEQ ID NO: 1973106 - RNA, 13 nt, Homo sapiens
aaucaaacugcaa

SEQ ID NO: 1973107 - RNA, 22 nt, Homo sapiens
agcaagcucuuuuauaugcuaa

SEQ ID NO: 1973108 - RNA, 15 nt, Homo sapiens
cuccuaaaacaugaa

SEQ ID NO: 1973109 - RNA, 16 nt, Homo sapiens
ugcucccaguccugcc

SEQ ID NO: 1973110 - RNA, 13 nt, Homo sapiens
cccgacugaccac

SEQ ID NO: 1973111 - RNA, 19 nt, Homo sapiens
gcccaaccuagaccuguag

SEQ ID NO: 1973112 - RNA, 14 nt, Homo sapiens
uauacgcacgcacc

SEQ ID NO: 1973113 - RNA, 20 nt, Homo sapiens
acuuucucuaggaaucaaag

SEQ ID NO: 1973114 - RNA, 16 nt, Homo sapiens
caaucugcaaaaugga

SEQ ID NO: 1973115 - RNA, 15 nt, Homo sapiens
cauguuuuguauaca

SEQ ID NO: 1973116 - RNA, 14 nt, Homo sapiens
uucaauacagugaa

SEQ ID NO: 1973117 - RNA, 23 nt, Homo sapiens
ugcagcuucggggcaagugagac

SEQ ID NO: 1973118 - RNA, 15 nt, Homo sapiens
cuuaagaugcaaauc

SEQ ID NO: 1973119 - RNA, 15 nt, Homo sapiens
ugguuaguagacacu

SEQ ID NO: 1973120 - RNA, 23 nt, Homo sapiens
gugccucagucaauaaauuugca

SEQ ID NO: 1973121 - RNA, 20 nt, Homo sapiens
ucuuagaacagauggcugug

SEQ ID NO: 1973122 - RNA, 21 nt, Homo sapiens
aggcagccagauccccagggc

SEQ ID NO: 1973123 - RNA, 21 nt, Homo sapiens
cugagacaggaggauugccug

SEQ ID NO: 1973124 - RNA, 16 nt, Homo sapiens
uaagcaguugcaauga

SEQ ID NO: 1973125 - RNA, 13 nt, Homo sapiens
caaagauuucuca

SEQ ID NO: 1973126 - RNA, 14 nt, Homo sapiens
auucugcagccaca

SEQ ID NO: 1973127 - RNA, 19 nt, Homo sapiens
aaugcuuuucuaaugccuu

SEQ ID NO: 1973128 - RNA, 21 nt, Homo sapiens
uggcccuccacccccaccuca

SEQ ID NO: 1973129 - RNA, 17 nt, Homo sapiens
ccagagaaaaagggagg

SEQ ID NO: 1973130 - RNA, 13 nt, Homo sapiens
caaagcuugugaa

SEQ ID NO: 1973131 - RNA, 17 nt, Homo sapiens
ggagggacacuuaccca

SEQ ID NO: 1973132 - RNA, 14 nt, Homo sapiens
aagacaaucacugc

SEQ ID NO: 1973133 - RNA, 18 nt, Homo sapiens
uaauuuauuuuaauguaa

SEQ ID NO: 1973134 - RNA, 20 nt, Homo sapiens
gggacaggaugaccuggaua

SEQ ID NO: 1973135 - RNA, 17 nt, Homo sapiens
ucaacuuuccucaaauc

SEQ ID NO: 1973136 - RNA, 21 nt, Homo sapiens
agccugagcagagacaugacu

SEQ ID NO: 1973137 - RNA, 20 nt, Homo sapiens
uggcaaagaacucauuugaa

SEQ ID NO: 1973138 - RNA, 19 nt, Homo sapiens
cacacuugaccuucugucg

SEQ ID NO: 1973139 - RNA, 14 nt, Homo sapiens
auuacaucuuucac

SEQ ID NO: 1973140 - RNA, 19 nt, Homo sapiens
uuuucuugccuugguuguc

SEQ ID NO: 1973141 - RNA, 18 nt, Homo sapiens
ggacgguuucuagccucu

SEQ ID NO: 1973142 - RNA, 22 nt, Homo sapiens
caggaugcuggcugguggaaca

SEQ ID NO: 1973143 - RNA, 20 nt, Homo sapiens
gcgguucauacgcaucccau

SEQ ID NO: 1973144 - RNA, 19 nt, Homo sapiens
ugaguuaugaguuauucau

SEQ ID NO: 1973145 - RNA, 14 nt, Homo sapiens
aaccaacugccuua

SEQ ID NO: 1973146 - RNA, 19 nt, Homo sapiens
agaauaaaagaugauuucu

SEQ ID NO: 1973147 - RNA, 18 nt, Homo sapiens
acagcucuucuccaggcu

SEQ ID NO: 1973148 - RNA, 15 nt, Homo sapiens
caccagggacugcag

SEQ ID NO: 1973149 - RNA, 23 nt, Homo sapiens
gagccuccaugccuggcccaggu

SEQ ID NO: 1973150 - RNA, 13 nt, Homo sapiens
gcaggugcaguuu

SEQ ID NO: 1973151 - RNA, 17 nt, Homo sapiens
gugugaacguguaugua

SEQ ID NO: 1973152 - RNA, 19 nt, Homo sapiens
guugcaugccuauguacuc

SEQ ID NO: 1973153 - RNA, 12 nt, Homo sapiens
uugauacuguug

SEQ ID NO: 1973154 - RNA, 15 nt, Homo sapiens
ggagagagugcuauu

SEQ ID NO: 1973155 - RNA, 18 nt, Homo sapiens
ucuacagacuccaaaagg

SEQ ID NO: 1973156 - RNA, 17 nt, Homo sapiens
aucaaguccaucugaca

SEQ ID NO: 1973157 - RNA, 17 nt, Homo sapiens
cuccuuuguucuguauu

SEQ ID NO: 1973158 - RNA, 23 nt, Homo sapiens
cuggaggguaacuggggggccac

SEQ ID NO: 1973159 - RNA, 17 nt, Homo sapiens
gaggcucuguauuugcu

SEQ ID NO: 1973160 - RNA, 18 nt, Homo sapiens
ggugcagaccuuggggga

SEQ ID NO: 1973161 - RNA, 19 nt, Homo sapiens
aaucuucucuuugacaauu

SEQ ID NO: 1973162 - RNA, 18 nt, Homo sapiens
uuccucagaaaccaaagc

SEQ ID NO: 1973163 - RNA, 17 nt, Homo sapiens
aacacguggagauggaa

SEQ ID NO: 1973164 - RNA, 16 nt, Homo sapiens
guucucagaaccauuu

SEQ ID NO: 1973165 - RNA, 23 nt, Homo sapiens
uugccaagaccuuucaaagccau

SEQ ID NO: 1973166 - RNA, 12 nt, Homo sapiens
accaccuuucag

SEQ ID NO: 1973167 - RNA, 11 nt, Homo sapiens
aguaucuguaa

SEQ ID NO: 1973168 - RNA, 20 nt, Homo sapiens
ccucaguuuucagucaaguu

SEQ ID NO: 1973169 - RNA, 22 nt, Homo sapiens
cauuucuggacccuccacuuca

SEQ ID NO: 1973170 - RNA, 19 nt, Homo sapiens
gagcugcaguuuccucauc

SEQ ID NO: 1973171 - RNA, 17 nt, Homo sapiens
cguuuggaacaaucuaa

SEQ ID NO: 1973172 - RNA, 18 nt, Homo sapiens
gaccuuggaucagaugaa

SEQ ID NO: 1973173 - RNA, 16 nt, Homo sapiens
aagauaaauuggcuaa

SEQ ID NO: 1973174 - RNA, 16 nt, Homo sapiens
uucagggaaggaacuc

SEQ ID NO: 1973175 - RNA, 11 nt, Homo sapiens
ccacacauauu

SEQ ID NO: 1973176 - RNA, 20 nt, Homo sapiens
agauugacuauuuauacaaa

SEQ ID NO: 1973177 - RNA, 23 nt, Homo sapiens
acuauucuauaaacauaugcaaa

SEQ ID NO: 1973178 - RNA, 17 nt, Homo sapiens
ugcauuuuuaaagacag

SEQ ID NO: 1973179 - RNA, 17 nt, Homo sapiens
caaacagaacuauggaa

SEQ ID NO: 1973180 - RNA, 14 nt, Homo sapiens
cgccgucagggugg

SEQ ID NO: 1973181 - RNA, 21 nt, Homo sapiens
uaaaauuuuccuuuaugauuc

SEQ ID NO: 1973182 - RNA, 17 nt, Homo sapiens
uggcuaacugaugaauu

SEQ ID NO: 1973183 - RNA, 16 nt, Homo sapiens
gccuccugccaaggcc

SEQ ID NO: 1973184 - RNA, 21 nt, Homo sapiens
cacccacacagaggaccucuu

SEQ ID NO: 1973185 - RNA, 16 nt, Homo sapiens
aaucaccagagaccaa

SEQ ID NO: 1973186 - RNA, 14 nt, Homo sapiens
gucccauuccucag

SEQ ID NO: 1973187 - RNA, 17 nt, Homo sapiens
cucaaaacuguacuguc

SEQ ID NO: 1973188 - RNA, 15 nt, Homo sapiens
acaauguuugauacu

SEQ ID NO: 1973189 - RNA, 15 nt, Homo sapiens
caggacggaauauag

SEQ ID NO: 1973190 - RNA, 13 nt, Homo sapiens
gacagaacugucc

SEQ ID NO: 1973191 - RNA, 17 nt, Homo sapiens
caguggccugaucucug

SEQ ID NO: 1973192 - RNA, 18 nt, Homo sapiens
uaacgccagcacacuauu

SEQ ID NO: 1973193 - RNA, 18 nt, Homo sapiens
ugaaucaaacaaaaggaa

SEQ ID NO: 1973194 - RNA, 19 nt, Homo sapiens
cuccaggcagcagacacau

SEQ ID NO: 1973195 - RNA, 18 nt, Homo sapiens
ugagcuucaaggugauca

SEQ ID NO: 1973196 - RNA, 19 nt, Homo sapiens
ugguauaggaauguagaag

SEQ ID NO: 1973197 - RNA, 13 nt, Homo sapiens
uggggccauugcu

SEQ ID NO: 1973198 - RNA, 18 nt, Homo sapiens
gauccacccaaauaucaa

SEQ ID NO: 1973199 - RNA, 22 nt, Homo sapiens
ugagguccuucuguagugccau

SEQ ID NO: 1973200 - RNA, 15 nt, Homo sapiens
cuccgccuccugggu

SEQ ID NO: 1973201 - RNA, 13 nt, Homo sapiens
uccauagugcacu

SEQ ID NO: 1973202 - RNA, 13 nt, Homo sapiens
aggaaggacuuga

SEQ ID NO: 1973203 - RNA, 22 nt, Homo sapiens
uuagaugcacuaccauugcugu

SEQ ID NO: 1973204 - RNA, 19 nt, Homo sapiens
uaaugugguguuacuguag

SEQ ID NO: 1973205 - RNA, 22 nt, Homo sapiens
aaagaagggaucccuaacuguu

SEQ ID NO: 1973206 - RNA, 15 nt, Homo sapiens
aacaugaccaaaaac

SEQ ID NO: 1973207 - RNA, 19 nt, Homo sapiens
agcacugacagauuuccau

SEQ ID NO: 1973208 - RNA, 17 nt, Homo sapiens
aaaaugugucuguaaga

SEQ ID NO: 1973209 - RNA, 21 nt, Homo sapiens
caguaagccauugagugcagc

SEQ ID NO: 1973210 - RNA, 19 nt, Homo sapiens
uuaagcuccuucaguuuga

SEQ ID NO: 1973211 - RNA, 23 nt, Homo sapiens
agccaaggaggugaggagcagag

SEQ ID NO: 1973212 - RNA, 20 nt, Homo sapiens
ucaguugugaagaggggcca

SEQ ID NO: 1973213 - RNA, 19 nt, Homo sapiens
acuccucucccacagagug

SEQ ID NO: 1973214 - RNA, 23 nt, Homo sapiens
aaucccacccccacuucaugccc

SEQ ID NO: 1973215 - RNA, 20 nt, Homo sapiens
augcaguuaaacucauuguc

SEQ ID NO: 1973216 - RNA, 21 nt, Homo sapiens
agcugcaagacaucugcuuca

SEQ ID NO: 1973217 - RNA, 16 nt, Homo sapiens
agaaaauuggauguuu

SEQ ID NO: 1973218 - RNA, 22 nt, Homo sapiens
uccugucuuggaaggacuacua

SEQ ID NO: 1973219 - RNA, 11 nt, Homo sapiens
cuggugcacag

SEQ ID NO: 1973220 - RNA, 19 nt, Homo sapiens
cucucauauaagacaaaua

SEQ ID NO: 1973221 - RNA, 14 nt, Homo sapiens
uuuccucucucucc

SEQ ID NO: 1973222 - RNA, 14 nt, Homo sapiens
agugaaugccauuu

SEQ ID NO: 1973223 - RNA, 18 nt, Homo sapiens
cugccccaccccaccuca

SEQ ID NO: 1973224 - RNA, 19 nt, Homo sapiens
uagaacuuuaccuauggaa

SEQ ID NO: 1973225 - RNA, 21 nt, Homo sapiens
caaacuccugggcucaaguga

SEQ ID NO: 1973226 - RNA, 18 nt, Homo sapiens
auauuuaugucuauuuaa

SEQ ID NO: 1973227 - RNA, 15 nt, Homo sapiens
caacuggaaagucaa

SEQ ID NO: 1973228 - RNA, 22 nt, Homo sapiens
aguuucuucuuuaggcauuaaa

SEQ ID NO: 1973229 - RNA, 16 nt, Homo sapiens
ggcuggagcugccucu

SEQ ID NO: 1973230 - RNA, 23 nt, Homo sapiens
cagauaacagugugcucauagaa

SEQ ID NO: 1973231 - RNA, 24 nt, Homo sapiens
ugagacacacaauucauuggcucc

SEQ ID NO: 1973232 - RNA, 13 nt, Homo sapiens
aaaucguccuccc

SEQ ID NO: 1973233 - RNA, 15 nt, Homo sapiens
uaaucuucauggcca

SEQ ID NO: 1973234 - RNA, 21 nt, Homo sapiens
cauuuuccuuaggaaaaacau

SEQ ID NO: 1973235 - RNA, 21 nt, Homo sapiens
ugaagaaguuauaccuuccuc

SEQ ID NO: 1973236 - RNA, 19 nt, Homo sapiens
gugcuccagucauugcaca

SEQ ID NO: 1973237 - RNA, 20 nt, Homo sapiens
uuuaaugaauuuaaggcaaa

SEQ ID NO: 1973238 - RNA, 17 nt, Homo sapiens
gucguuuuagugucuga

SEQ ID NO: 1973239 - RNA, 18 nt, Homo sapiens
acucccacuucuucagcu

SEQ ID NO: 1973240 - RNA, 16 nt, Homo sapiens
cuaauaauagcauuca

SEQ ID NO: 1973241 - RNA, 20 nt, Homo sapiens
agaucuuuaaacugcuuuau

SEQ ID NO: 1973242 - RNA, 11 nt, Homo sapiens
ugcugccuuaa

SEQ ID NO: 1973243 - RNA, 12 nt, Homo sapiens
ucauauuccugc

SEQ ID NO: 1973244 - RNA, 19 nt, Homo sapiens
ccuacaucaaaugcucaag

SEQ ID NO: 1973245 - RNA, 15 nt, Homo sapiens
acaggggaucaaagu

SEQ ID NO: 1973246 - RNA, 10 nt, Homo sapiens
aaacuugaau

SEQ ID NO: 1973247 - RNA, 14 nt, Homo sapiens
uguuuacuuuaugu

SEQ ID NO: 1973248 - RNA, 15 nt, Homo sapiens
cucagcugguccuga

SEQ ID NO: 1973249 - RNA, 17 nt, Homo sapiens
uuucuggccugccuucg

SEQ ID NO: 1973250 - RNA, 15 nt, Homo sapiens
uugcaacacauucau

SEQ ID NO: 1973251 - RNA, 20 nt, Homo sapiens
gaagcagccuccuaauuuga

SEQ ID NO: 1973252 - RNA, 20 nt, Homo sapiens
cuuugcagugagugcugcuc

SEQ ID NO: 1973253 - RNA, 22 nt, Homo sapiens
ccauguggguguggcaguuaca

SEQ ID NO: 1973254 - RNA, 21 nt, Homo sapiens
gcacacagcuaggcaugccug

SEQ ID NO: 1973255 - RNA, 16 nt, Homo sapiens
caaguacuuugucuug

SEQ ID NO: 1973256 - RNA, 13 nt, Homo sapiens
ucuccauucagga

SEQ ID NO: 1973257 - RNA, 17 nt, Homo sapiens
ucauuuucacagcacua

SEQ ID NO: 1973258 - RNA, 16 nt, Homo sapiens
ugaggcggguggauca

SEQ ID NO: 1973259 - RNA, 19 nt, Homo sapiens
aucacucauucuaugaaca

SEQ ID NO: 1973260 - RNA, 18 nt, Homo sapiens
acaauaaagauacaugau

SEQ ID NO: 1973261 - RNA, 14 nt, Homo sapiens
ugccccuugacaac

SEQ ID NO: 1973262 - RNA, 18 nt, Homo sapiens
agcuaaaaugauuuuauc

SEQ ID NO: 1973263 - RNA, 18 nt, Homo sapiens
uuggcauucuuugcaaua

SEQ ID NO: 1973264 - RNA, 16 nt, Homo sapiens
gcuggagauguuuuag

SEQ ID NO: 1973265 - RNA, 19 nt, Homo sapiens
caugcucuuagaaaauuca

SEQ ID NO: 1973266 - RNA, 19 nt, Homo sapiens
acgcaaccaccaccaacca

SEQ ID NO: 1973267 - RNA, 20 nt, Homo sapiens
ugggagacuggaaaagggaa

SEQ ID NO: 1973268 - RNA, 22 nt, Homo sapiens
ucuccaaggguggugaccaaug

SEQ ID NO: 1973269 - RNA, 19 nt, Homo sapiens
cuggugacucaugccuuuu

SEQ ID NO: 1973270 - RNA, 19 nt, Homo sapiens
cccuuuuuuccuaugcaac

SEQ ID NO: 1973271 - RNA, 16 nt, Homo sapiens
agccuaggaccacuca

SEQ ID NO: 1973272 - RNA, 15 nt, Homo sapiens
acacucaucccuggu

SEQ ID NO: 1973273 - RNA, 14 nt, Homo sapiens
ugcuggcugugaaa

SEQ ID NO: 1973274 - RNA, 22 nt, Homo sapiens
agccuugggggggcugccuuug

SEQ ID NO: 1973275 - RNA, 22 nt, Homo sapiens
cuuccgugugucaucaggguug

SEQ ID NO: 1973276 - RNA, 15 nt, Homo sapiens
aaacuaucaagagag

SEQ ID NO: 1973277 - RNA, 13 nt, Homo sapiens
ucaggaaaccaca

SEQ ID NO: 1973278 - RNA, 15 nt, Homo sapiens
gguagacacaggaua

SEQ ID NO: 1973279 - RNA, 18 nt, Homo sapiens
ccacauucaccaaccaaa

SEQ ID NO: 1973280 - RNA, 13 nt, Homo sapiens
ugauauucaccua

SEQ ID NO: 1973281 - RNA, 14 nt, Homo sapiens
aaagcuucaaaaac

SEQ ID NO: 1973282 - RNA, 14 nt, Homo sapiens
caauucugugauau

SEQ ID NO: 1973283 - RNA, 16 nt, Homo sapiens
aggaugacacugccag

SEQ ID NO: 1973284 - RNA, 16 nt, Homo sapiens
cugcccuucagcaucc

SEQ ID NO: 1973285 - RNA, 15 nt, Homo sapiens
ugcggcaguugccgc

SEQ ID NO: 1973286 - RNA, 17 nt, Homo sapiens
uacaaaaauuagcugug

SEQ ID NO: 1973287 - RNA, 12 nt, Homo sapiens
uugcuaccaaaa

SEQ ID NO: 1973288 - RNA, 18 nt, Homo sapiens
acccugcaagaccacgga

SEQ ID NO: 1973289 - RNA, 22 nt, Homo sapiens
aaccaaagaccaucugaggaau

SEQ ID NO: 1973290 - RNA, 16 nt, Homo sapiens
uagacucacucuucca

SEQ ID NO: 1973291 - RNA, 16 nt, Homo sapiens
aauaauacaacuauca

SEQ ID NO: 1973292 - RNA, 21 nt, Homo sapiens
agcuguaccggccacugcaac

SEQ ID NO: 1973293 - RNA, 15 nt, Homo sapiens
cuccuagagugcagg

SEQ ID NO: 1973294 - RNA, 16 nt, Homo sapiens
ugaaaacccagacugu

SEQ ID NO: 1973295 - RNA, 17 nt, Homo sapiens
accugcuuggucuuuca

SEQ ID NO: 1973296 - RNA, 22 nt, Homo sapiens
uccucagccucugcaacugcaa

SEQ ID NO: 1973297 - RNA, 20 nt, Homo sapiens
agaccuuguuucaaucuuug

SEQ ID NO: 1973298 - RNA, 22 nt, Homo sapiens
cuauccauaguggacauuguug

SEQ ID NO: 1973299 - RNA, 13 nt, Homo sapiens
agucuucuauuua

SEQ ID NO: 1973300 - RNA, 13 nt, Homo sapiens
uuuuuucuuguca

SEQ ID NO: 1973301 - RNA, 20 nt, Homo sapiens
uuucacagcccauaauucau

SEQ ID NO: 1973302 - RNA, 19 nt, Homo sapiens
gacaagcgccgcugugagg

SEQ ID NO: 1973303 - RNA, 13 nt, Homo sapiens
aguccagcuuucu

SEQ ID NO: 1973304 - RNA, 17 nt, Homo sapiens
gagaggacaguggauug

SEQ ID NO: 1973305 - RNA, 14 nt, Homo sapiens
uuaugaguuagcuu

SEQ ID NO: 1973306 - RNA, 20 nt, Homo sapiens
ggcucacgcguucugggagc

SEQ ID NO: 1973307 - RNA, 16 nt, Homo sapiens
gaaaauuauauauacc

SEQ ID NO: 1973308 - RNA, 15 nt, Homo sapiens
uauaacaacaaugaa

SEQ ID NO: 1973309 - RNA, 18 nt, Homo sapiens
cuuuucauaucucuugcc

SEQ ID NO: 1973310 - RNA, 17 nt, Homo sapiens
cuucucacccgcuucuc

SEQ ID NO: 1973311 - RNA, 20 nt, Homo sapiens
aauuccacagucucugggag

SEQ ID NO: 1973312 - RNA, 19 nt, Homo sapiens
gaaucuuugucagcaguuc

SEQ ID NO: 1973313 - RNA, 15 nt, Homo sapiens
gccgucacccuggga

SEQ ID NO: 1973314 - RNA, 13 nt, Homo sapiens
acucugggcacaa

SEQ ID NO: 1973315 - RNA, 20 nt, Homo sapiens
cuggaagaaagcaacaaaga

SEQ ID NO: 1973316 - RNA, 14 nt, Homo sapiens
gcagagccagugug

SEQ ID NO: 1973317 - RNA, 16 nt, Homo sapiens
uaaagcaaacaugcaa

SEQ ID NO: 1973318 - RNA, 21 nt, Homo sapiens
caacuuaaugugcugcugcuu

SEQ ID NO: 1973319 - RNA, 16 nt, Homo sapiens
uauuauuuuuuccaca

SEQ ID NO: 1973320 - RNA, 19 nt, Homo sapiens
gguggaaggcagacagcag

SEQ ID NO: 1973321 - RNA, 23 nt, Homo sapiens
gacuccagaaucugcuguugcca

SEQ ID NO: 1973322 - RNA, 18 nt, Homo sapiens
aauaaaauucaacaaaca

SEQ ID NO: 1973323 - RNA, 17 nt, Homo sapiens
cauuucaucuacuacag

SEQ ID NO: 1973324 - RNA, 21 nt, Homo sapiens
uucuagccuauuuaccugcag

SEQ ID NO: 1973325 - RNA, 20 nt, Homo sapiens
uuauacacaacuuugcaaau

SEQ ID NO: 1973326 - RNA, 22 nt, Homo sapiens
gaucuugugacccuccaugcca

SEQ ID NO: 1973327 - RNA, 15 nt, Homo sapiens
acggcccaugcaauu

SEQ ID NO: 1973328 - RNA, 12 nt, Homo sapiens
ucuuugcacuuu

SEQ ID NO: 1973329 - RNA, 17 nt, Homo sapiens
cccuugccugugccagg

SEQ ID NO: 1973330 - RNA, 22 nt, Homo sapiens
ccuagcuuagagccucccucaa

SEQ ID NO: 1973331 - RNA, 22 nt, Homo sapiens
cuguuacugcuugggcuauacc

SEQ ID NO: 1973332 - RNA, 22 nt, Homo sapiens
gcuucuuauaguaacacuaaaa

SEQ ID NO: 1973333 - RNA, 13 nt, Homo sapiens
aguaaguacgugu

SEQ ID NO: 1973334 - RNA, 23 nt, Homo sapiens
acacagacacacaaaaugucaca

SEQ ID NO: 1973335 - RNA, 15 nt, Homo sapiens
ugagccugaaaaccu

SEQ ID NO: 1973336 - RNA, 16 nt, Homo sapiens
cuuggaaucaugcaaa

SEQ ID NO: 1973337 - RNA, 17 nt, Homo sapiens
uaugcaacucaucuuca

SEQ ID NO: 1973338 - RNA, 17 nt, Homo sapiens
ggcaaaugccugacuca

SEQ ID NO: 1973339 - RNA, 21 nt, Homo sapiens
cauaauuuauacaggucauau

SEQ ID NO: 1973340 - RNA, 14 nt, Homo sapiens
caugaggccaugca

SEQ ID NO: 1973341 - RNA, 23 nt, Homo sapiens
ggacaaagaauuccaaagcaaaa

SEQ ID NO: 1973342 - RNA, 22 nt, Homo sapiens
uguuugucucaccuacccauga

SEQ ID NO: 1973343 - RNA, 14 nt, Homo sapiens
ggguugaaagacau

SEQ ID NO: 1973344 - RNA, 19 nt, Homo sapiens
acugccuuacagacagaau

SEQ ID NO: 1973345 - RNA, 13 nt, Homo sapiens
uuuggcaacagaa

SEQ ID NO: 1973346 - RNA, 16 nt, Homo sapiens
ucuauuuuuguaugaa

SEQ ID NO: 1973347 - RNA, 16 nt, Homo sapiens
aaagcccagaucucug

SEQ ID NO: 1973348 - RNA, 14 nt, Homo sapiens
gaaaauauuuaaag

SEQ ID NO: 1973349 - RNA, 23 nt, Homo sapiens
uagauugauucacccuacccaca

SEQ ID NO: 1973350 - RNA, 12 nt, Homo sapiens
guuuugccagug

SEQ ID NO: 1973351 - RNA, 14 nt, Homo sapiens
auuuggggaccaaa

SEQ ID NO: 1973352 - RNA, 16 nt, Homo sapiens
gucacuguccagguag

SEQ ID NO: 1973353 - RNA, 22 nt, Homo sapiens
cccuaguuaguguuuugccuca

SEQ ID NO: 1973354 - RNA, 15 nt, Homo sapiens
ggccuauauauuuaa

SEQ ID NO: 1973355 - RNA, 19 nt, Homo sapiens
cccguugauaacucagugg

SEQ ID NO: 1973356 - RNA, 16 nt, Homo sapiens
ugucccaacccagaca

SEQ ID NO: 1973357 - RNA, 13 nt, Homo sapiens
caccuuccaguga

SEQ ID NO: 1973358 - RNA, 14 nt, Homo sapiens
ucaaaugaauuugc

SEQ ID NO: 1973359 - RNA, 16 nt, Homo sapiens
gagcccaucugcacag

SEQ ID NO: 1973360 - RNA, 13 nt, Homo sapiens
auuccauguuuca

SEQ ID NO: 1973361 - RNA, 21 nt, Homo sapiens
gcaaaaauagcucuugcuuug

SEQ ID NO: 1973362 - RNA, 15 nt, Homo sapiens
acaaggacaacuuua

SEQ ID NO: 1973363 - RNA, 16 nt, Homo sapiens
gcuuccgacaccucug

SEQ ID NO: 1973364 - RNA, 19 nt, Homo sapiens
aggaaagugaaaguugaau

SEQ ID NO: 1973365 - RNA, 23 nt, Homo sapiens
uagcagaggccggcccuggccau

SEQ ID NO: 1973366 - RNA, 18 nt, Homo sapiens
aacauuaaaacucauaau

SEQ ID NO: 1973367 - RNA, 15 nt, Homo sapiens
cuguguuguguccug

SEQ ID NO: 1973368 - RNA, 20 nt, Homo sapiens
uccacggaaaaugcuaucca

SEQ ID NO: 1973369 - RNA, 16 nt, Homo sapiens
gcuaguucuaauuuca

SEQ ID NO: 1973370 - RNA, 17 nt, Homo sapiens
ugggaauguccuuggca

SEQ ID NO: 1973371 - RNA, 15 nt, Homo sapiens
cagacgggaaugccu

SEQ ID NO: 1973372 - RNA, 21 nt, Homo sapiens
cauuuagaacuuuaagucuca

SEQ ID NO: 1973373 - RNA, 15 nt, Homo sapiens
gucuggggaccagcu

SEQ ID NO: 1973374 - RNA, 16 nt, Homo sapiens
uccuacuuauugccau

SEQ ID NO: 1973375 - RNA, 19 nt, Homo sapiens
ccagaugcccuguugguuu

SEQ ID NO: 1973376 - RNA, 21 nt, Homo sapiens
uacauuaaaauaaaccaaaua

SEQ ID NO: 1973377 - RNA, 24 nt, Homo sapiens
ucgaaaccugugauuucugugcca

SEQ ID NO: 1973378 - RNA, 21 nt, Homo sapiens
caugaacucuugaagucacac

SEQ ID NO: 1973379 - RNA, 16 nt, Homo sapiens
uggccaccugccaggc

SEQ ID NO: 1973380 - RNA, 15 nt, Homo sapiens
gagcagaugaugcca

SEQ ID NO: 1973381 - RNA, 17 nt, Homo sapiens
cuagccagaggcucuaa

SEQ ID NO: 1973382 - RNA, 14 nt, Homo sapiens
ucaaaaaguuccau

SEQ ID NO: 1973383 - RNA, 22 nt, Homo sapiens
acccucugggucucaguguccu

SEQ ID NO: 1973384 - RNA, 17 nt, Homo sapiens
agccuggguuaaguauu

SEQ ID NO: 1973385 - RNA, 9 nt, Homo sapiens
guguuaaau

SEQ ID NO: 1973386 - RNA, 14 nt, Homo sapiens
caaaaacaucacuc

SEQ ID NO: 1973387 - RNA, 15 nt, Homo sapiens
aagaugggagccuuu

SEQ ID NO: 1973388 - RNA, 22 nt, Homo sapiens
aauauaaucagacagguuuaaa

SEQ ID NO: 1973389 - RNA, 13 nt, Homo sapiens
ggcacccaagacc

SEQ ID NO: 1973390 - RNA, 13 nt, Homo sapiens
gacaaccaaaaca

SEQ ID NO: 1973391 - RNA, 14 nt, Homo sapiens
uuacuagauucaua

SEQ ID NO: 1973392 - RNA, 16 nt, Homo sapiens
ugccagacauggaccu

SEQ ID NO: 1973393 - RNA, 17 nt, Homo sapiens
gucccucugcagucucu

SEQ ID NO: 1973394 - RNA, 20 nt, Homo sapiens
accucuggauaauuuugcau

SEQ ID NO: 1973395 - RNA, 18 nt, Homo sapiens
uaacuggacauucugggg

SEQ ID NO: 1973396 - RNA, 16 nt, Homo sapiens
acaugcagcucugcag

SEQ ID NO: 1973397 - RNA, 15 nt, Homo sapiens
acaugaaaguuuugc

SEQ ID NO: 1973398 - RNA, 13 nt, Homo sapiens
caaacgcugaaaa

SEQ ID NO: 1973399 - RNA, 16 nt, Homo sapiens
aagggaaauugcagcc

SEQ ID NO: 1973400 - RNA, 13 nt, Homo sapiens
agcgucaguauuu

SEQ ID NO: 1973401 - RNA, 21 nt, Homo sapiens
aagaaggacaaggauguucac

SEQ ID NO: 1973402 - RNA, 20 nt, Homo sapiens
agguaggcuucuaccugcag

SEQ ID NO: 1973403 - RNA, 17 nt, Homo sapiens
uaaugaaaccugugucu

SEQ ID NO: 1973404 - RNA, 17 nt, Homo sapiens
caaauaauuuguauacc

SEQ ID NO: 1973405 - RNA, 18 nt, Homo sapiens
gaauauaacuuuuuccaa

SEQ ID NO: 1973406 - RNA, 15 nt, Homo sapiens
cuuccucagccagcc

SEQ ID NO: 1973407 - RNA, 24 nt, Homo sapiens
uagggauuuuuggcuacacacaaa

SEQ ID NO: 1973408 - RNA, 16 nt, Homo sapiens
uaaccaguuuagcuuu

SEQ ID NO: 1973409 - RNA, 23 nt, Homo sapiens
accaggagugagcccuucucugu

SEQ ID NO: 1973410 - RNA, 13 nt, Homo sapiens
cugggaugcugcg

SEQ ID NO: 1973411 - RNA, 21 nt, Homo sapiens
ccuaaauuaacaaauucagug

SEQ ID NO: 1973412 - RNA, 15 nt, Homo sapiens
aaucuauagaacuga

SEQ ID NO: 1973413 - RNA, 20 nt, Homo sapiens
gagagcggcggagacaagcc

SEQ ID NO: 1973414 - RNA, 14 nt, Homo sapiens
auuguuacaguacu

SEQ ID NO: 1973415 - RNA, 18 nt, Homo sapiens
agcauguugcaucucugc

SEQ ID NO: 1973416 - RNA, 19 nt, Homo sapiens
uuaguuuagguguuuggga

SEQ ID NO: 1973417 - RNA, 21 nt, Homo sapiens
cucagaguguggguccuucaa

SEQ ID NO: 1973418 - RNA, 20 nt, Homo sapiens
uggaccauuccugucccuuu

SEQ ID NO: 1973419 - RNA, 16 nt, Homo sapiens
uaauuuucaguucuau

SEQ ID NO: 1973420 - RNA, 17 nt, Homo sapiens
cuuaucuuacaaagugu

SEQ ID NO: 1973421 - RNA, 12 nt, Homo sapiens
gacuccucauca

SEQ ID NO: 1973422 - RNA, 14 nt, Homo sapiens
acaaaaacaacuua

SEQ ID NO: 1973423 - RNA, 13 nt, Homo sapiens
ucuagugaucucg

SEQ ID NO: 1973424 - RNA, 17 nt, Homo sapiens
cuuagcccaucuuucaa

SEQ ID NO: 1973425 - RNA, 17 nt, Homo sapiens
aaaccuggagaugauga

SEQ ID NO: 1973426 - RNA, 20 nt, Homo sapiens
uuaaauuaguucagccauug

SEQ ID NO: 1973427 - RNA, 14 nt, Homo sapiens
gcauuugugucugc

SEQ ID NO: 1973428 - RNA, 13 nt, Homo sapiens
uauuaaccugaau

SEQ ID NO: 1973429 - RNA, 14 nt, Homo sapiens
gaagccgugccugu

SEQ ID NO: 1973430 - RNA, 19 nt, Homo sapiens
cuucuguugcugguguacu

SEQ ID NO: 1973431 - RNA, 18 nt, Homo sapiens
aaggagaggcaacaucca

SEQ ID NO: 1973432 - RNA, 15 nt, Homo sapiens
acggcuuuucuugag

SEQ ID NO: 1973433 - RNA, 16 nt, Homo sapiens
ggcagaaaaaugucau

SEQ ID NO: 1973434 - RNA, 17 nt, Homo sapiens
agcauuaauacauuuca

SEQ ID NO: 1973435 - RNA, 17 nt, Homo sapiens
ucaaauuuguaaaguua

SEQ ID NO: 1973436 - RNA, 15 nt, Homo sapiens
uauaacagcaaauaa

SEQ ID NO: 1973437 - RNA, 20 nt, Homo sapiens
auugcagaaauacaguauga

SEQ ID NO: 1973438 - RNA, 22 nt, Homo sapiens
uuguauccguucaauaagcauu

SEQ ID NO: 1973439 - RNA, 14 nt, Homo sapiens
aacugcuccagcuc

SEQ ID NO: 1973440 - RNA, 22 nt, Homo sapiens
uggcuuuaugcaaauacaauca

SEQ ID NO: 1973441 - RNA, 20 nt, Homo sapiens
agauaguacauaaagguggu

SEQ ID NO: 1973442 - RNA, 19 nt, Homo sapiens
acucaucaauggggccagu

SEQ ID NO: 1973443 - RNA, 11 nt, Homo sapiens
uuguugacaaa

SEQ ID NO: 1973444 - RNA, 20 nt, Homo sapiens
cccgaaaacccccagcauua

SEQ ID NO: 1973445 - RNA, 15 nt, Homo sapiens
cccaucaagugcagu

SEQ ID NO: 1973446 - RNA, 17 nt, Homo sapiens
guuauaccccauauauu

SEQ ID NO: 1973447 - RNA, 21 nt, Homo sapiens
aaauugucuuaauggaugaaa

SEQ ID NO: 1973448 - RNA, 21 nt, Homo sapiens
auuuuguguauaaugugcuuu

SEQ ID NO: 1973449 - RNA, 18 nt, Homo sapiens
guguccugccuugaugaa

SEQ ID NO: 1973450 - RNA, 22 nt, Homo sapiens
acguggacuccagacucucugu

SEQ ID NO: 1973451 - RNA, 15 nt, Homo sapiens
caugcacagucauac

SEQ ID NO: 1973452 - RNA, 20 nt, Homo sapiens
agaauauguaacagccaaac

SEQ ID NO: 1973453 - RNA, 22 nt, Homo sapiens
uguuacaggaagucccuugcca

SEQ ID NO: 1973454 - RNA, 16 nt, Homo sapiens
ucuccauaggacagga

SEQ ID NO: 1973455 - RNA, 18 nt, Homo sapiens
cauuuguucucacaccaa

SEQ ID NO: 1973456 - RNA, 18 nt, Homo sapiens
augccuggaagcuuuguc

SEQ ID NO: 1973457 - RNA, 23 nt, Homo sapiens
ucacuugaggccaggacuuugag

SEQ ID NO: 1973458 - RNA, 13 nt, Homo sapiens
gaaguacuucccu

SEQ ID NO: 1973459 - RNA, 22 nt, Homo sapiens
uguagaugaaaaagcauguaca

SEQ ID NO: 1973460 - RNA, 18 nt, Homo sapiens
acuccaagcuucaaguga

SEQ ID NO: 1973461 - RNA, 23 nt, Homo sapiens
acucagcaacuguuagcugggaa

SEQ ID NO: 1973462 - RNA, 23 nt, Homo sapiens
ucaagauucuacuuggugguuug

SEQ ID NO: 1973463 - RNA, 19 nt, Homo sapiens
guuucaccguguuagccag

SEQ ID NO: 1973464 - RNA, 22 nt, Homo sapiens
aacucaugacugagucuggcaa

SEQ ID NO: 1973465 - RNA, 19 nt, Homo sapiens
cucaaagaugcguuugccu

SEQ ID NO: 1973466 - RNA, 20 nt, Homo sapiens
aaaaagucuacauacuuuca

SEQ ID NO: 1973467 - RNA, 19 nt, Homo sapiens
gcuccucgagggcagggac

SEQ ID NO: 1973468 - RNA, 14 nt, Homo sapiens
ggcuuuaacauccu

SEQ ID NO: 1973469 - RNA, 18 nt, Homo sapiens
acugcauuucacucuggg

SEQ ID NO: 1973470 - RNA, 12 nt, Homo sapiens
cugugcaaguca

SEQ ID NO: 1973471 - RNA, 18 nt, Homo sapiens
gaaugcacaguacuguuu

SEQ ID NO: 1973472 - RNA, 21 nt, Homo sapiens
uccuauaaagugccucggaca

SEQ ID NO: 1973473 - RNA, 23 nt, Homo sapiens
acuaaggggcagcuccugaccaa

SEQ ID NO: 1973474 - RNA, 18 nt, Homo sapiens
aggugauucucagggcug

SEQ ID NO: 1973475 - RNA, 22 nt, Homo sapiens
gcacaauauuccuaugcugcaa

SEQ ID NO: 1973476 - RNA, 17 nt, Homo sapiens
uugggaggccaaggugg

SEQ ID NO: 1973477 - RNA, 21 nt, Homo sapiens
auuucuacuaaaaauacaaaa

SEQ ID NO: 1973478 - RNA, 15 nt, Homo sapiens
gacaccuaacucuuc

SEQ ID NO: 1973479 - RNA, 13 nt, Homo sapiens
gacugccaaaaag

SEQ ID NO: 1973480 - RNA, 18 nt, Homo sapiens
cuucccugggcugugcua

SEQ ID NO: 1973481 - RNA, 15 nt, Homo sapiens
agugaaaacuuugua

SEQ ID NO: 1973482 - RNA, 21 nt, Homo sapiens
accauggaguggcagcccagc

SEQ ID NO: 1973483 - RNA, 23 nt, Homo sapiens
auguacaucuguuuguagccaca

SEQ ID NO: 1973484 - RNA, 14 nt, Homo sapiens
gccuagagcacucu

SEQ ID NO: 1973485 - RNA, 16 nt, Homo sapiens
gggccagggcccugca

SEQ ID NO: 1973486 - RNA, 20 nt, Homo sapiens
uuuuggaaucauacugccua

SEQ ID NO: 1973487 - RNA, 14 nt, Homo sapiens
auuuaucacuuuuu

SEQ ID NO: 1973488 - RNA, 18 nt, Homo sapiens
acaaguagcacacugagu

SEQ ID NO: 1973489 - RNA, 23 nt, Homo sapiens
uucccaagcccuggugaccagac

SEQ ID NO: 1973490 - RNA, 22 nt, Homo sapiens
aagguuuugguugcauuauuau

SEQ ID NO: 1973491 - RNA, 17 nt, Homo sapiens
acaagugagacaaaaag

SEQ ID NO: 1973492 - RNA, 20 nt, Homo sapiens
auuuccuuuauacugugaag

SEQ ID NO: 1973493 - RNA, 15 nt, Homo sapiens
cuccugggagcucau

SEQ ID NO: 1973494 - RNA, 14 nt, Homo sapiens
ccauuuaaucauuu

SEQ ID NO: 1973495 - RNA, 14 nt, Homo sapiens
ucacugaaccacug

SEQ ID NO: 1973496 - RNA, 14 nt, Homo sapiens
uaaacaaacaaaca

SEQ ID NO: 1973497 - RNA, 18 nt, Homo sapiens
aggcucaacugaggaugu

SEQ ID NO: 1973498 - RNA, 19 nt, Homo sapiens
caagggagacugaccauca

SEQ ID NO: 1973499 - RNA, 16 nt, Homo sapiens
guaucaggacugugac

SEQ ID NO: 1973500 - RNA, 22 nt, Homo sapiens
gauucauaaaguaaugaugaaa

SEQ ID NO: 1973501 - RNA, 23 nt, Homo sapiens
cuagccugcauaucauucaccca

SEQ ID NO: 1973502 - RNA, 16 nt, Homo sapiens
aaggaaaucuccucuu

SEQ ID NO: 1973503 - RNA, 18 nt, Homo sapiens
uuccauccuagugagaag

SEQ ID NO: 1973504 - RNA, 15 nt, Homo sapiens
gacaaacagugcacu

SEQ ID NO: 1973505 - RNA, 21 nt, Homo sapiens
gcccagaucguucugccacuu

SEQ ID NO: 1973506 - RNA, 18 nt, Homo sapiens
uguugaaucaaacaaaag

SEQ ID NO: 1973507 - RNA, 23 nt, Homo sapiens
ggcacugagaccuccacccacug

SEQ ID NO: 1973508 - RNA, 21 nt, Homo sapiens
cauuuuacacuuucucaauga

SEQ ID NO: 1973509 - RNA, 16 nt, Homo sapiens
gcccauagcacugggc

SEQ ID NO: 1973510 - RNA, 16 nt, Homo sapiens
cguucaaaacauucca

SEQ ID NO: 1973511 - RNA, 15 nt, Homo sapiens
aaugcuuaccuguga

SEQ ID NO: 1973512 - RNA, 16 nt, Homo sapiens
agaaaagaaauuaguu

SEQ ID NO: 1973513 - RNA, 18 nt, Homo sapiens
uaaaauguagaaauucua

SEQ ID NO: 1973514 - RNA, 20 nt, Homo sapiens
ucacuugcuggcugugaaac

SEQ ID NO: 1973515 - RNA, 12 nt, Homo sapiens
cacgagaucaag

SEQ ID NO: 1973516 - RNA, 14 nt, Homo sapiens
gauaugcaguaugc

SEQ ID NO: 1973517 - RNA, 18 nt, Homo sapiens
agcauugugaucaaagac

SEQ ID NO: 1973518 - RNA, 13 nt, Homo sapiens
guguggacugugc

SEQ ID NO: 1973519 - RNA, 17 nt, Homo sapiens
cugaaacuucaucacac

SEQ ID NO: 1973520 - RNA, 17 nt, Homo sapiens
aacugaaaacaagccau

SEQ ID NO: 1973521 - RNA, 14 nt, Homo sapiens
cuaaaagauugaga

SEQ ID NO: 1973522 - RNA, 19 nt, Homo sapiens
cccaauccauccugcucag

SEQ ID NO: 1973523 - RNA, 22 nt, Homo sapiens
gguuucagaaaauaaaugguuu

SEQ ID NO: 1973524 - RNA, 17 nt, Homo sapiens
aauagaagcuucuugcu

SEQ ID NO: 1973525 - RNA, 13 nt, Homo sapiens
gacagacagccac

SEQ ID NO: 1973526 - RNA, 19 nt, Homo sapiens
caauuucagcuucauauca

SEQ ID NO: 1973527 - RNA, 15 nt, Homo sapiens
aucaggccccacccc

SEQ ID NO: 1973528 - RNA, 20 nt, Homo sapiens
caaguggauauuuucuuaaa

SEQ ID NO: 1973529 - RNA, 18 nt, Homo sapiens
cucagucucugagcagug

SEQ ID NO: 1973530 - RNA, 16 nt, Homo sapiens
aagagcugcacagcaa

SEQ ID NO: 1973531 - RNA, 16 nt, Homo sapiens
aagauuaacacauuug

SEQ ID NO: 1973532 - RNA, 17 nt, Homo sapiens
ugaaacgucauguguuu

SEQ ID NO: 1973533 - RNA, 22 nt, Homo sapiens
agcacuacugggugucauuuca

SEQ ID NO: 1973534 - RNA, 20 nt, Homo sapiens
caccugcgcuucugcuggag

SEQ ID NO: 1973535 - RNA, 13 nt, Homo sapiens
gagacagaagcag

SEQ ID NO: 1973536 - RNA, 15 nt, Homo sapiens
cuccuuggccacaga

SEQ ID NO: 1973537 - RNA, 12 nt, Homo sapiens
gauucucuccua

SEQ ID NO: 1973538 - RNA, 16 nt, Homo sapiens
cugcuguuacuguuaa

SEQ ID NO: 1973539 - RNA, 17 nt, Homo sapiens
aagaaaugcccaaaaga

SEQ ID NO: 1973540 - RNA, 18 nt, Homo sapiens
aggaaauaucauaaugua

SEQ ID NO: 1973541 - RNA, 22 nt, Homo sapiens
cauauuaauugguuugugccuu

SEQ ID NO: 1973542 - RNA, 19 nt, Homo sapiens
agugugauauacaaagugu

SEQ ID NO: 1973543 - RNA, 18 nt, Homo sapiens
cacauccauucccaagaa

SEQ ID NO: 1973544 - RNA, 14 nt, Homo sapiens
uauauuaugucuua

SEQ ID NO: 1973545 - RNA, 14 nt, Homo sapiens
gcucuuucacagcu

SEQ ID NO: 1973546 - RNA, 14 nt, Homo sapiens
cugggcagaaggcc

SEQ ID NO: 1973547 - RNA, 13 nt, Homo sapiens
ggaaacucuccau

SEQ ID NO: 1973548 - RNA, 19 nt, Homo sapiens
caguaacccaaaccucaag

SEQ ID NO: 1973549 - RNA, 14 nt, Homo sapiens
cauuguaaucaaaa

SEQ ID NO: 1973550 - RNA, 16 nt, Homo sapiens
acaauaaacaugucaa

SEQ ID NO: 1973551 - RNA, 13 nt, Homo sapiens
gcacuccuggaca

SEQ ID NO: 1973552 - RNA, 16 nt, Homo sapiens
ccacgugcaguaucuc

SEQ ID NO: 1973553 - RNA, 16 nt, Homo sapiens
ccugaggagggcccug

SEQ ID NO: 1973554 - RNA, 22 nt, Homo sapiens
ccuggccagacaagaagacugu

SEQ ID NO: 1973555 - RNA, 18 nt, Homo sapiens
caggucccgagcccucac

SEQ ID NO: 1973556 - RNA, 21 nt, Homo sapiens
aacauucuauuucaacuucag

SEQ ID NO: 1973557 - RNA, 15 nt, Homo sapiens
agcacaaagcccaua

SEQ ID NO: 1973558 - RNA, 16 nt, Homo sapiens
auuacaaaaaaacacg

SEQ ID NO: 1973559 - RNA, 12 nt, Homo sapiens
ggugggaacuca

SEQ ID NO: 1973560 - RNA, 15 nt, Homo sapiens
ccugagaaggggcag

SEQ ID NO: 1973561 - RNA, 18 nt, Homo sapiens
guugaacuuugccaaaaa

SEQ ID NO: 1973562 - RNA, 21 nt, Homo sapiens
gaaugguuguacguuuugcac

SEQ ID NO: 1973563 - RNA, 13 nt, Homo sapiens
agaucaagccauc

SEQ ID NO: 1973564 - RNA, 20 nt, Homo sapiens
guuucagaauuuuguauauu

SEQ ID NO: 1973565 - RNA, 19 nt, Homo sapiens
gcauuuggugagagucaaa

SEQ ID NO: 1973566 - RNA, 16 nt, Homo sapiens
gcagccuuucacagga

SEQ ID NO: 1973567 - RNA, 18 nt, Homo sapiens
uugcuuccgccacucagc

SEQ ID NO: 1973568 - RNA, 17 nt, Homo sapiens
ucucauaaugcuuuguu

SEQ ID NO: 1973569 - RNA, 22 nt, Homo sapiens
cugagagacccaaggaggaaaa

SEQ ID NO: 1973570 - RNA, 17 nt, Homo sapiens
acuagggcuagucuucc

SEQ ID NO: 1973571 - RNA, 17 nt, Homo sapiens
aaauauuguauuugaga

SEQ ID NO: 1973572 - RNA, 20 nt, Homo sapiens
accucacuguccaauaugaa

SEQ ID NO: 1973573 - RNA, 22 nt, Homo sapiens
uuuagcauaguaccucugcuau

SEQ ID NO: 1973574 - RNA, 14 nt, Homo sapiens
caggagaccuucca

SEQ ID NO: 1973575 - RNA, 15 nt, Homo sapiens
ccagguucucauuag

SEQ ID NO: 1973576 - RNA, 18 nt, Homo sapiens
uuucuauuuuaaagagga

SEQ ID NO: 1973577 - RNA, 15 nt, Homo sapiens
gcagagagacaacag

SEQ ID NO: 1973578 - RNA, 19 nt, Homo sapiens
gccagggugggcagacaga

SEQ ID NO: 1973579 - RNA, 15 nt, Homo sapiens
ucaguguuugggaaa

SEQ ID NO: 1973580 - RNA, 13 nt, Homo sapiens
cuuaaaagccauc

SEQ ID NO: 1973581 - RNA, 18 nt, Homo sapiens
cugagcuggaucacuuga

SEQ ID NO: 1973582 - RNA, 22 nt, Homo sapiens
gaauaguucaggagacuuuaca

SEQ ID NO: 1973583 - RNA, 15 nt, Homo sapiens
caaaucaguuuuucu

SEQ ID NO: 1973584 - RNA, 17 nt, Homo sapiens
agcugccaggcugaaaa

SEQ ID NO: 1973585 - RNA, 16 nt, Homo sapiens
acaaaauggucaucca

SEQ ID NO: 1973586 - RNA, 23 nt, Homo sapiens
gcgcucuaauuccuauaaauacg

SEQ ID NO: 1973587 - RNA, 14 nt, Homo sapiens
ccaugaccuugacg

SEQ ID NO: 1973588 - RNA, 19 nt, Homo sapiens
ucagucuucacuugcacug

SEQ ID NO: 1973589 - RNA, 21 nt, Homo sapiens
cauaucgcugacuucauggaa

SEQ ID NO: 1973590 - RNA, 20 nt, Homo sapiens
aauauuugcuaaacauuugc

SEQ ID NO: 1973591 - RNA, 16 nt, Homo sapiens
uuguaauagccaaaaa

SEQ ID NO: 1973592 - RNA, 20 nt, Homo sapiens
aagagcaaaacuccgucuca

SEQ ID NO: 1973593 - RNA, 20 nt, Homo sapiens
aagaguaaaacucugucuca

SEQ ID NO: 1973594 - RNA, 20 nt, Homo sapiens
aagagcgaaacuccaucuca

SEQ ID NO: 1973595 - RNA, 21 nt, Homo sapiens
cuucaaauuuagcaaccuaga

SEQ ID NO: 1973596 - RNA, 15 nt, Homo sapiens
ccaggcuggagauaa

SEQ ID NO: 1973597 - RNA, 15 nt, Homo sapiens
gcuaugcuauggaau

SEQ ID NO: 1973598 - RNA, 20 nt, Homo sapiens
aauaaagcaaauauauuuag

SEQ ID NO: 1973599 - RNA, 15 nt, Homo sapiens
gggugggaaggggag

SEQ ID NO: 1973600 - RNA, 15 nt, Homo sapiens
gaaaaggcuugaguc

SEQ ID NO: 1973601 - RNA, 12 nt, Homo sapiens
uacauucuucaa

SEQ ID NO: 1973602 - RNA, 15 nt, Homo sapiens
gaaggccccagagag

SEQ ID NO: 1973603 - RNA, 17 nt, Homo sapiens
gauuuuuuccucugcau

SEQ ID NO: 1973604 - RNA, 20 nt, Homo sapiens
uucuaauaaauauacuauga

SEQ ID NO: 1973605 - RNA, 18 nt, Homo sapiens
cucuauuuagaugcauau

SEQ ID NO: 1973606 - RNA, 14 nt, Homo sapiens
cccaagacucccau

SEQ ID NO: 1973607 - RNA, 16 nt, Homo sapiens
gaacuggauucuuaac

SEQ ID NO: 1973608 - RNA, 18 nt, Homo sapiens
aucugcaguggagccuga

SEQ ID NO: 1973609 - RNA, 17 nt, Homo sapiens
uaucaguagaaacucua

SEQ ID NO: 1973610 - RNA, 17 nt, Homo sapiens
ucuggugccagauccuc

SEQ ID NO: 1973611 - RNA, 14 nt, Homo sapiens
guguaauaugcaca

SEQ ID NO: 1973612 - RNA, 20 nt, Homo sapiens
aggauguguuuucagucuuu

SEQ ID NO: 1973613 - RNA, 18 nt, Homo sapiens
acgccuguaaucccagca

SEQ ID NO: 1973614 - RNA, 17 nt, Homo sapiens
cugcucacgucugugag

SEQ ID NO: 1973615 - RNA, 16 nt, Homo sapiens
auugcacagagcacac

SEQ ID NO: 1973616 - RNA, 17 nt, Homo sapiens
ugggguccccacucccu

SEQ ID NO: 1973617 - RNA, 14 nt, Homo sapiens
cuuugggacugugu

SEQ ID NO: 1973618 - RNA, 14 nt, Homo sapiens
caguuugacauuug

SEQ ID NO: 1973619 - RNA, 22 nt, Homo sapiens
cagucgucccagcagcaccuca

SEQ ID NO: 1973620 - RNA, 13 nt, Homo sapiens
ccaguuucagggc

SEQ ID NO: 1973621 - RNA, 17 nt, Homo sapiens
gccuuguugauguggac

SEQ ID NO: 1973622 - RNA, 23 nt, Homo sapiens
cauacccuuacucugccagagua

SEQ ID NO: 1973623 - RNA, 13 nt, Homo sapiens
auucuugacuuau

SEQ ID NO: 1973624 - RNA, 20 nt, Homo sapiens
uaugacuaauauaacuugaa

SEQ ID NO: 1973625 - RNA, 22 nt, Homo sapiens
caacacugcugcuccagugcag

SEQ ID NO: 1973626 - RNA, 23 nt, Homo sapiens
caugggagggggcuugaagccaa

SEQ ID NO: 1973627 - RNA, 18 nt, Homo sapiens
aauucuuauggcugcuga

SEQ ID NO: 1973628 - RNA, 19 nt, Homo sapiens
aauuaggagaggcagagau

SEQ ID NO: 1973629 - RNA, 16 nt, Homo sapiens
cugggaauggggacac

SEQ ID NO: 1973630 - RNA, 18 nt, Homo sapiens
cugccuccccaacccugc

SEQ ID NO: 1973631 - RNA, 15 nt, Homo sapiens
uugccuugaaauuua

SEQ ID NO: 1973632 - RNA, 22 nt, Homo sapiens
uggaacccuggugucuccucca

SEQ ID NO: 1973633 - RNA, 15 nt, Homo sapiens
ugaacacacacacac

SEQ ID NO: 1973634 - RNA, 15 nt, Homo sapiens
uuuauuuugaaaugg

SEQ ID NO: 1973635 - RNA, 15 nt, Homo sapiens
ccugcucuaacaccu

SEQ ID NO: 1973636 - RNA, 15 nt, Homo sapiens
cucaugcauaugcau

SEQ ID NO: 1973637 - RNA, 16 nt, Homo sapiens
auguaccaaaacauug

SEQ ID NO: 1973638 - RNA, 20 nt, Homo sapiens
guuauuuucuuugaaauuca

SEQ ID NO: 1973639 - RNA, 19 nt, Homo sapiens
cuguguauguuuuauauca

SEQ ID NO: 1973640 - RNA, 17 nt, Homo sapiens
uuaaaggggguauguga

SEQ ID NO: 1973641 - RNA, 19 nt, Homo sapiens
aauacucccacuaugccug

SEQ ID NO: 1973642 - RNA, 20 nt, Homo sapiens
agaugcugguuuucuaccca

SEQ ID NO: 1973643 - RNA, 20 nt, Homo sapiens
cuggccggagucagugccag

SEQ ID NO: 1973644 - RNA, 13 nt, Homo sapiens
ugucucucaugaa

SEQ ID NO: 1973645 - RNA, 15 nt, Homo sapiens
ugugcuuugaaaaaa

SEQ ID NO: 1973646 - RNA, 13 nt, Homo sapiens
auauuauugauuc

SEQ ID NO: 1973647 - RNA, 23 nt, Homo sapiens
aaugcuuuucuaaucugcagugg

SEQ ID NO: 1973648 - RNA, 15 nt, Homo sapiens
ucgaaccacugagag

SEQ ID NO: 1973649 - RNA, 18 nt, Homo sapiens
ccuuugggagcucauucu

SEQ ID NO: 1973650 - RNA, 16 nt, Homo sapiens
cucagacugccaaaga

SEQ ID NO: 1973651 - RNA, 14 nt, Homo sapiens
aaggcauaaaugac

SEQ ID NO: 1973652 - RNA, 16 nt, Homo sapiens
aaguauucuccauccu

SEQ ID NO: 1973653 - RNA, 18 nt, Homo sapiens
acugaagugaacuaugaa

SEQ ID NO: 1973654 - RNA, 12 nt, Homo sapiens
cucaguccuccc

SEQ ID NO: 1973655 - RNA, 17 nt, Homo sapiens
gugcccuuugggguccc

SEQ ID NO: 1973656 - RNA, 17 nt, Homo sapiens
caugaaagcaccugccc

SEQ ID NO: 1973657 - RNA, 12 nt, Homo sapiens
ccauuuucaucc

SEQ ID NO: 1973658 - RNA, 21 nt, Homo sapiens
cgaaaugcuugcucaggcuca

SEQ ID NO: 1973659 - RNA, 23 nt, Homo sapiens
auugugugugugaagaugcucug

SEQ ID NO: 1973660 - RNA, 15 nt, Homo sapiens
cauuucaaaguuugg

SEQ ID NO: 1973661 - RNA, 20 nt, Homo sapiens
agccugcauugagcuugcau

SEQ ID NO: 1973662 - RNA, 12 nt, Homo sapiens
ucuuugcucagu

SEQ ID NO: 1973663 - RNA, 21 nt, Homo sapiens
aaucacaaaaaaacuguuauc

SEQ ID NO: 1973664 - RNA, 20 nt, Homo sapiens
uugagccugcaucuucuugc

SEQ ID NO: 1973665 - RNA, 23 nt, Homo sapiens
guaaccauaugcaguuuacuuug

SEQ ID NO: 1973666 - RNA, 18 nt, Homo sapiens
ggugguucaugccuguaa

SEQ ID NO: 1973667 - RNA, 18 nt, Homo sapiens
gacucuuuaugcuugcaa

SEQ ID NO: 1973668 - RNA, 20 nt, Homo sapiens
acugaauuuuuugucuguua

SEQ ID NO: 1973669 - RNA, 13 nt, Homo sapiens
ugucuuccacuuu

SEQ ID NO: 1973670 - RNA, 14 nt, Homo sapiens
cuggggcucugugc

SEQ ID NO: 1973671 - RNA, 18 nt, Homo sapiens
ucaauaacuauugcugcu

SEQ ID NO: 1973672 - RNA, 16 nt, Homo sapiens
gcauagaacuggguaa

SEQ ID NO: 1973673 - RNA, 21 nt, Homo sapiens
uccugaugaggagaaaggggc

SEQ ID NO: 1973674 - RNA, 12 nt, Homo sapiens
ucagaaaugcug

SEQ ID NO: 1973675 - RNA, 12 nt, Homo sapiens
uguaaaauggaa

SEQ ID NO: 1973676 - RNA, 17 nt, Homo sapiens
aagacuaucaaagacaa

SEQ ID NO: 1973677 - RNA, 15 nt, Homo sapiens
agaucuccugugcac

SEQ ID NO: 1973678 - RNA, 17 nt, Homo sapiens
ugugccaauacagacaa

SEQ ID NO: 1973679 - RNA, 15 nt, Homo sapiens
cguauuacaagagaa

SEQ ID NO: 1973680 - RNA, 16 nt, Homo sapiens
auuuuggaagaauuca

SEQ ID NO: 1973681 - RNA, 18 nt, Homo sapiens
auuugauaacaaguuuaa

SEQ ID NO: 1973682 - RNA, 14 nt, Homo sapiens
aguuacauugugcu

SEQ ID NO: 1973683 - RNA, 13 nt, Homo sapiens
ucaaacucuggug

SEQ ID NO: 1973684 - RNA, 15 nt, Homo sapiens
cccugagcaaugucu

SEQ ID NO: 1973685 - RNA, 21 nt, Homo sapiens
gcaccccaugugggugaccag

SEQ ID NO: 1973686 - RNA, 17 nt, Homo sapiens
acuugugcuuacaauau

SEQ ID NO: 1973687 - RNA, 21 nt, Homo sapiens
gucaagcaccugcaugugcug

SEQ ID NO: 1973688 - RNA, 14 nt, Homo sapiens
gaaauuuaaaugac

SEQ ID NO: 1973689 - RNA, 21 nt, Homo sapiens
ggguaugcucguuucucucaa

SEQ ID NO: 1973690 - RNA, 12 nt, Homo sapiens
acugcaaccucu

SEQ ID NO: 1973691 - RNA, 15 nt, Homo sapiens
cacuugacuuugcca

SEQ ID NO: 1973692 - RNA, 15 nt, Homo sapiens
caaaacaguuugaaa

SEQ ID NO: 1973693 - RNA, 13 nt, Homo sapiens
uacauguguuuga

SEQ ID NO: 1973694 - RNA, 13 nt, Homo sapiens
aaacccucuguca

SEQ ID NO: 1973695 - RNA, 14 nt, Homo sapiens
ccuuaacauuucuc

SEQ ID NO: 1973696 - RNA, 15 nt, Homo sapiens
caaaagcaaagugaa

SEQ ID NO: 1973697 - RNA, 18 nt, Homo sapiens
cuuccagauugacgacaa

SEQ ID NO: 1973698 - RNA, 18 nt, Homo sapiens
gaauuagcucacuuggug

SEQ ID NO: 1973699 - RNA, 17 nt, Homo sapiens
caguaacucaucuguca

SEQ ID NO: 1973700 - RNA, 15 nt, Homo sapiens
ugauuaaaacauuau

SEQ ID NO: 1973701 - RNA, 18 nt, Homo sapiens
ugaugacccuuuucauga

SEQ ID NO: 1973702 - RNA, 23 nt, Homo sapiens
gguccuugaugccagagggccag

SEQ ID NO: 1973703 - RNA, 16 nt, Homo sapiens
auuucuagcagaguga

SEQ ID NO: 1973704 - RNA, 15 nt, Homo sapiens
ucacuguguguuuua

SEQ ID NO: 1973705 - RNA, 19 nt, Homo sapiens
ucauaauaucaugugcacu

SEQ ID NO: 1973706 - RNA, 22 nt, Homo sapiens
uccaagcauaccaacacgagca

SEQ ID NO: 1973707 - RNA, 17 nt, Homo sapiens
acagcagagaagcugua

SEQ ID NO: 1973708 - RNA, 18 nt, Homo sapiens
cuaugccauuucuucucu

SEQ ID NO: 1973709 - RNA, 23 nt, Homo sapiens
gagcuggaaauaaaccuggagau

SEQ ID NO: 1973710 - RNA, 18 nt, Homo sapiens
gcccuuguccccaugaaa

SEQ ID NO: 1973711 - RNA, 13 nt, Homo sapiens
ucccuaaccacua

SEQ ID NO: 1973712 - RNA, 13 nt, Homo sapiens
cugcaacccauga

SEQ ID NO: 1973713 - RNA, 21 nt, Homo sapiens
aucacuugaauccuagggccu

SEQ ID NO: 1973714 - RNA, 16 nt, Homo sapiens
accagcucauguguac

SEQ ID NO: 1973715 - RNA, 15 nt, Homo sapiens
aaaaugcacugugac

SEQ ID NO: 1973716 - RNA, 16 nt, Homo sapiens
ugguucugccaucucu

SEQ ID NO: 1973717 - RNA, 22 nt, Homo sapiens
gaaccaagcggugccagccacg

SEQ ID NO: 1973718 - RNA, 21 nt, Homo sapiens
cuucuuacucauuacugcaaa

SEQ ID NO: 1973719 - RNA, 19 nt, Homo sapiens
ucugaccucaugaguguca

SEQ ID NO: 1973720 - RNA, 18 nt, Homo sapiens
acaaauguuacuucuaaa

SEQ ID NO: 1973721 - RNA, 21 nt, Homo sapiens
uauccccauucucugccugua

SEQ ID NO: 1973722 - RNA, 11 nt, Homo sapiens
ccuacugcugg

SEQ ID NO: 1973723 - RNA, 21 nt, Homo sapiens
gaguuauuuauuggcuggaga

SEQ ID NO: 1973724 - RNA, 19 nt, Homo sapiens
acauuggaaggcucccuaa

SEQ ID NO: 1973725 - RNA, 13 nt, Homo sapiens
aguccagugagaa

SEQ ID NO: 1973726 - RNA, 14 nt, Homo sapiens
accacaguuuaccu

SEQ ID NO: 1973727 - RNA, 22 nt, Homo sapiens
ggacuaaccccaacgcacagga

SEQ ID NO: 1973728 - RNA, 20 nt, Homo sapiens
ugguguuaaagcuguacacc

SEQ ID NO: 1973729 - RNA, 17 nt, Homo sapiens
agaucauccugaacuuc

SEQ ID NO: 1973730 - RNA, 15 nt, Homo sapiens
uuugcaugcaugcaa

SEQ ID NO: 1973731 - RNA, 18 nt, Homo sapiens
uaauaaccuuaaggagua

SEQ ID NO: 1973732 - RNA, 19 nt, Homo sapiens
aaagaacacgaauugcuca

SEQ ID NO: 1973733 - RNA, 13 nt, Homo sapiens
gcugcugcacugc

SEQ ID NO: 1973734 - RNA, 13 nt, Homo sapiens
gugugugcaugug

SEQ ID NO: 1973735 - RNA, 14 nt, Homo sapiens
guccugacaccugc

SEQ ID NO: 1973736 - RNA, 14 nt, Homo sapiens
uuuaucaaaggaga

SEQ ID NO: 1973737 - RNA, 16 nt, Homo sapiens
cuccacaacacugugu

SEQ ID NO: 1973738 - RNA, 13 nt, Homo sapiens
gcggcccucagug

SEQ ID NO: 1973739 - RNA, 22 nt, Homo sapiens
cuaaacugcugcaaaaguucuc

SEQ ID NO: 1973740 - RNA, 21 nt, Homo sapiens
agcgcgucaugacgugcauga

SEQ ID NO: 1973741 - RNA, 21 nt, Homo sapiens
ccauccauucagaaagcauuu

SEQ ID NO: 1973742 - RNA, 13 nt, Homo sapiens
cuagcuaucaaga

SEQ ID NO: 1973743 - RNA, 16 nt, Homo sapiens
ucuuauuuaacuuaac

SEQ ID NO: 1973744 - RNA, 16 nt, Homo sapiens
cauuuauugccucuau

SEQ ID NO: 1973745 - RNA, 12 nt, Homo sapiens
uaaacaugcauu

SEQ ID NO: 1973746 - RNA, 19 nt, Homo sapiens
ccuuugcucccuguugcug

SEQ ID NO: 1973747 - RNA, 16 nt, Homo sapiens
auuguugaugcucaca

SEQ ID NO: 1973748 - RNA, 14 nt, Homo sapiens
cggagaaacucauc

SEQ ID NO: 1973749 - RNA, 15 nt, Homo sapiens
auaucacagcauaac

SEQ ID NO: 1973750 - RNA, 21 nt, Homo sapiens
acgggaccauuuuuacaucca

SEQ ID NO: 1973751 - RNA, 15 nt, Homo sapiens
uaagggugucuuccu

SEQ ID NO: 1973752 - RNA, 20 nt, Homo sapiens
ggaggccagugccagcaccu

SEQ ID NO: 1973753 - RNA, 21 nt, Homo sapiens
gaaauccgaacaguuggggcu

SEQ ID NO: 1973754 - RNA, 19 nt, Homo sapiens
auggaauaaacuccauuua

SEQ ID NO: 1973755 - RNA, 22 nt, Homo sapiens
aucucaaugaaccauaaauuca

SEQ ID NO: 1973756 - RNA, 23 nt, Homo sapiens
uuugaugcccagacagcaaguau

SEQ ID NO: 1973757 - RNA, 21 nt, Homo sapiens
caccccuugcucucuguucuc

SEQ ID NO: 1973758 - RNA, 20 nt, Homo sapiens
ccccuccuccagccgcuggc

SEQ ID NO: 1973759 - RNA, 16 nt, Homo sapiens
ugcuccgugugucuca

SEQ ID NO: 1973760 - RNA, 23 nt, Homo sapiens
aucaacuugcuuaucaacuuccu

SEQ ID NO: 1973761 - RNA, 22 nt, Homo sapiens
cagagaagauaauguucuuuaa

SEQ ID NO: 1973762 - RNA, 14 nt, Homo sapiens
acagcauguguauu

SEQ ID NO: 1973763 - RNA, 22 nt, Homo sapiens
ugcuggcagaggcacucaggua

SEQ ID NO: 1973764 - RNA, 18 nt, Homo sapiens
agcugauugcacuaagcc

SEQ ID NO: 1973765 - RNA, 23 nt, Homo sapiens
caagagauucuucuagaucucau

SEQ ID NO: 1973766 - RNA, 19 nt, Homo sapiens
gaucauagguauuucaaaa

SEQ ID NO: 1973767 - RNA, 20 nt, Homo sapiens
uggguucacagaucuuucug

SEQ ID NO: 1973768 - RNA, 19 nt, Homo sapiens
uacuuuauacagcaaagga

SEQ ID NO: 1973769 - RNA, 22 nt, Homo sapiens
aaagugcuuuagucauauauga

SEQ ID NO: 1973770 - RNA, 14 nt, Homo sapiens
cuggagugcugcuu

SEQ ID NO: 1973771 - RNA, 16 nt, Homo sapiens
guguaugcgugcauug

SEQ ID NO: 1973772 - RNA, 22 nt, Homo sapiens
gcccccuccaggagagagccag

SEQ ID NO: 1973773 - RNA, 22 nt, Homo sapiens
uggaacaugcccacaacuuguc

SEQ ID NO: 1973774 - RNA, 17 nt, Homo sapiens
uauaacuaggcuguuaa

SEQ ID NO: 1973775 - RNA, 14 nt, Homo sapiens
cucaggaaggacau

SEQ ID NO: 1973776 - RNA, 23 nt, Homo sapiens
cuguguuucguguauaugccuca

SEQ ID NO: 1973777 - RNA, 17 nt, Homo sapiens
uaucagggcuaguuuaa

SEQ ID NO: 1973778 - RNA, 20 nt, Homo sapiens
uguaaauacauguacagaca

SEQ ID NO: 1973779 - RNA, 15 nt, Homo sapiens
cugaggaaggugcuu

SEQ ID NO: 1973780 - RNA, 15 nt, Homo sapiens
uuauuuagcucugaa

SEQ ID NO: 1973781 - RNA, 20 nt, Homo sapiens
ugaccugcugugcaccuuac

SEQ ID NO: 1973782 - RNA, 23 nt, Homo sapiens
uggggcagcacccuauaaaucaa

SEQ ID NO: 1973783 - RNA, 22 nt, Homo sapiens
agaaaaccucuccugaccccug

SEQ ID NO: 1973784 - RNA, 24 nt, Homo sapiens
gguucaagcgauucucuugccuca

SEQ ID NO: 1973785 - RNA, 22 nt, Homo sapiens
cauuuuuuaaauguucauguca

SEQ ID NO: 1973786 - RNA, 14 nt, Homo sapiens
cuuugcuguggcag

SEQ ID NO: 1973787 - RNA, 22 nt, Homo sapiens
cauugauugguaguucgaagaa

SEQ ID NO: 1973788 - RNA, 18 nt, Homo sapiens
uguuacagguuacgugag

SEQ ID NO: 1973789 - RNA, 15 nt, Homo sapiens
agccuuucuuaugga

SEQ ID NO: 1973790 - RNA, 22 nt, Homo sapiens
cuacaguggcugucacgcagcc

SEQ ID NO: 1973791 - RNA, 14 nt, Homo sapiens
acucuuauggccaa

SEQ ID NO: 1973792 - RNA, 15 nt, Homo sapiens
uccucucacuguugc

SEQ ID NO: 1973793 - RNA, 17 nt, Homo sapiens
gaggcuauuuuaauccu

SEQ ID NO: 1973794 - RNA, 19 nt, Homo sapiens
cuuuucauagugcucagau

SEQ ID NO: 1973795 - RNA, 17 nt, Homo sapiens
aagucucucuaagacaa

SEQ ID NO: 1973796 - RNA, 19 nt, Homo sapiens
cagaaucggcuuugcagug

SEQ ID NO: 1973797 - RNA, 14 nt, Homo sapiens
cccaaaucugccua

SEQ ID NO: 1973798 - RNA, 18 nt, Homo sapiens
augcaggugaugccauua

SEQ ID NO: 1973799 - RNA, 14 nt, Homo sapiens
ccagggcugcugua

SEQ ID NO: 1973800 - RNA, 13 nt, Homo sapiens
caccugagcauga

SEQ ID NO: 1973801 - RNA, 23 nt, Homo sapiens
caagcuuagaagccaccauguau

SEQ ID NO: 1973802 - RNA, 18 nt, Homo sapiens
cucacucugucacccagg

SEQ ID NO: 1973803 - RNA, 21 nt, Homo sapiens
uaucauuaggaaaacaucuua

SEQ ID NO: 1973804 - RNA, 19 nt, Homo sapiens
gcacauucuggcucaggga

SEQ ID NO: 1973805 - RNA, 19 nt, Homo sapiens
ugaaaccagaaaucuaauc

SEQ ID NO: 1973806 - RNA, 13 nt, Homo sapiens
aaugguuagcuua

SEQ ID NO: 1973807 - RNA, 22 nt, Homo sapiens
agagaagaccuugggccaagau

SEQ ID NO: 1973808 - RNA, 16 nt, Homo sapiens
gcuguggggcauagaa

SEQ ID NO: 1973809 - RNA, 13 nt, Homo sapiens
cauuccuuuuccc

SEQ ID NO: 1973810 - RNA, 23 nt, Homo sapiens
agguggacgggguugucgagauc

SEQ ID NO: 1973811 - RNA, 22 nt, Homo sapiens
gguggauuccugggcaagaacc

SEQ ID NO: 1973812 - RNA, 23 nt, Homo sapiens
ggaaccaaccaacaaacaaugcc

SEQ ID NO: 1973813 - RNA, 22 nt, Homo sapiens
cgacuaauuucaaaaugcuuuu

SEQ ID NO: 1973814 - RNA, 22 nt, Homo sapiens
cuucacaaccagccacacagag

SEQ ID NO: 1973815 - RNA, 15 nt, Homo sapiens
gcagacuacacagga

SEQ ID NO: 1973816 - RNA, 18 nt, Homo sapiens
gcaaaagcaucuauguga

SEQ ID NO: 1973817 - RNA, 19 nt, Homo sapiens
gguaguacuccugcaaaau

SEQ ID NO: 1973818 - RNA, 23 nt, Homo sapiens
cugacaccagagcccacuuccau

SEQ ID NO: 1973819 - RNA, 15 nt, Homo sapiens
ccuucuuucucuucc

SEQ ID NO: 1973820 - RNA, 19 nt, Homo sapiens
gaaucuuaagguguagcca

SEQ ID NO: 1973821 - RNA, 15 nt, Homo sapiens
ccucccuaaugcuca

SEQ ID NO: 1973822 - RNA, 22 nt, Homo sapiens
uuugccauauggaggacuguga

SEQ ID NO: 1973823 - RNA, 23 nt, Homo sapiens
aucuguucgauugaaauuuugca

SEQ ID NO: 1973824 - RNA, 21 nt, Homo sapiens
ccuuuuuaaaaagcaccuauu

SEQ ID NO: 1973825 - RNA, 17 nt, Homo sapiens
uccacagccccaaccuc

SEQ ID NO: 1973826 - RNA, 15 nt, Homo sapiens
caggccacuugcuca

SEQ ID NO: 1973827 - RNA, 12 nt, Homo sapiens
caauagucaaaa

SEQ ID NO: 1973828 - RNA, 14 nt, Homo sapiens
aagauuuuacuuua

SEQ ID NO: 1973829 - RNA, 22 nt, Homo sapiens
caggauuauucccaccugccac

SEQ ID NO: 1973830 - RNA, 13 nt, Homo sapiens
gcugcagugugag

SEQ ID NO: 1973831 - RNA, 14 nt, Homo sapiens
uuccagaaacaccc

SEQ ID NO: 1973832 - RNA, 23 nt, Homo sapiens
ucccuuuuuauaucccauuuuua

SEQ ID NO: 1973833 - RNA, 18 nt, Homo sapiens
agaaucacucgaacccgg

SEQ ID NO: 1973834 - RNA, 17 nt, Homo sapiens
cuacuguguugaaaugg

SEQ ID NO: 1973835 - RNA, 17 nt, Homo sapiens
auucuauuauacuacaa

SEQ ID NO: 1973836 - RNA, 14 nt, Homo sapiens
acauauuugcacug

SEQ ID NO: 1973837 - RNA, 21 nt, Homo sapiens
cuauauuuauuuauguaggau

SEQ ID NO: 1973838 - RNA, 19 nt, Homo sapiens
guauuaagauggucauauu

SEQ ID NO: 1973839 - RNA, 14 nt, Homo sapiens
auuucccacuucca

SEQ ID NO: 1973840 - RNA, 21 nt, Homo sapiens
cagggucucacuauauugcuc

SEQ ID NO: 1973841 - RNA, 20 nt, Homo sapiens
acuuuucuaacauaugucua

SEQ ID NO: 1973842 - RNA, 21 nt, Homo sapiens
auggucauuuccagacaaauu

SEQ ID NO: 1973843 - RNA, 14 nt, Homo sapiens
agaaugaguuauga

SEQ ID NO: 1973844 - RNA, 14 nt, Homo sapiens
cuuauuuacagaua

SEQ ID NO: 1973845 - RNA, 16 nt, Homo sapiens
guuuaggauuacuuag

SEQ ID NO: 1973846 - RNA, 20 nt, Homo sapiens
ugcaacagaaggguagguua

SEQ ID NO: 1973847 - RNA, 13 nt, Homo sapiens
cuugaacauuccc

SEQ ID NO: 1973848 - RNA, 17 nt, Homo sapiens
accuggauccagcacug

SEQ ID NO: 1973849 - RNA, 20 nt, Homo sapiens
agcuggcaccuuaguugcau

SEQ ID NO: 1973850 - RNA, 21 nt, Homo sapiens
cuaagaauaaacuccauuuaa

SEQ ID NO: 1973851 - RNA, 22 nt, Homo sapiens
ccuguucaguacucuacaauuc

SEQ ID NO: 1973852 - RNA, 18 nt, Homo sapiens
aagacacaucuuauugaa

SEQ ID NO: 1973853 - RNA, 18 nt, Homo sapiens
caagcacuuuaauggccu

SEQ ID NO: 1973854 - RNA, 15 nt, Homo sapiens
uguaugggaagcaug

SEQ ID NO: 1973855 - RNA, 14 nt, Homo sapiens
ccacacuccagcug

SEQ ID NO: 1973856 - RNA, 22 nt, Homo sapiens
gcacaggugacagaucauagga

SEQ ID NO: 1973857 - RNA, 13 nt, Homo sapiens
cagaccagugaaa

SEQ ID NO: 1973858 - RNA, 21 nt, Homo sapiens
aacuuugaggaggaagcagaa

SEQ ID NO: 1973859 - RNA, 21 nt, Homo sapiens
cuuuuucauccaggccugcca

SEQ ID NO: 1973860 - RNA, 16 nt, Homo sapiens
gcuuuuauuucuuaua

SEQ ID NO: 1973861 - RNA, 18 nt, Homo sapiens
uugucuaacuuuugugaa

SEQ ID NO: 1973862 - RNA, 13 nt, Homo sapiens
ugaguacccaaaa

SEQ ID NO: 1973863 - RNA, 19 nt, Homo sapiens
agauggaaggaagggagaa

SEQ ID NO: 1973864 - RNA, 19 nt, Homo sapiens
uggugaaacccccaucucu

SEQ ID NO: 1973865 - RNA, 22 nt, Homo sapiens
uaaaauacuaaacuacauuuua

SEQ ID NO: 1973866 - RNA, 18 nt, Homo sapiens
ggugcucuuugcugcacu

SEQ ID NO: 1973867 - RNA, 23 nt, Homo sapiens
aaacuaugauaaauuaugauaau

SEQ ID NO: 1973868 - RNA, 14 nt, Homo sapiens
ccuuuuacucagcu

SEQ ID NO: 1973869 - RNA, 23 nt, Homo sapiens
uccgcagaagcccugaugugucc

SEQ ID NO: 1973870 - RNA, 17 nt, Homo sapiens
uauuucuuaguccauca

SEQ ID NO: 1973871 - RNA, 13 nt, Homo sapiens
cauggaccugcac

SEQ ID NO: 1973872 - RNA, 19 nt, Homo sapiens
gaagcccugauguguccuc

SEQ ID NO: 1973873 - RNA, 14 nt, Homo sapiens
cauucuaagucaca

SEQ ID NO: 1973874 - RNA, 18 nt, Homo sapiens
aaagcugauuacugucaa

SEQ ID NO: 1973875 - RNA, 13 nt, Homo sapiens
auugcccugugag

SEQ ID NO: 1973876 - RNA, 19 nt, Homo sapiens
caggcuguaaauugaacuu

SEQ ID NO: 1973877 - RNA, 21 nt, Homo sapiens
uaaagaaugcaaccuagucag

SEQ ID NO: 1973878 - RNA, 16 nt, Homo sapiens
aagugauccacccacc

SEQ ID NO: 1973879 - RNA, 14 nt, Homo sapiens
auccuacucaacaa

SEQ ID NO: 1973880 - RNA, 15 nt, Homo sapiens
acuagcauuuuccac

SEQ ID NO: 1973881 - RNA, 15 nt, Homo sapiens
ugcucgcccaggaag

SEQ ID NO: 1973882 - RNA, 12 nt, Homo sapiens
cuaguacuauua

SEQ ID NO: 1973883 - RNA, 12 nt, Homo sapiens
ccaauacuacug

SEQ ID NO: 1973884 - RNA, 13 nt, Homo sapiens
aggaaaugugcuc

SEQ ID NO: 1973885 - RNA, 15 nt, Homo sapiens
agagaggcugccuca

SEQ ID NO: 1973886 - RNA, 21 nt, Homo sapiens
ugauuuaugguaguaauauua

SEQ ID NO: 1973887 - RNA, 21 nt, Homo sapiens
ucauaucuuccucaucaguag

SEQ ID NO: 1973888 - RNA, 22 nt, Homo sapiens
caggauauuugcacuauuucca

SEQ ID NO: 1973889 - RNA, 18 nt, Homo sapiens
gcaguucugcacccagcc

SEQ ID NO: 1973890 - RNA, 16 nt, Homo sapiens
acauuuccacaccaga

SEQ ID NO: 1973891 - RNA, 19 nt, Homo sapiens
gcuugggcccugcacagau

SEQ ID NO: 1973892 - RNA, 16 nt, Homo sapiens
uucacugugcucauca

SEQ ID NO: 1973893 - RNA, 13 nt, Homo sapiens
acaccaugugcaa

SEQ ID NO: 1973894 - RNA, 17 nt, Homo sapiens
augaaaaugaaccauuc

SEQ ID NO: 1973895 - RNA, 20 nt, Homo sapiens
caauuauauaaaucauuuca

SEQ ID NO: 1973896 - RNA, 21 nt, Homo sapiens
ucagccccugauccugugaag

SEQ ID NO: 1973897 - RNA, 15 nt, Homo sapiens
ugggagccuacccac

SEQ ID NO: 1973898 - RNA, 20 nt, Homo sapiens
cuguuuuuacuaaguuuuca

SEQ ID NO: 1973899 - RNA, 20 nt, Homo sapiens
caccaauggauuguggaaaa

SEQ ID NO: 1973900 - RNA, 15 nt, Homo sapiens
ugaccauaugcacaa

SEQ ID NO: 1973901 - RNA, 21 nt, Homo sapiens
agggaaguaacauuugccuua

SEQ ID NO: 1973902 - RNA, 24 nt, Homo sapiens
uaaauaaacagauguauuaugcug

SEQ ID NO: 1973903 - RNA, 14 nt, Homo sapiens
ucacugacaguuaa

SEQ ID NO: 1973904 - RNA, 18 nt, Homo sapiens
guuuucuuuucugugguu

SEQ ID NO: 1973905 - RNA, 17 nt, Homo sapiens
ugucuuuauucuuauua

SEQ ID NO: 1973906 - RNA, 17 nt, Homo sapiens
cagggaaggugagccag

SEQ ID NO: 1973907 - RNA, 21 nt, Homo sapiens
ucuuggauuacuuuacaccuc

SEQ ID NO: 1973908 - RNA, 14 nt, Homo sapiens
gagaccuugcuaag

SEQ ID NO: 1973909 - RNA, 15 nt, Homo sapiens
auggcaccuuuugca

SEQ ID NO: 1973910 - RNA, 15 nt, Homo sapiens
auuuuuauauagcuu

SEQ ID NO: 1973911 - RNA, 19 nt, Homo sapiens
ugucuguuuccucuguaua

SEQ ID NO: 1973912 - RNA, 15 nt, Homo sapiens
cuucuaguggguuua

SEQ ID NO: 1973913 - RNA, 18 nt, Homo sapiens
aaucuucagcauguucuc

SEQ ID NO: 1973914 - RNA, 21 nt, Homo sapiens
ugugguuugcuccagaauuaa

SEQ ID NO: 1973915 - RNA, 16 nt, Homo sapiens
cgaccagccagggaaa

SEQ ID NO: 1973916 - RNA, 16 nt, Homo sapiens
ugauccacuucucuca

SEQ ID NO: 1973917 - RNA, 16 nt, Homo sapiens
uccacuugaagcacuu

SEQ ID NO: 1973918 - RNA, 17 nt, Homo sapiens
aucucuaaccccucuga

SEQ ID NO: 1973919 - RNA, 18 nt, Homo sapiens
acugagccagucuuugaa

SEQ ID NO: 1973920 - RNA, 19 nt, Homo sapiens
uucccacagcacuaauuca

SEQ ID NO: 1973921 - RNA, 14 nt, Homo sapiens
ggaucugacugcac

SEQ ID NO: 1973922 - RNA, 16 nt, Homo sapiens
agcuguuuuguugaca

SEQ ID NO: 1973923 - RNA, 15 nt, Homo sapiens
ccccaacugugauca

SEQ ID NO: 1973924 - RNA, 22 nt, Homo sapiens
gaaauagcggugaaucuaguga

SEQ ID NO: 1973925 - RNA, 23 nt, Homo sapiens
acccuuuccggcacacugccaaa

SEQ ID NO: 1973926 - RNA, 12 nt, Homo sapiens
acugagccagaa

SEQ ID NO: 1973927 - RNA, 18 nt, Homo sapiens
acauagaaacauacacaa

SEQ ID NO: 1973928 - RNA, 15 nt, Homo sapiens
auacagaugacaaug

SEQ ID NO: 1973929 - RNA, 22 nt, Homo sapiens
auuguuagagaguauaacuuaa

SEQ ID NO: 1973930 - RNA, 18 nt, Homo sapiens
cacacuagaaaugcagca

SEQ ID NO: 1973931 - RNA, 23 nt, Homo sapiens
agaagccugaugcugacauucac

SEQ ID NO: 1973932 - RNA, 10 nt, Homo sapiens
uacucucuua

SEQ ID NO: 1973933 - RNA, 17 nt, Homo sapiens
cuaagcacagaaacuca

SEQ ID NO: 1973934 - RNA, 19 nt, Homo sapiens
caacacuggugugaccuga

SEQ ID NO: 1973935 - RNA, 14 nt, Homo sapiens
aauuuaaugcugcu

SEQ ID NO: 1973936 - RNA, 15 nt, Homo sapiens
agucucacugacaca

SEQ ID NO: 1973937 - RNA, 24 nt, Homo sapiens
uggggcaggcugggccauguccaa

SEQ ID NO: 1973938 - RNA, 18 nt, Homo sapiens
gucuucauaaaguacuug

SEQ ID NO: 1973939 - RNA, 17 nt, Homo sapiens
cgaggaggcauucuucu

SEQ ID NO: 1973940 - RNA, 17 nt, Homo sapiens
acuuugaggacauuuau

SEQ ID NO: 1973941 - RNA, 17 nt, Homo sapiens
ucggguggccugcgcua

SEQ ID NO: 1973942 - RNA, 17 nt, Homo sapiens
aggcacauaccacugca

SEQ ID NO: 1973943 - RNA, 23 nt, Homo sapiens
cuccaggguggcagcaacaauaa

SEQ ID NO: 1973944 - RNA, 18 nt, Homo sapiens
aguaaaaccacagcaguu

SEQ ID NO: 1973945 - RNA, 13 nt, Homo sapiens
gcaucagugcccu

SEQ ID NO: 1973946 - RNA, 14 nt, Homo sapiens
uuuaagcuaccaau

SEQ ID NO: 1973947 - RNA, 13 nt, Homo sapiens
aagaagaccagac

SEQ ID NO: 1973948 - RNA, 16 nt, Homo sapiens
agccagcaguuguaaa

SEQ ID NO: 1973949 - RNA, 14 nt, Homo sapiens
ugaugaacugccaa

SEQ ID NO: 1973950 - RNA, 13 nt, Homo sapiens
gagcagagaagua

SEQ ID NO: 1973951 - RNA, 18 nt, Homo sapiens
ucacugaguuuuccaugg

SEQ ID NO: 1973952 - RNA, 21 nt, Homo sapiens
guaaaugggggugcauuugag

SEQ ID NO: 1973953 - RNA, 17 nt, Homo sapiens
acccccaccaugcagcc

SEQ ID NO: 1973954 - RNA, 20 nt, Homo sapiens
cuucuguuugaucacuguga

SEQ ID NO: 1973955 - RNA, 16 nt, Homo sapiens
uucccuccaccagugu

SEQ ID NO: 1973956 - RNA, 21 nt, Homo sapiens
aauuucugucagaaugcuauu

SEQ ID NO: 1973957 - RNA, 23 nt, Homo sapiens
uguacacacacagaugcacacac

SEQ ID NO: 1973958 - RNA, 20 nt, Homo sapiens
caucuuuuuccacuuugacu

SEQ ID NO: 1973959 - RNA, 14 nt, Homo sapiens
aauaaugaucuucc

SEQ ID NO: 1973960 - RNA, 21 nt, Homo sapiens
cacuuuccccgugggccaugg

SEQ ID NO: 1973961 - RNA, 13 nt, Homo sapiens
auggccuuaccuu

SEQ ID NO: 1973962 - RNA, 17 nt, Homo sapiens
gguccccuccuucccaa

SEQ ID NO: 1973963 - RNA, 20 nt, Homo sapiens
aauuugaccaucucucuuau

SEQ ID NO: 1973964 - RNA, 15 nt, Homo sapiens
uaaaaacugcagugu

SEQ ID NO: 1973965 - RNA, 19 nt, Homo sapiens
aaguaaaggccucaucucc

SEQ ID NO: 1973966 - RNA, 20 nt, Homo sapiens
uaacaauauauagaauugua

SEQ ID NO: 1973967 - RNA, 17 nt, Homo sapiens
ccugcuuuccugcagca

SEQ ID NO: 1973968 - RNA, 14 nt, Homo sapiens
uuucccugcugcuu

SEQ ID NO: 1973969 - RNA, 17 nt, Homo sapiens
accuuacauguguaaag

SEQ ID NO: 1973970 - RNA, 22 nt, Homo sapiens
cugggaguguucccgugccugg

SEQ ID NO: 1973971 - RNA, 22 nt, Homo sapiens
uaaauuaaaagcccuaccuaaa

SEQ ID NO: 1973972 - RNA, 19 nt, Homo sapiens
ugagcaguggacacgugag

SEQ ID NO: 1973973 - RNA, 15 nt, Homo sapiens
aauacaagccuaugc

SEQ ID NO: 1973974 - RNA, 16 nt, Homo sapiens
gaacucuacgccacuc

SEQ ID NO: 1973975 - RNA, 13 nt, Homo sapiens
cauuaagcacugu

SEQ ID NO: 1973976 - RNA, 13 nt, Homo sapiens
aauugagcauagu

SEQ ID NO: 1973977 - RNA, 16 nt, Homo sapiens
cauauucauauuucaa

SEQ ID NO: 1973978 - RNA, 18 nt, Homo sapiens
cuugccccuguuaccuaa

SEQ ID NO: 1973979 - RNA, 23 nt, Homo sapiens
uugucagcagcagugaccacagc

SEQ ID NO: 1973980 - RNA, 16 nt, Homo sapiens
uaaauuauuuacugca

SEQ ID NO: 1973981 - RNA, 14 nt, Homo sapiens
aauauauauuuuag

SEQ ID NO: 1973982 - RNA, 21 nt, Homo sapiens
gcagcccaaucugccagacuu

SEQ ID NO: 1973983 - RNA, 22 nt, Homo sapiens
ccccaauggcuacucugcucac

SEQ ID NO: 1973984 - RNA, 21 nt, Homo sapiens
cauuaucuggaauauugugau

SEQ ID NO: 1973985 - RNA, 17 nt, Homo sapiens
ggcaccaaccugcauuu

SEQ ID NO: 1973986 - RNA, 23 nt, Homo sapiens
acgaguugcagccagggccagug

SEQ ID NO: 1973987 - RNA, 17 nt, Homo sapiens
cacccaggccaggcaug

SEQ ID NO: 1973988 - RNA, 13 nt, Homo sapiens
acauuugaacuau

SEQ ID NO: 1973989 - RNA, 19 nt, Homo sapiens
auuagguguucaggccagu

SEQ ID NO: 1973990 - RNA, 17 nt, Homo sapiens
ggacuguugaugccuuu

SEQ ID NO: 1973991 - RNA, 21 nt, Homo sapiens
uaugccauggaggcacuaaca

SEQ ID NO: 1973992 - RNA, 21 nt, Homo sapiens
ucacguuuggugcuucucaga

SEQ ID NO: 1973993 - RNA, 19 nt, Homo sapiens
gugauauacugguucacau

SEQ ID NO: 1973994 - RNA, 13 nt, Homo sapiens
cuuggaugugaug

SEQ ID NO: 1973995 - RNA, 15 nt, Homo sapiens
auuuuggacguguga

SEQ ID NO: 1973996 - RNA, 21 nt, Homo sapiens
acccuauauguggcauuccuu

SEQ ID NO: 1973997 - RNA, 19 nt, Homo sapiens
acauuugggagacauguga

SEQ ID NO: 1973998 - RNA, 21 nt, Homo sapiens
agagccucgcucuguuaccca

SEQ ID NO: 1973999 - RNA, 19 nt, Homo sapiens
cuugggaggacagguccug

SEQ ID NO: 1974000 - RNA, 12 nt, Homo sapiens
auaugaccaaaa

SEQ ID NO: 1974001 - RNA, 13 nt, Homo sapiens
gugaugaugcugu

SEQ ID NO: 1974002 - RNA, 20 nt, Homo sapiens
gaggcauagaauacacauuu

SEQ ID NO: 1974003 - RNA, 22 nt, Homo sapiens
uagguaggugguuuuauuucaa

SEQ ID NO: 1974004 - RNA, 20 nt, Homo sapiens
ugcugaccugaucaccucug

SEQ ID NO: 1974005 - RNA, 20 nt, Homo sapiens
acagcugcuucugugcauuu

SEQ ID NO: 1974006 - RNA, 15 nt, Homo sapiens
gcugggccagugcau

SEQ ID NO: 1974007 - RNA, 20 nt, Homo sapiens
uuuucucuuagaacauugua

SEQ ID NO: 1974008 - RNA, 21 nt, Homo sapiens
ucuugucugagaacaaauaca

SEQ ID NO: 1974009 - RNA, 16 nt, Homo sapiens
uucauauuguugcauu

SEQ ID NO: 1974010 - RNA, 21 nt, Homo sapiens
uccuucuguggcaacuuguac

SEQ ID NO: 1974011 - RNA, 17 nt, Homo sapiens
cacagaugauacuucca

SEQ ID NO: 1974012 - RNA, 22 nt, Homo sapiens
gaauugcuccugcaugcaacua

SEQ ID NO: 1974013 - RNA, 14 nt, Homo sapiens
cugcuugaccaaag

SEQ ID NO: 1974014 - RNA, 20 nt, Homo sapiens
ucuugagauguauuaugcaa

SEQ ID NO: 1974015 - RNA, 18 nt, Homo sapiens
aaucaugagcaagugaac

SEQ ID NO: 1974016 - RNA, 15 nt, Homo sapiens
aauagugauuuccac

SEQ ID NO: 1974017 - RNA, 18 nt, Homo sapiens
caaauauaaaucuuaaaa

SEQ ID NO: 1974018 - RNA, 20 nt, Homo sapiens
agacuaacaggagaaugcac

SEQ ID NO: 1974019 - RNA, 15 nt, Homo sapiens
augagugcaagcaaa

SEQ ID NO: 1974020 - RNA, 16 nt, Homo sapiens
cccaggaaguggccaa

SEQ ID NO: 1974021 - RNA, 19 nt, Homo sapiens
uaaauuuucuaugcuuauu

SEQ ID NO: 1974022 - RNA, 20 nt, Homo sapiens
cagccauaagaaagcacuau

SEQ ID NO: 1974023 - RNA, 14 nt, Homo sapiens
uguuuaugagccag

SEQ ID NO: 1974024 - RNA, 19 nt, Homo sapiens
aagcuuccuagcuuaucuc

SEQ ID NO: 1974025 - RNA, 19 nt, Homo sapiens
uguaauggacuaugcacac

SEQ ID NO: 1974026 - RNA, 20 nt, Homo sapiens
uacaacuggacucauuauca

SEQ ID NO: 1974027 - RNA, 20 nt, Homo sapiens
gagaccauguugacuuuccu

SEQ ID NO: 1974028 - RNA, 14 nt, Homo sapiens
gacuuccugaacuc

SEQ ID NO: 1974029 - RNA, 21 nt, Homo sapiens
ugcuucugccucagcuuccca

SEQ ID NO: 1974030 - RNA, 14 nt, Homo sapiens
cacuauguccagcu

SEQ ID NO: 1974031 - RNA, 20 nt, Homo sapiens
gccagaggcucuaauguaca

SEQ ID NO: 1974032 - RNA, 20 nt, Homo sapiens
ugccaaccggucacccagga

SEQ ID NO: 1974033 - RNA, 23 nt, Homo sapiens
gccucuucugagcuuacguaguu

SEQ ID NO: 1974034 - RNA, 12 nt, Homo sapiens
agcuuagcuguc

SEQ ID NO: 1974035 - RNA, 15 nt, Homo sapiens
cuuaagcacaauuaa

SEQ ID NO: 1974036 - RNA, 20 nt, Homo sapiens
acugauuucacaacagauca

SEQ ID NO: 1974037 - RNA, 13 nt, Homo sapiens
caaaacacugugu

SEQ ID NO: 1974038 - RNA, 20 nt, Homo sapiens
ugacauuuaauaacuuugcu

SEQ ID NO: 1974039 - RNA, 15 nt, Homo sapiens
agagugcucaaccua

SEQ ID NO: 1974040 - RNA, 20 nt, Homo sapiens
cugaggaucagcacugccag

SEQ ID NO: 1974041 - RNA, 15 nt, Homo sapiens
acaauugaacuucca

SEQ ID NO: 1974042 - RNA, 16 nt, Homo sapiens
uaaacuauuuauauca

SEQ ID NO: 1974043 - RNA, 23 nt, Homo sapiens
uaccuggcagcuagccagugcuc

SEQ ID NO: 1974044 - RNA, 14 nt, Homo sapiens
caacauuguacaag

SEQ ID NO: 1974045 - RNA, 13 nt, Homo sapiens
acuugauugccaa

SEQ ID NO: 1974046 - RNA, 16 nt, Homo sapiens
auugcugaauuaagga

SEQ ID NO: 1974047 - RNA, 21 nt, Homo sapiens
acagggccugcuauugcagaa

SEQ ID NO: 1974048 - RNA, 15 nt, Homo sapiens
ugccccgucaccauc

SEQ ID NO: 1974049 - RNA, 12 nt, Homo sapiens
ggagagaaaauu

SEQ ID NO: 1974050 - RNA, 16 nt, Homo sapiens
gaggcugcagaaggcc

SEQ ID NO: 1974051 - RNA, 21 nt, Homo sapiens
cuauaacauagaauugcaauc

SEQ ID NO: 1974052 - RNA, 18 nt, Homo sapiens
agguucauggauuacuuc

SEQ ID NO: 1974053 - RNA, 14 nt, Homo sapiens
acccaccccagugc

SEQ ID NO: 1974054 - RNA, 23 nt, Homo sapiens
ccggccacaacuacaccacgaga

SEQ ID NO: 1974055 - RNA, 18 nt, Homo sapiens
acuguaguucacuguaga

SEQ ID NO: 1974056 - RNA, 17 nt, Homo sapiens
augccucagccuccuga

SEQ ID NO: 1974057 - RNA, 22 nt, Homo sapiens
ucugguccaggcccuguggcag

SEQ ID NO: 1974058 - RNA, 14 nt, Homo sapiens
aggcaggagggcau

SEQ ID NO: 1974059 - RNA, 20 nt, Homo sapiens
gauccauuaaguaaacaaua

SEQ ID NO: 1974060 - RNA, 15 nt, Homo sapiens
caagagaguaaacag

SEQ ID NO: 1974061 - RNA, 21 nt, Homo sapiens
auuccagugguucugcuucaa

SEQ ID NO: 1974062 - RNA, 14 nt, Homo sapiens
uguucacugugagu

SEQ ID NO: 1974063 - RNA, 14 nt, Homo sapiens
ggcuccucagagcg

SEQ ID NO: 1974064 - RNA, 15 nt, Homo sapiens
cagggccccugugac

SEQ ID NO: 1974065 - RNA, 23 nt, Homo sapiens
uaaaauaaaguauauauagaauc

SEQ ID NO: 1974066 - RNA, 23 nt, Homo sapiens
ucauaacugggugguuugagggu

SEQ ID NO: 1974067 - RNA, 23 nt, Homo sapiens
caggcagucagguccaugugcac

SEQ ID NO: 1974068 - RNA, 16 nt, Homo sapiens
uuucaacucauugcau

SEQ ID NO: 1974069 - RNA, 17 nt, Homo sapiens
ugugugagaccagggga

SEQ ID NO: 1974070 - RNA, 17 nt, Homo sapiens
gcaguggcugugccacc

SEQ ID NO: 1974071 - RNA, 16 nt, Homo sapiens
cugaugccccagggau

SEQ ID NO: 1974072 - RNA, 12 nt, Homo sapiens
aguagagcaaag

SEQ ID NO: 1974073 - RNA, 13 nt, Homo sapiens
cucuagacaucua

SEQ ID NO: 1974074 - RNA, 23 nt, Homo sapiens
caucucaggacccgcccaagagu

SEQ ID NO: 1974075 - RNA, 16 nt, Homo sapiens
aguuugcagaugucau

SEQ ID NO: 1974076 - RNA, 14 nt, Homo sapiens
aauauagagaauuc

SEQ ID NO: 1974077 - RNA, 19 nt, Homo sapiens
acuggcugugugaccuuag

SEQ ID NO: 1974078 - RNA, 22 nt, Homo sapiens
uuacaggcgugagccacugcgc

SEQ ID NO: 1974079 - RNA, 21 nt, Homo sapiens
augagaauguauuaguacaaa

SEQ ID NO: 1974080 - RNA, 19 nt, Homo sapiens
aauuucuguacauuugcaa

SEQ ID NO: 1974081 - RNA, 15 nt, Homo sapiens
acagaaauccuuuca

SEQ ID NO: 1974082 - RNA, 13 nt, Homo sapiens
agcuaacuuauca

SEQ ID NO: 1974083 - RNA, 17 nt, Homo sapiens
aaggccccaagguuuac

SEQ ID NO: 1974084 - RNA, 15 nt, Homo sapiens
ugcucugcaaaagga

SEQ ID NO: 1974085 - RNA, 11 nt, Homo sapiens
aagcauuguuu

SEQ ID NO: 1974086 - RNA, 12 nt, Homo sapiens
agcaacugcugu

SEQ ID NO: 1974087 - RNA, 17 nt, Homo sapiens
ggauccuuugcugcuga

SEQ ID NO: 1974088 - RNA, 15 nt, Homo sapiens
uaucccugguuccua

SEQ ID NO: 1974089 - RNA, 15 nt, Homo sapiens
agggaaguccuggga

SEQ ID NO: 1974090 - RNA, 18 nt, Homo sapiens
cuccauaugcuguacaug

SEQ ID NO: 1974091 - RNA, 19 nt, Homo sapiens
cagucuccgcuagcucuuu

SEQ ID NO: 1974092 - RNA, 19 nt, Homo sapiens
gccaguguggaagcugccu

SEQ ID NO: 1974093 - RNA, 18 nt, Homo sapiens
ccuccuuggccaccagac

SEQ ID NO: 1974094 - RNA, 13 nt, Homo sapiens
acacaaucucugu

SEQ ID NO: 1974095 - RNA, 16 nt, Homo sapiens
aggcaucuacacagcc

SEQ ID NO: 1974096 - RNA, 19 nt, Homo sapiens
cagcagacugaccaucucc

SEQ ID NO: 1974097 - RNA, 22 nt, Homo sapiens
gaauaaaaauagaaaccugaau

SEQ ID NO: 1974098 - RNA, 17 nt, Homo sapiens
auacucaaaacaguaau

SEQ ID NO: 1974099 - RNA, 12 nt, Homo sapiens
caggcucugaga

SEQ ID NO: 1974100 - RNA, 21 nt, Homo sapiens
augcugguggaggaagggcug

SEQ ID NO: 1974101 - RNA, 20 nt, Homo sapiens
aauacguacuuuagcuggaa

SEQ ID NO: 1974102 - RNA, 14 nt, Homo sapiens
uuccagcaccacac

SEQ ID NO: 1974103 - RNA, 15 nt, Homo sapiens
caccucuccugugag

SEQ ID NO: 1974104 - RNA, 11 nt, Homo sapiens
uuccauucuca

SEQ ID NO: 1974105 - RNA, 21 nt, Homo sapiens
ggcugccugccccugcugcuu

SEQ ID NO: 1974106 - RNA, 16 nt, Homo sapiens
cucuccaaaacacuua

SEQ ID NO: 1974107 - RNA, 12 nt, Homo sapiens
uauuuugcauau

SEQ ID NO: 1974108 - RNA, 12 nt, Homo sapiens
aauuuugcuuau

SEQ ID NO: 1974109 - RNA, 19 nt, Homo sapiens
caacuacuguguuaugcaa

SEQ ID NO: 1974110 - RNA, 16 nt, Homo sapiens
cuguuccuuccugcag

SEQ ID NO: 1974111 - RNA, 17 nt, Homo sapiens
uuacuuuuuuacacuga

SEQ ID NO: 1974112 - RNA, 23 nt, Homo sapiens
caguuccaccaagaaaugaacuu

SEQ ID NO: 1974113 - RNA, 21 nt, Homo sapiens
aaguauacuuuuccccuguua

SEQ ID NO: 1974114 - RNA, 14 nt, Homo sapiens
gcagaccauugggg

SEQ ID NO: 1974115 - RNA, 20 nt, Homo sapiens
accccuggccucaagcaauc

SEQ ID NO: 1974116 - RNA, 21 nt, Homo sapiens
aggggccccuccucugugcuc

SEQ ID NO: 1974117 - RNA, 14 nt, Homo sapiens
ucaaaauccaaaaa

SEQ ID NO: 1974118 - RNA, 16 nt, Homo sapiens
ugacuaaaaauaucac

SEQ ID NO: 1974119 - RNA, 15 nt, Homo sapiens
gucucagugaaggaa

SEQ ID NO: 1974120 - RNA, 18 nt, Homo sapiens
gcucuuuugcacaaggaa

SEQ ID NO: 1974121 - RNA, 18 nt, Homo sapiens
uuaauggacuccacugaa

SEQ ID NO: 1974122 - RNA, 20 nt, Homo sapiens
cuugguuacuuaagaggcag

SEQ ID NO: 1974123 - RNA, 14 nt, Homo sapiens
auugcaaucuauaa

SEQ ID NO: 1974124 - RNA, 22 nt, Homo sapiens
aaauucuuuuucacacugaugu

SEQ ID NO: 1974125 - RNA, 21 nt, Homo sapiens
uugauuccugguuugacucag

SEQ ID NO: 1974126 - RNA, 22 nt, Homo sapiens
cagaugacaaaaauucaacuca

SEQ ID NO: 1974127 - RNA, 17 nt, Homo sapiens
cuguauuccugauaugc

SEQ ID NO: 1974128 - RNA, 18 nt, Homo sapiens
gguaucugugaacauguu

SEQ ID NO: 1974129 - RNA, 19 nt, Homo sapiens
cucgugguaggacuguaga

SEQ ID NO: 1974130 - RNA, 19 nt, Homo sapiens
acaggagaaaaugcaauuu

SEQ ID NO: 1974131 - RNA, 22 nt, Homo sapiens
cuguuuuguaagugcugcuaua

SEQ ID NO: 1974132 - RNA, 20 nt, Homo sapiens
uauauagcucuacacaacau

SEQ ID NO: 1974133 - RNA, 16 nt, Homo sapiens
caguccaagguauuga

SEQ ID NO: 1974134 - RNA, 15 nt, Homo sapiens
agcagaggucuccca

SEQ ID NO: 1974135 - RNA, 21 nt, Homo sapiens
uaaucagccucgcucuugucu

SEQ ID NO: 1974136 - RNA, 16 nt, Homo sapiens
agagaaauguuuucac

SEQ ID NO: 1974137 - RNA, 22 nt, Homo sapiens
accacacugaccacacuguauc

SEQ ID NO: 1974138 - RNA, 17 nt, Homo sapiens
augccagugugcugaug

SEQ ID NO: 1974139 - RNA, 17 nt, Homo sapiens
ugacuauauacaucucu

SEQ ID NO: 1974140 - RNA, 20 nt, Homo sapiens
cuacaggagauagcuuucuu

SEQ ID NO: 1974141 - RNA, 19 nt, Homo sapiens
acugugugugcaaagguga

SEQ ID NO: 1974142 - RNA, 22 nt, Homo sapiens
uccuucccucucaugacuugca

SEQ ID NO: 1974143 - RNA, 15 nt, Homo sapiens
uguaauggugcuuau

SEQ ID NO: 1974144 - RNA, 22 nt, Homo sapiens
gcucuccaccacccaacccaaa

SEQ ID NO: 1974145 - RNA, 22 nt, Homo sapiens
gaggcucuucucauucagcuaa

SEQ ID NO: 1974146 - RNA, 21 nt, Homo sapiens
guagauuacugaaaaaugcaa

SEQ ID NO: 1974147 - RNA, 22 nt, Homo sapiens
aggcauguggccuuuaucucaa

SEQ ID NO: 1974148 - RNA, 12 nt, Homo sapiens
cuaaagcacuuu

SEQ ID NO: 1974149 - RNA, 12 nt, Homo sapiens
uuaaagcauuuu

SEQ ID NO: 1974150 - RNA, 23 nt, Homo sapiens
guuucuggcagccaguaccuccu

SEQ ID NO: 1974151 - RNA, 16 nt, Homo sapiens
uacgcugcugcaggac

SEQ ID NO: 1974152 - RNA, 18 nt, Homo sapiens
ggcuucagccucucccac

SEQ ID NO: 1974153 - RNA, 16 nt, Homo sapiens
uucugcuuugcacagg

SEQ ID NO: 1974154 - RNA, 17 nt, Homo sapiens
cagucuuccuuguggaa

SEQ ID NO: 1974155 - RNA, 13 nt, Homo sapiens
gacaaucacuaca

SEQ ID NO: 1974156 - RNA, 13 nt, Homo sapiens
ccugcugcaucuu

SEQ ID NO: 1974157 - RNA, 14 nt, Homo sapiens
uauaaaacaguguu

SEQ ID NO: 1974158 - RNA, 17 nt, Homo sapiens
augcuguuaaccaaagg

SEQ ID NO: 1974159 - RNA, 22 nt, Homo sapiens
cuucuaggacgccacccagcaa

SEQ ID NO: 1974160 - RNA, 15 nt, Homo sapiens
uguguccuugugugc

SEQ ID NO: 1974161 - RNA, 23 nt, Homo sapiens
gguucacguacaaaacucuguau

SEQ ID NO: 1974162 - RNA, 21 nt, Homo sapiens
uaaaacaaguacaucuguaca

SEQ ID NO: 1974163 - RNA, 22 nt, Homo sapiens
aauacccguugauaacucagug

SEQ ID NO: 1974164 - RNA, 18 nt, Homo sapiens
ucagaaaauuagcaugaa

SEQ ID NO: 1974165 - RNA, 13 nt, Homo sapiens
aguauucaucugu

SEQ ID NO: 1974166 - RNA, 12 nt, Homo sapiens
auccaugcccuc

SEQ ID NO: 1974167 - RNA, 16 nt, Homo sapiens
auaaccccaccuugcc

SEQ ID NO: 1974168 - RNA, 19 nt, Homo sapiens
cuuaagacuuuugggacau

SEQ ID NO: 1974169 - RNA, 10 nt, Homo sapiens
ggugcacagc

SEQ ID NO: 1974170 - RNA, 10 nt, Homo sapiens
ugugcacauc

SEQ ID NO: 1974171 - RNA, 14 nt, Homo sapiens
cacauuaucuucau

SEQ ID NO: 1974172 - RNA, 21 nt, Homo sapiens
auagaaacacuuucucacuua

SEQ ID NO: 1974173 - RNA, 14 nt, Homo sapiens
cacaggcaucagga

SEQ ID NO: 1974174 - RNA, 12 nt, Homo sapiens
caugaaucuucc

SEQ ID NO: 1974175 - RNA, 18 nt, Homo sapiens
aucaauggcacgcuccug

SEQ ID NO: 1974176 - RNA, 16 nt, Homo sapiens
gaugggcaugaaugag

SEQ ID NO: 1974177 - RNA, 14 nt, Homo sapiens
gcuacuggcagcuc

SEQ ID NO: 1974178 - RNA, 16 nt, Homo sapiens
agaauuaaucaguaaa

SEQ ID NO: 1974179 - RNA, 18 nt, Homo sapiens
agcugaaccuguucaaaa

SEQ ID NO: 1974180 - RNA, 14 nt, Homo sapiens
auucaaggggagcc

SEQ ID NO: 1974181 - RNA, 17 nt, Homo sapiens
ucagaauucuucauccu

SEQ ID NO: 1974182 - RNA, 12 nt, Homo sapiens
ccucuacagguc

SEQ ID NO: 1974183 - RNA, 21 nt, Homo sapiens
aaacaacguugcuauuuccac

SEQ ID NO: 1974184 - RNA, 16 nt, Homo sapiens
ccuaggaccucaggcg

SEQ ID NO: 1974185 - RNA, 18 nt, Homo sapiens
uuccuucugagucaccua

SEQ ID NO: 1974186 - RNA, 21 nt, Homo sapiens
gaaucaugagccugcuggaag

SEQ ID NO: 1974187 - RNA, 21 nt, Homo sapiens
gugaggaaaucaaagugcuau

SEQ ID NO: 1974188 - RNA, 20 nt, Homo sapiens
acaaaguuuugcucuuguca

SEQ ID NO: 1974189 - RNA, 23 nt, Homo sapiens
ccuauagcagaagcacauuuuca

SEQ ID NO: 1974190 - RNA, 19 nt, Homo sapiens
cucccugacccugcuccua

SEQ ID NO: 1974191 - RNA, 20 nt, Homo sapiens
uaaguucagcaacuguuuaa

SEQ ID NO: 1974192 - RNA, 21 nt, Homo sapiens
cugccuucaccuccucuuuca

SEQ ID NO: 1974193 - RNA, 22 nt, Homo sapiens
ugaaaugauagauuugaccucc

SEQ ID NO: 1974194 - RNA, 22 nt, Homo sapiens
cugccagugagcucgccauuca

SEQ ID NO: 1974195 - RNA, 20 nt, Homo sapiens
ucuuuaaaguuacugaucac

SEQ ID NO: 1974196 - RNA, 16 nt, Homo sapiens
ucaggccucugcucuc

SEQ ID NO: 1974197 - RNA, 23 nt, Homo sapiens
gacauuucucuaacuccugccau

SEQ ID NO: 1974198 - RNA, 12 nt, Homo sapiens
ugagacauucca

SEQ ID NO: 1974199 - RNA, 14 nt, Homo sapiens
gggaggcaagaaaa

SEQ ID NO: 1974200 - RNA, 13 nt, Homo sapiens
gagcgcaaagugc

SEQ ID NO: 1974201 - RNA, 18 nt, Homo sapiens
cuggaaaacagaacacuu

SEQ ID NO: 1974202 - RNA, 14 nt, Homo sapiens
agccaagaaagcua

SEQ ID NO: 1974203 - RNA, 12 nt, Homo sapiens
aaggaugucugc

SEQ ID NO: 1974204 - RNA, 23 nt, Homo sapiens
auucagugagggucuucuuacau

SEQ ID NO: 1974205 - RNA, 14 nt, Homo sapiens
cacacacagacugu

SEQ ID NO: 1974206 - RNA, 13 nt, Homo sapiens
acagcaaccugua

SEQ ID NO: 1974207 - RNA, 19 nt, Homo sapiens
acucuugaauagacuucca

SEQ ID NO: 1974208 - RNA, 14 nt, Homo sapiens
ccgugcguggcacu

SEQ ID NO: 1974209 - RNA, 21 nt, Homo sapiens
gugaaauaauaaaaugcaaau

SEQ ID NO: 1974210 - RNA, 19 nt, Homo sapiens
cacaaucugucaguucuaa

SEQ ID NO: 1974211 - RNA, 22 nt, Homo sapiens
ccauuggaauaauaaauuugau

SEQ ID NO: 1974212 - RNA, 13 nt, Homo sapiens
uaaaaacaaacag

SEQ ID NO: 1974213 - RNA, 14 nt, Homo sapiens
ucaagaaaacugga

SEQ ID NO: 1974214 - RNA, 14 nt, Homo sapiens
aauaaaaauaagaa

SEQ ID NO: 1974215 - RNA, 18 nt, Homo sapiens
ccagucggccccaucucu

SEQ ID NO: 1974216 - RNA, 16 nt, Homo sapiens
ggcuugaaaugcauua

SEQ ID NO: 1974217 - RNA, 21 nt, Homo sapiens
uucuagugcuuuucagugaua

SEQ ID NO: 1974218 - RNA, 17 nt, Homo sapiens
cucugggcuauggacac

SEQ ID NO: 1974219 - RNA, 19 nt, Homo sapiens
ucaccuaagucucugugaa

SEQ ID NO: 1974220 - RNA, 20 nt, Homo sapiens
cuuuuuaaaguuuguucacu

SEQ ID NO: 1974221 - RNA, 22 nt, Homo sapiens
acuucugcuccauagacaucag

SEQ ID NO: 1974222 - RNA, 13 nt, Homo sapiens
auuagcucacuga

SEQ ID NO: 1974223 - RNA, 12 nt, Homo sapiens
uuccgccuccag

SEQ ID NO: 1974224 - RNA, 21 nt, Homo sapiens
agacuggguuccucuccaagc

SEQ ID NO: 1974225 - RNA, 13 nt, Homo sapiens
ugggaagggauaa

SEQ ID NO: 1974226 - RNA, 22 nt, Homo sapiens
cagauagcaucuuauacgagua

SEQ ID NO: 1974227 - RNA, 20 nt, Homo sapiens
gccacagcacuagagucacc

SEQ ID NO: 1974228 - RNA, 18 nt, Homo sapiens
cgcaccugaccgcugccc

SEQ ID NO: 1974229 - RNA, 17 nt, Homo sapiens
aacaggaauuucuguua

SEQ ID NO: 1974230 - RNA, 18 nt, Homo sapiens
ucauggauaaauugcaca

SEQ ID NO: 1974231 - RNA, 13 nt, Homo sapiens
ggcagaggggagc

SEQ ID NO: 1974232 - RNA, 20 nt, Homo sapiens
aagugcugugcaagguauua

SEQ ID NO: 1974233 - RNA, 17 nt, Homo sapiens
gcaggcacugaagcugc

SEQ ID NO: 1974234 - RNA, 23 nt, Homo sapiens
ccgugcacccuggaagggcaggu

SEQ ID NO: 1974235 - RNA, 21 nt, Homo sapiens
gcucugggagggauguucuag

SEQ ID NO: 1974236 - RNA, 17 nt, Homo sapiens
accugcuuccugaaaua

SEQ ID NO: 1974237 - RNA, 14 nt, Homo sapiens
cagccaacauguga

SEQ ID NO: 1974238 - RNA, 19 nt, Homo sapiens
ccagacaucaccaacuguc

SEQ ID NO: 1974239 - RNA, 19 nt, Homo sapiens
ggcauuucccaauauuugc

SEQ ID NO: 1974240 - RNA, 19 nt, Homo sapiens
gcaagauuccaaguucuca

SEQ ID NO: 1974241 - RNA, 22 nt, Homo sapiens
cugugucauucuguuagauacu

SEQ ID NO: 1974242 - RNA, 23 nt, Homo sapiens
uuccaguuuaaugaacuaccauc

SEQ ID NO: 1974243 - RNA, 16 nt, Homo sapiens
ugugauuucaauguag

SEQ ID NO: 1974244 - RNA, 12 nt, Homo sapiens
aauguugccagc

SEQ ID NO: 1974245 - RNA, 17 nt, Homo sapiens
ucucuauuaccacugaa

SEQ ID NO: 1974246 - RNA, 23 nt, Homo sapiens
uuguuaaguauugugcacuguau

SEQ ID NO: 1974247 - RNA, 13 nt, Homo sapiens
ccucuaauugcau

SEQ ID NO: 1974248 - RNA, 17 nt, Homo sapiens
gaagagaaagcacgugu

SEQ ID NO: 1974249 - RNA, 23 nt, Homo sapiens
gaucugccgccucagcuucucaa

SEQ ID NO: 1974250 - RNA, 14 nt, Homo sapiens
uaacacagugcagu

SEQ ID NO: 1974251 - RNA, 18 nt, Homo sapiens
gucagacacgauugagaa

SEQ ID NO: 1974252 - RNA, 22 nt, Homo sapiens
aauugcacaacagagacugaaa

SEQ ID NO: 1974253 - RNA, 15 nt, Homo sapiens
uucuauaaaacacau

SEQ ID NO: 1974254 - RNA, 18 nt, Homo sapiens
ucauuucucagcuguccu

SEQ ID NO: 1974255 - RNA, 16 nt, Homo sapiens
uucucuuuaaugccua

SEQ ID NO: 1974256 - RNA, 22 nt, Homo sapiens
aauucuguuuauguucuugcag

SEQ ID NO: 1974257 - RNA, 19 nt, Homo sapiens
ugugcuaaguugucuuaca

SEQ ID NO: 1974258 - RNA, 19 nt, Homo sapiens
aagacuucucuuuugcaca

SEQ ID NO: 1974259 - RNA, 12 nt, Homo sapiens
aaaaaauuccgg

SEQ ID NO: 1974260 - RNA, 14 nt, Homo sapiens
aaaaauuagccaga

SEQ ID NO: 1974261 - RNA, 14 nt, Homo sapiens
ugcugaaaauugcc

SEQ ID NO: 1974262 - RNA, 16 nt, Homo sapiens
auaucgaaauaguuac

SEQ ID NO: 1974263 - RNA, 21 nt, Homo sapiens
ugacauaacgcugacugcaaa

SEQ ID NO: 1974264 - RNA, 19 nt, Homo sapiens
uguauguuuuucuguauaa

SEQ ID NO: 1974265 - RNA, 18 nt, Homo sapiens
agaugaccagugccuugg

SEQ ID NO: 1974266 - RNA, 22 nt, Homo sapiens
uaauaaaaaguaacacaccaag

SEQ ID NO: 1974267 - RNA, 14 nt, Homo sapiens
gaaauaacugccuu

SEQ ID NO: 1974268 - RNA, 22 nt, Homo sapiens
ugggaaggcuugggauuugcug

SEQ ID NO: 1974269 - RNA, 20 nt, Homo sapiens
uaacaucaguuuuguuuacu

SEQ ID NO: 1974270 - RNA, 19 nt, Homo sapiens
guugcagucacucuaguca

SEQ ID NO: 1974271 - RNA, 19 nt, Homo sapiens
acaggagaaugcacagugg

SEQ ID NO: 1974272 - RNA, 22 nt, Homo sapiens
acagacucuucacagauuuuua

SEQ ID NO: 1974273 - RNA, 22 nt, Homo sapiens
ccagauaaacaaauuguugacu

SEQ ID NO: 1974274 - RNA, 23 nt, Homo sapiens
aaaucuugcucuuccauaaucuu

SEQ ID NO: 1974275 - RNA, 21 nt, Homo sapiens
cugcuacuggcaaaaggaucu

SEQ ID NO: 1974276 - RNA, 22 nt, Homo sapiens
cugguuucuaccagcucauaca

SEQ ID NO: 1974277 - RNA, 19 nt, Homo sapiens
cugucuggacuuuccagag

SEQ ID NO: 1974278 - RNA, 20 nt, Homo sapiens
uccccugacagggccagugc

SEQ ID NO: 1974279 - RNA, 16 nt, Homo sapiens
cagcugacaguccucu

SEQ ID NO: 1974280 - RNA, 22 nt, Homo sapiens
cuguauuuuuuuuuuccauuag

SEQ ID NO: 1974281 - RNA, 21 nt, Homo sapiens
uguguucauccagcuacuuag

SEQ ID NO: 1974282 - RNA, 20 nt, Homo sapiens
aguuguucuaguaacaauac

SEQ ID NO: 1974283 - RNA, 21 nt, Homo sapiens
gaucuguugggaaccagagag

SEQ ID NO: 1974284 - RNA, 23 nt, Homo sapiens
gacaggcgagagaggagccagac

SEQ ID NO: 1974285 - RNA, 18 nt, Homo sapiens
uuauaauuggugcauagc

SEQ ID NO: 1974286 - RNA, 13 nt, Homo sapiens
ggaaggugcugaa

SEQ ID NO: 1974287 - RNA, 22 nt, Homo sapiens
guauaugaacuuaacaugcugu

SEQ ID NO: 1974288 - RNA, 13 nt, Homo sapiens
aucccacuguaug

SEQ ID NO: 1974289 - RNA, 17 nt, Homo sapiens
aagaauauauugccaaa

SEQ ID NO: 1974290 - RNA, 16 nt, Homo sapiens
uccccacuagcauuuu

SEQ ID NO: 1974291 - RNA, 15 nt, Homo sapiens
ucaaucuucaaugaa

SEQ ID NO: 1974292 - RNA, 15 nt, Homo sapiens
cuucauuaauacugu

SEQ ID NO: 1974293 - RNA, 12 nt, Homo sapiens
uagaugugauua

SEQ ID NO: 1974294 - RNA, 19 nt, Homo sapiens
cagucacugacaguuaaua

SEQ ID NO: 1974295 - RNA, 22 nt, Homo sapiens
guggucaacagaugacaacagc

SEQ ID NO: 1974296 - RNA, 15 nt, Homo sapiens
aaggacaguccuauu

SEQ ID NO: 1974297 - RNA, 14 nt, Homo sapiens
auuguucccaguga

SEQ ID NO: 1974298 - RNA, 20 nt, Homo sapiens
aaaguagaauaagccuucaa

SEQ ID NO: 1974299 - RNA, 13 nt, Homo sapiens
gaaaucauagaag

SEQ ID NO: 1974300 - RNA, 20 nt, Homo sapiens
auccuccgccucccggguuc

SEQ ID NO: 1974301 - RNA, 17 nt, Homo sapiens
cugccucuauucaauuu

SEQ ID NO: 1974302 - RNA, 20 nt, Homo sapiens
auauuucaggcauacugaca

SEQ ID NO: 1974303 - RNA, 14 nt, Homo sapiens
caccuggcugaggc

SEQ ID NO: 1974304 - RNA, 20 nt, Homo sapiens
uagcgcugcucuuaugccau

SEQ ID NO: 1974305 - RNA, 16 nt, Homo sapiens
cucucucaacaucaca

SEQ ID NO: 1974306 - RNA, 14 nt, Homo sapiens
gcuucuccuuuuaa

SEQ ID NO: 1974307 - RNA, 21 nt, Homo sapiens
acugcaggaagagaggaccca

SEQ ID NO: 1974308 - RNA, 16 nt, Homo sapiens
gccagcaaggcagguu

SEQ ID NO: 1974309 - RNA, 20 nt, Homo sapiens
gcaaagcaaucaagcaccag

SEQ ID NO: 1974310 - RNA, 20 nt, Homo sapiens
caaaguuuaaauguauuuua

SEQ ID NO: 1974311 - RNA, 20 nt, Homo sapiens
aagcuauuagccaggaucau

SEQ ID NO: 1974312 - RNA, 14 nt, Homo sapiens
ucuguuuugcacag

SEQ ID NO: 1974313 - RNA, 17 nt, Homo sapiens
uagauuauguucaauga

SEQ ID NO: 1974314 - RNA, 19 nt, Homo sapiens
acaugaacacuuuuuauca

SEQ ID NO: 1974315 - RNA, 21 nt, Homo sapiens
cacacacccccccacaaggaa

SEQ ID NO: 1974316 - RNA, 21 nt, Homo sapiens
cuccccaguucauugcacuuu

SEQ ID NO: 1974317 - RNA, 13 nt, Homo sapiens
aggccaagcauuu

SEQ ID NO: 1974318 - RNA, 17 nt, Homo sapiens
cuagcugucugugaaua

SEQ ID NO: 1974319 - RNA, 15 nt, Homo sapiens
gaaaauauucuuugu

SEQ ID NO: 1974320 - RNA, 16 nt, Homo sapiens
agcugaggcaggugaa

SEQ ID NO: 1974321 - RNA, 14 nt, Homo sapiens
ucuaagucuuucca

SEQ ID NO: 1974322 - RNA, 23 nt, Homo sapiens
cucccauuacuuugauaucugau

SEQ ID NO: 1974323 - RNA, 22 nt, Homo sapiens
uuacuauagcauagauugucaa

SEQ ID NO: 1974324 - RNA, 20 nt, Homo sapiens
uguuuguugagugcacugac

SEQ ID NO: 1974325 - RNA, 17 nt, Homo sapiens
guggcagguuacagagu

SEQ ID NO: 1974326 - RNA, 14 nt, Homo sapiens
gaaacuucaguuga

SEQ ID NO: 1974327 - RNA, 14 nt, Homo sapiens
gaaauagugucuga

SEQ ID NO: 1974328 - RNA, 11 nt, Homo sapiens
ucuuccacugc

SEQ ID NO: 1974329 - RNA, 23 nt, Homo sapiens
agcagccuuucucucuuuauaca

SEQ ID NO: 1974330 - RNA, 16 nt, Homo sapiens
ccgaugcugaccucac

SEQ ID NO: 1974331 - RNA, 18 nt, Homo sapiens
gaagaauucagauugcug

SEQ ID NO: 1974332 - RNA, 17 nt, Homo sapiens
cugaugaaacucacaaa

SEQ ID NO: 1974333 - RNA, 16 nt, Homo sapiens
cucuaaaaugcuguuc

SEQ ID NO: 1974334 - RNA, 18 nt, Homo sapiens
uucaucugaggaguccaa

SEQ ID NO: 1974335 - RNA, 17 nt, Homo sapiens
aaauguaugugcucuua

SEQ ID NO: 1974336 - RNA, 14 nt, Homo sapiens
auguguuaaaauac

SEQ ID NO: 1974337 - RNA, 21 nt, Homo sapiens
gauuacugaauuguaucaauu

SEQ ID NO: 1974338 - RNA, 15 nt, Homo sapiens
cccgugaagcaauca

SEQ ID NO: 1974339 - RNA, 15 nt, Homo sapiens
gcugaaaaugugcau

SEQ ID NO: 1974340 - RNA, 20 nt, Homo sapiens
gccugcagcgagcugagauc

SEQ ID NO: 1974341 - RNA, 19 nt, Homo sapiens
ccacuggggaaugcuccca

SEQ ID NO: 1974342 - RNA, 14 nt, Homo sapiens
accauggcacuuaa

SEQ ID NO: 1974343 - RNA, 11 nt, Homo sapiens
cuauuacaugu

SEQ ID NO: 1974344 - RNA, 17 nt, Homo sapiens
ccugccccggccacucu

SEQ ID NO: 1974345 - RNA, 18 nt, Homo sapiens
ugagccaaacacacugua

SEQ ID NO: 1974346 - RNA, 13 nt, Homo sapiens
gucucuggaagag

SEQ ID NO: 1974347 - RNA, 13 nt, Homo sapiens
gagaguucucaca

SEQ ID NO: 1974348 - RNA, 22 nt, Homo sapiens
ucagcagaaacacacagucaca

SEQ ID NO: 1974349 - RNA, 12 nt, Homo sapiens
uauaagccaaaa

SEQ ID NO: 1974350 - RNA, 12 nt, Homo sapiens
auaaagccuuua

SEQ ID NO: 1974351 - RNA, 17 nt, Homo sapiens
cuguccucaccgucucg

SEQ ID NO: 1974352 - RNA, 13 nt, Homo sapiens
gccagaaauaucu

SEQ ID NO: 1974353 - RNA, 15 nt, Homo sapiens
cuaagcugcucuaaa

SEQ ID NO: 1974354 - RNA, 14 nt, Homo sapiens
ggugcugcauugag

SEQ ID NO: 1974355 - RNA, 21 nt, Homo sapiens
augagaagaaaauggaaccag

SEQ ID NO: 1974356 - RNA, 13 nt, Homo sapiens
uuaauaugaucug

SEQ ID NO: 1974357 - RNA, 15 nt, Homo sapiens
uggccaggacauuug

SEQ ID NO: 1974358 - RNA, 14 nt, Homo sapiens
gaaggaacucugca

SEQ ID NO: 1974359 - RNA, 14 nt, Homo sapiens
aucaaaacauccca

SEQ ID NO: 1974360 - RNA, 18 nt, Homo sapiens
auuuuggccacacuguca

SEQ ID NO: 1974361 - RNA, 14 nt, Homo sapiens
acgcuacugaguca

SEQ ID NO: 1974362 - RNA, 14 nt, Homo sapiens
cauaaaccugugcu

SEQ ID NO: 1974363 - RNA, 11 nt, Homo sapiens
auaaugcacug

SEQ ID NO: 1974364 - RNA, 14 nt, Homo sapiens
caggcaugagccac

SEQ ID NO: 1974365 - RNA, 20 nt, Homo sapiens
agauauugaugauaacacuu

SEQ ID NO: 1974366 - RNA, 12 nt, Homo sapiens
uucucucugugu

SEQ ID NO: 1974367 - RNA, 12 nt, Homo sapiens
ccugaguuucaa

SEQ ID NO: 1974368 - RNA, 18 nt, Homo sapiens
cauggugcgggcaccugu

SEQ ID NO: 1974369 - RNA, 16 nt, Homo sapiens
uaccuggacuggauca

SEQ ID NO: 1974370 - RNA, 16 nt, Homo sapiens
gcacaaauucaugugc

SEQ ID NO: 1974371 - RNA, 17 nt, Homo sapiens
agguagcuucuggaaau

SEQ ID NO: 1974372 - RNA, 18 nt, Homo sapiens
gacuaggauaauguccaa

SEQ ID NO: 1974373 - RNA, 13 nt, Homo sapiens
guguaugcugaug

SEQ ID NO: 1974374 - RNA, 22 nt, Homo sapiens
agaucucccuuaauaaacucac

SEQ ID NO: 1974375 - RNA, 23 nt, Homo sapiens
agacuuuaggaaugguucucuca

SEQ ID NO: 1974376 - RNA, 23 nt, Homo sapiens
gccaaagacaaauaguaggcaag

SEQ ID NO: 1974377 - RNA, 19 nt, Homo sapiens
auacuggccuggacuguuu

SEQ ID NO: 1974378 - RNA, 13 nt, Homo sapiens
aaaaugucacuga

SEQ ID NO: 1974379 - RNA, 18 nt, Homo sapiens
aaaacaagagaccacuuc

SEQ ID NO: 1974380 - RNA, 23 nt, Homo sapiens
guuuagugcaucuuugccucucg

SEQ ID NO: 1974381 - RNA, 16 nt, Homo sapiens
accaaucagcacucug

SEQ ID NO: 1974382 - RNA, 15 nt, Homo sapiens
ugcagggccuggcau

SEQ ID NO: 1974383 - RNA, 15 nt, Homo sapiens
uguaacauuaauucu

SEQ ID NO: 1974384 - RNA, 14 nt, Homo sapiens
ucuuuuccccauga

SEQ ID NO: 1974385 - RNA, 17 nt, Homo sapiens
augauugcuagccagca

SEQ ID NO: 1974386 - RNA, 15 nt, Homo sapiens
uucaccuucugccau

SEQ ID NO: 1974387 - RNA, 19 nt, Homo sapiens
cuccaugcugagaacaaaa

SEQ ID NO: 1974388 - RNA, 16 nt, Homo sapiens
ccaaacacguucccua

SEQ ID NO: 1974389 - RNA, 22 nt, Homo sapiens
ucuggggugggaguaacagggc

SEQ ID NO: 1974390 - RNA, 13 nt, Homo sapiens
gacacaaaugcau

SEQ ID NO: 1974391 - RNA, 13 nt, Homo sapiens
ugccuaaccuggg

SEQ ID NO: 1974392 - RNA, 16 nt, Homo sapiens
cuuucuaaggacccaa

SEQ ID NO: 1974393 - RNA, 14 nt, Homo sapiens
uccaaaguuaucca

SEQ ID NO: 1974394 - RNA, 13 nt, Homo sapiens
cucacuuaauaca

SEQ ID NO: 1974395 - RNA, 15 nt, Homo sapiens
aaauaggcauaucaa

SEQ ID NO: 1974396 - RNA, 18 nt, Homo sapiens
gcucuuaugugugccuuu

SEQ ID NO: 1974397 - RNA, 18 nt, Homo sapiens
uaaaugaaguaacuuguc

SEQ ID NO: 1974398 - RNA, 22 nt, Homo sapiens
acccagucccacacuguggcca

SEQ ID NO: 1974399 - RNA, 15 nt, Homo sapiens
ugccuucugcacaua

SEQ ID NO: 1974400 - RNA, 22 nt, Homo sapiens
auucucuaauaagaaaaccacc

SEQ ID NO: 1974401 - RNA, 21 nt, Homo sapiens
ccaagcaaaacuuuacuuuca

SEQ ID NO: 1974402 - RNA, 22 nt, Homo sapiens
acaggaacugugagagucuuug

SEQ ID NO: 1974403 - RNA, 18 nt, Homo sapiens
gagcucuccugggccagg

SEQ ID NO: 1974404 - RNA, 17 nt, Homo sapiens
ccacauauaaauguacu

SEQ ID NO: 1974405 - RNA, 18 nt, Homo sapiens
gccagcucagcaguucac

SEQ ID NO: 1974406 - RNA, 13 nt, Homo sapiens
auaaagauuuaua

SEQ ID NO: 1974407 - RNA, 20 nt, Homo sapiens
aacaacauccauguccuaug

SEQ ID NO: 1974408 - RNA, 21 nt, Homo sapiens
cgcuaccagggggucagaggg

SEQ ID NO: 1974409 - RNA, 20 nt, Homo sapiens
aaauaauuauauaacuguau

SEQ ID NO: 1974410 - RNA, 17 nt, Homo sapiens
gaaccacauggaacuua

SEQ ID NO: 1974411 - RNA, 18 nt, Homo sapiens
agagggccauugaacucu

SEQ ID NO: 1974412 - RNA, 13 nt, Homo sapiens
agccucagaaagg

SEQ ID NO: 1974413 - RNA, 22 nt, Homo sapiens
aaucaucaguuccuuugaucuc

SEQ ID NO: 1974414 - RNA, 17 nt, Homo sapiens
ccaacuguuucccugcu

SEQ ID NO: 1974415 - RNA, 19 nt, Homo sapiens
agcuucauuuccgugaagg

SEQ ID NO: 1974416 - RNA, 20 nt, Homo sapiens
auguaagggucauuagacaa

SEQ ID NO: 1974417 - RNA, 17 nt, Homo sapiens
uacuagguuguccauuu

SEQ ID NO: 1974418 - RNA, 24 nt, Homo sapiens
aaaggcaaaaagcauguguuugca

SEQ ID NO: 1974419 - RNA, 20 nt, Homo sapiens
gaacaauuuuuuuucuguaa

SEQ ID NO: 1974420 - RNA, 14 nt, Homo sapiens
acuucauggaucag

SEQ ID NO: 1974421 - RNA, 13 nt, Homo sapiens
uauauacaaguga

SEQ ID NO: 1974422 - RNA, 17 nt, Homo sapiens
ccucgcuccaacuccaa

SEQ ID NO: 1974423 - RNA, 15 nt, Homo sapiens
uacccuaaagugcaa

SEQ ID NO: 1974424 - RNA, 17 nt, Homo sapiens
aguugcuuuucagcuga

SEQ ID NO: 1974425 - RNA, 19 nt, Homo sapiens
gaagacugcccuacuauag

SEQ ID NO: 1974426 - RNA, 13 nt, Homo sapiens
auuauuuaccguu

SEQ ID NO: 1974427 - RNA, 19 nt, Homo sapiens
uuggugacaccucaccuca

SEQ ID NO: 1974428 - RNA, 18 nt, Homo sapiens
aaacacuagacuguauca

SEQ ID NO: 1974429 - RNA, 22 nt, Homo sapiens
ccauccaauggauugugcaaau

SEQ ID NO: 1974430 - RNA, 20 nt, Homo sapiens
aaauauacuugcuaucuaua

SEQ ID NO: 1974431 - RNA, 19 nt, Homo sapiens
gaccugacaagcacugcua

SEQ ID NO: 1974432 - RNA, 23 nt, Homo sapiens
ggccagggucugugugaaugugg

SEQ ID NO: 1974433 - RNA, 16 nt, Homo sapiens
uuacuagugugcaagu

SEQ ID NO: 1974434 - RNA, 18 nt, Homo sapiens
cugcuccuccaguacaau

SEQ ID NO: 1974435 - RNA, 14 nt, Homo sapiens
aaaacauacauuau

SEQ ID NO: 1974436 - RNA, 22 nt, Homo sapiens
gaagucuggagcacccugagaa

SEQ ID NO: 1974437 - RNA, 21 nt, Homo sapiens
uccagcccugaguuccuagcc

SEQ ID NO: 1974438 - RNA, 20 nt, Homo sapiens
aagcauggccuggacugacu

SEQ ID NO: 1974439 - RNA, 15 nt, Homo sapiens
agggcacugcugcug

SEQ ID NO: 1974440 - RNA, 21 nt, Homo sapiens
aguucaugucugaaacagaga

SEQ ID NO: 1974441 - RNA, 13 nt, Homo sapiens
ucaucuacuacag

SEQ ID NO: 1974442 - RNA, 13 nt, Homo sapiens
cggaauguaacuu

SEQ ID NO: 1974443 - RNA, 21 nt, Homo sapiens
caaacacaaccuacucugcaa

SEQ ID NO: 1974444 - RNA, 14 nt, Homo sapiens
cuuuuucaaagugu

SEQ ID NO: 1974445 - RNA, 17 nt, Homo sapiens
ucagagcugacacagga

SEQ ID NO: 1974446 - RNA, 13 nt, Homo sapiens
uugaaaacaaaga

SEQ ID NO: 1974447 - RNA, 21 nt, Homo sapiens
aaaucuuuuccaggaaaaaga

SEQ ID NO: 1974448 - RNA, 21 nt, Homo sapiens
ugccucucccauggcuuugug

SEQ ID NO: 1974449 - RNA, 12 nt, Homo sapiens
gcuaugcaaauc

SEQ ID NO: 1974450 - RNA, 18 nt, Homo sapiens
cggcuaagcaggcgcaag

SEQ ID NO: 1974451 - RNA, 20 nt, Homo sapiens
ugcccuugggguaagccaga

SEQ ID NO: 1974452 - RNA, 21 nt, Homo sapiens
cuugcuuccccuuuugccaau

SEQ ID NO: 1974453 - RNA, 18 nt, Homo sapiens
cuucauuuuauauuuaaa

SEQ ID NO: 1974454 - RNA, 17 nt, Homo sapiens
auccauuaucuauuuaa

SEQ ID NO: 1974455 - RNA, 21 nt, Homo sapiens
agcuuugcuuccgacaccucu

SEQ ID NO: 1974456 - RNA, 18 nt, Homo sapiens
gaaaagcaggcaaaagac

SEQ ID NO: 1974457 - RNA, 18 nt, Homo sapiens
gagagcucgcucuuggga

SEQ ID NO: 1974458 - RNA, 22 nt, Homo sapiens
ccuugauaaccauauaaauucu

SEQ ID NO: 1974459 - RNA, 19 nt, Homo sapiens
ccauuccacagcucugggc

SEQ ID NO: 1974460 - RNA, 21 nt, Homo sapiens
uugugucuaccuuguuauuaa

SEQ ID NO: 1974461 - RNA, 15 nt, Homo sapiens
ucuccaaagagaauu

SEQ ID NO: 1974462 - RNA, 21 nt, Homo sapiens
uuaauccuguaccaaaucuga

SEQ ID NO: 1974463 - RNA, 17 nt, Homo sapiens
ucugaauaaauaauucu

SEQ ID NO: 1974464 - RNA, 14 nt, Homo sapiens
uauuauacaaauac

SEQ ID NO: 1974465 - RNA, 19 nt, Homo sapiens
cgacauuuuucaauaaagu

SEQ ID NO: 1974466 - RNA, 15 nt, Homo sapiens
cucaggccugccaau

SEQ ID NO: 1974467 - RNA, 13 nt, Homo sapiens
cccuacacuguga

SEQ ID NO: 1974468 - RNA, 19 nt, Homo sapiens
cccaggccccaggcaucuu

SEQ ID NO: 1974469 - RNA, 22 nt, Homo sapiens
aagauggagaauaaauuauuga

SEQ ID NO: 1974470 - RNA, 21 nt, Homo sapiens
ggcagcauggagcuauaacua

SEQ ID NO: 1974471 - RNA, 16 nt, Homo sapiens
guugcgcgccugcucc

SEQ ID NO: 1974472 - RNA, 10 nt, Homo sapiens
agcaaaaacu

SEQ ID NO: 1974473 - RNA, 16 nt, Homo sapiens
cagcuuggggcagcca

SEQ ID NO: 1974474 - RNA, 20 nt, Homo sapiens
cagggaaucagggaccagcu

SEQ ID NO: 1974475 - RNA, 17 nt, Homo sapiens
uuuacuuccccuaugga

SEQ ID NO: 1974476 - RNA, 22 nt, Homo sapiens
ugaccuugaugagcugugcaca

SEQ ID NO: 1974477 - RNA, 19 nt, Homo sapiens
ucacuaaugaucacauucu

SEQ ID NO: 1974478 - RNA, 23 nt, Homo sapiens
auggacaugcuucagugcugcuc

SEQ ID NO: 1974479 - RNA, 16 nt, Homo sapiens
aaggguccuuucucca

SEQ ID NO: 1974480 - RNA, 13 nt, Homo sapiens
gcucacucagcca

SEQ ID NO: 1974481 - RNA, 20 nt, Homo sapiens
agccugaagagccccaaagc

SEQ ID NO: 1974482 - RNA, 16 nt, Homo sapiens
ucaaaucaaaaacagg

SEQ ID NO: 1974483 - RNA, 14 nt, Homo sapiens
ucuccacuuuguug

SEQ ID NO: 1974484 - RNA, 18 nt, Homo sapiens
gcaccuacuuacaugcau

SEQ ID NO: 1974485 - RNA, 16 nt, Homo sapiens
ucuggccaggcauggc

SEQ ID NO: 1974486 - RNA, 13 nt, Homo sapiens
aggcauugaauga

SEQ ID NO: 1974487 - RNA, 14 nt, Homo sapiens
cucuggggugcuga

SEQ ID NO: 1974488 - RNA, 17 nt, Homo sapiens
caacccacuggcacauu

SEQ ID NO: 1974489 - RNA, 14 nt, Homo sapiens
cacacucaugaaga

SEQ ID NO: 1974490 - RNA, 16 nt, Homo sapiens
uucuuaucccaugaga

SEQ ID NO: 1974491 - RNA, 21 nt, Homo sapiens
acagaugaguuaucuaagaau

SEQ ID NO: 1974492 - RNA, 21 nt, Homo sapiens
ucgcccacccgaguaccucca

SEQ ID NO: 1974493 - RNA, 14 nt, Homo sapiens
cugucauccacuuu

SEQ ID NO: 1974494 - RNA, 21 nt, Homo sapiens
caagguggccuuugugcugcg

SEQ ID NO: 1974495 - RNA, 21 nt, Homo sapiens
cccugccaugcucuccaaacc

SEQ ID NO: 1974496 - RNA, 15 nt, Homo sapiens
ccacuuggagcuaaa

SEQ ID NO: 1974497 - RNA, 13 nt, Homo sapiens
ccacaaggcacag

SEQ ID NO: 1974498 - RNA, 15 nt, Homo sapiens
gguuaacaccuucau

SEQ ID NO: 1974499 - RNA, 18 nt, Homo sapiens
ucucaggugacggacuca

SEQ ID NO: 1974500 - RNA, 18 nt, Homo sapiens
gccuugcggaagccauag

SEQ ID NO: 1974501 - RNA, 15 nt, Homo sapiens
ccaucccugcuuauu

SEQ ID NO: 1974502 - RNA, 19 nt, Homo sapiens
guuaauaaaggaacauuaa

SEQ ID NO: 1974503 - RNA, 23 nt, Homo sapiens
agccccggugugcggugcauaca

SEQ ID NO: 1974504 - RNA, 23 nt, Homo sapiens
uugcaauuaggauuuugauguga

SEQ ID NO: 1974505 - RNA, 15 nt, Homo sapiens
uugguucaacaucua

SEQ ID NO: 1974506 - RNA, 22 nt, Homo sapiens
augauaguccaauuuuuacuca

SEQ ID NO: 1974507 - RNA, 19 nt, Homo sapiens
cuccucaaacccagucuca

SEQ ID NO: 1974508 - RNA, 15 nt, Homo sapiens
gaagaacugcacuuu

SEQ ID NO: 1974509 - RNA, 16 nt, Homo sapiens
uucccucuucccugac

SEQ ID NO: 1974510 - RNA, 18 nt, Homo sapiens
ccucucagagucauugaa

SEQ ID NO: 1974511 - RNA, 23 nt, Homo sapiens
gugcuaggaacacuccuucacag

SEQ ID NO: 1974512 - RNA, 14 nt, Homo sapiens
cucgcccgcccacu

SEQ ID NO: 1974513 - RNA, 19 nt, Homo sapiens
gacacugaaggcaaaucuc

SEQ ID NO: 1974514 - RNA, 22 nt, Homo sapiens
aguuuagaugcuuugugacuua

SEQ ID NO: 1974515 - RNA, 22 nt, Homo sapiens
uaauuuuuucccagacuacuau

SEQ ID NO: 1974516 - RNA, 19 nt, Homo sapiens
uuuuuagagcuuccaaaug

SEQ ID NO: 1974517 - RNA, 17 nt, Homo sapiens
aucuccccaggccucca

SEQ ID NO: 1974518 - RNA, 21 nt, Homo sapiens
gcaaagcuucacuucauuuua

SEQ ID NO: 1974519 - RNA, 19 nt, Homo sapiens
gugcgaagacugagccaga

SEQ ID NO: 1974520 - RNA, 18 nt, Homo sapiens
gcgccagccucagacugg

SEQ ID NO: 1974521 - RNA, 12 nt, Homo sapiens
guguuacauaca

SEQ ID NO: 1974522 - RNA, 17 nt, Homo sapiens
gucuugcaauggcagcc

SEQ ID NO: 1974523 - RNA, 17 nt, Homo sapiens
uaccuauauugauuuaa

SEQ ID NO: 1974524 - RNA, 15 nt, Homo sapiens
aacccccaguguaau

SEQ ID NO: 1974525 - RNA, 19 nt, Homo sapiens
gcuggaggacuagaaccug

SEQ ID NO: 1974526 - RNA, 18 nt, Homo sapiens
ucuucaugaccuacuuca

SEQ ID NO: 1974527 - RNA, 20 nt, Homo sapiens
aaaacugccuuuuaucugcc

SEQ ID NO: 1974528 - RNA, 16 nt, Homo sapiens
guaaguuacuggcuga

SEQ ID NO: 1974529 - RNA, 18 nt, Homo sapiens
aacaggauguggaaaaug

SEQ ID NO: 1974530 - RNA, 17 nt, Homo sapiens
cgagacuccaucucaaa

SEQ ID NO: 1974531 - RNA, 17 nt, Homo sapiens
uaagacucugucucaaa

SEQ ID NO: 1974532 - RNA, 15 nt, Homo sapiens
ucauuucaaucuuuu

SEQ ID NO: 1974533 - RNA, 13 nt, Homo sapiens
gcacgguuuguga

SEQ ID NO: 1974534 - RNA, 16 nt, Homo sapiens
ucagcaccaugggccu

SEQ ID NO: 1974535 - RNA, 22 nt, Homo sapiens
aucucaugagaagucacucacu

SEQ ID NO: 1974536 - RNA, 19 nt, Homo sapiens
gcaguuguaccaagugaaa

SEQ ID NO: 1974537 - RNA, 17 nt, Homo sapiens
gauuuggggccucaaga

SEQ ID NO: 1974538 - RNA, 19 nt, Homo sapiens
uaacuugcugcaguaugaa

SEQ ID NO: 1974539 - RNA, 16 nt, Homo sapiens
auuuaugauuuaucua

SEQ ID NO: 1974540 - RNA, 20 nt, Homo sapiens
gcauaaauaugcagugauau

SEQ ID NO: 1974541 - RNA, 20 nt, Homo sapiens
cuggcugcuggcccacagcu

SEQ ID NO: 1974542 - RNA, 20 nt, Homo sapiens
acucuccaauguucuauuaa

SEQ ID NO: 1974543 - RNA, 20 nt, Homo sapiens
gaauaacaacuuucaguggc

SEQ ID NO: 1974544 - RNA, 23 nt, Homo sapiens
auugaauuauuuuguuacugucu

SEQ ID NO: 1974545 - RNA, 22 nt, Homo sapiens
aagacuaaccugcccacccacu

SEQ ID NO: 1974546 - RNA, 18 nt, Homo sapiens
aaauuuaauauagcuauu

SEQ ID NO: 1974547 - RNA, 22 nt, Homo sapiens
uuuguucaaugcuagaacaacg

SEQ ID NO: 1974548 - RNA, 15 nt, Homo sapiens
guaacuuuuguaguc

SEQ ID NO: 1974549 - RNA, 12 nt, Homo sapiens
caaagcauguga

SEQ ID NO: 1974550 - RNA, 15 nt, Homo sapiens
auuagcaugagcuuu

SEQ ID NO: 1974551 - RNA, 12 nt, Homo sapiens
accgcagggaca

SEQ ID NO: 1974552 - RNA, 21 nt, Homo sapiens
gagcugggccaggccuaagag

SEQ ID NO: 1974553 - RNA, 20 nt, Homo sapiens
guccugagcacugccaggag

SEQ ID NO: 1974554 - RNA, 11 nt, Homo sapiens
aaugcucugac

SEQ ID NO: 1974555 - RNA, 11 nt, Homo sapiens
acugcucugcc

SEQ ID NO: 1974556 - RNA, 13 nt, Homo sapiens
uuaucauauccuu

SEQ ID NO: 1974557 - RNA, 21 nt, Homo sapiens
ucucacucucuuccuuucauu

SEQ ID NO: 1974558 - RNA, 17 nt, Homo sapiens
aagaaaaggcaucacuu

SEQ ID NO: 1974559 - RNA, 15 nt, Homo sapiens
ucauuagagaucuga

SEQ ID NO: 1974560 - RNA, 21 nt, Homo sapiens
ugcaccucuuguuacucccug

SEQ ID NO: 1974561 - RNA, 12 nt, Homo sapiens
cauccaaagcag

SEQ ID NO: 1974562 - RNA, 20 nt, Homo sapiens
gcuucaugcaauccuuccaa

SEQ ID NO: 1974563 - RNA, 18 nt, Homo sapiens
uagagcagauucaguguu

SEQ ID NO: 1974564 - RNA, 20 nt, Homo sapiens
agacuccaccucuaccaaaa

SEQ ID NO: 1974565 - RNA, 12 nt, Homo sapiens
acaaaauuccag

SEQ ID NO: 1974566 - RNA, 19 nt, Homo sapiens
augucaucaaaaucugcac

SEQ ID NO: 1974567 - RNA, 18 nt, Homo sapiens
gccagggcccgaccuggg

SEQ ID NO: 1974568 - RNA, 18 nt, Homo sapiens
acagagggcucaccucuu

SEQ ID NO: 1974569 - RNA, 14 nt, Homo sapiens
ccacagcccuguca

SEQ ID NO: 1974570 - RNA, 14 nt, Homo sapiens
acuucaaauagcaa

SEQ ID NO: 1974571 - RNA, 17 nt, Homo sapiens
caucacaggcugugcca

SEQ ID NO: 1974572 - RNA, 22 nt, Homo sapiens
aaaaaguaccacauuccaugac

SEQ ID NO: 1974573 - RNA, 18 nt, Homo sapiens
uugaucacucuuugcaca

SEQ ID NO: 1974574 - RNA, 12 nt, Homo sapiens
uuugcuccuuca

SEQ ID NO: 1974575 - RNA, 15 nt, Homo sapiens
augugcagacacuca

SEQ ID NO: 1974576 - RNA, 22 nt, Homo sapiens
ugggucaucccagcaccugcca

SEQ ID NO: 1974577 - RNA, 21 nt, Homo sapiens
caggcuguuuauauguucaca

SEQ ID NO: 1974578 - RNA, 13 nt, Homo sapiens
gcuggaaucugaa

SEQ ID NO: 1974579 - RNA, 19 nt, Homo sapiens
ugagcuuucugaacagcug

SEQ ID NO: 1974580 - RNA, 15 nt, Homo sapiens
ugucauccaagccau

SEQ ID NO: 1974581 - RNA, 15 nt, Homo sapiens
aggguucuaaaugca

SEQ ID NO: 1974582 - RNA, 21 nt, Homo sapiens
cacuccagccugggugacaga

SEQ ID NO: 1974583 - RNA, 15 nt, Homo sapiens
gcaagcuguguuacu

SEQ ID NO: 1974584 - RNA, 20 nt, Homo sapiens
uacaggugacagugaagaua

SEQ ID NO: 1974585 - RNA, 17 nt, Homo sapiens
aauagacuucucuuaca

SEQ ID NO: 1974586 - RNA, 14 nt, Homo sapiens
ucuuacacacugga

SEQ ID NO: 1974587 - RNA, 21 nt, Homo sapiens
gaugcugagagaccucaggga

SEQ ID NO: 1974588 - RNA, 23 nt, Homo sapiens
cucgaacuccugaccucgugauu

SEQ ID NO: 1974589 - RNA, 14 nt, Homo sapiens
gaagccacccuccc

SEQ ID NO: 1974590 - RNA, 14 nt, Homo sapiens
aaacaugaauguac

SEQ ID NO: 1974591 - RNA, 18 nt, Homo sapiens
ccucuguccaggcacuga

SEQ ID NO: 1974592 - RNA, 13 nt, Homo sapiens
aaaaacaauaaag

SEQ ID NO: 1974593 - RNA, 15 nt, Homo sapiens
uauuauuuugcacug

SEQ ID NO: 1974594 - RNA, 23 nt, Homo sapiens
gugaucagaaggcuggggccagu

SEQ ID NO: 1974595 - RNA, 10 nt, Homo sapiens
ggcugugaaa

SEQ ID NO: 1974596 - RNA, 17 nt, Homo sapiens
ugggggcacagcugucu

SEQ ID NO: 1974597 - RNA, 18 nt, Homo sapiens
ggggaagaaaaacucuau

SEQ ID NO: 1974598 - RNA, 16 nt, Homo sapiens
cugaucauuacauggc

SEQ ID NO: 1974599 - RNA, 18 nt, Homo sapiens
auagcuauuuucuuacag

SEQ ID NO: 1974600 - RNA, 15 nt, Homo sapiens
uaggacagcaaagca

SEQ ID NO: 1974601 - RNA, 14 nt, Homo sapiens
ucugaggucccugu

SEQ ID NO: 1974602 - RNA, 17 nt, Homo sapiens
gugguucuaucaggggu

SEQ ID NO: 1974603 - RNA, 14 nt, Homo sapiens
uuguuaggccauuc

SEQ ID NO: 1974604 - RNA, 13 nt, Homo sapiens
uuuggaccacagc

SEQ ID NO: 1974605 - RNA, 21 nt, Homo sapiens
aaauugguauuaacuaugauc

SEQ ID NO: 1974606 - RNA, 20 nt, Homo sapiens
gacccauccugaacugggau

SEQ ID NO: 1974607 - RNA, 21 nt, Homo sapiens
ggcuucuucaugauggugguu

SEQ ID NO: 1974608 - RNA, 15 nt, Homo sapiens
auuuaaaaucauuca

SEQ ID NO: 1974609 - RNA, 23 nt, Homo sapiens
ccauucccaagggagacugacca

SEQ ID NO: 1974610 - RNA, 23 nt, Homo sapiens
ucugaauguuaaacuacucuuga

SEQ ID NO: 1974611 - RNA, 15 nt, Homo sapiens
gaagagcaagggaca

SEQ ID NO: 1974612 - RNA, 20 nt, Homo sapiens
agagagcuuaaauugucauu

SEQ ID NO: 1974613 - RNA, 14 nt, Homo sapiens
caauuccgcauuua

SEQ ID NO: 1974614 - RNA, 15 nt, Homo sapiens
ucuccaccccuacac

SEQ ID NO: 1974615 - RNA, 15 nt, Homo sapiens
cuccucucagcugaa

SEQ ID NO: 1974616 - RNA, 22 nt, Homo sapiens
auacaauauuuuaacaaugugc

SEQ ID NO: 1974617 - RNA, 21 nt, Homo sapiens
cccucucugcuccuucacugu

SEQ ID NO: 1974618 - RNA, 16 nt, Homo sapiens
caaacuuugcaucuca

SEQ ID NO: 1974619 - RNA, 18 nt, Homo sapiens
ugugagccucuuuguaau

SEQ ID NO: 1974620 - RNA, 22 nt, Homo sapiens
aaugugugucuuuuuguaucuc

SEQ ID NO: 1974621 - RNA, 19 nt, Homo sapiens
cuugugucaagacauuucu

SEQ ID NO: 1974622 - RNA, 19 nt, Homo sapiens
cacaggcaucuacacagcc

SEQ ID NO: 1974623 - RNA, 13 nt, Homo sapiens
agauggccaugua

SEQ ID NO: 1974624 - RNA, 18 nt, Homo sapiens
cucaguauccaugcucuu

SEQ ID NO: 1974625 - RNA, 13 nt, Homo sapiens
gcauuggugcuca

SEQ ID NO: 1974626 - RNA, 21 nt, Homo sapiens
gaaagaccaucuccccaggcu

SEQ ID NO: 1974627 - RNA, 17 nt, Homo sapiens
guuaucagugcuucccg

SEQ ID NO: 1974628 - RNA, 16 nt, Homo sapiens
ucaccucauaugcuau

SEQ ID NO: 1974629 - RNA, 15 nt, Homo sapiens
ucccaagguacagcu

SEQ ID NO: 1974630 - RNA, 17 nt, Homo sapiens
ccuaacacacuccaaga

SEQ ID NO: 1974631 - RNA, 14 nt, Homo sapiens
ugugagauggaugu

SEQ ID NO: 1974632 - RNA, 16 nt, Homo sapiens
cugacgcagccugaga

SEQ ID NO: 1974633 - RNA, 12 nt, Homo sapiens
gagacagaauag

SEQ ID NO: 1974634 - RNA, 17 nt, Homo sapiens
agaugcucuaucuugcu

SEQ ID NO: 1974635 - RNA, 20 nt, Homo sapiens
ucaucaaauauuaccaaaaa

SEQ ID NO: 1974636 - RNA, 18 nt, Homo sapiens
acaggguuugauagcacu

SEQ ID NO: 1974637 - RNA, 19 nt, Homo sapiens
ggccggaaaacaagccuga

SEQ ID NO: 1974638 - RNA, 13 nt, Homo sapiens
cuauauaccucac

SEQ ID NO: 1974639 - RNA, 16 nt, Homo sapiens
cuuuugauagauccac

SEQ ID NO: 1974640 - RNA, 14 nt, Homo sapiens
gaaaaccuagaucu

SEQ ID NO: 1974641 - RNA, 13 nt, Homo sapiens
gguccugcauuuc

SEQ ID NO: 1974642 - RNA, 19 nt, Homo sapiens
cacaggccugagauuucau

SEQ ID NO: 1974643 - RNA, 20 nt, Homo sapiens
acgacgggggcaggugcaag

SEQ ID NO: 1974644 - RNA, 20 nt, Homo sapiens
agcugagucucccuaaggca

SEQ ID NO: 1974645 - RNA, 15 nt, Homo sapiens
cucuuccuacccucc

SEQ ID NO: 1974646 - RNA, 21 nt, Homo sapiens
ucagagccucagcuucugggg

SEQ ID NO: 1974647 - RNA, 15 nt, Homo sapiens
aacaggcucugagau

SEQ ID NO: 1974648 - RNA, 20 nt, Homo sapiens
ccaaguuccuuggccaugca

SEQ ID NO: 1974649 - RNA, 20 nt, Homo sapiens
ugcaggguggauuguuacag

SEQ ID NO: 1974650 - RNA, 16 nt, Homo sapiens
ugcaaguguaucuccu

SEQ ID NO: 1974651 - RNA, 17 nt, Homo sapiens
cuaguggcucucaguua

SEQ ID NO: 1974652 - RNA, 15 nt, Homo sapiens
gagcacagcucagga

SEQ ID NO: 1974653 - RNA, 12 nt, Homo sapiens
cagugcucccuc

SEQ ID NO: 1974654 - RNA, 16 nt, Homo sapiens
ucccuauguugcuaua

SEQ ID NO: 1974655 - RNA, 22 nt, Homo sapiens
uacucuacagauuuuacaaaua

SEQ ID NO: 1974656 - RNA, 18 nt, Homo sapiens
cauacacguaaaugcaga

SEQ ID NO: 1974657 - RNA, 17 nt, Homo sapiens
gaggacaggaaaggccc

SEQ ID NO: 1974658 - RNA, 20 nt, Homo sapiens
gggagacaucaaaaccaccc

SEQ ID NO: 1974659 - RNA, 22 nt, Homo sapiens
gagaagccuucagcuccaggga

SEQ ID NO: 1974660 - RNA, 14 nt, Homo sapiens
aaggcuugccaaga

SEQ ID NO: 1974661 - RNA, 22 nt, Homo sapiens
acauauuugcacugaagcagaa

SEQ ID NO: 1974662 - RNA, 21 nt, Homo sapiens
uaucaaaaagcuaaugugcag

SEQ ID NO: 1974663 - RNA, 12 nt, Homo sapiens
agugcauucucc

SEQ ID NO: 1974664 - RNA, 17 nt, Homo sapiens
cucaagcaauccaagug

SEQ ID NO: 1974665 - RNA, 15 nt, Homo sapiens
accugcgcuguggac

SEQ ID NO: 1974666 - RNA, 16 nt, Homo sapiens
gaagagaagcugcuga

SEQ ID NO: 1974667 - RNA, 15 nt, Homo sapiens
uaguuguaucucuuu

SEQ ID NO: 1974668 - RNA, 12 nt, Homo sapiens
augacucugaga

SEQ ID NO: 1974669 - RNA, 23 nt, Homo sapiens
uggccaaagauuugagcacaaag

SEQ ID NO: 1974670 - RNA, 14 nt, Homo sapiens
uucaagagugcagu

SEQ ID NO: 1974671 - RNA, 13 nt, Homo sapiens
uccaagaauuuga

SEQ ID NO: 1974672 - RNA, 13 nt, Homo sapiens
cggggaguuuccg

SEQ ID NO: 1974673 - RNA, 20 nt, Homo sapiens
acuuuccccagaggaccaca

SEQ ID NO: 1974674 - RNA, 15 nt, Homo sapiens
guaaauccacaguga

SEQ ID NO: 1974675 - RNA, 17 nt, Homo sapiens
uaaagaaaauugccaaa

SEQ ID NO: 1974676 - RNA, 23 nt, Homo sapiens
gaagacacgcccgacucucucca

SEQ ID NO: 1974677 - RNA, 17 nt, Homo sapiens
caaggugaacaccacuu

SEQ ID NO: 1974678 - RNA, 15 nt, Homo sapiens
ggcuuccaucugccc

SEQ ID NO: 1974679 - RNA, 12 nt, Homo sapiens
uguaaauaaaua

SEQ ID NO: 1974680 - RNA, 12 nt, Homo sapiens
aacaaauaugca

SEQ ID NO: 1974681 - RNA, 19 nt, Homo sapiens
aucacacugggugguggcc

SEQ ID NO: 1974682 - RNA, 18 nt, Homo sapiens
ggcaugacuuugucccau

SEQ ID NO: 1974683 - RNA, 17 nt, Homo sapiens
ucacagaauagcacaaa

SEQ ID NO: 1974684 - RNA, 20 nt, Homo sapiens
accaagauggguggcaccaa

SEQ ID NO: 1974685 - RNA, 18 nt, Homo sapiens
ucuugaggggaccaggag

SEQ ID NO: 1974686 - RNA, 18 nt, Homo sapiens
cagucucccagauguugc

SEQ ID NO: 1974687 - RNA, 14 nt, Homo sapiens
cucauuucaucuca

SEQ ID NO: 1974688 - RNA, 15 nt, Homo sapiens
gggguucuuccucac

SEQ ID NO: 1974689 - RNA, 15 nt, Homo sapiens
aagugucuuuugaca

SEQ ID NO: 1974690 - RNA, 18 nt, Homo sapiens
ugcaugaauucacaaaca

SEQ ID NO: 1974691 - RNA, 21 nt, Homo sapiens
aguuguaacuuugccuucaca

SEQ ID NO: 1974692 - RNA, 14 nt, Homo sapiens
accuccuccaugca

SEQ ID NO: 1974693 - RNA, 19 nt, Homo sapiens
uuggacccauugccaguga

SEQ ID NO: 1974694 - RNA, 22 nt, Homo sapiens
ggaccccugaaacuggaccugc

SEQ ID NO: 1974695 - RNA, 20 nt, Homo sapiens
ucacugcuccaggccugcau

SEQ ID NO: 1974696 - RNA, 20 nt, Homo sapiens
aagagucaacauugauccag

SEQ ID NO: 1974697 - RNA, 13 nt, Homo sapiens
auagaguuccaaa

SEQ ID NO: 1974698 - RNA, 16 nt, Homo sapiens
gugagacacugcacag

SEQ ID NO: 1974699 - RNA, 14 nt, Homo sapiens
cuugucuucuggua

SEQ ID NO: 1974700 - RNA, 22 nt, Homo sapiens
aacacucaacaauaaagacuga

SEQ ID NO: 1974701 - RNA, 16 nt, Homo sapiens
uccugaugaaggcaga

SEQ ID NO: 1974702 - RNA, 22 nt, Homo sapiens
ucccgaagaaugaacccaagag

SEQ ID NO: 1974703 - RNA, 13 nt, Homo sapiens
ggacuauuuucuu

SEQ ID NO: 1974704 - RNA, 21 nt, Homo sapiens
cucuaugacauugauuggaau

SEQ ID NO: 1974705 - RNA, 19 nt, Homo sapiens
cugauaugcagaguauuuc

SEQ ID NO: 1974706 - RNA, 17 nt, Homo sapiens
aucagacuccugugcaa

SEQ ID NO: 1974707 - RNA, 18 nt, Homo sapiens
acacugguggaggagcug

SEQ ID NO: 1974708 - RNA, 15 nt, Homo sapiens
gcaaauguacuucuc

SEQ ID NO: 1974709 - RNA, 18 nt, Homo sapiens
gcacaccuguaaucccag

SEQ ID NO: 1974710 - RNA, 13 nt, Homo sapiens
uugggugugcuga

SEQ ID NO: 1974711 - RNA, 22 nt, Homo sapiens
gugggugcagcugucacagccc

SEQ ID NO: 1974712 - RNA, 21 nt, Homo sapiens
cccaggcuggucuugaacucc

SEQ ID NO: 1974713 - RNA, 23 nt, Homo sapiens
cuguuacgaugcaauucuagcca

SEQ ID NO: 1974714 - RNA, 16 nt, Homo sapiens
cuuagcuuuagaaaca

SEQ ID NO: 1974715 - RNA, 17 nt, Homo sapiens
aaaaccuguccuaugaa

SEQ ID NO: 1974716 - RNA, 21 nt, Homo sapiens
uccuguaggaagguacuguau

SEQ ID NO: 1974717 - RNA, 21 nt, Homo sapiens
caugagagaauuguaucauuu

SEQ ID NO: 1974718 - RNA, 14 nt, Homo sapiens
gaagaggaagcaag

SEQ ID NO: 1974719 - RNA, 23 nt, Homo sapiens
ccggaggucgaggcuacagugag

SEQ ID NO: 1974720 - RNA, 21 nt, Homo sapiens
cauuucuauuuauuuacugag

SEQ ID NO: 1974721 - RNA, 13 nt, Homo sapiens
aaaccccaucucu

SEQ ID NO: 1974722 - RNA, 17 nt, Homo sapiens
auuagaacuugaauacu

SEQ ID NO: 1974723 - RNA, 14 nt, Homo sapiens
uucagccaccucuc

SEQ ID NO: 1974724 - RNA, 19 nt, Homo sapiens
agucagcaacagagcaaaa

SEQ ID NO: 1974725 - RNA, 16 nt, Homo sapiens
guggagcugcuuccag

SEQ ID NO: 1974726 - RNA, 16 nt, Homo sapiens
gcacacuuuggcccag

SEQ ID NO: 1974727 - RNA, 15 nt, Homo sapiens
uuaucaucaccucaa

SEQ ID NO: 1974728 - RNA, 16 nt, Homo sapiens
ccuaaaucuccagugg

SEQ ID NO: 1974729 - RNA, 14 nt, Homo sapiens
gguagacugugaca

SEQ ID NO: 1974730 - RNA, 15 nt, Homo sapiens
uacaaauacuaucuc

SEQ ID NO: 1974731 - RNA, 17 nt, Homo sapiens
caaagguagggacugga

SEQ ID NO: 1974732 - RNA, 18 nt, Homo sapiens
aauauguuguuuaccuga

SEQ ID NO: 1974733 - RNA, 15 nt, Homo sapiens
gauauuaacugagaa

SEQ ID NO: 1974734 - RNA, 20 nt, Homo sapiens
cuaauaaacuuccaaacagg

SEQ ID NO: 1974735 - RNA, 20 nt, Homo sapiens
uggaagaugcagaagcaaua

SEQ ID NO: 1974736 - RNA, 21 nt, Homo sapiens
ggagccucgguggccaugcuu

SEQ ID NO: 1974737 - RNA, 15 nt, Homo sapiens
uggcuuaagccugug

SEQ ID NO: 1974738 - RNA, 20 nt, Homo sapiens
agagccauuuaacauuuccu

SEQ ID NO: 1974739 - RNA, 11 nt, Homo sapiens
uguguggugga

SEQ ID NO: 1974740 - RNA, 14 nt, Homo sapiens
uccuaaacauaauu

SEQ ID NO: 1974741 - RNA, 15 nt, Homo sapiens
ccaugacaccugcca

SEQ ID NO: 1974742 - RNA, 15 nt, Homo sapiens
ccucaccacagccuu

SEQ ID NO: 1974743 - RNA, 23 nt, Homo sapiens
ccccaaggaggcagccuggacca

SEQ ID NO: 1974744 - RNA, 22 nt, Homo sapiens
auuucauccuugaauccuaugu

SEQ ID NO: 1974745 - RNA, 13 nt, Homo sapiens
uauggaauaucau

SEQ ID NO: 1974746 - RNA, 12 nt, Homo sapiens
augugcacugaa

SEQ ID NO: 1974747 - RNA, 14 nt, Homo sapiens
cuccugacuguaac

SEQ ID NO: 1974748 - RNA, 12 nt, Homo sapiens
gaccacagccgg

SEQ ID NO: 1974749 - RNA, 15 nt, Homo sapiens
acagggugagcacuc

SEQ ID NO: 1974750 - RNA, 14 nt, Homo sapiens
ugaacugagccuag

SEQ ID NO: 1974751 - RNA, 22 nt, Homo sapiens
cuuccacgucuuccuccaagag

SEQ ID NO: 1974752 - RNA, 12 nt, Homo sapiens
ccugccaggcag

SEQ ID NO: 1974753 - RNA, 19 nt, Homo sapiens
ccauggguuaagagcucac

SEQ ID NO: 1974754 - RNA, 20 nt, Homo sapiens
agugccguagggaguaccug

SEQ ID NO: 1974755 - RNA, 20 nt, Homo sapiens
auuuguguagaaguccacag

SEQ ID NO: 1974756 - RNA, 22 nt, Homo sapiens
ggggaaauaauaaagaugcucu

SEQ ID NO: 1974757 - RNA, 13 nt, Homo sapiens
cugacucuugcag

SEQ ID NO: 1974758 - RNA, 18 nt, Homo sapiens
auguggcucagugccuuc

SEQ ID NO: 1974759 - RNA, 22 nt, Homo sapiens
gggccugcugcgucagaccagu

SEQ ID NO: 1974760 - RNA, 21 nt, Homo sapiens
gauucacaacuaggaccucau

SEQ ID NO: 1974761 - RNA, 22 nt, Homo sapiens
guuaaagcuuuggugccuggaa

SEQ ID NO: 1974762 - RNA, 20 nt, Homo sapiens
ugcuugugcacuggaugugg

SEQ ID NO: 1974763 - RNA, 14 nt, Homo sapiens
aggaagcacugaaa

SEQ ID NO: 1974764 - RNA, 23 nt, Homo sapiens
gcuucuuuucacuucagagcaca

SEQ ID NO: 1974765 - RNA, 11 nt, Homo sapiens
uugcacugggg

SEQ ID NO: 1974766 - RNA, 22 nt, Homo sapiens
ucuacaaaagugaaccaucuca

SEQ ID NO: 1974767 - RNA, 23 nt, Homo sapiens
acuucccuggguuagacugccag

SEQ ID NO: 1974768 - RNA, 23 nt, Homo sapiens
caggaggaggaggggagugcucu

SEQ ID NO: 1974769 - RNA, 21 nt, Homo sapiens
agcuggagaacaggauucuag

SEQ ID NO: 1974770 - RNA, 19 nt, Homo sapiens
gauaauaaaggcauuucaa

SEQ ID NO: 1974771 - RNA, 18 nt, Homo sapiens
acauuuuagaauacccca

SEQ ID NO: 1974772 - RNA, 19 nt, Homo sapiens
cacauucaugugggcauuu

SEQ ID NO: 1974773 - RNA, 23 nt, Homo sapiens
aaauuaaacgguaacauccaaaa

SEQ ID NO: 1974774 - RNA, 19 nt, Homo sapiens
agcaauuauugugccucag

SEQ ID NO: 1974775 - RNA, 16 nt, Homo sapiens
ucuaauguguggaaug

SEQ ID NO: 1974776 - RNA, 14 nt, Homo sapiens
ccaacaugugcuca

SEQ ID NO: 1974777 - RNA, 16 nt, Homo sapiens
agaaaaugaucugaau

SEQ ID NO: 1974778 - RNA, 23 nt, Homo sapiens
aucugaggaauucuguauagauu

SEQ ID NO: 1974779 - RNA, 20 nt, Homo sapiens
ucuguuacccgcagauccug

SEQ ID NO: 1974780 - RNA, 21 nt, Homo sapiens
ugcugcggguggguaucccac

SEQ ID NO: 1974781 - RNA, 18 nt, Homo sapiens
uaagcugccagccuuccc

SEQ ID NO: 1974782 - RNA, 23 nt, Homo sapiens
acaugcccaucccaguguccuag

SEQ ID NO: 1974783 - RNA, 18 nt, Homo sapiens
uuuagucugcauauauua

SEQ ID NO: 1974784 - RNA, 17 nt, Homo sapiens
ggccuuggucccagaca

SEQ ID NO: 1974785 - RNA, 22 nt, Homo sapiens
uuguuacauguaauauauuuca

SEQ ID NO: 1974786 - RNA, 17 nt, Homo sapiens
gcccccugugccagcuc

SEQ ID NO: 1974787 - RNA, 15 nt, Homo sapiens
ugucaccauugcaca

SEQ ID NO: 1974788 - RNA, 19 nt, Homo sapiens
ugugauaacuacucccagc

SEQ ID NO: 1974789 - RNA, 16 nt, Homo sapiens
ucuguacaaaguacua

SEQ ID NO: 1974790 - RNA, 17 nt, Homo sapiens
agagucaagcugaugaa

SEQ ID NO: 1974791 - RNA, 21 nt, Homo sapiens
guuauaugacuucuuguucau

SEQ ID NO: 1974792 - RNA, 17 nt, Homo sapiens
cagggauacccagugau

SEQ ID NO: 1974793 - RNA, 11 nt, Homo sapiens
aagugucuucu

SEQ ID NO: 1974794 - RNA, 23 nt, Homo sapiens
gcaagauacaacagcugccgacc

SEQ ID NO: 1974795 - RNA, 19 nt, Homo sapiens
ucuuuugagcuaaucuuca

SEQ ID NO: 1974796 - RNA, 19 nt, Homo sapiens
acucugccauccugauaca

SEQ ID NO: 1974797 - RNA, 15 nt, Homo sapiens
uccgccauucucaag

SEQ ID NO: 1974798 - RNA, 19 nt, Homo sapiens
caauuuucuguaagagaaa

SEQ ID NO: 1974799 - RNA, 18 nt, Homo sapiens
ggaguccucgacuuauca

SEQ ID NO: 1974800 - RNA, 17 nt, Homo sapiens
cauugauccagcucaga

SEQ ID NO: 1974801 - RNA, 19 nt, Homo sapiens
aaaugaauauucaacagcu

SEQ ID NO: 1974802 - RNA, 20 nt, Homo sapiens
uagcacaacugauaauauug

SEQ ID NO: 1974803 - RNA, 17 nt, Homo sapiens
uaaguuguaccaaaaca

SEQ ID NO: 1974804 - RNA, 22 nt, Homo sapiens
uagaggcaagaaagagauacca

SEQ ID NO: 1974805 - RNA, 18 nt, Homo sapiens
aucuaaaaagacuaaccu

SEQ ID NO: 1974806 - RNA, 14 nt, Homo sapiens
acuagaaggcuucu

SEQ ID NO: 1974807 - RNA, 17 nt, Homo sapiens
augacugagucuggcaa

SEQ ID NO: 1974808 - RNA, 19 nt, Homo sapiens
uugcaugaaagcacaaggu

SEQ ID NO: 1974809 - RNA, 14 nt, Homo sapiens
cuugucagacauaa

SEQ ID NO: 1974810 - RNA, 12 nt, Homo sapiens
acacaugugcug

SEQ ID NO: 1974811 - RNA, 17 nt, Homo sapiens
augaaaaauguguucca

SEQ ID NO: 1974812 - RNA, 17 nt, Homo sapiens
cggcaacaucaacccga

SEQ ID NO: 1974813 - RNA, 13 nt, Homo sapiens
gaucucaaguaua

SEQ ID NO: 1974814 - RNA, 20 nt, Homo sapiens
agccucccccugcugcucau

SEQ ID NO: 1974815 - RNA, 16 nt, Homo sapiens
gagaagcaauggguca

SEQ ID NO: 1974816 - RNA, 14 nt, Homo sapiens
uggccuuguaagac

SEQ ID NO: 1974817 - RNA, 14 nt, Homo sapiens
ggagagugcaacag

SEQ ID NO: 1974818 - RNA, 22 nt, Homo sapiens
aaauguacucagcuaucagcuc

SEQ ID NO: 1974819 - RNA, 20 nt, Homo sapiens
ccuagucuagcauucugcaa

SEQ ID NO: 1974820 - RNA, 18 nt, Homo sapiens
gacucagcggucauucua

SEQ ID NO: 1974821 - RNA, 23 nt, Homo sapiens
aggcucuggacagaugaauaccu

SEQ ID NO: 1974822 - RNA, 23 nt, Homo sapiens
aaacuaaucuuaacccugugcug

SEQ ID NO: 1974823 - RNA, 16 nt, Homo sapiens
aaagucacuuccccaa

SEQ ID NO: 1974824 - RNA, 17 nt, Homo sapiens
cugggcuucgggcuaug

SEQ ID NO: 1974825 - RNA, 22 nt, Homo sapiens
auguccgcccaccuagugcuuc

SEQ ID NO: 1974826 - RNA, 16 nt, Homo sapiens
ccagguuaccucacuu

SEQ ID NO: 1974827 - RNA, 17 nt, Homo sapiens
uuguagugagcccagau

SEQ ID NO: 1974828 - RNA, 19 nt, Homo sapiens
gccuccagugggaggacag

SEQ ID NO: 1974829 - RNA, 16 nt, Homo sapiens
aauccacccauguuau

SEQ ID NO: 1974830 - RNA, 22 nt, Homo sapiens
agacaggcacaaaaugugacau

SEQ ID NO: 1974831 - RNA, 20 nt, Homo sapiens
uggaaauucccuucaucugg

SEQ ID NO: 1974832 - RNA, 10 nt, Homo sapiens
uaaagccagc

SEQ ID NO: 1974833 - RNA, 20 nt, Homo sapiens
gauuaauggaaauguuuaca

SEQ ID NO: 1974834 - RNA, 18 nt, Homo sapiens
ccuauaucuauaaacacu

SEQ ID NO: 1974835 - RNA, 20 nt, Homo sapiens
ucauugcuaaccacugucug

SEQ ID NO: 1974836 - RNA, 22 nt, Homo sapiens
cugaggccuccagcuucaggca

SEQ ID NO: 1974837 - RNA, 22 nt, Homo sapiens
cauccagcugauacacaccuga

SEQ ID NO: 1974838 - RNA, 21 nt, Homo sapiens
ugaaaauggagaaagccacag

SEQ ID NO: 1974839 - RNA, 20 nt, Homo sapiens
gaccaaaugcuuuuccucaa

SEQ ID NO: 1974840 - RNA, 16 nt, Homo sapiens
uccuccacagugcugc

SEQ ID NO: 1974841 - RNA, 16 nt, Homo sapiens
uuuaccauuuguaaua

SEQ ID NO: 1974842 - RNA, 16 nt, Homo sapiens
uuuaaaauuuguccua

SEQ ID NO: 1974843 - RNA, 14 nt, Homo sapiens
cggcacacaaggca

SEQ ID NO: 1974844 - RNA, 23 nt, Homo sapiens
ggaaacagacaagcaacccaaac

SEQ ID NO: 1974845 - RNA, 23 nt, Homo sapiens
gucccccuaugcuccaguaugga

SEQ ID NO: 1974846 - RNA, 12 nt, Homo sapiens
gcuuugcaguga

SEQ ID NO: 1974847 - RNA, 20 nt, Homo sapiens
uguaacagauaucagugucu

SEQ ID NO: 1974848 - RNA, 13 nt, Homo sapiens
aaagaaaugcacu

SEQ ID NO: 1974849 - RNA, 22 nt, Homo sapiens
uggggcgggggucuauacauuc

SEQ ID NO: 1974850 - RNA, 16 nt, Homo sapiens
uuguaaaaaugucuuu

SEQ ID NO: 1974851 - RNA, 20 nt, Homo sapiens
acaucuuuagugucugagcu

SEQ ID NO: 1974852 - RNA, 14 nt, Homo sapiens
agggccacauggga

SEQ ID NO: 1974853 - RNA, 15 nt, Homo sapiens
uacuauucaaaaccu

SEQ ID NO: 1974854 - RNA, 17 nt, Homo sapiens
aaugcaucaauccugug

SEQ ID NO: 1974855 - RNA, 16 nt, Homo sapiens
guucuugggagggaau

SEQ ID NO: 1974856 - RNA, 20 nt, Homo sapiens
agagagggccuuuccuggcu

SEQ ID NO: 1974857 - RNA, 13 nt, Homo sapiens
gaauacuggccau

SEQ ID NO: 1974858 - RNA, 15 nt, Homo sapiens
uucuccagacagggu

SEQ ID NO: 1974859 - RNA, 12 nt, Homo sapiens
aaaauauuuagu

SEQ ID NO: 1974860 - RNA, 20 nt, Homo sapiens
agcaggggaguaugcaaaag

SEQ ID NO: 1974861 - RNA, 22 nt, Homo sapiens
ccaucauaauucuaaucuaaca

SEQ ID NO: 1974862 - RNA, 20 nt, Homo sapiens
uucccagcagugggggucag

SEQ ID NO: 1974863 - RNA, 20 nt, Homo sapiens
aaugauuuguguccauuuca

SEQ ID NO: 1974864 - RNA, 19 nt, Homo sapiens
acuccaggggggacaauau

SEQ ID NO: 1974865 - RNA, 19 nt, Homo sapiens
acuaaaguaguugaaacaa

SEQ ID NO: 1974866 - RNA, 15 nt, Homo sapiens
caacagaaaccagaa

SEQ ID NO: 1974867 - RNA, 21 nt, Homo sapiens
cgcccaggaugaaggggccag

SEQ ID NO: 1974868 - RNA, 17 nt, Homo sapiens
ggacagacccagggugg

SEQ ID NO: 1974869 - RNA, 16 nt, Homo sapiens
aggacaauacuggggu

SEQ ID NO: 1974870 - RNA, 17 nt, Homo sapiens
cccacuucugcacuugc

SEQ ID NO: 1974871 - RNA, 15 nt, Homo sapiens
ugaagauagccagag

SEQ ID NO: 1974872 - RNA, 14 nt, Homo sapiens
ucugcaucauccuc

SEQ ID NO: 1974873 - RNA, 20 nt, Homo sapiens
ggugcuggggagccaaaggc

SEQ ID NO: 1974874 - RNA, 17 nt, Homo sapiens
augcuuucacuucccac

SEQ ID NO: 1974875 - RNA, 19 nt, Homo sapiens
acuugucccgggacaccua

SEQ ID NO: 1974876 - RNA, 15 nt, Homo sapiens
uccugucguccugcc

SEQ ID NO: 1974877 - RNA, 14 nt, Homo sapiens
acuuugaaucaaaa

SEQ ID NO: 1974878 - RNA, 19 nt, Homo sapiens
uauuugcauguuaccuccu

SEQ ID NO: 1974879 - RNA, 12 nt, Homo sapiens
guaccccaugac

SEQ ID NO: 1974880 - RNA, 22 nt, Homo sapiens
agauuauuuuuaaauaauuuaa

SEQ ID NO: 1974881 - RNA, 19 nt, Homo sapiens
aaucagagaaaacuguuga

SEQ ID NO: 1974882 - RNA, 18 nt, Homo sapiens
guccugugaggacagcug

SEQ ID NO: 1974883 - RNA, 16 nt, Homo sapiens
gugugggggucuggga

SEQ ID NO: 1974884 - RNA, 16 nt, Homo sapiens
cacacacgcagacaca

SEQ ID NO: 1974885 - RNA, 18 nt, Homo sapiens
ugggaaacugcuuuucca

SEQ ID NO: 1974886 - RNA, 13 nt, Homo sapiens
gcagccucaggag

SEQ ID NO: 1974887 - RNA, 17 nt, Homo sapiens
guuaaagcauaugcuau

SEQ ID NO: 1974888 - RNA, 10 nt, Homo sapiens
guuaccuaau

SEQ ID NO: 1974889 - RNA, 17 nt, Homo sapiens
uguccaagcuauguauu

SEQ ID NO: 1974890 - RNA, 16 nt, Homo sapiens
uugcuuuacagcacug

SEQ ID NO: 1974891 - RNA, 22 nt, Homo sapiens
aaaaaccucuaugcaaucugag

SEQ ID NO: 1974892 - RNA, 14 nt, Homo sapiens
gguccugggggccu

SEQ ID NO: 1974893 - RNA, 18 nt, Homo sapiens
aucccaagcccugcauug

SEQ ID NO: 1974894 - RNA, 23 nt, Homo sapiens
aaacaugugguuaaugccaugga

SEQ ID NO: 1974895 - RNA, 14 nt, Homo sapiens
cacaguauuaucug

SEQ ID NO: 1974896 - RNA, 14 nt, Homo sapiens
gucauuuauggguu

SEQ ID NO: 1974897 - RNA, 13 nt, Homo sapiens
aaauuuaugugau

SEQ ID NO: 1974898 - RNA, 21 nt, Homo sapiens
accaaggcagugcaugcaugu

SEQ ID NO: 1974899 - RNA, 11 nt, Homo sapiens
ccagacauucu

SEQ ID NO: 1974900 - RNA, 19 nt, Homo sapiens
aaaaugguggcuucagcuc

SEQ ID NO: 1974901 - RNA, 16 nt, Homo sapiens
ugggagucauggacau

SEQ ID NO: 1974902 - RNA, 12 nt, Homo sapiens
uaaguugcagaa

SEQ ID NO: 1974903 - RNA, 12 nt, Homo sapiens
uauauugcagug

SEQ ID NO: 1974904 - RNA, 12 nt, Homo sapiens
cacuaugccuga

SEQ ID NO: 1974905 - RNA, 18 nt, Homo sapiens
aaaguuuucugcuguaaa

SEQ ID NO: 1974906 - RNA, 12 nt, Homo sapiens
ugcccuaauuag

SEQ ID NO: 1974907 - RNA, 13 nt, Homo sapiens
ucccuaacaucau

SEQ ID NO: 1974908 - RNA, 13 nt, Homo sapiens
ugaauugccaggg

SEQ ID NO: 1974909 - RNA, 20 nt, Homo sapiens
caaggaauggaaucuucucc

SEQ ID NO: 1974910 - RNA, 15 nt, Homo sapiens
cgguucgcauuauca

SEQ ID NO: 1974911 - RNA, 18 nt, Homo sapiens
gccaaaccacaagacucu

SEQ ID NO: 1974912 - RNA, 11 nt, Homo sapiens
guaaggcagua

SEQ ID NO: 1974913 - RNA, 18 nt, Homo sapiens
ugguaauuuuugcuuuuu

SEQ ID NO: 1974914 - RNA, 23 nt, Homo sapiens
cuuaggugugagguccaggguug

SEQ ID NO: 1974915 - RNA, 20 nt, Homo sapiens
acuaaguugcaagaucuuau

SEQ ID NO: 1974916 - RNA, 18 nt, Homo sapiens
uugaucuuccucugcuaa

SEQ ID NO: 1974917 - RNA, 21 nt, Homo sapiens
augcgaaauguucucaugaac

SEQ ID NO: 1974918 - RNA, 21 nt, Homo sapiens
ugcuuauaauaaagaaaaccu

SEQ ID NO: 1974919 - RNA, 19 nt, Homo sapiens
uguccaccaugcucucuca

SEQ ID NO: 1974920 - RNA, 14 nt, Homo sapiens
ugcuugcaguaauu

SEQ ID NO: 1974921 - RNA, 17 nt, Homo sapiens
aaugcugcugcugagac

SEQ ID NO: 1974922 - RNA, 21 nt, Homo sapiens
uccgcugucacccagcaaggc

SEQ ID NO: 1974923 - RNA, 19 nt, Homo sapiens
ucccucuggccggacagaa

SEQ ID NO: 1974924 - RNA, 14 nt, Homo sapiens
uuacaggcaugugc

SEQ ID NO: 1974925 - RNA, 23 nt, Homo sapiens
gggcaaaagacgggaagcaagau

SEQ ID NO: 1974926 - RNA, 16 nt, Homo sapiens
uaaugacagccuugca

SEQ ID NO: 1974927 - RNA, 16 nt, Homo sapiens
acuccagagacaggga

SEQ ID NO: 1974928 - RNA, 14 nt, Homo sapiens
agccccaauucgau

SEQ ID NO: 1974929 - RNA, 20 nt, Homo sapiens
auaauaguuuugagcauucu

SEQ ID NO: 1974930 - RNA, 18 nt, Homo sapiens
uggguccugaagcccucu

SEQ ID NO: 1974931 - RNA, 23 nt, Homo sapiens
acuucuucuucuuuuuguuaaca

SEQ ID NO: 1974932 - RNA, 21 nt, Homo sapiens
acccuggugaccuccugucac

SEQ ID NO: 1974933 - RNA, 16 nt, Homo sapiens
ucugaauagugucacc

SEQ ID NO: 1974934 - RNA, 19 nt, Homo sapiens
aggccucucucaggagcag

SEQ ID NO: 1974935 - RNA, 19 nt, Homo sapiens
ugaguucucauccacagag

SEQ ID NO: 1974936 - RNA, 20 nt, Homo sapiens
caaggcuuaggaaagugaua

SEQ ID NO: 1974937 - RNA, 23 nt, Homo sapiens
uacuaguggcauggagaaugcac

SEQ ID NO: 1974938 - RNA, 14 nt, Homo sapiens
ugcuccaaggcagu

SEQ ID NO: 1974939 - RNA, 19 nt, Homo sapiens
agcccagcucuugcucucu

SEQ ID NO: 1974940 - RNA, 14 nt, Homo sapiens
ugagaaacaucuag

SEQ ID NO: 1974941 - RNA, 16 nt, Homo sapiens
uaugccaagagugcac

SEQ ID NO: 1974942 - RNA, 13 nt, Homo sapiens
ugagaacaaagau

SEQ ID NO: 1974943 - RNA, 12 nt, Homo sapiens
cucugacaugac

SEQ ID NO: 1974944 - RNA, 15 nt, Homo sapiens
agaacuaucugcauu

SEQ ID NO: 1974945 - RNA, 14 nt, Homo sapiens
acaugccacuauga

SEQ ID NO: 1974946 - RNA, 18 nt, Homo sapiens
uuauguaguaauugacau

SEQ ID NO: 1974947 - RNA, 15 nt, Homo sapiens
aggcuaaaaagcaac

SEQ ID NO: 1974948 - RNA, 18 nt, Homo sapiens
gaaaugcuaugacuguau

SEQ ID NO: 1974949 - RNA, 12 nt, Homo sapiens
uuaauuacauaa

SEQ ID NO: 1974950 - RNA, 23 nt, Homo sapiens
aagcaccuagccucgcucuuggc

SEQ ID NO: 1974951 - RNA, 12 nt, Homo sapiens
uaacuuacaaac

SEQ ID NO: 1974952 - RNA, 22 nt, Homo sapiens
aaccgaagggacuggaucugca

SEQ ID NO: 1974953 - RNA, 18 nt, Homo sapiens
aggcaugagccaccacgc

SEQ ID NO: 1974954 - RNA, 17 nt, Homo sapiens
aaacucaccuugucuca

SEQ ID NO: 1974955 - RNA, 14 nt, Homo sapiens
agacaagugcucaa

SEQ ID NO: 1974956 - RNA, 14 nt, Homo sapiens
cuuggcaaaagccu

SEQ ID NO: 1974957 - RNA, 16 nt, Homo sapiens
auauggugggcacaga

SEQ ID NO: 1974958 - RNA, 17 nt, Homo sapiens
gaucaaccaaguuacac

SEQ ID NO: 1974959 - RNA, 16 nt, Homo sapiens
ccauaucaugcuaaaa

SEQ ID NO: 1974960 - RNA, 22 nt, Homo sapiens
auaaucuuggcaauuuuugaca

SEQ ID NO: 1974961 - RNA, 18 nt, Homo sapiens
cugggcucgucuuugcag

SEQ ID NO: 1974962 - RNA, 13 nt, Homo sapiens
ggggccaccuccu

SEQ ID NO: 1974963 - RNA, 11 nt, Homo sapiens
gcagugcaaca

SEQ ID NO: 1974964 - RNA, 11 nt, Homo sapiens
auggugcagug

SEQ ID NO: 1974965 - RNA, 18 nt, Homo sapiens
cuucccugcagagcuuug

SEQ ID NO: 1974966 - RNA, 20 nt, Homo sapiens
gacaggggcgugggauugaa

SEQ ID NO: 1974967 - RNA, 21 nt, Homo sapiens
cguguggaugagcgugcacuc

SEQ ID NO: 1974968 - RNA, 20 nt, Homo sapiens
aagcaguuacuaauaugccu

SEQ ID NO: 1974969 - RNA, 20 nt, Homo sapiens
aaauauuaacugacgaagaa

SEQ ID NO: 1974970 - RNA, 13 nt, Homo sapiens
acuggauguacca

SEQ ID NO: 1974971 - RNA, 11 nt, Homo sapiens
aaauacuacac

SEQ ID NO: 1974972 - RNA, 18 nt, Homo sapiens
uagauguuuccuugccuu

SEQ ID NO: 1974973 - RNA, 14 nt, Homo sapiens
uaauuaauuuccaa

SEQ ID NO: 1974974 - RNA, 19 nt, Homo sapiens
gauuuuaaaaagucuucac

SEQ ID NO: 1974975 - RNA, 15 nt, Homo sapiens
uguaacgcugccacu

SEQ ID NO: 1974976 - RNA, 20 nt, Homo sapiens
agaaugaaccaauaugaacu

SEQ ID NO: 1974977 - RNA, 15 nt, Homo sapiens
ccucagacuagcuuu

SEQ ID NO: 1974978 - RNA, 20 nt, Homo sapiens
ggaaucagggaccagcuuua

SEQ ID NO: 1974979 - RNA, 23 nt, Homo sapiens
guuagcugaaccgacacucaaaa

SEQ ID NO: 1974980 - RNA, 19 nt, Homo sapiens
uggacagguguuguauaua

SEQ ID NO: 1974981 - RNA, 18 nt, Homo sapiens
acaucuuucccuaaagaa

SEQ ID NO: 1974982 - RNA, 17 nt, Homo sapiens
gauaaacuaacuacugu

SEQ ID NO: 1974983 - RNA, 19 nt, Homo sapiens
uuacacugugucauucugu

SEQ ID NO: 1974984 - RNA, 17 nt, Homo sapiens
aaggccagcccacuggg

SEQ ID NO: 1974985 - RNA, 21 nt, Homo sapiens
agaaagugcauuaaacugaau

SEQ ID NO: 1974986 - RNA, 21 nt, Homo sapiens
acuuucuguacuaaacauuuc

SEQ ID NO: 1974987 - RNA, 20 nt, Homo sapiens
gagaucgcgccauugcacuc

SEQ ID NO: 1974988 - RNA, 20 nt, Homo sapiens
aagaucgcaccauugcacuc

SEQ ID NO: 1974989 - RNA, 14 nt, Homo sapiens
aauagcaucuagua

SEQ ID NO: 1974990 - RNA, 23 nt, Homo sapiens
cauuggcaaguguaaaaagauga

SEQ ID NO: 1974991 - RNA, 14 nt, Homo sapiens
aaugcaccacuuuu

SEQ ID NO: 1974992 - RNA, 19 nt, Homo sapiens
auuuucagugcuuugcccu

SEQ ID NO: 1974993 - RNA, 13 nt, Homo sapiens
cuacuaaggggcu

SEQ ID NO: 1974994 - RNA, 18 nt, Homo sapiens
cagcaucugccaggacac

SEQ ID NO: 1974995 - RNA, 22 nt, Homo sapiens
ggcuggacuggaggugggcaug

SEQ ID NO: 1974996 - RNA, 12 nt, Homo sapiens
cugcuguguagc

SEQ ID NO: 1974997 - RNA, 12 nt, Homo sapiens
agaagcugccau

SEQ ID NO: 1974998 - RNA, 17 nt, Homo sapiens
gacacgugauggaccaa

SEQ ID NO: 1974999 - RNA, 13 nt, Homo sapiens
aaaaccugugauu

SEQ ID NO: 1975000 - RNA, 18 nt, Homo sapiens
ccccaaaggaaacuacuc

SEQ ID NO: 1975001 - RNA, 14 nt, Homo sapiens
cucauucugucacc

SEQ ID NO: 1975002 - RNA, 11 nt, Homo sapiens
uagcuuuucau

SEQ ID NO: 1975003 - RNA, 23 nt, Homo sapiens
uuauaccuugccuguaguccagu

SEQ ID NO: 1975004 - RNA, 14 nt, Homo sapiens
uaaugauagucuua

SEQ ID NO: 1975005 - RNA, 22 nt, Homo sapiens
aguaaugcaagcaaaguaucaa

SEQ ID NO: 1975006 - RNA, 20 nt, Homo sapiens
gaacugcuggauucaaguga

SEQ ID NO: 1975007 - RNA, 16 nt, Homo sapiens
acaccucccugugaag

SEQ ID NO: 1975008 - RNA, 13 nt, Homo sapiens
auggaucugcaua

SEQ ID NO: 1975009 - RNA, 16 nt, Homo sapiens
agcaacuaggaaaauc

SEQ ID NO: 1975010 - RNA, 22 nt, Homo sapiens
auguguucggguuaagugauga

SEQ ID NO: 1975011 - RNA, 13 nt, Homo sapiens
acugccaugccuc

SEQ ID NO: 1975012 - RNA, 18 nt, Homo sapiens
auacauacacuuguauaa

SEQ ID NO: 1975013 - RNA, 21 nt, Homo sapiens
agcaaguuugaagagaccaca

SEQ ID NO: 1975014 - RNA, 14 nt, Homo sapiens
cucuuaauguugcu

SEQ ID NO: 1975015 - RNA, 19 nt, Homo sapiens
cuaacuggacaugaaggaa

SEQ ID NO: 1975016 - RNA, 21 nt, Homo sapiens
uaucauuuuaaaaacuuuauu

SEQ ID NO: 1975017 - RNA, 15 nt, Homo sapiens
gccugggcauccuca

SEQ ID NO: 1975018 - RNA, 20 nt, Homo sapiens
uggcagagaagaugaaauuu

SEQ ID NO: 1975019 - RNA, 20 nt, Homo sapiens
uaagccacucuuccaaaggc

SEQ ID NO: 1975020 - RNA, 16 nt, Homo sapiens
acucaggcugcuccuu

SEQ ID NO: 1975021 - RNA, 14 nt, Homo sapiens
uaaaagauucauuu

SEQ ID NO: 1975022 - RNA, 22 nt, Homo sapiens
cugggaaccucccagaggucca

SEQ ID NO: 1975023 - RNA, 15 nt, Homo sapiens
uacuucccaguauaa

SEQ ID NO: 1975024 - RNA, 16 nt, Homo sapiens
gaauagcauuugccac

SEQ ID NO: 1975025 - RNA, 14 nt, Homo sapiens
acauagcugugcua

SEQ ID NO: 1975026 - RNA, 18 nt, Homo sapiens
ccacgugacuuucaacaa

SEQ ID NO: 1975027 - RNA, 17 nt, Homo sapiens
uaugaccuaaauccauu

SEQ ID NO: 1975028 - RNA, 20 nt, Homo sapiens
auuucuagcagugaugaaaa

SEQ ID NO: 1975029 - RNA, 16 nt, Homo sapiens
guuugcuuagcauucc

SEQ ID NO: 1975030 - RNA, 15 nt, Homo sapiens
aacccccaacccaaa

SEQ ID NO: 1975031 - RNA, 22 nt, Homo sapiens
uccagcacacacacauaagcac

SEQ ID NO: 1975032 - RNA, 20 nt, Homo sapiens
acugagcagacuggugagca

SEQ ID NO: 1975033 - RNA, 20 nt, Homo sapiens
ccucccccaccuucaagcac

SEQ ID NO: 1975034 - RNA, 19 nt, Homo sapiens
accuugggaagauguauca

SEQ ID NO: 1975035 - RNA, 12 nt, Homo sapiens
guuaacaauauu

SEQ ID NO: 1975036 - RNA, 14 nt, Homo sapiens
caaauguuuaguga

SEQ ID NO: 1975037 - RNA, 15 nt, Homo sapiens
auccuagucauucuu

SEQ ID NO: 1975038 - RNA, 23 nt, Homo sapiens
cuguaacagcggcaggguguccc

SEQ ID NO: 1975039 - RNA, 16 nt, Homo sapiens
acuuuguaaauucuga

SEQ ID NO: 1975040 - RNA, 16 nt, Homo sapiens
agagggucacaguguu

SEQ ID NO: 1975041 - RNA, 19 nt, Homo sapiens
caugugugugguggugacu

SEQ ID NO: 1975042 - RNA, 17 nt, Homo sapiens
auaaaguugcugugaau

SEQ ID NO: 1975043 - RNA, 19 nt, Homo sapiens
gaauuguuuuuguacaguu

SEQ ID NO: 1975044 - RNA, 14 nt, Homo sapiens
ugcgagggccacag

SEQ ID NO: 1975045 - RNA, 15 nt, Homo sapiens
auucuucucacaucc

SEQ ID NO: 1975046 - RNA, 13 nt, Homo sapiens
guuuaauguuaau

SEQ ID NO: 1975047 - RNA, 13 nt, Homo sapiens
gguauaugugaua

SEQ ID NO: 1975048 - RNA, 23 nt, Homo sapiens
aacccucugcuucuccuucaaaa

SEQ ID NO: 1975049 - RNA, 12 nt, Homo sapiens
ucuuggugcugu

SEQ ID NO: 1975050 - RNA, 16 nt, Homo sapiens
agggaacacauuccuu

SEQ ID NO: 1975051 - RNA, 22 nt, Homo sapiens
aaaggagccugugaacccagga

SEQ ID NO: 1975052 - RNA, 10 nt, Homo sapiens
ucaagaaugc

SEQ ID NO: 1975053 - RNA, 14 nt, Homo sapiens
auaaaauaugagga

SEQ ID NO: 1975054 - RNA, 16 nt, Homo sapiens
ggggccacguggaugg

SEQ ID NO: 1975055 - RNA, 21 nt, Homo sapiens
acugcuuuuuccuuagcuuaa

SEQ ID NO: 1975056 - RNA, 23 nt, Homo sapiens
ccccuggcuccagagauggucac

SEQ ID NO: 1975057 - RNA, 21 nt, Homo sapiens
agaugaacccgaggcugagaa

SEQ ID NO: 1975058 - RNA, 13 nt, Homo sapiens
auuaaugcuaaau

SEQ ID NO: 1975059 - RNA, 16 nt, Homo sapiens
ccaaagacuacacugu

SEQ ID NO: 1975060 - RNA, 17 nt, Homo sapiens
uaugucucuagcaguga

SEQ ID NO: 1975061 - RNA, 16 nt, Homo sapiens
cagacuuugcugcauu

SEQ ID NO: 1975062 - RNA, 22 nt, Homo sapiens
acauauuucuugaguaauuuaa

SEQ ID NO: 1975063 - RNA, 16 nt, Homo sapiens
ccagggugguggugca

SEQ ID NO: 1975064 - RNA, 16 nt, Homo sapiens
agaaccaaaacuucca

SEQ ID NO: 1975065 - RNA, 12 nt, Homo sapiens
uuauguuccuca

SEQ ID NO: 1975066 - RNA, 14 nt, Homo sapiens
acauaacuccaucu

SEQ ID NO: 1975067 - RNA, 15 nt, Homo sapiens
auggguacuccagca

SEQ ID NO: 1975068 - RNA, 22 nt, Homo sapiens
caugagauuuauaagguuuuaa

SEQ ID NO: 1975069 - RNA, 18 nt, Homo sapiens
uggacaaaauugcagaua

SEQ ID NO: 1975070 - RNA, 18 nt, Homo sapiens
aguccauaacuuaccucu

SEQ ID NO: 1975071 - RNA, 18 nt, Homo sapiens
aagaauguuaagauuuau

SEQ ID NO: 1975072 - RNA, 16 nt, Homo sapiens
uggugugugccuguag

SEQ ID NO: 1975073 - RNA, 17 nt, Homo sapiens
uccuaguuccaccauca

SEQ ID NO: 1975074 - RNA, 16 nt, Homo sapiens
uagagcuuagcauauc

SEQ ID NO: 1975075 - RNA, 20 nt, Homo sapiens
cccagcucaggggcagcuca

SEQ ID NO: 1975076 - RNA, 18 nt, Homo sapiens
agagcaguggccaggcca

SEQ ID NO: 1975077 - RNA, 17 nt, Homo sapiens
cuguguggcugugcaau

SEQ ID NO: 1975078 - RNA, 16 nt, Homo sapiens
agucagaaaccaaagu

SEQ ID NO: 1975079 - RNA, 19 nt, Homo sapiens
ugaaugacuugacuucaaa

SEQ ID NO: 1975080 - RNA, 14 nt, Homo sapiens
guggaugaucucaa

SEQ ID NO: 1975081 - RNA, 16 nt, Homo sapiens
ugccucuccugggaca

SEQ ID NO: 1975082 - RNA, 18 nt, Homo sapiens
acuacaggagaugcuguc

SEQ ID NO: 1975083 - RNA, 14 nt, Homo sapiens
uuauccugacacau

SEQ ID NO: 1975084 - RNA, 23 nt, Homo sapiens
uggaagguggggacagggaugag

SEQ ID NO: 1975085 - RNA, 19 nt, Homo sapiens
ggccagcaagcucuucacu

SEQ ID NO: 1975086 - RNA, 23 nt, Homo sapiens
auugagcgcuauggguguuaacg

SEQ ID NO: 1975087 - RNA, 21 nt, Homo sapiens
cauacacacuguugucaaaaa

SEQ ID NO: 1975088 - RNA, 20 nt, Homo sapiens
acugaaauauuuucuaggaa

SEQ ID NO: 1975089 - RNA, 19 nt, Homo sapiens
acagcuauuagaacuaaua

SEQ ID NO: 1975090 - RNA, 15 nt, Homo sapiens
accccucaccuugca

SEQ ID NO: 1975091 - RNA, 18 nt, Homo sapiens
aacauuugcugccauuac

SEQ ID NO: 1975092 - RNA, 14 nt, Homo sapiens
cuuaauuugcacag

SEQ ID NO: 1975093 - RNA, 20 nt, Homo sapiens
auagagucaucaauguauuu

SEQ ID NO: 1975094 - RNA, 15 nt, Homo sapiens
augauuaacaaagca

SEQ ID NO: 1975095 - RNA, 16 nt, Homo sapiens
uguacaccccaggaca

SEQ ID NO: 1975096 - RNA, 19 nt, Homo sapiens
acccuuccccacugcacac

SEQ ID NO: 1975097 - RNA, 21 nt, Homo sapiens
ccugagaaugaccugcccugg

SEQ ID NO: 1975098 - RNA, 22 nt, Homo sapiens
ucaugcuuaauaaacaugucac

SEQ ID NO: 1975099 - RNA, 15 nt, Homo sapiens
acacaggucccugag

SEQ ID NO: 1975100 - RNA, 14 nt, Homo sapiens
ucccacuccugcug

SEQ ID NO: 1975101 - RNA, 18 nt, Homo sapiens
caagggaauauugccaau

SEQ ID NO: 1975102 - RNA, 20 nt, Homo sapiens
cuuauucucuguaggccaaa

SEQ ID NO: 1975103 - RNA, 20 nt, Homo sapiens
uagaagaaaguaaacuguaa

SEQ ID NO: 1975104 - RNA, 17 nt, Homo sapiens
aaaguaguuugaucuaa

SEQ ID NO: 1975105 - RNA, 17 nt, Homo sapiens
agcaacugucuauuucu

SEQ ID NO: 1975106 - RNA, 18 nt, Homo sapiens
cauaugugcuacccacaa

SEQ ID NO: 1975107 - RNA, 13 nt, Homo sapiens
ugugccaaccugu

SEQ ID NO: 1975108 - RNA, 13 nt, Homo sapiens
cgucucaaucucc

SEQ ID NO: 1975109 - RNA, 15 nt, Homo sapiens
auuagaagucuuuca

SEQ ID NO: 1975110 - RNA, 17 nt, Homo sapiens
cugccuacuccaaaaug

SEQ ID NO: 1975111 - RNA, 16 nt, Homo sapiens
aaaucucaaaacugua

SEQ ID NO: 1975112 - RNA, 23 nt, Homo sapiens
cuuaaauauuguaauaugacaga

SEQ ID NO: 1975113 - RNA, 18 nt, Homo sapiens
guagagguuuuguuguuu

SEQ ID NO: 1975114 - RNA, 14 nt, Homo sapiens
uacaggcacaggcc

SEQ ID NO: 1975115 - RNA, 17 nt, Homo sapiens
gcauuuguguagcugag

SEQ ID NO: 1975116 - RNA, 22 nt, Homo sapiens
ugguggcucuucagaggagcau

SEQ ID NO: 1975117 - RNA, 23 nt, Homo sapiens
uaucuguuuccuguucucuugua

SEQ ID NO: 1975118 - RNA, 18 nt, Homo sapiens
uaggaaugguucucucaa

SEQ ID NO: 1975119 - RNA, 21 nt, Homo sapiens
cccgguggcggccccagcacc

SEQ ID NO: 1975120 - RNA, 20 nt, Homo sapiens
aagguaccaaaaaaauccau

SEQ ID NO: 1975121 - RNA, 16 nt, Homo sapiens
gaccuacucuugccug

SEQ ID NO: 1975122 - RNA, 13 nt, Homo sapiens
ugccuuuugcaac

SEQ ID NO: 1975123 - RNA, 22 nt, Homo sapiens
auauucacaauggaaacuuuag

SEQ ID NO: 1975124 - RNA, 14 nt, Homo sapiens
cagcaucugggacu

SEQ ID NO: 1975125 - RNA, 20 nt, Homo sapiens
uaaccucugaggaccucagc

SEQ ID NO: 1975126 - RNA, 18 nt, Homo sapiens
accagcaggagguucugg

SEQ ID NO: 1975127 - RNA, 16 nt, Homo sapiens
agcgggugggaaccaa

SEQ ID NO: 1975128 - RNA, 20 nt, Homo sapiens
caggugacugccaccgugcc

SEQ ID NO: 1975129 - RNA, 19 nt, Homo sapiens
auguagcuucagucauuaa

SEQ ID NO: 1975130 - RNA, 17 nt, Homo sapiens
gacagaugaaugccgug

SEQ ID NO: 1975131 - RNA, 22 nt, Homo sapiens
cauagaacuggguaaaugcaaa

SEQ ID NO: 1975132 - RNA, 20 nt, Homo sapiens
aaagaaggugccgauuucau

SEQ ID NO: 1975133 - RNA, 15 nt, Homo sapiens
cuuugucucaccuca

SEQ ID NO: 1975134 - RNA, 15 nt, Homo sapiens
guacacugugucucu

SEQ ID NO: 1975135 - RNA, 19 nt, Homo sapiens
aggagauuuuccuuccuac

SEQ ID NO: 1975136 - RNA, 16 nt, Homo sapiens
cugggcagacugcaaa

SEQ ID NO: 1975137 - RNA, 16 nt, Homo sapiens
uaucaagugucuucca

SEQ ID NO: 1975138 - RNA, 18 nt, Homo sapiens
cacucacccaacaauccc

SEQ ID NO: 1975139 - RNA, 16 nt, Homo sapiens
auuaucaacagcauuu

SEQ ID NO: 1975140 - RNA, 15 nt, Homo sapiens
aauaagguacaagaa

SEQ ID NO: 1975141 - RNA, 13 nt, Homo sapiens
aaaggacucugcu

SEQ ID NO: 1975142 - RNA, 14 nt, Homo sapiens
uccugaauccuuuu

SEQ ID NO: 1975143 - RNA, 15 nt, Homo sapiens
cauuuauguacaaaa

SEQ ID NO: 1975144 - RNA, 14 nt, Homo sapiens
guaucguggagaaa

SEQ ID NO: 1975145 - RNA, 20 nt, Homo sapiens
uggaacaccuuggggucccu

SEQ ID NO: 1975146 - RNA, 15 nt, Homo sapiens
aacaucccugagaaa

SEQ ID NO: 1975147 - RNA, 11 nt, Homo sapiens
ccuaaagccag

SEQ ID NO: 1975148 - RNA, 17 nt, Homo sapiens
uccucuauaauuaguua

SEQ ID NO: 1975149 - RNA, 19 nt, Homo sapiens
ucccagcgagggacaccga

SEQ ID NO: 1975150 - RNA, 14 nt, Homo sapiens
auuucacaagcuau

SEQ ID NO: 1975151 - RNA, 16 nt, Homo sapiens
acaucuuauuuacuug

SEQ ID NO: 1975152 - RNA, 20 nt, Homo sapiens
gugggaggguaccagcagaa

SEQ ID NO: 1975153 - RNA, 17 nt, Homo sapiens
cuccaugagugcagcuc

SEQ ID NO: 1975154 - RNA, 13 nt, Homo sapiens
caaaggaaaaagu

SEQ ID NO: 1975155 - RNA, 12 nt, Homo sapiens
aggcugcaguga

SEQ ID NO: 1975156 - RNA, 19 nt, Homo sapiens
cacuuaucuuggaaucaug

SEQ ID NO: 1975157 - RNA, 19 nt, Homo sapiens
caagucauaccuacauuca

SEQ ID NO: 1975158 - RNA, 16 nt, Homo sapiens
acucugucacacuaaa

SEQ ID NO: 1975159 - RNA, 17 nt, Homo sapiens
cuggugugguacagaga

SEQ ID NO: 1975160 - RNA, 13 nt, Homo sapiens
uuuguuguucuga

SEQ ID NO: 1975161 - RNA, 20 nt, Homo sapiens
aggaggguauggugcugcuc

SEQ ID NO: 1975162 - RNA, 15 nt, Homo sapiens
cuugauuaauguacu

SEQ ID NO: 1975163 - RNA, 16 nt, Homo sapiens
ugagauguaagucuca

SEQ ID NO: 1975164 - RNA, 16 nt, Homo sapiens
aucuaaaaccaaauau

SEQ ID NO: 1975165 - RNA, 20 nt, Homo sapiens
ucaaaauguccagcuucucu

SEQ ID NO: 1975166 - RNA, 15 nt, Homo sapiens
auaugucacuagaga

SEQ ID NO: 1975167 - RNA, 13 nt, Homo sapiens
gcuguuccagugg

SEQ ID NO: 1975168 - RNA, 20 nt, Homo sapiens
ugcauggauuucuuugaaaa

SEQ ID NO: 1975169 - RNA, 13 nt, Homo sapiens
auaguacuaguuu

SEQ ID NO: 1975170 - RNA, 22 nt, Homo sapiens
auccucaaacacacaaacuauu

SEQ ID NO: 1975171 - RNA, 15 nt, Homo sapiens
cgggucugagacuga

SEQ ID NO: 1975172 - RNA, 23 nt, Homo sapiens
acuuguguuuuuuaaucagcauu

SEQ ID NO: 1975173 - RNA, 11 nt, Homo sapiens
gcagugcagca

SEQ ID NO: 1975174 - RNA, 11 nt, Homo sapiens
caggugcacag

SEQ ID NO: 1975175 - RNA, 19 nt, Homo sapiens
cagaggccaacacuguggg

SEQ ID NO: 1975176 - RNA, 16 nt, Homo sapiens
aaugaugggacaauaa

SEQ ID NO: 1975177 - RNA, 17 nt, Homo sapiens
gcuugggcccugcacag

SEQ ID NO: 1975178 - RNA, 15 nt, Homo sapiens
aauaccaauguucua

SEQ ID NO: 1975179 - RNA, 15 nt, Homo sapiens
uauuucuaaguauuu

SEQ ID NO: 1975180 - RNA, 15 nt, Homo sapiens
aagacucuauucuca

SEQ ID NO: 1975181 - RNA, 19 nt, Homo sapiens
agcuacaaaugaaaacaau

SEQ ID NO: 1975182 - RNA, 15 nt, Homo sapiens
ccuacauuaucucac

SEQ ID NO: 1975183 - RNA, 21 nt, Homo sapiens
gcauaauuuuuuucugcaacu

SEQ ID NO: 1975184 - RNA, 17 nt, Homo sapiens
ccuggaaagaggcaguc

SEQ ID NO: 1975185 - RNA, 19 nt, Homo sapiens
ucuccccgguaaugucacu

SEQ ID NO: 1975186 - RNA, 17 nt, Homo sapiens
augugauuaaguuccua

SEQ ID NO: 1975187 - RNA, 18 nt, Homo sapiens
acugacuuucucagccuc

SEQ ID NO: 1975188 - RNA, 14 nt, Homo sapiens
uucuguaguacucc

SEQ ID NO: 1975189 - RNA, 15 nt, Homo sapiens
cugggaauggaauaa

SEQ ID NO: 1975190 - RNA, 20 nt, Homo sapiens
ggcauugucuguaaugacaa

SEQ ID NO: 1975191 - RNA, 15 nt, Homo sapiens
uuucucuuaccacua

SEQ ID NO: 1975192 - RNA, 13 nt, Homo sapiens
cacugaaucagcu

SEQ ID NO: 1975193 - RNA, 13 nt, Homo sapiens
aagugaauaaccu

SEQ ID NO: 1975194 - RNA, 23 nt, Homo sapiens
uucaagcaggcgccaagugcuau

SEQ ID NO: 1975195 - RNA, 20 nt, Homo sapiens
gaacuuuuuuagaaaugcaa

SEQ ID NO: 1975196 - RNA, 16 nt, Homo sapiens
gcaucuauuuuaccau

SEQ ID NO: 1975197 - RNA, 15 nt, Homo sapiens
cucccgaauccugag

SEQ ID NO: 1975198 - RNA, 19 nt, Homo sapiens
acacaguuguaggguuaca

SEQ ID NO: 1975199 - RNA, 22 nt, Homo sapiens
gcacuccagccuaggcaacaag

SEQ ID NO: 1975200 - RNA, 15 nt, Homo sapiens
guucuuggugaugcu

SEQ ID NO: 1975201 - RNA, 15 nt, Homo sapiens
cagugaacauuccca

SEQ ID NO: 1975202 - RNA, 21 nt, Homo sapiens
ugcuuuuguuuuccugcuggu

SEQ ID NO: 1975203 - RNA, 18 nt, Homo sapiens
ugcaguggcgccaucuca

SEQ ID NO: 1975204 - RNA, 21 nt, Homo sapiens
aggcagcccccugcacaggga

SEQ ID NO: 1975205 - RNA, 22 nt, Homo sapiens
aaagucagagacagauaccucc

SEQ ID NO: 1975206 - RNA, 21 nt, Homo sapiens
gagacaaaaucuuaaaugcca

SEQ ID NO: 1975207 - RNA, 14 nt, Homo sapiens
augcgggggugccu

SEQ ID NO: 1975208 - RNA, 23 nt, Homo sapiens
caaaaaaaaaaaaaaaaaagaga

SEQ ID NO: 1975209 - RNA, 23 nt, Homo sapiens
gaccacacuuccuguccagagag

SEQ ID NO: 1975210 - RNA, 17 nt, Homo sapiens
gcaaccuccacauguuc

SEQ ID NO: 1975211 - RNA, 17 nt, Homo sapiens
aaggcagaaagauagcu

SEQ ID NO: 1975212 - RNA, 19 nt, Homo sapiens
uguauacuauaguaccagu

SEQ ID NO: 1975213 - RNA, 23 nt, Homo sapiens
acggaguccuguguuugugaguc

SEQ ID NO: 1975214 - RNA, 22 nt, Homo sapiens
acccaaguuuauuauaucauua

SEQ ID NO: 1975215 - RNA, 15 nt, Homo sapiens
ccagguuuugcacuc

SEQ ID NO: 1975216 - RNA, 17 nt, Homo sapiens
ggaagaaagaaugcaag

SEQ ID NO: 1975217 - RNA, 16 nt, Homo sapiens
ggagccccuuucagga

SEQ ID NO: 1975218 - RNA, 13 nt, Homo sapiens
ggcugcaugaccu

SEQ ID NO: 1975219 - RNA, 16 nt, Homo sapiens
ucauaaaaugcuauuu

SEQ ID NO: 1975220 - RNA, 24 nt, Homo sapiens
agcauuuccagagcagagccuaca

SEQ ID NO: 1975221 - RNA, 16 nt, Homo sapiens
gucaggaaacauauuu

SEQ ID NO: 1975222 - RNA, 13 nt, Homo sapiens
aagguugcaguga

SEQ ID NO: 1975223 - RNA, 14 nt, Homo sapiens
uuagugcauuucaa

SEQ ID NO: 1975224 - RNA, 15 nt, Homo sapiens
uggcaccagaugcaa

SEQ ID NO: 1975225 - RNA, 20 nt, Homo sapiens
uccacgggucucacuuauac

SEQ ID NO: 1975226 - RNA, 18 nt, Homo sapiens
gaauucaacagugugucu

SEQ ID NO: 1975227 - RNA, 19 nt, Homo sapiens
ugcugaagagggaaaguga

SEQ ID NO: 1975228 - RNA, 23 nt, Homo sapiens
accaacaggcuaccaacuuguau

SEQ ID NO: 1975229 - RNA, 21 nt, Homo sapiens
cagcugaccugguacugaggu

SEQ ID NO: 1975230 - RNA, 16 nt, Homo sapiens
aucugagucacuugaa

SEQ ID NO: 1975231 - RNA, 21 nt, Homo sapiens
acuacugacauguggggccag

SEQ ID NO: 1975232 - RNA, 14 nt, Homo sapiens
guaccauauagcaa

SEQ ID NO: 1975233 - RNA, 13 nt, Homo sapiens
uuugccacugcaa

SEQ ID NO: 1975234 - RNA, 18 nt, Homo sapiens
ccagccccagguucaaug

SEQ ID NO: 1975235 - RNA, 17 nt, Homo sapiens
gcugcagagcaccuuug

SEQ ID NO: 1975236 - RNA, 21 nt, Homo sapiens
uagaaaucucaucuuuguaau

SEQ ID NO: 1975237 - RNA, 20 nt, Homo sapiens
ccugcuacugccaaccucgc

SEQ ID NO: 1975238 - RNA, 13 nt, Homo sapiens
ccuggugacuccu

SEQ ID NO: 1975239 - RNA, 22 nt, Homo sapiens
cacaaacucuugguuucuucaa

SEQ ID NO: 1975240 - RNA, 17 nt, Homo sapiens
auauaacgcaggccuuu

SEQ ID NO: 1975241 - RNA, 14 nt, Homo sapiens
cuaaaggacauaca

SEQ ID NO: 1975242 - RNA, 13 nt, Homo sapiens
aaaaguaacacag

SEQ ID NO: 1975243 - RNA, 12 nt, Homo sapiens
caaaaccaaugc

SEQ ID NO: 1975244 - RNA, 16 nt, Homo sapiens
cugaccccagugcugc

SEQ ID NO: 1975245 - RNA, 18 nt, Homo sapiens
cuccuaaauuuccagggg

SEQ ID NO: 1975246 - RNA, 15 nt, Homo sapiens
uuagaaauaaaugaa

SEQ ID NO: 1975247 - RNA, 15 nt, Homo sapiens
uaaaagcaucuugau

SEQ ID NO: 1975248 - RNA, 18 nt, Homo sapiens
cuacaaucgcuaccugac

SEQ ID NO: 1975249 - RNA, 15 nt, Homo sapiens
cguauauugcuguua

SEQ ID NO: 1975250 - RNA, 19 nt, Homo sapiens
acaguaaauggcuuaucca

SEQ ID NO: 1975251 - RNA, 16 nt, Homo sapiens
ccaugccuaaagccca

SEQ ID NO: 1975252 - RNA, 17 nt, Homo sapiens
aggacacucgcuugccg

SEQ ID NO: 1975253 - RNA, 13 nt, Homo sapiens
auucucauuuagu

SEQ ID NO: 1975254 - RNA, 19 nt, Homo sapiens
acugcagaccuguccuccu

SEQ ID NO: 1975255 - RNA, 21 nt, Homo sapiens
gaaauuuaacauaguaauucu

SEQ ID NO: 1975256 - RNA, 17 nt, Homo sapiens
auacuugaagggccaga

SEQ ID NO: 1975257 - RNA, 15 nt, Homo sapiens
gccugacuccugggu

SEQ ID NO: 1975258 - RNA, 15 nt, Homo sapiens
ugguguaauuuauaa

SEQ ID NO: 1975259 - RNA, 15 nt, Homo sapiens
cagauucaggcauuu

SEQ ID NO: 1975260 - RNA, 15 nt, Homo sapiens
agaccugacugccug

SEQ ID NO: 1975261 - RNA, 16 nt, Homo sapiens
agugaaacuccaucuc

SEQ ID NO: 1975262 - RNA, 18 nt, Homo sapiens
ucaucgggccagaaggcg

SEQ ID NO: 1975263 - RNA, 19 nt, Homo sapiens
aagaguccagguaaauggu

SEQ ID NO: 1975264 - RNA, 18 nt, Homo sapiens
ugcuggaaacacagucac

SEQ ID NO: 1975265 - RNA, 12 nt, Homo sapiens
ugaggugggggc

SEQ ID NO: 1975266 - RNA, 16 nt, Homo sapiens
cgaggacccaggaaag

SEQ ID NO: 1975267 - RNA, 22 nt, Homo sapiens
ccagugcucaagguuacuggga

SEQ ID NO: 1975268 - RNA, 15 nt, Homo sapiens
ucaagaaugcaauau

SEQ ID NO: 1975269 - RNA, 20 nt, Homo sapiens
gagacaggcaccccucccag

SEQ ID NO: 1975270 - RNA, 18 nt, Homo sapiens
aguuugcucuaccaaaua

SEQ ID NO: 1975271 - RNA, 15 nt, Homo sapiens
cccagauacuuccca

SEQ ID NO: 1975272 - RNA, 15 nt, Homo sapiens
aggaaauacuuugca

SEQ ID NO: 1975273 - RNA, 12 nt, Homo sapiens
uuagagcucuca

SEQ ID NO: 1975274 - RNA, 15 nt, Homo sapiens
cuuaagaguucuaac

SEQ ID NO: 1975275 - RNA, 14 nt, Homo sapiens
auuuugagaucauc

SEQ ID NO: 1975276 - RNA, 17 nt, Homo sapiens
ugcauagugcugggaug

SEQ ID NO: 1975277 - RNA, 15 nt, Homo sapiens
cggugaaucuaguga

SEQ ID NO: 1975278 - RNA, 16 nt, Homo sapiens
uagaguggcagccaag

SEQ ID NO: 1975279 - RNA, 14 nt, Homo sapiens
ucgaccuacugaaa

SEQ ID NO: 1975280 - RNA, 19 nt, Homo sapiens
uccucaagacuuugauccu

SEQ ID NO: 1975281 - RNA, 13 nt, Homo sapiens
ccacaccaucucc

SEQ ID NO: 1975282 - RNA, 18 nt, Homo sapiens
cuagaagggucacuuuaa

SEQ ID NO: 1975283 - RNA, 21 nt, Homo sapiens
ggcuuggcugccccauuccag

SEQ ID NO: 1975284 - RNA, 20 nt, Homo sapiens
guuaaaauaaaauuguacau

SEQ ID NO: 1975285 - RNA, 19 nt, Homo sapiens
guaaaucacacaacagguu

SEQ ID NO: 1975286 - RNA, 21 nt, Homo sapiens
agugcaaaaacuuucaugccu

SEQ ID NO: 1975287 - RNA, 18 nt, Homo sapiens
gcacuacaggcacccgcc

SEQ ID NO: 1975288 - RNA, 16 nt, Homo sapiens
ugcauaagcacagaaa

SEQ ID NO: 1975289 - RNA, 18 nt, Homo sapiens
uaucaguagaagugucac

SEQ ID NO: 1975290 - RNA, 18 nt, Homo sapiens
ggucaggaacaguggcug

SEQ ID NO: 1975291 - RNA, 14 nt, Homo sapiens
cgcugauguucacc

SEQ ID NO: 1975292 - RNA, 19 nt, Homo sapiens
auauccuuucuaacaaaaa

SEQ ID NO: 1975293 - RNA, 15 nt, Homo sapiens
accuugaccaaaauc

SEQ ID NO: 1975294 - RNA, 18 nt, Homo sapiens
acuccaggcccaaggcuc

SEQ ID NO: 1975295 - RNA, 22 nt, Homo sapiens
aggucaucuggcggaggucucu

SEQ ID NO: 1975296 - RNA, 23 nt, Homo sapiens
gcauauaacuuauauuguaagaa

SEQ ID NO: 1975297 - RNA, 12 nt, Homo sapiens
gugccaggugag

SEQ ID NO: 1975298 - RNA, 19 nt, Homo sapiens
acaccuugacagggcacac

SEQ ID NO: 1975299 - RNA, 21 nt, Homo sapiens
ucuuuaccccugcugaccucc

SEQ ID NO: 1975300 - RNA, 18 nt, Homo sapiens
ccccgcccaggcuggcca

SEQ ID NO: 1975301 - RNA, 22 nt, Homo sapiens
augucuuuuacccggcacauuc

SEQ ID NO: 1975302 - RNA, 15 nt, Homo sapiens
aguugacuuacuguu

SEQ ID NO: 1975303 - RNA, 19 nt, Homo sapiens
guaagccucaccuuugccu

SEQ ID NO: 1975304 - RNA, 23 nt, Homo sapiens
ucucuuuggaaaauaguuugcaa

SEQ ID NO: 1975305 - RNA, 13 nt, Homo sapiens
cccuugcugcuuu

SEQ ID NO: 1975306 - RNA, 23 nt, Homo sapiens
ggucaggggcucccuacauuccc

SEQ ID NO: 1975307 - RNA, 20 nt, Homo sapiens
uucuucauggggguaagaaa

SEQ ID NO: 1975308 - RNA, 13 nt, Homo sapiens
cuuaaaaacugug

SEQ ID NO: 1975309 - RNA, 22 nt, Homo sapiens
ucuuugaacugcagcaaucaca

SEQ ID NO: 1975310 - RNA, 16 nt, Homo sapiens
uaaacucuccuuugau

SEQ ID NO: 1975311 - RNA, 16 nt, Homo sapiens
uagcauacauucagac

SEQ ID NO: 1975312 - RNA, 20 nt, Homo sapiens
aggguagauaaccuguacuu

SEQ ID NO: 1975313 - RNA, 18 nt, Homo sapiens
gcauaaguuaacuuccaa

SEQ ID NO: 1975314 - RNA, 12 nt, Homo sapiens
ucauacagagaa

SEQ ID NO: 1975315 - RNA, 14 nt, Homo sapiens
cauugagcaguaua

SEQ ID NO: 1975316 - RNA, 15 nt, Homo sapiens
uccacauacacugca

SEQ ID NO: 1975317 - RNA, 16 nt, Homo sapiens
uacaaaaacauggccu

SEQ ID NO: 1975318 - RNA, 21 nt, Homo sapiens
gcuucucucugcaaccuugaa

SEQ ID NO: 1975319 - RNA, 22 nt, Homo sapiens
ucagcuaucaguguucuucuca

SEQ ID NO: 1975320 - RNA, 16 nt, Homo sapiens
uccaagagguggguaa

SEQ ID NO: 1975321 - RNA, 20 nt, Homo sapiens
gccacccaggccacugaccu

SEQ ID NO: 1975322 - RNA, 13 nt, Homo sapiens
uuucaaacugaua

SEQ ID NO: 1975323 - RNA, 13 nt, Homo sapiens
agucuaacauauu

SEQ ID NO: 1975324 - RNA, 19 nt, Homo sapiens
cccuauuucuaugucauuu

SEQ ID NO: 1975325 - RNA, 12 nt, Homo sapiens
uaucaaacugaa

SEQ ID NO: 1975326 - RNA, 15 nt, Homo sapiens
cauauaugaccagaa

SEQ ID NO: 1975327 - RNA, 15 nt, Homo sapiens
gcagcccaaucugcc

SEQ ID NO: 1975328 - RNA, 22 nt, Homo sapiens
gacaaggcuacgcugacaauca

SEQ ID NO: 1975329 - RNA, 17 nt, Homo sapiens
acucuguccaucagaua

SEQ ID NO: 1975330 - RNA, 22 nt, Homo sapiens
ccuuacauuugaaaucuaugaa

SEQ ID NO: 1975331 - RNA, 21 nt, Homo sapiens
ggaggcacaacgcaccagaca

SEQ ID NO: 1975332 - RNA, 19 nt, Homo sapiens
ugucccuggcgcugugcua

SEQ ID NO: 1975333 - RNA, 19 nt, Homo sapiens
aauauuuuaucuuuuagcu

SEQ ID NO: 1975334 - RNA, 19 nt, Homo sapiens
uacauuucuaucaguacuu

SEQ ID NO: 1975335 - RNA, 14 nt, Homo sapiens
gaaggucaccagca

SEQ ID NO: 1975336 - RNA, 15 nt, Homo sapiens
uaggaguucacuuca

SEQ ID NO: 1975337 - RNA, 15 nt, Homo sapiens
ugcuggcauuugcac

SEQ ID NO: 1975338 - RNA, 20 nt, Homo sapiens
aucuggagaaaugcuuauaa

SEQ ID NO: 1975339 - RNA, 12 nt, Homo sapiens
agugacacugga

SEQ ID NO: 1975340 - RNA, 15 nt, Homo sapiens
cugcagccccccaga

SEQ ID NO: 1975341 - RNA, 14 nt, Homo sapiens
agugccaauccaag

SEQ ID NO: 1975342 - RNA, 15 nt, Homo sapiens
aauuauauagcugcu

SEQ ID NO: 1975343 - RNA, 16 nt, Homo sapiens
aacuaucaccaaaaga

SEQ ID NO: 1975344 - RNA, 12 nt, Homo sapiens
cuuaaagugaau

SEQ ID NO: 1975345 - RNA, 14 nt, Homo sapiens
cagguuuuugccca

SEQ ID NO: 1975346 - RNA, 20 nt, Homo sapiens
ucuauaaaaauacuacaaua

SEQ ID NO: 1975347 - RNA, 18 nt, Homo sapiens
cuuuuuaccaaguacaaa

SEQ ID NO: 1975348 - RNA, 12 nt, Homo sapiens
uagaaaacuggg

SEQ ID NO: 1975349 - RNA, 16 nt, Homo sapiens
cuaguggucuuuguaa

SEQ ID NO: 1975350 - RNA, 20 nt, Homo sapiens
gugggacaauggguggugaa

SEQ ID NO: 1975351 - RNA, 14 nt, Homo sapiens
cugccccaucacuu

SEQ ID NO: 1975352 - RNA, 22 nt, Homo sapiens
aaggaucuugccugcaugaaac

SEQ ID NO: 1975353 - RNA, 17 nt, Homo sapiens
aucuacaauacauauau

SEQ ID NO: 1975354 - RNA, 19 nt, Homo sapiens
agcaguaccccccuaccac

SEQ ID NO: 1975355 - RNA, 18 nt, Homo sapiens
cuccucucugggccuuug

SEQ ID NO: 1975356 - RNA, 22 nt, Homo sapiens
accugacuuaugaaacuugaaa

SEQ ID NO: 1975357 - RNA, 22 nt, Homo sapiens
auuccauggugauuccugggaa

SEQ ID NO: 1975358 - RNA, 16 nt, Homo sapiens
uagcauguuguagaua

SEQ ID NO: 1975359 - RNA, 16 nt, Homo sapiens
ugggugggaccacaga

SEQ ID NO: 1975360 - RNA, 14 nt, Homo sapiens
caggaagcuuguca

SEQ ID NO: 1975361 - RNA, 13 nt, Homo sapiens
ugccuaaggcuga

SEQ ID NO: 1975362 - RNA, 15 nt, Homo sapiens
ugaacauuguacugu

SEQ ID NO: 1975363 - RNA, 22 nt, Homo sapiens
ugucuguaaaaaauguaugcua

SEQ ID NO: 1975364 - RNA, 16 nt, Homo sapiens
ugaaagacauguaacu

SEQ ID NO: 1975365 - RNA, 18 nt, Homo sapiens
cuuugcugcacuauuugc

SEQ ID NO: 1975366 - RNA, 21 nt, Homo sapiens
ucacagggacccacauccaaa

SEQ ID NO: 1975367 - RNA, 15 nt, Homo sapiens
uguacacagaauugu

SEQ ID NO: 1975368 - RNA, 21 nt, Homo sapiens
aaagccuuuuuuuaggccaca

SEQ ID NO: 1975369 - RNA, 14 nt, Homo sapiens
gaaagcaauaacuu

SEQ ID NO: 1975370 - RNA, 20 nt, Homo sapiens
cuaacgagggauuacuuugg

SEQ ID NO: 1975371 - RNA, 16 nt, Homo sapiens
gaauuuaucugugaau

SEQ ID NO: 1975372 - RNA, 16 nt, Homo sapiens
ugaaagugccaaaaua

SEQ ID NO: 1975373 - RNA, 13 nt, Homo sapiens
aggguccagugga

SEQ ID NO: 1975374 - RNA, 21 nt, Homo sapiens
cccagcuccuuucaugcucca

SEQ ID NO: 1975375 - RNA, 18 nt, Homo sapiens
ggaaaaaaggaggauaga

SEQ ID NO: 1975376 - RNA, 18 nt, Homo sapiens
gaaagaaagcaccuguuu

SEQ ID NO: 1975377 - RNA, 15 nt, Homo sapiens
caaucuucauuuaau

SEQ ID NO: 1975378 - RNA, 15 nt, Homo sapiens
cuugucuccauuugg

SEQ ID NO: 1975379 - RNA, 21 nt, Homo sapiens
cuggaaucaaggaauccugag

SEQ ID NO: 1975380 - RNA, 14 nt, Homo sapiens
guguaagcauugua

SEQ ID NO: 1975381 - RNA, 19 nt, Homo sapiens
cuguaaucuaccaguggug

SEQ ID NO: 1975382 - RNA, 19 nt, Homo sapiens
auuugaggucaaguaagaa

SEQ ID NO: 1975383 - RNA, 23 nt, Homo sapiens
cgcaugucucccuccaguccucu

SEQ ID NO: 1975384 - RNA, 13 nt, Homo sapiens
aagaaaacuggaa

SEQ ID NO: 1975385 - RNA, 14 nt, Homo sapiens
ccuuguaaugccac

SEQ ID NO: 1975386 - RNA, 15 nt, Homo sapiens
ccuuuccccagugug

SEQ ID NO: 1975387 - RNA, 15 nt, Homo sapiens
uugucuuauugcacc

SEQ ID NO: 1975388 - RNA, 22 nt, Homo sapiens
aaaccuucugacuuugccaaaa

SEQ ID NO: 1975389 - RNA, 23 nt, Homo sapiens
cuguaaagguuuuuggaauuaug

SEQ ID NO: 1975390 - RNA, 16 nt, Homo sapiens
caaaauuguuuaccau

SEQ ID NO: 1975391 - RNA, 18 nt, Homo sapiens
gcuguuaacuguuaacua

SEQ ID NO: 1975392 - RNA, 16 nt, Homo sapiens
cugagugaaauacugu

SEQ ID NO: 1975393 - RNA, 18 nt, Homo sapiens
ggauuuuccaccaaauuc

SEQ ID NO: 1975394 - RNA, 16 nt, Homo sapiens
aagccuggcacccacc

SEQ ID NO: 1975395 - RNA, 16 nt, Homo sapiens
agaauuuucugcauua

SEQ ID NO: 1975396 - RNA, 17 nt, Homo sapiens
ugcauccuccgccuccc

SEQ ID NO: 1975397 - RNA, 18 nt, Homo sapiens
ccugaggaaaaguccaca

SEQ ID NO: 1975398 - RNA, 17 nt, Homo sapiens
gggacccaggcucccag

SEQ ID NO: 1975399 - RNA, 14 nt, Homo sapiens
caaauaaauggagu

SEQ ID NO: 1975400 - RNA, 12 nt, Homo sapiens
aacagugcagua

SEQ ID NO: 1975401 - RNA, 17 nt, Homo sapiens
caggacggucugugccc

SEQ ID NO: 1975402 - RNA, 19 nt, Homo sapiens
ucacuuuccuggauccagg

SEQ ID NO: 1975403 - RNA, 17 nt, Homo sapiens
gacuuuucugauuaaua

SEQ ID NO: 1975404 - RNA, 18 nt, Homo sapiens
auuguggugugagcuuca

SEQ ID NO: 1975405 - RNA, 20 nt, Homo sapiens
cuggccuccagccuuugcuc

SEQ ID NO: 1975406 - RNA, 14 nt, Homo sapiens
uguaaauuauuuca

SEQ ID NO: 1975407 - RNA, 20 nt, Homo sapiens
cuccuccagggccacgugcc

SEQ ID NO: 1975408 - RNA, 17 nt, Homo sapiens
uccuacccacaccucug

SEQ ID NO: 1975409 - RNA, 20 nt, Homo sapiens
auauaauaauaugugaugau

SEQ ID NO: 1975410 - RNA, 19 nt, Homo sapiens
uuguacaacauuguggaug

SEQ ID NO: 1975411 - RNA, 16 nt, Homo sapiens
uuaacuuuaccaugcu

SEQ ID NO: 1975412 - RNA, 15 nt, Homo sapiens
ugcccucugcucugc

SEQ ID NO: 1975413 - RNA, 20 nt, Homo sapiens
uccaauauucgcugugucag

SEQ ID NO: 1975414 - RNA, 21 nt, Homo sapiens
uccaaugucugcugaggaguu

SEQ ID NO: 1975415 - RNA, 14 nt, Homo sapiens
cgcccgcauagcac

SEQ ID NO: 1975416 - RNA, 18 nt, Homo sapiens
auucuagagugcauauau

SEQ ID NO: 1975417 - RNA, 22 nt, Homo sapiens
aggccauuccccgucucugguu

SEQ ID NO: 1975418 - RNA, 15 nt, Homo sapiens
guauguuauugcaua

SEQ ID NO: 1975419 - RNA, 23 nt, Homo sapiens
cguccaaggcaguucuguguccu

SEQ ID NO: 1975420 - RNA, 14 nt, Homo sapiens
auauaaaucuucaa

SEQ ID NO: 1975421 - RNA, 20 nt, Homo sapiens
ccugguggaacagagucaua

SEQ ID NO: 1975422 - RNA, 19 nt, Homo sapiens
gagacccugucucaaaaaa

SEQ ID NO: 1975423 - RNA, 17 nt, Homo sapiens
cacuuucauugccagug

SEQ ID NO: 1975424 - RNA, 22 nt, Homo sapiens
auuuguagguaauguuccugaa

SEQ ID NO: 1975425 - RNA, 18 nt, Homo sapiens
aagggugugggucaggga

SEQ ID NO: 1975426 - RNA, 13 nt, Homo sapiens
cugaaaugucagu

SEQ ID NO: 1975427 - RNA, 20 nt, Homo sapiens
aaauuuuaaugaagugcaau

SEQ ID NO: 1975428 - RNA, 23 nt, Homo sapiens
acucucuuuuuuuuuaaggugaa

SEQ ID NO: 1975429 - RNA, 17 nt, Homo sapiens
gcaccauugaacuguac

SEQ ID NO: 1975430 - RNA, 20 nt, Homo sapiens
cuccccgccuccucccugcc

SEQ ID NO: 1975431 - RNA, 19 nt, Homo sapiens
aggaagcugugagagcagu

SEQ ID NO: 1975432 - RNA, 17 nt, Homo sapiens
aggaggagacagccuca

SEQ ID NO: 1975433 - RNA, 22 nt, Homo sapiens
uccccucuggaaucuuccccaa

SEQ ID NO: 1975434 - RNA, 15 nt, Homo sapiens
ggcagugcaugugga

SEQ ID NO: 1975435 - RNA, 14 nt, Homo sapiens
ugacugggccuccc

SEQ ID NO: 1975436 - RNA, 14 nt, Homo sapiens
cugugaacagcuug

SEQ ID NO: 1975437 - RNA, 14 nt, Homo sapiens
ucuccuaauucugc

SEQ ID NO: 1975438 - RNA, 20 nt, Homo sapiens
ggcaacacagugagacuuca

SEQ ID NO: 1975439 - RNA, 23 nt, Homo sapiens
caguguuuagaagagccugacug

SEQ ID NO: 1975440 - RNA, 18 nt, Homo sapiens
ggaagaacuugucccuca

SEQ ID NO: 1975441 - RNA, 18 nt, Homo sapiens
ucuuggccgacucaggga

SEQ ID NO: 1975442 - RNA, 16 nt, Homo sapiens
uuaauaaauucagaua

SEQ ID NO: 1975443 - RNA, 14 nt, Homo sapiens
ccggaucauucacu

SEQ ID NO: 1975444 - RNA, 22 nt, Homo sapiens
cauggaaguacuauaauuuacc

SEQ ID NO: 1975445 - RNA, 18 nt, Homo sapiens
guaaucucucugcagcug

SEQ ID NO: 1975446 - RNA, 19 nt, Homo sapiens
cuggagccgccauucugca

SEQ ID NO: 1975447 - RNA, 20 nt, Homo sapiens
ucugugguuugggcuccaca

SEQ ID NO: 1975448 - RNA, 20 nt, Homo sapiens
ccaggcugccucggacucca

SEQ ID NO: 1975449 - RNA, 23 nt, Homo sapiens
uacaccaaugaaaacauguacua

SEQ ID NO: 1975450 - RNA, 14 nt, Homo sapiens
cuacugacuguauu

SEQ ID NO: 1975451 - RNA, 13 nt, Homo sapiens
aggaugugauaua

SEQ ID NO: 1975452 - RNA, 17 nt, Homo sapiens
agagauaaacuacauag

SEQ ID NO: 1975453 - RNA, 13 nt, Homo sapiens
caacaacauuccu

SEQ ID NO: 1975454 - RNA, 24 nt, Homo sapiens
ugauuagaaauuaccuguggauau

SEQ ID NO: 1975455 - RNA, 16 nt, Homo sapiens
cgcugacggaggagcu

SEQ ID NO: 1975456 - RNA, 19 nt, Homo sapiens
cuuaaaccugugcuuucau

SEQ ID NO: 1975457 - RNA, 20 nt, Homo sapiens
uuugugauauuucguguacu

SEQ ID NO: 1975458 - RNA, 19 nt, Homo sapiens
ggcucuuagcagcuuccag

SEQ ID NO: 1975459 - RNA, 23 nt, Homo sapiens
gcgaccgccgcagggacggggac

SEQ ID NO: 1975460 - RNA, 16 nt, Homo sapiens
agaauaaagauuuaua

SEQ ID NO: 1975461 - RNA, 20 nt, Homo sapiens
gaguucauacccuguuacca

SEQ ID NO: 1975462 - RNA, 18 nt, Homo sapiens
cuuuuuaauuucugcaaa

SEQ ID NO: 1975463 - RNA, 23 nt, Homo sapiens
gacagaaggugccacuuuaccca

SEQ ID NO: 1975464 - RNA, 12 nt, Homo sapiens
uuuaacauucac

SEQ ID NO: 1975465 - RNA, 18 nt, Homo sapiens
uuugagguaucacugcag

SEQ ID NO: 1975466 - RNA, 21 nt, Homo sapiens
cccauucucccucucaaggca

SEQ ID NO: 1975467 - RNA, 16 nt, Homo sapiens
aucuaggaagacuuug

SEQ ID NO: 1975468 - RNA, 14 nt, Homo sapiens
cuacuucucuugca

SEQ ID NO: 1975469 - RNA, 15 nt, Homo sapiens
cugauaucagaguua

SEQ ID NO: 1975470 - RNA, 18 nt, Homo sapiens
gccauuauuuucugucag

SEQ ID NO: 1975471 - RNA, 19 nt, Homo sapiens
aaaaaccaaaguacuuuug

SEQ ID NO: 1975472 - RNA, 22 nt, Homo sapiens
ugaaccccuggccagcucugag

SEQ ID NO: 1975473 - RNA, 13 nt, Homo sapiens
ccuuuaacaucuu

SEQ ID NO: 1975474 - RNA, 19 nt, Homo sapiens
cagcucuuucaaacuuggg

SEQ ID NO: 1975475 - RNA, 16 nt, Homo sapiens
aucugaggcaaucuaa

SEQ ID NO: 1975476 - RNA, 19 nt, Homo sapiens
acauugcagcuucaacuuu

SEQ ID NO: 1975477 - RNA, 16 nt, Homo sapiens
caucuugaaaaugcca

SEQ ID NO: 1975478 - RNA, 18 nt, Homo sapiens
aagcugggcaacaugccu

SEQ ID NO: 1975479 - RNA, 18 nt, Homo sapiens
cagccucagaauaaaaga

SEQ ID NO: 1975480 - RNA, 18 nt, Homo sapiens
cauuagaccaagcuuguc

SEQ ID NO: 1975481 - RNA, 15 nt, Homo sapiens
uggauuaugaaguga

SEQ ID NO: 1975482 - RNA, 23 nt, Homo sapiens
aggugccuccugacacaccugca

SEQ ID NO: 1975483 - RNA, 23 nt, Homo sapiens
uucugcauaguggccuuguccaa

SEQ ID NO: 1975484 - RNA, 23 nt, Homo sapiens
cuacaggggaggcugagacgcaa

SEQ ID NO: 1975485 - RNA, 14 nt, Homo sapiens
ccauuacuacugua

SEQ ID NO: 1975486 - RNA, 14 nt, Homo sapiens
acuucacuccagca

SEQ ID NO: 1975487 - RNA, 14 nt, Homo sapiens
ugaccuuguagcua

SEQ ID NO: 1975488 - RNA, 15 nt, Homo sapiens
uauuuacauaugaaa

SEQ ID NO: 1975489 - RNA, 18 nt, Homo sapiens
cuucugcagucagacuga

SEQ ID NO: 1975490 - RNA, 15 nt, Homo sapiens
auauguggaguucau

SEQ ID NO: 1975491 - RNA, 19 nt, Homo sapiens
auucuuauuuggacagcca

SEQ ID NO: 1975492 - RNA, 20 nt, Homo sapiens
cacccugaggagucugaggu

SEQ ID NO: 1975493 - RNA, 22 nt, Homo sapiens
uuuccuuugcauucaucucuca

SEQ ID NO: 1975494 - RNA, 15 nt, Homo sapiens
ucagcagcccuccuc

SEQ ID NO: 1975495 - RNA, 23 nt, Homo sapiens
ccuaacccccagccccuccaugu

SEQ ID NO: 1975496 - RNA, 16 nt, Homo sapiens
guucuauccccaagcu

SEQ ID NO: 1975497 - RNA, 13 nt, Homo sapiens
acuccauucucag

SEQ ID NO: 1975498 - RNA, 14 nt, Homo sapiens
caccccuaccucua

SEQ ID NO: 1975499 - RNA, 22 nt, Homo sapiens
auaucuggccacacugggcuca

SEQ ID NO: 1975500 - RNA, 12 nt, Homo sapiens
ccccucaagaaa

SEQ ID NO: 1975501 - RNA, 19 nt, Homo sapiens
agaggcaugugaugugcaa

SEQ ID NO: 1975502 - RNA, 12 nt, Homo sapiens
caggcugggaac

SEQ ID NO: 1975503 - RNA, 16 nt, Homo sapiens
ccuggagggaggcucu

SEQ ID NO: 1975504 - RNA, 21 nt, Homo sapiens
auuuuaugcuggacucuggac

SEQ ID NO: 1975505 - RNA, 16 nt, Homo sapiens
agcccucacccugggg

SEQ ID NO: 1975506 - RNA, 20 nt, Homo sapiens
ggugugaaccaccacaccca

SEQ ID NO: 1975507 - RNA, 15 nt, Homo sapiens
aagacaaaugcugcg

SEQ ID NO: 1975508 - RNA, 13 nt, Homo sapiens
auacaucccucag

SEQ ID NO: 1975509 - RNA, 17 nt, Homo sapiens
ucccuuggcagaguaug

SEQ ID NO: 1975510 - RNA, 14 nt, Homo sapiens
guuacgaagacaaa

SEQ ID NO: 1975511 - RNA, 15 nt, Homo sapiens
caacaccuguggaua

SEQ ID NO: 1975512 - RNA, 23 nt, Homo sapiens
cagguugccugggccacggugcc

SEQ ID NO: 1975513 - RNA, 23 nt, Homo sapiens
auuuuguaccaaccauccaauua

SEQ ID NO: 1975514 - RNA, 14 nt, Homo sapiens
guaauguggucacc

SEQ ID NO: 1975515 - RNA, 17 nt, Homo sapiens
caaacuccugaguucaa

SEQ ID NO: 1975516 - RNA, 17 nt, Homo sapiens
ucguguucacucagcac

SEQ ID NO: 1975517 - RNA, 22 nt, Homo sapiens
cugaagggaacuagagguguua

SEQ ID NO: 1975518 - RNA, 18 nt, Homo sapiens
agaaaaaaaagugucuca

SEQ ID NO: 1975519 - RNA, 22 nt, Homo sapiens
uuccagaagaagagaagcugcu

SEQ ID NO: 1975520 - RNA, 14 nt, Homo sapiens
ucuguguguugacu

SEQ ID NO: 1975521 - RNA, 13 nt, Homo sapiens
aguccaguacuug

SEQ ID NO: 1975522 - RNA, 17 nt, Homo sapiens
gccuggcccuugagugg

SEQ ID NO: 1975523 - RNA, 21 nt, Homo sapiens
cacugccuuaccuucacuuaa

SEQ ID NO: 1975524 - RNA, 22 nt, Homo sapiens
aaaauguucuguuugcugugga

SEQ ID NO: 1975525 - RNA, 19 nt, Homo sapiens
ucccucuaauuuaucuugu

SEQ ID NO: 1975526 - RNA, 18 nt, Homo sapiens
gcaagucggggccuggga

SEQ ID NO: 1975527 - RNA, 23 nt, Homo sapiens
cuucaauuguagaugaacaucuc

SEQ ID NO: 1975528 - RNA, 20 nt, Homo sapiens
uugacauuagucucagugaa

SEQ ID NO: 1975529 - RNA, 18 nt, Homo sapiens
uaaucuaucacuuuguuc

SEQ ID NO: 1975530 - RNA, 15 nt, Homo sapiens
agcugaacacaagca

SEQ ID NO: 1975531 - RNA, 22 nt, Homo sapiens
cuuggagaaaugaaaacagugu

SEQ ID NO: 1975532 - RNA, 17 nt, Homo sapiens
aaguuagaaaacauaau

SEQ ID NO: 1975533 - RNA, 16 nt, Homo sapiens
aagaugugcucccacc

SEQ ID NO: 1975534 - RNA, 12 nt, Homo sapiens
caugauuuccca

SEQ ID NO: 1975535 - RNA, 18 nt, Homo sapiens
auuucuuacaggcacaaa

SEQ ID NO: 1975536 - RNA, 18 nt, Homo sapiens
ccccugauucacugccua

SEQ ID NO: 1975537 - RNA, 18 nt, Homo sapiens
ggcuggaaaagucacaca

SEQ ID NO: 1975538 - RNA, 15 nt, Homo sapiens
acccugagguugugu

SEQ ID NO: 1975539 - RNA, 14 nt, Homo sapiens
ugccucagccuccc

SEQ ID NO: 1975540 - RNA, 12 nt, Homo sapiens
cgaaacuggaag

SEQ ID NO: 1975541 - RNA, 18 nt, Homo sapiens
cauagcgggcgcugccag

SEQ ID NO: 1975542 - RNA, 14 nt, Homo sapiens
auuccuuagucuca

SEQ ID NO: 1975543 - RNA, 19 nt, Homo sapiens
uugucauugagccuggcaa

SEQ ID NO: 1975544 - RNA, 13 nt, Homo sapiens
aacaacuaccuga

SEQ ID NO: 1975545 - RNA, 22 nt, Homo sapiens
uuuugaggaauuaucaugggaa

SEQ ID NO: 1975546 - RNA, 20 nt, Homo sapiens
accacaacugacacaggaaa

SEQ ID NO: 1975547 - RNA, 13 nt, Homo sapiens
cagugucugucag

SEQ ID NO: 1975548 - RNA, 13 nt, Homo sapiens
cagacucugucuc

SEQ ID NO: 1975549 - RNA, 23 nt, Homo sapiens
agcccuggaucucccaauggccu

SEQ ID NO: 1975550 - RNA, 16 nt, Homo sapiens
ugcucugcaagcagaa

SEQ ID NO: 1975551 - RNA, 18 nt, Homo sapiens
uaacgucuguaagcugaa

SEQ ID NO: 1975552 - RNA, 14 nt, Homo sapiens
uaauaucaugugca

SEQ ID NO: 1975553 - RNA, 18 nt, Homo sapiens
ugcugucagucugcuuau

SEQ ID NO: 1975554 - RNA, 11 nt, Homo sapiens
cauguguuucu

SEQ ID NO: 1975555 - RNA, 17 nt, Homo sapiens
ggaugcaaauaaagccu

SEQ ID NO: 1975556 - RNA, 19 nt, Homo sapiens
ugagccagucccucagcca

SEQ ID NO: 1975557 - RNA, 13 nt, Homo sapiens
cuaugccuugaaa

SEQ ID NO: 1975558 - RNA, 16 nt, Homo sapiens
caacaacucugauuaa

SEQ ID NO: 1975559 - RNA, 20 nt, Homo sapiens
cagcuucccaaguagcugag

SEQ ID NO: 1975560 - RNA, 18 nt, Homo sapiens
ugaugcuuuaugcaacua

SEQ ID NO: 1975561 - RNA, 22 nt, Homo sapiens
uuaugagcucuucauguuucag

SEQ ID NO: 1975562 - RNA, 15 nt, Homo sapiens
aaguuaaauugcacg

SEQ ID NO: 1975563 - RNA, 15 nt, Homo sapiens
uuucaucuaauguga

SEQ ID NO: 1975564 - RNA, 18 nt, Homo sapiens
uaacugcccucugaaaua

SEQ ID NO: 1975565 - RNA, 23 nt, Homo sapiens
ggcauaaagcugggaggccaaac

SEQ ID NO: 1975566 - RNA, 15 nt, Homo sapiens
cauuucuaacucuga

SEQ ID NO: 1975567 - RNA, 16 nt, Homo sapiens
cacuccuauggucaca

SEQ ID NO: 1975568 - RNA, 18 nt, Homo sapiens
uagcauuuuuccaacaca

SEQ ID NO: 1975569 - RNA, 18 nt, Homo sapiens
aaucagcucaaucuucaa

SEQ ID NO: 1975570 - RNA, 15 nt, Homo sapiens
uugcaucguggagac

SEQ ID NO: 1975571 - RNA, 20 nt, Homo sapiens
uagucauugucauaaguaaa

SEQ ID NO: 1975572 - RNA, 19 nt, Homo sapiens
auggugcccuuggaggcaa

SEQ ID NO: 1975573 - RNA, 14 nt, Homo sapiens
acaguggaucucaa

SEQ ID NO: 1975574 - RNA, 13 nt, Homo sapiens
cagagguauuccu

SEQ ID NO: 1975575 - RNA, 16 nt, Homo sapiens
ggcggauggcugugac

SEQ ID NO: 1975576 - RNA, 22 nt, Homo sapiens
uaacugaaccauuccaacuuca

SEQ ID NO: 1975577 - RNA, 18 nt, Homo sapiens
cugaagcguuacuacagc

SEQ ID NO: 1975578 - RNA, 15 nt, Homo sapiens
cagcuaucucucagu

SEQ ID NO: 1975579 - RNA, 16 nt, Homo sapiens
acuugaauauguagcu

SEQ ID NO: 1975580 - RNA, 24 nt, Homo sapiens
accuccccugguccugcacugucc

SEQ ID NO: 1975581 - RNA, 18 nt, Homo sapiens
gcuacucaggaggcugaa

SEQ ID NO: 1975582 - RNA, 15 nt, Homo sapiens
cucaauccugcagug

SEQ ID NO: 1975583 - RNA, 17 nt, Homo sapiens
gccagauuccccaggaa

SEQ ID NO: 1975584 - RNA, 12 nt, Homo sapiens
cucgccuaggcc

SEQ ID NO: 1975585 - RNA, 14 nt, Homo sapiens
ggcaguaccauuca

SEQ ID NO: 1975586 - RNA, 21 nt, Homo sapiens
auuuuuuuuuuuaacagucag

SEQ ID NO: 1975587 - RNA, 15 nt, Homo sapiens
ucaccuguguguaca

SEQ ID NO: 1975588 - RNA, 12 nt, Homo sapiens
ucaaugcuauaa

SEQ ID NO: 1975589 - RNA, 17 nt, Homo sapiens
gccaacaccuucuuggc

SEQ ID NO: 1975590 - RNA, 17 nt, Homo sapiens
gguacugagcagccacu

SEQ ID NO: 1975591 - RNA, 16 nt, Homo sapiens
cggaacagccaaagaa

SEQ ID NO: 1975592 - RNA, 16 nt, Homo sapiens
guucacccaaccacau

SEQ ID NO: 1975593 - RNA, 17 nt, Homo sapiens
gccugauccauccccag

SEQ ID NO: 1975594 - RNA, 13 nt, Homo sapiens
aagcaccaugaau

SEQ ID NO: 1975595 - RNA, 14 nt, Homo sapiens
uguaagcacugacu

SEQ ID NO: 1975596 - RNA, 18 nt, Homo sapiens
aggcaguaccauucagga

SEQ ID NO: 1975597 - RNA, 16 nt, Homo sapiens
gaggagccugcaacau

SEQ ID NO: 1975598 - RNA, 16 nt, Homo sapiens
agugcaaaagugagaa

SEQ ID NO: 1975599 - RNA, 22 nt, Homo sapiens
acuaacgcaaccaagugugcua

SEQ ID NO: 1975600 - RNA, 19 nt, Homo sapiens
augcacaguaucugcuguu

SEQ ID NO: 1975601 - RNA, 12 nt, Homo sapiens
cuaaagacagaa

SEQ ID NO: 1975602 - RNA, 19 nt, Homo sapiens
caaagcggagaaacauguu

SEQ ID NO: 1975603 - RNA, 14 nt, Homo sapiens
ccaaacagcuuaaa

SEQ ID NO: 1975604 - RNA, 14 nt, Homo sapiens
cuccacacuccacu

SEQ ID NO: 1975605 - RNA, 19 nt, Homo sapiens
cagucugcuucugcaccuu

SEQ ID NO: 1975606 - RNA, 15 nt, Homo sapiens
cugggcccuaggcau

SEQ ID NO: 1975607 - RNA, 15 nt, Homo sapiens
cacagcucuucacac

SEQ ID NO: 1975608 - RNA, 14 nt, Homo sapiens
acuagcuuuugcca

SEQ ID NO: 1975609 - RNA, 15 nt, Homo sapiens
cuaauuugugccuca

SEQ ID NO: 1975610 - RNA, 20 nt, Homo sapiens
ucaacaugugugacugcgca

SEQ ID NO: 1975611 - RNA, 19 nt, Homo sapiens
gacccugacuguauacaga

SEQ ID NO: 1975612 - RNA, 21 nt, Homo sapiens
acgugacuggucuccuaacca

SEQ ID NO: 1975613 - RNA, 18 nt, Homo sapiens
cuaauuauaaugcaaauu

SEQ ID NO: 1975614 - RNA, 16 nt, Homo sapiens
aacagaaaaaugaaau

SEQ ID NO: 1975615 - RNA, 22 nt, Homo sapiens
ucccaggcugcuggagugcagu

SEQ ID NO: 1975616 - RNA, 21 nt, Homo sapiens
ugaucagacauacagcugccu

SEQ ID NO: 1975617 - RNA, 17 nt, Homo sapiens
uagauucaucaccuuag

SEQ ID NO: 1975618 - RNA, 18 nt, Homo sapiens
uaaagcguuugcauuugc

SEQ ID NO: 1975619 - RNA, 18 nt, Homo sapiens
guggcauucacaucucau

SEQ ID NO: 1975620 - RNA, 17 nt, Homo sapiens
ucaguccaauaaauuau

SEQ ID NO: 1975621 - RNA, 14 nt, Homo sapiens
gccagcagcuguuu

SEQ ID NO: 1975622 - RNA, 12 nt, Homo sapiens
aauaggaccaga

SEQ ID NO: 1975623 - RNA, 19 nt, Homo sapiens
guugaacaucucacuuugc

SEQ ID NO: 1975624 - RNA, 15 nt, Homo sapiens
ucuguugucauugcu

SEQ ID NO: 1975625 - RNA, 15 nt, Homo sapiens
caugcacucaggcag

SEQ ID NO: 1975626 - RNA, 15 nt, Homo sapiens
uccaaaacaaaaaga

SEQ ID NO: 1975627 - RNA, 15 nt, Homo sapiens
cuuaagugugcaaaa

SEQ ID NO: 1975628 - RNA, 16 nt, Homo sapiens
auaaauaagcacuauu

SEQ ID NO: 1975629 - RNA, 14 nt, Homo sapiens
gauggugugccuuc

SEQ ID NO: 1975630 - RNA, 17 nt, Homo sapiens
aguggcaugguccugug

SEQ ID NO: 1975631 - RNA, 15 nt, Homo sapiens
ucuuaccugggaccu

SEQ ID NO: 1975632 - RNA, 14 nt, Homo sapiens
acugaacugugaac

SEQ ID NO: 1975633 - RNA, 21 nt, Homo sapiens
cccaggagguggcuauggcca

SEQ ID NO: 1975634 - RNA, 18 nt, Homo sapiens
aucuguaugucugccuaa

SEQ ID NO: 1975635 - RNA, 21 nt, Homo sapiens
aggcugcuuuccaaagccaau

SEQ ID NO: 1975636 - RNA, 17 nt, Homo sapiens
ugccacggcagccaccc

SEQ ID NO: 1975637 - RNA, 22 nt, Homo sapiens
uugauaagcaagaaagauuuca

SEQ ID NO: 1975638 - RNA, 23 nt, Homo sapiens
gggugguagugggagguugugca

SEQ ID NO: 1975639 - RNA, 13 nt, Homo sapiens
uuguauuucccca

SEQ ID NO: 1975640 - RNA, 13 nt, Homo sapiens
aaaguuacacuuu

SEQ ID NO: 1975641 - RNA, 13 nt, Homo sapiens
aaauguacacugg

SEQ ID NO: 1975642 - RNA, 17 nt, Homo sapiens
gagaaaagugggcugca

SEQ ID NO: 1975643 - RNA, 16 nt, Homo sapiens
ucccugcuuaccugac

SEQ ID NO: 1975644 - RNA, 18 nt, Homo sapiens
ugaacuccugggcucaag

SEQ ID NO: 1975645 - RNA, 17 nt, Homo sapiens
gucagaggaagccagca

SEQ ID NO: 1975646 - RNA, 16 nt, Homo sapiens
cuuauuguauuccuca

SEQ ID NO: 1975647 - RNA, 23 nt, Homo sapiens
gcuccacgaagccuuaagccaua

SEQ ID NO: 1975648 - RNA, 23 nt, Homo sapiens
aaggcaucauuuucaccuccauu

SEQ ID NO: 1975649 - RNA, 21 nt, Homo sapiens
acuuuucuuuauugcugugaa

SEQ ID NO: 1975650 - RNA, 15 nt, Homo sapiens
auuaaucuaccauuu

SEQ ID NO: 1975651 - RNA, 23 nt, Homo sapiens
ggaaagaagaguuggagugagau

SEQ ID NO: 1975652 - RNA, 23 nt, Homo sapiens
aguugucccgauuguaacucaaa

SEQ ID NO: 1975653 - RNA, 21 nt, Homo sapiens
uuaaaaaaaaaaaaaacauug

SEQ ID NO: 1975654 - RNA, 13 nt, Homo sapiens
acuguuccaaaaa

SEQ ID NO: 1975655 - RNA, 22 nt, Homo sapiens
gagauauuugguaccauggugu

SEQ ID NO: 1975656 - RNA, 13 nt, Homo sapiens
aacucucaagugu

SEQ ID NO: 1975657 - RNA, 16 nt, Homo sapiens
ccaccucaggcugcca

SEQ ID NO: 1975658 - RNA, 13 nt, Homo sapiens
ucauucuuuacau

SEQ ID NO: 1975659 - RNA, 13 nt, Homo sapiens
uaauucuuuccau

SEQ ID NO: 1975660 - RNA, 16 nt, Homo sapiens
uugccacuacccccuc

SEQ ID NO: 1975661 - RNA, 15 nt, Homo sapiens
uaauauucaugaaga

SEQ ID NO: 1975662 - RNA, 17 nt, Homo sapiens
gccucaucccaggcagu

SEQ ID NO: 1975663 - RNA, 14 nt, Homo sapiens
aguuucccuuccuc

SEQ ID NO: 1975664 - RNA, 15 nt, Homo sapiens
ugaauugaaauguuc

SEQ ID NO: 1975665 - RNA, 20 nt, Homo sapiens
ucacuucuuccauccaaaga

SEQ ID NO: 1975666 - RNA, 20 nt, Homo sapiens
cugggcaaggcgcucaggca

SEQ ID NO: 1975667 - RNA, 20 nt, Homo sapiens
uugaccacggacuccagucu

SEQ ID NO: 1975668 - RNA, 17 nt, Homo sapiens
aaucuugcucugcuuga

SEQ ID NO: 1975669 - RNA, 15 nt, Homo sapiens
acugacagggagcag

SEQ ID NO: 1975670 - RNA, 20 nt, Homo sapiens
agguggugggcaaaaacaau

SEQ ID NO: 1975671 - RNA, 22 nt, Homo sapiens
ugcuacuacugcagucuuuauu

SEQ ID NO: 1975672 - RNA, 16 nt, Homo sapiens
cuugcccccauuucac

SEQ ID NO: 1975673 - RNA, 23 nt, Homo sapiens
caaacaugcggugccaugaaggg

SEQ ID NO: 1975674 - RNA, 17 nt, Homo sapiens
agaaaaacaucuggaua

SEQ ID NO: 1975675 - RNA, 18 nt, Homo sapiens
aaugaccaguuuaccuga

SEQ ID NO: 1975676 - RNA, 13 nt, Homo sapiens
ugaauucugggaa

SEQ ID NO: 1975677 - RNA, 17 nt, Homo sapiens
gcagcuccgccuggcac

SEQ ID NO: 1975678 - RNA, 18 nt, Homo sapiens
uuauucuuccaaguucau

SEQ ID NO: 1975679 - RNA, 16 nt, Homo sapiens
ccugcugagcacagac

SEQ ID NO: 1975680 - RNA, 19 nt, Homo sapiens
cauuacuguuccagauucc

SEQ ID NO: 1975681 - RNA, 16 nt, Homo sapiens
uguccaacuaaaaaca

SEQ ID NO: 1975682 - RNA, 15 nt, Homo sapiens
ugggcagacacuguu

SEQ ID NO: 1975683 - RNA, 19 nt, Homo sapiens
aauaaauuccaaaauaucc

SEQ ID NO: 1975684 - RNA, 20 nt, Homo sapiens
auguuuccaucuucaguuuc

SEQ ID NO: 1975685 - RNA, 15 nt, Homo sapiens
gcaagcuauucaaug

SEQ ID NO: 1975686 - RNA, 19 nt, Homo sapiens
ucccauuugggcaguauag

SEQ ID NO: 1975687 - RNA, 23 nt, Homo sapiens
gagcagagcugauggagaaggaa

SEQ ID NO: 1975688 - RNA, 20 nt, Homo sapiens
gugggcggcuccuggugcua

SEQ ID NO: 1975689 - RNA, 16 nt, Homo sapiens
ugcccuuccucuuccc

SEQ ID NO: 1975690 - RNA, 11 nt, Homo sapiens
gccaggugccc

SEQ ID NO: 1975691 - RNA, 22 nt, Homo sapiens
guuuacaacaaacacugugaug

SEQ ID NO: 1975692 - RNA, 20 nt, Homo sapiens
acuuggaaguggggacauca

SEQ ID NO: 1975693 - RNA, 15 nt, Homo sapiens
caccugacagcuuua

SEQ ID NO: 1975694 - RNA, 24 nt, Homo sapiens
ugugaaaucucagauacuuaugaa

SEQ ID NO: 1975695 - RNA, 13 nt, Homo sapiens
uuacuaaucuuuc

SEQ ID NO: 1975696 - RNA, 18 nt, Homo sapiens
cacucuguaguuacugug

SEQ ID NO: 1975697 - RNA, 22 nt, Homo sapiens
cacauugucaccccaagccaua

SEQ ID NO: 1975698 - RNA, 13 nt, Homo sapiens
uuguccaugaugu

SEQ ID NO: 1975699 - RNA, 13 nt, Homo sapiens
uaccccugaucug

SEQ ID NO: 1975700 - RNA, 13 nt, Homo sapiens
auuaagaaugcca

SEQ ID NO: 1975701 - RNA, 12 nt, Homo sapiens
aaaaauauguga

SEQ ID NO: 1975702 - RNA, 22 nt, Homo sapiens
gggagcccacuguccugggccu

SEQ ID NO: 1975703 - RNA, 17 nt, Homo sapiens
uaacacgcugccugguc

SEQ ID NO: 1975704 - RNA, 19 nt, Homo sapiens
uaauugacauacucaggau

SEQ ID NO: 1975705 - RNA, 16 nt, Homo sapiens
gacaccugccuuaaca

SEQ ID NO: 1975706 - RNA, 20 nt, Homo sapiens
aucucaaauuuuaaguuaaa

SEQ ID NO: 1975707 - RNA, 21 nt, Homo sapiens
aacgaaacacagaacucagcc

SEQ ID NO: 1975708 - RNA, 15 nt, Homo sapiens
cugccucacaucucc

SEQ ID NO: 1975709 - RNA, 18 nt, Homo sapiens
auuaaguucucaauguga

SEQ ID NO: 1975710 - RNA, 13 nt, Homo sapiens
cugcccacggcca

SEQ ID NO: 1975711 - RNA, 14 nt, Homo sapiens
accuucagugaaag

SEQ ID NO: 1975712 - RNA, 13 nt, Homo sapiens
uaccuugugaagu

SEQ ID NO: 1975713 - RNA, 18 nt, Homo sapiens
agaaaaaaguacagaaca

SEQ ID NO: 1975714 - RNA, 17 nt, Homo sapiens
caaaacaaacaugcagu

SEQ ID NO: 1975715 - RNA, 13 nt, Homo sapiens
acgucugugcucu

SEQ ID NO: 1975716 - RNA, 20 nt, Homo sapiens
uaaaucauggguccagccua

SEQ ID NO: 1975717 - RNA, 15 nt, Homo sapiens
agggcaaucuugucc

SEQ ID NO: 1975718 - RNA, 11 nt, Homo sapiens
aucauggaaua

SEQ ID NO: 1975719 - RNA, 22 nt, Homo sapiens
cccugcccuucccccugcaaaa

SEQ ID NO: 1975720 - RNA, 20 nt, Homo sapiens
aacagcuguaaucuaugaau

SEQ ID NO: 1975721 - RNA, 17 nt, Homo sapiens
gaguccauuugaagccg

SEQ ID NO: 1975722 - RNA, 19 nt, Homo sapiens
cauucaugugggcauuucu

SEQ ID NO: 1975723 - RNA, 18 nt, Homo sapiens
ggaguguggccacguggg

SEQ ID NO: 1975724 - RNA, 18 nt, Homo sapiens
ugauugacagaacccuuu

SEQ ID NO: 1975725 - RNA, 18 nt, Homo sapiens
uacacccuuucuugacaa

SEQ ID NO: 1975726 - RNA, 13 nt, Homo sapiens
uuguaaaauccac

SEQ ID NO: 1975727 - RNA, 12 nt, Homo sapiens
aauuaacugaag

SEQ ID NO: 1975728 - RNA, 20 nt, Homo sapiens
guuucuauguccaaaccugg

SEQ ID NO: 1975729 - RNA, 18 nt, Homo sapiens
ugcaaauccuaugugauu

SEQ ID NO: 1975730 - RNA, 15 nt, Homo sapiens
cuagauacugaaugu

SEQ ID NO: 1975731 - RNA, 14 nt, Homo sapiens
augguccagaaacu

SEQ ID NO: 1975732 - RNA, 21 nt, Homo sapiens
ugugccauauuugugccauuc

SEQ ID NO: 1975733 - RNA, 12 nt, Homo sapiens
auaaagugaaua

SEQ ID NO: 1975734 - RNA, 17 nt, Homo sapiens
auaggauauacuguaug

SEQ ID NO: 1975735 - RNA, 21 nt, Homo sapiens
uuauuucugguaacucacuca

SEQ ID NO: 1975736 - RNA, 15 nt, Homo sapiens
uggauuaacauauag

SEQ ID NO: 1975737 - RNA, 15 nt, Homo sapiens
gaaaauguacauguu

SEQ ID NO: 1975738 - RNA, 17 nt, Homo sapiens
augaacauucaagagag

SEQ ID NO: 1975739 - RNA, 21 nt, Homo sapiens
guaaauugacguacuugcagu

SEQ ID NO: 1975740 - RNA, 15 nt, Homo sapiens
gcagcgcgugcacag

SEQ ID NO: 1975741 - RNA, 15 nt, Homo sapiens
aauaaauacuugccu

SEQ ID NO: 1975742 - RNA, 16 nt, Homo sapiens
augccacuucaccaag

SEQ ID NO: 1975743 - RNA, 20 nt, Homo sapiens
uuagauuguuaaaauaacua

SEQ ID NO: 1975744 - RNA, 17 nt, Homo sapiens
caaccauagaacugucc

SEQ ID NO: 1975745 - RNA, 16 nt, Homo sapiens
ucugauuucugaagug

SEQ ID NO: 1975746 - RNA, 18 nt, Homo sapiens
uauaucaagguuucaaua

SEQ ID NO: 1975747 - RNA, 19 nt, Homo sapiens
cuuaaaaacggauaaguuu

SEQ ID NO: 1975748 - RNA, 16 nt, Homo sapiens
cugaugugcaguuuaa

SEQ ID NO: 1975749 - RNA, 22 nt, Homo sapiens
uaaaguauuuucuucucuguga

SEQ ID NO: 1975750 - RNA, 20 nt, Homo sapiens
caggcaacgcacaaaacaga

SEQ ID NO: 1975751 - RNA, 20 nt, Homo sapiens
cccugcuccacgaagccuua

SEQ ID NO: 1975752 - RNA, 14 nt, Homo sapiens
cgauuagacuccau

SEQ ID NO: 1975753 - RNA, 19 nt, Homo sapiens
accuguccuugcacacucc

SEQ ID NO: 1975754 - RNA, 15 nt, Homo sapiens
ugacacuccuuucag

SEQ ID NO: 1975755 - RNA, 14 nt, Homo sapiens
uacccacauguaca

SEQ ID NO: 1975756 - RNA, 14 nt, Homo sapiens
cacuucagaucuga

SEQ ID NO: 1975757 - RNA, 18 nt, Homo sapiens
cuguguaaacucaucuga

SEQ ID NO: 1975758 - RNA, 21 nt, Homo sapiens
ugcaaauauugguuaguauuu

SEQ ID NO: 1975759 - RNA, 22 nt, Homo sapiens
aucccguaccucuucccaugac

SEQ ID NO: 1975760 - RNA, 13 nt, Homo sapiens
cuggcugugacaa

SEQ ID NO: 1975761 - RNA, 16 nt, Homo sapiens
acuuuucccauucagc

SEQ ID NO: 1975762 - RNA, 17 nt, Homo sapiens
ccuuaguccccaagccc

SEQ ID NO: 1975763 - RNA, 18 nt, Homo sapiens
uacaauuuccauauaguc

SEQ ID NO: 1975764 - RNA, 21 nt, Homo sapiens
gcaaacucaaguugaaggaca

SEQ ID NO: 1975765 - RNA, 16 nt, Homo sapiens
acccugccccaugaaa

SEQ ID NO: 1975766 - RNA, 16 nt, Homo sapiens
ugauggaagaugcagu

SEQ ID NO: 1975767 - RNA, 17 nt, Homo sapiens
uaaaacuauaaguaaua

SEQ ID NO: 1975768 - RNA, 19 nt, Homo sapiens
gccugauaauccuauuaca

SEQ ID NO: 1975769 - RNA, 14 nt, Homo sapiens
augaagacauuucu

SEQ ID NO: 1975770 - RNA, 16 nt, Homo sapiens
ugugaucaagcaauaa

SEQ ID NO: 1975771 - RNA, 15 nt, Homo sapiens
aaugaaauacugaga

SEQ ID NO: 1975772 - RNA, 13 nt, Homo sapiens
cucuuagcucagc

SEQ ID NO: 1975773 - RNA, 17 nt, Homo sapiens
uugccucuaccaguugg

SEQ ID NO: 1975774 - RNA, 12 nt, Homo sapiens
ucagauaaggua

SEQ ID NO: 1975775 - RNA, 12 nt, Homo sapiens
gcugauaaugaa

SEQ ID NO: 1975776 - RNA, 14 nt, Homo sapiens
auggcuuccuccug

SEQ ID NO: 1975777 - RNA, 17 nt, Homo sapiens
ucccagauuucaggaaa

SEQ ID NO: 1975778 - RNA, 14 nt, Homo sapiens
cacacuuguccaca

SEQ ID NO: 1975779 - RNA, 14 nt, Homo sapiens
uccuguugcacuga

SEQ ID NO: 1975780 - RNA, 19 nt, Homo sapiens
auugcaauaaauggcuuga

SEQ ID NO: 1975781 - RNA, 20 nt, Homo sapiens
auauucauguaccugugauc

SEQ ID NO: 1975782 - RNA, 14 nt, Homo sapiens
agauccucuugcca

SEQ ID NO: 1975783 - RNA, 14 nt, Homo sapiens
ccauuugugauacu

SEQ ID NO: 1975784 - RNA, 13 nt, Homo sapiens
gcccccaguggga

SEQ ID NO: 1975785 - RNA, 23 nt, Homo sapiens
auuauaagggagagcugagccag

SEQ ID NO: 1975786 - RNA, 19 nt, Homo sapiens
ggcuuuaaaacuuauccuc

SEQ ID NO: 1975787 - RNA, 23 nt, Homo sapiens
ugaccucuauaauugccacugag

SEQ ID NO: 1975788 - RNA, 17 nt, Homo sapiens
agaucuggaaccuuacc

SEQ ID NO: 1975789 - RNA, 22 nt, Homo sapiens
uuuaugaucuuaacuucacuuc

SEQ ID NO: 1975790 - RNA, 21 nt, Homo sapiens
gcaucgacacuaaaaacugau

SEQ ID NO: 1975791 - RNA, 18 nt, Homo sapiens
acuggauuuuugcucugc

SEQ ID NO: 1975792 - RNA, 14 nt, Homo sapiens
guauuaacuuguag

SEQ ID NO: 1975793 - RNA, 13 nt, Homo sapiens
uuguucuugauag

SEQ ID NO: 1975794 - RNA, 20 nt, Homo sapiens
cccuccuugggucauugacc

SEQ ID NO: 1975795 - RNA, 23 nt, Homo sapiens
agacagcaggcagcgccaagugc

SEQ ID NO: 1975796 - RNA, 19 nt, Homo sapiens
uugaaucuaaaaccaaaua

SEQ ID NO: 1975797 - RNA, 11 nt, Homo sapiens
caugaaucuuu

SEQ ID NO: 1975798 - RNA, 18 nt, Homo sapiens
aggacugggucugaccug

SEQ ID NO: 1975799 - RNA, 19 nt, Homo sapiens
auggcugaauaauauugca

SEQ ID NO: 1975800 - RNA, 17 nt, Homo sapiens
caguaaucuuuauacug

SEQ ID NO: 1975801 - RNA, 22 nt, Homo sapiens
uuuacuaaaauggcagcuuaaa

SEQ ID NO: 1975802 - RNA, 22 nt, Homo sapiens
acagaguugccaggcacuuuga

SEQ ID NO: 1975803 - RNA, 14 nt, Homo sapiens
cauucaaauacugu

SEQ ID NO: 1975804 - RNA, 13 nt, Homo sapiens
ugcagcucaggag

SEQ ID NO: 1975805 - RNA, 13 nt, Homo sapiens
agccucucuggcu

SEQ ID NO: 1975806 - RNA, 16 nt, Homo sapiens
aagggagggugacaug

SEQ ID NO: 1975807 - RNA, 14 nt, Homo sapiens
gcauuuuaagcaua

SEQ ID NO: 1975808 - RNA, 16 nt, Homo sapiens
uucucuaccucauggg

SEQ ID NO: 1975809 - RNA, 16 nt, Homo sapiens
uuuagagaaguucaau

SEQ ID NO: 1975810 - RNA, 16 nt, Homo sapiens
aggaagaaaucacuua

SEQ ID NO: 1975811 - RNA, 20 nt, Homo sapiens
guaacaauuguguagccuuu

SEQ ID NO: 1975812 - RNA, 22 nt, Homo sapiens
guaaaguuugcucuaccaaaua

SEQ ID NO: 1975813 - RNA, 21 nt, Homo sapiens
uucagaagccccauuugcaca

SEQ ID NO: 1975814 - RNA, 21 nt, Homo sapiens
gcgaacaguccaaucaguggg

SEQ ID NO: 1975815 - RNA, 16 nt, Homo sapiens
caugcagcaggugcaa

SEQ ID NO: 1975816 - RNA, 20 nt, Homo sapiens
uacaucuccuugaucauguc

SEQ ID NO: 1975817 - RNA, 10 nt, Homo sapiens
ugcugugaau

SEQ ID NO: 1975818 - RNA, 23 nt, Homo sapiens
aagcaacauucguucucuaacca

SEQ ID NO: 1975819 - RNA, 13 nt, Homo sapiens
cucuuacauugaa

SEQ ID NO: 1975820 - RNA, 21 nt, Homo sapiens
ggaguuuucuggagugagcac

SEQ ID NO: 1975821 - RNA, 16 nt, Homo sapiens
gcagacaaugacccca

SEQ ID NO: 1975822 - RNA, 13 nt, Homo sapiens
cauucucaccuau

SEQ ID NO: 1975823 - RNA, 14 nt, Homo sapiens
cccauuugccuugc

SEQ ID NO: 1975824 - RNA, 18 nt, Homo sapiens
gagcuugacuucaugcca

SEQ ID NO: 1975825 - RNA, 13 nt, Homo sapiens
uaacaacuguggu

SEQ ID NO: 1975826 - RNA, 20 nt, Homo sapiens
cuucuuucauucuaauccuu

SEQ ID NO: 1975827 - RNA, 17 nt, Homo sapiens
ccugcugggaaugcucc

SEQ ID NO: 1975828 - RNA, 16 nt, Homo sapiens
acgccaaugcacacac

SEQ ID NO: 1975829 - RNA, 20 nt, Homo sapiens
uugcauagaguauagcucug

SEQ ID NO: 1975830 - RNA, 16 nt, Homo sapiens
gcuguauuguguauca

SEQ ID NO: 1975831 - RNA, 22 nt, Homo sapiens
gcaauuccgcauuuaauucaug

SEQ ID NO: 1975832 - RNA, 15 nt, Homo sapiens
aaguacauacauucu

SEQ ID NO: 1975833 - RNA, 18 nt, Homo sapiens
gaucuucaagcagggaag

SEQ ID NO: 1975834 - RNA, 19 nt, Homo sapiens
uugcaauuuuuccaugaag

SEQ ID NO: 1975835 - RNA, 13 nt, Homo sapiens
acagcaaauuucu

SEQ ID NO: 1975836 - RNA, 22 nt, Homo sapiens
aacugugcccugccuucagcuu

SEQ ID NO: 1975837 - RNA, 14 nt, Homo sapiens
uguauccauccaug

SEQ ID NO: 1975838 - RNA, 21 nt, Homo sapiens
gaguggcucacccuguccaga

SEQ ID NO: 1975839 - RNA, 20 nt, Homo sapiens
uucaauaaaguacugcaaaa

SEQ ID NO: 1975840 - RNA, 15 nt, Homo sapiens
aguuuugaccuaaca

SEQ ID NO: 1975841 - RNA, 20 nt, Homo sapiens
aagaaguguuccuucauuaa

SEQ ID NO: 1975842 - RNA, 18 nt, Homo sapiens
uagccugggcucacugug

SEQ ID NO: 1975843 - RNA, 22 nt, Homo sapiens
cagugccagcaaugacaucuca

SEQ ID NO: 1975844 - RNA, 14 nt, Homo sapiens
ucugugcaggguau

SEQ ID NO: 1975845 - RNA, 16 nt, Homo sapiens
ugcaguggugcaugca

SEQ ID NO: 1975846 - RNA, 19 nt, Homo sapiens
ucacugcccccuccguccc

SEQ ID NO: 1975847 - RNA, 20 nt, Homo sapiens
uuaggucaguagacugugau

SEQ ID NO: 1975848 - RNA, 22 nt, Homo sapiens
caaccccucuccaggccuguca

SEQ ID NO: 1975849 - RNA, 19 nt, Homo sapiens
gcaggcugggccaugucca

SEQ ID NO: 1975850 - RNA, 14 nt, Homo sapiens
uauucaggagagua

SEQ ID NO: 1975851 - RNA, 23 nt, Homo sapiens
uauuaauaaagcauucuuuaaca

SEQ ID NO: 1975852 - RNA, 13 nt, Homo sapiens
acuccacuggaca

SEQ ID NO: 1975853 - RNA, 19 nt, Homo sapiens
uaguacuuuauuaguuuaa

SEQ ID NO: 1975854 - RNA, 17 nt, Homo sapiens
uaggccccugcccugua

SEQ ID NO: 1975855 - RNA, 17 nt, Homo sapiens
auguuguagcagugauu

SEQ ID NO: 1975856 - RNA, 20 nt, Homo sapiens
acaacuauuuucagauguga

SEQ ID NO: 1975857 - RNA, 14 nt, Homo sapiens
guaagcuguuuauu

SEQ ID NO: 1975858 - RNA, 20 nt, Homo sapiens
ucucccaaguccagugugac

SEQ ID NO: 1975859 - RNA, 19 nt, Homo sapiens
uguuugaagcacagugauc

SEQ ID NO: 1975860 - RNA, 19 nt, Homo sapiens
uauuguaaaaaauucacau

SEQ ID NO: 1975861 - RNA, 13 nt, Homo sapiens
cccacuucccacc

SEQ ID NO: 1975862 - RNA, 14 nt, Homo sapiens
acauacuuucaucc

SEQ ID NO: 1975863 - RNA, 20 nt, Homo sapiens
aauucccuuuuaacccagug

SEQ ID NO: 1975864 - RNA, 22 nt, Homo sapiens
aauuuaaauaauagacauacag

SEQ ID NO: 1975865 - RNA, 23 nt, Homo sapiens
cuguaugagacaggaaaaaccaa

SEQ ID NO: 1975866 - RNA, 17 nt, Homo sapiens
ucucaauuuaguauaau

SEQ ID NO: 1975867 - RNA, 15 nt, Homo sapiens
gggaauacuggccau

SEQ ID NO: 1975868 - RNA, 14 nt, Homo sapiens
cccuuugggagcaa

SEQ ID NO: 1975869 - RNA, 21 nt, Homo sapiens
cuggggcaggaagcuugucac

SEQ ID NO: 1975870 - RNA, 18 nt, Homo sapiens
cuuugacguggagcugcu

SEQ ID NO: 1975871 - RNA, 13 nt, Homo sapiens
uggcucucauggg

SEQ ID NO: 1975872 - RNA, 21 nt, Homo sapiens
gaaauuuuuuuccagaauuga

SEQ ID NO: 1975873 - RNA, 18 nt, Homo sapiens
accccucagggguuucau

SEQ ID NO: 1975874 - RNA, 15 nt, Homo sapiens
gcccacacccaggcc

SEQ ID NO: 1975875 - RNA, 12 nt, Homo sapiens
gacaacacuuaa

SEQ ID NO: 1975876 - RNA, 13 nt, Homo sapiens
aacagcaguguuc

SEQ ID NO: 1975877 - RNA, 16 nt, Homo sapiens
uggcaugcaccugcaa

SEQ ID NO: 1975878 - RNA, 18 nt, Homo sapiens
caagaugugggcagugau

SEQ ID NO: 1975879 - RNA, 15 nt, Homo sapiens
guggaugauguuucg

SEQ ID NO: 1975880 - RNA, 15 nt, Homo sapiens
acauauugagcacuu

SEQ ID NO: 1975881 - RNA, 16 nt, Homo sapiens
ccagggaggagucagu

SEQ ID NO: 1975882 - RNA, 18 nt, Homo sapiens
auauguauauacauauca

SEQ ID NO: 1975883 - RNA, 13 nt, Homo sapiens
ucaucuguuguuu

SEQ ID NO: 1975884 - RNA, 19 nt, Homo sapiens
ugaaguacucagauuugau

SEQ ID NO: 1975885 - RNA, 24 nt, Homo sapiens
gcagccucagaguggucgagugac

SEQ ID NO: 1975886 - RNA, 21 nt, Homo sapiens
ccuaggucauuuguagauaua

SEQ ID NO: 1975887 - RNA, 13 nt, Homo sapiens
ccugcaaaaucug

SEQ ID NO: 1975888 - RNA, 16 nt, Homo sapiens
auuaguugagaaagaa

SEQ ID NO: 1975889 - RNA, 18 nt, Homo sapiens
gaccacuccccucaaaac

SEQ ID NO: 1975890 - RNA, 12 nt, Homo sapiens
ucuuuacuuucc

SEQ ID NO: 1975891 - RNA, 12 nt, Homo sapiens
uuucuacuuccu

SEQ ID NO: 1975892 - RNA, 21 nt, Homo sapiens
augacacacugcggugucugc

SEQ ID NO: 1975893 - RNA, 22 nt, Homo sapiens
uagaaguuaaugauuuuacuua

SEQ ID NO: 1975894 - RNA, 15 nt, Homo sapiens
ggaauuccucuauga

SEQ ID NO: 1975895 - RNA, 20 nt, Homo sapiens
gcccuucccugacacugucu

SEQ ID NO: 1975896 - RNA, 23 nt, Homo sapiens
gaagaaagcuaaucuguuuagua

SEQ ID NO: 1975897 - RNA, 16 nt, Homo sapiens
acagcagccucugaag

SEQ ID NO: 1975898 - RNA, 19 nt, Homo sapiens
cauacucuccuuuugacuc

SEQ ID NO: 1975899 - RNA, 16 nt, Homo sapiens
uauugccucuacuuug

SEQ ID NO: 1975900 - RNA, 12 nt, Homo sapiens
auuuagauuuaa

SEQ ID NO: 1975901 - RNA, 20 nt, Homo sapiens
ucagguccaugugcacugca

SEQ ID NO: 1975902 - RNA, 14 nt, Homo sapiens
aagggccagcccua

SEQ ID NO: 1975903 - RNA, 22 nt, Homo sapiens
ucaaauacacauuugcuacugu

SEQ ID NO: 1975904 - RNA, 22 nt, Homo sapiens
uggaugauucaggagaguguau

SEQ ID NO: 1975905 - RNA, 18 nt, Homo sapiens
ccauucaugaugaacuca

SEQ ID NO: 1975906 - RNA, 14 nt, Homo sapiens
gcuauggugagaug

SEQ ID NO: 1975907 - RNA, 12 nt, Homo sapiens
ugccccaugaga

SEQ ID NO: 1975908 - RNA, 19 nt, Homo sapiens
cuaauacagacuaugucac

SEQ ID NO: 1975909 - RNA, 12 nt, Homo sapiens
caauccaagagu

SEQ ID NO: 1975910 - RNA, 21 nt, Homo sapiens
gugggauauugaauguuaaag

SEQ ID NO: 1975911 - RNA, 12 nt, Homo sapiens
ggcucucaggcc

SEQ ID NO: 1975912 - RNA, 12 nt, Homo sapiens
ugaggucucagc

SEQ ID NO: 1975913 - RNA, 15 nt, Homo sapiens
cagaccuaauaucau

SEQ ID NO: 1975914 - RNA, 14 nt, Homo sapiens
augaagcacugagc

SEQ ID NO: 1975915 - RNA, 22 nt, Homo sapiens
ccccugucucggggcuugcccc

SEQ ID NO: 1975916 - RNA, 20 nt, Homo sapiens
caugaugcuaaaggcugcga

SEQ ID NO: 1975917 - RNA, 12 nt, Homo sapiens
gcucaaugccau

SEQ ID NO: 1975918 - RNA, 17 nt, Homo sapiens
uacauugugacuguguu

SEQ ID NO: 1975919 - RNA, 17 nt, Homo sapiens
auguauaaaacuaggaa

SEQ ID NO: 1975920 - RNA, 19 nt, Homo sapiens
ucaagaugaugaugaucuu

SEQ ID NO: 1975921 - RNA, 14 nt, Homo sapiens
ucagucuacaggcc

SEQ ID NO: 1975922 - RNA, 14 nt, Homo sapiens
gucaccaugaucac

SEQ ID NO: 1975923 - RNA, 13 nt, Homo sapiens
gaaccugugcuca

SEQ ID NO: 1975924 - RNA, 16 nt, Homo sapiens
ucacacacaugcacac

SEQ ID NO: 1975925 - RNA, 13 nt, Homo sapiens
ugucauuguauuc

SEQ ID NO: 1975926 - RNA, 13 nt, Homo sapiens
gaagguugcucua

SEQ ID NO: 1975927 - RNA, 17 nt, Homo sapiens
gucuccuacuccugacu

SEQ ID NO: 1975928 - RNA, 15 nt, Homo sapiens
aacaacuucuuugua

SEQ ID NO: 1975929 - RNA, 21 nt, Homo sapiens
gaguaugugagaaccaaccaa

SEQ ID NO: 1975930 - RNA, 12 nt, Homo sapiens
gcucaccagccc

SEQ ID NO: 1975931 - RNA, 11 nt, Homo sapiens
cuguguuaaaa

SEQ ID NO: 1975932 - RNA, 14 nt, Homo sapiens
cuccuucccaaaag

SEQ ID NO: 1975933 - RNA, 21 nt, Homo sapiens
agaugcuguaguaacugccuc

SEQ ID NO: 1975934 - RNA, 13 nt, Homo sapiens
cgauggagcaguc

SEQ ID NO: 1975935 - RNA, 15 nt, Homo sapiens
ggcagcaaugguguu

SEQ ID NO: 1975936 - RNA, 15 nt, Homo sapiens
agggccucaucucag

SEQ ID NO: 1975937 - RNA, 18 nt, Homo sapiens
cccugggggauaccagcu

SEQ ID NO: 1975938 - RNA, 20 nt, Homo sapiens
cugacccagggacucuccaa

SEQ ID NO: 1975939 - RNA, 16 nt, Homo sapiens
uccacagcagcaaagg

SEQ ID NO: 1975940 - RNA, 21 nt, Homo sapiens
aucuuucuuccaaacaggcuc

SEQ ID NO: 1975941 - RNA, 12 nt, Homo sapiens
ugaggucagggg

SEQ ID NO: 1975942 - RNA, 23 nt, Homo sapiens
ugcuacaugacgacaaagcugcu

SEQ ID NO: 1975943 - RNA, 16 nt, Homo sapiens
acuuacuaaauaucau

SEQ ID NO: 1975944 - RNA, 17 nt, Homo sapiens
cagugaagauuuaccuc

SEQ ID NO: 1975945 - RNA, 16 nt, Homo sapiens
uuucaauaccagggaa

SEQ ID NO: 1975946 - RNA, 12 nt, Homo sapiens
agaaacccaagc

SEQ ID NO: 1975947 - RNA, 23 nt, Homo sapiens
aaguuucacuggcugguggcugu

SEQ ID NO: 1975948 - RNA, 22 nt, Homo sapiens
ucuccagccagcaaugaugucc

SEQ ID NO: 1975949 - RNA, 22 nt, Homo sapiens
aaauuuugauuaaccuuuucaa

SEQ ID NO: 1975950 - RNA, 19 nt, Homo sapiens
ccuuuuagggaauaauauu

SEQ ID NO: 1975951 - RNA, 13 nt, Homo sapiens
cccgugccaaaaa

SEQ ID NO: 1975952 - RNA, 18 nt, Homo sapiens
cuucaaugggcucuucca

SEQ ID NO: 1975953 - RNA, 23 nt, Homo sapiens
ccugaaaagggcggaagaguuac

SEQ ID NO: 1975954 - RNA, 17 nt, Homo sapiens
ccauguaagguugugca

SEQ ID NO: 1975955 - RNA, 15 nt, Homo sapiens
caucaggaaacagga

SEQ ID NO: 1975956 - RNA, 15 nt, Homo sapiens
uaguacugaagccaa

SEQ ID NO: 1975957 - RNA, 15 nt, Homo sapiens
auacccaaauccucu

SEQ ID NO: 1975958 - RNA, 15 nt, Homo sapiens
aaggauuuauucuca

SEQ ID NO: 1975959 - RNA, 16 nt, Homo sapiens
uguguaguaucuugaa

SEQ ID NO: 1975960 - RNA, 23 nt, Homo sapiens
cuagauuuaaccauggcacugag

SEQ ID NO: 1975961 - RNA, 15 nt, Homo sapiens
uaaaacauuuugacu

SEQ ID NO: 1975962 - RNA, 24 nt, Homo sapiens
aaucaucuauaaagaagaacuugc

SEQ ID NO: 1975963 - RNA, 22 nt, Homo sapiens
cuaagucccuuccuauucuccu

SEQ ID NO: 1975964 - RNA, 23 nt, Homo sapiens
uaugugacgacugcaaagccagu

SEQ ID NO: 1975965 - RNA, 16 nt, Homo sapiens
agcaaguuuucuucca

SEQ ID NO: 1975966 - RNA, 15 nt, Homo sapiens
uccgcuacuacauca

SEQ ID NO: 1975967 - RNA, 15 nt, Homo sapiens
guaaaaaauauuaaa

SEQ ID NO: 1975968 - RNA, 22 nt, Homo sapiens
gaaacuuggaugucacugccug

SEQ ID NO: 1975969 - RNA, 17 nt, Homo sapiens
cacagaggagugcagcc

SEQ ID NO: 1975970 - RNA, 20 nt, Homo sapiens
ccagccucgcccauccccuu

SEQ ID NO: 1975971 - RNA, 17 nt, Homo sapiens
ugcacguggccucuuga

SEQ ID NO: 1975972 - RNA, 22 nt, Homo sapiens
gguggauauuaaaaaucuguaa

SEQ ID NO: 1975973 - RNA, 14 nt, Homo sapiens
uauauccauaagau

SEQ ID NO: 1975974 - RNA, 22 nt, Homo sapiens
agcaagaucccauggguugugu

SEQ ID NO: 1975975 - RNA, 12 nt, Homo sapiens
uaaauacuguac

SEQ ID NO: 1975976 - RNA, 17 nt, Homo sapiens
ucauacagcauuacaaa

SEQ ID NO: 1975977 - RNA, 18 nt, Homo sapiens
cuugcccaguacauuuaa

SEQ ID NO: 1975978 - RNA, 19 nt, Homo sapiens
auuaauuuuggucuaaaac

SEQ ID NO: 1975979 - RNA, 22 nt, Homo sapiens
augggugggaguaaaagcaaca

SEQ ID NO: 1975980 - RNA, 15 nt, Homo sapiens
gugagacugacugca

SEQ ID NO: 1975981 - RNA, 20 nt, Homo sapiens
auuuccauugcuuauuaugu

SEQ ID NO: 1975982 - RNA, 22 nt, Homo sapiens
uuuuugagacagaguuucacuc

SEQ ID NO: 1975983 - RNA, 16 nt, Homo sapiens
uauguagaugugcauu

SEQ ID NO: 1975984 - RNA, 23 nt, Homo sapiens
uuccucugcaguuuugacauuua

SEQ ID NO: 1975985 - RNA, 18 nt, Homo sapiens
uagauguggccuuugaau

SEQ ID NO: 1975986 - RNA, 17 nt, Homo sapiens
cucauguguuugcauaa

SEQ ID NO: 1975987 - RNA, 14 nt, Homo sapiens
ugaaggugaccucu

SEQ ID NO: 1975988 - RNA, 16 nt, Homo sapiens
cuugaguaacauuuau

SEQ ID NO: 1975989 - RNA, 13 nt, Homo sapiens
aaagcaauuucuc

SEQ ID NO: 1975990 - RNA, 20 nt, Homo sapiens
ucccaagcuguauguacuuc

SEQ ID NO: 1975991 - RNA, 23 nt, Homo sapiens
aggaauccuggaccaagcacaaa

SEQ ID NO: 1975992 - RNA, 16 nt, Homo sapiens
ucagugggacucugau

SEQ ID NO: 1975993 - RNA, 15 nt, Homo sapiens
gauauacaaagggau

SEQ ID NO: 1975994 - RNA, 18 nt, Homo sapiens
cucaaaaaggugugucaa

SEQ ID NO: 1975995 - RNA, 14 nt, Homo sapiens
aacccucacuggga

SEQ ID NO: 1975996 - RNA, 22 nt, Homo sapiens
augaagagcuauuuaaugacac

SEQ ID NO: 1975997 - RNA, 15 nt, Homo sapiens
ccagugccaggccag

SEQ ID NO: 1975998 - RNA, 14 nt, Homo sapiens
uagagauaugcaca

SEQ ID NO: 1975999 - RNA, 22 nt, Homo sapiens
ucuguuggcaggcuggccaguc

SEQ ID NO: 1976000 - RNA, 21 nt, Homo sapiens
guagguaggucuguuugccac

SEQ ID NO: 1976001 - RNA, 23 nt, Homo sapiens
ugcaccccuggugucccugccug

SEQ ID NO: 1976002 - RNA, 17 nt, Homo sapiens
uucucauuuagcauuga

SEQ ID NO: 1976003 - RNA, 19 nt, Homo sapiens
aauaaaugauguacuacau

SEQ ID NO: 1976004 - RNA, 13 nt, Homo sapiens
ccgugugcuccuc

SEQ ID NO: 1976005 - RNA, 13 nt, Homo sapiens
ucuuuuguucucu

SEQ ID NO: 1976006 - RNA, 18 nt, Homo sapiens
cuacauuucuacuaugau

SEQ ID NO: 1976007 - RNA, 14 nt, Homo sapiens
uuaauauuccucag

SEQ ID NO: 1976008 - RNA, 19 nt, Homo sapiens
ugaugccuggcgcuuccag

SEQ ID NO: 1976009 - RNA, 16 nt, Homo sapiens
ccauagugagccauga

SEQ ID NO: 1976010 - RNA, 14 nt, Homo sapiens
uguacacagucagc

SEQ ID NO: 1976011 - RNA, 11 nt, Homo sapiens
gcuccauacaa

SEQ ID NO: 1976012 - RNA, 20 nt, Homo sapiens
ucaucaaaaucugcacaguc

SEQ ID NO: 1976013 - RNA, 15 nt, Homo sapiens
guuuugaguaauuca

SEQ ID NO: 1976014 - RNA, 20 nt, Homo sapiens
uccugauggaauuguuauac

SEQ ID NO: 1976015 - RNA, 19 nt, Homo sapiens
cguagguauuagugcuagu

SEQ ID NO: 1976016 - RNA, 16 nt, Homo sapiens
cuaaacccaauccaaa

SEQ ID NO: 1976017 - RNA, 18 nt, Homo sapiens
uacccagaaauccaucua

SEQ ID NO: 1976018 - RNA, 19 nt, Homo sapiens
auuuuguaauauugaggga

SEQ ID NO: 1976019 - RNA, 23 nt, Homo sapiens
aaaugccugcugcugccaaguua

SEQ ID NO: 1976020 - RNA, 18 nt, Homo sapiens
agcugccccacaggugug

SEQ ID NO: 1976021 - RNA, 17 nt, Homo sapiens
acaugucuguccucaga

SEQ ID NO: 1976022 - RNA, 14 nt, Homo sapiens
agugcggcugccau

SEQ ID NO: 1976023 - RNA, 15 nt, Homo sapiens
acucugagaucuaag

SEQ ID NO: 1976024 - RNA, 14 nt, Homo sapiens
agcacaaacauugc

SEQ ID NO: 1976025 - RNA, 14 nt, Homo sapiens
uucaauuauacuaa

SEQ ID NO: 1976026 - RNA, 15 nt, Homo sapiens
aucguucaacuccac

SEQ ID NO: 1976027 - RNA, 20 nt, Homo sapiens
gccaaggccaaaagaaguuu

SEQ ID NO: 1976028 - RNA, 23 nt, Homo sapiens
ucagaaauuuaauucauguuucu

SEQ ID NO: 1976029 - RNA, 23 nt, Homo sapiens
caauggugucaguauccaggcuu

SEQ ID NO: 1976030 - RNA, 20 nt, Homo sapiens
aaagcuacuugaaggacaca

SEQ ID NO: 1976031 - RNA, 18 nt, Homo sapiens
aaaggaaacccagcucac

SEQ ID NO: 1976032 - RNA, 21 nt, Homo sapiens
cgggcgguccuacugcuguga

SEQ ID NO: 1976033 - RNA, 17 nt, Homo sapiens
uccuaacauauauguau

SEQ ID NO: 1976034 - RNA, 16 nt, Homo sapiens
uaaaagcaucacauga

SEQ ID NO: 1976035 - RNA, 15 nt, Homo sapiens
ugggcucugcauccc

SEQ ID NO: 1976036 - RNA, 20 nt, Homo sapiens
gcaguucuggaauggaaggg

SEQ ID NO: 1976037 - RNA, 22 nt, Homo sapiens
aaucccuguaggcgugcuagca

SEQ ID NO: 1976038 - RNA, 19 nt, Homo sapiens
caaaggagccuacuccaag

SEQ ID NO: 1976039 - RNA, 16 nt, Homo sapiens
gagacaagcagaguaa

SEQ ID NO: 1976040 - RNA, 14 nt, Homo sapiens
gaccuuccugccac

SEQ ID NO: 1976041 - RNA, 19 nt, Homo sapiens
gagacagucucacucuguu

SEQ ID NO: 1976042 - RNA, 21 nt, Homo sapiens
cuuuaccauucagaccgagag

SEQ ID NO: 1976043 - RNA, 14 nt, Homo sapiens
gcugaauucucugc

SEQ ID NO: 1976044 - RNA, 20 nt, Homo sapiens
acccaaagauucuagugagu

SEQ ID NO: 1976045 - RNA, 14 nt, Homo sapiens
ugauguucuaaggc

SEQ ID NO: 1976046 - RNA, 23 nt, Homo sapiens
caccuugaugacuuccuauccau

SEQ ID NO: 1976047 - RNA, 18 nt, Homo sapiens
uuaguggauggaauauca

SEQ ID NO: 1976048 - RNA, 13 nt, Homo sapiens
ccuugcagcauuu

SEQ ID NO: 1976049 - RNA, 13 nt, Homo sapiens
cgcacugggcaca

SEQ ID NO: 1976050 - RNA, 13 nt, Homo sapiens
auuucugaaucuc

SEQ ID NO: 1976051 - RNA, 11 nt, Homo sapiens
gauucucaggg

SEQ ID NO: 1976052 - RNA, 19 nt, Homo sapiens
gaaugauuucuaugaacuu

SEQ ID NO: 1976053 - RNA, 15 nt, Homo sapiens
cuacuagagcuccau

SEQ ID NO: 1976054 - RNA, 19 nt, Homo sapiens
aaugauaggaaaaauccau

SEQ ID NO: 1976055 - RNA, 17 nt, Homo sapiens
aaauucauuugcuugca

SEQ ID NO: 1976056 - RNA, 13 nt, Homo sapiens
uauaaaaucuuuc

SEQ ID NO: 1976057 - RNA, 13 nt, Homo sapiens
uacuaaaucucac

SEQ ID NO: 1976058 - RNA, 14 nt, Homo sapiens
ucagauacaaaacu

SEQ ID NO: 1976059 - RNA, 12 nt, Homo sapiens
uggugacugucc

SEQ ID NO: 1976060 - RNA, 11 nt, Homo sapiens
ugaaaaaagcu

SEQ ID NO: 1976061 - RNA, 19 nt, Homo sapiens
augcccugccgugguggca

SEQ ID NO: 1976062 - RNA, 11 nt, Homo sapiens
acccucagcag

SEQ ID NO: 1976063 - RNA, 12 nt, Homo sapiens
ugacacaucucu

SEQ ID NO: 1976064 - RNA, 13 nt, Homo sapiens
uucccccacccuc

SEQ ID NO: 1976065 - RNA, 17 nt, Homo sapiens
cuugcuccuguguaaaa

SEQ ID NO: 1976066 - RNA, 17 nt, Homo sapiens
ugguguagcuacagaga

SEQ ID NO: 1976067 - RNA, 15 nt, Homo sapiens
gucuguggagccauc

SEQ ID NO: 1976068 - RNA, 19 nt, Homo sapiens
uccauuuuacuuccaugau

SEQ ID NO: 1976069 - RNA, 16 nt, Homo sapiens
uacugagaggaggggu

SEQ ID NO: 1976070 - RNA, 14 nt, Homo sapiens
aaauuaacuguaug

SEQ ID NO: 1976071 - RNA, 12 nt, Homo sapiens
ugaauacucuga

SEQ ID NO: 1976072 - RNA, 14 nt, Homo sapiens
gcuaugccaagcca

SEQ ID NO: 1976073 - RNA, 16 nt, Homo sapiens
ucauauaccagcaaua

SEQ ID NO: 1976074 - RNA, 20 nt, Homo sapiens
guuguuccaccuucccucau

SEQ ID NO: 1976075 - RNA, 16 nt, Homo sapiens
ugaagcuuuacuuuag

SEQ ID NO: 1976076 - RNA, 13 nt, Homo sapiens
ucaauccuaucac

SEQ ID NO: 1976077 - RNA, 18 nt, Homo sapiens
aagcaacagacuucucaa

SEQ ID NO: 1976078 - RNA, 20 nt, Homo sapiens
agccuucugaggacauucca

SEQ ID NO: 1976079 - RNA, 20 nt, Homo sapiens
uucagagugaguguaggggu

SEQ ID NO: 1976080 - RNA, 12 nt, Homo sapiens
aaaaccaaacaa

SEQ ID NO: 1976081 - RNA, 21 nt, Homo sapiens
agcacagggggauucugagca

SEQ ID NO: 1976082 - RNA, 20 nt, Homo sapiens
gucucaugcggacccucaca

SEQ ID NO: 1976083 - RNA, 12 nt, Homo sapiens
cucuuagcucag

SEQ ID NO: 1976084 - RNA, 15 nt, Homo sapiens
gauuaaauacauaug

SEQ ID NO: 1976085 - RNA, 15 nt, Homo sapiens
auugcgaaugugcag

SEQ ID NO: 1976086 - RNA, 14 nt, Homo sapiens
cauugucugcaaug

SEQ ID NO: 1976087 - RNA, 17 nt, Homo sapiens
uuccauccccaaacugu

SEQ ID NO: 1976088 - RNA, 11 nt, Homo sapiens
uuguagcuuuu

SEQ ID NO: 1976089 - RNA, 19 nt, Homo sapiens
caguaagaacaucauaaaa

SEQ ID NO: 1976090 - RNA, 12 nt, Homo sapiens
uacugugucagg

SEQ ID NO: 1976091 - RNA, 20 nt, Homo sapiens
auggaacacacuuggaugca

SEQ ID NO: 1976092 - RNA, 24 nt, Homo sapiens
ugaaaauuuuacacaguucaucau

SEQ ID NO: 1976093 - RNA, 22 nt, Homo sapiens
uuacacuuuuuggaagugaaaa

SEQ ID NO: 1976094 - RNA, 23 nt, Homo sapiens
uuauagagaugagggcucccuau

SEQ ID NO: 1976095 - RNA, 20 nt, Homo sapiens
gucacaucagauaagacaua

SEQ ID NO: 1976096 - RNA, 20 nt, Homo sapiens
acuauuaauagaacacagag

SEQ ID NO: 1976097 - RNA, 19 nt, Homo sapiens
aauuaaacaaauuccuucc

SEQ ID NO: 1976098 - RNA, 22 nt, Homo sapiens
aggugacuucagaauaacagca

SEQ ID NO: 1976099 - RNA, 22 nt, Homo sapiens
aacuacagaguuuaugauuuaa

SEQ ID NO: 1976100 - RNA, 22 nt, Homo sapiens
uuauucagaaaagaugugcaga

SEQ ID NO: 1976101 - RNA, 18 nt, Homo sapiens
ggucacuuccguuuaccu

SEQ ID NO: 1976102 - RNA, 18 nt, Homo sapiens
uguacaguauguucaaag

SEQ ID NO: 1976103 - RNA, 21 nt, Homo sapiens
gucuuuguaaugucaccaccu

SEQ ID NO: 1976104 - RNA, 16 nt, Homo sapiens
cacuagccaaaccuca

SEQ ID NO: 1976105 - RNA, 14 nt, Homo sapiens
accugacacaagag

SEQ ID NO: 1976106 - RNA, 16 nt, Homo sapiens
auuugguuagaagggu

SEQ ID NO: 1976107 - RNA, 18 nt, Homo sapiens
uugugaucuaucaauagu

SEQ ID NO: 1976108 - RNA, 20 nt, Homo sapiens
acccagggcucugcagcacc

SEQ ID NO: 1976109 - RNA, 16 nt, Homo sapiens
aagccauuauucacua

SEQ ID NO: 1976110 - RNA, 13 nt, Homo sapiens
cuugucauugccu

SEQ ID NO: 1976111 - RNA, 12 nt, Homo sapiens
aaugaagcuuug

SEQ ID NO: 1976112 - RNA, 16 nt, Homo sapiens
acucugauucaccucu

SEQ ID NO: 1976113 - RNA, 11 nt, Homo sapiens
caccuacuccu

SEQ ID NO: 1976114 - RNA, 13 nt, Homo sapiens
ugcagucacugca

SEQ ID NO: 1976115 - RNA, 19 nt, Homo sapiens
auuugcccuuaaggacaaa

SEQ ID NO: 1976116 - RNA, 18 nt, Homo sapiens
aaguguagggcaagggug

SEQ ID NO: 1976117 - RNA, 18 nt, Homo sapiens
aguccuuaggcuacugua

SEQ ID NO: 1976118 - RNA, 18 nt, Homo sapiens
ggcagguugaucagugag

SEQ ID NO: 1976119 - RNA, 19 nt, Homo sapiens
gagaaagguggacuggaag

SEQ ID NO: 1976120 - RNA, 18 nt, Homo sapiens
uaccacuaacuccugaga

SEQ ID NO: 1976121 - RNA, 22 nt, Homo sapiens
gccugauacuuuagccaucaua

SEQ ID NO: 1976122 - RNA, 12 nt, Homo sapiens
ugagagugcuag

SEQ ID NO: 1976123 - RNA, 17 nt, Homo sapiens
cuguauuucaagaccuc

SEQ ID NO: 1976124 - RNA, 13 nt, Homo sapiens
acuuugacucaga

SEQ ID NO: 1976125 - RNA, 12 nt, Homo sapiens
acacucaucccu

SEQ ID NO: 1976126 - RNA, 18 nt, Homo sapiens
uagucccagcuacucaga

SEQ ID NO: 1976127 - RNA, 19 nt, Homo sapiens
cgccuacuggacgcugccc

SEQ ID NO: 1976128 - RNA, 22 nt, Homo sapiens
gggaccugacugugggguccua

SEQ ID NO: 1976129 - RNA, 18 nt, Homo sapiens
uaaccucugcacuacuga

SEQ ID NO: 1976130 - RNA, 19 nt, Homo sapiens
uugcccuugcccugaccuc

SEQ ID NO: 1976131 - RNA, 12 nt, Homo sapiens
aaagaaauugaa

SEQ ID NO: 1976132 - RNA, 15 nt, Homo sapiens
accaucuacaccagu

SEQ ID NO: 1976133 - RNA, 21 nt, Homo sapiens
acuccaguuugcccaccacaa

SEQ ID NO: 1976134 - RNA, 14 nt, Homo sapiens
aauaacacagagag

SEQ ID NO: 1976135 - RNA, 17 nt, Homo sapiens
ucauauuaauguacuua

SEQ ID NO: 1976136 - RNA, 18 nt, Homo sapiens
uuacacuaaaaaaaugca

SEQ ID NO: 1976137 - RNA, 17 nt, Homo sapiens
gcaauaauaagugaugu

SEQ ID NO: 1976138 - RNA, 13 nt, Homo sapiens
gaaucucuuggau

SEQ ID NO: 1976139 - RNA, 12 nt, Homo sapiens
ccacaccacagg

SEQ ID NO: 1976140 - RNA, 19 nt, Homo sapiens
aaguaggugaucuuuguga

SEQ ID NO: 1976141 - RNA, 14 nt, Homo sapiens
uggcuaacuggcga

SEQ ID NO: 1976142 - RNA, 14 nt, Homo sapiens
uucuuaacuucuga

SEQ ID NO: 1976143 - RNA, 20 nt, Homo sapiens
uccuuuuaucucacaaauaa

SEQ ID NO: 1976144 - RNA, 22 nt, Homo sapiens
aaauuuuuauguaaaacccuuu

SEQ ID NO: 1976145 - RNA, 13 nt, Homo sapiens
ccaagccugacca

SEQ ID NO: 1976146 - RNA, 12 nt, Homo sapiens
auuuacauuaau

SEQ ID NO: 1976147 - RNA, 13 nt, Homo sapiens
cuccuguuuccau

SEQ ID NO: 1976148 - RNA, 15 nt, Homo sapiens
cuaucuggaagccac

SEQ ID NO: 1976149 - RNA, 13 nt, Homo sapiens
uucaaaugcauga

SEQ ID NO: 1976150 - RNA, 16 nt, Homo sapiens
uggcaagcucuaucac

SEQ ID NO: 1976151 - RNA, 19 nt, Homo sapiens
cagcuucccgaguagcugg

SEQ ID NO: 1976152 - RNA, 19 nt, Homo sapiens
auaauaaaggucacauaaa

SEQ ID NO: 1976153 - RNA, 23 nt, Homo sapiens
uguuauauagggaucaaccagcu

SEQ ID NO: 1976154 - RNA, 15 nt, Homo sapiens
cuacaaaaaugaagc

SEQ ID NO: 1976155 - RNA, 15 nt, Homo sapiens
uuggcugugugacag

SEQ ID NO: 1976156 - RNA, 21 nt, Homo sapiens
ugcauguaauggacuaugcac

SEQ ID NO: 1976157 - RNA, 14 nt, Homo sapiens
auuguguucacugu

SEQ ID NO: 1976158 - RNA, 13 nt, Homo sapiens
augccaccaaagg

SEQ ID NO: 1976159 - RNA, 23 nt, Homo sapiens
caggcccucccugucuccagggc

SEQ ID NO: 1976160 - RNA, 17 nt, Homo sapiens
uaaaaauauaagaacuu

SEQ ID NO: 1976161 - RNA, 20 nt, Homo sapiens
gcagauuuccagccuucuac

SEQ ID NO: 1976162 - RNA, 19 nt, Homo sapiens
ggaaaaugaccucaaggaa

SEQ ID NO: 1976163 - RNA, 14 nt, Homo sapiens
auaaacccaguugc

SEQ ID NO: 1976164 - RNA, 21 nt, Homo sapiens
uacauuuaaaaauacuucucu

SEQ ID NO: 1976165 - RNA, 16 nt, Homo sapiens
uuccuggucuguagaa

SEQ ID NO: 1976166 - RNA, 13 nt, Homo sapiens
aggggauccagcc

SEQ ID NO: 1976167 - RNA, 13 nt, Homo sapiens
cauguaccugaaa

SEQ ID NO: 1976168 - RNA, 22 nt, Homo sapiens
cugaguauugauaaacuuugaa

SEQ ID NO: 1976169 - RNA, 18 nt, Homo sapiens
aaaguagacugauuacac

SEQ ID NO: 1976170 - RNA, 16 nt, Homo sapiens
acacauccaucuugca

SEQ ID NO: 1976171 - RNA, 23 nt, Homo sapiens
caauguauacuucagugcucacc

SEQ ID NO: 1976172 - RNA, 15 nt, Homo sapiens
aauuaacugaacuua

SEQ ID NO: 1976173 - RNA, 14 nt, Homo sapiens
ggccugugugauac

SEQ ID NO: 1976174 - RNA, 19 nt, Homo sapiens
ucagauugaauguauuuaa

SEQ ID NO: 1976175 - RNA, 15 nt, Homo sapiens
ucacggcucacugua

SEQ ID NO: 1976176 - RNA, 14 nt, Homo sapiens
aucaaguccuacaa

SEQ ID NO: 1976177 - RNA, 19 nt, Homo sapiens
cauauauucccauguaaug

SEQ ID NO: 1976178 - RNA, 11 nt, Homo sapiens
ccaaaucucag

SEQ ID NO: 1976179 - RNA, 19 nt, Homo sapiens
caaacccaggcaggcauuu

SEQ ID NO: 1976180 - RNA, 22 nt, Homo sapiens
cauguugagguacaguuugcau

SEQ ID NO: 1976181 - RNA, 20 nt, Homo sapiens
gugaauacauucuuugcuag

SEQ ID NO: 1976182 - RNA, 17 nt, Homo sapiens
ucaacaagaguugucuu

SEQ ID NO: 1976183 - RNA, 22 nt, Homo sapiens
aaauacuuuuguacuuaaucca

SEQ ID NO: 1976184 - RNA, 14 nt, Homo sapiens
cuaaguggggaaaa

SEQ ID NO: 1976185 - RNA, 15 nt, Homo sapiens
gacaugcccaaaacu

SEQ ID NO: 1976186 - RNA, 23 nt, Homo sapiens
caccuccaggcuuucccacuucc

SEQ ID NO: 1976187 - RNA, 20 nt, Homo sapiens
aauggguuuuguguacugua

SEQ ID NO: 1976188 - RNA, 12 nt, Homo sapiens
cuaagccuccuu

SEQ ID NO: 1976189 - RNA, 21 nt, Homo sapiens
cuaccaacuuguauccaggcc

SEQ ID NO: 1976190 - RNA, 17 nt, Homo sapiens
accucuucuuucccucc

SEQ ID NO: 1976191 - RNA, 22 nt, Homo sapiens
aagugagacccugucucaaaaa

SEQ ID NO: 1976192 - RNA, 18 nt, Homo sapiens
agcuuucaaaagcaagaa

SEQ ID NO: 1976193 - RNA, 13 nt, Homo sapiens
ggcucccaaguca

SEQ ID NO: 1976194 - RNA, 19 nt, Homo sapiens
aggggagucaccagccaga

SEQ ID NO: 1976195 - RNA, 18 nt, Homo sapiens
guacaggcagcacagaga

SEQ ID NO: 1976196 - RNA, 17 nt, Homo sapiens
uuuuguaaauguacugg

SEQ ID NO: 1976197 - RNA, 14 nt, Homo sapiens
ugcauagcuugcac

SEQ ID NO: 1976198 - RNA, 23 nt, Homo sapiens
caagacuggcauggacaucagca

SEQ ID NO: 1976199 - RNA, 18 nt, Homo sapiens
aacccaccucucuucccu

SEQ ID NO: 1976200 - RNA, 12 nt, Homo sapiens
cagcccuggugg

SEQ ID NO: 1976201 - RNA, 16 nt, Homo sapiens
cgguuucagcuuccuc

SEQ ID NO: 1976202 - RNA, 16 nt, Homo sapiens
ucccaacucacugugc

SEQ ID NO: 1976203 - RNA, 23 nt, Homo sapiens
uuuuacauuuguuguacaaucag

SEQ ID NO: 1976204 - RNA, 17 nt, Homo sapiens
gcucugauugcagcaca

SEQ ID NO: 1976205 - RNA, 22 nt, Homo sapiens
agugucguuuucauaacuugcu

SEQ ID NO: 1976206 - RNA, 18 nt, Homo sapiens
aacucugggcugccaugu

SEQ ID NO: 1976207 - RNA, 17 nt, Homo sapiens
guaagaucugaauucua

SEQ ID NO: 1976208 - RNA, 14 nt, Homo sapiens
ccugugaaauacca

SEQ ID NO: 1976209 - RNA, 15 nt, Homo sapiens
ggcccauggcauuuu

SEQ ID NO: 1976210 - RNA, 16 nt, Homo sapiens
uuuccuuuuuugucua

SEQ ID NO: 1976211 - RNA, 16 nt, Homo sapiens
gcacacaggugcacag

SEQ ID NO: 1976212 - RNA, 23 nt, Homo sapiens
gcauugcugauuuugucugccca

SEQ ID NO: 1976213 - RNA, 20 nt, Homo sapiens
cagauggagaucagagguua

SEQ ID NO: 1976214 - RNA, 17 nt, Homo sapiens
aucugggcuuccuggag

SEQ ID NO: 1976215 - RNA, 15 nt, Homo sapiens
ccaaggaggggccag

SEQ ID NO: 1976216 - RNA, 20 nt, Homo sapiens
uggacacguggugcauuuug

SEQ ID NO: 1976217 - RNA, 19 nt, Homo sapiens
gccagcaccaagcgugauu

SEQ ID NO: 1976218 - RNA, 20 nt, Homo sapiens
cauacuuggacaguuaggga

SEQ ID NO: 1976219 - RNA, 17 nt, Homo sapiens
ucucugugucagcacag

SEQ ID NO: 1976220 - RNA, 23 nt, Homo sapiens
cuggaccagucccgucgugcagu

SEQ ID NO: 1976221 - RNA, 15 nt, Homo sapiens
caagacuuuagcuuu

SEQ ID NO: 1976222 - RNA, 23 nt, Homo sapiens
aauucauaacagcaaccuugaaa

SEQ ID NO: 1976223 - RNA, 19 nt, Homo sapiens
aaugaaaccaaagccagga

SEQ ID NO: 1976224 - RNA, 21 nt, Homo sapiens
cccuggggagcuuuugcccac

SEQ ID NO: 1976225 - RNA, 22 nt, Homo sapiens
gagagucauauacauuaguuuu

SEQ ID NO: 1976226 - RNA, 17 nt, Homo sapiens
agggccuggccuugucc

SEQ ID NO: 1976227 - RNA, 21 nt, Homo sapiens
auugccagugagauauauuca

SEQ ID NO: 1976228 - RNA, 16 nt, Homo sapiens
aacacaaccauagccu

SEQ ID NO: 1976229 - RNA, 13 nt, Homo sapiens
uguacuaccccag

SEQ ID NO: 1976230 - RNA, 17 nt, Homo sapiens
aaucacuccaacccugc

SEQ ID NO: 1976231 - RNA, 15 nt, Homo sapiens
gcaacuccauuuacc

SEQ ID NO: 1976232 - RNA, 18 nt, Homo sapiens
auugacuuugacaauuac

SEQ ID NO: 1976233 - RNA, 17 nt, Homo sapiens
gguuggagcgagcaucc

SEQ ID NO: 1976234 - RNA, 21 nt, Homo sapiens
cuggugugcagggugaagcag

SEQ ID NO: 1976235 - RNA, 13 nt, Homo sapiens
caauacccacugc

SEQ ID NO: 1976236 - RNA, 22 nt, Homo sapiens
caucuggagcugaagcguuacu

SEQ ID NO: 1976237 - RNA, 19 nt, Homo sapiens
cacaccugcggcccaaucc

SEQ ID NO: 1976238 - RNA, 13 nt, Homo sapiens
ugugguuguaaau

SEQ ID NO: 1976239 - RNA, 22 nt, Homo sapiens
gauauuuugauucucauugcca

SEQ ID NO: 1976240 - RNA, 13 nt, Homo sapiens
gaguaccuggacc

SEQ ID NO: 1976241 - RNA, 14 nt, Homo sapiens
ccaggggacacugu

SEQ ID NO: 1976242 - RNA, 22 nt, Homo sapiens
ccauagggggcugcacgggaug

SEQ ID NO: 1976243 - RNA, 15 nt, Homo sapiens
uggaaucccacugua

SEQ ID NO: 1976244 - RNA, 19 nt, Homo sapiens
guggaaauauaccuaccuc

SEQ ID NO: 1976245 - RNA, 17 nt, Homo sapiens
cuccugcccaagcacuu

SEQ ID NO: 1976246 - RNA, 13 nt, Homo sapiens
aggagucagucuc

SEQ ID NO: 1976247 - RNA, 22 nt, Homo sapiens
uuucuggacuggcguucaccuc

SEQ ID NO: 1976248 - RNA, 15 nt, Homo sapiens
caguguggcagugac

SEQ ID NO: 1976249 - RNA, 21 nt, Homo sapiens
cauguucccccuaaacauggc

SEQ ID NO: 1976250 - RNA, 21 nt, Homo sapiens
aggugcgaaugacaguagcau

SEQ ID NO: 1976251 - RNA, 18 nt, Homo sapiens
aacagguauauacuuuga

SEQ ID NO: 1976252 - RNA, 12 nt, Homo sapiens
agcaagagccaa

SEQ ID NO: 1976253 - RNA, 18 nt, Homo sapiens
acccuaggcaucacaugc

SEQ ID NO: 1976254 - RNA, 14 nt, Homo sapiens
aaaaauuagcugug

SEQ ID NO: 1976255 - RNA, 16 nt, Homo sapiens
gugagaagaaaugaca

SEQ ID NO: 1976256 - RNA, 14 nt, Homo sapiens
acugugacaaugac

SEQ ID NO: 1976257 - RNA, 23 nt, Homo sapiens
gaaagcuauaucaaucucucuua

SEQ ID NO: 1976258 - RNA, 21 nt, Homo sapiens
uguguugggaauugcaugcca

SEQ ID NO: 1976259 - RNA, 18 nt, Homo sapiens
agagaccaggcugugaaa

SEQ ID NO: 1976260 - RNA, 13 nt, Homo sapiens
uccaaccaggcag

SEQ ID NO: 1976261 - RNA, 16 nt, Homo sapiens
auaacuccaagcagac

SEQ ID NO: 1976262 - RNA, 21 nt, Homo sapiens
auggcuacuuugguuucuguc

SEQ ID NO: 1976263 - RNA, 18 nt, Homo sapiens
cacaaaagccugugcagg

SEQ ID NO: 1976264 - RNA, 12 nt, Homo sapiens
aaauaacuggaa

SEQ ID NO: 1976265 - RNA, 22 nt, Homo sapiens
cuggacauuuguggcagugcug

SEQ ID NO: 1976266 - RNA, 17 nt, Homo sapiens
agcaggcggggguuuga

SEQ ID NO: 1976267 - RNA, 15 nt, Homo sapiens
ggaugacccacuguc

SEQ ID NO: 1976268 - RNA, 19 nt, Homo sapiens
aaggcaggaggaucacuug

SEQ ID NO: 1976269 - RNA, 16 nt, Homo sapiens
cuuguuuaacauauau

SEQ ID NO: 1976270 - RNA, 23 nt, Homo sapiens
aguucuagcucuauuuacuucua

SEQ ID NO: 1976271 - RNA, 15 nt, Homo sapiens
uuaaauaaauggaau

SEQ ID NO: 1976272 - RNA, 18 nt, Homo sapiens
uuccuaguaaauuuaauu

SEQ ID NO: 1976273 - RNA, 13 nt, Homo sapiens
aauucaaacuggg

SEQ ID NO: 1976274 - RNA, 20 nt, Homo sapiens
gaagccaauaaaccuuccuu

SEQ ID NO: 1976275 - RNA, 17 nt, Homo sapiens
ggagauuuacaacuggg

SEQ ID NO: 1976276 - RNA, 13 nt, Homo sapiens
ugugcucagggaa

SEQ ID NO: 1976277 - RNA, 19 nt, Homo sapiens
gccugcuguggacccuguc

SEQ ID NO: 1976278 - RNA, 18 nt, Homo sapiens
ccuuuuucaacuuggaaa

SEQ ID NO: 1976279 - RNA, 19 nt, Homo sapiens
aaugaacuaauaauagcau

SEQ ID NO: 1976280 - RNA, 19 nt, Homo sapiens
aucucauacugucugggau

SEQ ID NO: 1976281 - RNA, 16 nt, Homo sapiens
aaaggagauaaaucua

SEQ ID NO: 1976282 - RNA, 16 nt, Homo sapiens
cagcuggaggcugcug

SEQ ID NO: 1976283 - RNA, 22 nt, Homo sapiens
cuuguuuuuuccccuugccuua

SEQ ID NO: 1976284 - RNA, 18 nt, Homo sapiens
cagaccacagagcuguca

SEQ ID NO: 1976285 - RNA, 19 nt, Homo sapiens
acuccucuuaauguuucca

SEQ ID NO: 1976286 - RNA, 14 nt, Homo sapiens
cuucuacugugaca

SEQ ID NO: 1976287 - RNA, 18 nt, Homo sapiens
gcacugaggguggcacuc

SEQ ID NO: 1976288 - RNA, 20 nt, Homo sapiens
uuuguauacauccuggguaa

SEQ ID NO: 1976289 - RNA, 18 nt, Homo sapiens
agcucacugcaaccucca

SEQ ID NO: 1976290 - RNA, 23 nt, Homo sapiens
cauauuuucacagguguggugua

SEQ ID NO: 1976291 - RNA, 12 nt, Homo sapiens
acagcacuuuga

SEQ ID NO: 1976292 - RNA, 19 nt, Homo sapiens
uaugaagucccucuauguc

SEQ ID NO: 1976293 - RNA, 19 nt, Homo sapiens
cuuuguauuacaacaugaa

SEQ ID NO: 1976294 - RNA, 13 nt, Homo sapiens
ugagagccuccag

SEQ ID NO: 1976295 - RNA, 18 nt, Homo sapiens
ucugcuauuugcuguuau

SEQ ID NO: 1976296 - RNA, 18 nt, Homo sapiens
cuuccccaggagcucucu

SEQ ID NO: 1976297 - RNA, 18 nt, Homo sapiens
gauauguuuucacuguau

SEQ ID NO: 1976298 - RNA, 18 nt, Homo sapiens
uccugaagauagccagag

SEQ ID NO: 1976299 - RNA, 17 nt, Homo sapiens
gaaucacuggcuguuaa

SEQ ID NO: 1976300 - RNA, 14 nt, Homo sapiens
aucuuucucauuac

SEQ ID NO: 1976301 - RNA, 14 nt, Homo sapiens
ugucuuauuaggga

SEQ ID NO: 1976302 - RNA, 12 nt, Homo sapiens
ucacuuggugca

SEQ ID NO: 1976303 - RNA, 22 nt, Homo sapiens
gaaauaguacuuacaaaugacu

SEQ ID NO: 1976304 - RNA, 18 nt, Homo sapiens
acuggcauagcuggacau

SEQ ID NO: 1976305 - RNA, 15 nt, Homo sapiens
agcaaaucacgacca

SEQ ID NO: 1976306 - RNA, 17 nt, Homo sapiens
ccgagagagauggaaua

SEQ ID NO: 1976307 - RNA, 17 nt, Homo sapiens
uaguuaauuauuucaac

SEQ ID NO: 1976308 - RNA, 22 nt, Homo sapiens
acguggcgggaaugagcugugu

SEQ ID NO: 1976309 - RNA, 15 nt, Homo sapiens
ugaaugccacucugu

SEQ ID NO: 1976310 - RNA, 23 nt, Homo sapiens
auacgugaaagaugcaagcaccu

SEQ ID NO: 1976311 - RNA, 13 nt, Homo sapiens
cacaaauugugaa

SEQ ID NO: 1976312 - RNA, 13 nt, Homo sapiens
gacugauucugug

SEQ ID NO: 1976313 - RNA, 22 nt, Homo sapiens
acaguuuauuauguacuauuca

SEQ ID NO: 1976314 - RNA, 21 nt, Homo sapiens
acuacagguauuuucaucaag

SEQ ID NO: 1976315 - RNA, 15 nt, Homo sapiens
auucugcagccacaa

SEQ ID NO: 1976316 - RNA, 22 nt, Homo sapiens
auacagcccugacgcaaugaaa

SEQ ID NO: 1976317 - RNA, 16 nt, Homo sapiens
gaggaccuaucccaaa

SEQ ID NO: 1976318 - RNA, 19 nt, Homo sapiens
caagaagugguccaucucc

SEQ ID NO: 1976319 - RNA, 14 nt, Homo sapiens
aauucuucuucuca

SEQ ID NO: 1976320 - RNA, 12 nt, Homo sapiens
gaaggacuauca

SEQ ID NO: 1976321 - RNA, 18 nt, Homo sapiens
auagaauugcaaucuaua

SEQ ID NO: 1976322 - RNA, 20 nt, Homo sapiens
cucccagugagaagggccug

SEQ ID NO: 1976323 - RNA, 17 nt, Homo sapiens
ugggcacuggcggucaa

SEQ ID NO: 1976324 - RNA, 21 nt, Homo sapiens
agcagccucaucccaggcagu

SEQ ID NO: 1976325 - RNA, 22 nt, Homo sapiens
ccuaaaacaccuggacauuccc

SEQ ID NO: 1976326 - RNA, 15 nt, Homo sapiens
uaaugaaggugccau

SEQ ID NO: 1976327 - RNA, 20 nt, Homo sapiens
uguaagcagauuacaauaaa

SEQ ID NO: 1976328 - RNA, 20 nt, Homo sapiens
ugugacaaucugccuuucac

SEQ ID NO: 1976329 - RNA, 15 nt, Homo sapiens
aagagugauguuuca

SEQ ID NO: 1976330 - RNA, 20 nt, Homo sapiens
gcccccugggcuugugaaca

SEQ ID NO: 1976331 - RNA, 19 nt, Homo sapiens
cagacugacccccaucuga

SEQ ID NO: 1976332 - RNA, 12 nt, Homo sapiens
gaaaugccaaag

SEQ ID NO: 1976333 - RNA, 12 nt, Homo sapiens
auaaaaguuccu

SEQ ID NO: 1976334 - RNA, 18 nt, Homo sapiens
uaguugggauuacaggug

SEQ ID NO: 1976335 - RNA, 14 nt, Homo sapiens
gaagugacucucac

SEQ ID NO: 1976336 - RNA, 15 nt, Homo sapiens
cuaaguaugaucuau

SEQ ID NO: 1976337 - RNA, 12 nt, Homo sapiens
gacuucacuuau

SEQ ID NO: 1976338 - RNA, 13 nt, Homo sapiens
aggaggccugcag

SEQ ID NO: 1976339 - RNA, 14 nt, Homo sapiens
acugcgccacugcu

SEQ ID NO: 1976340 - RNA, 13 nt, Homo sapiens
ugggcuucaucca

SEQ ID NO: 1976341 - RNA, 14 nt, Homo sapiens
agccugucccagga

SEQ ID NO: 1976342 - RNA, 20 nt, Homo sapiens
auccauggccagcagcaccu

SEQ ID NO: 1976343 - RNA, 18 nt, Homo sapiens
gcagggagccuucugcca

SEQ ID NO: 1976344 - RNA, 13 nt, Homo sapiens
uaauucuacagga

SEQ ID NO: 1976345 - RNA, 17 nt, Homo sapiens
auguugaucuuucucaa

SEQ ID NO: 1976346 - RNA, 16 nt, Homo sapiens
cuuucuuacauaauau

SEQ ID NO: 1976347 - RNA, 17 nt, Homo sapiens
cauggacauguguacau

SEQ ID NO: 1976348 - RNA, 13 nt, Homo sapiens
gcauucaagugua

SEQ ID NO: 1976349 - RNA, 23 nt, Homo sapiens
uugcuggcaucccggccaggugg

SEQ ID NO: 1976350 - RNA, 14 nt, Homo sapiens
acuuguguccugac

SEQ ID NO: 1976351 - RNA, 13 nt, Homo sapiens
auggguacauucc

SEQ ID NO: 1976352 - RNA, 22 nt, Homo sapiens
agcaacaauaaauagacacgca

SEQ ID NO: 1976353 - RNA, 13 nt, Homo sapiens
ccagcuacaagga

SEQ ID NO: 1976354 - RNA, 15 nt, Homo sapiens
gcuacuauaaucaaa

SEQ ID NO: 1976355 - RNA, 22 nt, Homo sapiens
aaagauccaagaaggccuucau

SEQ ID NO: 1976356 - RNA, 17 nt, Homo sapiens
uggaugcaucacacuca

SEQ ID NO: 1976357 - RNA, 23 nt, Homo sapiens
cuguaaauguuauuaaaauaucc

SEQ ID NO: 1976358 - RNA, 15 nt, Homo sapiens
caucagaaauaguca

SEQ ID NO: 1976359 - RNA, 14 nt, Homo sapiens
aauaucccagagaa

SEQ ID NO: 1976360 - RNA, 15 nt, Homo sapiens
cauugcugucugcag

SEQ ID NO: 1976361 - RNA, 16 nt, Homo sapiens
aaauuguuaacauagg

SEQ ID NO: 1976362 - RNA, 19 nt, Homo sapiens
ugcagggcugggucagggg

SEQ ID NO: 1976363 - RNA, 22 nt, Homo sapiens
auggcuuaauguuuauuccuga

SEQ ID NO: 1976364 - RNA, 22 nt, Homo sapiens
aaugucuuacuccuggcuuuaa

SEQ ID NO: 1976365 - RNA, 13 nt, Homo sapiens
acagaaauuaucu

SEQ ID NO: 1976366 - RNA, 13 nt, Homo sapiens
acacacagccuuu

SEQ ID NO: 1976367 - RNA, 14 nt, Homo sapiens
aaugacauagccau

SEQ ID NO: 1976368 - RNA, 18 nt, Homo sapiens
ucaccagagcauuuccaa

SEQ ID NO: 1976369 - RNA, 15 nt, Homo sapiens
ccauuggaugcauuu

SEQ ID NO: 1976370 - RNA, 22 nt, Homo sapiens
ccuagcacugccccacaugcau

SEQ ID NO: 1976371 - RNA, 15 nt, Homo sapiens
aauaaauacauucga

SEQ ID NO: 1976372 - RNA, 20 nt, Homo sapiens
cauucauacuguagaaacca

SEQ ID NO: 1976373 - RNA, 22 nt, Homo sapiens
accagaaugaggcacaugacag

SEQ ID NO: 1976374 - RNA, 15 nt, Homo sapiens
gcuaauagcugcuag

SEQ ID NO: 1976375 - RNA, 18 nt, Homo sapiens
auauggggaaaaaacugu

SEQ ID NO: 1976376 - RNA, 13 nt, Homo sapiens
ugccaacugguca

SEQ ID NO: 1976377 - RNA, 15 nt, Homo sapiens
gagccaccgugccca

SEQ ID NO: 1976378 - RNA, 21 nt, Homo sapiens
ucugacaacugugaagccacc

SEQ ID NO: 1976379 - RNA, 21 nt, Homo sapiens
gccuagacucuguaacaucac

SEQ ID NO: 1976380 - RNA, 15 nt, Homo sapiens
cuauucccaaaugcc

SEQ ID NO: 1976381 - RNA, 16 nt, Homo sapiens
augugacacauucucu

SEQ ID NO: 1976382 - RNA, 20 nt, Homo sapiens
acuaaauuacaaaugcaauu

SEQ ID NO: 1976383 - RNA, 15 nt, Homo sapiens
ccucccaaguagcug

SEQ ID NO: 1976384 - RNA, 18 nt, Homo sapiens
uuccugccccagacagac

SEQ ID NO: 1976385 - RNA, 17 nt, Homo sapiens
acacggaggccagacac

SEQ ID NO: 1976386 - RNA, 21 nt, Homo sapiens
aguccagagaacugacaugca

SEQ ID NO: 1976387 - RNA, 23 nt, Homo sapiens
gaaugaagcguugccauugaacu

SEQ ID NO: 1976388 - RNA, 18 nt, Homo sapiens
auuuccccaaagacuuau

SEQ ID NO: 1976389 - RNA, 17 nt, Homo sapiens
cucugacgcaccacugc

SEQ ID NO: 1976390 - RNA, 16 nt, Homo sapiens
ccugcccccacaccca

SEQ ID NO: 1976391 - RNA, 13 nt, Homo sapiens
uuauagucuucca

SEQ ID NO: 1976392 - RNA, 16 nt, Homo sapiens
aggguugguaaggggu

SEQ ID NO: 1976393 - RNA, 19 nt, Homo sapiens
ccaaccccugaccuacccc

SEQ ID NO: 1976394 - RNA, 22 nt, Homo sapiens
aucuaaggccuucccugucaga

SEQ ID NO: 1976395 - RNA, 19 nt, Homo sapiens
gaaaucaaaagggccaaag

SEQ ID NO: 1976396 - RNA, 17 nt, Homo sapiens
auguugcaucccugaaa

SEQ ID NO: 1976397 - RNA, 23 nt, Homo sapiens
ucucugcuuggcuuccccuccac

SEQ ID NO: 1976398 - RNA, 16 nt, Homo sapiens
gcaguaugcugucaug

SEQ ID NO: 1976399 - RNA, 11 nt, Homo sapiens
aaugccaaagg

SEQ ID NO: 1976400 - RNA, 23 nt, Homo sapiens
ggaauucauuuucaucacuggga

SEQ ID NO: 1976401 - RNA, 15 nt, Homo sapiens
uauaagugugaccag

SEQ ID NO: 1976402 - RNA, 21 nt, Homo sapiens
gaagcccggacugaccaaauc

SEQ ID NO: 1976403 - RNA, 21 nt, Homo sapiens
agccucuggcuccacaccucc

SEQ ID NO: 1976404 - RNA, 17 nt, Homo sapiens
aaaguaucugagauuac

SEQ ID NO: 1976405 - RNA, 17 nt, Homo sapiens
uagaauggcacauguca

SEQ ID NO: 1976406 - RNA, 21 nt, Homo sapiens
agagaccuucaaaugcgaaca

SEQ ID NO: 1976407 - RNA, 22 nt, Homo sapiens
gacaacccuguccucaggccug

SEQ ID NO: 1976408 - RNA, 14 nt, Homo sapiens
caguccucuuucaa

SEQ ID NO: 1976409 - RNA, 19 nt, Homo sapiens
cagagugauugguugcauc

SEQ ID NO: 1976410 - RNA, 15 nt, Homo sapiens
cuggaccaaggugaa

SEQ ID NO: 1976411 - RNA, 15 nt, Homo sapiens
cugugcaaagggaac

SEQ ID NO: 1976412 - RNA, 15 nt, Homo sapiens
ccagauggacuccag

SEQ ID NO: 1976413 - RNA, 23 nt, Homo sapiens
aucauuauuuaagccguucuuau

SEQ ID NO: 1976414 - RNA, 18 nt, Homo sapiens
gggugugggaucugagga

SEQ ID NO: 1976415 - RNA, 20 nt, Homo sapiens
ccagccaccacccucaggug

SEQ ID NO: 1976416 - RNA, 17 nt, Homo sapiens
accuggggcacagucca

SEQ ID NO: 1976417 - RNA, 15 nt, Homo sapiens
cagccauucuucagg

SEQ ID NO: 1976418 - RNA, 20 nt, Homo sapiens
cuguaaaaaauggagcucag

SEQ ID NO: 1976419 - RNA, 21 nt, Homo sapiens
aaagggaacacaaaacauuua

SEQ ID NO: 1976420 - RNA, 14 nt, Homo sapiens
ccuaauuaauuuca

SEQ ID NO: 1976421 - RNA, 23 nt, Homo sapiens
uggggcccauggggucucugcau

SEQ ID NO: 1976422 - RNA, 15 nt, Homo sapiens
agucauauaccuaua

SEQ ID NO: 1976423 - RNA, 16 nt, Homo sapiens
auaaagaguacagaua

SEQ ID NO: 1976424 - RNA, 23 nt, Homo sapiens
gagucaccuuuccccacuccuau

SEQ ID NO: 1976425 - RNA, 22 nt, Homo sapiens
cucagagcuguccucaagaugg

SEQ ID NO: 1976426 - RNA, 22 nt, Homo sapiens
caaacuaggaggaaaagacaga

SEQ ID NO: 1976427 - RNA, 13 nt, Homo sapiens
ucaggcagggugc

SEQ ID NO: 1976428 - RNA, 19 nt, Homo sapiens
caauguacauagacccucu

SEQ ID NO: 1976429 - RNA, 23 nt, Homo sapiens
cacagccaaccuagcuagcaaca

SEQ ID NO: 1976430 - RNA, 19 nt, Homo sapiens
ugagcaccuggacauguca

SEQ ID NO: 1976431 - RNA, 11 nt, Homo sapiens
caccagcauuu

SEQ ID NO: 1976432 - RNA, 14 nt, Homo sapiens
acgucaccaagaaa

SEQ ID NO: 1976433 - RNA, 19 nt, Homo sapiens
uuggcuaauaaauguugcc

SEQ ID NO: 1976434 - RNA, 14 nt, Homo sapiens
ugggagggagguaa

SEQ ID NO: 1976435 - RNA, 21 nt, Homo sapiens
uaaagaaaaguagguuuacau

SEQ ID NO: 1976436 - RNA, 13 nt, Homo sapiens
cucaaaauuugau

SEQ ID NO: 1976437 - RNA, 16 nt, Homo sapiens
auggcuaccaaaaaga

SEQ ID NO: 1976438 - RNA, 15 nt, Homo sapiens
auaaaauaaugaacu

SEQ ID NO: 1976439 - RNA, 21 nt, Homo sapiens
agaucacgccauuguacucca

SEQ ID NO: 1976440 - RNA, 13 nt, Homo sapiens
acagacuggcaau

SEQ ID NO: 1976441 - RNA, 17 nt, Homo sapiens
ccuaagcaccugccuca

SEQ ID NO: 1976442 - RNA, 20 nt, Homo sapiens
accacgccgcccuccauccg

SEQ ID NO: 1976443 - RNA, 15 nt, Homo sapiens
uuaauuucugucaaa

SEQ ID NO: 1976444 - RNA, 19 nt, Homo sapiens
ugcuggccaggcuggucuc

SEQ ID NO: 1976445 - RNA, 11 nt, Homo sapiens
cuuuaaaccac

SEQ ID NO: 1976446 - RNA, 17 nt, Homo sapiens
accugccucccauucua

SEQ ID NO: 1976447 - RNA, 13 nt, Homo sapiens
ucucugcaaugcu

SEQ ID NO: 1976448 - RNA, 21 nt, Homo sapiens
gcuuccugaaauaaacacugg

SEQ ID NO: 1976449 - RNA, 17 nt, Homo sapiens
cuggaaccugcaaaaaa

SEQ ID NO: 1976450 - RNA, 20 nt, Homo sapiens
ggacccuguugaggguccuc

SEQ ID NO: 1976451 - RNA, 20 nt, Homo sapiens
uggcugcugucauaacaucc

SEQ ID NO: 1976452 - RNA, 12 nt, Homo sapiens
auuuacagugaa

SEQ ID NO: 1976453 - RNA, 18 nt, Homo sapiens
ugccauguuuagauucca

SEQ ID NO: 1976454 - RNA, 23 nt, Homo sapiens
agcugaacaguguuggcuuucau

SEQ ID NO: 1976455 - RNA, 20 nt, Homo sapiens
ccccgaccccccuaccccau

SEQ ID NO: 1976456 - RNA, 17 nt, Homo sapiens
ugcuuuccuucaucucc

SEQ ID NO: 1976457 - RNA, 19 nt, Homo sapiens
auuuggaaagcacuggaau

SEQ ID NO: 1976458 - RNA, 15 nt, Homo sapiens
cauauuucauauuca

SEQ ID NO: 1976459 - RNA, 16 nt, Homo sapiens
aaacacaugccuuaaa

SEQ ID NO: 1976460 - RNA, 21 nt, Homo sapiens
aaauaaauggauaaguagaau

SEQ ID NO: 1976461 - RNA, 21 nt, Homo sapiens
uucaauuuauuugaaugauuu

SEQ ID NO: 1976462 - RNA, 18 nt, Homo sapiens
guacccuuuggggagcag

SEQ ID NO: 1976463 - RNA, 19 nt, Homo sapiens
ccaucuucgggaccaggau

SEQ ID NO: 1976464 - RNA, 11 nt, Homo sapiens
aggaagcaagc

SEQ ID NO: 1976465 - RNA, 14 nt, Homo sapiens
ucaaugcuauggac

SEQ ID NO: 1976466 - RNA, 20 nt, Homo sapiens
guggccucccugcucuaucc

SEQ ID NO: 1976467 - RNA, 16 nt, Homo sapiens
cacacuuaucuagcaa

SEQ ID NO: 1976468 - RNA, 22 nt, Homo sapiens
uaguaauuuuaaaagucucaca

SEQ ID NO: 1976469 - RNA, 12 nt, Homo sapiens
agauaugcacac

SEQ ID NO: 1976470 - RNA, 13 nt, Homo sapiens
aauuaacuaacuc

SEQ ID NO: 1976471 - RNA, 15 nt, Homo sapiens
ggcgaagugcuaaaa

SEQ ID NO: 1976472 - RNA, 15 nt, Homo sapiens
cuacugcaccauuua

SEQ ID NO: 1976473 - RNA, 15 nt, Homo sapiens
auccagcaaccuaua

SEQ ID NO: 1976474 - RNA, 16 nt, Homo sapiens
aggguguuugcagcug

SEQ ID NO: 1976475 - RNA, 16 nt, Homo sapiens
uaaaggcauuucaaag

SEQ ID NO: 1976476 - RNA, 18 nt, Homo sapiens
gucuuguuuuuuacucaa

SEQ ID NO: 1976477 - RNA, 20 nt, Homo sapiens
aguaaccuuucaaucaaaac

SEQ ID NO: 1976478 - RNA, 20 nt, Homo sapiens
ucccacucccggccugucau

SEQ ID NO: 1976479 - RNA, 13 nt, Homo sapiens
aauugcaguuuug

SEQ ID NO: 1976480 - RNA, 21 nt, Homo sapiens
agcuguggccuaggcuaccuc

SEQ ID NO: 1976481 - RNA, 14 nt, Homo sapiens
uaaaugagcccaca

SEQ ID NO: 1976482 - RNA, 19 nt, Homo sapiens
aacccaugccccugacaga

SEQ ID NO: 1976483 - RNA, 21 nt, Homo sapiens
gcccgagcgccugcguuccca

SEQ ID NO: 1976484 - RNA, 22 nt, Homo sapiens
caucauggagggagaagaaaga

SEQ ID NO: 1976485 - RNA, 15 nt, Homo sapiens
ccugucuuagacuuu

SEQ ID NO: 1976486 - RNA, 15 nt, Homo sapiens
agauuccaaaaagca

SEQ ID NO: 1976487 - RNA, 23 nt, Homo sapiens
guggaaagcgugugagugaggga

SEQ ID NO: 1976488 - RNA, 12 nt, Homo sapiens
cugcagccagcu

SEQ ID NO: 1976489 - RNA, 15 nt, Homo sapiens
acccugucucaaaaa

SEQ ID NO: 1976490 - RNA, 16 nt, Homo sapiens
accuguuauugccaau

SEQ ID NO: 1976491 - RNA, 23 nt, Homo sapiens
uaccuaaaucuguuugacagucu

SEQ ID NO: 1976492 - RNA, 23 nt, Homo sapiens
gagcuuccagugcauguugccau

SEQ ID NO: 1976493 - RNA, 13 nt, Homo sapiens
cuguaaaauccau

SEQ ID NO: 1976494 - RNA, 13 nt, Homo sapiens
ugagacacauggg

SEQ ID NO: 1976495 - RNA, 14 nt, Homo sapiens
cuagguaugaagua

SEQ ID NO: 1976496 - RNA, 18 nt, Homo sapiens
uacacugaaaaugucaca

SEQ ID NO: 1976497 - RNA, 19 nt, Homo sapiens
agaccugccugucucccac

SEQ ID NO: 1976498 - RNA, 22 nt, Homo sapiens
cgccuuaugccucagucuauuc

SEQ ID NO: 1976499 - RNA, 18 nt, Homo sapiens
ucgcccaggagacauccg

SEQ ID NO: 1976500 - RNA, 22 nt, Homo sapiens
auuuccucauuuuuauaauguc

SEQ ID NO: 1976501 - RNA, 16 nt, Homo sapiens
gcccugggguuuccac

SEQ ID NO: 1976502 - RNA, 16 nt, Homo sapiens
cucgagcuuggggcaa

SEQ ID NO: 1976503 - RNA, 12 nt, Homo sapiens
agugcugagauu

SEQ ID NO: 1976504 - RNA, 15 nt, Homo sapiens
ucaaguauuguuaau

SEQ ID NO: 1976505 - RNA, 16 nt, Homo sapiens
ggcuaagggggaccau

SEQ ID NO: 1976506 - RNA, 17 nt, Homo sapiens
accuggauguacuuaag

SEQ ID NO: 1976507 - RNA, 16 nt, Homo sapiens
gcaacagauagauguu

SEQ ID NO: 1976508 - RNA, 21 nt, Homo sapiens
uguaaaggaacaacugauaua

SEQ ID NO: 1976509 - RNA, 17 nt, Homo sapiens
aaguuguugacugugau

SEQ ID NO: 1976510 - RNA, 12 nt, Homo sapiens
ccccagcacuug

SEQ ID NO: 1976511 - RNA, 18 nt, Homo sapiens
ccuaagggccacauccca

SEQ ID NO: 1976512 - RNA, 22 nt, Homo sapiens
aucucuuuuggucccauccucu

SEQ ID NO: 1976513 - RNA, 16 nt, Homo sapiens
aggccagccuuggcac

SEQ ID NO: 1976514 - RNA, 20 nt, Homo sapiens
cagcaaguaugaaccacaug

SEQ ID NO: 1976515 - RNA, 16 nt, Homo sapiens
cagcuacagcaaauaa

SEQ ID NO: 1976516 - RNA, 15 nt, Homo sapiens
gcaucuccagcauuc

SEQ ID NO: 1976517 - RNA, 13 nt, Homo sapiens
caugucagccuca

SEQ ID NO: 1976518 - RNA, 19 nt, Homo sapiens
uucaugacauaauaaagua

SEQ ID NO: 1976519 - RNA, 21 nt, Homo sapiens
acacuggcguuacugcuugac

SEQ ID NO: 1976520 - RNA, 13 nt, Homo sapiens
aacauuuucucaa

SEQ ID NO: 1976521 - RNA, 15 nt, Homo sapiens
acaccucacucauac

SEQ ID NO: 1976522 - RNA, 19 nt, Homo sapiens
uuuaauaaaaaucauggaa

SEQ ID NO: 1976523 - RNA, 22 nt, Homo sapiens
auuuucuuccuucucagcacuu

SEQ ID NO: 1976524 - RNA, 17 nt, Homo sapiens
ucuucaugccugaugaa

SEQ ID NO: 1976525 - RNA, 17 nt, Homo sapiens
ugagcauuuuuaaggga

SEQ ID NO: 1976526 - RNA, 14 nt, Homo sapiens
cagguguugccaaa

SEQ ID NO: 1976527 - RNA, 18 nt, Homo sapiens
aguuucccuccuucccaa

SEQ ID NO: 1976528 - RNA, 17 nt, Homo sapiens
uaugcgugugacagugu

SEQ ID NO: 1976529 - RNA, 22 nt, Homo sapiens
cuguuuugguuuugcucacaaa

SEQ ID NO: 1976530 - RNA, 22 nt, Homo sapiens
uuuccuauguuucacugugcaa

SEQ ID NO: 1976531 - RNA, 17 nt, Homo sapiens
uaauagaaagauacaac

SEQ ID NO: 1976532 - RNA, 13 nt, Homo sapiens
uccagcucuggga

SEQ ID NO: 1976533 - RNA, 18 nt, Homo sapiens
guauacguauaaauauca

SEQ ID NO: 1976534 - RNA, 23 nt, Homo sapiens
auuacuaucauaauucagcacuu

SEQ ID NO: 1976535 - RNA, 16 nt, Homo sapiens
ccugccuccagcacuc

SEQ ID NO: 1976536 - RNA, 21 nt, Homo sapiens
ucacgcuuucaugaccacugg

SEQ ID NO: 1976537 - RNA, 15 nt, Homo sapiens
auuuuguucauacau

SEQ ID NO: 1976538 - RNA, 21 nt, Homo sapiens
ugaccacaucgcucuaggaua

SEQ ID NO: 1976539 - RNA, 19 nt, Homo sapiens
cgugaugaaaacuuucuaa

SEQ ID NO: 1976540 - RNA, 20 nt, Homo sapiens
aagugcauuuauugccucua

SEQ ID NO: 1976541 - RNA, 12 nt, Homo sapiens
gaacccaggaca

SEQ ID NO: 1976542 - RNA, 20 nt, Homo sapiens
ccgggcugggagcucugcag

SEQ ID NO: 1976543 - RNA, 16 nt, Homo sapiens
cuuucuuaaugugacc

SEQ ID NO: 1976544 - RNA, 20 nt, Homo sapiens
aucucuaccugggugugccc

SEQ ID NO: 1976545 - RNA, 20 nt, Homo sapiens
uggaaugcuucuucucaggc

SEQ ID NO: 1976546 - RNA, 14 nt, Homo sapiens
ccccagccugcucc

SEQ ID NO: 1976547 - RNA, 18 nt, Homo sapiens
uguuugcacuuggcaaaa

SEQ ID NO: 1976548 - RNA, 22 nt, Homo sapiens
uuuucaagcaaaguauugugaa

SEQ ID NO: 1976549 - RNA, 21 nt, Homo sapiens
caccucggcacacacugugcc

SEQ ID NO: 1976550 - RNA, 13 nt, Homo sapiens
augccuuuaguca

SEQ ID NO: 1976551 - RNA, 15 nt, Homo sapiens
gcccagcacugccca

SEQ ID NO: 1976552 - RNA, 20 nt, Homo sapiens
aaaauugaauaguuuauuuc

SEQ ID NO: 1976553 - RNA, 14 nt, Homo sapiens
uaucugugaacaug

SEQ ID NO: 1976554 - RNA, 12 nt, Homo sapiens
aacagaaagcau

SEQ ID NO: 1976555 - RNA, 21 nt, Homo sapiens
aaagagacuggagcaucugac

SEQ ID NO: 1976556 - RNA, 17 nt, Homo sapiens
ucaaacuuucaccucag

SEQ ID NO: 1976557 - RNA, 20 nt, Homo sapiens
cugaaacccauuuacuuagg

SEQ ID NO: 1976558 - RNA, 20 nt, Homo sapiens
guaggcaggaaggacugucc

SEQ ID NO: 1976559 - RNA, 21 nt, Homo sapiens
gaaguuuuaugcgugugacag

SEQ ID NO: 1976560 - RNA, 19 nt, Homo sapiens
ugugacggggguuggggug

SEQ ID NO: 1976561 - RNA, 16 nt, Homo sapiens
cagccacacagagccu

SEQ ID NO: 1976562 - RNA, 12 nt, Homo sapiens
gaacuugcaaua

SEQ ID NO: 1976563 - RNA, 19 nt, Homo sapiens
caacuccauguuugguguu

SEQ ID NO: 1976564 - RNA, 17 nt, Homo sapiens
ugcuguauugauaucac

SEQ ID NO: 1976565 - RNA, 18 nt, Homo sapiens
ugcuuggagcugagcaaa

SEQ ID NO: 1976566 - RNA, 13 nt, Homo sapiens
cugaaacauauuu

SEQ ID NO: 1976567 - RNA, 13 nt, Homo sapiens
cugaagcagguuc

SEQ ID NO: 1976568 - RNA, 19 nt, Homo sapiens
gcaguuucaaguaccaaaa

SEQ ID NO: 1976569 - RNA, 14 nt, Homo sapiens
acuuuauuugccua

SEQ ID NO: 1976570 - RNA, 13 nt, Homo sapiens
uucaaaacauaca

SEQ ID NO: 1976571 - RNA, 16 nt, Homo sapiens
cagagcauccgucucc

SEQ ID NO: 1976572 - RNA, 22 nt, Homo sapiens
auuucaauauuagcaagacagc

SEQ ID NO: 1976573 - RNA, 14 nt, Homo sapiens
auguaucucaggaa

SEQ ID NO: 1976574 - RNA, 13 nt, Homo sapiens
ugcacuacugaca

SEQ ID NO: 1976575 - RNA, 16 nt, Homo sapiens
aaucccagcauuuugg

SEQ ID NO: 1976576 - RNA, 14 nt, Homo sapiens
cagauucagcauuu

SEQ ID NO: 1976577 - RNA, 17 nt, Homo sapiens
cugucagaugucacaua

SEQ ID NO: 1976578 - RNA, 16 nt, Homo sapiens
cagcuuguaaauuaca

SEQ ID NO: 1976579 - RNA, 21 nt, Homo sapiens
aaguagcagugugaaguacaa

SEQ ID NO: 1976580 - RNA, 20 nt, Homo sapiens
ucagaaggggaggggagaca

SEQ ID NO: 1976581 - RNA, 19 nt, Homo sapiens
ccuuuggaacuauuuacaa

SEQ ID NO: 1976582 - RNA, 12 nt, Homo sapiens
aaaauacauuau

SEQ ID NO: 1976583 - RNA, 20 nt, Homo sapiens
cacugagucuuucuuagauu

SEQ ID NO: 1976584 - RNA, 19 nt, Homo sapiens
aucccuuuuuuuacauuuc

SEQ ID NO: 1976585 - RNA, 18 nt, Homo sapiens
ccagcucugucccaggau

SEQ ID NO: 1976586 - RNA, 18 nt, Homo sapiens
gggccacauggguccacu

SEQ ID NO: 1976587 - RNA, 16 nt, Homo sapiens
ugggcaggaccucaga

SEQ ID NO: 1976588 - RNA, 14 nt, Homo sapiens
caaauagugcuaau

SEQ ID NO: 1976589 - RNA, 14 nt, Homo sapiens
caacaagugcucuu

SEQ ID NO: 1976590 - RNA, 19 nt, Homo sapiens
auaacuucaugaagacuua

SEQ ID NO: 1976591 - RNA, 19 nt, Homo sapiens
agaacuucagaaagacuug

SEQ ID NO: 1976592 - RNA, 15 nt, Homo sapiens
ccaugcccagccugu

SEQ ID NO: 1976593 - RNA, 14 nt, Homo sapiens
aagucauggucaca

SEQ ID NO: 1976594 - RNA, 17 nt, Homo sapiens
gauugauaaguaaugaa

SEQ ID NO: 1976595 - RNA, 15 nt, Homo sapiens
ccucacuaccagaag

SEQ ID NO: 1976596 - RNA, 15 nt, Homo sapiens
uuauaaaagaugcau

SEQ ID NO: 1976597 - RNA, 15 nt, Homo sapiens
uuuugguaauauuca

SEQ ID NO: 1976598 - RNA, 19 nt, Homo sapiens
caauaauucuaugagauag

SEQ ID NO: 1976599 - RNA, 19 nt, Homo sapiens
auuaaugaaaagcagauug

SEQ ID NO: 1976600 - RNA, 19 nt, Homo sapiens
cgagcaccuguaaucccag

SEQ ID NO: 1976601 - RNA, 19 nt, Homo sapiens
uccagcggggcuucugggc

SEQ ID NO: 1976602 - RNA, 12 nt, Homo sapiens
caagguaaaaag

SEQ ID NO: 1976603 - RNA, 12 nt, Homo sapiens
caaaguaaaaaa

SEQ ID NO: 1976604 - RNA, 21 nt, Homo sapiens
cuuagcaugaauccuacauac

SEQ ID NO: 1976605 - RNA, 12 nt, Homo sapiens
uucucccauuua

SEQ ID NO: 1976606 - RNA, 16 nt, Homo sapiens
gccagaggugcuucac

SEQ ID NO: 1976607 - RNA, 18 nt, Homo sapiens
acggacaaagagauugag

SEQ ID NO: 1976608 - RNA, 15 nt, Homo sapiens
gacguaaucuccaca

SEQ ID NO: 1976609 - RNA, 16 nt, Homo sapiens
uucugccccugcugac

SEQ ID NO: 1976610 - RNA, 20 nt, Homo sapiens
gaucaacaucuuuucuugcc

SEQ ID NO: 1976611 - RNA, 15 nt, Homo sapiens
cuacucuaguucugu

SEQ ID NO: 1976612 - RNA, 13 nt, Homo sapiens
acgcacaggaaaa

SEQ ID NO: 1976613 - RNA, 14 nt, Homo sapiens
uccaggaugucaac

SEQ ID NO: 1976614 - RNA, 21 nt, Homo sapiens
cagcaccccugucucuagcca

SEQ ID NO: 1976615 - RNA, 15 nt, Homo sapiens
caugacggguuguga

SEQ ID NO: 1976616 - RNA, 20 nt, Homo sapiens
gugaagagggagaagcauga

SEQ ID NO: 1976617 - RNA, 18 nt, Homo sapiens
gaaggcgugagucuucau

SEQ ID NO: 1976618 - RNA, 14 nt, Homo sapiens
uagauccucugaua

SEQ ID NO: 1976619 - RNA, 23 nt, Homo sapiens
gaguuuauuggaggaucaaagaa

SEQ ID NO: 1976620 - RNA, 14 nt, Homo sapiens
gacucagagcucuc

SEQ ID NO: 1976621 - RNA, 24 nt, Homo sapiens
uguuggucacauggagcucuucca

SEQ ID NO: 1976622 - RNA, 13 nt, Homo sapiens
cucucucgcugcg

SEQ ID NO: 1976623 - RNA, 16 nt, Homo sapiens
cgggugccaggacaau

SEQ ID NO: 1976624 - RNA, 15 nt, Homo sapiens
ucuucucucaucuga

SEQ ID NO: 1976625 - RNA, 16 nt, Homo sapiens
auuucaccuacuuugu

SEQ ID NO: 1976626 - RNA, 17 nt, Homo sapiens
ugugugagugugugcaa

SEQ ID NO: 1976627 - RNA, 18 nt, Homo sapiens
uuaguaaauuucugugau

SEQ ID NO: 1976628 - RNA, 13 nt, Homo sapiens
guaagugcugcua

SEQ ID NO: 1976629 - RNA, 20 nt, Homo sapiens
accaauuugcaccaguuuua

SEQ ID NO: 1976630 - RNA, 23 nt, Homo sapiens
acgugauguggagggcacauucc

SEQ ID NO: 1976631 - RNA, 15 nt, Homo sapiens
cccacagugcucagu

SEQ ID NO: 1976632 - RNA, 24 nt, Homo sapiens
uuuguuuugagacaaagacucacu

SEQ ID NO: 1976633 - RNA, 15 nt, Homo sapiens
ggacuguaagggauu

SEQ ID NO: 1976634 - RNA, 18 nt, Homo sapiens
gacccacuucucaucaca

SEQ ID NO: 1976635 - RNA, 22 nt, Homo sapiens
ccugcacccaugacaaucaccu

SEQ ID NO: 1976636 - RNA, 14 nt, Homo sapiens
auucucaucuacuc

SEQ ID NO: 1976637 - RNA, 16 nt, Homo sapiens
aaaugaugccacuucc

SEQ ID NO: 1976638 - RNA, 15 nt, Homo sapiens
cuacaagagggcaaa

SEQ ID NO: 1976639 - RNA, 20 nt, Homo sapiens
gggaugcagggggaggcagc

SEQ ID NO: 1976640 - RNA, 13 nt, Homo sapiens
uuccgcagcucag

SEQ ID NO: 1976641 - RNA, 16 nt, Homo sapiens
gucucauuuagaacuu

SEQ ID NO: 1976642 - RNA, 22 nt, Homo sapiens
uguacauacugcagugugaauu

SEQ ID NO: 1976643 - RNA, 22 nt, Homo sapiens
aaagaauccauaaaaaguaaua

SEQ ID NO: 1976644 - RNA, 15 nt, Homo sapiens
ugauuuuuaucucca

SEQ ID NO: 1976645 - RNA, 16 nt, Homo sapiens
ccagacucugucucaa

SEQ ID NO: 1976646 - RNA, 16 nt, Homo sapiens
gccaggcaaaggaaau

SEQ ID NO: 1976647 - RNA, 21 nt, Homo sapiens
cccaagggagacugaccauca

SEQ ID NO: 1976648 - RNA, 20 nt, Homo sapiens
auuaugcacuggccacccaa

SEQ ID NO: 1976649 - RNA, 11 nt, Homo sapiens
cuuuauacuua

SEQ ID NO: 1976650 - RNA, 14 nt, Homo sapiens
auuuaauacacaau

SEQ ID NO: 1976651 - RNA, 15 nt, Homo sapiens
ccuuuccagccauag

SEQ ID NO: 1976652 - RNA, 14 nt, Homo sapiens
augguaacugcaca

SEQ ID NO: 1976653 - RNA, 19 nt, Homo sapiens
auggcagggccucaucuca

SEQ ID NO: 1976654 - RNA, 12 nt, Homo sapiens
gucaccaugacu

SEQ ID NO: 1976655 - RNA, 16 nt, Homo sapiens
uccauuacaccacagc

SEQ ID NO: 1976656 - RNA, 22 nt, Homo sapiens
cuagccuuggccucuuuccuca

SEQ ID NO: 1976657 - RNA, 18 nt, Homo sapiens
gaggugucuguaucagug

SEQ ID NO: 1976658 - RNA, 18 nt, Homo sapiens
ccccuacugugggcaaag

SEQ ID NO: 1976659 - RNA, 18 nt, Homo sapiens
ucacagcuucagccagga

SEQ ID NO: 1976660 - RNA, 17 nt, Homo sapiens
ucaaaacaaucuuguca

SEQ ID NO: 1976661 - RNA, 14 nt, Homo sapiens
uuaucaccaugcaa

SEQ ID NO: 1976662 - RNA, 17 nt, Homo sapiens
agaacauacacugugaa

SEQ ID NO: 1976663 - RNA, 14 nt, Homo sapiens
gaggugcagcugga

SEQ ID NO: 1976664 - RNA, 17 nt, Homo sapiens
caucaugaaaacuggga

SEQ ID NO: 1976665 - RNA, 18 nt, Homo sapiens
aagguguguacucagggc

SEQ ID NO: 1976666 - RNA, 21 nt, Homo sapiens
aagauuauccuguuacugaau

SEQ ID NO: 1976667 - RNA, 15 nt, Homo sapiens
cugacuuggggaaaa

SEQ ID NO: 1976668 - RNA, 21 nt, Homo sapiens
gcuucaaauaaaguccugaca

SEQ ID NO: 1976669 - RNA, 15 nt, Homo sapiens
aagauuaugaucuca

SEQ ID NO: 1976670 - RNA, 21 nt, Homo sapiens
ucugcugugagccgccaggaa

SEQ ID NO: 1976671 - RNA, 16 nt, Homo sapiens
gauucccaacugagug

SEQ ID NO: 1976672 - RNA, 15 nt, Homo sapiens
cuugggggugugaug

SEQ ID NO: 1976673 - RNA, 16 nt, Homo sapiens
gagacagaacugucca

SEQ ID NO: 1976674 - RNA, 14 nt, Homo sapiens
uggauggaauauca

SEQ ID NO: 1976675 - RNA, 17 nt, Homo sapiens
uguggcaguuacagggc

SEQ ID NO: 1976676 - RNA, 20 nt, Homo sapiens
cagcaauucuccugccucag

SEQ ID NO: 1976677 - RNA, 16 nt, Homo sapiens
ggaaguccuugcccac

SEQ ID NO: 1976678 - RNA, 22 nt, Homo sapiens
uaacccuauccuaauuguccac

SEQ ID NO: 1976679 - RNA, 22 nt, Homo sapiens
agccagaauucuggacaaccca

SEQ ID NO: 1976680 - RNA, 14 nt, Homo sapiens
agacucacuugcca

SEQ ID NO: 1976681 - RNA, 20 nt, Homo sapiens
auucucugcagcccauuccc

SEQ ID NO: 1976682 - RNA, 17 nt, Homo sapiens
cagaagucuaguuuuau

SEQ ID NO: 1976683 - RNA, 14 nt, Homo sapiens
uaaagacuaacuaa

SEQ ID NO: 1976684 - RNA, 21 nt, Homo sapiens
agaggaauuccagcaucugaa

SEQ ID NO: 1976685 - RNA, 19 nt, Homo sapiens
acugaccaaagacugcaga

SEQ ID NO: 1976686 - RNA, 13 nt, Homo sapiens
gaucuaguucuca

SEQ ID NO: 1976687 - RNA, 13 nt, Homo sapiens
uccuuaccgcaca

SEQ ID NO: 1976688 - RNA, 14 nt, Homo sapiens
ugagcuacuucaaa

SEQ ID NO: 1976689 - RNA, 14 nt, Homo sapiens
agaggagugugaag

SEQ ID NO: 1976690 - RNA, 18 nt, Homo sapiens
agaaguuugggcuaacau

SEQ ID NO: 1976691 - RNA, 22 nt, Homo sapiens
cuccaucuuauuuucauguaua

SEQ ID NO: 1976692 - RNA, 15 nt, Homo sapiens
uauggcuugugaacu

SEQ ID NO: 1976693 - RNA, 17 nt, Homo sapiens
uagauuaguauuuucca

SEQ ID NO: 1976694 - RNA, 21 nt, Homo sapiens
cuaauuguacccuucuugucu

SEQ ID NO: 1976695 - RNA, 20 nt, Homo sapiens
gggcugacugggccagggga

SEQ ID NO: 1976696 - RNA, 19 nt, Homo sapiens
gacaggcaccagaugggau

SEQ ID NO: 1976697 - RNA, 22 nt, Homo sapiens
gaugacgugcuccguagcucug

SEQ ID NO: 1976698 - RNA, 22 nt, Homo sapiens
acccauccuaccaaugcaugca

SEQ ID NO: 1976699 - RNA, 14 nt, Homo sapiens
uacaguuauuuugg

SEQ ID NO: 1976700 - RNA, 16 nt, Homo sapiens
caugacccagccugaa

SEQ ID NO: 1976701 - RNA, 20 nt, Homo sapiens
cccuugagcucaagugaucu

SEQ ID NO: 1976702 - RNA, 10 nt, Homo sapiens
ugucuucccc

SEQ ID NO: 1976703 - RNA, 11 nt, Homo sapiens
augguagucac

SEQ ID NO: 1976704 - RNA, 20 nt, Homo sapiens
cuacccccugugccuuguca

SEQ ID NO: 1976705 - RNA, 14 nt, Homo sapiens
agugaagcauuuaa

SEQ ID NO: 1976706 - RNA, 16 nt, Homo sapiens
ccugcaagaguggucc

SEQ ID NO: 1976707 - RNA, 17 nt, Homo sapiens
caagagagggaugcaug

SEQ ID NO: 1976708 - RNA, 20 nt, Homo sapiens
cgcauacuacaguaacugug

SEQ ID NO: 1976709 - RNA, 15 nt, Homo sapiens
aaagcauuuugcaaa

SEQ ID NO: 1976710 - RNA, 23 nt, Homo sapiens
ggaaaacuacagguguuguccaa

SEQ ID NO: 1976711 - RNA, 20 nt, Homo sapiens
gaaugguacaugucuuccau

SEQ ID NO: 1976712 - RNA, 15 nt, Homo sapiens
caacacaguuuugac

SEQ ID NO: 1976713 - RNA, 15 nt, Homo sapiens
gcagugagcugagau

SEQ ID NO: 1976714 - RNA, 22 nt, Homo sapiens
aaucgacuguauucgugcauuu

SEQ ID NO: 1976715 - RNA, 17 nt, Homo sapiens
agugcacugacugugaa

SEQ ID NO: 1976716 - RNA, 14 nt, Homo sapiens
gacucugagcucau

SEQ ID NO: 1976717 - RNA, 18 nt, Homo sapiens
agccaggagaccugcucu

SEQ ID NO: 1976718 - RNA, 13 nt, Homo sapiens
auucucccuuuau

SEQ ID NO: 1976719 - RNA, 11 nt, Homo sapiens
uucaacaaagg

SEQ ID NO: 1976720 - RNA, 14 nt, Homo sapiens
cucuggaggagcaa

SEQ ID NO: 1976721 - RNA, 16 nt, Homo sapiens
ccugucuaacugcugu

SEQ ID NO: 1976722 - RNA, 20 nt, Homo sapiens
gccucccuugacuuugcucc

SEQ ID NO: 1976723 - RNA, 13 nt, Homo sapiens
cugaauacauucu

SEQ ID NO: 1976724 - RNA, 15 nt, Homo sapiens
uaaaucauuucagua

SEQ ID NO: 1976725 - RNA, 22 nt, Homo sapiens
cuguuuuguuaauauaccccaa

SEQ ID NO: 1976726 - RNA, 21 nt, Homo sapiens
uucaaaacauucauaggcagu

SEQ ID NO: 1976727 - RNA, 13 nt, Homo sapiens
ugcucugagccac

SEQ ID NO: 1976728 - RNA, 19 nt, Homo sapiens
ucucaguggcuucaucugu

SEQ ID NO: 1976729 - RNA, 13 nt, Homo sapiens
aaaggugacuggg

SEQ ID NO: 1976730 - RNA, 13 nt, Homo sapiens
auaggugacaggg

SEQ ID NO: 1976731 - RNA, 18 nt, Homo sapiens
uccuugcugauuugcaca

SEQ ID NO: 1976732 - RNA, 16 nt, Homo sapiens
cccagaauugcugaca

SEQ ID NO: 1976733 - RNA, 14 nt, Homo sapiens
uuucucccaggaag

SEQ ID NO: 1976734 - RNA, 23 nt, Homo sapiens
aaugcaccauacucaugcaugca

SEQ ID NO: 1976735 - RNA, 15 nt, Homo sapiens
agaaaucaaacugcu

SEQ ID NO: 1976736 - RNA, 22 nt, Homo sapiens
gggugagcuccagcugcugcgc

SEQ ID NO: 1976737 - RNA, 20 nt, Homo sapiens
gccagccuucuuccauccca

SEQ ID NO: 1976738 - RNA, 20 nt, Homo sapiens
cuuccucccagacuugccuu

SEQ ID NO: 1976739 - RNA, 15 nt, Homo sapiens
auccucccaaucuca

SEQ ID NO: 1976740 - RNA, 12 nt, Homo sapiens
aaacacacucaa

SEQ ID NO: 1976741 - RNA, 14 nt, Homo sapiens
aagccggccggcug

SEQ ID NO: 1976742 - RNA, 22 nt, Homo sapiens
accuuauuuuacagaagugaaa

SEQ ID NO: 1976743 - RNA, 23 nt, Homo sapiens
acuuuucaccaggggugcucacc

SEQ ID NO: 1976744 - RNA, 12 nt, Homo sapiens
ccuccuaccuuu

SEQ ID NO: 1976745 - RNA, 14 nt, Homo sapiens
auaaucuaauuaca

SEQ ID NO: 1976746 - RNA, 22 nt, Homo sapiens
cuugcaugacaaaggccuguga

SEQ ID NO: 1976747 - RNA, 23 nt, Homo sapiens
ucagagugacuacacacaguacg

SEQ ID NO: 1976748 - RNA, 17 nt, Homo sapiens
cucagcuggaucuccau

SEQ ID NO: 1976749 - RNA, 19 nt, Homo sapiens
agaaaagcccaaguucaug

SEQ ID NO: 1976750 - RNA, 17 nt, Homo sapiens
gcaucaccaggguuucu

SEQ ID NO: 1976751 - RNA, 12 nt, Homo sapiens
cagaguuuucau

SEQ ID NO: 1976752 - RNA, 18 nt, Homo sapiens
aggagcuuccagugcaug

SEQ ID NO: 1976753 - RNA, 17 nt, Homo sapiens
ucccacucccuuuccaa

SEQ ID NO: 1976754 - RNA, 23 nt, Homo sapiens
ugacagcaguguuaaguguuuga

SEQ ID NO: 1976755 - RNA, 12 nt, Homo sapiens
auggacaacuua

SEQ ID NO: 1976756 - RNA, 13 nt, Homo sapiens
aaagcacuggaau

SEQ ID NO: 1976757 - RNA, 22 nt, Homo sapiens
gcuugauauaauaauuacuuaa

SEQ ID NO: 1976758 - RNA, 16 nt, Homo sapiens
ccuuccucccauuucc

SEQ ID NO: 1976759 - RNA, 21 nt, Homo sapiens
aucucaaggauccagacucuc

SEQ ID NO: 1976760 - RNA, 16 nt, Homo sapiens
aguccacaaagcauuu

SEQ ID NO: 1976761 - RNA, 16 nt, Homo sapiens
gaaggugcugacaaag

SEQ ID NO: 1976762 - RNA, 14 nt, Homo sapiens
aucuuugcacucca

SEQ ID NO: 1976763 - RNA, 19 nt, Homo sapiens
acuggaguucaguggugca

SEQ ID NO: 1976764 - RNA, 21 nt, Homo sapiens
aguaaagugaagaauuuaucu

SEQ ID NO: 1976765 - RNA, 22 nt, Homo sapiens
acugcccaaacuaaugaguuua

SEQ ID NO: 1976766 - RNA, 17 nt, Homo sapiens
cugaccuccuccuucau

SEQ ID NO: 1976767 - RNA, 20 nt, Homo sapiens
gcaccauucuccugccucag

SEQ ID NO: 1976768 - RNA, 20 nt, Homo sapiens
cuucuugccucugugcugug

SEQ ID NO: 1976769 - RNA, 19 nt, Homo sapiens
cuccaacccuagcaaaagu

SEQ ID NO: 1976770 - RNA, 22 nt, Homo sapiens
uaucuuuaaauaaaugugagaa

SEQ ID NO: 1976771 - RNA, 13 nt, Homo sapiens
ccaaaauaaucua

SEQ ID NO: 1976772 - RNA, 22 nt, Homo sapiens
uacauguauaucucgagugagu

SEQ ID NO: 1976773 - RNA, 19 nt, Homo sapiens
ccccugcaauguggugaca

SEQ ID NO: 1976774 - RNA, 15 nt, Homo sapiens
gccccauacagggca

SEQ ID NO: 1976775 - RNA, 21 nt, Homo sapiens
cugaacuuugcaaagaccuuc

SEQ ID NO: 1976776 - RNA, 17 nt, Homo sapiens
aacuggaguuggcaaua

SEQ ID NO: 1976777 - RNA, 16 nt, Homo sapiens
cagagggugacugugu

SEQ ID NO: 1976778 - RNA, 14 nt, Homo sapiens
uguggaugcugcug

SEQ ID NO: 1976779 - RNA, 20 nt, Homo sapiens
ccuggccccuccaauccucc

SEQ ID NO: 1976780 - RNA, 15 nt, Homo sapiens
aaaccacagcccugu

SEQ ID NO: 1976781 - RNA, 21 nt, Homo sapiens
cugcuggagugcaguggcaca

SEQ ID NO: 1976782 - RNA, 17 nt, Homo sapiens
gaaaagaaaguguuuua

SEQ ID NO: 1976783 - RNA, 23 nt, Homo sapiens
uaggaagcuuuuguuauguauuu

SEQ ID NO: 1976784 - RNA, 20 nt, Homo sapiens
cacauuuacuagcugugcaa

SEQ ID NO: 1976785 - RNA, 16 nt, Homo sapiens
uagaacuccaguacuc

SEQ ID NO: 1976786 - RNA, 23 nt, Homo sapiens
acggacuuccuuuaggaucucag

SEQ ID NO: 1976787 - RNA, 15 nt, Homo sapiens
ucccccagcacagau

SEQ ID NO: 1976788 - RNA, 12 nt, Homo sapiens
uugaaaguaaaa

SEQ ID NO: 1976789 - RNA, 14 nt, Homo sapiens
cuuaagaauugaau

SEQ ID NO: 1976790 - RNA, 21 nt, Homo sapiens
agcuauuaagaaaaucacauu

SEQ ID NO: 1976791 - RNA, 23 nt, Homo sapiens
auaaacuauacacuuaaugauac

SEQ ID NO: 1976792 - RNA, 13 nt, Homo sapiens
cacccagcaaaga

SEQ ID NO: 1976793 - RNA, 22 nt, Homo sapiens
aauaccuucugaacuacacugc

SEQ ID NO: 1976794 - RNA, 13 nt, Homo sapiens
cauggaaagggag

SEQ ID NO: 1976795 - RNA, 13 nt, Homo sapiens
caggcagccccac

SEQ ID NO: 1976796 - RNA, 22 nt, Homo sapiens
acaaacguauguaaauguauau

SEQ ID NO: 1976797 - RNA, 13 nt, Homo sapiens
uuuccagugugua

SEQ ID NO: 1976798 - RNA, 17 nt, Homo sapiens
cuugaaucaaguguaau

SEQ ID NO: 1976799 - RNA, 22 nt, Homo sapiens
gcacuaccacgccaagcuaauu

SEQ ID NO: 1976800 - RNA, 21 nt, Homo sapiens
aauagugaauacuuacuauaa

SEQ ID NO: 1976801 - RNA, 14 nt, Homo sapiens
agcugggaaccagc

SEQ ID NO: 1976802 - RNA, 13 nt, Homo sapiens
ccaggcuaccauc

SEQ ID NO: 1976803 - RNA, 17 nt, Homo sapiens
augcuucuaaggcaugg

SEQ ID NO: 1976804 - RNA, 23 nt, Homo sapiens
acacacuuguugauuaauggaaa

SEQ ID NO: 1976805 - RNA, 14 nt, Homo sapiens
cgcugcccacacca

SEQ ID NO: 1976806 - RNA, 12 nt, Homo sapiens
uuacauauguca

SEQ ID NO: 1976807 - RNA, 21 nt, Homo sapiens
aggcagggcucucccgugcau

SEQ ID NO: 1976808 - RNA, 19 nt, Homo sapiens
cagccccucucuacuguca

SEQ ID NO: 1976809 - RNA, 22 nt, Homo sapiens
aguuuacuuauaccucucucaa

SEQ ID NO: 1976810 - RNA, 21 nt, Homo sapiens
auugugaauaaaaauugauga

SEQ ID NO: 1976811 - RNA, 14 nt, Homo sapiens
uugcguucaaagag

SEQ ID NO: 1976812 - RNA, 20 nt, Homo sapiens
ugugguggcugcuccaugag

SEQ ID NO: 1976813 - RNA, 20 nt, Homo sapiens
cauugagcugagaucgugcc

SEQ ID NO: 1976814 - RNA, 18 nt, Homo sapiens
guauauaaauacaugcac

SEQ ID NO: 1976815 - RNA, 20 nt, Homo sapiens
aauguaauaaagugaacuuu

SEQ ID NO: 1976816 - RNA, 18 nt, Homo sapiens
aucacuuaguucucaggc

SEQ ID NO: 1976817 - RNA, 13 nt, Homo sapiens
gagcaagcaccaa

SEQ ID NO: 1976818 - RNA, 13 nt, Homo sapiens
ucaauggcaccuu

SEQ ID NO: 1976819 - RNA, 16 nt, Homo sapiens
ucacaugugcugcaaa

SEQ ID NO: 1976820 - RNA, 13 nt, Homo sapiens
uauguagcacaua

SEQ ID NO: 1976821 - RNA, 15 nt, Homo sapiens
uagagauaugcacac

SEQ ID NO: 1976822 - RNA, 17 nt, Homo sapiens
aaaaugaauugucuuca

SEQ ID NO: 1976823 - RNA, 18 nt, Homo sapiens
guucccaauaucauguga

SEQ ID NO: 1976824 - RNA, 14 nt, Homo sapiens
ugccucagcuuccc

SEQ ID NO: 1976825 - RNA, 14 nt, Homo sapiens
cucuuuaguguucu

SEQ ID NO: 1976826 - RNA, 18 nt, Homo sapiens
cagaggcaggaccagaag

SEQ ID NO: 1976827 - RNA, 13 nt, Homo sapiens
ucaagauacugga

SEQ ID NO: 1976828 - RNA, 14 nt, Homo sapiens
cgugccugccaagc

SEQ ID NO: 1976829 - RNA, 17 nt, Homo sapiens
ggcuaaaauuaguuuua

SEQ ID NO: 1976830 - RNA, 15 nt, Homo sapiens
auguauggugcaaug

SEQ ID NO: 1976831 - RNA, 17 nt, Homo sapiens
gagaacccauuucucca

SEQ ID NO: 1976832 - RNA, 19 nt, Homo sapiens
gauguggugggagcacagc

SEQ ID NO: 1976833 - RNA, 13 nt, Homo sapiens
ucacagaggcagu

SEQ ID NO: 1976834 - RNA, 16 nt, Homo sapiens
aucugagaaacuuaaa

SEQ ID NO: 1976835 - RNA, 20 nt, Homo sapiens
cuagaugauugauuaccaag

SEQ ID NO: 1976836 - RNA, 21 nt, Homo sapiens
ggaaaggguucacauaggcuc

SEQ ID NO: 1976837 - RNA, 17 nt, Homo sapiens
uucgcauuaagcacaca

SEQ ID NO: 1976838 - RNA, 14 nt, Homo sapiens
uccgcgcucggggc

SEQ ID NO: 1976839 - RNA, 14 nt, Homo sapiens
ugguuacaguuuga

SEQ ID NO: 1976840 - RNA, 22 nt, Homo sapiens
aaucaaguuugaccagugcagu

SEQ ID NO: 1976841 - RNA, 21 nt, Homo sapiens
cugugcugcuuuugagccuca

SEQ ID NO: 1976842 - RNA, 12 nt, Homo sapiens
uuuuccagaaau

SEQ ID NO: 1976843 - RNA, 14 nt, Homo sapiens
cuucaaaagcacug

SEQ ID NO: 1976844 - RNA, 15 nt, Homo sapiens
agcuagaacuggaag

SEQ ID NO: 1976845 - RNA, 17 nt, Homo sapiens
uaaaugaagaaggaaua

SEQ ID NO: 1976846 - RNA, 22 nt, Homo sapiens
uacuguaaauauuuuucacaua

SEQ ID NO: 1976847 - RNA, 18 nt, Homo sapiens
caaggcaggccuuuccua

SEQ ID NO: 1976848 - RNA, 22 nt, Homo sapiens
caacauucuguguucacaugug

SEQ ID NO: 1976849 - RNA, 15 nt, Homo sapiens
aauuuauaugucaga

SEQ ID NO: 1976850 - RNA, 13 nt, Homo sapiens
gguauaauguuua

SEQ ID NO: 1976851 - RNA, 22 nt, Homo sapiens
cuacccucuuauuguuccucuu

SEQ ID NO: 1976852 - RNA, 13 nt, Homo sapiens
uuauuacucucac

SEQ ID NO: 1976853 - RNA, 17 nt, Homo sapiens
cucaauugucauugaua

SEQ ID NO: 1976854 - RNA, 17 nt, Homo sapiens
uggcaugacaacuacuu

SEQ ID NO: 1976855 - RNA, 16 nt, Homo sapiens
ugucaagaacaggaca

SEQ ID NO: 1976856 - RNA, 14 nt, Homo sapiens
uaacucagccagaa

SEQ ID NO: 1976857 - RNA, 18 nt, Homo sapiens
cuaaagugccuaccccag

SEQ ID NO: 1976858 - RNA, 15 nt, Homo sapiens
cacaucuuuccucaa

SEQ ID NO: 1976859 - RNA, 15 nt, Homo sapiens
auggacacacaguca

SEQ ID NO: 1976860 - RNA, 15 nt, Homo sapiens
cauuucuugugaugu

SEQ ID NO: 1976861 - RNA, 21 nt, Homo sapiens
augaguaauacaucaaagagu

SEQ ID NO: 1976862 - RNA, 15 nt, Homo sapiens
agaaauaaauaaucu

SEQ ID NO: 1976863 - RNA, 16 nt, Homo sapiens
uucuuguuuucagaaa

SEQ ID NO: 1976864 - RNA, 20 nt, Homo sapiens
uauguaauauuuacauaaag

SEQ ID NO: 1976865 - RNA, 17 nt, Homo sapiens
guggccgaggacuuuga

SEQ ID NO: 1976866 - RNA, 19 nt, Homo sapiens
aaguaugccuuaagcagaa

SEQ ID NO: 1976867 - RNA, 19 nt, Homo sapiens
cugugaucaagcaauaaua

SEQ ID NO: 1976868 - RNA, 13 nt, Homo sapiens
aacagcacccucu

SEQ ID NO: 1976869 - RNA, 19 nt, Homo sapiens
caagucaagccuagccuga

SEQ ID NO: 1976870 - RNA, 17 nt, Homo sapiens
gagaagaggcugcugca

SEQ ID NO: 1976871 - RNA, 14 nt, Homo sapiens
agggucgcugcaua

SEQ ID NO: 1976872 - RNA, 16 nt, Homo sapiens
uaaauuuugcacugcu

SEQ ID NO: 1976873 - RNA, 16 nt, Homo sapiens
gaaaaaaagaugguau

SEQ ID NO: 1976874 - RNA, 17 nt, Homo sapiens
ccccaggaccagaagcu

SEQ ID NO: 1976875 - RNA, 11 nt, Homo sapiens
uggguggcucc

SEQ ID NO: 1976876 - RNA, 22 nt, Homo sapiens
guguggaccaaggagcuuccau

SEQ ID NO: 1976877 - RNA, 18 nt, Homo sapiens
acaguccucacagccucu

SEQ ID NO: 1976878 - RNA, 19 nt, Homo sapiens
cacagugauuagccucguc

SEQ ID NO: 1976879 - RNA, 23 nt, Homo sapiens
caccaaucagcaggauucuaaaa

SEQ ID NO: 1976880 - RNA, 17 nt, Homo sapiens
gccccccucauuacugc

SEQ ID NO: 1976881 - RNA, 19 nt, Homo sapiens
cuuucaagugaaaccagcu

SEQ ID NO: 1976882 - RNA, 17 nt, Homo sapiens
ggcccgcaccccggccu

SEQ ID NO: 1976883 - RNA, 21 nt, Homo sapiens
accuuucacgaacaugggcau

SEQ ID NO: 1976884 - RNA, 22 nt, Homo sapiens
uuccccagccccuuggauguga

SEQ ID NO: 1976885 - RNA, 22 nt, Homo sapiens
aauuuccugaugcauauugccc

SEQ ID NO: 1976886 - RNA, 21 nt, Homo sapiens
gaaucucaauaaaccagugaa

SEQ ID NO: 1976887 - RNA, 16 nt, Homo sapiens
aaaaaguuucacaggu

SEQ ID NO: 1976888 - RNA, 15 nt, Homo sapiens
ucuuagcauacauuc

SEQ ID NO: 1976889 - RNA, 20 nt, Homo sapiens
cugggacggcccaucuuggc

SEQ ID NO: 1976890 - RNA, 19 nt, Homo sapiens
ccuggggcuucuccugacc

SEQ ID NO: 1976891 - RNA, 16 nt, Homo sapiens
ucaguccacugcugag

SEQ ID NO: 1976892 - RNA, 14 nt, Homo sapiens
auguccaacuaaaa

SEQ ID NO: 1976893 - RNA, 22 nt, Homo sapiens
uuuaaacucaagacaaugcacc

SEQ ID NO: 1976894 - RNA, 20 nt, Homo sapiens
gaaaaaucccuguucugcca

SEQ ID NO: 1976895 - RNA, 17 nt, Homo sapiens
gaaguuggcacauuuca

SEQ ID NO: 1976896 - RNA, 21 nt, Homo sapiens
ccucuucccugucuuccccac

SEQ ID NO: 1976897 - RNA, 17 nt, Homo sapiens
augccuguuaauauuca

SEQ ID NO: 1976898 - RNA, 20 nt, Homo sapiens
ucugaauaaauacccauuga

SEQ ID NO: 1976899 - RNA, 14 nt, Homo sapiens
ugguaaagcacaug

SEQ ID NO: 1976900 - RNA, 17 nt, Homo sapiens
cugucuucuucauguca

SEQ ID NO: 1976901 - RNA, 16 nt, Homo sapiens
uaccauccccacccau

SEQ ID NO: 1976902 - RNA, 13 nt, Homo sapiens
aauaucuauuaac

SEQ ID NO: 1976903 - RNA, 20 nt, Homo sapiens
aaacacagauuguauucuau

SEQ ID NO: 1976904 - RNA, 20 nt, Homo sapiens
uaaaauugggcuugugauuu

SEQ ID NO: 1976905 - RNA, 14 nt, Homo sapiens
cuuugauaucugau

SEQ ID NO: 1976906 - RNA, 22 nt, Homo sapiens
ucucuccuuuucuuuuguuacu

SEQ ID NO: 1976907 - RNA, 19 nt, Homo sapiens
auguccaagugccacguga

SEQ ID NO: 1976908 - RNA, 22 nt, Homo sapiens
uacuuuuucaugaaaauggagu

SEQ ID NO: 1976909 - RNA, 13 nt, Homo sapiens
aaagcagacuuuu

SEQ ID NO: 1976910 - RNA, 15 nt, Homo sapiens
uauucagauugggaa

SEQ ID NO: 1976911 - RNA, 14 nt, Homo sapiens
aauuggguuuuaaa

SEQ ID NO: 1976912 - RNA, 15 nt, Homo sapiens
uauaugcaugcacag

SEQ ID NO: 1976913 - RNA, 18 nt, Homo sapiens
gacugcccagccacucca

SEQ ID NO: 1976914 - RNA, 17 nt, Homo sapiens
ugcaccagcgaagaauu

SEQ ID NO: 1976915 - RNA, 10 nt, Homo sapiens
aguguucacu

SEQ ID NO: 1976916 - RNA, 16 nt, Homo sapiens
guucuguuucaaugua

SEQ ID NO: 1976917 - RNA, 18 nt, Homo sapiens
uccuuuuguuuuccacuc

SEQ ID NO: 1976918 - RNA, 13 nt, Homo sapiens
cauucuucucaca

SEQ ID NO: 1976919 - RNA, 13 nt, Homo sapiens
uugccucaagacu

SEQ ID NO: 1976920 - RNA, 19 nt, Homo sapiens
uaaagagcugcacagcaaa

SEQ ID NO: 1976921 - RNA, 15 nt, Homo sapiens
ggcacauguguucag

SEQ ID NO: 1976922 - RNA, 19 nt, Homo sapiens
uaaaaccaguuuugcugcu

SEQ ID NO: 1976923 - RNA, 15 nt, Homo sapiens
gccagccaccacuga

SEQ ID NO: 1976924 - RNA, 13 nt, Homo sapiens
gaaagaauugagg

SEQ ID NO: 1976925 - RNA, 13 nt, Homo sapiens
aauacuggccaug

SEQ ID NO: 1976926 - RNA, 23 nt, Homo sapiens
cuggcccuguccuggcaucagua

SEQ ID NO: 1976927 - RNA, 19 nt, Homo sapiens
gacagggucucacuauguu

SEQ ID NO: 1976928 - RNA, 17 nt, Homo sapiens
aaaaugauaaacaaguc

SEQ ID NO: 1976929 - RNA, 14 nt, Homo sapiens
auuaauucuacuaa

SEQ ID NO: 1976930 - RNA, 12 nt, Homo sapiens
cucccacaguga

SEQ ID NO: 1976931 - RNA, 21 nt, Homo sapiens
ugcuuuuaaaugaccaaagau

SEQ ID NO: 1976932 - RNA, 12 nt, Homo sapiens
agccccaaaagg

SEQ ID NO: 1976933 - RNA, 19 nt, Homo sapiens
gaauacuugcacucuuuaa

SEQ ID NO: 1976934 - RNA, 16 nt, Homo sapiens
cuuucuguugccaugg

SEQ ID NO: 1976935 - RNA, 21 nt, Homo sapiens
ugguuuugauggcuggguccu

SEQ ID NO: 1976936 - RNA, 19 nt, Homo sapiens
caagcaaaucccaacauuu

SEQ ID NO: 1976937 - RNA, 20 nt, Homo sapiens
aaggagacacaacaacuccu

SEQ ID NO: 1976938 - RNA, 22 nt, Homo sapiens
cucuggcugucugucugcagug

SEQ ID NO: 1976939 - RNA, 16 nt, Homo sapiens
gcuuucaucuaaucuu

SEQ ID NO: 1976940 - RNA, 15 nt, Homo sapiens
uaagccuuuccauaa

SEQ ID NO: 1976941 - RNA, 12 nt, Homo sapiens
uacccaccugag

SEQ ID NO: 1976942 - RNA, 19 nt, Homo sapiens
ggccagagccgggguucca

SEQ ID NO: 1976943 - RNA, 14 nt, Homo sapiens
aauggaaucuucuc

SEQ ID NO: 1976944 - RNA, 16 nt, Homo sapiens
uguggauggucauugc

SEQ ID NO: 1976945 - RNA, 19 nt, Homo sapiens
aaaaugcaagccaucucua

SEQ ID NO: 1976946 - RNA, 16 nt, Homo sapiens
cauugcauguauugua

SEQ ID NO: 1976947 - RNA, 19 nt, Homo sapiens
ccaccucuguggcauugaa

SEQ ID NO: 1976948 - RNA, 12 nt, Homo sapiens
auauaccaaagc

SEQ ID NO: 1976949 - RNA, 19 nt, Homo sapiens
ccaugacguguuucuugaa

SEQ ID NO: 1976950 - RNA, 16 nt, Homo sapiens
cugcaaaacacuaaag

SEQ ID NO: 1976951 - RNA, 14 nt, Homo sapiens
uacaaacugcaaua

SEQ ID NO: 1976952 - RNA, 17 nt, Homo sapiens
augucuguaucacucug

SEQ ID NO: 1976953 - RNA, 17 nt, Homo sapiens
gagucugucacacucuc

SEQ ID NO: 1976954 - RNA, 18 nt, Homo sapiens
auggcuugccacagcucu

SEQ ID NO: 1976955 - RNA, 21 nt, Homo sapiens
agaugucuuccuaucaaaaag

SEQ ID NO: 1976956 - RNA, 14 nt, Homo sapiens
guagugcuuuccag

SEQ ID NO: 1976957 - RNA, 15 nt, Homo sapiens
cgagcagggugguga

SEQ ID NO: 1976958 - RNA, 18 nt, Homo sapiens
ucacccaaccacauccca

SEQ ID NO: 1976959 - RNA, 22 nt, Homo sapiens
gucugugcagaugcuuugccca

SEQ ID NO: 1976960 - RNA, 22 nt, Homo sapiens
gagaagcaacacuuugugaucu

SEQ ID NO: 1976961 - RNA, 18 nt, Homo sapiens
acacauuuggaccacagc

SEQ ID NO: 1976962 - RNA, 19 nt, Homo sapiens
uuagaaaugagaucuagag

SEQ ID NO: 1976963 - RNA, 16 nt, Homo sapiens
aauguugcucugggag

SEQ ID NO: 1976964 - RNA, 23 nt, Homo sapiens
gaucuggaacccagacucagaca

SEQ ID NO: 1976965 - RNA, 17 nt, Homo sapiens
accagugugacaucuac

SEQ ID NO: 1976966 - RNA, 18 nt, Homo sapiens
gaccgugcgagcugccgu

SEQ ID NO: 1976967 - RNA, 16 nt, Homo sapiens
accaggccaccaucug

SEQ ID NO: 1976968 - RNA, 15 nt, Homo sapiens
acacaggaugaaggc

SEQ ID NO: 1976969 - RNA, 18 nt, Homo sapiens
aaacucaagcuucuucac

SEQ ID NO: 1976970 - RNA, 17 nt, Homo sapiens
gaacuacauuaguacac

SEQ ID NO: 1976971 - RNA, 13 nt, Homo sapiens
aagaaggaacaau

SEQ ID NO: 1976972 - RNA, 13 nt, Homo sapiens
cagauggaccaaa

SEQ ID NO: 1976973 - RNA, 15 nt, Homo sapiens
ugagcccccugaccu

SEQ ID NO: 1976974 - RNA, 21 nt, Homo sapiens
caaugcuucuaucaaauacua

SEQ ID NO: 1976975 - RNA, 11 nt, Homo sapiens
auaagcuuucu

SEQ ID NO: 1976976 - RNA, 16 nt, Homo sapiens
cugucagaaucacaua

SEQ ID NO: 1976977 - RNA, 16 nt, Homo sapiens
cagucuguaacacuuu

SEQ ID NO: 1976978 - RNA, 17 nt, Homo sapiens
uguagauggcggugaug

SEQ ID NO: 1976979 - RNA, 11 nt, Homo sapiens
cugugcaauaa

SEQ ID NO: 1976980 - RNA, 15 nt, Homo sapiens
cucaacugacaugaa

SEQ ID NO: 1976981 - RNA, 16 nt, Homo sapiens
agugauuguuaugccu

SEQ ID NO: 1976982 - RNA, 20 nt, Homo sapiens
uccuuuuaaaaaccuagguc

SEQ ID NO: 1976983 - RNA, 14 nt, Homo sapiens
ucaaccucuguauu

SEQ ID NO: 1976984 - RNA, 21 nt, Homo sapiens
guauuaggucgguacuaagaa

SEQ ID NO: 1976985 - RNA, 23 nt, Homo sapiens
uguggggugugugcagggcugca

SEQ ID NO: 1976986 - RNA, 17 nt, Homo sapiens
cacauagagauaugcac

SEQ ID NO: 1976987 - RNA, 14 nt, Homo sapiens
agucuggagggcug

SEQ ID NO: 1976988 - RNA, 20 nt, Homo sapiens
cccccaaagggccuccucac

SEQ ID NO: 1976989 - RNA, 16 nt, Homo sapiens
caacccagcaaucuca

SEQ ID NO: 1976990 - RNA, 18 nt, Homo sapiens
gcauauuguacacuuuuu

SEQ ID NO: 1976991 - RNA, 21 nt, Homo sapiens
gccucugccccgucucaugag

SEQ ID NO: 1976992 - RNA, 17 nt, Homo sapiens
cccaggcuggagugcag

SEQ ID NO: 1976993 - RNA, 17 nt, Homo sapiens
cccaggcuagagugcaa

SEQ ID NO: 1976994 - RNA, 14 nt, Homo sapiens
acuuaagugugcaa

SEQ ID NO: 1976995 - RNA, 21 nt, Homo sapiens
cauuugcaauaaaagguuucc

SEQ ID NO: 1976996 - RNA, 17 nt, Homo sapiens
gaauagaaaggcuucca

SEQ ID NO: 1976997 - RNA, 21 nt, Homo sapiens
auaaaaaucccucuuccucca

SEQ ID NO: 1976998 - RNA, 19 nt, Homo sapiens
uaucccuggaguuccucau

SEQ ID NO: 1976999 - RNA, 13 nt, Homo sapiens
agcaggccaaaca

SEQ ID NO: 1977000 - RNA, 15 nt, Homo sapiens
acuucuugucuauag

SEQ ID NO: 1977001 - RNA, 20 nt, Homo sapiens
cucaguuucuucaccuguaa

SEQ ID NO: 1977002 - RNA, 14 nt, Homo sapiens
cccccugucucuca

SEQ ID NO: 1977003 - RNA, 18 nt, Homo sapiens
ucaauggaguaugucuga

SEQ ID NO: 1977004 - RNA, 19 nt, Homo sapiens
gaagaacaggccucuccau

SEQ ID NO: 1977005 - RNA, 19 nt, Homo sapiens
ugucagcccugugugguca

SEQ ID NO: 1977006 - RNA, 16 nt, Homo sapiens
ucaaacaaaaagucau

SEQ ID NO: 1977007 - RNA, 18 nt, Homo sapiens
gacauuccaaguuuuuca

SEQ ID NO: 1977008 - RNA, 22 nt, Homo sapiens
gacuguucaagagcacacuugg

SEQ ID NO: 1977009 - RNA, 11 nt, Homo sapiens
uaucaaagugu

SEQ ID NO: 1977010 - RNA, 21 nt, Homo sapiens
gaucaagucaccggagcuuuc

SEQ ID NO: 1977011 - RNA, 20 nt, Homo sapiens
cagagaugcaaugauaguua

SEQ ID NO: 1977012 - RNA, 15 nt, Homo sapiens
caauacuguuuccau

SEQ ID NO: 1977013 - RNA, 13 nt, Homo sapiens
accuuuucccaac

SEQ ID NO: 1977014 - RNA, 19 nt, Homo sapiens
aaagauuugacaugcucca

SEQ ID NO: 1977015 - RNA, 20 nt, Homo sapiens
cgugguggaagaggggacag

SEQ ID NO: 1977016 - RNA, 14 nt, Homo sapiens
cacucuaaauggaa

SEQ ID NO: 1977017 - RNA, 18 nt, Homo sapiens
caccuacuuacaugcauu

SEQ ID NO: 1977018 - RNA, 22 nt, Homo sapiens
uuaaacgguaacauccaaaagc

SEQ ID NO: 1977019 - RNA, 18 nt, Homo sapiens
gugguuuccaaggagcug

SEQ ID NO: 1977020 - RNA, 15 nt, Homo sapiens
uauuuaaaacaaaga

SEQ ID NO: 1977021 - RNA, 22 nt, Homo sapiens
ggccgccagcguguggagcaga

SEQ ID NO: 1977022 - RNA, 19 nt, Homo sapiens
ugauaauggaaacugucaa

SEQ ID NO: 1977023 - RNA, 23 nt, Homo sapiens
guuaccaguguuaauaaauggau

SEQ ID NO: 1977024 - RNA, 14 nt, Homo sapiens
gcccuauugcugcu

SEQ ID NO: 1977025 - RNA, 20 nt, Homo sapiens
gcuggagugcagugguguga

SEQ ID NO: 1977026 - RNA, 21 nt, Homo sapiens
cuaugagaauugggauuacau

SEQ ID NO: 1977027 - RNA, 22 nt, Homo sapiens
cacauaguagguacccaauuca

SEQ ID NO: 1977028 - RNA, 15 nt, Homo sapiens
uccaucuguacuuug

SEQ ID NO: 1977029 - RNA, 12 nt, Homo sapiens
caauauuugcua

SEQ ID NO: 1977030 - RNA, 17 nt, Homo sapiens
aauauccacaguacuca

SEQ ID NO: 1977031 - RNA, 14 nt, Homo sapiens
gagaggaguucaau

SEQ ID NO: 1977032 - RNA, 16 nt, Homo sapiens
gcuucauccacugaau

SEQ ID NO: 1977033 - RNA, 14 nt, Homo sapiens
cagaccugccccuc

SEQ ID NO: 1977034 - RNA, 19 nt, Homo sapiens
ucagagcugggaguagcau

SEQ ID NO: 1977035 - RNA, 22 nt, Homo sapiens
cuaaaggaagaaauacauauuu

SEQ ID NO: 1977036 - RNA, 14 nt, Homo sapiens
auacccacugccag

SEQ ID NO: 1977037 - RNA, 14 nt, Homo sapiens
aggacugggccacu

SEQ ID NO: 1977038 - RNA, 16 nt, Homo sapiens
acuugugauccuaaaa

SEQ ID NO: 1977039 - RNA, 13 nt, Homo sapiens
ugcccugcuauuu

SEQ ID NO: 1977040 - RNA, 23 nt, Homo sapiens
caggaugcugugauacacugaaa

SEQ ID NO: 1977041 - RNA, 20 nt, Homo sapiens
cccaugccaccggcuccacu

SEQ ID NO: 1977042 - RNA, 22 nt, Homo sapiens
cugccacgccgcccuaaaagca

SEQ ID NO: 1977043 - RNA, 16 nt, Homo sapiens
uugccgcuguauaaag

SEQ ID NO: 1977044 - RNA, 22 nt, Homo sapiens
ccagcuguaccggccacugcaa

SEQ ID NO: 1977045 - RNA, 15 nt, Homo sapiens
gcauaggaauugcac

SEQ ID NO: 1977046 - RNA, 14 nt, Homo sapiens
aagagaucaggaag

SEQ ID NO: 1977047 - RNA, 14 nt, Homo sapiens
gucuccauucugug

SEQ ID NO: 1977048 - RNA, 16 nt, Homo sapiens
gcccauucuucugggu

SEQ ID NO: 1977049 - RNA, 22 nt, Homo sapiens
gcacuacugggugucauuucau

SEQ ID NO: 1977050 - RNA, 18 nt, Homo sapiens
uaacuuuuaauguggcaa

SEQ ID NO: 1977051 - RNA, 13 nt, Homo sapiens
aaaaggcugagaa

SEQ ID NO: 1977052 - RNA, 12 nt, Homo sapiens
cuuuucuaugga

SEQ ID NO: 1977053 - RNA, 16 nt, Homo sapiens
acuuucagagaauuac

SEQ ID NO: 1977054 - RNA, 21 nt, Homo sapiens
accccaggaggaaaagcccag

SEQ ID NO: 1977055 - RNA, 15 nt, Homo sapiens
aagcucugaccacuu

SEQ ID NO: 1977056 - RNA, 13 nt, Homo sapiens
gcuuguaaucaag

SEQ ID NO: 1977057 - RNA, 13 nt, Homo sapiens
gaaaauaauauua

SEQ ID NO: 1977058 - RNA, 22 nt, Homo sapiens
gcucauuuugcaauuuuaucag

SEQ ID NO: 1977059 - RNA, 20 nt, Homo sapiens
uauuacguuguuucuuauag

SEQ ID NO: 1977060 - RNA, 20 nt, Homo sapiens
agcaaaauggauaugacaca

SEQ ID NO: 1977061 - RNA, 15 nt, Homo sapiens
guuuuuggauggcuu

SEQ ID NO: 1977062 - RNA, 14 nt, Homo sapiens
ggcagcuuugcaaa

SEQ ID NO: 1977063 - RNA, 14 nt, Homo sapiens
caugugacucugaa

SEQ ID NO: 1977064 - RNA, 16 nt, Homo sapiens
uguacuguacauaaau

SEQ ID NO: 1977065 - RNA, 21 nt, Homo sapiens
uggccaauucaguuucacuuu

SEQ ID NO: 1977066 - RNA, 12 nt, Homo sapiens
cuguccuaagca

SEQ ID NO: 1977067 - RNA, 21 nt, Homo sapiens
agguauaccuguugagacuga

SEQ ID NO: 1977068 - RNA, 14 nt, Homo sapiens
aauguaagaaucau

SEQ ID NO: 1977069 - RNA, 15 nt, Homo sapiens
ugguaguuuggaaag

SEQ ID NO: 1977070 - RNA, 15 nt, Homo sapiens
cuccccacucuaggg

SEQ ID NO: 1977071 - RNA, 20 nt, Homo sapiens
ugggcuggccagccaccacu

SEQ ID NO: 1977072 - RNA, 23 nt, Homo sapiens
gaagaguguuucuuccacaacag

SEQ ID NO: 1977073 - RNA, 11 nt, Homo sapiens
guccagcaccu

SEQ ID NO: 1977074 - RNA, 22 nt, Homo sapiens
aacauggugaaacuccaucucu

SEQ ID NO: 1977075 - RNA, 19 nt, Homo sapiens
ugaaguguggcugcaucuu

SEQ ID NO: 1977076 - RNA, 12 nt, Homo sapiens
cuugcacugaau

SEQ ID NO: 1977077 - RNA, 13 nt, Homo sapiens
ugacaaaccagag

SEQ ID NO: 1977078 - RNA, 20 nt, Homo sapiens
ucaggaaggaugagcauuua

SEQ ID NO: 1977079 - RNA, 19 nt, Homo sapiens
aacauucuuauuucaguua

SEQ ID NO: 1977080 - RNA, 17 nt, Homo sapiens
cagagacuuggggacca

SEQ ID NO: 1977081 - RNA, 17 nt, Homo sapiens
ugaguugugagggugaa

SEQ ID NO: 1977082 - RNA, 13 nt, Homo sapiens
caguagaguagaa

SEQ ID NO: 1977083 - RNA, 14 nt, Homo sapiens
aguaugaaguauaa

SEQ ID NO: 1977084 - RNA, 16 nt, Homo sapiens
cagaggcgucccgcac

SEQ ID NO: 1977085 - RNA, 18 nt, Homo sapiens
uuggaacagugcuacuga

SEQ ID NO: 1977086 - RNA, 20 nt, Homo sapiens
ucaucagaauccuuggcuga

SEQ ID NO: 1977087 - RNA, 17 nt, Homo sapiens
gcacagaugcccacgua

SEQ ID NO: 1977088 - RNA, 17 nt, Homo sapiens
ugcagcaaugaagggaa

SEQ ID NO: 1977089 - RNA, 20 nt, Homo sapiens
caaaguccuuuuuuuccauc

SEQ ID NO: 1977090 - RNA, 19 nt, Homo sapiens
cuuucacuauguccaugaa

SEQ ID NO: 1977091 - RNA, 20 nt, Homo sapiens
caugacacauuugaaaucau

SEQ ID NO: 1977092 - RNA, 20 nt, Homo sapiens
cuguaugauucuauggagcu

SEQ ID NO: 1977093 - RNA, 19 nt, Homo sapiens
gcaguauguuuguuucauu

SEQ ID NO: 1977094 - RNA, 22 nt, Homo sapiens
aagcgugguggacaugcacagc

SEQ ID NO: 1977095 - RNA, 20 nt, Homo sapiens
ccauauauugggugugaguu

SEQ ID NO: 1977096 - RNA, 13 nt, Homo sapiens
gcagaggugcaag

SEQ ID NO: 1977097 - RNA, 15 nt, Homo sapiens
aaucaaagcugagga

SEQ ID NO: 1977098 - RNA, 19 nt, Homo sapiens
ggugacagggccgugagca

SEQ ID NO: 1977099 - RNA, 16 nt, Homo sapiens
cugugucagaaacuga

SEQ ID NO: 1977100 - RNA, 16 nt, Homo sapiens
ccuccaaaugccaacu

SEQ ID NO: 1977101 - RNA, 20 nt, Homo sapiens
cauuauaaauaauguucauu

SEQ ID NO: 1977102 - RNA, 21 nt, Homo sapiens
caucagaaacaucugauuuga

SEQ ID NO: 1977103 - RNA, 22 nt, Homo sapiens
uaauaauuguagauucagugua

SEQ ID NO: 1977104 - RNA, 18 nt, Homo sapiens
uagaauauacugucuugu

SEQ ID NO: 1977105 - RNA, 21 nt, Homo sapiens
gcuggagucucagagcacaga

SEQ ID NO: 1977106 - RNA, 18 nt, Homo sapiens
uuguuucaaaauucucau

SEQ ID NO: 1977107 - RNA, 18 nt, Homo sapiens
agcuuuuuugccacaaag

SEQ ID NO: 1977108 - RNA, 22 nt, Homo sapiens
uuccuuguccccgcagcugcuu

SEQ ID NO: 1977109 - RNA, 19 nt, Homo sapiens
aacuaagaaaaaaagcaca

SEQ ID NO: 1977110 - RNA, 18 nt, Homo sapiens
cugaccacagacacuccu

SEQ ID NO: 1977111 - RNA, 14 nt, Homo sapiens
augcaagaugaacc

SEQ ID NO: 1977112 - RNA, 14 nt, Homo sapiens
accccagcuccuag

SEQ ID NO: 1977113 - RNA, 17 nt, Homo sapiens
uuccagaguccuccuuu

SEQ ID NO: 1977114 - RNA, 12 nt, Homo sapiens
caaacagaacua

SEQ ID NO: 1977115 - RNA, 22 nt, Homo sapiens
ugcagcccagaacgggccuccc

SEQ ID NO: 1977116 - RNA, 13 nt, Homo sapiens
cuguguucacaga

SEQ ID NO: 1977117 - RNA, 20 nt, Homo sapiens
aucagaaaauccugacaaaa

SEQ ID NO: 1977118 - RNA, 17 nt, Homo sapiens
uaacucaugccauucca

SEQ ID NO: 1977119 - RNA, 14 nt, Homo sapiens
cagcucaaagacuu

SEQ ID NO: 1977120 - RNA, 13 nt, Homo sapiens
cacacaaguagau

SEQ ID NO: 1977121 - RNA, 18 nt, Homo sapiens
gcuaccaugaagugaaaa

SEQ ID NO: 1977122 - RNA, 12 nt, Homo sapiens
gcaaguuugcac

SEQ ID NO: 1977123 - RNA, 13 nt, Homo sapiens
auaugaguauaca

SEQ ID NO: 1977124 - RNA, 22 nt, Homo sapiens
auucauauaggccagaguugca

SEQ ID NO: 1977125 - RNA, 16 nt, Homo sapiens
uguuucugcuaugacc

SEQ ID NO: 1977126 - RNA, 15 nt, Homo sapiens
gcugcaggauggacu

SEQ ID NO: 1977127 - RNA, 14 nt, Homo sapiens
uugaauacuuugag

SEQ ID NO: 1977128 - RNA, 21 nt, Homo sapiens
caguuuugaccuaacauaccg

SEQ ID NO: 1977129 - RNA, 13 nt, Homo sapiens
agcuugcagugag

SEQ ID NO: 1977130 - RNA, 19 nt, Homo sapiens
cauuggaauaaaacugucu

SEQ ID NO: 1977131 - RNA, 12 nt, Homo sapiens
cgucugugacau

SEQ ID NO: 1977132 - RNA, 12 nt, Homo sapiens
gcuuugagguac

SEQ ID NO: 1977133 - RNA, 19 nt, Homo sapiens
aguugaaaggccucaagaa

SEQ ID NO: 1977134 - RNA, 21 nt, Homo sapiens
ccaccugugaucccagcuacu

SEQ ID NO: 1977135 - RNA, 18 nt, Homo sapiens
ggucagcucuggccacaa

SEQ ID NO: 1977136 - RNA, 19 nt, Homo sapiens
cuuccuccucuacugguaa

SEQ ID NO: 1977137 - RNA, 18 nt, Homo sapiens
ccagaacuggacucagga

SEQ ID NO: 1977138 - RNA, 19 nt, Homo sapiens
uaagaaaaaggaugcacag

SEQ ID NO: 1977139 - RNA, 16 nt, Homo sapiens
cgaaacuggaaguuau

SEQ ID NO: 1977140 - RNA, 20 nt, Homo sapiens
ccugccgcauuuccuuucag

SEQ ID NO: 1977141 - RNA, 15 nt, Homo sapiens
uaauuuauuaaucua

SEQ ID NO: 1977142 - RNA, 17 nt, Homo sapiens
ggagauggcagcaguga

SEQ ID NO: 1977143 - RNA, 15 nt, Homo sapiens
cucuagacugacuca

SEQ ID NO: 1977144 - RNA, 22 nt, Homo sapiens
auccuugauuacuuccacugag

SEQ ID NO: 1977145 - RNA, 13 nt, Homo sapiens
uauguauuacaaa

SEQ ID NO: 1977146 - RNA, 13 nt, Homo sapiens
aacuccugccuau

SEQ ID NO: 1977147 - RNA, 18 nt, Homo sapiens
gagcuagaaccuggagag

SEQ ID NO: 1977148 - RNA, 23 nt, Homo sapiens
cagacacuguagucagaccucag

SEQ ID NO: 1977149 - RNA, 14 nt, Homo sapiens
caaacauguugccu

SEQ ID NO: 1977150 - RNA, 20 nt, Homo sapiens
aaucccaguacgauuugcag

SEQ ID NO: 1977151 - RNA, 14 nt, Homo sapiens
caacccaaggugag

SEQ ID NO: 1977152 - RNA, 16 nt, Homo sapiens
aauaaauuacaauuga

SEQ ID NO: 1977153 - RNA, 22 nt, Homo sapiens
agacugcauguaccauuugcau

SEQ ID NO: 1977154 - RNA, 14 nt, Homo sapiens
ucccccucuuucac

SEQ ID NO: 1977155 - RNA, 21 nt, Homo sapiens
uucgccaaggcucacaugcuc

SEQ ID NO: 1977156 - RNA, 21 nt, Homo sapiens
aaauucucuuuccuguagucc

SEQ ID NO: 1977157 - RNA, 21 nt, Homo sapiens
aagccucguuuugaugccauu

SEQ ID NO: 1977158 - RNA, 20 nt, Homo sapiens
uagacaugaaaucugaggaa

SEQ ID NO: 1977159 - RNA, 16 nt, Homo sapiens
aaauuuggugcuuaua

SEQ ID NO: 1977160 - RNA, 13 nt, Homo sapiens
gaguggcagccaa

SEQ ID NO: 1977161 - RNA, 15 nt, Homo sapiens
gaauaaccacuuaaa

SEQ ID NO: 1977162 - RNA, 20 nt, Homo sapiens
acuaucgucaggaaaccaaa

SEQ ID NO: 1977163 - RNA, 20 nt, Homo sapiens
uuauuuagaaauagaacuac

SEQ ID NO: 1977164 - RNA, 18 nt, Homo sapiens
uagcuugggacaaaucaa

SEQ ID NO: 1977165 - RNA, 17 nt, Homo sapiens
cacuggcuuuacauggg

SEQ ID NO: 1977166 - RNA, 20 nt, Homo sapiens
gaagaaucuuccuggcacaa

SEQ ID NO: 1977167 - RNA, 20 nt, Homo sapiens
aaaguguuuuucuuuaauca

SEQ ID NO: 1977168 - RNA, 23 nt, Homo sapiens
cuccuuaauuuaauugcuuugaa

SEQ ID NO: 1977169 - RNA, 23 nt, Homo sapiens
acaccacuuuacuuguguuauau

SEQ ID NO: 1977170 - RNA, 17 nt, Homo sapiens
aaguacagguacuuugu

SEQ ID NO: 1977171 - RNA, 20 nt, Homo sapiens
auagcuggggcuucaccagu

SEQ ID NO: 1977172 - RNA, 20 nt, Homo sapiens
ugcggaaaaacaaacaugaa

SEQ ID NO: 1977173 - RNA, 20 nt, Homo sapiens
uagagaaaauggaacauuaa

SEQ ID NO: 1977174 - RNA, 21 nt, Homo sapiens
uuauuaaauguagaaagugau

SEQ ID NO: 1977175 - RNA, 13 nt, Homo sapiens
cauuuucaccucc

SEQ ID NO: 1977176 - RNA, 21 nt, Homo sapiens
ggauguucaacuuaaugaaga

SEQ ID NO: 1977177 - RNA, 15 nt, Homo sapiens
augaaugugccuuga

SEQ ID NO: 1977178 - RNA, 20 nt, Homo sapiens
aauaaauauuuagucugcau

SEQ ID NO: 1977179 - RNA, 21 nt, Homo sapiens
gcuaggaaagggaagccugac

SEQ ID NO: 1977180 - RNA, 12 nt, Homo sapiens
gcugcaaugccc

SEQ ID NO: 1977181 - RNA, 18 nt, Homo sapiens
caacugucuaacuuuaga

SEQ ID NO: 1977182 - RNA, 13 nt, Homo sapiens
guaaaauacuucu

SEQ ID NO: 1977183 - RNA, 13 nt, Homo sapiens
cuggccagcauuu

SEQ ID NO: 1977184 - RNA, 17 nt, Homo sapiens
gcugcauacaguuugca

SEQ ID NO: 1977185 - RNA, 17 nt, Homo sapiens
auccaaaggugcucaga

SEQ ID NO: 1977186 - RNA, 15 nt, Homo sapiens
cagcaacugucuuau

SEQ ID NO: 1977187 - RNA, 18 nt, Homo sapiens
uuuuaaaauaagcauuua

SEQ ID NO: 1977188 - RNA, 11 nt, Homo sapiens
ugcacaacaga

SEQ ID NO: 1977189 - RNA, 22 nt, Homo sapiens
aaugcaccauacucaugcaugc

SEQ ID NO: 1977190 - RNA, 19 nt, Homo sapiens
uuaacaucauugcauaaca

SEQ ID NO: 1977191 - RNA, 21 nt, Homo sapiens
uguucauaauacaaaggugcu

SEQ ID NO: 1977192 - RNA, 21 nt, Homo sapiens
auaaacuaguuuccaguggau

SEQ ID NO: 1977193 - RNA, 21 nt, Homo sapiens
cucucgggagcccuagcccug

SEQ ID NO: 1977194 - RNA, 15 nt, Homo sapiens
aggccagcaccaucu

SEQ ID NO: 1977195 - RNA, 21 nt, Homo sapiens
auguagaauauucagacaaaa

SEQ ID NO: 1977196 - RNA, 16 nt, Homo sapiens
aaugugcuguguaaag

SEQ ID NO: 1977197 - RNA, 19 nt, Homo sapiens
gggauuuagagauacuguu

SEQ ID NO: 1977198 - RNA, 12 nt, Homo sapiens
uuccuucccaaa

SEQ ID NO: 1977199 - RNA, 14 nt, Homo sapiens
caguuuugccugag

SEQ ID NO: 1977200 - RNA, 19 nt, Homo sapiens
agcccgucuccucuucccu

SEQ ID NO: 1977201 - RNA, 16 nt, Homo sapiens
gccagaacacauggcu

SEQ ID NO: 1977202 - RNA, 19 nt, Homo sapiens
augucuuuuauuuacuuuu

SEQ ID NO: 1977203 - RNA, 20 nt, Homo sapiens
aaacagcccccacuccaguc

SEQ ID NO: 1977204 - RNA, 21 nt, Homo sapiens
aacauucugcccucaccucug

SEQ ID NO: 1977205 - RNA, 13 nt, Homo sapiens
cucacccucagga

SEQ ID NO: 1977206 - RNA, 21 nt, Homo sapiens
uccauauugcucucauuucaa

SEQ ID NO: 1977207 - RNA, 13 nt, Homo sapiens
uaucaagcuuuua

SEQ ID NO: 1977208 - RNA, 13 nt, Homo sapiens
uuuuaagcuauca

SEQ ID NO: 1977209 - RNA, 13 nt, Homo sapiens
gauacgacaacuu

SEQ ID NO: 1977210 - RNA, 13 nt, Homo sapiens
gaauaucuguuca

SEQ ID NO: 1977211 - RNA, 14 nt, Homo sapiens
cacauauauacaua

SEQ ID NO: 1977212 - RNA, 14 nt, Homo sapiens
uaagauuacaagau

SEQ ID NO: 1977213 - RNA, 14 nt, Homo sapiens
cgcauguaugcaug

SEQ ID NO: 1977214 - RNA, 20 nt, Homo sapiens
aaucuauugggauuuucuac

SEQ ID NO: 1977215 - RNA, 21 nt, Homo sapiens
aaagaaacuauaaaguuuuau

SEQ ID NO: 1977216 - RNA, 21 nt, Homo sapiens
uuuaaaauuauauagcaaaga

SEQ ID NO: 1977217 - RNA, 18 nt, Homo sapiens
augauguugucacuggug

SEQ ID NO: 1977218 - RNA, 16 nt, Homo sapiens
caauucaauagagaaa

SEQ ID NO: 1977219 - RNA, 18 nt, Homo sapiens
ugguggcaugcaccugca

SEQ ID NO: 1977220 - RNA, 16 nt, Homo sapiens
agucucagagcacaga

SEQ ID NO: 1977221 - RNA, 19 nt, Homo sapiens
ucuuuaacuuaauugcuau

SEQ ID NO: 1977222 - RNA, 19 nt, Homo sapiens
uguugagaugauauuuaac

SEQ ID NO: 1977223 - RNA, 19 nt, Homo sapiens
uccugucccaccaugcagu

SEQ ID NO: 1977224 - RNA, 15 nt, Homo sapiens
uaaaauagcuuugca

SEQ ID NO: 1977225 - RNA, 12 nt, Homo sapiens
uaagucagggaa

SEQ ID NO: 1977226 - RNA, 18 nt, Homo sapiens
uacuucaucauuuugaca

SEQ ID NO: 1977227 - RNA, 15 nt, Homo sapiens
cagagaaaauuguga

SEQ ID NO: 1977228 - RNA, 22 nt, Homo sapiens
ugaaucccaccugccaccagcc

SEQ ID NO: 1977229 - RNA, 19 nt, Homo sapiens
ucugcauugcccagucuuu

SEQ ID NO: 1977230 - RNA, 14 nt, Homo sapiens
auggagcucuaacc

SEQ ID NO: 1977231 - RNA, 13 nt, Homo sapiens
aguggcaguauug

SEQ ID NO: 1977232 - RNA, 17 nt, Homo sapiens
caauaaaaccacuguac

SEQ ID NO: 1977233 - RNA, 23 nt, Homo sapiens
ccauuuucuuauugcgcugcuac

SEQ ID NO: 1977234 - RNA, 17 nt, Homo sapiens
agaccuccccauguaca

SEQ ID NO: 1977235 - RNA, 20 nt, Homo sapiens
caaauugcuacauaguccaa

SEQ ID NO: 1977236 - RNA, 18 nt, Homo sapiens
agccaucucaagcaaguu

SEQ ID NO: 1977237 - RNA, 20 nt, Homo sapiens
aguggcuaccuacauacaau

SEQ ID NO: 1977238 - RNA, 13 nt, Homo sapiens
gaaagcugugaaa

SEQ ID NO: 1977239 - RNA, 20 nt, Homo sapiens
aaugcagcagggaugcccug

SEQ ID NO: 1977240 - RNA, 22 nt, Homo sapiens
aaagcuacugggccuccucuca

SEQ ID NO: 1977241 - RNA, 20 nt, Homo sapiens
accaucuggcagacuuacaa

SEQ ID NO: 1977242 - RNA, 14 nt, Homo sapiens
ccuuuuuccuguga

SEQ ID NO: 1977243 - RNA, 15 nt, Homo sapiens
guuuaugucaucaua

SEQ ID NO: 1977244 - RNA, 19 nt, Homo sapiens
uuucugaacuguuacaacu

SEQ ID NO: 1977245 - RNA, 20 nt, Homo sapiens
ucccacgucuggccaggcac

SEQ ID NO: 1977246 - RNA, 12 nt, Homo sapiens
ccuuaaauuugu

SEQ ID NO: 1977247 - RNA, 12 nt, Homo sapiens
auugaaugcgcu

SEQ ID NO: 1977248 - RNA, 16 nt, Homo sapiens
acaaaccacuguacau

SEQ ID NO: 1977249 - RNA, 15 nt, Homo sapiens
uggugcuaauaugac

SEQ ID NO: 1977250 - RNA, 15 nt, Homo sapiens
aggggaggguguuca

SEQ ID NO: 1977251 - RNA, 14 nt, Homo sapiens
agaagaggaggaag

SEQ ID NO: 1977252 - RNA, 14 nt, Homo sapiens
ugcccacggucuga

SEQ ID NO: 1977253 - RNA, 22 nt, Homo sapiens
agcugcuuucgaauaaagugaa

SEQ ID NO: 1977254 - RNA, 17 nt, Homo sapiens
ugugauguuaacuauua

SEQ ID NO: 1977255 - RNA, 14 nt, Homo sapiens
acguguuccagugu

SEQ ID NO: 1977256 - RNA, 20 nt, Homo sapiens
ggguccaaucuccgguguga

SEQ ID NO: 1977257 - RNA, 13 nt, Homo sapiens
acuacuacucugc

SEQ ID NO: 1977258 - RNA, 22 nt, Homo sapiens
cuuuucugugccagacauugcu

SEQ ID NO: 1977259 - RNA, 12 nt, Homo sapiens
aauuacuuugaa

SEQ ID NO: 1977260 - RNA, 12 nt, Homo sapiens
agaaacuuuauu

SEQ ID NO: 1977261 - RNA, 19 nt, Homo sapiens
ucccggcuuugcagggaga

SEQ ID NO: 1977262 - RNA, 20 nt, Homo sapiens
ccccuggcccagcggccccu

SEQ ID NO: 1977263 - RNA, 20 nt, Homo sapiens
ccuugugaacccugcaauaa

SEQ ID NO: 1977264 - RNA, 22 nt, Homo sapiens
uucaaugcuucuaucagacuca

SEQ ID NO: 1977265 - RNA, 20 nt, Homo sapiens
gaacacguucgacaaaagca

SEQ ID NO: 1977266 - RNA, 15 nt, Homo sapiens
gccuucuuccaggau

SEQ ID NO: 1977267 - RNA, 21 nt, Homo sapiens
cgccuccccaccacugagcca

SEQ ID NO: 1977268 - RNA, 16 nt, Homo sapiens
cucaguuaaacuguga

SEQ ID NO: 1977269 - RNA, 12 nt, Homo sapiens
aauuugaugaaa

SEQ ID NO: 1977270 - RNA, 16 nt, Homo sapiens
gcaccauggcuacuac

SEQ ID NO: 1977271 - RNA, 17 nt, Homo sapiens
aucuaauaaauacuuaa

SEQ ID NO: 1977272 - RNA, 15 nt, Homo sapiens
uugucagcacuguaa

SEQ ID NO: 1977273 - RNA, 21 nt, Homo sapiens
ucucuccuggucgcuuugcca

SEQ ID NO: 1977274 - RNA, 18 nt, Homo sapiens
aauauacauucaaacuua

SEQ ID NO: 1977275 - RNA, 14 nt, Homo sapiens
aauuaucuuggaaa

SEQ ID NO: 1977276 - RNA, 17 nt, Homo sapiens
agaaacguaacugugug

SEQ ID NO: 1977277 - RNA, 23 nt, Homo sapiens
gcccagggaggggggaugcugcu

SEQ ID NO: 1977278 - RNA, 19 nt, Homo sapiens
ccucagggugcacacagga

SEQ ID NO: 1977279 - RNA, 20 nt, Homo sapiens
caaagcuggcaauauuacaa

SEQ ID NO: 1977280 - RNA, 21 nt, Homo sapiens
uuuuuauauuuuauacugcac

SEQ ID NO: 1977281 - RNA, 20 nt, Homo sapiens
cucaaguauaugucauuuac

SEQ ID NO: 1977282 - RNA, 18 nt, Homo sapiens
cuguuuuaucucugugaa

SEQ ID NO: 1977283 - RNA, 17 nt, Homo sapiens
caacagagaugccauga

SEQ ID NO: 1977284 - RNA, 19 nt, Homo sapiens
aacacuuacuaccuggugu

SEQ ID NO: 1977285 - RNA, 23 nt, Homo sapiens
agcugggaccacacagacagggu

SEQ ID NO: 1977286 - RNA, 15 nt, Homo sapiens
cccaggguuuugccc

SEQ ID NO: 1977287 - RNA, 15 nt, Homo sapiens
guaccacuacuuaga

SEQ ID NO: 1977288 - RNA, 16 nt, Homo sapiens
uuuggggccucaagaa

SEQ ID NO: 1977289 - RNA, 13 nt, Homo sapiens
uugcacuguuacu

SEQ ID NO: 1977290 - RNA, 13 nt, Homo sapiens
cacugcacccucc

SEQ ID NO: 1977291 - RNA, 18 nt, Homo sapiens
uauucccaagcccaugag

SEQ ID NO: 1977292 - RNA, 16 nt, Homo sapiens
augaaauguaaauacu

SEQ ID NO: 1977293 - RNA, 19 nt, Homo sapiens
cucaccuguuugaaaccaa

SEQ ID NO: 1977294 - RNA, 18 nt, Homo sapiens
uguauuuaauuuuaacug

SEQ ID NO: 1977295 - RNA, 16 nt, Homo sapiens
ccaguugaucugcucu

SEQ ID NO: 1977296 - RNA, 15 nt, Homo sapiens
cugccagaccugcau

SEQ ID NO: 1977297 - RNA, 22 nt, Homo sapiens
cuagccuggggcuugaauuugc

SEQ ID NO: 1977298 - RNA, 14 nt, Homo sapiens
cacuguccauucca

SEQ ID NO: 1977299 - RNA, 18 nt, Homo sapiens
uucaagauccucuugcca

SEQ ID NO: 1977300 - RNA, 14 nt, Homo sapiens
gacuguuaucagga

SEQ ID NO: 1977301 - RNA, 16 nt, Homo sapiens
ggcagggcaaaugaca

SEQ ID NO: 1977302 - RNA, 12 nt, Homo sapiens
gccuugugucac

SEQ ID NO: 1977303 - RNA, 17 nt, Homo sapiens
cuuuaguagacauuuau

SEQ ID NO: 1977304 - RNA, 15 nt, Homo sapiens
gcaugaugcccuccc

SEQ ID NO: 1977305 - RNA, 17 nt, Homo sapiens
uguauguguguagacaa

SEQ ID NO: 1977306 - RNA, 19 nt, Homo sapiens
cuccugaguagcugggauu

SEQ ID NO: 1977307 - RNA, 15 nt, Homo sapiens
ggacuaacaaagaca

SEQ ID NO: 1977308 - RNA, 17 nt, Homo sapiens
gccaguuguugccaacc

SEQ ID NO: 1977309 - RNA, 19 nt, Homo sapiens
caaggucuacucccuccuc

SEQ ID NO: 1977310 - RNA, 13 nt, Homo sapiens
gaaaagauaacuu

SEQ ID NO: 1977311 - RNA, 11 nt, Homo sapiens
ccauggcuguu

SEQ ID NO: 1977312 - RNA, 18 nt, Homo sapiens
uggauuccucacuuugaa

SEQ ID NO: 1977313 - RNA, 21 nt, Homo sapiens
aacccuuacauuaugcuauga

SEQ ID NO: 1977314 - RNA, 15 nt, Homo sapiens
acuggaugugauuau

SEQ ID NO: 1977315 - RNA, 23 nt, Homo sapiens
auacauaagcggcguaaguuuaa

SEQ ID NO: 1977316 - RNA, 22 nt, Homo sapiens
uaauguuuaaaagcaaaacugc

SEQ ID NO: 1977317 - RNA, 17 nt, Homo sapiens
gcaaaguccguguccua

SEQ ID NO: 1977318 - RNA, 19 nt, Homo sapiens
aggcugagaacacugugaa

SEQ ID NO: 1977319 - RNA, 18 nt, Homo sapiens
ucuucuggugcuacucca

SEQ ID NO: 1977320 - RNA, 18 nt, Homo sapiens
ugaaaaggagagauuaaa

SEQ ID NO: 1977321 - RNA, 18 nt, Homo sapiens
ccuugucccagccaguga

SEQ ID NO: 1977322 - RNA, 16 nt, Homo sapiens
ucugcccugggcucau

SEQ ID NO: 1977323 - RNA, 13 nt, Homo sapiens
ugaugaagcugag

SEQ ID NO: 1977324 - RNA, 18 nt, Homo sapiens
ucaauucccaccuaugag

SEQ ID NO: 1977325 - RNA, 15 nt, Homo sapiens
ugauacaaauuccac

SEQ ID NO: 1977326 - RNA, 15 nt, Homo sapiens
gggucccuuaaagau

SEQ ID NO: 1977327 - RNA, 21 nt, Homo sapiens
agcacagaggacuuauucaac

SEQ ID NO: 1977328 - RNA, 21 nt, Homo sapiens
auccauucagaaagcauuuau

SEQ ID NO: 1977329 - RNA, 20 nt, Homo sapiens
uggaguguuuuuacauugau

SEQ ID NO: 1977330 - RNA, 15 nt, Homo sapiens
auauaauaauuacuu

SEQ ID NO: 1977331 - RNA, 19 nt, Homo sapiens
uuucauccugacucugccc

SEQ ID NO: 1977332 - RNA, 24 nt, Homo sapiens
ccaagugaccgacucauuuacaac

SEQ ID NO: 1977333 - RNA, 14 nt, Homo sapiens
aacacaggaaguca

SEQ ID NO: 1977334 - RNA, 23 nt, Homo sapiens
caaacucaguucaaaccauuuca

SEQ ID NO: 1977335 - RNA, 18 nt, Homo sapiens
cauguucuuaacuuuaaa

SEQ ID NO: 1977336 - RNA, 15 nt, Homo sapiens
ugaacgcacaugaca

SEQ ID NO: 1977337 - RNA, 16 nt, Homo sapiens
ugcuuagcuuguugaa

SEQ ID NO: 1977338 - RNA, 19 nt, Homo sapiens
acaguguugaaaauguuca

SEQ ID NO: 1977339 - RNA, 17 nt, Homo sapiens
acuuggaaaugggagac

SEQ ID NO: 1977340 - RNA, 22 nt, Homo sapiens
uuaauuuuuauaaauaugugaa

SEQ ID NO: 1977341 - RNA, 14 nt, Homo sapiens
acuaugauuauuaa

SEQ ID NO: 1977342 - RNA, 16 nt, Homo sapiens
aagcagaacacacucu

SEQ ID NO: 1977343 - RNA, 23 nt, Homo sapiens
cugugcugugacucgagucacac

SEQ ID NO: 1977344 - RNA, 21 nt, Homo sapiens
aaugacuauuguaaugccaau

SEQ ID NO: 1977345 - RNA, 14 nt, Homo sapiens
cuuucauuaggcaa

SEQ ID NO: 1977346 - RNA, 12 nt, Homo sapiens
uagagggacaaa

SEQ ID NO: 1977347 - RNA, 20 nt, Homo sapiens
uaaaccauaugaacauauau

SEQ ID NO: 1977348 - RNA, 18 nt, Homo sapiens
gauggcaucuagccagag

SEQ ID NO: 1977349 - RNA, 17 nt, Homo sapiens
uugaaucugggacugug

SEQ ID NO: 1977350 - RNA, 11 nt, Homo sapiens
ugccacccaca

SEQ ID NO: 1977351 - RNA, 21 nt, Homo sapiens
ccuccagggcuggacugaggc

SEQ ID NO: 1977352 - RNA, 22 nt, Homo sapiens
uuaaaguuucauuagucauauu

SEQ ID NO: 1977353 - RNA, 22 nt, Homo sapiens
aaagaguccuauuugcacugua

SEQ ID NO: 1977354 - RNA, 21 nt, Homo sapiens
caauaauagacuuauaugcag

SEQ ID NO: 1977355 - RNA, 22 nt, Homo sapiens
uucucaugugcuuuguagcuua

SEQ ID NO: 1977356 - RNA, 12 nt, Homo sapiens
guggugugccau

SEQ ID NO: 1977357 - RNA, 22 nt, Homo sapiens
ugcccacacuugggagcaaaag

SEQ ID NO: 1977358 - RNA, 22 nt, Homo sapiens
acugugaaccaacccccaucuc

SEQ ID NO: 1977359 - RNA, 20 nt, Homo sapiens
cagguagaaaauuauuugua

SEQ ID NO: 1977360 - RNA, 15 nt, Homo sapiens
ccugacaccaccauc

SEQ ID NO: 1977361 - RNA, 20 nt, Homo sapiens
uuagacacguguuguuccac

SEQ ID NO: 1977362 - RNA, 19 nt, Homo sapiens
ccugaguagcugggauuac

SEQ ID NO: 1977363 - RNA, 18 nt, Homo sapiens
uaauguuguuuacaauau

SEQ ID NO: 1977364 - RNA, 12 nt, Homo sapiens
caugucagcaau

SEQ ID NO: 1977365 - RNA, 21 nt, Homo sapiens
cgcagguuaugucagcagcuc

SEQ ID NO: 1977366 - RNA, 11 nt, Homo sapiens
aggagcucucc

SEQ ID NO: 1977367 - RNA, 17 nt, Homo sapiens
gaaaccucuacauauuu

SEQ ID NO: 1977368 - RNA, 19 nt, Homo sapiens
acuuugcuuaagaugcuaa

SEQ ID NO: 1977369 - RNA, 19 nt, Homo sapiens
agaaaacacaacauuuuaa

SEQ ID NO: 1977370 - RNA, 15 nt, Homo sapiens
cauuuggugacugug

SEQ ID NO: 1977371 - RNA, 17 nt, Homo sapiens
aucaugaaaccaaaaag

SEQ ID NO: 1977372 - RNA, 17 nt, Homo sapiens
ucaauuuggcagugaua

SEQ ID NO: 1977373 - RNA, 15 nt, Homo sapiens
gugaugaugaucuca

SEQ ID NO: 1977374 - RNA, 13 nt, Homo sapiens
ccuccauugcaca

SEQ ID NO: 1977375 - RNA, 19 nt, Homo sapiens
augaguauuauaggacuuu

SEQ ID NO: 1977376 - RNA, 21 nt, Homo sapiens
ugccgaaacccuugacuguua

SEQ ID NO: 1977377 - RNA, 21 nt, Homo sapiens
agagacagcuugaucaaaggc

SEQ ID NO: 1977378 - RNA, 20 nt, Homo sapiens
acccagggaggaagacugua

SEQ ID NO: 1977379 - RNA, 16 nt, Homo sapiens
auagugaacacacuga

SEQ ID NO: 1977380 - RNA, 14 nt, Homo sapiens
caguuugugcucua

SEQ ID NO: 1977381 - RNA, 20 nt, Homo sapiens
gugaaugcuuaccugugaga

SEQ ID NO: 1977382 - RNA, 22 nt, Homo sapiens
uuucuugcaagcaacaagcuau

SEQ ID NO: 1977383 - RNA, 20 nt, Homo sapiens
gaauagauggguuauuucaa

SEQ ID NO: 1977384 - RNA, 13 nt, Homo sapiens
agcuaucaccuag

SEQ ID NO: 1977385 - RNA, 16 nt, Homo sapiens
cugaagugaccccagc

SEQ ID NO: 1977386 - RNA, 13 nt, Homo sapiens
uauaguccaacau

SEQ ID NO: 1977387 - RNA, 12 nt, Homo sapiens
aagguuacugau

SEQ ID NO: 1977388 - RNA, 16 nt, Homo sapiens
agggugagggccuucu

SEQ ID NO: 1977389 - RNA, 10 nt, Homo sapiens
uugcaauacc

SEQ ID NO: 1977390 - RNA, 19 nt, Homo sapiens
accuggccuuccugccagg

SEQ ID NO: 1977391 - RNA, 17 nt, Homo sapiens
acuaacagauaagcaag

SEQ ID NO: 1977392 - RNA, 17 nt, Homo sapiens
ugucagcaucagcucag

SEQ ID NO: 1977393 - RNA, 18 nt, Homo sapiens
acucuagagagccuuaac

SEQ ID NO: 1977394 - RNA, 18 nt, Homo sapiens
gauccauccagcuugcca

SEQ ID NO: 1977395 - RNA, 23 nt, Homo sapiens
aucaucaaagcucacaccaaauu

SEQ ID NO: 1977396 - RNA, 15 nt, Homo sapiens
acaggcgugagccac

SEQ ID NO: 1977397 - RNA, 14 nt, Homo sapiens
auguauaucuuugc

SEQ ID NO: 1977398 - RNA, 14 nt, Homo sapiens
ggcuggcaugguga

SEQ ID NO: 1977399 - RNA, 18 nt, Homo sapiens
uuuucacagauuggggua

SEQ ID NO: 1977400 - RNA, 18 nt, Homo sapiens
gcuucagguccaggcugu

SEQ ID NO: 1977401 - RNA, 17 nt, Homo sapiens
cagauuugcuguucacc

SEQ ID NO: 1977402 - RNA, 21 nt, Homo sapiens
aaucaaaucugugcucuuuca

SEQ ID NO: 1977403 - RNA, 23 nt, Homo sapiens
uccccagcugggaagaacaugcu

SEQ ID NO: 1977404 - RNA, 21 nt, Homo sapiens
gaggcuugguuccuucccaau

SEQ ID NO: 1977405 - RNA, 19 nt, Homo sapiens
acaguccauaacuuaccuc

SEQ ID NO: 1977406 - RNA, 12 nt, Homo sapiens
uauaccgagacc

SEQ ID NO: 1977407 - RNA, 16 nt, Homo sapiens
auauaaauacaugcac

SEQ ID NO: 1977408 - RNA, 14 nt, Homo sapiens
auaauugccaaaua

SEQ ID NO: 1977409 - RNA, 16 nt, Homo sapiens
ugaaaaauauugcuaa

SEQ ID NO: 1977410 - RNA, 13 nt, Homo sapiens
cauuuuuugccac

SEQ ID NO: 1977411 - RNA, 14 nt, Homo sapiens
cuucauauaugcuu

SEQ ID NO: 1977412 - RNA, 14 nt, Homo sapiens
gagccuuuguugcu

SEQ ID NO: 1977413 - RNA, 18 nt, Homo sapiens
agauuaccugccacuucc

SEQ ID NO: 1977414 - RNA, 13 nt, Homo sapiens
uaauuauaucuaa

SEQ ID NO: 1977415 - RNA, 12 nt, Homo sapiens
gggaguggcgcg

SEQ ID NO: 1977416 - RNA, 18 nt, Homo sapiens
cagaaaguucaacuucca

SEQ ID NO: 1977417 - RNA, 22 nt, Homo sapiens
aggagagauauuuugauucuca

SEQ ID NO: 1977418 - RNA, 23 nt, Homo sapiens
cugacaguuggagggaaagccag

SEQ ID NO: 1977419 - RNA, 16 nt, Homo sapiens
uuaaauaucuggucuc

SEQ ID NO: 1977420 - RNA, 21 nt, Homo sapiens
cccauuacuuuaauacucacc

SEQ ID NO: 1977421 - RNA, 15 nt, Homo sapiens
ucagaaguacauuaa

SEQ ID NO: 1977422 - RNA, 16 nt, Homo sapiens
agucccugggccuagc

SEQ ID NO: 1977423 - RNA, 13 nt, Homo sapiens
ugccucuacccaa

SEQ ID NO: 1977424 - RNA, 13 nt, Homo sapiens
ugucucuaccuaa

SEQ ID NO: 1977425 - RNA, 20 nt, Homo sapiens
caaauaaucgagacugaaag

SEQ ID NO: 1977426 - RNA, 15 nt, Homo sapiens
ggguuugcucaugua

SEQ ID NO: 1977427 - RNA, 22 nt, Homo sapiens
ucuauguguuucuguaacaaau

SEQ ID NO: 1977428 - RNA, 17 nt, Homo sapiens
augcucuugucccuguc

SEQ ID NO: 1977429 - RNA, 12 nt, Homo sapiens
cuguaagggcag

SEQ ID NO: 1977430 - RNA, 17 nt, Homo sapiens
uguauagacucagugca

SEQ ID NO: 1977431 - RNA, 22 nt, Homo sapiens
ccugcgguggggcugaggggug

SEQ ID NO: 1977432 - RNA, 16 nt, Homo sapiens
acaaaaugcaaacuuu

SEQ ID NO: 1977433 - RNA, 20 nt, Homo sapiens
ccuggggaaagacgccuuca

SEQ ID NO: 1977434 - RNA, 19 nt, Homo sapiens
uuuucuuauuuaacuuaac

SEQ ID NO: 1977435 - RNA, 17 nt, Homo sapiens
ugaggaaagcauguauu

SEQ ID NO: 1977436 - RNA, 23 nt, Homo sapiens
aggcacuacaugaaauaaugcac

SEQ ID NO: 1977437 - RNA, 20 nt, Homo sapiens
ucaugcauuguaaucaucau

SEQ ID NO: 1977438 - RNA, 20 nt, Homo sapiens
gccucauccaaacuguaucu

SEQ ID NO: 1977439 - RNA, 22 nt, Homo sapiens
aguccagccccuccucccucag

SEQ ID NO: 1977440 - RNA, 20 nt, Homo sapiens
uacuugaaaauuaacaugaa

SEQ ID NO: 1977441 - RNA, 18 nt, Homo sapiens
acugaguguuauuugcac

SEQ ID NO: 1977442 - RNA, 13 nt, Homo sapiens
gaauccucuggga

SEQ ID NO: 1977443 - RNA, 20 nt, Homo sapiens
cguaugagauccuuuagucc

SEQ ID NO: 1977444 - RNA, 13 nt, Homo sapiens
gaacccuccagac

SEQ ID NO: 1977445 - RNA, 14 nt, Homo sapiens
ucuacccucuaguu

SEQ ID NO: 1977446 - RNA, 20 nt, Homo sapiens
cuaaaccauucaccaagagc

SEQ ID NO: 1977447 - RNA, 23 nt, Homo sapiens
aggcugagucagccccacuccac

SEQ ID NO: 1977448 - RNA, 20 nt, Homo sapiens
ucagacucuuggcuacagug

SEQ ID NO: 1977449 - RNA, 22 nt, Homo sapiens
aacuauucgaaugaaaagacaa

SEQ ID NO: 1977450 - RNA, 14 nt, Homo sapiens
aucuaucaccauua

SEQ ID NO: 1977451 - RNA, 21 nt, Homo sapiens
agcauccggccaaaugcaaaa

SEQ ID NO: 1977452 - RNA, 14 nt, Homo sapiens
gacguagaaagauc

SEQ ID NO: 1977453 - RNA, 20 nt, Homo sapiens
aacuuugaagcaacugugaa

SEQ ID NO: 1977454 - RNA, 14 nt, Homo sapiens
cuuucucacaugug

SEQ ID NO: 1977455 - RNA, 12 nt, Homo sapiens
uguuuaagacau

SEQ ID NO: 1977456 - RNA, 15 nt, Homo sapiens
cccggccacucccug

SEQ ID NO: 1977457 - RNA, 21 nt, Homo sapiens
auguugucaggucguucuuau

SEQ ID NO: 1977458 - RNA, 19 nt, Homo sapiens
uaauuuuguacauacugua

SEQ ID NO: 1977459 - RNA, 22 nt, Homo sapiens
ggccagggcucuggcagguggc

SEQ ID NO: 1977460 - RNA, 16 nt, Homo sapiens
cuguaccuguuccuua

SEQ ID NO: 1977461 - RNA, 12 nt, Homo sapiens
guuuguguggau

SEQ ID NO: 1977462 - RNA, 18 nt, Homo sapiens
acucaaccucuacagggu

SEQ ID NO: 1977463 - RNA, 13 nt, Homo sapiens
aacagccagugga

SEQ ID NO: 1977464 - RNA, 12 nt, Homo sapiens
ugcaagacagaa

SEQ ID NO: 1977465 - RNA, 18 nt, Homo sapiens
gauaucuuuggauaaugu

SEQ ID NO: 1977466 - RNA, 21 nt, Homo sapiens
uggcucuaggacccccagugc

SEQ ID NO: 1977467 - RNA, 20 nt, Homo sapiens
agugcagcugugaccccggg

SEQ ID NO: 1977468 - RNA, 19 nt, Homo sapiens
uaaugacuuaagcacacuu

SEQ ID NO: 1977469 - RNA, 20 nt, Homo sapiens
acagcucgggcccucuguga

SEQ ID NO: 1977470 - RNA, 14 nt, Homo sapiens
ccggcuggaccugg

SEQ ID NO: 1977471 - RNA, 18 nt, Homo sapiens
cucuucgauguacuuguu

SEQ ID NO: 1977472 - RNA, 21 nt, Homo sapiens
cagugugcuccagauggugcu

SEQ ID NO: 1977473 - RNA, 10 nt, Homo sapiens
aauugcacaa

SEQ ID NO: 1977474 - RNA, 12 nt, Homo sapiens
caaagcacuguu

SEQ ID NO: 1977475 - RNA, 10 nt, Homo sapiens
uauugcacua

SEQ ID NO: 1977476 - RNA, 14 nt, Homo sapiens
cuuuucacaaauaa

SEQ ID NO: 1977477 - RNA, 17 nt, Homo sapiens
gaaauuaugugacauuu

SEQ ID NO: 1977478 - RNA, 21 nt, Homo sapiens
auaaaacugcuagugaguuau

SEQ ID NO: 1977479 - RNA, 22 nt, Homo sapiens
uggaguccccucaccuccucua

SEQ ID NO: 1977480 - RNA, 17 nt, Homo sapiens
ccuccaggcccaucuca

SEQ ID NO: 1977481 - RNA, 17 nt, Homo sapiens
cuggcuaacacggugaa

SEQ ID NO: 1977482 - RNA, 23 nt, Homo sapiens
gaggcacugggaagccuagagaa

SEQ ID NO: 1977483 - RNA, 14 nt, Homo sapiens
auacaaacugugac

SEQ ID NO: 1977484 - RNA, 16 nt, Homo sapiens
guaaaaugaggccgga

SEQ ID NO: 1977485 - RNA, 14 nt, Homo sapiens
ugcucucucugagg

SEQ ID NO: 1977486 - RNA, 18 nt, Homo sapiens
caaauagaauuugagcau

SEQ ID NO: 1977487 - RNA, 19 nt, Homo sapiens
uuguacaaauguaagcaaa

SEQ ID NO: 1977488 - RNA, 22 nt, Homo sapiens
acagagccagcggcuccaacuc

SEQ ID NO: 1977489 - RNA, 21 nt, Homo sapiens
ugucucugguguucucuggcu

SEQ ID NO: 1977490 - RNA, 13 nt, Homo sapiens
caagucagcucuu

SEQ ID NO: 1977491 - RNA, 13 nt, Homo sapiens
aggcuggucucaa

SEQ ID NO: 1977492 - RNA, 17 nt, Homo sapiens
cucuuaccugggaccuc

SEQ ID NO: 1977493 - RNA, 15 nt, Homo sapiens
uuccaguucacauuu

SEQ ID NO: 1977494 - RNA, 13 nt, Homo sapiens
auuuuccucucuc

SEQ ID NO: 1977495 - RNA, 22 nt, Homo sapiens
ggaccucaccugcuggggaccu

SEQ ID NO: 1977496 - RNA, 21 nt, Homo sapiens
ccucucuaagugggcauugcc

SEQ ID NO: 1977497 - RNA, 18 nt, Homo sapiens
aggcacagcaaacugucc

SEQ ID NO: 1977498 - RNA, 23 nt, Homo sapiens
ugucuccuuugaaguagacucau

SEQ ID NO: 1977499 - RNA, 15 nt, Homo sapiens
uguccauuaucugcu

SEQ ID NO: 1977500 - RNA, 19 nt, Homo sapiens
acaccaguugcgaagggaa

SEQ ID NO: 1977501 - RNA, 15 nt, Homo sapiens
gauguuuguuuucaa

SEQ ID NO: 1977502 - RNA, 18 nt, Homo sapiens
gaaccucguugacaugca

SEQ ID NO: 1977503 - RNA, 21 nt, Homo sapiens
aacaucugcaguguucuguga

SEQ ID NO: 1977504 - RNA, 21 nt, Homo sapiens
uguaauaccugauugaucaca

SEQ ID NO: 1977505 - RNA, 16 nt, Homo sapiens
cuccauuucacuugac

SEQ ID NO: 1977506 - RNA, 20 nt, Homo sapiens
aaauaauaaaguaauugaca

SEQ ID NO: 1977507 - RNA, 18 nt, Homo sapiens
ccuccugcuggcucucuc

SEQ ID NO: 1977508 - RNA, 12 nt, Homo sapiens
ccacucagggau

SEQ ID NO: 1977509 - RNA, 17 nt, Homo sapiens
aagggcacucauuugga

SEQ ID NO: 1977510 - RNA, 14 nt, Homo sapiens
uuauacugagcuuu

SEQ ID NO: 1977511 - RNA, 17 nt, Homo sapiens
auggaaaggagaggaaa

SEQ ID NO: 1977512 - RNA, 18 nt, Homo sapiens
acagugaagcagcacugu

SEQ ID NO: 1977513 - RNA, 17 nt, Homo sapiens
aaucuauaacuacauau

SEQ ID NO: 1977514 - RNA, 22 nt, Homo sapiens
aggcagcaggauagagugggac

SEQ ID NO: 1977515 - RNA, 14 nt, Homo sapiens
caaggugaagcaaa

SEQ ID NO: 1977516 - RNA, 22 nt, Homo sapiens
aguucuaggcacuguaguucua

SEQ ID NO: 1977517 - RNA, 19 nt, Homo sapiens
gcagucugggaguggggaa

SEQ ID NO: 1977518 - RNA, 18 nt, Homo sapiens
cgcccucuaucaugguga

SEQ ID NO: 1977519 - RNA, 17 nt, Homo sapiens
cuggagccuccacugcc

SEQ ID NO: 1977520 - RNA, 23 nt, Homo sapiens
aacauuuucuguguguacaugua

SEQ ID NO: 1977521 - RNA, 12 nt, Homo sapiens
agucaugguguu

SEQ ID NO: 1977522 - RNA, 14 nt, Homo sapiens
ccguaucugucaca

SEQ ID NO: 1977523 - RNA, 16 nt, Homo sapiens
aauacaaaaguggcuc

SEQ ID NO: 1977524 - RNA, 14 nt, Homo sapiens
ucagagcugggaaa

SEQ ID NO: 1977525 - RNA, 14 nt, Homo sapiens
cugcugcugcucau

SEQ ID NO: 1977526 - RNA, 16 nt, Homo sapiens
caccaggcacugccug

SEQ ID NO: 1977527 - RNA, 23 nt, Homo sapiens
aggagagaggcucagccacacag

SEQ ID NO: 1977528 - RNA, 14 nt, Homo sapiens
uaucauucagcaac

SEQ ID NO: 1977529 - RNA, 18 nt, Homo sapiens
auagaacucagagccaga

SEQ ID NO: 1977530 - RNA, 17 nt, Homo sapiens
cucagugaggaucuuca

SEQ ID NO: 1977531 - RNA, 17 nt, Homo sapiens
ucucuccuccacucuga

SEQ ID NO: 1977532 - RNA, 20 nt, Homo sapiens
cugaacucuuaggcacauca

SEQ ID NO: 1977533 - RNA, 15 nt, Homo sapiens
uuuaaucugggagca

SEQ ID NO: 1977534 - RNA, 17 nt, Homo sapiens
uuuauuaggauuaccca

SEQ ID NO: 1977535 - RNA, 12 nt, Homo sapiens
ucaaagcacuug

SEQ ID NO: 1977536 - RNA, 22 nt, Homo sapiens
auguuauuuuguguacaaguug

SEQ ID NO: 1977537 - RNA, 18 nt, Homo sapiens
gacacacauucugccuug

SEQ ID NO: 1977538 - RNA, 17 nt, Homo sapiens
uggcuuugugcugcuga

SEQ ID NO: 1977539 - RNA, 11 nt, Homo sapiens
cggcugaccau

SEQ ID NO: 1977540 - RNA, 13 nt, Homo sapiens
auagcuucaggac

SEQ ID NO: 1977541 - RNA, 13 nt, Homo sapiens
auaauuucagggu

SEQ ID NO: 1977542 - RNA, 20 nt, Homo sapiens
ggcagcagaggcuccucuga

SEQ ID NO: 1977543 - RNA, 17 nt, Homo sapiens
auauuaagaaaauauuc

SEQ ID NO: 1977544 - RNA, 13 nt, Homo sapiens
cauguucugugac

SEQ ID NO: 1977545 - RNA, 20 nt, Homo sapiens
ucucuggccuguacccagua

SEQ ID NO: 1977546 - RNA, 15 nt, Homo sapiens
ccagcagcacuggaa

SEQ ID NO: 1977547 - RNA, 18 nt, Homo sapiens
gaaguagaauuuguccaa

SEQ ID NO: 1977548 - RNA, 20 nt, Homo sapiens
gggucucccuauguugccca

SEQ ID NO: 1977549 - RNA, 13 nt, Homo sapiens
guccacaaagcau

SEQ ID NO: 1977550 - RNA, 15 nt, Homo sapiens
aaguguagcacccug

SEQ ID NO: 1977551 - RNA, 22 nt, Homo sapiens
uugacagugccaauaaaugaua

SEQ ID NO: 1977552 - RNA, 22 nt, Homo sapiens
aaauguuuucauuuuacuggua

SEQ ID NO: 1977553 - RNA, 20 nt, Homo sapiens
aauccaguuauuagagaugu

SEQ ID NO: 1977554 - RNA, 16 nt, Homo sapiens
guucuuaaacuuucag

SEQ ID NO: 1977555 - RNA, 17 nt, Homo sapiens
auucaugcaucucaaca

SEQ ID NO: 1977556 - RNA, 17 nt, Homo sapiens
cagaugcugguggagga

SEQ ID NO: 1977557 - RNA, 15 nt, Homo sapiens
ggggcagcuucauga

SEQ ID NO: 1977558 - RNA, 15 nt, Homo sapiens
gagggucuucuuaca

SEQ ID NO: 1977559 - RNA, 14 nt, Homo sapiens
cugugcacuuaccc

SEQ ID NO: 1977560 - RNA, 23 nt, Homo sapiens
agauuuguuuuuaaacuguacag

SEQ ID NO: 1977561 - RNA, 18 nt, Homo sapiens
cccaugccccaacaaacu

SEQ ID NO: 1977562 - RNA, 12 nt, Homo sapiens
aaaugcaaaaua

SEQ ID NO: 1977563 - RNA, 21 nt, Homo sapiens
gucuagacuuucucaguggga

SEQ ID NO: 1977564 - RNA, 23 nt, Homo sapiens
uaaccaaugccuuuuuagaugua

SEQ ID NO: 1977565 - RNA, 21 nt, Homo sapiens
ggacaaauguuguccuguuaa

SEQ ID NO: 1977566 - RNA, 19 nt, Homo sapiens
cagacugcggugaacauuu

SEQ ID NO: 1977567 - RNA, 14 nt, Homo sapiens
aguugcauuuagcu

SEQ ID NO: 1977568 - RNA, 20 nt, Homo sapiens
cugccucagguguccgcuau

SEQ ID NO: 1977569 - RNA, 13 nt, Homo sapiens
aggcuacagggcc

SEQ ID NO: 1977570 - RNA, 22 nt, Homo sapiens
cagaaaccugcagggacuccau

SEQ ID NO: 1977571 - RNA, 21 nt, Homo sapiens
cugugccagacauugcucuca

SEQ ID NO: 1977572 - RNA, 14 nt, Homo sapiens
gcccagagcacuuu

SEQ ID NO: 1977573 - RNA, 21 nt, Homo sapiens
guggaauaugucuucuguaua

SEQ ID NO: 1977574 - RNA, 15 nt, Homo sapiens
gucuagcaugccaac

SEQ ID NO: 1977575 - RNA, 23 nt, Homo sapiens
uucuaguucagagccaagccuua

SEQ ID NO: 1977576 - RNA, 23 nt, Homo sapiens
uguuucuccuuaguuggcuggaa

SEQ ID NO: 1977577 - RNA, 12 nt, Homo sapiens
agaaaguguuca

SEQ ID NO: 1977578 - RNA, 14 nt, Homo sapiens
gcagaaccuggugg

SEQ ID NO: 1977579 - RNA, 13 nt, Homo sapiens
ccaugaagcugga

SEQ ID NO: 1977580 - RNA, 13 nt, Homo sapiens
cuucaaugcugca

SEQ ID NO: 1977581 - RNA, 13 nt, Homo sapiens
cugccaugcuucc

SEQ ID NO: 1977582 - RNA, 14 nt, Homo sapiens
uuuauauauuggaa

SEQ ID NO: 1977583 - RNA, 19 nt, Homo sapiens
ccaaaauaguuaagacaug

SEQ ID NO: 1977584 - RNA, 19 nt, Homo sapiens
agacagaaucucgcucugu

SEQ ID NO: 1977585 - RNA, 14 nt, Homo sapiens
aggauuacaggcau

SEQ ID NO: 1977586 - RNA, 11 nt, Homo sapiens
cuucugagcua

SEQ ID NO: 1977587 - RNA, 15 nt, Homo sapiens
aguucuguucauccu

SEQ ID NO: 1977588 - RNA, 20 nt, Homo sapiens
uuggggguaaaguuugcucu

SEQ ID NO: 1977589 - RNA, 17 nt, Homo sapiens
cuucacaguacccaaac

SEQ ID NO: 1977590 - RNA, 18 nt, Homo sapiens
ucccaaguagcugagauu

SEQ ID NO: 1977591 - RNA, 18 nt, Homo sapiens
uucugguuguuaugugau

SEQ ID NO: 1977592 - RNA, 22 nt, Homo sapiens
auuccacauccccaccuuccaa

SEQ ID NO: 1977593 - RNA, 17 nt, Homo sapiens
aacuaaaugacuuucaa

SEQ ID NO: 1977594 - RNA, 12 nt, Homo sapiens
uagaagugcuaa

SEQ ID NO: 1977595 - RNA, 12 nt, Homo sapiens
aaugcacuguga

SEQ ID NO: 1977596 - RNA, 18 nt, Homo sapiens
cuucaaagcaagcuggua

SEQ ID NO: 1977597 - RNA, 22 nt, Homo sapiens
ugcucuacuuuuuccuuuuacc

SEQ ID NO: 1977598 - RNA, 12 nt, Homo sapiens
acauauuugcau

SEQ ID NO: 1977599 - RNA, 20 nt, Homo sapiens
aggacuuaacggcuccagga

SEQ ID NO: 1977600 - RNA, 20 nt, Homo sapiens
cucgagcacugaagucacca

SEQ ID NO: 1977601 - RNA, 14 nt, Homo sapiens
aucaaaacauauca

SEQ ID NO: 1977602 - RNA, 15 nt, Homo sapiens
aaguuucuuuaccua

SEQ ID NO: 1977603 - RNA, 20 nt, Homo sapiens
uccuguuuuaagcagcucua

SEQ ID NO: 1977604 - RNA, 14 nt, Homo sapiens
uaagcucacacagc

SEQ ID NO: 1977605 - RNA, 23 nt, Homo sapiens
cccauuugugaucagcauuguga

SEQ ID NO: 1977606 - RNA, 20 nt, Homo sapiens
ucccuguucugguauuuccc

SEQ ID NO: 1977607 - RNA, 21 nt, Homo sapiens
ucuguccagccagcuccugca

SEQ ID NO: 1977608 - RNA, 15 nt, Homo sapiens
accacagguucucac

SEQ ID NO: 1977609 - RNA, 15 nt, Homo sapiens
ucaggcccaaagccu

SEQ ID NO: 1977610 - RNA, 15 nt, Homo sapiens
uaccaaaagggccau

SEQ ID NO: 1977611 - RNA, 22 nt, Homo sapiens
ugaggcaaauggcacauggcug

SEQ ID NO: 1977612 - RNA, 19 nt, Homo sapiens
uaguauuuuuauccaugac

SEQ ID NO: 1977613 - RNA, 14 nt, Homo sapiens
uggauggcacaaug

SEQ ID NO: 1977614 - RNA, 14 nt, Homo sapiens
caguucaagcuaua

SEQ ID NO: 1977615 - RNA, 23 nt, Homo sapiens
cugcugagagggcugcugaccau

SEQ ID NO: 1977616 - RNA, 22 nt, Homo sapiens
acagcugacuccaagcugcaug

SEQ ID NO: 1977617 - RNA, 17 nt, Homo sapiens
cacaguaaaaguaaaga

SEQ ID NO: 1977618 - RNA, 16 nt, Homo sapiens
caagaggcccagggag

SEQ ID NO: 1977619 - RNA, 14 nt, Homo sapiens
gugcccccaucacc

SEQ ID NO: 1977620 - RNA, 17 nt, Homo sapiens
ucuguagugcuacaggg

SEQ ID NO: 1977621 - RNA, 20 nt, Homo sapiens
ucacaauuuacgaaaccaaa

SEQ ID NO: 1977622 - RNA, 20 nt, Homo sapiens
cucaaaaaucaucaaagugu

SEQ ID NO: 1977623 - RNA, 22 nt, Homo sapiens
uuggggccauugcuuaccuugg

SEQ ID NO: 1977624 - RNA, 19 nt, Homo sapiens
uuguuucaaccaagucaug

SEQ ID NO: 1977625 - RNA, 22 nt, Homo sapiens
gagauuacaggugugagccacu

SEQ ID NO: 1977626 - RNA, 20 nt, Homo sapiens
cauccagggaacugagcaca

SEQ ID NO: 1977627 - RNA, 14 nt, Homo sapiens
uuauccacaaagua

SEQ ID NO: 1977628 - RNA, 20 nt, Homo sapiens
cacagggcauccaacugaga

SEQ ID NO: 1977629 - RNA, 16 nt, Homo sapiens
auuuaauugcuuugaa

SEQ ID NO: 1977630 - RNA, 23 nt, Homo sapiens
uauuucuucaaauaaaucucucc

SEQ ID NO: 1977631 - RNA, 21 nt, Homo sapiens
uggugagaaaucguugcugca

SEQ ID NO: 1977632 - RNA, 15 nt, Homo sapiens
caacauggcuuucuu

SEQ ID NO: 1977633 - RNA, 16 nt, Homo sapiens
cagaggcaacacugga

SEQ ID NO: 1977634 - RNA, 23 nt, Homo sapiens
agaggcauuuggaacaacaaauc

SEQ ID NO: 1977635 - RNA, 19 nt, Homo sapiens
cagaaaccuaucucaggga

SEQ ID NO: 1977636 - RNA, 15 nt, Homo sapiens
ucccuuccuccauug

SEQ ID NO: 1977637 - RNA, 13 nt, Homo sapiens
uagauucagggga

SEQ ID NO: 1977638 - RNA, 14 nt, Homo sapiens
ucugacaacuguga

SEQ ID NO: 1977639 - RNA, 20 nt, Homo sapiens
agaggaggcaacacugaucc

SEQ ID NO: 1977640 - RNA, 20 nt, Homo sapiens
agcauuuucauucauuuuaa

SEQ ID NO: 1977641 - RNA, 20 nt, Homo sapiens
uuucucaaaagagguuacuu

SEQ ID NO: 1977642 - RNA, 23 nt, Homo sapiens
ggaagagcuggguaccaggccac

SEQ ID NO: 1977643 - RNA, 22 nt, Homo sapiens
caagcaaaguaaugguucucau

SEQ ID NO: 1977644 - RNA, 16 nt, Homo sapiens
ugacuccuccaaggaa

SEQ ID NO: 1977645 - RNA, 16 nt, Homo sapiens
ugcaaaucacucugca

SEQ ID NO: 1977646 - RNA, 23 nt, Homo sapiens
cgcugagcagugaccuuccucac

SEQ ID NO: 1977647 - RNA, 22 nt, Homo sapiens
cgaauauaucaguaauuucaga

SEQ ID NO: 1977648 - RNA, 13 nt, Homo sapiens
gagagacccaagg

SEQ ID NO: 1977649 - RNA, 15 nt, Homo sapiens
guucuaugauuugua

SEQ ID NO: 1977650 - RNA, 15 nt, Homo sapiens
uacucaacauuauua

SEQ ID NO: 1977651 - RNA, 12 nt, Homo sapiens
gaacacacuugg

SEQ ID NO: 1977652 - RNA, 15 nt, Homo sapiens
guucaaaaacaagac

SEQ ID NO: 1977653 - RNA, 17 nt, Homo sapiens
aaaaauaaaccaaagga

SEQ ID NO: 1977654 - RNA, 16 nt, Homo sapiens
ugcaugcacuucuuac

SEQ ID NO: 1977655 - RNA, 18 nt, Homo sapiens
cucuacuguuuaacaaca

SEQ ID NO: 1977656 - RNA, 12 nt, Homo sapiens
gucccuaccugc

SEQ ID NO: 1977657 - RNA, 14 nt, Homo sapiens
gaaaugauaaguga

SEQ ID NO: 1977658 - RNA, 14 nt, Homo sapiens
aagaugaugaauga

SEQ ID NO: 1977659 - RNA, 18 nt, Homo sapiens
ggccgacaucagcccggu

SEQ ID NO: 1977660 - RNA, 22 nt, Homo sapiens
gaccuggagcgccacacacugc

SEQ ID NO: 1977661 - RNA, 14 nt, Homo sapiens
gggcaugcuuuauu

SEQ ID NO: 1977662 - RNA, 21 nt, Homo sapiens
cuaucauuuuuguacaguuug

SEQ ID NO: 1977663 - RNA, 14 nt, Homo sapiens
agaauuuaauguac

SEQ ID NO: 1977664 - RNA, 23 nt, Homo sapiens
ugcaaauuagggcuacauuguaa

SEQ ID NO: 1977665 - RNA, 17 nt, Homo sapiens
acucaagcagugugcug

SEQ ID NO: 1977666 - RNA, 18 nt, Homo sapiens
agccuucugugcugugag

SEQ ID NO: 1977667 - RNA, 14 nt, Homo sapiens
gcguugagccacca

SEQ ID NO: 1977668 - RNA, 22 nt, Homo sapiens
uuuccaguccuuggucaguuug

SEQ ID NO: 1977669 - RNA, 20 nt, Homo sapiens
gccaacuccaugaccaggcc

SEQ ID NO: 1977670 - RNA, 14 nt, Homo sapiens
aggaccagccagac

SEQ ID NO: 1977671 - RNA, 15 nt, Homo sapiens
agaagacaacauuaa

SEQ ID NO: 1977672 - RNA, 18 nt, Homo sapiens
ucugccacaccucuccaa

SEQ ID NO: 1977673 - RNA, 15 nt, Homo sapiens
uccauuuuacuucca

SEQ ID NO: 1977674 - RNA, 21 nt, Homo sapiens
acaucgccaaggacugacuga

SEQ ID NO: 1977675 - RNA, 19 nt, Homo sapiens
cuacagauauuaauguuaa

SEQ ID NO: 1977676 - RNA, 15 nt, Homo sapiens
cccagugcugcugua

SEQ ID NO: 1977677 - RNA, 21 nt, Homo sapiens
uggccacggccacggccacag

SEQ ID NO: 1977678 - RNA, 14 nt, Homo sapiens
ugcuguucagugcc

SEQ ID NO: 1977679 - RNA, 14 nt, Homo sapiens
ggagggucagccag

SEQ ID NO: 1977680 - RNA, 16 nt, Homo sapiens
acaaggaugacaagaa

SEQ ID NO: 1977681 - RNA, 15 nt, Homo sapiens
cugucugugccaugg

SEQ ID NO: 1977682 - RNA, 20 nt, Homo sapiens
ucucuggacuuucuccaaag

SEQ ID NO: 1977683 - RNA, 22 nt, Homo sapiens
gccuuggagaacgagaccugug

SEQ ID NO: 1977684 - RNA, 16 nt, Homo sapiens
caccucugcacaagcu

SEQ ID NO: 1977685 - RNA, 19 nt, Homo sapiens
caagagaccacuuccuuaa

SEQ ID NO: 1977686 - RNA, 21 nt, Homo sapiens
agaugggcaaaagacgggaag

SEQ ID NO: 1977687 - RNA, 14 nt, Homo sapiens
uauuuauuggucag

SEQ ID NO: 1977688 - RNA, 17 nt, Homo sapiens
ugauccuuuuauguuau

SEQ ID NO: 1977689 - RNA, 11 nt, Homo sapiens
gccacugggca

SEQ ID NO: 1977690 - RNA, 14 nt, Homo sapiens
cauguccaagaagc

SEQ ID NO: 1977691 - RNA, 23 nt, Homo sapiens
ggcccuggccuagcauacguaca

SEQ ID NO: 1977692 - RNA, 16 nt, Homo sapiens
auuacguuuacauucu

SEQ ID NO: 1977693 - RNA, 20 nt, Homo sapiens
cuaccuugaaagaagaaaag

SEQ ID NO: 1977694 - RNA, 13 nt, Homo sapiens
ugcuaguauuuga

SEQ ID NO: 1977695 - RNA, 19 nt, Homo sapiens
caggaugaguuacuugaaa

SEQ ID NO: 1977696 - RNA, 13 nt, Homo sapiens
cagggaauuucag

SEQ ID NO: 1977697 - RNA, 16 nt, Homo sapiens
cacucaguuguuccua

SEQ ID NO: 1977698 - RNA, 19 nt, Homo sapiens
ugaauauacagaaguucca

SEQ ID NO: 1977699 - RNA, 18 nt, Homo sapiens
agcuuguuuucuucacag

SEQ ID NO: 1977700 - RNA, 22 nt, Homo sapiens
uuaugauuacuaucauggcaua

SEQ ID NO: 1977701 - RNA, 17 nt, Homo sapiens
aaggcaauuucucugca

SEQ ID NO: 1977702 - RNA, 20 nt, Homo sapiens
uggcugggaguccuuaccuc

SEQ ID NO: 1977703 - RNA, 16 nt, Homo sapiens
ugguucauauaugcaa

SEQ ID NO: 1977704 - RNA, 14 nt, Homo sapiens
cccagggaaggugg

SEQ ID NO: 1977705 - RNA, 16 nt, Homo sapiens
aaaugcaaguguuuga

SEQ ID NO: 1977706 - RNA, 19 nt, Homo sapiens
uacaaaaauagcugggcau

SEQ ID NO: 1977707 - RNA, 16 nt, Homo sapiens
ccagacacauguccaa

SEQ ID NO: 1977708 - RNA, 22 nt, Homo sapiens
ugugcugucuccaugcuggaua

SEQ ID NO: 1977709 - RNA, 17 nt, Homo sapiens
accgaacaugaccaaaa

SEQ ID NO: 1977710 - RNA, 23 nt, Homo sapiens
ucagauuuuuuuuuccuguaaug

SEQ ID NO: 1977711 - RNA, 23 nt, Homo sapiens
uuuguaauaaaaugguacauuuc

SEQ ID NO: 1977712 - RNA, 20 nt, Homo sapiens
caugccugaggucuaccccu

SEQ ID NO: 1977713 - RNA, 20 nt, Homo sapiens
auuucacgggcaacacucac

SEQ ID NO: 1977714 - RNA, 17 nt, Homo sapiens
uugcuugggacauugca

SEQ ID NO: 1977715 - RNA, 21 nt, Homo sapiens
uggcucccucuuggucuuccc

SEQ ID NO: 1977716 - RNA, 14 nt, Homo sapiens
ucauauacaauugu

SEQ ID NO: 1977717 - RNA, 16 nt, Homo sapiens
auguguggauguguaa

SEQ ID NO: 1977718 - RNA, 14 nt, Homo sapiens
acccaaguccaggc

SEQ ID NO: 1977719 - RNA, 18 nt, Homo sapiens
aaaccucaaguaaacucc

SEQ ID NO: 1977720 - RNA, 12 nt, Homo sapiens
uguuacuugcac

SEQ ID NO: 1977721 - RNA, 15 nt, Homo sapiens
agauuuuguuugcau

SEQ ID NO: 1977722 - RNA, 15 nt, Homo sapiens
gagcagucagggugg

SEQ ID NO: 1977723 - RNA, 11 nt, Homo sapiens
gauacgcugga

SEQ ID NO: 1977724 - RNA, 23 nt, Homo sapiens
cuucccaaccuccccugguccug

SEQ ID NO: 1977725 - RNA, 21 nt, Homo sapiens
gcacuccagccugagugacag

SEQ ID NO: 1977726 - RNA, 15 nt, Homo sapiens
aggcucuaauguaca

SEQ ID NO: 1977727 - RNA, 15 nt, Homo sapiens
gucucuggcauuugu

SEQ ID NO: 1977728 - RNA, 19 nt, Homo sapiens
acuuaacaugggcucuuca

SEQ ID NO: 1977729 - RNA, 21 nt, Homo sapiens
ggagacagucaggaagccucc

SEQ ID NO: 1977730 - RNA, 12 nt, Homo sapiens
uucgauggcuca

SEQ ID NO: 1977731 - RNA, 12 nt, Homo sapiens
cuugaugguuua

SEQ ID NO: 1977732 - RNA, 14 nt, Homo sapiens
uucagaaauaugaa

SEQ ID NO: 1977733 - RNA, 14 nt, Homo sapiens
aaggacccugugag

SEQ ID NO: 1977734 - RNA, 23 nt, Homo sapiens
agaggugucacccaaaccggcag

SEQ ID NO: 1977735 - RNA, 19 nt, Homo sapiens
cucagggguuaagagcuca

SEQ ID NO: 1977736 - RNA, 13 nt, Homo sapiens
acucccuuuccaa

SEQ ID NO: 1977737 - RNA, 14 nt, Homo sapiens
acaauuuugucucu

SEQ ID NO: 1977738 - RNA, 22 nt, Homo sapiens
aaugacaaagaguagacauuuc

SEQ ID NO: 1977739 - RNA, 14 nt, Homo sapiens
acuaauugcccaaa

SEQ ID NO: 1977740 - RNA, 18 nt, Homo sapiens
ccaguauaagacuacuga

SEQ ID NO: 1977741 - RNA, 14 nt, Homo sapiens
cagagaaaggauug

SEQ ID NO: 1977742 - RNA, 22 nt, Homo sapiens
ggacaaaaccccccagauauca

SEQ ID NO: 1977743 - RNA, 22 nt, Homo sapiens
ccauggcuccucaccaccgaga

SEQ ID NO: 1977744 - RNA, 14 nt, Homo sapiens
acuuuagcuggaau

SEQ ID NO: 1977745 - RNA, 13 nt, Homo sapiens
uuaguaugcuaug

SEQ ID NO: 1977746 - RNA, 18 nt, Homo sapiens
ugguuuuuguagccuucc

SEQ ID NO: 1977747 - RNA, 16 nt, Homo sapiens
aagaugcccacugagg

SEQ ID NO: 1977748 - RNA, 23 nt, Homo sapiens
ccccaacacuguccuucccugcc

SEQ ID NO: 1977749 - RNA, 15 nt, Homo sapiens
aacagacccagugag

SEQ ID NO: 1977750 - RNA, 15 nt, Homo sapiens
aagcagcuaagcaau

SEQ ID NO: 1977751 - RNA, 20 nt, Homo sapiens
caaacaaaaaacugccuuug

SEQ ID NO: 1977752 - RNA, 19 nt, Homo sapiens
uaaugccauuaucccugaa

SEQ ID NO: 1977753 - RNA, 12 nt, Homo sapiens
agcuuugaaaua

SEQ ID NO: 1977754 - RNA, 17 nt, Homo sapiens
aaaauuugcaacauaua

SEQ ID NO: 1977755 - RNA, 14 nt, Homo sapiens
cuuuacugccugaa

SEQ ID NO: 1977756 - RNA, 21 nt, Homo sapiens
aaccgguggauccucaaacaa

SEQ ID NO: 1977757 - RNA, 17 nt, Homo sapiens
cuaauaaacagacuguu

SEQ ID NO: 1977758 - RNA, 22 nt, Homo sapiens
ucaggauccaagcuaagcacug

SEQ ID NO: 1977759 - RNA, 16 nt, Homo sapiens
cacagccaugcccuug

SEQ ID NO: 1977760 - RNA, 13 nt, Homo sapiens
ucuugugcuggau

SEQ ID NO: 1977761 - RNA, 17 nt, Homo sapiens
uggaagggaccaagcga

SEQ ID NO: 1977762 - RNA, 17 nt, Homo sapiens
uauacaccagcaauuua

SEQ ID NO: 1977763 - RNA, 16 nt, Homo sapiens
cauaugauugugcaca

SEQ ID NO: 1977764 - RNA, 18 nt, Homo sapiens
acucacagagucaaggcc

SEQ ID NO: 1977765 - RNA, 17 nt, Homo sapiens
agccuacauaacacauu

SEQ ID NO: 1977766 - RNA, 20 nt, Homo sapiens
cuugaaugcacuuuugcuca

SEQ ID NO: 1977767 - RNA, 15 nt, Homo sapiens
uagaagccaaguaaa

SEQ ID NO: 1977768 - RNA, 20 nt, Homo sapiens
uccccuggaacugucucuca

SEQ ID NO: 1977769 - RNA, 17 nt, Homo sapiens
cugaauuaugcuuccac

SEQ ID NO: 1977770 - RNA, 17 nt, Homo sapiens
uaaaaaugagugcuuaa

SEQ ID NO: 1977771 - RNA, 18 nt, Homo sapiens
uggaacauauagaaugca

SEQ ID NO: 1977772 - RNA, 17 nt, Homo sapiens
uguauacuccugucacc

SEQ ID NO: 1977773 - RNA, 18 nt, Homo sapiens
aaaucuagaagaugcagu

SEQ ID NO: 1977774 - RNA, 12 nt, Homo sapiens
ccugccaagcca

SEQ ID NO: 1977775 - RNA, 12 nt, Homo sapiens
caugccaagaca

SEQ ID NO: 1977776 - RNA, 13 nt, Homo sapiens
aacucaaugagcu

SEQ ID NO: 1977777 - RNA, 14 nt, Homo sapiens
ccagagaugacuau

SEQ ID NO: 1977778 - RNA, 14 nt, Homo sapiens
guucccaccauucc

SEQ ID NO: 1977779 - RNA, 18 nt, Homo sapiens
uuaugcagugaacuauuu

SEQ ID NO: 1977780 - RNA, 16 nt, Homo sapiens
cugcugccaucuccag

SEQ ID NO: 1977781 - RNA, 16 nt, Homo sapiens
guuuuaagcugcuaag

SEQ ID NO: 1977782 - RNA, 21 nt, Homo sapiens
uuaaauccuguugaaaagcca

SEQ ID NO: 1977783 - RNA, 19 nt, Homo sapiens
ucagaucacugcaaccucu

SEQ ID NO: 1977784 - RNA, 20 nt, Homo sapiens
cuaguaaugucuaaguaaug

SEQ ID NO: 1977785 - RNA, 16 nt, Homo sapiens
ugaagaaaaaauggca

SEQ ID NO: 1977786 - RNA, 14 nt, Homo sapiens
aggggaagugugcu

SEQ ID NO: 1977787 - RNA, 21 nt, Homo sapiens
uagucaucuuaaauuucaaac

SEQ ID NO: 1977788 - RNA, 17 nt, Homo sapiens
ccaguguaugucuugua

SEQ ID NO: 1977789 - RNA, 21 nt, Homo sapiens
agcagacucagcucugacauu

SEQ ID NO: 1977790 - RNA, 23 nt, Homo sapiens
ucccgagcuuagauucuguaugc

SEQ ID NO: 1977791 - RNA, 17 nt, Homo sapiens
auauuauaucacuccca

SEQ ID NO: 1977792 - RNA, 19 nt, Homo sapiens
ucuuuuaaagccagaaguc

SEQ ID NO: 1977793 - RNA, 13 nt, Homo sapiens
gaugccugacaca

SEQ ID NO: 1977794 - RNA, 17 nt, Homo sapiens
cugggcagccuuuccag

SEQ ID NO: 1977795 - RNA, 17 nt, Homo sapiens
ugcucuccuggagcaag

SEQ ID NO: 1977796 - RNA, 22 nt, Homo sapiens
uuagauucucugugucuaagau

SEQ ID NO: 1977797 - RNA, 14 nt, Homo sapiens
cauuugaacauguu

SEQ ID NO: 1977798 - RNA, 20 nt, Homo sapiens
agcugaagcguuacuacagc

SEQ ID NO: 1977799 - RNA, 20 nt, Homo sapiens
aacacaaugccaacagcugg

SEQ ID NO: 1977800 - RNA, 20 nt, Homo sapiens
gcaaguugcucugaccuccu

SEQ ID NO: 1977801 - RNA, 24 nt, Homo sapiens
ucuacaguuaauuaugugcauauu

SEQ ID NO: 1977802 - RNA, 19 nt, Homo sapiens
ccucaacccacaugggguu

SEQ ID NO: 1977803 - RNA, 14 nt, Homo sapiens
gcugcaggaaucaa

SEQ ID NO: 1977804 - RNA, 18 nt, Homo sapiens
ggggucucgcucugucac

SEQ ID NO: 1977805 - RNA, 21 nt, Homo sapiens
aguagauuuuaaaaguuauua

SEQ ID NO: 1977806 - RNA, 17 nt, Homo sapiens
uggaucaggaacccuua

SEQ ID NO: 1977807 - RNA, 14 nt, Homo sapiens
acuccaucucuuaa

SEQ ID NO: 1977808 - RNA, 14 nt, Homo sapiens
uuacauucauaucu

SEQ ID NO: 1977809 - RNA, 15 nt, Homo sapiens
augccaccacccacc

SEQ ID NO: 1977810 - RNA, 17 nt, Homo sapiens
cucagucuccugaguag

SEQ ID NO: 1977811 - RNA, 13 nt, Homo sapiens
gaggaagggccga

SEQ ID NO: 1977812 - RNA, 17 nt, Homo sapiens
aagccuccuauggaaug

SEQ ID NO: 1977813 - RNA, 16 nt, Homo sapiens
uucaugcauuugcacu

SEQ ID NO: 1977814 - RNA, 19 nt, Homo sapiens
cagagcccaaggucaggga

SEQ ID NO: 1977815 - RNA, 22 nt, Homo sapiens
ugcccccagacccaugugauuu

SEQ ID NO: 1977816 - RNA, 22 nt, Homo sapiens
augaccccuccccuaaugccug

SEQ ID NO: 1977817 - RNA, 18 nt, Homo sapiens
aaaacuggcuacugcucu

SEQ ID NO: 1977818 - RNA, 22 nt, Homo sapiens
acaguuguaccacugcuaauaa

SEQ ID NO: 1977819 - RNA, 17 nt, Homo sapiens
uuuuuaauuucccucuu

SEQ ID NO: 1977820 - RNA, 19 nt, Homo sapiens
acugcuaugccauuucuuc

SEQ ID NO: 1977821 - RNA, 20 nt, Homo sapiens
aucuuuuccagaguaugcaa

SEQ ID NO: 1977822 - RNA, 14 nt, Homo sapiens
cucaccaagcucaa

SEQ ID NO: 1977823 - RNA, 16 nt, Homo sapiens
cccaaauucaaagaaa

SEQ ID NO: 1977824 - RNA, 20 nt, Homo sapiens
cguccaccccccacacacac

SEQ ID NO: 1977825 - RNA, 14 nt, Homo sapiens
acaguaaaaauccu

SEQ ID NO: 1977826 - RNA, 13 nt, Homo sapiens
uauauacaaagaa

SEQ ID NO: 1977827 - RNA, 13 nt, Homo sapiens
aauuuaucaccua

SEQ ID NO: 1977828 - RNA, 17 nt, Homo sapiens
gaauuaaaucacggaug

SEQ ID NO: 1977829 - RNA, 17 nt, Homo sapiens
gcccuacuccacugccc

SEQ ID NO: 1977830 - RNA, 17 nt, Homo sapiens
gaaagacuuacaggccu

SEQ ID NO: 1977831 - RNA, 13 nt, Homo sapiens
uguuuuacuaucu

SEQ ID NO: 1977832 - RNA, 19 nt, Homo sapiens
aaaaccauguaauggauuu

SEQ ID NO: 1977833 - RNA, 18 nt, Homo sapiens
ucaagcuucacauuugcg

SEQ ID NO: 1977834 - RNA, 17 nt, Homo sapiens
ucacaugaccugaucac

SEQ ID NO: 1977835 - RNA, 19 nt, Homo sapiens
cacacccgcuccaccugca

SEQ ID NO: 1977836 - RNA, 12 nt, Homo sapiens
cagccagugacc

SEQ ID NO: 1977837 - RNA, 19 nt, Homo sapiens
uaauugugugucacaagaa

SEQ ID NO: 1977838 - RNA, 19 nt, Homo sapiens
agugagcccagauugugcc

SEQ ID NO: 1977839 - RNA, 19 nt, Homo sapiens
acuuccuuggaaacagagc

SEQ ID NO: 1977840 - RNA, 22 nt, Homo sapiens
auucauaguggauuaaugcauu

SEQ ID NO: 1977841 - RNA, 15 nt, Homo sapiens
ugucuggcuuuuugc

SEQ ID NO: 1977842 - RNA, 23 nt, Homo sapiens
ccugcauggcugagcugcccaca

SEQ ID NO: 1977843 - RNA, 23 nt, Homo sapiens
ucagcucaauuguuaaugugaug

SEQ ID NO: 1977844 - RNA, 19 nt, Homo sapiens
ugacaacaucccacagugg

SEQ ID NO: 1977845 - RNA, 23 nt, Homo sapiens
acccaguuugauaccugcacugu

SEQ ID NO: 1977846 - RNA, 13 nt, Homo sapiens
uagggacuggagg

SEQ ID NO: 1977847 - RNA, 17 nt, Homo sapiens
auguauuugucaaugca

SEQ ID NO: 1977848 - RNA, 17 nt, Homo sapiens
ugccuuuuccuauguaa

SEQ ID NO: 1977849 - RNA, 13 nt, Homo sapiens
ucaggaacagucu

SEQ ID NO: 1977850 - RNA, 23 nt, Homo sapiens
ucaauuuaaacccauuuuaguca

SEQ ID NO: 1977851 - RNA, 13 nt, Homo sapiens
guucaccagguca

SEQ ID NO: 1977852 - RNA, 16 nt, Homo sapiens
ucacaucugcaucuua

SEQ ID NO: 1977853 - RNA, 18 nt, Homo sapiens
caugauuaacaaagcaac

SEQ ID NO: 1977854 - RNA, 16 nt, Homo sapiens
accugcucacagggau

SEQ ID NO: 1977855 - RNA, 19 nt, Homo sapiens
gacauuagagaaaaccuua

SEQ ID NO: 1977856 - RNA, 20 nt, Homo sapiens
uucugagcauaaugcuccca

SEQ ID NO: 1977857 - RNA, 14 nt, Homo sapiens
uaacucauggguac

SEQ ID NO: 1977858 - RNA, 18 nt, Homo sapiens
ucucagaagccuagggga

SEQ ID NO: 1977859 - RNA, 22 nt, Homo sapiens
cugcccacgcuaguuccaucca

SEQ ID NO: 1977860 - RNA, 22 nt, Homo sapiens
agcuacuuugugagccaaagcu

SEQ ID NO: 1977861 - RNA, 17 nt, Homo sapiens
auccauuuuacacagca

SEQ ID NO: 1977862 - RNA, 18 nt, Homo sapiens
aaugggagccuuuccaau

SEQ ID NO: 1977863 - RNA, 14 nt, Homo sapiens
gucuaaaauuacau

SEQ ID NO: 1977864 - RNA, 19 nt, Homo sapiens
uucugaguagagcuuguaa

SEQ ID NO: 1977865 - RNA, 12 nt, Homo sapiens
uugaacauggaa

SEQ ID NO: 1977866 - RNA, 19 nt, Homo sapiens
gcggagggcagucugcuca

SEQ ID NO: 1977867 - RNA, 14 nt, Homo sapiens
aguaagacuugauu

SEQ ID NO: 1977868 - RNA, 16 nt, Homo sapiens
cauguaauaagcacuu

SEQ ID NO: 1977869 - RNA, 16 nt, Homo sapiens
ugugccccaccacguc

SEQ ID NO: 1977870 - RNA, 20 nt, Homo sapiens
ccaucaaagaaccuugaaga

SEQ ID NO: 1977871 - RNA, 18 nt, Homo sapiens
uuaaaggcaucuacacaa

SEQ ID NO: 1977872 - RNA, 14 nt, Homo sapiens
cagcaaaaacagcu

SEQ ID NO: 1977873 - RNA, 21 nt, Homo sapiens
cuuuugauccugggggaccaa

SEQ ID NO: 1977874 - RNA, 16 nt, Homo sapiens
uccucuuuugugagaa

SEQ ID NO: 1977875 - RNA, 23 nt, Homo sapiens
cuucuugcuuguaaaaauaugua

SEQ ID NO: 1977876 - RNA, 14 nt, Homo sapiens
aauaaagccacuuu

SEQ ID NO: 1977877 - RNA, 17 nt, Homo sapiens
auuucaccagucacugc

SEQ ID NO: 1977878 - RNA, 19 nt, Homo sapiens
aaaaauuauaguagcuuau

SEQ ID NO: 1977879 - RNA, 23 nt, Homo sapiens
aucuucuucagauucagcauuug

SEQ ID NO: 1977880 - RNA, 15 nt, Homo sapiens
guggcuuugcauuuc

SEQ ID NO: 1977881 - RNA, 15 nt, Homo sapiens
guauacuucaaguaa

SEQ ID NO: 1977882 - RNA, 15 nt, Homo sapiens
gucuuuuuccaaaaa

SEQ ID NO: 1977883 - RNA, 14 nt, Homo sapiens
ugcggcaucuccau

SEQ ID NO: 1977884 - RNA, 14 nt, Homo sapiens
caaucaacaucucu

SEQ ID NO: 1977885 - RNA, 21 nt, Homo sapiens
cucccaaaaaacuacuucuuu

SEQ ID NO: 1977886 - RNA, 17 nt, Homo sapiens
uuaaaaagucuucacuc

SEQ ID NO: 1977887 - RNA, 23 nt, Homo sapiens
auucugcuugguuccacaaucau

SEQ ID NO: 1977888 - RNA, 17 nt, Homo sapiens
gcccccaaauccuugag

SEQ ID NO: 1977889 - RNA, 18 nt, Homo sapiens
cuuucaggaauugcccau

SEQ ID NO: 1977890 - RNA, 15 nt, Homo sapiens
guuauuuguccucau

SEQ ID NO: 1977891 - RNA, 18 nt, Homo sapiens
aauuacucaaccaaucca

SEQ ID NO: 1977892 - RNA, 22 nt, Homo sapiens
uuguaguauuuugggagcaaaa

SEQ ID NO: 1977893 - RNA, 21 nt, Homo sapiens
uugaucuggaacccagacuca

SEQ ID NO: 1977894 - RNA, 23 nt, Homo sapiens
auauucaggaaauguucacugaa

SEQ ID NO: 1977895 - RNA, 18 nt, Homo sapiens
uucuuccccgaaucacac

SEQ ID NO: 1977896 - RNA, 20 nt, Homo sapiens
auuccuguaaaugugacaaa

SEQ ID NO: 1977897 - RNA, 18 nt, Homo sapiens
cgagugaggccauagcaa

SEQ ID NO: 1977898 - RNA, 15 nt, Homo sapiens
aacaagaaugcauug

SEQ ID NO: 1977899 - RNA, 13 nt, Homo sapiens
cagcacuuuggac

SEQ ID NO: 1977900 - RNA, 22 nt, Homo sapiens
aaagagaugucaaaaugugauu

SEQ ID NO: 1977901 - RNA, 14 nt, Homo sapiens
gcuaugagcuuuua

SEQ ID NO: 1977902 - RNA, 23 nt, Homo sapiens
aaaguucccuacuuccugugacu

SEQ ID NO: 1977903 - RNA, 19 nt, Homo sapiens
uucuccuuuugaccaaaua

SEQ ID NO: 1977904 - RNA, 15 nt, Homo sapiens
ugacaaaccauuucc

SEQ ID NO: 1977905 - RNA, 17 nt, Homo sapiens
cucccccagcccuguca

SEQ ID NO: 1977906 - RNA, 17 nt, Homo sapiens
ccacaucuugcucugcu

SEQ ID NO: 1977907 - RNA, 19 nt, Homo sapiens
gaacuucugacuacuuguu

SEQ ID NO: 1977908 - RNA, 15 nt, Homo sapiens
ugucuuggagugcau

SEQ ID NO: 1977909 - RNA, 14 nt, Homo sapiens
ccagaaugacccca

SEQ ID NO: 1977910 - RNA, 19 nt, Homo sapiens
gccacagggacuugccuca

SEQ ID NO: 1977911 - RNA, 16 nt, Homo sapiens
cugaacaaacuaaagg

SEQ ID NO: 1977912 - RNA, 13 nt, Homo sapiens
ccgcaagggguga

SEQ ID NO: 1977913 - RNA, 17 nt, Homo sapiens
uuuccccauucagugac

SEQ ID NO: 1977914 - RNA, 15 nt, Homo sapiens
ucagagcuacuuggg

SEQ ID NO: 1977915 - RNA, 15 nt, Homo sapiens
aacgcaagaggcauc

SEQ ID NO: 1977916 - RNA, 23 nt, Homo sapiens
cccuaucauuauuucaccaagcc

SEQ ID NO: 1977917 - RNA, 16 nt, Homo sapiens
ugguuaaguaauugca

SEQ ID NO: 1977918 - RNA, 16 nt, Homo sapiens
ccaaaaaccccagugu

SEQ ID NO: 1977919 - RNA, 21 nt, Homo sapiens
auaaucacucauucuaugaac

SEQ ID NO: 1977920 - RNA, 19 nt, Homo sapiens
guuagcauauggugcuuaa

SEQ ID NO: 1977921 - RNA, 17 nt, Homo sapiens
gaggugaaauucaguua

SEQ ID NO: 1977922 - RNA, 14 nt, Homo sapiens
cuugucaccuuuca

SEQ ID NO: 1977923 - RNA, 12 nt, Homo sapiens
ucuacaaaagaa

SEQ ID NO: 1977924 - RNA, 17 nt, Homo sapiens
aauuagcccaacuagaa

SEQ ID NO: 1977925 - RNA, 18 nt, Homo sapiens
cauuccucaugaauguaa

SEQ ID NO: 1977926 - RNA, 12 nt, Homo sapiens
guagaugugcug

SEQ ID NO: 1977927 - RNA, 19 nt, Homo sapiens
agauaggauauacuguaug

SEQ ID NO: 1977928 - RNA, 20 nt, Homo sapiens
gggagauuggcuuugccuuu

SEQ ID NO: 1977929 - RNA, 14 nt, Homo sapiens
uugcuguuuacucc

SEQ ID NO: 1977930 - RNA, 21 nt, Homo sapiens
cucacagccguccaacuuaaa

SEQ ID NO: 1977931 - RNA, 17 nt, Homo sapiens
guuuaaaaaucugccac

SEQ ID NO: 1977932 - RNA, 12 nt, Homo sapiens
agagacagauac

SEQ ID NO: 1977933 - RNA, 23 nt, Homo sapiens
ucagcugucaccugcucacaggg

SEQ ID NO: 1977934 - RNA, 12 nt, Homo sapiens
auauaccaagcu

SEQ ID NO: 1977935 - RNA, 14 nt, Homo sapiens
guuguccugcccug

SEQ ID NO: 1977936 - RNA, 15 nt, Homo sapiens
gagagcggcuucccc

SEQ ID NO: 1977937 - RNA, 13 nt, Homo sapiens
guuaacaucugaa

SEQ ID NO: 1977938 - RNA, 15 nt, Homo sapiens
ugugucacaaagaau

SEQ ID NO: 1977939 - RNA, 22 nt, Homo sapiens
guuucaacaaauuucauugcac

SEQ ID NO: 1977940 - RNA, 17 nt, Homo sapiens
cccucugcugcuuucca

SEQ ID NO: 1977941 - RNA, 16 nt, Homo sapiens
aauauuuccauauucu

SEQ ID NO: 1977942 - RNA, 20 nt, Homo sapiens
acccucucaggcugucccaa

SEQ ID NO: 1977943 - RNA, 15 nt, Homo sapiens
caaaacaagugcaag

SEQ ID NO: 1977944 - RNA, 16 nt, Homo sapiens
aagguuuaaagcuuau

SEQ ID NO: 1977945 - RNA, 15 nt, Homo sapiens
cccuuguugcacugc

SEQ ID NO: 1977946 - RNA, 16 nt, Homo sapiens
cgugugucuguguuga

SEQ ID NO: 1977947 - RNA, 19 nt, Homo sapiens
ucucaguguuaauacugag

SEQ ID NO: 1977948 - RNA, 11 nt, Homo sapiens
caaaaugcaga

SEQ ID NO: 1977949 - RNA, 16 nt, Homo sapiens
ugguaaauacugugaa

SEQ ID NO: 1977950 - RNA, 23 nt, Homo sapiens
cugaaauuuaucuuuucuucuau

SEQ ID NO: 1977951 - RNA, 23 nt, Homo sapiens
aaccgcuacaagagggcaaagcu

SEQ ID NO: 1977952 - RNA, 19 nt, Homo sapiens
aagaaguuuuguucugucc

SEQ ID NO: 1977953 - RNA, 22 nt, Homo sapiens
cauuuacuuagcagaaccacau

SEQ ID NO: 1977954 - RNA, 16 nt, Homo sapiens
uuccaaaaugccaaau

SEQ ID NO: 1977955 - RNA, 21 nt, Homo sapiens
uaucuauggcacccaugcacc

SEQ ID NO: 1977956 - RNA, 20 nt, Homo sapiens
ucaguguuuuuucacuuuag

SEQ ID NO: 1977957 - RNA, 16 nt, Homo sapiens
cuccccaaggcugcaa

SEQ ID NO: 1977958 - RNA, 15 nt, Homo sapiens
gcugcagucaucuac

SEQ ID NO: 1977959 - RNA, 16 nt, Homo sapiens
gugauauagugcuguu

SEQ ID NO: 1977960 - RNA, 21 nt, Homo sapiens
gugccucugcaaacuaaggag

SEQ ID NO: 1977961 - RNA, 15 nt, Homo sapiens
ccuuucacucugcau

SEQ ID NO: 1977962 - RNA, 18 nt, Homo sapiens
ggcuuaauugacugaaau

SEQ ID NO: 1977963 - RNA, 13 nt, Homo sapiens
caugucaccuuag

SEQ ID NO: 1977964 - RNA, 20 nt, Homo sapiens
guugccacaguagaacuguc

SEQ ID NO: 1977965 - RNA, 16 nt, Homo sapiens
gccuuaauguauuuga

SEQ ID NO: 1977966 - RNA, 14 nt, Homo sapiens
ucccauuggcaaaa

SEQ ID NO: 1977967 - RNA, 22 nt, Homo sapiens
ugacuguugcuguaaaagugaa

SEQ ID NO: 1977968 - RNA, 16 nt, Homo sapiens
ucaccaggucagggag

SEQ ID NO: 1977969 - RNA, 23 nt, Homo sapiens
ccuaauaaguccacaucuucuca

SEQ ID NO: 1977970 - RNA, 19 nt, Homo sapiens
gauaccauggcacugacaa

SEQ ID NO: 1977971 - RNA, 12 nt, Homo sapiens
ccaggguuguua

SEQ ID NO: 1977972 - RNA, 13 nt, Homo sapiens
auuuugcaaaaau

SEQ ID NO: 1977973 - RNA, 12 nt, Homo sapiens
aaauagauguaa

SEQ ID NO: 1977974 - RNA, 19 nt, Homo sapiens
cucaucuguuauccugcua

SEQ ID NO: 1977975 - RNA, 23 nt, Homo sapiens
auccuugucaaaaugagauucca

SEQ ID NO: 1977976 - RNA, 19 nt, Homo sapiens
gaacauucagauuuaccau

SEQ ID NO: 1977977 - RNA, 16 nt, Homo sapiens
cugaggcuuccagaga

SEQ ID NO: 1977978 - RNA, 16 nt, Homo sapiens
uuguacaagauuguca

SEQ ID NO: 1977979 - RNA, 15 nt, Homo sapiens
cacuuuaaaccuguu

SEQ ID NO: 1977980 - RNA, 19 nt, Homo sapiens
aagacagagauaccauuca

SEQ ID NO: 1977981 - RNA, 21 nt, Homo sapiens
guaccccagcucugcuugccg

SEQ ID NO: 1977982 - RNA, 16 nt, Homo sapiens
gauccuuccaccucag

SEQ ID NO: 1977983 - RNA, 14 nt, Homo sapiens
ugcagcucaucacc

SEQ ID NO: 1977984 - RNA, 16 nt, Homo sapiens
ucugggauguauucaa

SEQ ID NO: 1977985 - RNA, 19 nt, Homo sapiens
ucaaaugucagcagcuuua

SEQ ID NO: 1977986 - RNA, 23 nt, Homo sapiens
ucaagaacgagaagcagcauuug

SEQ ID NO: 1977987 - RNA, 23 nt, Homo sapiens
aaagaagagaugagaaaugauga

SEQ ID NO: 1977988 - RNA, 22 nt, Homo sapiens
acagccaccuggagaacuucau

SEQ ID NO: 1977989 - RNA, 15 nt, Homo sapiens
agucuguagcuugag

SEQ ID NO: 1977990 - RNA, 16 nt, Homo sapiens
cgcugacuucauggaa

SEQ ID NO: 1977991 - RNA, 17 nt, Homo sapiens
cuauauucucaguguag

SEQ ID NO: 1977992 - RNA, 21 nt, Homo sapiens
aaugaauuuuguaugcugaau

SEQ ID NO: 1977993 - RNA, 21 nt, Homo sapiens
caaaugaggggagaaugcuaa

SEQ ID NO: 1977994 - RNA, 15 nt, Homo sapiens
gauccagcucaaggg

SEQ ID NO: 1977995 - RNA, 16 nt, Homo sapiens
cuuuccuucaaagagg

SEQ ID NO: 1977996 - RNA, 17 nt, Homo sapiens
uaugcaaaccaggauuu

SEQ ID NO: 1977997 - RNA, 18 nt, Homo sapiens
uguucagaauggauuuau

SEQ ID NO: 1977998 - RNA, 19 nt, Homo sapiens
cacagcgaagacugcuaaa

SEQ ID NO: 1977999 - RNA, 14 nt, Homo sapiens
ggcagaaccugaaa

SEQ ID NO: 1978000 - RNA, 18 nt, Homo sapiens
aagaauucaaaccugacc

SEQ ID NO: 1978001 - RNA, 17 nt, Homo sapiens
uguguauuucucuguga

SEQ ID NO: 1978002 - RNA, 15 nt, Homo sapiens
ucuaugaacuugucu

SEQ ID NO: 1978003 - RNA, 14 nt, Homo sapiens
uaaacacccaugaa

SEQ ID NO: 1978004 - RNA, 20 nt, Homo sapiens
uuagaaaaagaacaugcagu

SEQ ID NO: 1978005 - RNA, 16 nt, Homo sapiens
ccagagcccagcucuu

SEQ ID NO: 1978006 - RNA, 19 nt, Homo sapiens
gaucagaauuuuaccaaaa

SEQ ID NO: 1978007 - RNA, 11 nt, Homo sapiens
ccuugcucugc

SEQ ID NO: 1978008 - RNA, 22 nt, Homo sapiens
aucaucccuuucucccagugaa

SEQ ID NO: 1978009 - RNA, 17 nt, Homo sapiens
gauugaaggauugugaa

SEQ ID NO: 1978010 - RNA, 12 nt, Homo sapiens
cugacaaccuca

SEQ ID NO: 1978011 - RNA, 15 nt, Homo sapiens
ugagguugugcugcc

SEQ ID NO: 1978012 - RNA, 15 nt, Homo sapiens
uugaacuucaccugc

SEQ ID NO: 1978013 - RNA, 16 nt, Homo sapiens
gacauuacuuguuuua

SEQ ID NO: 1978014 - RNA, 23 nt, Homo sapiens
gcucuuugaacuccgcugccuuc

SEQ ID NO: 1978015 - RNA, 16 nt, Homo sapiens
auagacagaaugauuu

SEQ ID NO: 1978016 - RNA, 16 nt, Homo sapiens
gaaaacugguuaauau

SEQ ID NO: 1978017 - RNA, 23 nt, Homo sapiens
guuggccuuggaauauggccaag

SEQ ID NO: 1978018 - RNA, 17 nt, Homo sapiens
cuacagagggauuuauu

SEQ ID NO: 1978019 - RNA, 15 nt, Homo sapiens
gagcuagcaaauaca

SEQ ID NO: 1978020 - RNA, 16 nt, Homo sapiens
aguaacuguaugaagu

SEQ ID NO: 1978021 - RNA, 15 nt, Homo sapiens
uaaaauaagucugau

SEQ ID NO: 1978022 - RNA, 11 nt, Homo sapiens
cacaccuguaa

SEQ ID NO: 1978023 - RNA, 23 nt, Homo sapiens
gugcaauuucuucuguagcuauu

SEQ ID NO: 1978024 - RNA, 24 nt, Homo sapiens
aacaaugaaguguuuuacaaugau

SEQ ID NO: 1978025 - RNA, 22 nt, Homo sapiens
guaauaggugucauggauagau

SEQ ID NO: 1978026 - RNA, 19 nt, Homo sapiens
ucauuguuuggaccugcau

SEQ ID NO: 1978027 - RNA, 17 nt, Homo sapiens
auaguguaagaacugua

SEQ ID NO: 1978028 - RNA, 12 nt, Homo sapiens
cuuccuaccucu

SEQ ID NO: 1978029 - RNA, 22 nt, Homo sapiens
aagaugguauauuugguacugu

SEQ ID NO: 1978030 - RNA, 12 nt, Homo sapiens
aaacacuguaau

SEQ ID NO: 1978031 - RNA, 14 nt, Homo sapiens
ugccuccagcacuc

SEQ ID NO: 1978032 - RNA, 14 nt, Homo sapiens
gcaucacaugcuca

SEQ ID NO: 1978033 - RNA, 22 nt, Homo sapiens
agaaaguugauauucaaccuca

SEQ ID NO: 1978034 - RNA, 22 nt, Homo sapiens
uauucuuguuuuacauuuggau

SEQ ID NO: 1978035 - RNA, 18 nt, Homo sapiens
agagacaggacuagcugg

SEQ ID NO: 1978036 - RNA, 20 nt, Homo sapiens
cagacuacacaggaugaggu

SEQ ID NO: 1978037 - RNA, 18 nt, Homo sapiens
aacgagccuccucagggg

SEQ ID NO: 1978038 - RNA, 23 nt, Homo sapiens
cuggacaaaggaguaguagcuga

SEQ ID NO: 1978039 - RNA, 21 nt, Homo sapiens
cauccaaggagaaacagagac

SEQ ID NO: 1978040 - RNA, 17 nt, Homo sapiens
uucccaacucacugugc

SEQ ID NO: 1978041 - RNA, 18 nt, Homo sapiens
cugagacccacaggucua

SEQ ID NO: 1978042 - RNA, 13 nt, Homo sapiens
ccacacugggacu

SEQ ID NO: 1978043 - RNA, 15 nt, Homo sapiens
gcugggcucgccaca

SEQ ID NO: 1978044 - RNA, 18 nt, Homo sapiens
agaggaagacuccugaaa

SEQ ID NO: 1978045 - RNA, 17 nt, Homo sapiens
acacacaaauauugcuu

SEQ ID NO: 1978046 - RNA, 22 nt, Homo sapiens
ggcucagcaugcagaagugcau

SEQ ID NO: 1978047 - RNA, 14 nt, Homo sapiens
acuuacagugccaa

SEQ ID NO: 1978048 - RNA, 15 nt, Homo sapiens
gauacaaacauguuc

SEQ ID NO: 1978049 - RNA, 19 nt, Homo sapiens
caccucugguccacacuag

SEQ ID NO: 1978050 - RNA, 21 nt, Homo sapiens
caguuuuggagaaaaauuaca

SEQ ID NO: 1978051 - RNA, 18 nt, Homo sapiens
cuauuuccucugugcaaa

SEQ ID NO: 1978052 - RNA, 16 nt, Homo sapiens
ucccacagugcuggga

SEQ ID NO: 1978053 - RNA, 17 nt, Homo sapiens
aagcgaauguguacaaa

SEQ ID NO: 1978054 - RNA, 14 nt, Homo sapiens
ccucaaucuauucu

SEQ ID NO: 1978055 - RNA, 18 nt, Homo sapiens
guguccccgaugcugacc

SEQ ID NO: 1978056 - RNA, 19 nt, Homo sapiens
aaugauguugucacuggug

SEQ ID NO: 1978057 - RNA, 21 nt, Homo sapiens
gcgagaaggaguguaugagug

SEQ ID NO: 1978058 - RNA, 18 nt, Homo sapiens
aguuguucuagcagugaa

SEQ ID NO: 1978059 - RNA, 14 nt, Homo sapiens
cacguuaguaauac

SEQ ID NO: 1978060 - RNA, 14 nt, Homo sapiens
agcuuggagugcca

SEQ ID NO: 1978061 - RNA, 17 nt, Homo sapiens
aaaucccugucuugcuu

SEQ ID NO: 1978062 - RNA, 17 nt, Homo sapiens
caggagcaguuugccac

SEQ ID NO: 1978063 - RNA, 17 nt, Homo sapiens
gcuuggaagccagguac

SEQ ID NO: 1978064 - RNA, 11 nt, Homo sapiens
gcucaaaggga

SEQ ID NO: 1978065 - RNA, 18 nt, Homo sapiens
agaaauaaaaauaccucu

SEQ ID NO: 1978066 - RNA, 17 nt, Homo sapiens
guuauaguaacucccau

SEQ ID NO: 1978067 - RNA, 16 nt, Homo sapiens
gccucucugcacacua

SEQ ID NO: 1978068 - RNA, 23 nt, Homo sapiens
ugcaaaauauuugacuauucugu

SEQ ID NO: 1978069 - RNA, 21 nt, Homo sapiens
ggggaugucuugagauguauu

SEQ ID NO: 1978070 - RNA, 18 nt, Homo sapiens
agagagguuugcaguccc

SEQ ID NO: 1978071 - RNA, 18 nt, Homo sapiens
ggaaauugcaguaacaaa

SEQ ID NO: 1978072 - RNA, 15 nt, Homo sapiens
aggaagcuacccaag

SEQ ID NO: 1978073 - RNA, 12 nt, Homo sapiens
aaauccuugaua

SEQ ID NO: 1978074 - RNA, 23 nt, Homo sapiens
ugcaguuauuucaaaaauuugca

SEQ ID NO: 1978075 - RNA, 14 nt, Homo sapiens
gacccugcucucac

SEQ ID NO: 1978076 - RNA, 23 nt, Homo sapiens
ugauauggccaauaaaaccauac

SEQ ID NO: 1978077 - RNA, 19 nt, Homo sapiens
gcuggagccuggugcccua

SEQ ID NO: 1978078 - RNA, 15 nt, Homo sapiens
auguagccagcagaa

SEQ ID NO: 1978079 - RNA, 16 nt, Homo sapiens
ucggcuuucauguaau

SEQ ID NO: 1978080 - RNA, 12 nt, Homo sapiens
guaccauagaaa

SEQ ID NO: 1978081 - RNA, 20 nt, Homo sapiens
ucccaggacagaaagaucuu

SEQ ID NO: 1978082 - RNA, 14 nt, Homo sapiens
ggccuccugccucu

SEQ ID NO: 1978083 - RNA, 22 nt, Homo sapiens
uuacagaaccaauucacuuuag

SEQ ID NO: 1978084 - RNA, 21 nt, Homo sapiens
gcuccagugacugaggggccu

SEQ ID NO: 1978085 - RNA, 14 nt, Homo sapiens
cuugacuauuucac

SEQ ID NO: 1978086 - RNA, 17 nt, Homo sapiens
accucucacacuggcuc

SEQ ID NO: 1978087 - RNA, 15 nt, Homo sapiens
cagggccaggugcuu

SEQ ID NO: 1978088 - RNA, 15 nt, Homo sapiens
agaaagcaggugcaa

SEQ ID NO: 1978089 - RNA, 21 nt, Homo sapiens
guggccuaauuuacaagcacg

SEQ ID NO: 1978090 - RNA, 15 nt, Homo sapiens
acucuugugaauuau

SEQ ID NO: 1978091 - RNA, 20 nt, Homo sapiens
auaaauuagaaucuccacua

SEQ ID NO: 1978092 - RNA, 22 nt, Homo sapiens
gagagucgcaucucagugcagg

SEQ ID NO: 1978093 - RNA, 16 nt, Homo sapiens
aacuguuccuuggucu

SEQ ID NO: 1978094 - RNA, 17 nt, Homo sapiens
ccacuucaucaaaauca

SEQ ID NO: 1978095 - RNA, 17 nt, Homo sapiens
aagaaauccagcuucau

SEQ ID NO: 1978096 - RNA, 21 nt, Homo sapiens
ccuacaccucuugcauuccau

SEQ ID NO: 1978097 - RNA, 19 nt, Homo sapiens
uguuaggguacauacgcua

SEQ ID NO: 1978098 - RNA, 15 nt, Homo sapiens
uuaaaauaaauuccu

SEQ ID NO: 1978099 - RNA, 17 nt, Homo sapiens
aacaguauuacaguguc

SEQ ID NO: 1978100 - RNA, 14 nt, Homo sapiens
agccuggcaacaca

SEQ ID NO: 1978101 - RNA, 19 nt, Homo sapiens
acauacaggccauacuuua

SEQ ID NO: 1978102 - RNA, 19 nt, Homo sapiens
cucagaaggccccagagag

SEQ ID NO: 1978103 - RNA, 18 nt, Homo sapiens
aaaaugcuucugcacaca

SEQ ID NO: 1978104 - RNA, 19 nt, Homo sapiens
acauugcuuuagacaaauu

SEQ ID NO: 1978105 - RNA, 14 nt, Homo sapiens
uaagucaguguuaa

SEQ ID NO: 1978106 - RNA, 21 nt, Homo sapiens
uuuaaguggcauuucuaugca

SEQ ID NO: 1978107 - RNA, 22 nt, Homo sapiens
uccugggaccuuuuguacuuua

SEQ ID NO: 1978108 - RNA, 20 nt, Homo sapiens
aguuacaguaaauacacugu

SEQ ID NO: 1978109 - RNA, 15 nt, Homo sapiens
cagaaaaauucuccu

SEQ ID NO: 1978110 - RNA, 12 nt, Homo sapiens
uugcaaaguaag

SEQ ID NO: 1978111 - RNA, 17 nt, Homo sapiens
uaauuuugaaaaacugc

SEQ ID NO: 1978112 - RNA, 17 nt, Homo sapiens
uagaacuccaguuuuca

SEQ ID NO: 1978113 - RNA, 16 nt, Homo sapiens
auaguaguuacuguca

SEQ ID NO: 1978114 - RNA, 23 nt, Homo sapiens
gauaacacaaguaaaacuguggu

SEQ ID NO: 1978115 - RNA, 20 nt, Homo sapiens
aaauuagguugaaacauauc

SEQ ID NO: 1978116 - RNA, 15 nt, Homo sapiens
cagguuaccucacuu

SEQ ID NO: 1978117 - RNA, 18 nt, Homo sapiens
aacucuuauuacuguugg

SEQ ID NO: 1978118 - RNA, 13 nt, Homo sapiens
caaaugcaccaug

SEQ ID NO: 1978119 - RNA, 16 nt, Homo sapiens
agcacagccaaucucc

SEQ ID NO: 1978120 - RNA, 16 nt, Homo sapiens
agaagacucacugugu

SEQ ID NO: 1978121 - RNA, 22 nt, Homo sapiens
agagaaggaauaaauuugucaa

SEQ ID NO: 1978122 - RNA, 19 nt, Homo sapiens
agauauucacuaaggacuu

SEQ ID NO: 1978123 - RNA, 23 nt, Homo sapiens
gguuagguuugucaacacaaaga

SEQ ID NO: 1978124 - RNA, 12 nt, Homo sapiens
aaucuacuguaa

SEQ ID NO: 1978125 - RNA, 13 nt, Homo sapiens
aaucaucuucucu

SEQ ID NO: 1978126 - RNA, 14 nt, Homo sapiens
caagcucaggacau

SEQ ID NO: 1978127 - RNA, 22 nt, Homo sapiens
uuuuaaaguacuuucuuauaaa

SEQ ID NO: 1978128 - RNA, 15 nt, Homo sapiens
uccccuuggcuguga

SEQ ID NO: 1978129 - RNA, 18 nt, Homo sapiens
uaagaagcggcauagcac

SEQ ID NO: 1978130 - RNA, 12 nt, Homo sapiens
uauucccaugag

SEQ ID NO: 1978131 - RNA, 22 nt, Homo sapiens
cuaauuauguagcucuuuguca

SEQ ID NO: 1978132 - RNA, 16 nt, Homo sapiens
acuuugucacuucugc

SEQ ID NO: 1978133 - RNA, 14 nt, Homo sapiens
augauuccagacag

SEQ ID NO: 1978134 - RNA, 15 nt, Homo sapiens
gcugggggacugggg

SEQ ID NO: 1978135 - RNA, 19 nt, Homo sapiens
cugcauggcaucagacuag

SEQ ID NO: 1978136 - RNA, 13 nt, Homo sapiens
cagcuucaaauaa

SEQ ID NO: 1978137 - RNA, 17 nt, Homo sapiens
gcacacugccagugucu

SEQ ID NO: 1978138 - RNA, 19 nt, Homo sapiens
uuuagaugugcugcuuuga

SEQ ID NO: 1978139 - RNA, 13 nt, Homo sapiens
uuagcuuucugaa

SEQ ID NO: 1978140 - RNA, 22 nt, Homo sapiens
cuccagccagcaaugaugucca

SEQ ID NO: 1978141 - RNA, 16 nt, Homo sapiens
gcagaccccaggcaag

SEQ ID NO: 1978142 - RNA, 20 nt, Homo sapiens
uggauucuuuaaacgcucua

SEQ ID NO: 1978143 - RNA, 23 nt, Homo sapiens
aaaaaugugaaauuuuuccacac

SEQ ID NO: 1978144 - RNA, 14 nt, Homo sapiens
ucagggaccugcug

SEQ ID NO: 1978145 - RNA, 17 nt, Homo sapiens
aaaauccaaaaugcaug

SEQ ID NO: 1978146 - RNA, 14 nt, Homo sapiens
auggcucugcaauu

SEQ ID NO: 1978147 - RNA, 21 nt, Homo sapiens
cuguggagaacaaagaccaau

SEQ ID NO: 1978148 - RNA, 15 nt, Homo sapiens
auguuuaauuuugca

SEQ ID NO: 1978149 - RNA, 18 nt, Homo sapiens
uaagugacacaaauugaa

SEQ ID NO: 1978150 - RNA, 19 nt, Homo sapiens
agcaauguaaaaaugguuu

SEQ ID NO: 1978151 - RNA, 16 nt, Homo sapiens
cuuuucugcauguucu

SEQ ID NO: 1978152 - RNA, 17 nt, Homo sapiens
agacaagcaagugcaca

SEQ ID NO: 1978153 - RNA, 22 nt, Homo sapiens
aacauuugccaccucuaaauau

SEQ ID NO: 1978154 - RNA, 22 nt, Homo sapiens
cucagaguguuuaauuguacuc

SEQ ID NO: 1978155 - RNA, 13 nt, Homo sapiens
auuucuugauuaa

SEQ ID NO: 1978156 - RNA, 13 nt, Homo sapiens
auaacuugauaua

SEQ ID NO: 1978157 - RNA, 23 nt, Homo sapiens
cuuucaucccucgggugugcuau

SEQ ID NO: 1978158 - RNA, 11 nt, Homo sapiens
gaaaacagacu

SEQ ID NO: 1978159 - RNA, 14 nt, Homo sapiens
uccucacacagauu

SEQ ID NO: 1978160 - RNA, 21 nt, Homo sapiens
gagcggcugcucgcccaggaa

SEQ ID NO: 1978161 - RNA, 15 nt, Homo sapiens
agcauauauaaucaa

SEQ ID NO: 1978162 - RNA, 18 nt, Homo sapiens
ucccagugcacauggcag

SEQ ID NO: 1978163 - RNA, 19 nt, Homo sapiens
cauauauauauauaacaua

SEQ ID NO: 1978164 - RNA, 19 nt, Homo sapiens
caccugucaaccugaauua

SEQ ID NO: 1978165 - RNA, 17 nt, Homo sapiens
auucaucucaaggaaua

SEQ ID NO: 1978166 - RNA, 11 nt, Homo sapiens
aucgugugcca

SEQ ID NO: 1978167 - RNA, 23 nt, Homo sapiens
ugcaccaaugcacugagugaagg

SEQ ID NO: 1978168 - RNA, 19 nt, Homo sapiens
cagaauuaugaagagguau

SEQ ID NO: 1978169 - RNA, 15 nt, Homo sapiens
gaaacauuugugaaa

SEQ ID NO: 1978170 - RNA, 17 nt, Homo sapiens
agagcaggauagcucuu

SEQ ID NO: 1978171 - RNA, 15 nt, Homo sapiens
ucuaggcacaugugg

SEQ ID NO: 1978172 - RNA, 20 nt, Homo sapiens
caccugccagccaucacaag

SEQ ID NO: 1978173 - RNA, 15 nt, Homo sapiens
agccacugugcugaa

SEQ ID NO: 1978174 - RNA, 13 nt, Homo sapiens
auccagugcugag

SEQ ID NO: 1978175 - RNA, 17 nt, Homo sapiens
gugaagcucacacugau

SEQ ID NO: 1978176 - RNA, 14 nt, Homo sapiens
acucuacacuguga

SEQ ID NO: 1978177 - RNA, 20 nt, Homo sapiens
aacucaacugggcucugucc

SEQ ID NO: 1978178 - RNA, 17 nt, Homo sapiens
cucuuauccaacaucaa

SEQ ID NO: 1978179 - RNA, 22 nt, Homo sapiens
auuuuucaaguaauaaaacaau

SEQ ID NO: 1978180 - RNA, 22 nt, Homo sapiens
aauauccagccucccacaagaa

SEQ ID NO: 1978181 - RNA, 22 nt, Homo sapiens
gggaucuguaaggaacuggaac

SEQ ID NO: 1978182 - RNA, 17 nt, Homo sapiens
aggacaccacuaggugg

SEQ ID NO: 1978183 - RNA, 14 nt, Homo sapiens
uggaacacuaauga

SEQ ID NO: 1978184 - RNA, 19 nt, Homo sapiens
cggcccugcugaagcugcu

SEQ ID NO: 1978185 - RNA, 23 nt, Homo sapiens
acaaugaguguuauaacagggaa

SEQ ID NO: 1978186 - RNA, 20 nt, Homo sapiens
ugcaagugucugugugcaag

SEQ ID NO: 1978187 - RNA, 14 nt, Homo sapiens
auugauccaggaga

SEQ ID NO: 1978188 - RNA, 17 nt, Homo sapiens
cuggggucccucugaag

SEQ ID NO: 1978189 - RNA, 18 nt, Homo sapiens
agcauccucucucacaug

SEQ ID NO: 1978190 - RNA, 14 nt, Homo sapiens
ugcugggauuucca

SEQ ID NO: 1978191 - RNA, 15 nt, Homo sapiens
aauuauagucaauau

SEQ ID NO: 1978192 - RNA, 15 nt, Homo sapiens
aaaauuugucuuaaa

SEQ ID NO: 1978193 - RNA, 14 nt, Homo sapiens
augagugcuuaaac

SEQ ID NO: 1978194 - RNA, 18 nt, Homo sapiens
aaaguucaacuuauuuca

SEQ ID NO: 1978195 - RNA, 19 nt, Homo sapiens
ugcugcaaagccuuuccag

SEQ ID NO: 1978196 - RNA, 17 nt, Homo sapiens
aguauuguacagcacug

SEQ ID NO: 1978197 - RNA, 19 nt, Homo sapiens
guaucuauuuauauaucau

SEQ ID NO: 1978198 - RNA, 23 nt, Homo sapiens
aaaugggcacaguaugcuccuua

SEQ ID NO: 1978199 - RNA, 16 nt, Homo sapiens
uacaguuaacucuccc

SEQ ID NO: 1978200 - RNA, 18 nt, Homo sapiens
ucuuucaucuccugagua

SEQ ID NO: 1978201 - RNA, 16 nt, Homo sapiens
uagaauaaauucccaa

SEQ ID NO: 1978202 - RNA, 21 nt, Homo sapiens
uauacuguaugugccaaagcu

SEQ ID NO: 1978203 - RNA, 14 nt, Homo sapiens
gaugaaaacauuca

SEQ ID NO: 1978204 - RNA, 22 nt, Homo sapiens
ugaaauguaggcaucaugcaug

SEQ ID NO: 1978205 - RNA, 21 nt, Homo sapiens
aaacgugucccgagcuuagau

SEQ ID NO: 1978206 - RNA, 17 nt, Homo sapiens
ggaggugauuccaguga

SEQ ID NO: 1978207 - RNA, 18 nt, Homo sapiens
gccagggcccugcagagg

SEQ ID NO: 1978208 - RNA, 16 nt, Homo sapiens
ccacucaccagcccua

SEQ ID NO: 1978209 - RNA, 16 nt, Homo sapiens
auuuuaggaugcagug

SEQ ID NO: 1978210 - RNA, 16 nt, Homo sapiens
aguuggugcugcucau

SEQ ID NO: 1978211 - RNA, 16 nt, Homo sapiens
uacauagcagacuuuc

SEQ ID NO: 1978212 - RNA, 21 nt, Homo sapiens
ucagauacaugguugugaccu

SEQ ID NO: 1978213 - RNA, 21 nt, Homo sapiens
ugucaucuuuuuccacuuuga

SEQ ID NO: 1978214 - RNA, 16 nt, Homo sapiens
caagagcacacuuggc

SEQ ID NO: 1978215 - RNA, 15 nt, Homo sapiens
aaauugucagaugcu

SEQ ID NO: 1978216 - RNA, 19 nt, Homo sapiens
ucgcaucucagugcaggag

SEQ ID NO: 1978217 - RNA, 23 nt, Homo sapiens
gaagacaucuuauccauccucac

SEQ ID NO: 1978218 - RNA, 13 nt, Homo sapiens
uauuaaauuugaa

SEQ ID NO: 1978219 - RNA, 15 nt, Homo sapiens
uguuuauaaugcaau

SEQ ID NO: 1978220 - RNA, 13 nt, Homo sapiens
uuuuuauuuauga

SEQ ID NO: 1978221 - RNA, 14 nt, Homo sapiens
cauaugcccucauc

SEQ ID NO: 1978222 - RNA, 17 nt, Homo sapiens
gacccagagguccaggu

SEQ ID NO: 1978223 - RNA, 14 nt, Homo sapiens
auauuuggcuuaua

SEQ ID NO: 1978224 - RNA, 21 nt, Homo sapiens
acugaggugccugcucaggug

SEQ ID NO: 1978225 - RNA, 15 nt, Homo sapiens
agcucagagugccac

SEQ ID NO: 1978226 - RNA, 16 nt, Homo sapiens
acucacagcaaggaug

SEQ ID NO: 1978227 - RNA, 22 nt, Homo sapiens
cagcuagcuuauucuuguguac

SEQ ID NO: 1978228 - RNA, 14 nt, Homo sapiens
acauggaacuuuag

SEQ ID NO: 1978229 - RNA, 14 nt, Homo sapiens
cuaaauaaacuagu

SEQ ID NO: 1978230 - RNA, 22 nt, Homo sapiens
augcacguggggcccacugcuc

SEQ ID NO: 1978231 - RNA, 18 nt, Homo sapiens
aggggcugggagcugccu

SEQ ID NO: 1978232 - RNA, 20 nt, Homo sapiens
cggacccugcccauaccccu

SEQ ID NO: 1978233 - RNA, 15 nt, Homo sapiens
ucacugagcacuguu

SEQ ID NO: 1978234 - RNA, 20 nt, Homo sapiens
uggaaagucucucuucugaa

SEQ ID NO: 1978235 - RNA, 13 nt, Homo sapiens
gccaucaccucag

SEQ ID NO: 1978236 - RNA, 15 nt, Homo sapiens
auuacucuacuguuc

SEQ ID NO: 1978237 - RNA, 15 nt, Homo sapiens
gcuucaaccccauga

SEQ ID NO: 1978238 - RNA, 15 nt, Homo sapiens
uguuuacagcacuac

SEQ ID NO: 1978239 - RNA, 21 nt, Homo sapiens
uugcaauauuuucagaagaaa

SEQ ID NO: 1978240 - RNA, 22 nt, Homo sapiens
uccuggcuguccuaccaucagc

SEQ ID NO: 1978241 - RNA, 14 nt, Homo sapiens
gcaccgucauggcu

SEQ ID NO: 1978242 - RNA, 23 nt, Homo sapiens
ugaggugugccuggccucugccu

SEQ ID NO: 1978243 - RNA, 15 nt, Homo sapiens
acaauuauuggcaaa

SEQ ID NO: 1978244 - RNA, 18 nt, Homo sapiens
augcaaguguuccuauuu

SEQ ID NO: 1978245 - RNA, 21 nt, Homo sapiens
ugcuucucuucuuuauugcac

SEQ ID NO: 1978246 - RNA, 18 nt, Homo sapiens
aaucaguaaauaguguca

SEQ ID NO: 1978247 - RNA, 23 nt, Homo sapiens
uuauucuuauuuggacagccaag

SEQ ID NO: 1978248 - RNA, 18 nt, Homo sapiens
ggagggggagagagcaag

SEQ ID NO: 1978249 - RNA, 18 nt, Homo sapiens
gaccccugacucaucauu

SEQ ID NO: 1978250 - RNA, 16 nt, Homo sapiens
gauguaugaaggcuuu

SEQ ID NO: 1978251 - RNA, 18 nt, Homo sapiens
cagccuccccgugccaaa

SEQ ID NO: 1978252 - RNA, 23 nt, Homo sapiens
guaguguguuuucauaacaacuu

SEQ ID NO: 1978253 - RNA, 18 nt, Homo sapiens
agcccugcuaaauaauga

SEQ ID NO: 1978254 - RNA, 15 nt, Homo sapiens
augugugaggagcug

SEQ ID NO: 1978255 - RNA, 17 nt, Homo sapiens
aauauccaauugcugcu

SEQ ID NO: 1978256 - RNA, 19 nt, Homo sapiens
auaacuauauaagacauua

SEQ ID NO: 1978257 - RNA, 20 nt, Homo sapiens
aucuaagugggagacaauau

SEQ ID NO: 1978258 - RNA, 13 nt, Homo sapiens
caaaggaucuccu

SEQ ID NO: 1978259 - RNA, 22 nt, Homo sapiens
uuuuacgaucuguuuccaaauc

SEQ ID NO: 1978260 - RNA, 20 nt, Homo sapiens
gugacuggcccacacgugca

SEQ ID NO: 1978261 - RNA, 22 nt, Homo sapiens
ugccccauuuauccaccuccau

SEQ ID NO: 1978262 - RNA, 23 nt, Homo sapiens
aaggcaaaucuccuuuguccauu

SEQ ID NO: 1978263 - RNA, 20 nt, Homo sapiens
gcugccugcuuugugcaggg

SEQ ID NO: 1978264 - RNA, 19 nt, Homo sapiens
cuuuuuuaagacucaauca

SEQ ID NO: 1978265 - RNA, 20 nt, Homo sapiens
cccugugaucuauaccaccu

SEQ ID NO: 1978266 - RNA, 19 nt, Homo sapiens
aacucaaggacagccacca

SEQ ID NO: 1978267 - RNA, 14 nt, Homo sapiens
gguggucuauuaaa

SEQ ID NO: 1978268 - RNA, 15 nt, Homo sapiens
ccugcagcacuuuuu

SEQ ID NO: 1978269 - RNA, 18 nt, Homo sapiens
aagaaauuuaauguuucu

SEQ ID NO: 1978270 - RNA, 21 nt, Homo sapiens
ugcuuuuuuugaaacuuugag

SEQ ID NO: 1978271 - RNA, 12 nt, Homo sapiens
gcucaaagggaa

SEQ ID NO: 1978272 - RNA, 15 nt, Homo sapiens
guuggaggcucucau

SEQ ID NO: 1978273 - RNA, 12 nt, Homo sapiens
acucacagccag

SEQ ID NO: 1978274 - RNA, 20 nt, Homo sapiens
gcuauaugccuuaagccaau

SEQ ID NO: 1978275 - RNA, 18 nt, Homo sapiens
acccugcccgcucccaac

SEQ ID NO: 1978276 - RNA, 15 nt, Homo sapiens
auggccaggccucag

SEQ ID NO: 1978277 - RNA, 23 nt, Homo sapiens
gguuuguguugagcguuugcacg

SEQ ID NO: 1978278 - RNA, 20 nt, Homo sapiens
gacuguaggcgccccugggg

SEQ ID NO: 1978279 - RNA, 22 nt, Homo sapiens
uugaaugacauuuuagggacau

SEQ ID NO: 1978280 - RNA, 20 nt, Homo sapiens
ugcagguuuguaaugcaaaa

SEQ ID NO: 1978281 - RNA, 19 nt, Homo sapiens
uguauuccaaggccuguga

SEQ ID NO: 1978282 - RNA, 17 nt, Homo sapiens
auuucucuacuugucau

SEQ ID NO: 1978283 - RNA, 16 nt, Homo sapiens
uugucugagaacaaau

SEQ ID NO: 1978284 - RNA, 18 nt, Homo sapiens
uccuaacccccuuacugu

SEQ ID NO: 1978285 - RNA, 18 nt, Homo sapiens
uagaagugugaagugcag

SEQ ID NO: 1978286 - RNA, 23 nt, Homo sapiens
aaauugccaagaaaaacaacuuu

SEQ ID NO: 1978287 - RNA, 22 nt, Homo sapiens
aaugucacaauaaaacaaucuc

SEQ ID NO: 1978288 - RNA, 20 nt, Homo sapiens
auuggagaaaagcacuuaaa

SEQ ID NO: 1978289 - RNA, 23 nt, Homo sapiens
gaauguguggccugcacagugaa

SEQ ID NO: 1978290 - RNA, 23 nt, Homo sapiens
aaccuguaaagcaggugcccagg

SEQ ID NO: 1978291 - RNA, 18 nt, Homo sapiens
ucugacaaugcugagguu

SEQ ID NO: 1978292 - RNA, 21 nt, Homo sapiens
uuucggaggccccacugaugc

SEQ ID NO: 1978293 - RNA, 22 nt, Homo sapiens
auaucucuguaaucucugucaa

SEQ ID NO: 1978294 - RNA, 23 nt, Homo sapiens
uacauaucuguguauuaucucaa

SEQ ID NO: 1978295 - RNA, 13 nt, Homo sapiens
aguuauaaccaac

SEQ ID NO: 1978296 - RNA, 19 nt, Homo sapiens
ggcuuaaguuuuacuugag

SEQ ID NO: 1978297 - RNA, 13 nt, Homo sapiens
gcgccugagauac

SEQ ID NO: 1978298 - RNA, 20 nt, Homo sapiens
ucauuauuuuuccacuuugu

SEQ ID NO: 1978299 - RNA, 19 nt, Homo sapiens
ucuggggaaaggggacaag

SEQ ID NO: 1978300 - RNA, 17 nt, Homo sapiens
aucccagacuugcugaa

SEQ ID NO: 1978301 - RNA, 18 nt, Homo sapiens
ccauggccaaggggccag

SEQ ID NO: 1978302 - RNA, 22 nt, Homo sapiens
guuucauauucaugcaaguauu

SEQ ID NO: 1978303 - RNA, 22 nt, Homo sapiens
ucugagcuagugauuugccuca

SEQ ID NO: 1978304 - RNA, 18 nt, Homo sapiens
cuuggagcucugaguucc

SEQ ID NO: 1978305 - RNA, 22 nt, Homo sapiens
acaggaggggcccacaauggag

SEQ ID NO: 1978306 - RNA, 20 nt, Homo sapiens
cugccuguggugagguccug

SEQ ID NO: 1978307 - RNA, 22 nt, Homo sapiens
aagccuauuugaacuacuuaaa

SEQ ID NO: 1978308 - RNA, 16 nt, Homo sapiens
ucuucuucagauucag

SEQ ID NO: 1978309 - RNA, 13 nt, Homo sapiens
aguaugauggcag

SEQ ID NO: 1978310 - RNA, 11 nt, Homo sapiens
auuacacugga

SEQ ID NO: 1978311 - RNA, 14 nt, Homo sapiens
cgucaggaaaccaa

SEQ ID NO: 1978312 - RNA, 15 nt, Homo sapiens
gaagguuagguuugu

SEQ ID NO: 1978313 - RNA, 22 nt, Homo sapiens
gugucccagaccccgacaccgg

SEQ ID NO: 1978314 - RNA, 23 nt, Homo sapiens
acaacuuaugacuaaaaauauca

SEQ ID NO: 1978315 - RNA, 16 nt, Homo sapiens
gucaucccggggccau

SEQ ID NO: 1978316 - RNA, 15 nt, Homo sapiens
auucaaggaucucaa

SEQ ID NO: 1978317 - RNA, 13 nt, Homo sapiens
aucaagacuggaa

SEQ ID NO: 1978318 - RNA, 13 nt, Homo sapiens
gcuacagcaaaua

SEQ ID NO: 1978319 - RNA, 13 nt, Homo sapiens
aucugcacaguca

SEQ ID NO: 1978320 - RNA, 16 nt, Homo sapiens
uauacucuucaaggac

SEQ ID NO: 1978321 - RNA, 23 nt, Homo sapiens
ccuggagacuaaccccaccacac

SEQ ID NO: 1978322 - RNA, 22 nt, Homo sapiens
gaauggcccaguccucucccaa

SEQ ID NO: 1978323 - RNA, 20 nt, Homo sapiens
aagugugcugugacaagcca

SEQ ID NO: 1978324 - RNA, 22 nt, Homo sapiens
cuuuaauuuccuugacuguaaa

SEQ ID NO: 1978325 - RNA, 18 nt, Homo sapiens
acauguauuuauggagug

SEQ ID NO: 1978326 - RNA, 18 nt, Homo sapiens
aauugacugaagcacagc

SEQ ID NO: 1978327 - RNA, 15 nt, Homo sapiens
aaucuaauacacuuu

SEQ ID NO: 1978328 - RNA, 15 nt, Homo sapiens
uaaagauuucuagua

SEQ ID NO: 1978329 - RNA, 13 nt, Homo sapiens
uaguagaauuccu

SEQ ID NO: 1978330 - RNA, 20 nt, Homo sapiens
gaaggagguucuaauauuca

SEQ ID NO: 1978331 - RNA, 20 nt, Homo sapiens
uuuggacugucuauaucaua

SEQ ID NO: 1978332 - RNA, 19 nt, Homo sapiens
auuccuuggcaugccuucc

SEQ ID NO: 1978333 - RNA, 15 nt, Homo sapiens
gaucuguacuuugug

SEQ ID NO: 1978334 - RNA, 21 nt, Homo sapiens
aaagauucccacccaauucaa

SEQ ID NO: 1978335 - RNA, 19 nt, Homo sapiens
ccgcucaggcugaccacuu

SEQ ID NO: 1978336 - RNA, 15 nt, Homo sapiens
acagaaggauguccc

SEQ ID NO: 1978337 - RNA, 21 nt, Homo sapiens
uaguucauagcaauuaacuga

SEQ ID NO: 1978338 - RNA, 23 nt, Homo sapiens
agacuugaauuuaguuuuuuacc

SEQ ID NO: 1978339 - RNA, 13 nt, Homo sapiens
cuacagaaugaga

SEQ ID NO: 1978340 - RNA, 14 nt, Homo sapiens
cauucuugugacuu

SEQ ID NO: 1978341 - RNA, 17 nt, Homo sapiens
agaucuauguacuguaa

SEQ ID NO: 1978342 - RNA, 14 nt, Homo sapiens
gccccccuccuugc

SEQ ID NO: 1978343 - RNA, 15 nt, Homo sapiens
acagggcauggccag

SEQ ID NO: 1978344 - RNA, 12 nt, Homo sapiens
cccaugcuuccu

SEQ ID NO: 1978345 - RNA, 19 nt, Homo sapiens
ccucacacugggacuugca

SEQ ID NO: 1978346 - RNA, 20 nt, Homo sapiens
auaaacauguuuuaacauua

SEQ ID NO: 1978347 - RNA, 20 nt, Homo sapiens
cagugagccaugaucaugcc

SEQ ID NO: 1978348 - RNA, 21 nt, Homo sapiens
uuggagaccgaagacugggau

SEQ ID NO: 1978349 - RNA, 18 nt, Homo sapiens
uguguauuuccagugcaa

SEQ ID NO: 1978350 - RNA, 17 nt, Homo sapiens
uaaauguuuuacaagaa

SEQ ID NO: 1978351 - RNA, 13 nt, Homo sapiens
ugagaucauucac

SEQ ID NO: 1978352 - RNA, 19 nt, Homo sapiens
ccuacuaaauguacagaua

SEQ ID NO: 1978353 - RNA, 20 nt, Homo sapiens
ucccccaccuucaagcaccc

SEQ ID NO: 1978354 - RNA, 18 nt, Homo sapiens
gcaugaugucuaccucag

SEQ ID NO: 1978355 - RNA, 14 nt, Homo sapiens
uuuguuuuaaauac

SEQ ID NO: 1978356 - RNA, 20 nt, Homo sapiens
acugccugugaaguggaugg

SEQ ID NO: 1978357 - RNA, 16 nt, Homo sapiens
aucccacuagcagcuu

SEQ ID NO: 1978358 - RNA, 13 nt, Homo sapiens
auuguucauauca

SEQ ID NO: 1978359 - RNA, 16 nt, Homo sapiens
cuaagcgcacauucau

SEQ ID NO: 1978360 - RNA, 24 nt, Homo sapiens
caaaaaacauuguuuuguguaaca

SEQ ID NO: 1978361 - RNA, 13 nt, Homo sapiens
acugaacauguuu

SEQ ID NO: 1978362 - RNA, 22 nt, Homo sapiens
uuucacccauccaugagcugcu

SEQ ID NO: 1978363 - RNA, 21 nt, Homo sapiens
agaaaaauagcugugaacaga

SEQ ID NO: 1978364 - RNA, 22 nt, Homo sapiens
gguaauuauguuuugugauuca

SEQ ID NO: 1978365 - RNA, 13 nt, Homo sapiens
uaugacaacucuu

SEQ ID NO: 1978366 - RNA, 17 nt, Homo sapiens
cuggauuucauacugua

SEQ ID NO: 1978367 - RNA, 15 nt, Homo sapiens
uaucauguaccucag

SEQ ID NO: 1978368 - RNA, 15 nt, Homo sapiens
ccaucccauuggcaa

SEQ ID NO: 1978369 - RNA, 16 nt, Homo sapiens
acagaccucaguuuua

SEQ ID NO: 1978370 - RNA, 19 nt, Homo sapiens
ugaucugggagagucucac

SEQ ID NO: 1978371 - RNA, 21 nt, Homo sapiens
ugaggaaaauuaauaucacag

SEQ ID NO: 1978372 - RNA, 12 nt, Homo sapiens
ccauucaucuca

SEQ ID NO: 1978373 - RNA, 15 nt, Homo sapiens
augaaugcagauuac

SEQ ID NO: 1978374 - RNA, 20 nt, Homo sapiens
uucaugugaucuauuacucu

SEQ ID NO: 1978375 - RNA, 15 nt, Homo sapiens
uguuauaauuugcac

SEQ ID NO: 1978376 - RNA, 14 nt, Homo sapiens
gaaaaaaaaauuca

SEQ ID NO: 1978377 - RNA, 16 nt, Homo sapiens
gaagccaagggggacc

SEQ ID NO: 1978378 - RNA, 12 nt, Homo sapiens
cugugucugucc

SEQ ID NO: 1978379 - RNA, 20 nt, Homo sapiens
cacccaggcuggagugcaau

SEQ ID NO: 1978380 - RNA, 16 nt, Homo sapiens
ugaggccaucucagga

SEQ ID NO: 1978381 - RNA, 22 nt, Homo sapiens
uucugauuugucccuaugcaua

SEQ ID NO: 1978382 - RNA, 17 nt, Homo sapiens
accuccuucaauuccau

SEQ ID NO: 1978383 - RNA, 19 nt, Homo sapiens
uauaguacuuuaugcaucu

SEQ ID NO: 1978384 - RNA, 12 nt, Homo sapiens
auuuuugcacaa

SEQ ID NO: 1978385 - RNA, 12 nt, Homo sapiens
auauuugcacua

SEQ ID NO: 1978386 - RNA, 12 nt, Homo sapiens
uuuucuacucca

SEQ ID NO: 1978387 - RNA, 22 nt, Homo sapiens
augaaacuccugauuuuguagu

SEQ ID NO: 1978388 - RNA, 23 nt, Homo sapiens
aucuccuaacaaaagaacuaaga

SEQ ID NO: 1978389 - RNA, 18 nt, Homo sapiens
cuaugucauuucauuucc

SEQ ID NO: 1978390 - RNA, 18 nt, Homo sapiens
ugauuggccacacacuga

SEQ ID NO: 1978391 - RNA, 18 nt, Homo sapiens
gaaaaauaguguguccau

SEQ ID NO: 1978392 - RNA, 18 nt, Homo sapiens
cccaggauugugcaauag

SEQ ID NO: 1978393 - RNA, 18 nt, Homo sapiens
gggacuucugucuucaca

SEQ ID NO: 1978394 - RNA, 19 nt, Homo sapiens
gaacccugcuugcacuuug

SEQ ID NO: 1978395 - RNA, 13 nt, Homo sapiens
gaacugucuuuca

SEQ ID NO: 1978396 - RNA, 21 nt, Homo sapiens
aauuauuacaugguacuacau

SEQ ID NO: 1978397 - RNA, 14 nt, Homo sapiens
ugcagcacugcugc

SEQ ID NO: 1978398 - RNA, 14 nt, Homo sapiens
cacaauaccacuau

SEQ ID NO: 1978399 - RNA, 23 nt, Homo sapiens
uuacagaaaauuguugugcuuag

SEQ ID NO: 1978400 - RNA, 14 nt, Homo sapiens
agucauuggcuuua

SEQ ID NO: 1978401 - RNA, 12 nt, Homo sapiens
gcaucacuuaac

SEQ ID NO: 1978402 - RNA, 18 nt, Homo sapiens
cuggcccaagauuauuca

SEQ ID NO: 1978403 - RNA, 15 nt, Homo sapiens
ccaguaaacagagga

SEQ ID NO: 1978404 - RNA, 14 nt, Homo sapiens
acuugagauguaug

SEQ ID NO: 1978405 - RNA, 16 nt, Homo sapiens
cacauuaaucucaaag

SEQ ID NO: 1978406 - RNA, 17 nt, Homo sapiens
caaucucauacaagcca

SEQ ID NO: 1978407 - RNA, 14 nt, Homo sapiens
uacuuucuuuacau

SEQ ID NO: 1978408 - RNA, 16 nt, Homo sapiens
ggagacuugccagagc

SEQ ID NO: 1978409 - RNA, 17 nt, Homo sapiens
aggaaaaacaugagcau

SEQ ID NO: 1978410 - RNA, 15 nt, Homo sapiens
ccuuggauuacuuug

SEQ ID NO: 1978411 - RNA, 12 nt, Homo sapiens
ucucuuguccug

SEQ ID NO: 1978412 - RNA, 17 nt, Homo sapiens
gaaucuuuuacugugga

SEQ ID NO: 1978413 - RNA, 16 nt, Homo sapiens
caguuuuccucucaau

SEQ ID NO: 1978414 - RNA, 19 nt, Homo sapiens
caggauguuugcucagcuu

SEQ ID NO: 1978415 - RNA, 16 nt, Homo sapiens
gcacuugugcuuucag

SEQ ID NO: 1978416 - RNA, 15 nt, Homo sapiens
uggagaccuuucuag

SEQ ID NO: 1978417 - RNA, 18 nt, Homo sapiens
auucauggcuaccucaga

SEQ ID NO: 1978418 - RNA, 22 nt, Homo sapiens
aauauauucagccuggcuucaa

SEQ ID NO: 1978419 - RNA, 12 nt, Homo sapiens
aauuuuugauca

SEQ ID NO: 1978420 - RNA, 16 nt, Homo sapiens
aaagcacagauuucaa

SEQ ID NO: 1978421 - RNA, 18 nt, Homo sapiens
ccaccuugaaccugucac

SEQ ID NO: 1978422 - RNA, 15 nt, Homo sapiens
cauuuucugcauuua

SEQ ID NO: 1978423 - RNA, 17 nt, Homo sapiens
ugugaaggacaugagac

SEQ ID NO: 1978424 - RNA, 16 nt, Homo sapiens
cuggugccccuuugcc

SEQ ID NO: 1978425 - RNA, 19 nt, Homo sapiens
uuuugaaagucccuaauaa

SEQ ID NO: 1978426 - RNA, 23 nt, Homo sapiens
uccaggggugggacacccuguga

SEQ ID NO: 1978427 - RNA, 22 nt, Homo sapiens
cauagaacugccuggauuccau

SEQ ID NO: 1978428 - RNA, 14 nt, Homo sapiens
caggcagauuugag

SEQ ID NO: 1978429 - RNA, 21 nt, Homo sapiens
ucccaagguucaauaaggccu

SEQ ID NO: 1978430 - RNA, 23 nt, Homo sapiens
aaauguaccccucucagucugca

SEQ ID NO: 1978431 - RNA, 22 nt, Homo sapiens
acuguuauucuauuauaucaga

SEQ ID NO: 1978432 - RNA, 19 nt, Homo sapiens
gacagaagaaacuacccuc

SEQ ID NO: 1978433 - RNA, 19 nt, Homo sapiens
auagacucugguguucuau

SEQ ID NO: 1978434 - RNA, 22 nt, Homo sapiens
auuggagacaucacuugccaau

SEQ ID NO: 1978435 - RNA, 23 nt, Homo sapiens
auggucagcucacacccuaauaa

SEQ ID NO: 1978436 - RNA, 13 nt, Homo sapiens
acaguagcuugaa

SEQ ID NO: 1978437 - RNA, 22 nt, Homo sapiens
augcacuugggagaaaauuaag

SEQ ID NO: 1978438 - RNA, 15 nt, Homo sapiens
ucacaggucuugccc

SEQ ID NO: 1978439 - RNA, 15 nt, Homo sapiens
guuucccuaucucga

SEQ ID NO: 1978440 - RNA, 19 nt, Homo sapiens
aaauuaacgucaccaguga

SEQ ID NO: 1978441 - RNA, 12 nt, Homo sapiens
agagacugugcu

SEQ ID NO: 1978442 - RNA, 17 nt, Homo sapiens
gccagaagggggccaug

SEQ ID NO: 1978443 - RNA, 14 nt, Homo sapiens
guuugacuagccau

SEQ ID NO: 1978444 - RNA, 20 nt, Homo sapiens
guggagacauauuucaguga

SEQ ID NO: 1978445 - RNA, 18 nt, Homo sapiens
uucugcuguggucuauaa

SEQ ID NO: 1978446 - RNA, 16 nt, Homo sapiens
cuuuaaggugcuaaac

SEQ ID NO: 1978447 - RNA, 14 nt, Homo sapiens
uuuagacacauuag

SEQ ID NO: 1978448 - RNA, 15 nt, Homo sapiens
accccaggucagggg

SEQ ID NO: 1978449 - RNA, 22 nt, Homo sapiens
aguauaauuguguugauucuuu

SEQ ID NO: 1978450 - RNA, 20 nt, Homo sapiens
caggcuggaguacaauggcg

SEQ ID NO: 1978451 - RNA, 20 nt, Homo sapiens
caggcuggagugcaauggca

SEQ ID NO: 1978452 - RNA, 17 nt, Homo sapiens
aucuggguucacugcaa

SEQ ID NO: 1978453 - RNA, 23 nt, Homo sapiens
aacucuuaacugaagaaagagaa

SEQ ID NO: 1978454 - RNA, 21 nt, Homo sapiens
acccugaggugagcaucaucu

SEQ ID NO: 1978455 - RNA, 16 nt, Homo sapiens
accuucucaccuguga

SEQ ID NO: 1978456 - RNA, 17 nt, Homo sapiens
cugcuaauaauuugcca

SEQ ID NO: 1978457 - RNA, 23 nt, Homo sapiens
uaucacuaaaaauuuuuacaaaa

SEQ ID NO: 1978458 - RNA, 15 nt, Homo sapiens
augcuguuggccuca

SEQ ID NO: 1978459 - RNA, 18 nt, Homo sapiens
aucagagcguuuguuccc

SEQ ID NO: 1978460 - RNA, 18 nt, Homo sapiens
acagucucugggagacuu

SEQ ID NO: 1978461 - RNA, 15 nt, Homo sapiens
gaauccaguuugcaa

SEQ ID NO: 1978462 - RNA, 21 nt, Homo sapiens
auggcaucucauugaggacaa

SEQ ID NO: 1978463 - RNA, 17 nt, Homo sapiens
gcaccucagacaaucca

SEQ ID NO: 1978464 - RNA, 21 nt, Homo sapiens
auaaauuauaucaauuuccuc

SEQ ID NO: 1978465 - RNA, 14 nt, Homo sapiens
acagcaaacugucc

SEQ ID NO: 1978466 - RNA, 17 nt, Homo sapiens
cacguuuuccauuauga

SEQ ID NO: 1978467 - RNA, 17 nt, Homo sapiens
agcagacuuuugugaac

SEQ ID NO: 1978468 - RNA, 16 nt, Homo sapiens
uucuaauuugcugcug

SEQ ID NO: 1978469 - RNA, 20 nt, Homo sapiens
auggagaaauagacuuugcc

SEQ ID NO: 1978470 - RNA, 15 nt, Homo sapiens
uugccuccuggaaaa

SEQ ID NO: 1978471 - RNA, 12 nt, Homo sapiens
gaggauugcacu

SEQ ID NO: 1978472 - RNA, 11 nt, Homo sapiens
ccaaccacaga

SEQ ID NO: 1978473 - RNA, 15 nt, Homo sapiens
gggaaaucaggguua

SEQ ID NO: 1978474 - RNA, 18 nt, Homo sapiens
agccaagaucccaucucu

SEQ ID NO: 1978475 - RNA, 23 nt, Homo sapiens
cucauuuuuguuuucauuaucuc

SEQ ID NO: 1978476 - RNA, 16 nt, Homo sapiens
ccaggaccccugagua

SEQ ID NO: 1978477 - RNA, 23 nt, Homo sapiens
aagagaucuuucuuuccaaaaca

SEQ ID NO: 1978478 - RNA, 12 nt, Homo sapiens
auuaaucauucc

SEQ ID NO: 1978479 - RNA, 13 nt, Homo sapiens
ggcccugggagag

SEQ ID NO: 1978480 - RNA, 14 nt, Homo sapiens
agucugagcccauu

SEQ ID NO: 1978481 - RNA, 23 nt, Homo sapiens
gguuugucacacgauaaagggau

SEQ ID NO: 1978482 - RNA, 19 nt, Homo sapiens
uucuuugagauagcccauc

SEQ ID NO: 1978483 - RNA, 15 nt, Homo sapiens
cuuaaagugaaggaa

SEQ ID NO: 1978484 - RNA, 19 nt, Homo sapiens
gauuccaguuuagugcuug

SEQ ID NO: 1978485 - RNA, 20 nt, Homo sapiens
cuccccauggugcagugaag

SEQ ID NO: 1978486 - RNA, 20 nt, Homo sapiens
gcuaacuuaguaagugcuuu

SEQ ID NO: 1978487 - RNA, 15 nt, Homo sapiens
uggggccagauccag

SEQ ID NO: 1978488 - RNA, 13 nt, Homo sapiens
aaauuuaagcaaa

SEQ ID NO: 1978489 - RNA, 13 nt, Homo sapiens
aucagauguuuca

SEQ ID NO: 1978490 - RNA, 13 nt, Homo sapiens
agucaaugugcag

SEQ ID NO: 1978491 - RNA, 19 nt, Homo sapiens
cugaagucaguguagaccu

SEQ ID NO: 1978492 - RNA, 20 nt, Homo sapiens
uggcccaggcuggagugcag

SEQ ID NO: 1978493 - RNA, 19 nt, Homo sapiens
ggcauggccgcgucacuuc

SEQ ID NO: 1978494 - RNA, 21 nt, Homo sapiens
gagucucauucuguugcccag

SEQ ID NO: 1978495 - RNA, 16 nt, Homo sapiens
ucucccuuguccuccu

SEQ ID NO: 1978496 - RNA, 22 nt, Homo sapiens
aggguguucgguugcgugcaug

SEQ ID NO: 1978497 - RNA, 17 nt, Homo sapiens
cugagacugaagaccag

SEQ ID NO: 1978498 - RNA, 23 nt, Homo sapiens
caaaagguggcccuucacugucc

SEQ ID NO: 1978499 - RNA, 19 nt, Homo sapiens
aaaaguuuguuacuuugaa

SEQ ID NO: 1978500 - RNA, 17 nt, Homo sapiens
uguuagauuccucuugc

SEQ ID NO: 1978501 - RNA, 13 nt, Homo sapiens
cuugauaugacua

SEQ ID NO: 1978502 - RNA, 17 nt, Homo sapiens
cucaguaacacagugca

SEQ ID NO: 1978503 - RNA, 14 nt, Homo sapiens
auaaauacugcugu

SEQ ID NO: 1978504 - RNA, 18 nt, Homo sapiens
uugaacagcuugcugcua

SEQ ID NO: 1978505 - RNA, 19 nt, Homo sapiens
aaucuuuccuugucucuca

SEQ ID NO: 1978506 - RNA, 12 nt, Homo sapiens
gguagagucauu

SEQ ID NO: 1978507 - RNA, 16 nt, Homo sapiens
uuacuuuuaccacuau

SEQ ID NO: 1978508 - RNA, 18 nt, Homo sapiens
ugauuucugacucuauca

SEQ ID NO: 1978509 - RNA, 13 nt, Homo sapiens
uguacacuacagc

SEQ ID NO: 1978510 - RNA, 21 nt, Homo sapiens
uaauaaaacagcugucucuaa

SEQ ID NO: 1978511 - RNA, 18 nt, Homo sapiens
gcucccuuccucccaaaa

SEQ ID NO: 1978512 - RNA, 12 nt, Homo sapiens
aacauugccauu

SEQ ID NO: 1978513 - RNA, 19 nt, Homo sapiens
ccucugaggcacucaucua

SEQ ID NO: 1978514 - RNA, 23 nt, Homo sapiens
uacauugcuuaaaauauauagug

SEQ ID NO: 1978515 - RNA, 14 nt, Homo sapiens
cuuucauaguucug

SEQ ID NO: 1978516 - RNA, 21 nt, Homo sapiens
ugcagagccacagcugugcau

SEQ ID NO: 1978517 - RNA, 17 nt, Homo sapiens
acaaaacuucuugucag

SEQ ID NO: 1978518 - RNA, 19 nt, Homo sapiens
cgcacacacagauaugcac

SEQ ID NO: 1978519 - RNA, 19 nt, Homo sapiens
guuuuaucuuaacacugaa

SEQ ID NO: 1978520 - RNA, 12 nt, Homo sapiens
gagcucucugag

SEQ ID NO: 1978521 - RNA, 21 nt, Homo sapiens
agaagauggcagauacaggag

SEQ ID NO: 1978522 - RNA, 17 nt, Homo sapiens
ggccuggcacagugucu

SEQ ID NO: 1978523 - RNA, 12 nt, Homo sapiens
uccuccugaugg

SEQ ID NO: 1978524 - RNA, 19 nt, Homo sapiens
ugucuuaauuuucuuucac

SEQ ID NO: 1978525 - RNA, 21 nt, Homo sapiens
acaaaucugugcuacacugga

SEQ ID NO: 1978526 - RNA, 22 nt, Homo sapiens
cuccucuuucaaccucagugau

SEQ ID NO: 1978527 - RNA, 16 nt, Homo sapiens
aacuccccuacaucaa

SEQ ID NO: 1978528 - RNA, 13 nt, Homo sapiens
ugugauaugcaca

SEQ ID NO: 1978529 - RNA, 19 nt, Homo sapiens
agaccggcugguggagcug

SEQ ID NO: 1978530 - RNA, 18 nt, Homo sapiens
guagaaaaugcaccaaau

SEQ ID NO: 1978531 - RNA, 16 nt, Homo sapiens
auuguuuuaagccaau

SEQ ID NO: 1978532 - RNA, 21 nt, Homo sapiens
auuaauaaagcauucuuuaac

SEQ ID NO: 1978533 - RNA, 17 nt, Homo sapiens
uucaguggacccugugg

SEQ ID NO: 1978534 - RNA, 15 nt, Homo sapiens
aaccagcccaaccau

SEQ ID NO: 1978535 - RNA, 17 nt, Homo sapiens
aaguuuugcaacaauaa

SEQ ID NO: 1978536 - RNA, 15 nt, Homo sapiens
cucccucacccugag

SEQ ID NO: 1978537 - RNA, 21 nt, Homo sapiens
aauaguccaccucccauuacu

SEQ ID NO: 1978538 - RNA, 14 nt, Homo sapiens
ugagcuugauucua

SEQ ID NO: 1978539 - RNA, 20 nt, Homo sapiens
ggugaaccuuaguaccuaaa

SEQ ID NO: 1978540 - RNA, 14 nt, Homo sapiens
ccuucauaagccau

SEQ ID NO: 1978541 - RNA, 21 nt, Homo sapiens
agcucuuugucucaccagcuc

SEQ ID NO: 1978542 - RNA, 20 nt, Homo sapiens
ugcaccacuuuuaacagaac

SEQ ID NO: 1978543 - RNA, 15 nt, Homo sapiens
aaauaacaaguacca

SEQ ID NO: 1978544 - RNA, 16 nt, Homo sapiens
ccaccagccugcacua

SEQ ID NO: 1978545 - RNA, 14 nt, Homo sapiens
caggacuacagcuu

SEQ ID NO: 1978546 - RNA, 20 nt, Homo sapiens
agccgagcggggagccagga

SEQ ID NO: 1978547 - RNA, 16 nt, Homo sapiens
aagauucucgccccuu

SEQ ID NO: 1978548 - RNA, 22 nt, Homo sapiens
agguugugaugauagcacuggu

SEQ ID NO: 1978549 - RNA, 17 nt, Homo sapiens
uucuccaagaaacugaa

SEQ ID NO: 1978550 - RNA, 12 nt, Homo sapiens
acccgcagccuc

SEQ ID NO: 1978551 - RNA, 18 nt, Homo sapiens
gacacagaucaagggccu

SEQ ID NO: 1978552 - RNA, 18 nt, Homo sapiens
ugaaaaaguguacaugaa

SEQ ID NO: 1978553 - RNA, 22 nt, Homo sapiens
gccuggcccaagcccuccacau

SEQ ID NO: 1978554 - RNA, 17 nt, Homo sapiens
aagcagucaauuuucac

SEQ ID NO: 1978555 - RNA, 18 nt, Homo sapiens
gaggcugcugcugcugca

SEQ ID NO: 1978556 - RNA, 18 nt, Homo sapiens
cccauucugacauccaca

SEQ ID NO: 1978557 - RNA, 23 nt, Homo sapiens
cccugccuguggaggugaccugu

SEQ ID NO: 1978558 - RNA, 15 nt, Homo sapiens
aaaaaggaguauaca

SEQ ID NO: 1978559 - RNA, 22 nt, Homo sapiens
caucccuagucucuacccagua

SEQ ID NO: 1978560 - RNA, 15 nt, Homo sapiens
gaggaaacucaccug

SEQ ID NO: 1978561 - RNA, 13 nt, Homo sapiens
uuuagccauacac

SEQ ID NO: 1978562 - RNA, 21 nt, Homo sapiens
aaacugcagagagacaacaga

SEQ ID NO: 1978563 - RNA, 19 nt, Homo sapiens
aacuccuuuagcagguggu

SEQ ID NO: 1978564 - RNA, 20 nt, Homo sapiens
gugagugacaucgguucagg

SEQ ID NO: 1978565 - RNA, 19 nt, Homo sapiens
ugguuuucccaucucaggu

SEQ ID NO: 1978566 - RNA, 21 nt, Homo sapiens
uggacauuuugggcuggauaa

SEQ ID NO: 1978567 - RNA, 14 nt, Homo sapiens
ucuaacauauguau

SEQ ID NO: 1978568 - RNA, 23 nt, Homo sapiens
cauacuccgugaggcugcugcca

SEQ ID NO: 1978569 - RNA, 22 nt, Homo sapiens
gcugacaaggcacuucauguaa

SEQ ID NO: 1978570 - RNA, 17 nt, Homo sapiens
ccaucuugguccuguca

SEQ ID NO: 1978571 - RNA, 15 nt, Homo sapiens
uucagaaguuaacau

SEQ ID NO: 1978572 - RNA, 13 nt, Homo sapiens
augagcagggaug

SEQ ID NO: 1978573 - RNA, 13 nt, Homo sapiens
agaugcaggugag

SEQ ID NO: 1978574 - RNA, 14 nt, Homo sapiens
aaaacccaaacuuc

SEQ ID NO: 1978575 - RNA, 13 nt, Homo sapiens
caguagugccaaa

SEQ ID NO: 1978576 - RNA, 23 nt, Homo sapiens
ccucuggacuggaaagcacaaga

SEQ ID NO: 1978577 - RNA, 22 nt, Homo sapiens
ucucccucuggucuacucuaga

SEQ ID NO: 1978578 - RNA, 20 nt, Homo sapiens
aaggugggcggaucaccuga

SEQ ID NO: 1978579 - RNA, 20 nt, Homo sapiens
aagguggguggaucacuuga

SEQ ID NO: 1978580 - RNA, 17 nt, Homo sapiens
ugggcucuaaauccauu

SEQ ID NO: 1978581 - RNA, 17 nt, Homo sapiens
cacauuacuugcacaag

SEQ ID NO: 1978582 - RNA, 14 nt, Homo sapiens
cuuggagcuaaaac

SEQ ID NO: 1978583 - RNA, 23 nt, Homo sapiens
agucuuccuccucagucuucuca

SEQ ID NO: 1978584 - RNA, 13 nt, Homo sapiens
agaaaagcacauu

SEQ ID NO: 1978585 - RNA, 15 nt, Homo sapiens
agaaagaucaaagac

SEQ ID NO: 1978586 - RNA, 14 nt, Homo sapiens
cgaauggcagcaua

SEQ ID NO: 1978587 - RNA, 14 nt, Homo sapiens
uauuggaacauguc

SEQ ID NO: 1978588 - RNA, 17 nt, Homo sapiens
acaggaaagaugcauuu

SEQ ID NO: 1978589 - RNA, 13 nt, Homo sapiens
gaguaacuuagaa

SEQ ID NO: 1978590 - RNA, 13 nt, Homo sapiens
uccucacugccac

SEQ ID NO: 1978591 - RNA, 13 nt, Homo sapiens
uuauaacuguaaa

SEQ ID NO: 1978592 - RNA, 14 nt, Homo sapiens
aagccacgaaugaa

SEQ ID NO: 1978593 - RNA, 18 nt, Homo sapiens
uauuuuguuggaguauua

SEQ ID NO: 1978594 - RNA, 20 nt, Homo sapiens
ugaauaucgagaacugccau

SEQ ID NO: 1978595 - RNA, 19 nt, Homo sapiens
aucuuaacuucacuuccau

SEQ ID NO: 1978596 - RNA, 23 nt, Homo sapiens
auaacgcacaacuucgugcucag

SEQ ID NO: 1978597 - RNA, 21 nt, Homo sapiens
gucuccucggccacuuucagu

SEQ ID NO: 1978598 - RNA, 11 nt, Homo sapiens
ugccacuaauu

SEQ ID NO: 1978599 - RNA, 19 nt, Homo sapiens
agacuguuucacauugcac

SEQ ID NO: 1978600 - RNA, 15 nt, Homo sapiens
cucuuugccauuucu

SEQ ID NO: 1978601 - RNA, 20 nt, Homo sapiens
aaucaagcuagaaggccaca

SEQ ID NO: 1978602 - RNA, 22 nt, Homo sapiens
ucucaaaccaagcaaaggaagg

SEQ ID NO: 1978603 - RNA, 21 nt, Homo sapiens
acuuuaauugaagaacugcac

SEQ ID NO: 1978604 - RNA, 16 nt, Homo sapiens
gcaacccgguuuacca

SEQ ID NO: 1978605 - RNA, 21 nt, Homo sapiens
aucuuugcugaagcugagcua

SEQ ID NO: 1978606 - RNA, 17 nt, Homo sapiens
gcagccugcugcucuca

SEQ ID NO: 1978607 - RNA, 19 nt, Homo sapiens
ccugacuaaacuaccaccu

SEQ ID NO: 1978608 - RNA, 22 nt, Homo sapiens
cagcgcccccaucugucuucag

SEQ ID NO: 1978609 - RNA, 11 nt, Homo sapiens
caaauauugcu

SEQ ID NO: 1978610 - RNA, 21 nt, Homo sapiens
gcagcugucauggaaaagccc

SEQ ID NO: 1978611 - RNA, 22 nt, Homo sapiens
aaccaagccugcugucuuguga

SEQ ID NO: 1978612 - RNA, 21 nt, Homo sapiens
aaugaugugugcaaguacgac

SEQ ID NO: 1978613 - RNA, 12 nt, Homo sapiens
uaugcagcucau

SEQ ID NO: 1978614 - RNA, 21 nt, Homo sapiens
caaguaagagguuaugccaaa

SEQ ID NO: 1978615 - RNA, 22 nt, Homo sapiens
cuuuccauccccuagaaauccu

SEQ ID NO: 1978616 - RNA, 13 nt, Homo sapiens
uaguugaaaggga

SEQ ID NO: 1978617 - RNA, 16 nt, Homo sapiens
ugugaggugggcccca

SEQ ID NO: 1978618 - RNA, 14 nt, Homo sapiens
gcagccagcauuac

SEQ ID NO: 1978619 - RNA, 20 nt, Homo sapiens
cuaaagugcuggaacuuuag

SEQ ID NO: 1978620 - RNA, 20 nt, Homo sapiens
cuggaaguaagaaauauuac

SEQ ID NO: 1978621 - RNA, 13 nt, Homo sapiens
gugucucaggaaa

SEQ ID NO: 1978622 - RNA, 14 nt, Homo sapiens
acaguccccagagu

SEQ ID NO: 1978623 - RNA, 15 nt, Homo sapiens
aguauuucuguggau

SEQ ID NO: 1978624 - RNA, 23 nt, Homo sapiens
cuugaauggcaugcuaguagcag

SEQ ID NO: 1978625 - RNA, 23 nt, Homo sapiens
aaauggagaaauaggaccuucca

SEQ ID NO: 1978626 - RNA, 22 nt, Homo sapiens
ucacaggucccaaauggcccug

SEQ ID NO: 1978627 - RNA, 23 nt, Homo sapiens
acaguugguuuugcaugucugca

SEQ ID NO: 1978628 - RNA, 19 nt, Homo sapiens
ucuucguauucccauuaga

SEQ ID NO: 1978629 - RNA, 16 nt, Homo sapiens
ugccuucacuuuacaa

SEQ ID NO: 1978630 - RNA, 21 nt, Homo sapiens
uuauaaauuucgcuucuuaga

SEQ ID NO: 1978631 - RNA, 15 nt, Homo sapiens
ccucuucccucugau

SEQ ID NO: 1978632 - RNA, 21 nt, Homo sapiens
uguccccuuuccccagugaca

SEQ ID NO: 1978633 - RNA, 18 nt, Homo sapiens
cagcaccuuucucugaga

SEQ ID NO: 1978634 - RNA, 21 nt, Homo sapiens
uuccuuuugcaaacaauuuua

SEQ ID NO: 1978635 - RNA, 22 nt, Homo sapiens
agacucggauggggacauggag

SEQ ID NO: 1978636 - RNA, 20 nt, Homo sapiens
auuaaaccggaccaucucuc

SEQ ID NO: 1978637 - RNA, 14 nt, Homo sapiens
uucaaugaaccaca

SEQ ID NO: 1978638 - RNA, 23 nt, Homo sapiens
cagggcugacauuguggcacauu

SEQ ID NO: 1978639 - RNA, 14 nt, Homo sapiens
aaugauuguuuaaa

SEQ ID NO: 1978640 - RNA, 20 nt, Homo sapiens
uccuggaccuugacagagca

SEQ ID NO: 1978641 - RNA, 16 nt, Homo sapiens
aaugcuaugacuguau

SEQ ID NO: 1978642 - RNA, 16 nt, Homo sapiens
gugccaaagcuuuacu

SEQ ID NO: 1978643 - RNA, 15 nt, Homo sapiens
uggcucucuccagga

SEQ ID NO: 1978644 - RNA, 13 nt, Homo sapiens
ccaguaucuccaa

SEQ ID NO: 1978645 - RNA, 12 nt, Homo sapiens
cacugugcccag

SEQ ID NO: 1978646 - RNA, 17 nt, Homo sapiens
ugcacauguacccuaaa

SEQ ID NO: 1978647 - RNA, 13 nt, Homo sapiens
guggccaguauuu

SEQ ID NO: 1978648 - RNA, 24 nt, Homo sapiens
acacuucguucgcagagcuuuuca

SEQ ID NO: 1978649 - RNA, 15 nt, Homo sapiens
cucugggcacagugg

SEQ ID NO: 1978650 - RNA, 15 nt, Homo sapiens
ccuucuugcuucuca

SEQ ID NO: 1978651 - RNA, 22 nt, Homo sapiens
gaauuuaaucuuugaggaaaag

SEQ ID NO: 1978652 - RNA, 19 nt, Homo sapiens
uuccggggagaaacccaga

SEQ ID NO: 1978653 - RNA, 18 nt, Homo sapiens
accuggagaugaugauga

SEQ ID NO: 1978654 - RNA, 15 nt, Homo sapiens
ucaugaaacugucca

SEQ ID NO: 1978655 - RNA, 16 nt, Homo sapiens
auguacucuacgccaa

SEQ ID NO: 1978656 - RNA, 19 nt, Homo sapiens
aaugaugauccuaggcauu

SEQ ID NO: 1978657 - RNA, 13 nt, Homo sapiens
gaaauaugaucca

SEQ ID NO: 1978658 - RNA, 13 nt, Homo sapiens
auccuauggaaaa

SEQ ID NO: 1978659 - RNA, 23 nt, Homo sapiens
agcuggcgaacccugggccaucc

SEQ ID NO: 1978660 - RNA, 23 nt, Homo sapiens
aguauuccuguugcugucuucag

SEQ ID NO: 1978661 - RNA, 18 nt, Homo sapiens
gucaaaaccaagucacuu

SEQ ID NO: 1978662 - RNA, 18 nt, Homo sapiens
acuuaauugccagcaaau

SEQ ID NO: 1978663 - RNA, 23 nt, Homo sapiens
cgucagccagcucccagccacau

SEQ ID NO: 1978664 - RNA, 19 nt, Homo sapiens
cugucuuugaguuguggug

SEQ ID NO: 1978665 - RNA, 17 nt, Homo sapiens
guccaugguccaucacu

SEQ ID NO: 1978666 - RNA, 22 nt, Homo sapiens
ugagccccugaggacaggggca

SEQ ID NO: 1978667 - RNA, 13 nt, Homo sapiens
gcucuucauuuau

SEQ ID NO: 1978668 - RNA, 16 nt, Homo sapiens
auucuaugucaaugau

SEQ ID NO: 1978669 - RNA, 17 nt, Homo sapiens
aaagucccaacccaaug

SEQ ID NO: 1978670 - RNA, 12 nt, Homo sapiens
uucugaucucag

SEQ ID NO: 1978671 - RNA, 21 nt, Homo sapiens
uucugacacuuucugcuggaa

SEQ ID NO: 1978672 - RNA, 21 nt, Homo sapiens
uuguguaauauauuguacacu

SEQ ID NO: 1978673 - RNA, 21 nt, Homo sapiens
aauagucuaaggccauggcau

SEQ ID NO: 1978674 - RNA, 21 nt, Homo sapiens
augcugauguccucaccacau

SEQ ID NO: 1978675 - RNA, 23 nt, Homo sapiens
uugaggugcgcucaccucagagc

SEQ ID NO: 1978676 - RNA, 16 nt, Homo sapiens
gcagaguaaguauuau

SEQ ID NO: 1978677 - RNA, 12 nt, Homo sapiens
cgcuuggcauca

SEQ ID NO: 1978678 - RNA, 14 nt, Homo sapiens
ccuggauuugcaua

SEQ ID NO: 1978679 - RNA, 17 nt, Homo sapiens
agucccuccacauuucc

SEQ ID NO: 1978680 - RNA, 17 nt, Homo sapiens
gagcugagccagucaug

SEQ ID NO: 1978681 - RNA, 16 nt, Homo sapiens
uuucaacagucuugcu

SEQ ID NO: 1978682 - RNA, 14 nt, Homo sapiens
auacucucuucccu

SEQ ID NO: 1978683 - RNA, 14 nt, Homo sapiens
ucauuuucaccucc

SEQ ID NO: 1978684 - RNA, 18 nt, Homo sapiens
gaggaggggguaggugau

SEQ ID NO: 1978685 - RNA, 14 nt, Homo sapiens
gcuuccacuucuau

SEQ ID NO: 1978686 - RNA, 19 nt, Homo sapiens
ccaucugaacacaaccaga

SEQ ID NO: 1978687 - RNA, 19 nt, Homo sapiens
aagcuaaugugcagggaua

SEQ ID NO: 1978688 - RNA, 23 nt, Homo sapiens
auucccaaucccauuccugggcu

SEQ ID NO: 1978689 - RNA, 15 nt, Homo sapiens
ugcagcucaacuuuc

SEQ ID NO: 1978690 - RNA, 20 nt, Homo sapiens
aaauucccccacuugggagc

SEQ ID NO: 1978691 - RNA, 13 nt, Homo sapiens
guuggggagcuga

SEQ ID NO: 1978692 - RNA, 15 nt, Homo sapiens
cugcauagcaguuug

SEQ ID NO: 1978693 - RNA, 14 nt, Homo sapiens
ccucuuauugcaaa

SEQ ID NO: 1978694 - RNA, 18 nt, Homo sapiens
auuugucgauauuuccau

SEQ ID NO: 1978695 - RNA, 20 nt, Homo sapiens
cacucagaggcccccagugg

SEQ ID NO: 1978696 - RNA, 20 nt, Homo sapiens
ugaccaagauacuuaagugc

SEQ ID NO: 1978697 - RNA, 15 nt, Homo sapiens
ucagccccaggagaa

SEQ ID NO: 1978698 - RNA, 22 nt, Homo sapiens
ucuguuugcuguggaacuacau

SEQ ID NO: 1978699 - RNA, 23 nt, Homo sapiens
agagaccugcucaggcgucgcug

SEQ ID NO: 1978700 - RNA, 20 nt, Homo sapiens
aggcagagggucacuuuaca

SEQ ID NO: 1978701 - RNA, 15 nt, Homo sapiens
auaaagagagcccua

SEQ ID NO: 1978702 - RNA, 15 nt, Homo sapiens
caugaaaauuacaac

SEQ ID NO: 1978703 - RNA, 16 nt, Homo sapiens
uaaaccucaaaauguc

SEQ ID NO: 1978704 - RNA, 15 nt, Homo sapiens
guuuggucacugcua

SEQ ID NO: 1978705 - RNA, 19 nt, Homo sapiens
gcaccaaaucaucucucau

SEQ ID NO: 1978706 - RNA, 22 nt, Homo sapiens
agaugucuuaaccuauucccaa

SEQ ID NO: 1978707 - RNA, 17 nt, Homo sapiens
uugucaaugauuuguca

SEQ ID NO: 1978708 - RNA, 22 nt, Homo sapiens
ugcuuuucccuagugcugguau

SEQ ID NO: 1978709 - RNA, 14 nt, Homo sapiens
auaaacacccauga

SEQ ID NO: 1978710 - RNA, 23 nt, Homo sapiens
gaagaauugaccuugaccauuaa

SEQ ID NO: 1978711 - RNA, 14 nt, Homo sapiens
ugaauaaaugucac

SEQ ID NO: 1978712 - RNA, 13 nt, Homo sapiens
uaggaauuggugu

SEQ ID NO: 1978713 - RNA, 17 nt, Homo sapiens
guuuuuaaguuugcacu

SEQ ID NO: 1978714 - RNA, 23 nt, Homo sapiens
gcucguuuccccacacaugccua

SEQ ID NO: 1978715 - RNA, 20 nt, Homo sapiens
uacuuggucuggccacuguc

SEQ ID NO: 1978716 - RNA, 12 nt, Homo sapiens
uuuaaauuuugu

SEQ ID NO: 1978717 - RNA, 19 nt, Homo sapiens
cugugaccugcugagcucu

SEQ ID NO: 1978718 - RNA, 18 nt, Homo sapiens
uggaauuauucuauguca

SEQ ID NO: 1978719 - RNA, 12 nt, Homo sapiens
augacagugaau

SEQ ID NO: 1978720 - RNA, 16 nt, Homo sapiens
ccccacuuuauugcca

SEQ ID NO: 1978721 - RNA, 13 nt, Homo sapiens
uaaggagccuuuc

SEQ ID NO: 1978722 - RNA, 23 nt, Homo sapiens
ccaggaaacagccucaguggcca

SEQ ID NO: 1978723 - RNA, 15 nt, Homo sapiens
aacucacaauuccaa

SEQ ID NO: 1978724 - RNA, 21 nt, Homo sapiens
auuaaauuuuagaucuuucaa

SEQ ID NO: 1978725 - RNA, 21 nt, Homo sapiens
agcccagcucaugcacaucag

SEQ ID NO: 1978726 - RNA, 22 nt, Homo sapiens
ugccucccacccuucucaggga

SEQ ID NO: 1978727 - RNA, 15 nt, Homo sapiens
cucuguaauugcaaa

SEQ ID NO: 1978728 - RNA, 15 nt, Homo sapiens
uucugaaacugcaua

SEQ ID NO: 1978729 - RNA, 15 nt, Homo sapiens
aagaaauaaucucua

SEQ ID NO: 1978730 - RNA, 18 nt, Homo sapiens
acucugccugaacacugc

SEQ ID NO: 1978731 - RNA, 18 nt, Homo sapiens
gaccaccaacacacagga

SEQ ID NO: 1978732 - RNA, 12 nt, Homo sapiens
aauaacacugua

SEQ ID NO: 1978733 - RNA, 12 nt, Homo sapiens
uaccacacagcc

SEQ ID NO: 1978734 - RNA, 18 nt, Homo sapiens
cccuguggccuuaugagc

SEQ ID NO: 1978735 - RNA, 20 nt, Homo sapiens
cucaugccccuaaucccagc

SEQ ID NO: 1978736 - RNA, 21 nt, Homo sapiens
ugcuuucuauuuuacauugag

SEQ ID NO: 1978737 - RNA, 15 nt, Homo sapiens
uuaauucagucucag

SEQ ID NO: 1978738 - RNA, 15 nt, Homo sapiens
cagagaguccagcua

SEQ ID NO: 1978739 - RNA, 23 nt, Homo sapiens
aguugcuaacuuaaaaaacugca

SEQ ID NO: 1978740 - RNA, 22 nt, Homo sapiens
uccaagaagcccuccuugccac

SEQ ID NO: 1978741 - RNA, 15 nt, Homo sapiens
agugaggccauagca

SEQ ID NO: 1978742 - RNA, 14 nt, Homo sapiens
gucuaaauaccuau

SEQ ID NO: 1978743 - RNA, 18 nt, Homo sapiens
gccaggcaccguggcuca

SEQ ID NO: 1978744 - RNA, 21 nt, Homo sapiens
acaggaucauguaaaugcuca

SEQ ID NO: 1978745 - RNA, 19 nt, Homo sapiens
ugugacccucucacuuugg

SEQ ID NO: 1978746 - RNA, 18 nt, Homo sapiens
gcuuugugccaucacuga

SEQ ID NO: 1978747 - RNA, 15 nt, Homo sapiens
uaauacaaacuaauu

SEQ ID NO: 1978748 - RNA, 17 nt, Homo sapiens
cucucuggauacugcaa

SEQ ID NO: 1978749 - RNA, 22 nt, Homo sapiens
ugagaugggagaaucacuugaa

SEQ ID NO: 1978750 - RNA, 16 nt, Homo sapiens
uccagaggguugugau

SEQ ID NO: 1978751 - RNA, 15 nt, Homo sapiens
cugaacauaguuuuc

SEQ ID NO: 1978752 - RNA, 23 nt, Homo sapiens
ucugcuugguguaaaccauucuu

SEQ ID NO: 1978753 - RNA, 22 nt, Homo sapiens
uuucccaccaccuuggacuccu

SEQ ID NO: 1978754 - RNA, 15 nt, Homo sapiens
agacuuggggaccag

SEQ ID NO: 1978755 - RNA, 17 nt, Homo sapiens
ucugggaauccuggaca

SEQ ID NO: 1978756 - RNA, 13 nt, Homo sapiens
uugccacauuuag

SEQ ID NO: 1978757 - RNA, 17 nt, Homo sapiens
uuucaccuguauugaau

SEQ ID NO: 1978758 - RNA, 13 nt, Homo sapiens
ugugaaagugcac

SEQ ID NO: 1978759 - RNA, 14 nt, Homo sapiens
cacucucuacuggu

SEQ ID NO: 1978760 - RNA, 22 nt, Homo sapiens
ggagcccggcuuccacucccca

SEQ ID NO: 1978761 - RNA, 19 nt, Homo sapiens
ucccucaaaugacccaaag

SEQ ID NO: 1978762 - RNA, 22 nt, Homo sapiens
ggccaaggagggugagugcaag

SEQ ID NO: 1978763 - RNA, 15 nt, Homo sapiens
uuucuguaaccaaaa

SEQ ID NO: 1978764 - RNA, 15 nt, Homo sapiens
caauuuguauaaaau

SEQ ID NO: 1978765 - RNA, 15 nt, Homo sapiens
ccugcuagucacugg

SEQ ID NO: 1978766 - RNA, 20 nt, Homo sapiens
uagcaaacaccaccaaguuc

SEQ ID NO: 1978767 - RNA, 20 nt, Homo sapiens
auacaauuuuuuuuauuagu

SEQ ID NO: 1978768 - RNA, 21 nt, Homo sapiens
ggcccugucugugugcugagc

SEQ ID NO: 1978769 - RNA, 23 nt, Homo sapiens
cccuaaggaaaucaaaucccauu

SEQ ID NO: 1978770 - RNA, 15 nt, Homo sapiens
cagagaaaguuccau

SEQ ID NO: 1978771 - RNA, 14 nt, Homo sapiens
ucugggcucugagu

SEQ ID NO: 1978772 - RNA, 16 nt, Homo sapiens
gcaaguauccagaccu

SEQ ID NO: 1978773 - RNA, 18 nt, Homo sapiens
gaaagcccgccucugucc

SEQ ID NO: 1978774 - RNA, 13 nt, Homo sapiens
cuuucacaucucu

SEQ ID NO: 1978775 - RNA, 13 nt, Homo sapiens
uccuuacacuccc

SEQ ID NO: 1978776 - RNA, 18 nt, Homo sapiens
cugaaugauuuccaaaga

SEQ ID NO: 1978777 - RNA, 20 nt, Homo sapiens
ggauacugcccggggcagcu

SEQ ID NO: 1978778 - RNA, 14 nt, Homo sapiens
cuccuucaaugcaa

SEQ ID NO: 1978779 - RNA, 14 nt, Homo sapiens
aaccucaaaacugu

SEQ ID NO: 1978780 - RNA, 16 nt, Homo sapiens
gacugcuaccuuucaa

SEQ ID NO: 1978781 - RNA, 12 nt, Homo sapiens
caacuccuggaa

SEQ ID NO: 1978782 - RNA, 14 nt, Homo sapiens
cuaauauggcaaaa

SEQ ID NO: 1978783 - RNA, 18 nt, Homo sapiens
aggugcagggaagugcag

SEQ ID NO: 1978784 - RNA, 14 nt, Homo sapiens
gggaagacaguggc

SEQ ID NO: 1978785 - RNA, 16 nt, Homo sapiens
aagauaggaguucucu

SEQ ID NO: 1978786 - RNA, 22 nt, Homo sapiens
gcacacaccacacacagcuaac

SEQ ID NO: 1978787 - RNA, 13 nt, Homo sapiens
aacucaucuucac

SEQ ID NO: 1978788 - RNA, 13 nt, Homo sapiens
cccagagcugccu

SEQ ID NO: 1978789 - RNA, 21 nt, Homo sapiens
ugcugagcaaaguucagcaag

SEQ ID NO: 1978790 - RNA, 16 nt, Homo sapiens
agccccucucuacugu

SEQ ID NO: 1978791 - RNA, 14 nt, Homo sapiens
gcuggcgccaucug

SEQ ID NO: 1978792 - RNA, 22 nt, Homo sapiens
cagcccaagauucuucagucug

SEQ ID NO: 1978793 - RNA, 19 nt, Homo sapiens
acaucaauaaauacuuuaa

SEQ ID NO: 1978794 - RNA, 18 nt, Homo sapiens
auauuucacagcaccaaa

SEQ ID NO: 1978795 - RNA, 15 nt, Homo sapiens
gcuuccacuguguuc

SEQ ID NO: 1978796 - RNA, 19 nt, Homo sapiens
ggguccuccuccagggaca

SEQ ID NO: 1978797 - RNA, 20 nt, Homo sapiens
cccuguccugcagucccaca

SEQ ID NO: 1978798 - RNA, 12 nt, Homo sapiens
ccagccaccacu

SEQ ID NO: 1978799 - RNA, 20 nt, Homo sapiens
gucaagaccagccugggcaa

SEQ ID NO: 1978800 - RNA, 19 nt, Homo sapiens
cgaacaaacugaugcgaaa

SEQ ID NO: 1978801 - RNA, 14 nt, Homo sapiens
aggcacacacugug

SEQ ID NO: 1978802 - RNA, 16 nt, Homo sapiens
aaauacacuaacagga

SEQ ID NO: 1978803 - RNA, 16 nt, Homo sapiens
ccugcccagugcacac

SEQ ID NO: 1978804 - RNA, 18 nt, Homo sapiens
cagugugauaaggacuuu

SEQ ID NO: 1978805 - RNA, 14 nt, Homo sapiens
uaaaauguaugcau

SEQ ID NO: 1978806 - RNA, 20 nt, Homo sapiens
guagcuuccuccaacccgca

SEQ ID NO: 1978807 - RNA, 19 nt, Homo sapiens
ccagcaauaggguggcaca

SEQ ID NO: 1978808 - RNA, 15 nt, Homo sapiens
uaaugcugaaacauc

SEQ ID NO: 1978809 - RNA, 23 nt, Homo sapiens
aacggcuaaccuggaccuggaac

SEQ ID NO: 1978810 - RNA, 17 nt, Homo sapiens
aacugcugcugugcaca

SEQ ID NO: 1978811 - RNA, 14 nt, Homo sapiens
auauuaacauucuu

SEQ ID NO: 1978812 - RNA, 16 nt, Homo sapiens
ccagucgagaccucac

SEQ ID NO: 1978813 - RNA, 17 nt, Homo sapiens
ugcggugccaugaaggg

SEQ ID NO: 1978814 - RNA, 20 nt, Homo sapiens
uuugcugcugcuuaauccua

SEQ ID NO: 1978815 - RNA, 20 nt, Homo sapiens
cacccccuucucugcuccac

SEQ ID NO: 1978816 - RNA, 19 nt, Homo sapiens
acacugcagugaccacuua

SEQ ID NO: 1978817 - RNA, 20 nt, Homo sapiens
uagaaagcuggcaacaugaa

SEQ ID NO: 1978818 - RNA, 21 nt, Homo sapiens
acauaauuggacucugucaca

SEQ ID NO: 1978819 - RNA, 17 nt, Homo sapiens
uagagauggggguuuca

SEQ ID NO: 1978820 - RNA, 18 nt, Homo sapiens
ugcuacaaaaacacagca

SEQ ID NO: 1978821 - RNA, 22 nt, Homo sapiens
uucagcauuauugaaauuguaa

SEQ ID NO: 1978822 - RNA, 19 nt, Homo sapiens
gagcaguucaugacccagg

SEQ ID NO: 1978823 - RNA, 14 nt, Homo sapiens
uaaauagugcagaa

SEQ ID NO: 1978824 - RNA, 20 nt, Homo sapiens
gauggguuuuguuaggggug

SEQ ID NO: 1978825 - RNA, 20 nt, Homo sapiens
uuaaauauaaauauccccag

SEQ ID NO: 1978826 - RNA, 21 nt, Homo sapiens
agcuaaaagaggccuguucau

SEQ ID NO: 1978827 - RNA, 19 nt, Homo sapiens
uucaaaagaugccauucau

SEQ ID NO: 1978828 - RNA, 17 nt, Homo sapiens
agugauaugauguguag

SEQ ID NO: 1978829 - RNA, 13 nt, Homo sapiens
ucgugcacucugc

SEQ ID NO: 1978830 - RNA, 14 nt, Homo sapiens
uucuccucaucucc

SEQ ID NO: 1978831 - RNA, 15 nt, Homo sapiens
gacaagauaaaggaa

SEQ ID NO: 1978832 - RNA, 22 nt, Homo sapiens
uuagggauaguacuaagcauuu

SEQ ID NO: 1978833 - RNA, 21 nt, Homo sapiens
ugcgccaucuucacauucuga

SEQ ID NO: 1978834 - RNA, 14 nt, Homo sapiens
cauguguguacaug

SEQ ID NO: 1978835 - RNA, 21 nt, Homo sapiens
ugcuugacaacaaccuaugca

SEQ ID NO: 1978836 - RNA, 15 nt, Homo sapiens
caucugacucacaag

SEQ ID NO: 1978837 - RNA, 18 nt, Homo sapiens
gcacuuuucugugucaua

SEQ ID NO: 1978838 - RNA, 17 nt, Homo sapiens
cugaccucacugugacc

SEQ ID NO: 1978839 - RNA, 20 nt, Homo sapiens
acccaaauaaauguguaaau

SEQ ID NO: 1978840 - RNA, 18 nt, Homo sapiens
agauucccuugcacugua

SEQ ID NO: 1978841 - RNA, 22 nt, Homo sapiens
gaaucagugaagccaaagggac

SEQ ID NO: 1978842 - RNA, 17 nt, Homo sapiens
gccauaauucuaaguua

SEQ ID NO: 1978843 - RNA, 18 nt, Homo sapiens
ggguauugugugagugca

SEQ ID NO: 1978844 - RNA, 22 nt, Homo sapiens
gccccuucugaggaugcugaga

SEQ ID NO: 1978845 - RNA, 19 nt, Homo sapiens
ugacggcaccaucuggaag

SEQ ID NO: 1978846 - RNA, 19 nt, Homo sapiens
gaccucuugcugccagcua

SEQ ID NO: 1978847 - RNA, 13 nt, Homo sapiens
cuuacuauagucu

SEQ ID NO: 1978848 - RNA, 16 nt, Homo sapiens
aagugcugcacucaaa

SEQ ID NO: 1978849 - RNA, 20 nt, Homo sapiens
cuggagugcaauggugugau

SEQ ID NO: 1978850 - RNA, 16 nt, Homo sapiens
aauaaauacucaguga

SEQ ID NO: 1978851 - RNA, 16 nt, Homo sapiens
ugccccguuucuugcc

SEQ ID NO: 1978852 - RNA, 20 nt, Homo sapiens
cuguuucuaauuugcugcug

SEQ ID NO: 1978853 - RNA, 15 nt, Homo sapiens
uucaaauccauagau

SEQ ID NO: 1978854 - RNA, 20 nt, Homo sapiens
cuagagcugacagcuuuguu

SEQ ID NO: 1978855 - RNA, 14 nt, Homo sapiens
gauuacugucaaua

SEQ ID NO: 1978856 - RNA, 13 nt, Homo sapiens
uaguauuggagca

SEQ ID NO: 1978857 - RNA, 18 nt, Homo sapiens
uguuuagucuaccaaaaa

SEQ ID NO: 1978858 - RNA, 21 nt, Homo sapiens
uuuucccugcaccacucucuu

SEQ ID NO: 1978859 - RNA, 20 nt, Homo sapiens
augcacauauggacucugca

SEQ ID NO: 1978860 - RNA, 20 nt, Homo sapiens
ggacaaucugcaaaauggag

SEQ ID NO: 1978861 - RNA, 13 nt, Homo sapiens
caucuucuuuuaa

SEQ ID NO: 1978862 - RNA, 22 nt, Homo sapiens
ccggcugcccccaucaccucua

SEQ ID NO: 1978863 - RNA, 22 nt, Homo sapiens
cuuccuggaaugcauucacuca

SEQ ID NO: 1978864 - RNA, 14 nt, Homo sapiens
cuguaucagucuuu

SEQ ID NO: 1978865 - RNA, 14 nt, Homo sapiens
gucuuccacuguac

SEQ ID NO: 1978866 - RNA, 16 nt, Homo sapiens
uucaguucauucccag

SEQ ID NO: 1978867 - RNA, 12 nt, Homo sapiens
ccaaagcugcag

SEQ ID NO: 1978868 - RNA, 22 nt, Homo sapiens
cacuggauugacuuugcuguca

SEQ ID NO: 1978869 - RNA, 18 nt, Homo sapiens
acgugcacaaauucaugu

SEQ ID NO: 1978870 - RNA, 13 nt, Homo sapiens
caggacccaggga

SEQ ID NO: 1978871 - RNA, 16 nt, Homo sapiens
guacuccuuaagaaca

SEQ ID NO: 1978872 - RNA, 23 nt, Homo sapiens
cacugcuguauuuuuauuuuugc

SEQ ID NO: 1978873 - RNA, 13 nt, Homo sapiens
guuucccucugua

SEQ ID NO: 1978874 - RNA, 20 nt, Homo sapiens
aaauaguguaagaacuguac

SEQ ID NO: 1978875 - RNA, 20 nt, Homo sapiens
cgcgcaccuguaaucccagc

SEQ ID NO: 1978876 - RNA, 21 nt, Homo sapiens
auuuguauucucugcaauuuu

SEQ ID NO: 1978877 - RNA, 15 nt, Homo sapiens
cugcuacaacuucag

SEQ ID NO: 1978878 - RNA, 17 nt, Homo sapiens
gcaacucuaacucugag

SEQ ID NO: 1978879 - RNA, 21 nt, Homo sapiens
caccucaugagucuaccugag

SEQ ID NO: 1978880 - RNA, 17 nt, Homo sapiens
ugaucagaguuccuccu

SEQ ID NO: 1978881 - RNA, 17 nt, Homo sapiens
guggacuacaggacaag

SEQ ID NO: 1978882 - RNA, 21 nt, Homo sapiens
ucagugccaaaaacaacaaca

SEQ ID NO: 1978883 - RNA, 14 nt, Homo sapiens
acaagcauuccuua

SEQ ID NO: 1978884 - RNA, 18 nt, Homo sapiens
cagccucacugcaucuuu

SEQ ID NO: 1978885 - RNA, 17 nt, Homo sapiens
gaccaauggguuugcca

SEQ ID NO: 1978886 - RNA, 15 nt, Homo sapiens
aaaaaccugauggaa

SEQ ID NO: 1978887 - RNA, 19 nt, Homo sapiens
cuauuccagcucauucauu

SEQ ID NO: 1978888 - RNA, 17 nt, Homo sapiens
ucugucaacaucaaaga

SEQ ID NO: 1978889 - RNA, 19 nt, Homo sapiens
guuuauuaaaaaaauggaa

SEQ ID NO: 1978890 - RNA, 13 nt, Homo sapiens
gaauuuuagcaca

SEQ ID NO: 1978891 - RNA, 12 nt, Homo sapiens
agaaaaaagaga

SEQ ID NO: 1978892 - RNA, 15 nt, Homo sapiens
aaucucuugucucac

SEQ ID NO: 1978893 - RNA, 15 nt, Homo sapiens
ugcagucaagcccug

SEQ ID NO: 1978894 - RNA, 20 nt, Homo sapiens
agaagcuuguauuaucagug

SEQ ID NO: 1978895 - RNA, 15 nt, Homo sapiens
uguuggcaguguuug

SEQ ID NO: 1978896 - RNA, 19 nt, Homo sapiens
ucaagauauauguguauac

SEQ ID NO: 1978897 - RNA, 13 nt, Homo sapiens
uccucacuuugaa

SEQ ID NO: 1978898 - RNA, 14 nt, Homo sapiens
cucuguuccugucc

SEQ ID NO: 1978899 - RNA, 17 nt, Homo sapiens
ccuggaggaacugcuug

SEQ ID NO: 1978900 - RNA, 17 nt, Homo sapiens
agaaugaaacaauccaa

SEQ ID NO: 1978901 - RNA, 18 nt, Homo sapiens
uacagguuuuaaaagccu

SEQ ID NO: 1978902 - RNA, 23 nt, Homo sapiens
uggaaaaguucuuuacuggugau

SEQ ID NO: 1978903 - RNA, 17 nt, Homo sapiens
auuugccaauuuacuuu

SEQ ID NO: 1978904 - RNA, 15 nt, Homo sapiens
ucucugaugauguca

SEQ ID NO: 1978905 - RNA, 22 nt, Homo sapiens
ucugauacaucugucagugagu

SEQ ID NO: 1978906 - RNA, 17 nt, Homo sapiens
acugcaaacauguugcc

SEQ ID NO: 1978907 - RNA, 14 nt, Homo sapiens
uguaucaaacugua

SEQ ID NO: 1978908 - RNA, 23 nt, Homo sapiens
caacucagagcacagccaaucuc

SEQ ID NO: 1978909 - RNA, 15 nt, Homo sapiens
cuggacugaggacca

SEQ ID NO: 1978910 - RNA, 15 nt, Homo sapiens
gagggugagguugca

SEQ ID NO: 1978911 - RNA, 19 nt, Homo sapiens
uaaacacauguucugugcc

SEQ ID NO: 1978912 - RNA, 21 nt, Homo sapiens
uuaacuggacugaauucaaau

SEQ ID NO: 1978913 - RNA, 21 nt, Homo sapiens
ucuggaccauauaccaucucc

SEQ ID NO: 1978914 - RNA, 23 nt, Homo sapiens
aaaguauuuaucuccugucuaca

SEQ ID NO: 1978915 - RNA, 15 nt, Homo sapiens
cccacauauggcaca

SEQ ID NO: 1978916 - RNA, 15 nt, Homo sapiens
cccagccuucacuga

SEQ ID NO: 1978917 - RNA, 19 nt, Homo sapiens
aaacacaucauaauggauu

SEQ ID NO: 1978918 - RNA, 14 nt, Homo sapiens
cugcccugucuccc

SEQ ID NO: 1978919 - RNA, 21 nt, Homo sapiens
aguccaggguggaugaucuca

SEQ ID NO: 1978920 - RNA, 17 nt, Homo sapiens
agacauaggccaugaaa

SEQ ID NO: 1978921 - RNA, 22 nt, Homo sapiens
caggauuuuagugcuugccacc

SEQ ID NO: 1978922 - RNA, 11 nt, Homo sapiens
aaauaaucucu

SEQ ID NO: 1978923 - RNA, 14 nt, Homo sapiens
gcccaaagccuuca

SEQ ID NO: 1978924 - RNA, 15 nt, Homo sapiens
gugccuggacauuug

SEQ ID NO: 1978925 - RNA, 18 nt, Homo sapiens
gcagguccccugcccuga

SEQ ID NO: 1978926 - RNA, 17 nt, Homo sapiens
aaucucaaaguguacaa

SEQ ID NO: 1978927 - RNA, 16 nt, Homo sapiens
ucaaaaccugugccag

SEQ ID NO: 1978928 - RNA, 11 nt, Homo sapiens
cacagacuccg

SEQ ID NO: 1978929 - RNA, 22 nt, Homo sapiens
acaaggugucuuuuccacuccu

SEQ ID NO: 1978930 - RNA, 19 nt, Homo sapiens
uagaaccaccaacaagcaa

SEQ ID NO: 1978931 - RNA, 17 nt, Homo sapiens
gcugcuggggaagacag

SEQ ID NO: 1978932 - RNA, 22 nt, Homo sapiens
aacaagauuuccacaauucuuc

SEQ ID NO: 1978933 - RNA, 14 nt, Homo sapiens
auuuggagugaugg

SEQ ID NO: 1978934 - RNA, 16 nt, Homo sapiens
cucacaguguuuuaga

SEQ ID NO: 1978935 - RNA, 21 nt, Homo sapiens
gcucuguccagaggcuuuaaa

SEQ ID NO: 1978936 - RNA, 21 nt, Homo sapiens
accuccccacccgcucccaca

SEQ ID NO: 1978937 - RNA, 16 nt, Homo sapiens
augaaaacagucccau

SEQ ID NO: 1978938 - RNA, 19 nt, Homo sapiens
aggaagggucaaaacauuu

SEQ ID NO: 1978939 - RNA, 15 nt, Homo sapiens
aggcucaaauuuuga

SEQ ID NO: 1978940 - RNA, 23 nt, Homo sapiens
agccuacaaugcugcgucuccca

SEQ ID NO: 1978941 - RNA, 15 nt, Homo sapiens
gacuaccaauuucuu

SEQ ID NO: 1978942 - RNA, 14 nt, Homo sapiens
uguauuuauuucau

SEQ ID NO: 1978943 - RNA, 13 nt, Homo sapiens
gcaccugaccaca

SEQ ID NO: 1978944 - RNA, 22 nt, Homo sapiens
aagucaucuguuuaauuuacac

SEQ ID NO: 1978945 - RNA, 13 nt, Homo sapiens
uacagucauucca

SEQ ID NO: 1978946 - RNA, 23 nt, Homo sapiens
agccaaauaaaaucuauacauac

SEQ ID NO: 1978947 - RNA, 13 nt, Homo sapiens
gaaacaacagcuu

SEQ ID NO: 1978948 - RNA, 17 nt, Homo sapiens
caaggcuggcaggucaa

SEQ ID NO: 1978949 - RNA, 23 nt, Homo sapiens
gaacaguuuaugcagugcugcuu

SEQ ID NO: 1978950 - RNA, 18 nt, Homo sapiens
ugcuauggagcaaaucca

SEQ ID NO: 1978951 - RNA, 23 nt, Homo sapiens
ccuaaaacucaaaacacccaaaa

SEQ ID NO: 1978952 - RNA, 18 nt, Homo sapiens
uguucaaaccucugccgc

SEQ ID NO: 1978953 - RNA, 13 nt, Homo sapiens
cccuccugcuccu

SEQ ID NO: 1978954 - RNA, 21 nt, Homo sapiens
gcacucaguguggacugggaa

SEQ ID NO: 1978955 - RNA, 16 nt, Homo sapiens
gcccccaccucagguu

SEQ ID NO: 1978956 - RNA, 15 nt, Homo sapiens
cucuucccacuccag

SEQ ID NO: 1978957 - RNA, 19 nt, Homo sapiens
gcucauugcuguaccacau

SEQ ID NO: 1978958 - RNA, 18 nt, Homo sapiens
uggcgcuggauguggauu

SEQ ID NO: 1978959 - RNA, 22 nt, Homo sapiens
gagacauacuugaagggccaga

SEQ ID NO: 1978960 - RNA, 22 nt, Homo sapiens
ccuggugaccagaccaaggcag

SEQ ID NO: 1978961 - RNA, 11 nt, Homo sapiens
acuuacccuca

SEQ ID NO: 1978962 - RNA, 22 nt, Homo sapiens
caacuccaggauuuaggccuua

SEQ ID NO: 1978963 - RNA, 18 nt, Homo sapiens
uucuugacaaaaccuaac

SEQ ID NO: 1978964 - RNA, 21 nt, Homo sapiens
uaaauauuuagucugcauugc

SEQ ID NO: 1978965 - RNA, 21 nt, Homo sapiens
acagcuugaguggguucucug

SEQ ID NO: 1978966 - RNA, 16 nt, Homo sapiens
guaaauaguauuugag

SEQ ID NO: 1978967 - RNA, 14 nt, Homo sapiens
ucuccugggcagcu

SEQ ID NO: 1978968 - RNA, 21 nt, Homo sapiens
guccuagagugccuccagggu

SEQ ID NO: 1978969 - RNA, 21 nt, Homo sapiens
gauaaaaaauuuauuaugucc

SEQ ID NO: 1978970 - RNA, 22 nt, Homo sapiens
ggcuggcccucucauucucacu

SEQ ID NO: 1978971 - RNA, 18 nt, Homo sapiens
acccaucguucucugcua

SEQ ID NO: 1978972 - RNA, 13 nt, Homo sapiens
acaucuuucacau

SEQ ID NO: 1978973 - RNA, 15 nt, Homo sapiens
gguagguugggacac

SEQ ID NO: 1978974 - RNA, 16 nt, Homo sapiens
gcucacucggcuucca

SEQ ID NO: 1978975 - RNA, 15 nt, Homo sapiens
uaaaacuccuguuuc

SEQ ID NO: 1978976 - RNA, 19 nt, Homo sapiens
uuagugugugugcaugugu

SEQ ID NO: 1978977 - RNA, 19 nt, Homo sapiens
acucugaccacagcccgcu

SEQ ID NO: 1978978 - RNA, 20 nt, Homo sapiens
gccccagugcgguuccucau

SEQ ID NO: 1978979 - RNA, 13 nt, Homo sapiens
cugucaucuguag

SEQ ID NO: 1978980 - RNA, 21 nt, Homo sapiens
uucuccaugucuguaguugcu

SEQ ID NO: 1978981 - RNA, 12 nt, Homo sapiens
ugcacacugagg

SEQ ID NO: 1978982 - RNA, 16 nt, Homo sapiens
caugucuccuacugag

SEQ ID NO: 1978983 - RNA, 16 nt, Homo sapiens
cuucugcccuugccaa

SEQ ID NO: 1978984 - RNA, 15 nt, Homo sapiens
gaggaaauucuuucc

SEQ ID NO: 1978985 - RNA, 10 nt, Homo sapiens
uggcuuccau

SEQ ID NO: 1978986 - RNA, 13 nt, Homo sapiens
ggaaacugggaug

SEQ ID NO: 1978987 - RNA, 13 nt, Homo sapiens
uuuuuuauuggaa

SEQ ID NO: 1978988 - RNA, 20 nt, Homo sapiens
agaauugugcuggucauaca

SEQ ID NO: 1978989 - RNA, 23 nt, Homo sapiens
ccaguaucucuucagucucuaua

SEQ ID NO: 1978990 - RNA, 13 nt, Homo sapiens
gccuuaacccugu

SEQ ID NO: 1978991 - RNA, 16 nt, Homo sapiens
acacuguuaucuucac

SEQ ID NO: 1978992 - RNA, 14 nt, Homo sapiens
cccaucauacccuu

SEQ ID NO: 1978993 - RNA, 24 nt, Homo sapiens
ccucuuugugugcgucacugugaa

SEQ ID NO: 1978994 - RNA, 19 nt, Homo sapiens
ugaguucccuugauucaaa

SEQ ID NO: 1978995 - RNA, 20 nt, Homo sapiens
gcuucuauuagccagucuuu

SEQ ID NO: 1978996 - RNA, 22 nt, Homo sapiens
ucaaacuucuggcuucaugcaa

SEQ ID NO: 1978997 - RNA, 16 nt, Homo sapiens
uuguagcagaaaggaa

SEQ ID NO: 1978998 - RNA, 16 nt, Homo sapiens
guggcaagggaugugc

SEQ ID NO: 1978999 - RNA, 22 nt, Homo sapiens
ccaugucuccuggacucagggu

SEQ ID NO: 1979000 - RNA, 22 nt, Homo sapiens
ugucuuggcagccuacuaggga

SEQ ID NO: 1979001 - RNA, 13 nt, Homo sapiens
cccuuaaugugag

SEQ ID NO: 1979002 - RNA, 15 nt, Homo sapiens
cgauuuaacugggaa

SEQ ID NO: 1979003 - RNA, 18 nt, Homo sapiens
guuugcugucaagccauu

SEQ ID NO: 1979004 - RNA, 16 nt, Homo sapiens
guuguauuaacaaaag

SEQ ID NO: 1979005 - RNA, 16 nt, Homo sapiens
cacugucugaagcaau

SEQ ID NO: 1979006 - RNA, 18 nt, Homo sapiens
ucaaguauuggcaaagau

SEQ ID NO: 1979007 - RNA, 18 nt, Homo sapiens
gaaagggauugcuuugca

SEQ ID NO: 1979008 - RNA, 19 nt, Homo sapiens
cauaugacuaaguucacua

SEQ ID NO: 1979009 - RNA, 22 nt, Homo sapiens
cacccuugguuccuaacuggaa

SEQ ID NO: 1979010 - RNA, 15 nt, Homo sapiens
ugccugccaccuuca

SEQ ID NO: 1979011 - RNA, 15 nt, Homo sapiens
cccaaaggcauccau

SEQ ID NO: 1979012 - RNA, 15 nt, Homo sapiens
ugugugugcaagugu

SEQ ID NO: 1979013 - RNA, 22 nt, Homo sapiens
ugagaugauacauccaaagcag

SEQ ID NO: 1979014 - RNA, 14 nt, Homo sapiens
gacagggucuugcu

SEQ ID NO: 1979015 - RNA, 18 nt, Homo sapiens
acugaacuuacacuguau

SEQ ID NO: 1979016 - RNA, 17 nt, Homo sapiens
uuauuucugucacagua

SEQ ID NO: 1979017 - RNA, 20 nt, Homo sapiens
caaggggcuggaaucucaug

SEQ ID NO: 1979018 - RNA, 13 nt, Homo sapiens
uguauguauacac

SEQ ID NO: 1979019 - RNA, 11 nt, Homo sapiens
cauuuuugcuu

SEQ ID NO: 1979020 - RNA, 18 nt, Homo sapiens
ucaaaccuacuaauccag

SEQ ID NO: 1979021 - RNA, 18 nt, Homo sapiens
aguuucuuuuauuuucau

SEQ ID NO: 1979022 - RNA, 22 nt, Homo sapiens
acauauucuuggagaacuuucc

SEQ ID NO: 1979023 - RNA, 16 nt, Homo sapiens
uucuuugaaauauaau

SEQ ID NO: 1979024 - RNA, 14 nt, Homo sapiens
ccaugggacaggga

SEQ ID NO: 1979025 - RNA, 14 nt, Homo sapiens
auguucauuaaauu

SEQ ID NO: 1979026 - RNA, 21 nt, Homo sapiens
gacuuaauguaaaacccaaaa

SEQ ID NO: 1979027 - RNA, 13 nt, Homo sapiens
aucuuugauacuu

SEQ ID NO: 1979028 - RNA, 13 nt, Homo sapiens
aauaaugauuuaa

SEQ ID NO: 1979029 - RNA, 15 nt, Homo sapiens
agccagcucauuuca

SEQ ID NO: 1979030 - RNA, 22 nt, Homo sapiens
agggggugcaaagacucugagc

SEQ ID NO: 1979031 - RNA, 19 nt, Homo sapiens
gcuccauuuuuagugaaau

SEQ ID NO: 1979032 - RNA, 22 nt, Homo sapiens
caugagggugacguagaauuga

SEQ ID NO: 1979033 - RNA, 13 nt, Homo sapiens
ccaggacccugaa

SEQ ID NO: 1979034 - RNA, 22 nt, Homo sapiens
agucuuuacagcugagcacauu

SEQ ID NO: 1979035 - RNA, 21 nt, Homo sapiens
cuccagggcgagcacuuucca

SEQ ID NO: 1979036 - RNA, 20 nt, Homo sapiens
ucuuuaaacugguuguucug

SEQ ID NO: 1979037 - RNA, 19 nt, Homo sapiens
aaguuuugacaucaaugau

SEQ ID NO: 1979038 - RNA, 14 nt, Homo sapiens
augccugccucaaa

SEQ ID NO: 1979039 - RNA, 11 nt, Homo sapiens
guauauucaaa

SEQ ID NO: 1979040 - RNA, 23 nt, Homo sapiens
gcuuaaaauccaaagugucauau

SEQ ID NO: 1979041 - RNA, 19 nt, Homo sapiens
uggaccagcccauuggccg

SEQ ID NO: 1979042 - RNA, 17 nt, Homo sapiens
auaaugaguucacuaca

SEQ ID NO: 1979043 - RNA, 15 nt, Homo sapiens
gucugcucaaugcca

SEQ ID NO: 1979044 - RNA, 17 nt, Homo sapiens
augacguguccuacagc

SEQ ID NO: 1979045 - RNA, 16 nt, Homo sapiens
gagaaaaaguucuaua

SEQ ID NO: 1979046 - RNA, 14 nt, Homo sapiens
gaaguugugcaacg

SEQ ID NO: 1979047 - RNA, 14 nt, Homo sapiens
gaugcugugcuaug

SEQ ID NO: 1979048 - RNA, 17 nt, Homo sapiens
gcuuguggggccuggga

SEQ ID NO: 1979049 - RNA, 21 nt, Homo sapiens
uaagggcacugagcccuuccc

SEQ ID NO: 1979050 - RNA, 14 nt, Homo sapiens
gcagaaaagugcuu

SEQ ID NO: 1979051 - RNA, 20 nt, Homo sapiens
ucaaaguuaagaaucuuuau

SEQ ID NO: 1979052 - RNA, 13 nt, Homo sapiens
gcagcugcagggg

SEQ ID NO: 1979053 - RNA, 19 nt, Homo sapiens
aagacugucagcuuccaaa

SEQ ID NO: 1979054 - RNA, 15 nt, Homo sapiens
accucaggugaucca

SEQ ID NO: 1979055 - RNA, 13 nt, Homo sapiens
gcauguacuugaa

SEQ ID NO: 1979056 - RNA, 17 nt, Homo sapiens
cagagcugaagaacuug

SEQ ID NO: 1979057 - RNA, 23 nt, Homo sapiens
agcuuuucuuuuuuaauuuccag

SEQ ID NO: 1979058 - RNA, 16 nt, Homo sapiens
caacaccugccauagg

SEQ ID NO: 1979059 - RNA, 23 nt, Homo sapiens
uaucuuaaaauugguuaaugaaa

SEQ ID NO: 1979060 - RNA, 15 nt, Homo sapiens
aagaaaucccugaga

SEQ ID NO: 1979061 - RNA, 14 nt, Homo sapiens
uugcuaugaagcgu

SEQ ID NO: 1979062 - RNA, 18 nt, Homo sapiens
aaaacagacucuucuugc

SEQ ID NO: 1979063 - RNA, 14 nt, Homo sapiens
ccuggguucuucca

SEQ ID NO: 1979064 - RNA, 23 nt, Homo sapiens
aaaaguaauguauaucuguaaua

SEQ ID NO: 1979065 - RNA, 15 nt, Homo sapiens
agcagauacugcugu

SEQ ID NO: 1979066 - RNA, 17 nt, Homo sapiens
augggacaggugccagg

SEQ ID NO: 1979067 - RNA, 18 nt, Homo sapiens
aguucucacuuguuucca

SEQ ID NO: 1979068 - RNA, 16 nt, Homo sapiens
caaacuacaaagcuga

SEQ ID NO: 1979069 - RNA, 18 nt, Homo sapiens
cacaaauuagcuaggcau

SEQ ID NO: 1979070 - RNA, 22 nt, Homo sapiens
ugaagcuucggccgcgccaccc

SEQ ID NO: 1979071 - RNA, 15 nt, Homo sapiens
auaacagcaaauaac

SEQ ID NO: 1979072 - RNA, 20 nt, Homo sapiens
ccuguggguggggcuucucu

SEQ ID NO: 1979073 - RNA, 21 nt, Homo sapiens
ccagccaccacccucaggugc

SEQ ID NO: 1979074 - RNA, 18 nt, Homo sapiens
agaugcugcaaugugagu

SEQ ID NO: 1979075 - RNA, 22 nt, Homo sapiens
gcuuuugcccacacacuuucca

SEQ ID NO: 1979076 - RNA, 14 nt, Homo sapiens
gcaggaaggaacaa

SEQ ID NO: 1979077 - RNA, 15 nt, Homo sapiens
ccaggaaucaugaag

SEQ ID NO: 1979078 - RNA, 13 nt, Homo sapiens
caugacauuccua

SEQ ID NO: 1979079 - RNA, 16 nt, Homo sapiens
cccaggugggagccaa

SEQ ID NO: 1979080 - RNA, 15 nt, Homo sapiens
ucccuuucauacaau

SEQ ID NO: 1979081 - RNA, 18 nt, Homo sapiens
ccacaaguccuuguucca

SEQ ID NO: 1979082 - RNA, 15 nt, Homo sapiens
ccaggagcuacucag

SEQ ID NO: 1979083 - RNA, 22 nt, Homo sapiens
gucuuuaacaucuugaacuggu

SEQ ID NO: 1979084 - RNA, 14 nt, Homo sapiens
augagcauccccag

SEQ ID NO: 1979085 - RNA, 15 nt, Homo sapiens
cuuuuaccuguuauu

SEQ ID NO: 1979086 - RNA, 18 nt, Homo sapiens
aucuguugacagugccaa

SEQ ID NO: 1979087 - RNA, 20 nt, Homo sapiens
cugccuuuagaguuccauga

SEQ ID NO: 1979088 - RNA, 23 nt, Homo sapiens
cugugaaaauuacacccaugcac

SEQ ID NO: 1979089 - RNA, 13 nt, Homo sapiens
cagaggucacuuc

SEQ ID NO: 1979090 - RNA, 21 nt, Homo sapiens
aaacauucaucaagcuguaca

SEQ ID NO: 1979091 - RNA, 15 nt, Homo sapiens
cucccagacuugccu

SEQ ID NO: 1979092 - RNA, 20 nt, Homo sapiens
gcaaagcucuguggccacau

SEQ ID NO: 1979093 - RNA, 23 nt, Homo sapiens
gaguuacagccugggcaauaaag

SEQ ID NO: 1979094 - RNA, 21 nt, Homo sapiens
gcugcuuugagcuacaggaca

SEQ ID NO: 1979095 - RNA, 22 nt, Homo sapiens
uggaacgcugccucagggccca

SEQ ID NO: 1979096 - RNA, 20 nt, Homo sapiens
gccauguaccuccccugccu

SEQ ID NO: 1979097 - RNA, 16 nt, Homo sapiens
aacucuugaccucagg

SEQ ID NO: 1979098 - RNA, 19 nt, Homo sapiens
agacgccugcuuuugcaaa

SEQ ID NO: 1979099 - RNA, 20 nt, Homo sapiens
gcaggcagccccacacccgc

SEQ ID NO: 1979100 - RNA, 18 nt, Homo sapiens
caaagcacgaaauguuau

SEQ ID NO: 1979101 - RNA, 17 nt, Homo sapiens
agagauacuuacauuuc

SEQ ID NO: 1979102 - RNA, 22 nt, Homo sapiens
uugcucacccaggaccucuggg

SEQ ID NO: 1979103 - RNA, 22 nt, Homo sapiens
aauuccaaagcaaaaccagaac

SEQ ID NO: 1979104 - RNA, 20 nt, Homo sapiens
caucaaaaaagauagaucua

SEQ ID NO: 1979105 - RNA, 13 nt, Homo sapiens
aggcacagaugaa

SEQ ID NO: 1979106 - RNA, 13 nt, Homo sapiens
acucaccgugcug

SEQ ID NO: 1979107 - RNA, 21 nt, Homo sapiens
caaauaaacaacuauggcugu

SEQ ID NO: 1979108 - RNA, 11 nt, Homo sapiens
uguacagguac

SEQ ID NO: 1979109 - RNA, 13 nt, Homo sapiens
gcuggagugcaga

SEQ ID NO: 1979110 - RNA, 13 nt, Homo sapiens
uguuaaguugaug

SEQ ID NO: 1979111 - RNA, 13 nt, Homo sapiens
aggagacagauca

SEQ ID NO: 1979112 - RNA, 12 nt, Homo sapiens
cucagcugccag

SEQ ID NO: 1979113 - RNA, 18 nt, Homo sapiens
acuauuucaauacuuaca

SEQ ID NO: 1979114 - RNA, 12 nt, Homo sapiens
cuucucaagacu

SEQ ID NO: 1979115 - RNA, 18 nt, Homo sapiens
uagcuuagcaucagaggu

SEQ ID NO: 1979116 - RNA, 17 nt, Homo sapiens
uacuacauacaagcaua

SEQ ID NO: 1979117 - RNA, 17 nt, Homo sapiens
acucugguuucuaccag

SEQ ID NO: 1979118 - RNA, 22 nt, Homo sapiens
auucaaaugaagauucagcagu

SEQ ID NO: 1979119 - RNA, 23 nt, Homo sapiens
ggacuccucaaaccacuugccug

SEQ ID NO: 1979120 - RNA, 17 nt, Homo sapiens
uaacagucuagugcaaa

SEQ ID NO: 1979121 - RNA, 17 nt, Homo sapiens
aagacugaaucuaccug

SEQ ID NO: 1979122 - RNA, 16 nt, Homo sapiens
ggcaggcuccaggccu

SEQ ID NO: 1979123 - RNA, 13 nt, Homo sapiens
aggauuaacuaaa

SEQ ID NO: 1979124 - RNA, 22 nt, Homo sapiens
uucaauguccuaaaaagacacg

SEQ ID NO: 1979125 - RNA, 20 nt, Homo sapiens
gcuagagggcgacucuggug

SEQ ID NO: 1979126 - RNA, 21 nt, Homo sapiens
ugucccaaguugcuaagugaa

SEQ ID NO: 1979127 - RNA, 13 nt, Homo sapiens
cuauaaugagccg

SEQ ID NO: 1979128 - RNA, 21 nt, Homo sapiens
cuucagguuuuaucaguagaa

SEQ ID NO: 1979129 - RNA, 15 nt, Homo sapiens
caccagcugccaaaa

SEQ ID NO: 1979130 - RNA, 15 nt, Homo sapiens
auaauugaagagaca

SEQ ID NO: 1979131 - RNA, 11 nt, Homo sapiens
gcgcgcugagc

SEQ ID NO: 1979132 - RNA, 20 nt, Homo sapiens
acagguuuucagcaacucag

SEQ ID NO: 1979133 - RNA, 22 nt, Homo sapiens
aaucagcuuaaaauccaaagug

SEQ ID NO: 1979134 - RNA, 22 nt, Homo sapiens
uuagcgcuggcuucauucucag

SEQ ID NO: 1979135 - RNA, 13 nt, Homo sapiens
acgugacccugug

SEQ ID NO: 1979136 - RNA, 20 nt, Homo sapiens
uguauaacuuguauuauuag

SEQ ID NO: 1979137 - RNA, 18 nt, Homo sapiens
accccauccucacacaga

SEQ ID NO: 1979138 - RNA, 15 nt, Homo sapiens
ucucucaaugaauaa

SEQ ID NO: 1979139 - RNA, 23 nt, Homo sapiens
gcagaucuuuuugugaaauucaa

SEQ ID NO: 1979140 - RNA, 16 nt, Homo sapiens
aggaugacuacagaca

SEQ ID NO: 1979141 - RNA, 12 nt, Homo sapiens
ugcccauugcac

SEQ ID NO: 1979142 - RNA, 18 nt, Homo sapiens
gacaaaugccacacggcu

SEQ ID NO: 1979143 - RNA, 19 nt, Homo sapiens
cagcaaacccugaugugac

SEQ ID NO: 1979144 - RNA, 17 nt, Homo sapiens
uucaggaggucaucuga

SEQ ID NO: 1979145 - RNA, 23 nt, Homo sapiens
caggcagccagugugacacugcu

SEQ ID NO: 1979146 - RNA, 12 nt, Homo sapiens
aagccagggucu

SEQ ID NO: 1979147 - RNA, 19 nt, Homo sapiens
guacugacagaaagcaagg

SEQ ID NO: 1979148 - RNA, 19 nt, Homo sapiens
cuuggccccagaggaccga

SEQ ID NO: 1979149 - RNA, 15 nt, Homo sapiens
guaauuguuacaauu

SEQ ID NO: 1979150 - RNA, 14 nt, Homo sapiens
auaaacauuuggca

SEQ ID NO: 1979151 - RNA, 19 nt, Homo sapiens
caagcaccugcaugugcug

SEQ ID NO: 1979152 - RNA, 13 nt, Homo sapiens
ugcaccuuugcac

SEQ ID NO: 1979153 - RNA, 19 nt, Homo sapiens
gaguauuaacaaaaccaaa

SEQ ID NO: 1979154 - RNA, 16 nt, Homo sapiens
aaucguuuuugcugca

SEQ ID NO: 1979155 - RNA, 17 nt, Homo sapiens
ggagacuuggaugucau

SEQ ID NO: 1979156 - RNA, 12 nt, Homo sapiens
caggcacgggug

SEQ ID NO: 1979157 - RNA, 15 nt, Homo sapiens
gacucaggccaguca

SEQ ID NO: 1979158 - RNA, 18 nt, Homo sapiens
guugugugugcuuucuaa

SEQ ID NO: 1979159 - RNA, 16 nt, Homo sapiens
ugccaaaauauaauca

SEQ ID NO: 1979160 - RNA, 23 nt, Homo sapiens
ugaagaguauccuuccuucaggg

SEQ ID NO: 1979161 - RNA, 15 nt, Homo sapiens
ucacuuccuauaugc

SEQ ID NO: 1979162 - RNA, 19 nt, Homo sapiens
agguaacucuuugcacaua

SEQ ID NO: 1979163 - RNA, 19 nt, Homo sapiens
aaugauacugaauuguuau

SEQ ID NO: 1979164 - RNA, 22 nt, Homo sapiens
gaauugaagacacguucuugcc

SEQ ID NO: 1979165 - RNA, 17 nt, Homo sapiens
guuuaugcagugcugcu

SEQ ID NO: 1979166 - RNA, 16 nt, Homo sapiens
gagagccugcacagcu

SEQ ID NO: 1979167 - RNA, 23 nt, Homo sapiens
ggaacuguguuucaaauggacug

SEQ ID NO: 1979168 - RNA, 13 nt, Homo sapiens
ugacagagcaaua

SEQ ID NO: 1979169 - RNA, 16 nt, Homo sapiens
uaaaauguuuaauuca

SEQ ID NO: 1979170 - RNA, 20 nt, Homo sapiens
guuuauauggauaaucugag

SEQ ID NO: 1979171 - RNA, 13 nt, Homo sapiens
cugcacacuccag

SEQ ID NO: 1979172 - RNA, 15 nt, Homo sapiens
guaauaaacucucua

SEQ ID NO: 1979173 - RNA, 18 nt, Homo sapiens
ugucuuuuuucacuacau

SEQ ID NO: 1979174 - RNA, 22 nt, Homo sapiens
uuccuauuuuaaaaccaugcag

SEQ ID NO: 1979175 - RNA, 22 nt, Homo sapiens
ccuauaaaacaaagucugggaa

SEQ ID NO: 1979176 - RNA, 17 nt, Homo sapiens
acuccuuagagacauca

SEQ ID NO: 1979177 - RNA, 23 nt, Homo sapiens
ugccaaacaugagagcccagaaa

SEQ ID NO: 1979178 - RNA, 22 nt, Homo sapiens
cguuggccggaggucaugauga

SEQ ID NO: 1979179 - RNA, 16 nt, Homo sapiens
agccuccuagauguaa

SEQ ID NO: 1979180 - RNA, 21 nt, Homo sapiens
uucccuuguauggauauacca

SEQ ID NO: 1979181 - RNA, 16 nt, Homo sapiens
uuuaaaaaaugucucu

SEQ ID NO: 1979182 - RNA, 15 nt, Homo sapiens
acuacaucuaguuaa

SEQ ID NO: 1979183 - RNA, 21 nt, Homo sapiens
uagccacauacuagcaucuua

SEQ ID NO: 1979184 - RNA, 20 nt, Homo sapiens
uccuaguacuuagaaauaca

SEQ ID NO: 1979185 - RNA, 16 nt, Homo sapiens
uuucuuccauucccau

SEQ ID NO: 1979186 - RNA, 23 nt, Homo sapiens
gauuuuucuaaccuugaaugcug

SEQ ID NO: 1979187 - RNA, 18 nt, Homo sapiens
auuuuaacauaggcaaga

SEQ ID NO: 1979188 - RNA, 20 nt, Homo sapiens
ucucgaacuccuggccucaa

SEQ ID NO: 1979189 - RNA, 22 nt, Homo sapiens
uuggaaaaaaaccacagccacu

SEQ ID NO: 1979190 - RNA, 20 nt, Homo sapiens
uaauagaauagcacagccag

SEQ ID NO: 1979191 - RNA, 18 nt, Homo sapiens
aggcuuaacgugucugag

SEQ ID NO: 1979192 - RNA, 21 nt, Homo sapiens
ucagcucugaggauguauacc

SEQ ID NO: 1979193 - RNA, 15 nt, Homo sapiens
cuccucucugagacu

SEQ ID NO: 1979194 - RNA, 18 nt, Homo sapiens
acucuuccagaaucccaa

SEQ ID NO: 1979195 - RNA, 21 nt, Homo sapiens
uucuacagacaucauguuacu

SEQ ID NO: 1979196 - RNA, 13 nt, Homo sapiens
cacacacuggccu

SEQ ID NO: 1979197 - RNA, 15 nt, Homo sapiens
cuaagauacuccaua

SEQ ID NO: 1979198 - RNA, 12 nt, Homo sapiens
ucacuccccaag

SEQ ID NO: 1979199 - RNA, 16 nt, Homo sapiens
ugcucuuucucugcca

SEQ ID NO: 1979200 - RNA, 15 nt, Homo sapiens
auuuuuaugugcagc

SEQ ID NO: 1979201 - RNA, 15 nt, Homo sapiens
ugaggacaauccccc

SEQ ID NO: 1979202 - RNA, 19 nt, Homo sapiens
uaaccaguuuuuucaccuc

SEQ ID NO: 1979203 - RNA, 18 nt, Homo sapiens
auucuuugaacaugaacu

SEQ ID NO: 1979204 - RNA, 15 nt, Homo sapiens
caugccacugccagg

SEQ ID NO: 1979205 - RNA, 9 nt, Homo sapiens
gccucggga

SEQ ID NO: 1979206 - RNA, 20 nt, Homo sapiens
ugugaccaaugucuugaugc

SEQ ID NO: 1979207 - RNA, 22 nt, Homo sapiens
ugagaaagcuuaaauacaccuu

SEQ ID NO: 1979208 - RNA, 22 nt, Homo sapiens
auaggcugacuuuugcagaugg

SEQ ID NO: 1979209 - RNA, 14 nt, Homo sapiens
augggacugugagg

SEQ ID NO: 1979210 - RNA, 13 nt, Homo sapiens
uuacugugucagg

SEQ ID NO: 1979211 - RNA, 15 nt, Homo sapiens
acagcacaugcacac

SEQ ID NO: 1979212 - RNA, 10 nt, Homo sapiens
agaaagaagc

SEQ ID NO: 1979213 - RNA, 16 nt, Homo sapiens
auaaaauuagcuugag

SEQ ID NO: 1979214 - RNA, 11 nt, Homo sapiens
auaaaauuccu

SEQ ID NO: 1979215 - RNA, 20 nt, Homo sapiens
guuauuguucagacauucca

SEQ ID NO: 1979216 - RNA, 17 nt, Homo sapiens
cugcuccagguucacuu

SEQ ID NO: 1979217 - RNA, 19 nt, Homo sapiens
uaguuuuucuuacuugcau

SEQ ID NO: 1979218 - RNA, 20 nt, Homo sapiens
gaaugcaagugaacuuggga

SEQ ID NO: 1979219 - RNA, 16 nt, Homo sapiens
gagccagcacccugau

SEQ ID NO: 1979220 - RNA, 13 nt, Homo sapiens
uacagacaucuaa

SEQ ID NO: 1979221 - RNA, 18 nt, Homo sapiens
guguagggguguguguau

SEQ ID NO: 1979222 - RNA, 13 nt, Homo sapiens
ucugccuccagga

SEQ ID NO: 1979223 - RNA, 16 nt, Homo sapiens
uacuuacugaacugug

SEQ ID NO: 1979224 - RNA, 20 nt, Homo sapiens
aggcuccaggagcagccaca

SEQ ID NO: 1979225 - RNA, 21 nt, Homo sapiens
uacccauagguaauacaaaaa

SEQ ID NO: 1979226 - RNA, 17 nt, Homo sapiens
cucggcguuagucccua

SEQ ID NO: 1979227 - RNA, 23 nt, Homo sapiens
gccguaguaccucccagcagggu

SEQ ID NO: 1979228 - RNA, 19 nt, Homo sapiens
ccagcaagcacuguggucu

SEQ ID NO: 1979229 - RNA, 13 nt, Homo sapiens
gcuccaugcaccu

SEQ ID NO: 1979230 - RNA, 16 nt, Homo sapiens
cgagaggcaauucagu

SEQ ID NO: 1979231 - RNA, 14 nt, Homo sapiens
agagcuugaugcca

SEQ ID NO: 1979232 - RNA, 23 nt, Homo sapiens
uguuaauucacagaauagcacaa

SEQ ID NO: 1979233 - RNA, 15 nt, Homo sapiens
gccuuuauggcugcu

SEQ ID NO: 1979234 - RNA, 21 nt, Homo sapiens
cucugguggagacaaaugagg

SEQ ID NO: 1979235 - RNA, 22 nt, Homo sapiens
cauugauucguaugccagcuca

SEQ ID NO: 1979236 - RNA, 23 nt, Homo sapiens
ccaacuccgaaagucugaaucuc

SEQ ID NO: 1979237 - RNA, 23 nt, Homo sapiens
ugcaccauucuuucuuggugcau

SEQ ID NO: 1979238 - RNA, 14 nt, Homo sapiens
ucccacacugaaau

SEQ ID NO: 1979239 - RNA, 13 nt, Homo sapiens
agucucugcugcu

SEQ ID NO: 1979240 - RNA, 23 nt, Homo sapiens
aagccagguuacauucuaaaaau

SEQ ID NO: 1979241 - RNA, 18 nt, Homo sapiens
gaaaucacugaaccucuc

SEQ ID NO: 1979242 - RNA, 19 nt, Homo sapiens
cugcauggaccuaacauuc

SEQ ID NO: 1979243 - RNA, 17 nt, Homo sapiens
ucaucguaaacauacuu

SEQ ID NO: 1979244 - RNA, 20 nt, Homo sapiens
ccugccuagucucacauguc

SEQ ID NO: 1979245 - RNA, 11 nt, Homo sapiens
ggacacuuuua

SEQ ID NO: 1979246 - RNA, 17 nt, Homo sapiens
ccugugccaucaccaua

SEQ ID NO: 1979247 - RNA, 19 nt, Homo sapiens
gcucuuugucucaccagcu

SEQ ID NO: 1979248 - RNA, 22 nt, Homo sapiens
uccuaaucuuaucaauucugau

SEQ ID NO: 1979249 - RNA, 15 nt, Homo sapiens
aaguguggaauugga

SEQ ID NO: 1979250 - RNA, 22 nt, Homo sapiens
aaauucuuaacuuuuaacauaa

SEQ ID NO: 1979251 - RNA, 12 nt, Homo sapiens
accuuauccugc

SEQ ID NO: 1979252 - RNA, 14 nt, Homo sapiens
ucaguuacuaagaa

SEQ ID NO: 1979253 - RNA, 14 nt, Homo sapiens
aauguaacacugau

SEQ ID NO: 1979254 - RNA, 23 nt, Homo sapiens
auguuccuuuuauuuauaacaau

SEQ ID NO: 1979255 - RNA, 17 nt, Homo sapiens
guguauuccauaugucu

SEQ ID NO: 1979256 - RNA, 22 nt, Homo sapiens
cccaaugaaagaagaguuccau

SEQ ID NO: 1979257 - RNA, 23 nt, Homo sapiens
uggaaggugacagcgauucccug

SEQ ID NO: 1979258 - RNA, 17 nt, Homo sapiens
ucuggaagaccugaaag

SEQ ID NO: 1979259 - RNA, 16 nt, Homo sapiens
acccguccauggcugg

SEQ ID NO: 1979260 - RNA, 15 nt, Homo sapiens
uaaguuaaacaguca

SEQ ID NO: 1979261 - RNA, 17 nt, Homo sapiens
aaacuauguaacaugua

SEQ ID NO: 1979262 - RNA, 16 nt, Homo sapiens
agcuuuaagcacccua

SEQ ID NO: 1979263 - RNA, 21 nt, Homo sapiens
ucaugucuccucaugucuuau

SEQ ID NO: 1979264 - RNA, 19 nt, Homo sapiens
gaaaguauguaccaaaaca

SEQ ID NO: 1979265 - RNA, 18 nt, Homo sapiens
gacaccuagacucuaaaa

SEQ ID NO: 1979266 - RNA, 15 nt, Homo sapiens
gaagggaauccuccu

SEQ ID NO: 1979267 - RNA, 20 nt, Homo sapiens
gaaaauccauucauucaauc

SEQ ID NO: 1979268 - RNA, 20 nt, Homo sapiens
gcauucuguacuaauacagc

SEQ ID NO: 1979269 - RNA, 19 nt, Homo sapiens
auucccuaucuuuuaguuu

SEQ ID NO: 1979270 - RNA, 13 nt, Homo sapiens
cguaggaaaacca

SEQ ID NO: 1979271 - RNA, 13 nt, Homo sapiens
guccccaccaauc

SEQ ID NO: 1979272 - RNA, 17 nt, Homo sapiens
auaaucaagggcacugu

SEQ ID NO: 1979273 - RNA, 18 nt, Homo sapiens
agauccacccuaucccug

SEQ ID NO: 1979274 - RNA, 21 nt, Homo sapiens
cccaggggaggcacaaagggc

SEQ ID NO: 1979275 - RNA, 12 nt, Homo sapiens
ucggcuuuuugc

SEQ ID NO: 1979276 - RNA, 14 nt, Homo sapiens
gaagagcuuggaaa

SEQ ID NO: 1979277 - RNA, 18 nt, Homo sapiens
aucugcuuaucagugugc

SEQ ID NO: 1979278 - RNA, 22 nt, Homo sapiens
ucccuggagagaaaguguguga

SEQ ID NO: 1979279 - RNA, 15 nt, Homo sapiens
ugagacucagugcag

SEQ ID NO: 1979280 - RNA, 13 nt, Homo sapiens
acuauuuccacau

SEQ ID NO: 1979281 - RNA, 14 nt, Homo sapiens
gaaaagguccaaaa

SEQ ID NO: 1979282 - RNA, 12 nt, Homo sapiens
uguuguguuucu

SEQ ID NO: 1979283 - RNA, 23 nt, Homo sapiens
auguugaagaacucaugugauuu

SEQ ID NO: 1979284 - RNA, 20 nt, Homo sapiens
ccccuugguacugaaaauga

SEQ ID NO: 1979285 - RNA, 16 nt, Homo sapiens
caaacuaggggacaaa

SEQ ID NO: 1979286 - RNA, 20 nt, Homo sapiens
uagcuugcacaacauccuca

SEQ ID NO: 1979287 - RNA, 14 nt, Homo sapiens
auuaagaaugaucu

SEQ ID NO: 1979288 - RNA, 21 nt, Homo sapiens
aaaacucgaggacuguauuug

SEQ ID NO: 1979289 - RNA, 15 nt, Homo sapiens
uaaggaacagcauug

SEQ ID NO: 1979290 - RNA, 11 nt, Homo sapiens
gccagcauuuu

SEQ ID NO: 1979291 - RNA, 14 nt, Homo sapiens
aaaugauacuucuc

SEQ ID NO: 1979292 - RNA, 18 nt, Homo sapiens
cuggauccggucugccug

SEQ ID NO: 1979293 - RNA, 22 nt, Homo sapiens
aauuuagaucaaauuaguaauu

SEQ ID NO: 1979294 - RNA, 16 nt, Homo sapiens
gaaauuuaauguuucu

SEQ ID NO: 1979295 - RNA, 22 nt, Homo sapiens
ugaugugcaaaaccuuuuacug

SEQ ID NO: 1979296 - RNA, 22 nt, Homo sapiens
cugaguauucauuuugcaacuu

SEQ ID NO: 1979297 - RNA, 14 nt, Homo sapiens
ugggccccaucauu

SEQ ID NO: 1979298 - RNA, 16 nt, Homo sapiens
aacgacauggaacuga

SEQ ID NO: 1979299 - RNA, 13 nt, Homo sapiens
ugugucuuguauu

SEQ ID NO: 1979300 - RNA, 22 nt, Homo sapiens
ccuuccuguccugccuccucau

SEQ ID NO: 1979301 - RNA, 19 nt, Homo sapiens
gcagaguugacaugagauu

SEQ ID NO: 1979302 - RNA, 16 nt, Homo sapiens
auauugcuucuucucc

SEQ ID NO: 1979303 - RNA, 13 nt, Homo sapiens
cucuacaaaaagc

SEQ ID NO: 1979304 - RNA, 20 nt, Homo sapiens
acaccugggggacagaggca

SEQ ID NO: 1979305 - RNA, 20 nt, Homo sapiens
cagugacugccgucagcucc

SEQ ID NO: 1979306 - RNA, 20 nt, Homo sapiens
guuuugcauuuuuugaauau

SEQ ID NO: 1979307 - RNA, 17 nt, Homo sapiens
aaucuuuccaguuagaa

SEQ ID NO: 1979308 - RNA, 18 nt, Homo sapiens
gaguacuacaguccuccc

SEQ ID NO: 1979309 - RNA, 18 nt, Homo sapiens
aggcaucugccucuggaa

SEQ ID NO: 1979310 - RNA, 15 nt, Homo sapiens
uagagcugagcacuu

SEQ ID NO: 1979311 - RNA, 22 nt, Homo sapiens
auuuauuucuuuuuugccaaau

SEQ ID NO: 1979312 - RNA, 15 nt, Homo sapiens
gcacggcccaagggg

SEQ ID NO: 1979313 - RNA, 17 nt, Homo sapiens
ggagaccagcucagagg

SEQ ID NO: 1979314 - RNA, 15 nt, Homo sapiens
ccgcucccuggauau

SEQ ID NO: 1979315 - RNA, 15 nt, Homo sapiens
ugcucuuagcugucu

SEQ ID NO: 1979316 - RNA, 21 nt, Homo sapiens
augaauccauauggagcuuuu

SEQ ID NO: 1979317 - RNA, 16 nt, Homo sapiens
ccagcggcucacaaag

SEQ ID NO: 1979318 - RNA, 23 nt, Homo sapiens
acacugaaacuguaugugcugua

SEQ ID NO: 1979319 - RNA, 13 nt, Homo sapiens
ucaugacauauga

SEQ ID NO: 1979320 - RNA, 16 nt, Homo sapiens
uggaugacacaauccc

SEQ ID NO: 1979321 - RNA, 18 nt, Homo sapiens
guuuucuugaacauacuu

SEQ ID NO: 1979322 - RNA, 15 nt, Homo sapiens
agcacugccaccagu

SEQ ID NO: 1979323 - RNA, 23 nt, Homo sapiens
gaaauguuuaauaaagcuuuaua

SEQ ID NO: 1979324 - RNA, 16 nt, Homo sapiens
uggagggaaugcucag

SEQ ID NO: 1979325 - RNA, 20 nt, Homo sapiens
gaaaucugucuugucauuuu

SEQ ID NO: 1979326 - RNA, 16 nt, Homo sapiens
aaagacaagugcucaa

SEQ ID NO: 1979327 - RNA, 18 nt, Homo sapiens
auggcugaguuuauuagu

SEQ ID NO: 1979328 - RNA, 18 nt, Homo sapiens
ccugacggacguccugcu

SEQ ID NO: 1979329 - RNA, 18 nt, Homo sapiens
cccugguggcuucagcag

SEQ ID NO: 1979330 - RNA, 21 nt, Homo sapiens
uccugaugugacgcacuguau

SEQ ID NO: 1979331 - RNA, 22 nt, Homo sapiens
gaacgucucucaccuagaccuu

SEQ ID NO: 1979332 - RNA, 17 nt, Homo sapiens
acccugagguccugcau

SEQ ID NO: 1979333 - RNA, 14 nt, Homo sapiens
acucaugacugaag

SEQ ID NO: 1979334 - RNA, 23 nt, Homo sapiens
aggcugagacugcagaggagcca

SEQ ID NO: 1979335 - RNA, 18 nt, Homo sapiens
gacccuucagggccagaa

SEQ ID NO: 1979336 - RNA, 22 nt, Homo sapiens
acaguagagcaaaucuaugaga

SEQ ID NO: 1979337 - RNA, 17 nt, Homo sapiens
ugauaaaauaaguaaca

SEQ ID NO: 1979338 - RNA, 18 nt, Homo sapiens
gcagagaaccaucaaggc

SEQ ID NO: 1979339 - RNA, 13 nt, Homo sapiens
aggauuaggcaaa

SEQ ID NO: 1979340 - RNA, 19 nt, Homo sapiens
agcuuucaugaguuuccca

SEQ ID NO: 1979341 - RNA, 21 nt, Homo sapiens
aaaagcuauguaucgcuccua

SEQ ID NO: 1979342 - RNA, 19 nt, Homo sapiens
aaaauaugaccacacucca

SEQ ID NO: 1979343 - RNA, 19 nt, Homo sapiens
caaacuuuuuccagcaaaa

SEQ ID NO: 1979344 - RNA, 17 nt, Homo sapiens
ugaaucuguuucuaugu

SEQ ID NO: 1979345 - RNA, 22 nt, Homo sapiens
ucacguacaaaacucuguauaa

SEQ ID NO: 1979346 - RNA, 14 nt, Homo sapiens
acugauuccuggag

SEQ ID NO: 1979347 - RNA, 18 nt, Homo sapiens
cauuaauagcagccuuuc

SEQ ID NO: 1979348 - RNA, 11 nt, Homo sapiens
guggcaauggg

SEQ ID NO: 1979349 - RNA, 12 nt, Homo sapiens
agugcacuuaau

SEQ ID NO: 1979350 - RNA, 20 nt, Homo sapiens
ggcuggagugcaguggcgca

SEQ ID NO: 1979351 - RNA, 20 nt, Homo sapiens
gacuggaaugcagugacaca

SEQ ID NO: 1979352 - RNA, 17 nt, Homo sapiens
uuaaaugcauguccuca

SEQ ID NO: 1979353 - RNA, 14 nt, Homo sapiens
ccaucucuacuaaa

SEQ ID NO: 1979354 - RNA, 23 nt, Homo sapiens
acauuaaaagaaguaaccaacug

SEQ ID NO: 1979355 - RNA, 22 nt, Homo sapiens
agccccucuucccuuccuccau

SEQ ID NO: 1979356 - RNA, 21 nt, Homo sapiens
ucaaauaugcaaagcacugac

SEQ ID NO: 1979357 - RNA, 15 nt, Homo sapiens
accuauccugaagau

SEQ ID NO: 1979358 - RNA, 21 nt, Homo sapiens
uugguacuacuagaugucuuu

SEQ ID NO: 1979359 - RNA, 16 nt, Homo sapiens
ccugcacuguccugcu

SEQ ID NO: 1979360 - RNA, 17 nt, Homo sapiens
aaugcuuuuugaucugu

SEQ ID NO: 1979361 - RNA, 15 nt, Homo sapiens
acuuugccacuggau

SEQ ID NO: 1979362 - RNA, 13 nt, Homo sapiens
ggagacaugcucu

SEQ ID NO: 1979363 - RNA, 12 nt, Homo sapiens
aggaggacaaaa

SEQ ID NO: 1979364 - RNA, 15 nt, Homo sapiens
gcuaaggcugccuca

SEQ ID NO: 1979365 - RNA, 22 nt, Homo sapiens
ccacauuugugccgacacuguu

SEQ ID NO: 1979366 - RNA, 10 nt, Homo sapiens
uaaaccugga

SEQ ID NO: 1979367 - RNA, 14 nt, Homo sapiens
accagaucucaggc

SEQ ID NO: 1979368 - RNA, 17 nt, Homo sapiens
gcuuguuucuauacugu

SEQ ID NO: 1979369 - RNA, 17 nt, Homo sapiens
agaugguaacagauuug

SEQ ID NO: 1979370 - RNA, 21 nt, Homo sapiens
cagaacucuccuuggauaauu

SEQ ID NO: 1979371 - RNA, 15 nt, Homo sapiens
ucgugacaacacuug

SEQ ID NO: 1979372 - RNA, 17 nt, Homo sapiens
gucuugucauuccaggu

SEQ ID NO: 1979373 - RNA, 16 nt, Homo sapiens
aucucuagaaagcucu

SEQ ID NO: 1979374 - RNA, 18 nt, Homo sapiens
acuccaggcugucuuuca

SEQ ID NO: 1979375 - RNA, 14 nt, Homo sapiens
uucccugaggaccu

SEQ ID NO: 1979376 - RNA, 19 nt, Homo sapiens
uuguuaaaaccuuacuuaa

SEQ ID NO: 1979377 - RNA, 20 nt, Homo sapiens
ucucaggggaaggauuugca

SEQ ID NO: 1979378 - RNA, 16 nt, Homo sapiens
aaugaaauuuuaccaa

SEQ ID NO: 1979379 - RNA, 20 nt, Homo sapiens
uggcagcgccucaucuucaa

SEQ ID NO: 1979380 - RNA, 17 nt, Homo sapiens
uccaucccacauaaaua

SEQ ID NO: 1979381 - RNA, 18 nt, Homo sapiens
ccacgaagacaaccauca

SEQ ID NO: 1979382 - RNA, 15 nt, Homo sapiens
agauaauugcuauuu

SEQ ID NO: 1979383 - RNA, 13 nt, Homo sapiens
caccucuguuucc

SEQ ID NO: 1979384 - RNA, 13 nt, Homo sapiens
ccucccacuggga

SEQ ID NO: 1979385 - RNA, 17 nt, Homo sapiens
ugcagggacuccaugcu

SEQ ID NO: 1979386 - RNA, 22 nt, Homo sapiens
aaacuuccagugcaacacugaa

SEQ ID NO: 1979387 - RNA, 22 nt, Homo sapiens
uugucuacauuaaaucacuuga

SEQ ID NO: 1979388 - RNA, 20 nt, Homo sapiens
uuggucaggcuggucucaaa

SEQ ID NO: 1979389 - RNA, 18 nt, Homo sapiens
cucugcagacugcuagug

SEQ ID NO: 1979390 - RNA, 14 nt, Homo sapiens
agcaucaccucagg

SEQ ID NO: 1979391 - RNA, 13 nt, Homo sapiens
ccacaaaauacac

SEQ ID NO: 1979392 - RNA, 23 nt, Homo sapiens
cucuggucuccacagauggcuca

SEQ ID NO: 1979393 - RNA, 20 nt, Homo sapiens
auucaguuucuaaaauugag

SEQ ID NO: 1979394 - RNA, 15 nt, Homo sapiens
aauauuucuuaaaaa

SEQ ID NO: 1979395 - RNA, 13 nt, Homo sapiens
uucuuacauauga

SEQ ID NO: 1979396 - RNA, 21 nt, Homo sapiens
aggacugguucugaggccaga

SEQ ID NO: 1979397 - RNA, 14 nt, Homo sapiens
aaagggacauugaa

SEQ ID NO: 1979398 - RNA, 17 nt, Homo sapiens
uuccagcuucuuuugcc

SEQ ID NO: 1979399 - RNA, 13 nt, Homo sapiens
aacuguauggaau

SEQ ID NO: 1979400 - RNA, 21 nt, Homo sapiens
cccaucuugauuggggcaguu

SEQ ID NO: 1979401 - RNA, 18 nt, Homo sapiens
ccguuuagaaaaaacaau

SEQ ID NO: 1979402 - RNA, 20 nt, Homo sapiens
auccuaccccuuugcacuug

SEQ ID NO: 1979403 - RNA, 19 nt, Homo sapiens
acuguucugagccaaauuc

SEQ ID NO: 1979404 - RNA, 20 nt, Homo sapiens
ccggagcagcaggaaggccc

SEQ ID NO: 1979405 - RNA, 12 nt, Homo sapiens
agaauucaguau

SEQ ID NO: 1979406 - RNA, 18 nt, Homo sapiens
uacccuguaacaugcaau

SEQ ID NO: 1979407 - RNA, 22 nt, Homo sapiens
cacuccuggugcaggucuccac

SEQ ID NO: 1979408 - RNA, 19 nt, Homo sapiens
ccucucccaguccauuucc

SEQ ID NO: 1979409 - RNA, 16 nt, Homo sapiens
cugagggagacugcaa

SEQ ID NO: 1979410 - RNA, 13 nt, Homo sapiens
aucauacuuccau

SEQ ID NO: 1979411 - RNA, 23 nt, Homo sapiens
guggacucuaacaguaguugcaa

SEQ ID NO: 1979412 - RNA, 19 nt, Homo sapiens
gaaucuagagcaaagccau

SEQ ID NO: 1979413 - RNA, 22 nt, Homo sapiens
aaauaggaagauuaaaaccaca

SEQ ID NO: 1979414 - RNA, 18 nt, Homo sapiens
uaauacguagcucucuua

SEQ ID NO: 1979415 - RNA, 14 nt, Homo sapiens
cugcauuuuacaca

SEQ ID NO: 1979416 - RNA, 18 nt, Homo sapiens
cagggucccucuguguau

SEQ ID NO: 1979417 - RNA, 15 nt, Homo sapiens
cagacauccugugau

SEQ ID NO: 1979418 - RNA, 18 nt, Homo sapiens
ucucacgauuccagugca

SEQ ID NO: 1979419 - RNA, 17 nt, Homo sapiens
gugcugguuccaugccu

SEQ ID NO: 1979420 - RNA, 18 nt, Homo sapiens
aagaugguugccaagcaa

SEQ ID NO: 1979421 - RNA, 14 nt, Homo sapiens
aacuugcacauuug

SEQ ID NO: 1979422 - RNA, 21 nt, Homo sapiens
agggcugaguuugcacagugg

SEQ ID NO: 1979423 - RNA, 12 nt, Homo sapiens
uuacagugcaga

SEQ ID NO: 1979424 - RNA, 16 nt, Homo sapiens
agcuucucugcugcuu

SEQ ID NO: 1979425 - RNA, 23 nt, Homo sapiens
gacaacacacaaaauaaugcagu

SEQ ID NO: 1979426 - RNA, 19 nt, Homo sapiens
auuggaacagaauguuuua

SEQ ID NO: 1979427 - RNA, 18 nt, Homo sapiens
uuugauuucgccaaucau

SEQ ID NO: 1979428 - RNA, 18 nt, Homo sapiens
augaacguuuucucuuca

SEQ ID NO: 1979429 - RNA, 17 nt, Homo sapiens
caaaacuguauauaaau

SEQ ID NO: 1979430 - RNA, 15 nt, Homo sapiens
uauacuuuaucaaag

SEQ ID NO: 1979431 - RNA, 14 nt, Homo sapiens
agauacauacagaa

SEQ ID NO: 1979432 - RNA, 20 nt, Homo sapiens
aagauauguaacaacaauua

SEQ ID NO: 1979433 - RNA, 15 nt, Homo sapiens
gaugugugucagaag

SEQ ID NO: 1979434 - RNA, 16 nt, Homo sapiens
gcucggggacagguga

SEQ ID NO: 1979435 - RNA, 16 nt, Homo sapiens
acuguggggcacuuga

SEQ ID NO: 1979436 - RNA, 15 nt, Homo sapiens
agaccauuaucagug

SEQ ID NO: 1979437 - RNA, 14 nt, Homo sapiens
gagaaauugaggau

SEQ ID NO: 1979438 - RNA, 21 nt, Homo sapiens
cagagugagcaagggggccca

SEQ ID NO: 1979439 - RNA, 18 nt, Homo sapiens
auuuucaccuauccagag

SEQ ID NO: 1979440 - RNA, 12 nt, Homo sapiens
aauguggcaagu

SEQ ID NO: 1979441 - RNA, 19 nt, Homo sapiens
auugcccauccaucugcuu

SEQ ID NO: 1979442 - RNA, 17 nt, Homo sapiens
ccaaauucuccuccuga

SEQ ID NO: 1979443 - RNA, 15 nt, Homo sapiens
agcuacuauauguca

SEQ ID NO: 1979444 - RNA, 23 nt, Homo sapiens
uggucaaaaucugcaaacucuaa

SEQ ID NO: 1979445 - RNA, 21 nt, Homo sapiens
aucuccaggauugaagagcau

SEQ ID NO: 1979446 - RNA, 19 nt, Homo sapiens
aucuugaaaugaaaguaua

SEQ ID NO: 1979447 - RNA, 21 nt, Homo sapiens
uuccuaugcuuugaaacagaa

SEQ ID NO: 1979448 - RNA, 19 nt, Homo sapiens
cagugacaacaucgcaaua

SEQ ID NO: 1979449 - RNA, 19 nt, Homo sapiens
aggcaaaugcccaagggaa

SEQ ID NO: 1979450 - RNA, 18 nt, Homo sapiens
cucaggccucucuacaag

SEQ ID NO: 1979451 - RNA, 21 nt, Homo sapiens
ucaguaaaacauaauguauca

SEQ ID NO: 1979452 - RNA, 19 nt, Homo sapiens
aacaacucguguucacuca

SEQ ID NO: 1979453 - RNA, 13 nt, Homo sapiens
uguguccugauga

SEQ ID NO: 1979454 - RNA, 13 nt, Homo sapiens
uguauccugauaa

SEQ ID NO: 1979455 - RNA, 18 nt, Homo sapiens
agagagauuccaucucaa

SEQ ID NO: 1979456 - RNA, 18 nt, Homo sapiens
guggaugcugagcuguga

SEQ ID NO: 1979457 - RNA, 20 nt, Homo sapiens
aguacacuugguguacuggg

SEQ ID NO: 1979458 - RNA, 18 nt, Homo sapiens
uaauuggccaugucgcca

SEQ ID NO: 1979459 - RNA, 14 nt, Homo sapiens
aaccucuacagggu

SEQ ID NO: 1979460 - RNA, 12 nt, Homo sapiens
guccugcacugu

SEQ ID NO: 1979461 - RNA, 18 nt, Homo sapiens
cagcagcacaaacauugc

SEQ ID NO: 1979462 - RNA, 20 nt, Homo sapiens
ucacaauaccucaugcuuca

SEQ ID NO: 1979463 - RNA, 15 nt, Homo sapiens
ugcuguguccucuag

SEQ ID NO: 1979464 - RNA, 20 nt, Homo sapiens
ccacauguacagacauacau

SEQ ID NO: 1979465 - RNA, 19 nt, Homo sapiens
gcuuuugcauuaaucuaag

SEQ ID NO: 1979466 - RNA, 18 nt, Homo sapiens
uccccacauauggcacaa

SEQ ID NO: 1979467 - RNA, 18 nt, Homo sapiens
uuuaccuucaaacuuuag

SEQ ID NO: 1979468 - RNA, 12 nt, Homo sapiens
gucacacacuga

SEQ ID NO: 1979469 - RNA, 12 nt, Homo sapiens
cugacacaguca

SEQ ID NO: 1979470 - RNA, 18 nt, Homo sapiens
caaacacaggauuuguaa

SEQ ID NO: 1979471 - RNA, 11 nt, Homo sapiens
agcagcacuuu

SEQ ID NO: 1979472 - RNA, 12 nt, Homo sapiens
ucaguaugugga

SEQ ID NO: 1979473 - RNA, 19 nt, Homo sapiens
agaugugggcagugauguc

SEQ ID NO: 1979474 - RNA, 14 nt, Homo sapiens
uggcagcucuccag

SEQ ID NO: 1979475 - RNA, 19 nt, Homo sapiens
aguaacgggacaguaaaca

SEQ ID NO: 1979476 - RNA, 22 nt, Homo sapiens
gauguuuuaaguuuaucuuuca

SEQ ID NO: 1979477 - RNA, 15 nt, Homo sapiens
cuguaaauaaccuau

SEQ ID NO: 1979478 - RNA, 18 nt, Homo sapiens
ucaauccugggcaaucag

SEQ ID NO: 1979479 - RNA, 19 nt, Homo sapiens
cagaugcaagccuguauca

SEQ ID NO: 1979480 - RNA, 15 nt, Homo sapiens
uucggagcuauacau

SEQ ID NO: 1979481 - RNA, 22 nt, Homo sapiens
cagagacacuaacgacuucagg

SEQ ID NO: 1979482 - RNA, 18 nt, Homo sapiens
acaggcaccucuccugcc

SEQ ID NO: 1979483 - RNA, 17 nt, Homo sapiens
guccuaggucaugaagg

SEQ ID NO: 1979484 - RNA, 19 nt, Homo sapiens
cagaacuccugcauggcuc

SEQ ID NO: 1979485 - RNA, 17 nt, Homo sapiens
auacucaauuuacuaau

SEQ ID NO: 1979486 - RNA, 18 nt, Homo sapiens
cagaguggaaacucagcc

SEQ ID NO: 1979487 - RNA, 21 nt, Homo sapiens
ccacaaaggccaaacugcugg

SEQ ID NO: 1979488 - RNA, 15 nt, Homo sapiens
caaagggcaguuuug

SEQ ID NO: 1979489 - RNA, 17 nt, Homo sapiens
ucucugaagcauguuuc

SEQ ID NO: 1979490 - RNA, 16 nt, Homo sapiens
aaguguccuucuugcu

SEQ ID NO: 1979491 - RNA, 22 nt, Homo sapiens
aguuauuucaaccagcacauuc

SEQ ID NO: 1979492 - RNA, 13 nt, Homo sapiens
aguagcacgcccu

SEQ ID NO: 1979493 - RNA, 16 nt, Homo sapiens
ugguuuugugcuuuaa

SEQ ID NO: 1979494 - RNA, 16 nt, Homo sapiens
aaccugugaagcugaa

SEQ ID NO: 1979495 - RNA, 19 nt, Homo sapiens
uguuuguguggauacccag

SEQ ID NO: 1979496 - RNA, 17 nt, Homo sapiens
ccuguucccaagcaaag

SEQ ID NO: 1979497 - RNA, 15 nt, Homo sapiens
gcucagaacaguauc

SEQ ID NO: 1979498 - RNA, 22 nt, Homo sapiens
ccuccgccugggucaugggccu

SEQ ID NO: 1979499 - RNA, 19 nt, Homo sapiens
gccugugaucguguguugc

SEQ ID NO: 1979500 - RNA, 11 nt, Homo sapiens
acccugccauu

SEQ ID NO: 1979501 - RNA, 17 nt, Homo sapiens
auuugagacagagucuc

SEQ ID NO: 1979502 - RNA, 20 nt, Homo sapiens
cagggaauccagccaugacc

SEQ ID NO: 1979503 - RNA, 12 nt, Homo sapiens
auuuuacuguau

SEQ ID NO: 1979504 - RNA, 23 nt, Homo sapiens
aggcucuccaaauuuugcuuuag

SEQ ID NO: 1979505 - RNA, 16 nt, Homo sapiens
guaggugggucuugga

SEQ ID NO: 1979506 - RNA, 14 nt, Homo sapiens
auucccugccuugc

SEQ ID NO: 1979507 - RNA, 22 nt, Homo sapiens
aaguguuuuuuauugaaugcuu

SEQ ID NO: 1979508 - RNA, 15 nt, Homo sapiens
ccacucaggugcaca

SEQ ID NO: 1979509 - RNA, 23 nt, Homo sapiens
uuccaaucuguccuguuacaaaa

SEQ ID NO: 1979510 - RNA, 20 nt, Homo sapiens
agaggcuccucucaggcugg

SEQ ID NO: 1979511 - RNA, 21 nt, Homo sapiens
guccauccuccucuccaugca

SEQ ID NO: 1979512 - RNA, 17 nt, Homo sapiens
cgcucacaccuguaauc

SEQ ID NO: 1979513 - RNA, 15 nt, Homo sapiens
uaccagggucucuca

SEQ ID NO: 1979514 - RNA, 20 nt, Homo sapiens
agugucuggguuuggcccaa

SEQ ID NO: 1979515 - RNA, 18 nt, Homo sapiens
uaucuugaaaaaguauug

SEQ ID NO: 1979516 - RNA, 14 nt, Homo sapiens
uuaauccuucuaac

SEQ ID NO: 1979517 - RNA, 14 nt, Homo sapiens
uuauuccuucuuac

SEQ ID NO: 1979518 - RNA, 16 nt, Homo sapiens
aaagcaucaccucagg

SEQ ID NO: 1979519 - RNA, 17 nt, Homo sapiens
acauacuuacaugugug

SEQ ID NO: 1979520 - RNA, 16 nt, Homo sapiens
cugaugagaauacuga

SEQ ID NO: 1979521 - RNA, 16 nt, Homo sapiens
cuuccuucuuacuugc

SEQ ID NO: 1979522 - RNA, 19 nt, Homo sapiens
gaugcaggccucugguguu

SEQ ID NO: 1979523 - RNA, 15 nt, Homo sapiens
gugaacucuggugcu

SEQ ID NO: 1979524 - RNA, 16 nt, Homo sapiens
ucuguggucacaguga

SEQ ID NO: 1979525 - RNA, 12 nt, Homo sapiens
cucauacauaaa

SEQ ID NO: 1979526 - RNA, 12 nt, Homo sapiens
caaauacauuca

SEQ ID NO: 1979527 - RNA, 13 nt, Homo sapiens
uagcucacacuca

SEQ ID NO: 1979528 - RNA, 15 nt, Homo sapiens
aaauuagccagacau

SEQ ID NO: 1979529 - RNA, 18 nt, Homo sapiens
gauccuuccucccaccuc

SEQ ID NO: 1979530 - RNA, 16 nt, Homo sapiens
aaccaucacagcuggg

SEQ ID NO: 1979531 - RNA, 13 nt, Homo sapiens
auuucuagcagag

SEQ ID NO: 1979532 - RNA, 13 nt, Homo sapiens
cuucuugaauuca

SEQ ID NO: 1979533 - RNA, 18 nt, Homo sapiens
agcauuuucaaugauguu

SEQ ID NO: 1979534 - RNA, 22 nt, Homo sapiens
uccaggacugugccagcacaaa

SEQ ID NO: 1979535 - RNA, 18 nt, Homo sapiens
aaaagcauguacaguguu

SEQ ID NO: 1979536 - RNA, 20 nt, Homo sapiens
auuuaaagugaacacacaca

SEQ ID NO: 1979537 - RNA, 15 nt, Homo sapiens
ucuucaagacucuga

SEQ ID NO: 1979538 - RNA, 17 nt, Homo sapiens
ggagcaaaaagcaacuu

SEQ ID NO: 1979539 - RNA, 22 nt, Homo sapiens
agcaaugcugaugaaucacugu

SEQ ID NO: 1979540 - RNA, 15 nt, Homo sapiens
aauguaauaauggaa

SEQ ID NO: 1979541 - RNA, 16 nt, Homo sapiens
uugcagcugugagaag

SEQ ID NO: 1979542 - RNA, 18 nt, Homo sapiens
guuccaaguauuuugcca

SEQ ID NO: 1979543 - RNA, 18 nt, Homo sapiens
augucauuuuccaaaaau

SEQ ID NO: 1979544 - RNA, 16 nt, Homo sapiens
aaucuacugucaauuu

SEQ ID NO: 1979545 - RNA, 16 nt, Homo sapiens
ugcugccacacugucu

SEQ ID NO: 1979546 - RNA, 18 nt, Homo sapiens
agaagcccagacuuccuu

SEQ ID NO: 1979547 - RNA, 19 nt, Homo sapiens
aacauuauuaaguaacuua

SEQ ID NO: 1979548 - RNA, 15 nt, Homo sapiens
ggaacuuugucacau

SEQ ID NO: 1979549 - RNA, 12 nt, Homo sapiens
cuugucauccac

SEQ ID NO: 1979550 - RNA, 16 nt, Homo sapiens
ggguaaacuguucuaa

SEQ ID NO: 1979551 - RNA, 16 nt, Homo sapiens
guuauugcacaaguuc

SEQ ID NO: 1979552 - RNA, 18 nt, Homo sapiens
cccaguagcugggaccac

SEQ ID NO: 1979553 - RNA, 23 nt, Homo sapiens
auacagugcucgccacagugggc

SEQ ID NO: 1979554 - RNA, 17 nt, Homo sapiens
aaagguagugaguaauu

SEQ ID NO: 1979555 - RNA, 13 nt, Homo sapiens
uaagugcuucaca

SEQ ID NO: 1979556 - RNA, 18 nt, Homo sapiens
ugaugagauacauuugau

SEQ ID NO: 1979557 - RNA, 15 nt, Homo sapiens
uaucaagucauggca

SEQ ID NO: 1979558 - RNA, 15 nt, Homo sapiens
auucuucauugcuug

SEQ ID NO: 1979559 - RNA, 16 nt, Homo sapiens
aaaguguuuguuggca

SEQ ID NO: 1979560 - RNA, 15 nt, Homo sapiens
ugggcugucagcuuu

SEQ ID NO: 1979561 - RNA, 13 nt, Homo sapiens
gaaauuucugugc

SEQ ID NO: 1979562 - RNA, 21 nt, Homo sapiens
auacauuauuucuguauauag

SEQ ID NO: 1979563 - RNA, 11 nt, Homo sapiens
gccagggaugg

SEQ ID NO: 1979564 - RNA, 15 nt, Homo sapiens
gccggucccccaugc

SEQ ID NO: 1979565 - RNA, 18 nt, Homo sapiens
gcaguagugcaccaucuc

SEQ ID NO: 1979566 - RNA, 20 nt, Homo sapiens
cagccuguaaacggugcuau

SEQ ID NO: 1979567 - RNA, 18 nt, Homo sapiens
aaggagggugagugcaag

SEQ ID NO: 1979568 - RNA, 17 nt, Homo sapiens
cugucuuagaucaggag

SEQ ID NO: 1979569 - RNA, 17 nt, Homo sapiens
uaucaggggugcauucu

SEQ ID NO: 1979570 - RNA, 19 nt, Homo sapiens
gauuuuggccacacuguca

SEQ ID NO: 1979571 - RNA, 18 nt, Homo sapiens
cagaucuguaauucacua

SEQ ID NO: 1979572 - RNA, 21 nt, Homo sapiens
uuguaaaugagugccacaaaa

SEQ ID NO: 1979573 - RNA, 22 nt, Homo sapiens
auauuagacaaaguucauucaa

SEQ ID NO: 1979574 - RNA, 16 nt, Homo sapiens
ugaaggaaugcaauaa

SEQ ID NO: 1979575 - RNA, 16 nt, Homo sapiens
uggggaagcuucuuaa

SEQ ID NO: 1979576 - RNA, 17 nt, Homo sapiens
aauacuuuauagcacau

SEQ ID NO: 1979577 - RNA, 18 nt, Homo sapiens
cugaaugugauacaugcc

SEQ ID NO: 1979578 - RNA, 15 nt, Homo sapiens
aaaccaccucagaaa

SEQ ID NO: 1979579 - RNA, 18 nt, Homo sapiens
agggugggggugauacua

SEQ ID NO: 1979580 - RNA, 20 nt, Homo sapiens
uguguuugggauacugcuua

SEQ ID NO: 1979581 - RNA, 17 nt, Homo sapiens
ugugaauccaucuugcu

SEQ ID NO: 1979582 - RNA, 16 nt, Homo sapiens
acaggaggucagcaca

SEQ ID NO: 1979583 - RNA, 14 nt, Homo sapiens
cccaaagugcacug

SEQ ID NO: 1979584 - RNA, 14 nt, Homo sapiens
auuaaaagacuguu

SEQ ID NO: 1979585 - RNA, 13 nt, Homo sapiens
aacuuugucacuu

SEQ ID NO: 1979586 - RNA, 16 nt, Homo sapiens
ugcuuaccugugagau

SEQ ID NO: 1979587 - RNA, 19 nt, Homo sapiens
gcugagguuugcacuuccu

SEQ ID NO: 1979588 - RNA, 20 nt, Homo sapiens
agaggucuuaucuguucagu

SEQ ID NO: 1979589 - RNA, 14 nt, Homo sapiens
uauguucacaguua

SEQ ID NO: 1979590 - RNA, 23 nt, Homo sapiens
ccccauguaucucaguaccccau

SEQ ID NO: 1979591 - RNA, 17 nt, Homo sapiens
ugccagaugcaauacaa

SEQ ID NO: 1979592 - RNA, 22 nt, Homo sapiens
augacauuucacugaugcuucu

SEQ ID NO: 1979593 - RNA, 19 nt, Homo sapiens
cuagauguccaagugccac

SEQ ID NO: 1979594 - RNA, 15 nt, Homo sapiens
ugggucuucccugua

SEQ ID NO: 1979595 - RNA, 19 nt, Homo sapiens
cucuaaacugguacaauuu

SEQ ID NO: 1979596 - RNA, 21 nt, Homo sapiens
uggauucaauuuuaaggcaua

SEQ ID NO: 1979597 - RNA, 21 nt, Homo sapiens
uccaaagaaauguaagggaaa

SEQ ID NO: 1979598 - RNA, 15 nt, Homo sapiens
aggguaaggcugugg

SEQ ID NO: 1979599 - RNA, 20 nt, Homo sapiens
caacagaacauauguugcaa

SEQ ID NO: 1979600 - RNA, 14 nt, Homo sapiens
gcccucugcuaaag

SEQ ID NO: 1979601 - RNA, 18 nt, Homo sapiens
aagaaaaaaaucuucucc

SEQ ID NO: 1979602 - RNA, 20 nt, Homo sapiens
aauaaaugaacugacuucaa

SEQ ID NO: 1979603 - RNA, 13 nt, Homo sapiens
agugcuaccucuc

SEQ ID NO: 1979604 - RNA, 13 nt, Homo sapiens
aacugugaugaag

SEQ ID NO: 1979605 - RNA, 19 nt, Homo sapiens
auauuacccagcugaauag

SEQ ID NO: 1979606 - RNA, 17 nt, Homo sapiens
acauucaguucuuauca

SEQ ID NO: 1979607 - RNA, 23 nt, Homo sapiens
gcagcuaugcuggaaaacugagc

SEQ ID NO: 1979608 - RNA, 16 nt, Homo sapiens
aaauaaacauguauaa

SEQ ID NO: 1979609 - RNA, 12 nt, Homo sapiens
ugcaggccaguc

SEQ ID NO: 1979610 - RNA, 22 nt, Homo sapiens
gaggagagauauuuugauucuc

SEQ ID NO: 1979611 - RNA, 20 nt, Homo sapiens
acgggucuguguucgacuca

SEQ ID NO: 1979612 - RNA, 14 nt, Homo sapiens
uaaagaccugagaa

SEQ ID NO: 1979613 - RNA, 15 nt, Homo sapiens
uauacucuucaagga

SEQ ID NO: 1979614 - RNA, 22 nt, Homo sapiens
auguaagauuauagauucuaaa

SEQ ID NO: 1979615 - RNA, 14 nt, Homo sapiens
uaccugcacacugu

SEQ ID NO: 1979616 - RNA, 14 nt, Homo sapiens
uuccauaugcucuu

SEQ ID NO: 1979617 - RNA, 12 nt, Homo sapiens
gccauacuucug

SEQ ID NO: 1979618 - RNA, 15 nt, Homo sapiens
aucuuccauggauuu

SEQ ID NO: 1979619 - RNA, 23 nt, Homo sapiens
gagcaaaagccucagaaagggau

SEQ ID NO: 1979620 - RNA, 18 nt, Homo sapiens
uguccauguuggccucca

SEQ ID NO: 1979621 - RNA, 24 nt, Homo sapiens
cugcucguugccugccacugagca

SEQ ID NO: 1979622 - RNA, 17 nt, Homo sapiens
uacacacauauacauau

SEQ ID NO: 1979623 - RNA, 23 nt, Homo sapiens
agcacacacuucacaaagccaag

SEQ ID NO: 1979624 - RNA, 16 nt, Homo sapiens
acauaguuaaaugugc

SEQ ID NO: 1979625 - RNA, 13 nt, Homo sapiens
gcaacugaauaaa

SEQ ID NO: 1979626 - RNA, 21 nt, Homo sapiens
uagcaaaggaaaaauugauga

SEQ ID NO: 1979627 - RNA, 14 nt, Homo sapiens
gugaccuggccaga

SEQ ID NO: 1979628 - RNA, 14 nt, Homo sapiens
ucaucaaacuccac

SEQ ID NO: 1979629 - RNA, 22 nt, Homo sapiens
ugaugugacgcuacuaaccuga

SEQ ID NO: 1979630 - RNA, 16 nt, Homo sapiens
aaugaagaccaugccu

SEQ ID NO: 1979631 - RNA, 19 nt, Homo sapiens
gcugccucccuggggacca

SEQ ID NO: 1979632 - RNA, 17 nt, Homo sapiens
cugagcuuguucauccu

SEQ ID NO: 1979633 - RNA, 20 nt, Homo sapiens
aggguuuuaucucugucuac

SEQ ID NO: 1979634 - RNA, 14 nt, Homo sapiens
cagagaacccugug

SEQ ID NO: 1979635 - RNA, 22 nt, Homo sapiens
auuuaaugaagacccaguguaa

SEQ ID NO: 1979636 - RNA, 16 nt, Homo sapiens
agucuuuccugauaua

SEQ ID NO: 1979637 - RNA, 15 nt, Homo sapiens
cuuuauuagcuuucu

SEQ ID NO: 1979638 - RNA, 16 nt, Homo sapiens
aggacugaagauuuca

SEQ ID NO: 1979639 - RNA, 20 nt, Homo sapiens
gcauuauguacacaggucaa

SEQ ID NO: 1979640 - RNA, 12 nt, Homo sapiens
ucccauguauuu

SEQ ID NO: 1979641 - RNA, 20 nt, Homo sapiens
ucuuauaagaaaacauguaa

SEQ ID NO: 1979642 - RNA, 19 nt, Homo sapiens
cugcacuccagucuggcaa

SEQ ID NO: 1979643 - RNA, 17 nt, Homo sapiens
aaaguuauuuaugcuau

SEQ ID NO: 1979644 - RNA, 18 nt, Homo sapiens
acccaccuggauucccug

SEQ ID NO: 1979645 - RNA, 13 nt, Homo sapiens
ggaaguccaucug

SEQ ID NO: 1979646 - RNA, 13 nt, Homo sapiens
guaacuccagcuc

SEQ ID NO: 1979647 - RNA, 14 nt, Homo sapiens
cuagagaugacuga

SEQ ID NO: 1979648 - RNA, 14 nt, Homo sapiens
aggagaccagcuca

SEQ ID NO: 1979649 - RNA, 19 nt, Homo sapiens
aacaucucaucaguaucca

SEQ ID NO: 1979650 - RNA, 14 nt, Homo sapiens
uccaaaacuuuaag

SEQ ID NO: 1979651 - RNA, 18 nt, Homo sapiens
gagccucgguggccaugc

SEQ ID NO: 1979652 - RNA, 16 nt, Homo sapiens
ccagcuggugcugcaa

SEQ ID NO: 1979653 - RNA, 10 nt, Homo sapiens
gaacccagga

SEQ ID NO: 1979654 - RNA, 20 nt, Homo sapiens
caagaauauuguauguuaaa

SEQ ID NO: 1979655 - RNA, 17 nt, Homo sapiens
gaugccagggcuggaag

SEQ ID NO: 1979656 - RNA, 21 nt, Homo sapiens
acccaugagcguccaggugau

SEQ ID NO: 1979657 - RNA, 18 nt, Homo sapiens
ugacuggaguaaaccaug

SEQ ID NO: 1979658 - RNA, 17 nt, Homo sapiens
aguugcugcagauuccu

SEQ ID NO: 1979659 - RNA, 11 nt, Homo sapiens
cucaugucuca

SEQ ID NO: 1979660 - RNA, 16 nt, Homo sapiens
uuaaauaugauuugca

SEQ ID NO: 1979661 - RNA, 15 nt, Homo sapiens
caugauaaggcucuu

SEQ ID NO: 1979662 - RNA, 13 nt, Homo sapiens
gugcugggaccaa

SEQ ID NO: 1979663 - RNA, 21 nt, Homo sapiens
aaaccuugcuaauuuucucaa

SEQ ID NO: 1979664 - RNA, 17 nt, Homo sapiens
aaugauuucacagugug

SEQ ID NO: 1979665 - RNA, 18 nt, Homo sapiens
cuccaauuucaagaguga

SEQ ID NO: 1979666 - RNA, 23 nt, Homo sapiens
gcuuuuccagcgcgcucgucauu

SEQ ID NO: 1979667 - RNA, 18 nt, Homo sapiens
agacucuuccaccagagc

SEQ ID NO: 1979668 - RNA, 19 nt, Homo sapiens
gccucccacccgaugcugc

SEQ ID NO: 1979669 - RNA, 17 nt, Homo sapiens
aauuuuuuuuccuugcc

SEQ ID NO: 1979670 - RNA, 15 nt, Homo sapiens
cugugcuguguggaa

SEQ ID NO: 1979671 - RNA, 17 nt, Homo sapiens
uaaaccaucaucuugcc

SEQ ID NO: 1979672 - RNA, 20 nt, Homo sapiens
cacugacagauguguuugca

SEQ ID NO: 1979673 - RNA, 21 nt, Homo sapiens
uggaaaaacaggauacgauga

SEQ ID NO: 1979674 - RNA, 22 nt, Homo sapiens
ugcugaaugggacccuguugau

SEQ ID NO: 1979675 - RNA, 14 nt, Homo sapiens
gacaccucacugag

SEQ ID NO: 1979676 - RNA, 14 nt, Homo sapiens
ggacacaucaggaa

SEQ ID NO: 1979677 - RNA, 13 nt, Homo sapiens
aagacacagugac

SEQ ID NO: 1979678 - RNA, 13 nt, Homo sapiens
aacacacagucac

SEQ ID NO: 1979679 - RNA, 13 nt, Homo sapiens
gucaauauuugag

SEQ ID NO: 1979680 - RNA, 17 nt, Homo sapiens
cucaucagaaacucaaa

SEQ ID NO: 1979681 - RNA, 12 nt, Homo sapiens
auuuggggacca

SEQ ID NO: 1979682 - RNA, 22 nt, Homo sapiens
ggccuucaguuuauuuccacua

SEQ ID NO: 1979683 - RNA, 16 nt, Homo sapiens
gcccuccagggccagg

SEQ ID NO: 1979684 - RNA, 22 nt, Homo sapiens
cauuucuguugaggcugcagau

SEQ ID NO: 1979685 - RNA, 17 nt, Homo sapiens
gacaucuggacacuggg

SEQ ID NO: 1979686 - RNA, 17 nt, Homo sapiens
gagcucuguagccuggu

SEQ ID NO: 1979687 - RNA, 20 nt, Homo sapiens
acuucccgccuccaugacuc

SEQ ID NO: 1979688 - RNA, 14 nt, Homo sapiens
cagugcccucacag

SEQ ID NO: 1979689 - RNA, 18 nt, Homo sapiens
agaaucaugugaacccgg

SEQ ID NO: 1979690 - RNA, 14 nt, Homo sapiens
ucaacaacuuguga

SEQ ID NO: 1979691 - RNA, 18 nt, Homo sapiens
uacugccaaaacauuuau

SEQ ID NO: 1979692 - RNA, 22 nt, Homo sapiens
cuagccaucuugaucuguguuu

SEQ ID NO: 1979693 - RNA, 18 nt, Homo sapiens
ugcagacugauaccaccu

SEQ ID NO: 1979694 - RNA, 20 nt, Homo sapiens
auagccaagaucccaucucu

SEQ ID NO: 1979695 - RNA, 16 nt, Homo sapiens
uuuuuguaaacuggaa

SEQ ID NO: 1979696 - RNA, 20 nt, Homo sapiens
ucaagaaacagccagcaaga

SEQ ID NO: 1979697 - RNA, 21 nt, Homo sapiens
uaaaauguggucugccaaucu

SEQ ID NO: 1979698 - RNA, 18 nt, Homo sapiens
auagccaggcucucugcu

SEQ ID NO: 1979699 - RNA, 21 nt, Homo sapiens
cuuacgaucaggcacagguca

SEQ ID NO: 1979700 - RNA, 12 nt, Homo sapiens
uuaaaguaguuc

SEQ ID NO: 1979701 - RNA, 20 nt, Homo sapiens
uuguaaauacacauagcaug

SEQ ID NO: 1979702 - RNA, 13 nt, Homo sapiens
aggacgugucuca

SEQ ID NO: 1979703 - RNA, 23 nt, Homo sapiens
uucacagugcuggggaacaacca

SEQ ID NO: 1979704 - RNA, 22 nt, Homo sapiens
caccagccaggcucugugcuga

SEQ ID NO: 1979705 - RNA, 18 nt, Homo sapiens
agauggauguuugucaaa

SEQ ID NO: 1979706 - RNA, 22 nt, Homo sapiens
aucuaggcgaaaguaaugggga

SEQ ID NO: 1979707 - RNA, 18 nt, Homo sapiens
aaucuuauguuuccaaga

SEQ ID NO: 1979708 - RNA, 16 nt, Homo sapiens
augcugaacaucacag

SEQ ID NO: 1979709 - RNA, 22 nt, Homo sapiens
ugcuacacauaugugcuucuca

SEQ ID NO: 1979710 - RNA, 14 nt, Homo sapiens
augaccccacaggu

SEQ ID NO: 1979711 - RNA, 17 nt, Homo sapiens
agucaucaugaacuggc

SEQ ID NO: 1979712 - RNA, 23 nt, Homo sapiens
aaacuuuuuuuuccuacuaucau

SEQ ID NO: 1979713 - RNA, 20 nt, Homo sapiens
uauuuuucuaaacguaagca

SEQ ID NO: 1979714 - RNA, 10 nt, Homo sapiens
aguccauuuc

SEQ ID NO: 1979715 - RNA, 20 nt, Homo sapiens
gucgcucucaugaagcccuu

SEQ ID NO: 1979716 - RNA, 22 nt, Homo sapiens
acaaggagauuucuuaguucau

SEQ ID NO: 1979717 - RNA, 23 nt, Homo sapiens
uucugauuucacucagggugaua

SEQ ID NO: 1979718 - RNA, 18 nt, Homo sapiens
gaaaauggagaaaaccag

SEQ ID NO: 1979719 - RNA, 21 nt, Homo sapiens
cuguuuauuaaaguacaacca

SEQ ID NO: 1979720 - RNA, 17 nt, Homo sapiens
ccacauuggcugccuua

SEQ ID NO: 1979721 - RNA, 16 nt, Homo sapiens
uccuguuuuugcaaaa

SEQ ID NO: 1979722 - RNA, 16 nt, Homo sapiens
ggaggcggcagugcaa

SEQ ID NO: 1979723 - RNA, 20 nt, Homo sapiens
agcugggggccaugagcucc

SEQ ID NO: 1979724 - RNA, 15 nt, Homo sapiens
auguauaaagugauu

SEQ ID NO: 1979725 - RNA, 14 nt, Homo sapiens
aaaggacaaaaaua

SEQ ID NO: 1979726 - RNA, 12 nt, Homo sapiens
cuggccaaaagc

SEQ ID NO: 1979727 - RNA, 14 nt, Homo sapiens
gagacugucaguag

SEQ ID NO: 1979728 - RNA, 15 nt, Homo sapiens
accucuccacacagg

SEQ ID NO: 1979729 - RNA, 17 nt, Homo sapiens
gauguauuuagcuugaa

SEQ ID NO: 1979730 - RNA, 14 nt, Homo sapiens
accuguacauucuu

SEQ ID NO: 1979731 - RNA, 17 nt, Homo sapiens
uucuguugucaccuuca

SEQ ID NO: 1979732 - RNA, 23 nt, Homo sapiens
uaacaaucaaaucugguauugaa

SEQ ID NO: 1979733 - RNA, 18 nt, Homo sapiens
cuugcucaaaaucuguga

SEQ ID NO: 1979734 - RNA, 16 nt, Homo sapiens
ugugauauacaaagug

SEQ ID NO: 1979735 - RNA, 15 nt, Homo sapiens
gcugaaggguaauau

SEQ ID NO: 1979736 - RNA, 21 nt, Homo sapiens
aaauuuagagucaauuugcug

SEQ ID NO: 1979737 - RNA, 22 nt, Homo sapiens
uguugcugagucugcagaugag

SEQ ID NO: 1979738 - RNA, 16 nt, Homo sapiens
acagcuuucugugcag

SEQ ID NO: 1979739 - RNA, 14 nt, Homo sapiens
acugaacauuccag

SEQ ID NO: 1979740 - RNA, 20 nt, Homo sapiens
accacaguuuauugauuuca

SEQ ID NO: 1979741 - RNA, 23 nt, Homo sapiens
ggauuugaagcaaagcaccagcu

SEQ ID NO: 1979742 - RNA, 21 nt, Homo sapiens
ggcaggaguagcugagcucac

SEQ ID NO: 1979743 - RNA, 23 nt, Homo sapiens
aaccucccacccugcaaagggaa

SEQ ID NO: 1979744 - RNA, 15 nt, Homo sapiens
aggccuguugcuuuu

SEQ ID NO: 1979745 - RNA, 23 nt, Homo sapiens
acuggcuucucuuucucugagug

SEQ ID NO: 1979746 - RNA, 16 nt, Homo sapiens
uguuuuaaguuuacug

SEQ ID NO: 1979747 - RNA, 13 nt, Homo sapiens
agcaacauuauuu

SEQ ID NO: 1979748 - RNA, 16 nt, Homo sapiens
acacaggcuguccuua

SEQ ID NO: 1979749 - RNA, 19 nt, Homo sapiens
aggaugucaccaacugaau

SEQ ID NO: 1979750 - RNA, 19 nt, Homo sapiens
auacugcauuucacucugg

SEQ ID NO: 1979751 - RNA, 14 nt, Homo sapiens
uauacauacuauga

SEQ ID NO: 1979752 - RNA, 15 nt, Homo sapiens
cuagaguucauggau

SEQ ID NO: 1979753 - RNA, 14 nt, Homo sapiens
auacauaccacuuu

SEQ ID NO: 1979754 - RNA, 20 nt, Homo sapiens
gccgacucccccaaccaagg

SEQ ID NO: 1979755 - RNA, 20 nt, Homo sapiens
uauaguuaaucuauaacuac

SEQ ID NO: 1979756 - RNA, 23 nt, Homo sapiens
agcucuuuaacaugguucaggua

SEQ ID NO: 1979757 - RNA, 21 nt, Homo sapiens
ccuguguugucucuagagcag

SEQ ID NO: 1979758 - RNA, 19 nt, Homo sapiens
aaacacagacauucugcca

SEQ ID NO: 1979759 - RNA, 23 nt, Homo sapiens
ccccaggccuuuuccacuuugag

SEQ ID NO: 1979760 - RNA, 18 nt, Homo sapiens
uccugccuugaugaagcc

SEQ ID NO: 1979761 - RNA, 15 nt, Homo sapiens
aacugugcaaggccu

SEQ ID NO: 1979762 - RNA, 18 nt, Homo sapiens
uguuugcccuuuggccag

SEQ ID NO: 1979763 - RNA, 20 nt, Homo sapiens
gccccugugccucuguccua

SEQ ID NO: 1979764 - RNA, 12 nt, Homo sapiens
cucuugugcauu

SEQ ID NO: 1979765 - RNA, 12 nt, Homo sapiens
aaccugugauuc

SEQ ID NO: 1979766 - RNA, 16 nt, Homo sapiens
agcacaaacugccauu

SEQ ID NO: 1979767 - RNA, 23 nt, Homo sapiens
uggcucacugcaagcucugccuc

SEQ ID NO: 1979768 - RNA, 13 nt, Homo sapiens
ccaauaaagugac

SEQ ID NO: 1979769 - RNA, 16 nt, Homo sapiens
uggcuggccaggacac

SEQ ID NO: 1979770 - RNA, 22 nt, Homo sapiens
ccagaggagcagaccagcacuu

SEQ ID NO: 1979771 - RNA, 12 nt, Homo sapiens
uauaaacuguga

SEQ ID NO: 1979772 - RNA, 17 nt, Homo sapiens
aaacccagaucgcugug

SEQ ID NO: 1979773 - RNA, 19 nt, Homo sapiens
accuugugacccagcacug

SEQ ID NO: 1979774 - RNA, 18 nt, Homo sapiens
aggaaaggggcgagcacc

SEQ ID NO: 1979775 - RNA, 18 nt, Homo sapiens
ucugugacaugcuaauua

SEQ ID NO: 1979776 - RNA, 21 nt, Homo sapiens
gcuggccagcauuuucauuca

SEQ ID NO: 1979777 - RNA, 13 nt, Homo sapiens
aauuuuacaguaa

SEQ ID NO: 1979778 - RNA, 16 nt, Homo sapiens
gagucgcugugccaca

SEQ ID NO: 1979779 - RNA, 23 nt, Homo sapiens
cuaaagccaaaguuucuguugaa

SEQ ID NO: 1979780 - RNA, 17 nt, Homo sapiens
aucacuuggagccagga

SEQ ID NO: 1979781 - RNA, 14 nt, Homo sapiens
ucccgucgugcagu

SEQ ID NO: 1979782 - RNA, 14 nt, Homo sapiens
auuucaguucacug

SEQ ID NO: 1979783 - RNA, 20 nt, Homo sapiens
uaaacagcuucaugccuuug

SEQ ID NO: 1979784 - RNA, 16 nt, Homo sapiens
gccacccauucuuccc

SEQ ID NO: 1979785 - RNA, 21 nt, Homo sapiens
auuuauaugucagagcuguua

SEQ ID NO: 1979786 - RNA, 21 nt, Homo sapiens
ugcucaauaaaguacaagagc

SEQ ID NO: 1979787 - RNA, 21 nt, Homo sapiens
ugcacuguauauagaagucua

SEQ ID NO: 1979788 - RNA, 23 nt, Homo sapiens
accuaguucuccccgauggggca

SEQ ID NO: 1979789 - RNA, 15 nt, Homo sapiens
ucauguuugugcaug

SEQ ID NO: 1979790 - RNA, 17 nt, Homo sapiens
acauucccucucaucca

SEQ ID NO: 1979791 - RNA, 16 nt, Homo sapiens
ugcuggggccgaaaga

SEQ ID NO: 1979792 - RNA, 20 nt, Homo sapiens
uuuuuauaaaaaugagugcu

SEQ ID NO: 1979793 - RNA, 14 nt, Homo sapiens
cacuguauccauuc

SEQ ID NO: 1979794 - RNA, 16 nt, Homo sapiens
agauauacacauggau

SEQ ID NO: 1979795 - RNA, 17 nt, Homo sapiens
uucaauagcauaucaca

SEQ ID NO: 1979796 - RNA, 14 nt, Homo sapiens
auguaauucuacca

SEQ ID NO: 1979797 - RNA, 17 nt, Homo sapiens
guguuucgugggaacaa

SEQ ID NO: 1979798 - RNA, 18 nt, Homo sapiens
cugccaacuccaugucag

SEQ ID NO: 1979799 - RNA, 23 nt, Homo sapiens
gucguuuuguugccaaggcagaa

SEQ ID NO: 1979800 - RNA, 23 nt, Homo sapiens
ugugguggcacgcgccuguaauc

SEQ ID NO: 1979801 - RNA, 15 nt, Homo sapiens
aaguauccacagaaa

SEQ ID NO: 1979802 - RNA, 19 nt, Homo sapiens
cgagacaggacgaggcaga

SEQ ID NO: 1979803 - RNA, 17 nt, Homo sapiens
agccaucucaagcaagu

SEQ ID NO: 1979804 - RNA, 21 nt, Homo sapiens
aguuuaaaucaagauuaugau

SEQ ID NO: 1979805 - RNA, 12 nt, Homo sapiens
acuuccauuccc

SEQ ID NO: 1979806 - RNA, 13 nt, Homo sapiens
aaagcacugagca

SEQ ID NO: 1979807 - RNA, 17 nt, Homo sapiens
ugagaacccuugcacua

SEQ ID NO: 1979808 - RNA, 17 nt, Homo sapiens
cuccaucuccacuccag

SEQ ID NO: 1979809 - RNA, 20 nt, Homo sapiens
uugcgccauugcacuccagc

SEQ ID NO: 1979810 - RNA, 15 nt, Homo sapiens
gucugauaaacugac

SEQ ID NO: 1979811 - RNA, 18 nt, Homo sapiens
ucuugcuggucuagucac

SEQ ID NO: 1979812 - RNA, 20 nt, Homo sapiens
ugcuaacauaaaauccaaua

SEQ ID NO: 1979813 - RNA, 16 nt, Homo sapiens
ggaaaggguggaugcu

SEQ ID NO: 1979814 - RNA, 18 nt, Homo sapiens
guaaguuuaugcauacag

SEQ ID NO: 1979815 - RNA, 14 nt, Homo sapiens
cauggcuauccuag

SEQ ID NO: 1979816 - RNA, 18 nt, Homo sapiens
uaugcaaaccucaucuuu

SEQ ID NO: 1979817 - RNA, 23 nt, Homo sapiens
aaauacaaaggaagaacaucugg

SEQ ID NO: 1979818 - RNA, 13 nt, Homo sapiens
acaagguauuuac

SEQ ID NO: 1979819 - RNA, 23 nt, Homo sapiens
gcugggaacuucuaaacacuuca

SEQ ID NO: 1979820 - RNA, 23 nt, Homo sapiens
caaaauaaauagugucucuucaa

SEQ ID NO: 1979821 - RNA, 14 nt, Homo sapiens
gaacugacaaugaa

SEQ ID NO: 1979822 - RNA, 16 nt, Homo sapiens
ccucuuguucauguca

SEQ ID NO: 1979823 - RNA, 22 nt, Homo sapiens
augacuucugccccagcuuuau

SEQ ID NO: 1979824 - RNA, 22 nt, Homo sapiens
aaagauaaaaaaacagcuuuau

SEQ ID NO: 1979825 - RNA, 17 nt, Homo sapiens
aagagaucuuucuuucc

SEQ ID NO: 1979826 - RNA, 16 nt, Homo sapiens
gaauuuuucuuccuga

SEQ ID NO: 1979827 - RNA, 20 nt, Homo sapiens
gagggccaccuccacaccca

SEQ ID NO: 1979828 - RNA, 15 nt, Homo sapiens
cguuuucaccagcaa

SEQ ID NO: 1979829 - RNA, 21 nt, Homo sapiens
uucuauuaaaauuuagcccua

SEQ ID NO: 1979830 - RNA, 19 nt, Homo sapiens
aucccuacaucuaacucau

SEQ ID NO: 1979831 - RNA, 15 nt, Homo sapiens
ugaccccugccugug

SEQ ID NO: 1979832 - RNA, 22 nt, Homo sapiens
uaauuucaaucaaccaaaguua

SEQ ID NO: 1979833 - RNA, 17 nt, Homo sapiens
aauaaaaugcaaaugca

SEQ ID NO: 1979834 - RNA, 14 nt, Homo sapiens
cuuugcucugaaug

SEQ ID NO: 1979835 - RNA, 17 nt, Homo sapiens
ucauugaagacccucaa

SEQ ID NO: 1979836 - RNA, 13 nt, Homo sapiens
cuuugcauuccau

SEQ ID NO: 1979837 - RNA, 21 nt, Homo sapiens
gugaauacucuucccacauac

SEQ ID NO: 1979838 - RNA, 17 nt, Homo sapiens
aaaugugcuauacugca

SEQ ID NO: 1979839 - RNA, 19 nt, Homo sapiens
agaucgguaucuuuguaau

SEQ ID NO: 1979840 - RNA, 18 nt, Homo sapiens
aaaacagcuauuuuagua

SEQ ID NO: 1979841 - RNA, 13 nt, Homo sapiens
agcacuaaccaau

SEQ ID NO: 1979842 - RNA, 13 nt, Homo sapiens
uuaacauauauau

SEQ ID NO: 1979843 - RNA, 22 nt, Homo sapiens
cccaaggacacgacacacagua

SEQ ID NO: 1979844 - RNA, 16 nt, Homo sapiens
aauguuuaaagaucau

SEQ ID NO: 1979845 - RNA, 20 nt, Homo sapiens
ugguucguguucauacugca

SEQ ID NO: 1979846 - RNA, 22 nt, Homo sapiens
uuucuucuugugauugcugcca

SEQ ID NO: 1979847 - RNA, 16 nt, Homo sapiens
acccacuaacuggcua

SEQ ID NO: 1979848 - RNA, 17 nt, Homo sapiens
gcagccguuuuccucau

SEQ ID NO: 1979849 - RNA, 17 nt, Homo sapiens
uaaauacugcuguauaa

SEQ ID NO: 1979850 - RNA, 22 nt, Homo sapiens
ggcacucaggugugggccgaac

SEQ ID NO: 1979851 - RNA, 13 nt, Homo sapiens
uugcagggguccc

SEQ ID NO: 1979852 - RNA, 20 nt, Homo sapiens
uucuccaaagaagauaugca

SEQ ID NO: 1979853 - RNA, 14 nt, Homo sapiens
agagucgcaucuca

SEQ ID NO: 1979854 - RNA, 19 nt, Homo sapiens
agaccaagccggugcccac

SEQ ID NO: 1979855 - RNA, 15 nt, Homo sapiens
agugguuugaucauu

SEQ ID NO: 1979856 - RNA, 18 nt, Homo sapiens
auuucuaaaauguuaaaa

SEQ ID NO: 1979857 - RNA, 21 nt, Homo sapiens
aguacagacgucucaagacug

SEQ ID NO: 1979858 - RNA, 21 nt, Homo sapiens
ugucagacacuacaugaugac

SEQ ID NO: 1979859 - RNA, 12 nt, Homo sapiens
cagcgugggggu

SEQ ID NO: 1979860 - RNA, 13 nt, Homo sapiens
gcguccaggugau

SEQ ID NO: 1979861 - RNA, 22 nt, Homo sapiens
gcccaagcugggcucccuuuaa

SEQ ID NO: 1979862 - RNA, 16 nt, Homo sapiens
uucauaagguaauuca

SEQ ID NO: 1979863 - RNA, 19 nt, Homo sapiens
aggcaagauuggcauauca

SEQ ID NO: 1979864 - RNA, 16 nt, Homo sapiens
aaugaccuuuuuacaa

SEQ ID NO: 1979865 - RNA, 17 nt, Homo sapiens
ucacagacaccagcaaa

SEQ ID NO: 1979866 - RNA, 14 nt, Homo sapiens
caacuaugcaauga

SEQ ID NO: 1979867 - RNA, 19 nt, Homo sapiens
gaaugcggccucugagaca

SEQ ID NO: 1979868 - RNA, 21 nt, Homo sapiens
uauguauggaugcguggauau

SEQ ID NO: 1979869 - RNA, 14 nt, Homo sapiens
ugcuuuucauguag

SEQ ID NO: 1979870 - RNA, 14 nt, Homo sapiens
uuugccauguugcc

SEQ ID NO: 1979871 - RNA, 14 nt, Homo sapiens
ucauacaugcauac

SEQ ID NO: 1979872 - RNA, 22 nt, Homo sapiens
cuuuuaauggaugguugaauua

SEQ ID NO: 1979873 - RNA, 17 nt, Homo sapiens
gcuggcaaacugugaau

SEQ ID NO: 1979874 - RNA, 22 nt, Homo sapiens
auagcacguggagcucuuggcu

SEQ ID NO: 1979875 - RNA, 16 nt, Homo sapiens
ggucucccuauaccga

SEQ ID NO: 1979876 - RNA, 16 nt, Homo sapiens
cuugggcuccauuccc

SEQ ID NO: 1979877 - RNA, 19 nt, Homo sapiens
uccugcccccaaggaggca

SEQ ID NO: 1979878 - RNA, 18 nt, Homo sapiens
agggacuccagaagcagc

SEQ ID NO: 1979879 - RNA, 24 nt, Homo sapiens
ugaaagguuggccuuacuguugaa

SEQ ID NO: 1979880 - RNA, 23 nt, Homo sapiens
gauguuuugugaccagguuugug

SEQ ID NO: 1979881 - RNA, 12 nt, Homo sapiens
ccucuagcugaa

SEQ ID NO: 1979882 - RNA, 15 nt, Homo sapiens
auucuaaaagauaag

SEQ ID NO: 1979883 - RNA, 18 nt, Homo sapiens
ccacauuuucagccaaag

SEQ ID NO: 1979884 - RNA, 20 nt, Homo sapiens
gagugggguagguugggaga

SEQ ID NO: 1979885 - RNA, 20 nt, Homo sapiens
cagccucaagucacucccaa

SEQ ID NO: 1979886 - RNA, 21 nt, Homo sapiens
gagauguucgcucgugcagua

SEQ ID NO: 1979887 - RNA, 13 nt, Homo sapiens
augagcaguccag

SEQ ID NO: 1979888 - RNA, 22 nt, Homo sapiens
uuuaaacugaaugaacaaccuc

SEQ ID NO: 1979889 - RNA, 21 nt, Homo sapiens
caccgaccccaccaccugguu

SEQ ID NO: 1979890 - RNA, 22 nt, Homo sapiens
caguugacccuauuuuuugaca

SEQ ID NO: 1979891 - RNA, 20 nt, Homo sapiens
guuuggacuuuuauuuuggc

SEQ ID NO: 1979892 - RNA, 22 nt, Homo sapiens
uagcuuccccaccagcuuuauu

SEQ ID NO: 1979893 - RNA, 16 nt, Homo sapiens
gccacacgcaugggca

SEQ ID NO: 1979894 - RNA, 16 nt, Homo sapiens
cuauuuuuucuugaca

SEQ ID NO: 1979895 - RNA, 22 nt, Homo sapiens
aagugcuaugacagagguguga

SEQ ID NO: 1979896 - RNA, 18 nt, Homo sapiens
gcccaccgcaggccuuac

SEQ ID NO: 1979897 - RNA, 14 nt, Homo sapiens
acuuuaaaaugcca

SEQ ID NO: 1979898 - RNA, 17 nt, Homo sapiens
caccuugccuugcuguu

SEQ ID NO: 1979899 - RNA, 20 nt, Homo sapiens
acacucauuuuagugcuuug

SEQ ID NO: 1979900 - RNA, 15 nt, Homo sapiens
uuaaaguucauugca

SEQ ID NO: 1979901 - RNA, 21 nt, Homo sapiens
acuugaggcuggcacuccccu

SEQ ID NO: 1979902 - RNA, 21 nt, Homo sapiens
aauggagaagaaaggccauca

SEQ ID NO: 1979903 - RNA, 11 nt, Homo sapiens
ccuuggaccaa

SEQ ID NO: 1979904 - RNA, 19 nt, Homo sapiens
cuuuauauuuauccacuac

SEQ ID NO: 1979905 - RNA, 13 nt, Homo sapiens
gucuccagacucu

SEQ ID NO: 1979906 - RNA, 16 nt, Homo sapiens
cuuaaagcauuugcaa

SEQ ID NO: 1979907 - RNA, 15 nt, Homo sapiens
aacuuugucacuucu

SEQ ID NO: 1979908 - RNA, 15 nt, Homo sapiens
aacucugucacuccu

SEQ ID NO: 1979909 - RNA, 12 nt, Homo sapiens
acagacagccac

SEQ ID NO: 1979910 - RNA, 12 nt, Homo sapiens
caugucaccuca

SEQ ID NO: 1979911 - RNA, 14 nt, Homo sapiens
ucaucuugacaugu

SEQ ID NO: 1979912 - RNA, 16 nt, Homo sapiens
cacuccagcgcugagu

SEQ ID NO: 1979913 - RNA, 24 nt, Homo sapiens
agcuagcucgugacuacauugaaa

SEQ ID NO: 1979914 - RNA, 17 nt, Homo sapiens
cuaagccuuuccauaag

SEQ ID NO: 1979915 - RNA, 17 nt, Homo sapiens
ccccaugggcacagugg

SEQ ID NO: 1979916 - RNA, 16 nt, Homo sapiens
agggggaacaaaucac

SEQ ID NO: 1979917 - RNA, 23 nt, Homo sapiens
gauggcgaggccucucucaggag

SEQ ID NO: 1979918 - RNA, 20 nt, Homo sapiens
uuccugggacuaugcuguaa

SEQ ID NO: 1979919 - RNA, 17 nt, Homo sapiens
uauacuuuaguagacau

SEQ ID NO: 1979920 - RNA, 18 nt, Homo sapiens
agcuauaacuaagcaucc

SEQ ID NO: 1979921 - RNA, 15 nt, Homo sapiens
gcuacacuugcaccu

SEQ ID NO: 1979922 - RNA, 22 nt, Homo sapiens
uaguucacauacaaaucaucca

SEQ ID NO: 1979923 - RNA, 20 nt, Homo sapiens
auauuuaaaacaaagaagcu

SEQ ID NO: 1979924 - RNA, 13 nt, Homo sapiens
ucauguacugcau

SEQ ID NO: 1979925 - RNA, 23 nt, Homo sapiens
ugggagcugaaccacagaaauca

SEQ ID NO: 1979926 - RNA, 11 nt, Homo sapiens
gugugcucucu

SEQ ID NO: 1979927 - RNA, 18 nt, Homo sapiens
guggauuccgagugguga

SEQ ID NO: 1979928 - RNA, 13 nt, Homo sapiens
uucuucaccugua

SEQ ID NO: 1979929 - RNA, 18 nt, Homo sapiens
cacacgagcuagcuucug

SEQ ID NO: 1979930 - RNA, 21 nt, Homo sapiens
cugaauagcuucuccaaaggc

SEQ ID NO: 1979931 - RNA, 18 nt, Homo sapiens
cauauaaccuaugccaau

SEQ ID NO: 1979932 - RNA, 15 nt, Homo sapiens
gcccagagacacagc

SEQ ID NO: 1979933 - RNA, 22 nt, Homo sapiens
cacagcugagcaaucucuugca

SEQ ID NO: 1979934 - RNA, 17 nt, Homo sapiens
aaaggcccccaucacac

SEQ ID NO: 1979935 - RNA, 17 nt, Homo sapiens
ggugaaaccccaucucu

SEQ ID NO: 1979936 - RNA, 22 nt, Homo sapiens
cagggugaucgcacaaccugca

SEQ ID NO: 1979937 - RNA, 22 nt, Homo sapiens
uauagucgaacaauucauauau

SEQ ID NO: 1979938 - RNA, 22 nt, Homo sapiens
gaagaaaagaaaaaagucuuug

SEQ ID NO: 1979939 - RNA, 24 nt, Homo sapiens
uggagguauucaauauccuuugcc

SEQ ID NO: 1979940 - RNA, 12 nt, Homo sapiens
cuagagacucaa

SEQ ID NO: 1979941 - RNA, 22 nt, Homo sapiens
ugggcaagucauuguccucuga

SEQ ID NO: 1979942 - RNA, 21 nt, Homo sapiens
uuuucaaucauaauaccugcu

SEQ ID NO: 1979943 - RNA, 22 nt, Homo sapiens
aauuuaucuuugauaacaggga

SEQ ID NO: 1979944 - RNA, 19 nt, Homo sapiens
agaauauagacagugcccu

SEQ ID NO: 1979945 - RNA, 22 nt, Homo sapiens
cuucccgccuuccaaaaccugc

SEQ ID NO: 1979946 - RNA, 20 nt, Homo sapiens
ccaggacuuuguuaacuuca

SEQ ID NO: 1979947 - RNA, 14 nt, Homo sapiens
guuacaaguuuaua

SEQ ID NO: 1979948 - RNA, 20 nt, Homo sapiens
gagugacuuaguguacauga

SEQ ID NO: 1979949 - RNA, 20 nt, Homo sapiens
ccacuguggaagucccucag

SEQ ID NO: 1979950 - RNA, 22 nt, Homo sapiens
aucagaggugaaugcacaguga

SEQ ID NO: 1979951 - RNA, 21 nt, Homo sapiens
gcauaauguuucuggauuuca

SEQ ID NO: 1979952 - RNA, 19 nt, Homo sapiens
cugggcgcuucccuuuuaa

SEQ ID NO: 1979953 - RNA, 19 nt, Homo sapiens
uaauacuuuugcugaugcu

SEQ ID NO: 1979954 - RNA, 21 nt, Homo sapiens
auuuaagcaauaaaacugcua

SEQ ID NO: 1979955 - RNA, 22 nt, Homo sapiens
cugggacaccuuuaacacagac

SEQ ID NO: 1979956 - RNA, 14 nt, Homo sapiens
ccaagaaaugcaaa

SEQ ID NO: 1979957 - RNA, 15 nt, Homo sapiens
cugauccuggagaaa

SEQ ID NO: 1979958 - RNA, 13 nt, Homo sapiens
cuccucuagcucu

SEQ ID NO: 1979959 - RNA, 14 nt, Homo sapiens
augccuaacagaga

SEQ ID NO: 1979960 - RNA, 17 nt, Homo sapiens
auuaagucaugugugaa

SEQ ID NO: 1979961 - RNA, 22 nt, Homo sapiens
gguuacauaucaaaacauccca

SEQ ID NO: 1979962 - RNA, 13 nt, Homo sapiens
accccaacagcac

SEQ ID NO: 1979963 - RNA, 15 nt, Homo sapiens
gucaggcugcagagg

SEQ ID NO: 1979964 - RNA, 14 nt, Homo sapiens
caccacggcagcuc

SEQ ID NO: 1979965 - RNA, 15 nt, Homo sapiens
aucauacccuucccu

SEQ ID NO: 1979966 - RNA, 10 nt, Homo sapiens
caggaucuca

SEQ ID NO: 1979967 - RNA, 21 nt, Homo sapiens
agugcccucgagcacugaagu

SEQ ID NO: 1979968 - RNA, 22 nt, Homo sapiens
aaaaaugcugcuucuccuccca

SEQ ID NO: 1979969 - RNA, 15 nt, Homo sapiens
caggcucagaucuca

SEQ ID NO: 1979970 - RNA, 16 nt, Homo sapiens
caaaccuuuagcugug

SEQ ID NO: 1979971 - RNA, 13 nt, Homo sapiens
aagcuagcauuaa

SEQ ID NO: 1979972 - RNA, 19 nt, Homo sapiens
cagucuuuuuaaacuugua

SEQ ID NO: 1979973 - RNA, 15 nt, Homo sapiens
aagaguucuaaccau

SEQ ID NO: 1979974 - RNA, 13 nt, Homo sapiens
cuugccacagugu

SEQ ID NO: 1979975 - RNA, 15 nt, Homo sapiens
gcugcuuguccugcu

SEQ ID NO: 1979976 - RNA, 14 nt, Homo sapiens
caguucugaugcuu

SEQ ID NO: 1979977 - RNA, 21 nt, Homo sapiens
cugcggugaggcaggggaguc

SEQ ID NO: 1979978 - RNA, 21 nt, Homo sapiens
gcaguucugcacccagccaaa

SEQ ID NO: 1979979 - RNA, 18 nt, Homo sapiens
aaauucccgccuaauaaa

SEQ ID NO: 1979980 - RNA, 19 nt, Homo sapiens
uuuucaauuugagauucua

SEQ ID NO: 1979981 - RNA, 20 nt, Homo sapiens
uugccaauucauuucucuau

SEQ ID NO: 1979982 - RNA, 18 nt, Homo sapiens
acuaauucuaauguggac

SEQ ID NO: 1979983 - RNA, 24 nt, Homo sapiens
accagauauauagaaggacugcag

SEQ ID NO: 1979984 - RNA, 14 nt, Homo sapiens
caagccaggugcca

SEQ ID NO: 1979985 - RNA, 21 nt, Homo sapiens
aaaggcaugcgcucacugcuu

SEQ ID NO: 1979986 - RNA, 21 nt, Homo sapiens
cuccugagugagguguugcag

SEQ ID NO: 1979987 - RNA, 15 nt, Homo sapiens
cagccuccaagaaac

SEQ ID NO: 1979988 - RNA, 19 nt, Homo sapiens
auuucuuucuuuccuuaau

SEQ ID NO: 1979989 - RNA, 13 nt, Homo sapiens
ccagcacccaaag

SEQ ID NO: 1979990 - RNA, 19 nt, Homo sapiens
gacuggaugguccaguguc

SEQ ID NO: 1979991 - RNA, 14 nt, Homo sapiens
gacuuccacuuugu

SEQ ID NO: 1979992 - RNA, 13 nt, Homo sapiens
gcggccucuugcu

SEQ ID NO: 1979993 - RNA, 22 nt, Homo sapiens
ucuuuggggagagcuggcagug

SEQ ID NO: 1979994 - RNA, 17 nt, Homo sapiens
auguccauucacuuuca

SEQ ID NO: 1979995 - RNA, 18 nt, Homo sapiens
gccagccgugagugcaga

SEQ ID NO: 1979996 - RNA, 13 nt, Homo sapiens
aacauuguacugu

SEQ ID NO: 1979997 - RNA, 21 nt, Homo sapiens
agguaaagcguuugcauuugc

SEQ ID NO: 1979998 - RNA, 18 nt, Homo sapiens
uacccccugccccagaga

SEQ ID NO: 1979999 - RNA, 14 nt, Homo sapiens
aagacagaauguca

SEQ ID NO: 1980000 - RNA, 14 nt, Homo sapiens
aagagugaaugugu

SEQ ID NO: 1980001 - RNA, 18 nt, Homo sapiens
auuuaaaaauuguuuauu

SEQ ID NO: 1980002 - RNA, 14 nt, Homo sapiens
uagaugucuuuucc

SEQ ID NO: 1980003 - RNA, 22 nt, Homo sapiens
agcuccggcagaagcagcugca

SEQ ID NO: 1980004 - RNA, 14 nt, Homo sapiens
cucaaagaccccau

SEQ ID NO: 1980005 - RNA, 15 nt, Homo sapiens
aguccuuuucuugcu

SEQ ID NO: 1980006 - RNA, 15 nt, Homo sapiens
ugaccaaugugugaa

SEQ ID NO: 1980007 - RNA, 19 nt, Homo sapiens
agaaacuguagucucagga

SEQ ID NO: 1980008 - RNA, 19 nt, Homo sapiens
augcaaaaggguaagauga

SEQ ID NO: 1980009 - RNA, 21 nt, Homo sapiens
ugaaucauuguauguggucau

SEQ ID NO: 1980010 - RNA, 21 nt, Homo sapiens
cuguuggauuuuaagcaaaag

SEQ ID NO: 1980011 - RNA, 22 nt, Homo sapiens
ugcuucgggaagaaggggacaa

SEQ ID NO: 1980012 - RNA, 16 nt, Homo sapiens
aucaagagucucucca

SEQ ID NO: 1980013 - RNA, 21 nt, Homo sapiens
aggcgccccuucccccuccaa

SEQ ID NO: 1980014 - RNA, 22 nt, Homo sapiens
uggcuuuggcacucucugccau

SEQ ID NO: 1980015 - RNA, 12 nt, Homo sapiens
uuccaaagucac

SEQ ID NO: 1980016 - RNA, 23 nt, Homo sapiens
cugaggcuguauguuugaucaca

SEQ ID NO: 1980017 - RNA, 20 nt, Homo sapiens
caguaagcugcucuauugua

SEQ ID NO: 1980018 - RNA, 12 nt, Homo sapiens
ucauagcucacu

SEQ ID NO: 1980019 - RNA, 12 nt, Homo sapiens
ugccucaugccu

SEQ ID NO: 1980020 - RNA, 14 nt, Homo sapiens
cucuguuuacccuc

SEQ ID NO: 1980021 - RNA, 19 nt, Homo sapiens
cauuccauugccuagcucu

SEQ ID NO: 1980022 - RNA, 18 nt, Homo sapiens
cuccucggcagaugcugu

SEQ ID NO: 1980023 - RNA, 19 nt, Homo sapiens
cuugugucuuuggugggga

SEQ ID NO: 1980024 - RNA, 16 nt, Homo sapiens
ggacucucagggauuc

SEQ ID NO: 1980025 - RNA, 16 nt, Homo sapiens
cuuggggccagggaag

SEQ ID NO: 1980026 - RNA, 23 nt, Homo sapiens
accgaccccuccccagugccucu

SEQ ID NO: 1980027 - RNA, 19 nt, Homo sapiens
ggcccuguccuaagcacuu

SEQ ID NO: 1980028 - RNA, 22 nt, Homo sapiens
aagcacauuuucagacugcaau

SEQ ID NO: 1980029 - RNA, 20 nt, Homo sapiens
aguacagggcagaaccaaga

SEQ ID NO: 1980030 - RNA, 20 nt, Homo sapiens
aacucguguucacucagcac

SEQ ID NO: 1980031 - RNA, 21 nt, Homo sapiens
agugaccgcaccucacacucc

SEQ ID NO: 1980032 - RNA, 18 nt, Homo sapiens
acaaauacucauguguau

SEQ ID NO: 1980033 - RNA, 22 nt, Homo sapiens
guggaacuuuuauuagauaaca

SEQ ID NO: 1980034 - RNA, 19 nt, Homo sapiens
auuaaaaagauagacuuca

SEQ ID NO: 1980035 - RNA, 16 nt, Homo sapiens
cagaccugccucuucc

SEQ ID NO: 1980036 - RNA, 21 nt, Homo sapiens
cugagugacgacgugguggag

SEQ ID NO: 1980037 - RNA, 19 nt, Homo sapiens
cuucuccccugcacuguaa

SEQ ID NO: 1980038 - RNA, 20 nt, Homo sapiens
gauaccacuuuucauugcaa

SEQ ID NO: 1980039 - RNA, 15 nt, Homo sapiens
agccccgagacacca

SEQ ID NO: 1980040 - RNA, 14 nt, Homo sapiens
uucugugaagcaaa

SEQ ID NO: 1980041 - RNA, 20 nt, Homo sapiens
accuggcagacuugcccagg

SEQ ID NO: 1980042 - RNA, 20 nt, Homo sapiens
caguuacucccuacacugau

SEQ ID NO: 1980043 - RNA, 20 nt, Homo sapiens
uaaugaaccguuuacagugu

SEQ ID NO: 1980044 - RNA, 13 nt, Homo sapiens
ugguuauuuagaa

SEQ ID NO: 1980045 - RNA, 22 nt, Homo sapiens
accagauaaagaacuaaaucau

SEQ ID NO: 1980046 - RNA, 14 nt, Homo sapiens
uuuuucaugcuuua

SEQ ID NO: 1980047 - RNA, 14 nt, Homo sapiens
acuuuuaauuaaau

SEQ ID NO: 1980048 - RNA, 16 nt, Homo sapiens
ugugagguguugcuaa

SEQ ID NO: 1980049 - RNA, 21 nt, Homo sapiens
cucaggucgugcgaaacaccc

SEQ ID NO: 1980050 - RNA, 15 nt, Homo sapiens
uucucaccagcugca

SEQ ID NO: 1980051 - RNA, 17 nt, Homo sapiens
ugaaacaauguugucca

SEQ ID NO: 1980052 - RNA, 21 nt, Homo sapiens
aggaccuuaaaugcuacugaa

SEQ ID NO: 1980053 - RNA, 17 nt, Homo sapiens
cuccuaaaguacuggga

SEQ ID NO: 1980054 - RNA, 23 nt, Homo sapiens
gcaaaccuaaaugcagucaguca

SEQ ID NO: 1980055 - RNA, 15 nt, Homo sapiens
cccuagaaacccaag

SEQ ID NO: 1980056 - RNA, 15 nt, Homo sapiens
aaauaagacaacaga

SEQ ID NO: 1980057 - RNA, 20 nt, Homo sapiens
uugacacuauucacuaaaau

SEQ ID NO: 1980058 - RNA, 17 nt, Homo sapiens
caggccuccaagccagg

SEQ ID NO: 1980059 - RNA, 12 nt, Homo sapiens
ccaggagccuca

SEQ ID NO: 1980060 - RNA, 19 nt, Homo sapiens
gcuguggcuccugccuuga

SEQ ID NO: 1980061 - RNA, 19 nt, Homo sapiens
aggucuuggaacuugccug

SEQ ID NO: 1980062 - RNA, 21 nt, Homo sapiens
aagcaucuugcauuaugcaau

SEQ ID NO: 1980063 - RNA, 15 nt, Homo sapiens
ggaaggugugugaac

SEQ ID NO: 1980064 - RNA, 15 nt, Homo sapiens
ccaaucaguuuauac

SEQ ID NO: 1980065 - RNA, 17 nt, Homo sapiens
cuuuaaauuaugccguu

SEQ ID NO: 1980066 - RNA, 17 nt, Homo sapiens
uuccuuucauuuacugu

SEQ ID NO: 1980067 - RNA, 20 nt, Homo sapiens
acuagccaucucaagcaagu

SEQ ID NO: 1980068 - RNA, 13 nt, Homo sapiens
acuuugcuuuuag

SEQ ID NO: 1980069 - RNA, 18 nt, Homo sapiens
ucuaaaccagaggacaaa

SEQ ID NO: 1980070 - RNA, 19 nt, Homo sapiens
uaaaauccuaagacacaaa

SEQ ID NO: 1980071 - RNA, 22 nt, Homo sapiens
gccucucucucccaacugcugc

SEQ ID NO: 1980072 - RNA, 10 nt, Homo sapiens
uuucauaaac

SEQ ID NO: 1980073 - RNA, 21 nt, Homo sapiens
gucuacaugccaugaccuucc

SEQ ID NO: 1980074 - RNA, 11 nt, Homo sapiens
acaaugugaua

SEQ ID NO: 1980075 - RNA, 19 nt, Homo sapiens
ucaugagcuuggacagcaa

SEQ ID NO: 1980076 - RNA, 21 nt, Homo sapiens
aagggauggaagaaguaaaua

SEQ ID NO: 1980077 - RNA, 18 nt, Homo sapiens
uguaauuaccacauugcc

SEQ ID NO: 1980078 - RNA, 17 nt, Homo sapiens
ccuuucgagcucugcag

SEQ ID NO: 1980079 - RNA, 11 nt, Homo sapiens
ugcaugccaaa

SEQ ID NO: 1980080 - RNA, 15 nt, Homo sapiens
gcccuacauugugcu

SEQ ID NO: 1980081 - RNA, 18 nt, Homo sapiens
aaaugaguaaacccagcu

SEQ ID NO: 1980082 - RNA, 18 nt, Homo sapiens
ugaaacuccagaugccac

SEQ ID NO: 1980083 - RNA, 18 nt, Homo sapiens
cugacguagcugcaaagg

SEQ ID NO: 1980084 - RNA, 15 nt, Homo sapiens
auuuaucaacaaguu

SEQ ID NO: 1980085 - RNA, 15 nt, Homo sapiens
gagccaaagaauauu

SEQ ID NO: 1980086 - RNA, 13 nt, Homo sapiens
gcagaggggccag

SEQ ID NO: 1980087 - RNA, 13 nt, Homo sapiens
agagagggagcag

SEQ ID NO: 1980088 - RNA, 13 nt, Homo sapiens
gaagaggggacag

SEQ ID NO: 1980089 - RNA, 23 nt, Homo sapiens
auuacaggcgugagccaccucac

SEQ ID NO: 1980090 - RNA, 13 nt, Homo sapiens
ggacugcaccuug

SEQ ID NO: 1980091 - RNA, 16 nt, Homo sapiens
ugugcuggucauggaa

SEQ ID NO: 1980092 - RNA, 19 nt, Homo sapiens
uuccugaaaauugcaauac

SEQ ID NO: 1980093 - RNA, 20 nt, Homo sapiens
aaauacauaaaacaaaagca

SEQ ID NO: 1980094 - RNA, 21 nt, Homo sapiens
aaacugucgguuugcuuugau

SEQ ID NO: 1980095 - RNA, 18 nt, Homo sapiens
cucacugcaaccuccacc

SEQ ID NO: 1980096 - RNA, 15 nt, Homo sapiens
ccuucauuucaucua

SEQ ID NO: 1980097 - RNA, 17 nt, Homo sapiens
ccagagccacuaccuuu

SEQ ID NO: 1980098 - RNA, 18 nt, Homo sapiens
gagaucuucauggugaca

SEQ ID NO: 1980099 - RNA, 14 nt, Homo sapiens
uggagggggcugca

SEQ ID NO: 1980100 - RNA, 21 nt, Homo sapiens
uagaacccauaaccauacaca

SEQ ID NO: 1980101 - RNA, 14 nt, Homo sapiens
uccugccaguugaa

SEQ ID NO: 1980102 - RNA, 15 nt, Homo sapiens
agcaucuauuuuacc

SEQ ID NO: 1980103 - RNA, 23 nt, Homo sapiens
cgugaaauugaugccaguggaau

SEQ ID NO: 1980104 - RNA, 18 nt, Homo sapiens
cuggcccagggaauccag

SEQ ID NO: 1980105 - RNA, 19 nt, Homo sapiens
aacauaaaaaaacuuccau

SEQ ID NO: 1980106 - RNA, 16 nt, Homo sapiens
cuggaagagccaaaga

SEQ ID NO: 1980107 - RNA, 22 nt, Homo sapiens
ccugcagaagcagaagugcaau

SEQ ID NO: 1980108 - RNA, 21 nt, Homo sapiens
uaaucuuucauagccauaccu

SEQ ID NO: 1980109 - RNA, 18 nt, Homo sapiens
ggaggaacacugcacucu

SEQ ID NO: 1980110 - RNA, 11 nt, Homo sapiens
uuggugccacu

SEQ ID NO: 1980111 - RNA, 20 nt, Homo sapiens
uugcaguucaccugcacuua

SEQ ID NO: 1980112 - RNA, 17 nt, Homo sapiens
caaagcugaauacauuc

SEQ ID NO: 1980113 - RNA, 14 nt, Homo sapiens
accacacugauccu

SEQ ID NO: 1980114 - RNA, 12 nt, Homo sapiens
cgugugccugag

SEQ ID NO: 1980115 - RNA, 12 nt, Homo sapiens
aaucguccuccc

SEQ ID NO: 1980116 - RNA, 17 nt, Homo sapiens
cagucucuccagcauca

SEQ ID NO: 1980117 - RNA, 17 nt, Homo sapiens
guaugcacgugugcaca

SEQ ID NO: 1980118 - RNA, 14 nt, Homo sapiens
uaacugacaaacca

SEQ ID NO: 1980119 - RNA, 12 nt, Homo sapiens
cuguccagcucc

SEQ ID NO: 1980120 - RNA, 21 nt, Homo sapiens
ucccuggcucccaugaccaua

SEQ ID NO: 1980121 - RNA, 13 nt, Homo sapiens
cacaaaacauuua

SEQ ID NO: 1980122 - RNA, 19 nt, Homo sapiens
uagcuaauuuuugcaaaua

SEQ ID NO: 1980123 - RNA, 18 nt, Homo sapiens
aggacagccgccuggaga

SEQ ID NO: 1980124 - RNA, 23 nt, Homo sapiens
gucaaccccacuguagacaggaa

SEQ ID NO: 1980125 - RNA, 21 nt, Homo sapiens
gagcccaugcucaaccacugu

SEQ ID NO: 1980126 - RNA, 17 nt, Homo sapiens
auacuguaacacuguau

SEQ ID NO: 1980127 - RNA, 12 nt, Homo sapiens
agcaaaggcagu

SEQ ID NO: 1980128 - RNA, 17 nt, Homo sapiens
caaaugaaacacuuuca

SEQ ID NO: 1980129 - RNA, 22 nt, Homo sapiens
ugucucacuuuuuacccagaac

SEQ ID NO: 1980130 - RNA, 20 nt, Homo sapiens
augagaaaccuauauuucaa

SEQ ID NO: 1980131 - RNA, 15 nt, Homo sapiens
uuaguuauacuccuc

SEQ ID NO: 1980132 - RNA, 14 nt, Homo sapiens
gguucaaacgggug

SEQ ID NO: 1980133 - RNA, 19 nt, Homo sapiens
uauuuuguuggaguauuau

SEQ ID NO: 1980134 - RNA, 18 nt, Homo sapiens
gcuuucuaggccacuggg

SEQ ID NO: 1980135 - RNA, 19 nt, Homo sapiens
aaggauaaagccacuucug

SEQ ID NO: 1980136 - RNA, 13 nt, Homo sapiens
cucuggauugaga

SEQ ID NO: 1980137 - RNA, 14 nt, Homo sapiens
cuccauuuccacuu

SEQ ID NO: 1980138 - RNA, 18 nt, Homo sapiens
ucaccaucggcaggcagu

SEQ ID NO: 1980139 - RNA, 14 nt, Homo sapiens
gccgcucccuggug

SEQ ID NO: 1980140 - RNA, 21 nt, Homo sapiens
uguaaaauguuuaauggugaa

SEQ ID NO: 1980141 - RNA, 15 nt, Homo sapiens
guaaauauucuuguc

SEQ ID NO: 1980142 - RNA, 15 nt, Homo sapiens
ugcagcaggugcaag

SEQ ID NO: 1980143 - RNA, 11 nt, Homo sapiens
ugcacacuugu

SEQ ID NO: 1980144 - RNA, 23 nt, Homo sapiens
guguaaugugacuucaugcuaua

SEQ ID NO: 1980145 - RNA, 15 nt, Homo sapiens
auaaacuuugaauuu

SEQ ID NO: 1980146 - RNA, 21 nt, Homo sapiens
gguacagacacucccacuugg

SEQ ID NO: 1980147 - RNA, 19 nt, Homo sapiens
ccuuuuaaauggcaugaca

SEQ ID NO: 1980148 - RNA, 17 nt, Homo sapiens
ccguggcugauggugug

SEQ ID NO: 1980149 - RNA, 16 nt, Homo sapiens
uccacgcacacaugga

SEQ ID NO: 1980150 - RNA, 14 nt, Homo sapiens
aggaaaaaugcugc

SEQ ID NO: 1980151 - RNA, 12 nt, Homo sapiens
uggacggaacca

SEQ ID NO: 1980152 - RNA, 19 nt, Homo sapiens
ucuacacauacugcaugcu

SEQ ID NO: 1980153 - RNA, 19 nt, Homo sapiens
uacagaaugaaucccauaa

SEQ ID NO: 1980154 - RNA, 22 nt, Homo sapiens
augcagauuccucagauucaau

SEQ ID NO: 1980155 - RNA, 19 nt, Homo sapiens
caaaccauuucagccaaac

SEQ ID NO: 1980156 - RNA, 22 nt, Homo sapiens
ccaaauuggauacugcugccaa

SEQ ID NO: 1980157 - RNA, 20 nt, Homo sapiens
cugcgcuuugaacgugccag

SEQ ID NO: 1980158 - RNA, 23 nt, Homo sapiens
augaauguuuacacucuuuguaa

SEQ ID NO: 1980159 - RNA, 18 nt, Homo sapiens
uguacuguuacuguguca

SEQ ID NO: 1980160 - RNA, 15 nt, Homo sapiens
gaagcacacugcagg

SEQ ID NO: 1980161 - RNA, 14 nt, Homo sapiens
agcuuggagggaug

SEQ ID NO: 1980162 - RNA, 17 nt, Homo sapiens
guacuaugucaaagcaa

SEQ ID NO: 1980163 - RNA, 23 nt, Homo sapiens
augccaaacaguuguaccacugc

SEQ ID NO: 1980164 - RNA, 18 nt, Homo sapiens
aaaccugccaagagucaa

SEQ ID NO: 1980165 - RNA, 15 nt, Homo sapiens
ccccuuuagaucucu

SEQ ID NO: 1980166 - RNA, 22 nt, Homo sapiens
ugggaucuucaaugaacugugc

SEQ ID NO: 1980167 - RNA, 17 nt, Homo sapiens
agugccucagugcugca

SEQ ID NO: 1980168 - RNA, 16 nt, Homo sapiens
ccucuuucaucuguaa

SEQ ID NO: 1980169 - RNA, 19 nt, Homo sapiens
ccagcuccuaguagcuuuc

SEQ ID NO: 1980170 - RNA, 20 nt, Homo sapiens
aacagguguuccuccucccc

SEQ ID NO: 1980171 - RNA, 13 nt, Homo sapiens
cuguugaaucuug

SEQ ID NO: 1980172 - RNA, 19 nt, Homo sapiens
uucuccaaaggcacugacc

SEQ ID NO: 1980173 - RNA, 19 nt, Homo sapiens
gagcacucucaccccaagc

SEQ ID NO: 1980174 - RNA, 21 nt, Homo sapiens
cagcagccccccuugccccac

SEQ ID NO: 1980175 - RNA, 18 nt, Homo sapiens
aacuauaagauacaauaa

SEQ ID NO: 1980176 - RNA, 15 nt, Homo sapiens
aagauagacaucaga

SEQ ID NO: 1980177 - RNA, 15 nt, Homo sapiens
cugaaacaucucaac

SEQ ID NO: 1980178 - RNA, 20 nt, Homo sapiens
ucauaaaguuagaaucuauu

SEQ ID NO: 1980179 - RNA, 18 nt, Homo sapiens
agaaauaagaauaaacuu

SEQ ID NO: 1980180 - RNA, 21 nt, Homo sapiens
uugcaucugcacauaggcagu

SEQ ID NO: 1980181 - RNA, 15 nt, Homo sapiens
auaguagaaaggcca

SEQ ID NO: 1980182 - RNA, 13 nt, Homo sapiens
cucaucugggcaa

SEQ ID NO: 1980183 - RNA, 13 nt, Homo sapiens
cucuucugggcua

SEQ ID NO: 1980184 - RNA, 23 nt, Homo sapiens
ucgaacuauuuucaaagacuuaa

SEQ ID NO: 1980185 - RNA, 17 nt, Homo sapiens
accccauuucuacuaaa

SEQ ID NO: 1980186 - RNA, 23 nt, Homo sapiens
gccuuauuucucauugccucuuc

SEQ ID NO: 1980187 - RNA, 16 nt, Homo sapiens
cuaaggcuuggaaaca

SEQ ID NO: 1980188 - RNA, 14 nt, Homo sapiens
aggaagcucagacu

SEQ ID NO: 1980189 - RNA, 13 nt, Homo sapiens
cagcgaccacugc

SEQ ID NO: 1980190 - RNA, 13 nt, Homo sapiens
gacuuucugauua

SEQ ID NO: 1980191 - RNA, 18 nt, Homo sapiens
uuuaaacuauaagcaaga

SEQ ID NO: 1980192 - RNA, 18 nt, Homo sapiens
aacaaaaaaagcaucuca

SEQ ID NO: 1980193 - RNA, 13 nt, Homo sapiens
gcaccuuccuuuc

SEQ ID NO: 1980194 - RNA, 15 nt, Homo sapiens
agcuucagaugguga

SEQ ID NO: 1980195 - RNA, 15 nt, Homo sapiens
aaagguucucaggug

SEQ ID NO: 1980196 - RNA, 21 nt, Homo sapiens
uaagucaucauuacuugggaa

SEQ ID NO: 1980197 - RNA, 20 nt, Homo sapiens
cauuuugggccuugcuaaau

SEQ ID NO: 1980198 - RNA, 15 nt, Homo sapiens
uuuagucaugugacc

SEQ ID NO: 1980199 - RNA, 19 nt, Homo sapiens
aguaacuugucuuaaauaa

SEQ ID NO: 1980200 - RNA, 17 nt, Homo sapiens
cauggggaagugcuccc

SEQ ID NO: 1980201 - RNA, 15 nt, Homo sapiens
ucacuucccugggaa

SEQ ID NO: 1980202 - RNA, 20 nt, Homo sapiens
gaaaugacaacaaggcccuu

SEQ ID NO: 1980203 - RNA, 17 nt, Homo sapiens
caagagagacagcacag

SEQ ID NO: 1980204 - RNA, 16 nt, Homo sapiens
aaagauccaagcuccu

SEQ ID NO: 1980205 - RNA, 16 nt, Homo sapiens
cauacguucuuuucaa

SEQ ID NO: 1980206 - RNA, 20 nt, Homo sapiens
gccacuuucuacaggccagc

SEQ ID NO: 1980207 - RNA, 21 nt, Homo sapiens
gaccuuccugauucauucuuc

SEQ ID NO: 1980208 - RNA, 15 nt, Homo sapiens
caucaaaaagccuua

SEQ ID NO: 1980209 - RNA, 22 nt, Homo sapiens
gagcuacagaacacuuugcuag

SEQ ID NO: 1980210 - RNA, 14 nt, Homo sapiens
auaaaaacugcuua

SEQ ID NO: 1980211 - RNA, 17 nt, Homo sapiens
aagguaccaagaucaca

SEQ ID NO: 1980212 - RNA, 14 nt, Homo sapiens
gugcuugggcucca

SEQ ID NO: 1980213 - RNA, 15 nt, Homo sapiens
augggcauaagcaaa

SEQ ID NO: 1980214 - RNA, 18 nt, Homo sapiens
uguuugucucaguuggaa

SEQ ID NO: 1980215 - RNA, 18 nt, Homo sapiens
aauacucugcagugauua

SEQ ID NO: 1980216 - RNA, 14 nt, Homo sapiens
gcucacagccacca

SEQ ID NO: 1980217 - RNA, 20 nt, Homo sapiens
cuaauuagaaaauauaguuu

SEQ ID NO: 1980218 - RNA, 16 nt, Homo sapiens
cacaagcuuguauaua

SEQ ID NO: 1980219 - RNA, 19 nt, Homo sapiens
augcaacauuuuaaggcaa

SEQ ID NO: 1980220 - RNA, 16 nt, Homo sapiens
auuacauuaugcccuu

SEQ ID NO: 1980221 - RNA, 21 nt, Homo sapiens
agugaauuagugucaugucag

SEQ ID NO: 1980222 - RNA, 20 nt, Homo sapiens
ucuaauacaaagaugagcuc

SEQ ID NO: 1980223 - RNA, 20 nt, Homo sapiens
gaaaccccuucucugugacc

SEQ ID NO: 1980224 - RNA, 12 nt, Homo sapiens
uucuauuuuccc

SEQ ID NO: 1980225 - RNA, 12 nt, Homo sapiens
uuugaaucugag

SEQ ID NO: 1980226 - RNA, 23 nt, Homo sapiens
cagagggaaaguaaauauuucag

SEQ ID NO: 1980227 - RNA, 20 nt, Homo sapiens
aacccaguguuuccacacuu

SEQ ID NO: 1980228 - RNA, 11 nt, Homo sapiens
ugcauguguau

SEQ ID NO: 1980229 - RNA, 23 nt, Homo sapiens
aaaaucuacuccaaauuauuuuc

SEQ ID NO: 1980230 - RNA, 18 nt, Homo sapiens
agaauggguuuacucuca

SEQ ID NO: 1980231 - RNA, 12 nt, Homo sapiens
uucuauggauuc

SEQ ID NO: 1980232 - RNA, 14 nt, Homo sapiens
ucuaauccaugugc

SEQ ID NO: 1980233 - RNA, 21 nt, Homo sapiens
uguacauguggaaaacucaca

SEQ ID NO: 1980234 - RNA, 15 nt, Homo sapiens
ggcagaaugaaucua

SEQ ID NO: 1980235 - RNA, 21 nt, Homo sapiens
caaugggcuagagggugccgg

SEQ ID NO: 1980236 - RNA, 20 nt, Homo sapiens
cuugaccuaagggacuccca

SEQ ID NO: 1980237 - RNA, 12 nt, Homo sapiens
cauugagcucuc

SEQ ID NO: 1980238 - RNA, 23 nt, Homo sapiens
auaucaaaagccugaaguggaau

SEQ ID NO: 1980239 - RNA, 15 nt, Homo sapiens
ccaagaguccaagcc

SEQ ID NO: 1980240 - RNA, 22 nt, Homo sapiens
cuuuuuaugacaggauguuugc

SEQ ID NO: 1980241 - RNA, 16 nt, Homo sapiens
gaucccaucuugauaa

SEQ ID NO: 1980242 - RNA, 18 nt, Homo sapiens
uaagaccauaacagccaa

SEQ ID NO: 1980243 - RNA, 19 nt, Homo sapiens
guucaaauuuugcauugug

SEQ ID NO: 1980244 - RNA, 14 nt, Homo sapiens
ucuggaaagugaug

SEQ ID NO: 1980245 - RNA, 17 nt, Homo sapiens
auuaaagaauucagaau

SEQ ID NO: 1980246 - RNA, 21 nt, Homo sapiens
cccaguaucucuucagucucu

SEQ ID NO: 1980247 - RNA, 13 nt, Homo sapiens
gacucucgcugug

SEQ ID NO: 1980248 - RNA, 17 nt, Homo sapiens
cuggucuccuaaccaag

SEQ ID NO: 1980249 - RNA, 16 nt, Homo sapiens
cuguggauacccuuac

SEQ ID NO: 1980250 - RNA, 22 nt, Homo sapiens
ccuaaauuguuguaauugcauu

SEQ ID NO: 1980251 - RNA, 12 nt, Homo sapiens
agcugaacccau

SEQ ID NO: 1980252 - RNA, 14 nt, Homo sapiens
caugagucuuguaa

SEQ ID NO: 1980253 - RNA, 17 nt, Homo sapiens
ucugguccuguuuucua

SEQ ID NO: 1980254 - RNA, 23 nt, Homo sapiens
aucuacuggaaauguagcacuua

SEQ ID NO: 1980255 - RNA, 15 nt, Homo sapiens
uggcacccaugcacc

SEQ ID NO: 1980256 - RNA, 11 nt, Homo sapiens
agugcugccau

SEQ ID NO: 1980257 - RNA, 11 nt, Homo sapiens
agggcugccag

SEQ ID NO: 1980258 - RNA, 23 nt, Homo sapiens
uuuaauuugauaucacagucuaa

SEQ ID NO: 1980259 - RNA, 14 nt, Homo sapiens
uaacaacucuaguc

SEQ ID NO: 1980260 - RNA, 15 nt, Homo sapiens
ccuuaacacauucaa

SEQ ID NO: 1980261 - RNA, 14 nt, Homo sapiens
auggucucuaccua

SEQ ID NO: 1980262 - RNA, 21 nt, Homo sapiens
caugaaacuuguuucacugaa

SEQ ID NO: 1980263 - RNA, 17 nt, Homo sapiens
cugaugccccagggauu

SEQ ID NO: 1980264 - RNA, 18 nt, Homo sapiens
aggccagcuccuuagaca

SEQ ID NO: 1980265 - RNA, 20 nt, Homo sapiens
acacaaacgggcucagcaaa

SEQ ID NO: 1980266 - RNA, 20 nt, Homo sapiens
cugggcagccguuuuccuca

SEQ ID NO: 1980267 - RNA, 15 nt, Homo sapiens
guuauuuuauugccu

SEQ ID NO: 1980268 - RNA, 23 nt, Homo sapiens
gugucuccuuaugguacacucca

SEQ ID NO: 1980269 - RNA, 17 nt, Homo sapiens
uacuugaagaauguuga

SEQ ID NO: 1980270 - RNA, 20 nt, Homo sapiens
auggaagcaaccagcaaauu

SEQ ID NO: 1980271 - RNA, 17 nt, Homo sapiens
uaauguccauaugcuaa

SEQ ID NO: 1980272 - RNA, 15 nt, Homo sapiens
uguaauauguacaca

SEQ ID NO: 1980273 - RNA, 18 nt, Homo sapiens
cuaauaaacagacuguuu

SEQ ID NO: 1980274 - RNA, 21 nt, Homo sapiens
gccaugcaacgggauugaagg

SEQ ID NO: 1980275 - RNA, 18 nt, Homo sapiens
auuuuuuuauacuaccaa

SEQ ID NO: 1980276 - RNA, 21 nt, Homo sapiens
caccagugccgccugugccca

SEQ ID NO: 1980277 - RNA, 19 nt, Homo sapiens
acagagcuggcugucuucc

SEQ ID NO: 1980278 - RNA, 13 nt, Homo sapiens
augugauggacug

SEQ ID NO: 1980279 - RNA, 20 nt, Homo sapiens
cagcccaaccuagaccugua

SEQ ID NO: 1980280 - RNA, 9 nt, Homo sapiens
aucugccac

SEQ ID NO: 1980281 - RNA, 13 nt, Homo sapiens
aaacucaccaucu

SEQ ID NO: 1980282 - RNA, 18 nt, Homo sapiens
aauaaauauuuagucugc

SEQ ID NO: 1980283 - RNA, 13 nt, Homo sapiens
ucaucuuugccau

SEQ ID NO: 1980284 - RNA, 16 nt, Homo sapiens
uaucaaaaucacuauc

SEQ ID NO: 1980285 - RNA, 18 nt, Homo sapiens
gaaaccaacuguugacau

SEQ ID NO: 1980286 - RNA, 23 nt, Homo sapiens
cugagggcagcuuugcaaaauga

SEQ ID NO: 1980287 - RNA, 15 nt, Homo sapiens
aaguguugacugugu

SEQ ID NO: 1980288 - RNA, 18 nt, Homo sapiens
cugugcaacaaacucaaa

SEQ ID NO: 1980289 - RNA, 19 nt, Homo sapiens
cauagacugaagauuuauu

SEQ ID NO: 1980290 - RNA, 12 nt, Homo sapiens
cuuaagaacugu

SEQ ID NO: 1980291 - RNA, 20 nt, Homo sapiens
ccacuaaugggugucaucuu

SEQ ID NO: 1980292 - RNA, 16 nt, Homo sapiens
ucuuggccguggcauu

SEQ ID NO: 1980293 - RNA, 13 nt, Homo sapiens
acaaacugaauuu

SEQ ID NO: 1980294 - RNA, 18 nt, Homo sapiens
augugacugccaucaucu

SEQ ID NO: 1980295 - RNA, 20 nt, Homo sapiens
guauuuuauuguaacagaca

SEQ ID NO: 1980296 - RNA, 13 nt, Homo sapiens
uguacauguggaa

SEQ ID NO: 1980297 - RNA, 17 nt, Homo sapiens
cacuuagguaguaccaa

SEQ ID NO: 1980298 - RNA, 22 nt, Homo sapiens
ccagccucuagaacagccagac

SEQ ID NO: 1980299 - RNA, 19 nt, Homo sapiens
acaaaauguagaauauuca

SEQ ID NO: 1980300 - RNA, 15 nt, Homo sapiens
ggaugauaguggaau

SEQ ID NO: 1980301 - RNA, 21 nt, Homo sapiens
ugcuccauacucuaacaucua

SEQ ID NO: 1980302 - RNA, 16 nt, Homo sapiens
ucaaguaccaccaagg

SEQ ID NO: 1980303 - RNA, 14 nt, Homo sapiens
cacauacgugcaca

SEQ ID NO: 1980304 - RNA, 17 nt, Homo sapiens
uccuugaccgcucucug

SEQ ID NO: 1980305 - RNA, 14 nt, Homo sapiens
ccggacaguggcac

SEQ ID NO: 1980306 - RNA, 20 nt, Homo sapiens
aggcauggcggcgcaugccu

SEQ ID NO: 1980307 - RNA, 23 nt, Homo sapiens
ggugcaugcacugucucagccaa

SEQ ID NO: 1980308 - RNA, 18 nt, Homo sapiens
caaaucacauauuuuaaa

SEQ ID NO: 1980309 - RNA, 18 nt, Homo sapiens
aaaaacuccccuuccuca

SEQ ID NO: 1980310 - RNA, 21 nt, Homo sapiens
gagcugagaucacaccacugc

SEQ ID NO: 1980311 - RNA, 21 nt, Homo sapiens
gagccgagaucacaccacugu

SEQ ID NO: 1980312 - RNA, 12 nt, Homo sapiens
aaaggugcuguu

SEQ ID NO: 1980313 - RNA, 12 nt, Homo sapiens
uaaggugcaguu

SEQ ID NO: 1980314 - RNA, 22 nt, Homo sapiens
gcacgccaacauggcacaugua

SEQ ID NO: 1980315 - RNA, 14 nt, Homo sapiens
caggaguagucuca

SEQ ID NO: 1980316 - RNA, 22 nt, Homo sapiens
aaacaggguuugauagcacuua

SEQ ID NO: 1980317 - RNA, 12 nt, Homo sapiens
ugagcuaacuua

SEQ ID NO: 1980318 - RNA, 21 nt, Homo sapiens
gucgcccuuacuucuugcccu

SEQ ID NO: 1980319 - RNA, 19 nt, Homo sapiens
cuaaauauuuaagugcagu

SEQ ID NO: 1980320 - RNA, 17 nt, Homo sapiens
cuuguuagcaaaaugga

SEQ ID NO: 1980321 - RNA, 23 nt, Homo sapiens
augagaaaacaggcucacagaga

SEQ ID NO: 1980322 - RNA, 14 nt, Homo sapiens
caaaugccauccag

SEQ ID NO: 1980323 - RNA, 15 nt, Homo sapiens
caucucaggggccag

SEQ ID NO: 1980324 - RNA, 13 nt, Homo sapiens
gcagucaguucau

SEQ ID NO: 1980325 - RNA, 15 nt, Homo sapiens
uauuuauaacuaaua

SEQ ID NO: 1980326 - RNA, 15 nt, Homo sapiens
ccuggcccaaagcag

SEQ ID NO: 1980327 - RNA, 18 nt, Homo sapiens
cgcacaugacauagcacu

SEQ ID NO: 1980328 - RNA, 13 nt, Homo sapiens
cgacuccaucucu

SEQ ID NO: 1980329 - RNA, 23 nt, Homo sapiens
agcuccacaagagagaugauacu

SEQ ID NO: 1980330 - RNA, 14 nt, Homo sapiens
agaaugaggcugcu

SEQ ID NO: 1980331 - RNA, 19 nt, Homo sapiens
cagauacugucucuuucau

SEQ ID NO: 1980332 - RNA, 12 nt, Homo sapiens
cuggugccccac

SEQ ID NO: 1980333 - RNA, 19 nt, Homo sapiens
auuaauguagggcagaaua

SEQ ID NO: 1980334 - RNA, 17 nt, Homo sapiens
acuuuuaauuagugaug

SEQ ID NO: 1980335 - RNA, 23 nt, Homo sapiens
aguggcccuuucaacaaugucuu

SEQ ID NO: 1980336 - RNA, 17 nt, Homo sapiens
cagauggcacuuugaag

SEQ ID NO: 1980337 - RNA, 17 nt, Homo sapiens
ggcuucuuugcuuucuc

SEQ ID NO: 1980338 - RNA, 23 nt, Homo sapiens
cucacccccagcuuugcuaccaa

SEQ ID NO: 1980339 - RNA, 21 nt, Homo sapiens
ccuucagaacagaggcauuua

SEQ ID NO: 1980340 - RNA, 12 nt, Homo sapiens
uuuaaacaucag

SEQ ID NO: 1980341 - RNA, 18 nt, Homo sapiens
uucccuucaacaugaaaa

SEQ ID NO: 1980342 - RNA, 19 nt, Homo sapiens
aacacugaagccauuugcc

SEQ ID NO: 1980343 - RNA, 19 nt, Homo sapiens
uaacaguaguccuuugaua

SEQ ID NO: 1980344 - RNA, 16 nt, Homo sapiens
ccagccucuuuaacau

SEQ ID NO: 1980345 - RNA, 17 nt, Homo sapiens
uugucaaaugaugauua

SEQ ID NO: 1980346 - RNA, 21 nt, Homo sapiens
cuucuggcagggaagugggga

SEQ ID NO: 1980347 - RNA, 13 nt, Homo sapiens
caccuugugccug

SEQ ID NO: 1980348 - RNA, 14 nt, Homo sapiens
uaacccaaugccug

SEQ ID NO: 1980349 - RNA, 22 nt, Homo sapiens
ccuggcagccacaacugcaguc

SEQ ID NO: 1980350 - RNA, 12 nt, Homo sapiens
uaucucuaauaa

SEQ ID NO: 1980351 - RNA, 21 nt, Homo sapiens
uuugugcuucuccuaacucaa

SEQ ID NO: 1980352 - RNA, 21 nt, Homo sapiens
uacauuuauuccuuccaagaa

SEQ ID NO: 1980353 - RNA, 14 nt, Homo sapiens
gccagugucauccg

SEQ ID NO: 1980354 - RNA, 16 nt, Homo sapiens
accauucccuagucau

SEQ ID NO: 1980355 - RNA, 23 nt, Homo sapiens
uauuuggaaagcacuggaauuca

SEQ ID NO: 1980356 - RNA, 17 nt, Homo sapiens
aagauuugugaacugga

SEQ ID NO: 1980357 - RNA, 17 nt, Homo sapiens
ugguuuuauaaucugau

SEQ ID NO: 1980358 - RNA, 22 nt, Homo sapiens
ugcaaggauucagcauuauucc

SEQ ID NO: 1980359 - RNA, 21 nt, Homo sapiens
cuugcagugagccgagauugc

SEQ ID NO: 1980360 - RNA, 16 nt, Homo sapiens
uccccaaugcucuccu

SEQ ID NO: 1980361 - RNA, 19 nt, Homo sapiens
ucugugcagucaucaacaa

SEQ ID NO: 1980362 - RNA, 22 nt, Homo sapiens
gguguuaauuuugcuaacuggg

SEQ ID NO: 1980363 - RNA, 15 nt, Homo sapiens
auucccuccucguca

SEQ ID NO: 1980364 - RNA, 23 nt, Homo sapiens
cagaagcagcuucuuuugucucc

SEQ ID NO: 1980365 - RNA, 15 nt, Homo sapiens
aucccuuccuuguua

SEQ ID NO: 1980366 - RNA, 19 nt, Homo sapiens
ucuacccugccuguacuac

SEQ ID NO: 1980367 - RNA, 15 nt, Homo sapiens
aaugauuucacagug

SEQ ID NO: 1980368 - RNA, 21 nt, Homo sapiens
gcagugagcugagaucgugcc

SEQ ID NO: 1980369 - RNA, 19 nt, Homo sapiens
cugcuccuggagccuuuga

SEQ ID NO: 1980370 - RNA, 19 nt, Homo sapiens
gaaucuugcugucaaggaa

SEQ ID NO: 1980371 - RNA, 20 nt, Homo sapiens
acacauuccugcauucaugu

SEQ ID NO: 1980372 - RNA, 17 nt, Homo sapiens
uagcaucuuccuugaua

SEQ ID NO: 1980373 - RNA, 15 nt, Homo sapiens
uaugugggauauuga

SEQ ID NO: 1980374 - RNA, 20 nt, Homo sapiens
ccgucuucucucucugcucc

SEQ ID NO: 1980375 - RNA, 15 nt, Homo sapiens
caaccuccccauugc

SEQ ID NO: 1980376 - RNA, 14 nt, Homo sapiens
cugagauacauaca

SEQ ID NO: 1980377 - RNA, 14 nt, Homo sapiens
aaauguuaugcagg

SEQ ID NO: 1980378 - RNA, 18 nt, Homo sapiens
aacacucugaauuccaag

SEQ ID NO: 1980379 - RNA, 17 nt, Homo sapiens
agauguaacccaccuug

SEQ ID NO: 1980380 - RNA, 13 nt, Homo sapiens
aguguucaaauac

SEQ ID NO: 1980381 - RNA, 23 nt, Homo sapiens
auccauucugucuuccuaggaac

SEQ ID NO: 1980382 - RNA, 14 nt, Homo sapiens
ccaaauuauggcaa

SEQ ID NO: 1980383 - RNA, 24 nt, Homo sapiens
cagccuuggagucuguucuaggga

SEQ ID NO: 1980384 - RNA, 14 nt, Homo sapiens
auuaccauuuguua

SEQ ID NO: 1980385 - RNA, 11 nt, Homo sapiens
uaaaacacuua

SEQ ID NO: 1980386 - RNA, 14 nt, Homo sapiens
auagucgcagcuac

SEQ ID NO: 1980387 - RNA, 14 nt, Homo sapiens
gucuuguacuucug

SEQ ID NO: 1980388 - RNA, 22 nt, Homo sapiens
gccaacaggccccccagccaag

SEQ ID NO: 1980389 - RNA, 15 nt, Homo sapiens
ugguuccuacauccu

SEQ ID NO: 1980390 - RNA, 13 nt, Homo sapiens
uggcucauuagcu

SEQ ID NO: 1980391 - RNA, 22 nt, Homo sapiens
uaggcacacagauccccuggaa

SEQ ID NO: 1980392 - RNA, 16 nt, Homo sapiens
auguugcccagugugu

SEQ ID NO: 1980393 - RNA, 16 nt, Homo sapiens
cuugggaauaaaucau

SEQ ID NO: 1980394 - RNA, 23 nt, Homo sapiens
agccuugauugguguugccaguu

SEQ ID NO: 1980395 - RNA, 19 nt, Homo sapiens
caucucugugauuaccucu

SEQ ID NO: 1980396 - RNA, 20 nt, Homo sapiens
ugcacagugguccagggucc

SEQ ID NO: 1980397 - RNA, 11 nt, Homo sapiens
cccgagcugcu

SEQ ID NO: 1980398 - RNA, 19 nt, Homo sapiens
cugaccucuugaucugccc

SEQ ID NO: 1980399 - RNA, 22 nt, Homo sapiens
agacucugguauggccaaagau

SEQ ID NO: 1980400 - RNA, 14 nt, Homo sapiens
cacauccaucagca

SEQ ID NO: 1980401 - RNA, 14 nt, Homo sapiens
gcguguacuacccc

SEQ ID NO: 1980402 - RNA, 12 nt, Homo sapiens
uuccugcccuac

SEQ ID NO: 1980403 - RNA, 19 nt, Homo sapiens
ggaagccugugccagcacc

SEQ ID NO: 1980404 - RNA, 23 nt, Homo sapiens
uuaaacuuucaauugucacuuuu

SEQ ID NO: 1980405 - RNA, 17 nt, Homo sapiens
gauucagaugucauuua

SEQ ID NO: 1980406 - RNA, 12 nt, Homo sapiens
aaggccuuccaa

SEQ ID NO: 1980407 - RNA, 12 nt, Homo sapiens
aagaccuuccag

SEQ ID NO: 1980408 - RNA, 18 nt, Homo sapiens
uacaaguuugcuaaaaga

SEQ ID NO: 1980409 - RNA, 14 nt, Homo sapiens
agccacacuugaac

SEQ ID NO: 1980410 - RNA, 21 nt, Homo sapiens
ucagagagccuagaacauccc

SEQ ID NO: 1980411 - RNA, 16 nt, Homo sapiens
agcuagauaugccuua

SEQ ID NO: 1980412 - RNA, 16 nt, Homo sapiens
acaguuaaacuggcuu

SEQ ID NO: 1980413 - RNA, 13 nt, Homo sapiens
cuuacuggugcua

SEQ ID NO: 1980414 - RNA, 13 nt, Homo sapiens
ccauuugauuuga

SEQ ID NO: 1980415 - RNA, 13 nt, Homo sapiens
ucaguugacuuua

SEQ ID NO: 1980416 - RNA, 14 nt, Homo sapiens
ugcuggaggguaau

SEQ ID NO: 1980417 - RNA, 17 nt, Homo sapiens
gagcaaaucgugccuug

SEQ ID NO: 1980418 - RNA, 14 nt, Homo sapiens
aauauugugcccca

SEQ ID NO: 1980419 - RNA, 17 nt, Homo sapiens
auauuaauaugcaugcu

SEQ ID NO: 1980420 - RNA, 16 nt, Homo sapiens
caucuaaaguaaaaag

SEQ ID NO: 1980421 - RNA, 21 nt, Homo sapiens
agcccuguuggcagcucuagc

SEQ ID NO: 1980422 - RNA, 19 nt, Homo sapiens
cuucaacauuuacauguau

SEQ ID NO: 1980423 - RNA, 17 nt, Homo sapiens
agauaaggcaagccagu

SEQ ID NO: 1980424 - RNA, 21 nt, Homo sapiens
ggcaggggugcuuccuccuca

SEQ ID NO: 1980425 - RNA, 16 nt, Homo sapiens
aucgcugucaucucag

SEQ ID NO: 1980426 - RNA, 11 nt, Homo sapiens
aggacagcagu

SEQ ID NO: 1980427 - RNA, 21 nt, Homo sapiens
cuccuccugcccuccaucuca

SEQ ID NO: 1980428 - RNA, 11 nt, Homo sapiens
caaacauuuga

SEQ ID NO: 1980429 - RNA, 22 nt, Homo sapiens
ccugaaaaaguuuuguggauua

SEQ ID NO: 1980430 - RNA, 13 nt, Homo sapiens
aaacucacaacuc

SEQ ID NO: 1980431 - RNA, 21 nt, Homo sapiens
ugacaagguucccaagacaau

SEQ ID NO: 1980432 - RNA, 19 nt, Homo sapiens
ggagcaagugugcucuccu

SEQ ID NO: 1980433 - RNA, 19 nt, Homo sapiens
agcuuuggacacacacagc

SEQ ID NO: 1980434 - RNA, 20 nt, Homo sapiens
cuucagagggaaacucagau

SEQ ID NO: 1980435 - RNA, 17 nt, Homo sapiens
guucauuuguggugaua

SEQ ID NO: 1980436 - RNA, 19 nt, Homo sapiens
agcagacguccauagcucc

SEQ ID NO: 1980437 - RNA, 20 nt, Homo sapiens
ggccuuucuucuaagagaua

SEQ ID NO: 1980438 - RNA, 15 nt, Homo sapiens
uaaaaauaaccacuu

SEQ ID NO: 1980439 - RNA, 12 nt, Homo sapiens
ugggaaggccag

SEQ ID NO: 1980440 - RNA, 14 nt, Homo sapiens
cauguuccucaaaa

SEQ ID NO: 1980441 - RNA, 20 nt, Homo sapiens
cuggggaggacaaaggugau

SEQ ID NO: 1980442 - RNA, 19 nt, Homo sapiens
acguuuguuucuucgugcc

SEQ ID NO: 1980443 - RNA, 15 nt, Homo sapiens
augcugucaggagau

SEQ ID NO: 1980444 - RNA, 22 nt, Homo sapiens
accaaaauuuugucccaucucu

SEQ ID NO: 1980445 - RNA, 18 nt, Homo sapiens
gagcaaaaaucugagaaa

SEQ ID NO: 1980446 - RNA, 14 nt, Homo sapiens
cucuuccugugauc

SEQ ID NO: 1980447 - RNA, 16 nt, Homo sapiens
gaagaaauuuaugaag

SEQ ID NO: 1980448 - RNA, 20 nt, Homo sapiens
uccccugcccccugcaggaa

SEQ ID NO: 1980449 - RNA, 17 nt, Homo sapiens
ugguacaucuaccuaaa

SEQ ID NO: 1980450 - RNA, 21 nt, Homo sapiens
cuuugcuauggggacauucca

SEQ ID NO: 1980451 - RNA, 14 nt, Homo sapiens
ccgaagucuuccau

SEQ ID NO: 1980452 - RNA, 23 nt, Homo sapiens
uccccaggaacguuucugaacaa

SEQ ID NO: 1980453 - RNA, 12 nt, Homo sapiens
gauccauuugaa

SEQ ID NO: 1980454 - RNA, 13 nt, Homo sapiens
ggucuugccugaa

SEQ ID NO: 1980455 - RNA, 12 nt, Homo sapiens
cugacucuugcc

SEQ ID NO: 1980456 - RNA, 18 nt, Homo sapiens
ugagaccagccuggccaa

SEQ ID NO: 1980457 - RNA, 19 nt, Homo sapiens
gcuauagugacaugcaguu

SEQ ID NO: 1980458 - RNA, 16 nt, Homo sapiens
ucaaacccagucuugu

SEQ ID NO: 1980459 - RNA, 15 nt, Homo sapiens
cauguuacccauuca

SEQ ID NO: 1980460 - RNA, 17 nt, Homo sapiens
cguuccuguugggcuga

SEQ ID NO: 1980461 - RNA, 16 nt, Homo sapiens
gacaaaauauuuccca

SEQ ID NO: 1980462 - RNA, 16 nt, Homo sapiens
auggacagcugagcac

SEQ ID NO: 1980463 - RNA, 10 nt, Homo sapiens
cacacaguuc

SEQ ID NO: 1980464 - RNA, 15 nt, Homo sapiens
cuucaaugcuuccuc

SEQ ID NO: 1980465 - RNA, 21 nt, Homo sapiens
uuaaaagauauaagacuuaau

SEQ ID NO: 1980466 - RNA, 13 nt, Homo sapiens
cggccgacugccu

SEQ ID NO: 1980467 - RNA, 15 nt, Homo sapiens
cacacgaugcauuua

SEQ ID NO: 1980468 - RNA, 16 nt, Homo sapiens
caagucccuuugugac

SEQ ID NO: 1980469 - RNA, 18 nt, Homo sapiens
gcaucaaggggucacuua

SEQ ID NO: 1980470 - RNA, 21 nt, Homo sapiens
auaugcauuugccuucaucca

SEQ ID NO: 1980471 - RNA, 13 nt, Homo sapiens
ugagaaacaguuc

SEQ ID NO: 1980472 - RNA, 22 nt, Homo sapiens
auacauauguagaaacauuuag

SEQ ID NO: 1980473 - RNA, 16 nt, Homo sapiens
auuguuuugccaguga

SEQ ID NO: 1980474 - RNA, 17 nt, Homo sapiens
aaacgucuuaaauauuc

SEQ ID NO: 1980475 - RNA, 17 nt, Homo sapiens
uucaggaguuacuggau

SEQ ID NO: 1980476 - RNA, 14 nt, Homo sapiens
cagugcaguuucuu

SEQ ID NO: 1980477 - RNA, 22 nt, Homo sapiens
auucugcuugguuccacaauca

SEQ ID NO: 1980478 - RNA, 17 nt, Homo sapiens
gguucuucagggccagu

SEQ ID NO: 1980479 - RNA, 14 nt, Homo sapiens
gccaucaaggagua

SEQ ID NO: 1980480 - RNA, 13 nt, Homo sapiens
aguugaacaucuc

SEQ ID NO: 1980481 - RNA, 21 nt, Homo sapiens
acccuugacaccugcugagaa

SEQ ID NO: 1980482 - RNA, 15 nt, Homo sapiens
ucgcugucaucucag

SEQ ID NO: 1980483 - RNA, 19 nt, Homo sapiens
gccauaauucuaaguuauu

SEQ ID NO: 1980484 - RNA, 22 nt, Homo sapiens
acuaaauauuuaagugcaguca

SEQ ID NO: 1980485 - RNA, 14 nt, Homo sapiens
cucuucuuacuuca

SEQ ID NO: 1980486 - RNA, 17 nt, Homo sapiens
acugggccuuagugggc

SEQ ID NO: 1980487 - RNA, 13 nt, Homo sapiens
uucauauaacguc

SEQ ID NO: 1980488 - RNA, 22 nt, Homo sapiens
cugcagcgccacccaguggaag

SEQ ID NO: 1980489 - RNA, 17 nt, Homo sapiens
gaacaaucaaagcacuu

SEQ ID NO: 1980490 - RNA, 17 nt, Homo sapiens
cuuuccugauguugaua

SEQ ID NO: 1980491 - RNA, 13 nt, Homo sapiens
ggaagggacacca

SEQ ID NO: 1980492 - RNA, 14 nt, Homo sapiens
cauguauuuuacac

SEQ ID NO: 1980493 - RNA, 17 nt, Homo sapiens
aaaguguguaucuagcu

SEQ ID NO: 1980494 - RNA, 14 nt, Homo sapiens
aggugaauagccau

SEQ ID NO: 1980495 - RNA, 20 nt, Homo sapiens
accccaaaggaacacugaca

SEQ ID NO: 1980496 - RNA, 16 nt, Homo sapiens
ucccagucucuacuca

SEQ ID NO: 1980497 - RNA, 23 nt, Homo sapiens
gacccacaaguauugcccuuuaa

SEQ ID NO: 1980498 - RNA, 18 nt, Homo sapiens
gcaaagaugcauuuucac

SEQ ID NO: 1980499 - RNA, 18 nt, Homo sapiens
aaaggugauugcagcuuu

SEQ ID NO: 1980500 - RNA, 15 nt, Homo sapiens
uaaaauaaauuauua

SEQ ID NO: 1980501 - RNA, 14 nt, Homo sapiens
cugcuccgagucuu

SEQ ID NO: 1980502 - RNA, 18 nt, Homo sapiens
ugguugggggaggggccu

SEQ ID NO: 1980503 - RNA, 13 nt, Homo sapiens
aaguuuucaggac

SEQ ID NO: 1980504 - RNA, 20 nt, Homo sapiens
uaaaaacuaacagcuacaaa

SEQ ID NO: 1980505 - RNA, 20 nt, Homo sapiens
uuagaugaggaaaugauccc

SEQ ID NO: 1980506 - RNA, 20 nt, Homo sapiens
ucagggcaagcucauagcac

SEQ ID NO: 1980507 - RNA, 23 nt, Homo sapiens
cggccagguugugucccaaaauc

SEQ ID NO: 1980508 - RNA, 19 nt, Homo sapiens
cagcaagauugcuuuaacu

SEQ ID NO: 1980509 - RNA, 20 nt, Homo sapiens
acggccuguacggacacugu

SEQ ID NO: 1980510 - RNA, 23 nt, Homo sapiens
ugcucucaaaccccugaccucaa

SEQ ID NO: 1980511 - RNA, 14 nt, Homo sapiens
auugucuuaauguc

SEQ ID NO: 1980512 - RNA, 22 nt, Homo sapiens
agacccuuauugcuguccugga

SEQ ID NO: 1980513 - RNA, 14 nt, Homo sapiens
cuccacuacagacc

SEQ ID NO: 1980514 - RNA, 19 nt, Homo sapiens
cacuggggcagacaauaaa

SEQ ID NO: 1980515 - RNA, 17 nt, Homo sapiens
acauuguuggcacucaa

SEQ ID NO: 1980516 - RNA, 14 nt, Homo sapiens
aggcugaggcagaa

SEQ ID NO: 1980517 - RNA, 13 nt, Homo sapiens
aaaaacuaguagu

SEQ ID NO: 1980518 - RNA, 16 nt, Homo sapiens
uggcuccuaucugugu

SEQ ID NO: 1980519 - RNA, 20 nt, Homo sapiens
uugaaacauacagaauguuc

SEQ ID NO: 1980520 - RNA, 14 nt, Homo sapiens
acauagugugagaa

SEQ ID NO: 1980521 - RNA, 12 nt, Homo sapiens
auucauguacau

SEQ ID NO: 1980522 - RNA, 17 nt, Homo sapiens
ugacgagauaagcaguu

SEQ ID NO: 1980523 - RNA, 18 nt, Homo sapiens
ggcugugggcaagccuaa

SEQ ID NO: 1980524 - RNA, 24 nt, Homo sapiens
acaauuugagcaauucauuucacu

SEQ ID NO: 1980525 - RNA, 22 nt, Homo sapiens
cagcaaacaggugcuaauuugu

SEQ ID NO: 1980526 - RNA, 11 nt, Homo sapiens
uuuccaaacaa

SEQ ID NO: 1980527 - RNA, 18 nt, Homo sapiens
ggagguugagaaugcagu

SEQ ID NO: 1980528 - RNA, 13 nt, Homo sapiens
ugcuaauaugaca

SEQ ID NO: 1980529 - RNA, 20 nt, Homo sapiens
uuuuuggugucucauaccca

SEQ ID NO: 1980530 - RNA, 23 nt, Homo sapiens
aauacacauacauauauacauuu

SEQ ID NO: 1980531 - RNA, 13 nt, Homo sapiens
cccugacauuucu

SEQ ID NO: 1980532 - RNA, 18 nt, Homo sapiens
caguaaaaucaaaugugc

SEQ ID NO: 1980533 - RNA, 17 nt, Homo sapiens
gaaggcuuccuaucugu

SEQ ID NO: 1980534 - RNA, 13 nt, Homo sapiens
gucccuuggcaca

SEQ ID NO: 1980535 - RNA, 16 nt, Homo sapiens
ucuuggugcucugugu

SEQ ID NO: 1980536 - RNA, 19 nt, Homo sapiens
agguggcuaagggggacca

SEQ ID NO: 1980537 - RNA, 14 nt, Homo sapiens
aacauauacuucca

SEQ ID NO: 1980538 - RNA, 22 nt, Homo sapiens
uaugaaagaccuuagacauaaa

SEQ ID NO: 1980539 - RNA, 21 nt, Homo sapiens
gauaagcacauuaaaguuaau

SEQ ID NO: 1980540 - RNA, 13 nt, Homo sapiens
aauaaaaauaccu

SEQ ID NO: 1980541 - RNA, 23 nt, Homo sapiens
gacauggagaccaucuaccccuu

SEQ ID NO: 1980542 - RNA, 14 nt, Homo sapiens
aaaccacuuuccuu

SEQ ID NO: 1980543 - RNA, 14 nt, Homo sapiens
cuguucauuucaca

SEQ ID NO: 1980544 - RNA, 14 nt, Homo sapiens
gcuaaacauuguga

SEQ ID NO: 1980545 - RNA, 21 nt, Homo sapiens
aauccuguuuuuagugcugac

SEQ ID NO: 1980546 - RNA, 12 nt, Homo sapiens
ggcaaaugaauu

SEQ ID NO: 1980547 - RNA, 12 nt, Homo sapiens
ccugaucaccug

SEQ ID NO: 1980548 - RNA, 12 nt, Homo sapiens
gggcaucagggc

SEQ ID NO: 1980549 - RNA, 21 nt, Homo sapiens
ccugacauuaagacacaccuc

SEQ ID NO: 1980550 - RNA, 22 nt, Homo sapiens
cccaucauucaugcuacugcca

SEQ ID NO: 1980551 - RNA, 16 nt, Homo sapiens
gagggaaauacaagga

SEQ ID NO: 1980552 - RNA, 15 nt, Homo sapiens
gagccgugaugccuc

SEQ ID NO: 1980553 - RNA, 23 nt, Homo sapiens
cccagaggccaggaaucugccau

SEQ ID NO: 1980554 - RNA, 16 nt, Homo sapiens
acacucuauaagauuc

SEQ ID NO: 1980555 - RNA, 12 nt, Homo sapiens
caaaacaugccg

SEQ ID NO: 1980556 - RNA, 22 nt, Homo sapiens
ccaaagcacuugcuuacauccu

SEQ ID NO: 1980557 - RNA, 13 nt, Homo sapiens
ccuuccaagcacc

SEQ ID NO: 1980558 - RNA, 16 nt, Homo sapiens
guacgaagaguauuuu

SEQ ID NO: 1980559 - RNA, 22 nt, Homo sapiens
agugccaauguuguguguugca

SEQ ID NO: 1980560 - RNA, 23 nt, Homo sapiens
acauccugugccuccaucagcua

SEQ ID NO: 1980561 - RNA, 13 nt, Homo sapiens
caagcgauucucc

SEQ ID NO: 1980562 - RNA, 20 nt, Homo sapiens
gcugccauauuguagcucaa

SEQ ID NO: 1980563 - RNA, 14 nt, Homo sapiens
cuucaauacuuaaa

SEQ ID NO: 1980564 - RNA, 20 nt, Homo sapiens
gggguuucacuguggucuca

SEQ ID NO: 1980565 - RNA, 13 nt, Homo sapiens
guuacgugaauaa

SEQ ID NO: 1980566 - RNA, 14 nt, Homo sapiens
uaguugaaauauca

SEQ ID NO: 1980567 - RNA, 14 nt, Homo sapiens
uccuucaauuccau

SEQ ID NO: 1980568 - RNA, 19 nt, Homo sapiens
cucccucaggcucugugga

SEQ ID NO: 1980569 - RNA, 22 nt, Homo sapiens
ucaagaggcacuucuuuauuaa

SEQ ID NO: 1980570 - RNA, 19 nt, Homo sapiens
uugaaucuauuucacuuau

SEQ ID NO: 1980571 - RNA, 20 nt, Homo sapiens
caguaugugugcucuuaucc

SEQ ID NO: 1980572 - RNA, 14 nt, Homo sapiens
cccuuagugacucu

SEQ ID NO: 1980573 - RNA, 16 nt, Homo sapiens
uccucuccuaacauau

SEQ ID NO: 1980574 - RNA, 20 nt, Homo sapiens
cccaggcuggagugaucuca

SEQ ID NO: 1980575 - RNA, 18 nt, Homo sapiens
ggcgcaaagggcaugggu

SEQ ID NO: 1980576 - RNA, 20 nt, Homo sapiens
uaaaaguuacuuaccacaga

SEQ ID NO: 1980577 - RNA, 15 nt, Homo sapiens
uauuggcacugcuaa

SEQ ID NO: 1980578 - RNA, 20 nt, Homo sapiens
gaggcaggaagauagcuuga

SEQ ID NO: 1980579 - RNA, 14 nt, Homo sapiens
uuacugaacugugu

SEQ ID NO: 1980580 - RNA, 15 nt, Homo sapiens
cuguagagccauuua

SEQ ID NO: 1980581 - RNA, 12 nt, Homo sapiens
aguuaacuauug

SEQ ID NO: 1980582 - RNA, 15 nt, Homo sapiens
gauugaacacaggca

SEQ ID NO: 1980583 - RNA, 14 nt, Homo sapiens
cuucucuuugccuc

SEQ ID NO: 1980584 - RNA, 21 nt, Homo sapiens
agcuucucaaaguacugggau

SEQ ID NO: 1980585 - RNA, 17 nt, Homo sapiens
caagugccauucauccu

SEQ ID NO: 1980586 - RNA, 17 nt, Homo sapiens
uuucucacauugcugua

SEQ ID NO: 1980587 - RNA, 22 nt, Homo sapiens
uaaaagaucuugaauagucuca

SEQ ID NO: 1980588 - RNA, 14 nt, Homo sapiens
uuuggaauuauguc

SEQ ID NO: 1980589 - RNA, 14 nt, Homo sapiens
cuauucaucaauga

SEQ ID NO: 1980590 - RNA, 18 nt, Homo sapiens
acccaaaaaaucaucuca

SEQ ID NO: 1980591 - RNA, 17 nt, Homo sapiens
cuguggcucacaguggg

SEQ ID NO: 1980592 - RNA, 18 nt, Homo sapiens
uauauaccaaagcacauu

SEQ ID NO: 1980593 - RNA, 12 nt, Homo sapiens
gggcucauucuu

SEQ ID NO: 1980594 - RNA, 22 nt, Homo sapiens
agaauuuuuacuuagauacuaa

SEQ ID NO: 1980595 - RNA, 15 nt, Homo sapiens
ugaaucuauuucacu

SEQ ID NO: 1980596 - RNA, 17 nt, Homo sapiens
gcccugcucccaccagg

SEQ ID NO: 1980597 - RNA, 17 nt, Homo sapiens
uuaaauguuugcaaugu

SEQ ID NO: 1980598 - RNA, 15 nt, Homo sapiens
gcauuuuuugcaagu

SEQ ID NO: 1980599 - RNA, 16 nt, Homo sapiens
auaauaauggcuaacu

SEQ ID NO: 1980600 - RNA, 16 nt, Homo sapiens
agauacaagucaucca

SEQ ID NO: 1980601 - RNA, 17 nt, Homo sapiens
aagagccaggugcugcu

SEQ ID NO: 1980602 - RNA, 18 nt, Homo sapiens
auccauauaacaauucag

SEQ ID NO: 1980603 - RNA, 20 nt, Homo sapiens
acucuagugcuacaugaugc

SEQ ID NO: 1980604 - RNA, 13 nt, Homo sapiens
ggacagccaccaa

SEQ ID NO: 1980605 - RNA, 16 nt, Homo sapiens
cccaccccacaauucc

SEQ ID NO: 1980606 - RNA, 13 nt, Homo sapiens
cuccuacauccag

SEQ ID NO: 1980607 - RNA, 20 nt, Homo sapiens
aaacauucauguaacucucc

SEQ ID NO: 1980608 - RNA, 15 nt, Homo sapiens
gagaaaacaauuccu

SEQ ID NO: 1980609 - RNA, 16 nt, Homo sapiens
gagaagcaggcagaua

SEQ ID NO: 1980610 - RNA, 13 nt, Homo sapiens
aaccuauacucac

SEQ ID NO: 1980611 - RNA, 13 nt, Homo sapiens
aagauauuuccaa

SEQ ID NO: 1980612 - RNA, 16 nt, Homo sapiens
uguucaauaugagucu

SEQ ID NO: 1980613 - RNA, 17 nt, Homo sapiens
cuguauuagucacagag

SEQ ID NO: 1980614 - RNA, 19 nt, Homo sapiens
ucagcuuauuguagcauau

SEQ ID NO: 1980615 - RNA, 19 nt, Homo sapiens
guaacugugcuguacugag

SEQ ID NO: 1980616 - RNA, 21 nt, Homo sapiens
uccuggcccuccacuccucau

SEQ ID NO: 1980617 - RNA, 17 nt, Homo sapiens
aggaggcuuugggacca

SEQ ID NO: 1980618 - RNA, 14 nt, Homo sapiens
uuaaauuucuggau

SEQ ID NO: 1980619 - RNA, 20 nt, Homo sapiens
ucagcauuauuccuccagga

SEQ ID NO: 1980620 - RNA, 13 nt, Homo sapiens
gaucacuacugca

SEQ ID NO: 1980621 - RNA, 22 nt, Homo sapiens
uucauugaggaaggaaaucugg

SEQ ID NO: 1980622 - RNA, 20 nt, Homo sapiens
aucuaaaugaaugagccaaa

SEQ ID NO: 1980623 - RNA, 19 nt, Homo sapiens
auccccagccuacugccuc

SEQ ID NO: 1980624 - RNA, 14 nt, Homo sapiens
gcguuuucauuugu

SEQ ID NO: 1980625 - RNA, 20 nt, Homo sapiens
gaccuuggguucccaauaca

SEQ ID NO: 1980626 - RNA, 18 nt, Homo sapiens
agaaacauucuuuuccac

SEQ ID NO: 1980627 - RNA, 20 nt, Homo sapiens
augggaccugaugaccuggg

SEQ ID NO: 1980628 - RNA, 20 nt, Homo sapiens
auaaaauuguaaaauuguau

SEQ ID NO: 1980629 - RNA, 18 nt, Homo sapiens
cuucuacccucaucauca

SEQ ID NO: 1980630 - RNA, 17 nt, Homo sapiens
ucccagccacaguguua

SEQ ID NO: 1980631 - RNA, 22 nt, Homo sapiens
ccaugcagcggccugagcagua

SEQ ID NO: 1980632 - RNA, 13 nt, Homo sapiens
agcuccacagggc

SEQ ID NO: 1980633 - RNA, 16 nt, Homo sapiens
cuucccucccuaucua

SEQ ID NO: 1980634 - RNA, 24 nt, Homo sapiens
auuuuaaaaacugacuuaaugcuc

SEQ ID NO: 1980635 - RNA, 17 nt, Homo sapiens
aguuaauucucaccauu

SEQ ID NO: 1980636 - RNA, 23 nt, Homo sapiens
cauuucccauuaaagagccaguu

SEQ ID NO: 1980637 - RNA, 17 nt, Homo sapiens
aaggcucagucucagga

SEQ ID NO: 1980638 - RNA, 22 nt, Homo sapiens
aggcuggaaaugguuucacuug

SEQ ID NO: 1980639 - RNA, 15 nt, Homo sapiens
ucaaauuacuaauga

SEQ ID NO: 1980640 - RNA, 22 nt, Homo sapiens
cacuagccaugauaacugcaau

SEQ ID NO: 1980641 - RNA, 21 nt, Homo sapiens
uccagaucuugccuccagaga

SEQ ID NO: 1980642 - RNA, 19 nt, Homo sapiens
ucaagccaguacgugcuaa

SEQ ID NO: 1980643 - RNA, 13 nt, Homo sapiens
aucaauaccugcu

SEQ ID NO: 1980644 - RNA, 15 nt, Homo sapiens
uacacagaucacagc

SEQ ID NO: 1980645 - RNA, 18 nt, Homo sapiens
aaggggugcccucuggau

SEQ ID NO: 1980646 - RNA, 18 nt, Homo sapiens
caugcccucucucgggag

SEQ ID NO: 1980647 - RNA, 15 nt, Homo sapiens
ugcagcauuuacuau

SEQ ID NO: 1980648 - RNA, 22 nt, Homo sapiens
cugaaguuucauuuaugauaca

SEQ ID NO: 1980649 - RNA, 14 nt, Homo sapiens
cugaucgugcuaaa

SEQ ID NO: 1980650 - RNA, 18 nt, Homo sapiens
ggccaagcaccuagccuc

SEQ ID NO: 1980651 - RNA, 15 nt, Homo sapiens
auuuauuugguguuu

SEQ ID NO: 1980652 - RNA, 16 nt, Homo sapiens
ucugucccucuuugcc

SEQ ID NO: 1980653 - RNA, 19 nt, Homo sapiens
cuggggucuguguggugcc

SEQ ID NO: 1980654 - RNA, 24 nt, Homo sapiens
ugacgccaggguaugaagaguguu

SEQ ID NO: 1980655 - RNA, 21 nt, Homo sapiens
acacugaggcccaauggccuu

SEQ ID NO: 1980656 - RNA, 22 nt, Homo sapiens
uguucccuagcugaggaugaca

SEQ ID NO: 1980657 - RNA, 19 nt, Homo sapiens
acaggcauagccacuugcu

SEQ ID NO: 1980658 - RNA, 14 nt, Homo sapiens
uugaugguauucau

SEQ ID NO: 1980659 - RNA, 19 nt, Homo sapiens
agagggccaacaacugucc

SEQ ID NO: 1980660 - RNA, 16 nt, Homo sapiens
caacaucucgagcccc

SEQ ID NO: 1980661 - RNA, 20 nt, Homo sapiens
aggguugggcccagaucugg

SEQ ID NO: 1980662 - RNA, 16 nt, Homo sapiens
uggcccacgcacuucg

SEQ ID NO: 1980663 - RNA, 14 nt, Homo sapiens
uauagcuacuaauu

SEQ ID NO: 1980664 - RNA, 19 nt, Homo sapiens
ccuuaaauguuuugccagc

SEQ ID NO: 1980665 - RNA, 16 nt, Homo sapiens
ccuugcccuuggagcu

SEQ ID NO: 1980666 - RNA, 20 nt, Homo sapiens
auuuuucaaccagcauuuua

SEQ ID NO: 1980667 - RNA, 15 nt, Homo sapiens
ucucuaaaccaucua

SEQ ID NO: 1980668 - RNA, 21 nt, Homo sapiens
aaagugcugggaugacaggca

SEQ ID NO: 1980669 - RNA, 16 nt, Homo sapiens
cuagcuggagugccau

SEQ ID NO: 1980670 - RNA, 13 nt, Homo sapiens
aacauuauucuca

SEQ ID NO: 1980671 - RNA, 14 nt, Homo sapiens
aaaucaaacugcuu

SEQ ID NO: 1980672 - RNA, 22 nt, Homo sapiens
aguguccuggacccuggccuaa

SEQ ID NO: 1980673 - RNA, 16 nt, Homo sapiens
acucugcacagccuag

SEQ ID NO: 1980674 - RNA, 18 nt, Homo sapiens
caaaacagacaucaugcu

SEQ ID NO: 1980675 - RNA, 14 nt, Homo sapiens
uuuuucugcacaau

SEQ ID NO: 1980676 - RNA, 23 nt, Homo sapiens
ucuaaugugguuauuucucugau

SEQ ID NO: 1980677 - RNA, 23 nt, Homo sapiens
cucuucuggacugcacacuucca

SEQ ID NO: 1980678 - RNA, 19 nt, Homo sapiens
cugcccgaccccaucucau

SEQ ID NO: 1980679 - RNA, 17 nt, Homo sapiens
aauacaaacaaucucuu

SEQ ID NO: 1980680 - RNA, 18 nt, Homo sapiens
caccggccuugcauugcc

SEQ ID NO: 1980681 - RNA, 18 nt, Homo sapiens
aaugaacaucucuugaaa

SEQ ID NO: 1980682 - RNA, 17 nt, Homo sapiens
auguggauuagcuagaa

SEQ ID NO: 1980683 - RNA, 18 nt, Homo sapiens
ugcuuugcucuacaaaua

SEQ ID NO: 1980684 - RNA, 15 nt, Homo sapiens
gacucagagugcaag

SEQ ID NO: 1980685 - RNA, 18 nt, Homo sapiens
cagcugcuuguugucaag

SEQ ID NO: 1980686 - RNA, 17 nt, Homo sapiens
cuuucuuacacaagagc

SEQ ID NO: 1980687 - RNA, 12 nt, Homo sapiens
gagggcuuuauu

SEQ ID NO: 1980688 - RNA, 18 nt, Homo sapiens
uggccgucacgcuuucau

SEQ ID NO: 1980689 - RNA, 16 nt, Homo sapiens
ugccacauaauucauu

SEQ ID NO: 1980690 - RNA, 13 nt, Homo sapiens
acuuaaaaacuug

SEQ ID NO: 1980691 - RNA, 14 nt, Homo sapiens
uguaugcaucuaua

SEQ ID NO: 1980692 - RNA, 14 nt, Homo sapiens
gaaaaggauaugca

SEQ ID NO: 1980693 - RNA, 17 nt, Homo sapiens
ugaacccauccaaugga

SEQ ID NO: 1980694 - RNA, 19 nt, Homo sapiens
cagcacacaccuauggcug

SEQ ID NO: 1980695 - RNA, 14 nt, Homo sapiens
uagcauguuccucc

SEQ ID NO: 1980696 - RNA, 20 nt, Homo sapiens
augcuaucaaauaacuaagg

SEQ ID NO: 1980697 - RNA, 19 nt, Homo sapiens
caaacaagaaacauuucag

SEQ ID NO: 1980698 - RNA, 20 nt, Homo sapiens
acauguguguauauaugugu

SEQ ID NO: 1980699 - RNA, 13 nt, Homo sapiens
gauuucaggauac

SEQ ID NO: 1980700 - RNA, 20 nt, Homo sapiens
ucaugguccccauggcaugg

SEQ ID NO: 1980701 - RNA, 21 nt, Homo sapiens
auuaaucaaaccacuguuauu

SEQ ID NO: 1980702 - RNA, 13 nt, Homo sapiens
aagccugacuuca

SEQ ID NO: 1980703 - RNA, 23 nt, Homo sapiens
ucagugacugaauucugccuugg

SEQ ID NO: 1980704 - RNA, 14 nt, Homo sapiens
aacacauggcuucc

SEQ ID NO: 1980705 - RNA, 16 nt, Homo sapiens
uuccaaaaacuguuaa

SEQ ID NO: 1980706 - RNA, 13 nt, Homo sapiens
uggagaaagcuca

SEQ ID NO: 1980707 - RNA, 19 nt, Homo sapiens
acauucaucaagcuguaca

SEQ ID NO: 1980708 - RNA, 12 nt, Homo sapiens
uggcacuuugaa

SEQ ID NO: 1980709 - RNA, 20 nt, Homo sapiens
acugucaguguacacgucug

SEQ ID NO: 1980710 - RNA, 20 nt, Homo sapiens
cgcuaugugacuugcgcuua

SEQ ID NO: 1980711 - RNA, 23 nt, Homo sapiens
cugugauugccauuucuucccaa

SEQ ID NO: 1980712 - RNA, 19 nt, Homo sapiens
ccagacacagacuggcaau

SEQ ID NO: 1980713 - RNA, 21 nt, Homo sapiens
uuugcaauaaaagguuuccua

SEQ ID NO: 1980714 - RNA, 16 nt, Homo sapiens
aaauaaaacagcagca

SEQ ID NO: 1980715 - RNA, 19 nt, Homo sapiens
acacuugggugaaaaguau

SEQ ID NO: 1980716 - RNA, 17 nt, Homo sapiens
cugaaguccauuuuccc

SEQ ID NO: 1980717 - RNA, 17 nt, Homo sapiens
gcuugucccuguggaag

SEQ ID NO: 1980718 - RNA, 19 nt, Homo sapiens
gugcugccuugcuucugua

SEQ ID NO: 1980719 - RNA, 17 nt, Homo sapiens
gccagugagcugugauc

SEQ ID NO: 1980720 - RNA, 22 nt, Homo sapiens
cuccugaccauaauccuagccc

SEQ ID NO: 1980721 - RNA, 14 nt, Homo sapiens
aagucuggcacuuc

SEQ ID NO: 1980722 - RNA, 21 nt, Homo sapiens
ggaaagguagcccccgaggga

SEQ ID NO: 1980723 - RNA, 17 nt, Homo sapiens
guagcuuaccugacaca

SEQ ID NO: 1980724 - RNA, 20 nt, Homo sapiens
aacuucaguccaacugucaa

SEQ ID NO: 1980725 - RNA, 22 nt, Homo sapiens
uucaaauacaaaguaaauacaa

SEQ ID NO: 1980726 - RNA, 12 nt, Homo sapiens
ucucugugaauu

SEQ ID NO: 1980727 - RNA, 15 nt, Homo sapiens
cagugcucagcuaaa

SEQ ID NO: 1980728 - RNA, 20 nt, Homo sapiens
uccauguguuuugcuuuuau

SEQ ID NO: 1980729 - RNA, 15 nt, Homo sapiens
ucccacuacaucugg

SEQ ID NO: 1980730 - RNA, 20 nt, Homo sapiens
gaagaacuuggcacacucuc

SEQ ID NO: 1980731 - RNA, 22 nt, Homo sapiens
uggacuguaacauccauguugu

SEQ ID NO: 1980732 - RNA, 23 nt, Homo sapiens
acccagaccugccugucucccac

SEQ ID NO: 1980733 - RNA, 19 nt, Homo sapiens
caagccccuuaguccccaa

SEQ ID NO: 1980734 - RNA, 15 nt, Homo sapiens
auuauuuccccuuca

SEQ ID NO: 1980735 - RNA, 14 nt, Homo sapiens
ucuuauuuuagaca

SEQ ID NO: 1980736 - RNA, 13 nt, Homo sapiens
aaaaauauuccaa

SEQ ID NO: 1980737 - RNA, 15 nt, Homo sapiens
uccuaaaucgugaua

SEQ ID NO: 1980738 - RNA, 13 nt, Homo sapiens
uaaauuauaccau

SEQ ID NO: 1980739 - RNA, 22 nt, Homo sapiens
ccucgacugcuuuaguggggaa

SEQ ID NO: 1980740 - RNA, 22 nt, Homo sapiens
cuggccaugccuggagacauau

SEQ ID NO: 1980741 - RNA, 16 nt, Homo sapiens
ggugagagaaguacaa

SEQ ID NO: 1980742 - RNA, 21 nt, Homo sapiens
auuacaggcacccaccacauc

SEQ ID NO: 1980743 - RNA, 19 nt, Homo sapiens
cucccacuuggccaagcag

SEQ ID NO: 1980744 - RNA, 22 nt, Homo sapiens
gggauguccuacuaucacugaa

SEQ ID NO: 1980745 - RNA, 18 nt, Homo sapiens
gcacugaaguagccaaca

SEQ ID NO: 1980746 - RNA, 16 nt, Homo sapiens
acagaucacuccugga

SEQ ID NO: 1980747 - RNA, 15 nt, Homo sapiens
uccaguccaaggaaa

SEQ ID NO: 1980748 - RNA, 13 nt, Homo sapiens
uuacagcuuuucu

SEQ ID NO: 1980749 - RNA, 13 nt, Homo sapiens
uuuaugcuuuaaa

SEQ ID NO: 1980750 - RNA, 21 nt, Homo sapiens
aauacugaauuuugagucuau

SEQ ID NO: 1980751 - RNA, 20 nt, Homo sapiens
ccugaaccguuacaaaagaa

SEQ ID NO: 1980752 - RNA, 18 nt, Homo sapiens
gcucaggaccaggcaaug

SEQ ID NO: 1980753 - RNA, 18 nt, Homo sapiens
aacuggcaugucauuugc

SEQ ID NO: 1980754 - RNA, 20 nt, Homo sapiens
ucugaacauacagagcccac

SEQ ID NO: 1980755 - RNA, 19 nt, Homo sapiens
ugucauaccagaaagcucu

SEQ ID NO: 1980756 - RNA, 20 nt, Homo sapiens
ugaggcauccuuccucacac

SEQ ID NO: 1980757 - RNA, 16 nt, Homo sapiens
accagccgaggccaca

SEQ ID NO: 1980758 - RNA, 15 nt, Homo sapiens
ucccaaccccaggaa

SEQ ID NO: 1980759 - RNA, 12 nt, Homo sapiens
uuaagagcucag

SEQ ID NO: 1980760 - RNA, 18 nt, Homo sapiens
cuguuagugacagagccc

SEQ ID NO: 1980761 - RNA, 22 nt, Homo sapiens
auuucauacaacagaaaccaga

SEQ ID NO: 1980762 - RNA, 11 nt, Homo sapiens
cauacauaaaa

SEQ ID NO: 1980763 - RNA, 15 nt, Homo sapiens
cacaacacacacacu

SEQ ID NO: 1980764 - RNA, 16 nt, Homo sapiens
uguaaacuuccaaguc

SEQ ID NO: 1980765 - RNA, 17 nt, Homo sapiens
uuuuucuaauagguacu

SEQ ID NO: 1980766 - RNA, 20 nt, Homo sapiens
ugcagugaauuuucauuucu

SEQ ID NO: 1980767 - RNA, 18 nt, Homo sapiens
aagagauuguuguuugcc

SEQ ID NO: 1980768 - RNA, 18 nt, Homo sapiens
agcccagcccggcaggga

SEQ ID NO: 1980769 - RNA, 18 nt, Homo sapiens
aggccugggccgcugcca

SEQ ID NO: 1980770 - RNA, 23 nt, Homo sapiens
uauuuuugcccugaguccaagag

SEQ ID NO: 1980771 - RNA, 22 nt, Homo sapiens
cuuggcuuuaugcaaauacaau

SEQ ID NO: 1980772 - RNA, 19 nt, Homo sapiens
acauuuuuauaaaaaugag

SEQ ID NO: 1980773 - RNA, 23 nt, Homo sapiens
augucagaaguuucuuuuuacau

SEQ ID NO: 1980774 - RNA, 16 nt, Homo sapiens
auaauuuaccuaagau

SEQ ID NO: 1980775 - RNA, 16 nt, Homo sapiens
ucacaguguugcccag

SEQ ID NO: 1980776 - RNA, 21 nt, Homo sapiens
cacauagauuaauggcacuga

SEQ ID NO: 1980777 - RNA, 16 nt, Homo sapiens
auucuacucaaaguca

SEQ ID NO: 1980778 - RNA, 20 nt, Homo sapiens
ucaccuagcagccucaaaac

SEQ ID NO: 1980779 - RNA, 17 nt, Homo sapiens
uaaauuauacacuauga

SEQ ID NO: 1980780 - RNA, 14 nt, Homo sapiens
acagugcguugcaa

SEQ ID NO: 1980781 - RNA, 20 nt, Homo sapiens
acugcacuauagccuaggug

SEQ ID NO: 1980782 - RNA, 22 nt, Homo sapiens
uggcuguccuaccaucagcucu

SEQ ID NO: 1980783 - RNA, 20 nt, Homo sapiens
cuuaaauauguggaguucau

SEQ ID NO: 1980784 - RNA, 23 nt, Homo sapiens
uuaguuccccaaauacaaaguua

SEQ ID NO: 1980785 - RNA, 14 nt, Homo sapiens
aaucaaaccucagg

SEQ ID NO: 1980786 - RNA, 20 nt, Homo sapiens
uuuguccuggucaugcacau

SEQ ID NO: 1980787 - RNA, 22 nt, Homo sapiens
uuccacagugugaagacacugu

SEQ ID NO: 1980788 - RNA, 14 nt, Homo sapiens
gggcccacguguau

SEQ ID NO: 1980789 - RNA, 15 nt, Homo sapiens
agacauggaccucca

SEQ ID NO: 1980790 - RNA, 19 nt, Homo sapiens
ucaccuuuuccuugcugau

SEQ ID NO: 1980791 - RNA, 15 nt, Homo sapiens
gccuuucaguauuga

SEQ ID NO: 1980792 - RNA, 16 nt, Homo sapiens
auaguauuuucuacua

SEQ ID NO: 1980793 - RNA, 14 nt, Homo sapiens
cugcugucauuuua

SEQ ID NO: 1980794 - RNA, 15 nt, Homo sapiens
augucuauucagcuu

SEQ ID NO: 1980795 - RNA, 16 nt, Homo sapiens
agaaguaugggaaaug

SEQ ID NO: 1980796 - RNA, 22 nt, Homo sapiens
uguacacaacaccuaaaaccag

SEQ ID NO: 1980797 - RNA, 15 nt, Homo sapiens
gcuagggaauaucaa

SEQ ID NO: 1980798 - RNA, 12 nt, Homo sapiens
aagaagcaguuu

SEQ ID NO: 1980799 - RNA, 15 nt, Homo sapiens
gacuccuggcccaag

SEQ ID NO: 1980800 - RNA, 21 nt, Homo sapiens
uaaaacuuuccugacuuacaa

SEQ ID NO: 1980801 - RNA, 16 nt, Homo sapiens
gcucagagaugugcac

SEQ ID NO: 1980802 - RNA, 19 nt, Homo sapiens
uucaaguuuuaaaguucau

SEQ ID NO: 1980803 - RNA, 22 nt, Homo sapiens
gugaagaacuauuuuauucuaa

SEQ ID NO: 1980804 - RNA, 17 nt, Homo sapiens
cccuaaaauauuacaaa

SEQ ID NO: 1980805 - RNA, 16 nt, Homo sapiens
gggaggcugaggcagc

SEQ ID NO: 1980806 - RNA, 16 nt, Homo sapiens
ccucagccucugcaac

SEQ ID NO: 1980807 - RNA, 14 nt, Homo sapiens
aaaguuuacaacau

SEQ ID NO: 1980808 - RNA, 20 nt, Homo sapiens
uaugucaggcaaagugcugc

SEQ ID NO: 1980809 - RNA, 20 nt, Homo sapiens
ucccugaagucuugcauuga

SEQ ID NO: 1980810 - RNA, 18 nt, Homo sapiens
cugcugcucaaaaugcca

SEQ ID NO: 1980811 - RNA, 17 nt, Homo sapiens
auauuacugauuuacaa

SEQ ID NO: 1980812 - RNA, 11 nt, Homo sapiens
cuaccaaaggg

SEQ ID NO: 1980813 - RNA, 21 nt, Homo sapiens
gggaucuaaaaggaggacagg

SEQ ID NO: 1980814 - RNA, 16 nt, Homo sapiens
aaucuuguuuugccaa

SEQ ID NO: 1980815 - RNA, 11 nt, Homo sapiens
auguccaaaga

SEQ ID NO: 1980816 - RNA, 19 nt, Homo sapiens
uuucugugaagcuaauaca

SEQ ID NO: 1980817 - RNA, 20 nt, Homo sapiens
auuguuucuccucugaagca

SEQ ID NO: 1980818 - RNA, 22 nt, Homo sapiens
auagaguuuuuauuaauuacuu

SEQ ID NO: 1980819 - RNA, 21 nt, Homo sapiens
auuucacacucauuuaaucug

SEQ ID NO: 1980820 - RNA, 11 nt, Homo sapiens
auguguauuau

SEQ ID NO: 1980821 - RNA, 18 nt, Homo sapiens
guauugagacacugucaa

SEQ ID NO: 1980822 - RNA, 20 nt, Homo sapiens
uggacucaagcaagauuuca

SEQ ID NO: 1980823 - RNA, 21 nt, Homo sapiens
acagcacuuuuccucuucuag

SEQ ID NO: 1980824 - RNA, 13 nt, Homo sapiens
ucauuaacaagaa

SEQ ID NO: 1980825 - RNA, 21 nt, Homo sapiens
aaucagaccuuuucuuugaaa

SEQ ID NO: 1980826 - RNA, 15 nt, Homo sapiens
cagccccucaugccu

SEQ ID NO: 1980827 - RNA, 15 nt, Homo sapiens
uuugcacuuugccau

SEQ ID NO: 1980828 - RNA, 14 nt, Homo sapiens
caguacgauuugca

SEQ ID NO: 1980829 - RNA, 22 nt, Homo sapiens
uuugggaaaauaaauacauucg

SEQ ID NO: 1980830 - RNA, 19 nt, Homo sapiens
gaggcccugagacagggau

SEQ ID NO: 1980831 - RNA, 12 nt, Homo sapiens
agaagccaagga

SEQ ID NO: 1980832 - RNA, 16 nt, Homo sapiens
acucagaaggcaaagg

SEQ ID NO: 1980833 - RNA, 16 nt, Homo sapiens
aaauaucuugcuuuca

SEQ ID NO: 1980834 - RNA, 22 nt, Homo sapiens
aggugguaugugacaccaaagc

SEQ ID NO: 1980835 - RNA, 21 nt, Homo sapiens
aaagcagaaaguucaacuucc

SEQ ID NO: 1980836 - RNA, 23 nt, Homo sapiens
cggcagggaagaggccagcguga

SEQ ID NO: 1980837 - RNA, 20 nt, Homo sapiens
cuucacuacuuuaauaaaga

SEQ ID NO: 1980838 - RNA, 19 nt, Homo sapiens
uccuagaggugggcagcug

SEQ ID NO: 1980839 - RNA, 23 nt, Homo sapiens
cccgugccacgcgcucugcaugc

SEQ ID NO: 1980840 - RNA, 23 nt, Homo sapiens
cuuguaauuguggauuaauguca

SEQ ID NO: 1980841 - RNA, 15 nt, Homo sapiens
aaaacaggucuucau

SEQ ID NO: 1980842 - RNA, 14 nt, Homo sapiens
uauuaaauuccucc

SEQ ID NO: 1980843 - RNA, 15 nt, Homo sapiens
cuggaggccucugca

SEQ ID NO: 1980844 - RNA, 14 nt, Homo sapiens
ccagccugggagau

SEQ ID NO: 1980845 - RNA, 15 nt, Homo sapiens
ccuuuuaaguuugaa

SEQ ID NO: 1980846 - RNA, 14 nt, Homo sapiens
ucacccaaugcaua

SEQ ID NO: 1980847 - RNA, 23 nt, Homo sapiens
gaaacuauauuuugucauaucaa

SEQ ID NO: 1980848 - RNA, 14 nt, Homo sapiens
cauggucagucuac

SEQ ID NO: 1980849 - RNA, 19 nt, Homo sapiens
uuaauacucaaaugaguaa

SEQ ID NO: 1980850 - RNA, 17 nt, Homo sapiens
agcucacuacaaccucc

SEQ ID NO: 1980851 - RNA, 14 nt, Homo sapiens
ucccacgaggaauc

SEQ ID NO: 1980852 - RNA, 19 nt, Homo sapiens
cugaccccgaccucagaga

SEQ ID NO: 1980853 - RNA, 18 nt, Homo sapiens
aguuuugaccuaacauac

SEQ ID NO: 1980854 - RNA, 20 nt, Homo sapiens
caggggugagccaccgugcc

SEQ ID NO: 1980855 - RNA, 14 nt, Homo sapiens
cauuaaaagacugu

SEQ ID NO: 1980856 - RNA, 14 nt, Homo sapiens
aagugguuucagca

SEQ ID NO: 1980857 - RNA, 14 nt, Homo sapiens
aagucguuucagga

SEQ ID NO: 1980858 - RNA, 14 nt, Homo sapiens
aguucucacucugg

SEQ ID NO: 1980859 - RNA, 19 nt, Homo sapiens
gaaacaaauaaacuagucu

SEQ ID NO: 1980860 - RNA, 16 nt, Homo sapiens
cagcuaacaauuguga

SEQ ID NO: 1980861 - RNA, 13 nt, Homo sapiens
cuagaaaucuguu

SEQ ID NO: 1980862 - RNA, 19 nt, Homo sapiens
gccuggccaagagaccagc

SEQ ID NO: 1980863 - RNA, 16 nt, Homo sapiens
ggcuggaaggggucca

SEQ ID NO: 1980864 - RNA, 19 nt, Homo sapiens
gacagaggaugagcucuac

SEQ ID NO: 1980865 - RNA, 11 nt, Homo sapiens
cucaccucucu

SEQ ID NO: 1980866 - RNA, 19 nt, Homo sapiens
gcaccacuguguauuuaac

SEQ ID NO: 1980867 - RNA, 20 nt, Homo sapiens
agcaggaauaaagacuugug

SEQ ID NO: 1980868 - RNA, 18 nt, Homo sapiens
caaaugacaugcacugac

SEQ ID NO: 1980869 - RNA, 19 nt, Homo sapiens
augcugaccugacuugccu

SEQ ID NO: 1980870 - RNA, 13 nt, Homo sapiens
auguucugcuuuc

SEQ ID NO: 1980871 - RNA, 18 nt, Homo sapiens
acaaaaugucacacuugu

SEQ ID NO: 1980872 - RNA, 17 nt, Homo sapiens
aaagcugaccccaaaga

SEQ ID NO: 1980873 - RNA, 14 nt, Homo sapiens
ucacccuacaagau

SEQ ID NO: 1980874 - RNA, 23 nt, Homo sapiens
uucauuccuaacacagcaugugu

SEQ ID NO: 1980875 - RNA, 18 nt, Homo sapiens
auucauaaaucuauucau

SEQ ID NO: 1980876 - RNA, 22 nt, Homo sapiens
cuggagaagcauccaaggaacu

SEQ ID NO: 1980877 - RNA, 17 nt, Homo sapiens
aguagaaaggccuuuaa

SEQ ID NO: 1980878 - RNA, 19 nt, Homo sapiens
acucuuaguuacucauuca

SEQ ID NO: 1980879 - RNA, 20 nt, Homo sapiens
caaucucagcuaacauucca

SEQ ID NO: 1980880 - RNA, 14 nt, Homo sapiens
ucuguuaccagagg

SEQ ID NO: 1980881 - RNA, 19 nt, Homo sapiens
guuauuuagggaacugcuu

SEQ ID NO: 1980882 - RNA, 16 nt, Homo sapiens
ccuccuuggugccucu

SEQ ID NO: 1980883 - RNA, 14 nt, Homo sapiens
ugaaguauugcuga

SEQ ID NO: 1980884 - RNA, 20 nt, Homo sapiens
accaauaaagugacccugcu

SEQ ID NO: 1980885 - RNA, 21 nt, Homo sapiens
aacuaguaaaaugcuggugaa

SEQ ID NO: 1980886 - RNA, 19 nt, Homo sapiens
ucuccucugggccacugau

SEQ ID NO: 1980887 - RNA, 18 nt, Homo sapiens
ugcaugugcgucaccguc

SEQ ID NO: 1980888 - RNA, 16 nt, Homo sapiens
aucuuuuuuagcauaa

SEQ ID NO: 1980889 - RNA, 23 nt, Homo sapiens
ccagcuacauuccucagcugcca

SEQ ID NO: 1980890 - RNA, 19 nt, Homo sapiens
ucacacgggggcagcugau

SEQ ID NO: 1980891 - RNA, 18 nt, Homo sapiens
uuccuuccaagucuuccu

SEQ ID NO: 1980892 - RNA, 22 nt, Homo sapiens
cacucuaauauaauauggauca

SEQ ID NO: 1980893 - RNA, 16 nt, Homo sapiens
accuucccaugcccug

SEQ ID NO: 1980894 - RNA, 22 nt, Homo sapiens
cacauguugccuugcauuugug

SEQ ID NO: 1980895 - RNA, 21 nt, Homo sapiens
acaggcgcccgccaccaugcc

SEQ ID NO: 1980896 - RNA, 18 nt, Homo sapiens
gccaaacagccccaaagu

SEQ ID NO: 1980897 - RNA, 12 nt, Homo sapiens
ugcagacaugag

SEQ ID NO: 1980898 - RNA, 20 nt, Homo sapiens
ugaauacuuacauucucuaa

SEQ ID NO: 1980899 - RNA, 20 nt, Homo sapiens
ugauuuauuaaauaaucucu

SEQ ID NO: 1980900 - RNA, 14 nt, Homo sapiens
uggaaacaggacca

SEQ ID NO: 1980901 - RNA, 15 nt, Homo sapiens
uggugcaaacacagc

SEQ ID NO: 1980902 - RNA, 12 nt, Homo sapiens
cuucccauucug

SEQ ID NO: 1980903 - RNA, 13 nt, Homo sapiens
cagugcuaccucu

SEQ ID NO: 1980904 - RNA, 20 nt, Homo sapiens
cagagggauaaaaacaauac

SEQ ID NO: 1980905 - RNA, 12 nt, Homo sapiens
ggaucagugggg

SEQ ID NO: 1980906 - RNA, 17 nt, Homo sapiens
ugucacucugccucuaa

SEQ ID NO: 1980907 - RNA, 12 nt, Homo sapiens
auaaaacucugc

SEQ ID NO: 1980908 - RNA, 16 nt, Homo sapiens
uguaugcauucaucca

SEQ ID NO: 1980909 - RNA, 20 nt, Homo sapiens
cugaacucccagaaccacua

SEQ ID NO: 1980910 - RNA, 13 nt, Homo sapiens
uuguaagcacuga

SEQ ID NO: 1980911 - RNA, 13 nt, Homo sapiens
uugguagcacuuu

SEQ ID NO: 1980912 - RNA, 15 nt, Homo sapiens
ugagugcgugcucag

SEQ ID NO: 1980913 - RNA, 18 nt, Homo sapiens
gggugcucugaaucugua

SEQ ID NO: 1980914 - RNA, 18 nt, Homo sapiens
agaguguggguccuucaa

SEQ ID NO: 1980915 - RNA, 19 nt, Homo sapiens
cuguuaucuaguaugcauu

SEQ ID NO: 1980916 - RNA, 14 nt, Homo sapiens
aaacuucacuccaa

SEQ ID NO: 1980917 - RNA, 19 nt, Homo sapiens
ugcuucaggauccaaguga

SEQ ID NO: 1980918 - RNA, 17 nt, Homo sapiens
auuucacgaacuguuca

SEQ ID NO: 1980919 - RNA, 18 nt, Homo sapiens
aggagcccuccauuccaa

SEQ ID NO: 1980920 - RNA, 15 nt, Homo sapiens
ugagcuguguucaca

SEQ ID NO: 1980921 - RNA, 14 nt, Homo sapiens
cugauaacucugua

SEQ ID NO: 1980922 - RNA, 20 nt, Homo sapiens
cauuucaucuacuacagggu

SEQ ID NO: 1980923 - RNA, 13 nt, Homo sapiens
aaugaacuaguuu

SEQ ID NO: 1980924 - RNA, 20 nt, Homo sapiens
auguaucacgggucacuuga

SEQ ID NO: 1980925 - RNA, 15 nt, Homo sapiens
aaguugaaaagccaa

SEQ ID NO: 1980926 - RNA, 15 nt, Homo sapiens
ugaucauaaugaggu

SEQ ID NO: 1980927 - RNA, 13 nt, Homo sapiens
ucugcuugaucaa

SEQ ID NO: 1980928 - RNA, 23 nt, Homo sapiens
ugaaggaggggguucuuccucac

SEQ ID NO: 1980929 - RNA, 12 nt, Homo sapiens
gugaggugagcc

SEQ ID NO: 1980930 - RNA, 15 nt, Homo sapiens
aauuaaggcaucauc

SEQ ID NO: 1980931 - RNA, 17 nt, Homo sapiens
cuugggcacaucugcug

SEQ ID NO: 1980932 - RNA, 17 nt, Homo sapiens
cucacucaaguucaagg

SEQ ID NO: 1980933 - RNA, 15 nt, Homo sapiens
aggcacugacugagc

SEQ ID NO: 1980934 - RNA, 16 nt, Homo sapiens
uucauucugaaucuga

SEQ ID NO: 1980935 - RNA, 14 nt, Homo sapiens
gccccugcucugua

SEQ ID NO: 1980936 - RNA, 17 nt, Homo sapiens
auuacuacucagccuuc

SEQ ID NO: 1980937 - RNA, 23 nt, Homo sapiens
augugguuauuuucuccaugucu

SEQ ID NO: 1980938 - RNA, 18 nt, Homo sapiens
uacauuaaaaaaauucca

SEQ ID NO: 1980939 - RNA, 17 nt, Homo sapiens
acggacucaugauuucu

SEQ ID NO: 1980940 - RNA, 15 nt, Homo sapiens
aucuuggcaggggug

SEQ ID NO: 1980941 - RNA, 12 nt, Homo sapiens
aaucaucucacc

SEQ ID NO: 1980942 - RNA, 12 nt, Homo sapiens
auucaucucucc

SEQ ID NO: 1980943 - RNA, 16 nt, Homo sapiens
uacauguaauccauca

SEQ ID NO: 1980944 - RNA, 13 nt, Homo sapiens
auuuaacacuaaa

SEQ ID NO: 1980945 - RNA, 22 nt, Homo sapiens
ccaggaacucgcaccugugcug

SEQ ID NO: 1980946 - RNA, 13 nt, Homo sapiens
uuggaauuuguaa

SEQ ID NO: 1980947 - RNA, 15 nt, Homo sapiens
aggaguuagaaccac

SEQ ID NO: 1980948 - RNA, 23 nt, Homo sapiens
aggagaaacaguuucaacucuga

SEQ ID NO: 1980949 - RNA, 15 nt, Homo sapiens
agcuaagccugauga

SEQ ID NO: 1980950 - RNA, 18 nt, Homo sapiens
auccagucacagccauac

SEQ ID NO: 1980951 - RNA, 21 nt, Homo sapiens
agccacuacauuacuucaaac

SEQ ID NO: 1980952 - RNA, 15 nt, Homo sapiens
uggccaaaguguaca

SEQ ID NO: 1980953 - RNA, 17 nt, Homo sapiens
cugcaugaaagcauucu

SEQ ID NO: 1980954 - RNA, 19 nt, Homo sapiens
ccaaaagcugcucagggaa

SEQ ID NO: 1980955 - RNA, 16 nt, Homo sapiens
gugacuuaguguacau

SEQ ID NO: 1980956 - RNA, 23 nt, Homo sapiens
uuuacuaagcacuguguuuauau

SEQ ID NO: 1980957 - RNA, 12 nt, Homo sapiens
aucaccuguggg

SEQ ID NO: 1980958 - RNA, 17 nt, Homo sapiens
acauuuucacaacucuu

SEQ ID NO: 1980959 - RNA, 20 nt, Homo sapiens
uccucucauugucuuguuau

SEQ ID NO: 1980960 - RNA, 19 nt, Homo sapiens
uggcugccagaaucuagag

SEQ ID NO: 1980961 - RNA, 15 nt, Homo sapiens
augugggaacagcuc

SEQ ID NO: 1980962 - RNA, 19 nt, Homo sapiens
gacagauuuaaccucugcc

SEQ ID NO: 1980963 - RNA, 17 nt, Homo sapiens
gcacuuuaaaugaagcu

SEQ ID NO: 1980964 - RNA, 14 nt, Homo sapiens
ggauauggugcaaa

SEQ ID NO: 1980965 - RNA, 20 nt, Homo sapiens
agguggguuuguaccuuccu

SEQ ID NO: 1980966 - RNA, 14 nt, Homo sapiens
gggcuuagugugag

SEQ ID NO: 1980967 - RNA, 16 nt, Homo sapiens
ccagauguuguuccug

SEQ ID NO: 1980968 - RNA, 14 nt, Homo sapiens
ggccauacugccuu

SEQ ID NO: 1980969 - RNA, 18 nt, Homo sapiens
ggcaucucccaccagcuc

SEQ ID NO: 1980970 - RNA, 21 nt, Homo sapiens
ugggaggcaagaaaaggacaa

SEQ ID NO: 1980971 - RNA, 14 nt, Homo sapiens
acaagucucagggg

SEQ ID NO: 1980972 - RNA, 20 nt, Homo sapiens
aauccugaggcaaaguagug

SEQ ID NO: 1980973 - RNA, 19 nt, Homo sapiens
uccuauucccugucacuac

SEQ ID NO: 1980974 - RNA, 19 nt, Homo sapiens
acaguuggagggaaagcca

SEQ ID NO: 1980975 - RNA, 20 nt, Homo sapiens
gaggugagaacuaaugccua

SEQ ID NO: 1980976 - RNA, 18 nt, Homo sapiens
cacacaugcuaggaugcg

SEQ ID NO: 1980977 - RNA, 21 nt, Homo sapiens
auaaaguugagagacaguaac

SEQ ID NO: 1980978 - RNA, 22 nt, Homo sapiens
aagaggagaaaaaaacuucuuu

SEQ ID NO: 1980979 - RNA, 22 nt, Homo sapiens
caucuccuguuuuuugaugcuu

SEQ ID NO: 1980980 - RNA, 11 nt, Homo sapiens
gagcaaaggcu

SEQ ID NO: 1980981 - RNA, 13 nt, Homo sapiens
aauagagugaauu

SEQ ID NO: 1980982 - RNA, 18 nt, Homo sapiens
ccacauuuccacaccaga

SEQ ID NO: 1980983 - RNA, 14 nt, Homo sapiens
aucuacacucucga

SEQ ID NO: 1980984 - RNA, 22 nt, Homo sapiens
cuugccaaaucaaaagacuuuu

SEQ ID NO: 1980985 - RNA, 13 nt, Homo sapiens
caucagcucucug

SEQ ID NO: 1980986 - RNA, 14 nt, Homo sapiens
agggccucugggag

SEQ ID NO: 1980987 - RNA, 16 nt, Homo sapiens
uugaugaaagugcaaa

SEQ ID NO: 1980988 - RNA, 22 nt, Homo sapiens
acaacaaagcaugcucaguauu

SEQ ID NO: 1980989 - RNA, 21 nt, Homo sapiens
acaagagggcaagccucuagu

SEQ ID NO: 1980990 - RNA, 21 nt, Homo sapiens
cacuucucccuggcccaggcu

SEQ ID NO: 1980991 - RNA, 13 nt, Homo sapiens
gucaucagauuau

SEQ ID NO: 1980992 - RNA, 16 nt, Homo sapiens
ccacuacaucugggac

SEQ ID NO: 1980993 - RNA, 14 nt, Homo sapiens
caaugcaugugcug

SEQ ID NO: 1980994 - RNA, 18 nt, Homo sapiens
uuuuuagcucaucggcua

SEQ ID NO: 1980995 - RNA, 23 nt, Homo sapiens
uuggcgugguccaugcugaugau

SEQ ID NO: 1980996 - RNA, 13 nt, Homo sapiens
ugaagaggggcca

SEQ ID NO: 1980997 - RNA, 13 nt, Homo sapiens
aucaacaugacug

SEQ ID NO: 1980998 - RNA, 13 nt, Homo sapiens
aaaagcauguaua

SEQ ID NO: 1980999 - RNA, 19 nt, Homo sapiens
acuuggggauuaucuguca

SEQ ID NO: 1981000 - RNA, 21 nt, Homo sapiens
cuauucucggggcccugugua

SEQ ID NO: 1981001 - RNA, 11 nt, Homo sapiens
uuccacuccac

SEQ ID NO: 1981002 - RNA, 15 nt, Homo sapiens
cuaaaugcacugacc

SEQ ID NO: 1981003 - RNA, 19 nt, Homo sapiens
uugauacaauauugugcau

SEQ ID NO: 1981004 - RNA, 18 nt, Homo sapiens
auaaucacaacccuucag

SEQ ID NO: 1981005 - RNA, 17 nt, Homo sapiens
cuagauuuaacucaguu

SEQ ID NO: 1981006 - RNA, 10 nt, Homo sapiens
aauuaggcag

SEQ ID NO: 1981007 - RNA, 15 nt, Homo sapiens
acuacaaacuucaaa

SEQ ID NO: 1981008 - RNA, 16 nt, Homo sapiens
uccuuuccaucagcuu

SEQ ID NO: 1981009 - RNA, 17 nt, Homo sapiens
uaaacaucacaugagac

SEQ ID NO: 1981010 - RNA, 11 nt, Homo sapiens
auccuacccca

SEQ ID NO: 1981011 - RNA, 22 nt, Homo sapiens
uccaggacucagggacucaggc

SEQ ID NO: 1981012 - RNA, 17 nt, Homo sapiens
aagauacauuucaucug

SEQ ID NO: 1981013 - RNA, 15 nt, Homo sapiens
cugucaagcuggugc

SEQ ID NO: 1981014 - RNA, 18 nt, Homo sapiens
ggaaggcaacgcaccauc

SEQ ID NO: 1981015 - RNA, 12 nt, Homo sapiens
aauugcugaaag

SEQ ID NO: 1981016 - RNA, 15 nt, Homo sapiens
agccacacuguggga

SEQ ID NO: 1981017 - RNA, 23 nt, Homo sapiens
uacucuaaacaauaguucacucc

SEQ ID NO: 1981018 - RNA, 16 nt, Homo sapiens
cuugggcuacuggcag

SEQ ID NO: 1981019 - RNA, 14 nt, Homo sapiens
agucacauugccau

SEQ ID NO: 1981020 - RNA, 15 nt, Homo sapiens
cagaaacuacauuuc

SEQ ID NO: 1981021 - RNA, 22 nt, Homo sapiens
uaaaauuuaucuuaaguucuau

SEQ ID NO: 1981022 - RNA, 16 nt, Homo sapiens
gccguccaagaacaag

SEQ ID NO: 1981023 - RNA, 18 nt, Homo sapiens
uccucaccacaguuuauu

SEQ ID NO: 1981024 - RNA, 15 nt, Homo sapiens
gcauuaaagugcugu

SEQ ID NO: 1981025 - RNA, 16 nt, Homo sapiens
acacauggaugcacac

SEQ ID NO: 1981026 - RNA, 20 nt, Homo sapiens
ccugcccccgggggcucaca

SEQ ID NO: 1981027 - RNA, 13 nt, Homo sapiens
uuggccacugucu

SEQ ID NO: 1981028 - RNA, 14 nt, Homo sapiens
uaagaaaugggacu

SEQ ID NO: 1981029 - RNA, 17 nt, Homo sapiens
acaggcccuuuccucag

SEQ ID NO: 1981030 - RNA, 21 nt, Homo sapiens
ucaccccacacccauguguac

SEQ ID NO: 1981031 - RNA, 14 nt, Homo sapiens
ucagagagcucacu

SEQ ID NO: 1981032 - RNA, 20 nt, Homo sapiens
agccuguucccacucagcag

SEQ ID NO: 1981033 - RNA, 15 nt, Homo sapiens
ucauggagaagacuu

SEQ ID NO: 1981034 - RNA, 21 nt, Homo sapiens
uuaauacagugagcucuagca

SEQ ID NO: 1981035 - RNA, 23 nt, Homo sapiens
gagccucacuggggcagacaaua

SEQ ID NO: 1981036 - RNA, 19 nt, Homo sapiens
auuuugugaaauuucauga

SEQ ID NO: 1981037 - RNA, 16 nt, Homo sapiens
agaaggacaccuccuu

SEQ ID NO: 1981038 - RNA, 15 nt, Homo sapiens
acaauuucauucagu

SEQ ID NO: 1981039 - RNA, 17 nt, Homo sapiens
cccauuuuaucuuugaa

SEQ ID NO: 1981040 - RNA, 15 nt, Homo sapiens
cugacagggccagug

SEQ ID NO: 1981041 - RNA, 20 nt, Homo sapiens
uaauguuuuguaauuuugca

SEQ ID NO: 1981042 - RNA, 16 nt, Homo sapiens
uuuugaugauugcuau

SEQ ID NO: 1981043 - RNA, 16 nt, Homo sapiens
agcagcaaaaccaaac

SEQ ID NO: 1981044 - RNA, 18 nt, Homo sapiens
acauugaugaugacuacg

SEQ ID NO: 1981045 - RNA, 22 nt, Homo sapiens
auccaggcacucagaaggcaaa

SEQ ID NO: 1981046 - RNA, 17 nt, Homo sapiens
gagaaguacacauuucu

SEQ ID NO: 1981047 - RNA, 13 nt, Homo sapiens
ugagaacccccua

SEQ ID NO: 1981048 - RNA, 17 nt, Homo sapiens
cagcugcuucugugcau

SEQ ID NO: 1981049 - RNA, 14 nt, Homo sapiens
uucuacuagccauu

SEQ ID NO: 1981050 - RNA, 16 nt, Homo sapiens
gagagaacagggaugc

SEQ ID NO: 1981051 - RNA, 15 nt, Homo sapiens
uucaccaagagccaa

SEQ ID NO: 1981052 - RNA, 23 nt, Homo sapiens
acucuguccuucgcccugugcac

SEQ ID NO: 1981053 - RNA, 17 nt, Homo sapiens
gagcagcuucagugaca

SEQ ID NO: 1981054 - RNA, 17 nt, Homo sapiens
agauagguggugccagu

SEQ ID NO: 1981055 - RNA, 17 nt, Homo sapiens
cagacaauaaaauggaa

SEQ ID NO: 1981056 - RNA, 15 nt, Homo sapiens
ccucuguguucagga

SEQ ID NO: 1981057 - RNA, 20 nt, Homo sapiens
gauauuuucucuaggaaaua

SEQ ID NO: 1981058 - RNA, 21 nt, Homo sapiens
cccagagggauugcugugaaa

SEQ ID NO: 1981059 - RNA, 14 nt, Homo sapiens
guucuaaugacaua

SEQ ID NO: 1981060 - RNA, 14 nt, Homo sapiens
auuaauauaaccau

SEQ ID NO: 1981061 - RNA, 22 nt, Homo sapiens
gguccuguuaacgucaucucag

SEQ ID NO: 1981062 - RNA, 17 nt, Homo sapiens
ggacaccuguacuggag

SEQ ID NO: 1981063 - RNA, 13 nt, Homo sapiens
uucuuuuuccaca

SEQ ID NO: 1981064 - RNA, 23 nt, Homo sapiens
cagaggaauaacaucaccacugu

SEQ ID NO: 1981065 - RNA, 19 nt, Homo sapiens
gcuuaauaaacaugucaca

SEQ ID NO: 1981066 - RNA, 22 nt, Homo sapiens
gccugccagcugggcuuggaag

SEQ ID NO: 1981067 - RNA, 18 nt, Homo sapiens
aauaauaucccacuggga

SEQ ID NO: 1981068 - RNA, 16 nt, Homo sapiens
cucguuagccuuccuc

SEQ ID NO: 1981069 - RNA, 20 nt, Homo sapiens
aggcccuggcccuuuccccu

SEQ ID NO: 1981070 - RNA, 18 nt, Homo sapiens
uggcacauccuaugcaau

SEQ ID NO: 1981071 - RNA, 18 nt, Homo sapiens
uacagagccgagcaauau

SEQ ID NO: 1981072 - RNA, 19 nt, Homo sapiens
ugcaggaaacauuucugac

SEQ ID NO: 1981073 - RNA, 22 nt, Homo sapiens
guugauugaauugugccuuuga

SEQ ID NO: 1981074 - RNA, 21 nt, Homo sapiens
cagcuguauugucugaacuug

SEQ ID NO: 1981075 - RNA, 15 nt, Homo sapiens
acaggaacuaggaua

SEQ ID NO: 1981076 - RNA, 19 nt, Homo sapiens
agccucuccccgcucugga

SEQ ID NO: 1981077 - RNA, 17 nt, Homo sapiens
gaauccuauuuaucaga

SEQ ID NO: 1981078 - RNA, 13 nt, Homo sapiens
acagauaaaugac

SEQ ID NO: 1981079 - RNA, 15 nt, Homo sapiens
uaaugucaauucuug

SEQ ID NO: 1981080 - RNA, 13 nt, Homo sapiens
aucaaggugcuga

SEQ ID NO: 1981081 - RNA, 17 nt, Homo sapiens
caccaucaaaugcugua

SEQ ID NO: 1981082 - RNA, 16 nt, Homo sapiens
gcagaguaacaggauc

SEQ ID NO: 1981083 - RNA, 21 nt, Homo sapiens
cauccuggcuaacacggugaa

SEQ ID NO: 1981084 - RNA, 14 nt, Homo sapiens
gaaggaaauucuua

SEQ ID NO: 1981085 - RNA, 15 nt, Homo sapiens
cuagggagggacaug

SEQ ID NO: 1981086 - RNA, 15 nt, Homo sapiens
aggagcaagcuugcu

SEQ ID NO: 1981087 - RNA, 12 nt, Homo sapiens
ccaaacuggagc

SEQ ID NO: 1981088 - RNA, 16 nt, Homo sapiens
agccugacucuucccu

SEQ ID NO: 1981089 - RNA, 23 nt, Homo sapiens
ugauacucuuucuaaugcugaua

SEQ ID NO: 1981090 - RNA, 18 nt, Homo sapiens
guuaauuuguuauguaua

SEQ ID NO: 1981091 - RNA, 12 nt, Homo sapiens
ggagaccaucua

SEQ ID NO: 1981092 - RNA, 23 nt, Homo sapiens
guggaugcaaauagauucagaga

SEQ ID NO: 1981093 - RNA, 18 nt, Homo sapiens
cugcgucucauacucacc

SEQ ID NO: 1981094 - RNA, 23 nt, Homo sapiens
ugcugaguuugugcugguguaug

SEQ ID NO: 1981095 - RNA, 13 nt, Homo sapiens
ccauuuacacuuu

SEQ ID NO: 1981096 - RNA, 13 nt, Homo sapiens
uugggaagacaug

SEQ ID NO: 1981097 - RNA, 13 nt, Homo sapiens
cagaucugcauuu

SEQ ID NO: 1981098 - RNA, 18 nt, Homo sapiens
gaauauuauaaagugcuu

SEQ ID NO: 1981099 - RNA, 21 nt, Homo sapiens
uaaccucaauuuauguuaaca

SEQ ID NO: 1981100 - RNA, 21 nt, Homo sapiens
uucuacuucaaaaacauuuca

SEQ ID NO: 1981101 - RNA, 17 nt, Homo sapiens
ugcaggaaggagcugcc

SEQ ID NO: 1981102 - RNA, 23 nt, Homo sapiens
aggaggguguaauggagcaucaa

SEQ ID NO: 1981103 - RNA, 12 nt, Homo sapiens
cagaagugaaaa

SEQ ID NO: 1981104 - RNA, 15 nt, Homo sapiens
gcuuucccacucuca

SEQ ID NO: 1981105 - RNA, 14 nt, Homo sapiens
acugagucacucac

SEQ ID NO: 1981106 - RNA, 23 nt, Homo sapiens
uguaaacuauaaacuacuguaau

SEQ ID NO: 1981107 - RNA, 20 nt, Homo sapiens
uaauuuuuaaggauguugcc

SEQ ID NO: 1981108 - RNA, 16 nt, Homo sapiens
ugccagugucuuagca

SEQ ID NO: 1981109 - RNA, 14 nt, Homo sapiens
caucccugccugga

SEQ ID NO: 1981110 - RNA, 21 nt, Homo sapiens
ccugaauucuuuuucauuuga

SEQ ID NO: 1981111 - RNA, 16 nt, Homo sapiens
cacugugcuguuguua

SEQ ID NO: 1981112 - RNA, 17 nt, Homo sapiens
caugcaugugcauauag

SEQ ID NO: 1981113 - RNA, 12 nt, Homo sapiens
auggugcucaga

SEQ ID NO: 1981114 - RNA, 15 nt, Homo sapiens
gacgucaccaagaaa

SEQ ID NO: 1981115 - RNA, 16 nt, Homo sapiens
caccuaguaugcucag

SEQ ID NO: 1981116 - RNA, 11 nt, Homo sapiens
ucucuugcccc

SEQ ID NO: 1981117 - RNA, 13 nt, Homo sapiens
uguggagucauuc

SEQ ID NO: 1981118 - RNA, 23 nt, Homo sapiens
ugaauacgcuaauaagugacaaa

SEQ ID NO: 1981119 - RNA, 19 nt, Homo sapiens
uguuuaagcccagccaagu

SEQ ID NO: 1981120 - RNA, 16 nt, Homo sapiens
auacagaaaaugcuuu

SEQ ID NO: 1981121 - RNA, 17 nt, Homo sapiens
uuguuccagauggggcc

SEQ ID NO: 1981122 - RNA, 13 nt, Homo sapiens
acaucucagggaa

SEQ ID NO: 1981123 - RNA, 16 nt, Homo sapiens
uggcuaacacagugaa

SEQ ID NO: 1981124 - RNA, 12 nt, Homo sapiens
ucagccagguga

SEQ ID NO: 1981125 - RNA, 19 nt, Homo sapiens
uuucaaaugucagcuuaaa

SEQ ID NO: 1981126 - RNA, 13 nt, Homo sapiens
aaauuaagcuuaa

SEQ ID NO: 1981127 - RNA, 19 nt, Homo sapiens
caucugccuuaaaaccaaa

SEQ ID NO: 1981128 - RNA, 20 nt, Homo sapiens
cugccagugccuuaccuccu

SEQ ID NO: 1981129 - RNA, 21 nt, Homo sapiens
ugcaugaccugaucauuacau

SEQ ID NO: 1981130 - RNA, 14 nt, Homo sapiens
uggauuaaaggcaa

SEQ ID NO: 1981131 - RNA, 23 nt, Homo sapiens
aacagacuggcuccaacacugca

SEQ ID NO: 1981132 - RNA, 17 nt, Homo sapiens
uagugacuuccugguga

SEQ ID NO: 1981133 - RNA, 21 nt, Homo sapiens
cccgcagugcugggaccagag

SEQ ID NO: 1981134 - RNA, 17 nt, Homo sapiens
aagagggggcuggccau

SEQ ID NO: 1981135 - RNA, 13 nt, Homo sapiens
gcaugauagacac

SEQ ID NO: 1981136 - RNA, 21 nt, Homo sapiens
auuauagcucuaauguuugca

SEQ ID NO: 1981137 - RNA, 13 nt, Homo sapiens
aauuauauaguua

SEQ ID NO: 1981138 - RNA, 22 nt, Homo sapiens
uggcaauaaacuccuacuaaau

SEQ ID NO: 1981139 - RNA, 11 nt, Homo sapiens
cuaaaugaagu

SEQ ID NO: 1981140 - RNA, 23 nt, Homo sapiens
uucucuguguaugagugugaaug

SEQ ID NO: 1981141 - RNA, 21 nt, Homo sapiens
auguaugugcacaugugucug

SEQ ID NO: 1981142 - RNA, 20 nt, Homo sapiens
uacacaguucugguguuccu

SEQ ID NO: 1981143 - RNA, 14 nt, Homo sapiens
aaucugagaaucac

SEQ ID NO: 1981144 - RNA, 23 nt, Homo sapiens
cuccugaccucaagugaucuguc

SEQ ID NO: 1981145 - RNA, 18 nt, Homo sapiens
uuagaagaaaauggauga

SEQ ID NO: 1981146 - RNA, 13 nt, Homo sapiens
cucacauuucauu

SEQ ID NO: 1981147 - RNA, 23 nt, Homo sapiens
ccucaccaggagcccggcuucca

SEQ ID NO: 1981148 - RNA, 21 nt, Homo sapiens
uuuaauucuuuucccagaaga

SEQ ID NO: 1981149 - RNA, 12 nt, Homo sapiens
aaucugcuccaa

SEQ ID NO: 1981150 - RNA, 19 nt, Homo sapiens
aaugcagggacaaaugcca

SEQ ID NO: 1981151 - RNA, 18 nt, Homo sapiens
uguuuauaauauugcagu

SEQ ID NO: 1981152 - RNA, 18 nt, Homo sapiens
cacaaaucuggugccucu

SEQ ID NO: 1981153 - RNA, 22 nt, Homo sapiens
uguaauuggaaucuucaccuca

SEQ ID NO: 1981154 - RNA, 18 nt, Homo sapiens
uuguaaaauaauucugag

SEQ ID NO: 1981155 - RNA, 14 nt, Homo sapiens
gccccuucuagggg

SEQ ID NO: 1981156 - RNA, 17 nt, Homo sapiens
acaacucggggacaaau

SEQ ID NO: 1981157 - RNA, 18 nt, Homo sapiens
acaugauuuuacaaguau

SEQ ID NO: 1981158 - RNA, 15 nt, Homo sapiens
gccaguccaucucaa

SEQ ID NO: 1981159 - RNA, 16 nt, Homo sapiens
auacaaauauugugau

SEQ ID NO: 1981160 - RNA, 17 nt, Homo sapiens
gaccuaaugggaccccc

SEQ ID NO: 1981161 - RNA, 14 nt, Homo sapiens
gggggaacaaugag

SEQ ID NO: 1981162 - RNA, 20 nt, Homo sapiens
aacccaguguucagcauaga

SEQ ID NO: 1981163 - RNA, 19 nt, Homo sapiens
uuacuuuuuccuggcucau

SEQ ID NO: 1981164 - RNA, 13 nt, Homo sapiens
gacuaacccaaug

SEQ ID NO: 1981165 - RNA, 16 nt, Homo sapiens
auuacuguauauacuu

SEQ ID NO: 1981166 - RNA, 13 nt, Homo sapiens
gcuguagagccau

SEQ ID NO: 1981167 - RNA, 14 nt, Homo sapiens
uauacaaacaggug

SEQ ID NO: 1981168 - RNA, 13 nt, Homo sapiens
uacagcacacacu

SEQ ID NO: 1981169 - RNA, 20 nt, Homo sapiens
ucaccauaguuuuguuuaau

SEQ ID NO: 1981170 - RNA, 20 nt, Homo sapiens
cauuucauuaagguuccagu

SEQ ID NO: 1981171 - RNA, 15 nt, Homo sapiens
ugagcagagacauga

SEQ ID NO: 1981172 - RNA, 22 nt, Homo sapiens
cuagcaaauacaggaguuuuca

SEQ ID NO: 1981173 - RNA, 21 nt, Homo sapiens
ccccguuccugacaucacagc

SEQ ID NO: 1981174 - RNA, 19 nt, Homo sapiens
caugauggccuuacacuga

SEQ ID NO: 1981175 - RNA, 22 nt, Homo sapiens
agugugcuccagauggugcuag

SEQ ID NO: 1981176 - RNA, 12 nt, Homo sapiens
caguuaccuuug

SEQ ID NO: 1981177 - RNA, 19 nt, Homo sapiens
ggcuacugguuaccuggag

SEQ ID NO: 1981178 - RNA, 17 nt, Homo sapiens
ccaguggauucccacag

SEQ ID NO: 1981179 - RNA, 20 nt, Homo sapiens
uggacuacauauuugcacug

SEQ ID NO: 1981180 - RNA, 15 nt, Homo sapiens
aaccuauuccacuua

SEQ ID NO: 1981181 - RNA, 19 nt, Homo sapiens
acccuguccuccaccugcc

SEQ ID NO: 1981182 - RNA, 20 nt, Homo sapiens
gugcagaagguuacuaccua

SEQ ID NO: 1981183 - RNA, 23 nt, Homo sapiens
uggaaauauuugucuucucaggc

SEQ ID NO: 1981184 - RNA, 13 nt, Homo sapiens
uuauacccaugaa

SEQ ID NO: 1981185 - RNA, 19 nt, Homo sapiens
cugugaagcaggucuuuca

SEQ ID NO: 1981186 - RNA, 14 nt, Homo sapiens
ugacuuuucaccuu

SEQ ID NO: 1981187 - RNA, 17 nt, Homo sapiens
ugucuccacugugccuu

SEQ ID NO: 1981188 - RNA, 14 nt, Homo sapiens
gcauuccaugacca

SEQ ID NO: 1981189 - RNA, 16 nt, Homo sapiens
ucaaacgacagaggag

SEQ ID NO: 1981190 - RNA, 17 nt, Homo sapiens
caucuuagucuuaccuu

SEQ ID NO: 1981191 - RNA, 23 nt, Homo sapiens
agauuuuuguuuuccacugugcu

SEQ ID NO: 1981192 - RNA, 19 nt, Homo sapiens
ucugcugcccaggccacag

SEQ ID NO: 1981193 - RNA, 22 nt, Homo sapiens
aaauacaauagagccacuaaga

SEQ ID NO: 1981194 - RNA, 12 nt, Homo sapiens
gcagacauccac

SEQ ID NO: 1981195 - RNA, 15 nt, Homo sapiens
gcuggagugcaguga

SEQ ID NO: 1981196 - RNA, 18 nt, Homo sapiens
uccuguuagcagucugua

SEQ ID NO: 1981197 - RNA, 14 nt, Homo sapiens
auaucugccuuuau

SEQ ID NO: 1981198 - RNA, 19 nt, Homo sapiens
auguuaagacuugacagug

SEQ ID NO: 1981199 - RNA, 18 nt, Homo sapiens
cguagugguacauuccau

SEQ ID NO: 1981200 - RNA, 22 nt, Homo sapiens
aauaaacaguugugaaccaaga

SEQ ID NO: 1981201 - RNA, 15 nt, Homo sapiens
gucaacaucaaagag

SEQ ID NO: 1981202 - RNA, 22 nt, Homo sapiens
agcagaaaucuagaagacuguc

SEQ ID NO: 1981203 - RNA, 14 nt, Homo sapiens
cuggccacagugag

SEQ ID NO: 1981204 - RNA, 16 nt, Homo sapiens
gguacuacaaccaauu

SEQ ID NO: 1981205 - RNA, 16 nt, Homo sapiens
gggaaacccucuccau

SEQ ID NO: 1981206 - RNA, 18 nt, Homo sapiens
uaugguucuuauucacug

SEQ ID NO: 1981207 - RNA, 19 nt, Homo sapiens
guccucagccuugccagag

SEQ ID NO: 1981208 - RNA, 20 nt, Homo sapiens
gccucccuucccagugggcu

SEQ ID NO: 1981209 - RNA, 21 nt, Homo sapiens
agagaccuugcgaccaugugu

SEQ ID NO: 1981210 - RNA, 22 nt, Homo sapiens
caaaagucuggcccacugugca

SEQ ID NO: 1981211 - RNA, 15 nt, Homo sapiens
cuuuaaacucaggga

SEQ ID NO: 1981212 - RNA, 15 nt, Homo sapiens
uaugaugcaguuuca

SEQ ID NO: 1981213 - RNA, 17 nt, Homo sapiens
ugccuucacugugcucc

SEQ ID NO: 1981214 - RNA, 20 nt, Homo sapiens
gauugcauaggaauugcaca

SEQ ID NO: 1981215 - RNA, 13 nt, Homo sapiens
gacgaaaguggaa

SEQ ID NO: 1981216 - RNA, 19 nt, Homo sapiens
cuaacagccucagcacauc

SEQ ID NO: 1981217 - RNA, 18 nt, Homo sapiens
gaaaccuucacuccagac

SEQ ID NO: 1981218 - RNA, 17 nt, Homo sapiens
gcugcuagagccagcaa

SEQ ID NO: 1981219 - RNA, 16 nt, Homo sapiens
cugauuagagugcaaa

SEQ ID NO: 1981220 - RNA, 21 nt, Homo sapiens
cuugcaguauaucacagagcc

SEQ ID NO: 1981221 - RNA, 23 nt, Homo sapiens
cccauaucauauaaaauuucagg

SEQ ID NO: 1981222 - RNA, 12 nt, Homo sapiens
gaguuuagcacg

SEQ ID NO: 1981223 - RNA, 13 nt, Homo sapiens
augcaagcccuuu

SEQ ID NO: 1981224 - RNA, 20 nt, Homo sapiens
uagcacuuugaaauaccuca

SEQ ID NO: 1981225 - RNA, 13 nt, Homo sapiens
gugagcugugagu

SEQ ID NO: 1981226 - RNA, 16 nt, Homo sapiens
ggaaggugccacuggu

SEQ ID NO: 1981227 - RNA, 11 nt, Homo sapiens
ccccauuucag

SEQ ID NO: 1981228 - RNA, 11 nt, Homo sapiens
cagcauuuccc

SEQ ID NO: 1981229 - RNA, 20 nt, Homo sapiens
aacaguuguaccacugcuaa

SEQ ID NO: 1981230 - RNA, 22 nt, Homo sapiens
uguaaaacugugacauuccaca

SEQ ID NO: 1981231 - RNA, 23 nt, Homo sapiens
gcaaggaucuuuuuucccucuua

SEQ ID NO: 1981232 - RNA, 18 nt, Homo sapiens
cugugccaggccaaagau

SEQ ID NO: 1981233 - RNA, 16 nt, Homo sapiens
gcccuccgaccucucu

SEQ ID NO: 1981234 - RNA, 19 nt, Homo sapiens
uugcuuccagaccuaggcu

SEQ ID NO: 1981235 - RNA, 21 nt, Homo sapiens
cacuuuuaacagaacagacag

SEQ ID NO: 1981236 - RNA, 21 nt, Homo sapiens
cacuucuaauaacugcagugu

SEQ ID NO: 1981237 - RNA, 16 nt, Homo sapiens
ugagacugaacugugu

SEQ ID NO: 1981238 - RNA, 23 nt, Homo sapiens
ucugcccuggaaccuaccagagc

SEQ ID NO: 1981239 - RNA, 16 nt, Homo sapiens
augccacuauaguuua

SEQ ID NO: 1981240 - RNA, 13 nt, Homo sapiens
uccccgagaacuu

SEQ ID NO: 1981241 - RNA, 18 nt, Homo sapiens
uagggagaugaguugcag

SEQ ID NO: 1981242 - RNA, 15 nt, Homo sapiens
acaagugcugaacag

SEQ ID NO: 1981243 - RNA, 15 nt, Homo sapiens
uccucaacagcugua

SEQ ID NO: 1981244 - RNA, 19 nt, Homo sapiens
cagguaaaugguaugauca

SEQ ID NO: 1981245 - RNA, 20 nt, Homo sapiens
cuggccuccuucaccaaaga

SEQ ID NO: 1981246 - RNA, 16 nt, Homo sapiens
caauaugaaaaccgua

SEQ ID NO: 1981247 - RNA, 12 nt, Homo sapiens
uaauaaauucca

SEQ ID NO: 1981248 - RNA, 15 nt, Homo sapiens
gggcacugauuugau

SEQ ID NO: 1981249 - RNA, 20 nt, Homo sapiens
uucuuuaaaaaaacacauaa

SEQ ID NO: 1981250 - RNA, 23 nt, Homo sapiens
acuugucccgggacaccuaggcu

SEQ ID NO: 1981251 - RNA, 14 nt, Homo sapiens
cuagucaguaucug

SEQ ID NO: 1981252 - RNA, 22 nt, Homo sapiens
agccuccuugccuggaacucac

SEQ ID NO: 1981253 - RNA, 16 nt, Homo sapiens
agcccucccuaccuac

SEQ ID NO: 1981254 - RNA, 17 nt, Homo sapiens
ggccugcccccacccca

SEQ ID NO: 1981255 - RNA, 15 nt, Homo sapiens
uauguucuuacuuug

SEQ ID NO: 1981256 - RNA, 16 nt, Homo sapiens
aaaggcugaagcuuuu

SEQ ID NO: 1981257 - RNA, 20 nt, Homo sapiens
acuauugagugaaacauuga

SEQ ID NO: 1981258 - RNA, 16 nt, Homo sapiens
caaauaaacaugucug

SEQ ID NO: 1981259 - RNA, 15 nt, Homo sapiens
caagccauggugaca

SEQ ID NO: 1981260 - RNA, 22 nt, Homo sapiens
caaacuuggauacuuggauuua

SEQ ID NO: 1981261 - RNA, 17 nt, Homo sapiens
aagagaguugcuuuuga

SEQ ID NO: 1981262 - RNA, 17 nt, Homo sapiens
caacacugcuguccaca

SEQ ID NO: 1981263 - RNA, 17 nt, Homo sapiens
uggaaaagaaaguacag

SEQ ID NO: 1981264 - RNA, 22 nt, Homo sapiens
uuauaguccuccuggaacuuga

SEQ ID NO: 1981265 - RNA, 20 nt, Homo sapiens
uauuuuaauuuaaucuucca

SEQ ID NO: 1981266 - RNA, 19 nt, Homo sapiens
ucuguaagguggacuucca

SEQ ID NO: 1981267 - RNA, 14 nt, Homo sapiens
cugcuuaggaguau

SEQ ID NO: 1981268 - RNA, 19 nt, Homo sapiens
aagccuuggaccaaaugga

SEQ ID NO: 1981269 - RNA, 14 nt, Homo sapiens
ugcuucaugcucag

SEQ ID NO: 1981270 - RNA, 19 nt, Homo sapiens
uuccucuuugaauucuucc

SEQ ID NO: 1981271 - RNA, 23 nt, Homo sapiens
cacuuugggaggccaaggcagaa

SEQ ID NO: 1981272 - RNA, 23 nt, Homo sapiens
guaaacucuggaugauucuucca

SEQ ID NO: 1981273 - RNA, 18 nt, Homo sapiens
aagaaauguuuauacaau

SEQ ID NO: 1981274 - RNA, 18 nt, Homo sapiens
ccacuuuggaaaauguca

SEQ ID NO: 1981275 - RNA, 17 nt, Homo sapiens
uuuaagcgcaacauuuc

SEQ ID NO: 1981276 - RNA, 19 nt, Homo sapiens
acauguuaacaccuaccuc

SEQ ID NO: 1981277 - RNA, 18 nt, Homo sapiens
uuauugguguuuacccag

SEQ ID NO: 1981278 - RNA, 17 nt, Homo sapiens
gaccauuguaacaauag

SEQ ID NO: 1981279 - RNA, 22 nt, Homo sapiens
aggaauuaugucguaagucacu

SEQ ID NO: 1981280 - RNA, 13 nt, Homo sapiens
uccccacccuggg

SEQ ID NO: 1981281 - RNA, 13 nt, Homo sapiens
augaagguaauau

SEQ ID NO: 1981282 - RNA, 14 nt, Homo sapiens
cauuuuaacaugga

SEQ ID NO: 1981283 - RNA, 13 nt, Homo sapiens
acaauauaugucc

SEQ ID NO: 1981284 - RNA, 19 nt, Homo sapiens
caauauugccaugguuuua

SEQ ID NO: 1981285 - RNA, 11 nt, Homo sapiens
auacuuccuua

SEQ ID NO: 1981286 - RNA, 22 nt, Homo sapiens
uuccuagaacaaaauguacaaa

SEQ ID NO: 1981287 - RNA, 19 nt, Homo sapiens
cauuaggaguaacuuucaa

SEQ ID NO: 1981288 - RNA, 18 nt, Homo sapiens
uuaaggaaaaauaaauau

SEQ ID NO: 1981289 - RNA, 18 nt, Homo sapiens
cuugucacauggaaucua

SEQ ID NO: 1981290 - RNA, 19 nt, Homo sapiens
aaugugacccccaaguccu

SEQ ID NO: 1981291 - RNA, 12 nt, Homo sapiens
ccacccaggaaa

SEQ ID NO: 1981292 - RNA, 15 nt, Homo sapiens
aagguaauaaauaca

SEQ ID NO: 1981293 - RNA, 18 nt, Homo sapiens
ugccaccucucacacugg

SEQ ID NO: 1981294 - RNA, 15 nt, Homo sapiens
uaguaaacacaggga

SEQ ID NO: 1981295 - RNA, 12 nt, Homo sapiens
agagggggaccu

SEQ ID NO: 1981296 - RNA, 17 nt, Homo sapiens
cacaauucuguuuuagg

SEQ ID NO: 1981297 - RNA, 21 nt, Homo sapiens
cuuuaugauaucaaagacuca

SEQ ID NO: 1981298 - RNA, 15 nt, Homo sapiens
agaaaauaauuaauu

SEQ ID NO: 1981299 - RNA, 14 nt, Homo sapiens
gaagaaauuaacuu

SEQ ID NO: 1981300 - RNA, 14 nt, Homo sapiens
aucagcaugaagaa

SEQ ID NO: 1981301 - RNA, 14 nt, Homo sapiens
agcucaaucugcaa

SEQ ID NO: 1981302 - RNA, 16 nt, Homo sapiens
auaaaagauucaccug

SEQ ID NO: 1981303 - RNA, 17 nt, Homo sapiens
gcccugccugguggcaa

SEQ ID NO: 1981304 - RNA, 13 nt, Homo sapiens
uccaacccaugag

SEQ ID NO: 1981305 - RNA, 17 nt, Homo sapiens
auccaggagguucaaaa

SEQ ID NO: 1981306 - RNA, 21 nt, Homo sapiens
ccucccuguauaagacacuuu

SEQ ID NO: 1981307 - RNA, 23 nt, Homo sapiens
ucaguuguuauuuauugaaauga

SEQ ID NO: 1981308 - RNA, 13 nt, Homo sapiens
uguguguagccaa

SEQ ID NO: 1981309 - RNA, 14 nt, Homo sapiens
augacuguaucuug

SEQ ID NO: 1981310 - RNA, 16 nt, Homo sapiens
agagcuuuacagugcc

SEQ ID NO: 1981311 - RNA, 23 nt, Homo sapiens
cgcuucuccaagucugcugauga

SEQ ID NO: 1981312 - RNA, 13 nt, Homo sapiens
gugagucaccugc

SEQ ID NO: 1981313 - RNA, 12 nt, Homo sapiens
ccuuaaccuuaa

SEQ ID NO: 1981314 - RNA, 16 nt, Homo sapiens
uccugagugcccucag

SEQ ID NO: 1981315 - RNA, 21 nt, Homo sapiens
gcuuccauuuuccuacaggca

SEQ ID NO: 1981316 - RNA, 18 nt, Homo sapiens
auauuccucugcugaaca

SEQ ID NO: 1981317 - RNA, 21 nt, Homo sapiens
agggccguaguaccucccagc

SEQ ID NO: 1981318 - RNA, 22 nt, Homo sapiens
aagucuuccauagagacuuugu

SEQ ID NO: 1981319 - RNA, 13 nt, Homo sapiens
caucugcuccuuc

SEQ ID NO: 1981320 - RNA, 23 nt, Homo sapiens
uuuccaaugccacagacaacuca

SEQ ID NO: 1981321 - RNA, 17 nt, Homo sapiens
agcucacaccugaccaa

SEQ ID NO: 1981322 - RNA, 13 nt, Homo sapiens
gucaggaugagaa

SEQ ID NO: 1981323 - RNA, 16 nt, Homo sapiens
uaccacaguggaugua

SEQ ID NO: 1981324 - RNA, 19 nt, Homo sapiens
uguacaguguguaaagugu

SEQ ID NO: 1981325 - RNA, 14 nt, Homo sapiens
cuaagcacauucca

SEQ ID NO: 1981326 - RNA, 16 nt, Homo sapiens
acuaaugacaagugac

SEQ ID NO: 1981327 - RNA, 21 nt, Homo sapiens
aucuuaagcaguaaucuguca

SEQ ID NO: 1981328 - RNA, 14 nt, Homo sapiens
auuugucuucauga

SEQ ID NO: 1981329 - RNA, 13 nt, Homo sapiens
acauuaugugguu

SEQ ID NO: 1981330 - RNA, 16 nt, Homo sapiens
cuugcaauguagucaa

SEQ ID NO: 1981331 - RNA, 16 nt, Homo sapiens
aagagauaaacuacau

SEQ ID NO: 1981332 - RNA, 18 nt, Homo sapiens
ugacugcccggcacagau

SEQ ID NO: 1981333 - RNA, 20 nt, Homo sapiens
augucucuuuaaugucacag

SEQ ID NO: 1981334 - RNA, 16 nt, Homo sapiens
ccugcccccacuuccu

SEQ ID NO: 1981335 - RNA, 18 nt, Homo sapiens
uugauuauuugcauguua

SEQ ID NO: 1981336 - RNA, 23 nt, Homo sapiens
gacucugucacacuaaacuucuu

SEQ ID NO: 1981337 - RNA, 15 nt, Homo sapiens
ggaaagaaaaggaaa

SEQ ID NO: 1981338 - RNA, 14 nt, Homo sapiens
accucacugcagua

SEQ ID NO: 1981339 - RNA, 20 nt, Homo sapiens
gccuacuccaagaauggagg

SEQ ID NO: 1981340 - RNA, 19 nt, Homo sapiens
guucuugggagaaaaucaa

SEQ ID NO: 1981341 - RNA, 14 nt, Homo sapiens
auuucccuuuauau

SEQ ID NO: 1981342 - RNA, 20 nt, Homo sapiens
gccuccaugaccugcgcucu

SEQ ID NO: 1981343 - RNA, 18 nt, Homo sapiens
uuguaaaugaaacuuaag

SEQ ID NO: 1981344 - RNA, 19 nt, Homo sapiens
uccuaaaaaucuguggcaa

SEQ ID NO: 1981345 - RNA, 22 nt, Homo sapiens
uccagaaccgccgaaugaagca

SEQ ID NO: 1981346 - RNA, 17 nt, Homo sapiens
acuuugcuuaguauuga

SEQ ID NO: 1981347 - RNA, 19 nt, Homo sapiens
ggcugauugggauuuccau

SEQ ID NO: 1981348 - RNA, 23 nt, Homo sapiens
accucccauucacagauaccucu

SEQ ID NO: 1981349 - RNA, 22 nt, Homo sapiens
ccugucagcauguuuccagcac

SEQ ID NO: 1981350 - RNA, 22 nt, Homo sapiens
cauauauuagcauuuaguccaa

SEQ ID NO: 1981351 - RNA, 20 nt, Homo sapiens
uaauggauuguuaaaaucau

SEQ ID NO: 1981352 - RNA, 13 nt, Homo sapiens
ccuuccauuccac

SEQ ID NO: 1981353 - RNA, 14 nt, Homo sapiens
guacaccucuugcc

SEQ ID NO: 1981354 - RNA, 13 nt, Homo sapiens
ucuuaauguuccu

SEQ ID NO: 1981355 - RNA, 16 nt, Homo sapiens
cgaauccccuaaacaa

SEQ ID NO: 1981356 - RNA, 19 nt, Homo sapiens
uaacaagguucuucuaaaa

SEQ ID NO: 1981357 - RNA, 14 nt, Homo sapiens
auaacaaaacacuc

SEQ ID NO: 1981358 - RNA, 13 nt, Homo sapiens
uuuagagagccug

SEQ ID NO: 1981359 - RNA, 16 nt, Homo sapiens
ugggcgcaguggcuca

SEQ ID NO: 1981360 - RNA, 23 nt, Homo sapiens
uuauacacaaagaauacuuucau

SEQ ID NO: 1981361 - RNA, 17 nt, Homo sapiens
ucaagcauuuaccaugu

SEQ ID NO: 1981362 - RNA, 13 nt, Homo sapiens
cccauguguaggu

SEQ ID NO: 1981363 - RNA, 16 nt, Homo sapiens
ccuauucauucacaau

SEQ ID NO: 1981364 - RNA, 18 nt, Homo sapiens
cccaucuuugucaguuua

SEQ ID NO: 1981365 - RNA, 16 nt, Homo sapiens
acaacaaaaaccaaaa

SEQ ID NO: 1981366 - RNA, 14 nt, Homo sapiens
auuguuuucagugu

SEQ ID NO: 1981367 - RNA, 18 nt, Homo sapiens
uccagucugccauaucac

SEQ ID NO: 1981368 - RNA, 22 nt, Homo sapiens
cuaguguuccugcaccaaaccu

SEQ ID NO: 1981369 - RNA, 15 nt, Homo sapiens
uggccauuguguugg

SEQ ID NO: 1981370 - RNA, 19 nt, Homo sapiens
cucaaagcccccacuucuc

SEQ ID NO: 1981371 - RNA, 20 nt, Homo sapiens
gcugagaucacgccauugua

SEQ ID NO: 1981372 - RNA, 12 nt, Homo sapiens
ugcccgccagcc

SEQ ID NO: 1981373 - RNA, 15 nt, Homo sapiens
gagaggcucugagaa

SEQ ID NO: 1981374 - RNA, 18 nt, Homo sapiens
auagcuaguuaugugaga

SEQ ID NO: 1981375 - RNA, 22 nt, Homo sapiens
uccucuuguucuaaucuuguca

SEQ ID NO: 1981376 - RNA, 15 nt, Homo sapiens
ucaacagccaagugu

SEQ ID NO: 1981377 - RNA, 19 nt, Homo sapiens
uccucagcaccccacuccu

SEQ ID NO: 1981378 - RNA, 21 nt, Homo sapiens
agugaaaggucacacuaccau

SEQ ID NO: 1981379 - RNA, 16 nt, Homo sapiens
ugcuuucuauuuugag

SEQ ID NO: 1981380 - RNA, 22 nt, Homo sapiens
cauacuuuuucuuugaauuuag

SEQ ID NO: 1981381 - RNA, 20 nt, Homo sapiens
ugccagagcccaagugccau

SEQ ID NO: 1981382 - RNA, 12 nt, Homo sapiens
uuuuaaugggag

SEQ ID NO: 1981383 - RNA, 12 nt, Homo sapiens
ucugacuuugaa

SEQ ID NO: 1981384 - RNA, 20 nt, Homo sapiens
gaguacacugccugccuuaa

SEQ ID NO: 1981385 - RNA, 14 nt, Homo sapiens
cuggagagcacugc

SEQ ID NO: 1981386 - RNA, 22 nt, Homo sapiens
auauugucaccucagcacugug

SEQ ID NO: 1981387 - RNA, 12 nt, Homo sapiens
agaggccauguu

SEQ ID NO: 1981388 - RNA, 20 nt, Homo sapiens
acugagcaguaccagugugc

SEQ ID NO: 1981389 - RNA, 14 nt, Homo sapiens
gcaaaugaguauuu

SEQ ID NO: 1981390 - RNA, 12 nt, Homo sapiens
ggccaaugucag

SEQ ID NO: 1981391 - RNA, 18 nt, Homo sapiens
auucagcucuucagagau

SEQ ID NO: 1981392 - RNA, 12 nt, Homo sapiens
guucuuacuuug

SEQ ID NO: 1981393 - RNA, 15 nt, Homo sapiens
uuuaaaucaaacuaa

SEQ ID NO: 1981394 - RNA, 17 nt, Homo sapiens
ccugaaagucccagauc

SEQ ID NO: 1981395 - RNA, 14 nt, Homo sapiens
agucuugaccucuc

SEQ ID NO: 1981396 - RNA, 16 nt, Homo sapiens
gcugcuugugaucuca

SEQ ID NO: 1981397 - RNA, 18 nt, Homo sapiens
cacuucauucugcagggu

SEQ ID NO: 1981398 - RNA, 15 nt, Homo sapiens
gccucugaacccccu

SEQ ID NO: 1981399 - RNA, 20 nt, Homo sapiens
ucccuucccccauccuccag

SEQ ID NO: 1981400 - RNA, 16 nt, Homo sapiens
ugugccuccagacuau

SEQ ID NO: 1981401 - RNA, 22 nt, Homo sapiens
cagaccagcuggcgggugugga

SEQ ID NO: 1981402 - RNA, 23 nt, Homo sapiens
caauaauauuucaagugccuaga

SEQ ID NO: 1981403 - RNA, 12 nt, Homo sapiens
agugccauucca

SEQ ID NO: 1981404 - RNA, 16 nt, Homo sapiens
gcauggguuagugcua

SEQ ID NO: 1981405 - RNA, 17 nt, Homo sapiens
ugaauuauaaaagccag

SEQ ID NO: 1981406 - RNA, 19 nt, Homo sapiens
aaaguggaagugacauugu

SEQ ID NO: 1981407 - RNA, 15 nt, Homo sapiens
ucugcuuaaucugag

SEQ ID NO: 1981408 - RNA, 17 nt, Homo sapiens
cacacaaaagggaaccc

SEQ ID NO: 1981409 - RNA, 23 nt, Homo sapiens
cuuuuuauacuuuguaaagacaa

SEQ ID NO: 1981410 - RNA, 21 nt, Homo sapiens
cggugagcuacaaaugcauuu

SEQ ID NO: 1981411 - RNA, 13 nt, Homo sapiens
cagaguguuuacc

SEQ ID NO: 1981412 - RNA, 11 nt, Homo sapiens
uacucucaccg

SEQ ID NO: 1981413 - RNA, 20 nt, Homo sapiens
augaucaguguuacugccua

SEQ ID NO: 1981414 - RNA, 15 nt, Homo sapiens
auuagcucacugaau

SEQ ID NO: 1981415 - RNA, 17 nt, Homo sapiens
ggggagauugaacuuuc

SEQ ID NO: 1981416 - RNA, 15 nt, Homo sapiens
uccauaaagcacauu

SEQ ID NO: 1981417 - RNA, 13 nt, Homo sapiens
gccagggugggcu

SEQ ID NO: 1981418 - RNA, 20 nt, Homo sapiens
ugcugggcccuggccuggau

SEQ ID NO: 1981419 - RNA, 20 nt, Homo sapiens
gccgcuuggugagugucugg

SEQ ID NO: 1981420 - RNA, 18 nt, Homo sapiens
uauaacuaggcuguuaac

SEQ ID NO: 1981421 - RNA, 23 nt, Homo sapiens
uaaaauuagaggauugcacuaga

SEQ ID NO: 1981422 - RNA, 16 nt, Homo sapiens
gagacuccgucacaac

SEQ ID NO: 1981423 - RNA, 16 nt, Homo sapiens
aacuguaaaugugaca

SEQ ID NO: 1981424 - RNA, 15 nt, Homo sapiens
augaaaugauuggaa

SEQ ID NO: 1981425 - RNA, 18 nt, Homo sapiens
cagagaaccugcuuuacu

SEQ ID NO: 1981426 - RNA, 16 nt, Homo sapiens
uaggaaggcacuacau

SEQ ID NO: 1981427 - RNA, 18 nt, Homo sapiens
caugcacacaggugcaca

SEQ ID NO: 1981428 - RNA, 22 nt, Homo sapiens
uaagucccuuuuuguauguguu

SEQ ID NO: 1981429 - RNA, 13 nt, Homo sapiens
uucuggacuaaaa

SEQ ID NO: 1981430 - RNA, 14 nt, Homo sapiens
gccccaucugggga

SEQ ID NO: 1981431 - RNA, 18 nt, Homo sapiens
acuaaauguauuccugua

SEQ ID NO: 1981432 - RNA, 21 nt, Homo sapiens
cuguagguacguuuuauauua

SEQ ID NO: 1981433 - RNA, 21 nt, Homo sapiens
uguucaugcacacuugcaccc

SEQ ID NO: 1981434 - RNA, 19 nt, Homo sapiens
uucagagaccauugcaaug

SEQ ID NO: 1981435 - RNA, 13 nt, Homo sapiens
accccacccaagu

SEQ ID NO: 1981436 - RNA, 21 nt, Homo sapiens
ugagggaggauuccucagggu

SEQ ID NO: 1981437 - RNA, 15 nt, Homo sapiens
guacagaagagacag

SEQ ID NO: 1981438 - RNA, 16 nt, Homo sapiens
uauaauaugugccuua

SEQ ID NO: 1981439 - RNA, 16 nt, Homo sapiens
ucaugagggcuggaug

SEQ ID NO: 1981440 - RNA, 18 nt, Homo sapiens
gcagccacuuucugccag

SEQ ID NO: 1981441 - RNA, 12 nt, Homo sapiens
uccuguccuuca

SEQ ID NO: 1981442 - RNA, 13 nt, Homo sapiens
aacccaaccucau

SEQ ID NO: 1981443 - RNA, 15 nt, Homo sapiens
cucccugacggugga

SEQ ID NO: 1981444 - RNA, 22 nt, Homo sapiens
aacaucuuuauuuucuuuaugu

SEQ ID NO: 1981445 - RNA, 17 nt, Homo sapiens
gacaaagaaacauuuua

SEQ ID NO: 1981446 - RNA, 12 nt, Homo sapiens
ucaucugguugu

SEQ ID NO: 1981447 - RNA, 22 nt, Homo sapiens
cuagaugccacugcccauagac

SEQ ID NO: 1981448 - RNA, 13 nt, Homo sapiens
gugccuaucugcc

SEQ ID NO: 1981449 - RNA, 17 nt, Homo sapiens
gacaccaguggugcguu

SEQ ID NO: 1981450 - RNA, 16 nt, Homo sapiens
ccugagauucuuuaag

SEQ ID NO: 1981451 - RNA, 12 nt, Homo sapiens
gagggugacuga

SEQ ID NO: 1981452 - RNA, 12 nt, Homo sapiens
uguagcuuuuau

SEQ ID NO: 1981453 - RNA, 22 nt, Homo sapiens
cccuauccauaguccugguccc

SEQ ID NO: 1981454 - RNA, 23 nt, Homo sapiens
cagcugggccuccugggugccag

SEQ ID NO: 1981455 - RNA, 22 nt, Homo sapiens
uagcauuggguagcuauacuca

SEQ ID NO: 1981456 - RNA, 17 nt, Homo sapiens
acagcaggguaccugaa

SEQ ID NO: 1981457 - RNA, 22 nt, Homo sapiens
guccaugccuuuaauguugccc

SEQ ID NO: 1981458 - RNA, 21 nt, Homo sapiens
ggccccgugaggcaaugggag

SEQ ID NO: 1981459 - RNA, 15 nt, Homo sapiens
gcagaauacauucaa

SEQ ID NO: 1981460 - RNA, 24 nt, Homo sapiens
auauuaaaaucacaaacucaucca

SEQ ID NO: 1981461 - RNA, 21 nt, Homo sapiens
aaagccucgggccacaugggu

SEQ ID NO: 1981462 - RNA, 20 nt, Homo sapiens
uugaacuuuuacuaaugauc

SEQ ID NO: 1981463 - RNA, 22 nt, Homo sapiens
agguucccuguucuuccuccag

SEQ ID NO: 1981464 - RNA, 15 nt, Homo sapiens
aacucaagcuucuuc

SEQ ID NO: 1981465 - RNA, 17 nt, Homo sapiens
ugccauggaaugacuga

SEQ ID NO: 1981466 - RNA, 18 nt, Homo sapiens
acagcagcugaacagcca

SEQ ID NO: 1981467 - RNA, 17 nt, Homo sapiens
aacuucuuucacucaca

SEQ ID NO: 1981468 - RNA, 16 nt, Homo sapiens
ugcuugcccgcuccca

SEQ ID NO: 1981469 - RNA, 21 nt, Homo sapiens
uuucccagucccauuccucag

SEQ ID NO: 1981470 - RNA, 18 nt, Homo sapiens
cuuuacuaaguaaucuca

SEQ ID NO: 1981471 - RNA, 15 nt, Homo sapiens
cugccgcugccccca

SEQ ID NO: 1981472 - RNA, 16 nt, Homo sapiens
gacaagggaaauguca

SEQ ID NO: 1981473 - RNA, 17 nt, Homo sapiens
ccucagcuucuucacag

SEQ ID NO: 1981474 - RNA, 20 nt, Homo sapiens
ccagagauagggaugucaua

SEQ ID NO: 1981475 - RNA, 20 nt, Homo sapiens
ucuucacuucagacaauuca

SEQ ID NO: 1981476 - RNA, 19 nt, Homo sapiens
ucaggccccgggcuucccu

SEQ ID NO: 1981477 - RNA, 12 nt, Homo sapiens
cagaucaugccc

SEQ ID NO: 1981478 - RNA, 12 nt, Homo sapiens
cagcucaugcca

SEQ ID NO: 1981479 - RNA, 16 nt, Homo sapiens
uaguuuaugaugcaaa

SEQ ID NO: 1981480 - RNA, 16 nt, Homo sapiens
auucuccauacucugu

SEQ ID NO: 1981481 - RNA, 18 nt, Homo sapiens
aacucagugggacauagc

SEQ ID NO: 1981482 - RNA, 15 nt, Homo sapiens
aggguguguguucac

SEQ ID NO: 1981483 - RNA, 17 nt, Homo sapiens
cgcagugugcacuaagg

SEQ ID NO: 1981484 - RNA, 14 nt, Homo sapiens
uguaauaaagugaa

SEQ ID NO: 1981485 - RNA, 19 nt, Homo sapiens
gacuaaaugaaaucuugca

SEQ ID NO: 1981486 - RNA, 21 nt, Homo sapiens
auuugggggaacuggacacaa

SEQ ID NO: 1981487 - RNA, 22 nt, Homo sapiens
uuuggaccaaaaaccaguauug

SEQ ID NO: 1981488 - RNA, 12 nt, Homo sapiens
caacaucuucaa

SEQ ID NO: 1981489 - RNA, 17 nt, Homo sapiens
aauaauuuuucacuuca

SEQ ID NO: 1981490 - RNA, 16 nt, Homo sapiens
ccaauuccaaguuuua

SEQ ID NO: 1981491 - RNA, 19 nt, Homo sapiens
uacccauagcuuccaugag

SEQ ID NO: 1981492 - RNA, 14 nt, Homo sapiens
aucugcuaugcuau

SEQ ID NO: 1981493 - RNA, 12 nt, Homo sapiens
ucuucacugugu

SEQ ID NO: 1981494 - RNA, 20 nt, Homo sapiens
uuaaucuuucuuuaccugag

SEQ ID NO: 1981495 - RNA, 16 nt, Homo sapiens
aacaaacuuuaauggu

SEQ ID NO: 1981496 - RNA, 23 nt, Homo sapiens
cagcuucauuaugcagcugaggu

SEQ ID NO: 1981497 - RNA, 18 nt, Homo sapiens
cauuccuuucucuucagu

SEQ ID NO: 1981498 - RNA, 17 nt, Homo sapiens
acuuugaaauaccucau

SEQ ID NO: 1981499 - RNA, 20 nt, Homo sapiens
ugcucuaagaagcugcaaua

SEQ ID NO: 1981500 - RNA, 16 nt, Homo sapiens
ugccacagaugauacu

SEQ ID NO: 1981501 - RNA, 15 nt, Homo sapiens
cuucccauuucucua

SEQ ID NO: 1981502 - RNA, 17 nt, Homo sapiens
ugagccaaacacacugu

SEQ ID NO: 1981503 - RNA, 19 nt, Homo sapiens
cuucagucuugguaaaaca

SEQ ID NO: 1981504 - RNA, 17 nt, Homo sapiens
gcugacauucacugagu

SEQ ID NO: 1981505 - RNA, 13 nt, Homo sapiens
gaaguuuguuaua

SEQ ID NO: 1981506 - RNA, 17 nt, Homo sapiens
cuauacuuuggucugcu

SEQ ID NO: 1981507 - RNA, 13 nt, Homo sapiens
gccuuaaaagcca

SEQ ID NO: 1981508 - RNA, 16 nt, Homo sapiens
cccagcggcucuuccu

SEQ ID NO: 1981509 - RNA, 18 nt, Homo sapiens
ucuugauaugaccuguua

SEQ ID NO: 1981510 - RNA, 21 nt, Homo sapiens
aauuguaccuauuucugauga

SEQ ID NO: 1981511 - RNA, 11 nt, Homo sapiens
auaucagggaa

SEQ ID NO: 1981512 - RNA, 20 nt, Homo sapiens
cauugauucuucagaacuuu

SEQ ID NO: 1981513 - RNA, 17 nt, Homo sapiens
uggcaacauuguacaag

SEQ ID NO: 1981514 - RNA, 20 nt, Homo sapiens
ucuuagagauacccucugag

SEQ ID NO: 1981515 - RNA, 17 nt, Homo sapiens
uuccucagauugcugaa

SEQ ID NO: 1981516 - RNA, 18 nt, Homo sapiens
gccuugcuugcugccuuc

SEQ ID NO: 1981517 - RNA, 21 nt, Homo sapiens
ccccucccucccucuuuccca

SEQ ID NO: 1981518 - RNA, 17 nt, Homo sapiens
cacuguccagggcccau

SEQ ID NO: 1981519 - RNA, 15 nt, Homo sapiens
aaaaaucccuuaccu

SEQ ID NO: 1981520 - RNA, 22 nt, Homo sapiens
gggaauauugccaaugcuacag

SEQ ID NO: 1981521 - RNA, 21 nt, Homo sapiens
agugcaguggcacgaucucag

SEQ ID NO: 1981522 - RNA, 14 nt, Homo sapiens
ucccgccucagggc

SEQ ID NO: 1981523 - RNA, 15 nt, Homo sapiens
guuggugacaccuca

SEQ ID NO: 1981524 - RNA, 14 nt, Homo sapiens
auucugaaugaaua

SEQ ID NO: 1981525 - RNA, 19 nt, Homo sapiens
ugcaacccagucacacugu

SEQ ID NO: 1981526 - RNA, 20 nt, Homo sapiens
uccaaaguccacacaaagau

SEQ ID NO: 1981527 - RNA, 22 nt, Homo sapiens
cacaagcuugucaaugauuuca

SEQ ID NO: 1981528 - RNA, 16 nt, Homo sapiens
uuuucauaauaccuca

SEQ ID NO: 1981529 - RNA, 19 nt, Homo sapiens
uuacaggaaagaugcauuu

SEQ ID NO: 1981530 - RNA, 15 nt, Homo sapiens
gccuaagacauguaa

SEQ ID NO: 1981531 - RNA, 20 nt, Homo sapiens
gaccuggcccccucaguguu

SEQ ID NO: 1981532 - RNA, 13 nt, Homo sapiens
aaaauacaauuca

SEQ ID NO: 1981533 - RNA, 14 nt, Homo sapiens
caagcagcaauaga

SEQ ID NO: 1981534 - RNA, 14 nt, Homo sapiens
aggacccuucccuu

SEQ ID NO: 1981535 - RNA, 13 nt, Homo sapiens
accucauggauug

SEQ ID NO: 1981536 - RNA, 23 nt, Homo sapiens
uagagcaucugucccacugggac

SEQ ID NO: 1981537 - RNA, 12 nt, Homo sapiens
gaggagugcagc

SEQ ID NO: 1981538 - RNA, 18 nt, Homo sapiens
cugaaaagaggagccaga

SEQ ID NO: 1981539 - RNA, 12 nt, Homo sapiens
gacgucugccac

SEQ ID NO: 1981540 - RNA, 19 nt, Homo sapiens
auuuagaccaaaagauuca

SEQ ID NO: 1981541 - RNA, 22 nt, Homo sapiens
cuauauccugugacugucucac

SEQ ID NO: 1981542 - RNA, 16 nt, Homo sapiens
cccuacucuguguaau

SEQ ID NO: 1981543 - RNA, 17 nt, Homo sapiens
ccacacaugaaucugca

SEQ ID NO: 1981544 - RNA, 18 nt, Homo sapiens
ccaggcuuacugagcugu

SEQ ID NO: 1981545 - RNA, 19 nt, Homo sapiens
acaaauuuacagagacaga

SEQ ID NO: 1981546 - RNA, 14 nt, Homo sapiens
ugcauuuaauuaga

SEQ ID NO: 1981547 - RNA, 16 nt, Homo sapiens
cacucaagcacugaua

SEQ ID NO: 1981548 - RNA, 16 nt, Homo sapiens
uaacccucacacugcu

SEQ ID NO: 1981549 - RNA, 22 nt, Homo sapiens
cauauguaugugugaguguaug

SEQ ID NO: 1981550 - RNA, 16 nt, Homo sapiens
ucaucucugccuuuga

SEQ ID NO: 1981551 - RNA, 22 nt, Homo sapiens
gacaacagccucuacaccaacg

SEQ ID NO: 1981552 - RNA, 16 nt, Homo sapiens
auucucaucaguccau

SEQ ID NO: 1981553 - RNA, 17 nt, Homo sapiens
guuuucuguugcauuac

SEQ ID NO: 1981554 - RNA, 20 nt, Homo sapiens
ccaggacucucuuucuucca

SEQ ID NO: 1981555 - RNA, 15 nt, Homo sapiens
aagcaagugguggga

SEQ ID NO: 1981556 - RNA, 22 nt, Homo sapiens
uaugugcaggcaccugauacuu

SEQ ID NO: 1981557 - RNA, 19 nt, Homo sapiens
auuucaaaugugcugucaa

SEQ ID NO: 1981558 - RNA, 18 nt, Homo sapiens
gcccccccagcugucauc

SEQ ID NO: 1981559 - RNA, 18 nt, Homo sapiens
gcuugucaaaagaaauaa

SEQ ID NO: 1981560 - RNA, 22 nt, Homo sapiens
cagcacgcuggacagcacucug

SEQ ID NO: 1981561 - RNA, 13 nt, Homo sapiens
aacagccugagcc

SEQ ID NO: 1981562 - RNA, 18 nt, Homo sapiens
uuucaguugccauugaca

SEQ ID NO: 1981563 - RNA, 19 nt, Homo sapiens
aagugauccacccaccuca

SEQ ID NO: 1981564 - RNA, 14 nt, Homo sapiens
ugacaccucacuga

SEQ ID NO: 1981565 - RNA, 12 nt, Homo sapiens
ucucugugcucu

SEQ ID NO: 1981566 - RNA, 16 nt, Homo sapiens
uaguaaguauuuccau

SEQ ID NO: 1981567 - RNA, 14 nt, Homo sapiens
aaauaauaauagua

SEQ ID NO: 1981568 - RNA, 23 nt, Homo sapiens
uccuuuucccaacuccucauguc

SEQ ID NO: 1981569 - RNA, 14 nt, Homo sapiens
auaauaaauuguca

SEQ ID NO: 1981570 - RNA, 14 nt, Homo sapiens
uguugcucagcucc

SEQ ID NO: 1981571 - RNA, 19 nt, Homo sapiens
gcgaagcguuguccucagc

SEQ ID NO: 1981572 - RNA, 13 nt, Homo sapiens
cuuacuuccagca

SEQ ID NO: 1981573 - RNA, 16 nt, Homo sapiens
ugccuacaauauucuc

SEQ ID NO: 1981574 - RNA, 18 nt, Homo sapiens
cucagccuguuccaugaa

SEQ ID NO: 1981575 - RNA, 15 nt, Homo sapiens
guaugacuucugcug

SEQ ID NO: 1981576 - RNA, 12 nt, Homo sapiens
cauuuuugcaua

SEQ ID NO: 1981577 - RNA, 12 nt, Homo sapiens
cccuuuugccca

SEQ ID NO: 1981578 - RNA, 12 nt, Homo sapiens
caggacaugugc

SEQ ID NO: 1981579 - RNA, 18 nt, Homo sapiens
aaaguuacuauucuguau

SEQ ID NO: 1981580 - RNA, 18 nt, Homo sapiens
auucucaaaauacguguu

SEQ ID NO: 1981581 - RNA, 14 nt, Homo sapiens
ugugaauuuugcca

SEQ ID NO: 1981582 - RNA, 13 nt, Homo sapiens
uaacagcuuugua

SEQ ID NO: 1981583 - RNA, 14 nt, Homo sapiens
auucauuccauuug

SEQ ID NO: 1981584 - RNA, 18 nt, Homo sapiens
uggaaagacaagcucaag

SEQ ID NO: 1981585 - RNA, 17 nt, Homo sapiens
ucaaggcugacuacuca

SEQ ID NO: 1981586 - RNA, 20 nt, Homo sapiens
ucucacuuuucuccaugagu

SEQ ID NO: 1981587 - RNA, 13 nt, Homo sapiens
gcuuaaacauuuu

SEQ ID NO: 1981588 - RNA, 18 nt, Homo sapiens
uaccacuuuaaacacccc

SEQ ID NO: 1981589 - RNA, 16 nt, Homo sapiens
aggccagccugucccu

SEQ ID NO: 1981590 - RNA, 15 nt, Homo sapiens
aauaagauauuuagu

SEQ ID NO: 1981591 - RNA, 16 nt, Homo sapiens
uuggcucaccauaacc

SEQ ID NO: 1981592 - RNA, 20 nt, Homo sapiens
agucaucugaugagaacaag

SEQ ID NO: 1981593 - RNA, 13 nt, Homo sapiens
gaagaacaggccu

SEQ ID NO: 1981594 - RNA, 18 nt, Homo sapiens
augaagagaagcugagaa

SEQ ID NO: 1981595 - RNA, 17 nt, Homo sapiens
cacugaucuugucauua

SEQ ID NO: 1981596 - RNA, 13 nt, Homo sapiens
ugcauagcucuau

SEQ ID NO: 1981597 - RNA, 13 nt, Homo sapiens
gccaggacugugu

SEQ ID NO: 1981598 - RNA, 20 nt, Homo sapiens
ucuuuggacagaagcagcuc

SEQ ID NO: 1981599 - RNA, 22 nt, Homo sapiens
cuuguuggauuccagugcaggu

SEQ ID NO: 1981600 - RNA, 17 nt, Homo sapiens
uugcuucagcugcugaa

SEQ ID NO: 1981601 - RNA, 13 nt, Homo sapiens
accuugaugagcu

SEQ ID NO: 1981602 - RNA, 19 nt, Homo sapiens
acuuaaaaugacaaagcca

SEQ ID NO: 1981603 - RNA, 23 nt, Homo sapiens
uaauuaaauuuugaguucuacau

SEQ ID NO: 1981604 - RNA, 20 nt, Homo sapiens
gaacaagcagcuaagcaaua

SEQ ID NO: 1981605 - RNA, 16 nt, Homo sapiens
auggcuacuaagcaca

SEQ ID NO: 1981606 - RNA, 15 nt, Homo sapiens
gaaccaacacagaca

SEQ ID NO: 1981607 - RNA, 12 nt, Homo sapiens
cuggagcccaca

SEQ ID NO: 1981608 - RNA, 15 nt, Homo sapiens
ugacaccgaguucca

SEQ ID NO: 1981609 - RNA, 14 nt, Homo sapiens
aucauucuggaguc

SEQ ID NO: 1981610 - RNA, 10 nt, Homo sapiens
aaaugcuucu

SEQ ID NO: 1981611 - RNA, 18 nt, Homo sapiens
gucagggaaggugccucu

SEQ ID NO: 1981612 - RNA, 18 nt, Homo sapiens
cuuaauacuaccuugaaa

SEQ ID NO: 1981613 - RNA, 18 nt, Homo sapiens
ccuuugggaggcugaggc

SEQ ID NO: 1981614 - RNA, 14 nt, Homo sapiens
uccucgcugccaga

SEQ ID NO: 1981615 - RNA, 20 nt, Homo sapiens
uucuucugcuaugugacuug

SEQ ID NO: 1981616 - RNA, 22 nt, Homo sapiens
auuaaaccggaccaucucucca

SEQ ID NO: 1981617 - RNA, 15 nt, Homo sapiens
cugccacacuagcuu

SEQ ID NO: 1981618 - RNA, 18 nt, Homo sapiens
aauaaacgaaacauuuag

SEQ ID NO: 1981619 - RNA, 19 nt, Homo sapiens
ucauaauuucuucacucaa

SEQ ID NO: 1981620 - RNA, 19 nt, Homo sapiens
gcuccagaugcagggcagu

SEQ ID NO: 1981621 - RNA, 15 nt, Homo sapiens
cauggagacgcauuu

SEQ ID NO: 1981622 - RNA, 17 nt, Homo sapiens
ggaugucccugggccag

SEQ ID NO: 1981623 - RNA, 20 nt, Homo sapiens
cccucaaaccuugaggagaa

SEQ ID NO: 1981624 - RNA, 14 nt, Homo sapiens
ucacaccugacaaa

SEQ ID NO: 1981625 - RNA, 17 nt, Homo sapiens
gcaaaauauuugugaaa

SEQ ID NO: 1981626 - RNA, 21 nt, Homo sapiens
uagaugcagguccauucugca

SEQ ID NO: 1981627 - RNA, 12 nt, Homo sapiens
caguuccaauga

SEQ ID NO: 1981628 - RNA, 21 nt, Homo sapiens
uuagaauauaucaaguacaac

SEQ ID NO: 1981629 - RNA, 21 nt, Homo sapiens
ccaaggguaugggaagccaua

SEQ ID NO: 1981630 - RNA, 17 nt, Homo sapiens
acugacucaacauggag

SEQ ID NO: 1981631 - RNA, 17 nt, Homo sapiens
uagcacaggcugagugc

SEQ ID NO: 1981632 - RNA, 14 nt, Homo sapiens
caucuuugaacuuc

SEQ ID NO: 1981633 - RNA, 11 nt, Homo sapiens
ucacugugcuc

SEQ ID NO: 1981634 - RNA, 12 nt, Homo sapiens
gugacauuccac

SEQ ID NO: 1981635 - RNA, 18 nt, Homo sapiens
acccaguggaaccaaaac

SEQ ID NO: 1981636 - RNA, 18 nt, Homo sapiens
cuccacccccuccuguca

SEQ ID NO: 1981637 - RNA, 13 nt, Homo sapiens
ccuuagugccagg

SEQ ID NO: 1981638 - RNA, 17 nt, Homo sapiens
ccuucucuuaguuauug

SEQ ID NO: 1981639 - RNA, 14 nt, Homo sapiens
agacacagugacca

SEQ ID NO: 1981640 - RNA, 22 nt, Homo sapiens
cucccuccaccucccugcaaua

SEQ ID NO: 1981641 - RNA, 12 nt, Homo sapiens
gagcagugccaa

SEQ ID NO: 1981642 - RNA, 22 nt, Homo sapiens
cacguaguagggucaggccacg

SEQ ID NO: 1981643 - RNA, 15 nt, Homo sapiens
cucaaucccuuugca

SEQ ID NO: 1981644 - RNA, 22 nt, Homo sapiens
gaaguauccaauuaugugacaa

SEQ ID NO: 1981645 - RNA, 12 nt, Homo sapiens
cugggccugaac

SEQ ID NO: 1981646 - RNA, 17 nt, Homo sapiens
gcugggguacccggggg

SEQ ID NO: 1981647 - RNA, 12 nt, Homo sapiens
auauuaaucacc

SEQ ID NO: 1981648 - RNA, 19 nt, Homo sapiens
ucaaaggccagguugcuaa

SEQ ID NO: 1981649 - RNA, 17 nt, Homo sapiens
gggacauuccaauuugc

SEQ ID NO: 1981650 - RNA, 18 nt, Homo sapiens
uuauuaccuuuacauauu

SEQ ID NO: 1981651 - RNA, 21 nt, Homo sapiens
acugccuguuaagucugagaa

SEQ ID NO: 1981652 - RNA, 14 nt, Homo sapiens
aacaucucuuucuc

SEQ ID NO: 1981653 - RNA, 18 nt, Homo sapiens
aggugaugguaacugcac

SEQ ID NO: 1981654 - RNA, 15 nt, Homo sapiens
gccucaagacuauag

SEQ ID NO: 1981655 - RNA, 17 nt, Homo sapiens
gauuaaucuaccuugca

SEQ ID NO: 1981656 - RNA, 21 nt, Homo sapiens
gaggguuccucuuaggucaga

SEQ ID NO: 1981657 - RNA, 14 nt, Homo sapiens
gacuuagcugggag

SEQ ID NO: 1981658 - RNA, 21 nt, Homo sapiens
uucugcuaaauaucaccuagc

SEQ ID NO: 1981659 - RNA, 14 nt, Homo sapiens
guuguguguguucu

SEQ ID NO: 1981660 - RNA, 20 nt, Homo sapiens
ccucaguucccucuugcuca

SEQ ID NO: 1981661 - RNA, 21 nt, Homo sapiens
ucugcuaauacagguccugca

SEQ ID NO: 1981662 - RNA, 23 nt, Homo sapiens
caaacaccacuuuacuuguguua

SEQ ID NO: 1981663 - RNA, 19 nt, Homo sapiens
cuauuaccuguuaguauua

SEQ ID NO: 1981664 - RNA, 16 nt, Homo sapiens
caguccaccugaggaa

SEQ ID NO: 1981665 - RNA, 22 nt, Homo sapiens
uauuaccagguccauuuugccu

SEQ ID NO: 1981666 - RNA, 13 nt, Homo sapiens
aaggccauucuuu

SEQ ID NO: 1981667 - RNA, 17 nt, Homo sapiens
guaggggcccacuucac

SEQ ID NO: 1981668 - RNA, 15 nt, Homo sapiens
accaugccuacuaaa

SEQ ID NO: 1981669 - RNA, 17 nt, Homo sapiens
cccacgauggaauguaa

SEQ ID NO: 1981670 - RNA, 12 nt, Homo sapiens
ucacuauugaaa

SEQ ID NO: 1981671 - RNA, 17 nt, Homo sapiens
caaggcuggagugcagu

SEQ ID NO: 1981672 - RNA, 18 nt, Homo sapiens
caguuggagcuccagccu

SEQ ID NO: 1981673 - RNA, 16 nt, Homo sapiens
gggagugggcgcagug

SEQ ID NO: 1981674 - RNA, 13 nt, Homo sapiens
aggcaugagccac

SEQ ID NO: 1981675 - RNA, 20 nt, Homo sapiens
ucagugcaguuucuuuucac

SEQ ID NO: 1981676 - RNA, 12 nt, Homo sapiens
gcaggugccaac

SEQ ID NO: 1981677 - RNA, 15 nt, Homo sapiens
auauuaaaaucacaa

SEQ ID NO: 1981678 - RNA, 17 nt, Homo sapiens
ccucagugcauccccac

SEQ ID NO: 1981679 - RNA, 21 nt, Homo sapiens
cuauauuugcuuuuugcuaac

SEQ ID NO: 1981680 - RNA, 18 nt, Homo sapiens
uguaaacuaguacuauua

SEQ ID NO: 1981681 - RNA, 14 nt, Homo sapiens
gcaaggaaggacac

SEQ ID NO: 1981682 - RNA, 20 nt, Homo sapiens
agaugcuacgcuccagcuga

SEQ ID NO: 1981683 - RNA, 13 nt, Homo sapiens
acaucauuccuuu

SEQ ID NO: 1981684 - RNA, 16 nt, Homo sapiens
ccccgccuuccugggc

SEQ ID NO: 1981685 - RNA, 14 nt, Homo sapiens
gaauauuacuggau

SEQ ID NO: 1981686 - RNA, 11 nt, Homo sapiens
gggugagccag

SEQ ID NO: 1981687 - RNA, 16 nt, Homo sapiens
augaaaaagcauguac

SEQ ID NO: 1981688 - RNA, 15 nt, Homo sapiens
uuacauugccugacu

SEQ ID NO: 1981689 - RNA, 15 nt, Homo sapiens
uuccacagauuauca

SEQ ID NO: 1981690 - RNA, 15 nt, Homo sapiens
uaugcauaaagccaa

SEQ ID NO: 1981691 - RNA, 18 nt, Homo sapiens
accgcccgccucuguccu

SEQ ID NO: 1981692 - RNA, 22 nt, Homo sapiens
guagaucugcuuucuguucauc

SEQ ID NO: 1981693 - RNA, 23 nt, Homo sapiens
auacaggagacccaacaaugagu

SEQ ID NO: 1981694 - RNA, 23 nt, Homo sapiens
ccuucuccaccgcacagacuggg

SEQ ID NO: 1981695 - RNA, 21 nt, Homo sapiens
aggauauuaaauguugcuuua

SEQ ID NO: 1981696 - RNA, 15 nt, Homo sapiens
cauagcagugcuuga

SEQ ID NO: 1981697 - RNA, 22 nt, Homo sapiens
aagauuaacacucauuuccaau

SEQ ID NO: 1981698 - RNA, 24 nt, Homo sapiens
cccagcaaaggggagucucagcuu

SEQ ID NO: 1981699 - RNA, 23 nt, Homo sapiens
ggugggaggccccugguggcaug

SEQ ID NO: 1981700 - RNA, 20 nt, Homo sapiens
uugaaaacaacaaaacacua

SEQ ID NO: 1981701 - RNA, 18 nt, Homo sapiens
accccaguggauucucau

SEQ ID NO: 1981702 - RNA, 18 nt, Homo sapiens
gauucugauaaugcucac

SEQ ID NO: 1981703 - RNA, 17 nt, Homo sapiens
ccccagccagggcucaa

SEQ ID NO: 1981704 - RNA, 23 nt, Homo sapiens
accauguacauaauucuugcuau

SEQ ID NO: 1981705 - RNA, 16 nt, Homo sapiens
gcucguggacugugcu

SEQ ID NO: 1981706 - RNA, 14 nt, Homo sapiens
agcuguguucacag

SEQ ID NO: 1981707 - RNA, 18 nt, Homo sapiens
ccuggaagggaccugguu

SEQ ID NO: 1981708 - RNA, 12 nt, Homo sapiens
ggucccggcuga

SEQ ID NO: 1981709 - RNA, 19 nt, Homo sapiens
cuuuauaaucuacuccuug

SEQ ID NO: 1981710 - RNA, 13 nt, Homo sapiens
uguaaaaauccuu

SEQ ID NO: 1981711 - RNA, 20 nt, Homo sapiens
cagagaccccaggaucccag

SEQ ID NO: 1981712 - RNA, 18 nt, Homo sapiens
ucuggauagggaugaaga

SEQ ID NO: 1981713 - RNA, 15 nt, Homo sapiens
cugaauuacucucca

SEQ ID NO: 1981714 - RNA, 15 nt, Homo sapiens
gucaccaaguguauu

SEQ ID NO: 1981715 - RNA, 22 nt, Homo sapiens
gcccguggcuuggcaucugugu

SEQ ID NO: 1981716 - RNA, 20 nt, Homo sapiens
ccuccccagacagggcucca

SEQ ID NO: 1981717 - RNA, 22 nt, Homo sapiens
ucugggagagccagcuuugcua

SEQ ID NO: 1981718 - RNA, 16 nt, Homo sapiens
cuccugacagcaauaa

SEQ ID NO: 1981719 - RNA, 22 nt, Homo sapiens
ccuggcaaucaauacagcuuca

SEQ ID NO: 1981720 - RNA, 22 nt, Homo sapiens
uggggucugugaucacccucuc

SEQ ID NO: 1981721 - RNA, 21 nt, Homo sapiens
caucuauuuuggauuguauau

SEQ ID NO: 1981722 - RNA, 18 nt, Homo sapiens
uagaugaaaaagcaugua

SEQ ID NO: 1981723 - RNA, 20 nt, Homo sapiens
uucagugagcugcacugacc

SEQ ID NO: 1981724 - RNA, 19 nt, Homo sapiens
caggaaaauguauugauuc

SEQ ID NO: 1981725 - RNA, 19 nt, Homo sapiens
cucuucuacuuguaaaaug

SEQ ID NO: 1981726 - RNA, 18 nt, Homo sapiens
ucccagaggcuccuggag

SEQ ID NO: 1981727 - RNA, 18 nt, Homo sapiens
gaaagucuccuguaucau

SEQ ID NO: 1981728 - RNA, 12 nt, Homo sapiens
ccccaaguccua

SEQ ID NO: 1981729 - RNA, 15 nt, Homo sapiens
acaacaaaaggacuu

SEQ ID NO: 1981730 - RNA, 23 nt, Homo sapiens
caaauacggaaguaaaccugaac

SEQ ID NO: 1981731 - RNA, 15 nt, Homo sapiens
uagggauaacacugu

SEQ ID NO: 1981732 - RNA, 21 nt, Homo sapiens
augcaauuucauuuaaacuuc

SEQ ID NO: 1981733 - RNA, 20 nt, Homo sapiens
uccuagauggcagucacuga

SEQ ID NO: 1981734 - RNA, 23 nt, Homo sapiens
aaaaauucacauccaaugcauag

SEQ ID NO: 1981735 - RNA, 23 nt, Homo sapiens
gccccguuucuugccccagugug

SEQ ID NO: 1981736 - RNA, 16 nt, Homo sapiens
gugaggcauugcacag

SEQ ID NO: 1981737 - RNA, 23 nt, Homo sapiens
ucaaacauaaugaugaguaagau

SEQ ID NO: 1981738 - RNA, 15 nt, Homo sapiens
uccacaccugggcau

SEQ ID NO: 1981739 - RNA, 17 nt, Homo sapiens
aaagaaaauaccaagga

SEQ ID NO: 1981740 - RNA, 21 nt, Homo sapiens
auauuuguaauuuuacacaaa

SEQ ID NO: 1981741 - RNA, 19 nt, Homo sapiens
uacggcaaccacauguccc

SEQ ID NO: 1981742 - RNA, 13 nt, Homo sapiens
uguaagugccuau

SEQ ID NO: 1981743 - RNA, 17 nt, Homo sapiens
aacaugaagccaggugu

SEQ ID NO: 1981744 - RNA, 18 nt, Homo sapiens
gguccugauuucagggaa

SEQ ID NO: 1981745 - RNA, 23 nt, Homo sapiens
agaaguguggggauuuucacuga

SEQ ID NO: 1981746 - RNA, 23 nt, Homo sapiens
ucuaguuuccuuuuugagauacu

SEQ ID NO: 1981747 - RNA, 15 nt, Homo sapiens
ggcuauuugaagaau

SEQ ID NO: 1981748 - RNA, 15 nt, Homo sapiens
aacuauuuagagaau

SEQ ID NO: 1981749 - RNA, 20 nt, Homo sapiens
acuuuggguuuuuaacucau

SEQ ID NO: 1981750 - RNA, 14 nt, Homo sapiens
gacaaaacacugug

SEQ ID NO: 1981751 - RNA, 22 nt, Homo sapiens
uaucauugcaggagccauauga

SEQ ID NO: 1981752 - RNA, 20 nt, Homo sapiens
ggacucuccacucaaugucu

SEQ ID NO: 1981753 - RNA, 13 nt, Homo sapiens
uaucguaucauug

SEQ ID NO: 1981754 - RNA, 17 nt, Homo sapiens
caugagguguugugcau

SEQ ID NO: 1981755 - RNA, 14 nt, Homo sapiens
gcuccccugaggaa

SEQ ID NO: 1981756 - RNA, 13 nt, Homo sapiens
guuguucuuggcu

SEQ ID NO: 1981757 - RNA, 18 nt, Homo sapiens
ucuagaagugccaucuca

SEQ ID NO: 1981758 - RNA, 18 nt, Homo sapiens
cccagugcugcuguaaau

SEQ ID NO: 1981759 - RNA, 13 nt, Homo sapiens
uacacuuguauaa

SEQ ID NO: 1981760 - RNA, 20 nt, Homo sapiens
gucaaggcaguagaacucca

SEQ ID NO: 1981761 - RNA, 14 nt, Homo sapiens
accagaaguccuau

SEQ ID NO: 1981762 - RNA, 16 nt, Homo sapiens
aaagguuuacagugaa

SEQ ID NO: 1981763 - RNA, 14 nt, Homo sapiens
uucugaagaucaau

SEQ ID NO: 1981764 - RNA, 19 nt, Homo sapiens
gaaagcaaaagcaagggac

SEQ ID NO: 1981765 - RNA, 14 nt, Homo sapiens
cuuuuaucucacaa

SEQ ID NO: 1981766 - RNA, 15 nt, Homo sapiens
caggcuggccagucc

SEQ ID NO: 1981767 - RNA, 19 nt, Homo sapiens
cagaugcuguuguuguuac

SEQ ID NO: 1981768 - RNA, 14 nt, Homo sapiens
auacugacaaacca

SEQ ID NO: 1981769 - RNA, 21 nt, Homo sapiens
gagcacuggguugacuuucag

SEQ ID NO: 1981770 - RNA, 19 nt, Homo sapiens
uccucagagcaggggccag

SEQ ID NO: 1981771 - RNA, 20 nt, Homo sapiens
gaaguuucuguugcuguuaa

SEQ ID NO: 1981772 - RNA, 15 nt, Homo sapiens
cuguauggaaacacu

SEQ ID NO: 1981773 - RNA, 18 nt, Homo sapiens
aauaucaugugcacuuca

SEQ ID NO: 1981774 - RNA, 12 nt, Homo sapiens
accuauucugaa

SEQ ID NO: 1981775 - RNA, 22 nt, Homo sapiens
cggggcugucccgugcaugggu

SEQ ID NO: 1981776 - RNA, 17 nt, Homo sapiens
accauaccuuugcuacu

SEQ ID NO: 1981777 - RNA, 19 nt, Homo sapiens
aucuaucaccauuacuuuu

SEQ ID NO: 1981778 - RNA, 16 nt, Homo sapiens
ggucucuaccacugcu

SEQ ID NO: 1981779 - RNA, 22 nt, Homo sapiens
aaagcaaauauauaaugcaaca

SEQ ID NO: 1981780 - RNA, 14 nt, Homo sapiens
cuaaaguaguuuaa

SEQ ID NO: 1981781 - RNA, 20 nt, Homo sapiens
uccagaaaucauacugcaua

SEQ ID NO: 1981782 - RNA, 15 nt, Homo sapiens
ugcauaggcucuuaa

SEQ ID NO: 1981783 - RNA, 14 nt, Homo sapiens
uagaauucccaaga

SEQ ID NO: 1981784 - RNA, 14 nt, Homo sapiens
auagaucuucauga

SEQ ID NO: 1981785 - RNA, 17 nt, Homo sapiens
uccuggucccuuuuuga

SEQ ID NO: 1981786 - RNA, 18 nt, Homo sapiens
cccagguuggagugcagu

SEQ ID NO: 1981787 - RNA, 15 nt, Homo sapiens
uguucccuauuuugc

SEQ ID NO: 1981788 - RNA, 22 nt, Homo sapiens
cuuggcaaaagccuuguguaua

SEQ ID NO: 1981789 - RNA, 23 nt, Homo sapiens
uauuucuaaaacauuaauugagg

SEQ ID NO: 1981790 - RNA, 19 nt, Homo sapiens
aagaaaagugggccagugu

SEQ ID NO: 1981791 - RNA, 14 nt, Homo sapiens
ucucauuauucaca

SEQ ID NO: 1981792 - RNA, 19 nt, Homo sapiens
cuuaaucuuuucacaaaua

SEQ ID NO: 1981793 - RNA, 13 nt, Homo sapiens
ugaacuucaccug

SEQ ID NO: 1981794 - RNA, 17 nt, Homo sapiens
agucauagggcugauaa

SEQ ID NO: 1981795 - RNA, 21 nt, Homo sapiens
aacagcauucuugucacaaua

SEQ ID NO: 1981796 - RNA, 21 nt, Homo sapiens
aaauuagcugggcauggugcg

SEQ ID NO: 1981797 - RNA, 11 nt, Homo sapiens
ucucuguguau

SEQ ID NO: 1981798 - RNA, 23 nt, Homo sapiens
aaguuccaugaauucuugauuuc

SEQ ID NO: 1981799 - RNA, 20 nt, Homo sapiens
aucagacccaacccaugaag

SEQ ID NO: 1981800 - RNA, 13 nt, Homo sapiens
acagaacauuuau

SEQ ID NO: 1981801 - RNA, 14 nt, Homo sapiens
gugugcucuuaucc

SEQ ID NO: 1981802 - RNA, 12 nt, Homo sapiens
aaauucuugaua

SEQ ID NO: 1981803 - RNA, 16 nt, Homo sapiens
uuaggccauauauauu

SEQ ID NO: 1981804 - RNA, 14 nt, Homo sapiens
uacagauucugcua

SEQ ID NO: 1981805 - RNA, 12 nt, Homo sapiens
ccucucugcaaa

SEQ ID NO: 1981806 - RNA, 14 nt, Homo sapiens
aggagggaggugcu

SEQ ID NO: 1981807 - RNA, 20 nt, Homo sapiens
cagucagguccaugugcacu

SEQ ID NO: 1981808 - RNA, 20 nt, Homo sapiens
uaauaaaaauuguagcuuuu

SEQ ID NO: 1981809 - RNA, 13 nt, Homo sapiens
uucauacaacaga

SEQ ID NO: 1981810 - RNA, 19 nt, Homo sapiens
cuuuuauuugaaaugucau

SEQ ID NO: 1981811 - RNA, 17 nt, Homo sapiens
auagccaaggccaaagg

SEQ ID NO: 1981812 - RNA, 16 nt, Homo sapiens
guuauccugugcuaca

SEQ ID NO: 1981813 - RNA, 16 nt, Homo sapiens
cucuggagccagagag

SEQ ID NO: 1981814 - RNA, 20 nt, Homo sapiens
gcuauuugcaaacuuacuua

SEQ ID NO: 1981815 - RNA, 12 nt, Homo sapiens
uccaugauucca

SEQ ID NO: 1981816 - RNA, 12 nt, Homo sapiens
gaccugaugacc

SEQ ID NO: 1981817 - RNA, 20 nt, Homo sapiens
ccaguaucucuucagucucu

SEQ ID NO: 1981818 - RNA, 12 nt, Homo sapiens
uuaauaaacaug

SEQ ID NO: 1981819 - RNA, 18 nt, Homo sapiens
gcauuucagguugugcau

SEQ ID NO: 1981820 - RNA, 15 nt, Homo sapiens
aaggaaaauugcacu

SEQ ID NO: 1981821 - RNA, 17 nt, Homo sapiens
ggccccucccacaccca

SEQ ID NO: 1981822 - RNA, 14 nt, Homo sapiens
agagccaagcugca

SEQ ID NO: 1981823 - RNA, 15 nt, Homo sapiens
cuuuuaaacuggaaa

SEQ ID NO: 1981824 - RNA, 21 nt, Homo sapiens
augaaucucaagauucaguag

SEQ ID NO: 1981825 - RNA, 21 nt, Homo sapiens
acccucugacuguauuugaga

SEQ ID NO: 1981826 - RNA, 23 nt, Homo sapiens
uacauuuuuggggggagagacac

SEQ ID NO: 1981827 - RNA, 20 nt, Homo sapiens
auuaaauguuugacacaauu

SEQ ID NO: 1981828 - RNA, 22 nt, Homo sapiens
gcccucucccuguguucugggc

SEQ ID NO: 1981829 - RNA, 18 nt, Homo sapiens
ugccccagaaaaauaacu

SEQ ID NO: 1981830 - RNA, 16 nt, Homo sapiens
accaaauaaaguagaa

SEQ ID NO: 1981831 - RNA, 15 nt, Homo sapiens
ugcuagaagcuguaa

SEQ ID NO: 1981832 - RNA, 19 nt, Homo sapiens
gagcuuagccuugugcccu

SEQ ID NO: 1981833 - RNA, 14 nt, Homo sapiens
cccagcacagacuc

SEQ ID NO: 1981834 - RNA, 17 nt, Homo sapiens
agacaggaaaaagacua

SEQ ID NO: 1981835 - RNA, 19 nt, Homo sapiens
caaucuuaacucauugcaa

SEQ ID NO: 1981836 - RNA, 13 nt, Homo sapiens
caccgccaugcaa

SEQ ID NO: 1981837 - RNA, 16 nt, Homo sapiens
cgagucaugcacucag

SEQ ID NO: 1981838 - RNA, 14 nt, Homo sapiens
gccaccccaccaga

SEQ ID NO: 1981839 - RNA, 23 nt, Homo sapiens
caagauaaccccaagacagucuu

SEQ ID NO: 1981840 - RNA, 19 nt, Homo sapiens
ggauauucgguaauaucau

SEQ ID NO: 1981841 - RNA, 11 nt, Homo sapiens
guuaccauauu

SEQ ID NO: 1981842 - RNA, 15 nt, Homo sapiens
ugaaggaaacugaac

SEQ ID NO: 1981843 - RNA, 18 nt, Homo sapiens
cuguucccuugcaggggu

SEQ ID NO: 1981844 - RNA, 13 nt, Homo sapiens
ugucgcaucucag

SEQ ID NO: 1981845 - RNA, 21 nt, Homo sapiens
agccccugccagcagcugccu

SEQ ID NO: 1981846 - RNA, 20 nt, Homo sapiens
auaaauccgcuucuccugca

SEQ ID NO: 1981847 - RNA, 17 nt, Homo sapiens
cacuuuuuuguuugaau

SEQ ID NO: 1981848 - RNA, 18 nt, Homo sapiens
acacacaguaaauguuua

SEQ ID NO: 1981849 - RNA, 15 nt, Homo sapiens
gugccagcagcccuu

SEQ ID NO: 1981850 - RNA, 15 nt, Homo sapiens
uaggcauuugcugaa

SEQ ID NO: 1981851 - RNA, 11 nt, Homo sapiens
uuaugagauuu

SEQ ID NO: 1981852 - RNA, 22 nt, Homo sapiens
cuccagucuccugacauuaaga

SEQ ID NO: 1981853 - RNA, 21 nt, Homo sapiens
gcucaagcuguccucccaccu

SEQ ID NO: 1981854 - RNA, 22 nt, Homo sapiens
aggggguggggaagaagacaca

SEQ ID NO: 1981855 - RNA, 19 nt, Homo sapiens
aucuacugaaugaccucuc

SEQ ID NO: 1981856 - RNA, 15 nt, Homo sapiens
gguugggcuggugcu

SEQ ID NO: 1981857 - RNA, 21 nt, Homo sapiens
caaaaaagcgaaccgugagga

SEQ ID NO: 1981858 - RNA, 21 nt, Homo sapiens
ggugcuaguaaauuuucaaac

SEQ ID NO: 1981859 - RNA, 18 nt, Homo sapiens
aaacuuuccugacuuaca

SEQ ID NO: 1981860 - RNA, 13 nt, Homo sapiens
uuaucuaacagac

SEQ ID NO: 1981861 - RNA, 14 nt, Homo sapiens
uacaaaguuucaaa

SEQ ID NO: 1981862 - RNA, 15 nt, Homo sapiens
caagacugcucccuu

SEQ ID NO: 1981863 - RNA, 23 nt, Homo sapiens
ugcuuaaacccuuuagugcuuug

SEQ ID NO: 1981864 - RNA, 15 nt, Homo sapiens
ucacggaccccaugu

SEQ ID NO: 1981865 - RNA, 13 nt, Homo sapiens
ucagcacauucca

SEQ ID NO: 1981866 - RNA, 16 nt, Homo sapiens
cucauguagccucaac

SEQ ID NO: 1981867 - RNA, 19 nt, Homo sapiens
agcacccugcccaccaaga

SEQ ID NO: 1981868 - RNA, 16 nt, Homo sapiens
gugcaacccagucaca

SEQ ID NO: 1981869 - RNA, 15 nt, Homo sapiens
cuggaacaucaucaa

SEQ ID NO: 1981870 - RNA, 16 nt, Homo sapiens
gugacuucccugguca

SEQ ID NO: 1981871 - RNA, 23 nt, Homo sapiens
agagacagaaagcagaacaguga

SEQ ID NO: 1981872 - RNA, 20 nt, Homo sapiens
ugaagauuucucugagauca

SEQ ID NO: 1981873 - RNA, 22 nt, Homo sapiens
cgauggauccgugacagcacuu

SEQ ID NO: 1981874 - RNA, 15 nt, Homo sapiens
aagaugguugccaag

SEQ ID NO: 1981875 - RNA, 17 nt, Homo sapiens
auugacaaaaaccagca

SEQ ID NO: 1981876 - RNA, 19 nt, Homo sapiens
cacuuuugaagcaauauca

SEQ ID NO: 1981877 - RNA, 14 nt, Homo sapiens
gaaagaaaccagac

SEQ ID NO: 1981878 - RNA, 14 nt, Homo sapiens
gauaacaaccugga

SEQ ID NO: 1981879 - RNA, 18 nt, Homo sapiens
cugggccaccagccacuu

SEQ ID NO: 1981880 - RNA, 17 nt, Homo sapiens
aauaaaauuauuugcag

SEQ ID NO: 1981881 - RNA, 16 nt, Homo sapiens
cacccacgagcacuuu

SEQ ID NO: 1981882 - RNA, 12 nt, Homo sapiens
cuguguacugug

SEQ ID NO: 1981883 - RNA, 22 nt, Homo sapiens
agaugagaacaaagcuguuaaa

SEQ ID NO: 1981884 - RNA, 22 nt, Homo sapiens
ggccccagcccuacucugugua

SEQ ID NO: 1981885 - RNA, 16 nt, Homo sapiens
ucuggucguuugacca

SEQ ID NO: 1981886 - RNA, 15 nt, Homo sapiens
ugagagugagacuca

SEQ ID NO: 1981887 - RNA, 16 nt, Homo sapiens
aucacagcagugcaua

SEQ ID NO: 1981888 - RNA, 23 nt, Homo sapiens
acagcugcucaauaaaguacaag

SEQ ID NO: 1981889 - RNA, 20 nt, Homo sapiens
uuccaaaggcauaagacccu

SEQ ID NO: 1981890 - RNA, 11 nt, Homo sapiens
uguucaggaua

SEQ ID NO: 1981891 - RNA, 20 nt, Homo sapiens
uuuguuaccauacugucucu

SEQ ID NO: 1981892 - RNA, 16 nt, Homo sapiens
cuuuggagaucaagga

SEQ ID NO: 1981893 - RNA, 20 nt, Homo sapiens
agcuguuuagggucuucucc

SEQ ID NO: 1981894 - RNA, 18 nt, Homo sapiens
ccagccccuccucccuca

SEQ ID NO: 1981895 - RNA, 12 nt, Homo sapiens
cauuugcaauua

SEQ ID NO: 1981896 - RNA, 17 nt, Homo sapiens
cagcagcucauagaauu

SEQ ID NO: 1981897 - RNA, 15 nt, Homo sapiens
uccgccacaucccuc

SEQ ID NO: 1981898 - RNA, 16 nt, Homo sapiens
uagucucacauguccc

SEQ ID NO: 1981899 - RNA, 17 nt, Homo sapiens
uacuucagugcaccuac

SEQ ID NO: 1981900 - RNA, 21 nt, Homo sapiens
uauacaugacugcaacuguau

SEQ ID NO: 1981901 - RNA, 17 nt, Homo sapiens
ugucaaugggaccugug

SEQ ID NO: 1981902 - RNA, 21 nt, Homo sapiens
aaccagacuugaauacaacau

SEQ ID NO: 1981903 - RNA, 17 nt, Homo sapiens
guaguccagccuuccag

SEQ ID NO: 1981904 - RNA, 21 nt, Homo sapiens
acuacuccucugcagugccuu

SEQ ID NO: 1981905 - RNA, 18 nt, Homo sapiens
aaacauuucuaaaccaga

SEQ ID NO: 1981906 - RNA, 14 nt, Homo sapiens
cucagggugggggg

SEQ ID NO: 1981907 - RNA, 16 nt, Homo sapiens
uagcugacuacaaauu

SEQ ID NO: 1981908 - RNA, 21 nt, Homo sapiens
auuuuguaauaauaaagaaua

SEQ ID NO: 1981909 - RNA, 13 nt, Homo sapiens
ccuggacagugag

SEQ ID NO: 1981910 - RNA, 13 nt, Homo sapiens
ccugcacagugac

SEQ ID NO: 1981911 - RNA, 17 nt, Homo sapiens
cugaaaauacuuaggaa

SEQ ID NO: 1981912 - RNA, 15 nt, Homo sapiens
aguuucugauucacu

SEQ ID NO: 1981913 - RNA, 22 nt, Homo sapiens
cgcucuuggcagguacucagcg

SEQ ID NO: 1981914 - RNA, 20 nt, Homo sapiens
ucagauuugcuguucaccca

SEQ ID NO: 1981915 - RNA, 18 nt, Homo sapiens
gcagccugcaccuggugg

SEQ ID NO: 1981916 - RNA, 17 nt, Homo sapiens
guguauuaucacugucu

SEQ ID NO: 1981917 - RNA, 18 nt, Homo sapiens
aagucaaacaguguggcu

SEQ ID NO: 1981918 - RNA, 17 nt, Homo sapiens
ucucugcagacuuccca

SEQ ID NO: 1981919 - RNA, 15 nt, Homo sapiens
auuuguucuuugcca

SEQ ID NO: 1981920 - RNA, 15 nt, Homo sapiens
gacuuuuaaugucau

SEQ ID NO: 1981921 - RNA, 15 nt, Homo sapiens
auuuuaggaaacuuu

SEQ ID NO: 1981922 - RNA, 17 nt, Homo sapiens
cagcagaucauuuagga

SEQ ID NO: 1981923 - RNA, 22 nt, Homo sapiens
cuauauuccuuuuucuaugaaa

SEQ ID NO: 1981924 - RNA, 18 nt, Homo sapiens
guaaaaauauuaacugac

SEQ ID NO: 1981925 - RNA, 14 nt, Homo sapiens
uauuucugauacug

SEQ ID NO: 1981926 - RNA, 20 nt, Homo sapiens
aaauuguaagugaaguaaaa

SEQ ID NO: 1981927 - RNA, 18 nt, Homo sapiens
cacuuuaaagcaauugca

SEQ ID NO: 1981928 - RNA, 15 nt, Homo sapiens
uugggcugucaacau

SEQ ID NO: 1981929 - RNA, 14 nt, Homo sapiens
acagguaucugucc

SEQ ID NO: 1981930 - RNA, 20 nt, Homo sapiens
auucucucauagaacauuga

SEQ ID NO: 1981931 - RNA, 22 nt, Homo sapiens
uuaguaaauacaucacuguaua

SEQ ID NO: 1981932 - RNA, 19 nt, Homo sapiens
acccaucuaguacuugaaa

SEQ ID NO: 1981933 - RNA, 16 nt, Homo sapiens
ucacagacccacaaga

SEQ ID NO: 1981934 - RNA, 16 nt, Homo sapiens
cuugcugauggcugcu

SEQ ID NO: 1981935 - RNA, 18 nt, Homo sapiens
ggccccucuccccaggga

SEQ ID NO: 1981936 - RNA, 16 nt, Homo sapiens
accuguuuuuguuucu

SEQ ID NO: 1981937 - RNA, 14 nt, Homo sapiens
uagacucaucuuuu

SEQ ID NO: 1981938 - RNA, 13 nt, Homo sapiens
cagggccuugaca

SEQ ID NO: 1981939 - RNA, 14 nt, Homo sapiens
cagucuauucacag

SEQ ID NO: 1981940 - RNA, 16 nt, Homo sapiens
uggccugcgcuagcuu

SEQ ID NO: 1981941 - RNA, 18 nt, Homo sapiens
acagccccucuggacaca

SEQ ID NO: 1981942 - RNA, 21 nt, Homo sapiens
ugucaagaacaggacauagca

SEQ ID NO: 1981943 - RNA, 14 nt, Homo sapiens
cuacaauuugccau

SEQ ID NO: 1981944 - RNA, 20 nt, Homo sapiens
uuuuuauucaaacuaccuau

SEQ ID NO: 1981945 - RNA, 19 nt, Homo sapiens
aauagaauuauaacuggaa

SEQ ID NO: 1981946 - RNA, 22 nt, Homo sapiens
agaucuguaaguaacuucacau

SEQ ID NO: 1981947 - RNA, 17 nt, Homo sapiens
cuuugucuuacuggcaa

SEQ ID NO: 1981948 - RNA, 15 nt, Homo sapiens
aguagugcugugauu

SEQ ID NO: 1981949 - RNA, 20 nt, Homo sapiens
caaggcugcuuagaauccaa

SEQ ID NO: 1981950 - RNA, 18 nt, Homo sapiens
ugcacuccccguguucau

SEQ ID NO: 1981951 - RNA, 13 nt, Homo sapiens
gaggaggggcccg

SEQ ID NO: 1981952 - RNA, 17 nt, Homo sapiens
ucucacacuucauccua

SEQ ID NO: 1981953 - RNA, 12 nt, Homo sapiens
gagugaauuuca

SEQ ID NO: 1981954 - RNA, 19 nt, Homo sapiens
agggcagggaaacccuggg

SEQ ID NO: 1981955 - RNA, 17 nt, Homo sapiens
caacugaucauuugcag

SEQ ID NO: 1981956 - RNA, 22 nt, Homo sapiens
ucacuaauucauuaaucugccu

SEQ ID NO: 1981957 - RNA, 20 nt, Homo sapiens
uuuagccaccaucuuugcag

SEQ ID NO: 1981958 - RNA, 23 nt, Homo sapiens
caugaagugauauaaaagcugca

SEQ ID NO: 1981959 - RNA, 18 nt, Homo sapiens
uuaagcaauaaaacugcu

SEQ ID NO: 1981960 - RNA, 18 nt, Homo sapiens
ccuggggagccagggcua

SEQ ID NO: 1981961 - RNA, 15 nt, Homo sapiens
uuaccucacagugau

SEQ ID NO: 1981962 - RNA, 23 nt, Homo sapiens
uacacccaauuuuaaaaaauaac

SEQ ID NO: 1981963 - RNA, 16 nt, Homo sapiens
gugacaggacuuucau

SEQ ID NO: 1981964 - RNA, 15 nt, Homo sapiens
ccaggcuggagugca

SEQ ID NO: 1981965 - RNA, 20 nt, Homo sapiens
ucccuaacuuaacauugcau

SEQ ID NO: 1981966 - RNA, 18 nt, Homo sapiens
agcauuucccucccggga

SEQ ID NO: 1981967 - RNA, 16 nt, Homo sapiens
cuuggccacugaauua

SEQ ID NO: 1981968 - RNA, 12 nt, Homo sapiens
cuccguccuguc

SEQ ID NO: 1981969 - RNA, 18 nt, Homo sapiens
augcuuuuaaacugauua

SEQ ID NO: 1981970 - RNA, 19 nt, Homo sapiens
gucucucagagaucuugca

SEQ ID NO: 1981971 - RNA, 18 nt, Homo sapiens
aaaucauuucaguaucau

SEQ ID NO: 1981972 - RNA, 14 nt, Homo sapiens
guggucccugagga

SEQ ID NO: 1981973 - RNA, 14 nt, Homo sapiens
accacagggccaga

SEQ ID NO: 1981974 - RNA, 21 nt, Homo sapiens
guccucguucaaaacauucca

SEQ ID NO: 1981975 - RNA, 19 nt, Homo sapiens
auauaauuauauguuguaa

SEQ ID NO: 1981976 - RNA, 20 nt, Homo sapiens
aacucuucgggagacauguu

SEQ ID NO: 1981977 - RNA, 16 nt, Homo sapiens
ucccuuccccacaaua

SEQ ID NO: 1981978 - RNA, 21 nt, Homo sapiens
aaguagaauagugguugccaa

SEQ ID NO: 1981979 - RNA, 13 nt, Homo sapiens
uacuuuucugcca

SEQ ID NO: 1981980 - RNA, 17 nt, Homo sapiens
acaugccugccaaagac

SEQ ID NO: 1981981 - RNA, 14 nt, Homo sapiens
ccagcccucaggcc

SEQ ID NO: 1981982 - RNA, 18 nt, Homo sapiens
ucugucacaccagccaua

SEQ ID NO: 1981983 - RNA, 20 nt, Homo sapiens
ucaauacuauggaguaccau

SEQ ID NO: 1981984 - RNA, 21 nt, Homo sapiens
ggucuccaagggcaucacugg

SEQ ID NO: 1981985 - RNA, 13 nt, Homo sapiens
aguccucugcucc

SEQ ID NO: 1981986 - RNA, 18 nt, Homo sapiens
uguuauugguaccucuca

SEQ ID NO: 1981987 - RNA, 17 nt, Homo sapiens
aaauucugaugagcauu

SEQ ID NO: 1981988 - RNA, 15 nt, Homo sapiens
cuucucagcucccau

SEQ ID NO: 1981989 - RNA, 15 nt, Homo sapiens
uuuuccuguucuuaa

SEQ ID NO: 1981990 - RNA, 14 nt, Homo sapiens
ugaagagcaaaaau

SEQ ID NO: 1981991 - RNA, 19 nt, Homo sapiens
cuuggaaaggcucccuguc

SEQ ID NO: 1981992 - RNA, 13 nt, Homo sapiens
uuuucauguauuu

SEQ ID NO: 1981993 - RNA, 20 nt, Homo sapiens
aagcuuaugcuuaaauucaa

SEQ ID NO: 1981994 - RNA, 16 nt, Homo sapiens
cccaagguggucuugg

SEQ ID NO: 1981995 - RNA, 16 nt, Homo sapiens
uaauucugcugucuca

SEQ ID NO: 1981996 - RNA, 20 nt, Homo sapiens
uauacaaugaguaaaaucac

SEQ ID NO: 1981997 - RNA, 18 nt, Homo sapiens
uaauggucaaugcuagca

SEQ ID NO: 1981998 - RNA, 18 nt, Homo sapiens
aaacucucauuauuugug

SEQ ID NO: 1981999 - RNA, 14 nt, Homo sapiens
cugaccaggcccaa

SEQ ID NO: 1982000 - RNA, 13 nt, Homo sapiens
uucugugucauac

SEQ ID NO: 1982001 - RNA, 22 nt, Homo sapiens
uguagaugggggaacugugaau

SEQ ID NO: 1982002 - RNA, 22 nt, Homo sapiens
ggcuaacagucuagugcaaaag

SEQ ID NO: 1982003 - RNA, 16 nt, Homo sapiens
uauuguauuugagaaa

SEQ ID NO: 1982004 - RNA, 16 nt, Homo sapiens
acccugcugaccuccc

SEQ ID NO: 1982005 - RNA, 15 nt, Homo sapiens
ccccuggcuuugccu

SEQ ID NO: 1982006 - RNA, 19 nt, Homo sapiens
gcccugaguuccuagccac

SEQ ID NO: 1982007 - RNA, 16 nt, Homo sapiens
ccauuaaaguucucaa

SEQ ID NO: 1982008 - RNA, 19 nt, Homo sapiens
ucccacuauuuauuacuga

SEQ ID NO: 1982009 - RNA, 19 nt, Homo sapiens
ugcaaggccugguguuucu

SEQ ID NO: 1982010 - RNA, 13 nt, Homo sapiens
cugaaccccaugg

SEQ ID NO: 1982011 - RNA, 18 nt, Homo sapiens
ucagcuuaaaauccaaag

SEQ ID NO: 1982012 - RNA, 18 nt, Homo sapiens
cacuucuaugcaaaugcc

SEQ ID NO: 1982013 - RNA, 11 nt, Homo sapiens
uccuccccaaa

SEQ ID NO: 1982014 - RNA, 23 nt, Homo sapiens
ucaaauuugccaccacuagagcu

SEQ ID NO: 1982015 - RNA, 16 nt, Homo sapiens
uuugauacaguauuau

SEQ ID NO: 1982016 - RNA, 20 nt, Homo sapiens
gagggcugcaguucuacuca

SEQ ID NO: 1982017 - RNA, 17 nt, Homo sapiens
cuaugccgccaccggcc

SEQ ID NO: 1982018 - RNA, 18 nt, Homo sapiens
ggacagcggguaaaaaga

SEQ ID NO: 1982019 - RNA, 15 nt, Homo sapiens
uggcgcaggaacuca

SEQ ID NO: 1982020 - RNA, 19 nt, Homo sapiens
uucuagcuaccuguauuau

SEQ ID NO: 1982021 - RNA, 15 nt, Homo sapiens
aucuaaaaccaaaua

SEQ ID NO: 1982022 - RNA, 20 nt, Homo sapiens
uauuggaaaggucauugugg

SEQ ID NO: 1982023 - RNA, 14 nt, Homo sapiens
ugacucagaauauu

SEQ ID NO: 1982024 - RNA, 15 nt, Homo sapiens
gagcccauucccacc

SEQ ID NO: 1982025 - RNA, 23 nt, Homo sapiens
uacuaaggaguaaucuguguaca

SEQ ID NO: 1982026 - RNA, 19 nt, Homo sapiens
cugacccuguaaaauggag

SEQ ID NO: 1982027 - RNA, 17 nt, Homo sapiens
agccuccgccugcugug

SEQ ID NO: 1982028 - RNA, 20 nt, Homo sapiens
cucaaaugugaccaugugaa

SEQ ID NO: 1982029 - RNA, 23 nt, Homo sapiens
aaaaguauucuuguuagaaucug

SEQ ID NO: 1982030 - RNA, 18 nt, Homo sapiens
uaaugaaaaacuauguca

SEQ ID NO: 1982031 - RNA, 13 nt, Homo sapiens
uauugauauucaa

SEQ ID NO: 1982032 - RNA, 16 nt, Homo sapiens
uccccuucuagccuuu

SEQ ID NO: 1982033 - RNA, 22 nt, Homo sapiens
ucccaggccugccugcauggca

SEQ ID NO: 1982034 - RNA, 19 nt, Homo sapiens
aucaucaaguaauacaaac

SEQ ID NO: 1982035 - RNA, 12 nt, Homo sapiens
caagaucuugaa

SEQ ID NO: 1982036 - RNA, 20 nt, Homo sapiens
guacucuuguuuccuuauau

SEQ ID NO: 1982037 - RNA, 19 nt, Homo sapiens
caccaucaucauagaggau

SEQ ID NO: 1982038 - RNA, 16 nt, Homo sapiens
cuucaucugggacaaa

SEQ ID NO: 1982039 - RNA, 18 nt, Homo sapiens
guauggaauacaguguua

SEQ ID NO: 1982040 - RNA, 21 nt, Homo sapiens
caggcuuggauggaacaugcc

SEQ ID NO: 1982041 - RNA, 21 nt, Homo sapiens
cagagcugcuccccucugcac

SEQ ID NO: 1982042 - RNA, 13 nt, Homo sapiens
guucagaaggugu

SEQ ID NO: 1982043 - RNA, 20 nt, Homo sapiens
aacaaguugagcuaugacuu

SEQ ID NO: 1982044 - RNA, 14 nt, Homo sapiens
cuucccaccucucu

SEQ ID NO: 1982045 - RNA, 21 nt, Homo sapiens
aacuauuggagggugggagag

SEQ ID NO: 1982046 - RNA, 22 nt, Homo sapiens
cauguuuuuggggacacugaca

SEQ ID NO: 1982047 - RNA, 13 nt, Homo sapiens
agcagccaggagg

SEQ ID NO: 1982048 - RNA, 14 nt, Homo sapiens
guucauauucacua

SEQ ID NO: 1982049 - RNA, 19 nt, Homo sapiens
aaucuguggccacucgagu

SEQ ID NO: 1982050 - RNA, 15 nt, Homo sapiens
cccagcagggccuca

SEQ ID NO: 1982051 - RNA, 14 nt, Homo sapiens
guuauguacuguac

SEQ ID NO: 1982052 - RNA, 21 nt, Homo sapiens
aaaagacagcacuacagauau

SEQ ID NO: 1982053 - RNA, 13 nt, Homo sapiens
aucauuccauuuu

SEQ ID NO: 1982054 - RNA, 22 nt, Homo sapiens
guucagaaaauuaaacuacaga

SEQ ID NO: 1982055 - RNA, 18 nt, Homo sapiens
agcaaugacaucucaggg

SEQ ID NO: 1982056 - RNA, 15 nt, Homo sapiens
caguggugugaucuu

SEQ ID NO: 1982057 - RNA, 15 nt, Homo sapiens
caguggcgugaucuc

SEQ ID NO: 1982058 - RNA, 13 nt, Homo sapiens
gagcacacccgug

SEQ ID NO: 1982059 - RNA, 16 nt, Homo sapiens
gcaagcgacaggaaag

SEQ ID NO: 1982060 - RNA, 22 nt, Homo sapiens
gagagaaguuaauccacaucuu

SEQ ID NO: 1982061 - RNA, 20 nt, Homo sapiens
ggaccagaaaccugggagag

SEQ ID NO: 1982062 - RNA, 23 nt, Homo sapiens
uuugaugaaauaaaauaucaaua

SEQ ID NO: 1982063 - RNA, 14 nt, Homo sapiens
ugggugcucagaau

SEQ ID NO: 1982064 - RNA, 11 nt, Homo sapiens
uaaaaugacau

SEQ ID NO: 1982065 - RNA, 18 nt, Homo sapiens
ccuaaguuuacuucucua

SEQ ID NO: 1982066 - RNA, 23 nt, Homo sapiens
gugcagcgcagcuggacucugca

SEQ ID NO: 1982067 - RNA, 20 nt, Homo sapiens
acaguaacuugguuauacau

SEQ ID NO: 1982068 - RNA, 16 nt, Homo sapiens
cauuuuugaaaccaaa

SEQ ID NO: 1982069 - RNA, 20 nt, Homo sapiens
aaggcugccagguguggaac

SEQ ID NO: 1982070 - RNA, 12 nt, Homo sapiens
cagagcccggug

SEQ ID NO: 1982071 - RNA, 17 nt, Homo sapiens
cccaccaguuauuccuu

SEQ ID NO: 1982072 - RNA, 22 nt, Homo sapiens
ccccgauugaaagaaccagaga

SEQ ID NO: 1982073 - RNA, 18 nt, Homo sapiens
aauugagauccaguuuuu

SEQ ID NO: 1982074 - RNA, 21 nt, Homo sapiens
agagcuaagaaauaaggcuaa

SEQ ID NO: 1982075 - RNA, 21 nt, Homo sapiens
gggaagugagggcucacucag

SEQ ID NO: 1982076 - RNA, 17 nt, Homo sapiens
cauagcuugcaguuuca

SEQ ID NO: 1982077 - RNA, 19 nt, Homo sapiens
agcucuuuauuacauagcu

SEQ ID NO: 1982078 - RNA, 20 nt, Homo sapiens
gcugugugugugugaguaug

SEQ ID NO: 1982079 - RNA, 19 nt, Homo sapiens
acuuuaaauucaagcugcu

SEQ ID NO: 1982080 - RNA, 14 nt, Homo sapiens
cauccauuccucuu

SEQ ID NO: 1982081 - RNA, 15 nt, Homo sapiens
ugucuggaugcacac

SEQ ID NO: 1982082 - RNA, 15 nt, Homo sapiens
ucacucaguccagcu

SEQ ID NO: 1982083 - RNA, 20 nt, Homo sapiens
ccuucccuugccacuuugca

SEQ ID NO: 1982084 - RNA, 22 nt, Homo sapiens
aaucagucuuccuuguggaaug

SEQ ID NO: 1982085 - RNA, 17 nt, Homo sapiens
auggcuccuccauaucu

SEQ ID NO: 1982086 - RNA, 22 nt, Homo sapiens
uauauauucucaaauugcucua

SEQ ID NO: 1982087 - RNA, 14 nt, Homo sapiens
cagaaucuccaucc

SEQ ID NO: 1982088 - RNA, 13 nt, Homo sapiens
aguaacacuggcg

SEQ ID NO: 1982089 - RNA, 19 nt, Homo sapiens
gaacccagcaguucuguua

SEQ ID NO: 1982090 - RNA, 15 nt, Homo sapiens
gcugccauuaaugaa

SEQ ID NO: 1982091 - RNA, 13 nt, Homo sapiens
uugaccuuuccag

SEQ ID NO: 1982092 - RNA, 19 nt, Homo sapiens
uucacccggcugggcuccu

SEQ ID NO: 1982093 - RNA, 22 nt, Homo sapiens
acucuaaagaauucuugaaaaa

SEQ ID NO: 1982094 - RNA, 23 nt, Homo sapiens
aggagaagggggcucugccccag

SEQ ID NO: 1982095 - RNA, 18 nt, Homo sapiens
gcuucaagugauauaugu

SEQ ID NO: 1982096 - RNA, 22 nt, Homo sapiens
ugggaaaauaaauacauucgaa

SEQ ID NO: 1982097 - RNA, 20 nt, Homo sapiens
uccuaaauuuuuacaucaaa

SEQ ID NO: 1982098 - RNA, 23 nt, Homo sapiens
cagucauucuaggauguggagcu

SEQ ID NO: 1982099 - RNA, 17 nt, Homo sapiens
auccguaccaucgguca

SEQ ID NO: 1982100 - RNA, 17 nt, Homo sapiens
accaacuuaagaauuug

SEQ ID NO: 1982101 - RNA, 18 nt, Homo sapiens
gcggccucguuccagugg

SEQ ID NO: 1982102 - RNA, 15 nt, Homo sapiens
aagggugacauccca

SEQ ID NO: 1982103 - RNA, 18 nt, Homo sapiens
uggaauaaaccacacuua

SEQ ID NO: 1982104 - RNA, 23 nt, Homo sapiens
cccucuuuucugaucugcaguuu

SEQ ID NO: 1982105 - RNA, 15 nt, Homo sapiens
aguagucuugaugac

SEQ ID NO: 1982106 - RNA, 15 nt, Homo sapiens
uuccauuccaagccu

SEQ ID NO: 1982107 - RNA, 18 nt, Homo sapiens
caaaaugggcccuugccu

SEQ ID NO: 1982108 - RNA, 23 nt, Homo sapiens
cagccaucguccugggacucgga

SEQ ID NO: 1982109 - RNA, 19 nt, Homo sapiens
ccgagguucgagucuugcu

SEQ ID NO: 1982110 - RNA, 14 nt, Homo sapiens
cugagauccagaga

SEQ ID NO: 1982111 - RNA, 19 nt, Homo sapiens
gccgacccugcggccucca

SEQ ID NO: 1982112 - RNA, 13 nt, Homo sapiens
uucuucaaucuga

SEQ ID NO: 1982113 - RNA, 14 nt, Homo sapiens
aguaugugugguuu

SEQ ID NO: 1982114 - RNA, 19 nt, Homo sapiens
ccagggugagaacgugccc

SEQ ID NO: 1982115 - RNA, 17 nt, Homo sapiens
cccauaugccugggcag

SEQ ID NO: 1982116 - RNA, 20 nt, Homo sapiens
auucuagugaaugaaucuca

SEQ ID NO: 1982117 - RNA, 23 nt, Homo sapiens
uggcaagacugucuuaccuggca

SEQ ID NO: 1982118 - RNA, 23 nt, Homo sapiens
accuuggcaccagacacccagga

SEQ ID NO: 1982119 - RNA, 18 nt, Homo sapiens
acaugcaaaucuggcuua

SEQ ID NO: 1982120 - RNA, 21 nt, Homo sapiens
aguuuuguacauagcaaauaa

SEQ ID NO: 1982121 - RNA, 23 nt, Homo sapiens
uccccagacaccgccacauggcu

SEQ ID NO: 1982122 - RNA, 19 nt, Homo sapiens
uugacaauuugccauagca

SEQ ID NO: 1982123 - RNA, 21 nt, Homo sapiens
gacuuggacaggagucagugu

SEQ ID NO: 1982124 - RNA, 19 nt, Homo sapiens
uugggacgcacagugcagu

SEQ ID NO: 1982125 - RNA, 18 nt, Homo sapiens
accaagcguuucccaguc

SEQ ID NO: 1982126 - RNA, 18 nt, Homo sapiens
auuucaaugucagccuuu

SEQ ID NO: 1982127 - RNA, 18 nt, Homo sapiens
ucacaaaaucacuuuaag

SEQ ID NO: 1982128 - RNA, 23 nt, Homo sapiens
cucaucaguguccucuugcucaa

SEQ ID NO: 1982129 - RNA, 17 nt, Homo sapiens
cacucauuucaucucau

SEQ ID NO: 1982130 - RNA, 18 nt, Homo sapiens
ucagucuuuaaucugaga

SEQ ID NO: 1982131 - RNA, 13 nt, Homo sapiens
ccagaugccaggg

SEQ ID NO: 1982132 - RNA, 17 nt, Homo sapiens
accucucucaaaucuca

SEQ ID NO: 1982133 - RNA, 15 nt, Homo sapiens
ugagguggugccuuc

SEQ ID NO: 1982134 - RNA, 19 nt, Homo sapiens
cgcagggaugucgcugggg

SEQ ID NO: 1982135 - RNA, 15 nt, Homo sapiens
uuaccuucuuucuaa

SEQ ID NO: 1982136 - RNA, 20 nt, Homo sapiens
ucauaugcaaagcauauuaa

SEQ ID NO: 1982137 - RNA, 13 nt, Homo sapiens
gaaggcuucacuc

SEQ ID NO: 1982138 - RNA, 18 nt, Homo sapiens
ugccgcagugaucaaagu

SEQ ID NO: 1982139 - RNA, 14 nt, Homo sapiens
uuugguaccaagaa

SEQ ID NO: 1982140 - RNA, 22 nt, Homo sapiens
cagccaacuauggccuguggau

SEQ ID NO: 1982141 - RNA, 14 nt, Homo sapiens
ccagccagugccau

SEQ ID NO: 1982142 - RNA, 17 nt, Homo sapiens
agccucuacaccaacgc

SEQ ID NO: 1982143 - RNA, 20 nt, Homo sapiens
agagguggcugcugugcuag

SEQ ID NO: 1982144 - RNA, 21 nt, Homo sapiens
ccucuaguaaauuuaagucca

SEQ ID NO: 1982145 - RNA, 23 nt, Homo sapiens
cuuauuugggguugcaucagaaa

SEQ ID NO: 1982146 - RNA, 17 nt, Homo sapiens
cuccuggaucccuuuca

SEQ ID NO: 1982147 - RNA, 12 nt, Homo sapiens
gcaaaacccagg

SEQ ID NO: 1982148 - RNA, 12 nt, Homo sapiens
cauguuuuuacc

SEQ ID NO: 1982149 - RNA, 12 nt, Homo sapiens
cuggacugaccu

SEQ ID NO: 1982150 - RNA, 19 nt, Homo sapiens
uaaaacagaauauugacaa

SEQ ID NO: 1982151 - RNA, 13 nt, Homo sapiens
gccaucucagguu

SEQ ID NO: 1982152 - RNA, 16 nt, Homo sapiens
acauaaccaauuugua

SEQ ID NO: 1982153 - RNA, 17 nt, Homo sapiens
uauauacccacauguac

SEQ ID NO: 1982154 - RNA, 15 nt, Homo sapiens
cauggcaucaccucc

SEQ ID NO: 1982155 - RNA, 19 nt, Homo sapiens
cacauuuuuaaaagaacaa

SEQ ID NO: 1982156 - RNA, 17 nt, Homo sapiens
cugcuacacaaaagcca

SEQ ID NO: 1982157 - RNA, 20 nt, Homo sapiens
uuauuuagcccauaaucucu

SEQ ID NO: 1982158 - RNA, 22 nt, Homo sapiens
acauaaaauuuaaaaacuuaaa

SEQ ID NO: 1982159 - RNA, 20 nt, Homo sapiens
ucaagggauguauuggaaca

SEQ ID NO: 1982160 - RNA, 20 nt, Homo sapiens
ugccuuuaucugucuuuaug

SEQ ID NO: 1982161 - RNA, 19 nt, Homo sapiens
aaccauuuuuguuacucuc

SEQ ID NO: 1982162 - RNA, 21 nt, Homo sapiens
cagccuccacucccugucuga

SEQ ID NO: 1982163 - RNA, 20 nt, Homo sapiens
uccuaacccccuuacugugc

SEQ ID NO: 1982164 - RNA, 22 nt, Homo sapiens
aaaucuugguugaugccaaaaa

SEQ ID NO: 1982165 - RNA, 24 nt, Homo sapiens
ccagcggcccugucauccagcuca

SEQ ID NO: 1982166 - RNA, 20 nt, Homo sapiens
uggugaaaccccgucucuac

SEQ ID NO: 1982167 - RNA, 14 nt, Homo sapiens
aucuugaggacuuu

SEQ ID NO: 1982168 - RNA, 15 nt, Homo sapiens
aauucugauacauua

SEQ ID NO: 1982169 - RNA, 20 nt, Homo sapiens
gaaagaccaggccaauguca

SEQ ID NO: 1982170 - RNA, 23 nt, Homo sapiens
aagcaucuugcauuaugcaauuu

SEQ ID NO: 1982171 - RNA, 16 nt, Homo sapiens
uaucaugguagucacu

SEQ ID NO: 1982172 - RNA, 14 nt, Homo sapiens
uucaauacuuacau

SEQ ID NO: 1982173 - RNA, 17 nt, Homo sapiens
gaaaaaaauguacauuu

SEQ ID NO: 1982174 - RNA, 22 nt, Homo sapiens
cuggacuuuccuguugucuaca

SEQ ID NO: 1982175 - RNA, 17 nt, Homo sapiens
cuggaaacacagucacu

SEQ ID NO: 1982176 - RNA, 23 nt, Homo sapiens
uuccuuacucccaggcacugucu

SEQ ID NO: 1982177 - RNA, 18 nt, Homo sapiens
cuccaaaggcacugaccc

SEQ ID NO: 1982178 - RNA, 14 nt, Homo sapiens
acugggaccugagu

SEQ ID NO: 1982179 - RNA, 18 nt, Homo sapiens
ugccuugggcgggccauu

SEQ ID NO: 1982180 - RNA, 12 nt, Homo sapiens
uuagaaauggau

SEQ ID NO: 1982181 - RNA, 14 nt, Homo sapiens
cuaauaaugcugaa

SEQ ID NO: 1982182 - RNA, 15 nt, Homo sapiens
cuugcccaaguccca

SEQ ID NO: 1982183 - RNA, 18 nt, Homo sapiens
acuuuaacccucucuucc

SEQ ID NO: 1982184 - RNA, 23 nt, Homo sapiens
cauccuuaaaacaauucugugac

SEQ ID NO: 1982185 - RNA, 16 nt, Homo sapiens
uuaccaaggaugaauu

SEQ ID NO: 1982186 - RNA, 13 nt, Homo sapiens
acggacucagugg

SEQ ID NO: 1982187 - RNA, 21 nt, Homo sapiens
accguuuccuuucauuuacug

SEQ ID NO: 1982188 - RNA, 21 nt, Homo sapiens
gaacccugggaacaauuucca

SEQ ID NO: 1982189 - RNA, 13 nt, Homo sapiens
gagacaucaggga

SEQ ID NO: 1982190 - RNA, 15 nt, Homo sapiens
aagaaaauaucacuu

SEQ ID NO: 1982191 - RNA, 20 nt, Homo sapiens
gaauuauaauuaguuccuca

SEQ ID NO: 1982192 - RNA, 17 nt, Homo sapiens
uuuaagccgaagggcaa

SEQ ID NO: 1982193 - RNA, 20 nt, Homo sapiens
ccugaggccccaggugggaa

SEQ ID NO: 1982194 - RNA, 21 nt, Homo sapiens
agacagauucuucacuguguu

SEQ ID NO: 1982195 - RNA, 11 nt, Homo sapiens
cggcugcucag

SEQ ID NO: 1982196 - RNA, 16 nt, Homo sapiens
gagaccacggggagca

SEQ ID NO: 1982197 - RNA, 18 nt, Homo sapiens
ugaacagcagaaagacug

SEQ ID NO: 1982198 - RNA, 20 nt, Homo sapiens
ucuucaagucccaucauaga

SEQ ID NO: 1982199 - RNA, 19 nt, Homo sapiens
gccaguccugccuggccag

SEQ ID NO: 1982200 - RNA, 20 nt, Homo sapiens
uagaacaugugucuaucugc

SEQ ID NO: 1982201 - RNA, 15 nt, Homo sapiens
uuuaauuucuaugaa

SEQ ID NO: 1982202 - RNA, 17 nt, Homo sapiens
aggguggugaguagagc

SEQ ID NO: 1982203 - RNA, 16 nt, Homo sapiens
uacuaugcacaacaga

SEQ ID NO: 1982204 - RNA, 15 nt, Homo sapiens
cauuaaagagccauu

SEQ ID NO: 1982205 - RNA, 14 nt, Homo sapiens
ucugccuuagccua

SEQ ID NO: 1982206 - RNA, 17 nt, Homo sapiens
gaccucucucagcccca

SEQ ID NO: 1982207 - RNA, 22 nt, Homo sapiens
ucauaaaaauacaacagugcau

SEQ ID NO: 1982208 - RNA, 14 nt, Homo sapiens
uccauuuuacuucc

SEQ ID NO: 1982209 - RNA, 22 nt, Homo sapiens
uugggcagagcuggcucugagc

SEQ ID NO: 1982210 - RNA, 15 nt, Homo sapiens
ugguggagaaccaca

SEQ ID NO: 1982211 - RNA, 21 nt, Homo sapiens
uaggaagguacuguaugauca

SEQ ID NO: 1982212 - RNA, 20 nt, Homo sapiens
guguuuuguauuuaaagcau

SEQ ID NO: 1982213 - RNA, 21 nt, Homo sapiens
auaaguaacuugucaaggaau

SEQ ID NO: 1982214 - RNA, 15 nt, Homo sapiens
ucacuggaaagggga

SEQ ID NO: 1982215 - RNA, 21 nt, Homo sapiens
uauaggaaaaguuauugugau

SEQ ID NO: 1982216 - RNA, 24 nt, Homo sapiens
uccuguuagcuccucacuguggua

SEQ ID NO: 1982217 - RNA, 16 nt, Homo sapiens
gcugucuugugaucac

SEQ ID NO: 1982218 - RNA, 19 nt, Homo sapiens
guuugguuguaaaugcucg

SEQ ID NO: 1982219 - RNA, 19 nt, Homo sapiens
cauggucugcccucugcau

SEQ ID NO: 1982220 - RNA, 18 nt, Homo sapiens
uucccugcacacacaugc

SEQ ID NO: 1982221 - RNA, 23 nt, Homo sapiens
gucucacgggcaugggcacuccc

SEQ ID NO: 1982222 - RNA, 20 nt, Homo sapiens
ucuauaaguguucaguguug

SEQ ID NO: 1982223 - RNA, 22 nt, Homo sapiens
uaaaaauaaaaaacacugggag

SEQ ID NO: 1982224 - RNA, 15 nt, Homo sapiens
gaaugugaagcguua

SEQ ID NO: 1982225 - RNA, 14 nt, Homo sapiens
accacuuccugcua

SEQ ID NO: 1982226 - RNA, 13 nt, Homo sapiens
uaacuuauuuucc

SEQ ID NO: 1982227 - RNA, 12 nt, Homo sapiens
uauguagauaac

SEQ ID NO: 1982228 - RNA, 18 nt, Homo sapiens
auacaccauaugccucau

SEQ ID NO: 1982229 - RNA, 16 nt, Homo sapiens
ugacuucuccaggcag

SEQ ID NO: 1982230 - RNA, 20 nt, Homo sapiens
caggaagcugugagagcagu

SEQ ID NO: 1982231 - RNA, 16 nt, Homo sapiens
guuacauaacaagaaa

SEQ ID NO: 1982232 - RNA, 22 nt, Homo sapiens
guaaagaaaaaagcaccaaagg

SEQ ID NO: 1982233 - RNA, 13 nt, Homo sapiens
ucugcccaggugu

SEQ ID NO: 1982234 - RNA, 21 nt, Homo sapiens
acaaaaucaaauaauaccuua

SEQ ID NO: 1982235 - RNA, 22 nt, Homo sapiens
ccagacuucucccgugagccag

SEQ ID NO: 1982236 - RNA, 14 nt, Homo sapiens
agggcucuuugaug

SEQ ID NO: 1982237 - RNA, 13 nt, Homo sapiens
uaauuuuuggaga

SEQ ID NO: 1982238 - RNA, 16 nt, Homo sapiens
aaaguaaugguucuca

SEQ ID NO: 1982239 - RNA, 19 nt, Homo sapiens
agggaaacuggcugagggg

SEQ ID NO: 1982240 - RNA, 17 nt, Homo sapiens
ccugcagucagugcuaa

SEQ ID NO: 1982241 - RNA, 17 nt, Homo sapiens
auucuguuaaaacucaa

SEQ ID NO: 1982242 - RNA, 13 nt, Homo sapiens
ccagcaauuccau

SEQ ID NO: 1982243 - RNA, 20 nt, Homo sapiens
gaggacccucccagguuucc

SEQ ID NO: 1982244 - RNA, 20 nt, Homo sapiens
agggaggcgggggcugcccu

SEQ ID NO: 1982245 - RNA, 22 nt, Homo sapiens
uugaggggcuuugucagcauca

SEQ ID NO: 1982246 - RNA, 17 nt, Homo sapiens
acaauguuuuuuauacu

SEQ ID NO: 1982247 - RNA, 16 nt, Homo sapiens
gaggcaggagaauggc

SEQ ID NO: 1982248 - RNA, 16 nt, Homo sapiens
caaagggaacagugag

SEQ ID NO: 1982249 - RNA, 22 nt, Homo sapiens
aaaccauuuuugcugaauucau

SEQ ID NO: 1982250 - RNA, 19 nt, Homo sapiens
caccaacucugcacuccau

SEQ ID NO: 1982251 - RNA, 17 nt, Homo sapiens
ugggauguucagcacug

SEQ ID NO: 1982252 - RNA, 14 nt, Homo sapiens
aucuugaguauuua

SEQ ID NO: 1982253 - RNA, 16 nt, Homo sapiens
gcaucugcagccagca

SEQ ID NO: 1982254 - RNA, 16 nt, Homo sapiens
gaggauucugugccuc

SEQ ID NO: 1982255 - RNA, 14 nt, Homo sapiens
uaccuagcauuuca

SEQ ID NO: 1982256 - RNA, 13 nt, Homo sapiens
ucugcauggggcu

SEQ ID NO: 1982257 - RNA, 15 nt, Homo sapiens
gacauugcaccagau

SEQ ID NO: 1982258 - RNA, 14 nt, Homo sapiens
ggcucugacucugc

SEQ ID NO: 1982259 - RNA, 20 nt, Homo sapiens
gguggaucacaaggucaaga

SEQ ID NO: 1982260 - RNA, 15 nt, Homo sapiens
ccaagugaguugaau

SEQ ID NO: 1982261 - RNA, 21 nt, Homo sapiens
cugacuaaacuaccaccucag

SEQ ID NO: 1982262 - RNA, 17 nt, Homo sapiens
guuuuuggaguguuaug

SEQ ID NO: 1982263 - RNA, 22 nt, Homo sapiens
auagggguaagguaugggagag

SEQ ID NO: 1982264 - RNA, 23 nt, Homo sapiens
auacuugccugugacauuuugcc

SEQ ID NO: 1982265 - RNA, 21 nt, Homo sapiens
ccucuuguucuaaucuuguca

SEQ ID NO: 1982266 - RNA, 22 nt, Homo sapiens
caaacaaagaugccacauucaa

SEQ ID NO: 1982267 - RNA, 17 nt, Homo sapiens
gacuuuuauaugcuuuu

SEQ ID NO: 1982268 - RNA, 15 nt, Homo sapiens
uaaaauaaaccaaau

SEQ ID NO: 1982269 - RNA, 21 nt, Homo sapiens
ggcagugguguggagaagcca

SEQ ID NO: 1982270 - RNA, 18 nt, Homo sapiens
cuuucuuauuuuguaaua

SEQ ID NO: 1982271 - RNA, 17 nt, Homo sapiens
guuuuguaagaugcugg

SEQ ID NO: 1982272 - RNA, 18 nt, Homo sapiens
gggcugguagcucaggug

SEQ ID NO: 1982273 - RNA, 15 nt, Homo sapiens
ucccuggugcuuaug

SEQ ID NO: 1982274 - RNA, 13 nt, Homo sapiens
uauaaaauucuug

SEQ ID NO: 1982275 - RNA, 21 nt, Homo sapiens
ccucuccuuggaaauacuuua

SEQ ID NO: 1982276 - RNA, 14 nt, Homo sapiens
caauucauugugaa

SEQ ID NO: 1982277 - RNA, 21 nt, Homo sapiens
gaaauacaauauaucuugucu

SEQ ID NO: 1982278 - RNA, 19 nt, Homo sapiens
ggaggccuggggaggcccu

SEQ ID NO: 1982279 - RNA, 21 nt, Homo sapiens
uuuaauaucaacucucacucc

SEQ ID NO: 1982280 - RNA, 21 nt, Homo sapiens
aggcaauuucaccaccaaaug

SEQ ID NO: 1982281 - RNA, 22 nt, Homo sapiens
cuccaaaugcugacccaugcaa

SEQ ID NO: 1982282 - RNA, 11 nt, Homo sapiens
uauacagugcc

SEQ ID NO: 1982283 - RNA, 23 nt, Homo sapiens
gaugccucuugcagggucuugcu

SEQ ID NO: 1982284 - RNA, 19 nt, Homo sapiens
cauggcucccgaguacagu

SEQ ID NO: 1982285 - RNA, 21 nt, Homo sapiens
aaccguaugagggaacugugu

SEQ ID NO: 1982286 - RNA, 20 nt, Homo sapiens
cuggguccaggguaggcaag

SEQ ID NO: 1982287 - RNA, 20 nt, Homo sapiens
cuuauuauguaagggucauu

SEQ ID NO: 1982288 - RNA, 14 nt, Homo sapiens
gccccauuuaccca

SEQ ID NO: 1982289 - RNA, 14 nt, Homo sapiens
uaaaaguugcaaag

SEQ ID NO: 1982290 - RNA, 20 nt, Homo sapiens
ggaauaaccuuccauacauu

SEQ ID NO: 1982291 - RNA, 17 nt, Homo sapiens
gggugugacauauuuca

SEQ ID NO: 1982292 - RNA, 22 nt, Homo sapiens
auuuuuuuuaaagaagagugac

SEQ ID NO: 1982293 - RNA, 16 nt, Homo sapiens
acuagaagaaagggca

SEQ ID NO: 1982294 - RNA, 21 nt, Homo sapiens
aaagcacacucauccccucac

SEQ ID NO: 1982295 - RNA, 17 nt, Homo sapiens
gcauuugcccuguggau

SEQ ID NO: 1982296 - RNA, 19 nt, Homo sapiens
acuucuguccacucuggag

SEQ ID NO: 1982297 - RNA, 13 nt, Homo sapiens
augagccagcucu

SEQ ID NO: 1982298 - RNA, 19 nt, Homo sapiens
guuagaugcuuagugugaa

SEQ ID NO: 1982299 - RNA, 14 nt, Homo sapiens
ggcuagaagcacag

SEQ ID NO: 1982300 - RNA, 18 nt, Homo sapiens
auacugguuauaguugau

SEQ ID NO: 1982301 - RNA, 22 nt, Homo sapiens
aacagacggacagcguguggca

SEQ ID NO: 1982302 - RNA, 20 nt, Homo sapiens
cucuagcagagcaauuugau

SEQ ID NO: 1982303 - RNA, 15 nt, Homo sapiens
uucuguggcuaaaca

SEQ ID NO: 1982304 - RNA, 15 nt, Homo sapiens
gcgugugugcaagug

SEQ ID NO: 1982305 - RNA, 16 nt, Homo sapiens
uauacuuccaugcacu

SEQ ID NO: 1982306 - RNA, 18 nt, Homo sapiens
ucuugcuaucucucaaga

SEQ ID NO: 1982307 - RNA, 14 nt, Homo sapiens
ccugagagcuggcc

SEQ ID NO: 1982308 - RNA, 21 nt, Homo sapiens
aaggucaugccacugcacucu

SEQ ID NO: 1982309 - RNA, 15 nt, Homo sapiens
gacaaauaguaggcu

SEQ ID NO: 1982310 - RNA, 20 nt, Homo sapiens
ucauacaugcauacaaagag

SEQ ID NO: 1982311 - RNA, 20 nt, Homo sapiens
aaggcgcuuugaaacagggg

SEQ ID NO: 1982312 - RNA, 14 nt, Homo sapiens
gcugcuucugcaaa

SEQ ID NO: 1982313 - RNA, 23 nt, Homo sapiens
accugaacugggcagacugcaaa

SEQ ID NO: 1982314 - RNA, 17 nt, Homo sapiens
cugcccgcagaccucug

SEQ ID NO: 1982315 - RNA, 17 nt, Homo sapiens
auauguuuauguaacua

SEQ ID NO: 1982316 - RNA, 14 nt, Homo sapiens
cuucugcacacaaa

SEQ ID NO: 1982317 - RNA, 17 nt, Homo sapiens
uguugcgcucccaccuc

SEQ ID NO: 1982318 - RNA, 10 nt, Homo sapiens
ggaggcuugg

SEQ ID NO: 1982319 - RNA, 15 nt, Homo sapiens
ugauuaaacagcaaa

SEQ ID NO: 1982320 - RNA, 17 nt, Homo sapiens
uaaauuacacauguaga

SEQ ID NO: 1982321 - RNA, 22 nt, Homo sapiens
caaccccgaggggcuugcaggg

SEQ ID NO: 1982322 - RNA, 19 nt, Homo sapiens
aaagaaggcuggcugaaag

SEQ ID NO: 1982323 - RNA, 23 nt, Homo sapiens
ucccgaaugaagcguugccauug

SEQ ID NO: 1982324 - RNA, 18 nt, Homo sapiens
ccccucaacacccugcuu

SEQ ID NO: 1982325 - RNA, 22 nt, Homo sapiens
ucaggugaucuaccugccucag

SEQ ID NO: 1982326 - RNA, 19 nt, Homo sapiens
aggcauaugcacagucaag

SEQ ID NO: 1982327 - RNA, 11 nt, Homo sapiens
uguuggucugu

SEQ ID NO: 1982328 - RNA, 21 nt, Homo sapiens
aacaauacaugcugcuaauuc

SEQ ID NO: 1982329 - RNA, 14 nt, Homo sapiens
ucuaucugugaacg

SEQ ID NO: 1982330 - RNA, 18 nt, Homo sapiens
gaccucgugaucuaccca

SEQ ID NO: 1982331 - RNA, 22 nt, Homo sapiens
gcugcucacauucugagaaaca

SEQ ID NO: 1982332 - RNA, 23 nt, Homo sapiens
augcacugugacaccagaauaau

SEQ ID NO: 1982333 - RNA, 18 nt, Homo sapiens
ugauuuugaccaaugccu

SEQ ID NO: 1982334 - RNA, 17 nt, Homo sapiens
uaagauuauagauucua

SEQ ID NO: 1982335 - RNA, 21 nt, Homo sapiens
cuguggugcccucugacaagg

SEQ ID NO: 1982336 - RNA, 17 nt, Homo sapiens
aggaaccaggaggacaa

SEQ ID NO: 1982337 - RNA, 14 nt, Homo sapiens
aagcacuguguuua

SEQ ID NO: 1982338 - RNA, 17 nt, Homo sapiens
gacuugauugguuuaaa

SEQ ID NO: 1982339 - RNA, 14 nt, Homo sapiens
augagccacugcac

SEQ ID NO: 1982340 - RNA, 14 nt, Homo sapiens
aauagacacaucaa

SEQ ID NO: 1982341 - RNA, 15 nt, Homo sapiens
gggcagagccaggaa

SEQ ID NO: 1982342 - RNA, 16 nt, Homo sapiens
aguaugggcacucagg

SEQ ID NO: 1982343 - RNA, 20 nt, Homo sapiens
guaaacuucugcaacaagca

SEQ ID NO: 1982344 - RNA, 22 nt, Homo sapiens
ucaccaaaauagucuucucaaa

SEQ ID NO: 1982345 - RNA, 15 nt, Homo sapiens
cggggagcaaaccag

SEQ ID NO: 1982346 - RNA, 17 nt, Homo sapiens
gacgggugggaaugacc

SEQ ID NO: 1982347 - RNA, 13 nt, Homo sapiens
uguucuucccagg

SEQ ID NO: 1982348 - RNA, 16 nt, Homo sapiens
aucuguuugacagucu

SEQ ID NO: 1982349 - RNA, 16 nt, Homo sapiens
uaccaaaauuauuuca

SEQ ID NO: 1982350 - RNA, 12 nt, Homo sapiens
gcaucauuucag

SEQ ID NO: 1982351 - RNA, 12 nt, Homo sapiens
guagcauuuuau

SEQ ID NO: 1982352 - RNA, 18 nt, Homo sapiens
ggaaaauauguaacugga

SEQ ID NO: 1982353 - RNA, 21 nt, Homo sapiens
gaauggacgugcugggaccaa

SEQ ID NO: 1982354 - RNA, 20 nt, Homo sapiens
auaaguaucacacuguauau

SEQ ID NO: 1982355 - RNA, 13 nt, Homo sapiens
uaaaaaauggaac

SEQ ID NO: 1982356 - RNA, 19 nt, Homo sapiens
gaggcuacagggccaaacg

SEQ ID NO: 1982357 - RNA, 19 nt, Homo sapiens
cuggacucuaaagaccaaa

SEQ ID NO: 1982358 - RNA, 14 nt, Homo sapiens
gagcaaacauuuua

SEQ ID NO: 1982359 - RNA, 23 nt, Homo sapiens
gcucccccucccccacugccaua

SEQ ID NO: 1982360 - RNA, 21 nt, Homo sapiens
aggcagccuggaccacuccuc

SEQ ID NO: 1982361 - RNA, 19 nt, Homo sapiens
gcaauaaauaacacuuguc

SEQ ID NO: 1982362 - RNA, 18 nt, Homo sapiens
cauggugcagggagacau

SEQ ID NO: 1982363 - RNA, 17 nt, Homo sapiens
cuggaaaaggagcuuca

SEQ ID NO: 1982364 - RNA, 14 nt, Homo sapiens
augcucauaccucu

SEQ ID NO: 1982365 - RNA, 17 nt, Homo sapiens
agacuguagggaugaaa

SEQ ID NO: 1982366 - RNA, 20 nt, Homo sapiens
agccuggccccggccuuuau

SEQ ID NO: 1982367 - RNA, 21 nt, Homo sapiens
uuaaugagggaaaauguuuac

SEQ ID NO: 1982368 - RNA, 18 nt, Homo sapiens
cggcucaugccuguaauc

SEQ ID NO: 1982369 - RNA, 23 nt, Homo sapiens
cuucuucacuuacccauuagcca

SEQ ID NO: 1982370 - RNA, 17 nt, Homo sapiens
cuuaguauuaacagaaa

SEQ ID NO: 1982371 - RNA, 15 nt, Homo sapiens
cuguugucaaaaagu

SEQ ID NO: 1982372 - RNA, 21 nt, Homo sapiens
agcccagacgauggcacaaac

SEQ ID NO: 1982373 - RNA, 22 nt, Homo sapiens
ggagcagaggcccuucacccag

SEQ ID NO: 1982374 - RNA, 19 nt, Homo sapiens
ccgacaacagagacuggac

SEQ ID NO: 1982375 - RNA, 21 nt, Homo sapiens
agauacccaucuugaaaaaca

SEQ ID NO: 1982376 - RNA, 14 nt, Homo sapiens
gccaagaaagcuau

SEQ ID NO: 1982377 - RNA, 13 nt, Homo sapiens
aagcaggugcuac

SEQ ID NO: 1982378 - RNA, 15 nt, Homo sapiens
gacaugggggugcca

SEQ ID NO: 1982379 - RNA, 18 nt, Homo sapiens
auguuuggaauaaaguca

SEQ ID NO: 1982380 - RNA, 16 nt, Homo sapiens
uaucacaauguacuau

SEQ ID NO: 1982381 - RNA, 16 nt, Homo sapiens
auuuuucagcacuuaa

SEQ ID NO: 1982382 - RNA, 19 nt, Homo sapiens
ucuauggauuuaauaccau

SEQ ID NO: 1982383 - RNA, 22 nt, Homo sapiens
guagggcuggggagucgugaac

SEQ ID NO: 1982384 - RNA, 18 nt, Homo sapiens
gaaugaaaggcaaugaca

SEQ ID NO: 1982385 - RNA, 20 nt, Homo sapiens
aacugcuuccuuucuugauu

SEQ ID NO: 1982386 - RNA, 12 nt, Homo sapiens
aaauuagucacu

SEQ ID NO: 1982387 - RNA, 22 nt, Homo sapiens
gugacuaaaaaugcaucuggcu

SEQ ID NO: 1982388 - RNA, 17 nt, Homo sapiens
aaaaugcaccacuuuuu

SEQ ID NO: 1982389 - RNA, 18 nt, Homo sapiens
gcagggcuggucuugggg

SEQ ID NO: 1982390 - RNA, 23 nt, Homo sapiens
uaaaugaaauuguaaaaccuguc

SEQ ID NO: 1982391 - RNA, 18 nt, Homo sapiens
uaaacucaagacaaugca

SEQ ID NO: 1982392 - RNA, 22 nt, Homo sapiens
uggaagacagagaccuccugcc

SEQ ID NO: 1982393 - RNA, 23 nt, Homo sapiens
gaggcgggaguggaguggaagaa

SEQ ID NO: 1982394 - RNA, 22 nt, Homo sapiens
cuaauuuuucaacuuggaucau

SEQ ID NO: 1982395 - RNA, 17 nt, Homo sapiens
aacuugaagucuugaaa

SEQ ID NO: 1982396 - RNA, 17 nt, Homo sapiens
cuaaauaagaaaauaac

SEQ ID NO: 1982397 - RNA, 23 nt, Homo sapiens
uuggaaaaauucauugucucuag

SEQ ID NO: 1982398 - RNA, 22 nt, Homo sapiens
gaaauuacuggagccaugucua

SEQ ID NO: 1982399 - RNA, 22 nt, Homo sapiens
ugucaaagugaaagacauuuca

SEQ ID NO: 1982400 - RNA, 22 nt, Homo sapiens
gaggugcgcgacgggcacagug

SEQ ID NO: 1982401 - RNA, 12 nt, Homo sapiens
cagggagggaag

SEQ ID NO: 1982402 - RNA, 18 nt, Homo sapiens
gcccacuagagggcccau

SEQ ID NO: 1982403 - RNA, 15 nt, Homo sapiens
uguggguaccuguau

SEQ ID NO: 1982404 - RNA, 22 nt, Homo sapiens
aguuccgccucccggguucaca

SEQ ID NO: 1982405 - RNA, 18 nt, Homo sapiens
cugaugagagagugcuga

SEQ ID NO: 1982406 - RNA, 18 nt, Homo sapiens
agauuguauagugcaugu

SEQ ID NO: 1982407 - RNA, 19 nt, Homo sapiens
uguacagaaacaacugcca

SEQ ID NO: 1982408 - RNA, 16 nt, Homo sapiens
cgugucucauuugcca

SEQ ID NO: 1982409 - RNA, 14 nt, Homo sapiens
cuuauggaacugag

SEQ ID NO: 1982410 - RNA, 18 nt, Homo sapiens
guauuauuuaguaaaauu

SEQ ID NO: 1982411 - RNA, 16 nt, Homo sapiens
ucuggaauacaugaaa

SEQ ID NO: 1982412 - RNA, 12 nt, Homo sapiens
cuuaaugcaaau

SEQ ID NO: 1982413 - RNA, 15 nt, Homo sapiens
ccaugccaugaauga

SEQ ID NO: 1982414 - RNA, 15 nt, Homo sapiens
aucgacuaagacuuu

SEQ ID NO: 1982415 - RNA, 14 nt, Homo sapiens
ucagauccuccuca

SEQ ID NO: 1982416 - RNA, 12 nt, Homo sapiens
acuucucuccag

SEQ ID NO: 1982417 - RNA, 16 nt, Homo sapiens
uuagaaccacagcaga

SEQ ID NO: 1982418 - RNA, 16 nt, Homo sapiens
ucugcccagaauucua

SEQ ID NO: 1982419 - RNA, 14 nt, Homo sapiens
gaagauuucagagg

SEQ ID NO: 1982420 - RNA, 20 nt, Homo sapiens
ugucaguuugugaagugauu

SEQ ID NO: 1982421 - RNA, 14 nt, Homo sapiens
auagaccuaugaua

SEQ ID NO: 1982422 - RNA, 18 nt, Homo sapiens
aucugagcucuuaucuau

SEQ ID NO: 1982423 - RNA, 21 nt, Homo sapiens
aaaguauuuugaaguuuacau

SEQ ID NO: 1982424 - RNA, 13 nt, Homo sapiens
aggccaacaaacc

SEQ ID NO: 1982425 - RNA, 17 nt, Homo sapiens
augcaaugccucuggaa

SEQ ID NO: 1982426 - RNA, 17 nt, Homo sapiens
gacauaaguucauucau

SEQ ID NO: 1982427 - RNA, 18 nt, Homo sapiens
uucuugccuugaguucca

SEQ ID NO: 1982428 - RNA, 17 nt, Homo sapiens
cuucagucucacagaga

SEQ ID NO: 1982429 - RNA, 15 nt, Homo sapiens
gaauaagcacuugaa

SEQ ID NO: 1982430 - RNA, 19 nt, Homo sapiens
uaucaaccccagacacugg

SEQ ID NO: 1982431 - RNA, 14 nt, Homo sapiens
augcugcuuugcac

SEQ ID NO: 1982432 - RNA, 12 nt, Homo sapiens
agggaacagcaa

SEQ ID NO: 1982433 - RNA, 14 nt, Homo sapiens
aguugcugucaucc

SEQ ID NO: 1982434 - RNA, 17 nt, Homo sapiens
uuacaugaagcuguaua

SEQ ID NO: 1982435 - RNA, 19 nt, Homo sapiens
cuaggcccugugagcacaa

SEQ ID NO: 1982436 - RNA, 21 nt, Homo sapiens
auagcacaugauuugggcucu

SEQ ID NO: 1982437 - RNA, 15 nt, Homo sapiens
uucuaaacggugacc

SEQ ID NO: 1982438 - RNA, 18 nt, Homo sapiens
cuucagugaaauuuucag

SEQ ID NO: 1982439 - RNA, 22 nt, Homo sapiens
gacaaagcgugguggacaugca

SEQ ID NO: 1982440 - RNA, 14 nt, Homo sapiens
uaaggauuuuucaa

SEQ ID NO: 1982441 - RNA, 21 nt, Homo sapiens
ucaguucauggcaucacaucu

SEQ ID NO: 1982442 - RNA, 11 nt, Homo sapiens
uuucauuccau

SEQ ID NO: 1982443 - RNA, 21 nt, Homo sapiens
ucuuucaggacucuaccucau

SEQ ID NO: 1982444 - RNA, 19 nt, Homo sapiens
agagugaauacacuggaau

SEQ ID NO: 1982445 - RNA, 18 nt, Homo sapiens
acguaauuuguuauauca

SEQ ID NO: 1982446 - RNA, 12 nt, Homo sapiens
aauccuugagaa

SEQ ID NO: 1982447 - RNA, 15 nt, Homo sapiens
gcuagucacuggaaa

SEQ ID NO: 1982448 - RNA, 21 nt, Homo sapiens
cucagaguccacuguggcacu

SEQ ID NO: 1982449 - RNA, 16 nt, Homo sapiens
auacaugacugcaacu

SEQ ID NO: 1982450 - RNA, 18 nt, Homo sapiens
uuucccaaagccagaacc

SEQ ID NO: 1982451 - RNA, 21 nt, Homo sapiens
cacagaacuauguacuuuaaa

SEQ ID NO: 1982452 - RNA, 21 nt, Homo sapiens
uagaugcacuaccauugcugu

SEQ ID NO: 1982453 - RNA, 18 nt, Homo sapiens
uuggaaaaaaaccacagc

SEQ ID NO: 1982454 - RNA, 19 nt, Homo sapiens
cagcacuccaucacugaga

SEQ ID NO: 1982455 - RNA, 13 nt, Homo sapiens
cauuguucaggaa

SEQ ID NO: 1982456 - RNA, 16 nt, Homo sapiens
cuaaauaccugcccug

SEQ ID NO: 1982457 - RNA, 21 nt, Homo sapiens
aacaccuuccuccugcagaca

SEQ ID NO: 1982458 - RNA, 16 nt, Homo sapiens
ucuacauccaauguau

SEQ ID NO: 1982459 - RNA, 16 nt, Homo sapiens
caguccauuuccuaau

SEQ ID NO: 1982460 - RNA, 21 nt, Homo sapiens
caugggccagcccuugcucua

SEQ ID NO: 1982461 - RNA, 15 nt, Homo sapiens
aggaguaguggcccu

SEQ ID NO: 1982462 - RNA, 22 nt, Homo sapiens
uaaaaugaauuuguuguuccuu

SEQ ID NO: 1982463 - RNA, 16 nt, Homo sapiens
gcccugcagagcaaua

SEQ ID NO: 1982464 - RNA, 16 nt, Homo sapiens
guccccagcauugcag

SEQ ID NO: 1982465 - RNA, 20 nt, Homo sapiens
guuggagccugcucuuugaa

SEQ ID NO: 1982466 - RNA, 12 nt, Homo sapiens
cuugaaaacugc

SEQ ID NO: 1982467 - RNA, 22 nt, Homo sapiens
uaacucauccguuugccaauca

SEQ ID NO: 1982468 - RNA, 17 nt, Homo sapiens
auaauuacaaugcacaa

SEQ ID NO: 1982469 - RNA, 20 nt, Homo sapiens
ccaugcaggggccacaucca

SEQ ID NO: 1982470 - RNA, 18 nt, Homo sapiens
cuccugugcuuucccuga

SEQ ID NO: 1982471 - RNA, 13 nt, Homo sapiens
ugacaaugaccaa

SEQ ID NO: 1982472 - RNA, 15 nt, Homo sapiens
ggaaagaaccgaaga

SEQ ID NO: 1982473 - RNA, 11 nt, Homo sapiens
acaucugucac

SEQ ID NO: 1982474 - RNA, 13 nt, Homo sapiens
uccuuacugauau

SEQ ID NO: 1982475 - RNA, 22 nt, Homo sapiens
aacacuuucccaugagugugau

SEQ ID NO: 1982476 - RNA, 10 nt, Homo sapiens
aauguacaaa

SEQ ID NO: 1982477 - RNA, 15 nt, Homo sapiens
agagaggacuguuga

SEQ ID NO: 1982478 - RNA, 12 nt, Homo sapiens
acugugugcuca

SEQ ID NO: 1982479 - RNA, 16 nt, Homo sapiens
gaggaaacugcacugu

SEQ ID NO: 1982480 - RNA, 15 nt, Homo sapiens
ugcuggaaagggagg

SEQ ID NO: 1982481 - RNA, 15 nt, Homo sapiens
ccuuaacacacuggc

SEQ ID NO: 1982482 - RNA, 22 nt, Homo sapiens
gcacuaagucaugguccuggcu

SEQ ID NO: 1982483 - RNA, 20 nt, Homo sapiens
acggaaaugcaguacuguaa

SEQ ID NO: 1982484 - RNA, 13 nt, Homo sapiens
acuggcugugaga

SEQ ID NO: 1982485 - RNA, 16 nt, Homo sapiens
agggagggccuugauu

SEQ ID NO: 1982486 - RNA, 21 nt, Homo sapiens
cuggcuuccuuggcuugccug

SEQ ID NO: 1982487 - RNA, 13 nt, Homo sapiens
gcuaaacauguga

SEQ ID NO: 1982488 - RNA, 20 nt, Homo sapiens
uauuuguacaccaauauuca

SEQ ID NO: 1982489 - RNA, 14 nt, Homo sapiens
uacuaaagugucua

SEQ ID NO: 1982490 - RNA, 23 nt, Homo sapiens
auuucuuuucucuuuaaucuccu

SEQ ID NO: 1982491 - RNA, 20 nt, Homo sapiens
ucucaggggccaacuaggca

SEQ ID NO: 1982492 - RNA, 14 nt, Homo sapiens
ucccagcaccugcc

SEQ ID NO: 1982493 - RNA, 20 nt, Homo sapiens
cagacucuagugcuacauga

SEQ ID NO: 1982494 - RNA, 19 nt, Homo sapiens
acugagaugugaacacauc

SEQ ID NO: 1982495 - RNA, 23 nt, Homo sapiens
uuccuacgccuugucauuggaaa

SEQ ID NO: 1982496 - RNA, 15 nt, Homo sapiens
aaggaaguacugcac

SEQ ID NO: 1982497 - RNA, 16 nt, Homo sapiens
caaccaggauccugau

SEQ ID NO: 1982498 - RNA, 17 nt, Homo sapiens
aggcauuuccugcugaa

SEQ ID NO: 1982499 - RNA, 19 nt, Homo sapiens
cuguggcuuuuuguucaga

SEQ ID NO: 1982500 - RNA, 23 nt, Homo sapiens
ccagaacaaauuuuaacaaaagg

SEQ ID NO: 1982501 - RNA, 20 nt, Homo sapiens
gcugggaguagcauggacuc

SEQ ID NO: 1982502 - RNA, 21 nt, Homo sapiens
ucucacacaucacauucccau

SEQ ID NO: 1982503 - RNA, 21 nt, Homo sapiens
uaugagaagaaaaauggaaaa

SEQ ID NO: 1982504 - RNA, 16 nt, Homo sapiens
auuauuuucugucaga

SEQ ID NO: 1982505 - RNA, 21 nt, Homo sapiens
acaaaagaaggucaaacugug

SEQ ID NO: 1982506 - RNA, 17 nt, Homo sapiens
auugcuggaaaccaagu

SEQ ID NO: 1982507 - RNA, 18 nt, Homo sapiens
ucaggguguuaaggcagu

SEQ ID NO: 1982508 - RNA, 15 nt, Homo sapiens
acugcucugaugaag

SEQ ID NO: 1982509 - RNA, 18 nt, Homo sapiens
cugcggguccucagcugc

SEQ ID NO: 1982510 - RNA, 15 nt, Homo sapiens
uucagaagacacugc

SEQ ID NO: 1982511 - RNA, 16 nt, Homo sapiens
ucuuuaaccucaucua

SEQ ID NO: 1982512 - RNA, 16 nt, Homo sapiens
auuuuacuuccaugau

SEQ ID NO: 1982513 - RNA, 16 nt, Homo sapiens
augaaaccagaaggau

SEQ ID NO: 1982514 - RNA, 13 nt, Homo sapiens
ggaaggugccacu

SEQ ID NO: 1982515 - RNA, 14 nt, Homo sapiens
caugcaaggugccc

SEQ ID NO: 1982516 - RNA, 23 nt, Homo sapiens
uuacaauauuaugaaauuucacu

SEQ ID NO: 1982517 - RNA, 16 nt, Homo sapiens
gucauaucuucacaau

SEQ ID NO: 1982518 - RNA, 16 nt, Homo sapiens
gagaacacugugcucu

SEQ ID NO: 1982519 - RNA, 15 nt, Homo sapiens
aaccaagcaaaggaa

SEQ ID NO: 1982520 - RNA, 14 nt, Homo sapiens
aauaaaagcacuua

SEQ ID NO: 1982521 - RNA, 17 nt, Homo sapiens
cuguugguccacugugu

SEQ ID NO: 1982522 - RNA, 12 nt, Homo sapiens
aaccccagugga

SEQ ID NO: 1982523 - RNA, 15 nt, Homo sapiens
ggcuaaaaccaucau

SEQ ID NO: 1982524 - RNA, 22 nt, Homo sapiens
aaaguugcauguuaugugaguc

SEQ ID NO: 1982525 - RNA, 23 nt, Homo sapiens
auagaaggaggagagggaaaaug

SEQ ID NO: 1982526 - RNA, 17 nt, Homo sapiens
cuuugccagcagagcca

SEQ ID NO: 1982527 - RNA, 16 nt, Homo sapiens
cauuaccuugugcuaa

SEQ ID NO: 1982528 - RNA, 22 nt, Homo sapiens
ugaauuuaagcaugaguggccu

SEQ ID NO: 1982529 - RNA, 20 nt, Homo sapiens
ucugaggaguggaguucucu

SEQ ID NO: 1982530 - RNA, 18 nt, Homo sapiens
gcuucaccgcauuccagg

SEQ ID NO: 1982531 - RNA, 15 nt, Homo sapiens
gccuuagggauacag

SEQ ID NO: 1982532 - RNA, 13 nt, Homo sapiens
cuuugaauguggc

SEQ ID NO: 1982533 - RNA, 15 nt, Homo sapiens
ccagcagcucaagaa

SEQ ID NO: 1982534 - RNA, 18 nt, Homo sapiens
ggcugguagagcagguga

SEQ ID NO: 1982535 - RNA, 19 nt, Homo sapiens
gagaauggcuuuggucucu

SEQ ID NO: 1982536 - RNA, 14 nt, Homo sapiens
ggagugguugcuau

SEQ ID NO: 1982537 - RNA, 16 nt, Homo sapiens
gaagugacaagaugcu

SEQ ID NO: 1982538 - RNA, 21 nt, Homo sapiens
auguauaaacauaaguugcau

SEQ ID NO: 1982539 - RNA, 19 nt, Homo sapiens
uuuggccuaacccucagaa

SEQ ID NO: 1982540 - RNA, 16 nt, Homo sapiens
cauguuguaaugcugc

SEQ ID NO: 1982541 - RNA, 15 nt, Homo sapiens
uauuuacaagggaag

SEQ ID NO: 1982542 - RNA, 19 nt, Homo sapiens
acauugauuuuucuauaau

SEQ ID NO: 1982543 - RNA, 23 nt, Homo sapiens
aaggauucugcagaaaaaaaaga

SEQ ID NO: 1982544 - RNA, 16 nt, Homo sapiens
uccgucuucacacugc

SEQ ID NO: 1982545 - RNA, 15 nt, Homo sapiens
aaaguaagacacaaa

SEQ ID NO: 1982546 - RNA, 14 nt, Homo sapiens
aaugaucacauucu

SEQ ID NO: 1982547 - RNA, 21 nt, Homo sapiens
ggaaucacaaaccaagccaug

SEQ ID NO: 1982548 - RNA, 21 nt, Homo sapiens
acacauugaaugcgcuuuauu

SEQ ID NO: 1982549 - RNA, 14 nt, Homo sapiens
cuauaaauggacuu

SEQ ID NO: 1982550 - RNA, 21 nt, Homo sapiens
gcuauuaagaauuuaagacuu

SEQ ID NO: 1982551 - RNA, 16 nt, Homo sapiens
acagaaccacagggcu

SEQ ID NO: 1982552 - RNA, 19 nt, Homo sapiens
auuauauuuuuccugggau

SEQ ID NO: 1982553 - RNA, 16 nt, Homo sapiens
caggcagccagcaucu

SEQ ID NO: 1982554 - RNA, 15 nt, Homo sapiens
caauccccagcccuu

SEQ ID NO: 1982555 - RNA, 17 nt, Homo sapiens
ugugaagccagaucucg

SEQ ID NO: 1982556 - RNA, 14 nt, Homo sapiens
agccucugaauaug

SEQ ID NO: 1982557 - RNA, 21 nt, Homo sapiens
uaaacaccauagggacccauu

SEQ ID NO: 1982558 - RNA, 20 nt, Homo sapiens
gaagugcccucgagcacuga

SEQ ID NO: 1982559 - RNA, 20 nt, Homo sapiens
cuuuuuuagaaaugcaaaau

SEQ ID NO: 1982560 - RNA, 21 nt, Homo sapiens
acaaaugaucgcuaucuagca

SEQ ID NO: 1982561 - RNA, 14 nt, Homo sapiens
guaugcucauacuu

SEQ ID NO: 1982562 - RNA, 20 nt, Homo sapiens
uuaaaguuucauuagucaua

SEQ ID NO: 1982563 - RNA, 23 nt, Homo sapiens
aaacagaacugcagucagcauga

SEQ ID NO: 1982564 - RNA, 19 nt, Homo sapiens
aucuauugcagauauuuga

SEQ ID NO: 1982565 - RNA, 22 nt, Homo sapiens
cuuuuaggauguaacuuuauaa

SEQ ID NO: 1982566 - RNA, 18 nt, Homo sapiens
cugcagccaggacugggg

SEQ ID NO: 1982567 - RNA, 19 nt, Homo sapiens
uccuaggagagccaaccuc

SEQ ID NO: 1982568 - RNA, 21 nt, Homo sapiens
aacugcuucccuuacuuugcu

SEQ ID NO: 1982569 - RNA, 17 nt, Homo sapiens
ccagugaguaccugcaa

SEQ ID NO: 1982570 - RNA, 20 nt, Homo sapiens
cuccgugcuuaaccaaagaa

SEQ ID NO: 1982571 - RNA, 18 nt, Homo sapiens
agguggagguugugcaug

SEQ ID NO: 1982572 - RNA, 19 nt, Homo sapiens
aggaugaaggcaaugccau

SEQ ID NO: 1982573 - RNA, 19 nt, Homo sapiens
gaaaugagauacauucccg

SEQ ID NO: 1982574 - RNA, 16 nt, Homo sapiens
auaaaugagcaaauau

SEQ ID NO: 1982575 - RNA, 21 nt, Homo sapiens
cccuggugggccaacaaagaa

SEQ ID NO: 1982576 - RNA, 12 nt, Homo sapiens
agcagucagggu

SEQ ID NO: 1982577 - RNA, 17 nt, Homo sapiens
gucuacauugagcauuu

SEQ ID NO: 1982578 - RNA, 21 nt, Homo sapiens
aacagugacuugauugccaag

SEQ ID NO: 1982579 - RNA, 19 nt, Homo sapiens
guugcacacccacucagcu

SEQ ID NO: 1982580 - RNA, 17 nt, Homo sapiens
ccaaguugcagugagca

SEQ ID NO: 1982581 - RNA, 13 nt, Homo sapiens
ggaagacuugaag

SEQ ID NO: 1982582 - RNA, 21 nt, Homo sapiens
uaccugucauuuugcacugua

SEQ ID NO: 1982583 - RNA, 17 nt, Homo sapiens
agcagugcuuuucacua

SEQ ID NO: 1982584 - RNA, 14 nt, Homo sapiens
agucaucaggugug

SEQ ID NO: 1982585 - RNA, 15 nt, Homo sapiens
ccaucuucuuuauac

SEQ ID NO: 1982586 - RNA, 20 nt, Homo sapiens
acacagccuuccuucugcuc

SEQ ID NO: 1982587 - RNA, 19 nt, Homo sapiens
aaucugcuuuguuaaugaa

SEQ ID NO: 1982588 - RNA, 17 nt, Homo sapiens
gcuuuggaugucuuugc

SEQ ID NO: 1982589 - RNA, 18 nt, Homo sapiens
uggcgcaggugccaugcc

SEQ ID NO: 1982590 - RNA, 17 nt, Homo sapiens
caaauaaguuacaucua

SEQ ID NO: 1982591 - RNA, 21 nt, Homo sapiens
gccuccucucucaaacugggg

SEQ ID NO: 1982592 - RNA, 15 nt, Homo sapiens
uguagugcuacaggg

SEQ ID NO: 1982593 - RNA, 15 nt, Homo sapiens
cagaguccuuuccaa

SEQ ID NO: 1982594 - RNA, 15 nt, Homo sapiens
auuuugcagcaguga

SEQ ID NO: 1982595 - RNA, 22 nt, Homo sapiens
agaggaaccguuuuacacugga

SEQ ID NO: 1982596 - RNA, 17 nt, Homo sapiens
uuuacucaucaggucau

SEQ ID NO: 1982597 - RNA, 14 nt, Homo sapiens
uaugaaaacugaag

SEQ ID NO: 1982598 - RNA, 21 nt, Homo sapiens
ugugauuugguugcacuuuag

SEQ ID NO: 1982599 - RNA, 20 nt, Homo sapiens
ccucucaacauuaccaaaau

SEQ ID NO: 1982600 - RNA, 12 nt, Homo sapiens
ccuuuguuucaa

SEQ ID NO: 1982601 - RNA, 12 nt, Homo sapiens
cauuuguuuaaa

SEQ ID NO: 1982602 - RNA, 14 nt, Homo sapiens
ggacaaacagggaa

SEQ ID NO: 1982603 - RNA, 18 nt, Homo sapiens
guccccuaaaccaaaaac

SEQ ID NO: 1982604 - RNA, 19 nt, Homo sapiens
ugagcacaaagguagcuuu

SEQ ID NO: 1982605 - RNA, 21 nt, Homo sapiens
aaccuguuuccuggaccagug

SEQ ID NO: 1982606 - RNA, 20 nt, Homo sapiens
gcccagaucucugcaucucu

SEQ ID NO: 1982607 - RNA, 15 nt, Homo sapiens
uaauacccacauuac

SEQ ID NO: 1982608 - RNA, 21 nt, Homo sapiens
cucaaucaugggaauuuuaac

SEQ ID NO: 1982609 - RNA, 17 nt, Homo sapiens
agagcccucagaaccau

SEQ ID NO: 1982610 - RNA, 13 nt, Homo sapiens
agguaugguggca

SEQ ID NO: 1982611 - RNA, 21 nt, Homo sapiens
ccaccucccugccuccaggaa

SEQ ID NO: 1982612 - RNA, 15 nt, Homo sapiens
ccuugaaacaguucc

SEQ ID NO: 1982613 - RNA, 12 nt, Homo sapiens
uauuuugaacaa

SEQ ID NO: 1982614 - RNA, 18 nt, Homo sapiens
uaaaaaaaaaaacuguug

SEQ ID NO: 1982615 - RNA, 15 nt, Homo sapiens
augcucgugugauuu

SEQ ID NO: 1982616 - RNA, 14 nt, Homo sapiens
caggugugggcucc

SEQ ID NO: 1982617 - RNA, 19 nt, Homo sapiens
uaagauccacaaaugaagg

SEQ ID NO: 1982618 - RNA, 22 nt, Homo sapiens
cacugcaggcaugcugaacaag

SEQ ID NO: 1982619 - RNA, 22 nt, Homo sapiens
ccccuuaaggguugaaggcagu

SEQ ID NO: 1982620 - RNA, 19 nt, Homo sapiens
ucaaaccaaaucacugaac

SEQ ID NO: 1982621 - RNA, 18 nt, Homo sapiens
cuggccucaagugagcca

SEQ ID NO: 1982622 - RNA, 23 nt, Homo sapiens
agcaacccugugauacuauuacc

SEQ ID NO: 1982623 - RNA, 15 nt, Homo sapiens
caauagugucauccu

SEQ ID NO: 1982624 - RNA, 23 nt, Homo sapiens
auuagcuaaaaccuuccauguca

SEQ ID NO: 1982625 - RNA, 17 nt, Homo sapiens
uggaccauggaguggca

SEQ ID NO: 1982626 - RNA, 18 nt, Homo sapiens
uuacuugaagacugugaa

SEQ ID NO: 1982627 - RNA, 17 nt, Homo sapiens
uaugcacacacauauau

SEQ ID NO: 1982628 - RNA, 15 nt, Homo sapiens
cccagagccacagaa

SEQ ID NO: 1982629 - RNA, 21 nt, Homo sapiens
acuuguuucaccauacuucau

SEQ ID NO: 1982630 - RNA, 16 nt, Homo sapiens
uaaacucucuagcuua

SEQ ID NO: 1982631 - RNA, 16 nt, Homo sapiens
guaaaaggccaaaccu

SEQ ID NO: 1982632 - RNA, 24 nt, Homo sapiens
aguaguaccuuucagaacucacau

SEQ ID NO: 1982633 - RNA, 15 nt, Homo sapiens
ucaguuuaggacuau

SEQ ID NO: 1982634 - RNA, 22 nt, Homo sapiens
augggacggagguccuuuggac

SEQ ID NO: 1982635 - RNA, 12 nt, Homo sapiens
aucuuugcuacu

SEQ ID NO: 1982636 - RNA, 17 nt, Homo sapiens
ugccccuacugcaaaug

SEQ ID NO: 1982637 - RNA, 17 nt, Homo sapiens
cucccaaacuccaagac

SEQ ID NO: 1982638 - RNA, 16 nt, Homo sapiens
cuucaguauguuguca

SEQ ID NO: 1982639 - RNA, 21 nt, Homo sapiens
acugugaaauaccacaagccu

SEQ ID NO: 1982640 - RNA, 16 nt, Homo sapiens
acuuuucaccuccuuc

SEQ ID NO: 1982641 - RNA, 16 nt, Homo sapiens
gauaauuuagacucug

SEQ ID NO: 1982642 - RNA, 22 nt, Homo sapiens
ugguuauuguucagacauucca

SEQ ID NO: 1982643 - RNA, 19 nt, Homo sapiens
uugguacuuauuacugcua

SEQ ID NO: 1982644 - RNA, 14 nt, Homo sapiens
augagcaacuccug

SEQ ID NO: 1982645 - RNA, 19 nt, Homo sapiens
aaccacggaggaugaugcc

SEQ ID NO: 1982646 - RNA, 22 nt, Homo sapiens
acucugcccagaccacacguag

SEQ ID NO: 1982647 - RNA, 16 nt, Homo sapiens
uccagguaacuuugaa

SEQ ID NO: 1982648 - RNA, 23 nt, Homo sapiens
cuugcuuuccugggccuuugcaa

SEQ ID NO: 1982649 - RNA, 14 nt, Homo sapiens
ugagauugugaagu

SEQ ID NO: 1982650 - RNA, 18 nt, Homo sapiens
ccucuggccaaauaugca

SEQ ID NO: 1982651 - RNA, 18 nt, Homo sapiens
agggaaccuguuagucuc

SEQ ID NO: 1982652 - RNA, 22 nt, Homo sapiens
gaauguuggcaaaucacuucaa

SEQ ID NO: 1982653 - RNA, 23 nt, Homo sapiens
uuauauugauaacagcacugacu

SEQ ID NO: 1982654 - RNA, 15 nt, Homo sapiens
ugggaacauacagaa

SEQ ID NO: 1982655 - RNA, 15 nt, Homo sapiens
gaaagguauguuacu

SEQ ID NO: 1982656 - RNA, 21 nt, Homo sapiens
ggcuuucuuuucucuaugaaa

SEQ ID NO: 1982657 - RNA, 22 nt, Homo sapiens
ucccugggaaagaggguacuag

SEQ ID NO: 1982658 - RNA, 14 nt, Homo sapiens
agggaaagccagaa

SEQ ID NO: 1982659 - RNA, 21 nt, Homo sapiens
uccaccauuucuucugcacaa

SEQ ID NO: 1982660 - RNA, 18 nt, Homo sapiens
cucucaggugccagucuu

SEQ ID NO: 1982661 - RNA, 18 nt, Homo sapiens
gcucucuggaccugacca

SEQ ID NO: 1982662 - RNA, 23 nt, Homo sapiens
ccaugugcaaacgcuguauucca

SEQ ID NO: 1982663 - RNA, 16 nt, Homo sapiens
guggcuuagcugccau

SEQ ID NO: 1982664 - RNA, 17 nt, Homo sapiens
agugauugauagagugu

SEQ ID NO: 1982665 - RNA, 19 nt, Homo sapiens
accccgucugccccuugac

SEQ ID NO: 1982666 - RNA, 22 nt, Homo sapiens
caugcuccuugccucugcucug

SEQ ID NO: 1982667 - RNA, 15 nt, Homo sapiens
gaugcuaccaugccu

SEQ ID NO: 1982668 - RNA, 18 nt, Homo sapiens
aaagcaguguuugcucca

SEQ ID NO: 1982669 - RNA, 20 nt, Homo sapiens
agcacccucuccagaugcag

SEQ ID NO: 1982670 - RNA, 15 nt, Homo sapiens
auggucagaaugggu

SEQ ID NO: 1982671 - RNA, 21 nt, Homo sapiens
aggccaagaggcuguucccac

SEQ ID NO: 1982672 - RNA, 15 nt, Homo sapiens
accucaucucugaaa

SEQ ID NO: 1982673 - RNA, 22 nt, Homo sapiens
uaacagauggaaaaacugaggc

SEQ ID NO: 1982674 - RNA, 17 nt, Homo sapiens
acaauacaccuucccca

SEQ ID NO: 1982675 - RNA, 11 nt, Homo sapiens
auaugacaaag

SEQ ID NO: 1982676 - RNA, 20 nt, Homo sapiens
cagaggauaucggcauuugu

SEQ ID NO: 1982677 - RNA, 16 nt, Homo sapiens
ccccuggcugugcucu

SEQ ID NO: 1982678 - RNA, 11 nt, Homo sapiens
uucaccauaau

SEQ ID NO: 1982679 - RNA, 14 nt, Homo sapiens
gcagucacuuccac

SEQ ID NO: 1982680 - RNA, 19 nt, Homo sapiens
cacucguuccccuccucuu

SEQ ID NO: 1982681 - RNA, 13 nt, Homo sapiens
agcaucuugcauc

SEQ ID NO: 1982682 - RNA, 14 nt, Homo sapiens
cuguguugccacag

SEQ ID NO: 1982683 - RNA, 20 nt, Homo sapiens
agcgugggacccuucagcca

SEQ ID NO: 1982684 - RNA, 17 nt, Homo sapiens
augauaaaagcacuuac

SEQ ID NO: 1982685 - RNA, 12 nt, Homo sapiens
auuuuggagcuu

SEQ ID NO: 1982686 - RNA, 22 nt, Homo sapiens
uuggacuauccgaagagaucca

SEQ ID NO: 1982687 - RNA, 23 nt, Homo sapiens
gagaaaggauugauuugaacuua

SEQ ID NO: 1982688 - RNA, 19 nt, Homo sapiens
uguauaauaaacaaucuua

SEQ ID NO: 1982689 - RNA, 14 nt, Homo sapiens
auauccauaaccuc

SEQ ID NO: 1982690 - RNA, 17 nt, Homo sapiens
cuuacaacuccugcauc

SEQ ID NO: 1982691 - RNA, 19 nt, Homo sapiens
caccucguauuucaccucu

SEQ ID NO: 1982692 - RNA, 13 nt, Homo sapiens
uaagcaacuguaa

SEQ ID NO: 1982693 - RNA, 20 nt, Homo sapiens
gguaguacuccugcaaaauu

SEQ ID NO: 1982694 - RNA, 13 nt, Homo sapiens
acuucuagcucau

SEQ ID NO: 1982695 - RNA, 14 nt, Homo sapiens
uguucaauacugua

SEQ ID NO: 1982696 - RNA, 17 nt, Homo sapiens
aaauuuuagauuuaccu

SEQ ID NO: 1982697 - RNA, 17 nt, Homo sapiens
guucuuucauacuacau

SEQ ID NO: 1982698 - RNA, 20 nt, Homo sapiens
agcaacauuuguuuuagucu

SEQ ID NO: 1982699 - RNA, 13 nt, Homo sapiens
aaaucaacacuuu

SEQ ID NO: 1982700 - RNA, 13 nt, Homo sapiens
ucuucaacuaauu

SEQ ID NO: 1982701 - RNA, 15 nt, Homo sapiens
uggcagcugucucaa

SEQ ID NO: 1982702 - RNA, 21 nt, Homo sapiens
uaggagucuucugccucuuaa

SEQ ID NO: 1982703 - RNA, 18 nt, Homo sapiens
aaacuauguaacauguag

SEQ ID NO: 1982704 - RNA, 23 nt, Homo sapiens
caacugucuuagacugcuagcuu

SEQ ID NO: 1982705 - RNA, 18 nt, Homo sapiens
uagaaccacuuccugcua

SEQ ID NO: 1982706 - RNA, 14 nt, Homo sapiens
cagggugcauguga

SEQ ID NO: 1982707 - RNA, 16 nt, Homo sapiens
ggagcagccaccccau

SEQ ID NO: 1982708 - RNA, 22 nt, Homo sapiens
caaucuuggcagacuaaaacaa

SEQ ID NO: 1982709 - RNA, 17 nt, Homo sapiens
gaaaguacguuaugaua

SEQ ID NO: 1982710 - RNA, 13 nt, Homo sapiens
auuacagguguga

SEQ ID NO: 1982711 - RNA, 18 nt, Homo sapiens
uugccgaauuuacuugua

SEQ ID NO: 1982712 - RNA, 11 nt, Homo sapiens
gccaaugcaac

SEQ ID NO: 1982713 - RNA, 15 nt, Homo sapiens
uguaauagcauacau

SEQ ID NO: 1982714 - RNA, 19 nt, Homo sapiens
aacuugcuucuaaaugccc

SEQ ID NO: 1982715 - RNA, 19 nt, Homo sapiens
uuuaaugcaaugcauaucu

SEQ ID NO: 1982716 - RNA, 21 nt, Homo sapiens
gcacccuguaucacagacugg

SEQ ID NO: 1982717 - RNA, 22 nt, Homo sapiens
uaaaguguugccaccauaccuc

SEQ ID NO: 1982718 - RNA, 14 nt, Homo sapiens
gcacggagggcagu

SEQ ID NO: 1982719 - RNA, 13 nt, Homo sapiens
ugugugugugcgu

SEQ ID NO: 1982720 - RNA, 13 nt, Homo sapiens
ccccugugccucu

SEQ ID NO: 1982721 - RNA, 12 nt, Homo sapiens
ggcaacaucaac

SEQ ID NO: 1982722 - RNA, 21 nt, Homo sapiens
auguacagacaaauacuuaga

SEQ ID NO: 1982723 - RNA, 19 nt, Homo sapiens
gguaggggcagggaggcaa

SEQ ID NO: 1982724 - RNA, 15 nt, Homo sapiens
augagcccuagaaga

SEQ ID NO: 1982725 - RNA, 19 nt, Homo sapiens
ugaugcauuuuuaauaagc

SEQ ID NO: 1982726 - RNA, 18 nt, Homo sapiens
ugcauauguaaagcacau

SEQ ID NO: 1982727 - RNA, 20 nt, Homo sapiens
ggcggagguugcaaugagcc

SEQ ID NO: 1982728 - RNA, 13 nt, Homo sapiens
gggaugcuugccu

SEQ ID NO: 1982729 - RNA, 19 nt, Homo sapiens
caguacuaaucaugugagg

SEQ ID NO: 1982730 - RNA, 15 nt, Homo sapiens
guauggugaccucuc

SEQ ID NO: 1982731 - RNA, 22 nt, Homo sapiens
cauuucuuuuccaaaauuacuu

SEQ ID NO: 1982732 - RNA, 18 nt, Homo sapiens
ccuacugcuuccucugaa

SEQ ID NO: 1982733 - RNA, 20 nt, Homo sapiens
cucgaggacugauacugcag

SEQ ID NO: 1982734 - RNA, 18 nt, Homo sapiens
accuuguuugaguuauca

SEQ ID NO: 1982735 - RNA, 16 nt, Homo sapiens
caaaccaggugcaauu

SEQ ID NO: 1982736 - RNA, 21 nt, Homo sapiens
acaaaagcccaauguaaugca

SEQ ID NO: 1982737 - RNA, 17 nt, Homo sapiens
ccaauauuuaccagacc

SEQ ID NO: 1982738 - RNA, 13 nt, Homo sapiens
guaauaaguaaaa

SEQ ID NO: 1982739 - RNA, 13 nt, Homo sapiens
uguucucccuccu

SEQ ID NO: 1982740 - RNA, 20 nt, Homo sapiens
gcauacgguaugauauugca

SEQ ID NO: 1982741 - RNA, 18 nt, Homo sapiens
agugagaaaaugccucaa

SEQ ID NO: 1982742 - RNA, 22 nt, Homo sapiens
cccaugcuuuguaggugucuca

SEQ ID NO: 1982743 - RNA, 19 nt, Homo sapiens
agcaggguucugaggcaaa

SEQ ID NO: 1982744 - RNA, 18 nt, Homo sapiens
auuuaaaauccagcaaca

SEQ ID NO: 1982745 - RNA, 21 nt, Homo sapiens
cuuaccugaauaauuacuaca

SEQ ID NO: 1982746 - RNA, 14 nt, Homo sapiens
uuauuuccauggau

SEQ ID NO: 1982747 - RNA, 16 nt, Homo sapiens
aaauaccaaguauuua

SEQ ID NO: 1982748 - RNA, 21 nt, Homo sapiens
gcucuccugacgcagcacaag

SEQ ID NO: 1982749 - RNA, 21 nt, Homo sapiens
aaagcugugucucuguauaua

SEQ ID NO: 1982750 - RNA, 14 nt, Homo sapiens
aaaacagacccucc

SEQ ID NO: 1982751 - RNA, 15 nt, Homo sapiens
caguagacugcagug

SEQ ID NO: 1982752 - RNA, 21 nt, Homo sapiens
ugauggcaccacugcacucca

SEQ ID NO: 1982753 - RNA, 12 nt, Homo sapiens
aucuacaguacu

SEQ ID NO: 1982754 - RNA, 20 nt, Homo sapiens
cuccagagaaacccagggag

SEQ ID NO: 1982755 - RNA, 21 nt, Homo sapiens
cagacaacacugggaaacaga

SEQ ID NO: 1982756 - RNA, 14 nt, Homo sapiens
auugugugucacaa

SEQ ID NO: 1982757 - RNA, 20 nt, Homo sapiens
uccgacacauuuaccaaauu

SEQ ID NO: 1982758 - RNA, 20 nt, Homo sapiens
augaaauaaaaagauccugc

SEQ ID NO: 1982759 - RNA, 21 nt, Homo sapiens
uuaccaggcacugguuguuga

SEQ ID NO: 1982760 - RNA, 15 nt, Homo sapiens
gcugggcugagccaa

SEQ ID NO: 1982761 - RNA, 22 nt, Homo sapiens
ugcuaucucgcuagccauauau

SEQ ID NO: 1982762 - RNA, 18 nt, Homo sapiens
ugugggugaagugccugc

SEQ ID NO: 1982763 - RNA, 13 nt, Homo sapiens
ugauaauuugcua

SEQ ID NO: 1982764 - RNA, 13 nt, Homo sapiens
cauuguacuuaaa

SEQ ID NO: 1982765 - RNA, 14 nt, Homo sapiens
aggccuaccugcuc

SEQ ID NO: 1982766 - RNA, 22 nt, Homo sapiens
gcuuucugccaucuagccagcc

SEQ ID NO: 1982767 - RNA, 15 nt, Homo sapiens
uagguagaacacugc

SEQ ID NO: 1982768 - RNA, 17 nt, Homo sapiens
aucuugacauguaauga

SEQ ID NO: 1982769 - RNA, 13 nt, Homo sapiens
uucaaaaguucca

SEQ ID NO: 1982770 - RNA, 19 nt, Homo sapiens
uuaauguuuagauuuuuca

SEQ ID NO: 1982771 - RNA, 22 nt, Homo sapiens
ugacuccuuucucuaaaacugc

SEQ ID NO: 1982772 - RNA, 20 nt, Homo sapiens
aacaaauguggcuccaagcu

SEQ ID NO: 1982773 - RNA, 17 nt, Homo sapiens
cgcuggucuggauggua

SEQ ID NO: 1982774 - RNA, 21 nt, Homo sapiens
uuugcauuuugauauugcugu

SEQ ID NO: 1982775 - RNA, 17 nt, Homo sapiens
uucuuuagcugucacuu

SEQ ID NO: 1982776 - RNA, 12 nt, Homo sapiens
uccaaaccagac

SEQ ID NO: 1982777 - RNA, 17 nt, Homo sapiens
ccagacucugagcugcu

SEQ ID NO: 1982778 - RNA, 21 nt, Homo sapiens
uacguuaauacgcaggcaucu

SEQ ID NO: 1982779 - RNA, 23 nt, Homo sapiens
cuucuguguaugugauguuguua

SEQ ID NO: 1982780 - RNA, 15 nt, Homo sapiens
acccaugaggcaaug

SEQ ID NO: 1982781 - RNA, 13 nt, Homo sapiens
uauauaagccaaa

SEQ ID NO: 1982782 - RNA, 16 nt, Homo sapiens
ggucuaacacuggcau

SEQ ID NO: 1982783 - RNA, 12 nt, Homo sapiens
ucuuuauugcau

SEQ ID NO: 1982784 - RNA, 21 nt, Homo sapiens
gacuccacacagcguuugcca

SEQ ID NO: 1982785 - RNA, 22 nt, Homo sapiens
uguaaaucaauuacagauuaaa

SEQ ID NO: 1982786 - RNA, 20 nt, Homo sapiens
caaaauaagccaugcugcuu

SEQ ID NO: 1982787 - RNA, 23 nt, Homo sapiens
gucccuguuuauuccaaaugcca

SEQ ID NO: 1982788 - RNA, 14 nt, Homo sapiens
acugacacccagug

SEQ ID NO: 1982789 - RNA, 15 nt, Homo sapiens
gaagccaguccagaa

SEQ ID NO: 1982790 - RNA, 19 nt, Homo sapiens
auuuuuuuuaacugcauuc

SEQ ID NO: 1982791 - RNA, 23 nt, Homo sapiens
cucuaguaucacuuuugcuguga

SEQ ID NO: 1982792 - RNA, 20 nt, Homo sapiens
aacugugugcaacagacaaa

SEQ ID NO: 1982793 - RNA, 17 nt, Homo sapiens
ggucuucagccucccuc

SEQ ID NO: 1982794 - RNA, 13 nt, Homo sapiens
uccacagcugugu

SEQ ID NO: 1982795 - RNA, 18 nt, Homo sapiens
gccaauauuucugauaua

SEQ ID NO: 1982796 - RNA, 22 nt, Homo sapiens
cccuacucccugcagaugccac

SEQ ID NO: 1982797 - RNA, 22 nt, Homo sapiens
cauguucagggaugcucauucc

SEQ ID NO: 1982798 - RNA, 14 nt, Homo sapiens
cugccugugcauga

SEQ ID NO: 1982799 - RNA, 15 nt, Homo sapiens
cauguucacugugag

SEQ ID NO: 1982800 - RNA, 19 nt, Homo sapiens
uaaaccuggaacaucucac

SEQ ID NO: 1982801 - RNA, 17 nt, Homo sapiens
uuaaauuccacagauua

SEQ ID NO: 1982802 - RNA, 17 nt, Homo sapiens
ggacacugucagugcua

SEQ ID NO: 1982803 - RNA, 24 nt, Homo sapiens
cuguguguuugggaagguggguga

SEQ ID NO: 1982804 - RNA, 16 nt, Homo sapiens
gaaaugcucuuuugca

SEQ ID NO: 1982805 - RNA, 18 nt, Homo sapiens
caucuguauauacaaaga

SEQ ID NO: 1982806 - RNA, 16 nt, Homo sapiens
uugcacugaaauggaa

SEQ ID NO: 1982807 - RNA, 14 nt, Homo sapiens
ggggaugugacaug

SEQ ID NO: 1982808 - RNA, 16 nt, Homo sapiens
ugaauucuaaaccaau

SEQ ID NO: 1982809 - RNA, 23 nt, Homo sapiens
ucucccuguuggucgguggguug

SEQ ID NO: 1982810 - RNA, 15 nt, Homo sapiens
ccagugcuccaggca

SEQ ID NO: 1982811 - RNA, 17 nt, Homo sapiens
acaugaaaaauaaucca

SEQ ID NO: 1982812 - RNA, 19 nt, Homo sapiens
gacgcuggcuaaagugggu

SEQ ID NO: 1982813 - RNA, 22 nt, Homo sapiens
acuuuggcuuacauuugaauaa

SEQ ID NO: 1982814 - RNA, 22 nt, Homo sapiens
ggaaaaucauuugaggucagaa

SEQ ID NO: 1982815 - RNA, 21 nt, Homo sapiens
ggccacuccccagugcuccug

SEQ ID NO: 1982816 - RNA, 13 nt, Homo sapiens
aaaauacuaugaa

SEQ ID NO: 1982817 - RNA, 15 nt, Homo sapiens
gugaugugccuacuc

SEQ ID NO: 1982818 - RNA, 15 nt, Homo sapiens
ccuggcucacagcca

SEQ ID NO: 1982819 - RNA, 16 nt, Homo sapiens
aacaccuuccagcuuu

SEQ ID NO: 1982820 - RNA, 15 nt, Homo sapiens
gaacuccucaagggc

SEQ ID NO: 1982821 - RNA, 12 nt, Homo sapiens
cuacuacagagu

SEQ ID NO: 1982822 - RNA, 16 nt, Homo sapiens
aucagaccacauuuga

SEQ ID NO: 1982823 - RNA, 21 nt, Homo sapiens
cauugcuaaagucaggccauu

SEQ ID NO: 1982824 - RNA, 18 nt, Homo sapiens
ccucuccuggcugugguu

SEQ ID NO: 1982825 - RNA, 17 nt, Homo sapiens
cugugugugauuugcua

SEQ ID NO: 1982826 - RNA, 17 nt, Homo sapiens
caugguguguggugcua

SEQ ID NO: 1982827 - RNA, 18 nt, Homo sapiens
ugauuauggagccuuaga

SEQ ID NO: 1982828 - RNA, 16 nt, Homo sapiens
caaaaaauugcuccua

SEQ ID NO: 1982829 - RNA, 20 nt, Homo sapiens
uccugccuuucuuccaucag

SEQ ID NO: 1982830 - RNA, 14 nt, Homo sapiens
ccccaagcucaguu

SEQ ID NO: 1982831 - RNA, 13 nt, Homo sapiens
agcacacucuucu

SEQ ID NO: 1982832 - RNA, 19 nt, Homo sapiens
ugaacacagccugggacca

SEQ ID NO: 1982833 - RNA, 16 nt, Homo sapiens
gucaccccaagccaua

SEQ ID NO: 1982834 - RNA, 14 nt, Homo sapiens
uguaaauaugaauc

SEQ ID NO: 1982835 - RNA, 14 nt, Homo sapiens
cugaacacauuucu

SEQ ID NO: 1982836 - RNA, 13 nt, Homo sapiens
gugaaacauacaa

SEQ ID NO: 1982837 - RNA, 15 nt, Homo sapiens
gaacagacacuuuaa

SEQ ID NO: 1982838 - RNA, 17 nt, Homo sapiens
ccaacacuuuugggagg

SEQ ID NO: 1982839 - RNA, 18 nt, Homo sapiens
uucauccuugaccucauu

SEQ ID NO: 1982840 - RNA, 22 nt, Homo sapiens
cuauggcccugcaaaaauauaa

SEQ ID NO: 1982841 - RNA, 19 nt, Homo sapiens
aguagcuguggggagcugg

SEQ ID NO: 1982842 - RNA, 12 nt, Homo sapiens
aauaacagagag

SEQ ID NO: 1982843 - RNA, 17 nt, Homo sapiens
gcccccugaguucccaa

SEQ ID NO: 1982844 - RNA, 22 nt, Homo sapiens
uuccgcuuggagcuauuuucca

SEQ ID NO: 1982845 - RNA, 18 nt, Homo sapiens
augcuauuguugcaauau

SEQ ID NO: 1982846 - RNA, 20 nt, Homo sapiens
auuucagcuggagauacuga

SEQ ID NO: 1982847 - RNA, 11 nt, Homo sapiens
gagacuugcca

SEQ ID NO: 1982848 - RNA, 22 nt, Homo sapiens
cucagcccccgcccgucaccac

SEQ ID NO: 1982849 - RNA, 20 nt, Homo sapiens
cugugguuccucugcucacc

SEQ ID NO: 1982850 - RNA, 19 nt, Homo sapiens
aaguuagucaauccuguca

SEQ ID NO: 1982851 - RNA, 21 nt, Homo sapiens
gaguaauauagugacuaugaa

SEQ ID NO: 1982852 - RNA, 16 nt, Homo sapiens
accuucguuaagugau

SEQ ID NO: 1982853 - RNA, 14 nt, Homo sapiens
cugagacagggauu

SEQ ID NO: 1982854 - RNA, 14 nt, Homo sapiens
ccaaaacacugccu

SEQ ID NO: 1982855 - RNA, 18 nt, Homo sapiens
uaaaaaauaacuaucaac

SEQ ID NO: 1982856 - RNA, 23 nt, Homo sapiens
ugcaauggaauauaaauaucaca

SEQ ID NO: 1982857 - RNA, 16 nt, Homo sapiens
cagucguaaccguggc

SEQ ID NO: 1982858 - RNA, 21 nt, Homo sapiens
augugcaaccuaauuguagca

SEQ ID NO: 1982859 - RNA, 13 nt, Homo sapiens
aggguggucucaa

SEQ ID NO: 1982860 - RNA, 14 nt, Homo sapiens
cuuugaaguggcac

SEQ ID NO: 1982861 - RNA, 23 nt, Homo sapiens
augucugcuugucaaaagaaaua

SEQ ID NO: 1982862 - RNA, 11 nt, Homo sapiens
uaccuaaagac

SEQ ID NO: 1982863 - RNA, 15 nt, Homo sapiens
accccguagauuccc

SEQ ID NO: 1982864 - RNA, 22 nt, Homo sapiens
aguucuggaagggacuuuagag

SEQ ID NO: 1982865 - RNA, 21 nt, Homo sapiens
gaggaauuugaagcucagaaa

SEQ ID NO: 1982866 - RNA, 17 nt, Homo sapiens
auuuguccaauugagua

SEQ ID NO: 1982867 - RNA, 14 nt, Homo sapiens
uggagccccugugu

SEQ ID NO: 1982868 - RNA, 16 nt, Homo sapiens
caggccagagggcagu

SEQ ID NO: 1982869 - RNA, 17 nt, Homo sapiens
aacccagucacugugag

SEQ ID NO: 1982870 - RNA, 22 nt, Homo sapiens
gucuaagccggcuuuccucuau

SEQ ID NO: 1982871 - RNA, 16 nt, Homo sapiens
ugcacacagcuaggca

SEQ ID NO: 1982872 - RNA, 17 nt, Homo sapiens
aguauuuggcauucucu

SEQ ID NO: 1982873 - RNA, 21 nt, Homo sapiens
cacacagauauacacauggau

SEQ ID NO: 1982874 - RNA, 20 nt, Homo sapiens
aaggcugcuaaguggaagac

SEQ ID NO: 1982875 - RNA, 21 nt, Homo sapiens
caagcauuuaauguagccaug

SEQ ID NO: 1982876 - RNA, 15 nt, Homo sapiens
ucaacauuaccaaaa

SEQ ID NO: 1982877 - RNA, 21 nt, Homo sapiens
cuuuugagagcucuucagaga

SEQ ID NO: 1982878 - RNA, 21 nt, Homo sapiens
guaccuguaggaaacagaaaa

SEQ ID NO: 1982879 - RNA, 14 nt, Homo sapiens
gggcuacaguccuu

SEQ ID NO: 1982880 - RNA, 18 nt, Homo sapiens
ggccuuucccucuucccu

SEQ ID NO: 1982881 - RNA, 18 nt, Homo sapiens
accuuauucuacaucauu

SEQ ID NO: 1982882 - RNA, 16 nt, Homo sapiens
auguggauacagucau

SEQ ID NO: 1982883 - RNA, 14 nt, Homo sapiens
cuguaaaaugcacc

SEQ ID NO: 1982884 - RNA, 15 nt, Homo sapiens
agcccgaacaccauu

SEQ ID NO: 1982885 - RNA, 23 nt, Homo sapiens
agcuguuucucaagaccaacaga

SEQ ID NO: 1982886 - RNA, 17 nt, Homo sapiens
agaacagagaagcccuu

SEQ ID NO: 1982887 - RNA, 13 nt, Homo sapiens
aacacuacucuua

SEQ ID NO: 1982888 - RNA, 19 nt, Homo sapiens
guggacauguggguggaga

SEQ ID NO: 1982889 - RNA, 16 nt, Homo sapiens
auaauguaauacugua

SEQ ID NO: 1982890 - RNA, 15 nt, Homo sapiens
cauuuaguccuguac

SEQ ID NO: 1982891 - RNA, 16 nt, Homo sapiens
uacuaucuagugucua

SEQ ID NO: 1982892 - RNA, 23 nt, Homo sapiens
ugggccucugguucugacacuuu

SEQ ID NO: 1982893 - RNA, 21 nt, Homo sapiens
cucauucagggauagcacuga

SEQ ID NO: 1982894 - RNA, 16 nt, Homo sapiens
acucaaggcuugaguc

SEQ ID NO: 1982895 - RNA, 20 nt, Homo sapiens
augcccucaggggacuugaa

SEQ ID NO: 1982896 - RNA, 22 nt, Homo sapiens
accacccaugugagggaauaaa

SEQ ID NO: 1982897 - RNA, 22 nt, Homo sapiens
uacaaugggaaaagagucucua

SEQ ID NO: 1982898 - RNA, 21 nt, Homo sapiens
cccucugucggcuuuuugcca

SEQ ID NO: 1982899 - RNA, 15 nt, Homo sapiens
acagccaagcaccuc

SEQ ID NO: 1982900 - RNA, 22 nt, Homo sapiens
agaacaccugagcugcugcaug

SEQ ID NO: 1982901 - RNA, 21 nt, Homo sapiens
uaacagauggaaaaacugagg

SEQ ID NO: 1982902 - RNA, 18 nt, Homo sapiens
ugcagcuccagucagugu

SEQ ID NO: 1982903 - RNA, 20 nt, Homo sapiens
uuucuaagcuguuucuugau

SEQ ID NO: 1982904 - RNA, 15 nt, Homo sapiens
agauuauaacaaauu

SEQ ID NO: 1982905 - RNA, 19 nt, Homo sapiens
accugccucagccuuccaa

SEQ ID NO: 1982906 - RNA, 16 nt, Homo sapiens
uauagcugcuuggauu

SEQ ID NO: 1982907 - RNA, 20 nt, Homo sapiens
cugggcuggggccaccuuug

SEQ ID NO: 1982908 - RNA, 18 nt, Homo sapiens
ucuguccauuuauccaca

SEQ ID NO: 1982909 - RNA, 22 nt, Homo sapiens
guauguagaagccuaggaucac

SEQ ID NO: 1982910 - RNA, 21 nt, Homo sapiens
ucaaucccuagggcuggcaga

SEQ ID NO: 1982911 - RNA, 19 nt, Homo sapiens
aucucggcucagugcaacc

SEQ ID NO: 1982912 - RNA, 20 nt, Homo sapiens
aaagcaugugaauucuggca

SEQ ID NO: 1982913 - RNA, 14 nt, Homo sapiens
aacaagauggagau

SEQ ID NO: 1982914 - RNA, 17 nt, Homo sapiens
ugucccccaacuugaga

SEQ ID NO: 1982915 - RNA, 18 nt, Homo sapiens
cuccugcucauacagaag

SEQ ID NO: 1982916 - RNA, 21 nt, Homo sapiens
uggacagaaaaugcaaugaca

SEQ ID NO: 1982917 - RNA, 13 nt, Homo sapiens
acuucaccuuucc

SEQ ID NO: 1982918 - RNA, 20 nt, Homo sapiens
acggacuccagucugugugu

SEQ ID NO: 1982919 - RNA, 17 nt, Homo sapiens
uguacuaguaguuaaga

SEQ ID NO: 1982920 - RNA, 16 nt, Homo sapiens
ucucuugccugcucca

SEQ ID NO: 1982921 - RNA, 21 nt, Homo sapiens
uauuucuaagaaauagagcca

SEQ ID NO: 1982922 - RNA, 16 nt, Homo sapiens
augacuggcuccugac

SEQ ID NO: 1982923 - RNA, 23 nt, Homo sapiens
ugagcauaucugguauaugucau

SEQ ID NO: 1982924 - RNA, 16 nt, Homo sapiens
ugggaaagauuacuuu

SEQ ID NO: 1982925 - RNA, 17 nt, Homo sapiens
guuuuucugaagacagu

SEQ ID NO: 1982926 - RNA, 15 nt, Homo sapiens
ucaaaaugcugcuuc

SEQ ID NO: 1982927 - RNA, 15 nt, Homo sapiens
cacugaguugcacau

SEQ ID NO: 1982928 - RNA, 15 nt, Homo sapiens
cccagcguccacucu

SEQ ID NO: 1982929 - RNA, 11 nt, Homo sapiens
gguagcauuuu

SEQ ID NO: 1982930 - RNA, 22 nt, Homo sapiens
cuuuugcccacacuugggagca

SEQ ID NO: 1982931 - RNA, 16 nt, Homo sapiens
cacauauuucacaugu

SEQ ID NO: 1982932 - RNA, 16 nt, Homo sapiens
cgccugguggugggcc

SEQ ID NO: 1982933 - RNA, 15 nt, Homo sapiens
ugccuuuacuauaug

SEQ ID NO: 1982934 - RNA, 22 nt, Homo sapiens
uuucauagugaccuguguuuca

SEQ ID NO: 1982935 - RNA, 19 nt, Homo sapiens
gcaucugugccuucucuau

SEQ ID NO: 1982936 - RNA, 16 nt, Homo sapiens
aaacaaaaaacccaca

SEQ ID NO: 1982937 - RNA, 18 nt, Homo sapiens
cccagggugaagccuuca

SEQ ID NO: 1982938 - RNA, 17 nt, Homo sapiens
ugcucaaagauguacug

SEQ ID NO: 1982939 - RNA, 16 nt, Homo sapiens
uacugaaggcuucugc

SEQ ID NO: 1982940 - RNA, 19 nt, Homo sapiens
cuacaauccuaccuuuuga

SEQ ID NO: 1982941 - RNA, 19 nt, Homo sapiens
uccccuuuugccaaucuca

SEQ ID NO: 1982942 - RNA, 15 nt, Homo sapiens
aaaagacugaaucua

SEQ ID NO: 1982943 - RNA, 16 nt, Homo sapiens
ccagaggaacugucca

SEQ ID NO: 1982944 - RNA, 20 nt, Homo sapiens
aaucauauuguuacugguac

SEQ ID NO: 1982945 - RNA, 13 nt, Homo sapiens
aaagaggacuuga

SEQ ID NO: 1982946 - RNA, 22 nt, Homo sapiens
cuugugaaaacgcaaacaugaa

SEQ ID NO: 1982947 - RNA, 23 nt, Homo sapiens
caaagacgguagagagaaacagc

SEQ ID NO: 1982948 - RNA, 12 nt, Homo sapiens
aagcaacaaaga

SEQ ID NO: 1982949 - RNA, 12 nt, Homo sapiens
uauaaacauauc

SEQ ID NO: 1982950 - RNA, 13 nt, Homo sapiens
uuaacaagcucuu

SEQ ID NO: 1982951 - RNA, 13 nt, Homo sapiens
uccacaagccauu

SEQ ID NO: 1982952 - RNA, 14 nt, Homo sapiens
caaucagcccagug

SEQ ID NO: 1982953 - RNA, 19 nt, Homo sapiens
ucagguggggaguccaggg

SEQ ID NO: 1982954 - RNA, 21 nt, Homo sapiens
gaaccaaaaaaccccagcuau

SEQ ID NO: 1982955 - RNA, 20 nt, Homo sapiens
cacuaccaaacacucagucc

SEQ ID NO: 1982956 - RNA, 21 nt, Homo sapiens
auacaaacauguuccugggau

SEQ ID NO: 1982957 - RNA, 20 nt, Homo sapiens
auagauuuaaagaauaugaa

SEQ ID NO: 1982958 - RNA, 13 nt, Homo sapiens
ucuacacugccuu

SEQ ID NO: 1982959 - RNA, 22 nt, Homo sapiens
gcccaggagccucacuggggca

SEQ ID NO: 1982960 - RNA, 15 nt, Homo sapiens
cccggagcuuugcaa

SEQ ID NO: 1982961 - RNA, 17 nt, Homo sapiens
acauguuacugcuucau

SEQ ID NO: 1982962 - RNA, 13 nt, Homo sapiens
aguauucugccau

SEQ ID NO: 1982963 - RNA, 17 nt, Homo sapiens
ucucuuggcucuacucc

SEQ ID NO: 1982964 - RNA, 14 nt, Homo sapiens
auauaacuaucucu

SEQ ID NO: 1982965 - RNA, 15 nt, Homo sapiens
caugaggccaugcaa

SEQ ID NO: 1982966 - RNA, 15 nt, Homo sapiens
accaagcucugucca

SEQ ID NO: 1982967 - RNA, 23 nt, Homo sapiens
ccuaauuuuguacauacuguauu

SEQ ID NO: 1982968 - RNA, 12 nt, Homo sapiens
acccaggaugau

SEQ ID NO: 1982969 - RNA, 22 nt, Homo sapiens
aggagguagcucccagcacuca

SEQ ID NO: 1982970 - RNA, 19 nt, Homo sapiens
agccuggcucccaggacac

SEQ ID NO: 1982971 - RNA, 17 nt, Homo sapiens
uugacuaaugaggcauu

SEQ ID NO: 1982972 - RNA, 13 nt, Homo sapiens
cuguuaugccaaa

SEQ ID NO: 1982973 - RNA, 14 nt, Homo sapiens
gagagcuguauuaa

SEQ ID NO: 1982974 - RNA, 11 nt, Homo sapiens
cacugaucaau

SEQ ID NO: 1982975 - RNA, 20 nt, Homo sapiens
ugcuauggaaugauugugga

SEQ ID NO: 1982976 - RNA, 12 nt, Homo sapiens
gcacgcacacac

SEQ ID NO: 1982977 - RNA, 19 nt, Homo sapiens
aauuaucugcauuuaucuu

SEQ ID NO: 1982978 - RNA, 16 nt, Homo sapiens
aauuuaugaagauagu

SEQ ID NO: 1982979 - RNA, 16 nt, Homo sapiens
cuauucucuccaaaaa

SEQ ID NO: 1982980 - RNA, 22 nt, Homo sapiens
uaacauccacaaagagauuauu

SEQ ID NO: 1982981 - RNA, 15 nt, Homo sapiens
agcauacaacuggac

SEQ ID NO: 1982982 - RNA, 15 nt, Homo sapiens
cccagcacagacuca

SEQ ID NO: 1982983 - RNA, 14 nt, Homo sapiens
aaagauuuuaccug

SEQ ID NO: 1982984 - RNA, 23 nt, Homo sapiens
auccccagccccuccucccucag

SEQ ID NO: 1982985 - RNA, 22 nt, Homo sapiens
auucuccuccuauugccuccau

SEQ ID NO: 1982986 - RNA, 19 nt, Homo sapiens
ccuuauuuauauucaucaa

SEQ ID NO: 1982987 - RNA, 24 nt, Homo sapiens
aaacaggguuugauagcacuuaaa

SEQ ID NO: 1982988 - RNA, 15 nt, Homo sapiens
ugcacaccucaugag

SEQ ID NO: 1982989 - RNA, 18 nt, Homo sapiens
acuuucagguacuaaaua

SEQ ID NO: 1982990 - RNA, 16 nt, Homo sapiens
acucugauagaauuau

SEQ ID NO: 1982991 - RNA, 14 nt, Homo sapiens
cccugccgugggcc

SEQ ID NO: 1982992 - RNA, 14 nt, Homo sapiens
cccaaaacugccac

SEQ ID NO: 1982993 - RNA, 19 nt, Homo sapiens
cuaccuuuuaccuagccac

SEQ ID NO: 1982994 - RNA, 14 nt, Homo sapiens
uagccgccaccugc

SEQ ID NO: 1982995 - RNA, 17 nt, Homo sapiens
acaagaaagcuguggcu

SEQ ID NO: 1982996 - RNA, 20 nt, Homo sapiens
gauaauuuugaaaugauuca

SEQ ID NO: 1982997 - RNA, 19 nt, Homo sapiens
aaagagagaccccagucaa

SEQ ID NO: 1982998 - RNA, 18 nt, Homo sapiens
guggauuaaccugccagg

SEQ ID NO: 1982999 - RNA, 16 nt, Homo sapiens
ccuucuccacagggac

SEQ ID NO: 1983000 - RNA, 18 nt, Homo sapiens
cuggugggacaacaaaga

SEQ ID NO: 1983001 - RNA, 13 nt, Homo sapiens
uguuuacagugga

SEQ ID NO: 1983002 - RNA, 15 nt, Homo sapiens
uggccuuugcaauuu

SEQ ID NO: 1983003 - RNA, 20 nt, Homo sapiens
acaacaaucccagcaucuga

SEQ ID NO: 1983004 - RNA, 12 nt, Homo sapiens
aacugacuucca

SEQ ID NO: 1983005 - RNA, 16 nt, Homo sapiens
acucgcaccugugcug

SEQ ID NO: 1983006 - RNA, 18 nt, Homo sapiens
ggacagccugcacagugg

SEQ ID NO: 1983007 - RNA, 14 nt, Homo sapiens
ugcauuuuccucuu

SEQ ID NO: 1983008 - RNA, 17 nt, Homo sapiens
aaauaaaaagaguauau

SEQ ID NO: 1983009 - RNA, 17 nt, Homo sapiens
gcugcucuuaugccauu

SEQ ID NO: 1983010 - RNA, 15 nt, Homo sapiens
cagaugcagggcagu

SEQ ID NO: 1983011 - RNA, 20 nt, Homo sapiens
caguacuucagcaagagaga

SEQ ID NO: 1983012 - RNA, 15 nt, Homo sapiens
ucguuuuugcugcag

SEQ ID NO: 1983013 - RNA, 15 nt, Homo sapiens
cagcagcagcuuuca

SEQ ID NO: 1983014 - RNA, 15 nt, Homo sapiens
gaaacucuacccuga

SEQ ID NO: 1983015 - RNA, 13 nt, Homo sapiens
agcccucagggcu

SEQ ID NO: 1983016 - RNA, 14 nt, Homo sapiens
guguuucaagcuac

SEQ ID NO: 1983017 - RNA, 21 nt, Homo sapiens
gcuggaacagauucacacugu

SEQ ID NO: 1983018 - RNA, 10 nt, Homo sapiens
ccucccugaa

SEQ ID NO: 1983019 - RNA, 14 nt, Homo sapiens
aucccagcacuuug

SEQ ID NO: 1983020 - RNA, 18 nt, Homo sapiens
gugagccaagauugcacc

SEQ ID NO: 1983021 - RNA, 21 nt, Homo sapiens
gggucaugaugcucuuuccca

SEQ ID NO: 1983022 - RNA, 13 nt, Homo sapiens
gacuuaggccaga

SEQ ID NO: 1983023 - RNA, 17 nt, Homo sapiens
acauaaagcacuaccua

SEQ ID NO: 1983024 - RNA, 18 nt, Homo sapiens
ggauuaaaaugagugaaa

SEQ ID NO: 1983025 - RNA, 22 nt, Homo sapiens
gugguuuuccagaagugaugaa

SEQ ID NO: 1983026 - RNA, 14 nt, Homo sapiens
uccaggccucuagu

SEQ ID NO: 1983027 - RNA, 23 nt, Homo sapiens
uagaagccugcagaauccagcua

SEQ ID NO: 1983028 - RNA, 23 nt, Homo sapiens
agaccuugcugauaaaacagauu

SEQ ID NO: 1983029 - RNA, 18 nt, Homo sapiens
cagcugcuugggcuucau

SEQ ID NO: 1983030 - RNA, 15 nt, Homo sapiens
agugcagggcaaaau

SEQ ID NO: 1983031 - RNA, 21 nt, Homo sapiens
ccaaugacacccaugccagag

SEQ ID NO: 1983032 - RNA, 22 nt, Homo sapiens
cuugugguugaaaaccacaguc

SEQ ID NO: 1983033 - RNA, 16 nt, Homo sapiens
uaaaguuccaugaaga

SEQ ID NO: 1983034 - RNA, 20 nt, Homo sapiens
auaaaacaucuuugaaauua

SEQ ID NO: 1983035 - RNA, 23 nt, Homo sapiens
ccaaucggcuuucauuuugcauu

SEQ ID NO: 1983036 - RNA, 15 nt, Homo sapiens
ggaauacagaagcag

SEQ ID NO: 1983037 - RNA, 19 nt, Homo sapiens
gguucuuagucucagcacu

SEQ ID NO: 1983038 - RNA, 18 nt, Homo sapiens
uuuaaauggcuacuuugg

SEQ ID NO: 1983039 - RNA, 14 nt, Homo sapiens
agauggaguucuug

SEQ ID NO: 1983040 - RNA, 17 nt, Homo sapiens
guaauauuacuuuaaca

SEQ ID NO: 1983041 - RNA, 22 nt, Homo sapiens
gggcuuggcugugcccucagau

SEQ ID NO: 1983042 - RNA, 19 nt, Homo sapiens
uaccauuauuuuacagucu

SEQ ID NO: 1983043 - RNA, 18 nt, Homo sapiens
guggagggcucugccuau

SEQ ID NO: 1983044 - RNA, 14 nt, Homo sapiens
auguuaauacauca

SEQ ID NO: 1983045 - RNA, 21 nt, Homo sapiens
guccaacugccuguucaauaa

SEQ ID NO: 1983046 - RNA, 19 nt, Homo sapiens
ucgccaaguuggagugcaa

SEQ ID NO: 1983047 - RNA, 16 nt, Homo sapiens
guguuuaagacauuuu

SEQ ID NO: 1983048 - RNA, 16 nt, Homo sapiens
uacaauuauuguauau

SEQ ID NO: 1983049 - RNA, 18 nt, Homo sapiens
ccuuuuagguagaauuua

SEQ ID NO: 1983050 - RNA, 16 nt, Homo sapiens
gauauauaggcuauuu

SEQ ID NO: 1983051 - RNA, 17 nt, Homo sapiens
uuaggagacacagggaa

SEQ ID NO: 1983052 - RNA, 19 nt, Homo sapiens
ugagaaaacagggaauaca

SEQ ID NO: 1983053 - RNA, 23 nt, Homo sapiens
auuaauacucugcagugauuaga

SEQ ID NO: 1983054 - RNA, 13 nt, Homo sapiens
cccaaaaugugau

SEQ ID NO: 1983055 - RNA, 19 nt, Homo sapiens
aauccucccacuucagccu

SEQ ID NO: 1983056 - RNA, 18 nt, Homo sapiens
uuggauaaguuucuauuc

SEQ ID NO: 1983057 - RNA, 19 nt, Homo sapiens
acgcggccccacauugcac

SEQ ID NO: 1983058 - RNA, 17 nt, Homo sapiens
ggccaugccacccuguu

SEQ ID NO: 1983059 - RNA, 15 nt, Homo sapiens
uguuuuguacuuuag

SEQ ID NO: 1983060 - RNA, 14 nt, Homo sapiens
cuacacucuugacu

SEQ ID NO: 1983061 - RNA, 22 nt, Homo sapiens
cagucaucuagaauucacugag

SEQ ID NO: 1983062 - RNA, 13 nt, Homo sapiens
gaauacugaugga

SEQ ID NO: 1983063 - RNA, 17 nt, Homo sapiens
aaugcuaguuucauuca

SEQ ID NO: 1983064 - RNA, 15 nt, Homo sapiens
ugcacagauuuacuc

SEQ ID NO: 1983065 - RNA, 17 nt, Homo sapiens
caacacccaaagcaugg

SEQ ID NO: 1983066 - RNA, 21 nt, Homo sapiens
caacagucuugcugaauuaag

SEQ ID NO: 1983067 - RNA, 14 nt, Homo sapiens
cacacacccacuaa

SEQ ID NO: 1983068 - RNA, 22 nt, Homo sapiens
gauucuuccugauucaaagacu

SEQ ID NO: 1983069 - RNA, 14 nt, Homo sapiens
gacaaucacugcca

SEQ ID NO: 1983070 - RNA, 13 nt, Homo sapiens
aggcccauguaua

SEQ ID NO: 1983071 - RNA, 15 nt, Homo sapiens
ccuucugggacaugg

SEQ ID NO: 1983072 - RNA, 18 nt, Homo sapiens
ccagggccacucugccuc

SEQ ID NO: 1983073 - RNA, 19 nt, Homo sapiens
gauucagguguauggaauu

SEQ ID NO: 1983074 - RNA, 12 nt, Homo sapiens
gccugugugcga

SEQ ID NO: 1983075 - RNA, 10 nt, Homo sapiens
cauauuucaa

SEQ ID NO: 1983076 - RNA, 18 nt, Homo sapiens
ucauuccucacgcccuuc

SEQ ID NO: 1983077 - RNA, 17 nt, Homo sapiens
ugaggucccuguauguc

SEQ ID NO: 1983078 - RNA, 17 nt, Homo sapiens
agcagauccucaauaaa

SEQ ID NO: 1983079 - RNA, 13 nt, Homo sapiens
ucauuuguuaaua

SEQ ID NO: 1983080 - RNA, 20 nt, Homo sapiens
agaaaacccuugggccagaa

SEQ ID NO: 1983081 - RNA, 13 nt, Homo sapiens
auaagaucacuga

SEQ ID NO: 1983082 - RNA, 19 nt, Homo sapiens
ugaauuuuuaagcugcaaa

SEQ ID NO: 1983083 - RNA, 14 nt, Homo sapiens
caccagcaggcacu

SEQ ID NO: 1983084 - RNA, 15 nt, Homo sapiens
acccauugucucauu

SEQ ID NO: 1983085 - RNA, 23 nt, Homo sapiens
aauugaaaugggaacaauaucaa

SEQ ID NO: 1983086 - RNA, 16 nt, Homo sapiens
uaucaauccaagaacu

SEQ ID NO: 1983087 - RNA, 12 nt, Homo sapiens
aaaaauacaugu

SEQ ID NO: 1983088 - RNA, 22 nt, Homo sapiens
cacuacuccugaggaugcuacu

SEQ ID NO: 1983089 - RNA, 19 nt, Homo sapiens
ucgcugucgugacuacaca

SEQ ID NO: 1983090 - RNA, 19 nt, Homo sapiens
agcacagauuugcauuuca

SEQ ID NO: 1983091 - RNA, 20 nt, Homo sapiens
agugcucccuuccuccucaa

SEQ ID NO: 1983092 - RNA, 21 nt, Homo sapiens
caaagagggugagggccuucu

SEQ ID NO: 1983093 - RNA, 17 nt, Homo sapiens
ucuaaaucucuaucucu

SEQ ID NO: 1983094 - RNA, 20 nt, Homo sapiens
cagauggaaagaggugaaaa

SEQ ID NO: 1983095 - RNA, 19 nt, Homo sapiens
gcuuaaacccauacaaugu

SEQ ID NO: 1983096 - RNA, 17 nt, Homo sapiens
ggacuccaugcugccag

SEQ ID NO: 1983097 - RNA, 18 nt, Homo sapiens
ugagaagcuucuaauuag

SEQ ID NO: 1983098 - RNA, 15 nt, Homo sapiens
uagugagggccucaa

SEQ ID NO: 1983099 - RNA, 21 nt, Homo sapiens
ccuauuuagauggccaugaag

SEQ ID NO: 1983100 - RNA, 17 nt, Homo sapiens
ccuggcagggcccagug

SEQ ID NO: 1983101 - RNA, 15 nt, Homo sapiens
ucauagggucucuuc

SEQ ID NO: 1983102 - RNA, 15 nt, Homo sapiens
aaaauuuuagcucuu

SEQ ID NO: 1983103 - RNA, 13 nt, Homo sapiens
cagagcuggugau

SEQ ID NO: 1983104 - RNA, 18 nt, Homo sapiens
gaacgugauuagugaaag

SEQ ID NO: 1983105 - RNA, 18 nt, Homo sapiens
agcauccaaguggcauaa

SEQ ID NO: 1983106 - RNA, 16 nt, Homo sapiens
gcuaaaggaagugaau

SEQ ID NO: 1983107 - RNA, 19 nt, Homo sapiens
gcucagucccuacugagua

SEQ ID NO: 1983108 - RNA, 14 nt, Homo sapiens
ugaggcucucuagu

SEQ ID NO: 1983109 - RNA, 23 nt, Homo sapiens
uggcagaaugcuagcucugagcc

SEQ ID NO: 1983110 - RNA, 21 nt, Homo sapiens
uugugaaaucaauguguacaa

SEQ ID NO: 1983111 - RNA, 20 nt, Homo sapiens
gcuuggguggagaagccauu

SEQ ID NO: 1983112 - RNA, 11 nt, Homo sapiens
cgaugaugaug

SEQ ID NO: 1983113 - RNA, 19 nt, Homo sapiens
gacugagaagauguuaauu

SEQ ID NO: 1983114 - RNA, 14 nt, Homo sapiens
ggauggcaccucag

SEQ ID NO: 1983115 - RNA, 18 nt, Homo sapiens
ccauccgcaucucaacaa

SEQ ID NO: 1983116 - RNA, 15 nt, Homo sapiens
gaguaaaauucaguu

SEQ ID NO: 1983117 - RNA, 19 nt, Homo sapiens
ugugaaucugggugggaua

SEQ ID NO: 1983118 - RNA, 17 nt, Homo sapiens
agguuuaggucaagaag

SEQ ID NO: 1983119 - RNA, 23 nt, Homo sapiens
aaacuuuccuguacucacugagu

SEQ ID NO: 1983120 - RNA, 14 nt, Homo sapiens
aagcuggagugcag

SEQ ID NO: 1983121 - RNA, 13 nt, Homo sapiens
aacaaaucaugca

SEQ ID NO: 1983122 - RNA, 20 nt, Homo sapiens
ccauuguuuugccagugaag

SEQ ID NO: 1983123 - RNA, 17 nt, Homo sapiens
aggaggccucaccauac

SEQ ID NO: 1983124 - RNA, 23 nt, Homo sapiens
gacaccugccuuaugcaagggga

SEQ ID NO: 1983125 - RNA, 20 nt, Homo sapiens
aagacaugauuuccuugaau

SEQ ID NO: 1983126 - RNA, 16 nt, Homo sapiens
accuuaucugugcgug

SEQ ID NO: 1983127 - RNA, 16 nt, Homo sapiens
gacaacaaccuaugca

SEQ ID NO: 1983128 - RNA, 14 nt, Homo sapiens
cuagucuguuucau

SEQ ID NO: 1983129 - RNA, 18 nt, Homo sapiens
ugccacugugugccuucu

SEQ ID NO: 1983130 - RNA, 16 nt, Homo sapiens
gcuuguggcagccuga

SEQ ID NO: 1983131 - RNA, 14 nt, Homo sapiens
aaagcccauccuug

SEQ ID NO: 1983132 - RNA, 23 nt, Homo sapiens
uucaggccauggguucaccagcc

SEQ ID NO: 1983133 - RNA, 21 nt, Homo sapiens
gccuccagaaccuuacuggca

SEQ ID NO: 1983134 - RNA, 18 nt, Homo sapiens
acagcaugccuucaaauc

SEQ ID NO: 1983135 - RNA, 16 nt, Homo sapiens
augaaaucucaggaau

SEQ ID NO: 1983136 - RNA, 17 nt, Homo sapiens
ucauuggccacugucuc

SEQ ID NO: 1983137 - RNA, 24 nt, Homo sapiens
uccucuugcaguuguucuuuaauc

SEQ ID NO: 1983138 - RNA, 18 nt, Homo sapiens
ccuguccugccuaaggcu

SEQ ID NO: 1983139 - RNA, 16 nt, Homo sapiens
cagccuaugagcaucc

SEQ ID NO: 1983140 - RNA, 22 nt, Homo sapiens
guggcagaagugucacccugug

SEQ ID NO: 1983141 - RNA, 15 nt, Homo sapiens
agcccuuggaucagu

SEQ ID NO: 1983142 - RNA, 23 nt, Homo sapiens
uuguuacuguauccucauuugua

SEQ ID NO: 1983143 - RNA, 13 nt, Homo sapiens
uugaaccauucau

SEQ ID NO: 1983144 - RNA, 15 nt, Homo sapiens
ucaaacuacugccau

SEQ ID NO: 1983145 - RNA, 19 nt, Homo sapiens
uaaaagucucguugcucau

SEQ ID NO: 1983146 - RNA, 17 nt, Homo sapiens
ggagagguuacccgaga

SEQ ID NO: 1983147 - RNA, 16 nt, Homo sapiens
agagguggauccugua

SEQ ID NO: 1983148 - RNA, 20 nt, Homo sapiens
ugagaacuuccaacaagccu

SEQ ID NO: 1983149 - RNA, 20 nt, Homo sapiens
ugugagaauugugcuuucac

SEQ ID NO: 1983150 - RNA, 20 nt, Homo sapiens
cuuccuugccugaugacaau

SEQ ID NO: 1983151 - RNA, 18 nt, Homo sapiens
cagcugcccuugcagggu

SEQ ID NO: 1983152 - RNA, 15 nt, Homo sapiens
gaagaugaacuuugu

SEQ ID NO: 1983153 - RNA, 16 nt, Homo sapiens
uccacaauaaggucaa

SEQ ID NO: 1983154 - RNA, 19 nt, Homo sapiens
cugcccagagcugggugag

SEQ ID NO: 1983155 - RNA, 12 nt, Homo sapiens
augaauucuuga

SEQ ID NO: 1983156 - RNA, 13 nt, Homo sapiens
gaagacuacaauu

SEQ ID NO: 1983157 - RNA, 13 nt, Homo sapiens
caccacaguguuu

SEQ ID NO: 1983158 - RNA, 14 nt, Homo sapiens
cuacgccaaagugc

SEQ ID NO: 1983159 - RNA, 18 nt, Homo sapiens
agaggggaaccucaacug

SEQ ID NO: 1983160 - RNA, 13 nt, Homo sapiens
cugcgucuccugc

SEQ ID NO: 1983161 - RNA, 17 nt, Homo sapiens
ggccuggagcacaaaga

SEQ ID NO: 1983162 - RNA, 19 nt, Homo sapiens
acuuauuggauauucauuc

SEQ ID NO: 1983163 - RNA, 17 nt, Homo sapiens
caugcaccuugcuccca

SEQ ID NO: 1983164 - RNA, 15 nt, Homo sapiens
guaaauauguacauu

SEQ ID NO: 1983165 - RNA, 22 nt, Homo sapiens
uccuuggaccguaucacugguc

SEQ ID NO: 1983166 - RNA, 14 nt, Homo sapiens
auacacaguacuuu

SEQ ID NO: 1983167 - RNA, 21 nt, Homo sapiens
agggacgguuguggugaaguu

SEQ ID NO: 1983168 - RNA, 20 nt, Homo sapiens
ucccuguuauuuuucugccc

SEQ ID NO: 1983169 - RNA, 17 nt, Homo sapiens
agauuccgcaccaauaa

SEQ ID NO: 1983170 - RNA, 11 nt, Homo sapiens
ugccuuugacc

SEQ ID NO: 1983171 - RNA, 16 nt, Homo sapiens
cuggaagaacugcaug

SEQ ID NO: 1983172 - RNA, 18 nt, Homo sapiens
auuccuguuacuuuacag

SEQ ID NO: 1983173 - RNA, 12 nt, Homo sapiens
aaucacuuugag

SEQ ID NO: 1983174 - RNA, 18 nt, Homo sapiens
cucauccucuccacagcu

SEQ ID NO: 1983175 - RNA, 21 nt, Homo sapiens
ggcccccgaccaacacuugca

SEQ ID NO: 1983176 - RNA, 16 nt, Homo sapiens
ggaauuauucccauga

SEQ ID NO: 1983177 - RNA, 19 nt, Homo sapiens
auucaauaaaaugcacuga

SEQ ID NO: 1983178 - RNA, 18 nt, Homo sapiens
gcugcccccaacacucca

SEQ ID NO: 1983179 - RNA, 20 nt, Homo sapiens
auuaaacuugucagaauuuc

SEQ ID NO: 1983180 - RNA, 21 nt, Homo sapiens
gccaaagccccaugugccuug

SEQ ID NO: 1983181 - RNA, 20 nt, Homo sapiens
ucaguuauaaagucaaggac

SEQ ID NO: 1983182 - RNA, 20 nt, Homo sapiens
gccacugugcccagcaguuu

SEQ ID NO: 1983183 - RNA, 15 nt, Homo sapiens
ucuaaguuccacuga

SEQ ID NO: 1983184 - RNA, 12 nt, Homo sapiens
auugguaaaaac

SEQ ID NO: 1983185 - RNA, 14 nt, Homo sapiens
gaugugagccaccg

SEQ ID NO: 1983186 - RNA, 16 nt, Homo sapiens
acugugaagaucucac

SEQ ID NO: 1983187 - RNA, 12 nt, Homo sapiens
ucuaaucuaugc

SEQ ID NO: 1983188 - RNA, 22 nt, Homo sapiens
ucagcauccagguuuaugaaug

SEQ ID NO: 1983189 - RNA, 20 nt, Homo sapiens
aacuaaugucagcacauguu

SEQ ID NO: 1983190 - RNA, 18 nt, Homo sapiens
uccugggggaugugcacg

SEQ ID NO: 1983191 - RNA, 15 nt, Homo sapiens
agccuggcuggagag

SEQ ID NO: 1983192 - RNA, 14 nt, Homo sapiens
gagucuacagagaa

SEQ ID NO: 1983193 - RNA, 23 nt, Homo sapiens
acgugcaugcuuuaaaaaacaca

SEQ ID NO: 1983194 - RNA, 23 nt, Homo sapiens
aaggagacucaccucugccucaa

SEQ ID NO: 1983195 - RNA, 13 nt, Homo sapiens
guagauaaggaaa

SEQ ID NO: 1983196 - RNA, 19 nt, Homo sapiens
gacauuucuuaaaacuuua

SEQ ID NO: 1983197 - RNA, 21 nt, Homo sapiens
agcagguguaaccguaaccca

SEQ ID NO: 1983198 - RNA, 23 nt, Homo sapiens
gaagggagggccuugauuuccag

SEQ ID NO: 1983199 - RNA, 19 nt, Homo sapiens
auaaguuauugcaguuuau

SEQ ID NO: 1983200 - RNA, 16 nt, Homo sapiens
auaaagugccaguuug

SEQ ID NO: 1983201 - RNA, 12 nt, Homo sapiens
uaaggaacugga

SEQ ID NO: 1983202 - RNA, 21 nt, Homo sapiens
aagcucuagaaucugcaauuc

SEQ ID NO: 1983203 - RNA, 20 nt, Homo sapiens
ugagguggaagagggcugca

SEQ ID NO: 1983204 - RNA, 14 nt, Homo sapiens
ccccaacacgcagg

SEQ ID NO: 1983205 - RNA, 15 nt, Homo sapiens
ucuuaauguuuccaa

SEQ ID NO: 1983206 - RNA, 23 nt, Homo sapiens
auccuggaaggacacagugauga

SEQ ID NO: 1983207 - RNA, 14 nt, Homo sapiens
ccugcugcagggac

SEQ ID NO: 1983208 - RNA, 14 nt, Homo sapiens
ucccugcacauaaa

SEQ ID NO: 1983209 - RNA, 15 nt, Homo sapiens
gaacugcauugacuu

SEQ ID NO: 1983210 - RNA, 16 nt, Homo sapiens
ugcacaccagugucgu

SEQ ID NO: 1983211 - RNA, 17 nt, Homo sapiens
auuaaacguaugcaugu

SEQ ID NO: 1983212 - RNA, 13 nt, Homo sapiens
uugauucacucaa

SEQ ID NO: 1983213 - RNA, 14 nt, Homo sapiens
caccuacugcacuu

SEQ ID NO: 1983214 - RNA, 17 nt, Homo sapiens
ucuauagaaaugaucau

SEQ ID NO: 1983215 - RNA, 20 nt, Homo sapiens
agagccugugugaaaauacu

SEQ ID NO: 1983216 - RNA, 15 nt, Homo sapiens
aguuaaggagccuaa

SEQ ID NO: 1983217 - RNA, 15 nt, Homo sapiens
ccuauuguucacuuu

SEQ ID NO: 1983218 - RNA, 19 nt, Homo sapiens
ucaacacaaagacauggaa

SEQ ID NO: 1983219 - RNA, 17 nt, Homo sapiens
uaacacuggagugguaa

SEQ ID NO: 1983220 - RNA, 16 nt, Homo sapiens
agccucucaccuggac

SEQ ID NO: 1983221 - RNA, 14 nt, Homo sapiens
ggaagcuuacucuc

SEQ ID NO: 1983222 - RNA, 21 nt, Homo sapiens
uuuuaaugauacugucuaaga

SEQ ID NO: 1983223 - RNA, 13 nt, Homo sapiens
accuuagugcaac

SEQ ID NO: 1983224 - RNA, 16 nt, Homo sapiens
ugagacacaggaugaa

SEQ ID NO: 1983225 - RNA, 20 nt, Homo sapiens
uccuuuaccuuucagugcag

SEQ ID NO: 1983226 - RNA, 20 nt, Homo sapiens
gaguuaucuuuaacugacuu

SEQ ID NO: 1983227 - RNA, 21 nt, Homo sapiens
ucugagcaguuucauugugau

SEQ ID NO: 1983228 - RNA, 13 nt, Homo sapiens
agagggcuuccuc

SEQ ID NO: 1983229 - RNA, 22 nt, Homo sapiens
cccuuaauaacauacaaugacc

SEQ ID NO: 1983230 - RNA, 18 nt, Homo sapiens
agcaaacagggcuuuacu

SEQ ID NO: 1983231 - RNA, 14 nt, Homo sapiens
cugcagucaauguu

SEQ ID NO: 1983232 - RNA, 16 nt, Homo sapiens
aacacuuagugaucau

SEQ ID NO: 1983233 - RNA, 19 nt, Homo sapiens
uuuaaugccgauauacucu

SEQ ID NO: 1983234 - RNA, 16 nt, Homo sapiens
acuauuuacuauucaa

SEQ ID NO: 1983235 - RNA, 18 nt, Homo sapiens
agauucaccuaagagauu

SEQ ID NO: 1983236 - RNA, 14 nt, Homo sapiens
aggauggagcugaa

SEQ ID NO: 1983237 - RNA, 19 nt, Homo sapiens
agcaugcaauaaugugcaa

SEQ ID NO: 1983238 - RNA, 22 nt, Homo sapiens
uagugguagagguggugagaag

SEQ ID NO: 1983239 - RNA, 20 nt, Homo sapiens
gaaaauuagacugugauuca

SEQ ID NO: 1983240 - RNA, 19 nt, Homo sapiens
aggaaacccucuucuuccc

SEQ ID NO: 1983241 - RNA, 22 nt, Homo sapiens
ugauuuuuugcauuccugacaa

SEQ ID NO: 1983242 - RNA, 21 nt, Homo sapiens
cccugugacccucucacuuac

SEQ ID NO: 1983243 - RNA, 18 nt, Homo sapiens
uguguucugucaccaacu

SEQ ID NO: 1983244 - RNA, 14 nt, Homo sapiens
gauauaauuacuua

SEQ ID NO: 1983245 - RNA, 20 nt, Homo sapiens
cagccaagagggcugcaaaa

SEQ ID NO: 1983246 - RNA, 14 nt, Homo sapiens
cccuccacauuucc

SEQ ID NO: 1983247 - RNA, 16 nt, Homo sapiens
agcuaggcuaagucaa

SEQ ID NO: 1983248 - RNA, 11 nt, Homo sapiens
auuuuuccacu

SEQ ID NO: 1983249 - RNA, 18 nt, Homo sapiens
acuuaauguaauucagga

SEQ ID NO: 1983250 - RNA, 16 nt, Homo sapiens
acucaagggaaaggca

SEQ ID NO: 1983251 - RNA, 15 nt, Homo sapiens
ugggaaugucucuuu

SEQ ID NO: 1983252 - RNA, 16 nt, Homo sapiens
cuguagaaucuagcca

SEQ ID NO: 1983253 - RNA, 16 nt, Homo sapiens
gcugcgucugcacuga

SEQ ID NO: 1983254 - RNA, 21 nt, Homo sapiens
ccugaguagcugggaugacag

SEQ ID NO: 1983255 - RNA, 15 nt, Homo sapiens
aaaagaccaucuccu

SEQ ID NO: 1983256 - RNA, 21 nt, Homo sapiens
ugcuauccccaucucccugcc

SEQ ID NO: 1983257 - RNA, 22 nt, Homo sapiens
gaguaccuccagucacacuccc

SEQ ID NO: 1983258 - RNA, 19 nt, Homo sapiens
uccaacugggcauuucaau

SEQ ID NO: 1983259 - RNA, 12 nt, Homo sapiens
ggcccaugcaau

SEQ ID NO: 1983260 - RNA, 13 nt, Homo sapiens
gaagagacaggca

SEQ ID NO: 1983261 - RNA, 14 nt, Homo sapiens
uuaagucagagcca

SEQ ID NO: 1983262 - RNA, 13 nt, Homo sapiens
accauaugaauga

SEQ ID NO: 1983263 - RNA, 14 nt, Homo sapiens
uauacguguagcua

SEQ ID NO: 1983264 - RNA, 18 nt, Homo sapiens
ugguaauauugacuugua

SEQ ID NO: 1983265 - RNA, 20 nt, Homo sapiens
aauccacuaugacaucuaag

SEQ ID NO: 1983266 - RNA, 15 nt, Homo sapiens
ccuccuuggugccug

SEQ ID NO: 1983267 - RNA, 20 nt, Homo sapiens
gccuagaguggcagccaaga

SEQ ID NO: 1983268 - RNA, 21 nt, Homo sapiens
caauauuccaguaaaugcaga

SEQ ID NO: 1983269 - RNA, 12 nt, Homo sapiens
caaagacuguau

SEQ ID NO: 1983270 - RNA, 11 nt, Homo sapiens
cacuacaagcu

SEQ ID NO: 1983271 - RNA, 23 nt, Homo sapiens
caggaucagaugacucucuccaa

SEQ ID NO: 1983272 - RNA, 16 nt, Homo sapiens
ccccauuccuacccac

SEQ ID NO: 1983273 - RNA, 18 nt, Homo sapiens
ggacuaacccaaugccug

SEQ ID NO: 1983274 - RNA, 18 nt, Homo sapiens
guauaccuaucacuuaca

SEQ ID NO: 1983275 - RNA, 21 nt, Homo sapiens
agucuugugggggcagcuuuu

SEQ ID NO: 1983276 - RNA, 17 nt, Homo sapiens
uggcauuacaauugcag

SEQ ID NO: 1983277 - RNA, 15 nt, Homo sapiens
agccagaaagcacua

SEQ ID NO: 1983278 - RNA, 15 nt, Homo sapiens
guauaaucccaccca

SEQ ID NO: 1983279 - RNA, 13 nt, Homo sapiens
ucucccaguccau

SEQ ID NO: 1983280 - RNA, 16 nt, Homo sapiens
ggcuccuggugcuaac

SEQ ID NO: 1983281 - RNA, 14 nt, Homo sapiens
gauaacaacacugu

SEQ ID NO: 1983282 - RNA, 22 nt, Homo sapiens
ucagaaggagcuacaaaaccua

SEQ ID NO: 1983283 - RNA, 17 nt, Homo sapiens
ugccaagaccauuucac

SEQ ID NO: 1983284 - RNA, 14 nt, Homo sapiens
cucccuggaugaca

SEQ ID NO: 1983285 - RNA, 18 nt, Homo sapiens
aggguagcccgccugcca

SEQ ID NO: 1983286 - RNA, 14 nt, Homo sapiens
agaacacuccaagc

SEQ ID NO: 1983287 - RNA, 11 nt, Homo sapiens
agcuacuugau

SEQ ID NO: 1983288 - RNA, 20 nt, Homo sapiens
ucagcugagguucauuacaa

SEQ ID NO: 1983289 - RNA, 16 nt, Homo sapiens
auugaacucaaugaua

SEQ ID NO: 1983290 - RNA, 18 nt, Homo sapiens
cggaccuccaucagagcc

SEQ ID NO: 1983291 - RNA, 18 nt, Homo sapiens
agauggacucaggaucca

SEQ ID NO: 1983292 - RNA, 21 nt, Homo sapiens
gccgagauugcaccacugcac

SEQ ID NO: 1983293 - RNA, 18 nt, Homo sapiens
ugggaaacacuccuugca

SEQ ID NO: 1983294 - RNA, 23 nt, Homo sapiens
cuuuuaaagaaaaauaugauacu

SEQ ID NO: 1983295 - RNA, 16 nt, Homo sapiens
cucugauaaaacuggu

SEQ ID NO: 1983296 - RNA, 19 nt, Homo sapiens
ugaaccugagguugcuuua

SEQ ID NO: 1983297 - RNA, 15 nt, Homo sapiens
cuaucaaagcacaua

SEQ ID NO: 1983298 - RNA, 16 nt, Homo sapiens
ggcugcuaggccagag

SEQ ID NO: 1983299 - RNA, 23 nt, Homo sapiens
gcugcccagcugcuccccugcca

SEQ ID NO: 1983300 - RNA, 19 nt, Homo sapiens
uguccuuuccaucugucca

SEQ ID NO: 1983301 - RNA, 15 nt, Homo sapiens
ccuuaaccugggacc

SEQ ID NO: 1983302 - RNA, 17 nt, Homo sapiens
aaguuucaucagucaau

SEQ ID NO: 1983303 - RNA, 22 nt, Homo sapiens
cauuuaaaauugcuauguuacu

SEQ ID NO: 1983304 - RNA, 22 nt, Homo sapiens
uaaaauauuuucuguguguucc

SEQ ID NO: 1983305 - RNA, 13 nt, Homo sapiens
cagcucuaagcag

SEQ ID NO: 1983306 - RNA, 21 nt, Homo sapiens
acaaaaaggugcagaaggcaa

SEQ ID NO: 1983307 - RNA, 18 nt, Homo sapiens
uucaucugacuaugacau

SEQ ID NO: 1983308 - RNA, 17 nt, Homo sapiens
auggcuuguucagucac

SEQ ID NO: 1983309 - RNA, 17 nt, Homo sapiens
cagcaaaacuuuccaac

SEQ ID NO: 1983310 - RNA, 19 nt, Homo sapiens
ccuguucuuccuaccaaau

SEQ ID NO: 1983311 - RNA, 17 nt, Homo sapiens
uauuauuuuagugugua

SEQ ID NO: 1983312 - RNA, 18 nt, Homo sapiens
auugucuguaaugacaaa

SEQ ID NO: 1983313 - RNA, 20 nt, Homo sapiens
cuuaacacuaccaauuuccc

SEQ ID NO: 1983314 - RNA, 14 nt, Homo sapiens
agacccuuucccca

SEQ ID NO: 1983315 - RNA, 19 nt, Homo sapiens
ccuggaagcaggugcuaca

SEQ ID NO: 1983316 - RNA, 14 nt, Homo sapiens
cccuccacauccca

SEQ ID NO: 1983317 - RNA, 24 nt, Homo sapiens
aacaggaauuucuguuagcaauau

SEQ ID NO: 1983318 - RNA, 19 nt, Homo sapiens
uucuaggccaaaaauggug

SEQ ID NO: 1983319 - RNA, 23 nt, Homo sapiens
gcuauuugccaagaccauuucac

SEQ ID NO: 1983320 - RNA, 12 nt, Homo sapiens
ccuaaugcuccu

SEQ ID NO: 1983321 - RNA, 20 nt, Homo sapiens
gucuggggagaaaucccuca

SEQ ID NO: 1983322 - RNA, 20 nt, Homo sapiens
ccacauugagaucacuacuc

SEQ ID NO: 1983323 - RNA, 18 nt, Homo sapiens
accugcguugugagcucu

SEQ ID NO: 1983324 - RNA, 15 nt, Homo sapiens
auucaccaaccaaag

SEQ ID NO: 1983325 - RNA, 20 nt, Homo sapiens
agacccugccaacuuuccag

SEQ ID NO: 1983326 - RNA, 20 nt, Homo sapiens
aagugauccacccaccucag

SEQ ID NO: 1983327 - RNA, 20 nt, Homo sapiens
aggugauccgcccaccucag

SEQ ID NO: 1983328 - RNA, 14 nt, Homo sapiens
cguuucugcucugu

SEQ ID NO: 1983329 - RNA, 18 nt, Homo sapiens
caaacuacagaauaaugu

SEQ ID NO: 1983330 - RNA, 12 nt, Homo sapiens
cauugauguuaa

SEQ ID NO: 1983331 - RNA, 22 nt, Homo sapiens
agaaguucuuguucuucaggag

SEQ ID NO: 1983332 - RNA, 16 nt, Homo sapiens
accccuaugaacucuu

SEQ ID NO: 1983333 - RNA, 15 nt, Homo sapiens
gacagagcaagugag

SEQ ID NO: 1983334 - RNA, 19 nt, Homo sapiens
aaagaaaauauaguuugau

SEQ ID NO: 1983335 - RNA, 14 nt, Homo sapiens
agcauuagguauau

SEQ ID NO: 1983336 - RNA, 17 nt, Homo sapiens
acucuguaaaagugucu

SEQ ID NO: 1983337 - RNA, 16 nt, Homo sapiens
ugcauuuuguguacag

SEQ ID NO: 1983338 - RNA, 18 nt, Homo sapiens
gaacaaccucggcuccug

SEQ ID NO: 1983339 - RNA, 19 nt, Homo sapiens
gaaauaacaagucgaugaa

SEQ ID NO: 1983340 - RNA, 18 nt, Homo sapiens
acaauuucuuuugguuca

SEQ ID NO: 1983341 - RNA, 13 nt, Homo sapiens
ugucaugccaaaa

SEQ ID NO: 1983342 - RNA, 21 nt, Homo sapiens
ccgugccaaaaaucuuuucau

SEQ ID NO: 1983343 - RNA, 16 nt, Homo sapiens
aucguggagacagggc

SEQ ID NO: 1983344 - RNA, 13 nt, Homo sapiens
ugcaccacuuuua

SEQ ID NO: 1983345 - RNA, 16 nt, Homo sapiens
guauuagcucacugaa

SEQ ID NO: 1983346 - RNA, 21 nt, Homo sapiens
auggaugggggaacucagauc

SEQ ID NO: 1983347 - RNA, 17 nt, Homo sapiens
caagaaaaacaucuuug

SEQ ID NO: 1983348 - RNA, 21 nt, Homo sapiens
gguuugauuucuaaguguuuc

SEQ ID NO: 1983349 - RNA, 19 nt, Homo sapiens
cugaggaggggccugggca

SEQ ID NO: 1983350 - RNA, 18 nt, Homo sapiens
cauacagaguguccugau

SEQ ID NO: 1983351 - RNA, 20 nt, Homo sapiens
aggauauugggucucagccc

SEQ ID NO: 1983352 - RNA, 12 nt, Homo sapiens
cuaaccaagaga

SEQ ID NO: 1983353 - RNA, 16 nt, Homo sapiens
ugucgccucugcauuc

SEQ ID NO: 1983354 - RNA, 24 nt, Homo sapiens
gcaguuaugugaccucacgugcaa

SEQ ID NO: 1983355 - RNA, 18 nt, Homo sapiens
guccagcucagucucagc

SEQ ID NO: 1983356 - RNA, 18 nt, Homo sapiens
ccgccuuccuggagaccc

SEQ ID NO: 1983357 - RNA, 21 nt, Homo sapiens
gugaaaggaagcuccacuguc

SEQ ID NO: 1983358 - RNA, 13 nt, Homo sapiens
acgauggaguaca

SEQ ID NO: 1983359 - RNA, 21 nt, Homo sapiens
uuagaaaaauccuacaaggcu

SEQ ID NO: 1983360 - RNA, 14 nt, Homo sapiens
auuccuugauucac

SEQ ID NO: 1983361 - RNA, 12 nt, Homo sapiens
agaacuuuagua

SEQ ID NO: 1983362 - RNA, 12 nt, Homo sapiens
guuacuuuguaa

SEQ ID NO: 1983363 - RNA, 19 nt, Homo sapiens
agguggggaccaaaaccau

SEQ ID NO: 1983364 - RNA, 19 nt, Homo sapiens
gcgccaagucuggcaccau

SEQ ID NO: 1983365 - RNA, 23 nt, Homo sapiens
ugaagaugauaccugaagcuguc

SEQ ID NO: 1983366 - RNA, 16 nt, Homo sapiens
uguguuggauuaauua

SEQ ID NO: 1983367 - RNA, 18 nt, Homo sapiens
guccagucucuucugcug

SEQ ID NO: 1983368 - RNA, 22 nt, Homo sapiens
ggcgcguuugugcauaucugcc

SEQ ID NO: 1983369 - RNA, 15 nt, Homo sapiens
ccuggugaaagagua

SEQ ID NO: 1983370 - RNA, 21 nt, Homo sapiens
ugucaacaaagugcuuuuuca

SEQ ID NO: 1983371 - RNA, 20 nt, Homo sapiens
uucccccacacccagaucac

SEQ ID NO: 1983372 - RNA, 12 nt, Homo sapiens
agaauuugcaca

SEQ ID NO: 1983373 - RNA, 14 nt, Homo sapiens
agucagaugcccag

SEQ ID NO: 1983374 - RNA, 23 nt, Homo sapiens
gaggucauuaaaauuacauugag

SEQ ID NO: 1983375 - RNA, 21 nt, Homo sapiens
caacccugcccacuucagccc

SEQ ID NO: 1983376 - RNA, 22 nt, Homo sapiens
ccuugcccacggcaacugccuu

SEQ ID NO: 1983377 - RNA, 16 nt, Homo sapiens
agaacuauguacuuua

SEQ ID NO: 1983378 - RNA, 13 nt, Homo sapiens
ugggcuacaagga

SEQ ID NO: 1983379 - RNA, 24 nt, Homo sapiens
uaaauucagccaacaugugacuaa

SEQ ID NO: 1983380 - RNA, 17 nt, Homo sapiens
uacaaaugugugacugc

SEQ ID NO: 1983381 - RNA, 11 nt, Homo sapiens
gcugugcugcu

SEQ ID NO: 1983382 - RNA, 11 nt, Homo sapiens
ccagugcucca

SEQ ID NO: 1983383 - RNA, 20 nt, Homo sapiens
cuaagucauuccuccagugc

SEQ ID NO: 1983384 - RNA, 18 nt, Homo sapiens
ugggagugaacauuucua

SEQ ID NO: 1983385 - RNA, 17 nt, Homo sapiens
ccaugaggcaaugucag

SEQ ID NO: 1983386 - RNA, 14 nt, Homo sapiens
uccuguguagcaua

SEQ ID NO: 1983387 - RNA, 19 nt, Homo sapiens
gccacacccuccccauuca

SEQ ID NO: 1983388 - RNA, 19 nt, Homo sapiens
auauaugugaggauguauc

SEQ ID NO: 1983389 - RNA, 22 nt, Homo sapiens
guuauccuuguuccuguuacaa

SEQ ID NO: 1983390 - RNA, 18 nt, Homo sapiens
agauuauauauuauuucu

SEQ ID NO: 1983391 - RNA, 14 nt, Homo sapiens
aaguuucacucaca

SEQ ID NO: 1983392 - RNA, 22 nt, Homo sapiens
ggaaccucccuagguccuuccc

SEQ ID NO: 1983393 - RNA, 20 nt, Homo sapiens
uaguuuugucaaacuguaga

SEQ ID NO: 1983394 - RNA, 23 nt, Homo sapiens
uccucuacugugcaucuccuuga

SEQ ID NO: 1983395 - RNA, 22 nt, Homo sapiens
aaugcauccaaauaggagucuu

SEQ ID NO: 1983396 - RNA, 15 nt, Homo sapiens
gugcccuguagcucc

SEQ ID NO: 1983397 - RNA, 22 nt, Homo sapiens
uuucuaacucacaggcauagag

SEQ ID NO: 1983398 - RNA, 20 nt, Homo sapiens
aaaaugaaguuuugauuuau

SEQ ID NO: 1983399 - RNA, 18 nt, Homo sapiens
caccuguugcuuacaauu

SEQ ID NO: 1983400 - RNA, 13 nt, Homo sapiens
aagagaagcauca

SEQ ID NO: 1983401 - RNA, 16 nt, Homo sapiens
ugaaauuauccauggu

SEQ ID NO: 1983402 - RNA, 23 nt, Homo sapiens
ccaucgucuuguguacacugcuc

SEQ ID NO: 1983403 - RNA, 13 nt, Homo sapiens
uaaguuucacuga

SEQ ID NO: 1983404 - RNA, 17 nt, Homo sapiens
uuaaagcuuaaacugaa

SEQ ID NO: 1983405 - RNA, 19 nt, Homo sapiens
augccagccacugugauag

SEQ ID NO: 1983406 - RNA, 16 nt, Homo sapiens
ucugccccugaucacu

SEQ ID NO: 1983407 - RNA, 11 nt, Homo sapiens
gccagaccuca

SEQ ID NO: 1983408 - RNA, 15 nt, Homo sapiens
gagcacuuguuuuaa

SEQ ID NO: 1983409 - RNA, 19 nt, Homo sapiens
agugauuuagaacagucau

SEQ ID NO: 1983410 - RNA, 21 nt, Homo sapiens
uacaaggaagggccaccacac

SEQ ID NO: 1983411 - RNA, 18 nt, Homo sapiens
aguaauaucaaagcauuu

SEQ ID NO: 1983412 - RNA, 16 nt, Homo sapiens
auggcccuaccagaca

SEQ ID NO: 1983413 - RNA, 20 nt, Homo sapiens
aaaggaagagaaaugcaacg

SEQ ID NO: 1983414 - RNA, 17 nt, Homo sapiens
uacuggucccacuucac

SEQ ID NO: 1983415 - RNA, 16 nt, Homo sapiens
acugauaaaccuaaua

SEQ ID NO: 1983416 - RNA, 17 nt, Homo sapiens
gauauauucucuaauaa

SEQ ID NO: 1983417 - RNA, 14 nt, Homo sapiens
cccacauauuucaa

SEQ ID NO: 1983418 - RNA, 15 nt, Homo sapiens
ggcugguuaccacca

SEQ ID NO: 1983419 - RNA, 16 nt, Homo sapiens
gcccaggccagcacuu

SEQ ID NO: 1983420 - RNA, 17 nt, Homo sapiens
acucaccucugccucaa

SEQ ID NO: 1983421 - RNA, 21 nt, Homo sapiens
cuugcaagggaagagccuuua

SEQ ID NO: 1983422 - RNA, 14 nt, Homo sapiens
gucucguggcaaca

SEQ ID NO: 1983423 - RNA, 23 nt, Homo sapiens
gaacagaauguuuuacugugaaa

SEQ ID NO: 1983424 - RNA, 13 nt, Homo sapiens
ugacuuacuguac

SEQ ID NO: 1983425 - RNA, 21 nt, Homo sapiens
ccacuguuucucuugagcugg

SEQ ID NO: 1983426 - RNA, 14 nt, Homo sapiens
agcuuacaugagaa

SEQ ID NO: 1983427 - RNA, 17 nt, Homo sapiens
gugccagaauccucuca

SEQ ID NO: 1983428 - RNA, 20 nt, Homo sapiens
ucggggcaggaagucccuga

SEQ ID NO: 1983429 - RNA, 15 nt, Homo sapiens
auggcagaagacacc

SEQ ID NO: 1983430 - RNA, 18 nt, Homo sapiens
uaaagaaucuaauucugu

SEQ ID NO: 1983431 - RNA, 19 nt, Homo sapiens
acacaccccaacaugccug

SEQ ID NO: 1983432 - RNA, 18 nt, Homo sapiens
guguugugagagcuggga

SEQ ID NO: 1983433 - RNA, 15 nt, Homo sapiens
acuacaccacgagaa

SEQ ID NO: 1983434 - RNA, 16 nt, Homo sapiens
aaaguugcugugaaua

SEQ ID NO: 1983435 - RNA, 15 nt, Homo sapiens
cugaagcuguucuca

SEQ ID NO: 1983436 - RNA, 23 nt, Homo sapiens
ugguuccggaauccuguccucag

SEQ ID NO: 1983437 - RNA, 21 nt, Homo sapiens
gcaggcugggacggaccagca

SEQ ID NO: 1983438 - RNA, 14 nt, Homo sapiens
aacacugucugcau

SEQ ID NO: 1983439 - RNA, 22 nt, Homo sapiens
aaaugucugccauuugcugcuu

SEQ ID NO: 1983440 - RNA, 14 nt, Homo sapiens
uaaaucuccagugg

SEQ ID NO: 1983441 - RNA, 23 nt, Homo sapiens
ugaggcaaucuaagggagucauu

SEQ ID NO: 1983442 - RNA, 14 nt, Homo sapiens
aaugggacagggug

SEQ ID NO: 1983443 - RNA, 17 nt, Homo sapiens
ugagccaccguguccuu

SEQ ID NO: 1983444 - RNA, 14 nt, Homo sapiens
caaaauaaugaagu

SEQ ID NO: 1983445 - RNA, 13 nt, Homo sapiens
guuaaaacauaag

SEQ ID NO: 1983446 - RNA, 15 nt, Homo sapiens
uugaucauuucugcc

SEQ ID NO: 1983447 - RNA, 23 nt, Homo sapiens
uuaacuguucaguauugcaauaa

SEQ ID NO: 1983448 - RNA, 17 nt, Homo sapiens
auuaucuauacauaaaa

SEQ ID NO: 1983449 - RNA, 15 nt, Homo sapiens
cugaaccauguggca

SEQ ID NO: 1983450 - RNA, 20 nt, Homo sapiens
ugaggagcuguuacugaaua

SEQ ID NO: 1983451 - RNA, 23 nt, Homo sapiens
uguauaaaaaagaaaacuugugu

SEQ ID NO: 1983452 - RNA, 22 nt, Homo sapiens
aggucugcccggagcagcagcu

SEQ ID NO: 1983453 - RNA, 14 nt, Homo sapiens
ucagggaccaagga

SEQ ID NO: 1983454 - RNA, 23 nt, Homo sapiens
gagaaagagaaaucaauagugca

SEQ ID NO: 1983455 - RNA, 15 nt, Homo sapiens
auugcacugaucuua

SEQ ID NO: 1983456 - RNA, 18 nt, Homo sapiens
uccucuaugaacuaugga

SEQ ID NO: 1983457 - RNA, 15 nt, Homo sapiens
uugguguacuguaau

SEQ ID NO: 1983458 - RNA, 16 nt, Homo sapiens
gccccaaacuuucuca

SEQ ID NO: 1983459 - RNA, 18 nt, Homo sapiens
auguuugaguauucugca

SEQ ID NO: 1983460 - RNA, 17 nt, Homo sapiens
guggggcaagauuuucc

SEQ ID NO: 1983461 - RNA, 13 nt, Homo sapiens
aagaggccuguuu

SEQ ID NO: 1983462 - RNA, 21 nt, Homo sapiens
caaagauuugacaugcuccac

SEQ ID NO: 1983463 - RNA, 14 nt, Homo sapiens
guaagaacugcucu

SEQ ID NO: 1983464 - RNA, 21 nt, Homo sapiens
guauaaaggcuaaaagggaaa

SEQ ID NO: 1983465 - RNA, 19 nt, Homo sapiens
cauucagagcuauggugcu

SEQ ID NO: 1983466 - RNA, 19 nt, Homo sapiens
uguuuacugacauggugcu

SEQ ID NO: 1983467 - RNA, 14 nt, Homo sapiens
uccuaacuagaauu

SEQ ID NO: 1983468 - RNA, 21 nt, Homo sapiens
gacauuugggagacaugugac

SEQ ID NO: 1983469 - RNA, 22 nt, Homo sapiens
cuaaugugcauuaaaacaaauc

SEQ ID NO: 1983470 - RNA, 20 nt, Homo sapiens
ugcucauuuucuuuaggaca

SEQ ID NO: 1983471 - RNA, 16 nt, Homo sapiens
ccggaagucuguucuc

SEQ ID NO: 1983472 - RNA, 18 nt, Homo sapiens
cuuucccuucuuggugcu

SEQ ID NO: 1983473 - RNA, 12 nt, Homo sapiens
ugacagaacaag

SEQ ID NO: 1983474 - RNA, 19 nt, Homo sapiens
agaaggcaggaacacugga

SEQ ID NO: 1983475 - RNA, 13 nt, Homo sapiens
ugcaggcacagua

SEQ ID NO: 1983476 - RNA, 17 nt, Homo sapiens
caaguuguguuugauau

SEQ ID NO: 1983477 - RNA, 19 nt, Homo sapiens
aauucuguauuaacugaau

SEQ ID NO: 1983478 - RNA, 20 nt, Homo sapiens
aguuguagaagaaaauuuaa

SEQ ID NO: 1983479 - RNA, 13 nt, Homo sapiens
gauagaugucuau

SEQ ID NO: 1983480 - RNA, 13 nt, Homo sapiens
acagcuuccccau

SEQ ID NO: 1983481 - RNA, 22 nt, Homo sapiens
cauccauagugcacuagcauuu

SEQ ID NO: 1983482 - RNA, 23 nt, Homo sapiens
acgcagaagagggggaggggaag

SEQ ID NO: 1983483 - RNA, 15 nt, Homo sapiens
cucccacauugucac

SEQ ID NO: 1983484 - RNA, 17 nt, Homo sapiens
uuucagugauaucuuuc

SEQ ID NO: 1983485 - RNA, 15 nt, Homo sapiens
acgguaggccaagcu

SEQ ID NO: 1983486 - RNA, 20 nt, Homo sapiens
uagagaucuauguacuguaa

SEQ ID NO: 1983487 - RNA, 20 nt, Homo sapiens
uaauuagcauggccacaucu

SEQ ID NO: 1983488 - RNA, 14 nt, Homo sapiens
auguucaugugauu

SEQ ID NO: 1983489 - RNA, 21 nt, Homo sapiens
agggaaggagcccagccagaa

SEQ ID NO: 1983490 - RNA, 14 nt, Homo sapiens
uggaccccaucugu

SEQ ID NO: 1983491 - RNA, 21 nt, Homo sapiens
auaucagcuuuucugauggua

SEQ ID NO: 1983492 - RNA, 19 nt, Homo sapiens
aauaauauaaaauguuuca

SEQ ID NO: 1983493 - RNA, 23 nt, Homo sapiens
ucugacgucaacccaagcucugg

SEQ ID NO: 1983494 - RNA, 12 nt, Homo sapiens
uaaauacauucg

SEQ ID NO: 1983495 - RNA, 21 nt, Homo sapiens
aacuugccagugugugauuca

SEQ ID NO: 1983496 - RNA, 17 nt, Homo sapiens
cgacugagccaugcuca

SEQ ID NO: 1983497 - RNA, 17 nt, Homo sapiens
aacucgcacaaccauga

SEQ ID NO: 1983498 - RNA, 16 nt, Homo sapiens
uuaaguaggaaucuga

SEQ ID NO: 1983499 - RNA, 14 nt, Homo sapiens
accugcuucuauua

SEQ ID NO: 1983500 - RNA, 21 nt, Homo sapiens
ugccuuaucaaaagagcaaaa

SEQ ID NO: 1983501 - RNA, 14 nt, Homo sapiens
caaaggugugcaaa

SEQ ID NO: 1983502 - RNA, 15 nt, Homo sapiens
agacuaucaguuccc

SEQ ID NO: 1983503 - RNA, 21 nt, Homo sapiens
gcccuggagaagcagcuaaca

SEQ ID NO: 1983504 - RNA, 15 nt, Homo sapiens
uacaucuaugugaug

SEQ ID NO: 1983505 - RNA, 15 nt, Homo sapiens
cugcugcccagugca

SEQ ID NO: 1983506 - RNA, 21 nt, Homo sapiens
agagagcaaucuugcugugaa

SEQ ID NO: 1983507 - RNA, 12 nt, Homo sapiens
guucugucauau

SEQ ID NO: 1983508 - RNA, 18 nt, Homo sapiens
cacucuccugaggagcag

SEQ ID NO: 1983509 - RNA, 17 nt, Homo sapiens
gaaagcagggacuugaa

SEQ ID NO: 1983510 - RNA, 14 nt, Homo sapiens
ugguagcucaggug

SEQ ID NO: 1983511 - RNA, 19 nt, Homo sapiens
uaacagaacagcuucaggu

SEQ ID NO: 1983512 - RNA, 21 nt, Homo sapiens
acuugggaauaaaucauagca

SEQ ID NO: 1983513 - RNA, 15 nt, Homo sapiens
ugugugggcacgugu

SEQ ID NO: 1983514 - RNA, 14 nt, Homo sapiens
gcucugagcuguca

SEQ ID NO: 1983515 - RNA, 19 nt, Homo sapiens
cacuuaguccuuuaucauc

SEQ ID NO: 1983516 - RNA, 18 nt, Homo sapiens
uaagcauugguuauucaa

SEQ ID NO: 1983517 - RNA, 13 nt, Homo sapiens
gagaaggggccca

SEQ ID NO: 1983518 - RNA, 18 nt, Homo sapiens
ucagcccuuggggguccu

SEQ ID NO: 1983519 - RNA, 11 nt, Homo sapiens
guuuucauuaa

SEQ ID NO: 1983520 - RNA, 21 nt, Homo sapiens
gcacaggcuggagugcagugg

SEQ ID NO: 1983521 - RNA, 13 nt, Homo sapiens
auagcccaaaaca

SEQ ID NO: 1983522 - RNA, 18 nt, Homo sapiens
acucccaaacuccaagac

SEQ ID NO: 1983523 - RNA, 17 nt, Homo sapiens
ugcaaagcgcuauuuca

SEQ ID NO: 1983524 - RNA, 14 nt, Homo sapiens
aaauucaucuagac

SEQ ID NO: 1983525 - RNA, 21 nt, Homo sapiens
uaaacucgagauacagcuuuu

SEQ ID NO: 1983526 - RNA, 17 nt, Homo sapiens
acccaaauguucaucaa

SEQ ID NO: 1983527 - RNA, 13 nt, Homo sapiens
aaugguaagcauu

SEQ ID NO: 1983528 - RNA, 19 nt, Homo sapiens
gcuccgccccagcccucag

SEQ ID NO: 1983529 - RNA, 19 nt, Homo sapiens
uuggauggagacuccauga

SEQ ID NO: 1983530 - RNA, 16 nt, Homo sapiens
auggggcauguccuuu

SEQ ID NO: 1983531 - RNA, 22 nt, Homo sapiens
ucuuuccaagaccaaccuacaa

SEQ ID NO: 1983532 - RNA, 16 nt, Homo sapiens
ggggacugccuggaga

SEQ ID NO: 1983533 - RNA, 13 nt, Homo sapiens
uggugccaagcuu

SEQ ID NO: 1983534 - RNA, 15 nt, Homo sapiens
gacccucaccuuccu

SEQ ID NO: 1983535 - RNA, 14 nt, Homo sapiens
ccaaaguugcucac

SEQ ID NO: 1983536 - RNA, 19 nt, Homo sapiens
agcaaccagagcacuguau

SEQ ID NO: 1983537 - RNA, 17 nt, Homo sapiens
gcccugacuccuggacu

SEQ ID NO: 1983538 - RNA, 21 nt, Homo sapiens
cagcuccagcuguuaccugag

SEQ ID NO: 1983539 - RNA, 23 nt, Homo sapiens
acucaucccuguuccucaaggcc

SEQ ID NO: 1983540 - RNA, 17 nt, Homo sapiens
gcaauaaacauaugugu

SEQ ID NO: 1983541 - RNA, 23 nt, Homo sapiens
acuucucugcugccucuguggaa

SEQ ID NO: 1983542 - RNA, 20 nt, Homo sapiens
ugagacagccggaucuugga

SEQ ID NO: 1983543 - RNA, 16 nt, Homo sapiens
auauaguuauugcaca

SEQ ID NO: 1983544 - RNA, 15 nt, Homo sapiens
augggccacacaagu

SEQ ID NO: 1983545 - RNA, 19 nt, Homo sapiens
gaugguggugcauccguga

SEQ ID NO: 1983546 - RNA, 18 nt, Homo sapiens
ucuggaauccaaaccaca

SEQ ID NO: 1983547 - RNA, 14 nt, Homo sapiens
uucugaccaaaaug

SEQ ID NO: 1983548 - RNA, 19 nt, Homo sapiens
gccuucugccugcugacca

SEQ ID NO: 1983549 - RNA, 19 nt, Homo sapiens
uggaauuuucauacacgua

SEQ ID NO: 1983550 - RNA, 14 nt, Homo sapiens
cuuugguauuucac

SEQ ID NO: 1983551 - RNA, 11 nt, Homo sapiens
uguaacacauu

SEQ ID NO: 1983552 - RNA, 14 nt, Homo sapiens
uuaacaguaucuca

SEQ ID NO: 1983553 - RNA, 19 nt, Homo sapiens
uuccaaucauacaaauacu

SEQ ID NO: 1983554 - RNA, 18 nt, Homo sapiens
ggcauaaugaguuccuga

SEQ ID NO: 1983555 - RNA, 14 nt, Homo sapiens
agagccugugaucc

SEQ ID NO: 1983556 - RNA, 22 nt, Homo sapiens
caacaucuuuuuaaccugcaaa

SEQ ID NO: 1983557 - RNA, 15 nt, Homo sapiens
agucacucacacugg

SEQ ID NO: 1983558 - RNA, 22 nt, Homo sapiens
cacguucugauuucugcccuug

SEQ ID NO: 1983559 - RNA, 13 nt, Homo sapiens
cuguauacuuuag

SEQ ID NO: 1983560 - RNA, 13 nt, Homo sapiens
ucccaguguucca

SEQ ID NO: 1983561 - RNA, 17 nt, Homo sapiens
aacuguagguaugaucu

SEQ ID NO: 1983562 - RNA, 13 nt, Homo sapiens
ucugaaaacauca

SEQ ID NO: 1983563 - RNA, 15 nt, Homo sapiens
uuccuuuccuuucau

SEQ ID NO: 1983564 - RNA, 20 nt, Homo sapiens
cauuaaaacaaauccauaau

SEQ ID NO: 1983565 - RNA, 14 nt, Homo sapiens
gcaguguuugcucc

SEQ ID NO: 1983566 - RNA, 14 nt, Homo sapiens
uuagauuaaaucuc

SEQ ID NO: 1983567 - RNA, 17 nt, Homo sapiens
gcuuccucacuccaaaa

SEQ ID NO: 1983568 - RNA, 21 nt, Homo sapiens
aaucagauugacagcauauag

SEQ ID NO: 1983569 - RNA, 14 nt, Homo sapiens
aaaugaaacacuuu

SEQ ID NO: 1983570 - RNA, 13 nt, Homo sapiens
gaugagaguacac

SEQ ID NO: 1983571 - RNA, 23 nt, Homo sapiens
aaggcugaugucuuaacugucac

SEQ ID NO: 1983572 - RNA, 20 nt, Homo sapiens
agagauuugcuuuaccuucc

SEQ ID NO: 1983573 - RNA, 19 nt, Homo sapiens
aucuauagcuaaguacaca

SEQ ID NO: 1983574 - RNA, 18 nt, Homo sapiens
uuuaacaugguauuauca

SEQ ID NO: 1983575 - RNA, 15 nt, Homo sapiens
uaaugauaaaguaau

SEQ ID NO: 1983576 - RNA, 21 nt, Homo sapiens
aggagaggggaggucacucuu

SEQ ID NO: 1983577 - RNA, 19 nt, Homo sapiens
caccaggaggcggcagugc

SEQ ID NO: 1983578 - RNA, 19 nt, Homo sapiens
aagggccacgacaaagcag

SEQ ID NO: 1983579 - RNA, 15 nt, Homo sapiens
aaggugaguucucac

SEQ ID NO: 1983580 - RNA, 19 nt, Homo sapiens
cuauaucaaacaugcacac

SEQ ID NO: 1983581 - RNA, 22 nt, Homo sapiens
caccuggguuggucuaauccua

SEQ ID NO: 1983582 - RNA, 22 nt, Homo sapiens
uuaaguaagcaacagcauaaca

SEQ ID NO: 1983583 - RNA, 22 nt, Homo sapiens
gcaauacgggagugacccagcu

SEQ ID NO: 1983584 - RNA, 19 nt, Homo sapiens
gaagagucccggagcucaa

SEQ ID NO: 1983585 - RNA, 13 nt, Homo sapiens
auacgaaggugag

SEQ ID NO: 1983586 - RNA, 19 nt, Homo sapiens
uccuaagccaugggagaca

SEQ ID NO: 1983587 - RNA, 19 nt, Homo sapiens
gaggacuguugacauccaa

SEQ ID NO: 1983588 - RNA, 21 nt, Homo sapiens
agcaguuacugugaauguucc

SEQ ID NO: 1983589 - RNA, 22 nt, Homo sapiens
cuuaucucccugcuucauaucu

SEQ ID NO: 1983590 - RNA, 23 nt, Homo sapiens
caaaggcccccuacgccaaucaa

SEQ ID NO: 1983591 - RNA, 14 nt, Homo sapiens
aauguaagcuguuu

SEQ ID NO: 1983592 - RNA, 14 nt, Homo sapiens
caagucacagacug

SEQ ID NO: 1983593 - RNA, 22 nt, Homo sapiens
acccugauuuuacacacauuaa

SEQ ID NO: 1983594 - RNA, 12 nt, Homo sapiens
agaaaugucuaa

SEQ ID NO: 1983595 - RNA, 15 nt, Homo sapiens
acucgcacuuaucaa

SEQ ID NO: 1983596 - RNA, 16 nt, Homo sapiens
caaaucugcaccccac

SEQ ID NO: 1983597 - RNA, 16 nt, Homo sapiens
gaggagaaacuggaac

SEQ ID NO: 1983598 - RNA, 21 nt, Homo sapiens
cagcuuugucuccaaagaaga

SEQ ID NO: 1983599 - RNA, 19 nt, Homo sapiens
ugucuaaaaauaaaaugca

SEQ ID NO: 1983600 - RNA, 16 nt, Homo sapiens
uaacucccuuuuuaca

SEQ ID NO: 1983601 - RNA, 19 nt, Homo sapiens
cuccggggucugugcugug

SEQ ID NO: 1983602 - RNA, 22 nt, Homo sapiens
guccgugaauggucucugucaa

SEQ ID NO: 1983603 - RNA, 13 nt, Homo sapiens
cagauaaauuuca

SEQ ID NO: 1983604 - RNA, 13 nt, Homo sapiens
cugaaaaauaucu

SEQ ID NO: 1983605 - RNA, 15 nt, Homo sapiens
gccccucucuaggga

SEQ ID NO: 1983606 - RNA, 15 nt, Homo sapiens
gaaaagggaucugcu

SEQ ID NO: 1983607 - RNA, 21 nt, Homo sapiens
cagacuagcuuucagucuucu

SEQ ID NO: 1983608 - RNA, 21 nt, Homo sapiens
cuuccaaaccaccuucccuca

SEQ ID NO: 1983609 - RNA, 23 nt, Homo sapiens
auuagggacuugugucacaucuc

SEQ ID NO: 1983610 - RNA, 15 nt, Homo sapiens
gaaacauugcaugua

SEQ ID NO: 1983611 - RNA, 15 nt, Homo sapiens
ggaacgucagccagc

SEQ ID NO: 1983612 - RNA, 19 nt, Homo sapiens
uccacagggacacacguga

SEQ ID NO: 1983613 - RNA, 17 nt, Homo sapiens
aaugcuacauacuccaa

SEQ ID NO: 1983614 - RNA, 18 nt, Homo sapiens
caccugccaaaugaauaa

SEQ ID NO: 1983615 - RNA, 23 nt, Homo sapiens
aaguugaauuuucuuuccagcca

SEQ ID NO: 1983616 - RNA, 17 nt, Homo sapiens
aauuuguuuuagccauu

SEQ ID NO: 1983617 - RNA, 13 nt, Homo sapiens
gccacccuaccug

SEQ ID NO: 1983618 - RNA, 13 nt, Homo sapiens
gcagucauaucaa

SEQ ID NO: 1983619 - RNA, 15 nt, Homo sapiens
accaagugaggccau

SEQ ID NO: 1983620 - RNA, 14 nt, Homo sapiens
uagcuaacuacugu

SEQ ID NO: 1983621 - RNA, 12 nt, Homo sapiens
ugaucugugaua

SEQ ID NO: 1983622 - RNA, 22 nt, Homo sapiens
aaaccauaaaacccuauacaag

SEQ ID NO: 1983623 - RNA, 17 nt, Homo sapiens
auguuuccugcucuucc

SEQ ID NO: 1983624 - RNA, 16 nt, Homo sapiens
aaggcuccaucuccag

SEQ ID NO: 1983625 - RNA, 20 nt, Homo sapiens
uaaucaauaucccaacauuc

SEQ ID NO: 1983626 - RNA, 13 nt, Homo sapiens
cgaacagggacuu

SEQ ID NO: 1983627 - RNA, 15 nt, Homo sapiens
cuguacaugacugua

SEQ ID NO: 1983628 - RNA, 21 nt, Homo sapiens
cacuggcauuaaagugcugua

SEQ ID NO: 1983629 - RNA, 13 nt, Homo sapiens
uagcaaaagaaga

SEQ ID NO: 1983630 - RNA, 19 nt, Homo sapiens
aggacuugcuaaagcacuu

SEQ ID NO: 1983631 - RNA, 13 nt, Homo sapiens
ugccuacauuccc

SEQ ID NO: 1983632 - RNA, 11 nt, Homo sapiens
aguugugauug

SEQ ID NO: 1983633 - RNA, 17 nt, Homo sapiens
ccuguuuaaaaaaagua

SEQ ID NO: 1983634 - RNA, 12 nt, Homo sapiens
agugauccuccc

SEQ ID NO: 1983635 - RNA, 23 nt, Homo sapiens
cuuggcucccucugcugaucuca

SEQ ID NO: 1983636 - RNA, 16 nt, Homo sapiens
uagccaucuaaugcuu

SEQ ID NO: 1983637 - RNA, 23 nt, Homo sapiens
ccuagaacuuuguuaacgcacuu

SEQ ID NO: 1983638 - RNA, 12 nt, Homo sapiens
cuauacugcacu

SEQ ID NO: 1983639 - RNA, 15 nt, Homo sapiens
cauuuguacugaccc

SEQ ID NO: 1983640 - RNA, 15 nt, Homo sapiens
uauauagcagcuuua

SEQ ID NO: 1983641 - RNA, 15 nt, Homo sapiens
gauuuuuuauugcua

SEQ ID NO: 1983642 - RNA, 19 nt, Homo sapiens
agccaucaugugccuggaa

SEQ ID NO: 1983643 - RNA, 16 nt, Homo sapiens
uggguucacaccauuc

SEQ ID NO: 1983644 - RNA, 17 nt, Homo sapiens
gauuuucaaaaccagcu

SEQ ID NO: 1983645 - RNA, 17 nt, Homo sapiens
aauuaaaggaacagagu

SEQ ID NO: 1983646 - RNA, 20 nt, Homo sapiens
cuuuucuuuugugguuucuc

SEQ ID NO: 1983647 - RNA, 15 nt, Homo sapiens
ugccuuuaaauauaa

SEQ ID NO: 1983648 - RNA, 22 nt, Homo sapiens
ucaccaauggcuccuugcccuc

SEQ ID NO: 1983649 - RNA, 19 nt, Homo sapiens
caugaagcacacacacaaa

SEQ ID NO: 1983650 - RNA, 23 nt, Homo sapiens
ugaaaaaguagauugaguauaaa

SEQ ID NO: 1983651 - RNA, 17 nt, Homo sapiens
caguuaugugaccucac

SEQ ID NO: 1983652 - RNA, 13 nt, Homo sapiens
aaacuaggcauuu

SEQ ID NO: 1983653 - RNA, 16 nt, Homo sapiens
aagacacccugucugc

SEQ ID NO: 1983654 - RNA, 21 nt, Homo sapiens
auccuccuuucuauaguucca

SEQ ID NO: 1983655 - RNA, 22 nt, Homo sapiens
cuuuaaauuaugacgugcacaa

SEQ ID NO: 1983656 - RNA, 18 nt, Homo sapiens
aaaagaccaucuccugua

SEQ ID NO: 1983657 - RNA, 13 nt, Homo sapiens
ucuccaucaccuu

SEQ ID NO: 1983658 - RNA, 16 nt, Homo sapiens
ccuauuuaaagaccug

SEQ ID NO: 1983659 - RNA, 20 nt, Homo sapiens
agagacccuggugcugccac

SEQ ID NO: 1983660 - RNA, 15 nt, Homo sapiens
gauucucuugccuca

SEQ ID NO: 1983661 - RNA, 16 nt, Homo sapiens
cuacucaggagacuga

SEQ ID NO: 1983662 - RNA, 19 nt, Homo sapiens
acuaugaagguaaagggag

SEQ ID NO: 1983663 - RNA, 20 nt, Homo sapiens
guccccagaaacuccaaccc

SEQ ID NO: 1983664 - RNA, 16 nt, Homo sapiens
acuugagcuguauaua

SEQ ID NO: 1983665 - RNA, 16 nt, Homo sapiens
ugcauuucaccuguga

SEQ ID NO: 1983666 - RNA, 16 nt, Homo sapiens
gcuggccagugcugcc

SEQ ID NO: 1983667 - RNA, 17 nt, Homo sapiens
auuaaaaugaauuucuu

SEQ ID NO: 1983668 - RNA, 20 nt, Homo sapiens
uagagucacagcuuucccag

SEQ ID NO: 1983669 - RNA, 20 nt, Homo sapiens
ucucuuccuuugguuauuaa

SEQ ID NO: 1983670 - RNA, 20 nt, Homo sapiens
uccuuuuuauuuguuugcaa

SEQ ID NO: 1983671 - RNA, 16 nt, Homo sapiens
uaugaaauccuugacu

SEQ ID NO: 1983672 - RNA, 18 nt, Homo sapiens
uccuggcagggcgccaag

SEQ ID NO: 1983673 - RNA, 21 nt, Homo sapiens
cacugaaauauccuaaccccc

SEQ ID NO: 1983674 - RNA, 19 nt, Homo sapiens
gaacuuuagugaaacauaa

SEQ ID NO: 1983675 - RNA, 16 nt, Homo sapiens
ggcacgucccaugugc

SEQ ID NO: 1983676 - RNA, 23 nt, Homo sapiens
caugguguaaauauuagugcagu

SEQ ID NO: 1983677 - RNA, 20 nt, Homo sapiens
cuguucuuacugguugacau

SEQ ID NO: 1983678 - RNA, 15 nt, Homo sapiens
cuuugauaguguaaa

SEQ ID NO: 1983679 - RNA, 14 nt, Homo sapiens
ggccccaucuggau

SEQ ID NO: 1983680 - RNA, 11 nt, Homo sapiens
ccaaggucucc

SEQ ID NO: 1983681 - RNA, 18 nt, Homo sapiens
cauaguuucaaaucugua

SEQ ID NO: 1983682 - RNA, 16 nt, Homo sapiens
gcaagacuucacugca

SEQ ID NO: 1983683 - RNA, 22 nt, Homo sapiens
gccaaugucugauuuaacacua

SEQ ID NO: 1983684 - RNA, 18 nt, Homo sapiens
auuuuggaaccuaauaaa

SEQ ID NO: 1983685 - RNA, 18 nt, Homo sapiens
acugaguccucguagcca

SEQ ID NO: 1983686 - RNA, 18 nt, Homo sapiens
acucuaggguccagugga

SEQ ID NO: 1983687 - RNA, 15 nt, Homo sapiens
ugacccaaaugcaaa

SEQ ID NO: 1983688 - RNA, 17 nt, Homo sapiens
uguguuuauuucacuug

SEQ ID NO: 1983689 - RNA, 18 nt, Homo sapiens
agugcucaagcagcaaaa

SEQ ID NO: 1983690 - RNA, 12 nt, Homo sapiens
agauuguguucc

SEQ ID NO: 1983691 - RNA, 13 nt, Homo sapiens
aauguuauaucau

SEQ ID NO: 1983692 - RNA, 17 nt, Homo sapiens
caguguugacacuuaaa

SEQ ID NO: 1983693 - RNA, 16 nt, Homo sapiens
aggguccugcccuccg

SEQ ID NO: 1983694 - RNA, 21 nt, Homo sapiens
gucuacaaacugaacacugca

SEQ ID NO: 1983695 - RNA, 13 nt, Homo sapiens
gugcaugugcacu

SEQ ID NO: 1983696 - RNA, 13 nt, Homo sapiens
acaaauguaugau

SEQ ID NO: 1983697 - RNA, 21 nt, Homo sapiens
auacuugauaguuuggcuaua

SEQ ID NO: 1983698 - RNA, 17 nt, Homo sapiens
uguauuaauaucuccau

SEQ ID NO: 1983699 - RNA, 20 nt, Homo sapiens
ccugcagcuccagucagugu

SEQ ID NO: 1983700 - RNA, 16 nt, Homo sapiens
aaaggaugucuuucag

SEQ ID NO: 1983701 - RNA, 15 nt, Homo sapiens
auuuuugacauuaau

SEQ ID NO: 1983702 - RNA, 17 nt, Homo sapiens
gcaguuuccucagugau

SEQ ID NO: 1983703 - RNA, 22 nt, Homo sapiens
agaggccacacuuucugggaaa

SEQ ID NO: 1983704 - RNA, 13 nt, Homo sapiens
gagguaaagggug

SEQ ID NO: 1983705 - RNA, 13 nt, Homo sapiens
ugaaacauuugcc

SEQ ID NO: 1983706 - RNA, 16 nt, Homo sapiens
cuaaucuguaaucaca

SEQ ID NO: 1983707 - RNA, 13 nt, Homo sapiens
cuuucuugacucu

SEQ ID NO: 1983708 - RNA, 15 nt, Homo sapiens
aacauagcaucucag

SEQ ID NO: 1983709 - RNA, 20 nt, Homo sapiens
aauaccauaggaagacauaa

SEQ ID NO: 1983710 - RNA, 16 nt, Homo sapiens
aucuuagggcaucgcu

SEQ ID NO: 1983711 - RNA, 13 nt, Homo sapiens
cugucucccugaa

SEQ ID NO: 1983712 - RNA, 23 nt, Homo sapiens
cuauacaaacuacagaguuuaug

SEQ ID NO: 1983713 - RNA, 17 nt, Homo sapiens
gagggacacaugccccu

SEQ ID NO: 1983714 - RNA, 12 nt, Homo sapiens
uucucaacuggg

SEQ ID NO: 1983715 - RNA, 19 nt, Homo sapiens
aagacauaggaacauguag

SEQ ID NO: 1983716 - RNA, 16 nt, Homo sapiens
agcaagaccucaucuc

SEQ ID NO: 1983717 - RNA, 15 nt, Homo sapiens
aguaaccaaggcccu

SEQ ID NO: 1983718 - RNA, 21 nt, Homo sapiens
ucaggauugcgagagaugugu

SEQ ID NO: 1983719 - RNA, 15 nt, Homo sapiens
ucaagccauuccaaa

SEQ ID NO: 1983720 - RNA, 16 nt, Homo sapiens
agguucaaugagaugg

SEQ ID NO: 1983721 - RNA, 14 nt, Homo sapiens
cagugaugauguuu

SEQ ID NO: 1983722 - RNA, 18 nt, Homo sapiens
uucucagaaccauuucac

SEQ ID NO: 1983723 - RNA, 21 nt, Homo sapiens
aaccacugcuaugccauuucu

SEQ ID NO: 1983724 - RNA, 13 nt, Homo sapiens
cuacaauuguaaa

SEQ ID NO: 1983725 - RNA, 19 nt, Homo sapiens
ucuauacacauaagcauaa

SEQ ID NO: 1983726 - RNA, 20 nt, Homo sapiens
agugacuguuguagcauuuu

SEQ ID NO: 1983727 - RNA, 17 nt, Homo sapiens
ugacccagggacucucc

SEQ ID NO: 1983728 - RNA, 11 nt, Homo sapiens
aagauguuggg

SEQ ID NO: 1983729 - RNA, 16 nt, Homo sapiens
cugaggauaccuucca

SEQ ID NO: 1983730 - RNA, 11 nt, Homo sapiens
ccaaaaccuuc

SEQ ID NO: 1983731 - RNA, 13 nt, Homo sapiens
uaguuuccuuuag

SEQ ID NO: 1983732 - RNA, 21 nt, Homo sapiens
auuuaauggaaucagauauug

SEQ ID NO: 1983733 - RNA, 18 nt, Homo sapiens
agugaggaugacagugac

SEQ ID NO: 1983734 - RNA, 16 nt, Homo sapiens
ugcuaaggaguucuca

SEQ ID NO: 1983735 - RNA, 21 nt, Homo sapiens
cacacaugggcaucuauggga

SEQ ID NO: 1983736 - RNA, 18 nt, Homo sapiens
gcugaguugguguugaca

SEQ ID NO: 1983737 - RNA, 16 nt, Homo sapiens
cacgauuaacugugaa

SEQ ID NO: 1983738 - RNA, 17 nt, Homo sapiens
uuacccauaggucuuaa

SEQ ID NO: 1983739 - RNA, 14 nt, Homo sapiens
agacauaucucuaa

SEQ ID NO: 1983740 - RNA, 18 nt, Homo sapiens
uccccuccuugggcacuu

SEQ ID NO: 1983741 - RNA, 18 nt, Homo sapiens
ccaacugacaaagaugca

SEQ ID NO: 1983742 - RNA, 22 nt, Homo sapiens
cuuaacgaauaaaggucccaug

SEQ ID NO: 1983743 - RNA, 22 nt, Homo sapiens
cauaauaaccaaacauaacauu

SEQ ID NO: 1983744 - RNA, 18 nt, Homo sapiens
cuacuguaaaccccaaga

SEQ ID NO: 1983745 - RNA, 15 nt, Homo sapiens
aagacaaaacagauc

SEQ ID NO: 1983746 - RNA, 14 nt, Homo sapiens
aggccaucuggggc

SEQ ID NO: 1983747 - RNA, 17 nt, Homo sapiens
ccagugccaggccagug

SEQ ID NO: 1983748 - RNA, 13 nt, Homo sapiens
uggaagccuauaa

SEQ ID NO: 1983749 - RNA, 21 nt, Homo sapiens
uggacucucuguggucccuuc

SEQ ID NO: 1983750 - RNA, 16 nt, Homo sapiens
aauacuauugcauuuu

SEQ ID NO: 1983751 - RNA, 16 nt, Homo sapiens
gcaaucuuaagcagag

SEQ ID NO: 1983752 - RNA, 19 nt, Homo sapiens
ccaggaggggaacacugcc

SEQ ID NO: 1983753 - RNA, 22 nt, Homo sapiens
ccucacuugcuucuuauccuua

SEQ ID NO: 1983754 - RNA, 22 nt, Homo sapiens
uaacuacaaauuaucauacuac

SEQ ID NO: 1983755 - RNA, 13 nt, Homo sapiens
cuguuuagaacua

SEQ ID NO: 1983756 - RNA, 12 nt, Homo sapiens
cucuccugcaaa

SEQ ID NO: 1983757 - RNA, 21 nt, Homo sapiens
cuuaaguauugucaccaggau

SEQ ID NO: 1983758 - RNA, 15 nt, Homo sapiens
ugaauucauaucgcc

SEQ ID NO: 1983759 - RNA, 16 nt, Homo sapiens
aaugauuguguagcca

SEQ ID NO: 1983760 - RNA, 15 nt, Homo sapiens
agcacugcuccagug

SEQ ID NO: 1983761 - RNA, 12 nt, Homo sapiens
caguuuugacau

SEQ ID NO: 1983762 - RNA, 13 nt, Homo sapiens
aauuauuaccauc

SEQ ID NO: 1983763 - RNA, 15 nt, Homo sapiens
ucccccacagccacu

SEQ ID NO: 1983764 - RNA, 22 nt, Homo sapiens
aggcugucggggucaagcugga

SEQ ID NO: 1983765 - RNA, 16 nt, Homo sapiens
cugccccuacccugga

SEQ ID NO: 1983766 - RNA, 20 nt, Homo sapiens
caguagcuuaaauaaauuca

SEQ ID NO: 1983767 - RNA, 15 nt, Homo sapiens
ugagauugcugugug

SEQ ID NO: 1983768 - RNA, 20 nt, Homo sapiens
uccagcuugggcaacagagc

SEQ ID NO: 1983769 - RNA, 20 nt, Homo sapiens
uaacauaaauaaaaauucaa

SEQ ID NO: 1983770 - RNA, 19 nt, Homo sapiens
uugagucagaaaacagaga

SEQ ID NO: 1983771 - RNA, 22 nt, Homo sapiens
aagaauugaggaugucccugaa

SEQ ID NO: 1983772 - RNA, 21 nt, Homo sapiens
ccaagagcaggaggugccuga

SEQ ID NO: 1983773 - RNA, 21 nt, Homo sapiens
gaugaauccuagcuucuucca

SEQ ID NO: 1983774 - RNA, 23 nt, Homo sapiens
aaaugacgguguuaauuuugcua

SEQ ID NO: 1983775 - RNA, 15 nt, Homo sapiens
agaagaagcuacugc

SEQ ID NO: 1983776 - RNA, 11 nt, Homo sapiens
acaagaagcug

SEQ ID NO: 1983777 - RNA, 14 nt, Homo sapiens
ugggaccugaauga

SEQ ID NO: 1983778 - RNA, 19 nt, Homo sapiens
guuugacuagccaucucaa

SEQ ID NO: 1983779 - RNA, 15 nt, Homo sapiens
caaugcuguuauccc

SEQ ID NO: 1983780 - RNA, 19 nt, Homo sapiens
auaggaccuuccacacagg

SEQ ID NO: 1983781 - RNA, 17 nt, Homo sapiens
ugauuguggaauggaga

SEQ ID NO: 1983782 - RNA, 11 nt, Homo sapiens
agauccagugc

SEQ ID NO: 1983783 - RNA, 14 nt, Homo sapiens
gauagcagauauca

SEQ ID NO: 1983784 - RNA, 13 nt, Homo sapiens
aaaucuccagugu

SEQ ID NO: 1983785 - RNA, 23 nt, Homo sapiens
caagagauagagaccaucuuugc

SEQ ID NO: 1983786 - RNA, 16 nt, Homo sapiens
ucacaggugacucuaa

SEQ ID NO: 1983787 - RNA, 17 nt, Homo sapiens
aggcgggagcaucucuu

SEQ ID NO: 1983788 - RNA, 19 nt, Homo sapiens
uguccuuggggacaucuca

SEQ ID NO: 1983789 - RNA, 21 nt, Homo sapiens
uaagagagugaacauauccau

SEQ ID NO: 1983790 - RNA, 19 nt, Homo sapiens
ugucuauuuuuucuugaca

SEQ ID NO: 1983791 - RNA, 16 nt, Homo sapiens
aggcuguacacugcac

SEQ ID NO: 1983792 - RNA, 13 nt, Homo sapiens
uauauauuacuug

SEQ ID NO: 1983793 - RNA, 20 nt, Homo sapiens
acugggccuuagugggccag

SEQ ID NO: 1983794 - RNA, 20 nt, Homo sapiens
gaaguugcagugagcugaua

SEQ ID NO: 1983795 - RNA, 14 nt, Homo sapiens
cuaguaugaaagcu

SEQ ID NO: 1983796 - RNA, 11 nt, Homo sapiens
uuugagcucug

SEQ ID NO: 1983797 - RNA, 15 nt, Homo sapiens
aaaaugugcaauaug

SEQ ID NO: 1983798 - RNA, 14 nt, Homo sapiens
ugagccuugugcau

SEQ ID NO: 1983799 - RNA, 17 nt, Homo sapiens
uucaugucuuuacugga

SEQ ID NO: 1983800 - RNA, 22 nt, Homo sapiens
acauauuuaagagauacuugau

SEQ ID NO: 1983801 - RNA, 13 nt, Homo sapiens
uacaucaucucca

SEQ ID NO: 1983802 - RNA, 16 nt, Homo sapiens
aaugaugccacuuccc

SEQ ID NO: 1983803 - RNA, 14 nt, Homo sapiens
accaaagagacugg

SEQ ID NO: 1983804 - RNA, 13 nt, Homo sapiens
gauaaagcacugu

SEQ ID NO: 1983805 - RNA, 15 nt, Homo sapiens
uccaaagcauugcag

SEQ ID NO: 1983806 - RNA, 12 nt, Homo sapiens
ucaccgggggca

SEQ ID NO: 1983807 - RNA, 16 nt, Homo sapiens
auaccaggaccaguuu

SEQ ID NO: 1983808 - RNA, 19 nt, Homo sapiens
caauugauggacuacucua

SEQ ID NO: 1983809 - RNA, 20 nt, Homo sapiens
augcaaggucuugcauuuaa

SEQ ID NO: 1983810 - RNA, 21 nt, Homo sapiens
gagagcacagugaucaccagc

SEQ ID NO: 1983811 - RNA, 18 nt, Homo sapiens
agcagcagaccuccuagc

SEQ ID NO: 1983812 - RNA, 15 nt, Homo sapiens
gauucuaccacacag

SEQ ID NO: 1983813 - RNA, 17 nt, Homo sapiens
ccuagcaggcuguucca

SEQ ID NO: 1983814 - RNA, 21 nt, Homo sapiens
auuagucuuuuguaauaucaa

SEQ ID NO: 1983815 - RNA, 16 nt, Homo sapiens
ugcucuuaugccauuu

SEQ ID NO: 1983816 - RNA, 15 nt, Homo sapiens
acauaauugcaugaa

SEQ ID NO: 1983817 - RNA, 14 nt, Homo sapiens
guggauuaaccugc

SEQ ID NO: 1983818 - RNA, 13 nt, Homo sapiens
ggaccucugcucu

SEQ ID NO: 1983819 - RNA, 23 nt, Homo sapiens
ccccagcaccauuuaugagucuc

SEQ ID NO: 1983820 - RNA, 16 nt, Homo sapiens
ucuuuccuaaagccaa

SEQ ID NO: 1983821 - RNA, 13 nt, Homo sapiens
ugauucaagugag

SEQ ID NO: 1983822 - RNA, 17 nt, Homo sapiens
accuagcaauuccauca

SEQ ID NO: 1983823 - RNA, 16 nt, Homo sapiens
accaaguauagccuau

SEQ ID NO: 1983824 - RNA, 23 nt, Homo sapiens
uaggcagcaagggcugauucuag

SEQ ID NO: 1983825 - RNA, 22 nt, Homo sapiens
ccgugucucgcgcgacugagaa

SEQ ID NO: 1983826 - RNA, 16 nt, Homo sapiens
agccuagccgaccuca

SEQ ID NO: 1983827 - RNA, 19 nt, Homo sapiens
aaguucuggagaaagguau

SEQ ID NO: 1983828 - RNA, 15 nt, Homo sapiens
aagacuaacuugaaa

SEQ ID NO: 1983829 - RNA, 20 nt, Homo sapiens
cacacacaaugugucugaga

SEQ ID NO: 1983830 - RNA, 21 nt, Homo sapiens
ccuaugaaaaaauuaguugag

SEQ ID NO: 1983831 - RNA, 20 nt, Homo sapiens
aauuaaagaugccauagcau

SEQ ID NO: 1983832 - RNA, 19 nt, Homo sapiens
ugaggguaucugacaaugc

SEQ ID NO: 1983833 - RNA, 12 nt, Homo sapiens
cacuguucaaua

SEQ ID NO: 1983834 - RNA, 23 nt, Homo sapiens
auugcuaaaagcauguauaguua

SEQ ID NO: 1983835 - RNA, 13 nt, Homo sapiens
cuguuugucugau

SEQ ID NO: 1983836 - RNA, 13 nt, Homo sapiens
cacagugucacug

SEQ ID NO: 1983837 - RNA, 20 nt, Homo sapiens
aggcccuugucgugggaugg

SEQ ID NO: 1983838 - RNA, 23 nt, Homo sapiens
ggcguaggcuacagagaagccuu

SEQ ID NO: 1983839 - RNA, 16 nt, Homo sapiens
uuuaaacacaugccuu

SEQ ID NO: 1983840 - RNA, 17 nt, Homo sapiens
auguaaauguaaacuca

SEQ ID NO: 1983841 - RNA, 14 nt, Homo sapiens
uucagaccagugaa

SEQ ID NO: 1983842 - RNA, 18 nt, Homo sapiens
accacugugucccagugu

SEQ ID NO: 1983843 - RNA, 13 nt, Homo sapiens
ugagguaccagcc

SEQ ID NO: 1983844 - RNA, 19 nt, Homo sapiens
aauagcugcaccaucccag

SEQ ID NO: 1983845 - RNA, 13 nt, Homo sapiens
cuccucucagcuu

SEQ ID NO: 1983846 - RNA, 23 nt, Homo sapiens
aacagauuugcuccuaaaccauu

SEQ ID NO: 1983847 - RNA, 14 nt, Homo sapiens
cuacgaaucuuccg

SEQ ID NO: 1983848 - RNA, 14 nt, Homo sapiens
gaaagggaaagcug

SEQ ID NO: 1983849 - RNA, 16 nt, Homo sapiens
ugcccuguuagcuuuc

SEQ ID NO: 1983850 - RNA, 12 nt, Homo sapiens
ucuaacuccacu

SEQ ID NO: 1983851 - RNA, 17 nt, Homo sapiens
uucuugaauucauguac

SEQ ID NO: 1983852 - RNA, 19 nt, Homo sapiens
aagacuucagauuccccac

SEQ ID NO: 1983853 - RNA, 13 nt, Homo sapiens
auguucuguguca

SEQ ID NO: 1983854 - RNA, 14 nt, Homo sapiens
aaucuguagucacu

SEQ ID NO: 1983855 - RNA, 21 nt, Homo sapiens
cgaggucaugccacugcacug

SEQ ID NO: 1983856 - RNA, 20 nt, Homo sapiens
uccuguuaauucuagaucag

SEQ ID NO: 1983857 - RNA, 21 nt, Homo sapiens
guacgucaacuguauguacau

SEQ ID NO: 1983858 - RNA, 18 nt, Homo sapiens
gcaccgcuucucagccac

SEQ ID NO: 1983859 - RNA, 16 nt, Homo sapiens
acaucccaagccagaa

SEQ ID NO: 1983860 - RNA, 21 nt, Homo sapiens
ccaacugagccaaaaacaaua

SEQ ID NO: 1983861 - RNA, 16 nt, Homo sapiens
acauuauuaaucauuc

SEQ ID NO: 1983862 - RNA, 14 nt, Homo sapiens
ucuuacuuaugugu

SEQ ID NO: 1983863 - RNA, 16 nt, Homo sapiens
accccucaacaccucu

SEQ ID NO: 1983864 - RNA, 19 nt, Homo sapiens
ucacacucaaggacaggag

SEQ ID NO: 1983865 - RNA, 16 nt, Homo sapiens
cucccauuucucucuu

SEQ ID NO: 1983866 - RNA, 15 nt, Homo sapiens
cuacagguccagggu

SEQ ID NO: 1983867 - RNA, 22 nt, Homo sapiens
aaugucgauuaaaaucacucuc

SEQ ID NO: 1983868 - RNA, 13 nt, Homo sapiens
uaauuauuauuca

SEQ ID NO: 1983869 - RNA, 11 nt, Homo sapiens
gccacaguaua

SEQ ID NO: 1983870 - RNA, 20 nt, Homo sapiens
uauuuugugaagacugggaa

SEQ ID NO: 1983871 - RNA, 17 nt, Homo sapiens
acaucggccuccaugac

SEQ ID NO: 1983872 - RNA, 16 nt, Homo sapiens
augcaacaacauguau

SEQ ID NO: 1983873 - RNA, 16 nt, Homo sapiens
ggcaggcucccaggga

SEQ ID NO: 1983874 - RNA, 19 nt, Homo sapiens
gcauucuaucguuauuaua

SEQ ID NO: 1983875 - RNA, 21 nt, Homo sapiens
caguaaaaucaaaugugcauc

SEQ ID NO: 1983876 - RNA, 18 nt, Homo sapiens
caagucucagauucccau

SEQ ID NO: 1983877 - RNA, 15 nt, Homo sapiens
acgauuccuucccac

SEQ ID NO: 1983878 - RNA, 14 nt, Homo sapiens
cacuuccaccagcc

SEQ ID NO: 1983879 - RNA, 21 nt, Homo sapiens
aaagcaucaauacaaccagcc

SEQ ID NO: 1983880 - RNA, 13 nt, Homo sapiens
auuuaucacugaa

SEQ ID NO: 1983881 - RNA, 19 nt, Homo sapiens
ucaagagugguaucuugca

SEQ ID NO: 1983882 - RNA, 19 nt, Homo sapiens
ccaggccugggaugcagug

SEQ ID NO: 1983883 - RNA, 18 nt, Homo sapiens
agggauauuuaacuggag

SEQ ID NO: 1983884 - RNA, 16 nt, Homo sapiens
ccuccggugugagaua

SEQ ID NO: 1983885 - RNA, 15 nt, Homo sapiens
aacugcuuugugcau

SEQ ID NO: 1983886 - RNA, 13 nt, Homo sapiens
aacugaacacugc

SEQ ID NO: 1983887 - RNA, 16 nt, Homo sapiens
aaauuugaauaaucag

SEQ ID NO: 1983888 - RNA, 14 nt, Homo sapiens
uaagauaugcauua

SEQ ID NO: 1983889 - RNA, 14 nt, Homo sapiens
uaauuuaugcagaa

SEQ ID NO: 1983890 - RNA, 23 nt, Homo sapiens
ugagaaauuuuuuuccagaauug

SEQ ID NO: 1983891 - RNA, 13 nt, Homo sapiens
cuugcccaacucc

SEQ ID NO: 1983892 - RNA, 21 nt, Homo sapiens
cuuuucaucucauuaauucaa

SEQ ID NO: 1983893 - RNA, 23 nt, Homo sapiens
aauuuauuugaaaaugcaucaca

SEQ ID NO: 1983894 - RNA, 22 nt, Homo sapiens
uaauacauuaaauaugugaaau

SEQ ID NO: 1983895 - RNA, 17 nt, Homo sapiens
gaauauaguucugugua

SEQ ID NO: 1983896 - RNA, 18 nt, Homo sapiens
aacccaaggacugaggga

SEQ ID NO: 1983897 - RNA, 13 nt, Homo sapiens
uauccaagacuua

SEQ ID NO: 1983898 - RNA, 15 nt, Homo sapiens
cugagggcauugcuu

SEQ ID NO: 1983899 - RNA, 19 nt, Homo sapiens
cauguuuuugauauuugau

SEQ ID NO: 1983900 - RNA, 12 nt, Homo sapiens
ugugccaguuua

SEQ ID NO: 1983901 - RNA, 21 nt, Homo sapiens
accuggugggcucaaccacac

SEQ ID NO: 1983902 - RNA, 16 nt, Homo sapiens
uaucccaagaaugcaa

SEQ ID NO: 1983903 - RNA, 16 nt, Homo sapiens
uuccuguuugcuggga

SEQ ID NO: 1983904 - RNA, 21 nt, Homo sapiens
agcugaauagagggaguagaa

SEQ ID NO: 1983905 - RNA, 20 nt, Homo sapiens
uagcauuguaaaagcauuuu

SEQ ID NO: 1983906 - RNA, 24 nt, Homo sapiens
ucgcaaccuccgccucccagguuc

SEQ ID NO: 1983907 - RNA, 22 nt, Homo sapiens
caaaaugaaggcgggccugcaa

SEQ ID NO: 1983908 - RNA, 22 nt, Homo sapiens
acauuuaaaaaacauuuuacag

SEQ ID NO: 1983909 - RNA, 15 nt, Homo sapiens
aagucacccuuccac

SEQ ID NO: 1983910 - RNA, 17 nt, Homo sapiens
ccucagacguugccuga

SEQ ID NO: 1983911 - RNA, 24 nt, Homo sapiens
auaauuuuccugugacacuuauaa

SEQ ID NO: 1983912 - RNA, 20 nt, Homo sapiens
gcaaguggccauuaccaucu

SEQ ID NO: 1983913 - RNA, 12 nt, Homo sapiens
cuuuaucaaaau

SEQ ID NO: 1983914 - RNA, 22 nt, Homo sapiens
auguacuuccaguauccugaaa

SEQ ID NO: 1983915 - RNA, 17 nt, Homo sapiens
ucccugaaacaucucaa

SEQ ID NO: 1983916 - RNA, 16 nt, Homo sapiens
gaccgcaggaggaaau

SEQ ID NO: 1983917 - RNA, 17 nt, Homo sapiens
guguacauguuggguau

SEQ ID NO: 1983918 - RNA, 12 nt, Homo sapiens
uauauaugugcu

SEQ ID NO: 1983919 - RNA, 15 nt, Homo sapiens
ucccuagauugugaa

SEQ ID NO: 1983920 - RNA, 19 nt, Homo sapiens
ggccgggugugguggcuca

SEQ ID NO: 1983921 - RNA, 14 nt, Homo sapiens
caugaucauucuca

SEQ ID NO: 1983922 - RNA, 17 nt, Homo sapiens
ggcuagaaccuggagag

SEQ ID NO: 1983923 - RNA, 14 nt, Homo sapiens
uguuaugacuccuu

SEQ ID NO: 1983924 - RNA, 13 nt, Homo sapiens
acaaucucagcuc

SEQ ID NO: 1983925 - RNA, 22 nt, Homo sapiens
uuucauggaaguggcagugaaa

SEQ ID NO: 1983926 - RNA, 23 nt, Homo sapiens
agccucaagucuuauuuccucaa

SEQ ID NO: 1983927 - RNA, 15 nt, Homo sapiens
ugcuuuuugucaugu

SEQ ID NO: 1983928 - RNA, 20 nt, Homo sapiens
agggugaguguuuccacuca

SEQ ID NO: 1983929 - RNA, 21 nt, Homo sapiens
ugcacacucacuuguaagaaa

SEQ ID NO: 1983930 - RNA, 18 nt, Homo sapiens
agucugcuuaccaaaaca

SEQ ID NO: 1983931 - RNA, 18 nt, Homo sapiens
gcccggaccuccaucaga

SEQ ID NO: 1983932 - RNA, 16 nt, Homo sapiens
cauggugacagucucc

SEQ ID NO: 1983933 - RNA, 22 nt, Homo sapiens
uggaaaggcucagucucaggag

SEQ ID NO: 1983934 - RNA, 15 nt, Homo sapiens
gccagccaucacaag

SEQ ID NO: 1983935 - RNA, 21 nt, Homo sapiens
gaguaucugaggcacauguca

SEQ ID NO: 1983936 - RNA, 16 nt, Homo sapiens
cuuaaaggcuguggua

SEQ ID NO: 1983937 - RNA, 13 nt, Homo sapiens
aaacaagccuuaa

SEQ ID NO: 1983938 - RNA, 17 nt, Homo sapiens
agagccuggugcugcug

SEQ ID NO: 1983939 - RNA, 17 nt, Homo sapiens
aaaacgugcauggauau

SEQ ID NO: 1983940 - RNA, 16 nt, Homo sapiens
ccacguguuuugacau

SEQ ID NO: 1983941 - RNA, 13 nt, Homo sapiens
guaugugccauuu

SEQ ID NO: 1983942 - RNA, 20 nt, Homo sapiens
aucacagaaacggucuuuau

SEQ ID NO: 1983943 - RNA, 21 nt, Homo sapiens
auuagcuuggggccagggaag

SEQ ID NO: 1983944 - RNA, 13 nt, Homo sapiens
accccagcauucc

SEQ ID NO: 1983945 - RNA, 13 nt, Homo sapiens
uucaaagcucuaa

SEQ ID NO: 1983946 - RNA, 21 nt, Homo sapiens
aaaaugucuuaaugcaaauuu

SEQ ID NO: 1983947 - RNA, 21 nt, Homo sapiens
ucuaaacuuccccaucuucua

SEQ ID NO: 1983948 - RNA, 17 nt, Homo sapiens
auguggaaaaaugagag

SEQ ID NO: 1983949 - RNA, 18 nt, Homo sapiens
agaauauaucaaguacaa

SEQ ID NO: 1983950 - RNA, 23 nt, Homo sapiens
aaaaugagugacuagacguucau

SEQ ID NO: 1983951 - RNA, 16 nt, Homo sapiens
uccauuaaauauaaag

SEQ ID NO: 1983952 - RNA, 21 nt, Homo sapiens
cugacugaaggaaaagcaaga

SEQ ID NO: 1983953 - RNA, 14 nt, Homo sapiens
auuuuuccaaaagc

SEQ ID NO: 1983954 - RNA, 18 nt, Homo sapiens
uucaaaaacaagacagac

SEQ ID NO: 1983955 - RNA, 15 nt, Homo sapiens
ugcacaggcacuguc

SEQ ID NO: 1983956 - RNA, 17 nt, Homo sapiens
cuuagacugaaaaacug

SEQ ID NO: 1983957 - RNA, 18 nt, Homo sapiens
uggcacgaucucagcuca

SEQ ID NO: 1983958 - RNA, 17 nt, Homo sapiens
cugagcacgcuaccaaa

SEQ ID NO: 1983959 - RNA, 21 nt, Homo sapiens
accaccgcauaugcaugccag

SEQ ID NO: 1983960 - RNA, 16 nt, Homo sapiens
gcacaaagacagagac

SEQ ID NO: 1983961 - RNA, 14 nt, Homo sapiens
aggaagcuccaguu

SEQ ID NO: 1983962 - RNA, 21 nt, Homo sapiens
auaagcaaaaucagaaguaua

SEQ ID NO: 1983963 - RNA, 18 nt, Homo sapiens
guaacaacuguggucaau

SEQ ID NO: 1983964 - RNA, 16 nt, Homo sapiens
uuacuauuuacuuuau

SEQ ID NO: 1983965 - RNA, 14 nt, Homo sapiens
ggagagcacugcca

SEQ ID NO: 1983966 - RNA, 13 nt, Homo sapiens
gggacaccagcca

SEQ ID NO: 1983967 - RNA, 18 nt, Homo sapiens
augucuucuguauaacua

SEQ ID NO: 1983968 - RNA, 15 nt, Homo sapiens
uuugcauugccaagu

SEQ ID NO: 1983969 - RNA, 19 nt, Homo sapiens
gccuacugccucuccagca

SEQ ID NO: 1983970 - RNA, 13 nt, Homo sapiens
ugucccaagguga

SEQ ID NO: 1983971 - RNA, 18 nt, Homo sapiens
cacuuauccuguucucug

SEQ ID NO: 1983972 - RNA, 18 nt, Homo sapiens
aucccuggccaccugcca

SEQ ID NO: 1983973 - RNA, 14 nt, Homo sapiens
acacuuucuaugcu

SEQ ID NO: 1983974 - RNA, 21 nt, Homo sapiens
uaaucuuucuaaaaauucaua

SEQ ID NO: 1983975 - RNA, 19 nt, Homo sapiens
aaggcaggcagaucacuug

SEQ ID NO: 1983976 - RNA, 21 nt, Homo sapiens
aaugccaagggggugacugga

SEQ ID NO: 1983977 - RNA, 15 nt, Homo sapiens
ugcuacgugugauuu

SEQ ID NO: 1983978 - RNA, 18 nt, Homo sapiens
gucacagaagcagcuaaa

SEQ ID NO: 1983979 - RNA, 15 nt, Homo sapiens
cucuacccacuucuc

SEQ ID NO: 1983980 - RNA, 13 nt, Homo sapiens
gaaauaaaacugu

SEQ ID NO: 1983981 - RNA, 17 nt, Homo sapiens
acaaaauccaugaacaa

SEQ ID NO: 1983982 - RNA, 22 nt, Homo sapiens
aagguuucuauuuucucugaua

SEQ ID NO: 1983983 - RNA, 17 nt, Homo sapiens
agggcaggaaaugauaa

SEQ ID NO: 1983984 - RNA, 17 nt, Homo sapiens
cauaguuuacaauauua

SEQ ID NO: 1983985 - RNA, 17 nt, Homo sapiens
uucacauaguuugauaa

SEQ ID NO: 1983986 - RNA, 16 nt, Homo sapiens
gcaauaaaugcucaau

SEQ ID NO: 1983987 - RNA, 21 nt, Homo sapiens
cccaggcagugggucuucccu

SEQ ID NO: 1983988 - RNA, 18 nt, Homo sapiens
ugaggcaggagaaucacu

SEQ ID NO: 1983989 - RNA, 20 nt, Homo sapiens
uucuaagagguagauaccag

SEQ ID NO: 1983990 - RNA, 18 nt, Homo sapiens
gccacauccaacauuucc

SEQ ID NO: 1983991 - RNA, 12 nt, Homo sapiens
cuuuauuuuaga

SEQ ID NO: 1983992 - RNA, 22 nt, Homo sapiens
ugcaccuugugucuguacacgu

SEQ ID NO: 1983993 - RNA, 15 nt, Homo sapiens
ggugugcucagggga

SEQ ID NO: 1983994 - RNA, 17 nt, Homo sapiens
gaaagcugaguguuuca

SEQ ID NO: 1983995 - RNA, 17 nt, Homo sapiens
ucugauguaaaugaagu

SEQ ID NO: 1983996 - RNA, 21 nt, Homo sapiens
uguagauuaccugccacuucc

SEQ ID NO: 1983997 - RNA, 21 nt, Homo sapiens
uauguuuguacaagauuguca

SEQ ID NO: 1983998 - RNA, 17 nt, Homo sapiens
agugggugucucugcau

SEQ ID NO: 1983999 - RNA, 20 nt, Homo sapiens
cucccugcuucaauacccaa

SEQ ID NO: 1984000 - RNA, 14 nt, Homo sapiens
uuacaccaguuuga

SEQ ID NO: 1984001 - RNA, 18 nt, Homo sapiens
acugcauuggacugaggg

SEQ ID NO: 1984002 - RNA, 16 nt, Homo sapiens
gaacugggaguccagg

SEQ ID NO: 1984003 - RNA, 12 nt, Homo sapiens
cucucagggcca

SEQ ID NO: 1984004 - RNA, 14 nt, Homo sapiens
gguaagaaguuuua

SEQ ID NO: 1984005 - RNA, 15 nt, Homo sapiens
cuguagaguugcuga

SEQ ID NO: 1984006 - RNA, 23 nt, Homo sapiens
uaaaauuaaucacaaauuucacu

SEQ ID NO: 1984007 - RNA, 22 nt, Homo sapiens
agggaucuugcauucccagugg

SEQ ID NO: 1984008 - RNA, 12 nt, Homo sapiens
gugaaacuaauc

SEQ ID NO: 1984009 - RNA, 12 nt, Homo sapiens
aauaaacugugc

SEQ ID NO: 1984010 - RNA, 14 nt, Homo sapiens
agaugcaccaagua

SEQ ID NO: 1984011 - RNA, 18 nt, Homo sapiens
uguuacugccuaucagca

SEQ ID NO: 1984012 - RNA, 16 nt, Homo sapiens
cugagcaguaccagug

SEQ ID NO: 1984013 - RNA, 16 nt, Homo sapiens
cacccugauccucacc

SEQ ID NO: 1984014 - RNA, 18 nt, Homo sapiens
aagacaguaaagaccauu

SEQ ID NO: 1984015 - RNA, 13 nt, Homo sapiens
aaagguaggugca

SEQ ID NO: 1984016 - RNA, 20 nt, Homo sapiens
ucagucuuuuccaugaacuu

SEQ ID NO: 1984017 - RNA, 19 nt, Homo sapiens
ugcuucuggggacaccuca

SEQ ID NO: 1984018 - RNA, 22 nt, Homo sapiens
uggaacacuacucuuacaugua

SEQ ID NO: 1984019 - RNA, 13 nt, Homo sapiens
agacagugcggau

SEQ ID NO: 1984020 - RNA, 19 nt, Homo sapiens
ccuguacucccagcacuuu

SEQ ID NO: 1984021 - RNA, 13 nt, Homo sapiens
uaacugccuaaaa

SEQ ID NO: 1984022 - RNA, 22 nt, Homo sapiens
uuauuuguauuacuagauucau

SEQ ID NO: 1984023 - RNA, 21 nt, Homo sapiens
aaaaugucaguguuugggaaa

SEQ ID NO: 1984024 - RNA, 23 nt, Homo sapiens
gaagaauuggcagaagcaguugc

SEQ ID NO: 1984025 - RNA, 13 nt, Homo sapiens
uuguucucagggg

SEQ ID NO: 1984026 - RNA, 15 nt, Homo sapiens
ugucagcagcuuuaa

SEQ ID NO: 1984027 - RNA, 20 nt, Homo sapiens
gccccuuugggcccugcaug

SEQ ID NO: 1984028 - RNA, 16 nt, Homo sapiens
auguuucccagggcaa

SEQ ID NO: 1984029 - RNA, 15 nt, Homo sapiens
gaggaauuggccgcu

SEQ ID NO: 1984030 - RNA, 19 nt, Homo sapiens
cucccagcugacaguccuc

SEQ ID NO: 1984031 - RNA, 23 nt, Homo sapiens
ccccaccuguguccccgaugcug

SEQ ID NO: 1984032 - RNA, 14 nt, Homo sapiens
agaauuuaccucuu

SEQ ID NO: 1984033 - RNA, 23 nt, Homo sapiens
agucccuggaaaaacagucacug

SEQ ID NO: 1984034 - RNA, 17 nt, Homo sapiens
auguaauuauauauacu

SEQ ID NO: 1984035 - RNA, 21 nt, Homo sapiens
gcuauuucaggcccucagcug

SEQ ID NO: 1984036 - RNA, 18 nt, Homo sapiens
caccagcaccgugacagu

SEQ ID NO: 1984037 - RNA, 16 nt, Homo sapiens
guguauauggacaaaa

SEQ ID NO: 1984038 - RNA, 20 nt, Homo sapiens
gguuuagaggaccagugagu

SEQ ID NO: 1984039 - RNA, 12 nt, Homo sapiens
cuuggacaccau

SEQ ID NO: 1984040 - RNA, 22 nt, Homo sapiens
acaccuuuuccccaaccacaga

SEQ ID NO: 1984041 - RNA, 18 nt, Homo sapiens
agauuugucuaauugcau

SEQ ID NO: 1984042 - RNA, 21 nt, Homo sapiens
uagcucugguauauaauccau

SEQ ID NO: 1984043 - RNA, 20 nt, Homo sapiens
uaucccuauuuugcugauga

SEQ ID NO: 1984044 - RNA, 16 nt, Homo sapiens
gaagauguugguuaug

SEQ ID NO: 1984045 - RNA, 15 nt, Homo sapiens
gucaagcuccuagua

SEQ ID NO: 1984046 - RNA, 16 nt, Homo sapiens
ucacucauagccacuu

SEQ ID NO: 1984047 - RNA, 16 nt, Homo sapiens
cagaguugguggagaa

SEQ ID NO: 1984048 - RNA, 12 nt, Homo sapiens
agucagugucug

SEQ ID NO: 1984049 - RNA, 21 nt, Homo sapiens
ucugagcucauuuggggacca

SEQ ID NO: 1984050 - RNA, 22 nt, Homo sapiens
gaaacaguacagcuauuucuca

SEQ ID NO: 1984051 - RNA, 17 nt, Homo sapiens
acaguguuuccugagua

SEQ ID NO: 1984052 - RNA, 20 nt, Homo sapiens
gaaguucuuggauuacuuua

SEQ ID NO: 1984053 - RNA, 18 nt, Homo sapiens
auagaaacaauacuguuc

SEQ ID NO: 1984054 - RNA, 17 nt, Homo sapiens
uggcccaggucucucaa

SEQ ID NO: 1984055 - RNA, 17 nt, Homo sapiens
uuuaaccccccuguaca

SEQ ID NO: 1984056 - RNA, 21 nt, Homo sapiens
uucacagcagccacuugacua

SEQ ID NO: 1984057 - RNA, 13 nt, Homo sapiens
auuucuauacagu

SEQ ID NO: 1984058 - RNA, 19 nt, Homo sapiens
auuauucuaugucaaugau

SEQ ID NO: 1984059 - RNA, 15 nt, Homo sapiens
cucagccuugcacac

SEQ ID NO: 1984060 - RNA, 18 nt, Homo sapiens
uuuccugguccaucucau

SEQ ID NO: 1984061 - RNA, 16 nt, Homo sapiens
ccucccagguucacac

SEQ ID NO: 1984062 - RNA, 17 nt, Homo sapiens
aaaguuggggacaugcu

SEQ ID NO: 1984063 - RNA, 14 nt, Homo sapiens
aaggcuucagucuc

SEQ ID NO: 1984064 - RNA, 19 nt, Homo sapiens
gcaaagacguggggcccca

SEQ ID NO: 1984065 - RNA, 22 nt, Homo sapiens
ccauaguuuuguuuaauuugcu

SEQ ID NO: 1984066 - RNA, 16 nt, Homo sapiens
agccaaauaaaaucua

SEQ ID NO: 1984067 - RNA, 19 nt, Homo sapiens
uacccagcuucaaacuaua

SEQ ID NO: 1984068 - RNA, 17 nt, Homo sapiens
aaacaacaucauuccaa

SEQ ID NO: 1984069 - RNA, 12 nt, Homo sapiens
auaaacuaccaa

SEQ ID NO: 1984070 - RNA, 17 nt, Homo sapiens
caucuggggacuaauau

SEQ ID NO: 1984071 - RNA, 15 nt, Homo sapiens
aagggagucucucuu

SEQ ID NO: 1984072 - RNA, 23 nt, Homo sapiens
cagauguuuguuuucaaaauacu

SEQ ID NO: 1984073 - RNA, 11 nt, Homo sapiens
ugcugugccaa

SEQ ID NO: 1984074 - RNA, 21 nt, Homo sapiens
guccccggccacgucugugcu

SEQ ID NO: 1984075 - RNA, 17 nt, Homo sapiens
aagucuauaaugcaauc

SEQ ID NO: 1984076 - RNA, 14 nt, Homo sapiens
ugggguccagggag

SEQ ID NO: 1984077 - RNA, 20 nt, Homo sapiens
uaugaagaaagauacuaaua

SEQ ID NO: 1984078 - RNA, 23 nt, Homo sapiens
gaaaaucuauauuugucuuccga

SEQ ID NO: 1984079 - RNA, 16 nt, Homo sapiens
aaaugauuacuaagga

SEQ ID NO: 1984080 - RNA, 21 nt, Homo sapiens
guaaaugcucgugugauuucc

SEQ ID NO: 1984081 - RNA, 23 nt, Homo sapiens
auccuaucagccugucucuucca

SEQ ID NO: 1984082 - RNA, 16 nt, Homo sapiens
ccuccugugaaccaac

SEQ ID NO: 1984083 - RNA, 12 nt, Homo sapiens
caagacuucaaa

SEQ ID NO: 1984084 - RNA, 21 nt, Homo sapiens
cucucaccagauaaguccuuu

SEQ ID NO: 1984085 - RNA, 16 nt, Homo sapiens
acaaucaaggccacug

SEQ ID NO: 1984086 - RNA, 18 nt, Homo sapiens
caaaugugucccagugaa

SEQ ID NO: 1984087 - RNA, 18 nt, Homo sapiens
gcaugcagaagugcauga

SEQ ID NO: 1984088 - RNA, 17 nt, Homo sapiens
aggacccuaagaugaag

SEQ ID NO: 1984089 - RNA, 18 nt, Homo sapiens
aggcagcugucacugcug

SEQ ID NO: 1984090 - RNA, 12 nt, Homo sapiens
uagagaagcaag

SEQ ID NO: 1984091 - RNA, 17 nt, Homo sapiens
ccuaauacaacauguag

SEQ ID NO: 1984092 - RNA, 20 nt, Homo sapiens
uuguuguaaccugcugugau

SEQ ID NO: 1984093 - RNA, 17 nt, Homo sapiens
uuguaaaguuagccuuu

SEQ ID NO: 1984094 - RNA, 18 nt, Homo sapiens
ugaaaggggacaccugua

SEQ ID NO: 1984095 - RNA, 16 nt, Homo sapiens
cuguggagucaaggau

SEQ ID NO: 1984096 - RNA, 22 nt, Homo sapiens
ccugugagcuaggaauuguguu

SEQ ID NO: 1984097 - RNA, 12 nt, Homo sapiens
gaaucuuuacaa

SEQ ID NO: 1984098 - RNA, 22 nt, Homo sapiens
agacagcaccacugcugaggag

SEQ ID NO: 1984099 - RNA, 18 nt, Homo sapiens
ccagugggcauagucagu

SEQ ID NO: 1984100 - RNA, 12 nt, Homo sapiens
gggccagagcca

SEQ ID NO: 1984101 - RNA, 17 nt, Homo sapiens
auuuccgccacaucccu

SEQ ID NO: 1984102 - RNA, 11 nt, Homo sapiens
guacaguuuuu

SEQ ID NO: 1984103 - RNA, 16 nt, Homo sapiens
ccucagaauaaaagau

SEQ ID NO: 1984104 - RNA, 19 nt, Homo sapiens
aagagauccaucaagacaa

SEQ ID NO: 1984105 - RNA, 22 nt, Homo sapiens
gacccuuugaggcccccaguga

SEQ ID NO: 1984106 - RNA, 15 nt, Homo sapiens
ucugggugaccucac

SEQ ID NO: 1984107 - RNA, 18 nt, Homo sapiens
ucucacuguguugcccag

SEQ ID NO: 1984108 - RNA, 13 nt, Homo sapiens
uacagaguuuuag

SEQ ID NO: 1984109 - RNA, 20 nt, Homo sapiens
uacauucugcaagcacaucu

SEQ ID NO: 1984110 - RNA, 19 nt, Homo sapiens
uucaauccagagagcuuaa

SEQ ID NO: 1984111 - RNA, 17 nt, Homo sapiens
cacugugcucagauucc

SEQ ID NO: 1984112 - RNA, 19 nt, Homo sapiens
ugaggugccugcucaggug

SEQ ID NO: 1984113 - RNA, 20 nt, Homo sapiens
ucuuucccuccuuggugauu

SEQ ID NO: 1984114 - RNA, 19 nt, Homo sapiens
cuaaucuguaaaugagaaa

SEQ ID NO: 1984115 - RNA, 19 nt, Homo sapiens
uggcucugaugcugagcga

SEQ ID NO: 1984116 - RNA, 16 nt, Homo sapiens
uccuggcccaggugag

SEQ ID NO: 1984117 - RNA, 19 nt, Homo sapiens
cuuauuacaugcugcuaua

SEQ ID NO: 1984118 - RNA, 14 nt, Homo sapiens
uugcccacuggccg

SEQ ID NO: 1984119 - RNA, 21 nt, Homo sapiens
ugcauagcagaugguuuccac

SEQ ID NO: 1984120 - RNA, 17 nt, Homo sapiens
acuccucaaccuugacu

SEQ ID NO: 1984121 - RNA, 18 nt, Homo sapiens
cuuuuuaaccugcaaaau

SEQ ID NO: 1984122 - RNA, 17 nt, Homo sapiens
uugagcuagggggguca

SEQ ID NO: 1984123 - RNA, 10 nt, Homo sapiens
agucaaucca

SEQ ID NO: 1984124 - RNA, 23 nt, Homo sapiens
aagaacugaaaucauacuucuua

SEQ ID NO: 1984125 - RNA, 23 nt, Homo sapiens
aaugagugauuccaguauuucau

SEQ ID NO: 1984126 - RNA, 14 nt, Homo sapiens
auaacauuuuccca

SEQ ID NO: 1984127 - RNA, 13 nt, Homo sapiens
aacuuagcuuuau

SEQ ID NO: 1984128 - RNA, 19 nt, Homo sapiens
augaaccccuggcuccuuc

SEQ ID NO: 1984129 - RNA, 13 nt, Homo sapiens
ucuugaagacuuu

SEQ ID NO: 1984130 - RNA, 16 nt, Homo sapiens
aucugccuuuguuucu

SEQ ID NO: 1984131 - RNA, 23 nt, Homo sapiens
aacacuagucuguguaacuuuaa

SEQ ID NO: 1984132 - RNA, 22 nt, Homo sapiens
aaucaugccauugcacuccagc

SEQ ID NO: 1984133 - RNA, 18 nt, Homo sapiens
acaauuaacauacaucau

SEQ ID NO: 1984134 - RNA, 18 nt, Homo sapiens
ucccucuacuaauuuccu

SEQ ID NO: 1984135 - RNA, 14 nt, Homo sapiens
gcuccucuguucag

SEQ ID NO: 1984136 - RNA, 18 nt, Homo sapiens
uaagugcauuuauugccu

SEQ ID NO: 1984137 - RNA, 12 nt, Homo sapiens
caagccugugga

SEQ ID NO: 1984138 - RNA, 19 nt, Homo sapiens
acucccggagccugugcag

SEQ ID NO: 1984139 - RNA, 14 nt, Homo sapiens
cuugaauuuaauac

SEQ ID NO: 1984140 - RNA, 20 nt, Homo sapiens
gcaaauaauacuaauuuaua

SEQ ID NO: 1984141 - RNA, 22 nt, Homo sapiens
gcacacuaguuuaugcuaccua

SEQ ID NO: 1984142 - RNA, 12 nt, Homo sapiens
auccuugcuaag

SEQ ID NO: 1984143 - RNA, 18 nt, Homo sapiens
ucuuuaaaggcaucuaca

SEQ ID NO: 1984144 - RNA, 15 nt, Homo sapiens
ccaggacacccagug

SEQ ID NO: 1984145 - RNA, 19 nt, Homo sapiens
aaaucuuuuaaaaauucaa

SEQ ID NO: 1984146 - RNA, 21 nt, Homo sapiens
accccggggugcccacaggcc

SEQ ID NO: 1984147 - RNA, 21 nt, Homo sapiens
cucaaaauaugucaacuuaaa

SEQ ID NO: 1984148 - RNA, 17 nt, Homo sapiens
ccggagagggagucagu

SEQ ID NO: 1984149 - RNA, 17 nt, Homo sapiens
uggcacugccacugugg

SEQ ID NO: 1984150 - RNA, 19 nt, Homo sapiens
ggacuacaggcaccugcca

SEQ ID NO: 1984151 - RNA, 19 nt, Homo sapiens
cuucucuccagcugacuaa

SEQ ID NO: 1984152 - RNA, 18 nt, Homo sapiens
cauuucuguuacuuguca

SEQ ID NO: 1984153 - RNA, 21 nt, Homo sapiens
auugucauuugggcuuucugu

SEQ ID NO: 1984154 - RNA, 16 nt, Homo sapiens
cuagucaaugacauga

SEQ ID NO: 1984155 - RNA, 16 nt, Homo sapiens
caagauaaaaaucaca

SEQ ID NO: 1984156 - RNA, 20 nt, Homo sapiens
uggagccaggaguuugagac

SEQ ID NO: 1984157 - RNA, 18 nt, Homo sapiens
uuugcaucugaaagagaa

SEQ ID NO: 1984158 - RNA, 14 nt, Homo sapiens
cuuucuucuagugc

SEQ ID NO: 1984159 - RNA, 16 nt, Homo sapiens
gaagagauccaaagac

SEQ ID NO: 1984160 - RNA, 15 nt, Homo sapiens
auuuuguacauguau

SEQ ID NO: 1984161 - RNA, 17 nt, Homo sapiens
gcacuguugcaaacuca

SEQ ID NO: 1984162 - RNA, 14 nt, Homo sapiens
uacccaugaagauu

SEQ ID NO: 1984163 - RNA, 14 nt, Homo sapiens
agaugcugauguuc

SEQ ID NO: 1984164 - RNA, 22 nt, Homo sapiens
gaugucaaaacaagacuccuca

SEQ ID NO: 1984165 - RNA, 12 nt, Homo sapiens
aguucaaauacu

SEQ ID NO: 1984166 - RNA, 15 nt, Homo sapiens
uaauucagcucuuga

SEQ ID NO: 1984167 - RNA, 16 nt, Homo sapiens
aaacaaaaaggaaaug

SEQ ID NO: 1984168 - RNA, 17 nt, Homo sapiens
gcgguggccucuuuuca

SEQ ID NO: 1984169 - RNA, 23 nt, Homo sapiens
uuauguauuugaaaacucacaga

SEQ ID NO: 1984170 - RNA, 22 nt, Homo sapiens
uggggaggacaaaacuucuugu

SEQ ID NO: 1984171 - RNA, 14 nt, Homo sapiens
aauccuguacaauu

SEQ ID NO: 1984172 - RNA, 20 nt, Homo sapiens
agggccagauuucauucuca

SEQ ID NO: 1984173 - RNA, 13 nt, Homo sapiens
auaucuaggcauu

SEQ ID NO: 1984174 - RNA, 16 nt, Homo sapiens
aauaucugaaauguga

SEQ ID NO: 1984175 - RNA, 20 nt, Homo sapiens
auauuuuaccaccagucaau

SEQ ID NO: 1984176 - RNA, 18 nt, Homo sapiens
aagaacuuugcacacuuc

SEQ ID NO: 1984177 - RNA, 16 nt, Homo sapiens
gcugagauuacaggca

SEQ ID NO: 1984178 - RNA, 16 nt, Homo sapiens
cuggaagccugcugau

SEQ ID NO: 1984179 - RNA, 21 nt, Homo sapiens
gauggugugcuggcccugcgc

SEQ ID NO: 1984180 - RNA, 19 nt, Homo sapiens
auuccuguuagccaggugg

SEQ ID NO: 1984181 - RNA, 23 nt, Homo sapiens
ucagaccuugcaaucacaaaagg

SEQ ID NO: 1984182 - RNA, 17 nt, Homo sapiens
cuggggugggugugagc

SEQ ID NO: 1984183 - RNA, 15 nt, Homo sapiens
aaccagcuacuugau

SEQ ID NO: 1984184 - RNA, 19 nt, Homo sapiens
gaguuuccccagacaccgc

SEQ ID NO: 1984185 - RNA, 19 nt, Homo sapiens
accuuucuagggacaugaa

SEQ ID NO: 1984186 - RNA, 23 nt, Homo sapiens
cagcccaggucccuccgcggcug

SEQ ID NO: 1984187 - RNA, 19 nt, Homo sapiens
gcacuugggggcucagcaa

SEQ ID NO: 1984188 - RNA, 16 nt, Homo sapiens
ccucacuucuggcacu

SEQ ID NO: 1984189 - RNA, 16 nt, Homo sapiens
cacugcacuguuuuca

SEQ ID NO: 1984190 - RNA, 13 nt, Homo sapiens
gaaauacacaggg

SEQ ID NO: 1984191 - RNA, 20 nt, Homo sapiens
gaguuauucaaaugaaggug

SEQ ID NO: 1984192 - RNA, 17 nt, Homo sapiens
uggcuuaagccugugua

SEQ ID NO: 1984193 - RNA, 18 nt, Homo sapiens
cccagugcaugguggcca

SEQ ID NO: 1984194 - RNA, 14 nt, Homo sapiens
ucccccuuccaugg

SEQ ID NO: 1984195 - RNA, 13 nt, Homo sapiens
uuuccugccuucu

SEQ ID NO: 1984196 - RNA, 17 nt, Homo sapiens
cugauaauaugcaaaug

SEQ ID NO: 1984197 - RNA, 21 nt, Homo sapiens
gauuuuuauuuucuucuuugg

SEQ ID NO: 1984198 - RNA, 16 nt, Homo sapiens
ccggugaggggagggu

SEQ ID NO: 1984199 - RNA, 13 nt, Homo sapiens
caagacuguaaau

SEQ ID NO: 1984200 - RNA, 18 nt, Homo sapiens
gucccuuggaaccuuugu

SEQ ID NO: 1984201 - RNA, 15 nt, Homo sapiens
caacagaaacuucuc

SEQ ID NO: 1984202 - RNA, 18 nt, Homo sapiens
ccagguuuaugaaugaca

SEQ ID NO: 1984203 - RNA, 15 nt, Homo sapiens
uccuguacucugggg

SEQ ID NO: 1984204 - RNA, 17 nt, Homo sapiens
uguaauuguauuucaaa

SEQ ID NO: 1984205 - RNA, 15 nt, Homo sapiens
uaccauggcacugac

SEQ ID NO: 1984206 - RNA, 22 nt, Homo sapiens
augaauucauacucuguugccu

SEQ ID NO: 1984207 - RNA, 13 nt, Homo sapiens
acucuucauucag

SEQ ID NO: 1984208 - RNA, 11 nt, Homo sapiens
gacagcauuuu

SEQ ID NO: 1984209 - RNA, 16 nt, Homo sapiens
uauacaugaccuuaau

SEQ ID NO: 1984210 - RNA, 18 nt, Homo sapiens
uaagccagaauccagaag

SEQ ID NO: 1984211 - RNA, 16 nt, Homo sapiens
uucagaguggacuugu

SEQ ID NO: 1984212 - RNA, 20 nt, Homo sapiens
ggcaggagaaucacucgaac

SEQ ID NO: 1984213 - RNA, 16 nt, Homo sapiens
gaagcuguugcggaca

SEQ ID NO: 1984214 - RNA, 12 nt, Homo sapiens
caacuuugacaa

SEQ ID NO: 1984215 - RNA, 13 nt, Homo sapiens
uaaaccaaccuuu

SEQ ID NO: 1984216 - RNA, 18 nt, Homo sapiens
acugauacuucacuacuu

SEQ ID NO: 1984217 - RNA, 21 nt, Homo sapiens
gucucaaaccaagcaaaggaa

SEQ ID NO: 1984218 - RNA, 16 nt, Homo sapiens
auaaacauaucaaugu

SEQ ID NO: 1984219 - RNA, 16 nt, Homo sapiens
guaugcaagucuguga

SEQ ID NO: 1984220 - RNA, 15 nt, Homo sapiens
aguuucuucaccugu

SEQ ID NO: 1984221 - RNA, 23 nt, Homo sapiens
gaugcacacacacagaugucuua

SEQ ID NO: 1984222 - RNA, 20 nt, Homo sapiens
agugagccaggaaagcagca

SEQ ID NO: 1984223 - RNA, 14 nt, Homo sapiens
caaucuugaacuca

SEQ ID NO: 1984224 - RNA, 14 nt, Homo sapiens
auaaauugcucaaa

SEQ ID NO: 1984225 - RNA, 23 nt, Homo sapiens
auuacucuauugauacaauauug

SEQ ID NO: 1984226 - RNA, 16 nt, Homo sapiens
gcccccugccagugaa

SEQ ID NO: 1984227 - RNA, 23 nt, Homo sapiens
gaaccauauccauguugcugacu

SEQ ID NO: 1984228 - RNA, 15 nt, Homo sapiens
aacauuuaaauucca

SEQ ID NO: 1984229 - RNA, 15 nt, Homo sapiens
acuguguucccucau

SEQ ID NO: 1984230 - RNA, 12 nt, Homo sapiens
uggcacuauccg

SEQ ID NO: 1984231 - RNA, 21 nt, Homo sapiens
cauguuuagcagaaauaggca

SEQ ID NO: 1984232 - RNA, 19 nt, Homo sapiens
ccagaguagccaugaggag

SEQ ID NO: 1984233 - RNA, 10 nt, Homo sapiens
agacagagac

SEQ ID NO: 1984234 - RNA, 17 nt, Homo sapiens
cuguucaucuugccaag

SEQ ID NO: 1984235 - RNA, 19 nt, Homo sapiens
ccaggcugucagcgccuca

SEQ ID NO: 1984236 - RNA, 13 nt, Homo sapiens
caguguacugcuu

SEQ ID NO: 1984237 - RNA, 18 nt, Homo sapiens
auguugccauguguuuua

SEQ ID NO: 1984238 - RNA, 14 nt, Homo sapiens
gcaugugcagcuau

SEQ ID NO: 1984239 - RNA, 20 nt, Homo sapiens
uggccuaggcuaccucaaga

SEQ ID NO: 1984240 - RNA, 19 nt, Homo sapiens
ccuugacuugaaaugcucu

SEQ ID NO: 1984241 - RNA, 20 nt, Homo sapiens
accuuuuacauugugacugu

SEQ ID NO: 1984242 - RNA, 15 nt, Homo sapiens
ugguaugaccaguga

SEQ ID NO: 1984243 - RNA, 14 nt, Homo sapiens
guuuuaccagcucc

SEQ ID NO: 1984244 - RNA, 16 nt, Homo sapiens
acccuaaaacaugugu

SEQ ID NO: 1984245 - RNA, 19 nt, Homo sapiens
accgaaaggccaaauuccc

SEQ ID NO: 1984246 - RNA, 22 nt, Homo sapiens
ggaagucucuuuuuuuacucuu

SEQ ID NO: 1984247 - RNA, 21 nt, Homo sapiens
ucuuucuauuuaugcaacuca

SEQ ID NO: 1984248 - RNA, 16 nt, Homo sapiens
ccuaucaaagcuucaa

SEQ ID NO: 1984249 - RNA, 16 nt, Homo sapiens
agcaccaaccuuccaa

SEQ ID NO: 1984250 - RNA, 23 nt, Homo sapiens
agccaaacacuguuucuaacuca

SEQ ID NO: 1984251 - RNA, 19 nt, Homo sapiens
uauuuggagcaagugacau

SEQ ID NO: 1984252 - RNA, 17 nt, Homo sapiens
agagaaccgagcaaaga

SEQ ID NO: 1984253 - RNA, 19 nt, Homo sapiens
cucuagacaacuaccccuu

SEQ ID NO: 1984254 - RNA, 13 nt, Homo sapiens
gucauauauucau

SEQ ID NO: 1984255 - RNA, 18 nt, Homo sapiens
uccuagaagugguuugua

SEQ ID NO: 1984256 - RNA, 20 nt, Homo sapiens
gagccucgguggccaugcuu

SEQ ID NO: 1984257 - RNA, 20 nt, Homo sapiens
gggucuuuaauaaaacaaca

SEQ ID NO: 1984258 - RNA, 11 nt, Homo sapiens
uguggucacag

SEQ ID NO: 1984259 - RNA, 17 nt, Homo sapiens
caggaguuagaggccag

SEQ ID NO: 1984260 - RNA, 15 nt, Homo sapiens
guauucuacccuguu

SEQ ID NO: 1984261 - RNA, 15 nt, Homo sapiens
cuggcaagcugcaaa

SEQ ID NO: 1984262 - RNA, 12 nt, Homo sapiens
aaaaauaugugu

SEQ ID NO: 1984263 - RNA, 17 nt, Homo sapiens
uugaucaaauauuucaa

SEQ ID NO: 1984264 - RNA, 19 nt, Homo sapiens
auucacaauggaaacuuua

SEQ ID NO: 1984265 - RNA, 13 nt, Homo sapiens
aucaucacucauc

SEQ ID NO: 1984266 - RNA, 18 nt, Homo sapiens
uaaaauguguacagugaa

SEQ ID NO: 1984267 - RNA, 18 nt, Homo sapiens
gguuucgccauuuggcca

SEQ ID NO: 1984268 - RNA, 16 nt, Homo sapiens
auaguuugaauucagu

SEQ ID NO: 1984269 - RNA, 16 nt, Homo sapiens
ugaggcuccugugcua

SEQ ID NO: 1984270 - RNA, 18 nt, Homo sapiens
uuuuucuucuuguuucuc

SEQ ID NO: 1984271 - RNA, 14 nt, Homo sapiens
uccccgggcaucuu

SEQ ID NO: 1984272 - RNA, 21 nt, Homo sapiens
aagcaagguguuuaaguaauu

SEQ ID NO: 1984273 - RNA, 23 nt, Homo sapiens
ugcuguaugauauuaauguggaa

SEQ ID NO: 1984274 - RNA, 18 nt, Homo sapiens
ucuguccguuuacuccaa

SEQ ID NO: 1984275 - RNA, 21 nt, Homo sapiens
cucccauaauugcuuugccaa

SEQ ID NO: 1984276 - RNA, 20 nt, Homo sapiens
cgggcuguagaucagguuug

SEQ ID NO: 1984277 - RNA, 18 nt, Homo sapiens
agcugguaaacuauuugu

SEQ ID NO: 1984278 - RNA, 16 nt, Homo sapiens
ugaguguaacaagaaa

SEQ ID NO: 1984279 - RNA, 20 nt, Homo sapiens
uucccuggggaaaacuugca

SEQ ID NO: 1984280 - RNA, 12 nt, Homo sapiens
cuccacccuaua

SEQ ID NO: 1984281 - RNA, 20 nt, Homo sapiens
cuucaugucacugcucuuga

SEQ ID NO: 1984282 - RNA, 15 nt, Homo sapiens
uaauuguaucagagg

SEQ ID NO: 1984283 - RNA, 19 nt, Homo sapiens
aaggcucauuuacuugaaa

SEQ ID NO: 1984284 - RNA, 20 nt, Homo sapiens
acauuaugagagacugcuca

SEQ ID NO: 1984285 - RNA, 18 nt, Homo sapiens
agcccuggcauguuccug

SEQ ID NO: 1984286 - RNA, 22 nt, Homo sapiens
aguuuauaggagaacguaucaa

SEQ ID NO: 1984287 - RNA, 17 nt, Homo sapiens
auaugaaaagagcaaaa

SEQ ID NO: 1984288 - RNA, 17 nt, Homo sapiens
cuuccugggcaaagaag

SEQ ID NO: 1984289 - RNA, 14 nt, Homo sapiens
caacugauugcaac

SEQ ID NO: 1984290 - RNA, 18 nt, Homo sapiens
auugaauuaaaacagcug

SEQ ID NO: 1984291 - RNA, 18 nt, Homo sapiens
caaaucuauagcauuuaa

SEQ ID NO: 1984292 - RNA, 21 nt, Homo sapiens
acaaguacaucuguacaugac

SEQ ID NO: 1984293 - RNA, 16 nt, Homo sapiens
auaaacccuccuuggu

SEQ ID NO: 1984294 - RNA, 15 nt, Homo sapiens
gagaacaguuucauc

SEQ ID NO: 1984295 - RNA, 20 nt, Homo sapiens
uagccauuuuucaaagcaau

SEQ ID NO: 1984296 - RNA, 17 nt, Homo sapiens
caccagagcaaccucuc

SEQ ID NO: 1984297 - RNA, 21 nt, Homo sapiens
uacacgugccuguagucccag

SEQ ID NO: 1984298 - RNA, 21 nt, Homo sapiens
gcaaggccuuucuguguguga

SEQ ID NO: 1984299 - RNA, 14 nt, Homo sapiens
uuccaucaauuuua

SEQ ID NO: 1984300 - RNA, 17 nt, Homo sapiens
uccugucacugagcaca

SEQ ID NO: 1984301 - RNA, 17 nt, Homo sapiens
ucaaagaugacuugaaa

SEQ ID NO: 1984302 - RNA, 21 nt, Homo sapiens
ccaaagggugaagcuauuuau

SEQ ID NO: 1984303 - RNA, 20 nt, Homo sapiens
ugcacaaguaacacauuugg

SEQ ID NO: 1984304 - RNA, 19 nt, Homo sapiens
agccuccuuuugcuugaaa

SEQ ID NO: 1984305 - RNA, 18 nt, Homo sapiens
acguugccucuacuuuau

SEQ ID NO: 1984306 - RNA, 23 nt, Homo sapiens
auaauggaaaaaaaaaaaagagg

SEQ ID NO: 1984307 - RNA, 19 nt, Homo sapiens
cuggcaguacagagugcag

SEQ ID NO: 1984308 - RNA, 12 nt, Homo sapiens
ugucuguacuuc

SEQ ID NO: 1984309 - RNA, 12 nt, Homo sapiens
cagaacagccag

SEQ ID NO: 1984310 - RNA, 17 nt, Homo sapiens
ugagggaaacaaaauau

SEQ ID NO: 1984311 - RNA, 19 nt, Homo sapiens
aaggaaaauuaauccucac

SEQ ID NO: 1984312 - RNA, 17 nt, Homo sapiens
caggcugggccaugucc

SEQ ID NO: 1984313 - RNA, 20 nt, Homo sapiens
aucuggacuuauuuuuggac

SEQ ID NO: 1984314 - RNA, 16 nt, Homo sapiens
gaagcagaagugcaau

SEQ ID NO: 1984315 - RNA, 20 nt, Homo sapiens
ccuucugcuguauacuguac

SEQ ID NO: 1984316 - RNA, 18 nt, Homo sapiens
aggaacuuuuaaacugca

SEQ ID NO: 1984317 - RNA, 14 nt, Homo sapiens
acacuguagucaga

SEQ ID NO: 1984318 - RNA, 17 nt, Homo sapiens
gaagggcugaguggucu

SEQ ID NO: 1984319 - RNA, 21 nt, Homo sapiens
gcugcacacagacggccuagg

SEQ ID NO: 1984320 - RNA, 12 nt, Homo sapiens
aacaugauuuca

SEQ ID NO: 1984321 - RNA, 21 nt, Homo sapiens
ugaaaaacuggcaacauucca

SEQ ID NO: 1984322 - RNA, 10 nt, Homo sapiens
agcaugugug

SEQ ID NO: 1984323 - RNA, 23 nt, Homo sapiens
caaaaccgaguugccagcuccca

SEQ ID NO: 1984324 - RNA, 13 nt, Homo sapiens
gcuugggcccagu

SEQ ID NO: 1984325 - RNA, 20 nt, Homo sapiens
uucagacuuaaagcacugau

SEQ ID NO: 1984326 - RNA, 18 nt, Homo sapiens
caaggugcacagaccuca

SEQ ID NO: 1984327 - RNA, 16 nt, Homo sapiens
guguuggcacaugccu

SEQ ID NO: 1984328 - RNA, 15 nt, Homo sapiens
ugggcugaguacagu

SEQ ID NO: 1984329 - RNA, 16 nt, Homo sapiens
cagugccccuagcuua

SEQ ID NO: 1984330 - RNA, 22 nt, Homo sapiens
ugcacauuugugcauaaauuuc

SEQ ID NO: 1984331 - RNA, 13 nt, Homo sapiens
aauaauguucacg

SEQ ID NO: 1984332 - RNA, 17 nt, Homo sapiens
ggugcaaucacagcuca

SEQ ID NO: 1984333 - RNA, 17 nt, Homo sapiens
gaaauauauaauauuca

SEQ ID NO: 1984334 - RNA, 21 nt, Homo sapiens
gccugggcugugaggacaggg

SEQ ID NO: 1984335 - RNA, 15 nt, Homo sapiens
aagaucauugccauc

SEQ ID NO: 1984336 - RNA, 16 nt, Homo sapiens
ugcacuauagccauuu

SEQ ID NO: 1984337 - RNA, 19 nt, Homo sapiens
ugaaauuuggcuaauaaca

SEQ ID NO: 1984338 - RNA, 15 nt, Homo sapiens
ugaagggguucucac

SEQ ID NO: 1984339 - RNA, 14 nt, Homo sapiens
ucacccaacucaag

SEQ ID NO: 1984340 - RNA, 22 nt, Homo sapiens
ccugagucggccccacauggga

SEQ ID NO: 1984341 - RNA, 14 nt, Homo sapiens
uuguuaagugcagu

SEQ ID NO: 1984342 - RNA, 16 nt, Homo sapiens
accaggucuacaguga

SEQ ID NO: 1984343 - RNA, 13 nt, Homo sapiens
cuuggaccaaaug

SEQ ID NO: 1984344 - RNA, 22 nt, Homo sapiens
agcuugauccagaccucuacaa

SEQ ID NO: 1984345 - RNA, 13 nt, Homo sapiens
ggguggggugccu

SEQ ID NO: 1984346 - RNA, 22 nt, Homo sapiens
ccaguggauucuuguuuugcuu

SEQ ID NO: 1984347 - RNA, 19 nt, Homo sapiens
agaucacacacaugcacac

SEQ ID NO: 1984348 - RNA, 15 nt, Homo sapiens
cauccugcucaggaa

SEQ ID NO: 1984349 - RNA, 16 nt, Homo sapiens
auggacaucagcauca

SEQ ID NO: 1984350 - RNA, 22 nt, Homo sapiens
aacauggccugcugggcccaag

SEQ ID NO: 1984351 - RNA, 22 nt, Homo sapiens
cagugaauguguguauguauga

SEQ ID NO: 1984352 - RNA, 17 nt, Homo sapiens
guaauuuccacuuggga

SEQ ID NO: 1984353 - RNA, 15 nt, Homo sapiens
agacccacagcccug

SEQ ID NO: 1984354 - RNA, 23 nt, Homo sapiens
guaacuauaccucugguucccau

SEQ ID NO: 1984355 - RNA, 21 nt, Homo sapiens
aacugaggagcggacucacuu

SEQ ID NO: 1984356 - RNA, 11 nt, Homo sapiens
ugaauaugccu

SEQ ID NO: 1984357 - RNA, 14 nt, Homo sapiens
ugcgucugcucuuc

SEQ ID NO: 1984358 - RNA, 23 nt, Homo sapiens
ccugcgcgcaugugcgcacacac

SEQ ID NO: 1984359 - RNA, 15 nt, Homo sapiens
aacaguaacugccau

SEQ ID NO: 1984360 - RNA, 17 nt, Homo sapiens
agauuauggaaguuuuc

SEQ ID NO: 1984361 - RNA, 19 nt, Homo sapiens
ucaccugggaccuuacucc

SEQ ID NO: 1984362 - RNA, 19 nt, Homo sapiens
uuacaaacaagauacguau

SEQ ID NO: 1984363 - RNA, 21 nt, Homo sapiens
uugaagagauuucaacauauc

SEQ ID NO: 1984364 - RNA, 14 nt, Homo sapiens
uugaacguuuucua

SEQ ID NO: 1984365 - RNA, 11 nt, Homo sapiens
ccuuuguguaa

SEQ ID NO: 1984366 - RNA, 16 nt, Homo sapiens
gcuuugaauacuaaau

SEQ ID NO: 1984367 - RNA, 18 nt, Homo sapiens
aauaauacugaccuaccu

SEQ ID NO: 1984368 - RNA, 20 nt, Homo sapiens
auuguuccaguacuauggag

SEQ ID NO: 1984369 - RNA, 15 nt, Homo sapiens
auuguauuacagaug

SEQ ID NO: 1984370 - RNA, 15 nt, Homo sapiens
aaaggagucagagca

SEQ ID NO: 1984371 - RNA, 17 nt, Homo sapiens
uguacuaauacagggag

SEQ ID NO: 1984372 - RNA, 19 nt, Homo sapiens
uugacagcuuugcugcuga

SEQ ID NO: 1984373 - RNA, 20 nt, Homo sapiens
aauauaugauuagccaggca

SEQ ID NO: 1984374 - RNA, 14 nt, Homo sapiens
agggcacacacugu

SEQ ID NO: 1984375 - RNA, 14 nt, Homo sapiens
uguacaaauucuua

SEQ ID NO: 1984376 - RNA, 14 nt, Homo sapiens
uguuuaaauucaca

SEQ ID NO: 1984377 - RNA, 23 nt, Homo sapiens
ggcagacacuguuugcccagugu

SEQ ID NO: 1984378 - RNA, 22 nt, Homo sapiens
uucagaccagccccaccaugca

SEQ ID NO: 1984379 - RNA, 22 nt, Homo sapiens
cagaggugauucuuacauauga

SEQ ID NO: 1984380 - RNA, 17 nt, Homo sapiens
ucuugcaacuuguuaaa

SEQ ID NO: 1984381 - RNA, 16 nt, Homo sapiens
uuuucaacuuugaaua

SEQ ID NO: 1984382 - RNA, 17 nt, Homo sapiens
auguauuaucacaucaa

SEQ ID NO: 1984383 - RNA, 12 nt, Homo sapiens
uucuccugaaac

SEQ ID NO: 1984384 - RNA, 11 nt, Homo sapiens
agucugaguca

SEQ ID NO: 1984385 - RNA, 22 nt, Homo sapiens
acuggcaauaaacuccuacuaa

SEQ ID NO: 1984386 - RNA, 17 nt, Homo sapiens
cugauccuucaacucug

SEQ ID NO: 1984387 - RNA, 21 nt, Homo sapiens
agcaaauauguuugcauuaaa

SEQ ID NO: 1984388 - RNA, 14 nt, Homo sapiens
gcaggggcuuccca

SEQ ID NO: 1984389 - RNA, 23 nt, Homo sapiens
ccagagccccccacaaugaugau

SEQ ID NO: 1984390 - RNA, 17 nt, Homo sapiens
agacucuaaauauuuca

SEQ ID NO: 1984391 - RNA, 16 nt, Homo sapiens
cacagacuggcaauaa

SEQ ID NO: 1984392 - RNA, 23 nt, Homo sapiens
acaaaaccuacacacauaccuuc

SEQ ID NO: 1984393 - RNA, 17 nt, Homo sapiens
gguuuuguguuuuguca

SEQ ID NO: 1984394 - RNA, 13 nt, Homo sapiens
uuaguccaaauaa

SEQ ID NO: 1984395 - RNA, 11 nt, Homo sapiens
cuguugcacug

SEQ ID NO: 1984396 - RNA, 15 nt, Homo sapiens
uacuaauugagccau

SEQ ID NO: 1984397 - RNA, 21 nt, Homo sapiens
auggggacacagaucauggua

SEQ ID NO: 1984398 - RNA, 16 nt, Homo sapiens
ucuaagaaccaaaaaa

SEQ ID NO: 1984399 - RNA, 16 nt, Homo sapiens
ucagggagccuggaag

SEQ ID NO: 1984400 - RNA, 17 nt, Homo sapiens
aggcaggcagccugaga

SEQ ID NO: 1984401 - RNA, 21 nt, Homo sapiens
caguaacaaauaaagugcagu

SEQ ID NO: 1984402 - RNA, 21 nt, Homo sapiens
uuuacuaagaugacauugcua

SEQ ID NO: 1984403 - RNA, 11 nt, Homo sapiens
auauauacuca

SEQ ID NO: 1984404 - RNA, 16 nt, Homo sapiens
ccuuuuuacacuuuau

SEQ ID NO: 1984405 - RNA, 19 nt, Homo sapiens
gugacuaauggcaugagaa

SEQ ID NO: 1984406 - RNA, 15 nt, Homo sapiens
uggcuaacugaugaa

SEQ ID NO: 1984407 - RNA, 20 nt, Homo sapiens
cccaccagagugaugugugg

SEQ ID NO: 1984408 - RNA, 17 nt, Homo sapiens
uuuaaguuuccuuccag

SEQ ID NO: 1984409 - RNA, 14 nt, Homo sapiens
gccagcuacuuccu

SEQ ID NO: 1984410 - RNA, 23 nt, Homo sapiens
uaauuuucaggaagaaagggaaa

SEQ ID NO: 1984411 - RNA, 14 nt, Homo sapiens
gccugcaccuggug

SEQ ID NO: 1984412 - RNA, 22 nt, Homo sapiens
cagcucagcuucuuccuagguc

SEQ ID NO: 1984413 - RNA, 19 nt, Homo sapiens
auuuucagaauuuaaucuu

SEQ ID NO: 1984414 - RNA, 17 nt, Homo sapiens
guaaagucaacauaugc

SEQ ID NO: 1984415 - RNA, 21 nt, Homo sapiens
caugagccuguuuauugccau

SEQ ID NO: 1984416 - RNA, 15 nt, Homo sapiens
aggaaaccuuuucau

SEQ ID NO: 1984417 - RNA, 15 nt, Homo sapiens
aaaguuuuaaccuca

SEQ ID NO: 1984418 - RNA, 22 nt, Homo sapiens
uuauauugaacuguaaauaugu

SEQ ID NO: 1984419 - RNA, 14 nt, Homo sapiens
caucuucuggaguc

SEQ ID NO: 1984420 - RNA, 17 nt, Homo sapiens
ugacaugauauagucag

SEQ ID NO: 1984421 - RNA, 23 nt, Homo sapiens
ugugcuaccccuuugauuaugca

SEQ ID NO: 1984422 - RNA, 19 nt, Homo sapiens
uaacuugguuauacaugac

SEQ ID NO: 1984423 - RNA, 17 nt, Homo sapiens
uuaucuuguacagccuu

SEQ ID NO: 1984424 - RNA, 22 nt, Homo sapiens
uucccuggggccccauuugcca

SEQ ID NO: 1984425 - RNA, 23 nt, Homo sapiens
cugaaguuggccaccuugcuuga

SEQ ID NO: 1984426 - RNA, 15 nt, Homo sapiens
cccccaagccugggc

SEQ ID NO: 1984427 - RNA, 23 nt, Homo sapiens
ucucuugauucauaaugacuuaa

SEQ ID NO: 1984428 - RNA, 18 nt, Homo sapiens
acucagaggcagugacag

SEQ ID NO: 1984429 - RNA, 21 nt, Homo sapiens
aauagcaaaauauuaucugaa

SEQ ID NO: 1984430 - RNA, 19 nt, Homo sapiens
gugacugaauucugccuug

SEQ ID NO: 1984431 - RNA, 12 nt, Homo sapiens
cagaauucccuu

SEQ ID NO: 1984432 - RNA, 11 nt, Homo sapiens
gugggccaugg

SEQ ID NO: 1984433 - RNA, 19 nt, Homo sapiens
caucuggguuuguuuacag

SEQ ID NO: 1984434 - RNA, 15 nt, Homo sapiens
aaugaaugagccaaa

SEQ ID NO: 1984435 - RNA, 15 nt, Homo sapiens
cuuuucucaguuugg

SEQ ID NO: 1984436 - RNA, 23 nt, Homo sapiens
cugcuugccauucucuugcauug

SEQ ID NO: 1984437 - RNA, 18 nt, Homo sapiens
agaucgcaccacugcacu

SEQ ID NO: 1984438 - RNA, 13 nt, Homo sapiens
ggcacagccagaa

SEQ ID NO: 1984439 - RNA, 18 nt, Homo sapiens
ggauuuuuaaaaugucaa

SEQ ID NO: 1984440 - RNA, 18 nt, Homo sapiens
augaggauaaugggaaga

SEQ ID NO: 1984441 - RNA, 21 nt, Homo sapiens
uuaagaacacuaaaaaguccu

SEQ ID NO: 1984442 - RNA, 22 nt, Homo sapiens
gaauagccuggccaccagccau

SEQ ID NO: 1984443 - RNA, 16 nt, Homo sapiens
ccuuagacaccuauca

SEQ ID NO: 1984444 - RNA, 18 nt, Homo sapiens
gacagaggauuucugcuu

SEQ ID NO: 1984445 - RNA, 21 nt, Homo sapiens
cugucccccacacccguguca

SEQ ID NO: 1984446 - RNA, 16 nt, Homo sapiens
cuaacaguaguugcaa

SEQ ID NO: 1984447 - RNA, 16 nt, Homo sapiens
uaacagaaauguacag

SEQ ID NO: 1984448 - RNA, 17 nt, Homo sapiens
agaccuguucuuuccau

SEQ ID NO: 1984449 - RNA, 20 nt, Homo sapiens
ugcaguagugcaccaucuca

SEQ ID NO: 1984450 - RNA, 13 nt, Homo sapiens
guugaacuuugcc

SEQ ID NO: 1984451 - RNA, 23 nt, Homo sapiens
uacagaaucacagcccucaugau

SEQ ID NO: 1984452 - RNA, 23 nt, Homo sapiens
cuccagaauggucuuucuaaugu

SEQ ID NO: 1984453 - RNA, 22 nt, Homo sapiens
uuacaaaaucagguaacuaacu

SEQ ID NO: 1984454 - RNA, 14 nt, Homo sapiens
caaggcacugagcg

SEQ ID NO: 1984455 - RNA, 18 nt, Homo sapiens
accauuccucagguauaa

SEQ ID NO: 1984456 - RNA, 18 nt, Homo sapiens
ggcuccagaaauguuugc

SEQ ID NO: 1984457 - RNA, 22 nt, Homo sapiens
ggagccccuucugcucagcucu

SEQ ID NO: 1984458 - RNA, 23 nt, Homo sapiens
gaaagggcaguggacgugcugcg

SEQ ID NO: 1984459 - RNA, 23 nt, Homo sapiens
gugucaugucagcaucagcucag

SEQ ID NO: 1984460 - RNA, 22 nt, Homo sapiens
caauaaaaacaacuuucacuuc

SEQ ID NO: 1984461 - RNA, 16 nt, Homo sapiens
gaaacauuccgaagag

SEQ ID NO: 1984462 - RNA, 20 nt, Homo sapiens
uguauuaacugaauucugaa

SEQ ID NO: 1984463 - RNA, 18 nt, Homo sapiens
uccuauuguucacuuuau

SEQ ID NO: 1984464 - RNA, 17 nt, Homo sapiens
ggucuuucaaaaagcau

SEQ ID NO: 1984465 - RNA, 20 nt, Homo sapiens
agguugcagugagccaugau

SEQ ID NO: 1984466 - RNA, 23 nt, Homo sapiens
ggaaugcacacagcggcugccuc

SEQ ID NO: 1984467 - RNA, 18 nt, Homo sapiens
uauuuacacauacaacuu

SEQ ID NO: 1984468 - RNA, 15 nt, Homo sapiens
cuuaacaaagccuuu

SEQ ID NO: 1984469 - RNA, 15 nt, Homo sapiens
aaagcuugaggccau

SEQ ID NO: 1984470 - RNA, 13 nt, Homo sapiens
uuguuuacccaau

SEQ ID NO: 1984471 - RNA, 20 nt, Homo sapiens
agaguacacccuuuccagga

SEQ ID NO: 1984472 - RNA, 15 nt, Homo sapiens
ucugagcuccaccuc

SEQ ID NO: 1984473 - RNA, 16 nt, Homo sapiens
cugguguuacacauac

SEQ ID NO: 1984474 - RNA, 21 nt, Homo sapiens
cuacaauacaacacauugaaa

SEQ ID NO: 1984475 - RNA, 16 nt, Homo sapiens
gcuaaauucuauguua

SEQ ID NO: 1984476 - RNA, 20 nt, Homo sapiens
ugcugaaauaaaaugauuaa

SEQ ID NO: 1984477 - RNA, 23 nt, Homo sapiens
cuggguggcuacucugugccaga

SEQ ID NO: 1984478 - RNA, 15 nt, Homo sapiens
acuucugccuugagu

SEQ ID NO: 1984479 - RNA, 21 nt, Homo sapiens
agcaagggggacauugcccaa

SEQ ID NO: 1984480 - RNA, 13 nt, Homo sapiens
accuccuuggcac

SEQ ID NO: 1984481 - RNA, 19 nt, Homo sapiens
cccagacagggcuccagcc

SEQ ID NO: 1984482 - RNA, 14 nt, Homo sapiens
accuucaccuggau

SEQ ID NO: 1984483 - RNA, 14 nt, Homo sapiens
caggaccucuggac

SEQ ID NO: 1984484 - RNA, 14 nt, Homo sapiens
gaaaauuaacacug

SEQ ID NO: 1984485 - RNA, 15 nt, Homo sapiens
cauagagauaugcac

SEQ ID NO: 1984486 - RNA, 13 nt, Homo sapiens
caggacaguuuau

SEQ ID NO: 1984487 - RNA, 18 nt, Homo sapiens
ugcagggaagagggcagu

SEQ ID NO: 1984488 - RNA, 16 nt, Homo sapiens
cccauuaccagcauuu

SEQ ID NO: 1984489 - RNA, 22 nt, Homo sapiens
uggugacauuuugcaugaugaa

SEQ ID NO: 1984490 - RNA, 18 nt, Homo sapiens
cagcuaagcaauagauaa

SEQ ID NO: 1984491 - RNA, 22 nt, Homo sapiens
caaggagcaacagcgauggcag

SEQ ID NO: 1984492 - RNA, 15 nt, Homo sapiens
uacacugcaucucaa

SEQ ID NO: 1984493 - RNA, 22 nt, Homo sapiens
aggucuguugaagugcauguua

SEQ ID NO: 1984494 - RNA, 18 nt, Homo sapiens
cugugcucgggugcugcc

SEQ ID NO: 1984495 - RNA, 13 nt, Homo sapiens
cccuacaccaaca

SEQ ID NO: 1984496 - RNA, 21 nt, Homo sapiens
agcuuggguccaccaugcaga

SEQ ID NO: 1984497 - RNA, 17 nt, Homo sapiens
ccacugcccacuggccg

SEQ ID NO: 1984498 - RNA, 16 nt, Homo sapiens
ggguaugucaguguca

SEQ ID NO: 1984499 - RNA, 13 nt, Homo sapiens
ucacaacucucug

SEQ ID NO: 1984500 - RNA, 17 nt, Homo sapiens
gccccugcucacagugu

SEQ ID NO: 1984501 - RNA, 19 nt, Homo sapiens
auuuguacaaauacugccu

SEQ ID NO: 1984502 - RNA, 21 nt, Homo sapiens
acuugauaugugcaccaauac

SEQ ID NO: 1984503 - RNA, 13 nt, Homo sapiens
aacaauauuacuu

SEQ ID NO: 1984504 - RNA, 13 nt, Homo sapiens
gcuaccaaaaacu

SEQ ID NO: 1984505 - RNA, 21 nt, Homo sapiens
caugauuuuauacauagucac

SEQ ID NO: 1984506 - RNA, 22 nt, Homo sapiens
caaguguaaaauauuuugaauc

SEQ ID NO: 1984507 - RNA, 15 nt, Homo sapiens
gccuuaacuucuuaa

SEQ ID NO: 1984508 - RNA, 18 nt, Homo sapiens
agguggagaaaucacaga

SEQ ID NO: 1984509 - RNA, 13 nt, Homo sapiens
uagaguggugcug

SEQ ID NO: 1984510 - RNA, 22 nt, Homo sapiens
aagcauucuuguguaauacuuc

SEQ ID NO: 1984511 - RNA, 12 nt, Homo sapiens
aaaaugugacuc

SEQ ID NO: 1984512 - RNA, 17 nt, Homo sapiens
uagaagcagcauaggaa

SEQ ID NO: 1984513 - RNA, 14 nt, Homo sapiens
ugauugcuuugcug

SEQ ID NO: 1984514 - RNA, 14 nt, Homo sapiens
ucugcacaccuacu

SEQ ID NO: 1984515 - RNA, 16 nt, Homo sapiens
caguuauuaaucugga

SEQ ID NO: 1984516 - RNA, 14 nt, Homo sapiens
aauggucaguugua

SEQ ID NO: 1984517 - RNA, 18 nt, Homo sapiens
cugccacauacaccacaa

SEQ ID NO: 1984518 - RNA, 19 nt, Homo sapiens
gcuauacagaaaaaccaca

SEQ ID NO: 1984519 - RNA, 16 nt, Homo sapiens
ggagacuuugauguca

SEQ ID NO: 1984520 - RNA, 20 nt, Homo sapiens
gauucaacacuuaagucuca

SEQ ID NO: 1984521 - RNA, 15 nt, Homo sapiens
cuauguacuguaaua

SEQ ID NO: 1984522 - RNA, 18 nt, Homo sapiens
uggaucuccauucucuca

SEQ ID NO: 1984523 - RNA, 17 nt, Homo sapiens
ccacucugggcaaagcc

SEQ ID NO: 1984524 - RNA, 19 nt, Homo sapiens
cagcuggcuagcauuccuc

SEQ ID NO: 1984525 - RNA, 15 nt, Homo sapiens
ugucuaucauaugaa

SEQ ID NO: 1984526 - RNA, 12 nt, Homo sapiens
uuucaaaacaca

SEQ ID NO: 1984527 - RNA, 15 nt, Homo sapiens
uuccugugcuuauau

SEQ ID NO: 1984528 - RNA, 10 nt, Homo sapiens
accagucacc

SEQ ID NO: 1984529 - RNA, 18 nt, Homo sapiens
agaacaccagagaccuca

SEQ ID NO: 1984530 - RNA, 20 nt, Homo sapiens
uccuuuggaaugcuguauua

SEQ ID NO: 1984531 - RNA, 22 nt, Homo sapiens
gugauuuuauuuuugcaaaaua

SEQ ID NO: 1984532 - RNA, 21 nt, Homo sapiens
uaggaaaaguuauugugauaa

SEQ ID NO: 1984533 - RNA, 23 nt, Homo sapiens
ccauacguucagaggugcagcug

SEQ ID NO: 1984534 - RNA, 14 nt, Homo sapiens
cagcacuugucuca

SEQ ID NO: 1984535 - RNA, 16 nt, Homo sapiens
gccugauccagccuuu

SEQ ID NO: 1984536 - RNA, 12 nt, Homo sapiens
augccacuccuc

SEQ ID NO: 1984537 - RNA, 17 nt, Homo sapiens
cuuaaagaaaauugcau

SEQ ID NO: 1984538 - RNA, 20 nt, Homo sapiens
aaucuuaaaaguguuguuau

SEQ ID NO: 1984539 - RNA, 17 nt, Homo sapiens
gaaacauuuugcugauu

SEQ ID NO: 1984540 - RNA, 14 nt, Homo sapiens
aacagagaagggaa

SEQ ID NO: 1984541 - RNA, 22 nt, Homo sapiens
ucaucagaagauaacuugagca

SEQ ID NO: 1984542 - RNA, 11 nt, Homo sapiens
aaacugcugaa

SEQ ID NO: 1984543 - RNA, 14 nt, Homo sapiens
cuuccuccugaugg

SEQ ID NO: 1984544 - RNA, 16 nt, Homo sapiens
caccucuguacagacc

SEQ ID NO: 1984545 - RNA, 20 nt, Homo sapiens
uaccaccgacauuuuucaau

SEQ ID NO: 1984546 - RNA, 20 nt, Homo sapiens
uucaaaccacaauauccagc

SEQ ID NO: 1984547 - RNA, 16 nt, Homo sapiens
gaaaaugaaacuagaa

SEQ ID NO: 1984548 - RNA, 22 nt, Homo sapiens
cacaaaagucucaauguuccau

SEQ ID NO: 1984549 - RNA, 20 nt, Homo sapiens
cacguaaccuaugucagaca

SEQ ID NO: 1984550 - RNA, 19 nt, Homo sapiens
cagagcaaugacugugcuc

SEQ ID NO: 1984551 - RNA, 15 nt, Homo sapiens
ccucucuacagucuc

SEQ ID NO: 1984552 - RNA, 22 nt, Homo sapiens
uaaugaauacuuucuuagauuu

SEQ ID NO: 1984553 - RNA, 21 nt, Homo sapiens
ccacaagaacaauucaagaaa

SEQ ID NO: 1984554 - RNA, 18 nt, Homo sapiens
agaauauguuaaugcaaa

SEQ ID NO: 1984555 - RNA, 19 nt, Homo sapiens
caauaauugaaguguuccc

SEQ ID NO: 1984556 - RNA, 12 nt, Homo sapiens
aaacugcacugu

SEQ ID NO: 1984557 - RNA, 17 nt, Homo sapiens
cuguguguacauguaca

SEQ ID NO: 1984558 - RNA, 12 nt, Homo sapiens
ccccaagaauga

SEQ ID NO: 1984559 - RNA, 13 nt, Homo sapiens
gcaauagaacccu

SEQ ID NO: 1984560 - RNA, 15 nt, Homo sapiens
caggcguucagcuca

SEQ ID NO: 1984561 - RNA, 15 nt, Homo sapiens
gacuguucuucccag

SEQ ID NO: 1984562 - RNA, 23 nt, Homo sapiens
aaagcaacaucuucauagaugaa

SEQ ID NO: 1984563 - RNA, 18 nt, Homo sapiens
ccugccaccagucacugu

SEQ ID NO: 1984564 - RNA, 20 nt, Homo sapiens
gaaaaauaguaaacauuaag

SEQ ID NO: 1984565 - RNA, 14 nt, Homo sapiens
gaggugagccucac

SEQ ID NO: 1984566 - RNA, 15 nt, Homo sapiens
gauccaguuagcaac

SEQ ID NO: 1984567 - RNA, 12 nt, Homo sapiens
uauuauguauaa

SEQ ID NO: 1984568 - RNA, 12 nt, Homo sapiens
uaaaauguauuu

SEQ ID NO: 1984569 - RNA, 16 nt, Homo sapiens
ugaggggcuccuggaa

SEQ ID NO: 1984570 - RNA, 14 nt, Homo sapiens
ucucaaguuuuauu

SEQ ID NO: 1984571 - RNA, 16 nt, Homo sapiens
uggagugcauuugacu

SEQ ID NO: 1984572 - RNA, 18 nt, Homo sapiens
guauucucauaauacuga

SEQ ID NO: 1984573 - RNA, 18 nt, Homo sapiens
uuaaccucuuaucacuaa

SEQ ID NO: 1984574 - RNA, 22 nt, Homo sapiens
cagucucggguggcuagucaga

SEQ ID NO: 1984575 - RNA, 13 nt, Homo sapiens
cacagucacaguc

SEQ ID NO: 1984576 - RNA, 13 nt, Homo sapiens
acauaaugcacug

SEQ ID NO: 1984577 - RNA, 13 nt, Homo sapiens
aaaauauucacuc

SEQ ID NO: 1984578 - RNA, 21 nt, Homo sapiens
aguggauuucccauccccugu

SEQ ID NO: 1984579 - RNA, 13 nt, Homo sapiens
ugcugccugggua

SEQ ID NO: 1984580 - RNA, 13 nt, Homo sapiens
uggaaccuggcag

SEQ ID NO: 1984581 - RNA, 15 nt, Homo sapiens
caucuggccccaucu

SEQ ID NO: 1984582 - RNA, 19 nt, Homo sapiens
augauuuagugaucaaauu

SEQ ID NO: 1984583 - RNA, 13 nt, Homo sapiens
uuccuuaagccag

SEQ ID NO: 1984584 - RNA, 19 nt, Homo sapiens
ugcccauggaagucucaaa

SEQ ID NO: 1984585 - RNA, 16 nt, Homo sapiens
ggccuggccuauuuaa

SEQ ID NO: 1984586 - RNA, 14 nt, Homo sapiens
cuggcuucuggcca

SEQ ID NO: 1984587 - RNA, 21 nt, Homo sapiens
gaacuugcuauggaaaggaca

SEQ ID NO: 1984588 - RNA, 19 nt, Homo sapiens
auuuaacuaugaacugaag

SEQ ID NO: 1984589 - RNA, 13 nt, Homo sapiens
aguucuaucagga

SEQ ID NO: 1984590 - RNA, 24 nt, Homo sapiens
gauaauauccagccucccacaaga

SEQ ID NO: 1984591 - RNA, 20 nt, Homo sapiens
aaaaguuguacugcaucuua

SEQ ID NO: 1984592 - RNA, 20 nt, Homo sapiens
aauaguauuucagcugcaau

SEQ ID NO: 1984593 - RNA, 21 nt, Homo sapiens
ugaagagauccuucuguaaag

SEQ ID NO: 1984594 - RNA, 11 nt, Homo sapiens
aaguaagcaac

SEQ ID NO: 1984595 - RNA, 17 nt, Homo sapiens
aaggugcaguugcucau

SEQ ID NO: 1984596 - RNA, 22 nt, Homo sapiens
cuauuaguaguuaauucuguca

SEQ ID NO: 1984597 - RNA, 13 nt, Homo sapiens
cuuuuugggacca

SEQ ID NO: 1984598 - RNA, 20 nt, Homo sapiens
cuaaucuugaauguuuguga

SEQ ID NO: 1984599 - RNA, 13 nt, Homo sapiens
ucaggagaaggcc

SEQ ID NO: 1984600 - RNA, 19 nt, Homo sapiens
gcuguguacucuuaggcua

SEQ ID NO: 1984601 - RNA, 16 nt, Homo sapiens
gcacugagagugaagu

SEQ ID NO: 1984602 - RNA, 18 nt, Homo sapiens
agagaaaauaaauuccaa

SEQ ID NO: 1984603 - RNA, 15 nt, Homo sapiens
cauggcagccaucaa

SEQ ID NO: 1984604 - RNA, 10 nt, Homo sapiens
gcacagauua

SEQ ID NO: 1984605 - RNA, 20 nt, Homo sapiens
agagucaacaggucacuuga

SEQ ID NO: 1984606 - RNA, 18 nt, Homo sapiens
uuuuguaaaacaaugcca

SEQ ID NO: 1984607 - RNA, 22 nt, Homo sapiens
aucuuuaucaugaagcacauca

SEQ ID NO: 1984608 - RNA, 16 nt, Homo sapiens
uugaaaguuagcauaa

SEQ ID NO: 1984609 - RNA, 18 nt, Homo sapiens
ccugacaaaaacaagcaa

SEQ ID NO: 1984610 - RNA, 17 nt, Homo sapiens
cugauuuuaacaauaac

SEQ ID NO: 1984611 - RNA, 17 nt, Homo sapiens
cugaccagccuugacac

SEQ ID NO: 1984612 - RNA, 11 nt, Homo sapiens
gcccacuucca

SEQ ID NO: 1984613 - RNA, 18 nt, Homo sapiens
gugagggcucacucagcc

SEQ ID NO: 1984614 - RNA, 16 nt, Homo sapiens
cagaauacaagccacu

SEQ ID NO: 1984615 - RNA, 14 nt, Homo sapiens
aauagacaaaaagu

SEQ ID NO: 1984616 - RNA, 22 nt, Homo sapiens
acugaaucuucagcauguucuc

SEQ ID NO: 1984617 - RNA, 15 nt, Homo sapiens
aagcuaccauuuauc

SEQ ID NO: 1984618 - RNA, 16 nt, Homo sapiens
ucuuauuuugcuacug

SEQ ID NO: 1984619 - RNA, 17 nt, Homo sapiens
cauagugcaaaacugug

SEQ ID NO: 1984620 - RNA, 16 nt, Homo sapiens
uuauuaagauguauaa

SEQ ID NO: 1984621 - RNA, 23 nt, Homo sapiens
augucacgagcguucaaacugcu

SEQ ID NO: 1984622 - RNA, 20 nt, Homo sapiens
ucaagaguccggauuucuaa

SEQ ID NO: 1984623 - RNA, 18 nt, Homo sapiens
aucccacuccacuauguu

SEQ ID NO: 1984624 - RNA, 14 nt, Homo sapiens
uaaaaauacauuuu

SEQ ID NO: 1984625 - RNA, 14 nt, Homo sapiens
uuaauuuacuuuaa

SEQ ID NO: 1984626 - RNA, 14 nt, Homo sapiens
uauuuuuacaaaaa

SEQ ID NO: 1984627 - RNA, 20 nt, Homo sapiens
cugcggacacacgcaaaagc

SEQ ID NO: 1984628 - RNA, 22 nt, Homo sapiens
aagguucucagguguugccaaa

SEQ ID NO: 1984629 - RNA, 13 nt, Homo sapiens
aggcauggcagaa

SEQ ID NO: 1984630 - RNA, 13 nt, Homo sapiens
cagaauggaggca

SEQ ID NO: 1984631 - RNA, 19 nt, Homo sapiens
gaaguuaagagaaagucac

SEQ ID NO: 1984632 - RNA, 12 nt, Homo sapiens
cuuuuuacuguu

SEQ ID NO: 1984633 - RNA, 18 nt, Homo sapiens
uaugcauguagcauauaa

SEQ ID NO: 1984634 - RNA, 22 nt, Homo sapiens
ugaacauuuaucaaucaguaua

SEQ ID NO: 1984635 - RNA, 13 nt, Homo sapiens
ggagaaauagcug

SEQ ID NO: 1984636 - RNA, 22 nt, Homo sapiens
ccucaaaacgggucaguauuaa

SEQ ID NO: 1984637 - RNA, 18 nt, Homo sapiens
uccagcuucccuuugauu

SEQ ID NO: 1984638 - RNA, 22 nt, Homo sapiens
uguuggucaggcuggucucaaa

SEQ ID NO: 1984639 - RNA, 18 nt, Homo sapiens
ccacuaucccaaucaaag

SEQ ID NO: 1984640 - RNA, 14 nt, Homo sapiens
cccagaauagcuuu

SEQ ID NO: 1984641 - RNA, 16 nt, Homo sapiens
aauaaaaacucuuaua

SEQ ID NO: 1984642 - RNA, 21 nt, Homo sapiens
aguguucugggauuucucuag

SEQ ID NO: 1984643 - RNA, 15 nt, Homo sapiens
uuccauguugucuua

SEQ ID NO: 1984644 - RNA, 18 nt, Homo sapiens
uuucauuuaggugaggaa

SEQ ID NO: 1984645 - RNA, 18 nt, Homo sapiens
uggaagucugucucagga

SEQ ID NO: 1984646 - RNA, 16 nt, Homo sapiens
guaagaaaagcaguuu

SEQ ID NO: 1984647 - RNA, 22 nt, Homo sapiens
uucuuuucagcagagucuagua

SEQ ID NO: 1984648 - RNA, 15 nt, Homo sapiens
ucaaucaaccaaagu

SEQ ID NO: 1984649 - RNA, 20 nt, Homo sapiens
auucagugacuuaauaucua

SEQ ID NO: 1984650 - RNA, 23 nt, Homo sapiens
gauuuccugcugccauccucacc

SEQ ID NO: 1984651 - RNA, 17 nt, Homo sapiens
uacuagauugugauccc

SEQ ID NO: 1984652 - RNA, 17 nt, Homo sapiens
gcugggcucagugaagu

SEQ ID NO: 1984653 - RNA, 16 nt, Homo sapiens
ugucuuacuacuuuaa

SEQ ID NO: 1984654 - RNA, 16 nt, Homo sapiens
uguuauuuucagugau

SEQ ID NO: 1984655 - RNA, 20 nt, Homo sapiens
cuccuggcccaggugagucc

SEQ ID NO: 1984656 - RNA, 23 nt, Homo sapiens
cugcugaccaauugugcugccau

SEQ ID NO: 1984657 - RNA, 21 nt, Homo sapiens
uucauuaggguaauaucaucu

SEQ ID NO: 1984658 - RNA, 17 nt, Homo sapiens
acuuuuucuuguauuca

SEQ ID NO: 1984659 - RNA, 15 nt, Homo sapiens
uggcaguugucauca

SEQ ID NO: 1984660 - RNA, 23 nt, Homo sapiens
uucccaaguaugccuuaagcaga

SEQ ID NO: 1984661 - RNA, 19 nt, Homo sapiens
agccauauuugauaguaua

SEQ ID NO: 1984662 - RNA, 21 nt, Homo sapiens
acaauuauuuuuacaguucuc

SEQ ID NO: 1984663 - RNA, 18 nt, Homo sapiens
uuucuuaaugaaccuuag

SEQ ID NO: 1984664 - RNA, 11 nt, Homo sapiens
uuacauaugcc

SEQ ID NO: 1984665 - RNA, 16 nt, Homo sapiens
auuuaauuauuuccua

SEQ ID NO: 1984666 - RNA, 16 nt, Homo sapiens
cucugcagacuuccca

SEQ ID NO: 1984667 - RNA, 20 nt, Homo sapiens
ugaaacauuugacacauaaa

SEQ ID NO: 1984668 - RNA, 10 nt, Homo sapiens
uucugcugag

SEQ ID NO: 1984669 - RNA, 18 nt, Homo sapiens
ugcccggcaggguccuag

SEQ ID NO: 1984670 - RNA, 12 nt, Homo sapiens
gucaguccuuga

SEQ ID NO: 1984671 - RNA, 16 nt, Homo sapiens
acaucuggacacuggg

SEQ ID NO: 1984672 - RNA, 16 nt, Homo sapiens
ucuucuguucucuggu

SEQ ID NO: 1984673 - RNA, 22 nt, Homo sapiens
aucagggccaccauugucucaa

SEQ ID NO: 1984674 - RNA, 17 nt, Homo sapiens
ugcugagggucugggau

SEQ ID NO: 1984675 - RNA, 15 nt, Homo sapiens
ucacacaacacugau

SEQ ID NO: 1984676 - RNA, 13 nt, Homo sapiens
uuucugugucauu

SEQ ID NO: 1984677 - RNA, 18 nt, Homo sapiens
aaaauggcaaaugcacug

SEQ ID NO: 1984678 - RNA, 17 nt, Homo sapiens
uccagcugcgacuuuua

SEQ ID NO: 1984679 - RNA, 23 nt, Homo sapiens
auuaauaacgucuuuuuauaucu

SEQ ID NO: 1984680 - RNA, 15 nt, Homo sapiens
ugggauuuaccagcu

SEQ ID NO: 1984681 - RNA, 12 nt, Homo sapiens
uugggaagacca

SEQ ID NO: 1984682 - RNA, 20 nt, Homo sapiens
cuuucagaacacucaaaggu

SEQ ID NO: 1984683 - RNA, 16 nt, Homo sapiens
uccugagaccagccaa

SEQ ID NO: 1984684 - RNA, 17 nt, Homo sapiens
acuacaauguagucuca

SEQ ID NO: 1984685 - RNA, 20 nt, Homo sapiens
cucuuaccagggagauuugc

SEQ ID NO: 1984686 - RNA, 22 nt, Homo sapiens
gaaaagaaucggcaauguuuca

SEQ ID NO: 1984687 - RNA, 22 nt, Homo sapiens
uguaaacauucaucaagcugua

SEQ ID NO: 1984688 - RNA, 16 nt, Homo sapiens
aguggucucuacugug

SEQ ID NO: 1984689 - RNA, 21 nt, Homo sapiens
uggacacaauaggucuuucuc

SEQ ID NO: 1984690 - RNA, 18 nt, Homo sapiens
ccugaaacaugugccccu

SEQ ID NO: 1984691 - RNA, 20 nt, Homo sapiens
cauugcuguaccacaucugc

SEQ ID NO: 1984692 - RNA, 14 nt, Homo sapiens
cuuugugaaaaaua

SEQ ID NO: 1984693 - RNA, 22 nt, Homo sapiens
aagacaaacuccggcacugggu

SEQ ID NO: 1984694 - RNA, 21 nt, Homo sapiens
agucaccauuaggucacuuaa

SEQ ID NO: 1984695 - RNA, 21 nt, Homo sapiens
aaagaguuugaugaggcccuc

SEQ ID NO: 1984696 - RNA, 13 nt, Homo sapiens
uaacaaacaucac

SEQ ID NO: 1984697 - RNA, 21 nt, Homo sapiens
acugaaguuuuugaaauaccu

SEQ ID NO: 1984698 - RNA, 21 nt, Homo sapiens
caagcuggaguuaauaaucua

SEQ ID NO: 1984699 - RNA, 13 nt, Homo sapiens
auugcaaauugag

SEQ ID NO: 1984700 - RNA, 15 nt, Homo sapiens
uccuugacuccuuug

SEQ ID NO: 1984701 - RNA, 15 nt, Homo sapiens
aauguugcaauguga

SEQ ID NO: 1984702 - RNA, 14 nt, Homo sapiens
agcuaagauuaucu

SEQ ID NO: 1984703 - RNA, 20 nt, Homo sapiens
cagauagcacugggugugag

SEQ ID NO: 1984704 - RNA, 13 nt, Homo sapiens
uaaaauaaacuag

SEQ ID NO: 1984705 - RNA, 23 nt, Homo sapiens
gcuacuuuugcaggauaauaauu

SEQ ID NO: 1984706 - RNA, 13 nt, Homo sapiens
acccagugcagaa

SEQ ID NO: 1984707 - RNA, 12 nt, Homo sapiens
cgaaaaguugcu

SEQ ID NO: 1984708 - RNA, 15 nt, Homo sapiens
cuauugugaccacag

SEQ ID NO: 1984709 - RNA, 13 nt, Homo sapiens
cauauaacaugca

SEQ ID NO: 1984710 - RNA, 13 nt, Homo sapiens
cuuuuguguacag

SEQ ID NO: 1984711 - RNA, 17 nt, Homo sapiens
guuugcuuauuguucca

SEQ ID NO: 1984712 - RNA, 23 nt, Homo sapiens
uucaaaauaaacaauaaaugggc

SEQ ID NO: 1984713 - RNA, 23 nt, Homo sapiens
acagcaucugccaggacacugcc

SEQ ID NO: 1984714 - RNA, 21 nt, Homo sapiens
cgccagauaaaauguucagug

SEQ ID NO: 1984715 - RNA, 18 nt, Homo sapiens
uguugacauucugaaugc

SEQ ID NO: 1984716 - RNA, 18 nt, Homo sapiens
cccugccacuuugcaugg

SEQ ID NO: 1984717 - RNA, 22 nt, Homo sapiens
gucccuguuagcauaaugugag

SEQ ID NO: 1984718 - RNA, 17 nt, Homo sapiens
cucuccuugucacagaa

SEQ ID NO: 1984719 - RNA, 19 nt, Homo sapiens
aaaugauucagcucccuua

SEQ ID NO: 1984720 - RNA, 15 nt, Homo sapiens
uaacauauauuguua

SEQ ID NO: 1984721 - RNA, 17 nt, Homo sapiens
uccuaaaguagacuuca

SEQ ID NO: 1984722 - RNA, 12 nt, Homo sapiens
gaaguugcuuga

SEQ ID NO: 1984723 - RNA, 20 nt, Homo sapiens
uacagagaaaaugaauuugg

SEQ ID NO: 1984724 - RNA, 21 nt, Homo sapiens
ggucuuaggaugucuguaaua

SEQ ID NO: 1984725 - RNA, 16 nt, Homo sapiens
ucaguugcaguaguau

SEQ ID NO: 1984726 - RNA, 12 nt, Homo sapiens
auaaaaacccaa

SEQ ID NO: 1984727 - RNA, 23 nt, Homo sapiens
auguguuucagguggaacaggag

SEQ ID NO: 1984728 - RNA, 12 nt, Homo sapiens
acuauuaacaug

SEQ ID NO: 1984729 - RNA, 18 nt, Homo sapiens
cagcaaccauucaucuuu

SEQ ID NO: 1984730 - RNA, 19 nt, Homo sapiens
uuaguucucacugucuccu

SEQ ID NO: 1984731 - RNA, 15 nt, Homo sapiens
aauuacaucugucau

SEQ ID NO: 1984732 - RNA, 15 nt, Homo sapiens
uuucucccccuaguu

SEQ ID NO: 1984733 - RNA, 18 nt, Homo sapiens
agucuggcaaacaugugc

SEQ ID NO: 1984734 - RNA, 13 nt, Homo sapiens
ggccgagagcaga

SEQ ID NO: 1984735 - RNA, 17 nt, Homo sapiens
cccuugguucugcacug

SEQ ID NO: 1984736 - RNA, 19 nt, Homo sapiens
ugcagcaccggccucggga

SEQ ID NO: 1984737 - RNA, 20 nt, Homo sapiens
cugaauauauaaacacucca

SEQ ID NO: 1984738 - RNA, 21 nt, Homo sapiens
gaaugaccacgggccucaguu

SEQ ID NO: 1984739 - RNA, 14 nt, Homo sapiens
acgagauaauguau

SEQ ID NO: 1984740 - RNA, 15 nt, Homo sapiens
acuguuuugacaaau

SEQ ID NO: 1984741 - RNA, 19 nt, Homo sapiens
gccagccuccuugcugacc

SEQ ID NO: 1984742 - RNA, 18 nt, Homo sapiens
cugcucgggaaggccuga

SEQ ID NO: 1984743 - RNA, 15 nt, Homo sapiens
uccugccacaacaga

SEQ ID NO: 1984744 - RNA, 19 nt, Homo sapiens
aucacauaugugcauagau

SEQ ID NO: 1984745 - RNA, 20 nt, Homo sapiens
uccuuggucuuuguaucuuc

SEQ ID NO: 1984746 - RNA, 17 nt, Homo sapiens
gcccaggcacuccugag

SEQ ID NO: 1984747 - RNA, 21 nt, Homo sapiens
uuaaaacagaaaggugcagga

SEQ ID NO: 1984748 - RNA, 13 nt, Homo sapiens
aaauuuaagcauu

SEQ ID NO: 1984749 - RNA, 14 nt, Homo sapiens
ccaucuuuccaucc

SEQ ID NO: 1984750 - RNA, 15 nt, Homo sapiens
cucagaguaaugucu

SEQ ID NO: 1984751 - RNA, 15 nt, Homo sapiens
cucucagcauagccu

SEQ ID NO: 1984752 - RNA, 22 nt, Homo sapiens
guacuuuguuaaaaacacugcu

SEQ ID NO: 1984753 - RNA, 18 nt, Homo sapiens
cuucuuuacuaacacugg

SEQ ID NO: 1984754 - RNA, 17 nt, Homo sapiens
aauuaaaaucuaauuca

SEQ ID NO: 1984755 - RNA, 18 nt, Homo sapiens
ggaccacuuuuauuuauu

SEQ ID NO: 1984756 - RNA, 12 nt, Homo sapiens
ccaaagggccca

SEQ ID NO: 1984757 - RNA, 15 nt, Homo sapiens
uauagaucacauaac

SEQ ID NO: 1984758 - RNA, 18 nt, Homo sapiens
ucaucuugacauguaaug

SEQ ID NO: 1984759 - RNA, 19 nt, Homo sapiens
auuaauaccuaaacuguau

SEQ ID NO: 1984760 - RNA, 19 nt, Homo sapiens
acaguccucaccacaguuu

SEQ ID NO: 1984761 - RNA, 13 nt, Homo sapiens
acagaugccccag

SEQ ID NO: 1984762 - RNA, 16 nt, Homo sapiens
uaauguauaaugggaa

SEQ ID NO: 1984763 - RNA, 16 nt, Homo sapiens
accuggccccaggcug

SEQ ID NO: 1984764 - RNA, 21 nt, Homo sapiens
uaccuuuuaauuaaugaaaua

SEQ ID NO: 1984765 - RNA, 19 nt, Homo sapiens
auccuacccuuuucugggg

SEQ ID NO: 1984766 - RNA, 13 nt, Homo sapiens
agccaaggaguca

SEQ ID NO: 1984767 - RNA, 19 nt, Homo sapiens
cagagcccugggcaucaga

SEQ ID NO: 1984768 - RNA, 15 nt, Homo sapiens
agccuguauagacag

SEQ ID NO: 1984769 - RNA, 19 nt, Homo sapiens
ucugggucaugcacugagg

SEQ ID NO: 1984770 - RNA, 19 nt, Homo sapiens
auucucaguguagggcaga

SEQ ID NO: 1984771 - RNA, 22 nt, Homo sapiens
cagaacaguggcucguauccca

SEQ ID NO: 1984772 - RNA, 13 nt, Homo sapiens
aguuugagacagg

SEQ ID NO: 1984773 - RNA, 17 nt, Homo sapiens
ggguggaggcuaagccu

SEQ ID NO: 1984774 - RNA, 16 nt, Homo sapiens
gaugucuauguagcug

SEQ ID NO: 1984775 - RNA, 16 nt, Homo sapiens
agucuguacuucauca

SEQ ID NO: 1984776 - RNA, 23 nt, Homo sapiens
gugacacacuacaccacacacaa

SEQ ID NO: 1984777 - RNA, 16 nt, Homo sapiens
agcucgcauuugucaa

SEQ ID NO: 1984778 - RNA, 15 nt, Homo sapiens
cuguaagcuccauga

SEQ ID NO: 1984779 - RNA, 15 nt, Homo sapiens
cauccuuccauccau

SEQ ID NO: 1984780 - RNA, 13 nt, Homo sapiens
uucgacuaccuuu

SEQ ID NO: 1984781 - RNA, 21 nt, Homo sapiens
uccugggcagcauacugagac

SEQ ID NO: 1984782 - RNA, 22 nt, Homo sapiens
uaaagcgacaucccaguagugu

SEQ ID NO: 1984783 - RNA, 21 nt, Homo sapiens
gaucacugccaaaaugguaca

SEQ ID NO: 1984784 - RNA, 22 nt, Homo sapiens
aauguugaagaacucaugugau

SEQ ID NO: 1984785 - RNA, 15 nt, Homo sapiens
gccaacuucucccac

SEQ ID NO: 1984786 - RNA, 20 nt, Homo sapiens
agcacaagaaguuucuucag

SEQ ID NO: 1984787 - RNA, 15 nt, Homo sapiens
uaaaagacuuugaug

SEQ ID NO: 1984788 - RNA, 13 nt, Homo sapiens
cauauaaacucau

SEQ ID NO: 1984789 - RNA, 23 nt, Homo sapiens
augggaccugcucuuaaccucaa

SEQ ID NO: 1984790 - RNA, 19 nt, Homo sapiens
ucagcucucaguugcagcc

SEQ ID NO: 1984791 - RNA, 22 nt, Homo sapiens
uacuggauacucugcuccggaa

SEQ ID NO: 1984792 - RNA, 23 nt, Homo sapiens
ugggcuucaguaaguccccggcg

SEQ ID NO: 1984793 - RNA, 15 nt, Homo sapiens
augaauuuggccaga

SEQ ID NO: 1984794 - RNA, 16 nt, Homo sapiens
caugcuuuuuguauca

SEQ ID NO: 1984795 - RNA, 22 nt, Homo sapiens
aucaauacugcacacugcacau

SEQ ID NO: 1984796 - RNA, 15 nt, Homo sapiens
aaaaaucagggccac

SEQ ID NO: 1984797 - RNA, 15 nt, Homo sapiens
gcccagcacuugaau

SEQ ID NO: 1984798 - RNA, 22 nt, Homo sapiens
ucacuugaagccaaacuguugg

SEQ ID NO: 1984799 - RNA, 15 nt, Homo sapiens
ccccagcaguugaau

SEQ ID NO: 1984800 - RNA, 22 nt, Homo sapiens
accuguucuuccuaccaaauau

SEQ ID NO: 1984801 - RNA, 17 nt, Homo sapiens
augaauaggaugauucc

SEQ ID NO: 1984802 - RNA, 16 nt, Homo sapiens
aagacugguauucucu

SEQ ID NO: 1984803 - RNA, 18 nt, Homo sapiens
ucuuuaguuagugauuau

SEQ ID NO: 1984804 - RNA, 13 nt, Homo sapiens
agucacacugcug

SEQ ID NO: 1984805 - RNA, 18 nt, Homo sapiens
aauagaaauaaaccuaug

SEQ ID NO: 1984806 - RNA, 14 nt, Homo sapiens
aauccuuugcuuca

SEQ ID NO: 1984807 - RNA, 13 nt, Homo sapiens
guaauauguuaca

SEQ ID NO: 1984808 - RNA, 17 nt, Homo sapiens
cauuuuauguuaaggga

SEQ ID NO: 1984809 - RNA, 15 nt, Homo sapiens
gcacaugccaaugca

SEQ ID NO: 1984810 - RNA, 16 nt, Homo sapiens
gucagaaaacagagaa

SEQ ID NO: 1984811 - RNA, 16 nt, Homo sapiens
accaguuguugauaac

SEQ ID NO: 1984812 - RNA, 14 nt, Homo sapiens
cugggcuaccguga

SEQ ID NO: 1984813 - RNA, 19 nt, Homo sapiens
agucuugucauugccagcu

SEQ ID NO: 1984814 - RNA, 14 nt, Homo sapiens
ggcccgacauuucu

SEQ ID NO: 1984815 - RNA, 23 nt, Homo sapiens
gacgaagcggagagagccaagac

SEQ ID NO: 1984816 - RNA, 13 nt, Homo sapiens
aauagguguguga

SEQ ID NO: 1984817 - RNA, 16 nt, Homo sapiens
ccugcaccucauucca

SEQ ID NO: 1984818 - RNA, 15 nt, Homo sapiens
ugaucacagacacca

SEQ ID NO: 1984819 - RNA, 16 nt, Homo sapiens
aggccuccacacauaa

SEQ ID NO: 1984820 - RNA, 14 nt, Homo sapiens
ucuggaguggaaaa

SEQ ID NO: 1984821 - RNA, 20 nt, Homo sapiens
auuucuacacguugcccauc

SEQ ID NO: 1984822 - RNA, 13 nt, Homo sapiens
cuucccugaucaa

SEQ ID NO: 1984823 - RNA, 19 nt, Homo sapiens
aacaucugaucuguauaaa

SEQ ID NO: 1984824 - RNA, 18 nt, Homo sapiens
uacguuacagcuuucaca

SEQ ID NO: 1984825 - RNA, 15 nt, Homo sapiens
ucaggagagccagcc

SEQ ID NO: 1984826 - RNA, 22 nt, Homo sapiens
ucccugagaggauguagagauu

SEQ ID NO: 1984827 - RNA, 20 nt, Homo sapiens
aaagccugccucuuccagga

SEQ ID NO: 1984828 - RNA, 17 nt, Homo sapiens
uuaaccccauguccuca

SEQ ID NO: 1984829 - RNA, 14 nt, Homo sapiens
cuuuuauacuguac

SEQ ID NO: 1984830 - RNA, 15 nt, Homo sapiens
agcucauagcacaug

SEQ ID NO: 1984831 - RNA, 16 nt, Homo sapiens
guacaagagaugggau

SEQ ID NO: 1984832 - RNA, 11 nt, Homo sapiens
cacuugauguu

SEQ ID NO: 1984833 - RNA, 19 nt, Homo sapiens
aauucuuguagaugcauua

SEQ ID NO: 1984834 - RNA, 12 nt, Homo sapiens
ccagaugugguu

SEQ ID NO: 1984835 - RNA, 21 nt, Homo sapiens
aaagccaaccagccuuugggu

SEQ ID NO: 1984836 - RNA, 22 nt, Homo sapiens
accuuuuaacuccucaauucca

SEQ ID NO: 1984837 - RNA, 15 nt, Homo sapiens
guccaggcuggucuu

SEQ ID NO: 1984838 - RNA, 20 nt, Homo sapiens
caaucuuucaugucuuguca

SEQ ID NO: 1984839 - RNA, 16 nt, Homo sapiens
uggccuauccgcugcc

SEQ ID NO: 1984840 - RNA, 14 nt, Homo sapiens
uguauccgacucua

SEQ ID NO: 1984841 - RNA, 14 nt, Homo sapiens
cuuccaacaaggaa

SEQ ID NO: 1984842 - RNA, 23 nt, Homo sapiens
ccacuucugggucaugcacugag

SEQ ID NO: 1984843 - RNA, 18 nt, Homo sapiens
aauuuuaaguacuuugcu

SEQ ID NO: 1984844 - RNA, 12 nt, Homo sapiens
acacagcaauac

SEQ ID NO: 1984845 - RNA, 17 nt, Homo sapiens
aggcaugaagagcaaaa

SEQ ID NO: 1984846 - RNA, 22 nt, Homo sapiens
uggaccaggaagcccugaaucc

SEQ ID NO: 1984847 - RNA, 22 nt, Homo sapiens
agugugugaaaauucaggugcu

SEQ ID NO: 1984848 - RNA, 17 nt, Homo sapiens
auuuuauuaggauuacc

SEQ ID NO: 1984849 - RNA, 14 nt, Homo sapiens
ugaagguguguccu

SEQ ID NO: 1984850 - RNA, 16 nt, Homo sapiens
ccccucagauuccacc

SEQ ID NO: 1984851 - RNA, 17 nt, Homo sapiens
cauuauuucaaccgcuu

SEQ ID NO: 1984852 - RNA, 19 nt, Homo sapiens
aacuccauucauaguggau

SEQ ID NO: 1984853 - RNA, 12 nt, Homo sapiens
cuaggucacuug

SEQ ID NO: 1984854 - RNA, 22 nt, Homo sapiens
gagccaagaucgcaccacugca

SEQ ID NO: 1984855 - RNA, 19 nt, Homo sapiens
ucaugccuguaaucccagc

SEQ ID NO: 1984856 - RNA, 18 nt, Homo sapiens
uggccaucuucuuucuuc

SEQ ID NO: 1984857 - RNA, 21 nt, Homo sapiens
uuggauaaaauaaaugcaauu

SEQ ID NO: 1984858 - RNA, 15 nt, Homo sapiens
guucuuccucucuca

SEQ ID NO: 1984859 - RNA, 15 nt, Homo sapiens
aucaauacugcacac

SEQ ID NO: 1984860 - RNA, 14 nt, Homo sapiens
ugcugggacagcua

SEQ ID NO: 1984861 - RNA, 14 nt, Homo sapiens
caguucaaucaaac

SEQ ID NO: 1984862 - RNA, 14 nt, Homo sapiens
gucauuuccggacu

SEQ ID NO: 1984863 - RNA, 16 nt, Homo sapiens
auagaugaguccuguu

SEQ ID NO: 1984864 - RNA, 22 nt, Homo sapiens
ggcaaaugacaugcacugaccc

SEQ ID NO: 1984865 - RNA, 16 nt, Homo sapiens
uucaagugcacugagc

SEQ ID NO: 1984866 - RNA, 14 nt, Homo sapiens
gcuucuccugguca

SEQ ID NO: 1984867 - RNA, 18 nt, Homo sapiens
cuguuugaaacuuuucaa

SEQ ID NO: 1984868 - RNA, 20 nt, Homo sapiens
uacacagugggaacucugac

SEQ ID NO: 1984869 - RNA, 14 nt, Homo sapiens
ugaaugugucaggu

SEQ ID NO: 1984870 - RNA, 18 nt, Homo sapiens
cagauuugcaacagcaaa

SEQ ID NO: 1984871 - RNA, 15 nt, Homo sapiens
aaagcuucacuucau

SEQ ID NO: 1984872 - RNA, 16 nt, Homo sapiens
cuuugucaaaaggaag

SEQ ID NO: 1984873 - RNA, 17 nt, Homo sapiens
ccagacuuuagugcccu

SEQ ID NO: 1984874 - RNA, 23 nt, Homo sapiens
agauuauauaucauaaaguaugc

SEQ ID NO: 1984875 - RNA, 15 nt, Homo sapiens
uaucaagcacuaaaa

SEQ ID NO: 1984876 - RNA, 15 nt, Homo sapiens
ggcggccaggcacag

SEQ ID NO: 1984877 - RNA, 19 nt, Homo sapiens
aacaugaccacucuuggcu

SEQ ID NO: 1984878 - RNA, 18 nt, Homo sapiens
gggcucuaaugugucucu

SEQ ID NO: 1984879 - RNA, 16 nt, Homo sapiens
ugcagugaugcaauaa

SEQ ID NO: 1984880 - RNA, 23 nt, Homo sapiens
agagacuuuauccaugccaauag

SEQ ID NO: 1984881 - RNA, 15 nt, Homo sapiens
acauaauaagacuuu

SEQ ID NO: 1984882 - RNA, 15 nt, Homo sapiens
uggcucacacagacu

SEQ ID NO: 1984883 - RNA, 20 nt, Homo sapiens
aaguccagauuuacacuggg

SEQ ID NO: 1984884 - RNA, 22 nt, Homo sapiens
acaggccccaguuauugugaaa

SEQ ID NO: 1984885 - RNA, 16 nt, Homo sapiens
uacucgaguuacagac

SEQ ID NO: 1984886 - RNA, 16 nt, Homo sapiens
acccucccuccagggu

SEQ ID NO: 1984887 - RNA, 21 nt, Homo sapiens
cuagugguaaaacauccaaga

SEQ ID NO: 1984888 - RNA, 20 nt, Homo sapiens
aaauaauuuuucacuucaaa

SEQ ID NO: 1984889 - RNA, 19 nt, Homo sapiens
uggaguuuuguuuccucug

SEQ ID NO: 1984890 - RNA, 15 nt, Homo sapiens
cuuguaucugaagac

SEQ ID NO: 1984891 - RNA, 21 nt, Homo sapiens
cauaauaaaaggaguucagau

SEQ ID NO: 1984892 - RNA, 15 nt, Homo sapiens
ucaaggcugcaguga

SEQ ID NO: 1984893 - RNA, 13 nt, Homo sapiens
gagaacacuguga

SEQ ID NO: 1984894 - RNA, 11 nt, Homo sapiens
aguagggccag

SEQ ID NO: 1984895 - RNA, 13 nt, Homo sapiens
ggacugugccuga

SEQ ID NO: 1984896 - RNA, 18 nt, Homo sapiens
auaagcuggacuaguguc

SEQ ID NO: 1984897 - RNA, 17 nt, Homo sapiens
cagaugcuccaagauuc

SEQ ID NO: 1984898 - RNA, 17 nt, Homo sapiens
cagaauguaucugugaa

SEQ ID NO: 1984899 - RNA, 20 nt, Homo sapiens
acccucggccucuacuuugu

SEQ ID NO: 1984900 - RNA, 19 nt, Homo sapiens
augacuugaggcacaaauc

SEQ ID NO: 1984901 - RNA, 17 nt, Homo sapiens
cuuucacgggccccauu

SEQ ID NO: 1984902 - RNA, 19 nt, Homo sapiens
ccauguuguaaugcugcac

SEQ ID NO: 1984903 - RNA, 17 nt, Homo sapiens
cauauaucuuacauaua

SEQ ID NO: 1984904 - RNA, 19 nt, Homo sapiens
guaagacacacagccuuuc

SEQ ID NO: 1984905 - RNA, 14 nt, Homo sapiens
auugagagugauuc

SEQ ID NO: 1984906 - RNA, 15 nt, Homo sapiens
agagaucuauguacu

SEQ ID NO: 1984907 - RNA, 16 nt, Homo sapiens
acauauuuguggaaua

SEQ ID NO: 1984908 - RNA, 23 nt, Homo sapiens
gagucuaaccugcgucauuucag

SEQ ID NO: 1984909 - RNA, 20 nt, Homo sapiens
gccuggauucauuuccugcc

SEQ ID NO: 1984910 - RNA, 18 nt, Homo sapiens
ccugaguucugacacugu

SEQ ID NO: 1984911 - RNA, 16 nt, Homo sapiens
acagauugcugccuca

SEQ ID NO: 1984912 - RNA, 16 nt, Homo sapiens
gggucucuagugcugu

SEQ ID NO: 1984913 - RNA, 19 nt, Homo sapiens
uaacuugagcuucacuguc

SEQ ID NO: 1984914 - RNA, 22 nt, Homo sapiens
uucaguuucuucugcgccucag

SEQ ID NO: 1984915 - RNA, 22 nt, Homo sapiens
aagguauuuuguaauauucucu

SEQ ID NO: 1984916 - RNA, 13 nt, Homo sapiens
uaccaucagggac

SEQ ID NO: 1984917 - RNA, 20 nt, Homo sapiens
uagaacggaauguguggggu

SEQ ID NO: 1984918 - RNA, 21 nt, Homo sapiens
ucuauaaagaagaacuugcau

SEQ ID NO: 1984919 - RNA, 14 nt, Homo sapiens
uuucuggccaaaag

SEQ ID NO: 1984920 - RNA, 22 nt, Homo sapiens
caucuuguaaauaaugcuuaac

SEQ ID NO: 1984921 - RNA, 19 nt, Homo sapiens
aauuaaugacagagccagu

SEQ ID NO: 1984922 - RNA, 19 nt, Homo sapiens
cagaagaagcuggugcccu

SEQ ID NO: 1984923 - RNA, 13 nt, Homo sapiens
uucaucagaguua

SEQ ID NO: 1984924 - RNA, 19 nt, Homo sapiens
acccuccacucagcugucc

SEQ ID NO: 1984925 - RNA, 13 nt, Homo sapiens
aaaagcacacucc

SEQ ID NO: 1984926 - RNA, 11 nt, Homo sapiens
ugugugcacau

SEQ ID NO: 1984927 - RNA, 16 nt, Homo sapiens
caaaaggcagcucacc

SEQ ID NO: 1984928 - RNA, 12 nt, Homo sapiens
agggccaggugc

SEQ ID NO: 1984929 - RNA, 22 nt, Homo sapiens
ucuccugcuuuaaccaccccau

SEQ ID NO: 1984930 - RNA, 21 nt, Homo sapiens
aguaacucccaucaccucuaa

SEQ ID NO: 1984931 - RNA, 13 nt, Homo sapiens
auaaaucuauuca

SEQ ID NO: 1984932 - RNA, 15 nt, Homo sapiens
auuuuuaaguacaaa

SEQ ID NO: 1984933 - RNA, 23 nt, Homo sapiens
cuccgaugcccgcccggggaguu

SEQ ID NO: 1984934 - RNA, 9 nt, Homo sapiens
aaccuggag

SEQ ID NO: 1984935 - RNA, 20 nt, Homo sapiens
caauugauccucccaucuca

SEQ ID NO: 1984936 - RNA, 11 nt, Homo sapiens
gcaugagccac

SEQ ID NO: 1984937 - RNA, 22 nt, Homo sapiens
cccgggcauccacguagggggc

SEQ ID NO: 1984938 - RNA, 14 nt, Homo sapiens
ucuuaccaguguga

SEQ ID NO: 1984939 - RNA, 15 nt, Homo sapiens
ucagcacuagccaaa

SEQ ID NO: 1984940 - RNA, 14 nt, Homo sapiens
aguucuaggcauag

SEQ ID NO: 1984941 - RNA, 15 nt, Homo sapiens
gauucuacagugaug

SEQ ID NO: 1984942 - RNA, 17 nt, Homo sapiens
aacauugacuucuuggu

SEQ ID NO: 1984943 - RNA, 12 nt, Homo sapiens
cuugacaccacu

SEQ ID NO: 1984944 - RNA, 23 nt, Homo sapiens
acagguguuuuuccacaagugcc

SEQ ID NO: 1984945 - RNA, 16 nt, Homo sapiens
accuuucugcacauaa

SEQ ID NO: 1984946 - RNA, 13 nt, Homo sapiens
uagaggcauuuag

SEQ ID NO: 1984947 - RNA, 20 nt, Homo sapiens
aaagaccugaauaccacuua

SEQ ID NO: 1984948 - RNA, 17 nt, Homo sapiens
auauauaaauaaucaca

SEQ ID NO: 1984949 - RNA, 15 nt, Homo sapiens
uagucaugauucuau

SEQ ID NO: 1984950 - RNA, 23 nt, Homo sapiens
gugcuaauaacagugcauauucc

SEQ ID NO: 1984951 - RNA, 16 nt, Homo sapiens
ugggccccucagggga

SEQ ID NO: 1984952 - RNA, 18 nt, Homo sapiens
cacauacccucacuuaaa

SEQ ID NO: 1984953 - RNA, 18 nt, Homo sapiens
agaugaaacauuaacucu

SEQ ID NO: 1984954 - RNA, 21 nt, Homo sapiens
auacuacuccuguaauuccua

SEQ ID NO: 1984955 - RNA, 20 nt, Homo sapiens
gcucaucuguuaugcauagc

SEQ ID NO: 1984956 - RNA, 18 nt, Homo sapiens
uauuuuucaaaacauaca

SEQ ID NO: 1984957 - RNA, 18 nt, Homo sapiens
gccccguuuuaaggacau

SEQ ID NO: 1984958 - RNA, 18 nt, Homo sapiens
augccuccugcccugcua

SEQ ID NO: 1984959 - RNA, 23 nt, Homo sapiens
cuuaaucaguguagccccaagaa

SEQ ID NO: 1984960 - RNA, 15 nt, Homo sapiens
aauuggcucuaguca

SEQ ID NO: 1984961 - RNA, 22 nt, Homo sapiens
aaaucagccagacaugguggca

SEQ ID NO: 1984962 - RNA, 20 nt, Homo sapiens
ccaaaggaucuuuguuccuc

SEQ ID NO: 1984963 - RNA, 21 nt, Homo sapiens
aggacgcacgcucgcugccau

SEQ ID NO: 1984964 - RNA, 22 nt, Homo sapiens
uucuuagcccuugggcacugca

SEQ ID NO: 1984965 - RNA, 17 nt, Homo sapiens
agccuuuccuguagccu

SEQ ID NO: 1984966 - RNA, 17 nt, Homo sapiens
acuugacaucaacugca

SEQ ID NO: 1984967 - RNA, 16 nt, Homo sapiens
ucucacugcaagcaca

SEQ ID NO: 1984968 - RNA, 15 nt, Homo sapiens
ugcauugagcucucu

SEQ ID NO: 1984969 - RNA, 19 nt, Homo sapiens
ccuguccugaaagccacag

SEQ ID NO: 1984970 - RNA, 17 nt, Homo sapiens
cuuuccuuucauccuca

SEQ ID NO: 1984971 - RNA, 23 nt, Homo sapiens
cugucgguguuuggaggcugcug

SEQ ID NO: 1984972 - RNA, 22 nt, Homo sapiens
aaaaccuacacacauaccuuca

SEQ ID NO: 1984973 - RNA, 13 nt, Homo sapiens
agagaacagggau

SEQ ID NO: 1984974 - RNA, 23 nt, Homo sapiens
gguggccugcggggagccaucac

SEQ ID NO: 1984975 - RNA, 15 nt, Homo sapiens
ugaaaccaaaacaua

SEQ ID NO: 1984976 - RNA, 20 nt, Homo sapiens
agaguuguuuauaaugucaa

SEQ ID NO: 1984977 - RNA, 23 nt, Homo sapiens
uuaaguaucuuuuuucaaaaaca

SEQ ID NO: 1984978 - RNA, 21 nt, Homo sapiens
acuucucuccuccacucugag

SEQ ID NO: 1984979 - RNA, 21 nt, Homo sapiens
aauacugccagaugcugaugu

SEQ ID NO: 1984980 - RNA, 21 nt, Homo sapiens
cuucccccacccagcuuucuu

SEQ ID NO: 1984981 - RNA, 14 nt, Homo sapiens
ucuauaaggccaua

SEQ ID NO: 1984982 - RNA, 14 nt, Homo sapiens
cagccaccagggag

SEQ ID NO: 1984983 - RNA, 17 nt, Homo sapiens
ugaggacuguuggcuga

SEQ ID NO: 1984984 - RNA, 15 nt, Homo sapiens
uucagcucugaucug

SEQ ID NO: 1984985 - RNA, 14 nt, Homo sapiens
aggggcccacaggg

SEQ ID NO: 1984986 - RNA, 14 nt, Homo sapiens
ucgaggccugaagc

SEQ ID NO: 1984987 - RNA, 15 nt, Homo sapiens
cuuuucuccaugagu

SEQ ID NO: 1984988 - RNA, 12 nt, Homo sapiens
ucccugccaacu

SEQ ID NO: 1984989 - RNA, 14 nt, Homo sapiens
uagcgaacugcacu

SEQ ID NO: 1984990 - RNA, 21 nt, Homo sapiens
aggagaaucgcuugaacccag

SEQ ID NO: 1984991 - RNA, 21 nt, Homo sapiens
auauuaaagucagaauauuaa

SEQ ID NO: 1984992 - RNA, 13 nt, Homo sapiens
gcuaggagcaaag

SEQ ID NO: 1984993 - RNA, 19 nt, Homo sapiens
uucuaacugaaggugcagu

SEQ ID NO: 1984994 - RNA, 23 nt, Homo sapiens
uggguuggagggcacuuggccag

SEQ ID NO: 1984995 - RNA, 16 nt, Homo sapiens
ccucugggagcuucuu

SEQ ID NO: 1984996 - RNA, 20 nt, Homo sapiens
accaaauacuuucugagaug

SEQ ID NO: 1984997 - RNA, 18 nt, Homo sapiens
uuaucgggagcagugucu

SEQ ID NO: 1984998 - RNA, 21 nt, Homo sapiens
gaaacuaaucuuaacccugug

SEQ ID NO: 1984999 - RNA, 20 nt, Homo sapiens
aauacuccagagacagggaa

SEQ ID NO: 1985000 - RNA, 12 nt, Homo sapiens
auugaauacaca

SEQ ID NO: 1985001 - RNA, 18 nt, Homo sapiens
auaaacaccauuuaguca

SEQ ID NO: 1985002 - RNA, 11 nt, Homo sapiens
uccugcauguu

SEQ ID NO: 1985003 - RNA, 17 nt, Homo sapiens
auuggagaagauuuaug

SEQ ID NO: 1985004 - RNA, 14 nt, Homo sapiens
aaauauuuagucug

SEQ ID NO: 1985005 - RNA, 18 nt, Homo sapiens
agcacaugucucauuuua

SEQ ID NO: 1985006 - RNA, 17 nt, Homo sapiens
auugacccuagccagag

SEQ ID NO: 1985007 - RNA, 15 nt, Homo sapiens
ugguguuucccuucc

SEQ ID NO: 1985008 - RNA, 18 nt, Homo sapiens
gugccagauauaacuguc

SEQ ID NO: 1985009 - RNA, 18 nt, Homo sapiens
ugucuuuguuguagugaa

SEQ ID NO: 1985010 - RNA, 14 nt, Homo sapiens
gcacacacagugau

SEQ ID NO: 1985011 - RNA, 16 nt, Homo sapiens
gaagaaggaccaguga

SEQ ID NO: 1985012 - RNA, 15 nt, Homo sapiens
ucugguagcuccaca

SEQ ID NO: 1985013 - RNA, 15 nt, Homo sapiens
acagccuccaaguca

SEQ ID NO: 1985014 - RNA, 17 nt, Homo sapiens
aauuuggaaacuaauaa

SEQ ID NO: 1985015 - RNA, 19 nt, Homo sapiens
uaaacucagcuacugcaaa

SEQ ID NO: 1985016 - RNA, 20 nt, Homo sapiens
ucagggguacacagagcuaa

SEQ ID NO: 1985017 - RNA, 19 nt, Homo sapiens
ucugggcaagaggaaaaug

SEQ ID NO: 1985018 - RNA, 13 nt, Homo sapiens
aacaaacagggcu

SEQ ID NO: 1985019 - RNA, 16 nt, Homo sapiens
aucauucuacaaguaa

SEQ ID NO: 1985020 - RNA, 15 nt, Homo sapiens
aaggcauuucuauca

SEQ ID NO: 1985021 - RNA, 14 nt, Homo sapiens
aucuuccuucucag

SEQ ID NO: 1985022 - RNA, 23 nt, Homo sapiens
gacaguugauggagccccagggu

SEQ ID NO: 1985023 - RNA, 23 nt, Homo sapiens
gcuucauuugggaaauucagcuu

SEQ ID NO: 1985024 - RNA, 22 nt, Homo sapiens
ccuacccuuuaaagguaacuuc

SEQ ID NO: 1985025 - RNA, 14 nt, Homo sapiens
aucuauagcacaua

SEQ ID NO: 1985026 - RNA, 21 nt, Homo sapiens
caguuacucccuacacugaug

SEQ ID NO: 1985027 - RNA, 17 nt, Homo sapiens
uccucucuuaaaugcaa

SEQ ID NO: 1985028 - RNA, 17 nt, Homo sapiens
ugggaaaggugcucaaa

SEQ ID NO: 1985029 - RNA, 20 nt, Homo sapiens
ggaguucccccaaccaucuu

SEQ ID NO: 1985030 - RNA, 15 nt, Homo sapiens
uugggcaugcucagc

SEQ ID NO: 1985031 - RNA, 14 nt, Homo sapiens
uucaugaaaauccu

SEQ ID NO: 1985032 - RNA, 21 nt, Homo sapiens
gacccuguccugcagucccac

SEQ ID NO: 1985033 - RNA, 16 nt, Homo sapiens
agauguuauacaacca

SEQ ID NO: 1985034 - RNA, 18 nt, Homo sapiens
accgugccacuuuccacc

SEQ ID NO: 1985035 - RNA, 20 nt, Homo sapiens
uuauuuacaugugauuguga

SEQ ID NO: 1985036 - RNA, 12 nt, Homo sapiens
aauuguacaaua

SEQ ID NO: 1985037 - RNA, 20 nt, Homo sapiens
guaauaauaaaaccaaagaa

SEQ ID NO: 1985038 - RNA, 20 nt, Homo sapiens
aguucugcacccagccaaac

SEQ ID NO: 1985039 - RNA, 15 nt, Homo sapiens
acauccuagcauuug

SEQ ID NO: 1985040 - RNA, 15 nt, Homo sapiens
gcccucccagcagug

SEQ ID NO: 1985041 - RNA, 20 nt, Homo sapiens
uuugggguagcggcccugag

SEQ ID NO: 1985042 - RNA, 16 nt, Homo sapiens
cugacaaugcugccau

SEQ ID NO: 1985043 - RNA, 13 nt, Homo sapiens
aguucagucugua

SEQ ID NO: 1985044 - RNA, 20 nt, Homo sapiens
ucccaggcuggagugcagug

SEQ ID NO: 1985045 - RNA, 16 nt, Homo sapiens
cucaagacaaugcacc

SEQ ID NO: 1985046 - RNA, 12 nt, Homo sapiens
uagcuguuucaa

SEQ ID NO: 1985047 - RNA, 17 nt, Homo sapiens
uucuuucuuaaccacuu

SEQ ID NO: 1985048 - RNA, 17 nt, Homo sapiens
caccuacauuaucucac

SEQ ID NO: 1985049 - RNA, 19 nt, Homo sapiens
uaacaucucuuucaucuag

SEQ ID NO: 1985050 - RNA, 18 nt, Homo sapiens
aucuguaggucacucucc

SEQ ID NO: 1985051 - RNA, 14 nt, Homo sapiens
cuucuacaaaagaa

SEQ ID NO: 1985052 - RNA, 20 nt, Homo sapiens
ugcuuaccucucagccuuag

SEQ ID NO: 1985053 - RNA, 18 nt, Homo sapiens
ugaaucccaccugccacc

SEQ ID NO: 1985054 - RNA, 17 nt, Homo sapiens
ggcuggccaaggugucc

SEQ ID NO: 1985055 - RNA, 12 nt, Homo sapiens
cuuccacagccc

SEQ ID NO: 1985056 - RNA, 23 nt, Homo sapiens
cccagccaucugcccaggggugc

SEQ ID NO: 1985057 - RNA, 21 nt, Homo sapiens
cguaucugcucuuaggugcuu

SEQ ID NO: 1985058 - RNA, 13 nt, Homo sapiens
caaaucaaagcag

SEQ ID NO: 1985059 - RNA, 17 nt, Homo sapiens
aguuucuucaccuguaa

SEQ ID NO: 1985060 - RNA, 18 nt, Homo sapiens
gcacugggggacauggga

SEQ ID NO: 1985061 - RNA, 13 nt, Homo sapiens
ucuauaaaacaca

SEQ ID NO: 1985062 - RNA, 13 nt, Homo sapiens
aauaaaaugcacu

SEQ ID NO: 1985063 - RNA, 24 nt, Homo sapiens
gaggaaauguuggaacucugugca

SEQ ID NO: 1985064 - RNA, 14 nt, Homo sapiens
ucucagccucugaa

SEQ ID NO: 1985065 - RNA, 14 nt, Homo sapiens
uccuuguaucugua

SEQ ID NO: 1985066 - RNA, 21 nt, Homo sapiens
aucaccagaaaauuaauuuca

SEQ ID NO: 1985067 - RNA, 20 nt, Homo sapiens
uccauccugggugacagcaa

SEQ ID NO: 1985068 - RNA, 17 nt, Homo sapiens
cugugaugcaugagcuc

SEQ ID NO: 1985069 - RNA, 15 nt, Homo sapiens
agcugcugaaugcau

SEQ ID NO: 1985070 - RNA, 18 nt, Homo sapiens
auguggguugugauauug

SEQ ID NO: 1985071 - RNA, 14 nt, Homo sapiens
ugaaggccuggaau

SEQ ID NO: 1985072 - RNA, 14 nt, Homo sapiens
aaccuaagauguaa

SEQ ID NO: 1985073 - RNA, 18 nt, Homo sapiens
gauggguaucaugcuucu

SEQ ID NO: 1985074 - RNA, 16 nt, Homo sapiens
ucccauuccugaagaa

SEQ ID NO: 1985075 - RNA, 18 nt, Homo sapiens
ccucuaccuccuggguuc

SEQ ID NO: 1985076 - RNA, 20 nt, Homo sapiens
ggagggccugggccccaguu

SEQ ID NO: 1985077 - RNA, 22 nt, Homo sapiens
aaauauagauuagaaaaauucc

SEQ ID NO: 1985078 - RNA, 15 nt, Homo sapiens
ucaaucacguguaua

SEQ ID NO: 1985079 - RNA, 15 nt, Homo sapiens
cacaccccucaaaaa

SEQ ID NO: 1985080 - RNA, 23 nt, Homo sapiens
cuaaucaacagauaaaugacaag

SEQ ID NO: 1985081 - RNA, 18 nt, Homo sapiens
cugcccagccucagcuga

SEQ ID NO: 1985082 - RNA, 18 nt, Homo sapiens
auuccuaacuagaauuag

SEQ ID NO: 1985083 - RNA, 20 nt, Homo sapiens
cucuuucuuggugucugucc

SEQ ID NO: 1985084 - RNA, 11 nt, Homo sapiens
aacuacuguau

SEQ ID NO: 1985085 - RNA, 16 nt, Homo sapiens
cacggauggugcaugg

SEQ ID NO: 1985086 - RNA, 23 nt, Homo sapiens
ccuuuaccccaccuuccugggaa

SEQ ID NO: 1985087 - RNA, 17 nt, Homo sapiens
cuaaaagaaaaucuauu

SEQ ID NO: 1985088 - RNA, 18 nt, Homo sapiens
ugaauuugccuuccucau

SEQ ID NO: 1985089 - RNA, 13 nt, Homo sapiens
gccagagaauaga

SEQ ID NO: 1985090 - RNA, 13 nt, Homo sapiens
gucagagaacaga

SEQ ID NO: 1985091 - RNA, 18 nt, Homo sapiens
agaucuuuauaaccugau

SEQ ID NO: 1985092 - RNA, 19 nt, Homo sapiens
agccuucuuugcuugccuc

SEQ ID NO: 1985093 - RNA, 15 nt, Homo sapiens
uuuauuuuccuguga

SEQ ID NO: 1985094 - RNA, 23 nt, Homo sapiens
aaucugagaggccacagugcaau

SEQ ID NO: 1985095 - RNA, 16 nt, Homo sapiens
caagugacucuccugc

SEQ ID NO: 1985096 - RNA, 13 nt, Homo sapiens
agcggcugcucaa

SEQ ID NO: 1985097 - RNA, 17 nt, Homo sapiens
gaagcacagcagcaucu

SEQ ID NO: 1985098 - RNA, 17 nt, Homo sapiens
ccucuuucuaucuucac

SEQ ID NO: 1985099 - RNA, 20 nt, Homo sapiens
ugguggcacacgccuguaau

SEQ ID NO: 1985100 - RNA, 23 nt, Homo sapiens
caagucauaccuacauucaagga

SEQ ID NO: 1985101 - RNA, 19 nt, Homo sapiens
aaaauacaugguaucucuu

SEQ ID NO: 1985102 - RNA, 17 nt, Homo sapiens
cuauacagugcauccuu

SEQ ID NO: 1985103 - RNA, 15 nt, Homo sapiens
aaauuuugcauuuca

SEQ ID NO: 1985104 - RNA, 22 nt, Homo sapiens
aggugaacaagguaaaacaacu

SEQ ID NO: 1985105 - RNA, 23 nt, Homo sapiens
aaagaaucccacccccacuucau

SEQ ID NO: 1985106 - RNA, 18 nt, Homo sapiens
gugaauggccuuccuucc

SEQ ID NO: 1985107 - RNA, 22 nt, Homo sapiens
gaugugaaaacaucucaauaac

SEQ ID NO: 1985108 - RNA, 13 nt, Homo sapiens
aagguagcccagc

SEQ ID NO: 1985109 - RNA, 12 nt, Homo sapiens
ggcagauccagg

SEQ ID NO: 1985110 - RNA, 21 nt, Homo sapiens
ucuauugcucaucagcuuuau

SEQ ID NO: 1985111 - RNA, 14 nt, Homo sapiens
acuguccuggcuac

SEQ ID NO: 1985112 - RNA, 18 nt, Homo sapiens
auuuuauugcuagccauc

SEQ ID NO: 1985113 - RNA, 21 nt, Homo sapiens
aaggguucuguaaaauggaaa

SEQ ID NO: 1985114 - RNA, 15 nt, Homo sapiens
aaaucccccuuucuc

SEQ ID NO: 1985115 - RNA, 15 nt, Homo sapiens
cauuuuucauauucu

SEQ ID NO: 1985116 - RNA, 16 nt, Homo sapiens
ggagcagcuggcacug

SEQ ID NO: 1985117 - RNA, 18 nt, Homo sapiens
aauaccauuaaaacugcu

SEQ ID NO: 1985118 - RNA, 13 nt, Homo sapiens
guuuucaaauguc

SEQ ID NO: 1985119 - RNA, 23 nt, Homo sapiens
auguuguguggcaaugggauuug

SEQ ID NO: 1985120 - RNA, 17 nt, Homo sapiens
uuguuucuguuucuugc

SEQ ID NO: 1985121 - RNA, 11 nt, Homo sapiens
uaugucuuccc

SEQ ID NO: 1985122 - RNA, 14 nt, Homo sapiens
agauuuuaaagaca

SEQ ID NO: 1985123 - RNA, 20 nt, Homo sapiens
gacccagcccugaacaaagc

SEQ ID NO: 1985124 - RNA, 15 nt, Homo sapiens
cuugaauuccuggaa

SEQ ID NO: 1985125 - RNA, 23 nt, Homo sapiens
ccaacguggggcagcacagagag

SEQ ID NO: 1985126 - RNA, 12 nt, Homo sapiens
ccaaauuaucaa

SEQ ID NO: 1985127 - RNA, 19 nt, Homo sapiens
ucccucucguaagauuucc

SEQ ID NO: 1985128 - RNA, 15 nt, Homo sapiens
gcuagugacagccac

SEQ ID NO: 1985129 - RNA, 19 nt, Homo sapiens
aagcacuugcuuacauccu

SEQ ID NO: 1985130 - RNA, 22 nt, Homo sapiens
gaaccgacgcaugaaguggaaa

SEQ ID NO: 1985131 - RNA, 15 nt, Homo sapiens
uggccugcugggaac

SEQ ID NO: 1985132 - RNA, 16 nt, Homo sapiens
gcuguauguaaacugu

SEQ ID NO: 1985133 - RNA, 12 nt, Homo sapiens
cugugcucagau

SEQ ID NO: 1985134 - RNA, 17 nt, Homo sapiens
ucugugggcacuggugg

SEQ ID NO: 1985135 - RNA, 13 nt, Homo sapiens
agccagacccaga

SEQ ID NO: 1985136 - RNA, 17 nt, Homo sapiens
cccuuuugcauugccaa

SEQ ID NO: 1985137 - RNA, 16 nt, Homo sapiens
cagggauccaauauga

SEQ ID NO: 1985138 - RNA, 18 nt, Homo sapiens
gaauuggaaucacauucu

SEQ ID NO: 1985139 - RNA, 20 nt, Homo sapiens
auaugaaacucuacauuuaa

SEQ ID NO: 1985140 - RNA, 22 nt, Homo sapiens
ggugaaacuaacagauaagcaa

SEQ ID NO: 1985141 - RNA, 15 nt, Homo sapiens
ggugagaugcagcug

SEQ ID NO: 1985142 - RNA, 22 nt, Homo sapiens
cagccucaaguaggaguuuuau

SEQ ID NO: 1985143 - RNA, 17 nt, Homo sapiens
agaguccuuucaggaag

SEQ ID NO: 1985144 - RNA, 12 nt, Homo sapiens
agauuguucuca

SEQ ID NO: 1985145 - RNA, 13 nt, Homo sapiens
ucaggaguucaag

SEQ ID NO: 1985146 - RNA, 15 nt, Homo sapiens
acccuggaguggcau

SEQ ID NO: 1985147 - RNA, 12 nt, Homo sapiens
ucucccuuuaug

SEQ ID NO: 1985148 - RNA, 16 nt, Homo sapiens
caacgugcaacugaca

SEQ ID NO: 1985149 - RNA, 12 nt, Homo sapiens
uucaaaugggcu

SEQ ID NO: 1985150 - RNA, 16 nt, Homo sapiens
ccgucaaaagagucuu

SEQ ID NO: 1985151 - RNA, 15 nt, Homo sapiens
cugaccuugaaucuu

SEQ ID NO: 1985152 - RNA, 14 nt, Homo sapiens
agggcaccagggac

SEQ ID NO: 1985153 - RNA, 23 nt, Homo sapiens
cucccuuuuaaaaggagcacauu

SEQ ID NO: 1985154 - RNA, 14 nt, Homo sapiens
ucacaccacaaauc

SEQ ID NO: 1985155 - RNA, 14 nt, Homo sapiens
gcggaucacuugag

SEQ ID NO: 1985156 - RNA, 18 nt, Homo sapiens
uaaauguucuaacagauc

SEQ ID NO: 1985157 - RNA, 16 nt, Homo sapiens
cauuuuacuuccauga

SEQ ID NO: 1985158 - RNA, 18 nt, Homo sapiens
agcagccagagcugugcc

SEQ ID NO: 1985159 - RNA, 18 nt, Homo sapiens
ccugguaccuagcaaagc

SEQ ID NO: 1985160 - RNA, 18 nt, Homo sapiens
cagauaaaacauggacaa

SEQ ID NO: 1985161 - RNA, 22 nt, Homo sapiens
gucuuuuuuucccuaccauuca

SEQ ID NO: 1985162 - RNA, 20 nt, Homo sapiens
caaaauauuuaagugaagga

SEQ ID NO: 1985163 - RNA, 13 nt, Homo sapiens
gcagccucaaaac

SEQ ID NO: 1985164 - RNA, 21 nt, Homo sapiens
cuaugauuguccguaggccca

SEQ ID NO: 1985165 - RNA, 14 nt, Homo sapiens
acagauaugcacac

SEQ ID NO: 1985166 - RNA, 17 nt, Homo sapiens
ccaaacucaggcuuuca

SEQ ID NO: 1985167 - RNA, 19 nt, Homo sapiens
gagcuuuuuguucccucau

SEQ ID NO: 1985168 - RNA, 20 nt, Homo sapiens
cuugcccagagaugccucca

SEQ ID NO: 1985169 - RNA, 14 nt, Homo sapiens
aacaugaagcauaa

SEQ ID NO: 1985170 - RNA, 21 nt, Homo sapiens
uugcuuuauaauuucuaccca

SEQ ID NO: 1985171 - RNA, 16 nt, Homo sapiens
ugauucgcccaccuca

SEQ ID NO: 1985172 - RNA, 22 nt, Homo sapiens
uaauccuggagucucacugucu

SEQ ID NO: 1985173 - RNA, 16 nt, Homo sapiens
uaaaauugaguuugua

SEQ ID NO: 1985174 - RNA, 18 nt, Homo sapiens
caauaaacugcuuugcaa

SEQ ID NO: 1985175 - RNA, 13 nt, Homo sapiens
augcuucugagag

SEQ ID NO: 1985176 - RNA, 15 nt, Homo sapiens
uagagaaauaugauu

SEQ ID NO: 1985177 - RNA, 21 nt, Homo sapiens
ucauagaugcaggaggcucag

SEQ ID NO: 1985178 - RNA, 18 nt, Homo sapiens
cuuuuguuaccacagagu

SEQ ID NO: 1985179 - RNA, 22 nt, Homo sapiens
cuuggcaucgaccacaccagcc

SEQ ID NO: 1985180 - RNA, 17 nt, Homo sapiens
acgcuuccagaccaccu

SEQ ID NO: 1985181 - RNA, 16 nt, Homo sapiens
cccagcccugcagcaa

SEQ ID NO: 1985182 - RNA, 22 nt, Homo sapiens
cucagaaucugauaccaaagag

SEQ ID NO: 1985183 - RNA, 23 nt, Homo sapiens
auuaaagaaagaaaaaugcugaa

SEQ ID NO: 1985184 - RNA, 19 nt, Homo sapiens
cucaaagggagaggucuca

SEQ ID NO: 1985185 - RNA, 21 nt, Homo sapiens
ugcucuguaggagcuacccuu

SEQ ID NO: 1985186 - RNA, 14 nt, Homo sapiens
cagucacagccaua

SEQ ID NO: 1985187 - RNA, 14 nt, Homo sapiens
uauagaugaggcag

SEQ ID NO: 1985188 - RNA, 18 nt, Homo sapiens
uagccuuagaagucacac

SEQ ID NO: 1985189 - RNA, 21 nt, Homo sapiens
ccucaaguucuuggaccaguu

SEQ ID NO: 1985190 - RNA, 19 nt, Homo sapiens
aguuuucacauucuuacua

SEQ ID NO: 1985191 - RNA, 21 nt, Homo sapiens
gcuuuccuucugcccuuccuc

SEQ ID NO: 1985192 - RNA, 17 nt, Homo sapiens
uguggaccucacaagau

SEQ ID NO: 1985193 - RNA, 18 nt, Homo sapiens
gagcuuaaacagaagcag

SEQ ID NO: 1985194 - RNA, 20 nt, Homo sapiens
gccuaacacacuccaagaua

SEQ ID NO: 1985195 - RNA, 14 nt, Homo sapiens
cccucagugagaua

SEQ ID NO: 1985196 - RNA, 18 nt, Homo sapiens
aaaggagccuaggccagg

SEQ ID NO: 1985197 - RNA, 15 nt, Homo sapiens
ccaucaacugugaaa

SEQ ID NO: 1985198 - RNA, 17 nt, Homo sapiens
ugaacuaggugaucuca

SEQ ID NO: 1985199 - RNA, 19 nt, Homo sapiens
cuagaaccuagaagggcua

SEQ ID NO: 1985200 - RNA, 21 nt, Homo sapiens
uaacauauuaugaaaguagua

SEQ ID NO: 1985201 - RNA, 15 nt, Homo sapiens
gcugucucaucccca

SEQ ID NO: 1985202 - RNA, 20 nt, Homo sapiens
agacuacaggugugagccac

SEQ ID NO: 1985203 - RNA, 17 nt, Homo sapiens
aggaauuaaguuaggga

SEQ ID NO: 1985204 - RNA, 17 nt, Homo sapiens
cuuauggacuguuuuga

SEQ ID NO: 1985205 - RNA, 21 nt, Homo sapiens
gucauagacuccuuugcuaau

SEQ ID NO: 1985206 - RNA, 22 nt, Homo sapiens
gggacaguaauaagaauggaaa

SEQ ID NO: 1985207 - RNA, 15 nt, Homo sapiens
uucuaaaccaaaaau

SEQ ID NO: 1985208 - RNA, 15 nt, Homo sapiens
ccaauguaacacugg

SEQ ID NO: 1985209 - RNA, 15 nt, Homo sapiens
uuauugcacauuguu

SEQ ID NO: 1985210 - RNA, 21 nt, Homo sapiens
guauuuauauuagagugcccu

SEQ ID NO: 1985211 - RNA, 18 nt, Homo sapiens
uuccaggcgaugugcaag

SEQ ID NO: 1985212 - RNA, 15 nt, Homo sapiens
acagccccaaccucc

SEQ ID NO: 1985213 - RNA, 15 nt, Homo sapiens
aaacacaaaccacaa

SEQ ID NO: 1985214 - RNA, 16 nt, Homo sapiens
uuuauuccagacaguc

SEQ ID NO: 1985215 - RNA, 17 nt, Homo sapiens
ccuccaugcaggccuua

SEQ ID NO: 1985216 - RNA, 19 nt, Homo sapiens
uacuucauucagaccagug

SEQ ID NO: 1985217 - RNA, 20 nt, Homo sapiens
ggggcagacaauaaacccuc

SEQ ID NO: 1985218 - RNA, 21 nt, Homo sapiens
gagaaaaccuuaaaaguaaua

SEQ ID NO: 1985219 - RNA, 14 nt, Homo sapiens
gccugaucuugccu

SEQ ID NO: 1985220 - RNA, 20 nt, Homo sapiens
ucucuggaacccaggaccuc

SEQ ID NO: 1985221 - RNA, 19 nt, Homo sapiens
aagugauccuuccaccuca

SEQ ID NO: 1985222 - RNA, 20 nt, Homo sapiens
acaaauguauuaaugcuaua

SEQ ID NO: 1985223 - RNA, 21 nt, Homo sapiens
agccugggauuucuaugcagu

SEQ ID NO: 1985224 - RNA, 20 nt, Homo sapiens
uccgcagaauggacuugaua

SEQ ID NO: 1985225 - RNA, 13 nt, Homo sapiens
cacuguuugccca

SEQ ID NO: 1985226 - RNA, 19 nt, Homo sapiens
uugccccaggacucuggca

SEQ ID NO: 1985227 - RNA, 22 nt, Homo sapiens
ucauacuccuuuuaagcaguga

SEQ ID NO: 1985228 - RNA, 20 nt, Homo sapiens
cacagcagcugaacagccaa

SEQ ID NO: 1985229 - RNA, 12 nt, Homo sapiens
ugcucucugagu

SEQ ID NO: 1985230 - RNA, 22 nt, Homo sapiens
aaaaagcaggaaaaaaggaaua

SEQ ID NO: 1985231 - RNA, 16 nt, Homo sapiens
uauaaucccacccacc

SEQ ID NO: 1985232 - RNA, 17 nt, Homo sapiens
aauccaagauucugcug

SEQ ID NO: 1985233 - RNA, 21 nt, Homo sapiens
aggggucugguggucucugcu

SEQ ID NO: 1985234 - RNA, 20 nt, Homo sapiens
cugggucaccuuccugggca

SEQ ID NO: 1985235 - RNA, 14 nt, Homo sapiens
gcuacaaucuugga

SEQ ID NO: 1985236 - RNA, 16 nt, Homo sapiens
guauagaguacugcag

SEQ ID NO: 1985237 - RNA, 18 nt, Homo sapiens
gcaaugguuugugucaaa

SEQ ID NO: 1985238 - RNA, 17 nt, Homo sapiens
gcauucaaguguacagu

SEQ ID NO: 1985239 - RNA, 23 nt, Homo sapiens
uguccuggaaccaggcuugccug

SEQ ID NO: 1985240 - RNA, 20 nt, Homo sapiens
agggaacccaacagucauga

SEQ ID NO: 1985241 - RNA, 17 nt, Homo sapiens
agccuucaagugccaaa

SEQ ID NO: 1985242 - RNA, 16 nt, Homo sapiens
uccuuccagcacugac

SEQ ID NO: 1985243 - RNA, 14 nt, Homo sapiens
guuuauuugcacua

SEQ ID NO: 1985244 - RNA, 11 nt, Homo sapiens
cuauguuguuu

SEQ ID NO: 1985245 - RNA, 16 nt, Homo sapiens
aaagaguuucuguuca

SEQ ID NO: 1985246 - RNA, 22 nt, Homo sapiens
cuucagaacugcccuugcugcc

SEQ ID NO: 1985247 - RNA, 13 nt, Homo sapiens
auggcgucugcuc

SEQ ID NO: 1985248 - RNA, 17 nt, Homo sapiens
gaaauuuugcaccagcg

SEQ ID NO: 1985249 - RNA, 21 nt, Homo sapiens
ccagauccuuuuccagaaaua

SEQ ID NO: 1985250 - RNA, 21 nt, Homo sapiens
gcccgguggcggcagggccag

SEQ ID NO: 1985251 - RNA, 20 nt, Homo sapiens
acaagaagguggaaggcagu

SEQ ID NO: 1985252 - RNA, 16 nt, Homo sapiens
aggaggcccagcugcu

SEQ ID NO: 1985253 - RNA, 20 nt, Homo sapiens
uuuccacugugcuauuacaa

SEQ ID NO: 1985254 - RNA, 14 nt, Homo sapiens
uuaaauaaacugug

SEQ ID NO: 1985255 - RNA, 15 nt, Homo sapiens
gaauccaagccucca

SEQ ID NO: 1985256 - RNA, 19 nt, Homo sapiens
gugcucuuccucaucucau

SEQ ID NO: 1985257 - RNA, 18 nt, Homo sapiens
gcaccuuaagauuuugca

SEQ ID NO: 1985258 - RNA, 18 nt, Homo sapiens
guggauuuuguagauguu

SEQ ID NO: 1985259 - RNA, 22 nt, Homo sapiens
uauaaagcaucuaaacuuuaau

SEQ ID NO: 1985260 - RNA, 23 nt, Homo sapiens
aagccaaagaaaaauaacccuuu

SEQ ID NO: 1985261 - RNA, 22 nt, Homo sapiens
uccagaaucgcuagacuaagaa

SEQ ID NO: 1985262 - RNA, 23 nt, Homo sapiens
uugccagauuaccgacacuguca

SEQ ID NO: 1985263 - RNA, 12 nt, Homo sapiens
acacacugacca

SEQ ID NO: 1985264 - RNA, 17 nt, Homo sapiens
uaaucgagucuaccucu

SEQ ID NO: 1985265 - RNA, 18 nt, Homo sapiens
ucaaaugcagcaauccca

SEQ ID NO: 1985266 - RNA, 15 nt, Homo sapiens
accugggcugugaug

SEQ ID NO: 1985267 - RNA, 13 nt, Homo sapiens
gaaggggugcccc

SEQ ID NO: 1985268 - RNA, 13 nt, Homo sapiens
agccucgucuuca

SEQ ID NO: 1985269 - RNA, 15 nt, Homo sapiens
ccuagaaagggcaag

SEQ ID NO: 1985270 - RNA, 19 nt, Homo sapiens
uuaaucauaguuacugugu

SEQ ID NO: 1985271 - RNA, 11 nt, Homo sapiens
gcccagggaag

SEQ ID NO: 1985272 - RNA, 14 nt, Homo sapiens
ucugauaccuucug

SEQ ID NO: 1985273 - RNA, 14 nt, Homo sapiens
ugguucuauaugaa

SEQ ID NO: 1985274 - RNA, 21 nt, Homo sapiens
uuccacagugugaagacacug

SEQ ID NO: 1985275 - RNA, 19 nt, Homo sapiens
aguggguucagaaccaaga

SEQ ID NO: 1985276 - RNA, 23 nt, Homo sapiens
gacccccagcacuuggggguuca

SEQ ID NO: 1985277 - RNA, 18 nt, Homo sapiens
guauuagauaucaauguu

SEQ ID NO: 1985278 - RNA, 15 nt, Homo sapiens
uuaguuuguuuuaca

SEQ ID NO: 1985279 - RNA, 17 nt, Homo sapiens
agaaguuaagcagccuu

SEQ ID NO: 1985280 - RNA, 23 nt, Homo sapiens
uugggauggaauggccucugaaa

SEQ ID NO: 1985281 - RNA, 19 nt, Homo sapiens
gucuuauugaaaugcagau

SEQ ID NO: 1985282 - RNA, 15 nt, Homo sapiens
cagucaacaguucaa

SEQ ID NO: 1985283 - RNA, 20 nt, Homo sapiens
gcagggaagaggggugcaga

SEQ ID NO: 1985284 - RNA, 22 nt, Homo sapiens
uuggcuggcuuguuugauuuca

SEQ ID NO: 1985285 - RNA, 16 nt, Homo sapiens
uccuaguaauugccua

SEQ ID NO: 1985286 - RNA, 15 nt, Homo sapiens
uacaaucagcugcuu

SEQ ID NO: 1985287 - RNA, 12 nt, Homo sapiens
ggagcuggugac

SEQ ID NO: 1985288 - RNA, 15 nt, Homo sapiens
aauuauaucacuuca

SEQ ID NO: 1985289 - RNA, 15 nt, Homo sapiens
aacaauaucauauca

SEQ ID NO: 1985290 - RNA, 14 nt, Homo sapiens
ugcauuccagaaca

SEQ ID NO: 1985291 - RNA, 14 nt, Homo sapiens
uccccaccacacuu

SEQ ID NO: 1985292 - RNA, 19 nt, Homo sapiens
uggcgcgaucucagcucac

SEQ ID NO: 1985293 - RNA, 17 nt, Homo sapiens
uaaaaauuguagcuuuu

SEQ ID NO: 1985294 - RNA, 19 nt, Homo sapiens
ggugcccuuuggggucccg

SEQ ID NO: 1985295 - RNA, 19 nt, Homo sapiens
ccaauuacagggugacuca

SEQ ID NO: 1985296 - RNA, 23 nt, Homo sapiens
auagaguauagcucuguagugga

SEQ ID NO: 1985297 - RNA, 14 nt, Homo sapiens
uugucuagaguuga

SEQ ID NO: 1985298 - RNA, 20 nt, Homo sapiens
auauugagaucagcauucaa

SEQ ID NO: 1985299 - RNA, 13 nt, Homo sapiens
cacugaggacaca

SEQ ID NO: 1985300 - RNA, 21 nt, Homo sapiens
cacagggcaaaaucgccauag

SEQ ID NO: 1985301 - RNA, 17 nt, Homo sapiens
aaagauauggcugcuuc

SEQ ID NO: 1985302 - RNA, 15 nt, Homo sapiens
ucauagcaauuaacu

SEQ ID NO: 1985303 - RNA, 18 nt, Homo sapiens
cacuuaucagcaugaaga

SEQ ID NO: 1985304 - RNA, 16 nt, Homo sapiens
aaaccacugggcauaa

SEQ ID NO: 1985305 - RNA, 23 nt, Homo sapiens
agggacggggaagccgagcucca

SEQ ID NO: 1985306 - RNA, 17 nt, Homo sapiens
uaauuaaguaaaccaaa

SEQ ID NO: 1985307 - RNA, 17 nt, Homo sapiens
ccuaucugacuucauac

SEQ ID NO: 1985308 - RNA, 15 nt, Homo sapiens
aguguugacauagcc

SEQ ID NO: 1985309 - RNA, 12 nt, Homo sapiens
gugacucagagc

SEQ ID NO: 1985310 - RNA, 12 nt, Homo sapiens
aaaccucaauaa

SEQ ID NO: 1985311 - RNA, 18 nt, Homo sapiens
accccccuccugcuccuc

SEQ ID NO: 1985312 - RNA, 12 nt, Homo sapiens
uuuguuaccaua

SEQ ID NO: 1985313 - RNA, 20 nt, Homo sapiens
gugucuuccacuuugcauau

SEQ ID NO: 1985314 - RNA, 23 nt, Homo sapiens
uuaguauuugcccggggggaaaa

SEQ ID NO: 1985315 - RNA, 22 nt, Homo sapiens
cuaaaggggacuagacaguuag

SEQ ID NO: 1985316 - RNA, 21 nt, Homo sapiens
ccuuucuaaaucugagaucuc

SEQ ID NO: 1985317 - RNA, 23 nt, Homo sapiens
uaagauuauagauucuaaagauu

SEQ ID NO: 1985318 - RNA, 17 nt, Homo sapiens
aagaacuguacauugug

SEQ ID NO: 1985319 - RNA, 14 nt, Homo sapiens
aaauccucuucccu

SEQ ID NO: 1985320 - RNA, 19 nt, Homo sapiens
uucaauaaaguugagcaaa

SEQ ID NO: 1985321 - RNA, 15 nt, Homo sapiens
uugcacuucaaaaaa

SEQ ID NO: 1985322 - RNA, 16 nt, Homo sapiens
cauagugaacacacug

SEQ ID NO: 1985323 - RNA, 13 nt, Homo sapiens
acuccaguagcuc

SEQ ID NO: 1985324 - RNA, 23 nt, Homo sapiens
augaaaagucguuuuccaaacug

SEQ ID NO: 1985325 - RNA, 16 nt, Homo sapiens
cccacuuagcagggac

SEQ ID NO: 1985326 - RNA, 17 nt, Homo sapiens
acuaaucgaaugaacaa

SEQ ID NO: 1985327 - RNA, 12 nt, Homo sapiens
uacacauuccau

SEQ ID NO: 1985328 - RNA, 19 nt, Homo sapiens
ggcagcuucaagugccuuu

SEQ ID NO: 1985329 - RNA, 12 nt, Homo sapiens
auugugugagug

SEQ ID NO: 1985330 - RNA, 12 nt, Homo sapiens
aggaugugauga

SEQ ID NO: 1985331 - RNA, 20 nt, Homo sapiens
caggugugcaccaccaugcc

SEQ ID NO: 1985332 - RNA, 16 nt, Homo sapiens
cacuguaaagccaguu

SEQ ID NO: 1985333 - RNA, 20 nt, Homo sapiens
uccugcccacuaaaagaauu

SEQ ID NO: 1985334 - RNA, 20 nt, Homo sapiens
uuagcagggauucucucauc

SEQ ID NO: 1985335 - RNA, 23 nt, Homo sapiens
aagaaguuguuugaggcaaauua

SEQ ID NO: 1985336 - RNA, 15 nt, Homo sapiens
cauacacaugugcac

SEQ ID NO: 1985337 - RNA, 22 nt, Homo sapiens
cagggcagccccacaacuuuaa

SEQ ID NO: 1985338 - RNA, 18 nt, Homo sapiens
uucuacagccucagaaac

SEQ ID NO: 1985339 - RNA, 15 nt, Homo sapiens
uagagacacagagau

SEQ ID NO: 1985340 - RNA, 18 nt, Homo sapiens
uuucuaauuggcaugaag

SEQ ID NO: 1985341 - RNA, 15 nt, Homo sapiens
gucaucuagaauuca

SEQ ID NO: 1985342 - RNA, 19 nt, Homo sapiens
augaaacaccuucucugga

SEQ ID NO: 1985343 - RNA, 15 nt, Homo sapiens
cugagccaaacacac

SEQ ID NO: 1985344 - RNA, 20 nt, Homo sapiens
guaaauuugacagugccaca

SEQ ID NO: 1985345 - RNA, 11 nt, Homo sapiens
uaaaauggagg

SEQ ID NO: 1985346 - RNA, 23 nt, Homo sapiens
auuccagagcacugcuccagugg

SEQ ID NO: 1985347 - RNA, 21 nt, Homo sapiens
augacucaccuugcucugcca

SEQ ID NO: 1985348 - RNA, 18 nt, Homo sapiens
uggcgguggaccaaagga

SEQ ID NO: 1985349 - RNA, 20 nt, Homo sapiens
gcauaccugucucagcuguu

SEQ ID NO: 1985350 - RNA, 18 nt, Homo sapiens
uacauuugaacuauaucc

SEQ ID NO: 1985351 - RNA, 13 nt, Homo sapiens
ugcugucaugccc

SEQ ID NO: 1985352 - RNA, 12 nt, Homo sapiens
uugauaucugau

SEQ ID NO: 1985353 - RNA, 22 nt, Homo sapiens
ugcucacagccuuucugaggac

SEQ ID NO: 1985354 - RNA, 17 nt, Homo sapiens
ggugacagccgucccaa

SEQ ID NO: 1985355 - RNA, 20 nt, Homo sapiens
acaucuauugcagagacuca

SEQ ID NO: 1985356 - RNA, 22 nt, Homo sapiens
cagccucugaccccuccucacu

SEQ ID NO: 1985357 - RNA, 15 nt, Homo sapiens
acuauguuucuauuc

SEQ ID NO: 1985358 - RNA, 20 nt, Homo sapiens
uguauaguuuugaauccuuu

SEQ ID NO: 1985359 - RNA, 15 nt, Homo sapiens
uucuucugucaucua

SEQ ID NO: 1985360 - RNA, 23 nt, Homo sapiens
uuuaaauuggagaaaagcacuua

SEQ ID NO: 1985361 - RNA, 15 nt, Homo sapiens
gugagucacacucag

SEQ ID NO: 1985362 - RNA, 16 nt, Homo sapiens
ucaccaauaacuucag

SEQ ID NO: 1985363 - RNA, 17 nt, Homo sapiens
ucugggccugcugagga

SEQ ID NO: 1985364 - RNA, 21 nt, Homo sapiens
caugaacaaguuaguuucuca

SEQ ID NO: 1985365 - RNA, 20 nt, Homo sapiens
uuugcaagggaaaagucucu

SEQ ID NO: 1985366 - RNA, 13 nt, Homo sapiens
uauacacauggau

SEQ ID NO: 1985367 - RNA, 22 nt, Homo sapiens
ggaccuuuaaaaagcaggaaau

SEQ ID NO: 1985368 - RNA, 13 nt, Homo sapiens
cccagggugcagg

SEQ ID NO: 1985369 - RNA, 16 nt, Homo sapiens
auggucauauuucaca

SEQ ID NO: 1985370 - RNA, 19 nt, Homo sapiens
ucugcuuagaaauaacaga

SEQ ID NO: 1985371 - RNA, 17 nt, Homo sapiens
gaaacugagaccaaaga

SEQ ID NO: 1985372 - RNA, 22 nt, Homo sapiens
cagaagaaaagacuuaccugaa

SEQ ID NO: 1985373 - RNA, 22 nt, Homo sapiens
gggaucccacuauauugcacag

SEQ ID NO: 1985374 - RNA, 20 nt, Homo sapiens
uuccuguucacucuguuaau

SEQ ID NO: 1985375 - RNA, 13 nt, Homo sapiens
uccuucccacugu

SEQ ID NO: 1985376 - RNA, 18 nt, Homo sapiens
ccucuugcagggucuugc

SEQ ID NO: 1985377 - RNA, 18 nt, Homo sapiens
guaugaaaaugauuuauu

SEQ ID NO: 1985378 - RNA, 20 nt, Homo sapiens
gaagguaacuagaaagugag

SEQ ID NO: 1985379 - RNA, 16 nt, Homo sapiens
uggagccugggcagca

SEQ ID NO: 1985380 - RNA, 14 nt, Homo sapiens
aaauguaucuuuau

SEQ ID NO: 1985381 - RNA, 15 nt, Homo sapiens
uaagucuuucccaau

SEQ ID NO: 1985382 - RNA, 16 nt, Homo sapiens
agaauccccuccaucu

SEQ ID NO: 1985383 - RNA, 14 nt, Homo sapiens
uuucacauaugugu

SEQ ID NO: 1985384 - RNA, 13 nt, Homo sapiens
cuuggcugugagg

SEQ ID NO: 1985385 - RNA, 16 nt, Homo sapiens
ucaacagcaaguguga

SEQ ID NO: 1985386 - RNA, 18 nt, Homo sapiens
uccuucccuucuuugcug

SEQ ID NO: 1985387 - RNA, 17 nt, Homo sapiens
uucugggcuacugccac

SEQ ID NO: 1985388 - RNA, 17 nt, Homo sapiens
uaagauggaagcuucca

SEQ ID NO: 1985389 - RNA, 17 nt, Homo sapiens
ucugggccagaugcugg

SEQ ID NO: 1985390 - RNA, 14 nt, Homo sapiens
ucccaacaccucac

SEQ ID NO: 1985391 - RNA, 22 nt, Homo sapiens
agacagauaccuccaacccugc

SEQ ID NO: 1985392 - RNA, 20 nt, Homo sapiens
aauuuguauaugacugcauu

SEQ ID NO: 1985393 - RNA, 11 nt, Homo sapiens
cugcucuugcc

SEQ ID NO: 1985394 - RNA, 22 nt, Homo sapiens
gaccccuuucccccaccccaga

SEQ ID NO: 1985395 - RNA, 21 nt, Homo sapiens
gcgagcacugugagcaccuga

SEQ ID NO: 1985396 - RNA, 16 nt, Homo sapiens
auuuauauauauaugu

SEQ ID NO: 1985397 - RNA, 13 nt, Homo sapiens
gggacaugaaguu

SEQ ID NO: 1985398 - RNA, 13 nt, Homo sapiens
gguucaugaauau

SEQ ID NO: 1985399 - RNA, 17 nt, Homo sapiens
acuuauccaucuuugaa

SEQ ID NO: 1985400 - RNA, 13 nt, Homo sapiens
uaaugcacuccug

SEQ ID NO: 1985401 - RNA, 20 nt, Homo sapiens
aaacuuagguaagaagauuc

SEQ ID NO: 1985402 - RNA, 18 nt, Homo sapiens
ucagaaauagcuccucaa

SEQ ID NO: 1985403 - RNA, 18 nt, Homo sapiens
guuaaaggaaaagcacaa

SEQ ID NO: 1985404 - RNA, 14 nt, Homo sapiens
ccagcguaucauag

SEQ ID NO: 1985405 - RNA, 19 nt, Homo sapiens
agcuuuuccugauguucca

SEQ ID NO: 1985406 - RNA, 21 nt, Homo sapiens
gaacucaaacgaugugcaaua

SEQ ID NO: 1985407 - RNA, 15 nt, Homo sapiens
cguuugugauugcca

SEQ ID NO: 1985408 - RNA, 16 nt, Homo sapiens
auuugaaauauggucu

SEQ ID NO: 1985409 - RNA, 20 nt, Homo sapiens
ccuaauucuuguagaugcau

SEQ ID NO: 1985410 - RNA, 15 nt, Homo sapiens
gcccacacgugcaua

SEQ ID NO: 1985411 - RNA, 21 nt, Homo sapiens
caccauggucaucaccacccu

SEQ ID NO: 1985412 - RNA, 23 nt, Homo sapiens
gcauccggcaugagggcugagau

SEQ ID NO: 1985413 - RNA, 11 nt, Homo sapiens
aacguguaugu

SEQ ID NO: 1985414 - RNA, 23 nt, Homo sapiens
aaugucuuuuuuuuaaugugcug

SEQ ID NO: 1985415 - RNA, 18 nt, Homo sapiens
agcacuccucccugaugu

SEQ ID NO: 1985416 - RNA, 19 nt, Homo sapiens
ccagcagugccuugugcaa

SEQ ID NO: 1985417 - RNA, 21 nt, Homo sapiens
agcgccaaaacaagccaaaga

SEQ ID NO: 1985418 - RNA, 17 nt, Homo sapiens
ccccgguugcuggucag

SEQ ID NO: 1985419 - RNA, 16 nt, Homo sapiens
guuaugcaagcacaaa

SEQ ID NO: 1985420 - RNA, 23 nt, Homo sapiens
cuaaagugcugggauuacaggcg

SEQ ID NO: 1985421 - RNA, 18 nt, Homo sapiens
gacgcagguguaccuccc

SEQ ID NO: 1985422 - RNA, 21 nt, Homo sapiens
agugaaaaucuuggagacccu

SEQ ID NO: 1985423 - RNA, 13 nt, Homo sapiens
acccacagcugca

SEQ ID NO: 1985424 - RNA, 18 nt, Homo sapiens
aucuucccuuuauuacaa

SEQ ID NO: 1985425 - RNA, 15 nt, Homo sapiens
acaucagcaagacuu

SEQ ID NO: 1985426 - RNA, 20 nt, Homo sapiens
gagccgagaucgugccauug

SEQ ID NO: 1985427 - RNA, 14 nt, Homo sapiens
ucugagucaucaaa

SEQ ID NO: 1985428 - RNA, 15 nt, Homo sapiens
gcugggagcuucucu

SEQ ID NO: 1985429 - RNA, 16 nt, Homo sapiens
auuauuuuccagauaa

SEQ ID NO: 1985430 - RNA, 18 nt, Homo sapiens
cugagcaaacaaaaccac

SEQ ID NO: 1985431 - RNA, 19 nt, Homo sapiens
uaaaacuacauggucaaca

SEQ ID NO: 1985432 - RNA, 14 nt, Homo sapiens
ugucauacagagaa

SEQ ID NO: 1985433 - RNA, 13 nt, Homo sapiens
caccucagggcau

SEQ ID NO: 1985434 - RNA, 12 nt, Homo sapiens
ccagugccucuc

SEQ ID NO: 1985435 - RNA, 19 nt, Homo sapiens
aaguaauuguaugugcuug

SEQ ID NO: 1985436 - RNA, 15 nt, Homo sapiens
uaauaauuacuuaau

SEQ ID NO: 1985437 - RNA, 15 nt, Homo sapiens
uagacugagguauaa

SEQ ID NO: 1985438 - RNA, 16 nt, Homo sapiens
gagaccccagucguga

SEQ ID NO: 1985439 - RNA, 13 nt, Homo sapiens
agccgcugugagc

SEQ ID NO: 1985440 - RNA, 18 nt, Homo sapiens
cuuauccuagcacaugcu

SEQ ID NO: 1985441 - RNA, 17 nt, Homo sapiens
acuagauguaugugaau

SEQ ID NO: 1985442 - RNA, 17 nt, Homo sapiens
aguuuuguaaaaacuga

SEQ ID NO: 1985443 - RNA, 20 nt, Homo sapiens
ggauugaauuaaaacagcug

SEQ ID NO: 1985444 - RNA, 16 nt, Homo sapiens
uggaccacagcaugaa

SEQ ID NO: 1985445 - RNA, 12 nt, Homo sapiens
uuugaaccaaaa

SEQ ID NO: 1985446 - RNA, 17 nt, Homo sapiens
cuggcaccgcaguuuug

SEQ ID NO: 1985447 - RNA, 21 nt, Homo sapiens
uuucuuuucuauggagcaaaa

SEQ ID NO: 1985448 - RNA, 16 nt, Homo sapiens
aacaaccugugcccag

SEQ ID NO: 1985449 - RNA, 16 nt, Homo sapiens
auugaaugaugugaua

SEQ ID NO: 1985450 - RNA, 17 nt, Homo sapiens
aucacaguuguguuccu

SEQ ID NO: 1985451 - RNA, 17 nt, Homo sapiens
ucugggccaaguuccuc

SEQ ID NO: 1985452 - RNA, 20 nt, Homo sapiens
aaaugccuucuguuuuccaa

SEQ ID NO: 1985453 - RNA, 17 nt, Homo sapiens
aaaagggaggcucucug

SEQ ID NO: 1985454 - RNA, 13 nt, Homo sapiens
gggagugggagag

SEQ ID NO: 1985455 - RNA, 23 nt, Homo sapiens
uaucuuuaggucuuugccuucca

SEQ ID NO: 1985456 - RNA, 22 nt, Homo sapiens
ucagaacuucugccucuaagcu

SEQ ID NO: 1985457 - RNA, 17 nt, Homo sapiens
cuguggagggugcccag

SEQ ID NO: 1985458 - RNA, 17 nt, Homo sapiens
aaugauggcccauucua

SEQ ID NO: 1985459 - RNA, 17 nt, Homo sapiens
gaaggacagcucuuccc

SEQ ID NO: 1985460 - RNA, 18 nt, Homo sapiens
guagguugcacacuuugg

SEQ ID NO: 1985461 - RNA, 17 nt, Homo sapiens
accuugacuucugccca

SEQ ID NO: 1985462 - RNA, 21 nt, Homo sapiens
auagcaauuccccuacaucaa

SEQ ID NO: 1985463 - RNA, 23 nt, Homo sapiens
ccuugacugaagcgaacaucuuc

SEQ ID NO: 1985464 - RNA, 21 nt, Homo sapiens
aaauuuaauuaaagccuuaag

SEQ ID NO: 1985465 - RNA, 12 nt, Homo sapiens
uacagcacugua

SEQ ID NO: 1985466 - RNA, 20 nt, Homo sapiens
ugauacuuccaagugauaau

SEQ ID NO: 1985467 - RNA, 19 nt, Homo sapiens
uuagaauccgaagggaauu

SEQ ID NO: 1985468 - RNA, 20 nt, Homo sapiens
uggcuuuaguggccaucauu

SEQ ID NO: 1985469 - RNA, 16 nt, Homo sapiens
aagucgugucugucag

SEQ ID NO: 1985470 - RNA, 12 nt, Homo sapiens
gacaacaucuga

SEQ ID NO: 1985471 - RNA, 17 nt, Homo sapiens
ggcccugagccaaaaga

SEQ ID NO: 1985472 - RNA, 13 nt, Homo sapiens
caaguaccucauc

SEQ ID NO: 1985473 - RNA, 17 nt, Homo sapiens
ugcuucuguugaucuca

SEQ ID NO: 1985474 - RNA, 16 nt, Homo sapiens
cugauccauccaucuc

SEQ ID NO: 1985475 - RNA, 16 nt, Homo sapiens
ugacugguuguucaaa

SEQ ID NO: 1985476 - RNA, 23 nt, Homo sapiens
ccagcccuguucugggugcagcu

SEQ ID NO: 1985477 - RNA, 15 nt, Homo sapiens
agccaucuaaugcuu

SEQ ID NO: 1985478 - RNA, 18 nt, Homo sapiens
caggaaaaaaaauucugu

SEQ ID NO: 1985479 - RNA, 23 nt, Homo sapiens
gcagcagcgguggccucuuuuca

SEQ ID NO: 1985480 - RNA, 21 nt, Homo sapiens
aagcagccacgaggugcaaca

SEQ ID NO: 1985481 - RNA, 14 nt, Homo sapiens
gggagaaggcauga

SEQ ID NO: 1985482 - RNA, 14 nt, Homo sapiens
uaaaggacaggcca

SEQ ID NO: 1985483 - RNA, 17 nt, Homo sapiens
uuucccuucucuucuaa

SEQ ID NO: 1985484 - RNA, 15 nt, Homo sapiens
auuuuuaaacaaaga

SEQ ID NO: 1985485 - RNA, 14 nt, Homo sapiens
auuucacagcacca

SEQ ID NO: 1985486 - RNA, 11 nt, Homo sapiens
gacaacccagg

SEQ ID NO: 1985487 - RNA, 14 nt, Homo sapiens
ugggugucugcuaa

SEQ ID NO: 1985488 - RNA, 13 nt, Homo sapiens
cucuccaaacagu

SEQ ID NO: 1985489 - RNA, 16 nt, Homo sapiens
aggcccuucucuccag

SEQ ID NO: 1985490 - RNA, 21 nt, Homo sapiens
guauucuuuuuccaucccuag

SEQ ID NO: 1985491 - RNA, 17 nt, Homo sapiens
auauuaagauucuugac

SEQ ID NO: 1985492 - RNA, 15 nt, Homo sapiens
uuuauuugagacaga

SEQ ID NO: 1985493 - RNA, 18 nt, Homo sapiens
augccuccaagccauuca

SEQ ID NO: 1985494 - RNA, 22 nt, Homo sapiens
uacaguucacagaggucuuuca

SEQ ID NO: 1985495 - RNA, 20 nt, Homo sapiens
augguccauuucaugugauc

SEQ ID NO: 1985496 - RNA, 17 nt, Homo sapiens
ggcugguaacaguucau

SEQ ID NO: 1985497 - RNA, 19 nt, Homo sapiens
aguuuugguucacuauuca

SEQ ID NO: 1985498 - RNA, 11 nt, Homo sapiens
aaauacuucua

SEQ ID NO: 1985499 - RNA, 21 nt, Homo sapiens
agaccugcugagggaccagcc

SEQ ID NO: 1985500 - RNA, 19 nt, Homo sapiens
ggaauuauuuugaauguca

SEQ ID NO: 1985501 - RNA, 14 nt, Homo sapiens
gccagggaaacaaa

SEQ ID NO: 1985502 - RNA, 23 nt, Homo sapiens
ccagcuucauaauuuccaugaua

SEQ ID NO: 1985503 - RNA, 18 nt, Homo sapiens
cuuuucccugcaccacuc

SEQ ID NO: 1985504 - RNA, 22 nt, Homo sapiens
auuuguugggagucacauuugc

SEQ ID NO: 1985505 - RNA, 20 nt, Homo sapiens
aagaaucggcaauguuucaa

SEQ ID NO: 1985506 - RNA, 21 nt, Homo sapiens
ggaaagagcagucagagucca

SEQ ID NO: 1985507 - RNA, 12 nt, Homo sapiens
caauacccaaau

SEQ ID NO: 1985508 - RNA, 13 nt, Homo sapiens
agaugagauuccc

SEQ ID NO: 1985509 - RNA, 20 nt, Homo sapiens
uugucuguuuuuguaacuua

SEQ ID NO: 1985510 - RNA, 15 nt, Homo sapiens
ugaccuuuguccuua

SEQ ID NO: 1985511 - RNA, 17 nt, Homo sapiens
aaccuggaggcuggacc

SEQ ID NO: 1985512 - RNA, 15 nt, Homo sapiens
acuacauuccaaaga

SEQ ID NO: 1985513 - RNA, 19 nt, Homo sapiens
acaacuguggacuccaguu

SEQ ID NO: 1985514 - RNA, 16 nt, Homo sapiens
gaugguccgugcccag

SEQ ID NO: 1985515 - RNA, 17 nt, Homo sapiens
acaaauguuagagccau

SEQ ID NO: 1985516 - RNA, 14 nt, Homo sapiens
uuuauauucaacuc

SEQ ID NO: 1985517 - RNA, 23 nt, Homo sapiens
cagaacccagggcucugccccag

SEQ ID NO: 1985518 - RNA, 13 nt, Homo sapiens
uaguuaaguuaag

SEQ ID NO: 1985519 - RNA, 13 nt, Homo sapiens
ccaaaagaagccc

SEQ ID NO: 1985520 - RNA, 18 nt, Homo sapiens
guggguacaaaaagucaa

SEQ ID NO: 1985521 - RNA, 21 nt, Homo sapiens
aucagggggcaugaagcacau

SEQ ID NO: 1985522 - RNA, 17 nt, Homo sapiens
ccagcuacuuuugccaa

SEQ ID NO: 1985523 - RNA, 16 nt, Homo sapiens
ugugacuaucuuuaug

SEQ ID NO: 1985524 - RNA, 14 nt, Homo sapiens
cagcacugugaugc

SEQ ID NO: 1985525 - RNA, 14 nt, Homo sapiens
agacacugugcaaa

SEQ ID NO: 1985526 - RNA, 16 nt, Homo sapiens
cucauggagucaucuu

SEQ ID NO: 1985527 - RNA, 22 nt, Homo sapiens
caguugacaggucauccuugcc

SEQ ID NO: 1985528 - RNA, 14 nt, Homo sapiens
gcccuuuucaggaa

SEQ ID NO: 1985529 - RNA, 16 nt, Homo sapiens
gauucaaaugcaugau

SEQ ID NO: 1985530 - RNA, 13 nt, Homo sapiens
ugguguguucaag

SEQ ID NO: 1985531 - RNA, 17 nt, Homo sapiens
gguuuauaugcacuuuc

SEQ ID NO: 1985532 - RNA, 18 nt, Homo sapiens
gugcagggaaccgugaua

SEQ ID NO: 1985533 - RNA, 22 nt, Homo sapiens
acaagcaacagcaaaagcccua

SEQ ID NO: 1985534 - RNA, 13 nt, Homo sapiens
cugggcugugagg

SEQ ID NO: 1985535 - RNA, 17 nt, Homo sapiens
ugagacugaaauuuagu

SEQ ID NO: 1985536 - RNA, 19 nt, Homo sapiens
caaaacacucuggaucuua

SEQ ID NO: 1985537 - RNA, 16 nt, Homo sapiens
ugcccagugaccaguc

SEQ ID NO: 1985538 - RNA, 21 nt, Homo sapiens
augagccaaaaugacuuugaa

SEQ ID NO: 1985539 - RNA, 18 nt, Homo sapiens
aguagcugggaugacagg

SEQ ID NO: 1985540 - RNA, 17 nt, Homo sapiens
gcucacauucugagaaa

SEQ ID NO: 1985541 - RNA, 18 nt, Homo sapiens
ccaaacugggggcucugu

SEQ ID NO: 1985542 - RNA, 19 nt, Homo sapiens
aacccagaagauguauuca

SEQ ID NO: 1985543 - RNA, 15 nt, Homo sapiens
uucugcguguguaua

SEQ ID NO: 1985544 - RNA, 21 nt, Homo sapiens
uaagaaacuagcagauuugua

SEQ ID NO: 1985545 - RNA, 19 nt, Homo sapiens
ugacccaacugauccugcu

SEQ ID NO: 1985546 - RNA, 19 nt, Homo sapiens
aggaugugauuguggaaug

SEQ ID NO: 1985547 - RNA, 15 nt, Homo sapiens
uguuuuaacauuauu

SEQ ID NO: 1985548 - RNA, 14 nt, Homo sapiens
ccauaggugcaguu

SEQ ID NO: 1985549 - RNA, 17 nt, Homo sapiens
ggccuucugaacuccau

SEQ ID NO: 1985550 - RNA, 21 nt, Homo sapiens
gggaaggaggccaagcagugc

SEQ ID NO: 1985551 - RNA, 15 nt, Homo sapiens
uuuuacuacaguaaa

SEQ ID NO: 1985552 - RNA, 15 nt, Homo sapiens
gggcaagucauuguc

SEQ ID NO: 1985553 - RNA, 13 nt, Homo sapiens
cucugcacauguc

SEQ ID NO: 1985554 - RNA, 10 nt, Homo sapiens
ucagagccag

SEQ ID NO: 1985555 - RNA, 17 nt, Homo sapiens
ugguacugaaaaugaga

SEQ ID NO: 1985556 - RNA, 14 nt, Homo sapiens
accugccuggugca

SEQ ID NO: 1985557 - RNA, 11 nt, Homo sapiens
uauuuugauca

SEQ ID NO: 1985558 - RNA, 23 nt, Homo sapiens
gcucugcaccccucugcccucau

SEQ ID NO: 1985559 - RNA, 15 nt, Homo sapiens
gggcacuggcccagg

SEQ ID NO: 1985560 - RNA, 18 nt, Homo sapiens
acauauuuuuauacuuua

SEQ ID NO: 1985561 - RNA, 13 nt, Homo sapiens
uucugcuguucuu

SEQ ID NO: 1985562 - RNA, 19 nt, Homo sapiens
ugugguaggccuuuuaaca

SEQ ID NO: 1985563 - RNA, 16 nt, Homo sapiens
aguaaguagaugccug

SEQ ID NO: 1985564 - RNA, 18 nt, Homo sapiens
agaucuauguacuguaau

SEQ ID NO: 1985565 - RNA, 16 nt, Homo sapiens
auacuuguauucccuu

SEQ ID NO: 1985566 - RNA, 22 nt, Homo sapiens
gaaaguguguauuuaacucugu

SEQ ID NO: 1985567 - RNA, 17 nt, Homo sapiens
uccucacuuucucuugu

SEQ ID NO: 1985568 - RNA, 18 nt, Homo sapiens
cagucucccgaguagcug

SEQ ID NO: 1985569 - RNA, 20 nt, Homo sapiens
cagaaggaaaaaaacaugaa

SEQ ID NO: 1985570 - RNA, 22 nt, Homo sapiens
ccggggcauuugggcacuguag

SEQ ID NO: 1985571 - RNA, 18 nt, Homo sapiens
aauagcauuugccacuua

SEQ ID NO: 1985572 - RNA, 16 nt, Homo sapiens
ccaggcugucaggggc

SEQ ID NO: 1985573 - RNA, 16 nt, Homo sapiens
gucaguagugccagaa

SEQ ID NO: 1985574 - RNA, 18 nt, Homo sapiens
aguuggaagugugugauc

SEQ ID NO: 1985575 - RNA, 21 nt, Homo sapiens
aggcaggaacaaacagggcug

SEQ ID NO: 1985576 - RNA, 15 nt, Homo sapiens
auacuggucucaggc

SEQ ID NO: 1985577 - RNA, 18 nt, Homo sapiens
uggacauuuuuucaguca

SEQ ID NO: 1985578 - RNA, 17 nt, Homo sapiens
uaacuuuuguaagacaa

SEQ ID NO: 1985579 - RNA, 21 nt, Homo sapiens
agccucucucggucaacagca

SEQ ID NO: 1985580 - RNA, 23 nt, Homo sapiens
cugcccgcccgcccgcauagcac

SEQ ID NO: 1985581 - RNA, 17 nt, Homo sapiens
accauauuuuauuguau

SEQ ID NO: 1985582 - RNA, 15 nt, Homo sapiens
cugacaaaagggaca

SEQ ID NO: 1985583 - RNA, 20 nt, Homo sapiens
ucuggcuucccuaaacugca

SEQ ID NO: 1985584 - RNA, 19 nt, Homo sapiens
aauauaagaccucuggcau

SEQ ID NO: 1985585 - RNA, 13 nt, Homo sapiens
acauucacugagu

SEQ ID NO: 1985586 - RNA, 12 nt, Homo sapiens
ucuuuucuugga

SEQ ID NO: 1985587 - RNA, 19 nt, Homo sapiens
uccugcaggugucuaucca

SEQ ID NO: 1985588 - RNA, 16 nt, Homo sapiens
ggcagaauggugggcu

SEQ ID NO: 1985589 - RNA, 17 nt, Homo sapiens
uaagaaaugaacaaaag

SEQ ID NO: 1985590 - RNA, 17 nt, Homo sapiens
ucacgaguucaggagau

SEQ ID NO: 1985591 - RNA, 12 nt, Homo sapiens
auaugugccaau

SEQ ID NO: 1985592 - RNA, 12 nt, Homo sapiens
auuagugccaua

SEQ ID NO: 1985593 - RNA, 13 nt, Homo sapiens
gcuuauauucaac

SEQ ID NO: 1985594 - RNA, 19 nt, Homo sapiens
aucagauaauuaugcuuuu

SEQ ID NO: 1985595 - RNA, 11 nt, Homo sapiens
uuguuuuggac

SEQ ID NO: 1985596 - RNA, 22 nt, Homo sapiens
uaugacucaccuugcucugcca

SEQ ID NO: 1985597 - RNA, 19 nt, Homo sapiens
gcauuuuucuaaugggcua

SEQ ID NO: 1985598 - RNA, 10 nt, Homo sapiens
agaagccagu

SEQ ID NO: 1985599 - RNA, 16 nt, Homo sapiens
uuccuccagccaccuc

SEQ ID NO: 1985600 - RNA, 21 nt, Homo sapiens
gcaguuucucuccaacucccu

SEQ ID NO: 1985601 - RNA, 14 nt, Homo sapiens
gagacucagugcag

SEQ ID NO: 1985602 - RNA, 22 nt, Homo sapiens
aguggucaagcccuugcccaga

SEQ ID NO: 1985603 - RNA, 17 nt, Homo sapiens
auuuggugguacuuuau

SEQ ID NO: 1985604 - RNA, 18 nt, Homo sapiens
cucaguuacaagugcagg

SEQ ID NO: 1985605 - RNA, 13 nt, Homo sapiens
gauuuagcuuguu

SEQ ID NO: 1985606 - RNA, 15 nt, Homo sapiens
auuuaggaguauuau

SEQ ID NO: 1985607 - RNA, 16 nt, Homo sapiens
auaugaaaaucuccau

SEQ ID NO: 1985608 - RNA, 17 nt, Homo sapiens
uuuucucacugugccaa

SEQ ID NO: 1985609 - RNA, 17 nt, Homo sapiens
uguauucucuuccucau

SEQ ID NO: 1985610 - RNA, 20 nt, Homo sapiens
agaaggggagaagucagcua

SEQ ID NO: 1985611 - RNA, 13 nt, Homo sapiens
gcuauuucugggu

SEQ ID NO: 1985612 - RNA, 19 nt, Homo sapiens
gcauuuugguuuuuccuca

SEQ ID NO: 1985613 - RNA, 20 nt, Homo sapiens
ccuugcauccaucugggcua

SEQ ID NO: 1985614 - RNA, 17 nt, Homo sapiens
aggaggcugcaugcucu

SEQ ID NO: 1985615 - RNA, 16 nt, Homo sapiens
ucccuaaaauacuuau

SEQ ID NO: 1985616 - RNA, 14 nt, Homo sapiens
uuaagaaguacaau

SEQ ID NO: 1985617 - RNA, 12 nt, Homo sapiens
cauccuuccuau

SEQ ID NO: 1985618 - RNA, 17 nt, Homo sapiens
agccuagcccuucucuc

SEQ ID NO: 1985619 - RNA, 16 nt, Homo sapiens
aacggauaagaaucua

SEQ ID NO: 1985620 - RNA, 14 nt, Homo sapiens
gucaucugcuccuu

SEQ ID NO: 1985621 - RNA, 14 nt, Homo sapiens
gcacacugccaaau

SEQ ID NO: 1985622 - RNA, 23 nt, Homo sapiens
ugaggaucagagcguuuguuccc

SEQ ID NO: 1985623 - RNA, 17 nt, Homo sapiens
gccuccucagugaaggu

SEQ ID NO: 1985624 - RNA, 21 nt, Homo sapiens
aaguguccccuauggggaugg

SEQ ID NO: 1985625 - RNA, 14 nt, Homo sapiens
aaaggaacucuaga

SEQ ID NO: 1985626 - RNA, 20 nt, Homo sapiens
guacccucgcaugacuguua

SEQ ID NO: 1985627 - RNA, 15 nt, Homo sapiens
gcccagcacaggaau

SEQ ID NO: 1985628 - RNA, 22 nt, Homo sapiens
ccaacgcgaaaccaauuccuca

SEQ ID NO: 1985629 - RNA, 20 nt, Homo sapiens
gccuuccccugggcccugac

SEQ ID NO: 1985630 - RNA, 17 nt, Homo sapiens
guucucuccccuugcac

SEQ ID NO: 1985631 - RNA, 23 nt, Homo sapiens
caguggcauucacaucucaugua

SEQ ID NO: 1985632 - RNA, 20 nt, Homo sapiens
ugaaacuauuuacaaugugu

SEQ ID NO: 1985633 - RNA, 18 nt, Homo sapiens
auucaaacuuuuauuagc

SEQ ID NO: 1985634 - RNA, 24 nt, Homo sapiens
cagggaaaugggcagacugaacca

SEQ ID NO: 1985635 - RNA, 22 nt, Homo sapiens
aaagggauguuauuauccuugg

SEQ ID NO: 1985636 - RNA, 19 nt, Homo sapiens
caggaugcuggggcacuuu

SEQ ID NO: 1985637 - RNA, 18 nt, Homo sapiens
caugaaaggaagaguuau

SEQ ID NO: 1985638 - RNA, 19 nt, Homo sapiens
cauuccacacagaaugcaa

SEQ ID NO: 1985639 - RNA, 15 nt, Homo sapiens
acuaagagucucuau

SEQ ID NO: 1985640 - RNA, 22 nt, Homo sapiens
ugaaaaauaguguguccaugca

SEQ ID NO: 1985641 - RNA, 17 nt, Homo sapiens
gauccuguugggaaaga

SEQ ID NO: 1985642 - RNA, 17 nt, Homo sapiens
auuauaaacaaccuaga

SEQ ID NO: 1985643 - RNA, 20 nt, Homo sapiens
uagaggauauugggucucag

SEQ ID NO: 1985644 - RNA, 11 nt, Homo sapiens
uugaagccaaa

SEQ ID NO: 1985645 - RNA, 18 nt, Homo sapiens
aggccuggccagaugcac

SEQ ID NO: 1985646 - RNA, 16 nt, Homo sapiens
cagaccaccuuucaca

SEQ ID NO: 1985647 - RNA, 19 nt, Homo sapiens
cuuaucaacauuuguucca

SEQ ID NO: 1985648 - RNA, 17 nt, Homo sapiens
cuucagcagcgugcaau

SEQ ID NO: 1985649 - RNA, 18 nt, Homo sapiens
cuuaaggacaaagugcca

SEQ ID NO: 1985650 - RNA, 13 nt, Homo sapiens
gcccuuccagugg

SEQ ID NO: 1985651 - RNA, 14 nt, Homo sapiens
ugaggacuucacaa

SEQ ID NO: 1985652 - RNA, 23 nt, Homo sapiens
ugacagagugccaacuucuuuca

SEQ ID NO: 1985653 - RNA, 17 nt, Homo sapiens
caacacuguacacauaa

SEQ ID NO: 1985654 - RNA, 20 nt, Homo sapiens
uaugaagaauacccaggaag

SEQ ID NO: 1985655 - RNA, 23 nt, Homo sapiens
ggagagguuugucaacacaaaga

SEQ ID NO: 1985656 - RNA, 20 nt, Homo sapiens
auccacagaaccuuugucaa

SEQ ID NO: 1985657 - RNA, 13 nt, Homo sapiens
gcuacugcacucu

SEQ ID NO: 1985658 - RNA, 18 nt, Homo sapiens
cacacaaaugcagacaca

SEQ ID NO: 1985659 - RNA, 22 nt, Homo sapiens
ggagccggccaccagaugcuga

SEQ ID NO: 1985660 - RNA, 14 nt, Homo sapiens
aaccuuacaugugu

SEQ ID NO: 1985661 - RNA, 20 nt, Homo sapiens
caagcgacgacagaugcuaa

SEQ ID NO: 1985662 - RNA, 17 nt, Homo sapiens
cugagcacccgcugaca

SEQ ID NO: 1985663 - RNA, 12 nt, Homo sapiens
aaugacagaucc

SEQ ID NO: 1985664 - RNA, 17 nt, Homo sapiens
guuuuugauaaaguaau

SEQ ID NO: 1985665 - RNA, 13 nt, Homo sapiens
caauauaaaugga

SEQ ID NO: 1985666 - RNA, 17 nt, Homo sapiens
ggccuuagugggccagg

SEQ ID NO: 1985667 - RNA, 20 nt, Homo sapiens
gagaauuuccuuacucuuga

SEQ ID NO: 1985668 - RNA, 16 nt, Homo sapiens
gggccugcuccagacc

SEQ ID NO: 1985669 - RNA, 13 nt, Homo sapiens
uguccguccugcu

SEQ ID NO: 1985670 - RNA, 16 nt, Homo sapiens
aucgcugccuugccau

SEQ ID NO: 1985671 - RNA, 19 nt, Homo sapiens
ucaccuuugucagaccaua

SEQ ID NO: 1985672 - RNA, 16 nt, Homo sapiens
cuguguucuaugcaaa

SEQ ID NO: 1985673 - RNA, 15 nt, Homo sapiens
cauuuucuguuccag

SEQ ID NO: 1985674 - RNA, 17 nt, Homo sapiens
aaucauuuugugucuca

SEQ ID NO: 1985675 - RNA, 18 nt, Homo sapiens
cauuguuaugcacuuuuc

SEQ ID NO: 1985676 - RNA, 19 nt, Homo sapiens
uggcuacacacaaaccagu

SEQ ID NO: 1985677 - RNA, 15 nt, Homo sapiens
aauauauuuuaucug

SEQ ID NO: 1985678 - RNA, 14 nt, Homo sapiens
ugcaaaugacuguc

SEQ ID NO: 1985679 - RNA, 20 nt, Homo sapiens
ggaccuugggaucagaucaa

SEQ ID NO: 1985680 - RNA, 17 nt, Homo sapiens
uaugcuggacugcauuc

SEQ ID NO: 1985681 - RNA, 18 nt, Homo sapiens
gaaacuagauaauuucaa

SEQ ID NO: 1985682 - RNA, 15 nt, Homo sapiens
augugcuuguuagcu

SEQ ID NO: 1985683 - RNA, 18 nt, Homo sapiens
cuuagugauaaaacuggg

SEQ ID NO: 1985684 - RNA, 18 nt, Homo sapiens
acugcagccucgaccucc

SEQ ID NO: 1985685 - RNA, 19 nt, Homo sapiens
aaauguauuuugacacugg

SEQ ID NO: 1985686 - RNA, 17 nt, Homo sapiens
gccccaaaguugcucac

SEQ ID NO: 1985687 - RNA, 19 nt, Homo sapiens
gcucccucuuggucuuccc

SEQ ID NO: 1985688 - RNA, 21 nt, Homo sapiens
uuugacgacagugcauuugcc

SEQ ID NO: 1985689 - RNA, 18 nt, Homo sapiens
cuuaauugugaacagcca

SEQ ID NO: 1985690 - RNA, 19 nt, Homo sapiens
uaggugggauuacaggugc

SEQ ID NO: 1985691 - RNA, 22 nt, Homo sapiens
cuccaaggauccucuccacucc

SEQ ID NO: 1985692 - RNA, 12 nt, Homo sapiens
gacuuggcacuu

SEQ ID NO: 1985693 - RNA, 12 nt, Homo sapiens
uuguaacuaaua

SEQ ID NO: 1985694 - RNA, 20 nt, Homo sapiens
aggugggcagaucacuggag

SEQ ID NO: 1985695 - RNA, 20 nt, Homo sapiens
ucaucuccagcuaacugugg

SEQ ID NO: 1985696 - RNA, 19 nt, Homo sapiens
cuggucccuucaguaucuu

SEQ ID NO: 1985697 - RNA, 23 nt, Homo sapiens
uaaaauccuaagacacaaaugca

SEQ ID NO: 1985698 - RNA, 21 nt, Homo sapiens
gaaaagaaaccagagucaaau

SEQ ID NO: 1985699 - RNA, 23 nt, Homo sapiens
aacacuaaugaggaaacugcacu

SEQ ID NO: 1985700 - RNA, 22 nt, Homo sapiens
auggauuaaauggcaccuguau

SEQ ID NO: 1985701 - RNA, 19 nt, Homo sapiens
acuccuauggucacagacu

SEQ ID NO: 1985702 - RNA, 22 nt, Homo sapiens
aagcucuucuucccagcacuau

SEQ ID NO: 1985703 - RNA, 13 nt, Homo sapiens
auagagauaugca

SEQ ID NO: 1985704 - RNA, 16 nt, Homo sapiens
uaagaugccaugugca

SEQ ID NO: 1985705 - RNA, 14 nt, Homo sapiens
cugaagagguugaa

SEQ ID NO: 1985706 - RNA, 20 nt, Homo sapiens
uaguuuuacccuauaucuau

SEQ ID NO: 1985707 - RNA, 16 nt, Homo sapiens
cuguccugcucacguc

SEQ ID NO: 1985708 - RNA, 14 nt, Homo sapiens
ucauuuugcaacuu

SEQ ID NO: 1985709 - RNA, 14 nt, Homo sapiens
caggaacucuggac

SEQ ID NO: 1985710 - RNA, 16 nt, Homo sapiens
augaaauuaaccauuu

SEQ ID NO: 1985711 - RNA, 15 nt, Homo sapiens
ugccaaagaaagugg

SEQ ID NO: 1985712 - RNA, 22 nt, Homo sapiens
gaauuucaucucaucaggcaaa

SEQ ID NO: 1985713 - RNA, 23 nt, Homo sapiens
caugagggcagaggugcuaccug

SEQ ID NO: 1985714 - RNA, 23 nt, Homo sapiens
cucccaagguccucucaguucuc

SEQ ID NO: 1985715 - RNA, 17 nt, Homo sapiens
gaaauugcauauaugua

SEQ ID NO: 1985716 - RNA, 21 nt, Homo sapiens
uauauugauaacagcacugac

SEQ ID NO: 1985717 - RNA, 18 nt, Homo sapiens
ccucuacuuaaugagaua

SEQ ID NO: 1985718 - RNA, 20 nt, Homo sapiens
gcgccacccgggcaaggguc

SEQ ID NO: 1985719 - RNA, 18 nt, Homo sapiens
aaucugggauguacuguu

SEQ ID NO: 1985720 - RNA, 19 nt, Homo sapiens
uauauguauaucacauucc

SEQ ID NO: 1985721 - RNA, 19 nt, Homo sapiens
gauucauauaaccacaacu

SEQ ID NO: 1985722 - RNA, 19 nt, Homo sapiens
auuauacuuacuucuggca

SEQ ID NO: 1985723 - RNA, 17 nt, Homo sapiens
uaccccaccucaugccu

SEQ ID NO: 1985724 - RNA, 18 nt, Homo sapiens
uuagcauugggugcaaau

SEQ ID NO: 1985725 - RNA, 19 nt, Homo sapiens
uuugucccaucgguagcuu

SEQ ID NO: 1985726 - RNA, 18 nt, Homo sapiens
aauguuaauggucaaugc

SEQ ID NO: 1985727 - RNA, 15 nt, Homo sapiens
aggacaugaacagac

SEQ ID NO: 1985728 - RNA, 21 nt, Homo sapiens
uuuugaagaggccuaagucaa

SEQ ID NO: 1985729 - RNA, 20 nt, Homo sapiens
guaucuaccaucuaaucuau

SEQ ID NO: 1985730 - RNA, 14 nt, Homo sapiens
cgugacacaugcuc

SEQ ID NO: 1985731 - RNA, 18 nt, Homo sapiens
ccuuaauucuuaccucau

SEQ ID NO: 1985732 - RNA, 16 nt, Homo sapiens
ucaugaaagcaucuga

SEQ ID NO: 1985733 - RNA, 16 nt, Homo sapiens
uccugugggccucaag

SEQ ID NO: 1985734 - RNA, 16 nt, Homo sapiens
ugaagaaaggaacuga

SEQ ID NO: 1985735 - RNA, 20 nt, Homo sapiens
aacuuagaucaucagucacc

SEQ ID NO: 1985736 - RNA, 15 nt, Homo sapiens
acagaaaacgguuaa

SEQ ID NO: 1985737 - RNA, 16 nt, Homo sapiens
acuuaccuacugggga

SEQ ID NO: 1985738 - RNA, 16 nt, Homo sapiens
cagugcauuugccuug

SEQ ID NO: 1985739 - RNA, 22 nt, Homo sapiens
acauuucauugucuuagucaaa

SEQ ID NO: 1985740 - RNA, 20 nt, Homo sapiens
cagaggcugcaaggauucag

SEQ ID NO: 1985741 - RNA, 16 nt, Homo sapiens
ucaauguaguuuucca

SEQ ID NO: 1985742 - RNA, 15 nt, Homo sapiens
augccuuaagcagaa

SEQ ID NO: 1985743 - RNA, 21 nt, Homo sapiens
gccuccucuguccagggcccu

SEQ ID NO: 1985744 - RNA, 14 nt, Homo sapiens
uaggccacacagca

SEQ ID NO: 1985745 - RNA, 16 nt, Homo sapiens
ccuucaaauccugcca

SEQ ID NO: 1985746 - RNA, 23 nt, Homo sapiens
aaagccagcauuuccucagucuc

SEQ ID NO: 1985747 - RNA, 23 nt, Homo sapiens
uccagagguauuccucucuuaaa

SEQ ID NO: 1985748 - RNA, 20 nt, Homo sapiens
aaccucgaagcuguucucug

SEQ ID NO: 1985749 - RNA, 18 nt, Homo sapiens
gcugcaggaaaagcaaaa

SEQ ID NO: 1985750 - RNA, 17 nt, Homo sapiens
uggcugauggaguaaau

SEQ ID NO: 1985751 - RNA, 15 nt, Homo sapiens
uaccucugacaucaa

SEQ ID NO: 1985752 - RNA, 17 nt, Homo sapiens
cuaccuagaaguaagaa

SEQ ID NO: 1985753 - RNA, 15 nt, Homo sapiens
cagacgucucaagac

SEQ ID NO: 1985754 - RNA, 22 nt, Homo sapiens
auaauuuuccuuuuucauguaa

SEQ ID NO: 1985755 - RNA, 19 nt, Homo sapiens
gggagucagucaugucacu

SEQ ID NO: 1985756 - RNA, 14 nt, Homo sapiens
uguuauucuugccc

SEQ ID NO: 1985757 - RNA, 18 nt, Homo sapiens
ucccauugcaucaccucu

SEQ ID NO: 1985758 - RNA, 20 nt, Homo sapiens
ggauaccccaaaguccaggc

SEQ ID NO: 1985759 - RNA, 16 nt, Homo sapiens
gacauggaauuaccuu

SEQ ID NO: 1985760 - RNA, 16 nt, Homo sapiens
gccugccaugggccag

SEQ ID NO: 1985761 - RNA, 17 nt, Homo sapiens
caaucagagagcucacu

SEQ ID NO: 1985762 - RNA, 17 nt, Homo sapiens
cacaugcucaaugacuc

SEQ ID NO: 1985763 - RNA, 20 nt, Homo sapiens
aaacauuuggcauuccugaa

SEQ ID NO: 1985764 - RNA, 17 nt, Homo sapiens
uagcaggcaaugcugua

SEQ ID NO: 1985765 - RNA, 22 nt, Homo sapiens
ccccaggaaggccacagugcug

SEQ ID NO: 1985766 - RNA, 12 nt, Homo sapiens
uuguucucagaa

SEQ ID NO: 1985767 - RNA, 18 nt, Homo sapiens
gccagccccugccucgag

SEQ ID NO: 1985768 - RNA, 19 nt, Homo sapiens
caggccuuaccgcucuguu

SEQ ID NO: 1985769 - RNA, 22 nt, Homo sapiens
gcagaaaaccuaccacauucac

SEQ ID NO: 1985770 - RNA, 22 nt, Homo sapiens
gcuaauuauuuuagcacaaaga

SEQ ID NO: 1985771 - RNA, 17 nt, Homo sapiens
ucucaugugcuuuguag

SEQ ID NO: 1985772 - RNA, 18 nt, Homo sapiens
ucuucucuauuucuggau

SEQ ID NO: 1985773 - RNA, 16 nt, Homo sapiens
auaugaaucugcucac

SEQ ID NO: 1985774 - RNA, 20 nt, Homo sapiens
uguguugccaugugugcuga

SEQ ID NO: 1985775 - RNA, 15 nt, Homo sapiens
acucugcucucagga

SEQ ID NO: 1985776 - RNA, 22 nt, Homo sapiens
agggccccucucuccacauucc

SEQ ID NO: 1985777 - RNA, 17 nt, Homo sapiens
cuaaguuauuuacuuuu

SEQ ID NO: 1985778 - RNA, 18 nt, Homo sapiens
aacaggcucaauauuccu

SEQ ID NO: 1985779 - RNA, 22 nt, Homo sapiens
uacuauuaagcaagaaugcagu

SEQ ID NO: 1985780 - RNA, 15 nt, Homo sapiens
guuuucacuugucuc

SEQ ID NO: 1985781 - RNA, 19 nt, Homo sapiens
gcugauuuacuaacaguaa

SEQ ID NO: 1985782 - RNA, 16 nt, Homo sapiens
uccuagccccaaacca

SEQ ID NO: 1985783 - RNA, 15 nt, Homo sapiens
ggauuuaugacauua

SEQ ID NO: 1985784 - RNA, 15 nt, Homo sapiens
uacauaauugauuaa

SEQ ID NO: 1985785 - RNA, 14 nt, Homo sapiens
uaccugggaccuca

SEQ ID NO: 1985786 - RNA, 18 nt, Homo sapiens
caaauucuuuaguacuca

SEQ ID NO: 1985787 - RNA, 15 nt, Homo sapiens
uaauaugugccuuaa

SEQ ID NO: 1985788 - RNA, 16 nt, Homo sapiens
uggucugugugugaca

SEQ ID NO: 1985789 - RNA, 17 nt, Homo sapiens
aggccauggugcacaaa

SEQ ID NO: 1985790 - RNA, 16 nt, Homo sapiens
ucccaaagugcuggga

SEQ ID NO: 1985791 - RNA, 22 nt, Homo sapiens
cgugauagaagaaaagcacugg

SEQ ID NO: 1985792 - RNA, 21 nt, Homo sapiens
uauauccgccuggcauuucac

SEQ ID NO: 1985793 - RNA, 19 nt, Homo sapiens
uccuugaagcuuguaucug

SEQ ID NO: 1985794 - RNA, 11 nt, Homo sapiens
auaguguaaac

SEQ ID NO: 1985795 - RNA, 15 nt, Homo sapiens
acuucaaauguguaa

SEQ ID NO: 1985796 - RNA, 17 nt, Homo sapiens
aucucaaaguguacaaa

SEQ ID NO: 1985797 - RNA, 20 nt, Homo sapiens
caaguaaaaggaaaugcucc

SEQ ID NO: 1985798 - RNA, 23 nt, Homo sapiens
uuugaaaaaaagaaagcauuugu

SEQ ID NO: 1985799 - RNA, 14 nt, Homo sapiens
auaacagguuuaaa

SEQ ID NO: 1985800 - RNA, 16 nt, Homo sapiens
augcuacgugugauuu

SEQ ID NO: 1985801 - RNA, 16 nt, Homo sapiens
cuugagagcugcugag

SEQ ID NO: 1985802 - RNA, 19 nt, Homo sapiens
cuugaucagugugcuaacc

SEQ ID NO: 1985803 - RNA, 23 nt, Homo sapiens
ggcacauucuuaaauauuuccau

SEQ ID NO: 1985804 - RNA, 20 nt, Homo sapiens
caagccuguugucuuaacau

SEQ ID NO: 1985805 - RNA, 18 nt, Homo sapiens
cacgagugggaaggacuu

SEQ ID NO: 1985806 - RNA, 18 nt, Homo sapiens
caggaagugucuagagga

SEQ ID NO: 1985807 - RNA, 16 nt, Homo sapiens
ccaagugcuaugacag

SEQ ID NO: 1985808 - RNA, 14 nt, Homo sapiens
cacaacacaauaca

SEQ ID NO: 1985809 - RNA, 12 nt, Homo sapiens
uccugaccucaa

SEQ ID NO: 1985810 - RNA, 21 nt, Homo sapiens
agucagggaccugcugcucag

SEQ ID NO: 1985811 - RNA, 18 nt, Homo sapiens
gucagaaauauucuuauu

SEQ ID NO: 1985812 - RNA, 17 nt, Homo sapiens
gauuaauuuuuccauaa

SEQ ID NO: 1985813 - RNA, 17 nt, Homo sapiens
cuaggauacugcugcgu

SEQ ID NO: 1985814 - RNA, 20 nt, Homo sapiens
ggcccuccucagcacggugc

SEQ ID NO: 1985815 - RNA, 23 nt, Homo sapiens
uaauaaacugcaaguucauuuua

SEQ ID NO: 1985816 - RNA, 15 nt, Homo sapiens
uggcauuucuuuaug

SEQ ID NO: 1985817 - RNA, 17 nt, Homo sapiens
aaugugugucugaagac

SEQ ID NO: 1985818 - RNA, 13 nt, Homo sapiens
agcaugugucaug

SEQ ID NO: 1985819 - RNA, 15 nt, Homo sapiens
aggugagagugcaga

SEQ ID NO: 1985820 - RNA, 12 nt, Homo sapiens
caauaugagucu

SEQ ID NO: 1985821 - RNA, 15 nt, Homo sapiens
uuggugaaacccaga

SEQ ID NO: 1985822 - RNA, 20 nt, Homo sapiens
uaaauuuaauauacugcaua

SEQ ID NO: 1985823 - RNA, 13 nt, Homo sapiens
aauacaugcacac

SEQ ID NO: 1985824 - RNA, 19 nt, Homo sapiens
agccucuucgcugaccucg

SEQ ID NO: 1985825 - RNA, 13 nt, Homo sapiens
aaacuuagaucau

SEQ ID NO: 1985826 - RNA, 12 nt, Homo sapiens
cagccaccacug

SEQ ID NO: 1985827 - RNA, 18 nt, Homo sapiens
gugggcggaucacuugag

SEQ ID NO: 1985828 - RNA, 17 nt, Homo sapiens
gacugccaugcuagaca

SEQ ID NO: 1985829 - RNA, 15 nt, Homo sapiens
ugcuuaaucugagga

SEQ ID NO: 1985830 - RNA, 21 nt, Homo sapiens
acugagggcaggaggcuccau

SEQ ID NO: 1985831 - RNA, 18 nt, Homo sapiens
aaaagugucucaaaggag

SEQ ID NO: 1985832 - RNA, 16 nt, Homo sapiens
cacuguguaaccaggu

SEQ ID NO: 1985833 - RNA, 15 nt, Homo sapiens
ggaacagcaggugcc

SEQ ID NO: 1985834 - RNA, 21 nt, Homo sapiens
acaauugcaacagaagcaaaa

SEQ ID NO: 1985835 - RNA, 14 nt, Homo sapiens
gagcaacacaggau

SEQ ID NO: 1985836 - RNA, 17 nt, Homo sapiens
ccuucacggcacuggau

SEQ ID NO: 1985837 - RNA, 23 nt, Homo sapiens
ugccuggccuggggaccaggugc

SEQ ID NO: 1985838 - RNA, 14 nt, Homo sapiens
cccacccgcuccca

SEQ ID NO: 1985839 - RNA, 15 nt, Homo sapiens
aaccaugccagggau

SEQ ID NO: 1985840 - RNA, 17 nt, Homo sapiens
ccaaaccuuaucuccac

SEQ ID NO: 1985841 - RNA, 22 nt, Homo sapiens
uuuuugcccagagaguccagcu

SEQ ID NO: 1985842 - RNA, 13 nt, Homo sapiens
caaauaaacucca

SEQ ID NO: 1985843 - RNA, 19 nt, Homo sapiens
ugccugugugagcaucucu

SEQ ID NO: 1985844 - RNA, 20 nt, Homo sapiens
uugcacuccagccugggcaa

SEQ ID NO: 1985845 - RNA, 15 nt, Homo sapiens
auuguuuugccagug

SEQ ID NO: 1985846 - RNA, 14 nt, Homo sapiens
cucuacugccuugg

SEQ ID NO: 1985847 - RNA, 21 nt, Homo sapiens
acucccuaauuuaugugcuau

SEQ ID NO: 1985848 - RNA, 21 nt, Homo sapiens
uacacucucaaagcaaauaau

SEQ ID NO: 1985849 - RNA, 19 nt, Homo sapiens
ugccagacuggagugcagu

SEQ ID NO: 1985850 - RNA, 17 nt, Homo sapiens
cacauguguuaucuacc

SEQ ID NO: 1985851 - RNA, 15 nt, Homo sapiens
uugauuagacuccua

SEQ ID NO: 1985852 - RNA, 15 nt, Homo sapiens
uugcuaugacuacau

SEQ ID NO: 1985853 - RNA, 15 nt, Homo sapiens
ucacaguuucuucca

SEQ ID NO: 1985854 - RNA, 14 nt, Homo sapiens
uuccccguccccug

SEQ ID NO: 1985855 - RNA, 14 nt, Homo sapiens
uggugggacacugg

SEQ ID NO: 1985856 - RNA, 18 nt, Homo sapiens
agucugugagugcgucug

SEQ ID NO: 1985857 - RNA, 13 nt, Homo sapiens
uucagcaucucac

SEQ ID NO: 1985858 - RNA, 13 nt, Homo sapiens
uccugcaucccuc

SEQ ID NO: 1985859 - RNA, 22 nt, Homo sapiens
gucugguaaauagguauuauau

SEQ ID NO: 1985860 - RNA, 16 nt, Homo sapiens
cuuccacugagucuuu

SEQ ID NO: 1985861 - RNA, 22 nt, Homo sapiens
ucccucccgggggcacugccug

SEQ ID NO: 1985862 - RNA, 13 nt, Homo sapiens
aauccccuguugu

SEQ ID NO: 1985863 - RNA, 19 nt, Homo sapiens
uguuucuaaaacuaugguu

SEQ ID NO: 1985864 - RNA, 17 nt, Homo sapiens
cccacagguguguuucc

SEQ ID NO: 1985865 - RNA, 22 nt, Homo sapiens
cuauaaauggaccauccuugac

SEQ ID NO: 1985866 - RNA, 11 nt, Homo sapiens
cgccagacucg

SEQ ID NO: 1985867 - RNA, 16 nt, Homo sapiens
acaugcccauuacuaa

SEQ ID NO: 1985868 - RNA, 14 nt, Homo sapiens
guucccccagacag

SEQ ID NO: 1985869 - RNA, 15 nt, Homo sapiens
uccgaggccaguacc

SEQ ID NO: 1985870 - RNA, 19 nt, Homo sapiens
gugacacccacaaucccac

SEQ ID NO: 1985871 - RNA, 14 nt, Homo sapiens
agcaauaacauaca

SEQ ID NO: 1985872 - RNA, 13 nt, Homo sapiens
ggcucccaugacc

SEQ ID NO: 1985873 - RNA, 15 nt, Homo sapiens
uuuugccuguaagaa

SEQ ID NO: 1985874 - RNA, 22 nt, Homo sapiens
cuaugaaaagcccacaccuaac

SEQ ID NO: 1985875 - RNA, 16 nt, Homo sapiens
agucaacucuggccag

SEQ ID NO: 1985876 - RNA, 17 nt, Homo sapiens
ugggccccccuugccuc

SEQ ID NO: 1985877 - RNA, 14 nt, Homo sapiens
uucaucucauuaau

SEQ ID NO: 1985878 - RNA, 22 nt, Homo sapiens
caacaaauuaacuagauacaga

SEQ ID NO: 1985879 - RNA, 22 nt, Homo sapiens
ugccccagcuuuaucugucaca

SEQ ID NO: 1985880 - RNA, 20 nt, Homo sapiens
aggaguuuuauauacugugu

SEQ ID NO: 1985881 - RNA, 15 nt, Homo sapiens
auucucgaacugcau

SEQ ID NO: 1985882 - RNA, 17 nt, Homo sapiens
auccguaguucccugaa

SEQ ID NO: 1985883 - RNA, 18 nt, Homo sapiens
gcuguugaagucaccuug

SEQ ID NO: 1985884 - RNA, 15 nt, Homo sapiens
ccugaacacugugac

SEQ ID NO: 1985885 - RNA, 16 nt, Homo sapiens
gaaaauaaaagcacuu

SEQ ID NO: 1985886 - RNA, 20 nt, Homo sapiens
ugguaacugcuuuggucucu

SEQ ID NO: 1985887 - RNA, 19 nt, Homo sapiens
auccuuucaagacagaaag

SEQ ID NO: 1985888 - RNA, 18 nt, Homo sapiens
auuacauugcugccuuug

SEQ ID NO: 1985889 - RNA, 15 nt, Homo sapiens
uuguggugguugaga

SEQ ID NO: 1985890 - RNA, 17 nt, Homo sapiens
gaaaauuguugugcuua

SEQ ID NO: 1985891 - RNA, 15 nt, Homo sapiens
aagacggauccacag

SEQ ID NO: 1985892 - RNA, 17 nt, Homo sapiens
uagaaccuggagccacu

SEQ ID NO: 1985893 - RNA, 13 nt, Homo sapiens
ugcccacaaaaaa

SEQ ID NO: 1985894 - RNA, 15 nt, Homo sapiens
aucaaagacagcauc

SEQ ID NO: 1985895 - RNA, 22 nt, Homo sapiens
gccauaagaggugaucucuggg

SEQ ID NO: 1985896 - RNA, 18 nt, Homo sapiens
ucaucaauggggccaguc

SEQ ID NO: 1985897 - RNA, 18 nt, Homo sapiens
agcagcccugcucugggg

SEQ ID NO: 1985898 - RNA, 17 nt, Homo sapiens
ucuacuccaugcacaua

SEQ ID NO: 1985899 - RNA, 17 nt, Homo sapiens
agauugcuuuugugcau

SEQ ID NO: 1985900 - RNA, 17 nt, Homo sapiens
gauaacaagacuuugac

SEQ ID NO: 1985901 - RNA, 17 nt, Homo sapiens
agacucauacagaaggu

SEQ ID NO: 1985902 - RNA, 14 nt, Homo sapiens
guucauacagguga

SEQ ID NO: 1985903 - RNA, 16 nt, Homo sapiens
acucugcagacugaaa

SEQ ID NO: 1985904 - RNA, 23 nt, Homo sapiens
gaggccaaacacccaagcacaaa

SEQ ID NO: 1985905 - RNA, 24 nt, Homo sapiens
auugcagauucgagucacguccuu

SEQ ID NO: 1985906 - RNA, 23 nt, Homo sapiens
uggaggagcugggcuucugucca

SEQ ID NO: 1985907 - RNA, 23 nt, Homo sapiens
uuuguaauaauaaaaccaaagaa

SEQ ID NO: 1985908 - RNA, 20 nt, Homo sapiens
auaaacugugccaauacaga

SEQ ID NO: 1985909 - RNA, 14 nt, Homo sapiens
cauugccuugccaa

SEQ ID NO: 1985910 - RNA, 20 nt, Homo sapiens
ggcagagcccgguacagggc

SEQ ID NO: 1985911 - RNA, 18 nt, Homo sapiens
caaggcacugacugagca

SEQ ID NO: 1985912 - RNA, 17 nt, Homo sapiens
aaugaaaaggacuuuau

SEQ ID NO: 1985913 - RNA, 16 nt, Homo sapiens
ugaggaggaugcuaaa

SEQ ID NO: 1985914 - RNA, 10 nt, Homo sapiens
ucagucuuca

SEQ ID NO: 1985915 - RNA, 15 nt, Homo sapiens
auuaccucucuugcu

SEQ ID NO: 1985916 - RNA, 14 nt, Homo sapiens
gauguaugcagcua

SEQ ID NO: 1985917 - RNA, 14 nt, Homo sapiens
cagcaauggaugaa

SEQ ID NO: 1985918 - RNA, 22 nt, Homo sapiens
aagcuauguauuuaaauuauca

SEQ ID NO: 1985919 - RNA, 14 nt, Homo sapiens
gccucuuccaggaa

SEQ ID NO: 1985920 - RNA, 18 nt, Homo sapiens
gcccccacgccuccugcc

SEQ ID NO: 1985921 - RNA, 20 nt, Homo sapiens
ugaaucaggggcaaacggag

SEQ ID NO: 1985922 - RNA, 19 nt, Homo sapiens
ucccuggccauccauguga

SEQ ID NO: 1985923 - RNA, 14 nt, Homo sapiens
aauaaauacacaau

SEQ ID NO: 1985924 - RNA, 19 nt, Homo sapiens
cugaagugguugcauucua

SEQ ID NO: 1985925 - RNA, 20 nt, Homo sapiens
agugaauguuaacaugcgca

SEQ ID NO: 1985926 - RNA, 17 nt, Homo sapiens
uuuuacugaaugaucua

SEQ ID NO: 1985927 - RNA, 17 nt, Homo sapiens
cuuauguguuacauuau

SEQ ID NO: 1985928 - RNA, 20 nt, Homo sapiens
ccauguauucauccagaguu

SEQ ID NO: 1985929 - RNA, 20 nt, Homo sapiens
cccuggcuguuguauuacca

SEQ ID NO: 1985930 - RNA, 16 nt, Homo sapiens
uuccucaaagcauuug

SEQ ID NO: 1985931 - RNA, 18 nt, Homo sapiens
cuuagaccugccagccac

SEQ ID NO: 1985932 - RNA, 13 nt, Homo sapiens
ugaagcacaaaaa

SEQ ID NO: 1985933 - RNA, 20 nt, Homo sapiens
gcaggugagaacccugugga

SEQ ID NO: 1985934 - RNA, 15 nt, Homo sapiens
ucuccuugcuaccca

SEQ ID NO: 1985935 - RNA, 18 nt, Homo sapiens
ugggccgaggugacugca

SEQ ID NO: 1985936 - RNA, 18 nt, Homo sapiens
uaaguauuuuccuaagca

SEQ ID NO: 1985937 - RNA, 13 nt, Homo sapiens
uguagucucagcu

SEQ ID NO: 1985938 - RNA, 17 nt, Homo sapiens
gcacaugaauaauuuca

SEQ ID NO: 1985939 - RNA, 19 nt, Homo sapiens
gauuguuuuugcucaaggc

SEQ ID NO: 1985940 - RNA, 21 nt, Homo sapiens
cuguccuuucuagagcacugc

SEQ ID NO: 1985941 - RNA, 14 nt, Homo sapiens
uagguacauuggaa

SEQ ID NO: 1985942 - RNA, 14 nt, Homo sapiens
ccuucuauacaugu

SEQ ID NO: 1985943 - RNA, 16 nt, Homo sapiens
uuugguuucuucauuc

SEQ ID NO: 1985944 - RNA, 23 nt, Homo sapiens
gugugauguuuggauugauaucg

SEQ ID NO: 1985945 - RNA, 16 nt, Homo sapiens
uucuucuguccugaga

SEQ ID NO: 1985946 - RNA, 18 nt, Homo sapiens
agaauggagaggaacaca

SEQ ID NO: 1985947 - RNA, 19 nt, Homo sapiens
cucacaccacaaaucugaa

SEQ ID NO: 1985948 - RNA, 17 nt, Homo sapiens
cagacauguggugggac

SEQ ID NO: 1985949 - RNA, 14 nt, Homo sapiens
gcuuaaaaacucac

SEQ ID NO: 1985950 - RNA, 23 nt, Homo sapiens
caggaaggugccuggccauguca

SEQ ID NO: 1985951 - RNA, 20 nt, Homo sapiens
acauucaccaaccaaagggg

SEQ ID NO: 1985952 - RNA, 16 nt, Homo sapiens
uggaggcaccauuugu

SEQ ID NO: 1985953 - RNA, 21 nt, Homo sapiens
ccccaucaucccagcugcucc

SEQ ID NO: 1985954 - RNA, 20 nt, Homo sapiens
agcaaauggcagaaccaaag

SEQ ID NO: 1985955 - RNA, 22 nt, Homo sapiens
auaaaauaauuauaaauaucau

SEQ ID NO: 1985956 - RNA, 22 nt, Homo sapiens
uauacuuuuuucuuauuuaacu

SEQ ID NO: 1985957 - RNA, 16 nt, Homo sapiens
cuaacguccacuagcu

SEQ ID NO: 1985958 - RNA, 16 nt, Homo sapiens
ugggacaguggaugcc

SEQ ID NO: 1985959 - RNA, 17 nt, Homo sapiens
agugaccuaaccacuua

SEQ ID NO: 1985960 - RNA, 19 nt, Homo sapiens
uguucuuucuuacacaaga

SEQ ID NO: 1985961 - RNA, 20 nt, Homo sapiens
gccuuggugccaccaaaagu

SEQ ID NO: 1985962 - RNA, 22 nt, Homo sapiens
agcuaauggcgaucaucuuugc

SEQ ID NO: 1985963 - RNA, 19 nt, Homo sapiens
agaggauucugucuuccag

SEQ ID NO: 1985964 - RNA, 17 nt, Homo sapiens
ugcugauucaaggcauu

SEQ ID NO: 1985965 - RNA, 21 nt, Homo sapiens
ugggcuggaggcugagcugca

SEQ ID NO: 1985966 - RNA, 18 nt, Homo sapiens
caacgccucacugaaaca

SEQ ID NO: 1985967 - RNA, 20 nt, Homo sapiens
caggcgugagccaccgugcc

SEQ ID NO: 1985968 - RNA, 13 nt, Homo sapiens
uucccucccuauc

SEQ ID NO: 1985969 - RNA, 13 nt, Homo sapiens
ugaugcaauagug

SEQ ID NO: 1985970 - RNA, 15 nt, Homo sapiens
gccuguaacaaugua

SEQ ID NO: 1985971 - RNA, 12 nt, Homo sapiens
gucaugauugcc

SEQ ID NO: 1985972 - RNA, 18 nt, Homo sapiens
ucuugcuguugacauauu

SEQ ID NO: 1985973 - RNA, 15 nt, Homo sapiens
aaaaauauugcuaaa

SEQ ID NO: 1985974 - RNA, 18 nt, Homo sapiens
caccuaauaggcugggag

SEQ ID NO: 1985975 - RNA, 14 nt, Homo sapiens
ggcagccaccagcg

SEQ ID NO: 1985976 - RNA, 18 nt, Homo sapiens
cugaugccuguguacugc

SEQ ID NO: 1985977 - RNA, 15 nt, Homo sapiens
caauaaguucauuaa

SEQ ID NO: 1985978 - RNA, 17 nt, Homo sapiens
auuugacaacaauccaa

SEQ ID NO: 1985979 - RNA, 15 nt, Homo sapiens
aaaccaaguaucaca

SEQ ID NO: 1985980 - RNA, 22 nt, Homo sapiens
uucauagauagauaaguaucag

SEQ ID NO: 1985981 - RNA, 20 nt, Homo sapiens
auucauggaccacuguuucu

SEQ ID NO: 1985982 - RNA, 17 nt, Homo sapiens
uacuugcaguugugaua

SEQ ID NO: 1985983 - RNA, 17 nt, Homo sapiens
uuccuuaguuaucaguc

SEQ ID NO: 1985984 - RNA, 19 nt, Homo sapiens
acagaggugucauccacag

SEQ ID NO: 1985985 - RNA, 18 nt, Homo sapiens
uacucuaugugauuuauu

SEQ ID NO: 1985986 - RNA, 17 nt, Homo sapiens
caagauuguaaguaaau

SEQ ID NO: 1985987 - RNA, 23 nt, Homo sapiens
ccucuugaaugcuuaaaugauca

SEQ ID NO: 1985988 - RNA, 23 nt, Homo sapiens
auauucccccugagcugccaccu

SEQ ID NO: 1985989 - RNA, 17 nt, Homo sapiens
agucccagagcaccuca

SEQ ID NO: 1985990 - RNA, 23 nt, Homo sapiens
agaugacaaaccauaacugacaa

SEQ ID NO: 1985991 - RNA, 21 nt, Homo sapiens
uauaagugagaacaugcagua

SEQ ID NO: 1985992 - RNA, 17 nt, Homo sapiens
guagcucugcugcugau

SEQ ID NO: 1985993 - RNA, 18 nt, Homo sapiens
accuccgccagauccugc

SEQ ID NO: 1985994 - RNA, 15 nt, Homo sapiens
augcauuuagcauga

SEQ ID NO: 1985995 - RNA, 18 nt, Homo sapiens
cucucgacaguauccaca

SEQ ID NO: 1985996 - RNA, 16 nt, Homo sapiens
aauauuuaagugcagu

SEQ ID NO: 1985997 - RNA, 22 nt, Homo sapiens
guacagaauucugcuaccucac

SEQ ID NO: 1985998 - RNA, 19 nt, Homo sapiens
cagcaccaagcauguccca

SEQ ID NO: 1985999 - RNA, 18 nt, Homo sapiens
acuuuguuuaaaccuucc

SEQ ID NO: 1986000 - RNA, 19 nt, Homo sapiens
aaucagcugcugacuggca

SEQ ID NO: 1986001 - RNA, 15 nt, Homo sapiens
uagcucugcugcuga

SEQ ID NO: 1986002 - RNA, 18 nt, Homo sapiens
aauaaaaaaguaacaagg

SEQ ID NO: 1986003 - RNA, 14 nt, Homo sapiens
aguuaucaucucac

SEQ ID NO: 1986004 - RNA, 19 nt, Homo sapiens
cucauucuuuucagcuugu

SEQ ID NO: 1986005 - RNA, 15 nt, Homo sapiens
gagccagcucccucu

SEQ ID NO: 1986006 - RNA, 17 nt, Homo sapiens
guugucaaaacuccacu

SEQ ID NO: 1986007 - RNA, 19 nt, Homo sapiens
cugccugagaauguuacca

SEQ ID NO: 1986008 - RNA, 21 nt, Homo sapiens
auuaaguaaucuuuuuacagu

SEQ ID NO: 1986009 - RNA, 19 nt, Homo sapiens
agcccuggguuuaauguca

SEQ ID NO: 1986010 - RNA, 21 nt, Homo sapiens
cauuggauucaucagcauuug

SEQ ID NO: 1986011 - RNA, 14 nt, Homo sapiens
accucuaacaacaa

SEQ ID NO: 1986012 - RNA, 20 nt, Homo sapiens
caaagaagguuaccaagaag

SEQ ID NO: 1986013 - RNA, 16 nt, Homo sapiens
gauggaccccagcauu

SEQ ID NO: 1986014 - RNA, 15 nt, Homo sapiens
ggaaauuuuaguuau

SEQ ID NO: 1986015 - RNA, 19 nt, Homo sapiens
acauccauguccuaugugu

SEQ ID NO: 1986016 - RNA, 15 nt, Homo sapiens
caauaacuucugacc

SEQ ID NO: 1986017 - RNA, 14 nt, Homo sapiens
guuggagacucagc

SEQ ID NO: 1986018 - RNA, 16 nt, Homo sapiens
ugcuucgucaauggcu

SEQ ID NO: 1986019 - RNA, 18 nt, Homo sapiens
auguuccagacauucucg

SEQ ID NO: 1986020 - RNA, 17 nt, Homo sapiens
ugaagucacacuguaac

SEQ ID NO: 1986021 - RNA, 11 nt, Homo sapiens
uuaaagugaua

SEQ ID NO: 1986022 - RNA, 14 nt, Homo sapiens
gaaugucaguucau

SEQ ID NO: 1986023 - RNA, 20 nt, Homo sapiens
caccgugccugaucugcaca

SEQ ID NO: 1986024 - RNA, 12 nt, Homo sapiens
cuuuugauuugu

SEQ ID NO: 1986025 - RNA, 12 nt, Homo sapiens
ccaaagcacagc

SEQ ID NO: 1986026 - RNA, 22 nt, Homo sapiens
acaugauggagcgcaccugccc

SEQ ID NO: 1986027 - RNA, 16 nt, Homo sapiens
uaccuuucuagccuua

SEQ ID NO: 1986028 - RNA, 17 nt, Homo sapiens
uggcucacucagcacuu

SEQ ID NO: 1986029 - RNA, 19 nt, Homo sapiens
aucaacaacauccacuguu

SEQ ID NO: 1986030 - RNA, 23 nt, Homo sapiens
gcccuauggauuugaaguuugcc

SEQ ID NO: 1986031 - RNA, 17 nt, Homo sapiens
uauaccaaggcaaaaaa

SEQ ID NO: 1986032 - RNA, 19 nt, Homo sapiens
ugcuuguguuuauuacugc

SEQ ID NO: 1986033 - RNA, 20 nt, Homo sapiens
aguuaaacuuuagugcuaca

SEQ ID NO: 1986034 - RNA, 20 nt, Homo sapiens
uugauucugauaaugcucac

SEQ ID NO: 1986035 - RNA, 17 nt, Homo sapiens
ugggcaacuauucauga

SEQ ID NO: 1986036 - RNA, 13 nt, Homo sapiens
uaaccucaucuac

SEQ ID NO: 1986037 - RNA, 13 nt, Homo sapiens
acaccucaaauac

SEQ ID NO: 1986038 - RNA, 14 nt, Homo sapiens
aacacucaguccac

SEQ ID NO: 1986039 - RNA, 23 nt, Homo sapiens
uucuuaagacagagucuugcucu

SEQ ID NO: 1986040 - RNA, 23 nt, Homo sapiens
gaccaaugugugaaguaugcacu

SEQ ID NO: 1986041 - RNA, 14 nt, Homo sapiens
acgaguuacuggau

SEQ ID NO: 1986042 - RNA, 13 nt, Homo sapiens
acauggcuuucag

SEQ ID NO: 1986043 - RNA, 22 nt, Homo sapiens
acuguaaggcaaucauggugcu

SEQ ID NO: 1986044 - RNA, 13 nt, Homo sapiens
uguagcugaugaa

SEQ ID NO: 1986045 - RNA, 22 nt, Homo sapiens
cauauagauuguccuuuugcaa

SEQ ID NO: 1986046 - RNA, 22 nt, Homo sapiens
ucagguuugaggguuugcagaa

SEQ ID NO: 1986047 - RNA, 20 nt, Homo sapiens
cugggaccacaagugugcau

SEQ ID NO: 1986048 - RNA, 18 nt, Homo sapiens
uaauguacacauugcauu

SEQ ID NO: 1986049 - RNA, 17 nt, Homo sapiens
cuguaguuuaugaugca

SEQ ID NO: 1986050 - RNA, 19 nt, Homo sapiens
uaccagcauccacucuccc

SEQ ID NO: 1986051 - RNA, 18 nt, Homo sapiens
gccacuggccaucuccac

SEQ ID NO: 1986052 - RNA, 18 nt, Homo sapiens
aauacuucucaaaccugu

SEQ ID NO: 1986053 - RNA, 20 nt, Homo sapiens
caaugccugccugaacaaag

SEQ ID NO: 1986054 - RNA, 23 nt, Homo sapiens
uuggagcaggggugcugggaccu

SEQ ID NO: 1986055 - RNA, 19 nt, Homo sapiens
ucuuccccuuguguuugaa

SEQ ID NO: 1986056 - RNA, 16 nt, Homo sapiens
gcuacugguuaccugg

SEQ ID NO: 1986057 - RNA, 17 nt, Homo sapiens
acauacacuguauguua

SEQ ID NO: 1986058 - RNA, 21 nt, Homo sapiens
ucacauuguuugcugcuauug

SEQ ID NO: 1986059 - RNA, 18 nt, Homo sapiens
ugugggaaaauggcagaa

SEQ ID NO: 1986060 - RNA, 15 nt, Homo sapiens
ugucagaaacaauga

SEQ ID NO: 1986061 - RNA, 14 nt, Homo sapiens
accagcugcucugc

SEQ ID NO: 1986062 - RNA, 15 nt, Homo sapiens
aucgggagugcacuu

SEQ ID NO: 1986063 - RNA, 14 nt, Homo sapiens
gagccuucugauga

SEQ ID NO: 1986064 - RNA, 14 nt, Homo sapiens
gcuacuaagcacau

SEQ ID NO: 1986065 - RNA, 14 nt, Homo sapiens
ucaugccugaugaa

SEQ ID NO: 1986066 - RNA, 21 nt, Homo sapiens
auuuugggguuguguugucac

SEQ ID NO: 1986067 - RNA, 21 nt, Homo sapiens
acaagaugaaauuccauuugu

SEQ ID NO: 1986068 - RNA, 21 nt, Homo sapiens
ggaggagccggggacucccag

SEQ ID NO: 1986069 - RNA, 16 nt, Homo sapiens
ccuuucaaauuucaca

SEQ ID NO: 1986070 - RNA, 19 nt, Homo sapiens
ugcugcuggaucacagcug

SEQ ID NO: 1986071 - RNA, 15 nt, Homo sapiens
acgcaucacuggggc

SEQ ID NO: 1986072 - RNA, 13 nt, Homo sapiens
ugacugcugugaa

SEQ ID NO: 1986073 - RNA, 15 nt, Homo sapiens
aauccacuauuucca

SEQ ID NO: 1986074 - RNA, 11 nt, Homo sapiens
gcauccuccag

SEQ ID NO: 1986075 - RNA, 21 nt, Homo sapiens
cacccccaacaggaauucuau

SEQ ID NO: 1986076 - RNA, 15 nt, Homo sapiens
cucccauagcaaaga

SEQ ID NO: 1986077 - RNA, 22 nt, Homo sapiens
ggcauaggucucuuugcuuucu

SEQ ID NO: 1986078 - RNA, 16 nt, Homo sapiens
gaauggaggaauccuu

SEQ ID NO: 1986079 - RNA, 13 nt, Homo sapiens
aagaaagaaccaa

SEQ ID NO: 1986080 - RNA, 18 nt, Homo sapiens
ccaaaauacuugcaucca

SEQ ID NO: 1986081 - RNA, 21 nt, Homo sapiens
ggcgaaucauuuguucaaagc

SEQ ID NO: 1986082 - RNA, 19 nt, Homo sapiens
cuugaggcagggucucacu

SEQ ID NO: 1986083 - RNA, 22 nt, Homo sapiens
uaagaaccuuuugagugccuua

SEQ ID NO: 1986084 - RNA, 20 nt, Homo sapiens
auucuuuguauuaccaaagc

SEQ ID NO: 1986085 - RNA, 13 nt, Homo sapiens
ugucaccacaucu

SEQ ID NO: 1986086 - RNA, 12 nt, Homo sapiens
agaucuuuacau

SEQ ID NO: 1986087 - RNA, 22 nt, Homo sapiens
uaaucuggacuccucuguccag

SEQ ID NO: 1986088 - RNA, 23 nt, Homo sapiens
gggcaaagaacugccccaucucc

SEQ ID NO: 1986089 - RNA, 16 nt, Homo sapiens
uacucuuccaucuuuc

SEQ ID NO: 1986090 - RNA, 15 nt, Homo sapiens
gaagccacagacucu

SEQ ID NO: 1986091 - RNA, 13 nt, Homo sapiens
uccacggacucaa

SEQ ID NO: 1986092 - RNA, 19 nt, Homo sapiens
uugaugauuaauucaccuu

SEQ ID NO: 1986093 - RNA, 17 nt, Homo sapiens
uauuugacaacaaucca

SEQ ID NO: 1986094 - RNA, 22 nt, Homo sapiens
uaaaauagacuuacugcaguua

SEQ ID NO: 1986095 - RNA, 16 nt, Homo sapiens
uucacacuguccccca

SEQ ID NO: 1986096 - RNA, 16 nt, Homo sapiens
gucaacauuuccaaaa

SEQ ID NO: 1986097 - RNA, 22 nt, Homo sapiens
auguucuuauuaaaaaucuaac

SEQ ID NO: 1986098 - RNA, 16 nt, Homo sapiens
aagaagauucauuuaa

SEQ ID NO: 1986099 - RNA, 17 nt, Homo sapiens
auuucugggcacuuuuu

SEQ ID NO: 1986100 - RNA, 15 nt, Homo sapiens
guuaggauagcauuu

SEQ ID NO: 1986101 - RNA, 23 nt, Homo sapiens
uaucagccgauaucaacacuugu

SEQ ID NO: 1986102 - RNA, 21 nt, Homo sapiens
ugguuuucacauacacucaaa

SEQ ID NO: 1986103 - RNA, 18 nt, Homo sapiens
gaaaaacugcagucauca

SEQ ID NO: 1986104 - RNA, 15 nt, Homo sapiens
cuaauggacuuucag

SEQ ID NO: 1986105 - RNA, 14 nt, Homo sapiens
uuugauauaacaaa

SEQ ID NO: 1986106 - RNA, 18 nt, Homo sapiens
aggagcgggaccuguggc

SEQ ID NO: 1986107 - RNA, 20 nt, Homo sapiens
uggaugcagccucacagucc

SEQ ID NO: 1986108 - RNA, 23 nt, Homo sapiens
cacuccguccauccgacugcccc

SEQ ID NO: 1986109 - RNA, 16 nt, Homo sapiens
ggagcaggaacagaga

SEQ ID NO: 1986110 - RNA, 21 nt, Homo sapiens
gaacacccgacuccucaaaag

SEQ ID NO: 1986111 - RNA, 16 nt, Homo sapiens
caugaggacaaagugu

SEQ ID NO: 1986112 - RNA, 21 nt, Homo sapiens
cucuuagagaaagaacuauga

SEQ ID NO: 1986113 - RNA, 16 nt, Homo sapiens
ucagcucccauuucua

SEQ ID NO: 1986114 - RNA, 19 nt, Homo sapiens
gaagaaggaagaagccaga

SEQ ID NO: 1986115 - RNA, 15 nt, Homo sapiens
aguggcaagaccaaa

SEQ ID NO: 1986116 - RNA, 20 nt, Homo sapiens
caauacuguuuccauuuuaa

SEQ ID NO: 1986117 - RNA, 21 nt, Homo sapiens
uucugcauguucauugcaaac

SEQ ID NO: 1986118 - RNA, 23 nt, Homo sapiens
accagccuccugggacugugacu

SEQ ID NO: 1986119 - RNA, 18 nt, Homo sapiens
agugagccaucaucaugg

SEQ ID NO: 1986120 - RNA, 15 nt, Homo sapiens
cccauggaagcaaua

SEQ ID NO: 1986121 - RNA, 17 nt, Homo sapiens
uucuccugucccuccau

SEQ ID NO: 1986122 - RNA, 18 nt, Homo sapiens
ccaaacucauaacagucu

SEQ ID NO: 1986123 - RNA, 17 nt, Homo sapiens
gaaguuuuuuacuuugg

SEQ ID NO: 1986124 - RNA, 23 nt, Homo sapiens
gcccccaggccaggugaggucca

SEQ ID NO: 1986125 - RNA, 16 nt, Homo sapiens
aguugcugaugaacuc

SEQ ID NO: 1986126 - RNA, 15 nt, Homo sapiens
ggccagaagaucuac

SEQ ID NO: 1986127 - RNA, 20 nt, Homo sapiens
uucauaaacuuuucucuuau

SEQ ID NO: 1986128 - RNA, 22 nt, Homo sapiens
uucaauccuugaagguauaucu

SEQ ID NO: 1986129 - RNA, 22 nt, Homo sapiens
gaucaccccagccucacuccau

SEQ ID NO: 1986130 - RNA, 16 nt, Homo sapiens
uccaccaaauucugaa

SEQ ID NO: 1986131 - RNA, 21 nt, Homo sapiens
ugaagacauuucugcucucag

SEQ ID NO: 1986132 - RNA, 20 nt, Homo sapiens
ggagguugcagugagccaaa

SEQ ID NO: 1986133 - RNA, 17 nt, Homo sapiens
uaaguacuccauuguaa

SEQ ID NO: 1986134 - RNA, 20 nt, Homo sapiens
gagcaacuuucuggggccua

SEQ ID NO: 1986135 - RNA, 17 nt, Homo sapiens
cagggaugacaaccugg

SEQ ID NO: 1986136 - RNA, 19 nt, Homo sapiens
cugacagcacuccucggca

SEQ ID NO: 1986137 - RNA, 19 nt, Homo sapiens
acuuauuuagauucacuua

SEQ ID NO: 1986138 - RNA, 12 nt, Homo sapiens
uucggaagaccu

SEQ ID NO: 1986139 - RNA, 23 nt, Homo sapiens
agccuguguuagugucuguccau

SEQ ID NO: 1986140 - RNA, 14 nt, Homo sapiens
gauuccacuaucuc

SEQ ID NO: 1986141 - RNA, 20 nt, Homo sapiens
aaguuccauauagacaccaa

SEQ ID NO: 1986142 - RNA, 12 nt, Homo sapiens
gaaggugcaguu

SEQ ID NO: 1986143 - RNA, 18 nt, Homo sapiens
aauuuuauugcuggaauc

SEQ ID NO: 1986144 - RNA, 20 nt, Homo sapiens
ucauuuuuuaagugacuuua

SEQ ID NO: 1986145 - RNA, 19 nt, Homo sapiens
ggcuggacugcaguggccu

SEQ ID NO: 1986146 - RNA, 22 nt, Homo sapiens
uucauuuacuguggcuucuuaa

SEQ ID NO: 1986147 - RNA, 16 nt, Homo sapiens
agccuguuugggaugu

SEQ ID NO: 1986148 - RNA, 14 nt, Homo sapiens
cuuaaccauucuac

SEQ ID NO: 1986149 - RNA, 19 nt, Homo sapiens
caccccagcugaccuggua

SEQ ID NO: 1986150 - RNA, 21 nt, Homo sapiens
gugaacaccuccuagccacau

SEQ ID NO: 1986151 - RNA, 13 nt, Homo sapiens
augagacaucaug

SEQ ID NO: 1986152 - RNA, 13 nt, Homo sapiens
cagucaagggcau

SEQ ID NO: 1986153 - RNA, 15 nt, Homo sapiens
gccccaauucgaucc

SEQ ID NO: 1986154 - RNA, 12 nt, Homo sapiens
uaaaacugcaca

SEQ ID NO: 1986155 - RNA, 18 nt, Homo sapiens
ccaaacacguucccuaau

SEQ ID NO: 1986156 - RNA, 14 nt, Homo sapiens
aaacuguacuacau

SEQ ID NO: 1986157 - RNA, 11 nt, Homo sapiens
uaacugcauua

SEQ ID NO: 1986158 - RNA, 18 nt, Homo sapiens
uccccauccccaccagcu

SEQ ID NO: 1986159 - RNA, 17 nt, Homo sapiens
agcuuaucucuuuuaua

SEQ ID NO: 1986160 - RNA, 23 nt, Homo sapiens
gucuuugauucaccaaacaugaa

SEQ ID NO: 1986161 - RNA, 15 nt, Homo sapiens
aaauaggauccugga

SEQ ID NO: 1986162 - RNA, 14 nt, Homo sapiens
aggcuucucuccac

SEQ ID NO: 1986163 - RNA, 21 nt, Homo sapiens
ugccucagacguugccugaga

SEQ ID NO: 1986164 - RNA, 22 nt, Homo sapiens
gggaggacaaaacuucuuguca

SEQ ID NO: 1986165 - RNA, 17 nt, Homo sapiens
caaauauauugcaaaaa

SEQ ID NO: 1986166 - RNA, 12 nt, Homo sapiens
ccaucaucccag

SEQ ID NO: 1986167 - RNA, 12 nt, Homo sapiens
auaucaucauag

SEQ ID NO: 1986168 - RNA, 17 nt, Homo sapiens
aaugucuuaaugcaaau

SEQ ID NO: 1986169 - RNA, 20 nt, Homo sapiens
uaugaccuuccaaguuugac

SEQ ID NO: 1986170 - RNA, 22 nt, Homo sapiens
aggucucauagguugagcaauu

SEQ ID NO: 1986171 - RNA, 20 nt, Homo sapiens
aacaacgagauaccaucuca

SEQ ID NO: 1986172 - RNA, 16 nt, Homo sapiens
agaagugccaucucaa

SEQ ID NO: 1986173 - RNA, 18 nt, Homo sapiens
aggcaggucugaagcuca

SEQ ID NO: 1986174 - RNA, 18 nt, Homo sapiens
guuugggccccucagagc

SEQ ID NO: 1986175 - RNA, 16 nt, Homo sapiens
uuuccucugaagggaa

SEQ ID NO: 1986176 - RNA, 17 nt, Homo sapiens
gugguuucuacuucccc

SEQ ID NO: 1986177 - RNA, 17 nt, Homo sapiens
cacuucauucacauuca

SEQ ID NO: 1986178 - RNA, 19 nt, Homo sapiens
cggucgcccuuugcugcau

SEQ ID NO: 1986179 - RNA, 18 nt, Homo sapiens
acuguguuuaucuugaua

SEQ ID NO: 1986180 - RNA, 15 nt, Homo sapiens
cuaggguaggggcaa

SEQ ID NO: 1986181 - RNA, 23 nt, Homo sapiens
uauuuuguauauuuguaaacuac

SEQ ID NO: 1986182 - RNA, 16 nt, Homo sapiens
uucaaugaacugugcu

SEQ ID NO: 1986183 - RNA, 14 nt, Homo sapiens
cgaguaacuccccu

SEQ ID NO: 1986184 - RNA, 14 nt, Homo sapiens
augugcaacauucu

SEQ ID NO: 1986185 - RNA, 19 nt, Homo sapiens
aaugcaguccucaucucca

SEQ ID NO: 1986186 - RNA, 18 nt, Homo sapiens
gguggaaacuuuucuuaa

SEQ ID NO: 1986187 - RNA, 22 nt, Homo sapiens
cugacgcaggcaccuucuuggc

SEQ ID NO: 1986188 - RNA, 15 nt, Homo sapiens
acaggacagcgggaa

SEQ ID NO: 1986189 - RNA, 21 nt, Homo sapiens
ugauggagacaguaacacugg

SEQ ID NO: 1986190 - RNA, 13 nt, Homo sapiens
aaugaauagcuug

SEQ ID NO: 1986191 - RNA, 18 nt, Homo sapiens
gacuaagaaaugccagug

SEQ ID NO: 1986192 - RNA, 12 nt, Homo sapiens
acauguaugugu

SEQ ID NO: 1986193 - RNA, 17 nt, Homo sapiens
ucaaaucuccugcugau

SEQ ID NO: 1986194 - RNA, 18 nt, Homo sapiens
uaaaauauggacuuccaa

SEQ ID NO: 1986195 - RNA, 23 nt, Homo sapiens
ggcuaagacccaaacauaugcac

SEQ ID NO: 1986196 - RNA, 16 nt, Homo sapiens
aaacuuuaaugaacua

SEQ ID NO: 1986197 - RNA, 14 nt, Homo sapiens
gcaagcagugcccu

SEQ ID NO: 1986198 - RNA, 21 nt, Homo sapiens
cauagaugaacuauuagacau

SEQ ID NO: 1986199 - RNA, 20 nt, Homo sapiens
agggccccugcacacucagu

SEQ ID NO: 1986200 - RNA, 21 nt, Homo sapiens
cuucgggggcggcucugggaa

SEQ ID NO: 1986201 - RNA, 20 nt, Homo sapiens
uacauacagagauuguagua

SEQ ID NO: 1986202 - RNA, 18 nt, Homo sapiens
cauuuuucuacugcucuu

SEQ ID NO: 1986203 - RNA, 17 nt, Homo sapiens
cucacgggacuauuucc

SEQ ID NO: 1986204 - RNA, 18 nt, Homo sapiens
gcuguucucauuccuguu

SEQ ID NO: 1986205 - RNA, 17 nt, Homo sapiens
auggaaucagcugcuac

SEQ ID NO: 1986206 - RNA, 21 nt, Homo sapiens
uguaagguggacuuccagcuu

SEQ ID NO: 1986207 - RNA, 13 nt, Homo sapiens
gagcgagauucca

SEQ ID NO: 1986208 - RNA, 15 nt, Homo sapiens
uaauacacauaucua

SEQ ID NO: 1986209 - RNA, 13 nt, Homo sapiens
gaggccacagcug

SEQ ID NO: 1986210 - RNA, 16 nt, Homo sapiens
gcuugguggccuggga

SEQ ID NO: 1986211 - RNA, 13 nt, Homo sapiens
ucaaguaauccac

SEQ ID NO: 1986212 - RNA, 18 nt, Homo sapiens
aagaauaaaaugcaguga

SEQ ID NO: 1986213 - RNA, 14 nt, Homo sapiens
ugauugaaaccaag

SEQ ID NO: 1986214 - RNA, 22 nt, Homo sapiens
auaucauuuauuuuuuacauua

SEQ ID NO: 1986215 - RNA, 14 nt, Homo sapiens
aaacccaaaacagu

SEQ ID NO: 1986216 - RNA, 13 nt, Homo sapiens
agcuagcugagua

SEQ ID NO: 1986217 - RNA, 22 nt, Homo sapiens
ggccugcgacccugggggcaca

SEQ ID NO: 1986218 - RNA, 10 nt, Homo sapiens
uaauugugaa

SEQ ID NO: 1986219 - RNA, 14 nt, Homo sapiens
guuccuugagcacc

SEQ ID NO: 1986220 - RNA, 19 nt, Homo sapiens
ugugacuccucaggguuga

SEQ ID NO: 1986221 - RNA, 15 nt, Homo sapiens
ucgacuugacuuuuu

SEQ ID NO: 1986222 - RNA, 15 nt, Homo sapiens
aagaccaguauuuca

SEQ ID NO: 1986223 - RNA, 11 nt, Homo sapiens
ucccacacugu

SEQ ID NO: 1986224 - RNA, 22 nt, Homo sapiens
guuuuguuggugugaaaauaca

SEQ ID NO: 1986225 - RNA, 19 nt, Homo sapiens
cuagccagaggacugugau

SEQ ID NO: 1986226 - RNA, 23 nt, Homo sapiens
ucccuaaaguguuguggccuuaa

SEQ ID NO: 1986227 - RNA, 18 nt, Homo sapiens
uugccacggaaacauaca

SEQ ID NO: 1986228 - RNA, 21 nt, Homo sapiens
ggaauacugugcauaagccau

SEQ ID NO: 1986229 - RNA, 21 nt, Homo sapiens
cuguaaaggucaacaauaaaa

SEQ ID NO: 1986230 - RNA, 13 nt, Homo sapiens
cagaaaacauaau

SEQ ID NO: 1986231 - RNA, 19 nt, Homo sapiens
gaggguaaauaugacuccu

SEQ ID NO: 1986232 - RNA, 12 nt, Homo sapiens
ucaagaagucuu

SEQ ID NO: 1986233 - RNA, 14 nt, Homo sapiens
agauaagacauauc

SEQ ID NO: 1986234 - RNA, 16 nt, Homo sapiens
uauauguaaacaguga

SEQ ID NO: 1986235 - RNA, 13 nt, Homo sapiens
cuccucacacucc

SEQ ID NO: 1986236 - RNA, 21 nt, Homo sapiens
guaccugcaaguauccagacc

SEQ ID NO: 1986237 - RNA, 20 nt, Homo sapiens
gccaggcaggugccuggaca

SEQ ID NO: 1986238 - RNA, 15 nt, Homo sapiens
ugaacugucuuggcu

SEQ ID NO: 1986239 - RNA, 17 nt, Homo sapiens
auccccuuuguguagaa

SEQ ID NO: 1986240 - RNA, 22 nt, Homo sapiens
uaagaaauagacagucaggcua

SEQ ID NO: 1986241 - RNA, 20 nt, Homo sapiens
uaaaagguaugguggggaua

SEQ ID NO: 1986242 - RNA, 19 nt, Homo sapiens
uguaaaguuucuagaauuu

SEQ ID NO: 1986243 - RNA, 21 nt, Homo sapiens
agagaaaccuccggugugaga

SEQ ID NO: 1986244 - RNA, 20 nt, Homo sapiens
cucggugagccggggccguc

SEQ ID NO: 1986245 - RNA, 23 nt, Homo sapiens
gccuggcuccaaacccucgaggc

SEQ ID NO: 1986246 - RNA, 22 nt, Homo sapiens
uuuuggacacugugcuacugaa

SEQ ID NO: 1986247 - RNA, 16 nt, Homo sapiens
auucucucugcucagu

SEQ ID NO: 1986248 - RNA, 23 nt, Homo sapiens
agaagccaaaauacuucugagac

SEQ ID NO: 1986249 - RNA, 19 nt, Homo sapiens
uccaucauggcagugauga

SEQ ID NO: 1986250 - RNA, 23 nt, Homo sapiens
uggggagauuugccacaucuuaa

SEQ ID NO: 1986251 - RNA, 13 nt, Homo sapiens
cagucagauuuau

SEQ ID NO: 1986252 - RNA, 16 nt, Homo sapiens
gaauuaaaacuucuua

SEQ ID NO: 1986253 - RNA, 13 nt, Homo sapiens
gagacaugugaca

SEQ ID NO: 1986254 - RNA, 14 nt, Homo sapiens
caaaacugcaaauu

SEQ ID NO: 1986255 - RNA, 16 nt, Homo sapiens
uucuccaucacaacca

SEQ ID NO: 1986256 - RNA, 14 nt, Homo sapiens
acauguaguugaau

SEQ ID NO: 1986257 - RNA, 15 nt, Homo sapiens
cucucuaguuuccag

SEQ ID NO: 1986258 - RNA, 15 nt, Homo sapiens
ugaucagguaacuuu

SEQ ID NO: 1986259 - RNA, 13 nt, Homo sapiens
cuaauguacaaua

SEQ ID NO: 1986260 - RNA, 23 nt, Homo sapiens
acuucaaaaaaaucuaacaguaa

SEQ ID NO: 1986261 - RNA, 16 nt, Homo sapiens
auuauuccugcacuca

SEQ ID NO: 1986262 - RNA, 16 nt, Homo sapiens
uuaagacaacuacagc

SEQ ID NO: 1986263 - RNA, 22 nt, Homo sapiens
uauguauuaaaauaucccaagc

SEQ ID NO: 1986264 - RNA, 19 nt, Homo sapiens
gauucuccagccaaccuca

SEQ ID NO: 1986265 - RNA, 20 nt, Homo sapiens
agauugggcggggcuucucu

SEQ ID NO: 1986266 - RNA, 15 nt, Homo sapiens
ccauggccccagcug

SEQ ID NO: 1986267 - RNA, 21 nt, Homo sapiens
uaaagcaugaaaugugaauuu

SEQ ID NO: 1986268 - RNA, 18 nt, Homo sapiens
gagagauucaugcugauu

SEQ ID NO: 1986269 - RNA, 14 nt, Homo sapiens
aaguuuacugggga

SEQ ID NO: 1986270 - RNA, 17 nt, Homo sapiens
uauuuuauucugaagga

SEQ ID NO: 1986271 - RNA, 19 nt, Homo sapiens
gggaauucgagcugggcau

SEQ ID NO: 1986272 - RNA, 19 nt, Homo sapiens
acuuuauuugaacuaugag

SEQ ID NO: 1986273 - RNA, 15 nt, Homo sapiens
augaaaucuucccag

SEQ ID NO: 1986274 - RNA, 14 nt, Homo sapiens
ucccuggaccucug

SEQ ID NO: 1986275 - RNA, 19 nt, Homo sapiens
aguuuagauuuuaaucaaa

SEQ ID NO: 1986276 - RNA, 20 nt, Homo sapiens
gucacucuagucaaugacau

SEQ ID NO: 1986277 - RNA, 17 nt, Homo sapiens
agcuuuccggggaggag

SEQ ID NO: 1986278 - RNA, 17 nt, Homo sapiens
auuuuuagacucaucaa

SEQ ID NO: 1986279 - RNA, 15 nt, Homo sapiens
guucagaaauaugaa

SEQ ID NO: 1986280 - RNA, 21 nt, Homo sapiens
cccuagcucuuccccaucuca

SEQ ID NO: 1986281 - RNA, 15 nt, Homo sapiens
cugcuggacagccuc

SEQ ID NO: 1986282 - RNA, 15 nt, Homo sapiens
guaacucacuuuaaa

SEQ ID NO: 1986283 - RNA, 16 nt, Homo sapiens
ggaaaaaaaauaaugu

SEQ ID NO: 1986284 - RNA, 16 nt, Homo sapiens
aagauauuuacucaaa

SEQ ID NO: 1986285 - RNA, 20 nt, Homo sapiens
auucgaaccaggaaauggaa

SEQ ID NO: 1986286 - RNA, 20 nt, Homo sapiens
gaagaguuucuccuuuugac

SEQ ID NO: 1986287 - RNA, 22 nt, Homo sapiens
aacuuuacuaaguaaucucaca

SEQ ID NO: 1986288 - RNA, 18 nt, Homo sapiens
ccuuugugguuacaguuu

SEQ ID NO: 1986289 - RNA, 17 nt, Homo sapiens
auugugaauaaguuuuc

SEQ ID NO: 1986290 - RNA, 13 nt, Homo sapiens
aaggacugaagaa

SEQ ID NO: 1986291 - RNA, 22 nt, Homo sapiens
aacauuugccaagugaguugaa

SEQ ID NO: 1986292 - RNA, 20 nt, Homo sapiens
ccccugugccugcugggcac

SEQ ID NO: 1986293 - RNA, 19 nt, Homo sapiens
gcccaggcuggagugcaac

SEQ ID NO: 1986294 - RNA, 16 nt, Homo sapiens
ggaagaggagaugaca

SEQ ID NO: 1986295 - RNA, 19 nt, Homo sapiens
cugugguuugcuccagaau

SEQ ID NO: 1986296 - RNA, 20 nt, Homo sapiens
ugaguauuccaugagcugcu

SEQ ID NO: 1986297 - RNA, 16 nt, Homo sapiens
ugguggaucuguccaa

SEQ ID NO: 1986298 - RNA, 17 nt, Homo sapiens
gguaaguaaacagucag

SEQ ID NO: 1986299 - RNA, 18 nt, Homo sapiens
ugguaagcuuccaggaaa

SEQ ID NO: 1986300 - RNA, 16 nt, Homo sapiens
aggcaaauauaagcug

SEQ ID NO: 1986301 - RNA, 14 nt, Homo sapiens
agcagcacugugag

SEQ ID NO: 1986302 - RNA, 22 nt, Homo sapiens
aauacaagaguggagagaagcu

SEQ ID NO: 1986303 - RNA, 20 nt, Homo sapiens
ugacuugugguugaauuaaa

SEQ ID NO: 1986304 - RNA, 19 nt, Homo sapiens
aaggccccagaugauccca

SEQ ID NO: 1986305 - RNA, 23 nt, Homo sapiens
uuucaguggcuaccuacauacaa

SEQ ID NO: 1986306 - RNA, 13 nt, Homo sapiens
ucacuggugcuau

SEQ ID NO: 1986307 - RNA, 14 nt, Homo sapiens
acauuuagaacuuu

SEQ ID NO: 1986308 - RNA, 14 nt, Homo sapiens
gcaagaaacacugg

SEQ ID NO: 1986309 - RNA, 16 nt, Homo sapiens
caagaaaaaaagggag

SEQ ID NO: 1986310 - RNA, 14 nt, Homo sapiens
uacaugccaugacc

SEQ ID NO: 1986311 - RNA, 22 nt, Homo sapiens
ggggacugcuaccucugagaag

SEQ ID NO: 1986312 - RNA, 23 nt, Homo sapiens
ccaagcuggagugcaguggugcg

SEQ ID NO: 1986313 - RNA, 14 nt, Homo sapiens
uagauuacugaaaa

SEQ ID NO: 1986314 - RNA, 15 nt, Homo sapiens
ccagcuuaucuccuc

SEQ ID NO: 1986315 - RNA, 18 nt, Homo sapiens
agggagggcuguggugcc

SEQ ID NO: 1986316 - RNA, 23 nt, Homo sapiens
acuggggccuccagaacucacug

SEQ ID NO: 1986317 - RNA, 13 nt, Homo sapiens
acuuguaauccca

SEQ ID NO: 1986318 - RNA, 15 nt, Homo sapiens
cucccagccacagca

SEQ ID NO: 1986319 - RNA, 12 nt, Homo sapiens
auauauacucaa

SEQ ID NO: 1986320 - RNA, 13 nt, Homo sapiens
agggccagaaaua

SEQ ID NO: 1986321 - RNA, 14 nt, Homo sapiens
agcacccauuccaa

SEQ ID NO: 1986322 - RNA, 22 nt, Homo sapiens
uagaccgcgugauaaaacuggg

SEQ ID NO: 1986323 - RNA, 19 nt, Homo sapiens
cauucacaauacaguggau

SEQ ID NO: 1986324 - RNA, 20 nt, Homo sapiens
aacaacuuuauacccagaaa

SEQ ID NO: 1986325 - RNA, 21 nt, Homo sapiens
ggccccagcccuacucugugu

SEQ ID NO: 1986326 - RNA, 13 nt, Homo sapiens
acucaacccauug

SEQ ID NO: 1986327 - RNA, 22 nt, Homo sapiens
agaggacguguuacccacugcc

SEQ ID NO: 1986328 - RNA, 19 nt, Homo sapiens
ucagcuuuuguucuagacu

SEQ ID NO: 1986329 - RNA, 18 nt, Homo sapiens
ggaaagauuauauuuuau

SEQ ID NO: 1986330 - RNA, 18 nt, Homo sapiens
uuugauaugaaguguuag

SEQ ID NO: 1986331 - RNA, 17 nt, Homo sapiens
augucuucauaauauaa

SEQ ID NO: 1986332 - RNA, 23 nt, Homo sapiens
caauguuucuguuucaggcuucc

SEQ ID NO: 1986333 - RNA, 12 nt, Homo sapiens
caggaccugccu

SEQ ID NO: 1986334 - RNA, 13 nt, Homo sapiens
cgaauucaucccc

SEQ ID NO: 1986335 - RNA, 23 nt, Homo sapiens
caaauuagacaaccaaguaugaa

SEQ ID NO: 1986336 - RNA, 20 nt, Homo sapiens
auauucccggucagcaguau

SEQ ID NO: 1986337 - RNA, 16 nt, Homo sapiens
guuucugcagaggcag

SEQ ID NO: 1986338 - RNA, 19 nt, Homo sapiens
guuuccuucccuacccagu

SEQ ID NO: 1986339 - RNA, 23 nt, Homo sapiens
ggucaugcaagugagaaagacau

SEQ ID NO: 1986340 - RNA, 20 nt, Homo sapiens
auugaacuguaaauauguca

SEQ ID NO: 1986341 - RNA, 23 nt, Homo sapiens
acagcuugucugguaaguggcuu

SEQ ID NO: 1986342 - RNA, 13 nt, Homo sapiens
uuguguucucaaa

SEQ ID NO: 1986343 - RNA, 14 nt, Homo sapiens
cugguaccaagcug

SEQ ID NO: 1986344 - RNA, 16 nt, Homo sapiens
ccacuugggaggguca

SEQ ID NO: 1986345 - RNA, 15 nt, Homo sapiens
ggcacuaacacuggg

SEQ ID NO: 1986346 - RNA, 22 nt, Homo sapiens
gaauuuuguucucugggagaaa

SEQ ID NO: 1986347 - RNA, 12 nt, Homo sapiens
ugccagagccaa

SEQ ID NO: 1986348 - RNA, 22 nt, Homo sapiens
aggagaaugaaauguaugugcu

SEQ ID NO: 1986349 - RNA, 14 nt, Homo sapiens
uccacaaacacauu

SEQ ID NO: 1986350 - RNA, 12 nt, Homo sapiens
gccccuucaucc

SEQ ID NO: 1986351 - RNA, 23 nt, Homo sapiens
uucuuuuauuaauggcauguaau

SEQ ID NO: 1986352 - RNA, 16 nt, Homo sapiens
cacugugucauucugu

SEQ ID NO: 1986353 - RNA, 20 nt, Homo sapiens
guguaagaacaacuaccuga

SEQ ID NO: 1986354 - RNA, 21 nt, Homo sapiens
ccaggaaggaagcuguugcuu

SEQ ID NO: 1986355 - RNA, 15 nt, Homo sapiens
aauuucucauacuua

SEQ ID NO: 1986356 - RNA, 23 nt, Homo sapiens
auuuaucugugcaaauccuugau

SEQ ID NO: 1986357 - RNA, 13 nt, Homo sapiens
aagaucuugcaga

SEQ ID NO: 1986358 - RNA, 14 nt, Homo sapiens
guggacagcagcug

SEQ ID NO: 1986359 - RNA, 16 nt, Homo sapiens
gcauuagcacuaccau

SEQ ID NO: 1986360 - RNA, 17 nt, Homo sapiens
cacauccccagcugccu

SEQ ID NO: 1986361 - RNA, 16 nt, Homo sapiens
cccugucccucuaaua

SEQ ID NO: 1986362 - RNA, 12 nt, Homo sapiens
auauucccugac

SEQ ID NO: 1986363 - RNA, 17 nt, Homo sapiens
ugugcgacuucacaaaa

SEQ ID NO: 1986364 - RNA, 15 nt, Homo sapiens
auuugcuagcaguaa

SEQ ID NO: 1986365 - RNA, 23 nt, Homo sapiens
auuuaaagggaaauugagcugcu

SEQ ID NO: 1986366 - RNA, 17 nt, Homo sapiens
agauguaaauagaugac

SEQ ID NO: 1986367 - RNA, 17 nt, Homo sapiens
caaauuuuaacaaaagg

SEQ ID NO: 1986368 - RNA, 12 nt, Homo sapiens
uacugacauaua

SEQ ID NO: 1986369 - RNA, 21 nt, Homo sapiens
ccuccaagccauucacuuccc

SEQ ID NO: 1986370 - RNA, 15 nt, Homo sapiens
acaguaaugcaagca

SEQ ID NO: 1986371 - RNA, 14 nt, Homo sapiens
uuuaaguccaccuc

SEQ ID NO: 1986372 - RNA, 17 nt, Homo sapiens
ucauuucagauauucca

SEQ ID NO: 1986373 - RNA, 14 nt, Homo sapiens
uuaauuuauuuugc

SEQ ID NO: 1986374 - RNA, 12 nt, Homo sapiens
ucacagggccaa

SEQ ID NO: 1986375 - RNA, 22 nt, Homo sapiens
uguaagucccaugaauacacaa

SEQ ID NO: 1986376 - RNA, 17 nt, Homo sapiens
ccucaaauauaguauau

SEQ ID NO: 1986377 - RNA, 22 nt, Homo sapiens
cucacaaaguagaggaauccau

SEQ ID NO: 1986378 - RNA, 19 nt, Homo sapiens
aaagagaagguuucuucca

SEQ ID NO: 1986379 - RNA, 18 nt, Homo sapiens
aggugggggccuccucag

SEQ ID NO: 1986380 - RNA, 15 nt, Homo sapiens
uagugaauaaaguca

SEQ ID NO: 1986381 - RNA, 24 nt, Homo sapiens
aaucuacuggaauagauuccgagg

SEQ ID NO: 1986382 - RNA, 22 nt, Homo sapiens
uccacuaggugcccagucuuga

SEQ ID NO: 1986383 - RNA, 16 nt, Homo sapiens
uuccugaauguaauua

SEQ ID NO: 1986384 - RNA, 13 nt, Homo sapiens
uauauuguuauau

SEQ ID NO: 1986385 - RNA, 13 nt, Homo sapiens
cucucugucucuc

SEQ ID NO: 1986386 - RNA, 22 nt, Homo sapiens
aggccagggaaagcccguguca

SEQ ID NO: 1986387 - RNA, 19 nt, Homo sapiens
ugaggucaucccggggcca

SEQ ID NO: 1986388 - RNA, 19 nt, Homo sapiens
ugccagaggaugcucuuuc

SEQ ID NO: 1986389 - RNA, 18 nt, Homo sapiens
uacggcuuuuccaaugau

SEQ ID NO: 1986390 - RNA, 11 nt, Homo sapiens
uuaacuccucc

SEQ ID NO: 1986391 - RNA, 11 nt, Homo sapiens
cccacucccua

SEQ ID NO: 1986392 - RNA, 18 nt, Homo sapiens
ccacuccaaaaaucagug

SEQ ID NO: 1986393 - RNA, 17 nt, Homo sapiens
aagagauugcacaguca

SEQ ID NO: 1986394 - RNA, 12 nt, Homo sapiens
gaguagcagaaa

SEQ ID NO: 1986395 - RNA, 22 nt, Homo sapiens
cuuguuagugcacagcacaaau

SEQ ID NO: 1986396 - RNA, 21 nt, Homo sapiens
gcaaaccaucccagcacugca

SEQ ID NO: 1986397 - RNA, 16 nt, Homo sapiens
ugugagcagucucagc

SEQ ID NO: 1986398 - RNA, 23 nt, Homo sapiens
gauuuauauuuuaaagcuuggug

SEQ ID NO: 1986399 - RNA, 21 nt, Homo sapiens
aaguccaauuccaaagccaga

SEQ ID NO: 1986400 - RNA, 15 nt, Homo sapiens
agccacuuuccucuu

SEQ ID NO: 1986401 - RNA, 17 nt, Homo sapiens
caacuccagccacccag

SEQ ID NO: 1986402 - RNA, 19 nt, Homo sapiens
uggugagguugugcugccu

SEQ ID NO: 1986403 - RNA, 20 nt, Homo sapiens
gaaguggcugaugggaacca

SEQ ID NO: 1986404 - RNA, 21 nt, Homo sapiens
gaaccagaauuacauguuaau

SEQ ID NO: 1986405 - RNA, 12 nt, Homo sapiens
aagugcuucaca

SEQ ID NO: 1986406 - RNA, 18 nt, Homo sapiens
aaggaugacaaaauggaa

SEQ ID NO: 1986407 - RNA, 16 nt, Homo sapiens
aacgcacuaacccagc

SEQ ID NO: 1986408 - RNA, 12 nt, Homo sapiens
ugggcuguuuag

SEQ ID NO: 1986409 - RNA, 17 nt, Homo sapiens
caaaugcuauacugugu

SEQ ID NO: 1986410 - RNA, 22 nt, Homo sapiens
caauguaaauauuacacaucaa

SEQ ID NO: 1986411 - RNA, 20 nt, Homo sapiens
uaaccaggggcugacaaugc

SEQ ID NO: 1986412 - RNA, 21 nt, Homo sapiens
ccugggcaaugcagugcagca

SEQ ID NO: 1986413 - RNA, 21 nt, Homo sapiens
aauaaguaacauauaaauuaa

SEQ ID NO: 1986414 - RNA, 17 nt, Homo sapiens
gucuucuucaauacuga

SEQ ID NO: 1986415 - RNA, 17 nt, Homo sapiens
cagagcugucugaacuc

SEQ ID NO: 1986416 - RNA, 21 nt, Homo sapiens
caaauaggagggagacugugg

SEQ ID NO: 1986417 - RNA, 20 nt, Homo sapiens
ugcuagugucuuugucaugc

SEQ ID NO: 1986418 - RNA, 17 nt, Homo sapiens
gcaaagguaauaauaca

SEQ ID NO: 1986419 - RNA, 15 nt, Homo sapiens
aguaaaguguuaaua

SEQ ID NO: 1986420 - RNA, 18 nt, Homo sapiens
accaaacaggaaguggac

SEQ ID NO: 1986421 - RNA, 20 nt, Homo sapiens
uaccucauaguaucuucacu

SEQ ID NO: 1986422 - RNA, 14 nt, Homo sapiens
gcccuccgccauuc

SEQ ID NO: 1986423 - RNA, 22 nt, Homo sapiens
cuguuaaccaaagggcagaaua

SEQ ID NO: 1986424 - RNA, 19 nt, Homo sapiens
uaaucaaaaagaagacauu

SEQ ID NO: 1986425 - RNA, 17 nt, Homo sapiens
acgccuguaaucccagc

SEQ ID NO: 1986426 - RNA, 23 nt, Homo sapiens
gaaaauuaguaugguaauuaaau

SEQ ID NO: 1986427 - RNA, 18 nt, Homo sapiens
ugacacuuuaauuaccaa

SEQ ID NO: 1986428 - RNA, 16 nt, Homo sapiens
uuuucuggacucugga

SEQ ID NO: 1986429 - RNA, 20 nt, Homo sapiens
ucacuuuacaaauucaagcc

SEQ ID NO: 1986430 - RNA, 22 nt, Homo sapiens
caguguugugccccuucacuca

SEQ ID NO: 1986431 - RNA, 18 nt, Homo sapiens
aguguucccugaucccug

SEQ ID NO: 1986432 - RNA, 20 nt, Homo sapiens
aaugcugcaggacuugagaa

SEQ ID NO: 1986433 - RNA, 14 nt, Homo sapiens
accuuacugaaaaa

SEQ ID NO: 1986434 - RNA, 19 nt, Homo sapiens
uacuggugugagccacugu

SEQ ID NO: 1986435 - RNA, 16 nt, Homo sapiens
ucugaccaugacucau

SEQ ID NO: 1986436 - RNA, 16 nt, Homo sapiens
gccugucacgugguca

SEQ ID NO: 1986437 - RNA, 18 nt, Homo sapiens
gaacuucgaaaacuuuaa

SEQ ID NO: 1986438 - RNA, 14 nt, Homo sapiens
cugguggucaggga

SEQ ID NO: 1986439 - RNA, 14 nt, Homo sapiens
gaugagcacacaca

SEQ ID NO: 1986440 - RNA, 21 nt, Homo sapiens
caggaccucaccuuggcucug

SEQ ID NO: 1986441 - RNA, 20 nt, Homo sapiens
ccaauggaacucgcucagaa

SEQ ID NO: 1986442 - RNA, 16 nt, Homo sapiens
aucuccuguggcucau

SEQ ID NO: 1986443 - RNA, 23 nt, Homo sapiens
aucaugaaaguccagcacuggaa

SEQ ID NO: 1986444 - RNA, 19 nt, Homo sapiens
gcucgcccaggacuccccg

SEQ ID NO: 1986445 - RNA, 20 nt, Homo sapiens
uccccuucucucaucucuua

SEQ ID NO: 1986446 - RNA, 13 nt, Homo sapiens
gccccuacauuuu

SEQ ID NO: 1986447 - RNA, 21 nt, Homo sapiens
guuuccuugggaguugucauu

SEQ ID NO: 1986448 - RNA, 23 nt, Homo sapiens
augcgaacaaccuuuucucugga

SEQ ID NO: 1986449 - RNA, 23 nt, Homo sapiens
acauuugaguauccgauucgcca

SEQ ID NO: 1986450 - RNA, 20 nt, Homo sapiens
ucauccaggcucccaaaaga

SEQ ID NO: 1986451 - RNA, 16 nt, Homo sapiens
aagccaaagccaauaa

SEQ ID NO: 1986452 - RNA, 21 nt, Homo sapiens
cucaagcacugacacucauua

SEQ ID NO: 1986453 - RNA, 15 nt, Homo sapiens
caaauaacagucuga

SEQ ID NO: 1986454 - RNA, 17 nt, Homo sapiens
ucuuccagcaugcaucc

SEQ ID NO: 1986455 - RNA, 16 nt, Homo sapiens
gccuucucccugggaa

SEQ ID NO: 1986456 - RNA, 14 nt, Homo sapiens
aagaaaaaauggca

SEQ ID NO: 1986457 - RNA, 18 nt, Homo sapiens
gccacugaauuagccaaa

SEQ ID NO: 1986458 - RNA, 17 nt, Homo sapiens
aaguuuuaauaccuaag

SEQ ID NO: 1986459 - RNA, 23 nt, Homo sapiens
cuggaaggucaauuucaguguau

SEQ ID NO: 1986460 - RNA, 19 nt, Homo sapiens
agccgagaucgugccauug

SEQ ID NO: 1986461 - RNA, 14 nt, Homo sapiens
ucaagcgauccucc

SEQ ID NO: 1986462 - RNA, 13 nt, Homo sapiens
ucaaaaggucuaa

SEQ ID NO: 1986463 - RNA, 21 nt, Homo sapiens
ggacggcucugaccugagcua

SEQ ID NO: 1986464 - RNA, 22 nt, Homo sapiens
ugagaagaaaaucagagaggga

SEQ ID NO: 1986465 - RNA, 11 nt, Homo sapiens
aaagagugaau

SEQ ID NO: 1986466 - RNA, 23 nt, Homo sapiens
ccuggaggaacugcuugugcacu

SEQ ID NO: 1986467 - RNA, 21 nt, Homo sapiens
uuuggucaaguaguuugacuc

SEQ ID NO: 1986468 - RNA, 22 nt, Homo sapiens
ccccuagcugggccaacuccag

SEQ ID NO: 1986469 - RNA, 17 nt, Homo sapiens
auagagaucuuauguca

SEQ ID NO: 1986470 - RNA, 14 nt, Homo sapiens
cuugacaaucaucu

SEQ ID NO: 1986471 - RNA, 20 nt, Homo sapiens
uucaggugcuuuugauguga

SEQ ID NO: 1986472 - RNA, 22 nt, Homo sapiens
aguuguguuguuuuuuguucaa

SEQ ID NO: 1986473 - RNA, 13 nt, Homo sapiens
ucauugaccuaau

SEQ ID NO: 1986474 - RNA, 14 nt, Homo sapiens
ccacaguggaacca

SEQ ID NO: 1986475 - RNA, 18 nt, Homo sapiens
cucagaccuccagcccug

SEQ ID NO: 1986476 - RNA, 20 nt, Homo sapiens
gucacuuuuccugugcuguu

SEQ ID NO: 1986477 - RNA, 15 nt, Homo sapiens
gcaagcacugugguc

SEQ ID NO: 1986478 - RNA, 16 nt, Homo sapiens
ugcugacacugugacc

SEQ ID NO: 1986479 - RNA, 15 nt, Homo sapiens
ggacuccuggugccc

SEQ ID NO: 1986480 - RNA, 15 nt, Homo sapiens
guagccuaauauuca

SEQ ID NO: 1986481 - RNA, 14 nt, Homo sapiens
cacagagguuuuaa

SEQ ID NO: 1986482 - RNA, 19 nt, Homo sapiens
aaaucuaugaaguauauaa

SEQ ID NO: 1986483 - RNA, 21 nt, Homo sapiens
cugucuuggaagucugucuca

SEQ ID NO: 1986484 - RNA, 19 nt, Homo sapiens
aaccuccgccucucagguu

SEQ ID NO: 1986485 - RNA, 21 nt, Homo sapiens
ccccgacacccagcccagcuu

SEQ ID NO: 1986486 - RNA, 19 nt, Homo sapiens
cugggaugacuggcuuuga

SEQ ID NO: 1986487 - RNA, 17 nt, Homo sapiens
aacaggcucacugguca

SEQ ID NO: 1986488 - RNA, 21 nt, Homo sapiens
aggggcuguggccgucuccuc

SEQ ID NO: 1986489 - RNA, 12 nt, Homo sapiens
cuacugaucaac

SEQ ID NO: 1986490 - RNA, 22 nt, Homo sapiens
gaauuuaguauuaucaaaggga

SEQ ID NO: 1986491 - RNA, 15 nt, Homo sapiens
cacauuucucugugu

SEQ ID NO: 1986492 - RNA, 23 nt, Homo sapiens
agagaccuugcgaccauguguag

SEQ ID NO: 1986493 - RNA, 21 nt, Homo sapiens
caccagcaugguaguggcaaa

SEQ ID NO: 1986494 - RNA, 20 nt, Homo sapiens
agaugcaggauguucaggga

SEQ ID NO: 1986495 - RNA, 13 nt, Homo sapiens
ucagugagccaug

SEQ ID NO: 1986496 - RNA, 16 nt, Homo sapiens
aaaacagaacacuuau

SEQ ID NO: 1986497 - RNA, 14 nt, Homo sapiens
aucugaaccaagau

SEQ ID NO: 1986498 - RNA, 19 nt, Homo sapiens
uccugucuccucugucagu

SEQ ID NO: 1986499 - RNA, 13 nt, Homo sapiens
gugggacugagau

SEQ ID NO: 1986500 - RNA, 23 nt, Homo sapiens
caauuaauuccuguuugucuaca

SEQ ID NO: 1986501 - RNA, 20 nt, Homo sapiens
ugauggcgggcacuggguac

SEQ ID NO: 1986502 - RNA, 14 nt, Homo sapiens
uccagccugaacag

SEQ ID NO: 1986503 - RNA, 14 nt, Homo sapiens
cagcaguaucacag

SEQ ID NO: 1986504 - RNA, 15 nt, Homo sapiens
aaauauauacuaaac

SEQ ID NO: 1986505 - RNA, 20 nt, Homo sapiens
aaggauuuuuaaaaugauuu

SEQ ID NO: 1986506 - RNA, 19 nt, Homo sapiens
uuguaagggcucucaaaga

SEQ ID NO: 1986507 - RNA, 14 nt, Homo sapiens
auuuagcaaccuag

SEQ ID NO: 1986508 - RNA, 14 nt, Homo sapiens
cuuucccacccucc

SEQ ID NO: 1986509 - RNA, 14 nt, Homo sapiens
accucucaauuucu

SEQ ID NO: 1986510 - RNA, 21 nt, Homo sapiens
aagauucauauuuacuucuua

SEQ ID NO: 1986511 - RNA, 21 nt, Homo sapiens
ucaggguccagacccugaaga

SEQ ID NO: 1986512 - RNA, 16 nt, Homo sapiens
gagaauuaucucaagu

SEQ ID NO: 1986513 - RNA, 23 nt, Homo sapiens
agacccuugacaccugcugagaa

SEQ ID NO: 1986514 - RNA, 23 nt, Homo sapiens
ucaagcucaugucauuaugacau

SEQ ID NO: 1986515 - RNA, 17 nt, Homo sapiens
caugaaggcagagccau

SEQ ID NO: 1986516 - RNA, 18 nt, Homo sapiens
cucgcuagguucuuauca

SEQ ID NO: 1986517 - RNA, 12 nt, Homo sapiens
cuugaucauucu

SEQ ID NO: 1986518 - RNA, 16 nt, Homo sapiens
cucaggcgggacagug

SEQ ID NO: 1986519 - RNA, 21 nt, Homo sapiens
aguacaugcacacucaugugc

SEQ ID NO: 1986520 - RNA, 13 nt, Homo sapiens
uucaccaucaugu

SEQ ID NO: 1986521 - RNA, 19 nt, Homo sapiens
accaagggcagaggggugc

SEQ ID NO: 1986522 - RNA, 13 nt, Homo sapiens
aagauaucccuaa

SEQ ID NO: 1986523 - RNA, 13 nt, Homo sapiens
aacagggcauuuu

SEQ ID NO: 1986524 - RNA, 23 nt, Homo sapiens
uaaguuuuccuuuuguuuuccac

SEQ ID NO: 1986525 - RNA, 15 nt, Homo sapiens
gagcauagaagccac

SEQ ID NO: 1986526 - RNA, 14 nt, Homo sapiens
cauaauucuuauua

SEQ ID NO: 1986527 - RNA, 13 nt, Homo sapiens
acacagcuguucu

SEQ ID NO: 1986528 - RNA, 12 nt, Homo sapiens
uuuauucaggaa

SEQ ID NO: 1986529 - RNA, 13 nt, Homo sapiens
cugaccucaggug

SEQ ID NO: 1986530 - RNA, 17 nt, Homo sapiens
acugcaguuauuuacca

SEQ ID NO: 1986531 - RNA, 15 nt, Homo sapiens
gcuggaauuaugcug

SEQ ID NO: 1986532 - RNA, 14 nt, Homo sapiens
ccaauacuacugua

SEQ ID NO: 1986533 - RNA, 12 nt, Homo sapiens
gucagggugcug

SEQ ID NO: 1986534 - RNA, 14 nt, Homo sapiens
gccucaaccuccca

SEQ ID NO: 1986535 - RNA, 17 nt, Homo sapiens
cagcaguacucagcaug

SEQ ID NO: 1986536 - RNA, 21 nt, Homo sapiens
ucagccacgccucucucagcc

SEQ ID NO: 1986537 - RNA, 15 nt, Homo sapiens
aucuguaccaugacc

SEQ ID NO: 1986538 - RNA, 17 nt, Homo sapiens
aaggaguucagauguuu

SEQ ID NO: 1986539 - RNA, 18 nt, Homo sapiens
caggccuucccaccagga

SEQ ID NO: 1986540 - RNA, 20 nt, Homo sapiens
caaauacaugcacagucaua

SEQ ID NO: 1986541 - RNA, 13 nt, Homo sapiens
gucaugauuucaa

SEQ ID NO: 1986542 - RNA, 13 nt, Homo sapiens
guggugauuugga

SEQ ID NO: 1986543 - RNA, 13 nt, Homo sapiens
uugaagaugugau

SEQ ID NO: 1986544 - RNA, 16 nt, Homo sapiens
ucugcuguucuucacu

SEQ ID NO: 1986545 - RNA, 22 nt, Homo sapiens
ucuuacauuuuucagacuucau

SEQ ID NO: 1986546 - RNA, 19 nt, Homo sapiens
acuagagucugaacagcug

SEQ ID NO: 1986547 - RNA, 14 nt, Homo sapiens
ugugcacucauaug

SEQ ID NO: 1986548 - RNA, 16 nt, Homo sapiens
uuccugcuuccgagau

SEQ ID NO: 1986549 - RNA, 16 nt, Homo sapiens
acuggugugcucucuu

SEQ ID NO: 1986550 - RNA, 22 nt, Homo sapiens
uggugaaacacccaucguucuc

SEQ ID NO: 1986551 - RNA, 14 nt, Homo sapiens
aucuuggccaucua

SEQ ID NO: 1986552 - RNA, 14 nt, Homo sapiens
cuaaaagacaugca

SEQ ID NO: 1986553 - RNA, 13 nt, Homo sapiens
cucacuaccuccu

SEQ ID NO: 1986554 - RNA, 18 nt, Homo sapiens
accacaaggcuguugcau

SEQ ID NO: 1986555 - RNA, 14 nt, Homo sapiens
ucaugaaaacuggg

SEQ ID NO: 1986556 - RNA, 14 nt, Homo sapiens
aagggcaucaucua

SEQ ID NO: 1986557 - RNA, 17 nt, Homo sapiens
ucucggccccucugauu

SEQ ID NO: 1986558 - RNA, 15 nt, Homo sapiens
uaugaaacauaucau

SEQ ID NO: 1986559 - RNA, 15 nt, Homo sapiens
cuggccugagaguca

SEQ ID NO: 1986560 - RNA, 16 nt, Homo sapiens
caugaaggaucaaaaa

SEQ ID NO: 1986561 - RNA, 19 nt, Homo sapiens
guacaaugguuuauuccca

SEQ ID NO: 1986562 - RNA, 19 nt, Homo sapiens
auuccuugcuuucaucacu

SEQ ID NO: 1986563 - RNA, 16 nt, Homo sapiens
cuucucggagacccau

SEQ ID NO: 1986564 - RNA, 20 nt, Homo sapiens
aacauguuuuguauguuaaa

SEQ ID NO: 1986565 - RNA, 14 nt, Homo sapiens
cccuaagacuccuc

SEQ ID NO: 1986566 - RNA, 22 nt, Homo sapiens
auucuuuuauauaacuacauua

SEQ ID NO: 1986567 - RNA, 17 nt, Homo sapiens
guagaguggugcugcuu

SEQ ID NO: 1986568 - RNA, 13 nt, Homo sapiens
aacugacugccuu

SEQ ID NO: 1986569 - RNA, 14 nt, Homo sapiens
uuuauuaauaguca

SEQ ID NO: 1986570 - RNA, 15 nt, Homo sapiens
uuuguaauauucucc

SEQ ID NO: 1986571 - RNA, 16 nt, Homo sapiens
gugacucgaguguuua

SEQ ID NO: 1986572 - RNA, 19 nt, Homo sapiens
aaacccacauaaacacuuc

SEQ ID NO: 1986573 - RNA, 15 nt, Homo sapiens
auuucuuuuauguua

SEQ ID NO: 1986574 - RNA, 13 nt, Homo sapiens
auugguccaagau

SEQ ID NO: 1986575 - RNA, 15 nt, Homo sapiens
cgcaauuaugcuuuc

SEQ ID NO: 1986576 - RNA, 10 nt, Homo sapiens
ccugccauuc

SEQ ID NO: 1986577 - RNA, 20 nt, Homo sapiens
gugccuauuuauucauucag

SEQ ID NO: 1986578 - RNA, 12 nt, Homo sapiens
gcuugcacacau

SEQ ID NO: 1986579 - RNA, 22 nt, Homo sapiens
aaugcugccaugcccaccaucg

SEQ ID NO: 1986580 - RNA, 18 nt, Homo sapiens
agcaggucaggacucaga

SEQ ID NO: 1986581 - RNA, 23 nt, Homo sapiens
uccggauggaaucacagccaaua

SEQ ID NO: 1986582 - RNA, 23 nt, Homo sapiens
agauaugcaaauuccauagcuca

SEQ ID NO: 1986583 - RNA, 19 nt, Homo sapiens
ccugauggugaaaccaaac

SEQ ID NO: 1986584 - RNA, 17 nt, Homo sapiens
gcaugugcagacacuca

SEQ ID NO: 1986585 - RNA, 19 nt, Homo sapiens
ccguuuuaaggacauuaaa

SEQ ID NO: 1986586 - RNA, 17 nt, Homo sapiens
gccacucuacaggucca

SEQ ID NO: 1986587 - RNA, 14 nt, Homo sapiens
agaauacaauggga

SEQ ID NO: 1986588 - RNA, 14 nt, Homo sapiens
ccaaacauuacaaa

SEQ ID NO: 1986589 - RNA, 17 nt, Homo sapiens
uauauuuuucugagauu

SEQ ID NO: 1986590 - RNA, 19 nt, Homo sapiens
uggaaacauuggugaugcu

SEQ ID NO: 1986591 - RNA, 22 nt, Homo sapiens
cccaagggagacugaccaucau

SEQ ID NO: 1986592 - RNA, 23 nt, Homo sapiens
cauaggcccagugagaugcauuc

SEQ ID NO: 1986593 - RNA, 17 nt, Homo sapiens
agcaagagccacugagg

SEQ ID NO: 1986594 - RNA, 17 nt, Homo sapiens
ucuuuggaaauggcugu

SEQ ID NO: 1986595 - RNA, 15 nt, Homo sapiens
cguguuucacagugg

SEQ ID NO: 1986596 - RNA, 16 nt, Homo sapiens
ugaaagugaacaauca

SEQ ID NO: 1986597 - RNA, 19 nt, Homo sapiens
gaggugagagaagaccucu

SEQ ID NO: 1986598 - RNA, 22 nt, Homo sapiens
ucaauucuuuguauaugcauuc

SEQ ID NO: 1986599 - RNA, 20 nt, Homo sapiens
ugcuaguggccgaaccagaa

SEQ ID NO: 1986600 - RNA, 21 nt, Homo sapiens
gccuuaaaagccaucauguaa

SEQ ID NO: 1986601 - RNA, 13 nt, Homo sapiens
cagagacugggac

SEQ ID NO: 1986602 - RNA, 15 nt, Homo sapiens
agauagguaaauacc

SEQ ID NO: 1986603 - RNA, 15 nt, Homo sapiens
cagcuugcacaaaga

SEQ ID NO: 1986604 - RNA, 14 nt, Homo sapiens
augucuuuggcuca

SEQ ID NO: 1986605 - RNA, 14 nt, Homo sapiens
ucucacaagaugga

SEQ ID NO: 1986606 - RNA, 12 nt, Homo sapiens
uuucuggagcaa

SEQ ID NO: 1986607 - RNA, 17 nt, Homo sapiens
ugucuggugcacauaau

SEQ ID NO: 1986608 - RNA, 21 nt, Homo sapiens
gcucccccauaguucacugac

SEQ ID NO: 1986609 - RNA, 12 nt, Homo sapiens
aaaaagcuguau

SEQ ID NO: 1986610 - RNA, 20 nt, Homo sapiens
acagcuggguggcacugcca

SEQ ID NO: 1986611 - RNA, 22 nt, Homo sapiens
ugaauuuaaaaauaaauaccaa

SEQ ID NO: 1986612 - RNA, 22 nt, Homo sapiens
ugaggguauguuuuauauagca

SEQ ID NO: 1986613 - RNA, 19 nt, Homo sapiens
gcccaucaucccuucuucc

SEQ ID NO: 1986614 - RNA, 17 nt, Homo sapiens
uuaaacuuuuuuaacca

SEQ ID NO: 1986615 - RNA, 17 nt, Homo sapiens
caccugucuuggccucc

SEQ ID NO: 1986616 - RNA, 12 nt, Homo sapiens
uacugucugugu

SEQ ID NO: 1986617 - RNA, 13 nt, Homo sapiens
ucacugucaucug

SEQ ID NO: 1986618 - RNA, 21 nt, Homo sapiens
gcaaaaguggaaucacuguau

SEQ ID NO: 1986619 - RNA, 15 nt, Homo sapiens
augaauaaacaguua

SEQ ID NO: 1986620 - RNA, 22 nt, Homo sapiens
uguucuguuggaugacuuugag

SEQ ID NO: 1986621 - RNA, 14 nt, Homo sapiens
agcacccaagccag

SEQ ID NO: 1986622 - RNA, 16 nt, Homo sapiens
ucugggcuacugccac

SEQ ID NO: 1986623 - RNA, 12 nt, Homo sapiens
caguuuuuuaca

SEQ ID NO: 1986624 - RNA, 15 nt, Homo sapiens
aggcuuccuaucugu

SEQ ID NO: 1986625 - RNA, 17 nt, Homo sapiens
uccuaggucaugaagga

SEQ ID NO: 1986626 - RNA, 19 nt, Homo sapiens
acuuguacuuacacugaaa

SEQ ID NO: 1986627 - RNA, 15 nt, Homo sapiens
gagagggauggcuca

SEQ ID NO: 1986628 - RNA, 20 nt, Homo sapiens
ggccgaaaaggauaugcagu

SEQ ID NO: 1986629 - RNA, 11 nt, Homo sapiens
gagcugugcag

SEQ ID NO: 1986630 - RNA, 13 nt, Homo sapiens
uaaauauccaggu

SEQ ID NO: 1986631 - RNA, 19 nt, Homo sapiens
uuuuggcuugcuuaugugu

SEQ ID NO: 1986632 - RNA, 21 nt, Homo sapiens
gaaacuaccaggugugccugg

SEQ ID NO: 1986633 - RNA, 17 nt, Homo sapiens
agcgggucuaguggaaa

SEQ ID NO: 1986634 - RNA, 16 nt, Homo sapiens
auccagaucauuccuc

SEQ ID NO: 1986635 - RNA, 19 nt, Homo sapiens
ggcacccuggaaccgggaa

SEQ ID NO: 1986636 - RNA, 21 nt, Homo sapiens
ggaguaccuggaccuguccau

SEQ ID NO: 1986637 - RNA, 20 nt, Homo sapiens
agaagaaguuaucaacaugc

SEQ ID NO: 1986638 - RNA, 20 nt, Homo sapiens
aaggaggcugggcauggugg

SEQ ID NO: 1986639 - RNA, 13 nt, Homo sapiens
cugagaaccaaaa

SEQ ID NO: 1986640 - RNA, 13 nt, Homo sapiens
aaauaaacaugug

SEQ ID NO: 1986641 - RNA, 14 nt, Homo sapiens
gcuuguuccaaugc

SEQ ID NO: 1986642 - RNA, 19 nt, Homo sapiens
ucucuacucccucuuguca

SEQ ID NO: 1986643 - RNA, 22 nt, Homo sapiens
caaauacauacaaccuauguaa

SEQ ID NO: 1986644 - RNA, 14 nt, Homo sapiens
gaauguauaauauc

SEQ ID NO: 1986645 - RNA, 17 nt, Homo sapiens
aggauugaccuuugcac

SEQ ID NO: 1986646 - RNA, 19 nt, Homo sapiens
augagccgugaacugugca

SEQ ID NO: 1986647 - RNA, 22 nt, Homo sapiens
cgaccuccccacccgcucccac

SEQ ID NO: 1986648 - RNA, 20 nt, Homo sapiens
cuguuaaaucguaacaagca

SEQ ID NO: 1986649 - RNA, 15 nt, Homo sapiens
uuucuaugcauaaaa

SEQ ID NO: 1986650 - RNA, 15 nt, Homo sapiens
uuaauguacuuucau

SEQ ID NO: 1986651 - RNA, 18 nt, Homo sapiens
cuuugcuuuacagcacug

SEQ ID NO: 1986652 - RNA, 22 nt, Homo sapiens
aggaguuguuucugacccacug

SEQ ID NO: 1986653 - RNA, 20 nt, Homo sapiens
cugugccucuucccaucuca

SEQ ID NO: 1986654 - RNA, 16 nt, Homo sapiens
uuauaacuuccauuuu

SEQ ID NO: 1986655 - RNA, 23 nt, Homo sapiens
uccccaugcaugggaaagugcaa

SEQ ID NO: 1986656 - RNA, 13 nt, Homo sapiens
ugggaugggaucc

SEQ ID NO: 1986657 - RNA, 18 nt, Homo sapiens
uuuauauuuaaauaaagg

SEQ ID NO: 1986658 - RNA, 23 nt, Homo sapiens
uaaauuauuuuuaaugauuugag

SEQ ID NO: 1986659 - RNA, 22 nt, Homo sapiens
guuuccaagaugucccauugau

SEQ ID NO: 1986660 - RNA, 14 nt, Homo sapiens
uuccaugcccuugu

SEQ ID NO: 1986661 - RNA, 23 nt, Homo sapiens
aggcguuuguuauauaaaaauac

SEQ ID NO: 1986662 - RNA, 15 nt, Homo sapiens
ccaucacacaugcau

SEQ ID NO: 1986663 - RNA, 19 nt, Homo sapiens
cucuaaugcuugauuuagg

SEQ ID NO: 1986664 - RNA, 15 nt, Homo sapiens
cauuuauaaacuaga

SEQ ID NO: 1986665 - RNA, 19 nt, Homo sapiens
gggauggcuaaaaccauca

SEQ ID NO: 1986666 - RNA, 19 nt, Homo sapiens
uucagagcuucucacagca

SEQ ID NO: 1986667 - RNA, 23 nt, Homo sapiens
caguggcccauaaguguaaaaua

SEQ ID NO: 1986668 - RNA, 16 nt, Homo sapiens
uuauaagguaguacug

SEQ ID NO: 1986669 - RNA, 14 nt, Homo sapiens
agaagaugccagcu

SEQ ID NO: 1986670 - RNA, 16 nt, Homo sapiens
uuuaucuuaacacuga

SEQ ID NO: 1986671 - RNA, 19 nt, Homo sapiens
gucaugagcugucugggaa

SEQ ID NO: 1986672 - RNA, 18 nt, Homo sapiens
cugucuccucccagguuu

SEQ ID NO: 1986673 - RNA, 16 nt, Homo sapiens
aagcuagcacuaacuc

SEQ ID NO: 1986674 - RNA, 16 nt, Homo sapiens
uuauaaaccuucagaa

SEQ ID NO: 1986675 - RNA, 14 nt, Homo sapiens
auuuugagcauuag

SEQ ID NO: 1986676 - RNA, 15 nt, Homo sapiens
aguucuccuucccug

SEQ ID NO: 1986677 - RNA, 18 nt, Homo sapiens
ucuaacgggcauucacaa

SEQ ID NO: 1986678 - RNA, 19 nt, Homo sapiens
gaggccuuccagggacgaa

SEQ ID NO: 1986679 - RNA, 18 nt, Homo sapiens
auucuaaguuauuuacuu

SEQ ID NO: 1986680 - RNA, 13 nt, Homo sapiens
uacacacgcugcc

SEQ ID NO: 1986681 - RNA, 17 nt, Homo sapiens
gaauuaugucugcugaa

SEQ ID NO: 1986682 - RNA, 18 nt, Homo sapiens
uuggugacaaaauucauu

SEQ ID NO: 1986683 - RNA, 18 nt, Homo sapiens
uuugaggagcagcuucag

SEQ ID NO: 1986684 - RNA, 12 nt, Homo sapiens
ucauugcuaaaa

SEQ ID NO: 1986685 - RNA, 13 nt, Homo sapiens
accagaauucccu

SEQ ID NO: 1986686 - RNA, 20 nt, Homo sapiens
uaaugaacuaccaucugaug

SEQ ID NO: 1986687 - RNA, 17 nt, Homo sapiens
uagaaauugaaguuuca

SEQ ID NO: 1986688 - RNA, 18 nt, Homo sapiens
cuuccccugugacuccuc

SEQ ID NO: 1986689 - RNA, 18 nt, Homo sapiens
uccacugguggaccacgg

SEQ ID NO: 1986690 - RNA, 18 nt, Homo sapiens
cccuuggggguucaggga

SEQ ID NO: 1986691 - RNA, 14 nt, Homo sapiens
uuuguuguauggaa

SEQ ID NO: 1986692 - RNA, 12 nt, Homo sapiens
gauuauuugcau

SEQ ID NO: 1986693 - RNA, 21 nt, Homo sapiens
auagccaccccaagagugguu

SEQ ID NO: 1986694 - RNA, 20 nt, Homo sapiens
acugagacuuggaaccucau

SEQ ID NO: 1986695 - RNA, 13 nt, Homo sapiens
uugaagauucuau

SEQ ID NO: 1986696 - RNA, 23 nt, Homo sapiens
uccuaggucaugaaggacacucu

SEQ ID NO: 1986697 - RNA, 15 nt, Homo sapiens
uuguaaucauaaaua

SEQ ID NO: 1986698 - RNA, 17 nt, Homo sapiens
aauuuugcacugaagag

SEQ ID NO: 1986699 - RNA, 13 nt, Homo sapiens
cuugaauuguagg

SEQ ID NO: 1986700 - RNA, 24 nt, Homo sapiens
ucacuuggcugucugaccagagaa

SEQ ID NO: 1986701 - RNA, 12 nt, Homo sapiens
aauaaugcuuuu

SEQ ID NO: 1986702 - RNA, 19 nt, Homo sapiens
aacacugccugcucuucag

SEQ ID NO: 1986703 - RNA, 15 nt, Homo sapiens
aggaaaacaugacau

SEQ ID NO: 1986704 - RNA, 14 nt, Homo sapiens
ucccuccacauuuc

SEQ ID NO: 1986705 - RNA, 20 nt, Homo sapiens
agcaucauggaucaaccaag

SEQ ID NO: 1986706 - RNA, 18 nt, Homo sapiens
acugcaaaauaaaaucuc

SEQ ID NO: 1986707 - RNA, 20 nt, Homo sapiens
aaccauucacagugcaagaa

SEQ ID NO: 1986708 - RNA, 22 nt, Homo sapiens
aauggcaacaaacacauuguga

SEQ ID NO: 1986709 - RNA, 23 nt, Homo sapiens
gaagaguguggagucauucucau

SEQ ID NO: 1986710 - RNA, 13 nt, Homo sapiens
auuaggguaauau

SEQ ID NO: 1986711 - RNA, 16 nt, Homo sapiens
caauaauaaauccuca

SEQ ID NO: 1986712 - RNA, 18 nt, Homo sapiens
ccucauccuuuccugcca

SEQ ID NO: 1986713 - RNA, 22 nt, Homo sapiens
cuucucgaauugaagcaaguga

SEQ ID NO: 1986714 - RNA, 19 nt, Homo sapiens
aaguccccgaguuucccca

SEQ ID NO: 1986715 - RNA, 22 nt, Homo sapiens
guaaagccucagcaacagccag

SEQ ID NO: 1986716 - RNA, 22 nt, Homo sapiens
aagccccaccuuuaaguccucu

SEQ ID NO: 1986717 - RNA, 22 nt, Homo sapiens
ugugacuugaacuagauugcau

SEQ ID NO: 1986718 - RNA, 20 nt, Homo sapiens
cagcggucauucuacacuga

SEQ ID NO: 1986719 - RNA, 23 nt, Homo sapiens
gcaaugugcccccagacgcacgu

SEQ ID NO: 1986720 - RNA, 21 nt, Homo sapiens
uucccuuggcaaaugaaaguu

SEQ ID NO: 1986721 - RNA, 13 nt, Homo sapiens
aggaguuuugcaa

SEQ ID NO: 1986722 - RNA, 20 nt, Homo sapiens
ucuugcacgaggcaccagag

SEQ ID NO: 1986723 - RNA, 17 nt, Homo sapiens
gaaacugcuaauuacac

SEQ ID NO: 1986724 - RNA, 20 nt, Homo sapiens
gaagcuuugguucucugauu

SEQ ID NO: 1986725 - RNA, 16 nt, Homo sapiens
gugguuugcuccagaa

SEQ ID NO: 1986726 - RNA, 18 nt, Homo sapiens
uuuucagugcuuugcccu

SEQ ID NO: 1986727 - RNA, 14 nt, Homo sapiens
gaugccucuucuac

SEQ ID NO: 1986728 - RNA, 17 nt, Homo sapiens
uucgugccaugcccuua

SEQ ID NO: 1986729 - RNA, 16 nt, Homo sapiens
cagccuccaauguaca

SEQ ID NO: 1986730 - RNA, 19 nt, Homo sapiens
ugguuuuuggcucuuucag

SEQ ID NO: 1986731 - RNA, 21 nt, Homo sapiens
augaguagauaauuucagggu

SEQ ID NO: 1986732 - RNA, 15 nt, Homo sapiens
ccgugugggagaccg

SEQ ID NO: 1986733 - RNA, 16 nt, Homo sapiens
cauuaaguaaucaaua

SEQ ID NO: 1986734 - RNA, 17 nt, Homo sapiens
cuucauauuuuugauca

SEQ ID NO: 1986735 - RNA, 20 nt, Homo sapiens
ucuauugaaaaaucaccaca

SEQ ID NO: 1986736 - RNA, 19 nt, Homo sapiens
uucuucagguaacacuaca

SEQ ID NO: 1986737 - RNA, 23 nt, Homo sapiens
ccagguuugguuauuaugaauaa

SEQ ID NO: 1986738 - RNA, 13 nt, Homo sapiens
uaaaagcauuuug

SEQ ID NO: 1986739 - RNA, 22 nt, Homo sapiens
auguugaauucuuuugccaagg

SEQ ID NO: 1986740 - RNA, 16 nt, Homo sapiens
cccuccauucugcacu

SEQ ID NO: 1986741 - RNA, 20 nt, Homo sapiens
gaaaagaaaucagcagacac

SEQ ID NO: 1986742 - RNA, 14 nt, Homo sapiens
gagaagcagugagc

SEQ ID NO: 1986743 - RNA, 22 nt, Homo sapiens
guuucuuuccccaaaaauugac

SEQ ID NO: 1986744 - RNA, 17 nt, Homo sapiens
cccagauaccugugagg

SEQ ID NO: 1986745 - RNA, 14 nt, Homo sapiens
agaguaaagcaacu

SEQ ID NO: 1986746 - RNA, 18 nt, Homo sapiens
uacauacuaggugccuuu

SEQ ID NO: 1986747 - RNA, 16 nt, Homo sapiens
ccacaaacugccuguu

SEQ ID NO: 1986748 - RNA, 22 nt, Homo sapiens
aaauuuggguauagacaauaaa

SEQ ID NO: 1986749 - RNA, 14 nt, Homo sapiens
ugcccaggggagcc

SEQ ID NO: 1986750 - RNA, 19 nt, Homo sapiens
cagggcccaggccaugugg

SEQ ID NO: 1986751 - RNA, 19 nt, Homo sapiens
agggggucccuccaagugg

SEQ ID NO: 1986752 - RNA, 18 nt, Homo sapiens
aagcaugucucugcuucc

SEQ ID NO: 1986753 - RNA, 13 nt, Homo sapiens
ccccuacaugaaa

SEQ ID NO: 1986754 - RNA, 22 nt, Homo sapiens
accaucuggaaggacaucuaca

SEQ ID NO: 1986755 - RNA, 22 nt, Homo sapiens
cuuaguaagugcuuuucuuaua

SEQ ID NO: 1986756 - RNA, 16 nt, Homo sapiens
uucucacacuggugga

SEQ ID NO: 1986757 - RNA, 21 nt, Homo sapiens
cuugaggaaacugaggugcaa

SEQ ID NO: 1986758 - RNA, 22 nt, Homo sapiens
gcugggauggugggcuucaggg

SEQ ID NO: 1986759 - RNA, 12 nt, Homo sapiens
ucucaaguccau

SEQ ID NO: 1986760 - RNA, 18 nt, Homo sapiens
gugauaaguuccaaauau

SEQ ID NO: 1986761 - RNA, 15 nt, Homo sapiens
ucuacuuccucuggu

SEQ ID NO: 1986762 - RNA, 20 nt, Homo sapiens
ugcucaggcuugaaaugcau

SEQ ID NO: 1986763 - RNA, 16 nt, Homo sapiens
aaaguaagacaucuca

SEQ ID NO: 1986764 - RNA, 22 nt, Homo sapiens
uauagagguguaacacuuguca

SEQ ID NO: 1986765 - RNA, 14 nt, Homo sapiens
aucuagccuccauc

SEQ ID NO: 1986766 - RNA, 22 nt, Homo sapiens
gcugaguuggguuggaguacac

SEQ ID NO: 1986767 - RNA, 21 nt, Homo sapiens
ucucugccccguuucuugccc

SEQ ID NO: 1986768 - RNA, 20 nt, Homo sapiens
uugcgccguuguacuccagc

SEQ ID NO: 1986769 - RNA, 15 nt, Homo sapiens
ucccaaauaaacucc

SEQ ID NO: 1986770 - RNA, 19 nt, Homo sapiens
uggggggcaggccucccaa

SEQ ID NO: 1986771 - RNA, 24 nt, Homo sapiens
auugacaugugccagggcaaugau

SEQ ID NO: 1986772 - RNA, 20 nt, Homo sapiens
uuaaaauaacacuugcccau

SEQ ID NO: 1986773 - RNA, 12 nt, Homo sapiens
ccuccucaggag

SEQ ID NO: 1986774 - RNA, 13 nt, Homo sapiens
aacaggguauaug

SEQ ID NO: 1986775 - RNA, 15 nt, Homo sapiens
ugggguaauacuucc

SEQ ID NO: 1986776 - RNA, 21 nt, Homo sapiens
aaagccgggggccugcaucac

SEQ ID NO: 1986777 - RNA, 21 nt, Homo sapiens
uccuuuaucaagaagucugaa

SEQ ID NO: 1986778 - RNA, 20 nt, Homo sapiens
cagaugccucuagaagagac

SEQ ID NO: 1986779 - RNA, 16 nt, Homo sapiens
uaucuuaaaucuguga

SEQ ID NO: 1986780 - RNA, 16 nt, Homo sapiens
uccaaaggcucuguua

SEQ ID NO: 1986781 - RNA, 13 nt, Homo sapiens
acacagugcagug

SEQ ID NO: 1986782 - RNA, 11 nt, Homo sapiens
gcccagaauug

SEQ ID NO: 1986783 - RNA, 22 nt, Homo sapiens
aacuuggaaauagugauuucca

SEQ ID NO: 1986784 - RNA, 15 nt, Homo sapiens
uuuuauagucugaaa

SEQ ID NO: 1986785 - RNA, 22 nt, Homo sapiens
cugagaaccccucugggaaaau

SEQ ID NO: 1986786 - RNA, 16 nt, Homo sapiens
uguuccccugcucugu

SEQ ID NO: 1986787 - RNA, 15 nt, Homo sapiens
gaguuuuacugccug

SEQ ID NO: 1986788 - RNA, 22 nt, Homo sapiens
cuguccugccucucugcuccag

SEQ ID NO: 1986789 - RNA, 13 nt, Homo sapiens
ugggcaccucuag

SEQ ID NO: 1986790 - RNA, 18 nt, Homo sapiens
aagaaaauaugcaucuaa

SEQ ID NO: 1986791 - RNA, 12 nt, Homo sapiens
uugcagccaaag

SEQ ID NO: 1986792 - RNA, 16 nt, Homo sapiens
guaccgcaaugugacu

SEQ ID NO: 1986793 - RNA, 17 nt, Homo sapiens
agugauaagagcagugg

SEQ ID NO: 1986794 - RNA, 20 nt, Homo sapiens
ugugaauuauugacacugaa

SEQ ID NO: 1986795 - RNA, 14 nt, Homo sapiens
uagauauuacugga

SEQ ID NO: 1986796 - RNA, 16 nt, Homo sapiens
gugucuuggcacuguu

SEQ ID NO: 1986797 - RNA, 18 nt, Homo sapiens
uuucaggggugacucaga

SEQ ID NO: 1986798 - RNA, 15 nt, Homo sapiens
aauccuugacucuua

SEQ ID NO: 1986799 - RNA, 21 nt, Homo sapiens
gagguggcguccagcagucca

SEQ ID NO: 1986800 - RNA, 13 nt, Homo sapiens
aacuguaugcuca

SEQ ID NO: 1986801 - RNA, 14 nt, Homo sapiens
cuuccugcguagaa

SEQ ID NO: 1986802 - RNA, 20 nt, Homo sapiens
uaaagaaaaaagcaccaaag

SEQ ID NO: 1986803 - RNA, 15 nt, Homo sapiens
ugauuggugauucaa

SEQ ID NO: 1986804 - RNA, 23 nt, Homo sapiens
ggcagauuugcaacuaguaaaau

SEQ ID NO: 1986805 - RNA, 17 nt, Homo sapiens
cacucgccuacuaagua

SEQ ID NO: 1986806 - RNA, 23 nt, Homo sapiens
cuuccugguagaccacugccaua

SEQ ID NO: 1986807 - RNA, 21 nt, Homo sapiens
ggcgacugagccaugcucaga

SEQ ID NO: 1986808 - RNA, 19 nt, Homo sapiens
gagcugaaaaaucacaucc

SEQ ID NO: 1986809 - RNA, 14 nt, Homo sapiens
uuuuccaacagggg

SEQ ID NO: 1986810 - RNA, 22 nt, Homo sapiens
acaucuuuucacaacuuaccuu

SEQ ID NO: 1986811 - RNA, 16 nt, Homo sapiens
ugggaaaacagugaau

SEQ ID NO: 1986812 - RNA, 20 nt, Homo sapiens
gugggggccccgucucaggu

SEQ ID NO: 1986813 - RNA, 22 nt, Homo sapiens
agcaauguacaccagagccuca

SEQ ID NO: 1986814 - RNA, 13 nt, Homo sapiens
acagaaggggugg

SEQ ID NO: 1986815 - RNA, 18 nt, Homo sapiens
acuuuuuuuuaacacuuu

SEQ ID NO: 1986816 - RNA, 20 nt, Homo sapiens
ugaccuugagaagauucuuc

SEQ ID NO: 1986817 - RNA, 13 nt, Homo sapiens
ccaggccugcauu

SEQ ID NO: 1986818 - RNA, 19 nt, Homo sapiens
agugucuuaggguagaaag

SEQ ID NO: 1986819 - RNA, 21 nt, Homo sapiens
gggaaucauuuuucacuguac

SEQ ID NO: 1986820 - RNA, 14 nt, Homo sapiens
gauggagaugucuc

SEQ ID NO: 1986821 - RNA, 15 nt, Homo sapiens
gcccucuucaauccc

SEQ ID NO: 1986822 - RNA, 21 nt, Homo sapiens
acuucucugugaacuauuaau

SEQ ID NO: 1986823 - RNA, 15 nt, Homo sapiens
cagcacccaugggaa

SEQ ID NO: 1986824 - RNA, 22 nt, Homo sapiens
acacagagcgccucaccugcau

SEQ ID NO: 1986825 - RNA, 22 nt, Homo sapiens
accauuagauaaacacaggcag

SEQ ID NO: 1986826 - RNA, 18 nt, Homo sapiens
cagcagcaucucugaaca

SEQ ID NO: 1986827 - RNA, 21 nt, Homo sapiens
uugaguuugcaucaaucuuaa

SEQ ID NO: 1986828 - RNA, 22 nt, Homo sapiens
cuuaauauaaauucacuuucau

SEQ ID NO: 1986829 - RNA, 22 nt, Homo sapiens
agggugggaucagcccugccag

SEQ ID NO: 1986830 - RNA, 21 nt, Homo sapiens
cuguucuuccuauuucuuuca

SEQ ID NO: 1986831 - RNA, 15 nt, Homo sapiens
aucagugauuuucaa

SEQ ID NO: 1986832 - RNA, 21 nt, Homo sapiens
uccagggcuccaaaucugccu

SEQ ID NO: 1986833 - RNA, 14 nt, Homo sapiens
ccaguccucaggca

SEQ ID NO: 1986834 - RNA, 18 nt, Homo sapiens
uguaaaguugguuggaua

SEQ ID NO: 1986835 - RNA, 18 nt, Homo sapiens
cuguugcuuaaaccacuu

SEQ ID NO: 1986836 - RNA, 23 nt, Homo sapiens
uggcccagccggccucucuggcc

SEQ ID NO: 1986837 - RNA, 20 nt, Homo sapiens
ugucagucuguccacgugga

SEQ ID NO: 1986838 - RNA, 20 nt, Homo sapiens
gagaaaaugaauggacaaag

SEQ ID NO: 1986839 - RNA, 15 nt, Homo sapiens
agucugcuucagugc

SEQ ID NO: 1986840 - RNA, 16 nt, Homo sapiens
auggccuucauaucau

SEQ ID NO: 1986841 - RNA, 12 nt, Homo sapiens
gccuuagugggc

SEQ ID NO: 1986842 - RNA, 22 nt, Homo sapiens
aucugguauauguaaguguuca

SEQ ID NO: 1986843 - RNA, 16 nt, Homo sapiens
ugucugcuuucuccau

SEQ ID NO: 1986844 - RNA, 20 nt, Homo sapiens
uguccuuuuucacuuugaaa

SEQ ID NO: 1986845 - RNA, 14 nt, Homo sapiens
aaguucuucaccuc

SEQ ID NO: 1986846 - RNA, 19 nt, Homo sapiens
gccuccccgugccaaaaau

SEQ ID NO: 1986847 - RNA, 15 nt, Homo sapiens
auguauuugucaaug

SEQ ID NO: 1986848 - RNA, 16 nt, Homo sapiens
gcauuaccacacucag

SEQ ID NO: 1986849 - RNA, 16 nt, Homo sapiens
cuuggcuuuaugcaaa

SEQ ID NO: 1986850 - RNA, 20 nt, Homo sapiens
aggaugaauguaugugcacu

SEQ ID NO: 1986851 - RNA, 15 nt, Homo sapiens
auuuugauagcaaug

SEQ ID NO: 1986852 - RNA, 11 nt, Homo sapiens
aauauugauuu

SEQ ID NO: 1986853 - RNA, 15 nt, Homo sapiens
gccaccugcaggacc

SEQ ID NO: 1986854 - RNA, 17 nt, Homo sapiens
aggggaucccaccccau

SEQ ID NO: 1986855 - RNA, 23 nt, Homo sapiens
ggacuuccuauuaagacuuacuu

SEQ ID NO: 1986856 - RNA, 12 nt, Homo sapiens
aauaacuaucaa

SEQ ID NO: 1986857 - RNA, 16 nt, Homo sapiens
ucaccacuaccagcca

SEQ ID NO: 1986858 - RNA, 19 nt, Homo sapiens
uuaauaagcuacuagcaaa

SEQ ID NO: 1986859 - RNA, 18 nt, Homo sapiens
caaccuccaccuucuggg

SEQ ID NO: 1986860 - RNA, 21 nt, Homo sapiens
aagaugaguuauuuaacuggu

SEQ ID NO: 1986861 - RNA, 15 nt, Homo sapiens
gaggcuugggaccgc

SEQ ID NO: 1986862 - RNA, 23 nt, Homo sapiens
cuccaagugcggcacugcaaaga

SEQ ID NO: 1986863 - RNA, 14 nt, Homo sapiens
ucgugccacugcac

SEQ ID NO: 1986864 - RNA, 18 nt, Homo sapiens
uucucugccccguuucuu

SEQ ID NO: 1986865 - RNA, 17 nt, Homo sapiens
gucaauaaaccacuguu

SEQ ID NO: 1986866 - RNA, 12 nt, Homo sapiens
agucaucaucaa

SEQ ID NO: 1986867 - RNA, 18 nt, Homo sapiens
aacaucaugcauucacaa

SEQ ID NO: 1986868 - RNA, 15 nt, Homo sapiens
gcuguggcucugggu

SEQ ID NO: 1986869 - RNA, 11 nt, Homo sapiens
uaguugcuaag

SEQ ID NO: 1986870 - RNA, 21 nt, Homo sapiens
gccauagaauggcacauguca

SEQ ID NO: 1986871 - RNA, 14 nt, Homo sapiens
aacguggauuguga

SEQ ID NO: 1986872 - RNA, 13 nt, Homo sapiens
aagagcaacaauc

SEQ ID NO: 1986873 - RNA, 14 nt, Homo sapiens
cuguuagcugcuca

SEQ ID NO: 1986874 - RNA, 21 nt, Homo sapiens
uuucauucaaucaaccugcac

SEQ ID NO: 1986875 - RNA, 23 nt, Homo sapiens
aaccaugccuuccucaguaucca

SEQ ID NO: 1986876 - RNA, 17 nt, Homo sapiens
uagacuucccacucuag

SEQ ID NO: 1986877 - RNA, 16 nt, Homo sapiens
ugaacuuucacauagc

SEQ ID NO: 1986878 - RNA, 18 nt, Homo sapiens
uuugcaucucaguaugaa

SEQ ID NO: 1986879 - RNA, 14 nt, Homo sapiens
acgguucaccagcc

SEQ ID NO: 1986880 - RNA, 20 nt, Homo sapiens
ggaggcggagguugcaauga

SEQ ID NO: 1986881 - RNA, 18 nt, Homo sapiens
cgaagagugaagggcagu

SEQ ID NO: 1986882 - RNA, 13 nt, Homo sapiens
ucucauucuugcc

SEQ ID NO: 1986883 - RNA, 17 nt, Homo sapiens
agaaaugaggagacaca

SEQ ID NO: 1986884 - RNA, 19 nt, Homo sapiens
uacucuucuuacuggugcu

SEQ ID NO: 1986885 - RNA, 15 nt, Homo sapiens
cucuauguggaucua

SEQ ID NO: 1986886 - RNA, 14 nt, Homo sapiens
acaaucugggauag

SEQ ID NO: 1986887 - RNA, 13 nt, Homo sapiens
agccuagagaagg

SEQ ID NO: 1986888 - RNA, 12 nt, Homo sapiens
uaaaucauuuca

SEQ ID NO: 1986889 - RNA, 21 nt, Homo sapiens
cagggggggaaaugcauuuau

SEQ ID NO: 1986890 - RNA, 22 nt, Homo sapiens
cucccaguccaaauguccucca

SEQ ID NO: 1986891 - RNA, 12 nt, Homo sapiens
caguuugcacaa

SEQ ID NO: 1986892 - RNA, 20 nt, Homo sapiens
ucuuggggacuaacccaaug

SEQ ID NO: 1986893 - RNA, 19 nt, Homo sapiens
ucggucaggagggugcagu

SEQ ID NO: 1986894 - RNA, 15 nt, Homo sapiens
agucaccucauggaa

SEQ ID NO: 1986895 - RNA, 15 nt, Homo sapiens
auuuguaaaucugcc

SEQ ID NO: 1986896 - RNA, 19 nt, Homo sapiens
cugacagaaggaacacugc

SEQ ID NO: 1986897 - RNA, 17 nt, Homo sapiens
uucuagggagauguauu

SEQ ID NO: 1986898 - RNA, 22 nt, Homo sapiens
caccaucuuuugugagauguaa

SEQ ID NO: 1986899 - RNA, 13 nt, Homo sapiens
acauucacaccau

SEQ ID NO: 1986900 - RNA, 13 nt, Homo sapiens
ugauucacugcau

SEQ ID NO: 1986901 - RNA, 20 nt, Homo sapiens
cugacuuaaguggcauuaaa

SEQ ID NO: 1986902 - RNA, 14 nt, Homo sapiens
auuacucaccaaaa

SEQ ID NO: 1986903 - RNA, 14 nt, Homo sapiens
ccaucucaauuuaa

SEQ ID NO: 1986904 - RNA, 22 nt, Homo sapiens
agagcuuucaaggauaggcuuu

SEQ ID NO: 1986905 - RNA, 17 nt, Homo sapiens
gaccacuuggaaauaaa

SEQ ID NO: 1986906 - RNA, 21 nt, Homo sapiens
agucauuucguucccugauua

SEQ ID NO: 1986907 - RNA, 13 nt, Homo sapiens
uacagcaggcagu

SEQ ID NO: 1986908 - RNA, 18 nt, Homo sapiens
acauacccacacauucca

SEQ ID NO: 1986909 - RNA, 13 nt, Homo sapiens
ugacauaaccaac

SEQ ID NO: 1986910 - RNA, 23 nt, Homo sapiens
uaauucaagccucuaaacagaca

SEQ ID NO: 1986911 - RNA, 17 nt, Homo sapiens
cagcucuccaccagcug

SEQ ID NO: 1986912 - RNA, 16 nt, Homo sapiens
gccagugccauuccac

SEQ ID NO: 1986913 - RNA, 15 nt, Homo sapiens
gacuaggagcacugu

SEQ ID NO: 1986914 - RNA, 15 nt, Homo sapiens
gaccauuagcauuug

SEQ ID NO: 1986915 - RNA, 10 nt, Homo sapiens
cccaccugcg

SEQ ID NO: 1986916 - RNA, 17 nt, Homo sapiens
uggccccaucccaguug

SEQ ID NO: 1986917 - RNA, 13 nt, Homo sapiens
ucgagcugugcuc

SEQ ID NO: 1986918 - RNA, 17 nt, Homo sapiens
aaaauuucauagcugua

SEQ ID NO: 1986919 - RNA, 13 nt, Homo sapiens
agcauguuuucac

SEQ ID NO: 1986920 - RNA, 20 nt, Homo sapiens
aauaagucagguucuuuaca

SEQ ID NO: 1986921 - RNA, 19 nt, Homo sapiens
aggccucgccugcccuccu

SEQ ID NO: 1986922 - RNA, 21 nt, Homo sapiens
ccauuuauuaagcaguacaaa

SEQ ID NO: 1986923 - RNA, 18 nt, Homo sapiens
aacagccuuucaauucau

SEQ ID NO: 1986924 - RNA, 22 nt, Homo sapiens
acuccucaaaagcaaaugagau

SEQ ID NO: 1986925 - RNA, 15 nt, Homo sapiens
cuuucacccauccua

SEQ ID NO: 1986926 - RNA, 22 nt, Homo sapiens
auuuauguggcuuguuuauccu

SEQ ID NO: 1986927 - RNA, 20 nt, Homo sapiens
uuccauucuuuuaaaugggu

SEQ ID NO: 1986928 - RNA, 20 nt, Homo sapiens
ggaugcaaagguugcaguga

SEQ ID NO: 1986929 - RNA, 20 nt, Homo sapiens
uucccuucucuccuucccuc

SEQ ID NO: 1986930 - RNA, 18 nt, Homo sapiens
ucugccccaccuugccag

SEQ ID NO: 1986931 - RNA, 12 nt, Homo sapiens
gccauugcacuc

SEQ ID NO: 1986932 - RNA, 19 nt, Homo sapiens
gugagguuaguucugugug

SEQ ID NO: 1986933 - RNA, 13 nt, Homo sapiens
caugagauuuaua

SEQ ID NO: 1986934 - RNA, 19 nt, Homo sapiens
uauuuauuaaaaacccaua

SEQ ID NO: 1986935 - RNA, 17 nt, Homo sapiens
gaacuuuuaaugaacuu

SEQ ID NO: 1986936 - RNA, 19 nt, Homo sapiens
ugcuguacaacuucugggc

SEQ ID NO: 1986937 - RNA, 19 nt, Homo sapiens
cuaaugugaaaauguauuc

SEQ ID NO: 1986938 - RNA, 16 nt, Homo sapiens
gagccaaacacacugu

SEQ ID NO: 1986939 - RNA, 14 nt, Homo sapiens
cuugugaacugcug

SEQ ID NO: 1986940 - RNA, 14 nt, Homo sapiens
uauguaaauagcua

SEQ ID NO: 1986941 - RNA, 15 nt, Homo sapiens
aaauaagaaugauuu

SEQ ID NO: 1986942 - RNA, 21 nt, Homo sapiens
uuaaauaaaggaaauuuagau

SEQ ID NO: 1986943 - RNA, 16 nt, Homo sapiens
ccuuugugcacauuua

SEQ ID NO: 1986944 - RNA, 19 nt, Homo sapiens
ucguccuguguugccccaa

SEQ ID NO: 1986945 - RNA, 18 nt, Homo sapiens
uaauccccacccugggcu

SEQ ID NO: 1986946 - RNA, 21 nt, Homo sapiens
cuguguccccuucauccuuga

SEQ ID NO: 1986947 - RNA, 18 nt, Homo sapiens
cugggagcacaggcacug

SEQ ID NO: 1986948 - RNA, 22 nt, Homo sapiens
uggucacuggaacucaguguga

SEQ ID NO: 1986949 - RNA, 16 nt, Homo sapiens
aauucagaacauccuc

SEQ ID NO: 1986950 - RNA, 22 nt, Homo sapiens
aagcagugggguugggaccuca

SEQ ID NO: 1986951 - RNA, 18 nt, Homo sapiens
ccuuggccagaagucaag

SEQ ID NO: 1986952 - RNA, 14 nt, Homo sapiens
accugccacucaca

SEQ ID NO: 1986953 - RNA, 20 nt, Homo sapiens
auuuauuuuuuuacuuccuc

SEQ ID NO: 1986954 - RNA, 15 nt, Homo sapiens
gaauucacaccuuag

SEQ ID NO: 1986955 - RNA, 19 nt, Homo sapiens
uaauucaguacaacccaua

SEQ ID NO: 1986956 - RNA, 21 nt, Homo sapiens
ggcccagcaaucuccaugugu

SEQ ID NO: 1986957 - RNA, 15 nt, Homo sapiens
cuccaacacuuugag

SEQ ID NO: 1986958 - RNA, 18 nt, Homo sapiens
uuuguagagacaggguuu

SEQ ID NO: 1986959 - RNA, 21 nt, Homo sapiens
ucaccucucccuccaccuccu

SEQ ID NO: 1986960 - RNA, 14 nt, Homo sapiens
ggccccaccagugc

SEQ ID NO: 1986961 - RNA, 22 nt, Homo sapiens
uggacugguaaguaacuguggu

SEQ ID NO: 1986962 - RNA, 18 nt, Homo sapiens
cuccaguaacugcugucg

SEQ ID NO: 1986963 - RNA, 20 nt, Homo sapiens
guacucaguaagacagugca

SEQ ID NO: 1986964 - RNA, 22 nt, Homo sapiens
ggaggaaaaggcuuggugucug

SEQ ID NO: 1986965 - RNA, 18 nt, Homo sapiens
gaagcaggcuacacugac

SEQ ID NO: 1986966 - RNA, 19 nt, Homo sapiens
agcagggcuggucaccucc

SEQ ID NO: 1986967 - RNA, 18 nt, Homo sapiens
cccaccagagcuguggag

SEQ ID NO: 1986968 - RNA, 13 nt, Homo sapiens
gcugagugcugaa

SEQ ID NO: 1986969 - RNA, 18 nt, Homo sapiens
aauucuuacaaacaugug

SEQ ID NO: 1986970 - RNA, 13 nt, Homo sapiens
acagcuuucacag

SEQ ID NO: 1986971 - RNA, 22 nt, Homo sapiens
uggggaucccacucuucuugca

SEQ ID NO: 1986972 - RNA, 18 nt, Homo sapiens
ucccugaucccaguuucu

SEQ ID NO: 1986973 - RNA, 17 nt, Homo sapiens
ucuguucugaugccacc

SEQ ID NO: 1986974 - RNA, 20 nt, Homo sapiens
ccuguauagaccaugcacag

SEQ ID NO: 1986975 - RNA, 19 nt, Homo sapiens
cauauaugugaucugggca

SEQ ID NO: 1986976 - RNA, 20 nt, Homo sapiens
aucuaagcauuccacacugc

SEQ ID NO: 1986977 - RNA, 23 nt, Homo sapiens
uauucuguuuuguuaauauaccc

SEQ ID NO: 1986978 - RNA, 23 nt, Homo sapiens
ucuguggugcagugugugaaaau

SEQ ID NO: 1986979 - RNA, 22 nt, Homo sapiens
cucacccauugucucauugcca

SEQ ID NO: 1986980 - RNA, 15 nt, Homo sapiens
uauuaccuaaugaaa

SEQ ID NO: 1986981 - RNA, 14 nt, Homo sapiens
auuagcagcaaaac

SEQ ID NO: 1986982 - RNA, 22 nt, Homo sapiens
uggaaauguaauaauaaugaau

SEQ ID NO: 1986983 - RNA, 16 nt, Homo sapiens
cccaccccugagcuga

SEQ ID NO: 1986984 - RNA, 16 nt, Homo sapiens
cauuauuuaauuugua

SEQ ID NO: 1986985 - RNA, 15 nt, Homo sapiens
aucccaugagcuccu

SEQ ID NO: 1986986 - RNA, 18 nt, Homo sapiens
caucagcaagacuuuaua

SEQ ID NO: 1986987 - RNA, 14 nt, Homo sapiens
agugaauuguguag

SEQ ID NO: 1986988 - RNA, 14 nt, Homo sapiens
uccaucugcaucuu

SEQ ID NO: 1986989 - RNA, 18 nt, Homo sapiens
ucauuggcccucauucca

SEQ ID NO: 1986990 - RNA, 22 nt, Homo sapiens
guguucugucacucagcuuugc

SEQ ID NO: 1986991 - RNA, 15 nt, Homo sapiens
gcacacaccugcaca

SEQ ID NO: 1986992 - RNA, 21 nt, Homo sapiens
cacagaagguguucaaacaca

SEQ ID NO: 1986993 - RNA, 15 nt, Homo sapiens
cagcuguguggugcu

SEQ ID NO: 1986994 - RNA, 12 nt, Homo sapiens
accuucacuuaa

SEQ ID NO: 1986995 - RNA, 16 nt, Homo sapiens
gcccacgcugacuaca

SEQ ID NO: 1986996 - RNA, 13 nt, Homo sapiens
agcccaucaccuc

SEQ ID NO: 1986997 - RNA, 14 nt, Homo sapiens
ugaggccugugcuc

SEQ ID NO: 1986998 - RNA, 23 nt, Homo sapiens
uaaccagaugguuguguaugggu

SEQ ID NO: 1986999 - RNA, 13 nt, Homo sapiens
ugacagccuuccc

SEQ ID NO: 1987000 - RNA, 20 nt, Homo sapiens
acccagaguggcccaagacu

SEQ ID NO: 1987001 - RNA, 19 nt, Homo sapiens
ucguagugguacauuccau

SEQ ID NO: 1987002 - RNA, 21 nt, Homo sapiens
aaugcuggagaaaaauaucug

SEQ ID NO: 1987003 - RNA, 15 nt, Homo sapiens
cucauugaccuucag

SEQ ID NO: 1987004 - RNA, 23 nt, Homo sapiens
aggagaggaaaaguaaggugcag

SEQ ID NO: 1987005 - RNA, 15 nt, Homo sapiens
uacaauaaagcaaug

SEQ ID NO: 1987006 - RNA, 22 nt, Homo sapiens
ucagaagaagaugcugugaaca

SEQ ID NO: 1987007 - RNA, 15 nt, Homo sapiens
accagauagcucaau

SEQ ID NO: 1987008 - RNA, 16 nt, Homo sapiens
agaggagacagccugu

SEQ ID NO: 1987009 - RNA, 20 nt, Homo sapiens
caaacucucccccaaaugua

SEQ ID NO: 1987010 - RNA, 20 nt, Homo sapiens
uguugguauuauauaauuca

SEQ ID NO: 1987011 - RNA, 16 nt, Homo sapiens
ugaagaauuuaucucu

SEQ ID NO: 1987012 - RNA, 20 nt, Homo sapiens
auccuaaagaaggugauaaa

SEQ ID NO: 1987013 - RNA, 21 nt, Homo sapiens
gucaagagggggcaagucaca

SEQ ID NO: 1987014 - RNA, 15 nt, Homo sapiens
cccugaauguguaga

SEQ ID NO: 1987015 - RNA, 18 nt, Homo sapiens
uuaacugacaagcuccau

SEQ ID NO: 1987016 - RNA, 20 nt, Homo sapiens
cucuacucuggagguuuguu

SEQ ID NO: 1987017 - RNA, 15 nt, Homo sapiens
uuuggggugaaugaa

SEQ ID NO: 1987018 - RNA, 11 nt, Homo sapiens
ucuuuguucaa

SEQ ID NO: 1987019 - RNA, 12 nt, Homo sapiens
acgcacacagcu

SEQ ID NO: 1987020 - RNA, 15 nt, Homo sapiens
uucacagugucugua

SEQ ID NO: 1987021 - RNA, 16 nt, Homo sapiens
cagccgagcccagggg

SEQ ID NO: 1987022 - RNA, 17 nt, Homo sapiens
guccaccugugcugcug

SEQ ID NO: 1987023 - RNA, 20 nt, Homo sapiens
acauggagaaaucuacugaa

SEQ ID NO: 1987024 - RNA, 14 nt, Homo sapiens
agggacccuuccaa

SEQ ID NO: 1987025 - RNA, 16 nt, Homo sapiens
gggacuccaguucaca

SEQ ID NO: 1987026 - RNA, 16 nt, Homo sapiens
uauuccugaacuauaa

SEQ ID NO: 1987027 - RNA, 21 nt, Homo sapiens
ugccuccgcaccugaccgcug

SEQ ID NO: 1987028 - RNA, 14 nt, Homo sapiens
cuugcucucucuca

SEQ ID NO: 1987029 - RNA, 15 nt, Homo sapiens
aguuuucuaaauguu

SEQ ID NO: 1987030 - RNA, 12 nt, Homo sapiens
gaaagugcugcu

SEQ ID NO: 1987031 - RNA, 14 nt, Homo sapiens
gcaagaagccauuu

SEQ ID NO: 1987032 - RNA, 19 nt, Homo sapiens
agcaaccuguaacucacau

SEQ ID NO: 1987033 - RNA, 16 nt, Homo sapiens
acccuuggacuugagg

SEQ ID NO: 1987034 - RNA, 20 nt, Homo sapiens
ugccuacacacacagccuau

SEQ ID NO: 1987035 - RNA, 17 nt, Homo sapiens
gcaccaaucagcacucu

SEQ ID NO: 1987036 - RNA, 21 nt, Homo sapiens
gaaaaauauuaauaagacaaa

SEQ ID NO: 1987037 - RNA, 18 nt, Homo sapiens
ugggagaaggacuaucaa

SEQ ID NO: 1987038 - RNA, 23 nt, Homo sapiens
uuucauccuguuggcugcugcca

SEQ ID NO: 1987039 - RNA, 13 nt, Homo sapiens
caauucauuguga

SEQ ID NO: 1987040 - RNA, 22 nt, Homo sapiens
ccaugagaugagaugaccacca

SEQ ID NO: 1987041 - RNA, 16 nt, Homo sapiens
aucaagccucugguca

SEQ ID NO: 1987042 - RNA, 19 nt, Homo sapiens
aguguccugcuaccuuugu

SEQ ID NO: 1987043 - RNA, 20 nt, Homo sapiens
uuuuaugggaauucuuuaca

SEQ ID NO: 1987044 - RNA, 21 nt, Homo sapiens
aguagagcagccacaaccaaa

SEQ ID NO: 1987045 - RNA, 15 nt, Homo sapiens
cagacuguccaggga

SEQ ID NO: 1987046 - RNA, 16 nt, Homo sapiens
ggccagggcuggguca

SEQ ID NO: 1987047 - RNA, 19 nt, Homo sapiens
uaauaaaauacauacuaua

SEQ ID NO: 1987048 - RNA, 19 nt, Homo sapiens
caaguuugaccagugcagu

SEQ ID NO: 1987049 - RNA, 20 nt, Homo sapiens
cagggugugggaucugagga

SEQ ID NO: 1987050 - RNA, 22 nt, Homo sapiens
ucugaaagucaugcacauaccu

SEQ ID NO: 1987051 - RNA, 15 nt, Homo sapiens
gggcagcucauagag

SEQ ID NO: 1987052 - RNA, 14 nt, Homo sapiens
cugaauuccauaau

SEQ ID NO: 1987053 - RNA, 21 nt, Homo sapiens
cauuccaaaguucuuaucucu

SEQ ID NO: 1987054 - RNA, 22 nt, Homo sapiens
auagagggucuaagauucaucc

SEQ ID NO: 1987055 - RNA, 22 nt, Homo sapiens
augauuuccuggggcacagugg

SEQ ID NO: 1987056 - RNA, 21 nt, Homo sapiens
aggucuugugauauugcccag

SEQ ID NO: 1987057 - RNA, 20 nt, Homo sapiens
uuuuuagcugguggcaauaa

SEQ ID NO: 1987058 - RNA, 22 nt, Homo sapiens
aggaagaugcucaucugagcca

SEQ ID NO: 1987059 - RNA, 18 nt, Homo sapiens
cagaauuguugacuugca

SEQ ID NO: 1987060 - RNA, 23 nt, Homo sapiens
auugaacucuuugaaugacaaag

SEQ ID NO: 1987061 - RNA, 15 nt, Homo sapiens
gaacaaaugugaagg

SEQ ID NO: 1987062 - RNA, 22 nt, Homo sapiens
cauccagcucuacgugauuugg

SEQ ID NO: 1987063 - RNA, 14 nt, Homo sapiens
ugcaggacauguau

SEQ ID NO: 1987064 - RNA, 22 nt, Homo sapiens
gauauuaaccaggggccaugaa

SEQ ID NO: 1987065 - RNA, 18 nt, Homo sapiens
aacuuuuaucacuguugc

SEQ ID NO: 1987066 - RNA, 17 nt, Homo sapiens
gaaauuccuagugucuu

SEQ ID NO: 1987067 - RNA, 21 nt, Homo sapiens
cacuguuuugaaucucauaau

SEQ ID NO: 1987068 - RNA, 19 nt, Homo sapiens
uacaagcauucugucuuga

SEQ ID NO: 1987069 - RNA, 18 nt, Homo sapiens
auugacgacaagugcuga

SEQ ID NO: 1987070 - RNA, 21 nt, Homo sapiens
uaauuugguauccuuaucuag

SEQ ID NO: 1987071 - RNA, 15 nt, Homo sapiens
ccacacucuccauca

SEQ ID NO: 1987072 - RNA, 19 nt, Homo sapiens
agggugcagccacacucuu

SEQ ID NO: 1987073 - RNA, 22 nt, Homo sapiens
cauccuuauucacguugacagu

SEQ ID NO: 1987074 - RNA, 12 nt, Homo sapiens
agaaaauuuucc

SEQ ID NO: 1987075 - RNA, 20 nt, Homo sapiens
uuuuaaccaauaacuagcuu

SEQ ID NO: 1987076 - RNA, 16 nt, Homo sapiens
cugauuaccugccaau

SEQ ID NO: 1987077 - RNA, 16 nt, Homo sapiens
cacccacucacauucc

SEQ ID NO: 1987078 - RNA, 17 nt, Homo sapiens
cugccacucugccccuu

SEQ ID NO: 1987079 - RNA, 21 nt, Homo sapiens
cuacuccuggagcacuguaaa

SEQ ID NO: 1987080 - RNA, 17 nt, Homo sapiens
gcuguugacaucagccu

SEQ ID NO: 1987081 - RNA, 17 nt, Homo sapiens
caagaugcgcacugcau

SEQ ID NO: 1987082 - RNA, 23 nt, Homo sapiens
acaagauaccaaggcaaacccua

SEQ ID NO: 1987083 - RNA, 18 nt, Homo sapiens
augcaacacccucuucua

SEQ ID NO: 1987084 - RNA, 14 nt, Homo sapiens
gacagucauauaaa

SEQ ID NO: 1987085 - RNA, 23 nt, Homo sapiens
uaauauguugaguucaguuuacu

SEQ ID NO: 1987086 - RNA, 16 nt, Homo sapiens
auuauaagcuuaacua

SEQ ID NO: 1987087 - RNA, 21 nt, Homo sapiens
gaacaaccuuuucucuggaca

SEQ ID NO: 1987088 - RNA, 20 nt, Homo sapiens
caguucuguguggugcauuc

SEQ ID NO: 1987089 - RNA, 15 nt, Homo sapiens
acugauucucuacau

SEQ ID NO: 1987090 - RNA, 17 nt, Homo sapiens
guuuuccaaugugacua

SEQ ID NO: 1987091 - RNA, 17 nt, Homo sapiens
guuuuauuuugugcuau

SEQ ID NO: 1987092 - RNA, 17 nt, Homo sapiens
uauugcuugaguuauau

SEQ ID NO: 1987093 - RNA, 21 nt, Homo sapiens
acaaauauuuucuuuauuugu

SEQ ID NO: 1987094 - RNA, 18 nt, Homo sapiens
gaugaacuugagcucugu

SEQ ID NO: 1987095 - RNA, 15 nt, Homo sapiens
gaucaagguacaauu

SEQ ID NO: 1987096 - RNA, 19 nt, Homo sapiens
uuuaaaaaaaaagucagag

SEQ ID NO: 1987097 - RNA, 16 nt, Homo sapiens
agcuccuucaaugcaa

SEQ ID NO: 1987098 - RNA, 13 nt, Homo sapiens
uccugcaacucaa

SEQ ID NO: 1987099 - RNA, 11 nt, Homo sapiens
guuacauauua

SEQ ID NO: 1987100 - RNA, 15 nt, Homo sapiens
cacauccccaccuuc

SEQ ID NO: 1987101 - RNA, 21 nt, Homo sapiens
auauuuauguuuaagugcuug

SEQ ID NO: 1987102 - RNA, 19 nt, Homo sapiens
agaagugucacagccauag

SEQ ID NO: 1987103 - RNA, 12 nt, Homo sapiens
caggaccagcug

SEQ ID NO: 1987104 - RNA, 19 nt, Homo sapiens
aggugggcggaucaccuga

SEQ ID NO: 1987105 - RNA, 20 nt, Homo sapiens
cauuaggucccucacuccac

SEQ ID NO: 1987106 - RNA, 17 nt, Homo sapiens
aauucccaaucccauuc

SEQ ID NO: 1987107 - RNA, 17 nt, Homo sapiens
cucugacccuccuucua

SEQ ID NO: 1987108 - RNA, 18 nt, Homo sapiens
gugaucuugagaaccuuu

SEQ ID NO: 1987109 - RNA, 17 nt, Homo sapiens
cuaucugacuucauaca

SEQ ID NO: 1987110 - RNA, 15 nt, Homo sapiens
augcacacacacaga

SEQ ID NO: 1987111 - RNA, 15 nt, Homo sapiens
cuggugacccaguca

SEQ ID NO: 1987112 - RNA, 21 nt, Homo sapiens
aaauguuucuuuauggccauu

SEQ ID NO: 1987113 - RNA, 17 nt, Homo sapiens
ucuuguccaauggggcu

SEQ ID NO: 1987114 - RNA, 18 nt, Homo sapiens
aaagccucaugugugaaa

SEQ ID NO: 1987115 - RNA, 18 nt, Homo sapiens
acucagaucacuacugca

SEQ ID NO: 1987116 - RNA, 17 nt, Homo sapiens
gugucauuaaccaucuu

SEQ ID NO: 1987117 - RNA, 13 nt, Homo sapiens
cccuguuuaacau

SEQ ID NO: 1987118 - RNA, 19 nt, Homo sapiens
gacaucccccuccuugccg

SEQ ID NO: 1987119 - RNA, 20 nt, Homo sapiens
aaguaauuccucucacuaaa

SEQ ID NO: 1987120 - RNA, 13 nt, Homo sapiens
cacagcacuugag

SEQ ID NO: 1987121 - RNA, 21 nt, Homo sapiens
caaguaaaaggaaaugcuccu

SEQ ID NO: 1987122 - RNA, 15 nt, Homo sapiens
gucuaaaaugccuca

SEQ ID NO: 1987123 - RNA, 15 nt, Homo sapiens
uacucccagcuggug

SEQ ID NO: 1987124 - RNA, 21 nt, Homo sapiens
gauagaguucuuuuaagccca

SEQ ID NO: 1987125 - RNA, 19 nt, Homo sapiens
caagaacacacacauauac

SEQ ID NO: 1987126 - RNA, 12 nt, Homo sapiens
ugauugcagcuu

SEQ ID NO: 1987127 - RNA, 22 nt, Homo sapiens
aaauacagucuuccacaaagaa

SEQ ID NO: 1987128 - RNA, 17 nt, Homo sapiens
auacuggcuaacagaug

SEQ ID NO: 1987129 - RNA, 16 nt, Homo sapiens
uauucaucugugugua

SEQ ID NO: 1987130 - RNA, 22 nt, Homo sapiens
ucauauuggacugauaaucucu

SEQ ID NO: 1987131 - RNA, 18 nt, Homo sapiens
aucaauaaaaauuucaaa

SEQ ID NO: 1987132 - RNA, 15 nt, Homo sapiens
cgauaccgggacaca

SEQ ID NO: 1987133 - RNA, 21 nt, Homo sapiens
gaccccauuccugaucccaug

SEQ ID NO: 1987134 - RNA, 13 nt, Homo sapiens
cccucagauuccg

SEQ ID NO: 1987135 - RNA, 17 nt, Homo sapiens
aagcagugcacauuuca

SEQ ID NO: 1987136 - RNA, 19 nt, Homo sapiens
ugcaucaucucuuccucac

SEQ ID NO: 1987137 - RNA, 20 nt, Homo sapiens
aacucaagcuucuucacuca

SEQ ID NO: 1987138 - RNA, 15 nt, Homo sapiens
gaaaauuacaacaga

SEQ ID NO: 1987139 - RNA, 14 nt, Homo sapiens
gcuuuaacuccugc

SEQ ID NO: 1987140 - RNA, 16 nt, Homo sapiens
uccuuauucagccuua

SEQ ID NO: 1987141 - RNA, 14 nt, Homo sapiens
ucccugguccuuca

SEQ ID NO: 1987142 - RNA, 15 nt, Homo sapiens
cacuacaacagaauu

SEQ ID NO: 1987143 - RNA, 17 nt, Homo sapiens
gauuacucuuugagaua

SEQ ID NO: 1987144 - RNA, 19 nt, Homo sapiens
uucugggaagaaaguagga

SEQ ID NO: 1987145 - RNA, 18 nt, Homo sapiens
auauuuuuaugugcaaua

SEQ ID NO: 1987146 - RNA, 17 nt, Homo sapiens
ucaucuccuuuugcgcu

SEQ ID NO: 1987147 - RNA, 15 nt, Homo sapiens
ccuaggauacccaga

SEQ ID NO: 1987148 - RNA, 16 nt, Homo sapiens
gagagggcaaagggau

SEQ ID NO: 1987149 - RNA, 12 nt, Homo sapiens
cccagagcaucu

SEQ ID NO: 1987150 - RNA, 21 nt, Homo sapiens
agcaucuaaguuauaagacuc

SEQ ID NO: 1987151 - RNA, 19 nt, Homo sapiens
gugccugguucgugccaug

SEQ ID NO: 1987152 - RNA, 11 nt, Homo sapiens
cccuguuacaa

SEQ ID NO: 1987153 - RNA, 17 nt, Homo sapiens
aagaagguuaccaagaa

SEQ ID NO: 1987154 - RNA, 15 nt, Homo sapiens
cuuaucaaaggacac

SEQ ID NO: 1987155 - RNA, 23 nt, Homo sapiens
gugcagcaaccagagcacuguau

SEQ ID NO: 1987156 - RNA, 23 nt, Homo sapiens
auauccaaugaagaaggucucau

SEQ ID NO: 1987157 - RNA, 15 nt, Homo sapiens
uccucccauuuccca

SEQ ID NO: 1987158 - RNA, 16 nt, Homo sapiens
uuuaacaaacuaaaaa

SEQ ID NO: 1987159 - RNA, 13 nt, Homo sapiens
cuucucuccagag

SEQ ID NO: 1987160 - RNA, 16 nt, Homo sapiens
uugguuucacugagag

SEQ ID NO: 1987161 - RNA, 16 nt, Homo sapiens
ucaaaauccuacagau

SEQ ID NO: 1987162 - RNA, 14 nt, Homo sapiens
uucuaugaggcaac

SEQ ID NO: 1987163 - RNA, 14 nt, Homo sapiens
aaugucagaagcuu

SEQ ID NO: 1987164 - RNA, 14 nt, Homo sapiens
gugcccagguugcu

SEQ ID NO: 1987165 - RNA, 18 nt, Homo sapiens
uucuaaggagcacuagaa

SEQ ID NO: 1987166 - RNA, 14 nt, Homo sapiens
cuuuuauagcugcu

SEQ ID NO: 1987167 - RNA, 17 nt, Homo sapiens
acugccucugccuuaga

SEQ ID NO: 1987168 - RNA, 23 nt, Homo sapiens
acuggcaaagcagaaugugauau

SEQ ID NO: 1987169 - RNA, 24 nt, Homo sapiens
guuauuauuaccagcauuuguccu

SEQ ID NO: 1987170 - RNA, 16 nt, Homo sapiens
acaugauacuauucag

SEQ ID NO: 1987171 - RNA, 17 nt, Homo sapiens
guacguuaaaagcaaaa

SEQ ID NO: 1987172 - RNA, 22 nt, Homo sapiens
ucaaucugcaguuuaacaaaau

SEQ ID NO: 1987173 - RNA, 22 nt, Homo sapiens
ugacagguuuuccaaaaguaaa

SEQ ID NO: 1987174 - RNA, 20 nt, Homo sapiens
acaaccugugaucaagcaau

SEQ ID NO: 1987175 - RNA, 15 nt, Homo sapiens
uauuauuaccagcau

SEQ ID NO: 1987176 - RNA, 23 nt, Homo sapiens
uacauaggauggcuggcucugca

SEQ ID NO: 1987177 - RNA, 19 nt, Homo sapiens
cucuuuagcauugaagugu

SEQ ID NO: 1987178 - RNA, 19 nt, Homo sapiens
gacccaauccccagacuca

SEQ ID NO: 1987179 - RNA, 14 nt, Homo sapiens
gacacguucuugcc

SEQ ID NO: 1987180 - RNA, 15 nt, Homo sapiens
caaauggcuuacuua

SEQ ID NO: 1987181 - RNA, 15 nt, Homo sapiens
uaagaacacugagau

SEQ ID NO: 1987182 - RNA, 20 nt, Homo sapiens
agcugggucaggcagggugc

SEQ ID NO: 1987183 - RNA, 23 nt, Homo sapiens
uuguccuccugauccugacacau

SEQ ID NO: 1987184 - RNA, 19 nt, Homo sapiens
uccacaugcacauguauuc

SEQ ID NO: 1987185 - RNA, 19 nt, Homo sapiens
cuccuuccuugaacccuaa

SEQ ID NO: 1987186 - RNA, 17 nt, Homo sapiens
cugaauacaaagugaug

SEQ ID NO: 1987187 - RNA, 16 nt, Homo sapiens
uccccuggugguggaa

SEQ ID NO: 1987188 - RNA, 17 nt, Homo sapiens
gguuaauuucugucaaa

SEQ ID NO: 1987189 - RNA, 17 nt, Homo sapiens
cugaucauuaaagccug

SEQ ID NO: 1987190 - RNA, 15 nt, Homo sapiens
accccucucuuagag

SEQ ID NO: 1987191 - RNA, 20 nt, Homo sapiens
gugcacgcaggcacagcagc

SEQ ID NO: 1987192 - RNA, 23 nt, Homo sapiens
caaccuuuucccaaccauacaaa

SEQ ID NO: 1987193 - RNA, 15 nt, Homo sapiens
cugcauaguauucca

SEQ ID NO: 1987194 - RNA, 13 nt, Homo sapiens
gcugcuccaugag

SEQ ID NO: 1987195 - RNA, 13 nt, Homo sapiens
acagacggaaaug

SEQ ID NO: 1987196 - RNA, 18 nt, Homo sapiens
cagaaaaucgaccacagu

SEQ ID NO: 1987197 - RNA, 18 nt, Homo sapiens
auggcacugacaaugggc

SEQ ID NO: 1987198 - RNA, 11 nt, Homo sapiens
guaaaucucac

SEQ ID NO: 1987199 - RNA, 16 nt, Homo sapiens
uccaugggaccacaac

SEQ ID NO: 1987200 - RNA, 14 nt, Homo sapiens
aagggagaguucuu

SEQ ID NO: 1987201 - RNA, 17 nt, Homo sapiens
uggacacugccaagagc

SEQ ID NO: 1987202 - RNA, 22 nt, Homo sapiens
aacagcuaguagacaugaauuu

SEQ ID NO: 1987203 - RNA, 20 nt, Homo sapiens
aagagucucuauuucacaau

SEQ ID NO: 1987204 - RNA, 18 nt, Homo sapiens
cagaacuaaauuuuucau

SEQ ID NO: 1987205 - RNA, 16 nt, Homo sapiens
ggagucucaugcaaga

SEQ ID NO: 1987206 - RNA, 22 nt, Homo sapiens
cuaagcuggugccccacugaau

SEQ ID NO: 1987207 - RNA, 21 nt, Homo sapiens
ugcagaaacuaccagauuuga

SEQ ID NO: 1987208 - RNA, 24 nt, Homo sapiens
agacuacaguuguguuagccucuu

SEQ ID NO: 1987209 - RNA, 21 nt, Homo sapiens
acaacucugcuugcucaucca

SEQ ID NO: 1987210 - RNA, 14 nt, Homo sapiens
cugggggaaaaagc

SEQ ID NO: 1987211 - RNA, 16 nt, Homo sapiens
agaccagccugggcaa

SEQ ID NO: 1987212 - RNA, 18 nt, Homo sapiens
gcuauuauaauauagaaa

SEQ ID NO: 1987213 - RNA, 23 nt, Homo sapiens
uuauuugaggagauaacauuuca

SEQ ID NO: 1987214 - RNA, 21 nt, Homo sapiens
agcacuguggaacugcuauuu

SEQ ID NO: 1987215 - RNA, 15 nt, Homo sapiens
caucacacacugaga

SEQ ID NO: 1987216 - RNA, 18 nt, Homo sapiens
acauacccaaaguagcca

SEQ ID NO: 1987217 - RNA, 16 nt, Homo sapiens
agcgcaugcuggugca

SEQ ID NO: 1987218 - RNA, 13 nt, Homo sapiens
ggauugaggccag

SEQ ID NO: 1987219 - RNA, 20 nt, Homo sapiens
auuguaccaucauuuuauua

SEQ ID NO: 1987220 - RNA, 14 nt, Homo sapiens
ucaaagggacuuuu

SEQ ID NO: 1987221 - RNA, 14 nt, Homo sapiens
augggcaccaggca

SEQ ID NO: 1987222 - RNA, 22 nt, Homo sapiens
acuguauuucggcuaugucuca

SEQ ID NO: 1987223 - RNA, 20 nt, Homo sapiens
uccugcccaggacugcauug

SEQ ID NO: 1987224 - RNA, 14 nt, Homo sapiens
ucccaagaaugcaa

SEQ ID NO: 1987225 - RNA, 23 nt, Homo sapiens
ccagacuuuaccacuaugcaaua

SEQ ID NO: 1987226 - RNA, 17 nt, Homo sapiens
augugugaguguaugua

SEQ ID NO: 1987227 - RNA, 21 nt, Homo sapiens
gucaaccuuguuucuacuguu

SEQ ID NO: 1987228 - RNA, 20 nt, Homo sapiens
aauuuugauauaaucuuuca

SEQ ID NO: 1987229 - RNA, 14 nt, Homo sapiens
auguuugcacuuug

SEQ ID NO: 1987230 - RNA, 19 nt, Homo sapiens
cugcaucuuucucuuccca

SEQ ID NO: 1987231 - RNA, 15 nt, Homo sapiens
cucuacuuaauccaa

SEQ ID NO: 1987232 - RNA, 18 nt, Homo sapiens
gauuauagugacaaugaa

SEQ ID NO: 1987233 - RNA, 19 nt, Homo sapiens
cacacuggaggagcacaca

SEQ ID NO: 1987234 - RNA, 20 nt, Homo sapiens
ugaaucugguguuggggaaa

SEQ ID NO: 1987235 - RNA, 12 nt, Homo sapiens
cugcucacuuaa

SEQ ID NO: 1987236 - RNA, 23 nt, Homo sapiens
ggaguagggcucgccauguuucu

SEQ ID NO: 1987237 - RNA, 12 nt, Homo sapiens
caaaucuuacca

SEQ ID NO: 1987238 - RNA, 11 nt, Homo sapiens
cugucagggac

SEQ ID NO: 1987239 - RNA, 19 nt, Homo sapiens
uaauuuaaacaaauuuaga

SEQ ID NO: 1987240 - RNA, 18 nt, Homo sapiens
agcuccuguggccacagc

SEQ ID NO: 1987241 - RNA, 19 nt, Homo sapiens
cgaaccaggagcugcucac

SEQ ID NO: 1987242 - RNA, 21 nt, Homo sapiens
aacauucuuuuaacuucuuuc

SEQ ID NO: 1987243 - RNA, 12 nt, Homo sapiens
guccuugaacaa

SEQ ID NO: 1987244 - RNA, 14 nt, Homo sapiens
cucuuccuacaugu

SEQ ID NO: 1987245 - RNA, 16 nt, Homo sapiens
agaaaaugcagucauu

SEQ ID NO: 1987246 - RNA, 16 nt, Homo sapiens
aauucauucauuucau

SEQ ID NO: 1987247 - RNA, 12 nt, Homo sapiens
ugcaccaacagg

SEQ ID NO: 1987248 - RNA, 19 nt, Homo sapiens
uaaaaauuuauaagcauuu

SEQ ID NO: 1987249 - RNA, 16 nt, Homo sapiens
ccacggagcaguucag

SEQ ID NO: 1987250 - RNA, 13 nt, Homo sapiens
ugaaugcugccag

SEQ ID NO: 1987251 - RNA, 23 nt, Homo sapiens
gagcucucaagucaaggaagcug

SEQ ID NO: 1987252 - RNA, 18 nt, Homo sapiens
uuguccugagauggaaaa

SEQ ID NO: 1987253 - RNA, 23 nt, Homo sapiens
guucccuuuccccauucagugac

SEQ ID NO: 1987254 - RNA, 20 nt, Homo sapiens
ggaaagacauccauaaagaa

SEQ ID NO: 1987255 - RNA, 15 nt, Homo sapiens
uuauaaagcagauua

SEQ ID NO: 1987256 - RNA, 17 nt, Homo sapiens
uccugauguugguaucu

SEQ ID NO: 1987257 - RNA, 20 nt, Homo sapiens
caauguccagugagugaggu

SEQ ID NO: 1987258 - RNA, 16 nt, Homo sapiens
cuuuguuuaaaugcca

SEQ ID NO: 1987259 - RNA, 17 nt, Homo sapiens
acauccauucuucccuu

SEQ ID NO: 1987260 - RNA, 20 nt, Homo sapiens
caucuccuauaaucugucaa

SEQ ID NO: 1987261 - RNA, 12 nt, Homo sapiens
aucuaguucucu

SEQ ID NO: 1987262 - RNA, 22 nt, Homo sapiens
agacggcggccaggcacagggc

SEQ ID NO: 1987263 - RNA, 19 nt, Homo sapiens
agcuacucagaagccugag

SEQ ID NO: 1987264 - RNA, 11 nt, Homo sapiens
gugucaccucc

SEQ ID NO: 1987265 - RNA, 14 nt, Homo sapiens
ucauauguguaaaa

SEQ ID NO: 1987266 - RNA, 17 nt, Homo sapiens
ucaaugguagcauuuag

SEQ ID NO: 1987267 - RNA, 22 nt, Homo sapiens
gaguggcuugugauucugggau

SEQ ID NO: 1987268 - RNA, 20 nt, Homo sapiens
ugcugggguacacagugaga

SEQ ID NO: 1987269 - RNA, 18 nt, Homo sapiens
gcgggccagccaggcggg

SEQ ID NO: 1987270 - RNA, 19 nt, Homo sapiens
ggcuuaaugcuucuuucau

SEQ ID NO: 1987271 - RNA, 22 nt, Homo sapiens
aucccuggugaaggaucuugcc

SEQ ID NO: 1987272 - RNA, 13 nt, Homo sapiens
gccgcgugugaca

SEQ ID NO: 1987273 - RNA, 18 nt, Homo sapiens
auuaauuuaccaccaaua

SEQ ID NO: 1987274 - RNA, 18 nt, Homo sapiens
ccugagagguuucugggg

SEQ ID NO: 1987275 - RNA, 20 nt, Homo sapiens
cuuuuaacaugcauguuggg

SEQ ID NO: 1987276 - RNA, 15 nt, Homo sapiens
cauuuuucugaugau

SEQ ID NO: 1987277 - RNA, 15 nt, Homo sapiens
cacggcccugacuga

SEQ ID NO: 1987278 - RNA, 15 nt, Homo sapiens
cugcaaaccaauaga

SEQ ID NO: 1987279 - RNA, 14 nt, Homo sapiens
uguguugucuucag

SEQ ID NO: 1987280 - RNA, 19 nt, Homo sapiens
uuucagacuuuaaaauucu

SEQ ID NO: 1987281 - RNA, 13 nt, Homo sapiens
caggacugugacc

SEQ ID NO: 1987282 - RNA, 16 nt, Homo sapiens
gaugaagcucuggcca

SEQ ID NO: 1987283 - RNA, 17 nt, Homo sapiens
agacaauccacucucag

SEQ ID NO: 1987284 - RNA, 22 nt, Homo sapiens
accugaauaccacuuaccucaa

SEQ ID NO: 1987285 - RNA, 20 nt, Homo sapiens
aagcugaagaccauggauuu

SEQ ID NO: 1987286 - RNA, 18 nt, Homo sapiens
agauuuccaaaagacuug

SEQ ID NO: 1987287 - RNA, 16 nt, Homo sapiens
caucacgucaagcuuu

SEQ ID NO: 1987288 - RNA, 11 nt, Homo sapiens
gcaccuggcau

SEQ ID NO: 1987289 - RNA, 23 nt, Homo sapiens
caaauauuaucuuuguucuccua

SEQ ID NO: 1987290 - RNA, 23 nt, Homo sapiens
uccacuacucucuuccuccacuu

SEQ ID NO: 1987291 - RNA, 12 nt, Homo sapiens
ggccccaucucu

SEQ ID NO: 1987292 - RNA, 16 nt, Homo sapiens
uuagucacugcugcua

SEQ ID NO: 1987293 - RNA, 23 nt, Homo sapiens
ccuuuauugucuugguugccagu

SEQ ID NO: 1987294 - RNA, 14 nt, Homo sapiens
caauuaaagcaaaa

SEQ ID NO: 1987295 - RNA, 12 nt, Homo sapiens
caccucacugaa

SEQ ID NO: 1987296 - RNA, 17 nt, Homo sapiens
acugguuccuuccuuag

SEQ ID NO: 1987297 - RNA, 15 nt, Homo sapiens
uaaaugcucuucuga

SEQ ID NO: 1987298 - RNA, 12 nt, Homo sapiens
acaaauaaacuu

SEQ ID NO: 1987299 - RNA, 14 nt, Homo sapiens
accucccucugcca

SEQ ID NO: 1987300 - RNA, 23 nt, Homo sapiens
uccccuucucugugcaguagcau

SEQ ID NO: 1987301 - RNA, 16 nt, Homo sapiens
uccuacaguggcuguc

SEQ ID NO: 1987302 - RNA, 22 nt, Homo sapiens
uagcuuacacugaggacugugg

SEQ ID NO: 1987303 - RNA, 23 nt, Homo sapiens
acuugguccaacugcaacucauc

SEQ ID NO: 1987304 - RNA, 22 nt, Homo sapiens
ugaucucgaacuccuaaccuca

SEQ ID NO: 1987305 - RNA, 17 nt, Homo sapiens
aauuuacuuucugcacc

SEQ ID NO: 1987306 - RNA, 13 nt, Homo sapiens
aagucugagaaau

SEQ ID NO: 1987307 - RNA, 21 nt, Homo sapiens
guuuguccuuuuucacuuuga

SEQ ID NO: 1987308 - RNA, 20 nt, Homo sapiens
caaucuuguuuauagcaaaa

SEQ ID NO: 1987309 - RNA, 20 nt, Homo sapiens
cauuuucuugaugucacuau

SEQ ID NO: 1987310 - RNA, 16 nt, Homo sapiens
uucuuucuuaguccag

SEQ ID NO: 1987311 - RNA, 19 nt, Homo sapiens
accucuguucauuucacac

SEQ ID NO: 1987312 - RNA, 14 nt, Homo sapiens
uucuagccuuuuaa

SEQ ID NO: 1987313 - RNA, 14 nt, Homo sapiens
accuaaccacuuag

SEQ ID NO: 1987314 - RNA, 22 nt, Homo sapiens
ugaagauagaagguuugcagau

SEQ ID NO: 1987315 - RNA, 22 nt, Homo sapiens
uuucgucaccugacugcaauga

SEQ ID NO: 1987316 - RNA, 21 nt, Homo sapiens
cuuguaaugguucuuuacaca

SEQ ID NO: 1987317 - RNA, 22 nt, Homo sapiens
aaaaagaagaaagacacaaaga

SEQ ID NO: 1987318 - RNA, 16 nt, Homo sapiens
aagcggagagagccaa

SEQ ID NO: 1987319 - RNA, 21 nt, Homo sapiens
uuagauguugagaaauucugc

SEQ ID NO: 1987320 - RNA, 18 nt, Homo sapiens
gaagaauuuacuuuggaa

SEQ ID NO: 1987321 - RNA, 21 nt, Homo sapiens
gcuggggcuucaccagucugu

SEQ ID NO: 1987322 - RNA, 15 nt, Homo sapiens
uuauaagacaaugag

SEQ ID NO: 1987323 - RNA, 16 nt, Homo sapiens
gaccuuguagcuauau

SEQ ID NO: 1987324 - RNA, 16 nt, Homo sapiens
ggugccucucuuggcu

SEQ ID NO: 1987325 - RNA, 17 nt, Homo sapiens
aacccaucuucacgccu

SEQ ID NO: 1987326 - RNA, 20 nt, Homo sapiens
aaggaaaaaauaauauccau

SEQ ID NO: 1987327 - RNA, 11 nt, Homo sapiens
ggaaccugggg

SEQ ID NO: 1987328 - RNA, 15 nt, Homo sapiens
agcauguacuguacu

SEQ ID NO: 1987329 - RNA, 15 nt, Homo sapiens
gacacaaaccugccu

SEQ ID NO: 1987330 - RNA, 23 nt, Homo sapiens
gacgcagcccugggggccagcug

SEQ ID NO: 1987331 - RNA, 23 nt, Homo sapiens
ugaauccacccaaaucuauuguu

SEQ ID NO: 1987332 - RNA, 19 nt, Homo sapiens
uuucaaaauauacauucaa

SEQ ID NO: 1987333 - RNA, 17 nt, Homo sapiens
ccacucaagaagacacu

SEQ ID NO: 1987334 - RNA, 13 nt, Homo sapiens
agggcugggcuag

SEQ ID NO: 1987335 - RNA, 18 nt, Homo sapiens
cggguucaccauguugcc

SEQ ID NO: 1987336 - RNA, 17 nt, Homo sapiens
cucuugaauuccucuca

SEQ ID NO: 1987337 - RNA, 15 nt, Homo sapiens
accaugagaugguuu

SEQ ID NO: 1987338 - RNA, 17 nt, Homo sapiens
ggaugucacagggccaa

SEQ ID NO: 1987339 - RNA, 15 nt, Homo sapiens
aaauaaaacauagca

SEQ ID NO: 1987340 - RNA, 11 nt, Homo sapiens
caccucucauc

SEQ ID NO: 1987341 - RNA, 17 nt, Homo sapiens
acacauauuugcacaag

SEQ ID NO: 1987342 - RNA, 14 nt, Homo sapiens
auacaaguguuucu

SEQ ID NO: 1987343 - RNA, 17 nt, Homo sapiens
gacagaagguugccagg

SEQ ID NO: 1987344 - RNA, 23 nt, Homo sapiens
gccagugcuuuaauggcauguca

SEQ ID NO: 1987345 - RNA, 19 nt, Homo sapiens
uucauuauuucaaggaaua

SEQ ID NO: 1987346 - RNA, 21 nt, Homo sapiens
agaauauuuuaagaauuucac

SEQ ID NO: 1987347 - RNA, 22 nt, Homo sapiens
ucccuuuccagauauucaaguc

SEQ ID NO: 1987348 - RNA, 14 nt, Homo sapiens
uucauucaugaaua

SEQ ID NO: 1987349 - RNA, 14 nt, Homo sapiens
auccaucaagacaa

SEQ ID NO: 1987350 - RNA, 15 nt, Homo sapiens
acucacuaugaaggu

SEQ ID NO: 1987351 - RNA, 17 nt, Homo sapiens
uagaaggccacauguca

SEQ ID NO: 1987352 - RNA, 20 nt, Homo sapiens
aaugcuguaccuuucugaca

SEQ ID NO: 1987353 - RNA, 14 nt, Homo sapiens
ucuccccaccuuac

SEQ ID NO: 1987354 - RNA, 16 nt, Homo sapiens
auguaucaauggagca

SEQ ID NO: 1987355 - RNA, 14 nt, Homo sapiens
uaucaauagucaag

SEQ ID NO: 1987356 - RNA, 17 nt, Homo sapiens
gcagccacgucucaaca

SEQ ID NO: 1987357 - RNA, 20 nt, Homo sapiens
aaaagucccucccugccuga

SEQ ID NO: 1987358 - RNA, 14 nt, Homo sapiens
accugacucuugca

SEQ ID NO: 1987359 - RNA, 17 nt, Homo sapiens
cauccaaugcucaagaa

SEQ ID NO: 1987360 - RNA, 14 nt, Homo sapiens
uacaaugugacuuu

SEQ ID NO: 1987361 - RNA, 21 nt, Homo sapiens
caauaaacauuucauuuccca

SEQ ID NO: 1987362 - RNA, 18 nt, Homo sapiens
cuugcaauguagucaaua

SEQ ID NO: 1987363 - RNA, 15 nt, Homo sapiens
ccuugagucagaaaa

SEQ ID NO: 1987364 - RNA, 17 nt, Homo sapiens
aagauaaaccaguugaa

SEQ ID NO: 1987365 - RNA, 16 nt, Homo sapiens
acuuauggagugugcc

SEQ ID NO: 1987366 - RNA, 19 nt, Homo sapiens
uuuuuguuaucagucaaua

SEQ ID NO: 1987367 - RNA, 13 nt, Homo sapiens
acugagccaugcu

SEQ ID NO: 1987368 - RNA, 13 nt, Homo sapiens
cuucugccccgga

SEQ ID NO: 1987369 - RNA, 14 nt, Homo sapiens
gucaguauuaucua

SEQ ID NO: 1987370 - RNA, 13 nt, Homo sapiens
cuugugugugaug

SEQ ID NO: 1987371 - RNA, 19 nt, Homo sapiens
ugaacuauauccuuccuag

SEQ ID NO: 1987372 - RNA, 23 nt, Homo sapiens
cacugggacuuuguaaacuucca

SEQ ID NO: 1987373 - RNA, 20 nt, Homo sapiens
auggcuagaacguguuuaau

SEQ ID NO: 1987374 - RNA, 12 nt, Homo sapiens
acacauccugcu

SEQ ID NO: 1987375 - RNA, 21 nt, Homo sapiens
ugguuaaaagaacaacacuaa

SEQ ID NO: 1987376 - RNA, 19 nt, Homo sapiens
ugggugaucugcugcugag

SEQ ID NO: 1987377 - RNA, 22 nt, Homo sapiens
gaaguauuuuuuuaauuucuga

SEQ ID NO: 1987378 - RNA, 13 nt, Homo sapiens
aagguuuuauuca

SEQ ID NO: 1987379 - RNA, 16 nt, Homo sapiens
aucugggagagucuca

SEQ ID NO: 1987380 - RNA, 19 nt, Homo sapiens
auauacauacaugcauaca

SEQ ID NO: 1987381 - RNA, 14 nt, Homo sapiens
aaugucuguaucac

SEQ ID NO: 1987382 - RNA, 22 nt, Homo sapiens
gcuaaauguaccugagacauau

SEQ ID NO: 1987383 - RNA, 19 nt, Homo sapiens
cuugggcuauaaaagauuc

SEQ ID NO: 1987384 - RNA, 20 nt, Homo sapiens
ucauauaggccagaguugca

SEQ ID NO: 1987385 - RNA, 15 nt, Homo sapiens
cccaguucuucauuu

SEQ ID NO: 1987386 - RNA, 12 nt, Homo sapiens
aaaggucuuaaa

SEQ ID NO: 1987387 - RNA, 15 nt, Homo sapiens
aacaguccauugaaa

SEQ ID NO: 1987388 - RNA, 19 nt, Homo sapiens
uuagaagugcuaauuucug

SEQ ID NO: 1987389 - RNA, 15 nt, Homo sapiens
gcuucagaugaccuc

SEQ ID NO: 1987390 - RNA, 15 nt, Homo sapiens
ggccgggcagggugu

SEQ ID NO: 1987391 - RNA, 17 nt, Homo sapiens
aguagcauuuuucuaaa

SEQ ID NO: 1987392 - RNA, 18 nt, Homo sapiens
ugucgguuaccucugcau

SEQ ID NO: 1987393 - RNA, 12 nt, Homo sapiens
aaaaaaacagac

SEQ ID NO: 1987394 - RNA, 19 nt, Homo sapiens
aggcagcagggaagcaacc

SEQ ID NO: 1987395 - RNA, 14 nt, Homo sapiens
aauuuauccauuca

SEQ ID NO: 1987396 - RNA, 14 nt, Homo sapiens
cuccucucaucccc

SEQ ID NO: 1987397 - RNA, 16 nt, Homo sapiens
aagucaacccucuuac

SEQ ID NO: 1987398 - RNA, 18 nt, Homo sapiens
uaauccuuaacacauuca

SEQ ID NO: 1987399 - RNA, 12 nt, Homo sapiens
aacuauugagaa

SEQ ID NO: 1987400 - RNA, 22 nt, Homo sapiens
caugcugcuaauucaaagcucu

SEQ ID NO: 1987401 - RNA, 13 nt, Homo sapiens
aguugcuuuucag

SEQ ID NO: 1987402 - RNA, 18 nt, Homo sapiens
aaugagagacacacugaa

SEQ ID NO: 1987403 - RNA, 19 nt, Homo sapiens
uagguggagagaguggucu

SEQ ID NO: 1987404 - RNA, 21 nt, Homo sapiens
gaagucacaacaaaaggaaga

SEQ ID NO: 1987405 - RNA, 21 nt, Homo sapiens
uugcaauauuuuaaauauugu

SEQ ID NO: 1987406 - RNA, 14 nt, Homo sapiens
aguggccuugucca

SEQ ID NO: 1987407 - RNA, 19 nt, Homo sapiens
gauuauuuguguguucuaa

SEQ ID NO: 1987408 - RNA, 15 nt, Homo sapiens
cuccaucucaaaaag

SEQ ID NO: 1987409 - RNA, 12 nt, Homo sapiens
cacauacaguau

SEQ ID NO: 1987410 - RNA, 12 nt, Homo sapiens
gcacuuuggaca

SEQ ID NO: 1987411 - RNA, 15 nt, Homo sapiens
uggacagcaaggugg

SEQ ID NO: 1987412 - RNA, 17 nt, Homo sapiens
aagacccuaggugcuca

SEQ ID NO: 1987413 - RNA, 16 nt, Homo sapiens
cagccccucuaccucc

SEQ ID NO: 1987414 - RNA, 17 nt, Homo sapiens
cuaacauguugugccug

SEQ ID NO: 1987415 - RNA, 23 nt, Homo sapiens
ugguaagaccucugagaccaaaa

SEQ ID NO: 1987416 - RNA, 23 nt, Homo sapiens
gagcccggaguggacugauuuuc

SEQ ID NO: 1987417 - RNA, 18 nt, Homo sapiens
guaggcuggaguuaggga

SEQ ID NO: 1987418 - RNA, 19 nt, Homo sapiens
gagccaggaaagcagcaaa

SEQ ID NO: 1987419 - RNA, 18 nt, Homo sapiens
auucucccaaaguaccuu

SEQ ID NO: 1987420 - RNA, 16 nt, Homo sapiens
acccaggccacugacc

SEQ ID NO: 1987421 - RNA, 17 nt, Homo sapiens
gaugagcaagacauacu

SEQ ID NO: 1987422 - RNA, 20 nt, Homo sapiens
aaaaggccuuugggauuugc

SEQ ID NO: 1987423 - RNA, 16 nt, Homo sapiens
ucagaacagccaggua

SEQ ID NO: 1987424 - RNA, 14 nt, Homo sapiens
augaacuuuccaca

SEQ ID NO: 1987425 - RNA, 23 nt, Homo sapiens
ugcacagcuaacauggaaguacu

SEQ ID NO: 1987426 - RNA, 16 nt, Homo sapiens
aggcugucggggucaa

SEQ ID NO: 1987427 - RNA, 19 nt, Homo sapiens
aaacagccuuugggaaaug

SEQ ID NO: 1987428 - RNA, 16 nt, Homo sapiens
aaugaugguaaguuaa

SEQ ID NO: 1987429 - RNA, 15 nt, Homo sapiens
cugaacgcacaugac

SEQ ID NO: 1987430 - RNA, 19 nt, Homo sapiens
cugugagugcgucugaggg

SEQ ID NO: 1987431 - RNA, 23 nt, Homo sapiens
gcaagaacaccauccuacauaau

SEQ ID NO: 1987432 - RNA, 19 nt, Homo sapiens
ugcuaaaggagauuuacac

SEQ ID NO: 1987433 - RNA, 22 nt, Homo sapiens
ggcaauaaucuuuuaacagugu

SEQ ID NO: 1987434 - RNA, 20 nt, Homo sapiens
guaugcacuaaucaauacuu

SEQ ID NO: 1987435 - RNA, 14 nt, Homo sapiens
auagccacuauuaa

SEQ ID NO: 1987436 - RNA, 13 nt, Homo sapiens
uccucgcauuaaa

SEQ ID NO: 1987437 - RNA, 13 nt, Homo sapiens
ucauagcauucac

SEQ ID NO: 1987438 - RNA, 21 nt, Homo sapiens
uguuugguggggccauccaca

SEQ ID NO: 1987439 - RNA, 12 nt, Homo sapiens
gugaagcagcuc

SEQ ID NO: 1987440 - RNA, 13 nt, Homo sapiens
acacccuucccca

SEQ ID NO: 1987441 - RNA, 14 nt, Homo sapiens
gcugggccuggucu

SEQ ID NO: 1987442 - RNA, 23 nt, Homo sapiens
ucugauuuauguuuugaucaaau

SEQ ID NO: 1987443 - RNA, 17 nt, Homo sapiens
agagaguaucugagaac

SEQ ID NO: 1987444 - RNA, 17 nt, Homo sapiens
acucuuuccuaaagcca

SEQ ID NO: 1987445 - RNA, 20 nt, Homo sapiens
uggucuguggaucagcauuu

SEQ ID NO: 1987446 - RNA, 16 nt, Homo sapiens
ugcaguggguucucca

SEQ ID NO: 1987447 - RNA, 17 nt, Homo sapiens
auggugggcacagaagu

SEQ ID NO: 1987448 - RNA, 14 nt, Homo sapiens
ucuacaagcauuug

SEQ ID NO: 1987449 - RNA, 19 nt, Homo sapiens
aagacagggaagagcagaa

SEQ ID NO: 1987450 - RNA, 13 nt, Homo sapiens
uucucucagaaau

SEQ ID NO: 1987451 - RNA, 19 nt, Homo sapiens
ccuggaggggcaccaggug

SEQ ID NO: 1987452 - RNA, 11 nt, Homo sapiens
guaaguauuuu

SEQ ID NO: 1987453 - RNA, 16 nt, Homo sapiens
cuauuucuccaaagcc

SEQ ID NO: 1987454 - RNA, 18 nt, Homo sapiens
cagccaaccucauugcag

SEQ ID NO: 1987455 - RNA, 15 nt, Homo sapiens
cagaguggccuguga

SEQ ID NO: 1987456 - RNA, 19 nt, Homo sapiens
uugauuuuaauccuguaua

SEQ ID NO: 1987457 - RNA, 21 nt, Homo sapiens
uaccuuugaaauauuaaaauc

SEQ ID NO: 1987458 - RNA, 14 nt, Homo sapiens
gaaccccaggagau

SEQ ID NO: 1987459 - RNA, 18 nt, Homo sapiens
cuaagguuuagauaaaua

SEQ ID NO: 1987460 - RNA, 22 nt, Homo sapiens
ugaauuucaacgccugccuuug

SEQ ID NO: 1987461 - RNA, 12 nt, Homo sapiens
acugaugucauc

SEQ ID NO: 1987462 - RNA, 11 nt, Homo sapiens
ccagagucaga

SEQ ID NO: 1987463 - RNA, 17 nt, Homo sapiens
aaagcaauuacuacaaa

SEQ ID NO: 1987464 - RNA, 19 nt, Homo sapiens
augaugugaguacccagga

SEQ ID NO: 1987465 - RNA, 12 nt, Homo sapiens
aagcuuugaacc

SEQ ID NO: 1987466 - RNA, 20 nt, Homo sapiens
acagagugagacucugucuc

SEQ ID NO: 1987467 - RNA, 20 nt, Homo sapiens
acagagcaagacuccaucuc

SEQ ID NO: 1987468 - RNA, 20 nt, Homo sapiens
acagagcgagacuccgucuc

SEQ ID NO: 1987469 - RNA, 20 nt, Homo sapiens
acagagcgagauuccgucuu

SEQ ID NO: 1987470 - RNA, 21 nt, Homo sapiens
aacuacuguguuccuggcaau

SEQ ID NO: 1987471 - RNA, 14 nt, Homo sapiens
auacagaaugaauc

SEQ ID NO: 1987472 - RNA, 18 nt, Homo sapiens
aaaaauucauugucucua

SEQ ID NO: 1987473 - RNA, 19 nt, Homo sapiens
aucucugugauuaccucuc

SEQ ID NO: 1987474 - RNA, 13 nt, Homo sapiens
acagaggccuugg

SEQ ID NO: 1987475 - RNA, 23 nt, Homo sapiens
uaagauuguccagugcaaccaca

SEQ ID NO: 1987476 - RNA, 15 nt, Homo sapiens
auguuuucuuucuca

SEQ ID NO: 1987477 - RNA, 12 nt, Homo sapiens
guggaugugaug

SEQ ID NO: 1987478 - RNA, 15 nt, Homo sapiens
aucacauaaccuuaa

SEQ ID NO: 1987479 - RNA, 14 nt, Homo sapiens
accacaggcaugca

SEQ ID NO: 1987480 - RNA, 12 nt, Homo sapiens
ucagaaaacggg

SEQ ID NO: 1987481 - RNA, 13 nt, Homo sapiens
gcaacuaaggaca

SEQ ID NO: 1987482 - RNA, 21 nt, Homo sapiens
aaaccucacaaaccuucuuua

SEQ ID NO: 1987483 - RNA, 14 nt, Homo sapiens
cagccaacauggca

SEQ ID NO: 1987484 - RNA, 21 nt, Homo sapiens
guagaaggggaggacacuggu

SEQ ID NO: 1987485 - RNA, 16 nt, Homo sapiens
gcuuguauauacauau

SEQ ID NO: 1987486 - RNA, 15 nt, Homo sapiens
uucucuguacauauu

SEQ ID NO: 1987487 - RNA, 21 nt, Homo sapiens
aaaugggggcaggaaagccac

SEQ ID NO: 1987488 - RNA, 16 nt, Homo sapiens
aauuggcagcagauuu

SEQ ID NO: 1987489 - RNA, 19 nt, Homo sapiens
aaagcccacuuuguucgca

SEQ ID NO: 1987490 - RNA, 19 nt, Homo sapiens
gaauacccaggaagacuuu

SEQ ID NO: 1987491 - RNA, 15 nt, Homo sapiens
uacgcacguggagcu

SEQ ID NO: 1987492 - RNA, 17 nt, Homo sapiens
agcagcagcaucucuga

SEQ ID NO: 1987493 - RNA, 10 nt, Homo sapiens
uccuuggcau

SEQ ID NO: 1987494 - RNA, 18 nt, Homo sapiens
gaguuauguggauuucau

SEQ ID NO: 1987495 - RNA, 13 nt, Homo sapiens
uggagacuggaaa

SEQ ID NO: 1987496 - RNA, 19 nt, Homo sapiens
cugaguauguucauugcca

SEQ ID NO: 1987497 - RNA, 19 nt, Homo sapiens
cugcucccagagaccuugc

SEQ ID NO: 1987498 - RNA, 16 nt, Homo sapiens
cugguuuuacagagcu

SEQ ID NO: 1987499 - RNA, 18 nt, Homo sapiens
acaauaauuggaguucau

SEQ ID NO: 1987500 - RNA, 20 nt, Homo sapiens
agugagaugucagacaaauu

SEQ ID NO: 1987501 - RNA, 13 nt, Homo sapiens
augcgaaaguuug

SEQ ID NO: 1987502 - RNA, 15 nt, Homo sapiens
acagccuggaccacc

SEQ ID NO: 1987503 - RNA, 21 nt, Homo sapiens
auuguccccuaaaccaaaaac

SEQ ID NO: 1987504 - RNA, 19 nt, Homo sapiens
uagaaaaaaaaauucacau

SEQ ID NO: 1987505 - RNA, 14 nt, Homo sapiens
ugucuggugcagaa

SEQ ID NO: 1987506 - RNA, 18 nt, Homo sapiens
gcaacauaauaagacuuu

SEQ ID NO: 1987507 - RNA, 18 nt, Homo sapiens
cacuuuaaguaaaauaua

SEQ ID NO: 1987508 - RNA, 14 nt, Homo sapiens
uauacaacagugcu

SEQ ID NO: 1987509 - RNA, 14 nt, Homo sapiens
aagguuacuggaua

SEQ ID NO: 1987510 - RNA, 22 nt, Homo sapiens
gggcagggucucugcuccagca

SEQ ID NO: 1987511 - RNA, 16 nt, Homo sapiens
aacuugguucugaaua

SEQ ID NO: 1987512 - RNA, 14 nt, Homo sapiens
gaauaaauucccaa

SEQ ID NO: 1987513 - RNA, 16 nt, Homo sapiens
acuuguuaguacauaa

SEQ ID NO: 1987514 - RNA, 14 nt, Homo sapiens
cuagaagaugcagu

SEQ ID NO: 1987515 - RNA, 21 nt, Homo sapiens
augacaaauguauuaaugcua

SEQ ID NO: 1987516 - RNA, 12 nt, Homo sapiens
gugacccagugg

SEQ ID NO: 1987517 - RNA, 15 nt, Homo sapiens
cucuguccuacuucu

SEQ ID NO: 1987518 - RNA, 16 nt, Homo sapiens
acauguaacuuucgua

SEQ ID NO: 1987519 - RNA, 14 nt, Homo sapiens
aaucaacaccuuaa

SEQ ID NO: 1987520 - RNA, 15 nt, Homo sapiens
acuugccaaaacaga

SEQ ID NO: 1987521 - RNA, 23 nt, Homo sapiens
uggcuaggggagcagggggccca

SEQ ID NO: 1987522 - RNA, 18 nt, Homo sapiens
ccucccagagguccagcc

SEQ ID NO: 1987523 - RNA, 21 nt, Homo sapiens
guccaccccagucccuuucag

SEQ ID NO: 1987524 - RNA, 18 nt, Homo sapiens
ccaauugugcugccauuu

SEQ ID NO: 1987525 - RNA, 16 nt, Homo sapiens
cuauggagugcucaca

SEQ ID NO: 1987526 - RNA, 14 nt, Homo sapiens
cucuggcccaguga

SEQ ID NO: 1987527 - RNA, 20 nt, Homo sapiens
aauauagauagguagaacua

SEQ ID NO: 1987528 - RNA, 22 nt, Homo sapiens
ugcuccgucuaagucaugagcu

SEQ ID NO: 1987529 - RNA, 21 nt, Homo sapiens
caauaauaaguccaucuguca

SEQ ID NO: 1987530 - RNA, 21 nt, Homo sapiens
aaauuuuuuaaaagagacaaa

SEQ ID NO: 1987531 - RNA, 21 nt, Homo sapiens
caaggaaccucaagucaugcu

SEQ ID NO: 1987532 - RNA, 17 nt, Homo sapiens
guccuaggcucugggug

SEQ ID NO: 1987533 - RNA, 13 nt, Homo sapiens
ucccccuuucucc

SEQ ID NO: 1987534 - RNA, 15 nt, Homo sapiens
guaagugaacuacca

SEQ ID NO: 1987535 - RNA, 13 nt, Homo sapiens
ccugugccucuuc

SEQ ID NO: 1987536 - RNA, 15 nt, Homo sapiens
gcuuucauccugugu

SEQ ID NO: 1987537 - RNA, 17 nt, Homo sapiens
uauuugaaaguucucag

SEQ ID NO: 1987538 - RNA, 16 nt, Homo sapiens
agagcagcuagcucuu

SEQ ID NO: 1987539 - RNA, 19 nt, Homo sapiens
cagaggccuugcuguggag

SEQ ID NO: 1987540 - RNA, 15 nt, Homo sapiens
ucacugccagugcag

SEQ ID NO: 1987541 - RNA, 15 nt, Homo sapiens
ucuuucagcuccuga

SEQ ID NO: 1987542 - RNA, 15 nt, Homo sapiens
cacagacugaccccc

SEQ ID NO: 1987543 - RNA, 15 nt, Homo sapiens
ccauguccugaaaaa

SEQ ID NO: 1987544 - RNA, 23 nt, Homo sapiens
aaagacuuguguccccaccucag

SEQ ID NO: 1987545 - RNA, 16 nt, Homo sapiens
ucugaucugaugcaag

SEQ ID NO: 1987546 - RNA, 19 nt, Homo sapiens
auccugcucuuuugugaug

SEQ ID NO: 1987547 - RNA, 15 nt, Homo sapiens
aaggcaaauguuuau

SEQ ID NO: 1987548 - RNA, 16 nt, Homo sapiens
agcuggcuguauggaa

SEQ ID NO: 1987549 - RNA, 23 nt, Homo sapiens
cucaaacuccugaccucaggcaa

SEQ ID NO: 1987550 - RNA, 14 nt, Homo sapiens
cucccuccagggaa

SEQ ID NO: 1987551 - RNA, 21 nt, Homo sapiens
uguccugccuguggccaugac

SEQ ID NO: 1987552 - RNA, 17 nt, Homo sapiens
augucucuuguagaaga

SEQ ID NO: 1987553 - RNA, 13 nt, Homo sapiens
uuaagcacauuau

SEQ ID NO: 1987554 - RNA, 16 nt, Homo sapiens
cacagaaauuuucaau

SEQ ID NO: 1987555 - RNA, 17 nt, Homo sapiens
ccacuucugugggcaug

SEQ ID NO: 1987556 - RNA, 22 nt, Homo sapiens
uugaauuguaggugacuauuau

SEQ ID NO: 1987557 - RNA, 13 nt, Homo sapiens
cagccauuugcca

SEQ ID NO: 1987558 - RNA, 12 nt, Homo sapiens
aguguuuuggag

SEQ ID NO: 1987559 - RNA, 22 nt, Homo sapiens
ccaaagcacaugcuuagcuuau

SEQ ID NO: 1987560 - RNA, 22 nt, Homo sapiens
caacagauggauagucugucca

SEQ ID NO: 1987561 - RNA, 14 nt, Homo sapiens
agcugaaaagugau

SEQ ID NO: 1987562 - RNA, 16 nt, Homo sapiens
agggauguaacuauug

SEQ ID NO: 1987563 - RNA, 19 nt, Homo sapiens
gguuugaaagaugcagugg

SEQ ID NO: 1987564 - RNA, 14 nt, Homo sapiens
agaacaacuugaag

SEQ ID NO: 1987565 - RNA, 18 nt, Homo sapiens
gcuccauuuucuugucaa

SEQ ID NO: 1987566 - RNA, 21 nt, Homo sapiens
gcccugauguguccucaggga

SEQ ID NO: 1987567 - RNA, 12 nt, Homo sapiens
agagacaucaaa

SEQ ID NO: 1987568 - RNA, 21 nt, Homo sapiens
guucacuucuaaaccaaaaau

SEQ ID NO: 1987569 - RNA, 16 nt, Homo sapiens
uguauucucagcacuu

SEQ ID NO: 1987570 - RNA, 21 nt, Homo sapiens
agccauguccugcugcuucug

SEQ ID NO: 1987571 - RNA, 23 nt, Homo sapiens
agacagauaccuccaacccugcc

SEQ ID NO: 1987572 - RNA, 20 nt, Homo sapiens
auguaaggaggaaucaagaa

SEQ ID NO: 1987573 - RNA, 14 nt, Homo sapiens
cugugucuuggaau

SEQ ID NO: 1987574 - RNA, 20 nt, Homo sapiens
cucccuuggugguggggaca

SEQ ID NO: 1987575 - RNA, 14 nt, Homo sapiens
uugugaaccccaaa

SEQ ID NO: 1987576 - RNA, 17 nt, Homo sapiens
agaauuaggaaggccau

SEQ ID NO: 1987577 - RNA, 19 nt, Homo sapiens
acaaagaguagacauuucu

SEQ ID NO: 1987578 - RNA, 20 nt, Homo sapiens
cuugugugauguuuuacaca

SEQ ID NO: 1987579 - RNA, 20 nt, Homo sapiens
uuucagauuguggaauguug

SEQ ID NO: 1987580 - RNA, 15 nt, Homo sapiens
acagguucugagaua

SEQ ID NO: 1987581 - RNA, 15 nt, Homo sapiens
ugugacacacuggcu

SEQ ID NO: 1987582 - RNA, 18 nt, Homo sapiens
ucuguaaugcuuuacaca

SEQ ID NO: 1987583 - RNA, 22 nt, Homo sapiens
cugaagcucuucucuccagugu

SEQ ID NO: 1987584 - RNA, 18 nt, Homo sapiens
uaaacauuucuuucaaua

SEQ ID NO: 1987585 - RNA, 13 nt, Homo sapiens
uuuuucaguauuu

SEQ ID NO: 1987586 - RNA, 15 nt, Homo sapiens
acugugcaccaggca

SEQ ID NO: 1987587 - RNA, 13 nt, Homo sapiens
acagcuuccucac

SEQ ID NO: 1987588 - RNA, 19 nt, Homo sapiens
uuggugcaagugugcaugg

SEQ ID NO: 1987589 - RNA, 23 nt, Homo sapiens
ccuaggucagucuugcuggauuu

SEQ ID NO: 1987590 - RNA, 18 nt, Homo sapiens
aauaaugaguaguguaaa

SEQ ID NO: 1987591 - RNA, 20 nt, Homo sapiens
guaagaugcuccugguggcu

SEQ ID NO: 1987592 - RNA, 16 nt, Homo sapiens
cgagaaggugcuuccg

SEQ ID NO: 1987593 - RNA, 19 nt, Homo sapiens
ucugagacuauaacuguca

SEQ ID NO: 1987594 - RNA, 16 nt, Homo sapiens
uauggaaauaguacua

SEQ ID NO: 1987595 - RNA, 18 nt, Homo sapiens
cuccuuuugaccaaauaa

SEQ ID NO: 1987596 - RNA, 22 nt, Homo sapiens
caaggcgaguggauaauuccaa

SEQ ID NO: 1987597 - RNA, 17 nt, Homo sapiens
caggucagagcccagga

SEQ ID NO: 1987598 - RNA, 14 nt, Homo sapiens
ugggacaacacuuu

SEQ ID NO: 1987599 - RNA, 23 nt, Homo sapiens
acaugagggcugguguucauuaa

SEQ ID NO: 1987600 - RNA, 15 nt, Homo sapiens
caaaagugcauucaa

SEQ ID NO: 1987601 - RNA, 18 nt, Homo sapiens
cggucauuugaaugagac

SEQ ID NO: 1987602 - RNA, 14 nt, Homo sapiens
gaauuuauugccuc

SEQ ID NO: 1987603 - RNA, 17 nt, Homo sapiens
ccccuccgugcuuuucu

SEQ ID NO: 1987604 - RNA, 17 nt, Homo sapiens
cggcacuggguuugcuc

SEQ ID NO: 1987605 - RNA, 22 nt, Homo sapiens
acacucccugcuugcaggaggc

SEQ ID NO: 1987606 - RNA, 12 nt, Homo sapiens
ccccacugccac

SEQ ID NO: 1987607 - RNA, 20 nt, Homo sapiens
gacuccaaacagaccccugu

SEQ ID NO: 1987608 - RNA, 14 nt, Homo sapiens
auuuuaugauccag

SEQ ID NO: 1987609 - RNA, 18 nt, Homo sapiens
cuucuucugaucauuuca

SEQ ID NO: 1987610 - RNA, 17 nt, Homo sapiens
cauuuauuuuuauaucu

SEQ ID NO: 1987611 - RNA, 19 nt, Homo sapiens
cuugccuaugauacugucu

SEQ ID NO: 1987612 - RNA, 16 nt, Homo sapiens
acaugaccacauagca

SEQ ID NO: 1987613 - RNA, 21 nt, Homo sapiens
cagauggacagacagccaccc

SEQ ID NO: 1987614 - RNA, 12 nt, Homo sapiens
acucugaaccac

SEQ ID NO: 1987615 - RNA, 22 nt, Homo sapiens
acacagugcuauuugcauuucu

SEQ ID NO: 1987616 - RNA, 14 nt, Homo sapiens
uguacaucuuucau

SEQ ID NO: 1987617 - RNA, 15 nt, Homo sapiens
uggggagucucaugc

SEQ ID NO: 1987618 - RNA, 16 nt, Homo sapiens
acacccuuaugaauug

SEQ ID NO: 1987619 - RNA, 23 nt, Homo sapiens
uaaacugauugcuggcaacaaca

SEQ ID NO: 1987620 - RNA, 19 nt, Homo sapiens
uaauauuuguguguucacu

SEQ ID NO: 1987621 - RNA, 19 nt, Homo sapiens
agcacgcccuccugggccg

SEQ ID NO: 1987622 - RNA, 16 nt, Homo sapiens
gaacauuccuaucaau

SEQ ID NO: 1987623 - RNA, 22 nt, Homo sapiens
uaagccacauggcugggauuua

SEQ ID NO: 1987624 - RNA, 12 nt, Homo sapiens
agagaggcaugu

SEQ ID NO: 1987625 - RNA, 15 nt, Homo sapiens
acgagcuaguuaaac

SEQ ID NO: 1987626 - RNA, 18 nt, Homo sapiens
gccuucuuauugcuuuua

SEQ ID NO: 1987627 - RNA, 21 nt, Homo sapiens
cuccugggcucaagcagucua

SEQ ID NO: 1987628 - RNA, 19 nt, Homo sapiens
aaaucuugcuucagaccau

SEQ ID NO: 1987629 - RNA, 15 nt, Homo sapiens
ggcagucugggcacu

SEQ ID NO: 1987630 - RNA, 14 nt, Homo sapiens
aauagcacauaugg

SEQ ID NO: 1987631 - RNA, 12 nt, Homo sapiens
uagccacuggaa

SEQ ID NO: 1987632 - RNA, 12 nt, Homo sapiens
uagacacuggac

SEQ ID NO: 1987633 - RNA, 13 nt, Homo sapiens
ggucagagccacu

SEQ ID NO: 1987634 - RNA, 20 nt, Homo sapiens
acaaggcacaccagugcaag

SEQ ID NO: 1987635 - RNA, 23 nt, Homo sapiens
cuuagauuagcucuggaccagcc

SEQ ID NO: 1987636 - RNA, 18 nt, Homo sapiens
aacaaaaaaacuauaaaa

SEQ ID NO: 1987637 - RNA, 18 nt, Homo sapiens
uuucugguaaaacuuuag

SEQ ID NO: 1987638 - RNA, 17 nt, Homo sapiens
uuaaagaagcugcaugu

SEQ ID NO: 1987639 - RNA, 12 nt, Homo sapiens
ucaauaguauua

SEQ ID NO: 1987640 - RNA, 17 nt, Homo sapiens
cuaccacaucuucaugu

SEQ ID NO: 1987641 - RNA, 18 nt, Homo sapiens
ggcaacccucacuguguu

SEQ ID NO: 1987642 - RNA, 17 nt, Homo sapiens
cagccauaaaaccuggg

SEQ ID NO: 1987643 - RNA, 15 nt, Homo sapiens
cuauccucuuuggaa

SEQ ID NO: 1987644 - RNA, 19 nt, Homo sapiens
auuugugacaacauuucau

SEQ ID NO: 1987645 - RNA, 20 nt, Homo sapiens
ccuagcacuuugggaggcca

SEQ ID NO: 1987646 - RNA, 22 nt, Homo sapiens
cagagaccccaggaacaauaaa

SEQ ID NO: 1987647 - RNA, 18 nt, Homo sapiens
uuaauaaagacgauuugu

SEQ ID NO: 1987648 - RNA, 18 nt, Homo sapiens
gacugcggugaacauuuc

SEQ ID NO: 1987649 - RNA, 15 nt, Homo sapiens
uaaggcagaucuuug

SEQ ID NO: 1987650 - RNA, 22 nt, Homo sapiens
agaaccucagaggccacuugcu

SEQ ID NO: 1987651 - RNA, 20 nt, Homo sapiens
acuguauuuauugugaugcc

SEQ ID NO: 1987652 - RNA, 11 nt, Homo sapiens
gaaaugcaaaa

SEQ ID NO: 1987653 - RNA, 14 nt, Homo sapiens
aaacaauuuagcca

SEQ ID NO: 1987654 - RNA, 16 nt, Homo sapiens
uaaugaagacccagug

SEQ ID NO: 1987655 - RNA, 13 nt, Homo sapiens
uauuggcauuugu

SEQ ID NO: 1987656 - RNA, 21 nt, Homo sapiens
gcuuccagcagagccuugcag

SEQ ID NO: 1987657 - RNA, 13 nt, Homo sapiens
uggaagauucuau

SEQ ID NO: 1987658 - RNA, 14 nt, Homo sapiens
auucuaugacaaua

SEQ ID NO: 1987659 - RNA, 16 nt, Homo sapiens
uugcauuuucacaaau

SEQ ID NO: 1987660 - RNA, 17 nt, Homo sapiens
uuacugaucuuacucac

SEQ ID NO: 1987661 - RNA, 23 nt, Homo sapiens
guucugacauuaacaguuuucca

SEQ ID NO: 1987662 - RNA, 18 nt, Homo sapiens
cuuuugugguuucucugg

SEQ ID NO: 1987663 - RNA, 18 nt, Homo sapiens
cggagugagcaauggagu

SEQ ID NO: 1987664 - RNA, 11 nt, Homo sapiens
augucauuuga

SEQ ID NO: 1987665 - RNA, 22 nt, Homo sapiens
aaacaccaaacucauaacaguc

SEQ ID NO: 1987666 - RNA, 22 nt, Homo sapiens
agauccagggacugaagccaaa

SEQ ID NO: 1987667 - RNA, 17 nt, Homo sapiens
agacaucacuugccaau

SEQ ID NO: 1987668 - RNA, 11 nt, Homo sapiens
uugacaucucu

SEQ ID NO: 1987669 - RNA, 23 nt, Homo sapiens
aguguuccccuuccacugagggc

SEQ ID NO: 1987670 - RNA, 14 nt, Homo sapiens
ucuauugacuuuuc

SEQ ID NO: 1987671 - RNA, 20 nt, Homo sapiens
ucugucgcccuuagucauau

SEQ ID NO: 1987672 - RNA, 15 nt, Homo sapiens
guguggcagccacac

SEQ ID NO: 1987673 - RNA, 17 nt, Homo sapiens
cuccugugugacuggca

SEQ ID NO: 1987674 - RNA, 15 nt, Homo sapiens
acguggugaccucac

SEQ ID NO: 1987675 - RNA, 12 nt, Homo sapiens
cccuaugcugcc

SEQ ID NO: 1987676 - RNA, 10 nt, Homo sapiens
cucacuuuug

SEQ ID NO: 1987677 - RNA, 17 nt, Homo sapiens
uuacugaugcuccugaa

SEQ ID NO: 1987678 - RNA, 16 nt, Homo sapiens
cagacaugguggcaug

SEQ ID NO: 1987679 - RNA, 19 nt, Homo sapiens
agagagguuuuucuuggga

SEQ ID NO: 1987680 - RNA, 14 nt, Homo sapiens
acaaauuguuacuc

SEQ ID NO: 1987681 - RNA, 22 nt, Homo sapiens
ugacuucuuuacuaacacuggc

SEQ ID NO: 1987682 - RNA, 23 nt, Homo sapiens
gugcacaguaauaugaaagccac

SEQ ID NO: 1987683 - RNA, 13 nt, Homo sapiens
agcuuguuucccu

SEQ ID NO: 1987684 - RNA, 18 nt, Homo sapiens
uacagguaugugccacca

SEQ ID NO: 1987685 - RNA, 14 nt, Homo sapiens
uuugcaaaauggaa

SEQ ID NO: 1987686 - RNA, 15 nt, Homo sapiens
cugggaucuggcaca

SEQ ID NO: 1987687 - RNA, 13 nt, Homo sapiens
cuaaauagcacuu

SEQ ID NO: 1987688 - RNA, 15 nt, Homo sapiens
ccaggccucagggac

SEQ ID NO: 1987689 - RNA, 15 nt, Homo sapiens
cagggccuccaggac

SEQ ID NO: 1987690 - RNA, 22 nt, Homo sapiens
caugccuguaaucccaacacuu

SEQ ID NO: 1987691 - RNA, 19 nt, Homo sapiens
ugcuggaggaauuuuguca

SEQ ID NO: 1987692 - RNA, 13 nt, Homo sapiens
cuuugaguaccaa

SEQ ID NO: 1987693 - RNA, 13 nt, Homo sapiens
aaguggucuuaag

SEQ ID NO: 1987694 - RNA, 12 nt, Homo sapiens
ggagaacuacuu

SEQ ID NO: 1987695 - RNA, 20 nt, Homo sapiens
uugaaaugaguaaaaacuag

SEQ ID NO: 1987696 - RNA, 21 nt, Homo sapiens
ccaaggaaacccccaguguaa

SEQ ID NO: 1987697 - RNA, 19 nt, Homo sapiens
gccuggccccaaauguucu

SEQ ID NO: 1987698 - RNA, 21 nt, Homo sapiens
uucccuuucuacccaguacuc

SEQ ID NO: 1987699 - RNA, 15 nt, Homo sapiens
guuucuaacuuggag

SEQ ID NO: 1987700 - RNA, 20 nt, Homo sapiens
cuuugcugagccuguaaaau

SEQ ID NO: 1987701 - RNA, 17 nt, Homo sapiens
ucacucacucacuccaa

SEQ ID NO: 1987702 - RNA, 17 nt, Homo sapiens
acaagccaucaagcacu

SEQ ID NO: 1987703 - RNA, 20 nt, Homo sapiens
uuagauugaguaagauuuac

SEQ ID NO: 1987704 - RNA, 12 nt, Homo sapiens
acaauuccugua

SEQ ID NO: 1987705 - RNA, 22 nt, Homo sapiens
gaagcaguagacagauguuggu

SEQ ID NO: 1987706 - RNA, 15 nt, Homo sapiens
ugaaacuccgucuca

SEQ ID NO: 1987707 - RNA, 15 nt, Homo sapiens
ucaaaagcacuuugu

SEQ ID NO: 1987708 - RNA, 20 nt, Homo sapiens
uaaguuauuuacuuuuacca

SEQ ID NO: 1987709 - RNA, 11 nt, Homo sapiens
uaccucuagua

SEQ ID NO: 1987710 - RNA, 17 nt, Homo sapiens
guaccugcuggguguuu

SEQ ID NO: 1987711 - RNA, 14 nt, Homo sapiens
uauccugaaaggca

SEQ ID NO: 1987712 - RNA, 14 nt, Homo sapiens
gcacugagaccucc

SEQ ID NO: 1987713 - RNA, 18 nt, Homo sapiens
uaaguuauaaaaggugaa

SEQ ID NO: 1987714 - RNA, 12 nt, Homo sapiens
aguccagaagag

SEQ ID NO: 1987715 - RNA, 13 nt, Homo sapiens
acguccuuuggac

SEQ ID NO: 1987716 - RNA, 17 nt, Homo sapiens
aucucugugaaaccccu

SEQ ID NO: 1987717 - RNA, 18 nt, Homo sapiens
ucaagugucuuccaucau

SEQ ID NO: 1987718 - RNA, 23 nt, Homo sapiens
acaaaaaaguguucccuuuucaa

SEQ ID NO: 1987719 - RNA, 20 nt, Homo sapiens
ucgacuuuucuuaacaaccu

SEQ ID NO: 1987720 - RNA, 20 nt, Homo sapiens
gcauaagaaauguagcugaa

SEQ ID NO: 1987721 - RNA, 21 nt, Homo sapiens
gccuaccucuuagacauguug

SEQ ID NO: 1987722 - RNA, 15 nt, Homo sapiens
gaccagccuggccca

SEQ ID NO: 1987723 - RNA, 12 nt, Homo sapiens
cggagcuuucaa

SEQ ID NO: 1987724 - RNA, 12 nt, Homo sapiens
uggagcuuccaa

SEQ ID NO: 1987725 - RNA, 18 nt, Homo sapiens
agacuucaucuucaaaac

SEQ ID NO: 1987726 - RNA, 19 nt, Homo sapiens
aaauugauuaaaggggcug

SEQ ID NO: 1987727 - RNA, 12 nt, Homo sapiens
ccccacuuugaa

SEQ ID NO: 1987728 - RNA, 17 nt, Homo sapiens
ugagggaaaacauaaua

SEQ ID NO: 1987729 - RNA, 16 nt, Homo sapiens
accucacucuugccaa

SEQ ID NO: 1987730 - RNA, 16 nt, Homo sapiens
ggacaguggaugcugc

SEQ ID NO: 1987731 - RNA, 21 nt, Homo sapiens
ucaaaguguuuuucaagccug

SEQ ID NO: 1987732 - RNA, 17 nt, Homo sapiens
guaucuucauaaucuuu

SEQ ID NO: 1987733 - RNA, 19 nt, Homo sapiens
ucaggcagguuugccagug

SEQ ID NO: 1987734 - RNA, 12 nt, Homo sapiens
gucugacaggca

SEQ ID NO: 1987735 - RNA, 17 nt, Homo sapiens
gguaccaagagacuccu

SEQ ID NO: 1987736 - RNA, 19 nt, Homo sapiens
caggccaaacucaccugcc

SEQ ID NO: 1987737 - RNA, 19 nt, Homo sapiens
aucagcaggaaugcucuga

SEQ ID NO: 1987738 - RNA, 23 nt, Homo sapiens
gaacacuaacuaugcauggugcc

SEQ ID NO: 1987739 - RNA, 18 nt, Homo sapiens
ugcagacaggcuggcauu

SEQ ID NO: 1987740 - RNA, 11 nt, Homo sapiens
acucucugaac

SEQ ID NO: 1987741 - RNA, 15 nt, Homo sapiens
auuugaaguuugcca

SEQ ID NO: 1987742 - RNA, 15 nt, Homo sapiens
aggggaaguggucca

SEQ ID NO: 1987743 - RNA, 20 nt, Homo sapiens
auccugggggaccaaugagg

SEQ ID NO: 1987744 - RNA, 19 nt, Homo sapiens
cuuaaaguuuuaacuuuua

SEQ ID NO: 1987745 - RNA, 21 nt, Homo sapiens
ugagaaacaugaauuauuucc

SEQ ID NO: 1987746 - RNA, 22 nt, Homo sapiens
cagccuugcaucaagggcuuua

SEQ ID NO: 1987747 - RNA, 14 nt, Homo sapiens
ggccaggccugcca

SEQ ID NO: 1987748 - RNA, 18 nt, Homo sapiens
gaggggcccucaggccau

SEQ ID NO: 1987749 - RNA, 19 nt, Homo sapiens
caaauguguauaaacugcu

SEQ ID NO: 1987750 - RNA, 19 nt, Homo sapiens
agcuggaggcuccaggacu

SEQ ID NO: 1987751 - RNA, 18 nt, Homo sapiens
auggcuuguucaucaucc

SEQ ID NO: 1987752 - RNA, 15 nt, Homo sapiens
ugauuauagugacaa

SEQ ID NO: 1987753 - RNA, 17 nt, Homo sapiens
cuuccuuggccaagaga

SEQ ID NO: 1987754 - RNA, 15 nt, Homo sapiens
acagucagcucucuc

SEQ ID NO: 1987755 - RNA, 14 nt, Homo sapiens
aacacugcccucuu

SEQ ID NO: 1987756 - RNA, 20 nt, Homo sapiens
caucugggaaagacauccau

SEQ ID NO: 1987757 - RNA, 14 nt, Homo sapiens
aggcuggucuugaa

SEQ ID NO: 1987758 - RNA, 22 nt, Homo sapiens
uuucucuccaacucccucuggg

SEQ ID NO: 1987759 - RNA, 10 nt, Homo sapiens
aaauaaucuc

SEQ ID NO: 1987760 - RNA, 20 nt, Homo sapiens
agauaguagcauacauuuau

SEQ ID NO: 1987761 - RNA, 23 nt, Homo sapiens
agguccaggguuguuagaucuuc

SEQ ID NO: 1987762 - RNA, 12 nt, Homo sapiens
aagaccaagaca

SEQ ID NO: 1987763 - RNA, 18 nt, Homo sapiens
uugaaauugaaccuuugu

SEQ ID NO: 1987764 - RNA, 22 nt, Homo sapiens
gcaguggagggggcaagcuuug

SEQ ID NO: 1987765 - RNA, 15 nt, Homo sapiens
cagcaacuggugacu

SEQ ID NO: 1987766 - RNA, 16 nt, Homo sapiens
acccaaagcacaugcu

SEQ ID NO: 1987767 - RNA, 22 nt, Homo sapiens
agagcgaucucggcucacugca

SEQ ID NO: 1987768 - RNA, 13 nt, Homo sapiens
auccaaugcacug

SEQ ID NO: 1987769 - RNA, 16 nt, Homo sapiens
ucaacucccugagagc

SEQ ID NO: 1987770 - RNA, 15 nt, Homo sapiens
gaaccaggaggacaa

SEQ ID NO: 1987771 - RNA, 17 nt, Homo sapiens
cgaaauguucucaugaa

SEQ ID NO: 1987772 - RNA, 20 nt, Homo sapiens
cugauuauuuagagccauua

SEQ ID NO: 1987773 - RNA, 21 nt, Homo sapiens
uaucaagccaguacgugcuaa

SEQ ID NO: 1987774 - RNA, 20 nt, Homo sapiens
agcuuuuagaaaaugcaguc

SEQ ID NO: 1987775 - RNA, 19 nt, Homo sapiens
cuuaauggccuuaauuaau

SEQ ID NO: 1987776 - RNA, 18 nt, Homo sapiens
gacauaauuucacugaau

SEQ ID NO: 1987777 - RNA, 19 nt, Homo sapiens
gucacauuuagcugugcuc

SEQ ID NO: 1987778 - RNA, 21 nt, Homo sapiens
guguuuuucuuuuuccacaag

SEQ ID NO: 1987779 - RNA, 23 nt, Homo sapiens
aaguucaccagcccugagccaug

SEQ ID NO: 1987780 - RNA, 22 nt, Homo sapiens
gaacacaagugccccuggccaa

SEQ ID NO: 1987781 - RNA, 15 nt, Homo sapiens
uuagugauauuacau

SEQ ID NO: 1987782 - RNA, 14 nt, Homo sapiens
agagucaaccacca

SEQ ID NO: 1987783 - RNA, 14 nt, Homo sapiens
uuccguaaacauau

SEQ ID NO: 1987784 - RNA, 14 nt, Homo sapiens
ggacugguccaggc

SEQ ID NO: 1987785 - RNA, 15 nt, Homo sapiens
cugccucucuucuuc

SEQ ID NO: 1987786 - RNA, 21 nt, Homo sapiens
gaugagauuggcauggcuuua

SEQ ID NO: 1987787 - RNA, 21 nt, Homo sapiens
gaaaaaaauacaaaaagcaaa

SEQ ID NO: 1987788 - RNA, 21 nt, Homo sapiens
aacuaauucuuggguguuuau

SEQ ID NO: 1987789 - RNA, 16 nt, Homo sapiens
auacgaaaucaguuuc

SEQ ID NO: 1987790 - RNA, 21 nt, Homo sapiens
uugcugauaccauaugaauga

SEQ ID NO: 1987791 - RNA, 21 nt, Homo sapiens
acuacugcuggaaaaagcccu

SEQ ID NO: 1987792 - RNA, 11 nt, Homo sapiens
guauacugugu

SEQ ID NO: 1987793 - RNA, 13 nt, Homo sapiens
ugcuuccagugga

SEQ ID NO: 1987794 - RNA, 12 nt, Homo sapiens
aaucacaagcag

SEQ ID NO: 1987795 - RNA, 13 nt, Homo sapiens
aguagaacccagg

SEQ ID NO: 1987796 - RNA, 14 nt, Homo sapiens
cugcaagucuucau

SEQ ID NO: 1987797 - RNA, 12 nt, Homo sapiens
uaucuugcucca

SEQ ID NO: 1987798 - RNA, 15 nt, Homo sapiens
aggagcgcaucucaa

SEQ ID NO: 1987799 - RNA, 14 nt, Homo sapiens
aagacuccugggcu

SEQ ID NO: 1987800 - RNA, 19 nt, Homo sapiens
aacauaaagagaacucugg

SEQ ID NO: 1987801 - RNA, 23 nt, Homo sapiens
acugcaggggaggccacgugcag

SEQ ID NO: 1987802 - RNA, 22 nt, Homo sapiens
ucaaagaaaguguauugguuua

SEQ ID NO: 1987803 - RNA, 17 nt, Homo sapiens
auauguaugcaccucaa

SEQ ID NO: 1987804 - RNA, 17 nt, Homo sapiens
ucaacucucuuuguaaa

SEQ ID NO: 1987805 - RNA, 23 nt, Homo sapiens
ugugauuuugagcaaaccacaua

SEQ ID NO: 1987806 - RNA, 18 nt, Homo sapiens
aucauggcagugaugaaa

SEQ ID NO: 1987807 - RNA, 13 nt, Homo sapiens
ccgguuugccaug

SEQ ID NO: 1987808 - RNA, 20 nt, Homo sapiens
cuguuaagggaagcugauac

SEQ ID NO: 1987809 - RNA, 20 nt, Homo sapiens
gaacaguaaagaaagcagaa

SEQ ID NO: 1987810 - RNA, 16 nt, Homo sapiens
cagugcccaugggcua

SEQ ID NO: 1987811 - RNA, 23 nt, Homo sapiens
aggaacugcaauaauaucaaaac

SEQ ID NO: 1987812 - RNA, 19 nt, Homo sapiens
ugcuucuuggagucuucca

SEQ ID NO: 1987813 - RNA, 15 nt, Homo sapiens
agucaagcugaugaa

SEQ ID NO: 1987814 - RNA, 22 nt, Homo sapiens
uaaucaguuguuuaauaauuua

SEQ ID NO: 1987815 - RNA, 15 nt, Homo sapiens
uggagccaacagaug

SEQ ID NO: 1987816 - RNA, 18 nt, Homo sapiens
uucccuccaccagugugc

SEQ ID NO: 1987817 - RNA, 13 nt, Homo sapiens
guuguuuacuuaa

SEQ ID NO: 1987818 - RNA, 21 nt, Homo sapiens
gaagugagaacccagcugucc

SEQ ID NO: 1987819 - RNA, 19 nt, Homo sapiens
aagcuauagcuaaugugcu

SEQ ID NO: 1987820 - RNA, 20 nt, Homo sapiens
caaacaagaaacauuucaga

SEQ ID NO: 1987821 - RNA, 17 nt, Homo sapiens
gcuuugaguuaacucac

SEQ ID NO: 1987822 - RNA, 16 nt, Homo sapiens
cugacuucucacuucc

SEQ ID NO: 1987823 - RNA, 23 nt, Homo sapiens
ucaucccucccugccuaaggaag

SEQ ID NO: 1987824 - RNA, 12 nt, Homo sapiens
ugaagaucucag

SEQ ID NO: 1987825 - RNA, 22 nt, Homo sapiens
ggcccaugcaauuuuauuaaau

SEQ ID NO: 1987826 - RNA, 19 nt, Homo sapiens
augagccaucacuagaaga

SEQ ID NO: 1987827 - RNA, 22 nt, Homo sapiens
ucuuaaguuguggagagugcaa

SEQ ID NO: 1987828 - RNA, 17 nt, Homo sapiens
uaacauuucuguucuca

SEQ ID NO: 1987829 - RNA, 14 nt, Homo sapiens
caguacucuaguca

SEQ ID NO: 1987830 - RNA, 17 nt, Homo sapiens
gaccuucaacuuccaaa

SEQ ID NO: 1987831 - RNA, 19 nt, Homo sapiens
uaaagcuuucugacaagau

SEQ ID NO: 1987832 - RNA, 20 nt, Homo sapiens
uccagcucuuuccuccuucc

SEQ ID NO: 1987833 - RNA, 15 nt, Homo sapiens
gugcucaaggccagc

SEQ ID NO: 1987834 - RNA, 13 nt, Homo sapiens
aggauugucugcu

SEQ ID NO: 1987835 - RNA, 18 nt, Homo sapiens
acgccaccaucaacuuaa

SEQ ID NO: 1987836 - RNA, 15 nt, Homo sapiens
gauccuccacagaga

SEQ ID NO: 1987837 - RNA, 22 nt, Homo sapiens
aguaaguuugauuucauuaaua

SEQ ID NO: 1987838 - RNA, 18 nt, Homo sapiens
acgucuguucacugaaau

SEQ ID NO: 1987839 - RNA, 12 nt, Homo sapiens
ucuauaucauga

SEQ ID NO: 1987840 - RNA, 21 nt, Homo sapiens
ugucauuuuggcaucugcaaa

SEQ ID NO: 1987841 - RNA, 19 nt, Homo sapiens
ugugccugcucagcagagc

SEQ ID NO: 1987842 - RNA, 20 nt, Homo sapiens
cucccaaagggcacaccccu

SEQ ID NO: 1987843 - RNA, 15 nt, Homo sapiens
aaauucagaugcugu

SEQ ID NO: 1987844 - RNA, 17 nt, Homo sapiens
guccuagagcuacaggg

SEQ ID NO: 1987845 - RNA, 22 nt, Homo sapiens
aaggaauccucugggagcuucu

SEQ ID NO: 1987846 - RNA, 17 nt, Homo sapiens
uguccugaucugugaua

SEQ ID NO: 1987847 - RNA, 22 nt, Homo sapiens
cugacuguguucagugccuugg

SEQ ID NO: 1987848 - RNA, 21 nt, Homo sapiens
ugcuccuaggacccgucucca

SEQ ID NO: 1987849 - RNA, 12 nt, Homo sapiens
agacuaaggugg

SEQ ID NO: 1987850 - RNA, 14 nt, Homo sapiens
uaugacugcaccaa

SEQ ID NO: 1987851 - RNA, 22 nt, Homo sapiens
cagucucugucguggagccauu

SEQ ID NO: 1987852 - RNA, 14 nt, Homo sapiens
ucagugcucuguaa

SEQ ID NO: 1987853 - RNA, 20 nt, Homo sapiens
aauguucuuugucucaaaau

SEQ ID NO: 1987854 - RNA, 23 nt, Homo sapiens
uggugcccccagacagcugcuca

SEQ ID NO: 1987855 - RNA, 21 nt, Homo sapiens
cccagcuaucuauauggaauu

SEQ ID NO: 1987856 - RNA, 16 nt, Homo sapiens
cuuaaaaaagaauaca

SEQ ID NO: 1987857 - RNA, 14 nt, Homo sapiens
aguagaaaagugcu

SEQ ID NO: 1987858 - RNA, 21 nt, Homo sapiens
caaguuguuuaacugugcaug

SEQ ID NO: 1987859 - RNA, 13 nt, Homo sapiens
cugauuucuugcu

SEQ ID NO: 1987860 - RNA, 18 nt, Homo sapiens
aaagucuacauacuuuca

SEQ ID NO: 1987861 - RNA, 18 nt, Homo sapiens
ggauuggccaaacaucag

SEQ ID NO: 1987862 - RNA, 19 nt, Homo sapiens
uucuguggagguauugccu

SEQ ID NO: 1987863 - RNA, 20 nt, Homo sapiens
auuucuaauguaugcauuca

SEQ ID NO: 1987864 - RNA, 18 nt, Homo sapiens
uaugguguacauucuucc

SEQ ID NO: 1987865 - RNA, 14 nt, Homo sapiens
cuguguagcucuca

SEQ ID NO: 1987866 - RNA, 13 nt, Homo sapiens
gccaccaaaagaa

SEQ ID NO: 1987867 - RNA, 21 nt, Homo sapiens
cuuugcuggaguccuguucuc

SEQ ID NO: 1987868 - RNA, 23 nt, Homo sapiens
acaucccuccugggaaugaagca

SEQ ID NO: 1987869 - RNA, 16 nt, Homo sapiens
cccugugccacuuuga

SEQ ID NO: 1987870 - RNA, 14 nt, Homo sapiens
ccauguaaccacug

SEQ ID NO: 1987871 - RNA, 23 nt, Homo sapiens
gccaucauugaugaucacuguga

SEQ ID NO: 1987872 - RNA, 18 nt, Homo sapiens
acaaagucaagccacaug

SEQ ID NO: 1987873 - RNA, 17 nt, Homo sapiens
cugcuaccucacugggg

SEQ ID NO: 1987874 - RNA, 13 nt, Homo sapiens
ugacucugcauuu

SEQ ID NO: 1987875 - RNA, 11 nt, Homo sapiens
uuuucuaagug

SEQ ID NO: 1987876 - RNA, 21 nt, Homo sapiens
ugauacacagaauauaaucuu

SEQ ID NO: 1987877 - RNA, 19 nt, Homo sapiens
gaguacacucagccacugu

SEQ ID NO: 1987878 - RNA, 22 nt, Homo sapiens
auacuucuuguguguaugcaca

SEQ ID NO: 1987879 - RNA, 17 nt, Homo sapiens
aaaauucaagcauuuag

SEQ ID NO: 1987880 - RNA, 12 nt, Homo sapiens
ccagccaugcau

SEQ ID NO: 1987881 - RNA, 13 nt, Homo sapiens
ugaagccaugucu

SEQ ID NO: 1987882 - RNA, 13 nt, Homo sapiens
aaacacuauuugu

SEQ ID NO: 1987883 - RNA, 13 nt, Homo sapiens
uccagucucaaaa

SEQ ID NO: 1987884 - RNA, 13 nt, Homo sapiens
cuccuuccagggc

SEQ ID NO: 1987885 - RNA, 10 nt, Homo sapiens
uucuugucag

SEQ ID NO: 1987886 - RNA, 18 nt, Homo sapiens
gugaaauaguuacuauuu

SEQ ID NO: 1987887 - RNA, 22 nt, Homo sapiens
aucaggggauguacaucucucc

SEQ ID NO: 1987888 - RNA, 20 nt, Homo sapiens
uguuucaauugcaucuccca

SEQ ID NO: 1987889 - RNA, 19 nt, Homo sapiens
auacaucacagcagugcau

SEQ ID NO: 1987890 - RNA, 12 nt, Homo sapiens
uugcuguucacc

SEQ ID NO: 1987891 - RNA, 22 nt, Homo sapiens
cucccagugaccccugaccuca

SEQ ID NO: 1987892 - RNA, 15 nt, Homo sapiens
guugauguugauaaa

SEQ ID NO: 1987893 - RNA, 16 nt, Homo sapiens
aucuaauaaacuuuau

SEQ ID NO: 1987894 - RNA, 11 nt, Homo sapiens
ucccugcacau

SEQ ID NO: 1987895 - RNA, 15 nt, Homo sapiens
cccagccccacuuac

SEQ ID NO: 1987896 - RNA, 22 nt, Homo sapiens
ccaguuccuguagaacugagaa

SEQ ID NO: 1987897 - RNA, 19 nt, Homo sapiens
aacugguauauacauauau

SEQ ID NO: 1987898 - RNA, 20 nt, Homo sapiens
auugaugauguuguaaaaug

SEQ ID NO: 1987899 - RNA, 15 nt, Homo sapiens
aaauauugacucaaa

SEQ ID NO: 1987900 - RNA, 14 nt, Homo sapiens
ugagccucagaaua

SEQ ID NO: 1987901 - RNA, 17 nt, Homo sapiens
cacucacucugggugcc

SEQ ID NO: 1987902 - RNA, 15 nt, Homo sapiens
gaagcuacagguuac

SEQ ID NO: 1987903 - RNA, 14 nt, Homo sapiens
uguaaaagggauuu

SEQ ID NO: 1987904 - RNA, 16 nt, Homo sapiens
caucagcaccauggag

SEQ ID NO: 1987905 - RNA, 20 nt, Homo sapiens
auguucauaguuacauauuu

SEQ ID NO: 1987906 - RNA, 16 nt, Homo sapiens
agacaugaauggagac

SEQ ID NO: 1987907 - RNA, 17 nt, Homo sapiens
acaugugcagucacugg

SEQ ID NO: 1987908 - RNA, 22 nt, Homo sapiens
gaccuuucugagugacaugggu

SEQ ID NO: 1987909 - RNA, 23 nt, Homo sapiens
acuaacauuucccccgagcucuu

SEQ ID NO: 1987910 - RNA, 18 nt, Homo sapiens
guccuuuacaaacauaca

SEQ ID NO: 1987911 - RNA, 14 nt, Homo sapiens
ugaaaucaaugugu

SEQ ID NO: 1987912 - RNA, 18 nt, Homo sapiens
uaaauagaacaaccugca

SEQ ID NO: 1987913 - RNA, 17 nt, Homo sapiens
ucagcugcugcuauuau

SEQ ID NO: 1987914 - RNA, 17 nt, Homo sapiens
uuagacaagacugucua

SEQ ID NO: 1987915 - RNA, 21 nt, Homo sapiens
cuguacagaaaguaucacaaa

SEQ ID NO: 1987916 - RNA, 13 nt, Homo sapiens
cugcccauacccc

SEQ ID NO: 1987917 - RNA, 19 nt, Homo sapiens
aggcugagugcacuggcag

SEQ ID NO: 1987918 - RNA, 20 nt, Homo sapiens
gugaauauuagauugcugaa

SEQ ID NO: 1987919 - RNA, 20 nt, Homo sapiens
ucauauuuuuacaaauaauu

SEQ ID NO: 1987920 - RNA, 17 nt, Homo sapiens
ccaucucccaaggcugc

SEQ ID NO: 1987921 - RNA, 20 nt, Homo sapiens
uccccaccuuccccagacuc

SEQ ID NO: 1987922 - RNA, 15 nt, Homo sapiens
ucucagcaaucacaa

SEQ ID NO: 1987923 - RNA, 24 nt, Homo sapiens
uaauaaaguuaaauugcacgugca

SEQ ID NO: 1987924 - RNA, 17 nt, Homo sapiens
ucuggccacaucuugac

SEQ ID NO: 1987925 - RNA, 17 nt, Homo sapiens
caccaugacaccugcca

SEQ ID NO: 1987926 - RNA, 21 nt, Homo sapiens
auucauaggcaguaauguucc

SEQ ID NO: 1987927 - RNA, 15 nt, Homo sapiens
auugaagaacuggca

SEQ ID NO: 1987928 - RNA, 18 nt, Homo sapiens
uuuauuaggguacuuuau

SEQ ID NO: 1987929 - RNA, 16 nt, Homo sapiens
uauacacacaaaaagg

SEQ ID NO: 1987930 - RNA, 18 nt, Homo sapiens
ccuuuguguauucaucuu

SEQ ID NO: 1987931 - RNA, 23 nt, Homo sapiens
cugagagaguggagagugacaug

SEQ ID NO: 1987932 - RNA, 21 nt, Homo sapiens
aggauuuccucuugaaccaga

SEQ ID NO: 1987933 - RNA, 17 nt, Homo sapiens
uauagucacuaguugua

SEQ ID NO: 1987934 - RNA, 21 nt, Homo sapiens
guuuugugcggugugucucca

SEQ ID NO: 1987935 - RNA, 18 nt, Homo sapiens
uguacaauuuucauccca

SEQ ID NO: 1987936 - RNA, 17 nt, Homo sapiens
acaccucuaaacaucuc

SEQ ID NO: 1987937 - RNA, 16 nt, Homo sapiens
ccucuauuaguuucaa

SEQ ID NO: 1987938 - RNA, 13 nt, Homo sapiens
uaauugugaauua

SEQ ID NO: 1987939 - RNA, 13 nt, Homo sapiens
uuacugugauuca

SEQ ID NO: 1987940 - RNA, 13 nt, Homo sapiens
aguaagugugaau

SEQ ID NO: 1987941 - RNA, 14 nt, Homo sapiens
cucuugaaccacag

SEQ ID NO: 1987942 - RNA, 20 nt, Homo sapiens
cuuauugguugaaggucaca

SEQ ID NO: 1987943 - RNA, 12 nt, Homo sapiens
uuuaaauucaug

SEQ ID NO: 1987944 - RNA, 17 nt, Homo sapiens
ccugucucuagccacuu

SEQ ID NO: 1987945 - RNA, 18 nt, Homo sapiens
caauuccccuacaucaaa

SEQ ID NO: 1987946 - RNA, 21 nt, Homo sapiens
ugagcggccgccuguccuugg

SEQ ID NO: 1987947 - RNA, 17 nt, Homo sapiens
cuacacaagcaucaccu

SEQ ID NO: 1987948 - RNA, 18 nt, Homo sapiens
ccuuaguacaugcucugu

SEQ ID NO: 1987949 - RNA, 14 nt, Homo sapiens
aagacagcuuccca

SEQ ID NO: 1987950 - RNA, 20 nt, Homo sapiens
auuugggcuggaacauguaa

SEQ ID NO: 1987951 - RNA, 13 nt, Homo sapiens
ccuccuggcagcc

SEQ ID NO: 1987952 - RNA, 20 nt, Homo sapiens
uguuccauuugaaccaguga

SEQ ID NO: 1987953 - RNA, 20 nt, Homo sapiens
cagagcaagacucugucuca

SEQ ID NO: 1987954 - RNA, 20 nt, Homo sapiens
cagagugagacuccaucuca

SEQ ID NO: 1987955 - RNA, 15 nt, Homo sapiens
uuuaauaauauaucu

SEQ ID NO: 1987956 - RNA, 16 nt, Homo sapiens
uaaaccauaaaaagcu

SEQ ID NO: 1987957 - RNA, 19 nt, Homo sapiens
auccucucccuucuuacac

SEQ ID NO: 1987958 - RNA, 21 nt, Homo sapiens
aaaguauagauggccaaagga

SEQ ID NO: 1987959 - RNA, 21 nt, Homo sapiens
uacuuaacaaaguaaacaaaa

SEQ ID NO: 1987960 - RNA, 16 nt, Homo sapiens
cagaccacgaguucau

SEQ ID NO: 1987961 - RNA, 23 nt, Homo sapiens
gcccacccacuccuuauauugcu

SEQ ID NO: 1987962 - RNA, 17 nt, Homo sapiens
cuacaaacuucaaagag

SEQ ID NO: 1987963 - RNA, 18 nt, Homo sapiens
uaacaauuguguagccuu

SEQ ID NO: 1987964 - RNA, 15 nt, Homo sapiens
gcagguguaccuccc

SEQ ID NO: 1987965 - RNA, 12 nt, Homo sapiens
guacacauuuau

SEQ ID NO: 1987966 - RNA, 12 nt, Homo sapiens
uuacacauguau

SEQ ID NO: 1987967 - RNA, 18 nt, Homo sapiens
accaaggagccaaacauc

SEQ ID NO: 1987968 - RNA, 23 nt, Homo sapiens
cuuuuagaccaaaauaugaaaga

SEQ ID NO: 1987969 - RNA, 22 nt, Homo sapiens
cagccacacugugggacucuuc

SEQ ID NO: 1987970 - RNA, 13 nt, Homo sapiens
cuucaaauuguaa

SEQ ID NO: 1987971 - RNA, 13 nt, Homo sapiens
gacccaugcugcc

SEQ ID NO: 1987972 - RNA, 21 nt, Homo sapiens
aaucauugcuuaugacaugau

SEQ ID NO: 1987973 - RNA, 15 nt, Homo sapiens
acauagcgaauacaa

SEQ ID NO: 1987974 - RNA, 13 nt, Homo sapiens
uauuacaaacaag

SEQ ID NO: 1987975 - RNA, 17 nt, Homo sapiens
acuuggaauucucucac

SEQ ID NO: 1987976 - RNA, 21 nt, Homo sapiens
gaaaauguugagaaucccaaa

SEQ ID NO: 1987977 - RNA, 18 nt, Homo sapiens
augauuuagggaagcagg

SEQ ID NO: 1987978 - RNA, 13 nt, Homo sapiens
gagacuucuccca

SEQ ID NO: 1987979 - RNA, 22 nt, Homo sapiens
agcggucauucuacacugagga

SEQ ID NO: 1987980 - RNA, 19 nt, Homo sapiens
gccuuccugaggaugggca

SEQ ID NO: 1987981 - RNA, 18 nt, Homo sapiens
cuguaagguggacuucca

SEQ ID NO: 1987982 - RNA, 23 nt, Homo sapiens
ccuugcuguuuucaucucugcca

SEQ ID NO: 1987983 - RNA, 12 nt, Homo sapiens
uuuaaaaccacu

SEQ ID NO: 1987984 - RNA, 14 nt, Homo sapiens
auuuugacgucacu

SEQ ID NO: 1987985 - RNA, 20 nt, Homo sapiens
ccgcucccgcgggaagccag

SEQ ID NO: 1987986 - RNA, 19 nt, Homo sapiens
ggaacugucucucaugaac

SEQ ID NO: 1987987 - RNA, 20 nt, Homo sapiens
uuagccauuuuucaaagcaa

SEQ ID NO: 1987988 - RNA, 13 nt, Homo sapiens
ucagccuuccaaa

SEQ ID NO: 1987989 - RNA, 12 nt, Homo sapiens
agcacuugaugc

SEQ ID NO: 1987990 - RNA, 13 nt, Homo sapiens
uaaaacacucuaa

SEQ ID NO: 1987991 - RNA, 19 nt, Homo sapiens
guauacucuugaguguuua

SEQ ID NO: 1987992 - RNA, 14 nt, Homo sapiens
gaaaagucuacccc

SEQ ID NO: 1987993 - RNA, 18 nt, Homo sapiens
acaggugcgugcgugcua

SEQ ID NO: 1987994 - RNA, 18 nt, Homo sapiens
uauuaagguaacuacugc

SEQ ID NO: 1987995 - RNA, 13 nt, Homo sapiens
ucaugagcuugaa

SEQ ID NO: 1987996 - RNA, 14 nt, Homo sapiens
uccagcauguugca

SEQ ID NO: 1987997 - RNA, 12 nt, Homo sapiens
gauugauuuucu

SEQ ID NO: 1987998 - RNA, 20 nt, Homo sapiens
ccagccucaggcuugaggga

SEQ ID NO: 1987999 - RNA, 18 nt, Homo sapiens
aucccuagucuauugcag

SEQ ID NO: 1988000 - RNA, 22 nt, Homo sapiens
ugccuuaacugaugacauucca

SEQ ID NO: 1988001 - RNA, 15 nt, Homo sapiens
ugaauauuauacuuc

SEQ ID NO: 1988002 - RNA, 14 nt, Homo sapiens
aagcaucauggauc

SEQ ID NO: 1988003 - RNA, 21 nt, Homo sapiens
auguaguuuuccauccuucaa

SEQ ID NO: 1988004 - RNA, 21 nt, Homo sapiens
auguaaaggucacuuuucaca

SEQ ID NO: 1988005 - RNA, 18 nt, Homo sapiens
caauaaaagaaucugaua

SEQ ID NO: 1988006 - RNA, 21 nt, Homo sapiens
uguagccacuggcauagcccu

SEQ ID NO: 1988007 - RNA, 17 nt, Homo sapiens
ggaccuaggaccauuuc

SEQ ID NO: 1988008 - RNA, 20 nt, Homo sapiens
uguacuccagccugggcaac

SEQ ID NO: 1988009 - RNA, 19 nt, Homo sapiens
ugaguacuacaguccuccc

SEQ ID NO: 1988010 - RNA, 13 nt, Homo sapiens
ugaaaaacagcag

SEQ ID NO: 1988011 - RNA, 13 nt, Homo sapiens
uucagaacauaaa

SEQ ID NO: 1988012 - RNA, 15 nt, Homo sapiens
ugcaggggaagacca

SEQ ID NO: 1988013 - RNA, 15 nt, Homo sapiens
uaacaagcaagcaaa

SEQ ID NO: 1988014 - RNA, 19 nt, Homo sapiens
auccuuaguacaugcucug

SEQ ID NO: 1988015 - RNA, 15 nt, Homo sapiens
cagaacucagccuua

SEQ ID NO: 1988016 - RNA, 12 nt, Homo sapiens
aucccagggaaa

SEQ ID NO: 1988017 - RNA, 21 nt, Homo sapiens
gccagugggccugguagcaca

SEQ ID NO: 1988018 - RNA, 18 nt, Homo sapiens
cugucuuuauaacccaua

SEQ ID NO: 1988019 - RNA, 17 nt, Homo sapiens
uacugaacccugccucu

SEQ ID NO: 1988020 - RNA, 16 nt, Homo sapiens
ggccuacggagucagc

SEQ ID NO: 1988021 - RNA, 20 nt, Homo sapiens
caaaaaaguccaauuuuaau

SEQ ID NO: 1988022 - RNA, 12 nt, Homo sapiens
ccuucuaccuua

SEQ ID NO: 1988023 - RNA, 17 nt, Homo sapiens
caacuggcgaagccuga

SEQ ID NO: 1988024 - RNA, 21 nt, Homo sapiens
ccaucaauaaagaagcauucu

SEQ ID NO: 1988025 - RNA, 17 nt, Homo sapiens
ugcuuauggaaagccag

SEQ ID NO: 1988026 - RNA, 21 nt, Homo sapiens
uauaacuuccuggcuccuuca

SEQ ID NO: 1988027 - RNA, 17 nt, Homo sapiens
uaaauuuaucaaugaug

SEQ ID NO: 1988028 - RNA, 17 nt, Homo sapiens
aaccuaugaaacuauug

SEQ ID NO: 1988029 - RNA, 13 nt, Homo sapiens
caggccuguguga

SEQ ID NO: 1988030 - RNA, 21 nt, Homo sapiens
uguucaguuagcauggauuua

SEQ ID NO: 1988031 - RNA, 18 nt, Homo sapiens
gcauguaagccaagucau

SEQ ID NO: 1988032 - RNA, 23 nt, Homo sapiens
aggacucaguauuauuucaagac

SEQ ID NO: 1988033 - RNA, 16 nt, Homo sapiens
ucauaaacagcauuua

SEQ ID NO: 1988034 - RNA, 21 nt, Homo sapiens
auauaaccucccacccugcaa

SEQ ID NO: 1988035 - RNA, 21 nt, Homo sapiens
aaauauugcuuggacuaccua

SEQ ID NO: 1988036 - RNA, 16 nt, Homo sapiens
aaugcaauuugauaau

SEQ ID NO: 1988037 - RNA, 18 nt, Homo sapiens
agaggacucacuugccca

SEQ ID NO: 1988038 - RNA, 17 nt, Homo sapiens
acacacagccugugcuu

SEQ ID NO: 1988039 - RNA, 21 nt, Homo sapiens
acagcguggaugucgaugacu

SEQ ID NO: 1988040 - RNA, 15 nt, Homo sapiens
auuuagugucuugaa

SEQ ID NO: 1988041 - RNA, 23 nt, Homo sapiens
uaggguacucaucugacuugaac

SEQ ID NO: 1988042 - RNA, 20 nt, Homo sapiens
aacaucccuuauuaguuaca

SEQ ID NO: 1988043 - RNA, 17 nt, Homo sapiens
gcuccuuccugucuucc

SEQ ID NO: 1988044 - RNA, 15 nt, Homo sapiens
gagcugcaggggcau

SEQ ID NO: 1988045 - RNA, 17 nt, Homo sapiens
cagaugaccaaagccac

SEQ ID NO: 1988046 - RNA, 17 nt, Homo sapiens
uaaguaauuucaugcac

SEQ ID NO: 1988047 - RNA, 20 nt, Homo sapiens
caugacauauguagaugugc

SEQ ID NO: 1988048 - RNA, 21 nt, Homo sapiens
agccuuguggugugugcgcac

SEQ ID NO: 1988049 - RNA, 12 nt, Homo sapiens
uuaaagugccuu

SEQ ID NO: 1988050 - RNA, 20 nt, Homo sapiens
guguuccuagaaugcagcug

SEQ ID NO: 1988051 - RNA, 20 nt, Homo sapiens
caccugguggccaugcuccu

SEQ ID NO: 1988052 - RNA, 14 nt, Homo sapiens
ugauaugucagggc

SEQ ID NO: 1988053 - RNA, 15 nt, Homo sapiens
aguucugaguccuga

SEQ ID NO: 1988054 - RNA, 13 nt, Homo sapiens
aaugcagacacac

SEQ ID NO: 1988055 - RNA, 15 nt, Homo sapiens
acccagaacaugaag

SEQ ID NO: 1988056 - RNA, 21 nt, Homo sapiens
ggagccaguggggaagugcgu

SEQ ID NO: 1988057 - RNA, 23 nt, Homo sapiens
caccuaguaagugccugcuguau

SEQ ID NO: 1988058 - RNA, 18 nt, Homo sapiens
ccauccaucaugcaaaau

SEQ ID NO: 1988059 - RNA, 24 nt, Homo sapiens
agcagucuucucuucugccuuuau

SEQ ID NO: 1988060 - RNA, 13 nt, Homo sapiens
cauccugauacau

SEQ ID NO: 1988061 - RNA, 13 nt, Homo sapiens
gcccaagugggca

SEQ ID NO: 1988062 - RNA, 20 nt, Homo sapiens
ucauccuccaggaacugcag

SEQ ID NO: 1988063 - RNA, 21 nt, Homo sapiens
ccugucuggugccccuuugcc

SEQ ID NO: 1988064 - RNA, 15 nt, Homo sapiens
ccuaagcaaauagga

SEQ ID NO: 1988065 - RNA, 15 nt, Homo sapiens
uacuuauguugcaca

SEQ ID NO: 1988066 - RNA, 16 nt, Homo sapiens
gugguggaagcaagac

SEQ ID NO: 1988067 - RNA, 11 nt, Homo sapiens
agaugacaaag

SEQ ID NO: 1988068 - RNA, 12 nt, Homo sapiens
cccagucuuccu

SEQ ID NO: 1988069 - RNA, 15 nt, Homo sapiens
ucacacagagugccu

SEQ ID NO: 1988070 - RNA, 17 nt, Homo sapiens
ccuucccaugacccagg

SEQ ID NO: 1988071 - RNA, 17 nt, Homo sapiens
cuggcaucucacuuuau

SEQ ID NO: 1988072 - RNA, 16 nt, Homo sapiens
gaagcaagugguggga

SEQ ID NO: 1988073 - RNA, 14 nt, Homo sapiens
ugaaguacaaaagg

SEQ ID NO: 1988074 - RNA, 18 nt, Homo sapiens
caauggaaagcuuuucag

SEQ ID NO: 1988075 - RNA, 15 nt, Homo sapiens
ugaagucacacagug

SEQ ID NO: 1988076 - RNA, 20 nt, Homo sapiens
aauguaacuuauuuaaugaa

SEQ ID NO: 1988077 - RNA, 17 nt, Homo sapiens
uuuguaaaugacuuuca

SEQ ID NO: 1988078 - RNA, 17 nt, Homo sapiens
acaggucccacugcccu

SEQ ID NO: 1988079 - RNA, 19 nt, Homo sapiens
caaagacuugaaggcauua

SEQ ID NO: 1988080 - RNA, 14 nt, Homo sapiens
ccauaacuugaaaa

SEQ ID NO: 1988081 - RNA, 20 nt, Homo sapiens
uaagauaaauucaugcacuu

SEQ ID NO: 1988082 - RNA, 16 nt, Homo sapiens
uaaaagaaaucuucau

SEQ ID NO: 1988083 - RNA, 19 nt, Homo sapiens
auaauuuuccucaaucaca

SEQ ID NO: 1988084 - RNA, 15 nt, Homo sapiens
ucccugucucugcau

SEQ ID NO: 1988085 - RNA, 20 nt, Homo sapiens
cuucaagccuggcccaguga

SEQ ID NO: 1988086 - RNA, 18 nt, Homo sapiens
cuuugaguuuuguauuca

SEQ ID NO: 1988087 - RNA, 16 nt, Homo sapiens
uuguaucaaaguguga

SEQ ID NO: 1988088 - RNA, 17 nt, Homo sapiens
ccuuuguuggagucaaa

SEQ ID NO: 1988089 - RNA, 20 nt, Homo sapiens
gcccugcuuuaucaggggac

SEQ ID NO: 1988090 - RNA, 20 nt, Homo sapiens
ucaucucaccacaccacagg

SEQ ID NO: 1988091 - RNA, 20 nt, Homo sapiens
aguggugcagucuuggcuca

SEQ ID NO: 1988092 - RNA, 11 nt, Homo sapiens
aagaaggcauu

SEQ ID NO: 1988093 - RNA, 16 nt, Homo sapiens
gagacugguugcauaa

SEQ ID NO: 1988094 - RNA, 15 nt, Homo sapiens
aggacccacuuccug

SEQ ID NO: 1988095 - RNA, 21 nt, Homo sapiens
cucuaagaaauggcuuuccac

SEQ ID NO: 1988096 - RNA, 20 nt, Homo sapiens
uccugggggcugcugcacug

SEQ ID NO: 1988097 - RNA, 14 nt, Homo sapiens
aaaucgugccuugu

SEQ ID NO: 1988098 - RNA, 17 nt, Homo sapiens
uaaugaccauguuauau

SEQ ID NO: 1988099 - RNA, 19 nt, Homo sapiens
ugaaacuugagcauucaaa

SEQ ID NO: 1988100 - RNA, 21 nt, Homo sapiens
acacgcaggccucccugccuc

SEQ ID NO: 1988101 - RNA, 14 nt, Homo sapiens
gugcacacaccugc

SEQ ID NO: 1988102 - RNA, 20 nt, Homo sapiens
uauaaaucacagauuuccaa

SEQ ID NO: 1988103 - RNA, 15 nt, Homo sapiens
cauuguggagccaaa

SEQ ID NO: 1988104 - RNA, 21 nt, Homo sapiens
ccugcccaaggccuaccccag

SEQ ID NO: 1988105 - RNA, 21 nt, Homo sapiens
agcagaugccagcgccaugcu

SEQ ID NO: 1988106 - RNA, 18 nt, Homo sapiens
augcacuugaaaugaugg

SEQ ID NO: 1988107 - RNA, 22 nt, Homo sapiens
ucccacccaccuguagggcuag

SEQ ID NO: 1988108 - RNA, 14 nt, Homo sapiens
uaugacuacuacau

SEQ ID NO: 1988109 - RNA, 20 nt, Homo sapiens
gacacaugcuguuggccuca

SEQ ID NO: 1988110 - RNA, 18 nt, Homo sapiens
uauacuauuuagucucag

SEQ ID NO: 1988111 - RNA, 17 nt, Homo sapiens
gcacagagcccaaugca

SEQ ID NO: 1988112 - RNA, 16 nt, Homo sapiens
caacaggaacuuggag

SEQ ID NO: 1988113 - RNA, 17 nt, Homo sapiens
gucuaaguguccgagac

SEQ ID NO: 1988114 - RNA, 18 nt, Homo sapiens
uaggugggggaacacuga

SEQ ID NO: 1988115 - RNA, 21 nt, Homo sapiens
uauugccuuuagaaacugagu

SEQ ID NO: 1988116 - RNA, 22 nt, Homo sapiens
cuuuagaaggacucaguauuau

SEQ ID NO: 1988117 - RNA, 14 nt, Homo sapiens
accacuaggguccu

SEQ ID NO: 1988118 - RNA, 13 nt, Homo sapiens
ggaacacacuugg

SEQ ID NO: 1988119 - RNA, 20 nt, Homo sapiens
auggucaacacuuaaggguu

SEQ ID NO: 1988120 - RNA, 21 nt, Homo sapiens
aaaauauuuccugacuugagu

SEQ ID NO: 1988121 - RNA, 21 nt, Homo sapiens
cagaacuuaaucuggacacac

SEQ ID NO: 1988122 - RNA, 15 nt, Homo sapiens
uuccucgaaacugcc

SEQ ID NO: 1988123 - RNA, 11 nt, Homo sapiens
acuucuuguca

SEQ ID NO: 1988124 - RNA, 18 nt, Homo sapiens
agcuggccuggacaguau

SEQ ID NO: 1988125 - RNA, 19 nt, Homo sapiens
cugccuuugcaccacggga

SEQ ID NO: 1988126 - RNA, 22 nt, Homo sapiens
cuaugauucguguaauuacuua

SEQ ID NO: 1988127 - RNA, 22 nt, Homo sapiens
uuagaaucuuuuaaauacauuc

SEQ ID NO: 1988128 - RNA, 18 nt, Homo sapiens
ugcuuaaacuacaaacac

SEQ ID NO: 1988129 - RNA, 21 nt, Homo sapiens
aucaaaauaaaaagugacaca

SEQ ID NO: 1988130 - RNA, 19 nt, Homo sapiens
auccagcucuaagucucaa

SEQ ID NO: 1988131 - RNA, 19 nt, Homo sapiens
ugagagaaaugaaguuuau

SEQ ID NO: 1988132 - RNA, 18 nt, Homo sapiens
acagccgcagaaggggaa

SEQ ID NO: 1988133 - RNA, 15 nt, Homo sapiens
ggagcaguccaugca

SEQ ID NO: 1988134 - RNA, 21 nt, Homo sapiens
uuuccucuuccccuugcccuu

SEQ ID NO: 1988135 - RNA, 19 nt, Homo sapiens
gagagaaugauuuugcuga

SEQ ID NO: 1988136 - RNA, 18 nt, Homo sapiens
cagcuuugcccuccaaga

SEQ ID NO: 1988137 - RNA, 18 nt, Homo sapiens
uuaauuuucuauguguug

SEQ ID NO: 1988138 - RNA, 13 nt, Homo sapiens
guuauaacgcaag

SEQ ID NO: 1988139 - RNA, 13 nt, Homo sapiens
aaacaaauuccuu

SEQ ID NO: 1988140 - RNA, 18 nt, Homo sapiens
gagcaagcccugacccaa

SEQ ID NO: 1988141 - RNA, 15 nt, Homo sapiens
ggcaaucauggugcu

SEQ ID NO: 1988142 - RNA, 13 nt, Homo sapiens
cugugacuauaaa

SEQ ID NO: 1988143 - RNA, 21 nt, Homo sapiens
agagaauauuauaaagugcuu

SEQ ID NO: 1988144 - RNA, 19 nt, Homo sapiens
ugaggaacaaucacaaaag

SEQ ID NO: 1988145 - RNA, 18 nt, Homo sapiens
gaccucugccugaaguca

SEQ ID NO: 1988146 - RNA, 22 nt, Homo sapiens
cugaaaguaacucauaaucuau

SEQ ID NO: 1988147 - RNA, 19 nt, Homo sapiens
aauaauguccuuucauuug

SEQ ID NO: 1988148 - RNA, 20 nt, Homo sapiens
auuucuuuauuuucuucucc

SEQ ID NO: 1988149 - RNA, 19 nt, Homo sapiens
auaaaauccuaagacacaa

SEQ ID NO: 1988150 - RNA, 15 nt, Homo sapiens
guauaugucaucuca

SEQ ID NO: 1988151 - RNA, 19 nt, Homo sapiens
agaaaacaggcaaauuccu

SEQ ID NO: 1988152 - RNA, 13 nt, Homo sapiens
cacuguucaucuc

SEQ ID NO: 1988153 - RNA, 19 nt, Homo sapiens
cuaauacagcaacaauuua

SEQ ID NO: 1988154 - RNA, 22 nt, Homo sapiens
gcuaaagaaacugcuuacaguu

SEQ ID NO: 1988155 - RNA, 14 nt, Homo sapiens
cacacgagcaaacc

SEQ ID NO: 1988156 - RNA, 18 nt, Homo sapiens
gacuuaauuaugcuaaca

SEQ ID NO: 1988157 - RNA, 18 nt, Homo sapiens
aauagcugccuucaagga

SEQ ID NO: 1988158 - RNA, 18 nt, Homo sapiens
auuuuuuugcaugcaugc

SEQ ID NO: 1988159 - RNA, 16 nt, Homo sapiens
cacagauagcugccac

SEQ ID NO: 1988160 - RNA, 16 nt, Homo sapiens
aauccugagaaacaau

SEQ ID NO: 1988161 - RNA, 19 nt, Homo sapiens
ucucccacccuguaccuca

SEQ ID NO: 1988162 - RNA, 16 nt, Homo sapiens
ccagguggaacaaaca

SEQ ID NO: 1988163 - RNA, 17 nt, Homo sapiens
cauacucaaugcauaua

SEQ ID NO: 1988164 - RNA, 16 nt, Homo sapiens
uggaggcagagaccuc

SEQ ID NO: 1988165 - RNA, 16 nt, Homo sapiens
gcccugcccuuccuca

SEQ ID NO: 1988166 - RNA, 13 nt, Homo sapiens
aggaaagaguauu

SEQ ID NO: 1988167 - RNA, 17 nt, Homo sapiens
ccuguaaucucacuaca

SEQ ID NO: 1988168 - RNA, 20 nt, Homo sapiens
auauuuacaauaaaugaaga

SEQ ID NO: 1988169 - RNA, 23 nt, Homo sapiens
ugcccucaucccgaccucuuaga

SEQ ID NO: 1988170 - RNA, 17 nt, Homo sapiens
cugagauugucuguuca

SEQ ID NO: 1988171 - RNA, 22 nt, Homo sapiens
uuccuccucuauuuaagauaua

SEQ ID NO: 1988172 - RNA, 20 nt, Homo sapiens
aucuccaaaacuagcauucu

SEQ ID NO: 1988173 - RNA, 16 nt, Homo sapiens
uauuaagcaucagaaa

SEQ ID NO: 1988174 - RNA, 18 nt, Homo sapiens
acaggaggaaucauguca

SEQ ID NO: 1988175 - RNA, 16 nt, Homo sapiens
cugagcagauguaaua

SEQ ID NO: 1988176 - RNA, 14 nt, Homo sapiens
gauuuguagcacug

SEQ ID NO: 1988177 - RNA, 14 nt, Homo sapiens
uauuauuaucacau

SEQ ID NO: 1988178 - RNA, 23 nt, Homo sapiens
uacuuuguuaaaaacacugcuga

SEQ ID NO: 1988179 - RNA, 20 nt, Homo sapiens
gggaagagggggcuggccau

SEQ ID NO: 1988180 - RNA, 17 nt, Homo sapiens
gaggugaaugcacagug

SEQ ID NO: 1988181 - RNA, 14 nt, Homo sapiens
ugcaauacugcuua

SEQ ID NO: 1988182 - RNA, 13 nt, Homo sapiens
cgugauaaugcag

SEQ ID NO: 1988183 - RNA, 15 nt, Homo sapiens
cuuccucucugugau

SEQ ID NO: 1988184 - RNA, 11 nt, Homo sapiens
cuaagucacau

SEQ ID NO: 1988185 - RNA, 23 nt, Homo sapiens
agucugaaugcugccacaaccag

SEQ ID NO: 1988186 - RNA, 19 nt, Homo sapiens
aaauguaaauacucaugaa

SEQ ID NO: 1988187 - RNA, 16 nt, Homo sapiens
aggggaacacaggccc

SEQ ID NO: 1988188 - RNA, 14 nt, Homo sapiens
uaaguggcuuccca

SEQ ID NO: 1988189 - RNA, 18 nt, Homo sapiens
uguccugaggggcugcuu

SEQ ID NO: 1988190 - RNA, 19 nt, Homo sapiens
gccucaacaacguaaacuu

SEQ ID NO: 1988191 - RNA, 11 nt, Homo sapiens
gcaaccuguag

SEQ ID NO: 1988192 - RNA, 20 nt, Homo sapiens
caggugugagccaccgugcc

SEQ ID NO: 1988193 - RNA, 15 nt, Homo sapiens
ugcaaugaaagucaa

SEQ ID NO: 1988194 - RNA, 17 nt, Homo sapiens
gugugaccccacugcca

SEQ ID NO: 1988195 - RNA, 15 nt, Homo sapiens
uugccuucuuucaua

SEQ ID NO: 1988196 - RNA, 15 nt, Homo sapiens
cagaacuccauacca

SEQ ID NO: 1988197 - RNA, 16 nt, Homo sapiens
ucaagaacucugggcu

SEQ ID NO: 1988198 - RNA, 15 nt, Homo sapiens
gccccuuuuacuuuu

SEQ ID NO: 1988199 - RNA, 21 nt, Homo sapiens
auuggaaacauuuaacucaga

SEQ ID NO: 1988200 - RNA, 18 nt, Homo sapiens
acuguauauaaacauauc

SEQ ID NO: 1988201 - RNA, 14 nt, Homo sapiens
uuacugcauagcag

SEQ ID NO: 1988202 - RNA, 17 nt, Homo sapiens
aacaugcaacaaaaaug

SEQ ID NO: 1988203 - RNA, 17 nt, Homo sapiens
ugcuuuuuuaacagaua

SEQ ID NO: 1988204 - RNA, 18 nt, Homo sapiens
gauaagcuaacaccagac

SEQ ID NO: 1988205 - RNA, 20 nt, Homo sapiens
uuuuaggaaaggcugaugau

SEQ ID NO: 1988206 - RNA, 21 nt, Homo sapiens
ucuucagaauauggacaaaga

SEQ ID NO: 1988207 - RNA, 22 nt, Homo sapiens
ugauaugcauuugacuuguuaa

SEQ ID NO: 1988208 - RNA, 23 nt, Homo sapiens
ccaccccaggcccugccagagca

SEQ ID NO: 1988209 - RNA, 13 nt, Homo sapiens
uauuuuaggucaa

SEQ ID NO: 1988210 - RNA, 14 nt, Homo sapiens
aaccaguaaggaaa

SEQ ID NO: 1988211 - RNA, 16 nt, Homo sapiens
uugaccucucauaaau

SEQ ID NO: 1988212 - RNA, 17 nt, Homo sapiens
cucucuuuccuucuugc

SEQ ID NO: 1988213 - RNA, 16 nt, Homo sapiens
aaagaacucauuugaa
